United States Patent 10,058,623 (COMPOSITIONS AND METHODS FOR MODULATING UTRN EXPRESSION) - sequence listing, part 3

SEQ ID NO: 24398 - DNA, 15 bp, Homo sapiens
tttctttggtacacc

SEQ ID NO: 24399 - DNA, 15 bp, Homo sapiens
gtttctttggtacac

SEQ ID NO: 24400 - DNA, 15 bp, Homo sapiens
ggtttctttggtaca

SEQ ID NO: 24401 - DNA, 15 bp, Homo sapiens
aggtttctttggtac

SEQ ID NO: 24402 - DNA, 15 bp, Homo sapiens
gaggtttctttggta

SEQ ID NO: 24403 - DNA, 15 bp, Homo sapiens
tgaggtttctttggt

SEQ ID NO: 24404 - DNA, 15 bp, Homo sapiens
ttgaggtttctttgg

SEQ ID NO: 24405 - DNA, 15 bp, Homo sapiens
tttgaggtttctttg

SEQ ID NO: 24406 - DNA, 15 bp, Homo sapiens
ttttgaggtttcttt

SEQ ID NO: 24407 - DNA, 15 bp, Homo sapiens
attttgaggtttctt

SEQ ID NO: 24408 - DNA, 15 bp, Homo sapiens
tattttgaggtttct

SEQ ID NO: 24409 - DNA, 15 bp, Homo sapiens
gtattttgaggtttc

SEQ ID NO: 24410 - DNA, 15 bp, Homo sapiens
tgtattttgaggttt

SEQ ID NO: 24411 - DNA, 15 bp, Homo sapiens
ctgtattttgaggtt

SEQ ID NO: 24412 - DNA, 15 bp, Homo sapiens
actgtattttgaggt

SEQ ID NO: 24413 - DNA, 15 bp, Homo sapiens
cactgtattttgagg

SEQ ID NO: 24414 - DNA, 15 bp, Homo sapiens
ccactgtattttgag

SEQ ID NO: 24415 - DNA, 15 bp, Homo sapiens
gccactgtattttga

SEQ ID NO: 24416 - DNA, 15 bp, Homo sapiens
agccactgtattttg

SEQ ID NO: 24417 - DNA, 15 bp, Homo sapiens
gagccactgtatttt

SEQ ID NO: 24418 - DNA, 15 bp, Homo sapiens
tgagccactgtattt

SEQ ID NO: 24419 - DNA, 15 bp, Homo sapiens
ttgagccactgtatt

SEQ ID NO: 24420 - DNA, 15 bp, Homo sapiens
tttgagccactgtat

SEQ ID NO: 24421 - DNA, 15 bp, Homo sapiens
atttgagccactgta

SEQ ID NO: 24422 - DNA, 15 bp, Homo sapiens
tatttgagccactgt

SEQ ID NO: 24423 - DNA, 15 bp, Homo sapiens
ttatttgagccactg

SEQ ID NO: 24424 - DNA, 15 bp, Homo sapiens
tttatttgagccact

SEQ ID NO: 24425 - DNA, 15 bp, Homo sapiens
ttttatttgagccac

SEQ ID NO: 24426 - DNA, 15 bp, Homo sapiens
attttatttgagcca

SEQ ID NO: 24427 - DNA, 15 bp, Homo sapiens
gattttatttgagcc

SEQ ID NO: 24428 - DNA, 15 bp, Homo sapiens
tgattttatttgagc

SEQ ID NO: 24429 - DNA, 15 bp, Homo sapiens
ctgattttatttgag

SEQ ID NO: 24430 - DNA, 15 bp, Homo sapiens
tctgattttatttga

SEQ ID NO: 24431 - DNA, 15 bp, Homo sapiens
ctctgattttatttg

SEQ ID NO: 24432 - DNA, 15 bp, Homo sapiens
actctgattttattt

SEQ ID NO: 24433 - DNA, 15 bp, Homo sapiens
aactctgattttatt

SEQ ID NO: 24434 - DNA, 15 bp, Homo sapiens
aaactctgattttat

SEQ ID NO: 24435 - DNA, 15 bp, Homo sapiens
taaactctgatttta

SEQ ID NO: 24436 - DNA, 15 bp, Homo sapiens
ataaactctgatttt

SEQ ID NO: 24437 - DNA, 15 bp, Homo sapiens
aataaactctgattt

SEQ ID NO: 24438 - DNA, 15 bp, Homo sapiens
aaataaactctgatt

SEQ ID NO: 24439 - DNA, 15 bp, Homo sapiens
gaaataaactctgat

SEQ ID NO: 24440 - DNA, 15 bp, Homo sapiens
agaaataaactctga

SEQ ID NO: 24441 - DNA, 15 bp, Homo sapiens
aagaaataaactctg

SEQ ID NO: 24442 - DNA, 15 bp, Homo sapiens
aaagaaataaactct

SEQ ID NO: 24443 - DNA, 15 bp, Homo sapiens
gaaagaaataaactc

SEQ ID NO: 24444 - DNA, 15 bp, Homo sapiens
agaaagaaataaact

SEQ ID NO: 24445 - DNA, 15 bp, Homo sapiens
gagaaagaaataaac

SEQ ID NO: 24446 - DNA, 15 bp, Homo sapiens
agagaaagaaataaa

SEQ ID NO: 24447 - DNA, 15 bp, Homo sapiens
gagagaaagaaataa

SEQ ID NO: 24448 - DNA, 15 bp, Homo sapiens
ggagagaaagaaata

SEQ ID NO: 24449 - DNA, 15 bp, Homo sapiens
aggagagaaagaaat

SEQ ID NO: 24450 - DNA, 15 bp, Homo sapiens
aaggagagaaagaaa

SEQ ID NO: 24451 - DNA, 15 bp, Homo sapiens
taaggagagaaagaa

SEQ ID NO: 24452 - DNA, 15 bp, Homo sapiens
gtaaggagagaaaga

SEQ ID NO: 24453 - DNA, 15 bp, Homo sapiens
tgtaaggagagaaag

SEQ ID NO: 24454 - DNA, 15 bp, Homo sapiens
ctgtaaggagagaaa

SEQ ID NO: 24455 - DNA, 15 bp, Homo sapiens
actgtaaggagagaa

SEQ ID NO: 24456 - DNA, 15 bp, Homo sapiens
aactgtaaggagaga

SEQ ID NO: 24457 - DNA, 15 bp, Homo sapiens
gaactgtaaggagag

SEQ ID NO: 24458 - DNA, 15 bp, Homo sapiens
tgaactgtaaggaga

SEQ ID NO: 24459 - DNA, 15 bp, Homo sapiens
ctgaactgtaaggag

SEQ ID NO: 24460 - DNA, 15 bp, Homo sapiens
tctgaactgtaagga

SEQ ID NO: 24461 - DNA, 15 bp, Homo sapiens
ctctgaactgtaagg

SEQ ID NO: 24462 - DNA, 15 bp, Homo sapiens
actctgaactgtaag

SEQ ID NO: 24463 - DNA, 15 bp, Homo sapiens
aactctgaactgtaa

SEQ ID NO: 24464 - DNA, 15 bp, Homo sapiens
caactctgaactgta

SEQ ID NO: 24465 - DNA, 15 bp, Homo sapiens
ccaactctgaactgt

SEQ ID NO: 24466 - DNA, 15 bp, Homo sapiens
accaactctgaactg

SEQ ID NO: 24467 - DNA, 15 bp, Homo sapiens
caccaactctgaact

SEQ ID NO: 24468 - DNA, 15 bp, Homo sapiens
ccaccaactctgaac

SEQ ID NO: 24469 - DNA, 15 bp, Homo sapiens
cccaccaactctgaa

SEQ ID NO: 24470 - DNA, 15 bp, Homo sapiens
acccaccaactctga

SEQ ID NO: 24471 - DNA, 15 bp, Homo sapiens
cacccaccaactctg

SEQ ID NO: 24472 - DNA, 15 bp, Homo sapiens
tcacccaccaactct

SEQ ID NO: 24473 - DNA, 15 bp, Homo sapiens
atcacccaccaactc

SEQ ID NO: 24474 - DNA, 15 bp, Homo sapiens
catcacccaccaact

SEQ ID NO: 24475 - DNA, 15 bp, Homo sapiens
ccatcacccaccaac

SEQ ID NO: 24476 - DNA, 15 bp, Homo sapiens
tccatcacccaccaa

SEQ ID NO: 24477 - DNA, 15 bp, Homo sapiens
ctccatcacccacca

SEQ ID NO: 24478 - DNA, 15 bp, Homo sapiens
cctccatcacccacc

SEQ ID NO: 24479 - DNA, 15 bp, Homo sapiens
ccctccatcacccac

SEQ ID NO: 24480 - DNA, 15 bp, Homo sapiens
accctccatcaccca

SEQ ID NO: 24481 - DNA, 15 bp, Homo sapiens
caccctccatcaccc

SEQ ID NO: 24482 - DNA, 15 bp, Homo sapiens
ccaccctccatcacc

SEQ ID NO: 24483 - DNA, 15 bp, Homo sapiens
cccaccctccatcac

SEQ ID NO: 24484 - DNA, 15 bp, Homo sapiens
tcccaccctccatca

SEQ ID NO: 24485 - DNA, 15 bp, Homo sapiens
ttcccaccctccatc

SEQ ID NO: 24486 - DNA, 15 bp, Homo sapiens
cttcccaccctccat

SEQ ID NO: 24487 - DNA, 15 bp, Homo sapiens
ccttcccaccctcca

SEQ ID NO: 24488 - DNA, 15 bp, Homo sapiens
accttcccaccctcc

SEQ ID NO: 24489 - DNA, 15 bp, Homo sapiens
caccttcccaccctc

SEQ ID NO: 24490 - DNA, 15 bp, Homo sapiens
ccaccttcccaccct

SEQ ID NO: 24491 - DNA, 15 bp, Homo sapiens
gccaccttcccaccc

SEQ ID NO: 24492 - DNA, 15 bp, Homo sapiens
agccaccttcccacc

SEQ ID NO: 24493 - DNA, 15 bp, Homo sapiens
gagccaccttcccac

SEQ ID NO: 24494 - DNA, 15 bp, Homo sapiens
ggagccaccttccca

SEQ ID NO: 24495 - DNA, 15 bp, Homo sapiens
cggagccaccttccc

SEQ ID NO: 24496 - DNA, 15 bp, Homo sapiens
gcggagccaccttcc

SEQ ID NO: 24497 - DNA, 15 bp, Homo sapiens
agcggagccaccttc

SEQ ID NO: 24498 - DNA, 15 bp, Homo sapiens
aagcggagccacctt

SEQ ID NO: 24499 - DNA, 15 bp, Homo sapiens
gaagcggagccacct

SEQ ID NO: 24500 - DNA, 15 bp, Homo sapiens
tgaagcggagccacc

SEQ ID NO: 24501 - DNA, 15 bp, Homo sapiens
atgaagcggagccac

SEQ ID NO: 24502 - DNA, 15 bp, Homo sapiens
tatgaagcggagcca

SEQ ID NO: 24503 - DNA, 15 bp, Homo sapiens
atatgaagcggagcc

SEQ ID NO: 24504 - DNA, 15 bp, Homo sapiens
catatgaagcggagc

SEQ ID NO: 24505 - DNA, 15 bp, Homo sapiens
ccatatgaagcggag

SEQ ID NO: 24506 - DNA, 15 bp, Homo sapiens
accatatgaagcgga

SEQ ID NO: 24507 - DNA, 15 bp, Homo sapiens
gaccatatgaagcgg

SEQ ID NO: 24508 - DNA, 15 bp, Homo sapiens
agaccatatgaagcg

SEQ ID NO: 24509 - DNA, 15 bp, Homo sapiens
gagaccatatgaagc

SEQ ID NO: 24510 - DNA, 15 bp, Homo sapiens
agagaccatatgaag

SEQ ID NO: 24511 - DNA, 15 bp, Homo sapiens
gagagaccatatgaa

SEQ ID NO: 24512 - DNA, 15 bp, Homo sapiens
tgagagaccatatga

SEQ ID NO: 24513 - DNA, 15 bp, Homo sapiens
ctgagagaccatatg

SEQ ID NO: 24514 - DNA, 15 bp, Homo sapiens
cctgagagaccatat

SEQ ID NO: 24515 - DNA, 15 bp, Homo sapiens
ccctgagagaccata

SEQ ID NO: 24516 - DNA, 15 bp, Homo sapiens
tccctgagagaccat

SEQ ID NO: 24517 - DNA, 15 bp, Homo sapiens
atccctgagagacca

SEQ ID NO: 24518 - DNA, 15 bp, Homo sapiens
gatccctgagagacc

SEQ ID NO: 24519 - DNA, 15 bp, Homo sapiens
ggatccctgagagac

SEQ ID NO: 24520 - DNA, 15 bp, Homo sapiens
aggatccctgagaga

SEQ ID NO: 24521 - DNA, 15 bp, Homo sapiens
caggatccctgagag

SEQ ID NO: 24522 - DNA, 15 bp, Homo sapiens
ccaggatccctgaga

SEQ ID NO: 24523 - DNA, 15 bp, Homo sapiens
accaggatccctgag

SEQ ID NO: 24524 - DNA, 15 bp, Homo sapiens
aaccaggatccctga

SEQ ID NO: 24525 - DNA, 15 bp, Homo sapiens
gaaccaggatccctg

SEQ ID NO: 24526 - DNA, 15 bp, Homo sapiens
ggaaccaggatccct

SEQ ID NO: 24527 - DNA, 15 bp, Homo sapiens
aggaaccaggatccc

SEQ ID NO: 24528 - DNA, 15 bp, Homo sapiens
aaggaaccaggatcc

SEQ ID NO: 24529 - DNA, 15 bp, Homo sapiens
gaaggaaccaggatc

SEQ ID NO: 24530 - DNA, 15 bp, Homo sapiens
agaaggaaccaggat

SEQ ID NO: 24531 - DNA, 15 bp, Homo sapiens
gagaaggaaccagga

SEQ ID NO: 24532 - DNA, 15 bp, Homo sapiens
agagaaggaaccagg

SEQ ID NO: 24533 - DNA, 15 bp, Homo sapiens
gagagaaggaaccag

SEQ ID NO: 24534 - DNA, 15 bp, Homo sapiens
agagagaaggaacca

SEQ ID NO: 24535 - DNA, 15 bp, Homo sapiens
aagagagaaggaacc

SEQ ID NO: 24536 - DNA, 15 bp, Homo sapiens
caagagagaaggaac

SEQ ID NO: 24537 - DNA, 15 bp, Homo sapiens
acaagagagaaggaa

SEQ ID NO: 24538 - DNA, 15 bp, Homo sapiens
aacaagagagaagga

SEQ ID NO: 24539 - DNA, 15 bp, Homo sapiens
gaacaagagagaagg

SEQ ID NO: 24540 - DNA, 15 bp, Homo sapiens
agaacaagagagaag

SEQ ID NO: 24541 - DNA, 15 bp, Homo sapiens
cagaacaagagagaa

SEQ ID NO: 24542 - DNA, 15 bp, Homo sapiens
gcagaacaagagaga

SEQ ID NO: 24543 - DNA, 15 bp, Homo sapiens
ggcagaacaagagag

SEQ ID NO: 24544 - DNA, 15 bp, Homo sapiens
aggcagaacaagaga

SEQ ID NO: 24545 - DNA, 15 bp, Homo sapiens
aaggcagaacaagag

SEQ ID NO: 24546 - DNA, 15 bp, Homo sapiens
aaaggcagaacaaga

SEQ ID NO: 24547 - DNA, 15 bp, Homo sapiens
gaaaggcagaacaag

SEQ ID NO: 24548 - DNA, 15 bp, Homo sapiens
ggaaaggcagaacaa

SEQ ID NO: 24549 - DNA, 15 bp, Homo sapiens
tggaaaggcagaaca

SEQ ID NO: 24550 - DNA, 15 bp, Homo sapiens
ttggaaaggcagaac

SEQ ID NO: 24551 - DNA, 15 bp, Homo sapiens
tttggaaaggcagaa

SEQ ID NO: 24552 - DNA, 15 bp, Homo sapiens
ctttggaaaggcaga

SEQ ID NO: 24553 - DNA, 15 bp, Homo sapiens
actttggaaaggcag

SEQ ID NO: 24554 - DNA, 15 bp, Homo sapiens
cactttggaaaggca

SEQ ID NO: 24555 - DNA, 15 bp, Homo sapiens
acactttggaaaggc

SEQ ID NO: 24556 - DNA, 15 bp, Homo sapiens
aacactttggaaagg

SEQ ID NO: 24557 - DNA, 15 bp, Homo sapiens
caacactttggaaag

SEQ ID NO: 24558 - DNA, 15 bp, Homo sapiens
acaacactttggaaa

SEQ ID NO: 24559 - DNA, 15 bp, Homo sapiens
aacaacactttggaa

SEQ ID NO: 24560 - DNA, 15 bp, Homo sapiens
gaacaacactttgga

SEQ ID NO: 24561 - DNA, 15 bp, Homo sapiens
ggaacaacactttgg

SEQ ID NO: 24562 - DNA, 15 bp, Homo sapiens
tggaacaacactttg

SEQ ID NO: 24563 - DNA, 15 bp, Homo sapiens
atggaacaacacttt

SEQ ID NO: 24564 - DNA, 15 bp, Homo sapiens
aatggaacaacactt

SEQ ID NO: 24565 - DNA, 15 bp, Homo sapiens
aaatggaacaacact

SEQ ID NO: 24566 - DNA, 15 bp, Homo sapiens
aaaatggaacaacac

SEQ ID NO: 24567 - DNA, 15 bp, Homo sapiens
gaaaatggaacaaca

SEQ ID NO: 24568 - DNA, 15 bp, Homo sapiens
agaaaatggaacaac

SEQ ID NO: 24569 - DNA, 15 bp, Homo sapiens
aagaaaatggaacaa

SEQ ID NO: 24570 - DNA, 15 bp, Homo sapiens
caagaaaatggaaca

SEQ ID NO: 24571 - DNA, 15 bp, Homo sapiens
tcaagaaaatggaac

SEQ ID NO: 24572 - DNA, 15 bp, Homo sapiens
atcaagaaaatggaa

SEQ ID NO: 24573 - DNA, 15 bp, Homo sapiens
catcaagaaaatgga

SEQ ID NO: 24574 - DNA, 15 bp, Homo sapiens
tcatcaagaaaatgg

SEQ ID NO: 24575 - DNA, 15 bp, Homo sapiens
ctcatcaagaaaatg

SEQ ID NO: 24576 - DNA, 15 bp, Homo sapiens
cctcatcaagaaaat

SEQ ID NO: 24577 - DNA, 15 bp, Homo sapiens
gcctcatcaagaaaa

SEQ ID NO: 24578 - DNA, 15 bp, Homo sapiens
agcctcatcaagaaa

SEQ ID NO: 24579 - DNA, 15 bp, Homo sapiens
aagcctcatcaagaa

SEQ ID NO: 24580 - DNA, 15 bp, Homo sapiens
caagcctcatcaaga

SEQ ID NO: 24581 - DNA, 15 bp, Homo sapiens
gcaagcctcatcaag

SEQ ID NO: 24582 - DNA, 15 bp, Homo sapiens
ggcaagcctcatcaa

SEQ ID NO: 24583 - DNA, 15 bp, Homo sapiens
gggcaagcctcatca

SEQ ID NO: 24584 - DNA, 15 bp, Homo sapiens
ggggcaagcctcatc

SEQ ID NO: 24585 - DNA, 15 bp, Homo sapiens
aggggcaagcctcat

SEQ ID NO: 24586 - DNA, 15 bp, Homo sapiens
gaggggcaagcctca

SEQ ID NO: 24587 - DNA, 15 bp, Homo sapiens
tgaggggcaagcctc

SEQ ID NO: 24588 - DNA, 15 bp, Homo sapiens
ttgaggggcaagcct

SEQ ID NO: 24589 - DNA, 15 bp, Homo sapiens
gttgaggggcaagcc

SEQ ID NO: 24590 - DNA, 15 bp, Homo sapiens
tgttgaggggcaagc

SEQ ID NO: 24591 - DNA, 15 bp, Homo sapiens
gtgttgaggggcaag

SEQ ID NO: 24592 - DNA, 15 bp, Homo sapiens
agtgttgaggggcaa

SEQ ID NO: 24593 - DNA, 15 bp, Homo sapiens
tagtgttgaggggca

SEQ ID NO: 24594 - DNA, 15 bp, Homo sapiens
atagtgttgaggggc

SEQ ID NO: 24595 - DNA, 15 bp, Homo sapiens
acatagtgttgaggg

SEQ ID NO: 24596 - DNA, 15 bp, Homo sapiens
gacatagtgttgagg

SEQ ID NO: 24597 - DNA, 15 bp, Homo sapiens
tgacatagtgttgag

SEQ ID NO: 24598 - DNA, 15 bp, Homo sapiens
ttgacatagtgttga

SEQ ID NO: 24599 - DNA, 15 bp, Homo sapiens
cttgacatagtgttg

SEQ ID NO: 24600 - DNA, 15 bp, Homo sapiens
acttgacatagtgtt

SEQ ID NO: 24601 - DNA, 15 bp, Homo sapiens
aacttgacatagtgt

SEQ ID NO: 24602 - DNA, 15 bp, Homo sapiens
gaacttgacatagtg

SEQ ID NO: 24603 - DNA, 15 bp, Homo sapiens
agaacttgacatagt

SEQ ID NO: 24604 - DNA, 15 bp, Homo sapiens
tagaacttgacatag

SEQ ID NO: 24605 - DNA, 15 bp, Homo sapiens
ctagaacttgacata

SEQ ID NO: 24606 - DNA, 15 bp, Homo sapiens
actagaacttgacat

SEQ ID NO: 24607 - DNA, 15 bp, Homo sapiens
gactagaacttgaca

SEQ ID NO: 24608 - DNA, 15 bp, Homo sapiens
ggactagaacttgac

SEQ ID NO: 24609 - DNA, 15 bp, Homo sapiens
tggactagaacttga

SEQ ID NO: 24610 - DNA, 15 bp, Homo sapiens
ttggactagaacttg

SEQ ID NO: 24611 - DNA, 15 bp, Homo sapiens
cttggactagaactt

SEQ ID NO: 24612 - DNA, 15 bp, Homo sapiens
ccttggactagaact

SEQ ID NO: 24613 - DNA, 15 bp, Homo sapiens
tccttggactagaac

SEQ ID NO: 24614 - DNA, 15 bp, Homo sapiens
ttccttggactagaa

SEQ ID NO: 24615 - DNA, 15 bp, Homo sapiens
tttccttggactaga

SEQ ID NO: 24616 - DNA, 15 bp, Homo sapiens
ctttccttggactag

SEQ ID NO: 24617 - DNA, 15 bp, Homo sapiens
tctttccttggacta

SEQ ID NO: 24618 - DNA, 15 bp, Homo sapiens
ctctttccttggact

SEQ ID NO: 24619 - DNA, 15 bp, Homo sapiens
tctctttccttggac

SEQ ID NO: 24620 - DNA, 15 bp, Homo sapiens
ttctctttccttgga

SEQ ID NO: 24621 - DNA, 15 bp, Homo sapiens
tttctctttccttgg

SEQ ID NO: 24622 - DNA, 15 bp, Homo sapiens
ttttctctttccttg

SEQ ID NO: 24623 - DNA, 15 bp, Homo sapiens
cttttctctttcctt

SEQ ID NO: 24624 - DNA, 15 bp, Homo sapiens
tcttttctctttcct

SEQ ID NO: 24625 - DNA, 15 bp, Homo sapiens
ctcttttctctttcc

SEQ ID NO: 24626 - DNA, 15 bp, Homo sapiens
tctcttttctctttc

SEQ ID NO: 24627 - DNA, 15 bp, Homo sapiens
ttctcttttctcttt

SEQ ID NO: 24628 - DNA, 15 bp, Homo sapiens
cttctcttttctctt

SEQ ID NO: 24629 - DNA, 15 bp, Homo sapiens
acttctcttttctct

SEQ ID NO: 24630 - DNA, 15 bp, Homo sapiens
tacttctcttttctc

SEQ ID NO: 24631 - DNA, 15 bp, Homo sapiens
ttacttctcttttct

SEQ ID NO: 24632 - DNA, 15 bp, Homo sapiens
tttacttctcttttc

SEQ ID NO: 24633 - DNA, 15 bp, Homo sapiens
ttttacttctctttt

SEQ ID NO: 24634 - DNA, 15 bp, Homo sapiens
tttttacttctcttt

SEQ ID NO: 24635 - DNA, 15 bp, Homo sapiens
ttttttacttctctt

SEQ ID NO: 24636 - DNA, 15 bp, Homo sapiens
attttttacttctct

SEQ ID NO: 24637 - DNA, 15 bp, Homo sapiens
tattttttacttctc

SEQ ID NO: 24638 - DNA, 15 bp, Homo sapiens
ttattttttacttct

SEQ ID NO: 24639 - DNA, 15 bp, Homo sapiens
cttattttttacttc

SEQ ID NO: 24640 - DNA, 15 bp, Homo sapiens
gcttattttttactt

SEQ ID NO: 24641 - DNA, 15 bp, Homo sapiens
tgcttattttttact

SEQ ID NO: 24642 - DNA, 15 bp, Homo sapiens
ttgcttattttttac

SEQ ID NO: 24643 - DNA, 15 bp, Homo sapiens
attgcttatttttta

SEQ ID NO: 24644 - DNA, 15 bp, Homo sapiens
aattgcttatttttt

SEQ ID NO: 24645 - DNA, 15 bp, Homo sapiens
aaattgcttattttt

SEQ ID NO: 24646 - DNA, 15 bp, Homo sapiens
aaaattgcttatttt

SEQ ID NO: 24647 - DNA, 15 bp, Homo sapiens
aaaaattgcttattt

SEQ ID NO: 24648 - DNA, 15 bp, Homo sapiens
aaaaaattgcttatt

SEQ ID NO: 24649 - DNA, 15 bp, Homo sapiens
taaaaaattgcttat

SEQ ID NO: 24650 - DNA, 15 bp, Homo sapiens
ttaaaaaattgctta

SEQ ID NO: 24651 - DNA, 15 bp, Homo sapiens
tttaaaaaattgctt

SEQ ID NO: 24652 - DNA, 15 bp, Homo sapiens
ttttaaaaaattgct

SEQ ID NO: 24653 - DNA, 15 bp, Homo sapiens
gttttaaaaaattgc

SEQ ID NO: 24654 - DNA, 15 bp, Homo sapiens
cgttttaaaaaattg

SEQ ID NO: 24655 - DNA, 15 bp, Homo sapiens
acgttttaaaaaatt

SEQ ID NO: 24656 - DNA, 15 bp, Homo sapiens
cacgttttaaaaaat

SEQ ID NO: 24657 - DNA, 15 bp, Homo sapiens
gcacgttttaaaaaa

SEQ ID NO: 24658 - DNA, 15 bp, Homo sapiens
tgcacgttttaaaaa

SEQ ID NO: 24659 - DNA, 15 bp, Homo sapiens
atgcacgttttaaaa

SEQ ID NO: 24660 - DNA, 15 bp, Homo sapiens
catgcacgttttaaa

SEQ ID NO: 24661 - DNA, 15 bp, Homo sapiens
ccatgcacgttttaa

SEQ ID NO: 24662 - DNA, 15 bp, Homo sapiens
gccatgcacgtttta

SEQ ID NO: 24663 - DNA, 15 bp, Homo sapiens
ggccatgcacgtttt

SEQ ID NO: 24664 - DNA, 15 bp, Homo sapiens
gggccatgcacgttt

SEQ ID NO: 24665 - DNA, 15 bp, Homo sapiens
agggccatgcacgtt

SEQ ID NO: 24666 - DNA, 15 bp, Homo sapiens
gagggccatgcacgt

SEQ ID NO: 24667 - DNA, 15 bp, Homo sapiens
tgagggccatgcacg

SEQ ID NO: 24668 - DNA, 15 bp, Homo sapiens
ctgagggccatgcac

SEQ ID NO: 24669 - DNA, 15 bp, Homo sapiens
cctgagggccatgca

SEQ ID NO: 24670 - DNA, 15 bp, Homo sapiens
acctgagggccatgc

SEQ ID NO: 24671 - DNA, 15 bp, Homo sapiens
aacctgagggccatg

SEQ ID NO: 24672 - DNA, 15 bp, Homo sapiens
caacctgagggccat

SEQ ID NO: 24673 - DNA, 15 bp, Homo sapiens
gcaacctgagggcca

SEQ ID NO: 24674 - DNA, 15 bp, Homo sapiens
tgcaacctgagggcc

SEQ ID NO: 24675 - DNA, 15 bp, Homo sapiens
atgcaacctgagggc

SEQ ID NO: 24676 - DNA, 15 bp, Homo sapiens
aatgcaacctgaggg

SEQ ID NO: 24677 - DNA, 15 bp, Homo sapiens
gaatgcaacctgagg

SEQ ID NO: 24678 - DNA, 15 bp, Homo sapiens
ggaatgcaacctgag

SEQ ID NO: 24679 - DNA, 15 bp, Homo sapiens
aggaatgcaacctga

SEQ ID NO: 24680 - DNA, 15 bp, Homo sapiens
caggaatgcaacctg

SEQ ID NO: 24681 - DNA, 15 bp, Homo sapiens
tcaggaatgcaacct

SEQ ID NO: 24682 - DNA, 15 bp, Homo sapiens
atcaggaatgcaacc

SEQ ID NO: 24683 - DNA, 15 bp, Homo sapiens
aatcaggaatgcaac

SEQ ID NO: 24684 - DNA, 15 bp, Homo sapiens
aaatcaggaatgcaa

SEQ ID NO: 24685 - DNA, 15 bp, Homo sapiens
gaaatcaggaatgca

SEQ ID NO: 24686 - DNA, 15 bp, Homo sapiens
agaaatcaggaatgc

SEQ ID NO: 24687 - DNA, 15 bp, Homo sapiens
aagaaatcaggaatg

SEQ ID NO: 24688 - DNA, 15 bp, Homo sapiens
aaagaaatcaggaat

SEQ ID NO: 24689 - DNA, 15 bp, Homo sapiens
aaaagaaatcaggaa

SEQ ID NO: 24690 - DNA, 15 bp, Homo sapiens
gaaaagaaatcagga

SEQ ID NO: 24691 - DNA, 15 bp, Homo sapiens
tgaaaagaaatcagg

SEQ ID NO: 24692 - DNA, 15 bp, Homo sapiens
gtgaaaagaaatcag

SEQ ID NO: 24693 - DNA, 15 bp, Homo sapiens
tgtgaaaagaaatca

SEQ ID NO: 24694 - DNA, 15 bp, Homo sapiens
atgtgaaaagaaatc

SEQ ID NO: 24695 - DNA, 15 bp, Homo sapiens
gatgtgaaaagaaat

SEQ ID NO: 24696 - DNA, 15 bp, Homo sapiens
ggatgtgaaaagaaa

SEQ ID NO: 24697 - DNA, 15 bp, Homo sapiens
gggatgtgaaaagaa

SEQ ID NO: 24698 - DNA, 15 bp, Homo sapiens
tgggatgtgaaaaga

SEQ ID NO: 24699 - DNA, 15 bp, Homo sapiens
gtgggatgtgaaaag

SEQ ID NO: 24700 - DNA, 15 bp, Homo sapiens
agtgggatgtgaaaa

SEQ ID NO: 24701 - DNA, 15 bp, Homo sapiens
cagtgggatgtgaaa

SEQ ID NO: 24702 - DNA, 15 bp, Homo sapiens
ccagtgggatgtgaa

SEQ ID NO: 24703 - DNA, 15 bp, Homo sapiens
gccagtgggatgtga

SEQ ID NO: 24704 - DNA, 15 bp, Homo sapiens
agccagtgggatgtg

SEQ ID NO: 24705 - DNA, 15 bp, Homo sapiens
cagccagtgggatgt

SEQ ID NO: 24706 - DNA, 15 bp, Homo sapiens
gcagccagtgggatg

SEQ ID NO: 24707 - DNA, 15 bp, Homo sapiens
agcagccagtgggat

SEQ ID NO: 24708 - DNA, 15 bp, Homo sapiens
cagcagccagtggga

SEQ ID NO: 24709 - DNA, 15 bp, Homo sapiens
gcagcagccagtggg

SEQ ID NO: 24710 - DNA, 15 bp, Homo sapiens
agcagcagccagtgg

SEQ ID NO: 24711 - DNA, 15 bp, Homo sapiens
aagcagcagccagtg

SEQ ID NO: 24712 - DNA, 15 bp, Homo sapiens
taagcagcagccagt

SEQ ID NO: 24713 - DNA, 15 bp, Homo sapiens
ctaagcagcagccag

SEQ ID NO: 24714 - DNA, 15 bp, Homo sapiens
gctaagcagcagcca

SEQ ID NO: 24715 - DNA, 15 bp, Homo sapiens
ggctaagcagcagcc

SEQ ID NO: 24716 - DNA, 15 bp, Homo sapiens
tggctaagcagcagc

SEQ ID NO: 24717 - DNA, 15 bp, Homo sapiens
gtggctaagcagcag

SEQ ID NO: 24718 - DNA, 15 bp, Homo sapiens
cgtggctaagcagca

SEQ ID NO: 24719 - DNA, 15 bp, Homo sapiens
acgtggctaagcagc

SEQ ID NO: 24720 - DNA, 15 bp, Homo sapiens
cacgtggctaagcag

SEQ ID NO: 24721 - DNA, 15 bp, Homo sapiens
ccacgtggctaagca

SEQ ID NO: 24722 - DNA, 15 bp, Homo sapiens
tccacgtggctaagc

SEQ ID NO: 24723 - DNA, 15 bp, Homo sapiens
gtccacgtggctaag

SEQ ID NO: 24724 - DNA, 15 bp, Homo sapiens
agtccacgtggctaa

SEQ ID NO: 24725 - DNA, 15 bp, Homo sapiens
gagtccacgtggcta

SEQ ID NO: 24726 - DNA, 15 bp, Homo sapiens
tgagtccacgtggct

SEQ ID NO: 24727 - DNA, 15 bp, Homo sapiens
atgagtccacgtggc

SEQ ID NO: 24728 - DNA, 15 bp, Homo sapiens
gatgagtccacgtgg

SEQ ID NO: 24729 - DNA, 15 bp, Homo sapiens
agatgagtccacgtg

SEQ ID NO: 24730 - DNA, 15 bp, Homo sapiens
aagatgagtccacgt

SEQ ID NO: 24731 - DNA, 15 bp, Homo sapiens
caagatgagtccacg

SEQ ID NO: 24732 - DNA, 15 bp, Homo sapiens
gcaagatgagtccac

SEQ ID NO: 24733 - DNA, 15 bp, Homo sapiens
agcaagatgagtcca

SEQ ID NO: 24734 - DNA, 15 bp, Homo sapiens
cagcaagatgagtcc

SEQ ID NO: 24735 - DNA, 15 bp, Homo sapiens
gcagcaagatgagtc

SEQ ID NO: 24736 - DNA, 15 bp, Homo sapiens
tgcagcaagatgagt

SEQ ID NO: 24737 - DNA, 15 bp, Homo sapiens
ttgcagcaagatgag

SEQ ID NO: 24738 - DNA, 15 bp, Homo sapiens
cttgcagcaagatga

SEQ ID NO: 24739 - DNA, 15 bp, Homo sapiens
ccttgcagcaagatg

SEQ ID NO: 24740 - DNA, 15 bp, Homo sapiens
cccttgcagcaagat

SEQ ID NO: 24741 - DNA, 15 bp, Homo sapiens
tcccttgcagcaaga

SEQ ID NO: 24742 - DNA, 15 bp, Homo sapiens
ctcccttgcagcaag

SEQ ID NO: 24743 - DNA, 15 bp, Homo sapiens
cctcccttgcagcaa

SEQ ID NO: 24744 - DNA, 15 bp, Homo sapiens
acctcccttgcagca

SEQ ID NO: 24745 - DNA, 15 bp, Homo sapiens
aacctcccttgcagc

SEQ ID NO: 24746 - DNA, 15 bp, Homo sapiens
caacctcccttgcag

SEQ ID NO: 24747 - DNA, 15 bp, Homo sapiens
tcaacctcccttgca

SEQ ID NO: 24748 - DNA, 15 bp, Homo sapiens
ctcaacctcccttgc

SEQ ID NO: 24749 - DNA, 15 bp, Homo sapiens
tctcaacctcccttg

SEQ ID NO: 24750 - DNA, 15 bp, Homo sapiens
ttctcaacctccctt

SEQ ID NO: 24751 - DNA, 15 bp, Homo sapiens
tttctcaacctccct

SEQ ID NO: 24752 - DNA, 15 bp, Homo sapiens
atttctcaacctccc

SEQ ID NO: 24753 - DNA, 15 bp, Homo sapiens
tatttctcaacctcc

SEQ ID NO: 24754 - DNA, 15 bp, Homo sapiens
atatttctcaacctc

SEQ ID NO: 24755 - DNA, 15 bp, Homo sapiens
catatttctcaacct

SEQ ID NO: 24756 - DNA, 15 bp, Homo sapiens
ccatatttctcaacc

SEQ ID NO: 24757 - DNA, 15 bp, Homo sapiens
gccatatttctcaac

SEQ ID NO: 24758 - DNA, 15 bp, Homo sapiens
agccatatttctcaa

SEQ ID NO: 24759 - DNA, 15 bp, Homo sapiens
aagccatatttctca

SEQ ID NO: 24760 - DNA, 15 bp, Homo sapiens
caagccatatttctc

SEQ ID NO: 24761 - DNA, 15 bp, Homo sapiens
acaagccatatttct

SEQ ID NO: 24762 - DNA, 15 bp, Homo sapiens
cacaagccatatttc

SEQ ID NO: 24763 - DNA, 15 bp, Homo sapiens
gcacaagccatattt

SEQ ID NO: 24764 - DNA, 15 bp, Homo sapiens
agcacaagccatatt

SEQ ID NO: 24765 - DNA, 15 bp, Homo sapiens
cagcacaagccatat

SEQ ID NO: 24766 - DNA, 15 bp, Homo sapiens
tcagcacaagccata

SEQ ID NO: 24767 - DNA, 15 bp, Homo sapiens
ctcagcacaagccat

SEQ ID NO: 24768 - DNA, 15 bp, Homo sapiens
gctcagcacaagcca

SEQ ID NO: 24769 - DNA, 15 bp, Homo sapiens
agctcagcacaagcc

SEQ ID NO: 24770 - DNA, 15 bp, Homo sapiens
tagctcagcacaagc

SEQ ID NO: 24771 - DNA, 15 bp, Homo sapiens
ctagctcagcacaag

SEQ ID NO: 24772 - DNA, 15 bp, Homo sapiens
tctagctcagcacaa

SEQ ID NO: 24773 - DNA, 15 bp, Homo sapiens
ttctagctcagcaca

SEQ ID NO: 24774 - DNA, 15 bp, Homo sapiens
gttctagctcagcac

SEQ ID NO: 24775 - DNA, 15 bp, Homo sapiens
agttctagctcagca

SEQ ID NO: 24776 - DNA, 15 bp, Homo sapiens
cagttctagctcagc

SEQ ID NO: 24777 - DNA, 15 bp, Homo sapiens
acagttctagctcag

SEQ ID NO: 24778 - DNA, 15 bp, Homo sapiens
cacagttctagctca

SEQ ID NO: 24779 - DNA, 15 bp, Homo sapiens
ccacagttctagctc

SEQ ID NO: 24780 - DNA, 15 bp, Homo sapiens
cccacagttctagct

SEQ ID NO: 24781 - DNA, 15 bp, Homo sapiens
ccccacagttctagc

SEQ ID NO: 24782 - DNA, 15 bp, Homo sapiens
tccccacagttctag

SEQ ID NO: 24783 - DNA, 15 bp, Homo sapiens
atccccacagttcta

SEQ ID NO: 24784 - DNA, 15 bp, Homo sapiens
catccccacagttct

SEQ ID NO: 24785 - DNA, 15 bp, Homo sapiens
ccatccccacagttc

SEQ ID NO: 24786 - DNA, 15 bp, Homo sapiens
tccatccccacagtt

SEQ ID NO: 24787 - DNA, 15 bp, Homo sapiens
ctccatccccacagt

SEQ ID NO: 24788 - DNA, 15 bp, Homo sapiens
cctccatccccacag

SEQ ID NO: 24789 - DNA, 15 bp, Homo sapiens
tcctccatccccaca

SEQ ID NO: 24790 - DNA, 15 bp, Homo sapiens
ctcctccatccccac

SEQ ID NO: 24791 - DNA, 15 bp, Homo sapiens
tctcctccatcccca

SEQ ID NO: 24792 - DNA, 15 bp, Homo sapiens
ttctcctccatcccc

SEQ ID NO: 24793 - DNA, 15 bp, Homo sapiens
cttctcctccatccc

SEQ ID NO: 24794 - DNA, 15 bp, Homo sapiens
tcttctcctccatcc

SEQ ID NO: 24795 - DNA, 15 bp, Homo sapiens
ctcttctcctccatc

SEQ ID NO: 24796 - DNA, 15 bp, Homo sapiens
gctcttctcctccat

SEQ ID NO: 24797 - DNA, 15 bp, Homo sapiens
tgctcttctcctcca

SEQ ID NO: 24798 - DNA, 15 bp, Homo sapiens
ctgctcttctcctcc

SEQ ID NO: 24799 - DNA, 15 bp, Homo sapiens
cctgctcttctcctc

SEQ ID NO: 24800 - DNA, 15 bp, Homo sapiens
acctgctcttctcct

SEQ ID NO: 24801 - DNA, 15 bp, Homo sapiens
aacctgctcttctcc

SEQ ID NO: 24802 - DNA, 15 bp, Homo sapiens
aaacctgctcttctc

SEQ ID NO: 24803 - DNA, 15 bp, Homo sapiens
gaaacctgctcttct

SEQ ID NO: 24804 - DNA, 15 bp, Homo sapiens
agaaacctgctcttc

SEQ ID NO: 24805 - DNA, 15 bp, Homo sapiens
cagaaacctgctctt

SEQ ID NO: 24806 - DNA, 15 bp, Homo sapiens
tcagaaacctgctct

SEQ ID NO: 24807 - DNA, 15 bp, Homo sapiens
atcagaaacctgctc

SEQ ID NO: 24808 - DNA, 15 bp, Homo sapiens
tatcagaaacctgct

SEQ ID NO: 24809 - DNA, 15 bp, Homo sapiens
gtatcagaaacctgc

SEQ ID NO: 24810 - DNA, 15 bp, Homo sapiens
agtatcagaaacctg

SEQ ID NO: 24811 - DNA, 15 bp, Homo sapiens
cagtatcagaaacct

SEQ ID NO: 24812 - DNA, 15 bp, Homo sapiens
tcagtatcagaaacc

SEQ ID NO: 24813 - DNA, 15 bp, Homo sapiens
ttcagtatcagaaac

SEQ ID NO: 24814 - DNA, 15 bp, Homo sapiens
tttcagtatcagaaa

SEQ ID NO: 24815 - DNA, 15 bp, Homo sapiens
ttttcagtatcagaa

SEQ ID NO: 24816 - DNA, 15 bp, Homo sapiens
tttttcagtatcaga

SEQ ID NO: 24817 - DNA, 15 bp, Homo sapiens
ttttttcagtatcag

SEQ ID NO: 24818 - DNA, 15 bp, Homo sapiens
tttttttcagtatca

SEQ ID NO: 24819 - DNA, 15 bp, Homo sapiens
ttttttttcagtatc

SEQ ID NO: 24820 - DNA, 15 bp, Homo sapiens
tttttttttcagtat

SEQ ID NO: 24821 - DNA, 15 bp, Homo sapiens
ttttttttttcagta

SEQ ID NO: 24822 - DNA, 15 bp, Homo sapiens
tttttttttttcagt

SEQ ID NO: 24823 - DNA, 15 bp, Homo sapiens
ttttttttttttcag

SEQ ID NO: 24824 - DNA, 15 bp, Homo sapiens
ctttttttttttttc

SEQ ID NO: 24825 - DNA, 15 bp, Homo sapiens
ttttctttttttttt

SEQ ID NO: 24826 - DNA, 15 bp, Homo sapiens
cttttcttttttttt

SEQ ID NO: 24827 - DNA, 15 bp, Homo sapiens
tcttttctttttttt

SEQ ID NO: 24828 - DNA, 15 bp, Homo sapiens
tttcttttctttttt

SEQ ID NO: 24829 - DNA, 15 bp, Homo sapiens
ttttcttttcttttt

SEQ ID NO: 24830 - DNA, 15 bp, Homo sapiens
attttcttttctttt

SEQ ID NO: 24831 - DNA, 15 bp, Homo sapiens
tattttcttttcttt

SEQ ID NO: 24832 - DNA, 15 bp, Homo sapiens
ctattttcttttctt

SEQ ID NO: 24833 - DNA, 15 bp, Homo sapiens
tctattttcttttct

SEQ ID NO: 24834 - DNA, 15 bp, Homo sapiens
ttctattttcttttc

SEQ ID NO: 24835 - DNA, 15 bp, Homo sapiens
tttctattttctttt

SEQ ID NO: 24836 - DNA, 15 bp, Homo sapiens
ctttctattttcttt

SEQ ID NO: 24837 - DNA, 15 bp, Homo sapiens
cctttctattttctt

SEQ ID NO: 24838 - DNA, 15 bp, Homo sapiens
tcctttctattttct

SEQ ID NO: 24839 - DNA, 15 bp, Homo sapiens
ctcctttctattttc

SEQ ID NO: 24840 - DNA, 15 bp, Homo sapiens
tctcctttctatttt

SEQ ID NO: 24841 - DNA, 15 bp, Homo sapiens
ttctcctttctattt

SEQ ID NO: 24842 - DNA, 15 bp, Homo sapiens
attctcctttctatt

SEQ ID NO: 24843 - DNA, 15 bp, Homo sapiens
cattctcctttctat

SEQ ID NO: 24844 - DNA, 15 bp, Homo sapiens
ccattctcctttcta

SEQ ID NO: 24845 - DNA, 15 bp, Homo sapiens
tccattctcctttct

SEQ ID NO: 24846 - DNA, 15 bp, Homo sapiens
atccattctcctttc

SEQ ID NO: 24847 - DNA, 15 bp, Homo sapiens
tatccattctccttt

SEQ ID NO: 24848 - DNA, 15 bp, Homo sapiens
ttatccattctcctt

SEQ ID NO: 24849 - DNA, 15 bp, Homo sapiens
attatccattctcct

SEQ ID NO: 24850 - DNA, 15 bp, Homo sapiens
tattatccattctcc

SEQ ID NO: 24851 - DNA, 15 bp, Homo sapiens
ttattatccattctc

SEQ ID NO: 24852 - DNA, 15 bp, Homo sapiens
attattatccattct

SEQ ID NO: 24853 - DNA, 15 bp, Homo sapiens
tattattatccattc

SEQ ID NO: 24854 - DNA, 15 bp, Homo sapiens
ttattattatccatt

SEQ ID NO: 24855 - DNA, 15 bp, Homo sapiens
tttattattatccat

SEQ ID NO: 24856 - DNA, 15 bp, Homo sapiens
atttattattatcca

SEQ ID NO: 24857 - DNA, 15 bp, Homo sapiens
tatttattattatcc

SEQ ID NO: 24858 - DNA, 15 bp, Homo sapiens
atatttattattatc

SEQ ID NO: 24859 - DNA, 15 bp, Homo sapiens
tatatttattattat

SEQ ID NO: 24860 - DNA, 15 bp, Homo sapiens
gtatatttattatta

SEQ ID NO: 24861 - DNA, 15 bp, Homo sapiens
tgtatatttattatt

SEQ ID NO: 24862 - DNA, 15 bp, Homo sapiens
atgtatatttattat

SEQ ID NO: 24863 - DNA, 15 bp, Homo sapiens
tatgtatatttatta

SEQ ID NO: 24864 - DNA, 15 bp, Homo sapiens
atatgtatatttatt

SEQ ID NO: 24865 - DNA, 15 bp, Homo sapiens
catatgtatatttat

SEQ ID NO: 24866 - DNA, 15 bp, Homo sapiens
gcatatgtatattta

SEQ ID NO: 24867 - DNA, 15 bp, Homo sapiens
agcatatgtatattt

SEQ ID NO: 24868 - DNA, 15 bp, Homo sapiens
aagcatatgtatatt

SEQ ID NO: 24869 - DNA, 15 bp, Homo sapiens
aaagcatatgtatat

SEQ ID NO: 24870 - DNA, 15 bp, Homo sapiens
caaagcatatgtata

SEQ ID NO: 24871 - DNA, 15 bp, Homo sapiens
tcaaagcatatgtat

SEQ ID NO: 24872 - DNA, 15 bp, Homo sapiens
atcaaagcatatgta

SEQ ID NO: 24873 - DNA, 15 bp, Homo sapiens
gatcaaagcatatgt

SEQ ID NO: 24874 - DNA, 15 bp, Homo sapiens
tgatcaaagcatatg

SEQ ID NO: 24875 - DNA, 15 bp, Homo sapiens
gtgatcaaagcatat

SEQ ID NO: 24876 - DNA, 15 bp, Homo sapiens
tgtgatcaaagcata

SEQ ID NO: 24877 - DNA, 15 bp, Homo sapiens
ttgtgatcaaagcat

SEQ ID NO: 24878 - DNA, 15 bp, Homo sapiens
attgtgatcaaagca

SEQ ID NO: 24879 - DNA, 15 bp, Homo sapiens
aattgtgatcaaagc

SEQ ID NO: 24880 - DNA, 15 bp, Homo sapiens
aaattgtgatcaaag

SEQ ID NO: 24881 - DNA, 15 bp, Homo sapiens
gaaattgtgatcaaa

SEQ ID NO: 24882 - DNA, 15 bp, Homo sapiens
tgaaattgtgatcaa

SEQ ID NO: 24883 - DNA, 15 bp, Homo sapiens
atgaaattgtgatca

SEQ ID NO: 24884 - DNA, 15 bp, Homo sapiens
catgaaattgtgatc

SEQ ID NO: 24885 - DNA, 15 bp, Homo sapiens
ccatgaaattgtgat

SEQ ID NO: 24886 - DNA, 15 bp, Homo sapiens
cccatgaaattgtga

SEQ ID NO: 24887 - DNA, 15 bp, Homo sapiens
gcccatgaaattgtg

SEQ ID NO: 24888 - DNA, 15 bp, Homo sapiens
ggcccatgaaattgt

SEQ ID NO: 24889 - DNA, 15 bp, Homo sapiens
tggcccatgaaattg

SEQ ID NO: 24890 - DNA, 15 bp, Homo sapiens
ttggcccatgaaatt

SEQ ID NO: 24891 - DNA, 15 bp, Homo sapiens
cttggcccatgaaat

SEQ ID NO: 24892 - DNA, 15 bp, Homo sapiens
acttggcccatgaaa

SEQ ID NO: 24893 - DNA, 15 bp, Homo sapiens
aacttggcccatgaa

SEQ ID NO: 24894 - DNA, 15 bp, Homo sapiens
aaacttggcccatga

SEQ ID NO: 24895 - DNA, 15 bp, Homo sapiens
caaacttggcccatg

SEQ ID NO: 24896 - DNA, 15 bp, Homo sapiens
tcaaacttggcccat

SEQ ID NO: 24897 - DNA, 15 bp, Homo sapiens
ctcaaacttggccca

SEQ ID NO: 24898 - DNA, 15 bp, Homo sapiens
actcaaacttggccc

SEQ ID NO: 24899 - DNA, 15 bp, Homo sapiens
aactcaaacttggcc

SEQ ID NO: 24900 - DNA, 15 bp, Homo sapiens
aaactcaaacttggc

SEQ ID NO: 24901 - DNA, 15 bp, Homo sapiens
caaactcaaacttgg

SEQ ID NO: 24902 - DNA, 15 bp, Homo sapiens
ccaaactcaaacttg

SEQ ID NO: 24903 - DNA, 15 bp, Homo sapiens
tccaaactcaaactt

SEQ ID NO: 24904 - DNA, 15 bp, Homo sapiens
ttccaaactcaaact

SEQ ID NO: 24905 - DNA, 15 bp, Homo sapiens
attccaaactcaaac

SEQ ID NO: 24906 - DNA, 15 bp, Homo sapiens
aattccaaactcaaa

SEQ ID NO: 24907 - DNA, 15 bp, Homo sapiens
aaattccaaactcaa

SEQ ID NO: 24908 - DNA, 15 bp, Homo sapiens
aaaattccaaactca

SEQ ID NO: 24909 - DNA, 15 bp, Homo sapiens
gaaaattccaaactc

SEQ ID NO: 24910 - DNA, 15 bp, Homo sapiens
ggaaaattccaaact

SEQ ID NO: 24911 - DNA, 15 bp, Homo sapiens
tggaaaattccaaac

SEQ ID NO: 24912 - DNA, 15 bp, Homo sapiens
ttggaaaattccaaa

SEQ ID NO: 24913 - DNA, 15 bp, Homo sapiens
cttggaaaattccaa

SEQ ID NO: 24914 - DNA, 15 bp, Homo sapiens
acttggaaaattcca

SEQ ID NO: 24915 - DNA, 15 bp, Homo sapiens
gacttggaaaattcc

SEQ ID NO: 24916 - DNA, 15 bp, Homo sapiens
ggacttggaaaattc

SEQ ID NO: 24917 - DNA, 15 bp, Homo sapiens
aggacttggaaaatt

SEQ ID NO: 24918 - DNA, 15 bp, Homo sapiens
gaggacttggaaaat

SEQ ID NO: 24919 - DNA, 15 bp, Homo sapiens
tgaggacttggaaaa

SEQ ID NO: 24920 - DNA, 15 bp, Homo sapiens
ctgaggacttggaaa

SEQ ID NO: 24921 - DNA, 15 bp, Homo sapiens
tctgaggacttggaa

SEQ ID NO: 24922 - DNA, 15 bp, Homo sapiens
atctgaggacttgga

SEQ ID NO: 24923 - DNA, 15 bp, Homo sapiens
aatctgaggacttgg

SEQ ID NO: 24924 - DNA, 15 bp, Homo sapiens
gaatctgaggacttg

SEQ ID NO: 24925 - DNA, 15 bp, Homo sapiens
agaatctgaggactt

SEQ ID NO: 24926 - DNA, 15 bp, Homo sapiens
tagaatctgaggact

SEQ ID NO: 24927 - DNA, 15 bp, Homo sapiens
atagaatctgaggac

SEQ ID NO: 24928 - DNA, 15 bp, Homo sapiens
catagaatctgagga

SEQ ID NO: 24929 - DNA, 15 bp, Homo sapiens
tcatagaatctgagg

SEQ ID NO: 24930 - DNA, 15 bp, Homo sapiens
gtcatagaatctgag

SEQ ID NO: 24931 - DNA, 15 bp, Homo sapiens
tgtcatagaatctga

SEQ ID NO: 24932 - DNA, 15 bp, Homo sapiens
ctgtcatagaatctg

SEQ ID NO: 24933 - DNA, 15 bp, Homo sapiens
tctgtcatagaatct

SEQ ID NO: 24934 - DNA, 15 bp, Homo sapiens
ttctgtcatagaatc

SEQ ID NO: 24935 - DNA, 15 bp, Homo sapiens
gttctgtcatagaat

SEQ ID NO: 24936 - DNA, 15 bp, Homo sapiens
tgttctgtcatagaa

SEQ ID NO: 24937 - DNA, 15 bp, Homo sapiens
atgttctgtcataga

SEQ ID NO: 24938 - DNA, 15 bp, Homo sapiens
catgttctgtcatag

SEQ ID NO: 24939 - DNA, 15 bp, Homo sapiens
ccatgttctgtcata

SEQ ID NO: 24940 - DNA, 15 bp, Homo sapiens
accatgttctgtcat

SEQ ID NO: 24941 - DNA, 15 bp, Homo sapiens
caccatgttctgtca

SEQ ID NO: 24942 - DNA, 15 bp, Homo sapiens
ccaccatgttctgtc

SEQ ID NO: 24943 - DNA, 15 bp, Homo sapiens
accaccatgttctgt

SEQ ID NO: 24944 - DNA, 15 bp, Homo sapiens
caccaccatgttctg

SEQ ID NO: 24945 - DNA, 15 bp, Homo sapiens
ccaccaccatgttct

SEQ ID NO: 24946 - DNA, 15 bp, Homo sapiens
tccaccaccatgttc

SEQ ID NO: 24947 - DNA, 15 bp, Homo sapiens
ctccaccaccatgtt

SEQ ID NO: 24948 - DNA, 15 bp, Homo sapiens
tctccaccaccatgt

SEQ ID NO: 24949 - DNA, 15 bp, Homo sapiens
ctctccaccaccatg

SEQ ID NO: 24950 - DNA, 15 bp, Homo sapiens
tctctccaccaccat

SEQ ID NO: 24951 - DNA, 15 bp, Homo sapiens
ctctctccaccacca

SEQ ID NO: 24952 - DNA, 15 bp, Homo sapiens
gctctctccaccacc

SEQ ID NO: 24953 - DNA, 15 bp, Homo sapiens
agctctctccaccac

SEQ ID NO: 24954 - DNA, 15 bp, Homo sapiens
cagctctctccacca

SEQ ID NO: 24955 - DNA, 15 bp, Homo sapiens
gcagctctctccacc

SEQ ID NO: 24956 - DNA, 15 bp, Homo sapiens
ggcagctctctccac

SEQ ID NO: 24957 - DNA, 15 bp, Homo sapiens
gggcagctctctcca

SEQ ID NO: 24958 - DNA, 15 bp, Homo sapiens
ggggcagctctctcc

SEQ ID NO: 24959 - DNA, 15 bp, Homo sapiens
gggggcagctctctc

SEQ ID NO: 24960 - DNA, 15 bp, Homo sapiens
agggggcagctctct

SEQ ID NO: 24961 - DNA, 15 bp, Homo sapiens
cagggggcagctctc

SEQ ID NO: 24962 - DNA, 15 bp, Homo sapiens
ccagggggcagctct

SEQ ID NO: 24963 - DNA, 15 bp, Homo sapiens
gccagggggcagctc

SEQ ID NO: 24964 - DNA, 15 bp, Homo sapiens
agccagggggcagct

SEQ ID NO: 24965 - DNA, 15 bp, Homo sapiens
gagccagggggcagc

SEQ ID NO: 24966 - DNA, 15 bp, Homo sapiens
ggagccagggggcag

SEQ ID NO: 24967 - DNA, 15 bp, Homo sapiens
tggagccagggggca

SEQ ID NO: 24968 - DNA, 15 bp, Homo sapiens
ctggagccagggggc

SEQ ID NO: 24969 - DNA, 15 bp, Homo sapiens
actggagccaggggg

SEQ ID NO: 24970 - DNA, 15 bp, Homo sapiens
aactggagccagggg

SEQ ID NO: 24971 - DNA, 15 bp, Homo sapiens
aaactggagccaggg

SEQ ID NO: 24972 - DNA, 15 bp, Homo sapiens
caaactggagccagg

SEQ ID NO: 24973 - DNA, 15 bp, Homo sapiens
gcaaactggagccag

SEQ ID NO: 24974 - DNA, 15 bp, Homo sapiens
tgcaaactggagcca

SEQ ID NO: 24975 - DNA, 15 bp, Homo sapiens
ctgcaaactggagcc

SEQ ID NO: 24976 - DNA, 15 bp, Homo sapiens
tctgcaaactggagc

SEQ ID NO: 24977 - DNA, 15 bp, Homo sapiens
gtctgcaaactggag

SEQ ID NO: 24978 - DNA, 15 bp, Homo sapiens
agtctgcaaactgga

SEQ ID NO: 24979 - DNA, 15 bp, Homo sapiens
aagtctgcaaactgg

SEQ ID NO: 24980 - DNA, 15 bp, Homo sapiens
aaagtctgcaaactg

SEQ ID NO: 24981 - DNA, 15 bp, Homo sapiens
gaaagtctgcaaact

SEQ ID NO: 24982 - DNA, 15 bp, Homo sapiens
ggaaagtctgcaaac

SEQ ID NO: 24983 - DNA, 15 bp, Homo sapiens
gggaaagtctgcaaa

SEQ ID NO: 24984 - DNA, 15 bp, Homo sapiens
ggggaaagtctgcaa

SEQ ID NO: 24985 - DNA, 15 bp, Homo sapiens
aggggaaagtctgca

SEQ ID NO: 24986 - DNA, 15 bp, Homo sapiens
aaggggaaagtctgc

SEQ ID NO: 24987 - DNA, 15 bp, Homo sapiens
aaaggggaaagtctg

SEQ ID NO: 24988 - DNA, 15 bp, Homo sapiens
caaaggggaaagtct

SEQ ID NO: 24989 - DNA, 15 bp, Homo sapiens
acaaaggggaaagtc

SEQ ID NO: 24990 - DNA, 15 bp, Homo sapiens
gacaaaggggaaagt

SEQ ID NO: 24991 - DNA, 15 bp, Homo sapiens
agacaaaggggaaag

SEQ ID NO: 24992 - DNA, 15 bp, Homo sapiens
cagacaaaggggaaa

SEQ ID NO: 24993 - DNA, 15 bp, Homo sapiens
gcagacaaaggggaa

SEQ ID NO: 24994 - DNA, 15 bp, Homo sapiens
ggcagacaaagggga

SEQ ID NO: 24995 - DNA, 15 bp, Homo sapiens
gggcagacaaagggg

SEQ ID NO: 24996 - DNA, 15 bp, Homo sapiens
tgggcagacaaaggg

SEQ ID NO: 24997 - DNA, 15 bp, Homo sapiens
atgggcagacaaagg

SEQ ID NO: 24998 - DNA, 15 bp, Homo sapiens
catgggcagacaaag

SEQ ID NO: 24999 - DNA, 15 bp, Homo sapiens
gcatgggcagacaaa

SEQ ID NO: 25000 - DNA, 15 bp, Homo sapiens
agcatgggcagacaa

SEQ ID NO: 25001 - DNA, 15 bp, Homo sapiens
cagcatgggcagaca

SEQ ID NO: 25002 - DNA, 15 bp, Homo sapiens
ccagcatgggcagac

SEQ ID NO: 25003 - DNA, 15 bp, Homo sapiens
gccagcatgggcaga

SEQ ID NO: 25004 - DNA, 15 bp, Homo sapiens
agccagcatgggcag

SEQ ID NO: 25005 - DNA, 15 bp, Homo sapiens
gagccagcatgggca

SEQ ID NO: 25006 - DNA, 15 bp, Homo sapiens
ggagccagcatgggc

SEQ ID NO: 25007 - DNA, 15 bp, Homo sapiens
tggagccagcatggg

SEQ ID NO: 25008 - DNA, 15 bp, Homo sapiens
atggagccagcatgg

SEQ ID NO: 25009 - DNA, 15 bp, Homo sapiens
aatggagccagcatg

SEQ ID NO: 25010 - DNA, 15 bp, Homo sapiens
aaatggagccagcat

SEQ ID NO: 25011 - DNA, 15 bp, Homo sapiens
caaatggagccagca

SEQ ID NO: 25012 - DNA, 15 bp, Homo sapiens
ccaaatggagccagc

SEQ ID NO: 25013 - DNA, 15 bp, Homo sapiens
gccaaatggagccag

SEQ ID NO: 25014 - DNA, 15 bp, Homo sapiens
tgccaaatggagcca

SEQ ID NO: 25015 - DNA, 15 bp, Homo sapiens
gtgccaaatggagcc

SEQ ID NO: 25016 - DNA, 15 bp, Homo sapiens
agtgccaaatggagc

SEQ ID NO: 25017 - DNA, 15 bp, Homo sapiens
cagtgccaaatggag

SEQ ID NO: 25018 - DNA, 15 bp, Homo sapiens
ccagtgccaaatgga

SEQ ID NO: 25019 - DNA, 15 bp, Homo sapiens
cccagtgccaaatgg

SEQ ID NO: 25020 - DNA, 15 bp, Homo sapiens
tcccagtgccaaatg

SEQ ID NO: 25021 - DNA, 15 bp, Homo sapiens
ttcccagtgccaaat

SEQ ID NO: 25022 - DNA, 15 bp, Homo sapiens
cttcccagtgccaaa

SEQ ID NO: 25023 - DNA, 15 bp, Homo sapiens
ccttcccagtgccaa

SEQ ID NO: 25024 - DNA, 15 bp, Homo sapiens
cccttcccagtgcca

SEQ ID NO: 25025 - DNA, 15 bp, Homo sapiens
gcccttcccagtgcc

SEQ ID NO: 25026 - DNA, 15 bp, Homo sapiens
agcccttcccagtgc

SEQ ID NO: 25027 - DNA, 15 bp, Homo sapiens
aagcccttcccagtg

SEQ ID NO: 25028 - DNA, 15 bp, Homo sapiens
aaagcccttcccagt

SEQ ID NO: 25029 - DNA, 15 bp, Homo sapiens
caaagcccttcccag

SEQ ID NO: 25030 - DNA, 15 bp, Homo sapiens
gcaaagcccttccca

SEQ ID NO: 25031 - DNA, 15 bp, Homo sapiens
tgcaaagcccttccc

SEQ ID NO: 25032 - DNA, 15 bp, Homo sapiens
gtgcaaagcccttcc

SEQ ID NO: 25033 - DNA, 15 bp, Homo sapiens
ggtgcaaagcccttc

SEQ ID NO: 25034 - DNA, 15 bp, Homo sapiens
gggtgcaaagccctt

SEQ ID NO: 25035 - DNA, 15 bp, Homo sapiens
tgggtgcaaagccct

SEQ ID NO: 25036 - DNA, 15 bp, Homo sapiens
ttgggtgcaaagccc

SEQ ID NO: 25037 - DNA, 15 bp, Homo sapiens
cttgggtgcaaagcc

SEQ ID NO: 25038 - DNA, 15 bp, Homo sapiens
acttgggtgcaaagc

SEQ ID NO: 25039 - DNA, 15 bp, Homo sapiens
aacttgggtgcaaag

SEQ ID NO: 25040 - DNA, 15 bp, Homo sapiens
aaacttgggtgcaaa

SEQ ID NO: 25041 - DNA, 15 bp, Homo sapiens
caaacttgggtgcaa

SEQ ID NO: 25042 - DNA, 15 bp, Homo sapiens
acaaacttgggtgca

SEQ ID NO: 25043 - DNA, 15 bp, Homo sapiens
cacaaacttgggtgc

SEQ ID NO: 25044 - DNA, 15 bp, Homo sapiens
ccacaaacttgggtg

SEQ ID NO: 25045 - DNA, 15 bp, Homo sapiens
accacaaacttgggt

SEQ ID NO: 25046 - DNA, 15 bp, Homo sapiens
gaccacaaacttggg

SEQ ID NO: 25047 - DNA, 15 bp, Homo sapiens
tgaccacaaacttgg

SEQ ID NO: 25048 - DNA, 15 bp, Homo sapiens
ctgaccacaaacttg

SEQ ID NO: 25049 - DNA, 15 bp, Homo sapiens
actgaccacaaactt

SEQ ID NO: 25050 - DNA, 15 bp, Homo sapiens
aactgaccacaaact

SEQ ID NO: 25051 - DNA, 15 bp, Homo sapiens
caactgaccacaaac

SEQ ID NO: 25052 - DNA, 15 bp, Homo sapiens
ccaactgaccacaaa

SEQ ID NO: 25053 - DNA, 15 bp, Homo sapiens
gccaactgaccacaa

SEQ ID NO: 25054 - DNA, 15 bp, Homo sapiens
ggccaactgaccaca

SEQ ID NO: 25055 - DNA, 15 bp, Homo sapiens
tggccaactgaccac

SEQ ID NO: 25056 - DNA, 15 bp, Homo sapiens
ttggccaactgacca

SEQ ID NO: 25057 - DNA, 15 bp, Homo sapiens
cttggccaactgacc

SEQ ID NO: 25058 - DNA, 15 bp, Homo sapiens
gcttggccaactgac

SEQ ID NO: 25059 - DNA, 15 bp, Homo sapiens
tgcttggccaactga

SEQ ID NO: 25060 - DNA, 15 bp, Homo sapiens
gtgcttggccaactg

SEQ ID NO: 25061 - DNA, 15 bp, Homo sapiens
ggtgcttggccaact

SEQ ID NO: 25062 - DNA, 15 bp, Homo sapiens
gggtgcttggccaac

SEQ ID NO: 25063 - DNA, 15 bp, Homo sapiens
tgggtgcttggccaa

SEQ ID NO: 25064 - DNA, 15 bp, Homo sapiens
atgggtgcttggcca

SEQ ID NO: 25065 - DNA, 15 bp, Homo sapiens
catgggtgcttggcc

SEQ ID NO: 25066 - DNA, 15 bp, Homo sapiens
ccatgggtgcttggc

SEQ ID NO: 25067 - DNA, 15 bp, Homo sapiens
accatgggtgcttgg

SEQ ID NO: 25068 - DNA, 15 bp, Homo sapiens
gaccatgggtgcttg

SEQ ID NO: 25069 - DNA, 15 bp, Homo sapiens
agaccatgggtgctt

SEQ ID NO: 25070 - DNA, 15 bp, Homo sapiens
gagaccatgggtgct

SEQ ID NO: 25071 - DNA, 15 bp, Homo sapiens
ggagaccatgggtgc

SEQ ID NO: 25072 - DNA, 15 bp, Homo sapiens
gggagaccatgggtg

SEQ ID NO: 25073 - DNA, 15 bp, Homo sapiens
tgggagaccatgggt

SEQ ID NO: 25074 - DNA, 15 bp, Homo sapiens
gtgggagaccatggg

SEQ ID NO: 25075 - DNA, 15 bp, Homo sapiens
agtgggagaccatgg

SEQ ID NO: 25076 - DNA, 15 bp, Homo sapiens
gagtgggagaccatg

SEQ ID NO: 25077 - DNA, 15 bp, Homo sapiens
agagtgggagaccat

SEQ ID NO: 25078 - DNA, 15 bp, Homo sapiens
aagagtgggagacca

SEQ ID NO: 25079 - DNA, 15 bp, Homo sapiens
gaagagtgggagacc

SEQ ID NO: 25080 - DNA, 15 bp, Homo sapiens
ggaagagtgggagac

SEQ ID NO: 25081 - DNA, 15 bp, Homo sapiens
gggaagagtgggaga

SEQ ID NO: 25082 - DNA, 15 bp, Homo sapiens
ggggaagagtgggag

SEQ ID NO: 25083 - DNA, 15 bp, Homo sapiens
tggggaagagtggga

SEQ ID NO: 25084 - DNA, 15 bp, Homo sapiens
gtggggaagagtggg

SEQ ID NO: 25085 - DNA, 15 bp, Homo sapiens
agtggggaagagtgg

SEQ ID NO: 25086 - DNA, 15 bp, Homo sapiens
aagtggggaagagtg

SEQ ID NO: 25087 - DNA, 15 bp, Homo sapiens
caagtggggaagagt

SEQ ID NO: 25088 - DNA, 15 bp, Homo sapiens
gcaagtggggaagag

SEQ ID NO: 25089 - DNA, 15 bp, Homo sapiens
tgcaagtggggaaga

SEQ ID NO: 25090 - DNA, 15 bp, Homo sapiens
ttgcaagtggggaag

SEQ ID NO: 25091 - DNA, 15 bp, Homo sapiens
tttgcaagtggggaa

SEQ ID NO: 25092 - DNA, 15 bp, Homo sapiens
gtttgcaagtgggga

SEQ ID NO: 25093 - DNA, 15 bp, Homo sapiens
tgtttgcaagtgggg

SEQ ID NO: 25094 - DNA, 15 bp, Homo sapiens
ctgtttgcaagtggg

SEQ ID NO: 25095 - DNA, 15 bp, Homo sapiens
actgtttgcaagtgg

SEQ ID NO: 25096 - DNA, 15 bp, Homo sapiens
tactgtttgcaagtg

SEQ ID NO: 25097 - DNA, 15 bp, Homo sapiens
ctactgtttgcaagt

SEQ ID NO: 25098 - DNA, 15 bp, Homo sapiens
actactgtttgcaag

SEQ ID NO: 25099 - DNA, 15 bp, Homo sapiens
cactactgtttgcaa

SEQ ID NO: 25100 - DNA, 15 bp, Homo sapiens
acactactgtttgca

SEQ ID NO: 25101 - DNA, 15 bp, Homo sapiens
cacactactgtttgc

SEQ ID NO: 25102 - DNA, 15 bp, Homo sapiens
ccacactactgtttg

SEQ ID NO: 25103 - DNA, 15 bp, Homo sapiens
accacactactgttt

SEQ ID NO: 25104 - DNA, 15 bp, Homo sapiens
gaccacactactgtt

SEQ ID NO: 25105 - DNA, 15 bp, Homo sapiens
ggaccacactactgt

SEQ ID NO: 25106 - DNA, 15 bp, Homo sapiens
tggaccacactactg

SEQ ID NO: 25107 - DNA, 15 bp, Homo sapiens
gtggaccacactact

SEQ ID NO: 25108 - DNA, 15 bp, Homo sapiens
ggtggaccacactac

SEQ ID NO: 25109 - DNA, 15 bp, Homo sapiens
gggtggaccacacta

SEQ ID NO: 25110 - DNA, 15 bp, Homo sapiens
agggtggaccacact

SEQ ID NO: 25111 - DNA, 15 bp, Homo sapiens
aagggtggaccacac

SEQ ID NO: 25112 - DNA, 15 bp, Homo sapiens
caagggtggaccaca

SEQ ID NO: 25113 - DNA, 15 bp, Homo sapiens
gcaagggtggaccac

SEQ ID NO: 25114 - DNA, 15 bp, Homo sapiens
agcaagggtggacca

SEQ ID NO: 25115 - DNA, 15 bp, Homo sapiens
aagcaagggtggacc

SEQ ID NO: 25116 - DNA, 15 bp, Homo sapiens
caagcaagggtggac

SEQ ID NO: 25117 - DNA, 15 bp, Homo sapiens
ccaagcaagggtgga

SEQ ID NO: 25118 - DNA, 15 bp, Homo sapiens
cccaagcaagggtgg

SEQ ID NO: 25119 - DNA, 15 bp, Homo sapiens
tcccaagcaagggtg

SEQ ID NO: 25120 - DNA, 15 bp, Homo sapiens
ttcccaagcaagggt

SEQ ID NO: 25121 - DNA, 15 bp, Homo sapiens
tttcccaagcaaggg

SEQ ID NO: 25122 - DNA, 15 bp, Homo sapiens
ctttcccaagcaagg

SEQ ID NO: 25123 - DNA, 15 bp, Homo sapiens
tctttcccaagcaag

SEQ ID NO: 25124 - DNA, 15 bp, Homo sapiens
ctctttcccaagcaa

SEQ ID NO: 25125 - DNA, 15 bp, Homo sapiens
gctctttcccaagca

SEQ ID NO: 25126 - DNA, 15 bp, Homo sapiens
ggctctttcccaagc

SEQ ID NO: 25127 - DNA, 15 bp, Homo sapiens
gggctctttcccaag

SEQ ID NO: 25128 - DNA, 15 bp, Homo sapiens
tgggctctttcccaa

SEQ ID NO: 25129 - DNA, 15 bp, Homo sapiens
ctgggctctttccca

SEQ ID NO: 25130 - DNA, 15 bp, Homo sapiens
actgggctctttccc

SEQ ID NO: 25131 - DNA, 15 bp, Homo sapiens
cactgggctctttcc

SEQ ID NO: 25132 - DNA, 15 bp, Homo sapiens
gcactgggctctttc

SEQ ID NO: 25133 - DNA, 15 bp, Homo sapiens
agcactgggctcttt

SEQ ID NO: 25134 - DNA, 15 bp, Homo sapiens
gagcactgggctctt

SEQ ID NO: 25135 - DNA, 15 bp, Homo sapiens
tgagcactgggctct

SEQ ID NO: 25136 - DNA, 15 bp, Homo sapiens
atgagcactgggctc

SEQ ID NO: 25137 - DNA, 15 bp, Homo sapiens
aatgagcactgggct

SEQ ID NO: 25138 - DNA, 15 bp, Homo sapiens
aaatgagcactgggc

SEQ ID NO: 25139 - DNA, 15 bp, Homo sapiens
caaatgagcactggg

SEQ ID NO: 25140 - DNA, 15 bp, Homo sapiens
tcaaatgagcactgg

SEQ ID NO: 25141 - DNA, 15 bp, Homo sapiens
ctcaaatgagcactg

SEQ ID NO: 25142 - DNA, 15 bp, Homo sapiens
gctcaaatgagcact

SEQ ID NO: 25143 - DNA, 15 bp, Homo sapiens
tgctcaaatgagcac

SEQ ID NO: 25144 - DNA, 15 bp, Homo sapiens
ctgctcaaatgagca

SEQ ID NO: 25145 - DNA, 15 bp, Homo sapiens
actgctcaaatgagc

SEQ ID NO: 25146 - DNA, 15 bp, Homo sapiens
cactgctcaaatgag

SEQ ID NO: 25147 - DNA, 15 bp, Homo sapiens
tcactgctcaaatga

SEQ ID NO: 25148 - DNA, 15 bp, Homo sapiens
ctcactgctcaaatg

SEQ ID NO: 25149 - DNA, 15 bp, Homo sapiens
actcactgctcaaat

SEQ ID NO: 25150 - DNA, 15 bp, Homo sapiens
tactcactgctcaaa

SEQ ID NO: 25151 - DNA, 15 bp, Homo sapiens
gtactcactgctcaa

SEQ ID NO: 25152 - DNA, 15 bp, Homo sapiens
agtactcactgctca

SEQ ID NO: 25153 - DNA, 15 bp, Homo sapiens
tagtactcactgctc

SEQ ID NO: 25154 - DNA, 15 bp, Homo sapiens
ctagtactcactgct

SEQ ID NO: 25155 - DNA, 15 bp, Homo sapiens
cctagtactcactgc

SEQ ID NO: 25156 - DNA, 15 bp, Homo sapiens
tcctagtactcactg

SEQ ID NO: 25157 - DNA, 15 bp, Homo sapiens
gtcctagtactcact

SEQ ID NO: 25158 - DNA, 15 bp, Homo sapiens
ggtcctagtactcac

SEQ ID NO: 25159 - DNA, 15 bp, Homo sapiens
gggtcctagtactca

SEQ ID NO: 25160 - DNA, 15 bp, Homo sapiens
agggtcctagtactc

SEQ ID NO: 25161 - DNA, 15 bp, Homo sapiens
cagggtcctagtact

SEQ ID NO: 25162 - DNA, 15 bp, Homo sapiens
acagggtcctagtac

SEQ ID NO: 25163 - DNA, 15 bp, Homo sapiens
cacagggtcctagta

SEQ ID NO: 25164 - DNA, 15 bp, Homo sapiens
gcacagggtcctagt

SEQ ID NO: 25165 - DNA, 15 bp, Homo sapiens
ggcacagggtcctag

SEQ ID NO: 25166 - DNA, 15 bp, Homo sapiens
aggcacagggtccta

SEQ ID NO: 25167 - DNA, 15 bp, Homo sapiens
gaggcacagggtcct

SEQ ID NO: 25168 - DNA, 15 bp, Homo sapiens
agaggcacagggtcc

SEQ ID NO: 25169 - DNA, 15 bp, Homo sapiens
tagaggcacagggtc

SEQ ID NO: 25170 - DNA, 15 bp, Homo sapiens
ctagaggcacagggt

SEQ ID NO: 25171 - DNA, 15 bp, Homo sapiens
tctagaggcacaggg

SEQ ID NO: 25172 - DNA, 15 bp, Homo sapiens
gtctagaggcacagg

SEQ ID NO: 25173 - DNA, 15 bp, Homo sapiens
ggtctagaggcacag

SEQ ID NO: 25174 - DNA, 15 bp, Homo sapiens
cggtctagaggcaca

SEQ ID NO: 25175 - DNA, 15 bp, Homo sapiens
acggtctagaggcac

SEQ ID NO: 25176 - DNA, 15 bp, Homo sapiens
cacggtctagaggca

SEQ ID NO: 25177 - DNA, 15 bp, Homo sapiens
gcacggtctagaggc

SEQ ID NO: 25178 - DNA, 15 bp, Homo sapiens
agcacggtctagagg

SEQ ID NO: 25179 - DNA, 15 bp, Homo sapiens
aagcacggtctagag

SEQ ID NO: 25180 - DNA, 15 bp, Homo sapiens
aaagcacggtctaga

SEQ ID NO: 25181 - DNA, 15 bp, Homo sapiens
taaagcacggtctag

SEQ ID NO: 25182 - DNA, 15 bp, Homo sapiens
ctaaagcacggtcta

SEQ ID NO: 25183 - DNA, 15 bp, Homo sapiens
cctaaagcacggtct

SEQ ID NO: 25184 - DNA, 15 bp, Homo sapiens
tcctaaagcacggtc

SEQ ID NO: 25185 - DNA, 15 bp, Homo sapiens
gtcctaaagcacggt

SEQ ID NO: 25186 - DNA, 15 bp, Homo sapiens
agtcctaaagcacgg

SEQ ID NO: 25187 - DNA, 15 bp, Homo sapiens
aagtcctaaagcacg

SEQ ID NO: 25188 - DNA, 15 bp, Homo sapiens
caagtcctaaagcac

SEQ ID NO: 25189 - DNA, 15 bp, Homo sapiens
gcaagtcctaaagca

SEQ ID NO: 25190 - DNA, 15 bp, Homo sapiens
tgcaagtcctaaagc

SEQ ID NO: 25191 - DNA, 15 bp, Homo sapiens
atgcaagtcctaaag

SEQ ID NO: 25192 - DNA, 15 bp, Homo sapiens
tatgcaagtcctaaa

SEQ ID NO: 25193 - DNA, 15 bp, Homo sapiens
atatgcaagtcctaa

SEQ ID NO: 25194 - DNA, 15 bp, Homo sapiens
gatatgcaagtccta

SEQ ID NO: 25195 - DNA, 15 bp, Homo sapiens
ggatatgcaagtcct

SEQ ID NO: 25196 - DNA, 15 bp, Homo sapiens
gggatatgcaagtcc

SEQ ID NO: 25197 - DNA, 15 bp, Homo sapiens
ggggatatgcaagtc

SEQ ID NO: 25198 - DNA, 15 bp, Homo sapiens
aggggatatgcaagt

SEQ ID NO: 25199 - DNA, 15 bp, Homo sapiens
aaggggatatgcaag

SEQ ID NO: 25200 - DNA, 15 bp, Homo sapiens
caaggggatatgcaa

SEQ ID NO: 25201 - DNA, 15 bp, Homo sapiens
ccaaggggatatgca

SEQ ID NO: 25202 - DNA, 15 bp, Homo sapiens
accaaggggatatgc

SEQ ID NO: 25203 - DNA, 15 bp, Homo sapiens
gaccaaggggatatg

SEQ ID NO: 25204 - DNA, 15 bp, Homo sapiens
ggaccaaggggatat

SEQ ID NO: 25205 - DNA, 15 bp, Homo sapiens
aggaccaaggggata

SEQ ID NO: 25206 - DNA, 15 bp, Homo sapiens
gaggaccaaggggat

SEQ ID NO: 25207 - DNA, 15 bp, Homo sapiens
agaggaccaagggga

SEQ ID NO: 25208 - DNA, 15 bp, Homo sapiens
cagaggaccaagggg

SEQ ID NO: 25209 - DNA, 15 bp, Homo sapiens
tcagaggaccaaggg

SEQ ID NO: 25210 - DNA, 15 bp, Homo sapiens
atcagaggaccaagg

SEQ ID NO: 25211 - DNA, 15 bp, Homo sapiens
aatcagaggaccaag

SEQ ID NO: 25212 - DNA, 15 bp, Homo sapiens
aaatcagaggaccaa

SEQ ID NO: 25213 - DNA, 15 bp, Homo sapiens
gaaatcagaggacca

SEQ ID NO: 25214 - DNA, 15 bp, Homo sapiens
agaaatcagaggacc

SEQ ID NO: 25215 - DNA, 15 bp, Homo sapiens
gagaaatcagaggac

SEQ ID NO: 25216 - DNA, 15 bp, Homo sapiens
agagaaatcagagga

SEQ ID NO: 25217 - DNA, 15 bp, Homo sapiens
tagagaaatcagagg

SEQ ID NO: 25218 - DNA, 15 bp, Homo sapiens
atagagaaatcagag

SEQ ID NO: 25219 - DNA, 15 bp, Homo sapiens
aatagagaaatcaga

SEQ ID NO: 25220 - DNA, 15 bp, Homo sapiens
aaatagagaaatcag

SEQ ID NO: 25221 - DNA, 15 bp, Homo sapiens
gaaatagagaaatca

SEQ ID NO: 25222 - DNA, 15 bp, Homo sapiens
agaaatagagaaatc

SEQ ID NO: 25223 - DNA, 15 bp, Homo sapiens
cagaaatagagaaat

SEQ ID NO: 25224 - DNA, 15 bp, Homo sapiens
ccagaaatagagaaa

SEQ ID NO: 25225 - DNA, 15 bp, Homo sapiens
cccagaaatagagaa

SEQ ID NO: 25226 - DNA, 15 bp, Homo sapiens
ccccagaaatagaga

SEQ ID NO: 25227 - DNA, 15 bp, Homo sapiens
cccccagaaatagag

SEQ ID NO: 25228 - DNA, 15 bp, Homo sapiens
tcccccagaaataga

SEQ ID NO: 25229 - DNA, 15 bp, Homo sapiens
ctcccccagaaatag

SEQ ID NO: 25230 - DNA, 15 bp, Homo sapiens
tctcccccagaaata

SEQ ID NO: 25231 - DNA, 15 bp, Homo sapiens
ctctcccccagaaat

SEQ ID NO: 25232 - DNA, 15 bp, Homo sapiens
tctctcccccagaaa

SEQ ID NO: 25233 - DNA, 15 bp, Homo sapiens
atctctcccccagaa

SEQ ID NO: 25234 - DNA, 15 bp, Homo sapiens
catctctcccccaga

SEQ ID NO: 25235 - DNA, 15 bp, Homo sapiens
ccatctctcccccag

SEQ ID NO: 25236 - DNA, 15 bp, Homo sapiens
cccatctctccccca

SEQ ID NO: 25237 - DNA, 15 bp, Homo sapiens
ccccatctctccccc

SEQ ID NO: 25238 - DNA, 15 bp, Homo sapiens
tccccatctctcccc

SEQ ID NO: 25239 - DNA, 15 bp, Homo sapiens
atccccatctctccc

SEQ ID NO: 25240 - DNA, 15 bp, Homo sapiens
catccccatctctcc

SEQ ID NO: 25241 - DNA, 15 bp, Homo sapiens
ccatccccatctctc

SEQ ID NO: 25242 - DNA, 15 bp, Homo sapiens
tccatccccatctct

SEQ ID NO: 25243 - DNA, 15 bp, Homo sapiens
ttccatccccatctc

SEQ ID NO: 25244 - DNA, 15 bp, Homo sapiens
cttccatccccatct

SEQ ID NO: 25245 - DNA, 15 bp, Homo sapiens
tcttccatccccatc

SEQ ID NO: 25246 - DNA, 15 bp, Homo sapiens
ctcttccatccccat

SEQ ID NO: 25247 - DNA, 15 bp, Homo sapiens
cctcttccatcccca

SEQ ID NO: 25248 - DNA, 15 bp, Homo sapiens
ccctcttccatcccc

SEQ ID NO: 25249 - DNA, 15 bp, Homo sapiens
accctcttccatccc

SEQ ID NO: 25250 - DNA, 15 bp, Homo sapiens
taccctcttccatcc

SEQ ID NO: 25251 - DNA, 15 bp, Homo sapiens
ctaccctcttccatc

SEQ ID NO: 25252 - DNA, 15 bp, Homo sapiens
tctaccctcttccat

SEQ ID NO: 25253 - DNA, 15 bp, Homo sapiens
ctctaccctcttcca

SEQ ID NO: 25254 - DNA, 15 bp, Homo sapiens
actctaccctcttcc

SEQ ID NO: 25255 - DNA, 15 bp, Homo sapiens
cactctaccctcttc

SEQ ID NO: 25256 - DNA, 15 bp, Homo sapiens
tcactctaccctctt

SEQ ID NO: 25257 - DNA, 15 bp, Homo sapiens
ctcactctaccctct

SEQ ID NO: 25258 - DNA, 15 bp, Homo sapiens
cctcactctaccctc

SEQ ID NO: 25259 - DNA, 15 bp, Homo sapiens
gcctcactctaccct

SEQ ID NO: 25260 - DNA, 15 bp, Homo sapiens
ggcctcactctaccc

SEQ ID NO: 25261 - DNA, 15 bp, Homo sapiens
gggcctcactctacc

SEQ ID NO: 25262 - DNA, 15 bp, Homo sapiens
agggcctcactctac

SEQ ID NO: 25263 - DNA, 15 bp, Homo sapiens
gagggcctcactcta

SEQ ID NO: 25264 - DNA, 15 bp, Homo sapiens
agagggcctcactct

SEQ ID NO: 25265 - DNA, 15 bp, Homo sapiens
tagagggcctcactc

SEQ ID NO: 25266 - DNA, 15 bp, Homo sapiens
ttagagggcctcact

SEQ ID NO: 25267 - DNA, 15 bp, Homo sapiens
tttagagggcctcac

SEQ ID NO: 25268 - DNA, 15 bp, Homo sapiens
ttttagagggcctca

SEQ ID NO: 25269 - DNA, 15 bp, Homo sapiens
cttttagagggcctc

SEQ ID NO: 25270 - DNA, 15 bp, Homo sapiens
acttttagagggcct

SEQ ID NO: 25271 - DNA, 15 bp, Homo sapiens
gacttttagagggcc

SEQ ID NO: 25272 - DNA, 15 bp, Homo sapiens
tgacttttagagggc

SEQ ID NO: 25273 - DNA, 15 bp, Homo sapiens
ctgacttttagaggg

SEQ ID NO: 25274 - DNA, 15 bp, Homo sapiens
cctgacttttagagg

SEQ ID NO: 25275 - DNA, 15 bp, Homo sapiens
tcctgacttttagag

SEQ ID NO: 25276 - DNA, 15 bp, Homo sapiens
atcctgacttttaga

SEQ ID NO: 25277 - DNA, 15 bp, Homo sapiens
aatcctgacttttag

SEQ ID NO: 25278 - DNA, 15 bp, Homo sapiens
aaatcctgactttta

SEQ ID NO: 25279 - DNA, 15 bp, Homo sapiens
taaatcctgactttt

SEQ ID NO: 25280 - DNA, 15 bp, Homo sapiens
ttaaatcctgacttt

SEQ ID NO: 25281 - DNA, 15 bp, Homo sapiens
cttaaatcctgactt

SEQ ID NO: 25282 - DNA, 15 bp, Homo sapiens
ccttaaatcctgact

SEQ ID NO: 25283 - DNA, 15 bp, Homo sapiens
gccttaaatcctgac

SEQ ID NO: 25284 - DNA, 15 bp, Homo sapiens
tgccttaaatcctga

SEQ ID NO: 25285 - DNA, 15 bp, Homo sapiens
ttgccttaaatcctg

SEQ ID NO: 25286 - DNA, 15 bp, Homo sapiens
cttgccttaaatcct

SEQ ID NO: 25287 - DNA, 15 bp, Homo sapiens
ccttgccttaaatcc

SEQ ID NO: 25288 - DNA, 15 bp, Homo sapiens
accttgccttaaatc

SEQ ID NO: 25289 - DNA, 15 bp, Homo sapiens
gaccttgccttaaat

SEQ ID NO: 25290 - DNA, 15 bp, Homo sapiens
ggaccttgccttaaa

SEQ ID NO: 25291 - DNA, 15 bp, Homo sapiens
aggaccttgccttaa

SEQ ID NO: 25292 - DNA, 15 bp, Homo sapiens
aaggaccttgcctta

SEQ ID NO: 25293 - DNA, 15 bp, Homo sapiens
caaggaccttgcctt

SEQ ID NO: 25294 - DNA, 15 bp, Homo sapiens
gcaaggaccttgcct

SEQ ID NO: 25295 - DNA, 15 bp, Homo sapiens
agcaaggaccttgcc

SEQ ID NO: 25296 - DNA, 15 bp, Homo sapiens
aagcaaggaccttgc

SEQ ID NO: 25297 - DNA, 15 bp, Homo sapiens
caagcaaggaccttg

SEQ ID NO: 25298 - DNA, 15 bp, Homo sapiens
acaagcaaggacctt

SEQ ID NO: 25299 - DNA, 15 bp, Homo sapiens
gacaagcaaggacct

SEQ ID NO: 25300 - DNA, 15 bp, Homo sapiens
agacaagcaaggacc

SEQ ID NO: 25301 - DNA, 15 bp, Homo sapiens
tagacaagcaaggac

SEQ ID NO: 25302 - DNA, 15 bp, Homo sapiens
ctagacaagcaagga

SEQ ID NO: 25303 - DNA, 15 bp, Homo sapiens
cctagacaagcaagg

SEQ ID NO: 25304 - DNA, 15 bp, Homo sapiens
acctagacaagcaag

SEQ ID NO: 25305 - DNA, 15 bp, Homo sapiens
gacctagacaagcaa

SEQ ID NO: 25306 - DNA, 15 bp, Homo sapiens
agacctagacaagca

SEQ ID NO: 25307 - DNA, 15 bp, Homo sapiens
tagacctagacaagc

SEQ ID NO: 25308 - DNA, 15 bp, Homo sapiens
gtagacctagacaag

SEQ ID NO: 25309 - DNA, 15 bp, Homo sapiens
tgtagacctagacaa

SEQ ID NO: 25310 - DNA, 15 bp, Homo sapiens
ctgtagacctagaca

SEQ ID NO: 25311 - DNA, 15 bp, Homo sapiens
cctgtagacctagac

SEQ ID NO: 25312 - DNA, 15 bp, Homo sapiens
acctgtagacctaga

SEQ ID NO: 25313 - DNA, 15 bp, Homo sapiens
cacctgtagacctag

SEQ ID NO: 25314 - DNA, 15 bp, Homo sapiens
tcacctgtagaccta

SEQ ID NO: 25315 - DNA, 15 bp, Homo sapiens
atcacctgtagacct

SEQ ID NO: 25316 - DNA, 15 bp, Homo sapiens
catcacctgtagacc

SEQ ID NO: 25317 - DNA, 15 bp, Homo sapiens
gcatcacctgtagac

SEQ ID NO: 25318 - DNA, 15 bp, Homo sapiens
agcatcacctgtaga

SEQ ID NO: 25319 - DNA, 15 bp, Homo sapiens
tagcatcacctgtag

SEQ ID NO: 25320 - DNA, 15 bp, Homo sapiens
gtagcatcacctgta

SEQ ID NO: 25321 - DNA, 15 bp, Homo sapiens
tgtagcatcacctgt

SEQ ID NO: 25322 - DNA, 15 bp, Homo sapiens
ttgtagcatcacctg

SEQ ID NO: 25323 - DNA, 15 bp, Homo sapiens
tttgtagcatcacct

SEQ ID NO: 25324 - DNA, 15 bp, Homo sapiens
ctttgtagcatcacc

SEQ ID NO: 25325 - DNA, 15 bp, Homo sapiens
tctttgtagcatcac

SEQ ID NO: 25326 - DNA, 15 bp, Homo sapiens
ctctttgtagcatca

SEQ ID NO: 25327 - DNA, 15 bp, Homo sapiens
tctctttgtagcatc

SEQ ID NO: 25328 - DNA, 15 bp, Homo sapiens
ttctctttgtagcat

SEQ ID NO: 25329 - DNA, 15 bp, Homo sapiens
attctctttgtagca

SEQ ID NO: 25330 - DNA, 15 bp, Homo sapiens
cattctctttgtagc

SEQ ID NO: 25331 - DNA, 15 bp, Homo sapiens
acattctctttgtag

SEQ ID NO: 25332 - DNA, 15 bp, Homo sapiens
aacattctctttgta

SEQ ID NO: 25333 - DNA, 15 bp, Homo sapiens
taacattctctttgt

SEQ ID NO: 25334 - DNA, 15 bp, Homo sapiens
gtaacattctctttg

SEQ ID NO: 25335 - DNA, 15 bp, Homo sapiens
tgtaacattctcttt

SEQ ID NO: 25336 - DNA, 15 bp, Homo sapiens
atgtaacattctctt

SEQ ID NO: 25337 - DNA, 15 bp, Homo sapiens
aatgtaacattctct

SEQ ID NO: 25338 - DNA, 15 bp, Homo sapiens
caatgtaacattctc

SEQ ID NO: 25339 - DNA, 15 bp, Homo sapiens
tcaatgtaacattct

SEQ ID NO: 25340 - DNA, 15 bp, Homo sapiens
atcaatgtaacattc

SEQ ID NO: 25341 - DNA, 15 bp, Homo sapiens
aatcaatgtaacatt

SEQ ID NO: 25342 - DNA, 15 bp, Homo sapiens
gaatcaatgtaacat

SEQ ID NO: 25343 - DNA, 15 bp, Homo sapiens
tgaatcaatgtaaca

SEQ ID NO: 25344 - DNA, 15 bp, Homo sapiens
ctgaatcaatgtaac

SEQ ID NO: 25345 - DNA, 15 bp, Homo sapiens
actgaatcaatgtaa

SEQ ID NO: 25346 - DNA, 15 bp, Homo sapiens
aactgaatcaatgta

SEQ ID NO: 25347 - DNA, 15 bp, Homo sapiens
gaactgaatcaatgt

SEQ ID NO: 25348 - DNA, 15 bp, Homo sapiens
agaactgaatcaatg

SEQ ID NO: 25349 - DNA, 15 bp, Homo sapiens
aagaactgaatcaat

SEQ ID NO: 25350 - DNA, 15 bp, Homo sapiens
taagaactgaatcaa

SEQ ID NO: 25351 - DNA, 15 bp, Homo sapiens
ttaagaactgaatca

SEQ ID NO: 25352 - DNA, 15 bp, Homo sapiens
tttaagaactgaatc

SEQ ID NO: 25353 - DNA, 15 bp, Homo sapiens
ttttaagaactgaat

SEQ ID NO: 25354 - DNA, 15 bp, Homo sapiens
attttaagaactgaa

SEQ ID NO: 25355 - DNA, 15 bp, Homo sapiens
aattttaagaactga

SEQ ID NO: 25356 - DNA, 15 bp, Homo sapiens
aaattttaagaactg

SEQ ID NO: 25357 - DNA, 15 bp, Homo sapiens
aaaattttaagaact

SEQ ID NO: 25358 - DNA, 15 bp, Homo sapiens
gaaaattttaagaac

SEQ ID NO: 25359 - DNA, 15 bp, Homo sapiens
ggaaaattttaagaa

SEQ ID NO: 25360 - DNA, 15 bp, Homo sapiens
gggaaaattttaaga

SEQ ID NO: 25361 - DNA, 15 bp, Homo sapiens
agggaaaattttaag

SEQ ID NO: 25362 - DNA, 15 bp, Homo sapiens
aagggaaaattttaa

SEQ ID NO: 25363 - DNA, 15 bp, Homo sapiens
aaagggaaaatttta

SEQ ID NO: 25364 - DNA, 15 bp, Homo sapiens
aaaagggaaaatttt

SEQ ID NO: 25365 - DNA, 15 bp, Homo sapiens
gaaaagggaaaattt

SEQ ID NO: 25366 - DNA, 15 bp, Homo sapiens
ggaaaagggaaaatt

SEQ ID NO: 25367 - DNA, 15 bp, Homo sapiens
aggaaaagggaaaat

SEQ ID NO: 25368 - DNA, 15 bp, Homo sapiens
gaggaaaagggaaaa

SEQ ID NO: 25369 - DNA, 15 bp, Homo sapiens
tgaggaaaagggaaa

SEQ ID NO: 25370 - DNA, 15 bp, Homo sapiens
atgaggaaaagggaa

SEQ ID NO: 25371 - DNA, 15 bp, Homo sapiens
catgaggaaaaggga

SEQ ID NO: 25372 - DNA, 15 bp, Homo sapiens
gcatgaggaaaaggg

SEQ ID NO: 25373 - DNA, 15 bp, Homo sapiens
agcatgaggaaaagg

SEQ ID NO: 25374 - DNA, 15 bp, Homo sapiens
aagcatgaggaaaag

SEQ ID NO: 25375 - DNA, 15 bp, Homo sapiens
gaagcatgaggaaaa

SEQ ID NO: 25376 - DNA, 15 bp, Homo sapiens
agaagcatgaggaaa

SEQ ID NO: 25377 - DNA, 15 bp, Homo sapiens
cagaagcatgaggaa

SEQ ID NO: 25378 - DNA, 15 bp, Homo sapiens
acagaagcatgagga

SEQ ID NO: 25379 - DNA, 15 bp, Homo sapiens
aacagaagcatgagg

SEQ ID NO: 25380 - DNA, 15 bp, Homo sapiens
aaacagaagcatgag

SEQ ID NO: 25381 - DNA, 15 bp, Homo sapiens
gaaacagaagcatga

SEQ ID NO: 25382 - DNA, 15 bp, Homo sapiens
tgaaacagaagcatg

SEQ ID NO: 25383 - DNA, 15 bp, Homo sapiens
atgaaacagaagcat

SEQ ID NO: 25384 - DNA, 15 bp, Homo sapiens
aatgaaacagaagca

SEQ ID NO: 25385 - DNA, 15 bp, Homo sapiens
taatgaaacagaagc

SEQ ID NO: 25386 - DNA, 15 bp, Homo sapiens
ttaatgaaacagaag

SEQ ID NO: 25387 - DNA, 15 bp, Homo sapiens
attaatgaaacagaa

SEQ ID NO: 25388 - DNA, 15 bp, Homo sapiens
tattaatgaaacaga

SEQ ID NO: 25389 - DNA, 15 bp, Homo sapiens
atattaatgaaacag

SEQ ID NO: 25390 - DNA, 15 bp, Homo sapiens
aatattaatgaaaca

SEQ ID NO: 25391 - DNA, 15 bp, Homo sapiens
gaatattaatgaaac

SEQ ID NO: 25392 - DNA, 15 bp, Homo sapiens
tgaatattaatgaaa

SEQ ID NO: 25393 - DNA, 15 bp, Homo sapiens
atgaatattaatgaa

SEQ ID NO: 25394 - DNA, 15 bp, Homo sapiens
tatgaatattaatga

SEQ ID NO: 25395 - DNA, 15 bp, Homo sapiens
atatgaatattaatg

SEQ ID NO: 25396 - DNA, 15 bp, Homo sapiens
aatatgaatattaat

SEQ ID NO: 25397 - DNA, 15 bp, Homo sapiens
aaatatgaatattaa

SEQ ID NO: 25398 - DNA, 15 bp, Homo sapiens
taaatatgaatatta

SEQ ID NO: 25399 - DNA, 15 bp, Homo sapiens
gtaaatatgaatatt

SEQ ID NO: 25400 - DNA, 15 bp, Homo sapiens
agtaaatatgaatat

SEQ ID NO: 25401 - DNA, 15 bp, Homo sapiens
aagtaaatatgaata

SEQ ID NO: 25402 - DNA, 15 bp, Homo sapiens
aaagtaaatatgaat

SEQ ID NO: 25403 - DNA, 15 bp, Homo sapiens
aaaagtaaatatgaa

SEQ ID NO: 25404 - DNA, 15 bp, Homo sapiens
aaaaagtaaatatga

SEQ ID NO: 25405 - DNA, 15 bp, Homo sapiens
taaaaagtaaatatg

SEQ ID NO: 25406 - DNA, 15 bp, Homo sapiens
ataaaaagtaaatat

SEQ ID NO: 25407 - DNA, 15 bp, Homo sapiens
tataaaaagtaaata

SEQ ID NO: 25408 - DNA, 15 bp, Homo sapiens
ttataaaaagtaaat

SEQ ID NO: 25409 - DNA, 15 bp, Homo sapiens
attataaaaagtaaa

SEQ ID NO: 25410 - DNA, 15 bp, Homo sapiens
tattataaaaagtaa

SEQ ID NO: 25411 - DNA, 15 bp, Homo sapiens
atattataaaaagta

SEQ ID NO: 25412 - DNA, 15 bp, Homo sapiens
tatattataaaaagt

SEQ ID NO: 25413 - DNA, 15 bp, Homo sapiens
gtatattataaaaag

SEQ ID NO: 25414 - DNA, 15 bp, Homo sapiens
tgtatattataaaaa

SEQ ID NO: 25415 - DNA, 15 bp, Homo sapiens
atgtatattataaaa

SEQ ID NO: 25416 - DNA, 15 bp, Homo sapiens
catgtatattataaa

SEQ ID NO: 25417 - DNA, 15 bp, Homo sapiens
acatgtatattataa

SEQ ID NO: 25418 - DNA, 15 bp, Homo sapiens
aacatgtatattata

SEQ ID NO: 25419 - DNA, 15 bp, Homo sapiens
taacatgtatattat

SEQ ID NO: 25420 - DNA, 15 bp, Homo sapiens
ataacatgtatatta

SEQ ID NO: 25421 - DNA, 15 bp, Homo sapiens
cataacatgtatatt

SEQ ID NO: 25422 - DNA, 15 bp, Homo sapiens
acataacatgtatat

SEQ ID NO: 25423 - DNA, 15 bp, Homo sapiens
gacataacatgtata

SEQ ID NO: 25424 - DNA, 15 bp, Homo sapiens
agacataacatgtat

SEQ ID NO: 25425 - DNA, 15 bp, Homo sapiens
aagacataacatgta

SEQ ID NO: 25426 - DNA, 15 bp, Homo sapiens
aaagacataacatgt

SEQ ID NO: 25427 - DNA, 15 bp, Homo sapiens
taaagacataacatg

SEQ ID NO: 25428 - DNA, 15 bp, Homo sapiens
ttaaagacataacat

SEQ ID NO: 25429 - DNA, 15 bp, Homo sapiens
attaaagacataaca

SEQ ID NO: 25430 - DNA, 15 bp, Homo sapiens
tattaaagacataac

SEQ ID NO: 25431 - DNA, 15 bp, Homo sapiens
gtattaaagacataa

SEQ ID NO: 25432 - DNA, 15 bp, Homo sapiens
tgtattaaagacata

SEQ ID NO: 25433 - DNA, 15 bp, Homo sapiens
gtgtattaaagacat

SEQ ID NO: 25434 - DNA, 15 bp, Homo sapiens
agtgtattaaagaca

SEQ ID NO: 25435 - DNA, 15 bp, Homo sapiens
tagtgtattaaagac

SEQ ID NO: 25436 - DNA, 15 bp, Homo sapiens
ctagtgtattaaaga

SEQ ID NO: 25437 - DNA, 15 bp, Homo sapiens
cctagtgtattaaag

SEQ ID NO: 25438 - DNA, 15 bp, Homo sapiens
tcctagtgtattaaa

SEQ ID NO: 25439 - DNA, 15 bp, Homo sapiens
ctcctagtgtattaa

SEQ ID NO: 25440 - DNA, 15 bp, Homo sapiens
actcctagtgtatta

SEQ ID NO: 25441 - DNA, 15 bp, Homo sapiens
tactcctagtgtatt

SEQ ID NO: 25442 - DNA, 15 bp, Homo sapiens
ctactcctagtgtat

SEQ ID NO: 25443 - DNA, 15 bp, Homo sapiens
tctactcctagtgta

SEQ ID NO: 25444 - DNA, 15 bp, Homo sapiens
ttctactcctagtgt

SEQ ID NO: 25445 - DNA, 15 bp, Homo sapiens
attctactcctagtg

SEQ ID NO: 25446 - DNA, 15 bp, Homo sapiens
tattctactcctagt

SEQ ID NO: 25447 - DNA, 15 bp, Homo sapiens
atattctactcctag

SEQ ID NO: 25448 - DNA, 15 bp, Homo sapiens
aatattctactccta

SEQ ID NO: 25449 - DNA, 15 bp, Homo sapiens
aaatattctactcct

SEQ ID NO: 25450 - DNA, 15 bp, Homo sapiens
caaatattctactcc

SEQ ID NO: 25451 - DNA, 15 bp, Homo sapiens
acaaatattctactc

SEQ ID NO: 25452 - DNA, 15 bp, Homo sapiens
tacaaatattctact

SEQ ID NO: 25453 - DNA, 15 bp, Homo sapiens
ttacaaatattctac

SEQ ID NO: 25454 - DNA, 15 bp, Homo sapiens
attacaaatattcta

SEQ ID NO: 25455 - DNA, 15 bp, Homo sapiens
cattacaaatattct

SEQ ID NO: 25456 - DNA, 15 bp, Homo sapiens
tcattacaaatattc

SEQ ID NO: 25457 - DNA, 15 bp, Homo sapiens
ttcattacaaatatt

SEQ ID NO: 25458 - DNA, 15 bp, Homo sapiens
tttcattacaaatat

SEQ ID NO: 25459 - DNA, 15 bp, Homo sapiens
atttcattacaaata

SEQ ID NO: 25460 - DNA, 15 bp, Homo sapiens
catttcattacaaat

SEQ ID NO: 25461 - DNA, 15 bp, Homo sapiens
ccatttcattacaaa

SEQ ID NO: 25462 - DNA, 15 bp, Homo sapiens
tccatttcattacaa

SEQ ID NO: 25463 - DNA, 15 bp, Homo sapiens
ctccatttcattaca

SEQ ID NO: 25464 - DNA, 15 bp, Homo sapiens
actccatttcattac

SEQ ID NO: 25465 - DNA, 15 bp, Homo sapiens
cactccatttcatta

SEQ ID NO: 25466 - DNA, 15 bp, Homo sapiens
gcactccatttcatt

SEQ ID NO: 25467 - DNA, 15 bp, Homo sapiens
agcactccatttcat

SEQ ID NO: 25468 - DNA, 15 bp, Homo sapiens
cagcactccatttca

SEQ ID NO: 25469 - DNA, 15 bp, Homo sapiens
acagcactccatttc

SEQ ID NO: 25470 - DNA, 15 bp, Homo sapiens
aacagcactccattt

SEQ ID NO: 25471 - DNA, 15 bp, Homo sapiens
aaacagcactccatt

SEQ ID NO: 25472 - DNA, 15 bp, Homo sapiens
aaaacagcactccat

SEQ ID NO: 25473 - DNA, 15 bp, Homo sapiens
taaaacagcactcca

SEQ ID NO: 25474 - DNA, 15 bp, Homo sapiens
ttaaaacagcactcc

SEQ ID NO: 25475 - DNA, 15 bp, Homo sapiens
attaaaacagcactc

SEQ ID NO: 25476 - DNA, 15 bp, Homo sapiens
cattaaaacagcact

SEQ ID NO: 25477 - DNA, 15 bp, Homo sapiens
ccattaaaacagcac

SEQ ID NO: 25478 - DNA, 15 bp, Homo sapiens
tccattaaaacagca

SEQ ID NO: 25479 - DNA, 15 bp, Homo sapiens
atccattaaaacagc

SEQ ID NO: 25480 - DNA, 15 bp, Homo sapiens
catccattaaaacag

SEQ ID NO: 25481 - DNA, 15 bp, Homo sapiens
tcatccattaaaaca

SEQ ID NO: 25482 - DNA, 15 bp, Homo sapiens
ctcatccattaaaac

SEQ ID NO: 25483 - DNA, 15 bp, Homo sapiens
tctcatccattaaaa

SEQ ID NO: 25484 - DNA, 15 bp, Homo sapiens
ttctcatccattaaa

SEQ ID NO: 25485 - DNA, 15 bp, Homo sapiens
tttctcatccattaa

SEQ ID NO: 25486 - DNA, 15 bp, Homo sapiens
ctttctcatccatta

SEQ ID NO: 25487 - DNA, 15 bp, Homo sapiens
cctttctcatccatt

SEQ ID NO: 25488 - DNA, 15 bp, Homo sapiens
acctttctcatccat

SEQ ID NO: 25489 - DNA, 15 bp, Homo sapiens
tacctttctcatcca

SEQ ID NO: 25490 - DNA, 15 bp, Homo sapiens
ctacctttctcatcc

SEQ ID NO: 25491 - DNA, 15 bp, Homo sapiens
cctacctttctcatc

SEQ ID NO: 25492 - DNA, 15 bp, Homo sapiens
ccctacctttctcat

SEQ ID NO: 25493 - DNA, 15 bp, Homo sapiens
tccctacctttctca

SEQ ID NO: 25494 - DNA, 15 bp, Homo sapiens
ctccctacctttctc

SEQ ID NO: 25495 - DNA, 15 bp, Homo sapiens
cctccctacctttct

SEQ ID NO: 25496 - DNA, 15 bp, Homo sapiens
ccctccctacctttc

SEQ ID NO: 25497 - DNA, 15 bp, Homo sapiens
cccctccctaccttt

SEQ ID NO: 25498 - DNA, 15 bp, Homo sapiens
gcccctccctacctt

SEQ ID NO: 25499 - DNA, 15 bp, Homo sapiens
agcccctccctacct

SEQ ID NO: 25500 - DNA, 15 bp, Homo sapiens
gagcccctccctacc

SEQ ID NO: 25501 - DNA, 15 bp, Homo sapiens
tgagcccctccctac

SEQ ID NO: 25502 - DNA, 15 bp, Homo sapiens
ctgagcccctcccta

SEQ ID NO: 25503 - DNA, 15 bp, Homo sapiens
tctgagcccctccct

SEQ ID NO: 25504 - DNA, 15 bp, Homo sapiens
ctctgagcccctccc

SEQ ID NO: 25505 - DNA, 15 bp, Homo sapiens
tctctgagcccctcc

SEQ ID NO: 25506 - DNA, 15 bp, Homo sapiens
ctctctgagcccctc

SEQ ID NO: 25507 - DNA, 15 bp, Homo sapiens
cctctctgagcccct

SEQ ID NO: 25508 - DNA, 15 bp, Homo sapiens
ccctctctgagcccc

SEQ ID NO: 25509 - DNA, 15 bp, Homo sapiens
tccctctctgagccc

SEQ ID NO: 25510 - DNA, 15 bp, Homo sapiens
ctccctctctgagcc

SEQ ID NO: 25511 - DNA, 15 bp, Homo sapiens
cctccctctctgagc

SEQ ID NO: 25512 - DNA, 15 bp, Homo sapiens
gcctccctctctgag

SEQ ID NO: 25513 - DNA, 15 bp, Homo sapiens
agcctccctctctga

SEQ ID NO: 25514 - DNA, 15 bp, Homo sapiens
cagcctccctctctg

SEQ ID NO: 25515 - DNA, 15 bp, Homo sapiens
ccagcctccctctct

SEQ ID NO: 25516 - DNA, 15 bp, Homo sapiens
tccagcctccctctc

SEQ ID NO: 25517 - DNA, 15 bp, Homo sapiens
ctccagcctccctct

SEQ ID NO: 25518 - DNA, 15 bp, Homo sapiens
tctccagcctccctc

SEQ ID NO: 25519 - DNA, 15 bp, Homo sapiens
ttctccagcctccct

SEQ ID NO: 25520 - DNA, 15 bp, Homo sapiens
attctccagcctccc

SEQ ID NO: 25521 - DNA, 15 bp, Homo sapiens
tattctccagcctcc

SEQ ID NO: 25522 - DNA, 15 bp, Homo sapiens
atattctccagcctc

SEQ ID NO: 25523 - DNA, 15 bp, Homo sapiens
aatattctccagcct

SEQ ID NO: 25524 - DNA, 15 bp, Homo sapiens
gaatattctccagcc

SEQ ID NO: 25525 - DNA, 15 bp, Homo sapiens
tgaatattctccagc

SEQ ID NO: 25526 - DNA, 15 bp, Homo sapiens
gtgaatattctccag

SEQ ID NO: 25527 - DNA, 15 bp, Homo sapiens
agtgaatattctcca

SEQ ID NO: 25528 - DNA, 15 bp, Homo sapiens
aagtgaatattctcc

SEQ ID NO: 25529 - DNA, 15 bp, Homo sapiens
taagtgaatattctc

SEQ ID NO: 25530 - DNA, 15 bp, Homo sapiens
ataagtgaatattct

SEQ ID NO: 25531 - DNA, 15 bp, Homo sapiens
aataagtgaatattc

SEQ ID NO: 25532 - DNA, 15 bp, Homo sapiens
aaataagtgaatatt

SEQ ID NO: 25533 - DNA, 15 bp, Homo sapiens
taaataagtgaatat

SEQ ID NO: 25534 - DNA, 15 bp, Homo sapiens
ctaaataagtgaata

SEQ ID NO: 25535 - DNA, 15 bp, Homo sapiens
gctaaataagtgaat

SEQ ID NO: 25536 - DNA, 15 bp, Homo sapiens
agctaaataagtgaa

SEQ ID NO: 25537 - DNA, 15 bp, Homo sapiens
aagctaaataagtga

SEQ ID NO: 25538 - DNA, 15 bp, Homo sapiens
taagctaaataagtg

SEQ ID NO: 25539 - DNA, 15 bp, Homo sapiens
ttaagctaaataagt

SEQ ID NO: 25540 - DNA, 15 bp, Homo sapiens
attaagctaaataag

SEQ ID NO: 25541 - DNA, 15 bp, Homo sapiens
cattaagctaaataa

SEQ ID NO: 25542 - DNA, 15 bp, Homo sapiens
acattaagctaaata

SEQ ID NO: 25543 - DNA, 15 bp, Homo sapiens
aacattaagctaaat

SEQ ID NO: 25544 - DNA, 15 bp, Homo sapiens
aaacattaagctaaa

SEQ ID NO: 25545 - DNA, 15 bp, Homo sapiens
aaaacattaagctaa

SEQ ID NO: 25546 - DNA, 15 bp, Homo sapiens
gaaaacattaagcta

SEQ ID NO: 25547 - DNA, 15 bp, Homo sapiens
tgaaaacattaagct

SEQ ID NO: 25548 - DNA, 15 bp, Homo sapiens
ttgaaaacattaagc

SEQ ID NO: 25549 - DNA, 15 bp, Homo sapiens
gttgaaaacattaag

SEQ ID NO: 25550 - DNA, 15 bp, Homo sapiens
tgttgaaaacattaa

SEQ ID NO: 25551 - DNA, 15 bp, Homo sapiens
ctgttgaaaacatta

SEQ ID NO: 25552 - DNA, 15 bp, Homo sapiens
gctgttgaaaacatt

SEQ ID NO: 25553 - DNA, 15 bp, Homo sapiens
agctgttgaaaacat

SEQ ID NO: 25554 - DNA, 15 bp, Homo sapiens
aagctgttgaaaaca

SEQ ID NO: 25555 - DNA, 15 bp, Homo sapiens
taagctgttgaaaac

SEQ ID NO: 25556 - DNA, 15 bp, Homo sapiens
ttaagctgttgaaaa

SEQ ID NO: 25557 - DNA, 15 bp, Homo sapiens
tttaagctgttgaaa

SEQ ID NO: 25558 - DNA, 15 bp, Homo sapiens
ttttaagctgttgaa

SEQ ID NO: 25559 - DNA, 15 bp, Homo sapiens
tttttaagctgttga

SEQ ID NO: 25560 - DNA, 15 bp, Homo sapiens
ttttttaagctgttg

SEQ ID NO: 25561 - DNA, 15 bp, Homo sapiens
tttttttaagctgtt

SEQ ID NO: 25562 - DNA, 15 bp, Homo sapiens
ctttttttaagctgt

SEQ ID NO: 25563 - DNA, 15 bp, Homo sapiens
tctttttttaagctg

SEQ ID NO: 25564 - DNA, 15 bp, Homo sapiens
ctctttttttaagct

SEQ ID NO: 25565 - DNA, 15 bp, Homo sapiens
tctctttttttaagc

SEQ ID NO: 25566 - DNA, 15 bp, Homo sapiens
ttctctttttttaag

SEQ ID NO: 25567 - DNA, 15 bp, Homo sapiens
tttctctttttttaa

SEQ ID NO: 25568 - DNA, 15 bp, Homo sapiens
ttttctcttttttta

SEQ ID NO: 25569 - DNA, 15 bp, Homo sapiens
tttttctcttttttt

SEQ ID NO: 25570 - DNA, 15 bp, Homo sapiens
ttttttctctttttt

SEQ ID NO: 25571 - DNA, 15 bp, Homo sapiens
gttttttctcttttt

SEQ ID NO: 25572 - DNA, 15 bp, Homo sapiens
tgttttttctctttt

SEQ ID NO: 25573 - DNA, 15 bp, Homo sapiens
ttgttttttctcttt

SEQ ID NO: 25574 - DNA, 15 bp, Homo sapiens
gttgttttttctctt

SEQ ID NO: 25575 - DNA, 15 bp, Homo sapiens
ggttgttttttctct

SEQ ID NO: 25576 - DNA, 15 bp, Homo sapiens
aggttgttttttctc

SEQ ID NO: 25577 - DNA, 15 bp, Homo sapiens
aaggttgttttttct

SEQ ID NO: 25578 - DNA, 15 bp, Homo sapiens
aaaggttgttttttc

SEQ ID NO: 25579 - DNA, 15 bp, Homo sapiens
caaaggttgtttttt

SEQ ID NO: 25580 - DNA, 15 bp, Homo sapiens
tcaaaggttgttttt

SEQ ID NO: 25581 - DNA, 15 bp, Homo sapiens
ctcaaaggttgtttt

SEQ ID NO: 25582 - DNA, 15 bp, Homo sapiens
actcaaaggttgttt

SEQ ID NO: 25583 - DNA, 15 bp, Homo sapiens
cactcaaaggttgtt

SEQ ID NO: 25584 - DNA, 15 bp, Homo sapiens
ccactcaaaggttgt

SEQ ID NO: 25585 - DNA, 15 bp, Homo sapiens
gccactcaaaggttg

SEQ ID NO: 25586 - DNA, 15 bp, Homo sapiens
ggccactcaaaggtt

SEQ ID NO: 25587 - DNA, 15 bp, Homo sapiens
gggccactcaaaggt

SEQ ID NO: 25588 - DNA, 15 bp, Homo sapiens
agggccactcaaagg

SEQ ID NO: 25589 - DNA, 15 bp, Homo sapiens
aagggccactcaaag

SEQ ID NO: 25590 - DNA, 15 bp, Homo sapiens
caagggccactcaaa

SEQ ID NO: 25591 - DNA, 15 bp, Homo sapiens
acaagggccactcaa

SEQ ID NO: 25592 - DNA, 15 bp, Homo sapiens
cacaagggccactca

SEQ ID NO: 25593 - DNA, 15 bp, Homo sapiens
tcacaagggccactc

SEQ ID NO: 25594 - DNA, 15 bp, Homo sapiens
atcacaagggccact

SEQ ID NO: 25595 - DNA, 15 bp, Homo sapiens
aatcacaagggccac

SEQ ID NO: 25596 - DNA, 15 bp, Homo sapiens
taatcacaagggcca

SEQ ID NO: 25597 - DNA, 15 bp, Homo sapiens
ttaatcacaagggcc

SEQ ID NO: 25598 - DNA, 15 bp, Homo sapiens
tttaatcacaagggc

SEQ ID NO: 25599 - DNA, 15 bp, Homo sapiens
atttaatcacaaggg

SEQ ID NO: 25600 - DNA, 15 bp, Homo sapiens
catttaatcacaagg

SEQ ID NO: 25601 - DNA, 15 bp, Homo sapiens
ccatttaatcacaag

SEQ ID NO: 25602 - DNA, 15 bp, Homo sapiens
gccatttaatcacaa

SEQ ID NO: 25603 - DNA, 15 bp, Homo sapiens
tgccatttaatcaca

SEQ ID NO: 25604 - DNA, 15 bp, Homo sapiens
ctgccatttaatcac

SEQ ID NO: 25605 - DNA, 15 bp, Homo sapiens
actgccatttaatca

SEQ ID NO: 25606 - DNA, 15 bp, Homo sapiens
aactgccatttaatc

SEQ ID NO: 25607 - DNA, 15 bp, Homo sapiens
aaactgccatttaat

SEQ ID NO: 25608 - DNA, 15 bp, Homo sapiens
caaactgccatttaa

SEQ ID NO: 25609 - DNA, 15 bp, Homo sapiens
gcaaactgccattta

SEQ ID NO: 25610 - DNA, 15 bp, Homo sapiens
ggcaaactgccattt

SEQ ID NO: 25611 - DNA, 15 bp, Homo sapiens
gggcaaactgccatt

SEQ ID NO: 25612 - DNA, 15 bp, Homo sapiens
tgggcaaactgccat

SEQ ID NO: 25613 - DNA, 15 bp, Homo sapiens
ctgggcaaactgcca

SEQ ID NO: 25614 - DNA, 15 bp, Homo sapiens
tctgggcaaactgcc

SEQ ID NO: 25615 - DNA, 15 bp, Homo sapiens
gtctgggcaaactgc

SEQ ID NO: 25616 - DNA, 15 bp, Homo sapiens
agtctgggcaaactg

SEQ ID NO: 25617 - DNA, 15 bp, Homo sapiens
tagtctgggcaaact

SEQ ID NO: 25618 - DNA, 15 bp, Homo sapiens
ctagtctgggcaaac

SEQ ID NO: 25619 - DNA, 15 bp, Homo sapiens
tctagtctgggcaaa

SEQ ID NO: 25620 - DNA, 15 bp, Homo sapiens
ctctagtctgggcaa

SEQ ID NO: 25621 - DNA, 15 bp, Homo sapiens
cctctagtctgggca

SEQ ID NO: 25622 - DNA, 15 bp, Homo sapiens
ccctctagtctgggc

SEQ ID NO: 25623 - DNA, 15 bp, Homo sapiens
tccctctagtctggg

SEQ ID NO: 25624 - DNA, 15 bp, Homo sapiens
ctccctctagtctgg

SEQ ID NO: 25625 - DNA, 15 bp, Homo sapiens
gctccctctagtctg

SEQ ID NO: 25626 - DNA, 15 bp, Homo sapiens
ggctccctctagtct

SEQ ID NO: 25627 - DNA, 15 bp, Homo sapiens
tggctccctctagtc

SEQ ID NO: 25628 - DNA, 15 bp, Homo sapiens
ctggctccctctagt

SEQ ID NO: 25629 - DNA, 15 bp, Homo sapiens
gctggctccctctag

SEQ ID NO: 25630 - DNA, 15 bp, Homo sapiens
cgctggctccctcta

SEQ ID NO: 25631 - DNA, 15 bp, Homo sapiens
acgctggctccctct

SEQ ID NO: 25632 - DNA, 15 bp, Homo sapiens
aacgctggctccctc

SEQ ID NO: 25633 - DNA, 15 bp, Homo sapiens
caacgctggctccct

SEQ ID NO: 25634 - DNA, 15 bp, Homo sapiens
ccaacgctggctccc

SEQ ID NO: 25635 - DNA, 15 bp, Homo sapiens
cccaacgctggctcc

SEQ ID NO: 25636 - DNA, 15 bp, Homo sapiens
tcccaacgctggctc

SEQ ID NO: 25637 - DNA, 15 bp, Homo sapiens
ttcccaacgctggct

SEQ ID NO: 25638 - DNA, 15 bp, Homo sapiens
attcccaacgctggc

SEQ ID NO: 25639 - DNA, 15 bp, Homo sapiens
tattcccaacgctgg

SEQ ID NO: 25640 - DNA, 15 bp, Homo sapiens
ttattcccaacgctg

SEQ ID NO: 25641 - DNA, 15 bp, Homo sapiens
tttattcccaacgct

SEQ ID NO: 25642 - DNA, 15 bp, Homo sapiens
ttttattcccaacgc

SEQ ID NO: 25643 - DNA, 15 bp, Homo sapiens
tttttattcccaacg

SEQ ID NO: 25644 - DNA, 15 bp, Homo sapiens
gtttttattcccaac

SEQ ID NO: 25645 - DNA, 15 bp, Homo sapiens
agtttttattcccaa

SEQ ID NO: 25646 - DNA, 15 bp, Homo sapiens
tagtttttattccca

SEQ ID NO: 25647 - DNA, 15 bp, Homo sapiens
ttagtttttattccc

SEQ ID NO: 25648 - DNA, 15 bp, Homo sapiens
cttagtttttattcc

SEQ ID NO: 25649 - DNA, 15 bp, Homo sapiens
tcttagtttttattc

SEQ ID NO: 25650 - DNA, 15 bp, Homo sapiens
atcttagtttttatt

SEQ ID NO: 25651 - DNA, 15 bp, Homo sapiens
aatcttagtttttat

SEQ ID NO: 25652 - DNA, 15 bp, Homo sapiens
gaatcttagttttta

SEQ ID NO: 25653 - DNA, 15 bp, Homo sapiens
tgaatcttagttttt

SEQ ID NO: 25654 - DNA, 15 bp, Homo sapiens
gtgaatcttagtttt

SEQ ID NO: 25655 - DNA, 15 bp, Homo sapiens
agtgaatcttagttt

SEQ ID NO: 25656 - DNA, 15 bp, Homo sapiens
aagtgaatcttagtt

SEQ ID NO: 25657 - DNA, 15 bp, Homo sapiens
aaagtgaatcttagt

SEQ ID NO: 25658 - DNA, 15 bp, Homo sapiens
caaagtgaatcttag

SEQ ID NO: 25659 - DNA, 15 bp, Homo sapiens
tcaaagtgaatctta

SEQ ID NO: 25660 - DNA, 15 bp, Homo sapiens
ttcaaagtgaatctt

SEQ ID NO: 25661 - DNA, 15 bp, Homo sapiens
tttcaaagtgaatct

SEQ ID NO: 25662 - DNA, 15 bp, Homo sapiens
ttttcaaagtgaatc

SEQ ID NO: 25663 - DNA, 15 bp, Homo sapiens
attttcaaagtgaat

SEQ ID NO: 25664 - DNA, 15 bp, Homo sapiens
gattttcaaagtgaa

SEQ ID NO: 25665 - DNA, 15 bp, Homo sapiens
agattttcaaagtga

SEQ ID NO: 25666 - DNA, 15 bp, Homo sapiens
tagattttcaaagtg

SEQ ID NO: 25667 - DNA, 15 bp, Homo sapiens
ctagattttcaaagt

SEQ ID NO: 25668 - DNA, 15 bp, Homo sapiens
tctagattttcaaag

SEQ ID NO: 25669 - DNA, 15 bp, Homo sapiens
ttctagattttcaaa

SEQ ID NO: 25670 - DNA, 15 bp, Homo sapiens
tttctagattttcaa

SEQ ID NO: 25671 - DNA, 15 bp, Homo sapiens
ttttctagattttca

SEQ ID NO: 25672 - DNA, 15 bp, Homo sapiens
tttttctagattttc

SEQ ID NO: 25673 - DNA, 15 bp, Homo sapiens
ttttttctagatttt

SEQ ID NO: 25674 - DNA, 15 bp, Homo sapiens
tttttttctagattt

SEQ ID NO: 25675 - DNA, 15 bp, Homo sapiens
ttttttttctagatt

SEQ ID NO: 25676 - DNA, 15 bp, Homo sapiens
tttttttttctagat

SEQ ID NO: 25677 - DNA, 15 bp, Homo sapiens
ttttttttttctaga

SEQ ID NO: 25678 - DNA, 15 bp, Homo sapiens
attttttttttctag

SEQ ID NO: 25679 - DNA, 15 bp, Homo sapiens
cattttttttttcta

SEQ ID NO: 25680 - DNA, 15 bp, Homo sapiens
tcattttttttttct

SEQ ID NO: 25681 - DNA, 15 bp, Homo sapiens
gtcattttttttttc

SEQ ID NO: 25682 - DNA, 15 bp, Homo sapiens
agtcatttttttttt

SEQ ID NO: 25683 - DNA, 15 bp, Homo sapiens
tagtcattttttttt

SEQ ID NO: 25684 - DNA, 15 bp, Homo sapiens
gtagtcatttttttt

SEQ ID NO: 25685 - DNA, 15 bp, Homo sapiens
tgtagtcattttttt

SEQ ID NO: 25686 - DNA, 15 bp, Homo sapiens
gtgtagtcatttttt

SEQ ID NO: 25687 - DNA, 15 bp, Homo sapiens
tgtgtagtcattttt

SEQ ID NO: 25688 - DNA, 15 bp, Homo sapiens
ttgtgtagtcatttt

SEQ ID NO: 25689 - DNA, 15 bp, Homo sapiens
cttgtgtagtcattt

SEQ ID NO: 25690 - DNA, 15 bp, Homo sapiens
acttgtgtagtcatt

SEQ ID NO: 25691 - DNA, 15 bp, Homo sapiens
gacttgtgtagtcat

SEQ ID NO: 25692 - DNA, 15 bp, Homo sapiens
tgacttgtgtagtca

SEQ ID NO: 25693 - DNA, 15 bp, Homo sapiens
atgacttgtgtagtc

SEQ ID NO: 25694 - DNA, 15 bp, Homo sapiens
tatgacttgtgtagt

SEQ ID NO: 25695 - DNA, 15 bp, Homo sapiens
ttatgacttgtgtag

SEQ ID NO: 25696 - DNA, 15 bp, Homo sapiens
cttatgacttgtgta

SEQ ID NO: 25697 - DNA, 15 bp, Homo sapiens
tcttatgacttgtgt

SEQ ID NO: 25698 - DNA, 15 bp, Homo sapiens
ttcttatgacttgtg

SEQ ID NO: 25699 - DNA, 15 bp, Homo sapiens
attcttatgacttgt

SEQ ID NO: 25700 - DNA, 15 bp, Homo sapiens
cattcttatgacttg

SEQ ID NO: 25701 - DNA, 15 bp, Homo sapiens
acattcttatgactt

SEQ ID NO: 25702 - DNA, 15 bp, Homo sapiens
cacattcttatgact

SEQ ID NO: 25703 - DNA, 15 bp, Homo sapiens
gcacattcttatgac

SEQ ID NO: 25704 - DNA, 15 bp, Homo sapiens
agcacattcttatga

SEQ ID NO: 25705 - DNA, 15 bp, Homo sapiens
aagcacattcttatg

SEQ ID NO: 25706 - DNA, 15 bp, Homo sapiens
caagcacattcttat

SEQ ID NO: 25707 - DNA, 15 bp, Homo sapiens
tcaagcacattctta

SEQ ID NO: 25708 - DNA, 15 bp, Homo sapiens
atcaagcacattctt

SEQ ID NO: 25709 - DNA, 15 bp, Homo sapiens
catcaagcacattct

SEQ ID NO: 25710 - DNA, 15 bp, Homo sapiens
ccatcaagcacattc

SEQ ID NO: 25711 - DNA, 15 bp, Homo sapiens
gccatcaagcacatt

SEQ ID NO: 25712 - DNA, 15 bp, Homo sapiens
agccatcaagcacat

SEQ ID NO: 25713 - DNA, 15 bp, Homo sapiens
aagccatcaagcaca

SEQ ID NO: 25714 - DNA, 15 bp, Homo sapiens
caagccatcaagcac

SEQ ID NO: 25715 - DNA, 15 bp, Homo sapiens
ccaagccatcaagca

SEQ ID NO: 25716 - DNA, 15 bp, Homo sapiens
cccaagccatcaagc

SEQ ID NO: 25717 - DNA, 15 bp, Homo sapiens
acccaagccatcaag

SEQ ID NO: 25718 - DNA, 15 bp, Homo sapiens
aacccaagccatcaa

SEQ ID NO: 25719 - DNA, 15 bp, Homo sapiens
caacccaagccatca

SEQ ID NO: 25720 - DNA, 15 bp, Homo sapiens
acaacccaagccatc

SEQ ID NO: 25721 - DNA, 15 bp, Homo sapiens
gacaacccaagccat

SEQ ID NO: 25722 - DNA, 15 bp, Homo sapiens
agacaacccaagcca

SEQ ID NO: 25723 - DNA, 15 bp, Homo sapiens
cagacaacccaagcc

SEQ ID NO: 25724 - DNA, 15 bp, Homo sapiens
tcagacaacccaagc

SEQ ID NO: 25725 - DNA, 15 bp, Homo sapiens
ctcagacaacccaag

SEQ ID NO: 25726 - DNA, 15 bp, Homo sapiens
actcagacaacccaa

SEQ ID NO: 25727 - DNA, 15 bp, Homo sapiens
cactcagacaaccca

SEQ ID NO: 25728 - DNA, 15 bp, Homo sapiens
gcactcagacaaccc

SEQ ID NO: 25729 - DNA, 15 bp, Homo sapiens
tgcactcagacaacc

SEQ ID NO: 25730 - DNA, 15 bp, Homo sapiens
ttgcactcagacaac

SEQ ID NO: 25731 - DNA, 15 bp, Homo sapiens
cttgcactcagacaa

SEQ ID NO: 25732 - DNA, 15 bp, Homo sapiens
acttgcactcagaca

SEQ ID NO: 25733 - DNA, 15 bp, Homo sapiens
cacttgcactcagac

SEQ ID NO: 25734 - DNA, 15 bp, Homo sapiens
tcacttgcactcaga

SEQ ID NO: 25735 - DNA, 15 bp, Homo sapiens
ttcacttgcactcag

SEQ ID NO: 25736 - DNA, 15 bp, Homo sapiens
cttcacttgcactca

SEQ ID NO: 25737 - DNA, 15 bp, Homo sapiens
acttcacttgcactc

SEQ ID NO: 25738 - DNA, 15 bp, Homo sapiens
tacttcacttgcact

SEQ ID NO: 25739 - DNA, 15 bp, Homo sapiens
ctacttcacttgcac

SEQ ID NO: 25740 - DNA, 15 bp, Homo sapiens
cctacttcacttgca

SEQ ID NO: 25741 - DNA, 15 bp, Homo sapiens
ccctacttcacttgc

SEQ ID NO: 25742 - DNA, 15 bp, Homo sapiens
gccctacttcacttg

SEQ ID NO: 25743 - DNA, 15 bp, Homo sapiens
cgccctacttcactt

SEQ ID NO: 25744 - DNA, 15 bp, Homo sapiens
gcgccctacttcact

SEQ ID NO: 25745 - DNA, 15 bp, Homo sapiens
tgcgccctacttcac

SEQ ID NO: 25746 - DNA, 15 bp, Homo sapiens
ctgcgccctacttca

SEQ ID NO: 25747 - DNA, 15 bp, Homo sapiens
cctgcgccctacttc

SEQ ID NO: 25748 - DNA, 15 bp, Homo sapiens
gcctgcgccctactt

SEQ ID NO: 25749 - DNA, 15 bp, Homo sapiens
ggcctgcgccctact

SEQ ID NO: 25750 - DNA, 15 bp, Homo sapiens
aggcctgcgccctac

SEQ ID NO: 25751 - DNA, 15 bp, Homo sapiens
caggcctgcgcccta

SEQ ID NO: 25752 - DNA, 15 bp, Homo sapiens
ccaggcctgcgccct

SEQ ID NO: 25753 - DNA, 15 bp, Homo sapiens
accaggcctgcgccc

SEQ ID NO: 25754 - DNA, 15 bp, Homo sapiens
aaccaggcctgcgcc

SEQ ID NO: 25755 - DNA, 15 bp, Homo sapiens
aaaccaggcctgcgc

SEQ ID NO: 25756 - DNA, 15 bp, Homo sapiens
gaaaccaggcctgcg

SEQ ID NO: 25757 - DNA, 15 bp, Homo sapiens
ggaaaccaggcctgc

SEQ ID NO: 25758 - DNA, 15 bp, Homo sapiens
cggaaaccaggcctg

SEQ ID NO: 25759 - DNA, 15 bp, Homo sapiens
gcggaaaccaggcct

SEQ ID NO: 25760 - DNA, 15 bp, Homo sapiens
tgcggaaaccaggcc

SEQ ID NO: 25761 - DNA, 15 bp, Homo sapiens
atgcggaaaccaggc

SEQ ID NO: 25762 - DNA, 15 bp, Homo sapiens
aatgcggaaaccagg

SEQ ID NO: 25763 - DNA, 15 bp, Homo sapiens
gaatgcggaaaccag

SEQ ID NO: 25764 - DNA, 15 bp, Homo sapiens
ggaatgcggaaacca

SEQ ID NO: 25765 - DNA, 15 bp, Homo sapiens
gggaatgcggaaacc

SEQ ID NO: 25766 - DNA, 15 bp, Homo sapiens
agggaatgcggaaac

SEQ ID NO: 25767 - DNA, 15 bp, Homo sapiens
cagggaatgcggaaa

SEQ ID NO: 25768 - DNA, 15 bp, Homo sapiens
acagggaatgcggaa

SEQ ID NO: 25769 - DNA, 15 bp, Homo sapiens
gacagggaatgcgga

SEQ ID NO: 25770 - DNA, 15 bp, Homo sapiens
agacagggaatgcgg

SEQ ID NO: 25771 - DNA, 15 bp, Homo sapiens
cagacagggaatgcg

SEQ ID NO: 25772 - DNA, 15 bp, Homo sapiens
gcagacagggaatgc

SEQ ID NO: 25773 - DNA, 15 bp, Homo sapiens
agcagacagggaatg

SEQ ID NO: 25774 - DNA, 15 bp, Homo sapiens
gagcagacagggaat

SEQ ID NO: 25775 - DNA, 15 bp, Homo sapiens
tgagcagacagggaa

SEQ ID NO: 25776 - DNA, 15 bp, Homo sapiens
ctgagcagacaggga

SEQ ID NO: 25777 - DNA, 15 bp, Homo sapiens
gctgagcagacaggg

SEQ ID NO: 25778 - DNA, 15 bp, Homo sapiens
ggctgagcagacagg

SEQ ID NO: 25779 - DNA, 15 bp, Homo sapiens
aggctgagcagacag

SEQ ID NO: 25780 - DNA, 15 bp, Homo sapiens
aaggctgagcagaca

SEQ ID NO: 25781 - DNA, 15 bp, Homo sapiens
aaaggctgagcagac

SEQ ID NO: 25782 - DNA, 15 bp, Homo sapiens
aaaaggctgagcaga

SEQ ID NO: 25783 - DNA, 15 bp, Homo sapiens
taaaaggctgagcag

SEQ ID NO: 25784 - DNA, 15 bp, Homo sapiens
ctaaaaggctgagca

SEQ ID NO: 25785 - DNA, 15 bp, Homo sapiens
gctaaaaggctgagc

SEQ ID NO: 25786 - DNA, 15 bp, Homo sapiens
agctaaaaggctgag

SEQ ID NO: 25787 - DNA, 15 bp, Homo sapiens
gagctaaaaggctga

SEQ ID NO: 25788 - DNA, 15 bp, Homo sapiens
ggagctaaaaggctg

SEQ ID NO: 25789 - DNA, 15 bp, Homo sapiens
aggagctaaaaggct

SEQ ID NO: 25790 - DNA, 15 bp, Homo sapiens
taggagctaaaaggc

SEQ ID NO: 25791 - DNA, 15 bp, Homo sapiens
ttaggagctaaaagg

SEQ ID NO: 25792 - DNA, 15 bp, Homo sapiens
gttaggagctaaaag

SEQ ID NO: 25793 - DNA, 15 bp, Homo sapiens
ggttaggagctaaaa

SEQ ID NO: 25794 - DNA, 15 bp, Homo sapiens
gggttaggagctaaa

SEQ ID NO: 25795 - DNA, 15 bp, Homo sapiens
ggggttaggagctaa

SEQ ID NO: 25796 - DNA, 15 bp, Homo sapiens
tggggttaggagcta

SEQ ID NO: 25797 - DNA, 15 bp, Homo sapiens
atggggttaggagct

SEQ ID NO: 25798 - DNA, 15 bp, Homo sapiens
gatggggttaggagc

SEQ ID NO: 25799 - DNA, 15 bp, Homo sapiens
ggatggggttaggag

SEQ ID NO: 25800 - DNA, 15 bp, Homo sapiens
tggatggggttagga

SEQ ID NO: 25801 - DNA, 15 bp, Homo sapiens
gtggatggggttagg

SEQ ID NO: 25802 - DNA, 15 bp, Homo sapiens
agtggatggggttag

SEQ ID NO: 25803 - DNA, 15 bp, Homo sapiens
gagtggatggggtta

SEQ ID NO: 25804 - DNA, 15 bp, Homo sapiens
ggagtggatggggtt

SEQ ID NO: 25805 - DNA, 15 bp, Homo sapiens
gggagtggatggggt

SEQ ID NO: 25806 - DNA, 15 bp, Homo sapiens
agggagtggatgggg

SEQ ID NO: 25807 - DNA, 15 bp, Homo sapiens
tagggagtggatggg

SEQ ID NO: 25808 - DNA, 15 bp, Homo sapiens
ctagggagtggatgg

SEQ ID NO: 25809 - DNA, 15 bp, Homo sapiens
tctagggagtggatg

SEQ ID NO: 25810 - DNA, 15 bp, Homo sapiens
ctctagggagtggat

SEQ ID NO: 25811 - DNA, 15 bp, Homo sapiens
gctctagggagtgga

SEQ ID NO: 25812 - DNA, 15 bp, Homo sapiens
agctctagggagtgg

SEQ ID NO: 25813 - DNA, 15 bp, Homo sapiens
cagctctagggagtg

SEQ ID NO: 25814 - DNA, 15 bp, Homo sapiens
ccagctctagggagt

SEQ ID NO: 25815 - DNA, 15 bp, Homo sapiens
gccagctctagggag

SEQ ID NO: 25816 - DNA, 15 bp, Homo sapiens
ggccagctctaggga

SEQ ID NO: 25817 - DNA, 15 bp, Homo sapiens
tggccagctctaggg

SEQ ID NO: 25818 - DNA, 15 bp, Homo sapiens
ctggccagctctagg

SEQ ID NO: 25819 - DNA, 15 bp, Homo sapiens
gctggccagctctag

SEQ ID NO: 25820 - DNA, 15 bp, Homo sapiens
ggctggccagctcta

SEQ ID NO: 25821 - DNA, 15 bp, Homo sapiens
gggctggccagctct

SEQ ID NO: 25822 - DNA, 15 bp, Homo sapiens
tgggctggccagctc

SEQ ID NO: 25823 - DNA, 15 bp, Homo sapiens
ctgggctggccagct

SEQ ID NO: 25824 - DNA, 15 bp, Homo sapiens
tctgggctggccagc

SEQ ID NO: 25825 - DNA, 15 bp, Homo sapiens
gtctgggctggccag

SEQ ID NO: 25826 - DNA, 15 bp, Homo sapiens
ggtctgggctggcca

SEQ ID NO: 25827 - DNA, 15 bp, Homo sapiens
gggtctgggctggcc

SEQ ID NO: 25828 - DNA, 15 bp, Homo sapiens
tgggtctgggctggc

SEQ ID NO: 25829 - DNA, 15 bp, Homo sapiens
ctgggtctgggctgg

SEQ ID NO: 25830 - DNA, 15 bp, Homo sapiens
cctgggtctgggctg

SEQ ID NO: 25831 - DNA, 15 bp, Homo sapiens
tcctgggtctgggct

SEQ ID NO: 25832 - DNA, 15 bp, Homo sapiens
gtcctgggtctgggc

SEQ ID NO: 25833 - DNA, 15 bp, Homo sapiens
ggtcctgggtctggg

SEQ ID NO: 25834 - DNA, 15 bp, Homo sapiens
aggtcctgggtctgg

SEQ ID NO: 25835 - DNA, 15 bp, Homo sapiens
caggtcctgggtctg

SEQ ID NO: 25836 - DNA, 15 bp, Homo sapiens
ccaggtcctgggtct

SEQ ID NO: 25837 - DNA, 15 bp, Homo sapiens
tccaggtcctgggtc

SEQ ID NO: 25838 - DNA, 15 bp, Homo sapiens
atccaggtcctgggt

SEQ ID NO: 25839 - DNA, 15 bp, Homo sapiens
catccaggtcctggg

SEQ ID NO: 25840 - DNA, 15 bp, Homo sapiens
gcatccaggtcctgg

SEQ ID NO: 25841 - DNA, 15 bp, Homo sapiens
agcatccaggtcctg

SEQ ID NO: 25842 - DNA, 15 bp, Homo sapiens
cagcatccaggtcct

SEQ ID NO: 25843 - DNA, 15 bp, Homo sapiens
tcagcatccaggtcc

SEQ ID NO: 25844 - DNA, 15 bp, Homo sapiens
gtcagcatccaggtc

SEQ ID NO: 25845 - DNA, 15 bp, Homo sapiens
ggtcagcatccaggt

SEQ ID NO: 25846 - DNA, 15 bp, Homo sapiens
aggtcagcatccagg

SEQ ID NO: 25847 - DNA, 15 bp, Homo sapiens
gaggtcagcatccag

SEQ ID NO: 25848 - DNA, 15 bp, Homo sapiens
agaggtcagcatcca

SEQ ID NO: 25849 - DNA, 15 bp, Homo sapiens
aagaggtcagcatcc

SEQ ID NO: 25850 - DNA, 15 bp, Homo sapiens
gaagaggtcagcatc

SEQ ID NO: 25851 - DNA, 15 bp, Homo sapiens
tgaagaggtcagcat

SEQ ID NO: 25852 - DNA, 15 bp, Homo sapiens
ctgaagaggtcagca

SEQ ID NO: 25853 - DNA, 15 bp, Homo sapiens
cctgaagaggtcagc

SEQ ID NO: 25854 - DNA, 15 bp, Homo sapiens
ccctgaagaggtcag

SEQ ID NO: 25855 - DNA, 15 bp, Homo sapiens
gccctgaagaggtca

SEQ ID NO: 25856 - DNA, 15 bp, Homo sapiens
cgccctgaagaggtc

SEQ ID NO: 25857 - DNA, 15 bp, Homo sapiens
ccgccctgaagaggt

SEQ ID NO: 25858 - DNA, 15 bp, Homo sapiens
tccgccctgaagagg

SEQ ID NO: 25859 - DNA, 15 bp, Homo sapiens
ctccgccctgaagag

SEQ ID NO: 25860 - DNA, 15 bp, Homo sapiens
gctccgccctgaaga

SEQ ID NO: 25861 - DNA, 15 bp, Homo sapiens
agctccgccctgaag

SEQ ID NO: 25862 - DNA, 15 bp, Homo sapiens
cagctccgccctgaa

SEQ ID NO: 25863 - DNA, 15 bp, Homo sapiens
acagctccgccctga

SEQ ID NO: 25864 - DNA, 15 bp, Homo sapiens
aacagctccgccctg

SEQ ID NO: 25865 - DNA, 15 bp, Homo sapiens
caacagctccgccct

SEQ ID NO: 25866 - DNA, 15 bp, Homo sapiens
gcaacagctccgccc

SEQ ID NO: 25867 - DNA, 15 bp, Homo sapiens
agcaacagctccgcc

SEQ ID NO: 25868 - DNA, 15 bp, Homo sapiens
cagcaacagctccgc

SEQ ID NO: 25869 - DNA, 15 bp, Homo sapiens
acagcaacagctccg

SEQ ID NO: 25870 - DNA, 15 bp, Homo sapiens
cacagcaacagctcc

SEQ ID NO: 25871 - DNA, 15 bp, Homo sapiens
gcacagcaacagctc

SEQ ID NO: 25872 - DNA, 15 bp, Homo sapiens
agcacagcaacagct

SEQ ID NO: 25873 - DNA, 15 bp, Homo sapiens
gagcacagcaacagc

SEQ ID NO: 25874 - DNA, 15 bp, Homo sapiens
tgagcacagcaacag

SEQ ID NO: 25875 - DNA, 15 bp, Homo sapiens
ctgagcacagcaaca

SEQ ID NO: 25876 - DNA, 15 bp, Homo sapiens
tctgagcacagcaac

SEQ ID NO: 25877 - DNA, 15 bp, Homo sapiens
gtctgagcacagcaa

SEQ ID NO: 25878 - DNA, 15 bp, Homo sapiens
tgtctgagcacagca

SEQ ID NO: 25879 - DNA, 15 bp, Homo sapiens
atgtctgagcacagc

SEQ ID NO: 25880 - DNA, 15 bp, Homo sapiens
gatgtctgagcacag

SEQ ID NO: 25881 - DNA, 15 bp, Homo sapiens
cgatgtctgagcaca

SEQ ID NO: 25882 - DNA, 15 bp, Homo sapiens
acgatgtctgagcac

SEQ ID NO: 25883 - DNA, 15 bp, Homo sapiens
cacgatgtctgagca

SEQ ID NO: 25884 - DNA, 15 bp, Homo sapiens
tcacgatgtctgagc

SEQ ID NO: 25885 - DNA, 15 bp, Homo sapiens
gtcacgatgtctgag

SEQ ID NO: 25886 - DNA, 15 bp, Homo sapiens
tgtcacgatgtctga

SEQ ID NO: 25887 - DNA, 15 bp, Homo sapiens
ttgtcacgatgtctg

SEQ ID NO: 25888 - DNA, 15 bp, Homo sapiens
gttgtcacgatgtct

SEQ ID NO: 25889 - DNA, 15 bp, Homo sapiens
agttgtcacgatgtc

SEQ ID NO: 25890 - DNA, 15 bp, Homo sapiens
aagttgtcacgatgt

SEQ ID NO: 25891 - DNA, 15 bp, Homo sapiens
caagttgtcacgatg

SEQ ID NO: 25892 - DNA, 15 bp, Homo sapiens
acaagttgtcacgat

SEQ ID NO: 25893 - DNA, 15 bp, Homo sapiens
aacaagttgtcacga

SEQ ID NO: 25894 - DNA, 15 bp, Homo sapiens
caacaagttgtcacg

SEQ ID NO: 25895 - DNA, 15 bp, Homo sapiens
tcaacaagttgtcac

SEQ ID NO: 25896 - DNA, 15 bp, Homo sapiens
atcaacaagttgtca

SEQ ID NO: 25897 - DNA, 15 bp, Homo sapiens
catcaacaagttgtc

SEQ ID NO: 25898 - DNA, 15 bp, Homo sapiens
ccatcaacaagttgt

SEQ ID NO: 25899 - DNA, 15 bp, Homo sapiens
cccatcaacaagttg

SEQ ID NO: 25900 - DNA, 15 bp, Homo sapiens
tcccatcaacaagtt

SEQ ID NO: 25901 - DNA, 15 bp, Homo sapiens
ttcccatcaacaagt

SEQ ID NO: 25902 - DNA, 15 bp, Homo sapiens
tttcccatcaacaag

SEQ ID NO: 25903 - DNA, 15 bp, Homo sapiens
atttcccatcaacaa

SEQ ID NO: 25904 - DNA, 15 bp, Homo sapiens
catttcccatcaaca

SEQ ID NO: 25905 - DNA, 15 bp, Homo sapiens
acatttcccatcaac

SEQ ID NO: 25906 - DNA, 15 bp, Homo sapiens
tacatttcccatcaa

SEQ ID NO: 25907 - DNA, 15 bp, Homo sapiens
ctacatttcccatca

SEQ ID NO: 25908 - DNA, 15 bp, Homo sapiens
gctacatttcccatc

SEQ ID NO: 25909 - DNA, 15 bp, Homo sapiens
agctacatttcccat

SEQ ID NO: 25910 - DNA, 15 bp, Homo sapiens
cagctacatttccca

SEQ ID NO: 25911 - DNA, 15 bp, Homo sapiens
tcagctacatttccc

SEQ ID NO: 25912 - DNA, 15 bp, Homo sapiens
ttcagctacatttcc

SEQ ID NO: 25913 - DNA, 15 bp, Homo sapiens
tttcagctacatttc

SEQ ID NO: 25914 - DNA, 15 bp, Homo sapiens
ctttcagctacattt

SEQ ID NO: 25915 - DNA, 15 bp, Homo sapiens
actttcagctacatt

SEQ ID NO: 25916 - DNA, 15 bp, Homo sapiens
gactttcagctacat

SEQ ID NO: 25917 - DNA, 15 bp, Homo sapiens
agactttcagctaca

SEQ ID NO: 25918 - DNA, 15 bp, Homo sapiens
tagactttcagctac

SEQ ID NO: 25919 - DNA, 15 bp, Homo sapiens
ctagactttcagcta

SEQ ID NO: 25920 - DNA, 15 bp, Homo sapiens
gctagactttcagct

SEQ ID NO: 25921 - DNA, 15 bp, Homo sapiens
tgctagactttcagc

SEQ ID NO: 25922 - DNA, 15 bp, Homo sapiens
gtgctagactttcag

SEQ ID NO: 25923 - DNA, 15 bp, Homo sapiens
tgtgctagactttca

SEQ ID NO: 25924 - DNA, 15 bp, Homo sapiens
ttgtgctagactttc

SEQ ID NO: 25925 - DNA, 15 bp, Homo sapiens
tttgtgctagacttt

SEQ ID NO: 25926 - DNA, 15 bp, Homo sapiens
ttttgtgctagactt

SEQ ID NO: 25927 - DNA, 15 bp, Homo sapiens
tttttgtgctagact

SEQ ID NO: 25928 - DNA, 15 bp, Homo sapiens
ctttttgtgctagac

SEQ ID NO: 25929 - DNA, 15 bp, Homo sapiens
gctttttgtgctaga

SEQ ID NO: 25930 - DNA, 15 bp, Homo sapiens
agctttttgtgctag

SEQ ID NO: 25931 - DNA, 15 bp, Homo sapiens
cagctttttgtgcta

SEQ ID NO: 25932 - DNA, 15 bp, Homo sapiens
gcagctttttgtgct

SEQ ID NO: 25933 - DNA, 15 bp, Homo sapiens
agcagctttttgtgc

SEQ ID NO: 25934 - DNA, 15 bp, Homo sapiens
gagcagctttttgtg

SEQ ID NO: 25935 - DNA, 15 bp, Homo sapiens
agagcagctttttgt

SEQ ID NO: 25936 - DNA, 15 bp, Homo sapiens
aagagcagctttttg

SEQ ID NO: 25937 - DNA, 15 bp, Homo sapiens
caagagcagcttttt

SEQ ID NO: 25938 - DNA, 15 bp, Homo sapiens
ccaagagcagctttt

SEQ ID NO: 25939 - DNA, 15 bp, Homo sapiens
cccaagagcagcttt

SEQ ID NO: 25940 - DNA, 15 bp, Homo sapiens
acccaagagcagctt

SEQ ID NO: 25941 - DNA, 15 bp, Homo sapiens
aacccaagagcagct

SEQ ID NO: 25942 - DNA, 15 bp, Homo sapiens
caacccaagagcagc

SEQ ID NO: 25943 - DNA, 15 bp, Homo sapiens
ccaacccaagagcag

SEQ ID NO: 25944 - DNA, 15 bp, Homo sapiens
gccaacccaagagca

SEQ ID NO: 25945 - DNA, 15 bp, Homo sapiens
ggccaacccaagagc

SEQ ID NO: 25946 - DNA, 15 bp, Homo sapiens
tggccaacccaagag

SEQ ID NO: 25947 - DNA, 15 bp, Homo sapiens
ctggccaacccaaga

SEQ ID NO: 25948 - DNA, 15 bp, Homo sapiens
gctggccaacccaag

SEQ ID NO: 25949 - DNA, 15 bp, Homo sapiens
cgctggccaacccaa

SEQ ID NO: 25950 - DNA, 15 bp, Homo sapiens
tcgctggccaaccca

SEQ ID NO: 25951 - DNA, 15 bp, Homo sapiens
ttcgctggccaaccc

SEQ ID NO: 25952 - DNA, 15 bp, Homo sapiens
gttcgctggccaacc

SEQ ID NO: 25953 - DNA, 15 bp, Homo sapiens
ggttcgctggccaac

SEQ ID NO: 25954 - DNA, 15 bp, Homo sapiens
aggttcgctggccaa

SEQ ID NO: 25955 - DNA, 15 bp, Homo sapiens
gaggttcgctggcca

SEQ ID NO: 25956 - DNA, 15 bp, Homo sapiens
ggaggttcgctggcc

SEQ ID NO: 25957 - DNA, 15 bp, Homo sapiens
aggaggttcgctggc

SEQ ID NO: 25958 - DNA, 15 bp, Homo sapiens
aaggaggttcgctgg

SEQ ID NO: 25959 - DNA, 15 bp, Homo sapiens
gaaggaggttcgctg

SEQ ID NO: 25960 - DNA, 15 bp, Homo sapiens
tgaaggaggttcgct

SEQ ID NO: 25961 - DNA, 15 bp, Homo sapiens
atgaaggaggttcgc

SEQ ID NO: 25962 - DNA, 15 bp, Homo sapiens
catgaaggaggttcg

SEQ ID NO: 25963 - DNA, 15 bp, Homo sapiens
ccatgaaggaggttc

SEQ ID NO: 25964 - DNA, 15 bp, Homo sapiens
accatgaaggaggtt

SEQ ID NO: 25965 - DNA, 15 bp, Homo sapiens
taccatgaaggaggt

SEQ ID NO: 25966 - DNA, 15 bp, Homo sapiens
ttaccatgaaggagg

SEQ ID NO: 25967 - DNA, 15 bp, Homo sapiens
tttaccatgaaggag

SEQ ID NO: 25968 - DNA, 15 bp, Homo sapiens
ttttaccatgaagga

SEQ ID NO: 25969 - DNA, 15 bp, Homo sapiens
gttttaccatgaagg

SEQ ID NO: 25970 - DNA, 15 bp, Homo sapiens
agttttaccatgaag

SEQ ID NO: 25971 - DNA, 15 bp, Homo sapiens
gagttttaccatgaa

SEQ ID NO: 25972 - DNA, 15 bp, Homo sapiens
ggagttttaccatga

SEQ ID NO: 25973 - DNA, 15 bp, Homo sapiens
gggagttttaccatg

SEQ ID NO: 25974 - DNA, 15 bp, Homo sapiens
ggggagttttaccat

SEQ ID NO: 25975 - DNA, 15 bp, Homo sapiens
tggggagttttacca

SEQ ID NO: 25976 - DNA, 15 bp, Homo sapiens
atggggagttttacc

SEQ ID NO: 25977 - DNA, 15 bp, Homo sapiens
gatggggagttttac

SEQ ID NO: 25978 - DNA, 15 bp, Homo sapiens
ggatggggagtttta

SEQ ID NO: 25979 - DNA, 15 bp, Homo sapiens
gggatggggagtttt

SEQ ID NO: 25980 - DNA, 15 bp, Homo sapiens
agggatggggagttt

SEQ ID NO: 25981 - DNA, 15 bp, Homo sapiens
aagggatggggagtt

SEQ ID NO: 25982 - DNA, 15 bp, Homo sapiens
taagggatggggagt

SEQ ID NO: 25983 - DNA, 15 bp, Homo sapiens
ataagggatggggag

SEQ ID NO: 25984 - DNA, 15 bp, Homo sapiens
gataagggatgggga

SEQ ID NO: 25985 - DNA, 15 bp, Homo sapiens
ggataagggatgggg

SEQ ID NO: 25986 - DNA, 15 bp, Homo sapiens
tggataagggatggg

SEQ ID NO: 25987 - DNA, 15 bp, Homo sapiens
ttggataagggatgg

SEQ ID NO: 25988 - DNA, 15 bp, Homo sapiens
tttggataagggatg

SEQ ID NO: 25989 - DNA, 15 bp, Homo sapiens
atttggataagggat

SEQ ID NO: 25990 - DNA, 15 bp, Homo sapiens
gatttggataaggga

SEQ ID NO: 25991 - DNA, 15 bp, Homo sapiens
ggatttggataaggg

SEQ ID NO: 25992 - DNA, 15 bp, Homo sapiens
aggatttggataagg

SEQ ID NO: 25993 - DNA, 15 bp, Homo sapiens
aaggatttggataag

SEQ ID NO: 25994 - DNA, 15 bp, Homo sapiens
caaggatttggataa

SEQ ID NO: 25995 - DNA, 15 bp, Homo sapiens
ccaaggatttggata

SEQ ID NO: 25996 - DNA, 15 bp, Homo sapiens
cccaaggatttggat

SEQ ID NO: 25997 - DNA, 15 bp, Homo sapiens
tcccaaggatttgga

SEQ ID NO: 25998 - DNA, 15 bp, Homo sapiens
gtcccaaggatttgg

SEQ ID NO: 25999 - DNA, 15 bp, Homo sapiens
ggtcccaaggatttg

SEQ ID NO: 26000 - DNA, 15 bp, Homo sapiens
tggtcccaaggattt

SEQ ID NO: 26001 - DNA, 15 bp, Homo sapiens
ctggtcccaaggatt

SEQ ID NO: 26002 - DNA, 15 bp, Homo sapiens
tctggtcccaaggat

SEQ ID NO: 26003 - DNA, 15 bp, Homo sapiens
atctggtcccaagga

SEQ ID NO: 26004 - DNA, 15 bp, Homo sapiens
tatctggtcccaagg

SEQ ID NO: 26005 - DNA, 15 bp, Homo sapiens
atatctggtcccaag

SEQ ID NO: 26006 - DNA, 15 bp, Homo sapiens
catatctggtcccaa

SEQ ID NO: 26007 - DNA, 15 bp, Homo sapiens
gcatatctggtccca

SEQ ID NO: 26008 - DNA, 15 bp, Homo sapiens
agcatatctggtccc

SEQ ID NO: 26009 - DNA, 15 bp, Homo sapiens
aagcatatctggtcc

SEQ ID NO: 26010 - DNA, 15 bp, Homo sapiens
gaagcatatctggtc

SEQ ID NO: 26011 - DNA, 15 bp, Homo sapiens
tgaagcatatctggt

SEQ ID NO: 26012 - DNA, 15 bp, Homo sapiens
ctgaagcatatctgg

SEQ ID NO: 26013 - DNA, 15 bp, Homo sapiens
tctgaagcatatctg

SEQ ID NO: 26014 - DNA, 15 bp, Homo sapiens
ttctgaagcatatct

SEQ ID NO: 26015 - DNA, 15 bp, Homo sapiens
attctgaagcatatc

SEQ ID NO: 26016 - DNA, 15 bp, Homo sapiens
aattctgaagcatat

SEQ ID NO: 26017 - DNA, 15 bp, Homo sapiens
aaattctgaagcata

SEQ ID NO: 26018 - DNA, 15 bp, Homo sapiens
taaattctgaagcat

SEQ ID NO: 26019 - DNA, 15 bp, Homo sapiens
ataaattctgaagca

SEQ ID NO: 26020 - DNA, 15 bp, Homo sapiens
cataaattctgaagc

SEQ ID NO: 26021 - DNA, 15 bp, Homo sapiens
tcataaattctgaag

SEQ ID NO: 26022 - DNA, 15 bp, Homo sapiens
atcataaattctgaa

SEQ ID NO: 26023 - DNA, 15 bp, Homo sapiens
aatcataaattctga

SEQ ID NO: 26024 - DNA, 15 bp, Homo sapiens
aaatcataaattctg

SEQ ID NO: 26025 - DNA, 15 bp, Homo sapiens
aaaatcataaattct

SEQ ID NO: 26026 - DNA, 15 bp, Homo sapiens
aaaaatcataaattc

SEQ ID NO: 26027 - DNA, 15 bp, Homo sapiens
gaaaaatcataaatt

SEQ ID NO: 26028 - DNA, 15 bp, Homo sapiens
agaaaaatcataaat

SEQ ID NO: 26029 - DNA, 15 bp, Homo sapiens
aagaaaaatcataaa

SEQ ID NO: 26030 - DNA, 15 bp, Homo sapiens
aaagaaaaatcataa

SEQ ID NO: 26031 - DNA, 15 bp, Homo sapiens
aaaagaaaaatcata

SEQ ID NO: 26032 - DNA, 15 bp, Homo sapiens
aaaaagaaaaatcat

SEQ ID NO: 26033 - DNA, 15 bp, Homo sapiens
gaaaaagaaaaatca

SEQ ID NO: 26034 - DNA, 15 bp, Homo sapiens
ggaaaaagaaaaatc

SEQ ID NO: 26035 - DNA, 15 bp, Homo sapiens
gggaaaaagaaaaat

SEQ ID NO: 26036 - DNA, 15 bp, Homo sapiens
tgggaaaaagaaaaa

SEQ ID NO: 26037 - DNA, 15 bp, Homo sapiens
atgggaaaaagaaaa

SEQ ID NO: 26038 - DNA, 15 bp, Homo sapiens
aatgggaaaaagaaa

SEQ ID NO: 26039 - DNA, 15 bp, Homo sapiens
aaatgggaaaaagaa

SEQ ID NO: 26040 - DNA, 15 bp, Homo sapiens
gaaatgggaaaaaga

SEQ ID NO: 26041 - DNA, 15 bp, Homo sapiens
tgaaatgggaaaaag

SEQ ID NO: 26042 - DNA, 15 bp, Homo sapiens
ctgaaatgggaaaaa

SEQ ID NO: 26043 - DNA, 15 bp, Homo sapiens
tctgaaatgggaaaa

SEQ ID NO: 26044 - DNA, 15 bp, Homo sapiens
ttctgaaatgggaaa

SEQ ID NO: 26045 - DNA, 15 bp, Homo sapiens
tttctgaaatgggaa

SEQ ID NO: 26046 - DNA, 15 bp, Homo sapiens
ctttctgaaatggga

SEQ ID NO: 26047 - DNA, 15 bp, Homo sapiens
cctttctgaaatggg

SEQ ID NO: 26048 - DNA, 15 bp, Homo sapiens
gcctttctgaaatgg

SEQ ID NO: 26049 - DNA, 15 bp, Homo sapiens
agcctttctgaaatg

SEQ ID NO: 26050 - DNA, 15 bp, Homo sapiens
tagcctttctgaaat

SEQ ID NO: 26051 - DNA, 15 bp, Homo sapiens
atagcctttctgaaa

SEQ ID NO: 26052 - DNA, 15 bp, Homo sapiens
catagcctttctgaa

SEQ ID NO: 26053 - DNA, 15 bp, Homo sapiens
ccatagcctttctga

SEQ ID NO: 26054 - DNA, 15 bp, Homo sapiens
gccatagcctttctg

SEQ ID NO: 26055 - DNA, 15 bp, Homo sapiens
ggccatagcctttct

SEQ ID NO: 26056 - DNA, 15 bp, Homo sapiens
gggccatagcctttc

SEQ ID NO: 26057 - DNA, 15 bp, Homo sapiens
tgggccatagccttt

SEQ ID NO: 26058 - DNA, 15 bp, Homo sapiens
atgggccatagcctt

SEQ ID NO: 26059 - DNA, 15 bp, Homo sapiens
tatgggccatagcct

SEQ ID NO: 26060 - DNA, 15 bp, Homo sapiens
atatgggccatagcc

SEQ ID NO: 26061 - DNA, 15 bp, Homo sapiens
catatgggccatagc

SEQ ID NO: 26062 - DNA, 15 bp, Homo sapiens
gcatatgggccatag

SEQ ID NO: 26063 - DNA, 15 bp, Homo sapiens
ggcatatgggccata

SEQ ID NO: 26064 - DNA, 15 bp, Homo sapiens
gggcatatgggccat

SEQ ID NO: 26065 - DNA, 15 bp, Homo sapiens
agggcatatgggcca

SEQ ID NO: 26066 - DNA, 15 bp, Homo sapiens
tagggcatatgggcc

SEQ ID NO: 26067 - DNA, 15 bp, Homo sapiens
atagggcatatgggc

SEQ ID NO: 26068 - DNA, 15 bp, Homo sapiens
catagggcatatggg

SEQ ID NO: 26069 - DNA, 15 bp, Homo sapiens
acatagggcatatgg

SEQ ID NO: 26070 - DNA, 15 bp, Homo sapiens
aacatagggcatatg

SEQ ID NO: 26071 - DNA, 15 bp, Homo sapiens
taacatagggcatat

SEQ ID NO: 26072 - DNA, 15 bp, Homo sapiens
gtaacatagggcata

SEQ ID NO: 26073 - DNA, 15 bp, Homo sapiens
tgtaacatagggcat

SEQ ID NO: 26074 - DNA, 15 bp, Homo sapiens
atgtaacatagggca

SEQ ID NO: 26075 - DNA, 15 bp, Homo sapiens
tatgtaacatagggc

SEQ ID NO: 26076 - DNA, 15 bp, Homo sapiens
ttatgtaacataggg

SEQ ID NO: 26077 - DNA, 15 bp, Homo sapiens
tttatgtaacatagg

SEQ ID NO: 26078 - DNA, 15 bp, Homo sapiens
ctttatgtaacatag

SEQ ID NO: 26079 - DNA, 15 bp, Homo sapiens
gctttatgtaacata

SEQ ID NO: 26080 - DNA, 15 bp, Homo sapiens
ggctttatgtaacat

SEQ ID NO: 26081 - DNA, 15 bp, Homo sapiens
aggctttatgtaaca

SEQ ID NO: 26082 - DNA, 15 bp, Homo sapiens
gaggctttatgtaac

SEQ ID NO: 26083 - DNA, 15 bp, Homo sapiens
ggaggctttatgtaa

SEQ ID NO: 26084 - DNA, 15 bp, Homo sapiens
tggaggctttatgta

SEQ ID NO: 26085 - DNA, 15 bp, Homo sapiens
ctggaggctttatgt

SEQ ID NO: 26086 - DNA, 15 bp, Homo sapiens
tctggaggctttatg

SEQ ID NO: 26087 - DNA, 15 bp, Homo sapiens
ctctggaggctttat

SEQ ID NO: 26088 - DNA, 15 bp, Homo sapiens
cctctggaggcttta

SEQ ID NO: 26089 - DNA, 15 bp, Homo sapiens
tcctctggaggcttt

SEQ ID NO: 26090 - DNA, 15 bp, Homo sapiens
ctcctctggaggctt

SEQ ID NO: 26091 - DNA, 15 bp, Homo sapiens
actcctctggaggct

SEQ ID NO: 26092 - DNA, 15 bp, Homo sapiens
aactcctctggaggc

SEQ ID NO: 26093 - DNA, 15 bp, Homo sapiens
aaactcctctggagg

SEQ ID NO: 26094 - DNA, 15 bp, Homo sapiens
caaactcctctggag

SEQ ID NO: 26095 - DNA, 15 bp, Homo sapiens
ccaaactcctctgga

SEQ ID NO: 26096 - DNA, 15 bp, Homo sapiens
cccaaactcctctgg

SEQ ID NO: 26097 - DNA, 15 bp, Homo sapiens
tcccaaactcctctg

SEQ ID NO: 26098 - DNA, 15 bp, Homo sapiens
gtcccaaactcctct

SEQ ID NO: 26099 - DNA, 15 bp, Homo sapiens
tgtcccaaactcctc

SEQ ID NO: 26100 - DNA, 15 bp, Homo sapiens
ctgtcccaaactcct

SEQ ID NO: 26101 - DNA, 15 bp, Homo sapiens
actgtcccaaactcc

SEQ ID NO: 26102 - DNA, 15 bp, Homo sapiens
tactgtcccaaactc

SEQ ID NO: 26103 - DNA, 15 bp, Homo sapiens
gtactgtcccaaact

SEQ ID NO: 26104 - DNA, 15 bp, Homo sapiens
ggtactgtcccaaac

SEQ ID NO: 26105 - DNA, 15 bp, Homo sapiens
gggtactgtcccaaa

SEQ ID NO: 26106 - DNA, 15 bp, Homo sapiens
agggtactgtcccaa

SEQ ID NO: 26107 - DNA, 15 bp, Homo sapiens
tagggtactgtccca

SEQ ID NO: 26108 - DNA, 15 bp, Homo sapiens
atagggtactgtccc

SEQ ID NO: 26109 - DNA, 15 bp, Homo sapiens
gatagggtactgtcc

SEQ ID NO: 26110 - DNA, 15 bp, Homo sapiens
tgatagggtactgtc

SEQ ID NO: 26111 - DNA, 15 bp, Homo sapiens
atgatagggtactgt

SEQ ID NO: 26112 - DNA, 15 bp, Homo sapiens
gatgatagggtactg

SEQ ID NO: 26113 - DNA, 15 bp, Homo sapiens
ggatgatagggtact

SEQ ID NO: 26114 - DNA, 15 bp, Homo sapiens
tggatgatagggtac

SEQ ID NO: 26115 - DNA, 15 bp, Homo sapiens
ttggatgatagggta

SEQ ID NO: 26116 - DNA, 15 bp, Homo sapiens
attggatgatagggt

SEQ ID NO: 26117 - DNA, 15 bp, Homo sapiens
tattggatgataggg

SEQ ID NO: 26118 - DNA, 15 bp, Homo sapiens
atattggatgatagg

SEQ ID NO: 26119 - DNA, 15 bp, Homo sapiens
gatattggatgatag

SEQ ID NO: 26120 - DNA, 15 bp, Homo sapiens
agatattggatgata

SEQ ID NO: 26121 - DNA, 15 bp, Homo sapiens
aagatattggatgat

SEQ ID NO: 26122 - DNA, 15 bp, Homo sapiens
gaagatattggatga

SEQ ID NO: 26123 - DNA, 15 bp, Homo sapiens
tgaagatattggatg

SEQ ID NO: 26124 - DNA, 15 bp, Homo sapiens
atgaagatattggat

SEQ ID NO: 26125 - DNA, 15 bp, Homo sapiens
gatgaagatattgga

SEQ ID NO: 26126 - DNA, 15 bp, Homo sapiens
tgatgaagatattgg

SEQ ID NO: 26127 - DNA, 15 bp, Homo sapiens
atgatgaagatattg

SEQ ID NO: 26128 - DNA, 15 bp, Homo sapiens
aatgatgaagatatt

SEQ ID NO: 26129 - DNA, 15 bp, Homo sapiens
gaatgatgaagatat

SEQ ID NO: 26130 - DNA, 15 bp, Homo sapiens
agaatgatgaagata

SEQ ID NO: 26131 - DNA, 15 bp, Homo sapiens
cagaatgatgaagat

SEQ ID NO: 26132 - DNA, 15 bp, Homo sapiens
gcagaatgatgaaga

SEQ ID NO: 26133 - DNA, 15 bp, Homo sapiens
tgcagaatgatgaag

SEQ ID NO: 26134 - DNA, 15 bp, Homo sapiens
ctgcagaatgatgaa

SEQ ID NO: 26135 - DNA, 15 bp, Homo sapiens
tctgcagaatgatga

SEQ ID NO: 26136 - DNA, 15 bp, Homo sapiens
ttctgcagaatgatg

SEQ ID NO: 26137 - DNA, 15 bp, Homo sapiens
tttctgcagaatgat

SEQ ID NO: 26138 - DNA, 15 bp, Homo sapiens
ttttctgcagaatga

SEQ ID NO: 26139 - DNA, 15 bp, Homo sapiens
attttctgcagaatg

SEQ ID NO: 26140 - DNA, 15 bp, Homo sapiens
cattttctgcagaat

SEQ ID NO: 26141 - DNA, 15 bp, Homo sapiens
acattttctgcagaa

SEQ ID NO: 26142 - DNA, 15 bp, Homo sapiens
tacattttctgcaga

SEQ ID NO: 26143 - DNA, 15 bp, Homo sapiens
atacattttctgcag

SEQ ID NO: 26144 - DNA, 15 bp, Homo sapiens
catacattttctgca

SEQ ID NO: 26145 - DNA, 15 bp, Homo sapiens
tcatacattttctgc

SEQ ID NO: 26146 - DNA, 15 bp, Homo sapiens
ttcatacattttctg

SEQ ID NO: 26147 - DNA, 15 bp, Homo sapiens
attcatacattttct

SEQ ID NO: 26148 - DNA, 15 bp, Homo sapiens
tattcatacattttc

SEQ ID NO: 26149 - DNA, 15 bp, Homo sapiens
atattcatacatttt

SEQ ID NO: 26150 - DNA, 15 bp, Homo sapiens
aatattcatacattt

SEQ ID NO: 26151 - DNA, 15 bp, Homo sapiens
aaatattcatacatt

SEQ ID NO: 26152 - DNA, 15 bp, Homo sapiens
taaatattcatacat

SEQ ID NO: 26153 - DNA, 15 bp, Homo sapiens
gtaaatattcataca

SEQ ID NO: 26154 - DNA, 15 bp, Homo sapiens
tgtaaatattcatac

SEQ ID NO: 26155 - DNA, 15 bp, Homo sapiens
gtgtaaatattcata

SEQ ID NO: 26156 - DNA, 15 bp, Homo sapiens
agtgtaaatattcat

SEQ ID NO: 26157 - DNA, 15 bp, Homo sapiens
tagtgtaaatattca

SEQ ID NO: 26158 - DNA, 15 bp, Homo sapiens
ttagtgtaaatattc

SEQ ID NO: 26159 - DNA, 15 bp, Homo sapiens
cttagtgtaaatatt

SEQ ID NO: 26160 - DNA, 15 bp, Homo sapiens
acttagtgtaaatat

SEQ ID NO: 26161 - DNA, 15 bp, Homo sapiens
cacttagtgtaaata

SEQ ID NO: 26162 - DNA, 15 bp, Homo sapiens
ccacttagtgtaaat

SEQ ID NO: 26163 - DNA, 15 bp, Homo sapiens
tccacttagtgtaaa

SEQ ID NO: 26164 - DNA, 15 bp, Homo sapiens
ttccacttagtgtaa

SEQ ID NO: 26165 - DNA, 15 bp, Homo sapiens
gttccacttagtgta

SEQ ID NO: 26166 - DNA, 15 bp, Homo sapiens
tgttccacttagtgt

SEQ ID NO: 26167 - DNA, 15 bp, Homo sapiens
gtgttccacttagtg

SEQ ID NO: 26168 - DNA, 15 bp, Homo sapiens
tgtgttccacttagt

SEQ ID NO: 26169 - DNA, 15 bp, Homo sapiens
ttgtgttccacttag

SEQ ID NO: 26170 - DNA, 15 bp, Homo sapiens
tttgtgttccactta

SEQ ID NO: 26171 - DNA, 15 bp, Homo sapiens
gtttgtgttccactt

SEQ ID NO: 26172 - DNA, 15 bp, Homo sapiens
tgtttgtgttccact

SEQ ID NO: 26173 - DNA, 15 bp, Homo sapiens
ctgtttgtgttccac

SEQ ID NO: 26174 - DNA, 15 bp, Homo sapiens
cctgtttgtgttcca

SEQ ID NO: 26175 - DNA, 15 bp, Homo sapiens
ccctgtttgtgttcc

SEQ ID NO: 26176 - DNA, 15 bp, Homo sapiens
accctgtttgtgttc

SEQ ID NO: 26177 - DNA, 15 bp, Homo sapiens
aaccctgtttgtgtt

SEQ ID NO: 26178 - DNA, 15 bp, Homo sapiens
taaccctgtttgtgt

SEQ ID NO: 26179 - DNA, 15 bp, Homo sapiens
ataaccctgtttgtg

SEQ ID NO: 26180 - DNA, 15 bp, Homo sapiens
tataaccctgtttgt

SEQ ID NO: 26181 - DNA, 15 bp, Homo sapiens
ttataaccctgtttg

SEQ ID NO: 26182 - DNA, 15 bp, Homo sapiens
tttataaccctgttt

SEQ ID NO: 26183 - DNA, 15 bp, Homo sapiens
atttataaccctgtt

SEQ ID NO: 26184 - DNA, 15 bp, Homo sapiens
tatttataaccctgt

SEQ ID NO: 26185 - DNA, 15 bp, Homo sapiens
ctatttataaccctg

SEQ ID NO: 26186 - DNA, 15 bp, Homo sapiens
gctatttataaccct

SEQ ID NO: 26187 - DNA, 15 bp, Homo sapiens
ggctatttataaccc

SEQ ID NO: 26188 - DNA, 15 bp, Homo sapiens
aggctatttataacc

SEQ ID NO: 26189 - DNA, 15 bp, Homo sapiens
gaggctatttataac

SEQ ID NO: 26190 - DNA, 15 bp, Homo sapiens
tgaggctatttataa

SEQ ID NO: 26191 - DNA, 15 bp, Homo sapiens
ctgaggctatttata

SEQ ID NO: 26192 - DNA, 15 bp, Homo sapiens
cctgaggctatttat

SEQ ID NO: 26193 - DNA, 15 bp, Homo sapiens
acctgaggctattta

SEQ ID NO: 26194 - DNA, 15 bp, Homo sapiens
gacctgaggctattt

SEQ ID NO: 26195 - DNA, 15 bp, Homo sapiens
tgacctgaggctatt

SEQ ID NO: 26196 - DNA, 15 bp, Homo sapiens
ctgacctgaggctat

SEQ ID NO: 26197 - DNA, 15 bp, Homo sapiens
actgacctgaggcta

SEQ ID NO: 26198 - DNA, 15 bp, Homo sapiens
aactgacctgaggct

SEQ ID NO: 26199 - DNA, 15 bp, Homo sapiens
gaactgacctgaggc

SEQ ID NO: 26200 - DNA, 15 bp, Homo sapiens
tgaactgacctgagg

SEQ ID NO: 26201 - DNA, 15 bp, Homo sapiens
ctgaactgacctgag

SEQ ID NO: 26202 - DNA, 15 bp, Homo sapiens
cctgaactgacctga

SEQ ID NO: 26203 - DNA, 15 bp, Homo sapiens
acctgaactgacctg

SEQ ID NO: 26204 - DNA, 15 bp, Homo sapiens
gacctgaactgacct

SEQ ID NO: 26205 - DNA, 15 bp, Homo sapiens
tgacctgaactgacc

SEQ ID NO: 26206 - DNA, 15 bp, Homo sapiens
gtgacctgaactgac

SEQ ID NO: 26207 - DNA, 15 bp, Homo sapiens
cgtgacctgaactga

SEQ ID NO: 26208 - DNA, 15 bp, Homo sapiens
acgtgacctgaactg

SEQ ID NO: 26209 - DNA, 15 bp, Homo sapiens
aacgtgacctgaact

SEQ ID NO: 26210 - DNA, 15 bp, Homo sapiens
aaacgtgacctgaac

SEQ ID NO: 26211 - DNA, 15 bp, Homo sapiens
aaaacgtgacctgaa

SEQ ID NO: 26212 - DNA, 15 bp, Homo sapiens
caaaacgtgacctga

SEQ ID NO: 26213 - DNA, 15 bp, Homo sapiens
gcaaaacgtgacctg

SEQ ID NO: 26214 - DNA, 15 bp, Homo sapiens
agcaaaacgtgacct

SEQ ID NO: 26215 - DNA, 15 bp, Homo sapiens
cagcaaaacgtgacc

SEQ ID NO: 26216 - DNA, 15 bp, Homo sapiens
gcagcaaaacgtgac

SEQ ID NO: 26217 - DNA, 15 bp, Homo sapiens
ggcagcaaaacgtga

SEQ ID NO: 26218 - DNA, 15 bp, Homo sapiens
tggcagcaaaacgtg

SEQ ID NO: 26219 - DNA, 15 bp, Homo sapiens
ttggcagcaaaacgt

SEQ ID NO: 26220 - DNA, 15 bp, Homo sapiens
tttggcagcaaaacg

SEQ ID NO: 26221 - DNA, 15 bp, Homo sapiens
atttggcagcaaaac

SEQ ID NO: 26222 - DNA, 15 bp, Homo sapiens
catttggcagcaaaa

SEQ ID NO: 26223 - DNA, 15 bp, Homo sapiens
ccatttggcagcaaa

SEQ ID NO: 26224 - DNA, 15 bp, Homo sapiens
cccatttggcagcaa

SEQ ID NO: 26225 - DNA, 15 bp, Homo sapiens
acccatttggcagca

SEQ ID NO: 26226 - DNA, 15 bp, Homo sapiens
aacccatttggcagc

SEQ ID NO: 26227 - DNA, 15 bp, Homo sapiens
taacccatttggcag

SEQ ID NO: 26228 - DNA, 15 bp, Homo sapiens
ataacccatttggca

SEQ ID NO: 26229 - DNA, 15 bp, Homo sapiens
cataacccatttggc

SEQ ID NO: 26230 - DNA, 15 bp, Homo sapiens
ccataacccatttgg

SEQ ID NO: 26231 - DNA, 15 bp, Homo sapiens
tccataacccatttg

SEQ ID NO: 26232 - DNA, 15 bp, Homo sapiens
ttccataacccattt

SEQ ID NO: 26233 - DNA, 15 bp, Homo sapiens
tttccataacccatt

SEQ ID NO: 26234 - DNA, 15 bp, Homo sapiens
ttttccataacccat

SEQ ID NO: 26235 - DNA, 15 bp, Homo sapiens
tttttccataaccca

SEQ ID NO: 26236 - DNA, 15 bp, Homo sapiens
ctttttccataaccc

SEQ ID NO: 26237 - DNA, 15 bp, Homo sapiens
gctttttccataacc

SEQ ID NO: 26238 - DNA, 15 bp, Homo sapiens
ggctttttccataac

SEQ ID NO: 26239 - DNA, 15 bp, Homo sapiens
aggctttttccataa

SEQ ID NO: 26240 - DNA, 15 bp, Homo sapiens
aaggctttttccata

SEQ ID NO: 26241 - DNA, 15 bp, Homo sapiens
aaaggctttttccat

SEQ ID NO: 26242 - DNA, 15 bp, Homo sapiens
caaaggctttttcca

SEQ ID NO: 26243 - DNA, 15 bp, Homo sapiens
ccaaaggctttttcc

SEQ ID NO: 26244 - DNA, 15 bp, Homo sapiens
accaaaggctttttc

SEQ ID NO: 26245 - DNA, 15 bp, Homo sapiens
aaccaaaggcttttt

SEQ ID NO: 26246 - DNA, 15 bp, Homo sapiens
aaaccaaaggctttt

SEQ ID NO: 26247 - DNA, 15 bp, Homo sapiens
gaaaccaaaggcttt

SEQ ID NO: 26248 - DNA, 15 bp, Homo sapiens
ggaaaccaaaggctt

SEQ ID NO: 26249 - DNA, 15 bp, Homo sapiens
tggaaaccaaaggct

SEQ ID NO: 26250 - DNA, 15 bp, Homo sapiens
ctggaaaccaaaggc

SEQ ID NO: 26251 - DNA, 15 bp, Homo sapiens
tctggaaaccaaagg

SEQ ID NO: 26252 - DNA, 15 bp, Homo sapiens
ctctggaaaccaaag

SEQ ID NO: 26253 - DNA, 15 bp, Homo sapiens
gctctggaaaccaaa

SEQ ID NO: 26254 - DNA, 15 bp, Homo sapiens
agctctggaaaccaa

SEQ ID NO: 26255 - DNA, 15 bp, Homo sapiens
aagctctggaaacca

SEQ ID NO: 26256 - DNA, 15 bp, Homo sapiens
aaagctctggaaacc

SEQ ID NO: 26257 - DNA, 15 bp, Homo sapiens
aaaagctctggaaac

SEQ ID NO: 26258 - DNA, 15 bp, Homo sapiens
gaaaagctctggaaa

SEQ ID NO: 26259 - DNA, 15 bp, Homo sapiens
tgaaaagctctggaa

SEQ ID NO: 26260 - DNA, 15 bp, Homo sapiens
ctgaaaagctctgga

SEQ ID NO: 26261 - DNA, 15 bp, Homo sapiens
tctgaaaagctctgg

SEQ ID NO: 26262 - DNA, 15 bp, Homo sapiens
atctgaaaagctctg

SEQ ID NO: 26263 - DNA, 15 bp, Homo sapiens
gatctgaaaagctct

SEQ ID NO: 26264 - DNA, 15 bp, Homo sapiens
ggatctgaaaagctc

SEQ ID NO: 26265 - DNA, 15 bp, Homo sapiens
aggatctgaaaagct

SEQ ID NO: 26266 - DNA, 15 bp, Homo sapiens
caggatctgaaaagc

SEQ ID NO: 26267 - DNA, 15 bp, Homo sapiens
ccaggatctgaaaag

SEQ ID NO: 26268 - DNA, 15 bp, Homo sapiens
gccaggatctgaaaa

SEQ ID NO: 26269 - DNA, 15 bp, Homo sapiens
tgccaggatctgaaa

SEQ ID NO: 26270 - DNA, 15 bp, Homo sapiens
atgccaggatctgaa

SEQ ID NO: 26271 - DNA, 15 bp, Homo sapiens
aatgccaggatctga

SEQ ID NO: 26272 - DNA, 15 bp, Homo sapiens
caatgccaggatctg

SEQ ID NO: 26273 - DNA, 15 bp, Homo sapiens
acaatgccaggatct

SEQ ID NO: 26274 - DNA, 15 bp, Homo sapiens
cacaatgccaggatc

SEQ ID NO: 26275 - DNA, 15 bp, Homo sapiens
ccacaatgccaggat

SEQ ID NO: 26276 - DNA, 15 bp, Homo sapiens
tccacaatgccagga

SEQ ID NO: 26277 - DNA, 15 bp, Homo sapiens
atccacaatgccagg

SEQ ID NO: 26278 - DNA, 15 bp, Homo sapiens
tatccacaatgccag

SEQ ID NO: 26279 - DNA, 15 bp, Homo sapiens
ttatccacaatgcca

SEQ ID NO: 26280 - DNA, 15 bp, Homo sapiens
cttatccacaatgcc

SEQ ID NO: 26281 - DNA, 15 bp, Homo sapiens
ccttatccacaatgc

SEQ ID NO: 26282 - DNA, 15 bp, Homo sapiens
cccttatccacaatg

SEQ ID NO: 26283 - DNA, 15 bp, Homo sapiens
tcccttatccacaat

SEQ ID NO: 26284 - DNA, 15 bp, Homo sapiens
atcccttatccacaa

SEQ ID NO: 26285 - DNA, 15 bp, Homo sapiens
aatcccttatccaca

SEQ ID NO: 26286 - DNA, 15 bp, Homo sapiens
caatcccttatccac

SEQ ID NO: 26287 - DNA, 15 bp, Homo sapiens
acaatcccttatcca

SEQ ID NO: 26288 - DNA, 15 bp, Homo sapiens
cacaatcccttatcc

SEQ ID NO: 26289 - DNA, 15 bp, Homo sapiens
gcacaatcccttatc

SEQ ID NO: 26290 - DNA, 15 bp, Homo sapiens
tgcacaatcccttat

SEQ ID NO: 26291 - DNA, 15 bp, Homo sapiens
gtgcacaatccctta

SEQ ID NO: 26292 - DNA, 15 bp, Homo sapiens
ggtgcacaatccctt

SEQ ID NO: 26293 - DNA, 15 bp, Homo sapiens
aggtgcacaatccct

SEQ ID NO: 26294 - DNA, 15 bp, Homo sapiens
caggtgcacaatccc

SEQ ID NO: 26295 - DNA, 15 bp, Homo sapiens
ccaggtgcacaatcc

SEQ ID NO: 26296 - DNA, 15 bp, Homo sapiens
accaggtgcacaatc

SEQ ID NO: 26297 - DNA, 15 bp, Homo sapiens
taccaggtgcacaat

SEQ ID NO: 26298 - DNA, 15 bp, Homo sapiens
agtataaataaatta

SEQ ID NO: 26299 - DNA, 15 bp, Homo sapiens
aagtataaataaatt

SEQ ID NO: 26300 - DNA, 15 bp, Homo sapiens
aaagtataaataaat

SEQ ID NO: 26301 - DNA, 15 bp, Homo sapiens
aaaagtataaataaa

SEQ ID NO: 26302 - DNA, 15 bp, Homo sapiens
taaaagtataaataa

SEQ ID NO: 26303 - DNA, 15 bp, Homo sapiens
ataaaagtataaata

SEQ ID NO: 26304 - DNA, 15 bp, Homo sapiens
tataaaagtataaat

SEQ ID NO: 26305 - DNA, 15 bp, Homo sapiens
ctataaaagtataaa

SEQ ID NO: 26306 - DNA, 15 bp, Homo sapiens
tctataaaagtataa

SEQ ID NO: 26307 - DNA, 15 bp, Homo sapiens
atctataaaagtata

SEQ ID NO: 26308 - DNA, 15 bp, Homo sapiens
tatctataaaagtat

SEQ ID NO: 26309 - DNA, 15 bp, Homo sapiens
ctatctataaaagta

SEQ ID NO: 26310 - DNA, 15 bp, Homo sapiens
tctatctataaaagt

SEQ ID NO: 26311 - DNA, 15 bp, Homo sapiens
gtctatctataaaag

SEQ ID NO: 26312 - DNA, 15 bp, Homo sapiens
tgtctatctataaaa

SEQ ID NO: 26313 - DNA, 15 bp, Homo sapiens
ctgtctatctataaa

SEQ ID NO: 26314 - DNA, 15 bp, Homo sapiens
tctgtctatctataa

SEQ ID NO: 26315 - DNA, 15 bp, Homo sapiens
atctgtctatctata

SEQ ID NO: 26316 - DNA, 15 bp, Homo sapiens
aatctgtctatctat

SEQ ID NO: 26317 - DNA, 15 bp, Homo sapiens
aaatctgtctatcta

SEQ ID NO: 26318 - DNA, 15 bp, Homo sapiens
taaatctgtctatct

SEQ ID NO: 26319 - DNA, 15 bp, Homo sapiens
gtaaatctgtctatc

SEQ ID NO: 26320 - DNA, 15 bp, Homo sapiens
agtaaatctgtctat

SEQ ID NO: 26321 - DNA, 15 bp, Homo sapiens
tagtaaatctgtcta

SEQ ID NO: 26322 - DNA, 15 bp, Homo sapiens
gtagtaaatctgtct

SEQ ID NO: 26323 - DNA, 15 bp, Homo sapiens
agtagtaaatctgtc

SEQ ID NO: 26324 - DNA, 15 bp, Homo sapiens
cagtagtaaatctgt

SEQ ID NO: 26325 - DNA, 15 bp, Homo sapiens
ccagtagtaaatctg

SEQ ID NO: 26326 - DNA, 15 bp, Homo sapiens
tccagtagtaaatct

SEQ ID NO: 26327 - DNA, 15 bp, Homo sapiens
gtccagtagtaaatc

SEQ ID NO: 26328 - DNA, 15 bp, Homo sapiens
tgtccagtagtaaat

SEQ ID NO: 26329 - DNA, 15 bp, Homo sapiens
atgtccagtagtaaa

SEQ ID NO: 26330 - DNA, 15 bp, Homo sapiens
aatgtccagtagtaa

SEQ ID NO: 26331 - DNA, 15 bp, Homo sapiens
gaatgtccagtagta

SEQ ID NO: 26332 - DNA, 15 bp, Homo sapiens
agaatgtccagtagt

SEQ ID NO: 26333 - DNA, 15 bp, Homo sapiens
gagaatgtccagtag

SEQ ID NO: 26334 - DNA, 15 bp, Homo sapiens
agagaatgtccagta

SEQ ID NO: 26335 - DNA, 15 bp, Homo sapiens
cagagaatgtccagt

SEQ ID NO: 26336 - DNA, 15 bp, Homo sapiens
ccagagaatgtccag

SEQ ID NO: 26337 - DNA, 15 bp, Homo sapiens
gccagagaatgtcca

SEQ ID NO: 26338 - DNA, 15 bp, Homo sapiens
tgccagagaatgtcc

SEQ ID NO: 26339 - DNA, 15 bp, Homo sapiens
ctgccagagaatgtc

SEQ ID NO: 26340 - DNA, 15 bp, Homo sapiens
tctgccagagaatgt

SEQ ID NO: 26341 - DNA, 15 bp, Homo sapiens
ctctgccagagaatg

SEQ ID NO: 26342 - DNA, 15 bp, Homo sapiens
tctctgccagagaat

SEQ ID NO: 26343 - DNA, 15 bp, Homo sapiens
ttctctgccagagaa

SEQ ID NO: 26344 - DNA, 15 bp, Homo sapiens
tttctctgccagaga

SEQ ID NO: 26345 - DNA, 15 bp, Homo sapiens
ttttctctgccagag

SEQ ID NO: 26346 - DNA, 15 bp, Homo sapiens
tttttctctgccaga

SEQ ID NO: 26347 - DNA, 15 bp, Homo sapiens
atttttctctgccag

SEQ ID NO: 26348 - DNA, 15 bp, Homo sapiens
aatttttctctgcca

SEQ ID NO: 26349 - DNA, 15 bp, Homo sapiens
aaatttttctctgcc

SEQ ID NO: 26350 - DNA, 15 bp, Homo sapiens
gaaatttttctctgc

SEQ ID NO: 26351 - DNA, 15 bp, Homo sapiens
tgaaatttttctctg

SEQ ID NO: 26352 - DNA, 15 bp, Homo sapiens
atgaaatttttctct

SEQ ID NO: 26353 - DNA, 15 bp, Homo sapiens
catgaaatttttctc

SEQ ID NO: 26354 - DNA, 15 bp, Homo sapiens
ccatgaaatttttct

SEQ ID NO: 26355 - DNA, 15 bp, Homo sapiens
tccatgaaatttttc

SEQ ID NO: 26356 - DNA, 15 bp, Homo sapiens
ttccatgaaattttt

SEQ ID NO: 26357 - DNA, 15 bp, Homo sapiens
tttccatgaaatttt

SEQ ID NO: 26358 - DNA, 15 bp, Homo sapiens
ctttccatgaaattt

SEQ ID NO: 26359 - DNA, 15 bp, Homo sapiens
actttccatgaaatt

SEQ ID NO: 26360 - DNA, 15 bp, Homo sapiens
cactttccatgaaat

SEQ ID NO: 26361 - DNA, 15 bp, Homo sapiens
tcactttccatgaaa

SEQ ID NO: 26362 - DNA, 15 bp, Homo sapiens
ttcactttccatgaa

SEQ ID NO: 26363 - DNA, 15 bp, Homo sapiens
cttcactttccatga

SEQ ID NO: 26364 - DNA, 15 bp, Homo sapiens
acttcactttccatg

SEQ ID NO: 26365 - DNA, 15 bp, Homo sapiens
aacttcactttccat

SEQ ID NO: 26366 - DNA, 15 bp, Homo sapiens
aaacttcactttcca

SEQ ID NO: 26367 - DNA, 15 bp, Homo sapiens
taaacttcactttcc

SEQ ID NO: 26368 - DNA, 15 bp, Homo sapiens
ttaaacttcactttc

SEQ ID NO: 26369 - DNA, 15 bp, Homo sapiens
attaaacttcacttt

SEQ ID NO: 26370 - DNA, 15 bp, Homo sapiens
cattaaacttcactt

SEQ ID NO: 26371 - DNA, 15 bp, Homo sapiens
acattaaacttcact

SEQ ID NO: 26372 - DNA, 15 bp, Homo sapiens
cacattaaacttcac

SEQ ID NO: 26373 - DNA, 15 bp, Homo sapiens
tcacattaaacttca

SEQ ID NO: 26374 - DNA, 15 bp, Homo sapiens
ttcacattaaacttc

SEQ ID NO: 26375 - DNA, 15 bp, Homo sapiens
tttcacattaaactt

SEQ ID NO: 26376 - DNA, 15 bp, Homo sapiens
atttcacattaaact

SEQ ID NO: 26377 - DNA, 15 bp, Homo sapiens
catttcacattaaac

SEQ ID NO: 26378 - DNA, 15 bp, Homo sapiens
ccatttcacattaaa

SEQ ID NO: 26379 - DNA, 15 bp, Homo sapiens
gccatttcacattaa

SEQ ID NO: 26380 - DNA, 15 bp, Homo sapiens
tgccatttcacatta

SEQ ID NO: 26381 - DNA, 15 bp, Homo sapiens
gtgccatttcacatt

SEQ ID NO: 26382 - DNA, 15 bp, Homo sapiens
tatgtgccatttcac

SEQ ID NO: 26383 - DNA, 15 bp, Homo sapiens
ttatgtgccatttca

SEQ ID NO: 26384 - DNA, 15 bp, Homo sapiens
cttatgtgccatttc

SEQ ID NO: 26385 - DNA, 15 bp, Homo sapiens
acttatgtgccattt

SEQ ID NO: 26386 - DNA, 15 bp, Homo sapiens
cacttatgtgccatt

SEQ ID NO: 26387 - DNA, 15 bp, Homo sapiens
ccacttatgtgccat

SEQ ID NO: 26388 - DNA, 15 bp, Homo sapiens
accacttatgtgcca

SEQ ID NO: 26389 - DNA, 15 bp, Homo sapiens
gaccacttatgtgcc

SEQ ID NO: 26390 - DNA, 15 bp, Homo sapiens
ggaccacttatgtgc

SEQ ID NO: 26391 - DNA, 15 bp, Homo sapiens
aggaccacttatgtg

SEQ ID NO: 26392 - DNA, 15 bp, Homo sapiens
caggaccacttatgt

SEQ ID NO: 26393 - DNA, 15 bp, Homo sapiens
tcaggaccacttatg

SEQ ID NO: 26394 - DNA, 15 bp, Homo sapiens
gtcaggaccacttat

SEQ ID NO: 26395 - DNA, 15 bp, Homo sapiens
agtcaggaccactta

SEQ ID NO: 26396 - DNA, 15 bp, Homo sapiens
aagtcaggaccactt

SEQ ID NO: 26397 - DNA, 15 bp, Homo sapiens
caagtcaggaccact

SEQ ID NO: 26398 - DNA, 15 bp, Homo sapiens
gcaagtcaggaccac

SEQ ID NO: 26399 - DNA, 15 bp, Homo sapiens
tgcaagtcaggacca

SEQ ID NO: 26400 - DNA, 15 bp, Homo sapiens
ttgcaagtcaggacc

SEQ ID NO: 26401 - DNA, 15 bp, Homo sapiens
tttgcaagtcaggac

SEQ ID NO: 26402 - DNA, 15 bp, Homo sapiens
gtttgcaagtcagga

SEQ ID NO: 26403 - DNA, 15 bp, Homo sapiens
agtttgcaagtcagg

SEQ ID NO: 26404 - DNA, 15 bp, Homo sapiens
gagtttgcaagtcag

SEQ ID NO: 26405 - DNA, 15 bp, Homo sapiens
tgagtttgcaagtca

SEQ ID NO: 26406 - DNA, 15 bp, Homo sapiens
ctgagtttgcaagtc

SEQ ID NO: 26407 - DNA, 15 bp, Homo sapiens
cctgagtttgcaagt

SEQ ID NO: 26408 - DNA, 15 bp, Homo sapiens
tcctgagtttgcaag

SEQ ID NO: 26409 - DNA, 15 bp, Homo sapiens
ttcctgagtttgcaa

SEQ ID NO: 26410 - DNA, 15 bp, Homo sapiens
attcctgagtttgca

SEQ ID NO: 26411 - DNA, 15 bp, Homo sapiens
cattcctgagtttgc

SEQ ID NO: 26412 - DNA, 15 bp, Homo sapiens
ccattcctgagtttg

SEQ ID NO: 26413 - DNA, 15 bp, Homo sapiens
gccattcctgagttt

SEQ ID NO: 26414 - DNA, 15 bp, Homo sapiens
agccattcctgagtt

SEQ ID NO: 26415 - DNA, 15 bp, Homo sapiens
aagccattcctgagt

SEQ ID NO: 26416 - DNA, 15 bp, Homo sapiens
caagccattcctgag

SEQ ID NO: 26417 - DNA, 15 bp, Homo sapiens
acaagccattcctga

SEQ ID NO: 26418 - DNA, 15 bp, Homo sapiens
aacaagccattcctg

SEQ ID NO: 26419 - DNA, 15 bp, Homo sapiens
caacaagccattcct

SEQ ID NO: 26420 - DNA, 15 bp, Homo sapiens
tcaacaagccattcc

SEQ ID NO: 26421 - DNA, 15 bp, Homo sapiens
gtcaacaagccattc

SEQ ID NO: 26422 - DNA, 15 bp, Homo sapiens
ggtcaacaagccatt

SEQ ID NO: 26423 - DNA, 15 bp, Homo sapiens
tggtcaacaagccat

SEQ ID NO: 26424 - DNA, 15 bp, Homo sapiens
gtggtcaacaagcca

SEQ ID NO: 26425 - DNA, 15 bp, Homo sapiens
agtggtcaacaagcc

SEQ ID NO: 26426 - DNA, 15 bp, Homo sapiens
cagtggtcaacaagc

SEQ ID NO: 26427 - DNA, 15 bp, Homo sapiens
acagtggtcaacaag

SEQ ID NO: 26428 - DNA, 15 bp, Homo sapiens
gacagtggtcaacaa

SEQ ID NO: 26429 - DNA, 15 bp, Homo sapiens
ggacagtggtcaaca

SEQ ID NO: 26430 - DNA, 15 bp, Homo sapiens
aggacagtggtcaac

SEQ ID NO: 26431 - DNA, 15 bp, Homo sapiens
caggacagtggtcaa

SEQ ID NO: 26432 - DNA, 15 bp, Homo sapiens
ccaggacagtggtca

SEQ ID NO: 26433 - DNA, 15 bp, Homo sapiens
tccaggacagtggtc

SEQ ID NO: 26434 - DNA, 15 bp, Homo sapiens
ttccaggacagtggt

SEQ ID NO: 26435 - DNA, 15 bp, Homo sapiens
attccaggacagtgg

SEQ ID NO: 26436 - DNA, 15 bp, Homo sapiens
tattccaggacagtg

SEQ ID NO: 26437 - DNA, 15 bp, Homo sapiens
ttattccaggacagt

SEQ ID NO: 26438 - DNA, 15 bp, Homo sapiens
cttattccaggacag

SEQ ID NO: 26439 - DNA, 15 bp, Homo sapiens
tcttattccaggaca

SEQ ID NO: 26440 - DNA, 15 bp, Homo sapiens
ctcttattccaggac

SEQ ID NO: 26441 - DNA, 15 bp, Homo sapiens
tctcttattccagga

SEQ ID NO: 26442 - DNA, 15 bp, Homo sapiens
ctctcttattccagg

SEQ ID NO: 26443 - DNA, 15 bp, Homo sapiens
gctctcttattccag

SEQ ID NO: 26444 - DNA, 15 bp, Homo sapiens
ggctctcttattcca

SEQ ID NO: 26445 - DNA, 15 bp, Homo sapiens
gggctctcttattcc

SEQ ID NO: 26446 - DNA, 15 bp, Homo sapiens
tgggctctcttattc

SEQ ID NO: 26447 - DNA, 15 bp, Homo sapiens
ctgggctctcttatt

SEQ ID NO: 26448 - DNA, 15 bp, Homo sapiens
gctgggctctcttat

SEQ ID NO: 26449 - DNA, 15 bp, Homo sapiens
agctgggctctctta

SEQ ID NO: 26450 - DNA, 15 bp, Homo sapiens
aagctgggctctctt

SEQ ID NO: 26451 - DNA, 15 bp, Homo sapiens
aaagctgggctctct

SEQ ID NO: 26452 - DNA, 15 bp, Homo sapiens
caaagctgggctctc

SEQ ID NO: 26453 - DNA, 15 bp, Homo sapiens
acaaagctgggctct

SEQ ID NO: 26454 - DNA, 15 bp, Homo sapiens
aacaaagctgggctc

SEQ ID NO: 26455 - DNA, 15 bp, Homo sapiens
gaacaaagctgggct

SEQ ID NO: 26456 - DNA, 15 bp, Homo sapiens
agaacaaagctgggc

SEQ ID NO: 26457 - DNA, 15 bp, Homo sapiens
aagaacaaagctggg

SEQ ID NO: 26458 - DNA, 15 bp, Homo sapiens
caagaacaaagctgg

SEQ ID NO: 26459 - DNA, 15 bp, Homo sapiens
acaagaacaaagctg

SEQ ID NO: 26460 - DNA, 15 bp, Homo sapiens
gacaagaacaaagct

SEQ ID NO: 26461 - DNA, 15 bp, Homo sapiens
agacaagaacaaagc

SEQ ID NO: 26462 - DNA, 15 bp, Homo sapiens
aagacaagaacaaag

SEQ ID NO: 26463 - DNA, 15 bp, Homo sapiens
taagacaagaacaaa

SEQ ID NO: 26464 - DNA, 15 bp, Homo sapiens
ataagacaagaacaa

SEQ ID NO: 26465 - DNA, 15 bp, Homo sapiens
aataagacaagaaca

SEQ ID NO: 26466 - DNA, 15 bp, Homo sapiens
aaataagacaagaac

SEQ ID NO: 26467 - DNA, 15 bp, Homo sapiens
gaaataagacaagaa

SEQ ID NO: 26468 - DNA, 15 bp, Homo sapiens
agaaataagacaaga

SEQ ID NO: 26469 - DNA, 15 bp, Homo sapiens
cagaaataagacaag

SEQ ID NO: 26470 - DNA, 15 bp, Homo sapiens
ccagaaataagacaa

SEQ ID NO: 26471 - DNA, 15 bp, Homo sapiens
tccagaaataagaca

SEQ ID NO: 26472 - DNA, 15 bp, Homo sapiens
atccagaaataagac

SEQ ID NO: 26473 - DNA, 15 bp, Homo sapiens
gatccagaaataaga

SEQ ID NO: 26474 - DNA, 15 bp, Homo sapiens
cgatccagaaataag

SEQ ID NO: 26475 - DNA, 15 bp, Homo sapiens
gcgatccagaaataa

SEQ ID NO: 26476 - DNA, 15 bp, Homo sapiens
ggcgatccagaaata

SEQ ID NO: 26477 - DNA, 15 bp, Homo sapiens
gggcgatccagaaat

SEQ ID NO: 26478 - DNA, 15 bp, Homo sapiens
agggcgatccagaaa

SEQ ID NO: 26479 - DNA, 15 bp, Homo sapiens
aagggcgatccagaa

SEQ ID NO: 26480 - DNA, 15 bp, Homo sapiens
aaagggcgatccaga

SEQ ID NO: 26481 - DNA, 15 bp, Homo sapiens
gaaagggcgatccag

SEQ ID NO: 26482 - DNA, 15 bp, Homo sapiens
agaaagggcgatcca

SEQ ID NO: 26483 - DNA, 15 bp, Homo sapiens
gagaaagggcgatcc

SEQ ID NO: 26484 - DNA, 15 bp, Homo sapiens
ggagaaagggcgatc

SEQ ID NO: 26485 - DNA, 15 bp, Homo sapiens
aggagaaagggcgat

SEQ ID NO: 26486 - DNA, 15 bp, Homo sapiens
aaggagaaagggcga

SEQ ID NO: 26487 - DNA, 15 bp, Homo sapiens
aaaggagaaagggcg

SEQ ID NO: 26488 - DNA, 15 bp, Homo sapiens
caaaggagaaagggc

SEQ ID NO: 26489 - DNA, 15 bp, Homo sapiens
acaaaggagaaaggg

SEQ ID NO: 26490 - DNA, 15 bp, Homo sapiens
tacaaaggagaaagg

SEQ ID NO: 26491 - DNA, 15 bp, Homo sapiens
gtacaaaggagaaag

SEQ ID NO: 26492 - DNA, 15 bp, Homo sapiens
ggtacaaaggagaaa

SEQ ID NO: 26493 - DNA, 15 bp, Homo sapiens
aggtacaaaggagaa

SEQ ID NO: 26494 - DNA, 15 bp, Homo sapiens
aaggtacaaaggaga

SEQ ID NO: 26495 - DNA, 15 bp, Homo sapiens
gaaggtacaaaggag

SEQ ID NO: 26496 - DNA, 15 bp, Homo sapiens
agaaggtacaaagga

SEQ ID NO: 26497 - DNA, 15 bp, Homo sapiens
cagaaggtacaaagg

SEQ ID NO: 26498 - DNA, 15 bp, Homo sapiens
tcagaaggtacaaag

SEQ ID NO: 26499 - DNA, 15 bp, Homo sapiens
gtcagaaggtacaaa

SEQ ID NO: 26500 - DNA, 15 bp, Homo sapiens
tgtcagaaggtacaa

SEQ ID NO: 26501 - DNA, 15 bp, Homo sapiens
atgtcagaaggtaca

SEQ ID NO: 26502 - DNA, 15 bp, Homo sapiens
aatgtcagaaggtac

SEQ ID NO: 26503 - DNA, 15 bp, Homo sapiens
caatgtcagaaggta

SEQ ID NO: 26504 - DNA, 15 bp, Homo sapiens
acaatgtcagaaggt

SEQ ID NO: 26505 - DNA, 15 bp, Homo sapiens
aacaatgtcagaagg

SEQ ID NO: 26506 - DNA, 15 bp, Homo sapiens
aaacaatgtcagaag

SEQ ID NO: 26507 - DNA, 15 bp, Homo sapiens
gaaacaatgtcagaa

SEQ ID NO: 26508 - DNA, 15 bp, Homo sapiens
agaaacaatgtcaga

SEQ ID NO: 26509 - DNA, 15 bp, Homo sapiens
cagaaacaatgtcag

SEQ ID NO: 26510 - DNA, 15 bp, Homo sapiens
tcagaaacaatgtca

SEQ ID NO: 26511 - DNA, 15 bp, Homo sapiens
ctcagaaacaatgtc

SEQ ID NO: 26512 - DNA, 15 bp, Homo sapiens
actcagaaacaatgt

SEQ ID NO: 26513 - DNA, 15 bp, Homo sapiens
aactcagaaacaatg

SEQ ID NO: 26514 - DNA, 15 bp, Homo sapiens
gaactcagaaacaat

SEQ ID NO: 26515 - DNA, 15 bp, Homo sapiens
ggaactcagaaacaa

SEQ ID NO: 26516 - DNA, 15 bp, Homo sapiens
gggaactcagaaaca

SEQ ID NO: 26517 - DNA, 15 bp, Homo sapiens
agggaactcagaaac

SEQ ID NO: 26518 - DNA, 15 bp, Homo sapiens
gagggaactcagaaa

SEQ ID NO: 26519 - DNA, 15 bp, Homo sapiens
ggagggaactcagaa

SEQ ID NO: 26520 - DNA, 15 bp, Homo sapiens
aggagggaactcaga

SEQ ID NO: 26521 - DNA, 15 bp, Homo sapiens
gaggagggaactcag

SEQ ID NO: 26522 - DNA, 15 bp, Homo sapiens
ggaggagggaactca

SEQ ID NO: 26523 - DNA, 15 bp, Homo sapiens
gggaggagggaactc

SEQ ID NO: 26524 - DNA, 15 bp, Homo sapiens
tgggaggagggaact

SEQ ID NO: 26525 - DNA, 15 bp, Homo sapiens
atgggaggagggaac

SEQ ID NO: 26526 - DNA, 15 bp, Homo sapiens
gatgggaggagggaa

SEQ ID NO: 26527 - DNA, 15 bp, Homo sapiens
agatgggaggaggga

SEQ ID NO: 26528 - DNA, 15 bp, Homo sapiens
cagatgggaggaggg

SEQ ID NO: 26529 - DNA, 15 bp, Homo sapiens
gcagatgggaggagg

SEQ ID NO: 26530 - DNA, 15 bp, Homo sapiens
ggcagatgggaggag

SEQ ID NO: 26531 - DNA, 15 bp, Homo sapiens
tggcagatgggagga

SEQ ID NO: 26532 - DNA, 15 bp, Homo sapiens
gtggcagatgggagg

SEQ ID NO: 26533 - DNA, 15 bp, Homo sapiens
ggtggcagatgggag

SEQ ID NO: 26534 - DNA, 15 bp, Homo sapiens
gggtggcagatggga

SEQ ID NO: 26535 - DNA, 15 bp, Homo sapiens
cgggtggcagatggg

SEQ ID NO: 26536 - DNA, 15 bp, Homo sapiens
gcgggtggcagatgg

SEQ ID NO: 26537 - DNA, 15 bp, Homo sapiens
agcgggtggcagatg

SEQ ID NO: 26538 - DNA, 15 bp, Homo sapiens
gagcgggtggcagat

SEQ ID NO: 26539 - DNA, 15 bp, Homo sapiens
ggagcgggtggcaga

SEQ ID NO: 26540 - DNA, 15 bp, Homo sapiens
aggagcgggtggcag

SEQ ID NO: 26541 - DNA, 15 bp, Homo sapiens
aaggagcgggtggca

SEQ ID NO: 26542 - DNA, 15 bp, Homo sapiens
aaaggagcgggtggc

SEQ ID NO: 26543 - DNA, 15 bp, Homo sapiens
caaaggagcgggtgg

SEQ ID NO: 26544 - DNA, 15 bp, Homo sapiens
gcaaaggagcgggtg

SEQ ID NO: 26545 - DNA, 15 bp, Homo sapiens
tgcaaaggagcgggt

SEQ ID NO: 26546 - DNA, 15 bp, Homo sapiens
ttgcaaaggagcggg

SEQ ID NO: 26547 - DNA, 15 bp, Homo sapiens
gttgcaaaggagcgg

SEQ ID NO: 26548 - DNA, 15 bp, Homo sapiens
agttgcaaaggagcg

SEQ ID NO: 26549 - DNA, 15 bp, Homo sapiens
gagttgcaaaggagc

SEQ ID NO: 26550 - DNA, 15 bp, Homo sapiens
agagttgcaaaggag

SEQ ID NO: 26551 - DNA, 15 bp, Homo sapiens
cagagttgcaaagga

SEQ ID NO: 26552 - DNA, 15 bp, Homo sapiens
acagagttgcaaagg

SEQ ID NO: 26553 - DNA, 15 bp, Homo sapiens
tacagagttgcaaag

SEQ ID NO: 26554 - DNA, 15 bp, Homo sapiens
ctacagagttgcaaa

SEQ ID NO: 26555 - DNA, 15 bp, Homo sapiens
tctacagagttgcaa

SEQ ID NO: 26556 - DNA, 15 bp, Homo sapiens
ctctacagagttgca

SEQ ID NO: 26557 - DNA, 15 bp, Homo sapiens
gctctacagagttgc

SEQ ID NO: 26558 - DNA, 15 bp, Homo sapiens
tgctctacagagttg

SEQ ID NO: 26559 - DNA, 15 bp, Homo sapiens
atgctctacagagtt

SEQ ID NO: 26560 - DNA, 15 bp, Homo sapiens
aatgctctacagagt

SEQ ID NO: 26561 - DNA, 15 bp, Homo sapiens
aaatgctctacagag

SEQ ID NO: 26562 - DNA, 15 bp, Homo sapiens
aaaatgctctacaga

SEQ ID NO: 26563 - DNA, 15 bp, Homo sapiens
taaaatgctctacag

SEQ ID NO: 26564 - DNA, 15 bp, Homo sapiens
ttaaaatgctctaca

SEQ ID NO: 26565 - DNA, 15 bp, Homo sapiens
attaaaatgctctac

SEQ ID NO: 26566 - DNA, 15 bp, Homo sapiens
tattaaaatgctcta

SEQ ID NO: 26567 - DNA, 15 bp, Homo sapiens
ttattaaaatgctct

SEQ ID NO: 26568 - DNA, 15 bp, Homo sapiens
gttattaaaatgctc

SEQ ID NO: 26569 - DNA, 15 bp, Homo sapiens
tgttattaaaatgct

SEQ ID NO: 26570 - DNA, 15 bp, Homo sapiens
ctgttattaaaatgc

SEQ ID NO: 26571 - DNA, 15 bp, Homo sapiens
cctgttattaaaatg

SEQ ID NO: 26572 - DNA, 15 bp, Homo sapiens
acctgttattaaaat

SEQ ID NO: 26573 - DNA, 15 bp, Homo sapiens
aacctgttattaaaa

SEQ ID NO: 26574 - DNA, 15 bp, Homo sapiens
caacctgttattaaa

SEQ ID NO: 26575 - DNA, 15 bp, Homo sapiens
acaacctgttattaa

SEQ ID NO: 26576 - DNA, 15 bp, Homo sapiens
aacaacctgttatta

SEQ ID NO: 26577 - DNA, 15 bp, Homo sapiens
aaacaacctgttatt

SEQ ID NO: 26578 - DNA, 15 bp, Homo sapiens
caaacaacctgttat

SEQ ID NO: 26579 - DNA, 15 bp, Homo sapiens
acaaacaacctgtta

SEQ ID NO: 26580 - DNA, 15 bp, Homo sapiens
cacaaacaacctgtt

SEQ ID NO: 26581 - DNA, 15 bp, Homo sapiens
gcacaaacaacctgt

SEQ ID NO: 26582 - DNA, 15 bp, Homo sapiens
ggcacaaacaacctg

SEQ ID NO: 26583 - DNA, 15 bp, Homo sapiens
aggcacaaacaacct

SEQ ID NO: 26584 - DNA, 15 bp, Homo sapiens
caggcacaaacaacc

SEQ ID NO: 26585 - DNA, 15 bp, Homo sapiens
acaggcacaaacaac

SEQ ID NO: 26586 - DNA, 15 bp, Homo sapiens
gacaggcacaaacaa

SEQ ID NO: 26587 - DNA, 15 bp, Homo sapiens
agacaggcacaaaca

SEQ ID NO: 26588 - DNA, 15 bp, Homo sapiens
aagacaggcacaaac

SEQ ID NO: 26589 - DNA, 15 bp, Homo sapiens
caagacaggcacaaa

SEQ ID NO: 26590 - DNA, 15 bp, Homo sapiens
gcaagacaggcacaa

SEQ ID NO: 26591 - DNA, 15 bp, Homo sapiens
ggcaagacaggcaca

SEQ ID NO: 26592 - DNA, 15 bp, Homo sapiens
aggcaagacaggcac

SEQ ID NO: 26593 - DNA, 15 bp, Homo sapiens
gaggcaagacaggca

SEQ ID NO: 26594 - DNA, 15 bp, Homo sapiens
agaggcaagacaggc

SEQ ID NO: 26595 - DNA, 15 bp, Homo sapiens
cagaggcaagacagg

SEQ ID NO: 26596 - DNA, 15 bp, Homo sapiens
gcagaggcaagacag

SEQ ID NO: 26597 - DNA, 15 bp, Homo sapiens
tgcagaggcaagaca

SEQ ID NO: 26598 - DNA, 15 bp, Homo sapiens
ctgcagaggcaagac

SEQ ID NO: 26599 - DNA, 15 bp, Homo sapiens
gctgcagaggcaaga

SEQ ID NO: 26600 - DNA, 15 bp, Homo sapiens
tgctgcagaggcaag

SEQ ID NO: 26601 - DNA, 15 bp, Homo sapiens
gtgctgcagaggcaa

SEQ ID NO: 26602 - DNA, 15 bp, Homo sapiens
agtgctgcagaggca

SEQ ID NO: 26603 - DNA, 15 bp, Homo sapiens
gagtgctgcagaggc

SEQ ID NO: 26604 - DNA, 15 bp, Homo sapiens
tgagtgctgcagagg

SEQ ID NO: 26605 - DNA, 15 bp, Homo sapiens
gtgagtgctgcagag

SEQ ID NO: 26606 - DNA, 15 bp, Homo sapiens
agtgagtgctgcaga

SEQ ID NO: 26607 - DNA, 15 bp, Homo sapiens
gagtgagtgctgcag

SEQ ID NO: 26608 - DNA, 15 bp, Homo sapiens
ggagtgagtgctgca

SEQ ID NO: 26609 - DNA, 15 bp, Homo sapiens
gggagtgagtgctgc

SEQ ID NO: 26610 - DNA, 15 bp, Homo sapiens
tgggagtgagtgctg

SEQ ID NO: 26611 - DNA, 15 bp, Homo sapiens
gtgggagtgagtgct

SEQ ID NO: 26612 - DNA, 15 bp, Homo sapiens
ggtgggagtgagtgc

SEQ ID NO: 26613 - DNA, 15 bp, Homo sapiens
aggtgggagtgagtg

SEQ ID NO: 26614 - DNA, 15 bp, Homo sapiens
caggtgggagtgagt

SEQ ID NO: 26615 - DNA, 15 bp, Homo sapiens
acaggtgggagtgag

SEQ ID NO: 26616 - DNA, 15 bp, Homo sapiens
aacaggtgggagtga

SEQ ID NO: 26617 - DNA, 15 bp, Homo sapiens
aaacaggtgggagtg

SEQ ID NO: 26618 - DNA, 15 bp, Homo sapiens
gaaacaggtgggagt

SEQ ID NO: 26619 - DNA, 15 bp, Homo sapiens
ggaaacaggtgggag

SEQ ID NO: 26620 - DNA, 15 bp, Homo sapiens
aggaaacaggtggga

SEQ ID NO: 26621 - DNA, 15 bp, Homo sapiens
gaggaaacaggtggg

SEQ ID NO: 26622 - DNA, 15 bp, Homo sapiens
tgaggaaacaggtgg

SEQ ID NO: 26623 - DNA, 15 bp, Homo sapiens
ctgaggaaacaggtg

SEQ ID NO: 26624 - DNA, 15 bp, Homo sapiens
gctgaggaaacaggt

SEQ ID NO: 26625 - DNA, 15 bp, Homo sapiens
ggctgaggaaacagg

SEQ ID NO: 26626 - DNA, 15 bp, Homo sapiens
aggctgaggaaacag

SEQ ID NO: 26627 - DNA, 15 bp, Homo sapiens
gaggctgaggaaaca

SEQ ID NO: 26628 - DNA, 15 bp, Homo sapiens
agaggctgaggaaac

SEQ ID NO: 26629 - DNA, 15 bp, Homo sapiens
cagaggctgaggaaa

SEQ ID NO: 26630 - DNA, 15 bp, Homo sapiens
tcagaggctgaggaa

SEQ ID NO: 26631 - DNA, 15 bp, Homo sapiens
gtcagaggctgagga

SEQ ID NO: 26632 - DNA, 15 bp, Homo sapiens
agtcagaggctgagg

SEQ ID NO: 26633 - DNA, 15 bp, Homo sapiens
aagtcagaggctgag

SEQ ID NO: 26634 - DNA, 15 bp, Homo sapiens
gaagtcagaggctga

SEQ ID NO: 26635 - DNA, 15 bp, Homo sapiens
agaagtcagaggctg

SEQ ID NO: 26636 - DNA, 15 bp, Homo sapiens
gagaagtcagaggct

SEQ ID NO: 26637 - DNA, 15 bp, Homo sapiens
ggagaagtcagaggc

SEQ ID NO: 26638 - DNA, 15 bp, Homo sapiens
aggagaagtcagagg

SEQ ID NO: 26639 - DNA, 15 bp, Homo sapiens
aaggagaagtcagag

SEQ ID NO: 26640 - DNA, 15 bp, Homo sapiens
aaaggagaagtcaga

SEQ ID NO: 26641 - DNA, 15 bp, Homo sapiens
gaaaggagaagtcag

SEQ ID NO: 26642 - DNA, 15 bp, Homo sapiens
ggaaaggagaagtca

SEQ ID NO: 26643 - DNA, 15 bp, Homo sapiens
gggaaaggagaagtc

SEQ ID NO: 26644 - DNA, 15 bp, Homo sapiens
ggggaaaggagaagt

SEQ ID NO: 26645 - DNA, 15 bp, Homo sapiens
aggggaaaggagaag

SEQ ID NO: 26646 - DNA, 15 bp, Homo sapiens
aaggggaaaggagaa

SEQ ID NO: 26647 - DNA, 15 bp, Homo sapiens
aaaggggaaaggaga

SEQ ID NO: 26648 - DNA, 15 bp, Homo sapiens
aaaaggggaaaggag

SEQ ID NO: 26649 - DNA, 15 bp, Homo sapiens
aaaaaggggaaagga

SEQ ID NO: 26650 - DNA, 15 bp, Homo sapiens
caaaaaggggaaagg

SEQ ID NO: 26651 - DNA, 15 bp, Homo sapiens
ccaaaaaggggaaag

SEQ ID NO: 26652 - DNA, 15 bp, Homo sapiens
gccaaaaaggggaaa

SEQ ID NO: 26653 - DNA, 15 bp, Homo sapiens
tgccaaaaaggggaa

SEQ ID NO: 26654 - DNA, 15 bp, Homo sapiens
atgccaaaaagggga

SEQ ID NO: 26655 - DNA, 15 bp, Homo sapiens
catgccaaaaagggg

SEQ ID NO: 26656 - DNA, 15 bp, Homo sapiens
gcatgccaaaaaggg

SEQ ID NO: 26657 - DNA, 15 bp, Homo sapiens
agcatgccaaaaagg

SEQ ID NO: 26658 - DNA, 15 bp, Homo sapiens
gagcatgccaaaaag

SEQ ID NO: 26659 - DNA, 15 bp, Homo sapiens
agagcatgccaaaaa

SEQ ID NO: 26660 - DNA, 15 bp, Homo sapiens
cagagcatgccaaaa

SEQ ID NO: 26661 - DNA, 15 bp, Homo sapiens
tcagagcatgccaaa

SEQ ID NO: 26662 - DNA, 15 bp, Homo sapiens
gtcagagcatgccaa

SEQ ID NO: 26663 - DNA, 15 bp, Homo sapiens
ggtcagagcatgcca

SEQ ID NO: 26664 - DNA, 15 bp, Homo sapiens
aggtcagagcatgcc

SEQ ID NO: 26665 - DNA, 15 bp, Homo sapiens
caggtcagagcatgc

SEQ ID NO: 26666 - DNA, 15 bp, Homo sapiens
gcaggtcagagcatg

SEQ ID NO: 26667 - DNA, 15 bp, Homo sapiens
ggcaggtcagagcat

SEQ ID NO: 26668 - DNA, 15 bp, Homo sapiens
aggcaggtcagagca

SEQ ID NO: 26669 - DNA, 15 bp, Homo sapiens
gaggcaggtcagagc

SEQ ID NO: 26670 - DNA, 15 bp, Homo sapiens
ggaggcaggtcagag

SEQ ID NO: 26671 - DNA, 15 bp, Homo sapiens
cggaggcaggtcaga

SEQ ID NO: 26672 - DNA, 15 bp, Homo sapiens
acggaggcaggtcag

SEQ ID NO: 26673 - DNA, 15 bp, Homo sapiens
tacggaggcaggtca

SEQ ID NO: 26674 - DNA, 15 bp, Homo sapiens
ctacggaggcaggtc

SEQ ID NO: 26675 - DNA, 15 bp, Homo sapiens
actacggaggcaggt

SEQ ID NO: 26676 - DNA, 15 bp, Homo sapiens
aactacggaggcagg

SEQ ID NO: 26677 - DNA, 15 bp, Homo sapiens
caactacggaggcag

SEQ ID NO: 26678 - DNA, 15 bp, Homo sapiens
tcaactacggaggca

SEQ ID NO: 26679 - DNA, 15 bp, Homo sapiens
ttcaactacggaggc

SEQ ID NO: 26680 - DNA, 15 bp, Homo sapiens
gttcaactacggagg

SEQ ID NO: 26681 - DNA, 15 bp, Homo sapiens
ggttcaactacggag

SEQ ID NO: 26682 - DNA, 15 bp, Homo sapiens
gggttcaactacgga

SEQ ID NO: 26683 - DNA, 15 bp, Homo sapiens
cgggttcaactacgg

SEQ ID NO: 26684 - DNA, 15 bp, Homo sapiens
tcgggttcaactacg

SEQ ID NO: 26685 - DNA, 15 bp, Homo sapiens
atcgggttcaactac

SEQ ID NO: 26686 - DNA, 15 bp, Homo sapiens
aatcgggttcaacta

SEQ ID NO: 26687 - DNA, 15 bp, Homo sapiens
gaatcgggttcaact

SEQ ID NO: 26688 - DNA, 15 bp, Homo sapiens
ggaatcgggttcaac

SEQ ID NO: 26689 - DNA, 15 bp, Homo sapiens
aggaatcgggttcaa

SEQ ID NO: 26690 - DNA, 15 bp, Homo sapiens
caggaatcgggttca

SEQ ID NO: 26691 - DNA, 15 bp, Homo sapiens
tcaggaatcgggttc

SEQ ID NO: 26692 - DNA, 15 bp, Homo sapiens
ctcaggaatcgggtt

SEQ ID NO: 26693 - DNA, 15 bp, Homo sapiens
cctcaggaatcgggt

SEQ ID NO: 26694 - DNA, 15 bp, Homo sapiens
gcctcaggaatcggg

SEQ ID NO: 26695 - DNA, 15 bp, Homo sapiens
tgcctcaggaatcgg

SEQ ID NO: 26696 - DNA, 15 bp, Homo sapiens
ttgcctcaggaatcg

SEQ ID NO: 26697 - DNA, 15 bp, Homo sapiens
attgcctcaggaatc

SEQ ID NO: 26698 - DNA, 15 bp, Homo sapiens
cattgcctcaggaat

SEQ ID NO: 26699 - DNA, 15 bp, Homo sapiens
tcattgcctcaggaa

SEQ ID NO: 26700 - DNA, 15 bp, Homo sapiens
atcattgcctcagga

SEQ ID NO: 26701 - DNA, 15 bp, Homo sapiens
tatcattgcctcagg

SEQ ID NO: 26702 - DNA, 15 bp, Homo sapiens
atatcattgcctcag

SEQ ID NO: 26703 - DNA, 15 bp, Homo sapiens
catatcattgcctca

SEQ ID NO: 26704 - DNA, 15 bp, Homo sapiens
ccatatcattgcctc

SEQ ID NO: 26705 - DNA, 15 bp, Homo sapiens
gccatatcattgcct

SEQ ID NO: 26706 - DNA, 15 bp, Homo sapiens
tgccatatcattgcc

SEQ ID NO: 26707 - DNA, 15 bp, Homo sapiens
ctgccatatcattgc

SEQ ID NO: 26708 - DNA, 15 bp, Homo sapiens
cctgccatatcattg

SEQ ID NO: 26709 - DNA, 15 bp, Homo sapiens
acctgccatatcatt

SEQ ID NO: 26710 - DNA, 15 bp, Homo sapiens
gacctgccatatcat

SEQ ID NO: 26711 - DNA, 15 bp, Homo sapiens
ggacctgccatatca

SEQ ID NO: 26712 - DNA, 15 bp, Homo sapiens
gggacctgccatatc

SEQ ID NO: 26713 - DNA, 15 bp, Homo sapiens
agggacctgccatat

SEQ ID NO: 26714 - DNA, 15 bp, Homo sapiens
gagggacctgccata

SEQ ID NO: 26715 - DNA, 15 bp, Homo sapiens
tgagggacctgccat

SEQ ID NO: 26716 - DNA, 15 bp, Homo sapiens
ttgagggacctgcca

SEQ ID NO: 26717 - DNA, 15 bp, Homo sapiens
gttgagggacctgcc

SEQ ID NO: 26718 - DNA, 15 bp, Homo sapiens
agttgagggacctgc

SEQ ID NO: 26719 - DNA, 15 bp, Homo sapiens
gagttgagggacctg

SEQ ID NO: 26720 - DNA, 15 bp, Homo sapiens
agagttgagggacct

SEQ ID NO: 26721 - DNA, 15 bp, Homo sapiens
gagagttgagggacc

SEQ ID NO: 26722 - DNA, 15 bp, Homo sapiens
ggagagttgagggac

SEQ ID NO: 26723 - DNA, 15 bp, Homo sapiens
tggagagttgaggga

SEQ ID NO: 26724 - DNA, 15 bp, Homo sapiens
atggagagttgaggg

SEQ ID NO: 26725 - DNA, 15 bp, Homo sapiens
gatggagagttgagg

SEQ ID NO: 26726 - DNA, 15 bp, Homo sapiens
agatggagagttgag

SEQ ID NO: 26727 - DNA, 15 bp, Homo sapiens
tagatggagagttga

SEQ ID NO: 26728 - DNA, 15 bp, Homo sapiens
atagatggagagttg

SEQ ID NO: 26729 - DNA, 15 bp, Homo sapiens
tatagatggagagtt

SEQ ID NO: 26730 - DNA, 15 bp, Homo sapiens
ctatagatggagagt

SEQ ID NO: 26731 - DNA, 15 bp, Homo sapiens
gctatagatggagag

SEQ ID NO: 26732 - DNA, 15 bp, Homo sapiens
tgctatagatggaga

SEQ ID NO: 26733 - DNA, 15 bp, Homo sapiens
gtgctatagatggag

SEQ ID NO: 26734 - DNA, 15 bp, Homo sapiens
agtgctatagatgga

SEQ ID NO: 26735 - DNA, 15 bp, Homo sapiens
aagtgctatagatgg

SEQ ID NO: 26736 - DNA, 15 bp, Homo sapiens
caagtgctatagatg

SEQ ID NO: 26737 - DNA, 15 bp, Homo sapiens
gcaagtgctatagat

SEQ ID NO: 26738 - DNA, 15 bp, Homo sapiens
ggcaagtgctataga

SEQ ID NO: 26739 - DNA, 15 bp, Homo sapiens
aggcaagtgctatag

SEQ ID NO: 26740 - DNA, 15 bp, Homo sapiens
aaggcaagtgctata

SEQ ID NO: 26741 - DNA, 15 bp, Homo sapiens
caaggcaagtgctat

SEQ ID NO: 26742 - DNA, 15 bp, Homo sapiens
gcaaggcaagtgcta

SEQ ID NO: 26743 - DNA, 15 bp, Homo sapiens
ggcaaggcaagtgct

SEQ ID NO: 26744 - DNA, 15 bp, Homo sapiens
aggcaaggcaagtgc

SEQ ID NO: 26745 - DNA, 15 bp, Homo sapiens
caggcaaggcaagtg

SEQ ID NO: 26746 - DNA, 15 bp, Homo sapiens
ccaggcaaggcaagt

SEQ ID NO: 26747 - DNA, 15 bp, Homo sapiens
gccaggcaaggcaag

SEQ ID NO: 26748 - DNA, 15 bp, Homo sapiens
ggccaggcaaggcaa

SEQ ID NO: 26749 - DNA, 15 bp, Homo sapiens
aggccaggcaaggca

SEQ ID NO: 26750 - DNA, 15 bp, Homo sapiens
caggccaggcaaggc

SEQ ID NO: 26751 - DNA, 15 bp, Homo sapiens
ccaggccaggcaagg

SEQ ID NO: 26752 - DNA, 15 bp, Homo sapiens
cccaggccaggcaag

SEQ ID NO: 26753 - DNA, 15 bp, Homo sapiens
tcccaggccaggcaa

SEQ ID NO: 26754 - DNA, 15 bp, Homo sapiens
ttcccaggccaggca

SEQ ID NO: 26755 - DNA, 15 bp, Homo sapiens
gttcccaggccaggc

SEQ ID NO: 26756 - DNA, 15 bp, Homo sapiens
ggttcccaggccagg

SEQ ID NO: 26757 - DNA, 15 bp, Homo sapiens
cggttcccaggccag

SEQ ID NO: 26758 - DNA, 15 bp, Homo sapiens
ccggttcccaggcca

SEQ ID NO: 26759 - DNA, 15 bp, Homo sapiens
gccggttcccaggcc

SEQ ID NO: 26760 - DNA, 15 bp, Homo sapiens
agccggttcccaggc

SEQ ID NO: 26761 - DNA, 15 bp, Homo sapiens
gagccggttcccagg

SEQ ID NO: 26762 - DNA, 15 bp, Homo sapiens
agagccggttcccag

SEQ ID NO: 26763 - DNA, 15 bp, Homo sapiens
aagagccggttccca

SEQ ID NO: 26764 - DNA, 15 bp, Homo sapiens
aaagagccggttccc

SEQ ID NO: 26765 - DNA, 15 bp, Homo sapiens
gaaagagccggttcc

SEQ ID NO: 26766 - DNA, 15 bp, Homo sapiens
tgaaagagccggttc

SEQ ID NO: 26767 - DNA, 15 bp, Homo sapiens
gtgaaagagccggtt

SEQ ID NO: 26768 - DNA, 15 bp, Homo sapiens
agtgaaagagccggt

SEQ ID NO: 26769 - DNA, 15 bp, Homo sapiens
cagtgaaagagccgg

SEQ ID NO: 26770 - DNA, 15 bp, Homo sapiens
gcagtgaaagagccg

SEQ ID NO: 26771 - DNA, 15 bp, Homo sapiens
agcagtgaaagagcc

SEQ ID NO: 26772 - DNA, 15 bp, Homo sapiens
cagcagtgaaagagc

SEQ ID NO: 26773 - DNA, 15 bp, Homo sapiens
acagcagtgaaagag

SEQ ID NO: 26774 - DNA, 15 bp, Homo sapiens
tacagcagtgaaaga

SEQ ID NO: 26775 - DNA, 15 bp, Homo sapiens
gtacagcagtgaaag

SEQ ID NO: 26776 - DNA, 15 bp, Homo sapiens
agtacagcagtgaaa

SEQ ID NO: 26777 - DNA, 15 bp, Homo sapiens
cagtacagcagtgaa

SEQ ID NO: 26778 - DNA, 15 bp, Homo sapiens
gcagtacagcagtga

SEQ ID NO: 26779 - DNA, 15 bp, Homo sapiens
tgcagtacagcagtg

SEQ ID NO: 26780 - DNA, 15 bp, Homo sapiens
atgcagtacagcagt

SEQ ID NO: 26781 - DNA, 15 bp, Homo sapiens
catgcagtacagcag

SEQ ID NO: 26782 - DNA, 15 bp, Homo sapiens
ccatgcagtacagca

SEQ ID NO: 26783 - DNA, 15 bp, Homo sapiens
tccatgcagtacagc

SEQ ID NO: 26784 - DNA, 15 bp, Homo sapiens
ttccatgcagtacag

SEQ ID NO: 26785 - DNA, 15 bp, Homo sapiens
gttccatgcagtaca

SEQ ID NO: 26786 - DNA, 15 bp, Homo sapiens
tgttccatgcagtac

SEQ ID NO: 26787 - DNA, 15 bp, Homo sapiens
ctgttccatgcagta

SEQ ID NO: 26788 - DNA, 15 bp, Homo sapiens
tctgttccatgcagt

SEQ ID NO: 26789 - DNA, 15 bp, Homo sapiens
ctctgttccatgcag

SEQ ID NO: 26790 - DNA, 15 bp, Homo sapiens
actctgttccatgca

SEQ ID NO: 26791 - DNA, 15 bp, Homo sapiens
tactctgttccatgc

SEQ ID NO: 26792 - DNA, 15 bp, Homo sapiens
ctactctgttccatg

SEQ ID NO: 26793 - DNA, 15 bp, Homo sapiens
cctactctgttccat

SEQ ID NO: 26794 - DNA, 15 bp, Homo sapiens
gcctactctgttcca

SEQ ID NO: 26795 - DNA, 15 bp, Homo sapiens
tgcctactctgttcc

SEQ ID NO: 26796 - DNA, 15 bp, Homo sapiens
gtgcctactctgttc

SEQ ID NO: 26797 - DNA, 15 bp, Homo sapiens
agtgcctactctgtt

SEQ ID NO: 26798 - DNA, 15 bp, Homo sapiens
cagtgcctactctgt

SEQ ID NO: 26799 - DNA, 15 bp, Homo sapiens
gcagtgcctactctg

SEQ ID NO: 26800 - DNA, 15 bp, Homo sapiens
agcagtgcctactct

SEQ ID NO: 26801 - DNA, 15 bp, Homo sapiens
aagcagtgcctactc

SEQ ID NO: 26802 - DNA, 15 bp, Homo sapiens
taagcagtgcctact

SEQ ID NO: 26803 - DNA, 15 bp, Homo sapiens
ttaagcagtgcctac

SEQ ID NO: 26804 - DNA, 15 bp, Homo sapiens
tttaagcagtgccta

SEQ ID NO: 26805 - DNA, 15 bp, Homo sapiens
gtttaagcagtgcct

SEQ ID NO: 26806 - DNA, 15 bp, Homo sapiens
ggtttaagcagtgcc

SEQ ID NO: 26807 - DNA, 15 bp, Homo sapiens
aggtttaagcagtgc

SEQ ID NO: 26808 - DNA, 15 bp, Homo sapiens
taggtttaagcagtg

SEQ ID NO: 26809 - DNA, 15 bp, Homo sapiens
ataggtttaagcagt

SEQ ID NO: 26810 - DNA, 15 bp, Homo sapiens
gataggtttaagcag

SEQ ID NO: 26811 - DNA, 15 bp, Homo sapiens
tgataggtttaagca

SEQ ID NO: 26812 - DNA, 15 bp, Homo sapiens
ctgataggtttaagc

SEQ ID NO: 26813 - DNA, 15 bp, Homo sapiens
gctgataggtttaag

SEQ ID NO: 26814 - DNA, 15 bp, Homo sapiens
agctgataggtttaa

SEQ ID NO: 26815 - DNA, 15 bp, Homo sapiens
cagctgataggttta

SEQ ID NO: 26816 - DNA, 15 bp, Homo sapiens
gcagctgataggttt

SEQ ID NO: 26817 - DNA, 15 bp, Homo sapiens
ggcagctgataggtt

SEQ ID NO: 26818 - DNA, 15 bp, Homo sapiens
aggcagctgataggt

SEQ ID NO: 26819 - DNA, 15 bp, Homo sapiens
caggcagctgatagg

SEQ ID NO: 26820 - DNA, 15 bp, Homo sapiens
ccaggcagctgatag

SEQ ID NO: 26821 - DNA, 15 bp, Homo sapiens
gccaggcagctgata

SEQ ID NO: 26822 - DNA, 15 bp, Homo sapiens
agccaggcagctgat

SEQ ID NO: 26823 - DNA, 15 bp, Homo sapiens
gagccaggcagctga

SEQ ID NO: 26824 - DNA, 15 bp, Homo sapiens
agagccaggcagctg

SEQ ID NO: 26825 - DNA, 15 bp, Homo sapiens
gagagccaggcagct

SEQ ID NO: 26826 - DNA, 15 bp, Homo sapiens
agagagccaggcagc

SEQ ID NO: 26827 - DNA, 15 bp, Homo sapiens
gagagagccaggcag

SEQ ID NO: 26828 - DNA, 15 bp, Homo sapiens
tgagagagccaggca

SEQ ID NO: 26829 - DNA, 15 bp, Homo sapiens
ttgagagagccaggc

SEQ ID NO: 26830 - DNA, 15 bp, Homo sapiens
tttgagagagccagg

SEQ ID NO: 26831 - DNA, 15 bp, Homo sapiens
atttgagagagccag

SEQ ID NO: 26832 - DNA, 15 bp, Homo sapiens
catttgagagagcca

SEQ ID NO: 26833 - DNA, 15 bp, Homo sapiens
gcatttgagagagcc

SEQ ID NO: 26834 - DNA, 15 bp, Homo sapiens
agcatttgagagagc

SEQ ID NO: 26835 - DNA, 15 bp, Homo sapiens
gagcatttgagagag

SEQ ID NO: 26836 - DNA, 15 bp, Homo sapiens
agagcatttgagaga

SEQ ID NO: 26837 - DNA, 15 bp, Homo sapiens
aagagcatttgagag

SEQ ID NO: 26838 - DNA, 15 bp, Homo sapiens
aaagagcatttgaga

SEQ ID NO: 26839 - DNA, 15 bp, Homo sapiens
gaaagagcatttgag

SEQ ID NO: 26840 - DNA, 15 bp, Homo sapiens
ggaaagagcatttga

SEQ ID NO: 26841 - DNA, 15 bp, Homo sapiens
tggaaagagcatttg

SEQ ID NO: 26842 - DNA, 15 bp, Homo sapiens
ctggaaagagcattt

SEQ ID NO: 26843 - DNA, 15 bp, Homo sapiens
cctggaaagagcatt

SEQ ID NO: 26844 - DNA, 15 bp, Homo sapiens
tcctggaaagagcat

SEQ ID NO: 26845 - DNA, 15 bp, Homo sapiens
ttcctggaaagagca

SEQ ID NO: 26846 - DNA, 15 bp, Homo sapiens
gttcctggaaagagc

SEQ ID NO: 26847 - DNA, 15 bp, Homo sapiens
agttcctggaaagag

SEQ ID NO: 26848 - DNA, 15 bp, Homo sapiens
gagttcctggaaaga

SEQ ID NO: 26849 - DNA, 15 bp, Homo sapiens
agagttcctggaaag

SEQ ID NO: 26850 - DNA, 15 bp, Homo sapiens
cagagttcctggaaa

SEQ ID NO: 26851 - DNA, 15 bp, Homo sapiens
ccagagttcctggaa

SEQ ID NO: 26852 - DNA, 15 bp, Homo sapiens
gccagagttcctgga

SEQ ID NO: 26853 - DNA, 15 bp, Homo sapiens
tgccagagttcctgg

SEQ ID NO: 26854 - DNA, 15 bp, Homo sapiens
gtgccagagttcctg

SEQ ID NO: 26855 - DNA, 15 bp, Homo sapiens
agtgccagagttcct

SEQ ID NO: 26856 - DNA, 15 bp, Homo sapiens
cagtgccagagttcc

SEQ ID NO: 26857 - DNA, 15 bp, Homo sapiens
acagtgccagagttc

SEQ ID NO: 26858 - DNA, 15 bp, Homo sapiens
cacagtgccagagtt

SEQ ID NO: 26859 - DNA, 15 bp, Homo sapiens
tcacagtgccagagt

SEQ ID NO: 26860 - DNA, 15 bp, Homo sapiens
ttcacagtgccagag

SEQ ID NO: 26861 - DNA, 15 bp, Homo sapiens
gttcacagtgccaga

SEQ ID NO: 26862 - DNA, 15 bp, Homo sapiens
ggttcacagtgccag

SEQ ID NO: 26863 - DNA, 15 bp, Homo sapiens
gggttcacagtgcca

SEQ ID NO: 26864 - DNA, 15 bp, Homo sapiens
tgggttcacagtgcc

SEQ ID NO: 26865 - DNA, 15 bp, Homo sapiens
gtgggttcacagtgc

SEQ ID NO: 26866 - DNA, 15 bp, Homo sapiens
agtgggttcacagtg

SEQ ID NO: 26867 - DNA, 15 bp, Homo sapiens
cagtgggttcacagt

SEQ ID NO: 26868 - DNA, 15 bp, Homo sapiens
gcagtgggttcacag

SEQ ID NO: 26869 - DNA, 15 bp, Homo sapiens
agcagtgggttcaca

SEQ ID NO: 26870 - DNA, 15 bp, Homo sapiens
cagcagtgggttcac

SEQ ID NO: 26871 - DNA, 15 bp, Homo sapiens
tcagcagtgggttca

SEQ ID NO: 26872 - DNA, 15 bp, Homo sapiens
ttcagcagtgggttc

SEQ ID NO: 26873 - DNA, 15 bp, Homo sapiens
attcagcagtgggtt

SEQ ID NO: 26874 - DNA, 15 bp, Homo sapiens
gattcagcagtgggt

SEQ ID NO: 26875 - DNA, 15 bp, Homo sapiens
agattcagcagtggg

SEQ ID NO: 26876 - DNA, 15 bp, Homo sapiens
gagattcagcagtgg

SEQ ID NO: 26877 - DNA, 15 bp, Homo sapiens
cgagattcagcagtg

SEQ ID NO: 26878 - DNA, 15 bp, Homo sapiens
acgagattcagcagt

SEQ ID NO: 26879 - DNA, 15 bp, Homo sapiens
cacgagattcagcag

SEQ ID NO: 26880 - DNA, 15 bp, Homo sapiens
ccacgagattcagca

SEQ ID NO: 26881 - DNA, 15 bp, Homo sapiens
gccacgagattcagc

SEQ ID NO: 26882 - DNA, 15 bp, Homo sapiens
agccacgagattcag

SEQ ID NO: 26883 - DNA, 15 bp, Homo sapiens
gagccacgagattca

SEQ ID NO: 26884 - DNA, 15 bp, Homo sapiens
tgagccacgagattc

SEQ ID NO: 26885 - DNA, 15 bp, Homo sapiens
atgagccacgagatt

SEQ ID NO: 26886 - DNA, 15 bp, Homo sapiens
tatgagccacgagat

SEQ ID NO: 26887 - DNA, 15 bp, Homo sapiens
ttatgagccacgaga

SEQ ID NO: 26888 - DNA, 15 bp, Homo sapiens
tttatgagccacgag

SEQ ID NO: 26889 - DNA, 15 bp, Homo sapiens
atttatgagccacga

SEQ ID NO: 26890 - DNA, 15 bp, Homo sapiens
tatttatgagccacg

SEQ ID NO: 26891 - DNA, 15 bp, Homo sapiens
ttatttatgagccac

SEQ ID NO: 26892 - DNA, 15 bp, Homo sapiens
tttatttatgagcca

SEQ ID NO: 26893 - DNA, 15 bp, Homo sapiens
gtttatttatgagcc

SEQ ID NO: 26894 - DNA, 15 bp, Homo sapiens
agtttatttatgagc

SEQ ID NO: 26895 - DNA, 15 bp, Homo sapiens
gagtttatttatgag

SEQ ID NO: 26896 - DNA, 15 bp, Homo sapiens
agagtttatttatga

SEQ ID NO: 26897 - DNA, 15 bp, Homo sapiens
gagagtttatttatg

SEQ ID NO: 26898 - DNA, 15 bp, Homo sapiens
tgagagtttatttat

SEQ ID NO: 26899 - DNA, 15 bp, Homo sapiens
ttgagagtttattta

SEQ ID NO: 26900 - DNA, 15 bp, Homo sapiens
cttgagagtttattt

SEQ ID NO: 26901 - DNA, 15 bp, Homo sapiens
acttgagagtttatt

SEQ ID NO: 26902 - DNA, 15 bp, Homo sapiens
cacttgagagtttat

SEQ ID NO: 26903 - DNA, 15 bp, Homo sapiens
tcacttgagagttta

SEQ ID NO: 26904 - DNA, 15 bp, Homo sapiens
atcacttgagagttt

SEQ ID NO: 26905 - DNA, 15 bp, Homo sapiens
tatcacttgagagtt

SEQ ID NO: 26906 - DNA, 15 bp, Homo sapiens
ttatcacttgagagt

SEQ ID NO: 26907 - DNA, 15 bp, Homo sapiens
attatcacttgagag

SEQ ID NO: 26908 - DNA, 15 bp, Homo sapiens
aattatcacttgaga

SEQ ID NO: 26909 - DNA, 15 bp, Homo sapiens
caattatcacttgag

SEQ ID NO: 26910 - DNA, 15 bp, Homo sapiens
acaattatcacttga

SEQ ID NO: 26911 - DNA, 15 bp, Homo sapiens
cacaattatcacttg

SEQ ID NO: 26912 - DNA, 15 bp, Homo sapiens
tcacaattatcactt

SEQ ID NO: 26913 - DNA, 15 bp, Homo sapiens
gtcacaattatcact

SEQ ID NO: 26914 - DNA, 15 bp, Homo sapiens
agtcacaattatcac

SEQ ID NO: 26915 - DNA, 15 bp, Homo sapiens
aagtcacaattatca

SEQ ID NO: 26916 - DNA, 15 bp, Homo sapiens
caagtcacaattatc

SEQ ID NO: 26917 - DNA, 15 bp, Homo sapiens
tcaagtcacaattat

SEQ ID NO: 26918 - DNA, 15 bp, Homo sapiens
ttcaagtcacaatta

SEQ ID NO: 26919 - DNA, 15 bp, Homo sapiens
attcaagtcacaatt

SEQ ID NO: 26920 - DNA, 15 bp, Homo sapiens
aattcaagtcacaat

SEQ ID NO: 26921 - DNA, 15 bp, Homo sapiens
gaattcaagtcacaa

SEQ ID NO: 26922 - DNA, 15 bp, Homo sapiens
agaattcaagtcaca

SEQ ID NO: 26923 - DNA, 15 bp, Homo sapiens
gagaattcaagtcac

SEQ ID NO: 26924 - DNA, 15 bp, Homo sapiens
agagaattcaagtca

SEQ ID NO: 26925 - DNA, 15 bp, Homo sapiens
tagagaattcaagtc

SEQ ID NO: 26926 - DNA, 15 bp, Homo sapiens
ctagagaattcaagt

SEQ ID NO: 26927 - DNA, 15 bp, Homo sapiens
actagagaattcaag

SEQ ID NO: 26928 - DNA, 15 bp, Homo sapiens
aactagagaattcaa

SEQ ID NO: 26929 - DNA, 15 bp, Homo sapiens
gaactagagaattca

SEQ ID NO: 26930 - DNA, 15 bp, Homo sapiens
agaactagagaattc

SEQ ID NO: 26931 - DNA, 15 bp, Homo sapiens
aagaactagagaatt

SEQ ID NO: 26932 - DNA, 15 bp, Homo sapiens
taagaactagagaat

SEQ ID NO: 26933 - DNA, 15 bp, Homo sapiens
gtaagaactagagaa

SEQ ID NO: 26934 - DNA, 15 bp, Homo sapiens
ggtaagaactagaga

SEQ ID NO: 26935 - DNA, 15 bp, Homo sapiens
aggtaagaactagag

SEQ ID NO: 26936 - DNA, 15 bp, Homo sapiens
caggtaagaactaga

SEQ ID NO: 26937 - DNA, 15 bp, Homo sapiens
tcaggtaagaactag

SEQ ID NO: 26938 - DNA, 15 bp, Homo sapiens
gtcaggtaagaacta

SEQ ID NO: 26939 - DNA, 15 bp, Homo sapiens
ggtcaggtaagaact

SEQ ID NO: 26940 - DNA, 15 bp, Homo sapiens
tggtcaggtaagaac

SEQ ID NO: 26941 - DNA, 15 bp, Homo sapiens
gtggtcaggtaagaa

SEQ ID NO: 26942 - DNA, 15 bp, Homo sapiens
ggtggtcaggtaaga

SEQ ID NO: 26943 - DNA, 15 bp, Homo sapiens
aggtggtcaggtaag

SEQ ID NO: 26944 - DNA, 15 bp, Homo sapiens
gaggtggtcaggtaa

SEQ ID NO: 26945 - DNA, 15 bp, Homo sapiens
agaggtggtcaggta

SEQ ID NO: 26946 - DNA, 15 bp, Homo sapiens
aagaggtggtcaggt

SEQ ID NO: 26947 - DNA, 15 bp, Homo sapiens
taagaggtggtcagg

SEQ ID NO: 26948 - DNA, 15 bp, Homo sapiens
ttaagaggtggtcag

SEQ ID NO: 26949 - DNA, 15 bp, Homo sapiens
attaagaggtggtca

SEQ ID NO: 26950 - DNA, 15 bp, Homo sapiens
tattaagaggtggtc

SEQ ID NO: 26951 - DNA, 15 bp, Homo sapiens
atattaagaggtggt

SEQ ID NO: 26952 - DNA, 15 bp, Homo sapiens
gatattaagaggtgg

SEQ ID NO: 26953 - DNA, 15 bp, Homo sapiens
tgatattaagaggtg

SEQ ID NO: 26954 - DNA, 15 bp, Homo sapiens
atgatattaagaggt

SEQ ID NO: 26955 - DNA, 15 bp, Homo sapiens
gatgatattaagagg

SEQ ID NO: 26956 - DNA, 15 bp, Homo sapiens
ggatgatattaagag

SEQ ID NO: 26957 - DNA, 15 bp, Homo sapiens
aggatgatattaaga

SEQ ID NO: 26958 - DNA, 15 bp, Homo sapiens
caggatgatattaag

SEQ ID NO: 26959 - DNA, 15 bp, Homo sapiens
ccaggatgatattaa

SEQ ID NO: 26960 - DNA, 15 bp, Homo sapiens
tccaggatgatatta

SEQ ID NO: 26961 - DNA, 15 bp, Homo sapiens
ttccaggatgatatt

SEQ ID NO: 26962 - DNA, 15 bp, Homo sapiens
gttccaggatgatat

SEQ ID NO: 26963 - DNA, 15 bp, Homo sapiens
agttccaggatgata

SEQ ID NO: 26964 - DNA, 15 bp, Homo sapiens
cagttccaggatgat

SEQ ID NO: 26965 - DNA, 15 bp, Homo sapiens
acagttccaggatga

SEQ ID NO: 26966 - DNA, 15 bp, Homo sapiens
gacagttccaggatg

SEQ ID NO: 26967 - DNA, 15 bp, Homo sapiens
agacagttccaggat

SEQ ID NO: 26968 - DNA, 15 bp, Homo sapiens
aagacagttccagga

SEQ ID NO: 26969 - DNA, 15 bp, Homo sapiens
aaagacagttccagg

SEQ ID NO: 26970 - DNA, 15 bp, Homo sapiens
taaagacagttccag

SEQ ID NO: 26971 - DNA, 15 bp, Homo sapiens
ataaagacagttcca

SEQ ID NO: 26972 - DNA, 15 bp, Homo sapiens
tataaagacagttcc

SEQ ID NO: 26973 - DNA, 15 bp, Homo sapiens
atataaagacagttc

SEQ ID NO: 26974 - DNA, 15 bp, Homo sapiens
gatataaagacagtt

SEQ ID NO: 26975 - DNA, 15 bp, Homo sapiens
tgatataaagacagt

SEQ ID NO: 26976 - DNA, 15 bp, Homo sapiens
atgatataaagacag

SEQ ID NO: 26977 - DNA, 15 bp, Homo sapiens
gatgatataaagaca

SEQ ID NO: 26978 - DNA, 15 bp, Homo sapiens
agatgatataaagac

SEQ ID NO: 26979 - DNA, 15 bp, Homo sapiens
aagatgatataaaga

SEQ ID NO: 26980 - DNA, 15 bp, Homo sapiens
caagatgatataaag

SEQ ID NO: 26981 - DNA, 15 bp, Homo sapiens
ccaagatgatataaa

SEQ ID NO: 26982 - DNA, 15 bp, Homo sapiens
tccaagatgatataa

SEQ ID NO: 26983 - DNA, 15 bp, Homo sapiens
ttccaagatgatata

SEQ ID NO: 26984 - DNA, 15 bp, Homo sapiens
tttccaagatgatat

SEQ ID NO: 26985 - DNA, 15 bp, Homo sapiens
gtttccaagatgata

SEQ ID NO: 26986 - DNA, 15 bp, Homo sapiens
ggtttccaagatgat

SEQ ID NO: 26987 - DNA, 15 bp, Homo sapiens
gggtttccaagatga

SEQ ID NO: 26988 - DNA, 15 bp, Homo sapiens
agggtttccaagatg

SEQ ID NO: 26989 - DNA, 15 bp, Homo sapiens
cagggtttccaagat

SEQ ID NO: 26990 - DNA, 15 bp, Homo sapiens
ccagggtttccaaga

SEQ ID NO: 26991 - DNA, 15 bp, Homo sapiens
tccagggtttccaag

SEQ ID NO: 26992 - DNA, 15 bp, Homo sapiens
ctccagggtttccaa

SEQ ID NO: 26993 - DNA, 15 bp, Homo sapiens
gctccagggtttcca

SEQ ID NO: 26994 - DNA, 15 bp, Homo sapiens
agctccagggtttcc

SEQ ID NO: 26995 - DNA, 15 bp, Homo sapiens
cagctccagggtttc

SEQ ID NO: 26996 - DNA, 15 bp, Homo sapiens
tcagctccagggttt

SEQ ID NO: 26997 - DNA, 15 bp, Homo sapiens
atcagctccagggtt

SEQ ID NO: 26998 - DNA, 15 bp, Homo sapiens
aatcagctccagggt

SEQ ID NO: 26999 - DNA, 15 bp, Homo sapiens
aaatcagctccaggg

SEQ ID NO: 27000 - DNA, 15 bp, Homo sapiens
caaatcagctccagg

SEQ ID NO: 27001 - DNA, 15 bp, Homo sapiens
tcaaatcagctccag

SEQ ID NO: 27002 - DNA, 15 bp, Homo sapiens
ttcaaatcagctcca

SEQ ID NO: 27003 - DNA, 15 bp, Homo sapiens
tttcaaatcagctcc

SEQ ID NO: 27004 - DNA, 15 bp, Homo sapiens
atttcaaatcagctc

SEQ ID NO: 27005 - DNA, 15 bp, Homo sapiens
tatttcaaatcagct

SEQ ID NO: 27006 - DNA, 15 bp, Homo sapiens
gtatttcaaatcagc

SEQ ID NO: 27007 - DNA, 15 bp, Homo sapiens
ggtatttcaaatcag

SEQ ID NO: 27008 - DNA, 15 bp, Homo sapiens
aggtatttcaaatca

SEQ ID NO: 27009 - DNA, 15 bp, Homo sapiens
gaggtatttcaaatc

SEQ ID NO: 27010 - DNA, 15 bp, Homo sapiens
agaggtatttcaaat

SEQ ID NO: 27011 - DNA, 15 bp, Homo sapiens
cagaggtatttcaaa

SEQ ID NO: 27012 - DNA, 15 bp, Homo sapiens
ccagaggtatttcaa

SEQ ID NO: 27013 - DNA, 15 bp, Homo sapiens
accagaggtatttca

SEQ ID NO: 27014 - DNA, 15 bp, Homo sapiens
gaccagaggtatttc

SEQ ID NO: 27015 - DNA, 15 bp, Homo sapiens
tgaccagaggtattt

SEQ ID NO: 27016 - DNA, 15 bp, Homo sapiens
ctgaccagaggtatt

SEQ ID NO: 27017 - DNA, 15 bp, Homo sapiens
actgaccagaggtat

SEQ ID NO: 27018 - DNA, 15 bp, Homo sapiens
aactgaccagaggta

SEQ ID NO: 27019 - DNA, 15 bp, Homo sapiens
gaactgaccagaggt

SEQ ID NO: 27020 - DNA, 15 bp, Homo sapiens
ggaactgaccagagg

SEQ ID NO: 27021 - DNA, 15 bp, Homo sapiens
aggaactgaccagag

SEQ ID NO: 27022 - DNA, 15 bp, Homo sapiens
gaggaactgaccaga

SEQ ID NO: 27023 - DNA, 15 bp, Homo sapiens
tgaggaactgaccag

SEQ ID NO: 27024 - DNA, 15 bp, Homo sapiens
ctgaggaactgacca

SEQ ID NO: 27025 - DNA, 15 bp, Homo sapiens
gctgaggaactgacc

SEQ ID NO: 27026 - DNA, 15 bp, Homo sapiens
tgctgaggaactgac

SEQ ID NO: 27027 - DNA, 15 bp, Homo sapiens
atgctgaggaactga

SEQ ID NO: 27028 - DNA, 15 bp, Homo sapiens
gatgctgaggaactg

SEQ ID NO: 27029 - DNA, 15 bp, Homo sapiens
tgatgctgaggaact

SEQ ID NO: 27030 - DNA, 15 bp, Homo sapiens
ctgatgctgaggaac

SEQ ID NO: 27031 - DNA, 15 bp, Homo sapiens
actgatgctgaggaa

SEQ ID NO: 27032 - DNA, 15 bp, Homo sapiens
aactgatgctgagga

SEQ ID NO: 27033 - DNA, 15 bp, Homo sapiens
gaactgatgctgagg

SEQ ID NO: 27034 - DNA, 15 bp, Homo sapiens
agaactgatgctgag

SEQ ID NO: 27035 - DNA, 15 bp, Homo sapiens
cagaactgatgctga

SEQ ID NO: 27036 - DNA, 15 bp, Homo sapiens
acagaactgatgctg

SEQ ID NO: 27037 - DNA, 15 bp, Homo sapiens
gacagaactgatgct

SEQ ID NO: 27038 - DNA, 15 bp, Homo sapiens
agacagaactgatgc

SEQ ID NO: 27039 - DNA, 15 bp, Homo sapiens
tagacagaactgatg

SEQ ID NO: 27040 - DNA, 15 bp, Homo sapiens
ttagacagaactgat

SEQ ID NO: 27041 - DNA, 15 bp, Homo sapiens
attagacagaactga

SEQ ID NO: 27042 - DNA, 15 bp, Homo sapiens
cattagacagaactg

SEQ ID NO: 27043 - DNA, 15 bp, Homo sapiens
tcattagacagaact

SEQ ID NO: 27044 - DNA, 15 bp, Homo sapiens
ttcattagacagaac

SEQ ID NO: 27045 - DNA, 15 bp, Homo sapiens
gttcattagacagaa

SEQ ID NO: 27046 - DNA, 15 bp, Homo sapiens
tgttcattagacaga

SEQ ID NO: 27047 - DNA, 15 bp, Homo sapiens
gtgttcattagacag

SEQ ID NO: 27048 - DNA, 15 bp, Homo sapiens
ggtgttcattagaca

SEQ ID NO: 27049 - DNA, 15 bp, Homo sapiens
aggtgttcattagac

SEQ ID NO: 27050 - DNA, 15 bp, Homo sapiens
taggtgttcattaga

SEQ ID NO: 27051 - DNA, 15 bp, Homo sapiens
ataggtgttcattag

SEQ ID NO: 27052 - DNA, 15 bp, Homo sapiens
tataggtgttcatta

SEQ ID NO: 27053 - DNA, 15 bp, Homo sapiens
atataggtgttcatt

SEQ ID NO: 27054 - DNA, 15 bp, Homo sapiens
aatataggtgttcat

SEQ ID NO: 27055 - DNA, 15 bp, Homo sapiens
gaatataggtgttca

SEQ ID NO: 27056 - DNA, 15 bp, Homo sapiens
agaatataggtgttc

SEQ ID NO: 27057 - DNA, 15 bp, Homo sapiens
aagaatataggtgtt

SEQ ID NO: 27058 - DNA, 15 bp, Homo sapiens
gaagaatataggtgt

SEQ ID NO: 27059 - DNA, 15 bp, Homo sapiens
tgaagaatataggtg

SEQ ID NO: 27060 - DNA, 15 bp, Homo sapiens
atgaagaatataggt

SEQ ID NO: 27061 - DNA, 15 bp, Homo sapiens
aatgaagaatatagg

SEQ ID NO: 27062 - DNA, 15 bp, Homo sapiens
caatgaagaatatag

SEQ ID NO: 27063 - DNA, 15 bp, Homo sapiens
acaatgaagaatata

SEQ ID NO: 27064 - DNA, 15 bp, Homo sapiens
gacaatgaagaatat

SEQ ID NO: 27065 - DNA, 15 bp, Homo sapiens
agacaatgaagaata

SEQ ID NO: 27066 - DNA, 15 bp, Homo sapiens
gagacaatgaagaat

SEQ ID NO: 27067 - DNA, 15 bp, Homo sapiens
ggagacaatgaagaa

SEQ ID NO: 27068 - DNA, 15 bp, Homo sapiens
aggagacaatgaaga

SEQ ID NO: 27069 - DNA, 15 bp, Homo sapiens
gaggagacaatgaag

SEQ ID NO: 27070 - DNA, 15 bp, Homo sapiens
tgaggagacaatgaa

SEQ ID NO: 27071 - DNA, 15 bp, Homo sapiens
gtgaggagacaatga

SEQ ID NO: 27072 - DNA, 15 bp, Homo sapiens
agtgaggagacaatg

SEQ ID NO: 27073 - DNA, 15 bp, Homo sapiens
gagtgaggagacaat

SEQ ID NO: 27074 - DNA, 15 bp, Homo sapiens
agagtgaggagacaa

SEQ ID NO: 27075 - DNA, 15 bp, Homo sapiens
aagagtgaggagaca

SEQ ID NO: 27076 - DNA, 15 bp, Homo sapiens
caagagtgaggagac

SEQ ID NO: 27077 - DNA, 15 bp, Homo sapiens
ccaagagtgaggaga

SEQ ID NO: 27078 - DNA, 15 bp, Homo sapiens
gccaagagtgaggag

SEQ ID NO: 27079 - DNA, 15 bp, Homo sapiens
agccaagagtgagga

SEQ ID NO: 27080 - DNA, 15 bp, Homo sapiens
gagccaagagtgagg

SEQ ID NO: 27081 - DNA, 15 bp, Homo sapiens
agagccaagagtgag

SEQ ID NO: 27082 - DNA, 15 bp, Homo sapiens
tagagccaagagtga

SEQ ID NO: 27083 - DNA, 15 bp, Homo sapiens
ttagagccaagagtg

SEQ ID NO: 27084 - DNA, 15 bp, Homo sapiens
cttagagccaagagt

SEQ ID NO: 27085 - DNA, 15 bp, Homo sapiens
acttagagccaagag

SEQ ID NO: 27086 - DNA, 15 bp, Homo sapiens
aacttagagccaaga

SEQ ID NO: 27087 - DNA, 15 bp, Homo sapiens
caacttagagccaag

SEQ ID NO: 27088 - DNA, 15 bp, Homo sapiens
acaacttagagccaa

SEQ ID NO: 27089 - DNA, 15 bp, Homo sapiens
gacaacttagagcca

SEQ ID NO: 27090 - DNA, 15 bp, Homo sapiens
tgacaacttagagcc

SEQ ID NO: 27091 - DNA, 15 bp, Homo sapiens
gtgacaacttagagc

SEQ ID NO: 27092 - DNA, 15 bp, Homo sapiens
tgtgacaacttagag

SEQ ID NO: 27093 - DNA, 15 bp, Homo sapiens
ttgtgacaacttaga

SEQ ID NO: 27094 - DNA, 15 bp, Homo sapiens
cttgtgacaacttag

SEQ ID NO: 27095 - DNA, 15 bp, Homo sapiens
acttgtgacaactta

SEQ ID NO: 27096 - DNA, 15 bp, Homo sapiens
tacttgtgacaactt

SEQ ID NO: 27097 - DNA, 15 bp, Homo sapiens
ctacttgtgacaact

SEQ ID NO: 27098 - DNA, 15 bp, Homo sapiens
tctacttgtgacaac

SEQ ID NO: 27099 - DNA, 15 bp, Homo sapiens
atctacttgtgacaa

SEQ ID NO: 27100 - DNA, 15 bp, Homo sapiens
catctacttgtgaca

SEQ ID NO: 27101 - DNA, 15 bp, Homo sapiens
tcatctacttgtgac

SEQ ID NO: 27102 - DNA, 15 bp, Homo sapiens
atcatctacttgtga

SEQ ID NO: 27103 - DNA, 15 bp, Homo sapiens
aatcatctacttgtg

SEQ ID NO: 27104 - DNA, 15 bp, Homo sapiens
taatcatctacttgt

SEQ ID NO: 27105 - DNA, 15 bp, Homo sapiens
ataatcatctacttg

SEQ ID NO: 27106 - DNA, 15 bp, Homo sapiens
cataatcatctactt

SEQ ID NO: 27107 - DNA, 15 bp, Homo sapiens
acataatcatctact

SEQ ID NO: 27108 - DNA, 15 bp, Homo sapiens
gacataatcatctac

SEQ ID NO: 27109 - DNA, 15 bp, Homo sapiens
agacataatcatcta

SEQ ID NO: 27110 - DNA, 15 bp, Homo sapiens
gagacataatcatct

SEQ ID NO: 27111 - DNA, 15 bp, Homo sapiens
tgagacataatcatc

SEQ ID NO: 27112 - DNA, 15 bp, Homo sapiens
atgagacataatcat

SEQ ID NO: 27113 - DNA, 15 bp, Homo sapiens
aatgagacataatca

SEQ ID NO: 27114 - DNA, 15 bp, Homo sapiens
gaatgagacataatc

SEQ ID NO: 27115 - DNA, 15 bp, Homo sapiens
ggaatgagacataat

SEQ ID NO: 27116 - DNA, 15 bp, Homo sapiens
gggaatgagacataa

SEQ ID NO: 27117 - DNA, 15 bp, Homo sapiens
tgggaatgagacata

SEQ ID NO: 27118 - DNA, 15 bp, Homo sapiens
ttgggaatgagacat

SEQ ID NO: 27119 - DNA, 15 bp, Homo sapiens
cttgggaatgagaca

SEQ ID NO: 27120 - DNA, 15 bp, Homo sapiens
acttgggaatgagac

SEQ ID NO: 27121 - DNA, 15 bp, Homo sapiens
tacttgggaatgaga

SEQ ID NO: 27122 - DNA, 15 bp, Homo sapiens
ctacttgggaatgag

SEQ ID NO: 27123 - DNA, 15 bp, Homo sapiens
tctacttgggaatga

SEQ ID NO: 27124 - DNA, 15 bp, Homo sapiens
ctctacttgggaatg

SEQ ID NO: 27125 - DNA, 15 bp, Homo sapiens
tctctacttgggaat

SEQ ID NO: 27126 - DNA, 15 bp, Homo sapiens
atctctacttgggaa

SEQ ID NO: 27127 - DNA, 15 bp, Homo sapiens
tatctctacttggga

SEQ ID NO: 27128 - DNA, 15 bp, Homo sapiens
ctatctctacttggg

SEQ ID NO: 27129 - DNA, 15 bp, Homo sapiens
cctatctctacttgg

SEQ ID NO: 27130 - DNA, 15 bp, Homo sapiens
tcctatctctacttg

SEQ ID NO: 27131 - DNA, 15 bp, Homo sapiens
gtcctatctctactt

SEQ ID NO: 27132 - DNA, 15 bp, Homo sapiens
tgtcctatctctact

SEQ ID NO: 27133 - DNA, 15 bp, Homo sapiens
gtgtcctatctctac

SEQ ID NO: 27134 - DNA, 15 bp, Homo sapiens
tgtgtcctatctcta

SEQ ID NO: 27135 - DNA, 15 bp, Homo sapiens
atgtgtcctatctct

SEQ ID NO: 27136 - DNA, 15 bp, Homo sapiens
catgtgtcctatctc

SEQ ID NO: 27137 - DNA, 15 bp, Homo sapiens
tcatgtgtcctatct

SEQ ID NO: 27138 - DNA, 15 bp, Homo sapiens
ctcatgtgtcctatc

SEQ ID NO: 27139 - DNA, 15 bp, Homo sapiens
tctcatgtgtcctat

SEQ ID NO: 27140 - DNA, 15 bp, Homo sapiens
ctctcatgtgtccta

SEQ ID NO: 27141 - DNA, 15 bp, Homo sapiens
actctcatgtgtcct

SEQ ID NO: 27142 - DNA, 15 bp, Homo sapiens
cactctcatgtgtcc

SEQ ID NO: 27143 - DNA, 15 bp, Homo sapiens
ccactctcatgtgtc

SEQ ID NO: 27144 - DNA, 15 bp, Homo sapiens
cccactctcatgtgt

SEQ ID NO: 27145 - DNA, 15 bp, Homo sapiens
acccactctcatgtg

SEQ ID NO: 27146 - DNA, 15 bp, Homo sapiens
cacccactctcatgt

SEQ ID NO: 27147 - DNA, 15 bp, Homo sapiens
ccacccactctcatg

SEQ ID NO: 27148 - DNA, 15 bp, Homo sapiens
cccacccactctcat

SEQ ID NO: 27149 - DNA, 15 bp, Homo sapiens
acccacccactctca

SEQ ID NO: 27150 - DNA, 15 bp, Homo sapiens
cacccacccactctc

SEQ ID NO: 27151 - DNA, 15 bp, Homo sapiens
acacccacccactct

SEQ ID NO: 27152 - DNA, 15 bp, Homo sapiens
cacacccacccactc

SEQ ID NO: 27153 - DNA, 15 bp, Homo sapiens
gcacacccacccact

SEQ ID NO: 27154 - DNA, 15 bp, Homo sapiens
ggcacacccacccac

SEQ ID NO: 27155 - DNA, 15 bp, Homo sapiens
gggcacacccaccca

SEQ ID NO: 27156 - DNA, 15 bp, Homo sapiens
tgggcacacccaccc

SEQ ID NO: 27157 - DNA, 15 bp, Homo sapiens
atgggcacacccacc

SEQ ID NO: 27158 - DNA, 15 bp, Homo sapiens
tatgggcacacccac

SEQ ID NO: 27159 - DNA, 15 bp, Homo sapiens
ctatgggcacaccca

SEQ ID NO: 27160 - DNA, 15 bp, Homo sapiens
actatgggcacaccc

SEQ ID NO: 27161 - DNA, 15 bp, Homo sapiens
aactatgggcacacc

SEQ ID NO: 27162 - DNA, 15 bp, Homo sapiens
aaactatgggcacac

SEQ ID NO: 27163 - DNA, 15 bp, Homo sapiens
taaactatgggcaca

SEQ ID NO: 27164 - DNA, 15 bp, Homo sapiens
ctaaactatgggcac

SEQ ID NO: 27165 - DNA, 15 bp, Homo sapiens
tctaaactatgggca

SEQ ID NO: 27166 - DNA, 15 bp, Homo sapiens
gtctaaactatgggc

SEQ ID NO: 27167 - DNA, 15 bp, Homo sapiens
tgtctaaactatggg

SEQ ID NO: 27168 - DNA, 15 bp, Homo sapiens
ctgtctaaactatgg

SEQ ID NO: 27169 - DNA, 15 bp, Homo sapiens
cctgtctaaactatg

SEQ ID NO: 27170 - DNA, 15 bp, Homo sapiens
tcctgtctaaactat

SEQ ID NO: 27171 - DNA, 15 bp, Homo sapiens
gtcctgtctaaacta

SEQ ID NO: 27172 - DNA, 15 bp, Homo sapiens
agtcctgtctaaact

SEQ ID NO: 27173 - DNA, 15 bp, Homo sapiens
tagtcctgtctaaac

SEQ ID NO: 27174 - DNA, 15 bp, Homo sapiens
atagtcctgtctaaa

SEQ ID NO: 27175 - DNA, 15 bp, Homo sapiens
gatagtcctgtctaa

SEQ ID NO: 27176 - DNA, 15 bp, Homo sapiens
agatagtcctgtcta

SEQ ID NO: 27177 - DNA, 15 bp, Homo sapiens
aagatagtcctgtct

SEQ ID NO: 27178 - DNA, 15 bp, Homo sapiens
aaagatagtcctgtc

SEQ ID NO: 27179 - DNA, 15 bp, Homo sapiens
caaagatagtcctgt

SEQ ID NO: 27180 - DNA, 15 bp, Homo sapiens
acaaagatagtcctg

SEQ ID NO: 27181 - DNA, 15 bp, Homo sapiens
cacaaagatagtcct

SEQ ID NO: 27182 - DNA, 15 bp, Homo sapiens
acacaaagatagtcc

SEQ ID NO: 27183 - DNA, 15 bp, Homo sapiens
cacacaaagatagtc

SEQ ID NO: 27184 - DNA, 15 bp, Homo sapiens
ccacacaaagatagt

SEQ ID NO: 27185 - DNA, 15 bp, Homo sapiens
accacacaaagatag

SEQ ID NO: 27186 - DNA, 15 bp, Homo sapiens
taccacacaaagata

SEQ ID NO: 27187 - DNA, 15 bp, Homo sapiens
gtaccacacaaagat

SEQ ID NO: 27188 - DNA, 15 bp, Homo sapiens
ggtaccacacaaaga

SEQ ID NO: 27189 - DNA, 15 bp, Homo sapiens
tggtaccacacaaag

SEQ ID NO: 27190 - DNA, 15 bp, Homo sapiens
ctggtaccacacaaa

SEQ ID NO: 27191 - DNA, 15 bp, Homo sapiens
gctggtaccacacaa

SEQ ID NO: 27192 - DNA, 15 bp, Homo sapiens
agctggtaccacaca

SEQ ID NO: 27193 - DNA, 15 bp, Homo sapiens
cagctggtaccacac

SEQ ID NO: 27194 - DNA, 15 bp, Homo sapiens
gcagctggtaccaca

SEQ ID NO: 27195 - DNA, 15 bp, Homo sapiens
cgcagctggtaccac

SEQ ID NO: 27196 - DNA, 15 bp, Homo sapiens
ccgcagctggtacca

SEQ ID NO: 27197 - DNA, 15 bp, Homo sapiens
gccgcagctggtacc

SEQ ID NO: 27198 - DNA, 15 bp, Homo sapiens
tgccgcagctggtac

SEQ ID NO: 27199 - DNA, 15 bp, Homo sapiens
ctgccgcagctggta

SEQ ID NO: 27200 - DNA, 15 bp, Homo sapiens
cctgccgcagctggt

SEQ ID NO: 27201 - DNA, 15 bp, Homo sapiens
tcctgccgcagctgg

SEQ ID NO: 27202 - DNA, 15 bp, Homo sapiens
atcctgccgcagctg

SEQ ID NO: 27203 - DNA, 15 bp, Homo sapiens
gatcctgccgcagct

SEQ ID NO: 27204 - DNA, 15 bp, Homo sapiens
agatcctgccgcagc

SEQ ID NO: 27205 - DNA, 15 bp, Homo sapiens
tagatcctgccgcag

SEQ ID NO: 27206 - DNA, 15 bp, Homo sapiens
gtagatcctgccgca

SEQ ID NO: 27207 - DNA, 15 bp, Homo sapiens
tgtagatcctgccgc

SEQ ID NO: 27208 - DNA, 15 bp, Homo sapiens
ctgtagatcctgccg

SEQ ID NO: 27209 - DNA, 15 bp, Homo sapiens
tctgtagatcctgcc

SEQ ID NO: 27210 - DNA, 15 bp, Homo sapiens
atctgtagatcctgc

SEQ ID NO: 27211 - DNA, 15 bp, Homo sapiens
catctgtagatcctg

SEQ ID NO: 27212 - DNA, 15 bp, Homo sapiens
tcatctgtagatcct

SEQ ID NO: 27213 - DNA, 15 bp, Homo sapiens
gtcatctgtagatcc

SEQ ID NO: 27214 - DNA, 15 bp, Homo sapiens
agtcatctgtagatc

SEQ ID NO: 27215 - DNA, 15 bp, Homo sapiens
gagtcatctgtagat

SEQ ID NO: 27216 - DNA, 15 bp, Homo sapiens
tgagtcatctgtaga

SEQ ID NO: 27217 - DNA, 15 bp, Homo sapiens
gtgagtcatctgtag

SEQ ID NO: 27218 - DNA, 15 bp, Homo sapiens
tgtgagtcatctgta

SEQ ID NO: 27219 - DNA, 15 bp, Homo sapiens
gtgtgagtcatctgt

SEQ ID NO: 27220 - DNA, 15 bp, Homo sapiens
tgtgtgagtcatctg

SEQ ID NO: 27221 - DNA, 15 bp, Homo sapiens
atgtgtgagtcatct

SEQ ID NO: 27222 - DNA, 15 bp, Homo sapiens
catgtgtgagtcatc

SEQ ID NO: 27223 - DNA, 15 bp, Homo sapiens
acatgtgtgagtcat

SEQ ID NO: 27224 - DNA, 15 bp, Homo sapiens
aacatgtgtgagtca

SEQ ID NO: 27225 - DNA, 15 bp, Homo sapiens
taacatgtgtgagtc

SEQ ID NO: 27226 - DNA, 15 bp, Homo sapiens
ttaacatgtgtgagt

SEQ ID NO: 27227 - DNA, 15 bp, Homo sapiens
attaacatgtgtgag

SEQ ID NO: 27228 - DNA, 15 bp, Homo sapiens
tattaacatgtgtga

SEQ ID NO: 27229 - DNA, 15 bp, Homo sapiens
gtattaacatgtgtg

SEQ ID NO: 27230 - DNA, 15 bp, Homo sapiens
ggtattaacatgtgt

SEQ ID NO: 27231 - DNA, 15 bp, Homo sapiens
gggtattaacatgtg

SEQ ID NO: 27232 - DNA, 15 bp, Homo sapiens
tgggtattaacatgt

SEQ ID NO: 27233 - DNA, 15 bp, Homo sapiens
gtgggtattaacatg

SEQ ID NO: 27234 - DNA, 15 bp, Homo sapiens
tgtgggtattaacat

SEQ ID NO: 27235 - DNA, 15 bp, Homo sapiens
atgtgggtattaaca

SEQ ID NO: 27236 - DNA, 15 bp, Homo sapiens
gatgtgggtattaac

SEQ ID NO: 27237 - DNA, 15 bp, Homo sapiens
agatgtgggtattaa

SEQ ID NO: 27238 - DNA, 15 bp, Homo sapiens
aagatgtgggtatta

SEQ ID NO: 27239 - DNA, 15 bp, Homo sapiens
gaagatgtgggtatt

SEQ ID NO: 27240 - DNA, 15 bp, Homo sapiens
agaagatgtgggtat

SEQ ID NO: 27241 - DNA, 15 bp, Homo sapiens
cagaagatgtgggta

SEQ ID NO: 27242 - DNA, 15 bp, Homo sapiens
tcagaagatgtgggt

SEQ ID NO: 27243 - DNA, 15 bp, Homo sapiens
ctcagaagatgtggg

SEQ ID NO: 27244 - DNA, 15 bp, Homo sapiens
actcagaagatgtgg

SEQ ID NO: 27245 - DNA, 15 bp, Homo sapiens
cactcagaagatgtg

SEQ ID NO: 27246 - DNA, 15 bp, Homo sapiens
ccactcagaagatgt

SEQ ID NO: 27247 - DNA, 15 bp, Homo sapiens
gccactcagaagatg

SEQ ID NO: 27248 - DNA, 15 bp, Homo sapiens
ggccactcagaagat

SEQ ID NO: 27249 - DNA, 15 bp, Homo sapiens
tggccactcagaaga

SEQ ID NO: 27250 - DNA, 15 bp, Homo sapiens
ttggccactcagaag

SEQ ID NO: 27251 - DNA, 15 bp, Homo sapiens
gttggccactcagaa

SEQ ID NO: 27252 - DNA, 15 bp, Homo sapiens
tgttggccactcaga

SEQ ID NO: 27253 - DNA, 15 bp, Homo sapiens
atgttggccactcag

SEQ ID NO: 27254 - DNA, 15 bp, Homo sapiens
gatgttggccactca

SEQ ID NO: 27255 - DNA, 15 bp, Homo sapiens
ggatgttggccactc

SEQ ID NO: 27256 - DNA, 15 bp, Homo sapiens
aggatgttggccact

SEQ ID NO: 27257 - DNA, 15 bp, Homo sapiens
gaggatgttggccac

SEQ ID NO: 27258 - DNA, 15 bp, Homo sapiens
tgaggatgttggcca

SEQ ID NO: 27259 - DNA, 15 bp, Homo sapiens
ctgaggatgttggcc

SEQ ID NO: 27260 - DNA, 15 bp, Homo sapiens
tctgaggatgttggc

SEQ ID NO: 27261 - DNA, 15 bp, Homo sapiens
atctgaggatgttgg

SEQ ID NO: 27262 - DNA, 15 bp, Homo sapiens
aatctgaggatgttg

SEQ ID NO: 27263 - DNA, 15 bp, Homo sapiens
aaatctgaggatgtt

SEQ ID NO: 27264 - DNA, 15 bp, Homo sapiens
caaatctgaggatgt

SEQ ID NO: 27265 - DNA, 15 bp, Homo sapiens
gcaaatctgaggatg

SEQ ID NO: 27266 - DNA, 15 bp, Homo sapiens
tgcaaatctgaggat

SEQ ID NO: 27267 - DNA, 15 bp, Homo sapiens
atgcaaatctgagga

SEQ ID NO: 27268 - DNA, 15 bp, Homo sapiens
catgcaaatctgagg

SEQ ID NO: 27269 - DNA, 15 bp, Homo sapiens
acatgcaaatctgag

SEQ ID NO: 27270 - DNA, 15 bp, Homo sapiens
cacatgcaaatctga

SEQ ID NO: 27271 - DNA, 15 bp, Homo sapiens
ccacatgcaaatctg

SEQ ID NO: 27272 - DNA, 15 bp, Homo sapiens
cccacatgcaaatct

SEQ ID NO: 27273 - DNA, 15 bp, Homo sapiens
gcccacatgcaaatc

SEQ ID NO: 27274 - DNA, 15 bp, Homo sapiens
tgcccacatgcaaat

SEQ ID NO: 27275 - DNA, 15 bp, Homo sapiens
atgcccacatgcaaa

SEQ ID NO: 27276 - DNA, 15 bp, Homo sapiens
aatgcccacatgcaa

SEQ ID NO: 27277 - DNA, 15 bp, Homo sapiens
aaatgcccacatgca

SEQ ID NO: 27278 - DNA, 15 bp, Homo sapiens
caaatgcccacatgc

SEQ ID NO: 27279 - DNA, 15 bp, Homo sapiens
gcaaatgcccacatg

SEQ ID NO: 27280 - DNA, 15 bp, Homo sapiens
tgcaaatgcccacat

SEQ ID NO: 27281 - DNA, 15 bp, Homo sapiens
ttgcaaatgcccaca

SEQ ID NO: 27282 - DNA, 15 bp, Homo sapiens
cttgcaaatgcccac

SEQ ID NO: 27283 - DNA, 15 bp, Homo sapiens
tcttgcaaatgccca

SEQ ID NO: 27284 - DNA, 15 bp, Homo sapiens
ctcttgcaaatgccc

SEQ ID NO: 27285 - DNA, 15 bp, Homo sapiens
cctcttgcaaatgcc

SEQ ID NO: 27286 - DNA, 15 bp, Homo sapiens
tcctcttgcaaatgc

SEQ ID NO: 27287 - DNA, 15 bp, Homo sapiens
ttcctcttgcaaatg

SEQ ID NO: 27288 - DNA, 15 bp, Homo sapiens
cttcctcttgcaaat

SEQ ID NO: 27289 - DNA, 15 bp, Homo sapiens
gcttcctcttgcaaa

SEQ ID NO: 27290 - DNA, 15 bp, Homo sapiens
tgcttcctcttgcaa

SEQ ID NO: 27291 - DNA, 15 bp, Homo sapiens
gtgcttcctcttgca

SEQ ID NO: 27292 - DNA, 15 bp, Homo sapiens
tgtgcttcctcttgc

SEQ ID NO: 27293 - DNA, 15 bp, Homo sapiens
gtgtgcttcctcttg

SEQ ID NO: 27294 - DNA, 15 bp, Homo sapiens
tgtgtgcttcctctt

SEQ ID NO: 27295 - DNA, 15 bp, Homo sapiens
ctgtgtgcttcctct

SEQ ID NO: 27296 - DNA, 15 bp, Homo sapiens
tctgtgtgcttcctc

SEQ ID NO: 27297 - DNA, 15 bp, Homo sapiens
atctgtgtgcttcct

SEQ ID NO: 27298 - DNA, 15 bp, Homo sapiens
catctgtgtgcttcc

SEQ ID NO: 27299 - DNA, 15 bp, Homo sapiens
gcatctgtgtgcttc

SEQ ID NO: 27300 - DNA, 15 bp, Homo sapiens
agcatctgtgtgctt

SEQ ID NO: 27301 - DNA, 15 bp, Homo sapiens
cagcatctgtgtgct

SEQ ID NO: 27302 - DNA, 15 bp, Homo sapiens
acagcatctgtgtgc

SEQ ID NO: 27303 - DNA, 15 bp, Homo sapiens
cacagcatctgtgtg

SEQ ID NO: 27304 - DNA, 15 bp, Homo sapiens
tcacagcatctgtgt

SEQ ID NO: 27305 - DNA, 15 bp, Homo sapiens
atcacagcatctgtg

SEQ ID NO: 27306 - DNA, 15 bp, Homo sapiens
gatcacagcatctgt

SEQ ID NO: 27307 - DNA, 15 bp, Homo sapiens
tgatcacagcatctg

SEQ ID NO: 27308 - DNA, 15 bp, Homo sapiens
ctgatcacagcatct

SEQ ID NO: 27309 - DNA, 15 bp, Homo sapiens
cctgatcacagcatc

SEQ ID NO: 27310 - DNA, 15 bp, Homo sapiens
ccctgatcacagcat

SEQ ID NO: 27311 - DNA, 15 bp, Homo sapiens
gccctgatcacagca

SEQ ID NO: 27312 - DNA, 15 bp, Homo sapiens
agccctgatcacagc

SEQ ID NO: 27313 - DNA, 15 bp, Homo sapiens
cagccctgatcacag

SEQ ID NO: 27314 - DNA, 15 bp, Homo sapiens
tcagccctgatcaca

SEQ ID NO: 27315 - DNA, 15 bp, Homo sapiens
ctcagccctgatcac

SEQ ID NO: 27316 - DNA, 15 bp, Homo sapiens
tctcagccctgatca

SEQ ID NO: 27317 - DNA, 15 bp, Homo sapiens
atctcagccctgatc

SEQ ID NO: 27318 - DNA, 15 bp, Homo sapiens
catctcagccctgat

SEQ ID NO: 27319 - DNA, 15 bp, Homo sapiens
gcatctcagccctga

SEQ ID NO: 27320 - DNA, 15 bp, Homo sapiens
ggcatctcagccctg

SEQ ID NO: 27321 - DNA, 15 bp, Homo sapiens
aggcatctcagccct

SEQ ID NO: 27322 - DNA, 15 bp, Homo sapiens
taggcatctcagccc

SEQ ID NO: 27323 - DNA, 15 bp, Homo sapiens
gtaggcatctcagcc

SEQ ID NO: 27324 - DNA, 15 bp, Homo sapiens
tgtaggcatctcagc

SEQ ID NO: 27325 - DNA, 15 bp, Homo sapiens
ctgtaggcatctcag

SEQ ID NO: 27326 - DNA, 15 bp, Homo sapiens
cctgtaggcatctca

SEQ ID NO: 27327 - DNA, 15 bp, Homo sapiens
acctgtaggcatctc

SEQ ID NO: 27328 - DNA, 15 bp, Homo sapiens
cacctgtaggcatct

SEQ ID NO: 27329 - DNA, 15 bp, Homo sapiens
acacctgtaggcatc

SEQ ID NO: 27330 - DNA, 15 bp, Homo sapiens
cacacctgtaggcat

SEQ ID NO: 27331 - DNA, 15 bp, Homo sapiens
acacacctgtaggca

SEQ ID NO: 27332 - DNA, 15 bp, Homo sapiens
gacacacctgtaggc

SEQ ID NO: 27333 - DNA, 15 bp, Homo sapiens
agacacacctgtagg

SEQ ID NO: 27334 - DNA, 15 bp, Homo sapiens
cagacacacctgtag

SEQ ID NO: 27335 - DNA, 15 bp, Homo sapiens
gcagacacacctgta

SEQ ID NO: 27336 - DNA, 15 bp, Homo sapiens
agcagacacacctgt

SEQ ID NO: 27337 - DNA, 15 bp, Homo sapiens
cagcagacacacctg

SEQ ID NO: 27338 - DNA, 15 bp, Homo sapiens
ccagcagacacacct

SEQ ID NO: 27339 - DNA, 15 bp, Homo sapiens
cccagcagacacacc

SEQ ID NO: 27340 - DNA, 15 bp, Homo sapiens
gcccagcagacacac

SEQ ID NO: 27341 - DNA, 15 bp, Homo sapiens
agcccagcagacaca

SEQ ID NO: 27342 - DNA, 15 bp, Homo sapiens
cagcccagcagacac

SEQ ID NO: 27343 - DNA, 15 bp, Homo sapiens
gcagcccagcagaca

SEQ ID NO: 27344 - DNA, 15 bp, Homo sapiens
cgcagcccagcagac

SEQ ID NO: 27345 - DNA, 15 bp, Homo sapiens
ccgcagcccagcaga

SEQ ID NO: 27346 - DNA, 15 bp, Homo sapiens
gccgcagcccagcag

SEQ ID NO: 27347 - DNA, 15 bp, Homo sapiens
tgccgcagcccagca

SEQ ID NO: 27348 - DNA, 15 bp, Homo sapiens
ctgccgcagcccagc

SEQ ID NO: 27349 - DNA, 15 bp, Homo sapiens
cctgccgcagcccag

SEQ ID NO: 27350 - DNA, 15 bp, Homo sapiens
acctgccgcagccca

SEQ ID NO: 27351 - DNA, 15 bp, Homo sapiens
cacctgccgcagccc

SEQ ID NO: 27352 - DNA, 15 bp, Homo sapiens
ccacctgccgcagcc

SEQ ID NO: 27353 - DNA, 15 bp, Homo sapiens
accacctgccgcagc

SEQ ID NO: 27354 - DNA, 15 bp, Homo sapiens
caccacctgccgcag

SEQ ID NO: 27355 - DNA, 15 bp, Homo sapiens
ccaccacctgccgca

SEQ ID NO: 27356 - DNA, 15 bp, Homo sapiens
gccaccacctgccgc

SEQ ID NO: 27357 - DNA, 15 bp, Homo sapiens
ggccaccacctgccg

SEQ ID NO: 27358 - DNA, 15 bp, Homo sapiens
tggccaccacctgcc

SEQ ID NO: 27359 - DNA, 15 bp, Homo sapiens
ctggccaccacctgc

SEQ ID NO: 27360 - DNA, 15 bp, Homo sapiens
actggccaccacctg

SEQ ID NO: 27361 - DNA, 15 bp, Homo sapiens
cactggccaccacct

SEQ ID NO: 27362 - DNA, 15 bp, Homo sapiens
ccactggccaccacc

SEQ ID NO: 27363 - DNA, 15 bp, Homo sapiens
tccactggccaccac

SEQ ID NO: 27364 - DNA, 15 bp, Homo sapiens
ttccactggccacca

SEQ ID NO: 27365 - DNA, 15 bp, Homo sapiens
cttccactggccacc

SEQ ID NO: 27366 - DNA, 15 bp, Homo sapiens
tcttccactggccac

SEQ ID NO: 27367 - DNA, 15 bp, Homo sapiens
gtcttccactggcca

SEQ ID NO: 27368 - DNA, 15 bp, Homo sapiens
tgtcttccactggcc

SEQ ID NO: 27369 - DNA, 15 bp, Homo sapiens
ctgtcttccactggc

SEQ ID NO: 27370 - DNA, 15 bp, Homo sapiens
cctgtcttccactgg

SEQ ID NO: 27371 - DNA, 15 bp, Homo sapiens
acctgtcttccactg

SEQ ID NO: 27372 - DNA, 15 bp, Homo sapiens
aacctgtcttccact

SEQ ID NO: 27373 - DNA, 15 bp, Homo sapiens
caacctgtcttccac

SEQ ID NO: 27374 - DNA, 15 bp, Homo sapiens
acaacctgtcttcca

SEQ ID NO: 27375 - DNA, 15 bp, Homo sapiens
tacaacctgtcttcc

SEQ ID NO: 27376 - DNA, 15 bp, Homo sapiens
ctacaacctgtcttc

SEQ ID NO: 27377 - DNA, 15 bp, Homo sapiens
cctacaacctgtctt

SEQ ID NO: 27378 - DNA, 15 bp, Homo sapiens
acctacaacctgtct

SEQ ID NO: 27379 - DNA, 15 bp, Homo sapiens
tacctacaacctgtc

SEQ ID NO: 27380 - DNA, 15 bp, Homo sapiens
ctacctacaacctgt

SEQ ID NO: 27381 - DNA, 15 bp, Homo sapiens
cctacctacaacctg

SEQ ID NO: 27382 - DNA, 15 bp, Homo sapiens
ccctacctacaacct

SEQ ID NO: 27383 - DNA, 15 bp, Homo sapiens
tccctacctacaacc

SEQ ID NO: 27384 - DNA, 15 bp, Homo sapiens
ttccctacctacaac

SEQ ID NO: 27385 - DNA, 15 bp, Homo sapiens
tttccctacctacaa

SEQ ID NO: 27386 - DNA, 15 bp, Homo sapiens
ctttccctacctaca

SEQ ID NO: 27387 - DNA, 15 bp, Homo sapiens
actttccctacctac

SEQ ID NO: 27388 - DNA, 15 bp, Homo sapiens
cactttccctaccta

SEQ ID NO: 27389 - DNA, 15 bp, Homo sapiens
acactttccctacct

SEQ ID NO: 27390 - DNA, 15 bp, Homo sapiens
aacactttccctacc

SEQ ID NO: 27391 - DNA, 15 bp, Homo sapiens
caacactttccctac

SEQ ID NO: 27392 - DNA, 15 bp, Homo sapiens
gcaacactttcccta

SEQ ID NO: 27393 - DNA, 15 bp, Homo sapiens
ggcaacactttccct

SEQ ID NO: 27394 - DNA, 15 bp, Homo sapiens
aggcaacactttccc

SEQ ID NO: 27395 - DNA, 15 bp, Homo sapiens
gaggcaacactttcc

SEQ ID NO: 27396 - DNA, 15 bp, Homo sapiens
tgaggcaacactttc

SEQ ID NO: 27397 - DNA, 15 bp, Homo sapiens
atgaggcaacacttt

SEQ ID NO: 27398 - DNA, 15 bp, Homo sapiens
catgaggcaacactt

SEQ ID NO: 27399 - DNA, 15 bp, Homo sapiens
ccatgaggcaacact

SEQ ID NO: 27400 - DNA, 15 bp, Homo sapiens
tccatgaggcaacac

SEQ ID NO: 27401 - DNA, 15 bp, Homo sapiens
ctccatgaggcaaca

SEQ ID NO: 27402 - DNA, 15 bp, Homo sapiens
cctccatgaggcaac

SEQ ID NO: 27403 - DNA, 15 bp, Homo sapiens
ccctccatgaggcaa

SEQ ID NO: 27404 - DNA, 15 bp, Homo sapiens
accctccatgaggca

SEQ ID NO: 27405 - DNA, 15 bp, Homo sapiens
caccctccatgaggc

SEQ ID NO: 27406 - DNA, 15 bp, Homo sapiens
tcaccctccatgagg

SEQ ID NO: 27407 - DNA, 15 bp, Homo sapiens
atcaccctccatgag

SEQ ID NO: 27408 - DNA, 15 bp, Homo sapiens
gatcaccctccatga

SEQ ID NO: 27409 - DNA, 15 bp, Homo sapiens
ggatcaccctccatg

SEQ ID NO: 27410 - DNA, 15 bp, Homo sapiens
aggatcaccctccat

SEQ ID NO: 27411 - DNA, 15 bp, Homo sapiens
caggatcaccctcca

SEQ ID NO: 27412 - DNA, 15 bp, Homo sapiens
tcaggatcaccctcc

SEQ ID NO: 27413 - DNA, 15 bp, Homo sapiens
atcaggatcaccctc

SEQ ID NO: 27414 - DNA, 15 bp, Homo sapiens
tatcaggatcaccct

SEQ ID NO: 27415 - DNA, 15 bp, Homo sapiens
atatcaggatcaccc

SEQ ID NO: 27416 - DNA, 15 bp, Homo sapiens
catatcaggatcacc

SEQ ID NO: 27417 - DNA, 15 bp, Homo sapiens
ccatatcaggatcac

SEQ ID NO: 27418 - DNA, 15 bp, Homo sapiens
accatatcaggatca

SEQ ID NO: 27419 - DNA, 15 bp, Homo sapiens
caccatatcaggatc

SEQ ID NO: 27420 - DNA, 15 bp, Homo sapiens
ccaccatatcaggat

SEQ ID NO: 27421 - DNA, 15 bp, Homo sapiens
cccaccatatcagga

SEQ ID NO: 27422 - DNA, 15 bp, Homo sapiens
tcccaccatatcagg

SEQ ID NO: 27423 - DNA, 15 bp, Homo sapiens
ttcccaccatatcag

SEQ ID NO: 27424 - DNA, 15 bp, Homo sapiens
gttcccaccatatca

SEQ ID NO: 27425 - DNA, 15 bp, Homo sapiens
agttcccaccatatc

SEQ ID NO: 27426 - DNA, 15 bp, Homo sapiens
aagttcccaccatat

SEQ ID NO: 27427 - DNA, 15 bp, Homo sapiens
gaagttcccaccata

SEQ ID NO: 27428 - DNA, 15 bp, Homo sapiens
tgaagttcccaccat

SEQ ID NO: 27429 - DNA, 15 bp, Homo sapiens
ttgaagttcccacca

SEQ ID NO: 27430 - DNA, 15 bp, Homo sapiens
attgaagttcccacc

SEQ ID NO: 27431 - DNA, 15 bp, Homo sapiens
gattgaagttcccac

SEQ ID NO: 27432 - DNA, 15 bp, Homo sapiens
ggattgaagttccca

SEQ ID NO: 27433 - DNA, 15 bp, Homo sapiens
tggattgaagttccc

SEQ ID NO: 27434 - DNA, 15 bp, Homo sapiens
ctggattgaagttcc

SEQ ID NO: 27435 - DNA, 15 bp, Homo sapiens
tctggattgaagttc

SEQ ID NO: 27436 - DNA, 15 bp, Homo sapiens
gtctggattgaagtt

SEQ ID NO: 27437 - DNA, 15 bp, Homo sapiens
agtctggattgaagt

SEQ ID NO: 27438 - DNA, 15 bp, Homo sapiens
gagtctggattgaag

SEQ ID NO: 27439 - DNA, 15 bp, Homo sapiens
ggagtctggattgaa

SEQ ID NO: 27440 - DNA, 15 bp, Homo sapiens
cggagtctggattga

SEQ ID NO: 27441 - DNA, 15 bp, Homo sapiens
tcggagtctggattg

SEQ ID NO: 27442 - DNA, 15 bp, Homo sapiens
gtcggagtctggatt

SEQ ID NO: 27443 - DNA, 15 bp, Homo sapiens
tgtcggagtctggat

SEQ ID NO: 27444 - DNA, 15 bp, Homo sapiens
atgtcggagtctgga

SEQ ID NO: 27445 - DNA, 15 bp, Homo sapiens
gatgtcggagtctgg

SEQ ID NO: 27446 - DNA, 15 bp, Homo sapiens
cgatgtcggagtctg

SEQ ID NO: 27447 - DNA, 15 bp, Homo sapiens
gcgatgtcggagtct

SEQ ID NO: 27448 - DNA, 15 bp, Homo sapiens
ggcgatgtcggagtc

SEQ ID NO: 27449 - DNA, 15 bp, Homo sapiens
tggcgatgtcggagt

SEQ ID NO: 27450 - DNA, 15 bp, Homo sapiens
gtggcgatgtcggag

SEQ ID NO: 27451 - DNA, 15 bp, Homo sapiens
cgtggcgatgtcgga

SEQ ID NO: 27452 - DNA, 15 bp, Homo sapiens
ccgtggcgatgtcgg

SEQ ID NO: 27453 - DNA, 15 bp, Homo sapiens
cccgtggcgatgtcg

SEQ ID NO: 27454 - DNA, 15 bp, Homo sapiens
gcccgtggcgatgtc

SEQ ID NO: 27455 - DNA, 15 bp, Homo sapiens
tgcccgtggcgatgt

SEQ ID NO: 27456 - DNA, 15 bp, Homo sapiens
ttgcccgtggcgatg

SEQ ID NO: 27457 - DNA, 15 bp, Homo sapiens
cttgcccgtggcgat

SEQ ID NO: 27458 - DNA, 15 bp, Homo sapiens
gcttgcccgtggcga

SEQ ID NO: 27459 - DNA, 15 bp, Homo sapiens
agcttgcccgtggcg

SEQ ID NO: 27460 - DNA, 15 bp, Homo sapiens
cagcttgcccgtggc

SEQ ID NO: 27461 - DNA, 15 bp, Homo sapiens
tcagcttgcccgtgg

SEQ ID NO: 27462 - DNA, 15 bp, Homo sapiens
ttcagcttgcccgtg

SEQ ID NO: 27463 - DNA, 15 bp, Homo sapiens
attcagcttgcccgt

SEQ ID NO: 27464 - DNA, 15 bp, Homo sapiens
cattcagcttgcccg

SEQ ID NO: 27465 - DNA, 15 bp, Homo sapiens
tcattcagcttgccc

SEQ ID NO: 27466 - DNA, 15 bp, Homo sapiens
gtcattcagcttgcc

SEQ ID NO: 27467 - DNA, 15 bp, Homo sapiens
tgtcattcagcttgc

SEQ ID NO: 27468 - DNA, 15 bp, Homo sapiens
ctgtcattcagcttg

SEQ ID NO: 27469 - DNA, 15 bp, Homo sapiens
actgtcattcagctt

SEQ ID NO: 27470 - DNA, 15 bp, Homo sapiens
tactgtcattcagct

SEQ ID NO: 27471 - DNA, 15 bp, Homo sapiens
ttactgtcattcagc

SEQ ID NO: 27472 - DNA, 15 bp, Homo sapiens
tttactgtcattcag

SEQ ID NO: 27473 - DNA, 15 bp, Homo sapiens
gtttactgtcattca

SEQ ID NO: 27474 - DNA, 15 bp, Homo sapiens
tgtttactgtcattc

SEQ ID NO: 27475 - DNA, 15 bp, Homo sapiens
ttgtttactgtcatt

SEQ ID NO: 27476 - DNA, 15 bp, Homo sapiens
gttgtttactgtcat

SEQ ID NO: 27477 - DNA, 15 bp, Homo sapiens
ggttgtttactgtca

SEQ ID NO: 27478 - DNA, 15 bp, Homo sapiens
aggttgtttactgtc

SEQ ID NO: 27479 - DNA, 15 bp, Homo sapiens
aaggttgtttactgt

SEQ ID NO: 27480 - DNA, 15 bp, Homo sapiens
gaaggttgtttactg

SEQ ID NO: 27481 - DNA, 15 bp, Homo sapiens
tgaaggttgtttact

SEQ ID NO: 27482 - DNA, 15 bp, Homo sapiens
ctgaaggttgtttac

SEQ ID NO: 27483 - DNA, 15 bp, Homo sapiens
cctgaaggttgttta

SEQ ID NO: 27484 - DNA, 15 bp, Homo sapiens
ccctgaaggttgttt

SEQ ID NO: 27485 - DNA, 15 bp, Homo sapiens
gccctgaaggttgtt

SEQ ID NO: 27486 - DNA, 15 bp, Homo sapiens
agccctgaaggttgt

SEQ ID NO: 27487 - DNA, 15 bp, Homo sapiens
aagccctgaaggttg

SEQ ID NO: 27488 - DNA, 15 bp, Homo sapiens
caagccctgaaggtt

SEQ ID NO: 27489 - DNA, 15 bp, Homo sapiens
ccaagccctgaaggt

SEQ ID NO: 27490 - DNA, 15 bp, Homo sapiens
cccaagccctgaagg

SEQ ID NO: 27491 - DNA, 15 bp, Homo sapiens
ccccaagccctgaag

SEQ ID NO: 27492 - DNA, 15 bp, Homo sapiens
tccccaagccctgaa

SEQ ID NO: 27493 - DNA, 15 bp, Homo sapiens
gtccccaagccctga

SEQ ID NO: 27494 - DNA, 15 bp, Homo sapiens
cgtccccaagccctg

SEQ ID NO: 27495 - DNA, 15 bp, Homo sapiens
acgtccccaagccct

SEQ ID NO: 27496 - DNA, 15 bp, Homo sapiens
gacgtccccaagccc

SEQ ID NO: 27497 - DNA, 15 bp, Homo sapiens
tgacgtccccaagcc

SEQ ID NO: 27498 - DNA, 15 bp, Homo sapiens
ctgacgtccccaagc

SEQ ID NO: 27499 - DNA, 15 bp, Homo sapiens
gctgacgtccccaag

SEQ ID NO: 27500 - DNA, 15 bp, Homo sapiens
tgctgacgtccccaa

SEQ ID NO: 27501 - DNA, 15 bp, Homo sapiens
gtgctgacgtcccca

SEQ ID NO: 27502 - DNA, 15 bp, Homo sapiens
tgtgctgacgtcccc

SEQ ID NO: 27503 - DNA, 15 bp, Homo sapiens
gtgtgctgacgtccc

SEQ ID NO: 27504 - DNA, 15 bp, Homo sapiens
agtgtgctgacgtcc

SEQ ID NO: 27505 - DNA, 15 bp, Homo sapiens
gagtgtgctgacgtc

SEQ ID NO: 27506 - DNA, 15 bp, Homo sapiens
tgagtgtgctgacgt

SEQ ID NO: 27507 - DNA, 15 bp, Homo sapiens
gtgagtgtgctgacg

SEQ ID NO: 27508 - DNA, 15 bp, Homo sapiens
ggtgagtgtgctgac

SEQ ID NO: 27509 - DNA, 15 bp, Homo sapiens
aggtgagtgtgctga

SEQ ID NO: 27510 - DNA, 15 bp, Homo sapiens
caggtgagtgtgctg

SEQ ID NO: 27511 - DNA, 15 bp, Homo sapiens
acaggtgagtgtgct

SEQ ID NO: 27512 - DNA, 15 bp, Homo sapiens
cacaggtgagtgtgc

SEQ ID NO: 27513 - DNA, 15 bp, Homo sapiens
ccacaggtgagtgtg

SEQ ID NO: 27514 - DNA, 15 bp, Homo sapiens
tccacaggtgagtgt

SEQ ID NO: 27515 - DNA, 15 bp, Homo sapiens
ctccacaggtgagtg

SEQ ID NO: 27516 - DNA, 15 bp, Homo sapiens
tctccacaggtgagt

SEQ ID NO: 27517 - DNA, 15 bp, Homo sapiens
ctctccacaggtgag

SEQ ID NO: 27518 - DNA, 15 bp, Homo sapiens
gctctccacaggtga

SEQ ID NO: 27519 - DNA, 15 bp, Homo sapiens
ggctctccacaggtg

SEQ ID NO: 27520 - DNA, 15 bp, Homo sapiens
tggctctccacaggt

SEQ ID NO: 27521 - DNA, 15 bp, Homo sapiens
ctggctctccacagg

SEQ ID NO: 27522 - DNA, 15 bp, Homo sapiens
gctggctctccacag

SEQ ID NO: 27523 - DNA, 15 bp, Homo sapiens
ggctggctctccaca

SEQ ID NO: 27524 - DNA, 15 bp, Homo sapiens
tggctggctctccac

SEQ ID NO: 27525 - DNA, 15 bp, Homo sapiens
ctggctggctctcca

SEQ ID NO: 27526 - DNA, 15 bp, Homo sapiens
tctggctggctctcc

SEQ ID NO: 27527 - DNA, 15 bp, Homo sapiens
ttctggctggctctc

SEQ ID NO: 27528 - DNA, 15 bp, Homo sapiens
cttctggctggctct

SEQ ID NO: 27529 - DNA, 15 bp, Homo sapiens
tcttctggctggctc

SEQ ID NO: 27530 - DNA, 15 bp, Homo sapiens
gtcttctggctggct

SEQ ID NO: 27531 - DNA, 15 bp, Homo sapiens
tgtcttctggctggc

SEQ ID NO: 27532 - DNA, 15 bp, Homo sapiens
ctgtcttctggctgg

SEQ ID NO: 27533 - DNA, 15 bp, Homo sapiens
cctgtcttctggctg

SEQ ID NO: 27534 - DNA, 15 bp, Homo sapiens
gcctgtcttctggct

SEQ ID NO: 27535 - DNA, 15 bp, Homo sapiens
tgcctgtcttctggc

SEQ ID NO: 27536 - DNA, 15 bp, Homo sapiens
ctgcctgtcttctgg

SEQ ID NO: 27537 - DNA, 15 bp, Homo sapiens
actgcctgtcttctg

SEQ ID NO: 27538 - DNA, 15 bp, Homo sapiens
cactgcctgtcttct

SEQ ID NO: 27539 - DNA, 15 bp, Homo sapiens
ccactgcctgtcttc

SEQ ID NO: 27540 - DNA, 15 bp, Homo sapiens
gccactgcctgtctt

SEQ ID NO: 27541 - DNA, 15 bp, Homo sapiens
tgccactgcctgtct

SEQ ID NO: 27542 - DNA, 15 bp, Homo sapiens
gtgccactgcctgtc

SEQ ID NO: 27543 - DNA, 15 bp, Homo sapiens
tgtgccactgcctgt

SEQ ID NO: 27544 - DNA, 15 bp, Homo sapiens
ttgtgccactgcctg

SEQ ID NO: 27545 - DNA, 15 bp, Homo sapiens
cttgtgccactgcct

SEQ ID NO: 27546 - DNA, 15 bp, Homo sapiens
acttgtgccactgcc

SEQ ID NO: 27547 - DNA, 15 bp, Homo sapiens
aacttgtgccactgc

SEQ ID NO: 27548 - DNA, 15 bp, Homo sapiens
aaacttgtgccactg

SEQ ID NO: 27549 - DNA, 15 bp, Homo sapiens
aaaacttgtgccact

SEQ ID NO: 27550 - DNA, 15 bp, Homo sapiens
gaaaacttgtgccac

SEQ ID NO: 27551 - DNA, 15 bp, Homo sapiens
agaaaacttgtgcca

SEQ ID NO: 27552 - DNA, 15 bp, Homo sapiens
cagaaaacttgtgcc

SEQ ID NO: 27553 - DNA, 15 bp, Homo sapiens
tcagaaaacttgtgc

SEQ ID NO: 27554 - DNA, 15 bp, Homo sapiens
ctcagaaaacttgtg

SEQ ID NO: 27555 - DNA, 15 bp, Homo sapiens
cctcagaaaacttgt

SEQ ID NO: 27556 - DNA, 15 bp, Homo sapiens
acctcagaaaacttg

SEQ ID NO: 27557 - DNA, 15 bp, Homo sapiens
tacctcagaaaactt

SEQ ID NO: 27558 - DNA, 15 bp, Homo sapiens
ctacctcagaaaact

SEQ ID NO: 27559 - DNA, 15 bp, Homo sapiens
tctacctcagaaaac

SEQ ID NO: 27560 - DNA, 15 bp, Homo sapiens
ctctacctcagaaaa

SEQ ID NO: 27561 - DNA, 15 bp, Homo sapiens
tctctacctcagaaa

SEQ ID NO: 27562 - DNA, 15 bp, Homo sapiens
atctctacctcagaa

SEQ ID NO: 27563 - DNA, 15 bp, Homo sapiens
aatctctacctcaga

SEQ ID NO: 27564 - DNA, 15 bp, Homo sapiens
caatctctacctcag

SEQ ID NO: 27565 - DNA, 15 bp, Homo sapiens
acaatctctacctca

SEQ ID NO: 27566 - DNA, 15 bp, Homo sapiens
cacaatctctacctc

SEQ ID NO: 27567 - DNA, 15 bp, Homo sapiens
tcacaatctctacct

SEQ ID NO: 27568 - DNA, 15 bp, Homo sapiens
gtcacaatctctacc

SEQ ID NO: 27569 - DNA, 15 bp, Homo sapiens
agtcacaatctctac

SEQ ID NO: 27570 - DNA, 15 bp, Homo sapiens
cagtcacaatctcta

SEQ ID NO: 27571 - DNA, 15 bp, Homo sapiens
acagtcacaatctct

SEQ ID NO: 27572 - DNA, 15 bp, Homo sapiens
tacagtcacaatctc

SEQ ID NO: 27573 - DNA, 15 bp, Homo sapiens
ctacagtcacaatct

SEQ ID NO: 27574 - DNA, 15 bp, Homo sapiens
cctacagtcacaatc

SEQ ID NO: 27575 - DNA, 15 bp, Homo sapiens
acctacagtcacaat

SEQ ID NO: 27576 - DNA, 15 bp, Homo sapiens
cacctacagtcacaa

SEQ ID NO: 27577 - DNA, 15 bp, Homo sapiens
tcacctacagtcaca

SEQ ID NO: 27578 - DNA, 15 bp, Homo sapiens
gtcacctacagtcac

SEQ ID NO: 27579 - DNA, 15 bp, Homo sapiens
ggtcacctacagtca

SEQ ID NO: 27580 - DNA, 15 bp, Homo sapiens
tggtcacctacagtc

SEQ ID NO: 27581 - DNA, 15 bp, Homo sapiens
ttggtcacctacagt

SEQ ID NO: 27582 - DNA, 15 bp, Homo sapiens
cttggtcacctacag

SEQ ID NO: 27583 - DNA, 15 bp, Homo sapiens
ccttggtcacctaca

SEQ ID NO: 27584 - DNA, 15 bp, Homo sapiens
tccttggtcacctac

SEQ ID NO: 27585 - DNA, 15 bp, Homo sapiens
ttccttggtcaccta

SEQ ID NO: 27586 - DNA, 15 bp, Homo sapiens
gttccttggtcacct

SEQ ID NO: 27587 - DNA, 15 bp, Homo sapiens
tgttccttggtcacc

SEQ ID NO: 27588 - DNA, 15 bp, Homo sapiens
ttgttccttggtcac

SEQ ID NO: 27589 - DNA, 15 bp, Homo sapiens
tttgttccttggtca

SEQ ID NO: 27590 - DNA, 15 bp, Homo sapiens
ttttgttccttggtc

SEQ ID NO: 27591 - DNA, 15 bp, Homo sapiens
attttgttccttggt

SEQ ID NO: 27592 - DNA, 15 bp, Homo sapiens
tattttgttccttgg

SEQ ID NO: 27593 - DNA, 15 bp, Homo sapiens
atattttgttccttg

SEQ ID NO: 27594 - DNA, 15 bp, Homo sapiens
aatattttgttcctt

SEQ ID NO: 27595 - DNA, 15 bp, Homo sapiens
taatattttgttcct

SEQ ID NO: 27596 - DNA, 15 bp, Homo sapiens
ataatattttgttcc

SEQ ID NO: 27597 - DNA, 15 bp, Homo sapiens
cataatattttgttc

SEQ ID NO: 27598 - DNA, 15 bp, Homo sapiens
tcataatattttgtt

SEQ ID NO: 27599 - DNA, 15 bp, Homo sapiens
ttcataatattttgt

SEQ ID NO: 27600 - DNA, 15 bp, Homo sapiens
cttcataatattttg

SEQ ID NO: 27601 - DNA, 15 bp, Homo sapiens
tcttcataatatttt

SEQ ID NO: 27602 - DNA, 15 bp, Homo sapiens
gtcttcataatattt

SEQ ID NO: 27603 - DNA, 15 bp, Homo sapiens
ggtcttcataatatt

SEQ ID NO: 27604 - DNA, 15 bp, Homo sapiens
tggtcttcataatat

SEQ ID NO: 27605 - DNA, 15 bp, Homo sapiens
gtggtcttcataata

SEQ ID NO: 27606 - DNA, 15 bp, Homo sapiens
tgtggtcttcataat

SEQ ID NO: 27607 - DNA, 15 bp, Homo sapiens
atgtggtcttcataa

SEQ ID NO: 27608 - DNA, 15 bp, Homo sapiens
aatgtggtcttcata

SEQ ID NO: 27609 - DNA, 15 bp, Homo sapiens
caatgtggtcttcat

SEQ ID NO: 27610 - DNA, 15 bp, Homo sapiens
ccaatgtggtcttca

SEQ ID NO: 27611 - DNA, 15 bp, Homo sapiens
cccaatgtggtcttc

SEQ ID NO: 27612 - DNA, 15 bp, Homo sapiens
ccccaatgtggtctt

SEQ ID NO: 27613 - DNA, 15 bp, Homo sapiens
accccaatgtggtct

SEQ ID NO: 27614 - DNA, 15 bp, Homo sapiens
aaccccaatgtggtc

SEQ ID NO: 27615 - DNA, 15 bp, Homo sapiens
gaaccccaatgtggt

SEQ ID NO: 27616 - DNA, 15 bp, Homo sapiens
tgaaccccaatgtgg

SEQ ID NO: 27617 - DNA, 15 bp, Homo sapiens
atgaaccccaatgtg

SEQ ID NO: 27618 - DNA, 15 bp, Homo sapiens
tatgaaccccaatgt

SEQ ID NO: 27619 - DNA, 15 bp, Homo sapiens
ctatgaaccccaatg

SEQ ID NO: 27620 - DNA, 15 bp, Homo sapiens
cctatgaaccccaat

SEQ ID NO: 27621 - DNA, 15 bp, Homo sapiens
gcctatgaaccccaa

SEQ ID NO: 27622 - DNA, 15 bp, Homo sapiens
agcctatgaacccca

SEQ ID NO: 27623 - DNA, 15 bp, Homo sapiens
cagcctatgaacccc

SEQ ID NO: 27624 - DNA, 15 bp, Homo sapiens
ccagcctatgaaccc

SEQ ID NO: 27625 - DNA, 15 bp, Homo sapiens
accagcctatgaacc

SEQ ID NO: 27626 - DNA, 15 bp, Homo sapiens
caccagcctatgaac

SEQ ID NO: 27627 - DNA, 15 bp, Homo sapiens
ccaccagcctatgaa

SEQ ID NO: 27628 - DNA, 15 bp, Homo sapiens
gccaccagcctatga

SEQ ID NO: 27629 - DNA, 15 bp, Homo sapiens
ggccaccagcctatg

SEQ ID NO: 27630 - DNA, 15 bp, Homo sapiens
gggccaccagcctat

SEQ ID NO: 27631 - DNA, 15 bp, Homo sapiens
agggccaccagccta

SEQ ID NO: 27632 - DNA, 15 bp, Homo sapiens
cagggccaccagcct

SEQ ID NO: 27633 - DNA, 15 bp, Homo sapiens
acagggccaccagcc

SEQ ID NO: 27634 - DNA, 15 bp, Homo sapiens
tacagggccaccagc

SEQ ID NO: 27635 - DNA, 15 bp, Homo sapiens
ctacagggccaccag

SEQ ID NO: 27636 - DNA, 15 bp, Homo sapiens
cctacagggccacca

SEQ ID NO: 27637 - DNA, 15 bp, Homo sapiens
tcctacagggccacc

SEQ ID NO: 27638 - DNA, 15 bp, Homo sapiens
gtcctacagggccac

SEQ ID NO: 27639 - DNA, 15 bp, Homo sapiens
tgtcctacagggcca

SEQ ID NO: 27640 - DNA, 15 bp, Homo sapiens
gtgtcctacagggcc

SEQ ID NO: 27641 - DNA, 15 bp, Homo sapiens
agtgtcctacagggc

SEQ ID NO: 27642 - DNA, 15 bp, Homo sapiens
aagtgtcctacaggg

SEQ ID NO: 27643 - DNA, 15 bp, Homo sapiens
caagtgtcctacagg

SEQ ID NO: 27644 - DNA, 15 bp, Homo sapiens
ccaagtgtcctacag

SEQ ID NO: 27645 - DNA, 15 bp, Homo sapiens
tccaagtgtcctaca

SEQ ID NO: 27646 - DNA, 15 bp, Homo sapiens
gtccaagtgtcctac

SEQ ID NO: 27647 - DNA, 15 bp, Homo sapiens
tgtccaagtgtccta

SEQ ID NO: 27648 - DNA, 15 bp, Homo sapiens
gtgtccaagtgtcct

SEQ ID NO: 27649 - DNA, 15 bp, Homo sapiens
tgtgtccaagtgtcc

SEQ ID NO: 27650 - DNA, 15 bp, Homo sapiens
atgtgtccaagtgtc

SEQ ID NO: 27651 - DNA, 15 bp, Homo sapiens
aatgtgtccaagtgt

SEQ ID NO: 27652 - DNA, 15 bp, Homo sapiens
aaatgtgtccaagtg

SEQ ID NO: 27653 - DNA, 15 bp, Homo sapiens
aaaatgtgtccaagt

SEQ ID NO: 27654 - DNA, 15 bp, Homo sapiens
aaaaatgtgtccaag

SEQ ID NO: 27655 - DNA, 15 bp, Homo sapiens
aaaaaatgtgtccaa

SEQ ID NO: 27656 - DNA, 15 bp, Homo sapiens
aaaaaaatgtgtcca

SEQ ID NO: 27657 - DNA, 15 bp, Homo sapiens
aaaaaaaatgtgtcc

SEQ ID NO: 27658 - DNA, 15 bp, Homo sapiens
gaaaaaaaatgtgtc

SEQ ID NO: 27659 - DNA, 15 bp, Homo sapiens
ggaaaaaaaatgtgt

SEQ ID NO: 27660 - DNA, 15 bp, Homo sapiens
aggaaaaaaaatgtg

SEQ ID NO: 27661 - DNA, 15 bp, Homo sapiens
caggaaaaaaaatgt

SEQ ID NO: 27662 - DNA, 15 bp, Homo sapiens
gcaggaaaaaaaatg

SEQ ID NO: 27663 - DNA, 15 bp, Homo sapiens
ggcaggaaaaaaaat

SEQ ID NO: 27664 - DNA, 15 bp, Homo sapiens
tggcaggaaaaaaaa

SEQ ID NO: 27665 - DNA, 15 bp, Homo sapiens
ttggcaggaaaaaaa

SEQ ID NO: 27666 - DNA, 15 bp, Homo sapiens
gttggcaggaaaaaa

SEQ ID NO: 27667 - DNA, 15 bp, Homo sapiens
tgttggcaggaaaaa

SEQ ID NO: 27668 - DNA, 15 bp, Homo sapiens
gtgttggcaggaaaa

SEQ ID NO: 27669 - DNA, 15 bp, Homo sapiens
ggtgttggcaggaaa

SEQ ID NO: 27670 - DNA, 15 bp, Homo sapiens
tggtgttggcaggaa

SEQ ID NO: 27671 - DNA, 15 bp, Homo sapiens
ttggtgttggcagga

SEQ ID NO: 27672 - DNA, 15 bp, Homo sapiens
tttggtgttggcagg

SEQ ID NO: 27673 - DNA, 15 bp, Homo sapiens
ctttggtgttggcag

SEQ ID NO: 27674 - DNA, 15 bp, Homo sapiens
tctttggtgttggca

SEQ ID NO: 27675 - DNA, 15 bp, Homo sapiens
ttctttggtgttggc

SEQ ID NO: 27676 - DNA, 15 bp, Homo sapiens
attctttggtgttgg

SEQ ID NO: 27677 - DNA, 15 bp, Homo sapiens
tattctttggtgttg

SEQ ID NO: 27678 - DNA, 15 bp, Homo sapiens
ttattctttggtgtt

SEQ ID NO: 27679 - DNA, 15 bp, Homo sapiens
attattctttggtgt

SEQ ID NO: 27680 - DNA, 15 bp, Homo sapiens
aattattctttggtg

SEQ ID NO: 27681 - DNA, 15 bp, Homo sapiens
aaattattctttggt

SEQ ID NO: 27682 - DNA, 15 bp, Homo sapiens
gaaattattctttgg

SEQ ID NO: 27683 - DNA, 15 bp, Homo sapiens
agaaattattctttg

SEQ ID NO: 27684 - DNA, 15 bp, Homo sapiens
tagaaattattcttt

SEQ ID NO: 27685 - DNA, 15 bp, Homo sapiens
ctagaaattattctt

SEQ ID NO: 27686 - DNA, 15 bp, Homo sapiens
cctagaaattattct

SEQ ID NO: 27687 - DNA, 15 bp, Homo sapiens
acctagaaattattc

SEQ ID NO: 27688 - DNA, 15 bp, Homo sapiens
cacctagaaattatt

SEQ ID NO: 27689 - DNA, 15 bp, Homo sapiens
acacctagaaattat

SEQ ID NO: 27690 - DNA, 15 bp, Homo sapiens
gacacctagaaatta

SEQ ID NO: 27691 - DNA, 15 bp, Homo sapiens
agacacctagaaatt

SEQ ID NO: 27692 - DNA, 15 bp, Homo sapiens
gagacacctagaaat

SEQ ID NO: 27693 - DNA, 15 bp, Homo sapiens
agagacacctagaaa

SEQ ID NO: 27694 - DNA, 15 bp, Homo sapiens
aagagacacctagaa

SEQ ID NO: 27695 - DNA, 15 bp, Homo sapiens
gaagagacacctaga

SEQ ID NO: 27696 - DNA, 15 bp, Homo sapiens
agaagagacacctag

SEQ ID NO: 27697 - DNA, 15 bp, Homo sapiens
aagaagagacaccta

SEQ ID NO: 27698 - DNA, 15 bp, Homo sapiens
gaagaagagacacct

SEQ ID NO: 27699 - DNA, 15 bp, Homo sapiens
tgaagaagagacacc

SEQ ID NO: 27700 - DNA, 15 bp, Homo sapiens
gtgaagaagagacac

SEQ ID NO: 27701 - DNA, 15 bp, Homo sapiens
tgtgaagaagagaca

SEQ ID NO: 27702 - DNA, 15 bp, Homo sapiens
gtgtgaagaagagac

SEQ ID NO: 27703 - DNA, 15 bp, Homo sapiens
ggtgtgaagaagaga

SEQ ID NO: 27704 - DNA, 15 bp, Homo sapiens
aggtgtgaagaagag

SEQ ID NO: 27705 - DNA, 15 bp, Homo sapiens
aaggtgtgaagaaga

SEQ ID NO: 27706 - DNA, 15 bp, Homo sapiens
gaaggtgtgaagaag

SEQ ID NO: 27707 - DNA, 15 bp, Homo sapiens
ggaaggtgtgaagaa

SEQ ID NO: 27708 - DNA, 15 bp, Homo sapiens
gggaaggtgtgaaga

SEQ ID NO: 27709 - DNA, 15 bp, Homo sapiens
tgggaaggtgtgaag

SEQ ID NO: 27710 - DNA, 15 bp, Homo sapiens
atgggaaggtgtgaa

SEQ ID NO: 27711 - DNA, 15 bp, Homo sapiens
catgggaaggtgtga

SEQ ID NO: 27712 - DNA, 15 bp, Homo sapiens
tcatgggaaggtgtg

SEQ ID NO: 27713 - DNA, 15 bp, Homo sapiens
ttcatgggaaggtgt

SEQ ID NO: 27714 - DNA, 15 bp, Homo sapiens
cttcatgggaaggtg

SEQ ID NO: 27715 - DNA, 15 bp, Homo sapiens
gcttcatgggaaggt

SEQ ID NO: 27716 - DNA, 15 bp, Homo sapiens
agcttcatgggaagg

SEQ ID NO: 27717 - DNA, 15 bp, Homo sapiens
aagcttcatgggaag

SEQ ID NO: 27718 - DNA, 15 bp, Homo sapiens
caagcttcatgggaa

SEQ ID NO: 27719 - DNA, 15 bp, Homo sapiens
tcaagcttcatggga

SEQ ID NO: 27720 - DNA, 15 bp, Homo sapiens
ttcaagcttcatggg

SEQ ID NO: 27721 - DNA, 15 bp, Homo sapiens
tttcaagcttcatgg

SEQ ID NO: 27722 - DNA, 15 bp, Homo sapiens
ctttcaagcttcatg

SEQ ID NO: 27723 - DNA, 15 bp, Homo sapiens
actttcaagcttcat

SEQ ID NO: 27724 - DNA, 15 bp, Homo sapiens
aactttcaagcttca

SEQ ID NO: 27725 - DNA, 15 bp, Homo sapiens
gaactttcaagcttc

SEQ ID NO: 27726 - DNA, 15 bp, Homo sapiens
agaactttcaagctt

SEQ ID NO: 27727 - DNA, 15 bp, Homo sapiens
tagaactttcaagct

SEQ ID NO: 27728 - DNA, 15 bp, Homo sapiens
ctagaactttcaagc

SEQ ID NO: 27729 - DNA, 15 bp, Homo sapiens
tctagaactttcaag

SEQ ID NO: 27730 - DNA, 15 bp, Homo sapiens
ctctagaactttcaa

SEQ ID NO: 27731 - DNA, 15 bp, Homo sapiens
gctctagaactttca

SEQ ID NO: 27732 - DNA, 15 bp, Homo sapiens
agctctagaactttc

SEQ ID NO: 27733 - DNA, 15 bp, Homo sapiens
gagctctagaacttt

SEQ ID NO: 27734 - DNA, 15 bp, Homo sapiens
tgagctctagaactt

SEQ ID NO: 27735 - DNA, 15 bp, Homo sapiens
gtgagctctagaact

SEQ ID NO: 27736 - DNA, 15 bp, Homo sapiens
agtgagctctagaac

SEQ ID NO: 27737 - DNA, 15 bp, Homo sapiens
tagtgagctctagaa

SEQ ID NO: 27738 - DNA, 15 bp, Homo sapiens
ctagtgagctctaga

SEQ ID NO: 27739 - DNA, 15 bp, Homo sapiens
tctagtgagctctag

SEQ ID NO: 27740 - DNA, 15 bp, Homo sapiens
ttctagtgagctcta

SEQ ID NO: 27741 - DNA, 15 bp, Homo sapiens
tttctagtgagctct

SEQ ID NO: 27742 - DNA, 15 bp, Homo sapiens
gtttctagtgagctc

SEQ ID NO: 27743 - DNA, 15 bp, Homo sapiens
agtttctagtgagct

SEQ ID NO: 27744 - DNA, 15 bp, Homo sapiens
tagtttctagtgagc

SEQ ID NO: 27745 - DNA, 15 bp, Homo sapiens
ctagtttctagtgag

SEQ ID NO: 27746 - DNA, 15 bp, Homo sapiens
tctagtttctagtga

SEQ ID NO: 27747 - DNA, 15 bp, Homo sapiens
ttctagtttctagtg

SEQ ID NO: 27748 - DNA, 15 bp, Homo sapiens
tttctagtttctagt

SEQ ID NO: 27749 - DNA, 15 bp, Homo sapiens
ttttctagtttctag

SEQ ID NO: 27750 - DNA, 15 bp, Homo sapiens
tttttctagtttcta

SEQ ID NO: 27751 - DNA, 15 bp, Homo sapiens
atttttctagtttct

SEQ ID NO: 27752 - DNA, 15 bp, Homo sapiens
aatttttctagtttc

SEQ ID NO: 27753 - DNA, 15 bp, Homo sapiens
aaatttttctagttt

SEQ ID NO: 27754 - DNA, 15 bp, Homo sapiens
aaaatttttctagtt

SEQ ID NO: 27755 - DNA, 15 bp, Homo sapiens
gaaaatttttctagt

SEQ ID NO: 27756 - DNA, 15 bp, Homo sapiens
ggaaaatttttctag

SEQ ID NO: 27757 - DNA, 15 bp, Homo sapiens
aggaaaatttttcta

SEQ ID NO: 27758 - DNA, 15 bp, Homo sapiens
aaggaaaatttttct

SEQ ID NO: 27759 - DNA, 15 bp, Homo sapiens
taaggaaaatttttc

SEQ ID NO: 27760 - DNA, 15 bp, Homo sapiens
gtaaggaaaattttt

SEQ ID NO: 27761 - DNA, 15 bp, Homo sapiens
agtaaggaaaatttt

SEQ ID NO: 27762 - DNA, 15 bp, Homo sapiens
tagtaaggaaaattt

SEQ ID NO: 27763 - DNA, 15 bp, Homo sapiens
atagtaaggaaaatt

SEQ ID NO: 27764 - DNA, 15 bp, Homo sapiens
catagtaaggaaaat

SEQ ID NO: 27765 - DNA, 15 bp, Homo sapiens
tcatagtaaggaaaa

SEQ ID NO: 27766 - DNA, 15 bp, Homo sapiens
gtcatagtaaggaaa

SEQ ID NO: 27767 - DNA, 15 bp, Homo sapiens
tgtcatagtaaggaa

SEQ ID NO: 27768 - DNA, 15 bp, Homo sapiens
ctgtcatagtaagga

SEQ ID NO: 27769 - DNA, 15 bp, Homo sapiens
gctgtcatagtaagg

SEQ ID NO: 27770 - DNA, 15 bp, Homo sapiens
tgctgtcatagtaag

SEQ ID NO: 27771 - DNA, 15 bp, Homo sapiens
ttgctgtcatagtaa

SEQ ID NO: 27772 - DNA, 15 bp, Homo sapiens
cttgctgtcatagta

SEQ ID NO: 27773 - DNA, 15 bp, Homo sapiens
acttgctgtcatagt

SEQ ID NO: 27774 - DNA, 15 bp, Homo sapiens
cacttgctgtcatag

SEQ ID NO: 27775 - DNA, 15 bp, Homo sapiens
acacttgctgtcata

SEQ ID NO: 27776 - DNA, 15 bp, Homo sapiens
cacacttgctgtcat

SEQ ID NO: 27777 - DNA, 15 bp, Homo sapiens
gcacacttgctgtca

SEQ ID NO: 27778 - DNA, 15 bp, Homo sapiens
agcacacttgctgtc

SEQ ID NO: 27779 - DNA, 15 bp, Homo sapiens
aagcacacttgctgt

SEQ ID NO: 27780 - DNA, 15 bp, Homo sapiens
gaagcacacttgctg

SEQ ID NO: 27781 - DNA, 15 bp, Homo sapiens
cgaagcacacttgct

SEQ ID NO: 27782 - DNA, 15 bp, Homo sapiens
tcgaagcacacttgc

SEQ ID NO: 27783 - DNA, 15 bp, Homo sapiens
ctcgaagcacacttg

SEQ ID NO: 27784 - DNA, 15 bp, Homo sapiens
tctcgaagcacactt

SEQ ID NO: 27785 - DNA, 15 bp, Homo sapiens
ttctcgaagcacact

SEQ ID NO: 27786 - DNA, 15 bp, Homo sapiens
tttctcgaagcacac

SEQ ID NO: 27787 - DNA, 15 bp, Homo sapiens
ttttctcgaagcaca

SEQ ID NO: 27788 - DNA, 15 bp, Homo sapiens
gttttctcgaagcac

SEQ ID NO: 27789 - DNA, 15 bp, Homo sapiens
agttttctcgaagca

SEQ ID NO: 27790 - DNA, 15 bp, Homo sapiens
gagttttctcgaagc

SEQ ID NO: 27791 - DNA, 15 bp, Homo sapiens
tgagttttctcgaag

SEQ ID NO: 27792 - DNA, 15 bp, Homo sapiens
gtgagttttctcgaa

SEQ ID NO: 27793 - DNA, 15 bp, Homo sapiens
agtgagttttctcga

SEQ ID NO: 27794 - DNA, 15 bp, Homo sapiens
aagtgagttttctcg

SEQ ID NO: 27795 - DNA, 15 bp, Homo sapiens
caagtgagttttctc

SEQ ID NO: 27796 - DNA, 15 bp, Homo sapiens
gcaagtgagttttct

SEQ ID NO: 27797 - DNA, 15 bp, Homo sapiens
agcaagtgagttttc

SEQ ID NO: 27798 - DNA, 15 bp, Homo sapiens
cagcaagtgagtttt

SEQ ID NO: 27799 - DNA, 15 bp, Homo sapiens
tcagcaagtgagttt

SEQ ID NO: 27800 - DNA, 15 bp, Homo sapiens
gtcagcaagtgagtt

SEQ ID NO: 27801 - DNA, 15 bp, Homo sapiens
ggtcagcaagtgagt

SEQ ID NO: 27802 - DNA, 15 bp, Homo sapiens
aggtcagcaagtgag

SEQ ID NO: 27803 - DNA, 15 bp, Homo sapiens
aaggtcagcaagtga

SEQ ID NO: 27804 - DNA, 15 bp, Homo sapiens
aaaggtcagcaagtg

SEQ ID NO: 27805 - DNA, 15 bp, Homo sapiens
caaaggtcagcaagt

SEQ ID NO: 27806 - DNA, 15 bp, Homo sapiens
acaaaggtcagcaag

SEQ ID NO: 27807 - DNA, 15 bp, Homo sapiens
aacaaaggtcagcaa

SEQ ID NO: 27808 - DNA, 15 bp, Homo sapiens
gaacaaaggtcagca

SEQ ID NO: 27809 - DNA, 15 bp, Homo sapiens
ggaacaaaggtcagc

SEQ ID NO: 27810 - DNA, 15 bp, Homo sapiens
tggaacaaaggtcag

SEQ ID NO: 27811 - DNA, 15 bp, Homo sapiens
gtggaacaaaggtca

SEQ ID NO: 27812 - DNA, 15 bp, Homo sapiens
tgtggaacaaaggtc

SEQ ID NO: 27813 - DNA, 15 bp, Homo sapiens
ctgtggaacaaaggt

SEQ ID NO: 27814 - DNA, 15 bp, Homo sapiens
gctgtggaacaaagg

SEQ ID NO: 27815 - DNA, 15 bp, Homo sapiens
ggctgtggaacaaag

SEQ ID NO: 27816 - DNA, 15 bp, Homo sapiens
gggctgtggaacaaa

SEQ ID NO: 27817 - DNA, 15 bp, Homo sapiens
tgggctgtggaacaa

SEQ ID NO: 27818 - DNA, 15 bp, Homo sapiens
ctgggctgtggaaca

SEQ ID NO: 27819 - DNA, 15 bp, Homo sapiens
gctgggctgtggaac

SEQ ID NO: 27820 - DNA, 15 bp, Homo sapiens
tgctgggctgtggaa

SEQ ID NO: 27821 - DNA, 15 bp, Homo sapiens
ctgctgggctgtgga

SEQ ID NO: 27822 - DNA, 15 bp, Homo sapiens
cctgctgggctgtgg

SEQ ID NO: 27823 - DNA, 15 bp, Homo sapiens
acctgctgggctgtg

SEQ ID NO: 27824 - DNA, 15 bp, Homo sapiens
aacctgctgggctgt

SEQ ID NO: 27825 - DNA, 15 bp, Homo sapiens
caacctgctgggctg

SEQ ID NO: 27826 - DNA, 15 bp, Homo sapiens
gcaacctgctgggct

SEQ ID NO: 27827 - DNA, 15 bp, Homo sapiens
ggcaacctgctgggc

SEQ ID NO: 27828 - DNA, 15 bp, Homo sapiens
tggcaacctgctggg

SEQ ID NO: 27829 - DNA, 15 bp, Homo sapiens
gtggcaacctgctgg

SEQ ID NO: 27830 - DNA, 15 bp, Homo sapiens
ggtggcaacctgctg

SEQ ID NO: 27831 - DNA, 15 bp, Homo sapiens
aggtggcaacctgct

SEQ ID NO: 27832 - DNA, 15 bp, Homo sapiens
caggtggcaacctgc

SEQ ID NO: 27833 - DNA, 15 bp, Homo sapiens
tcaggtggcaacctg

SEQ ID NO: 27834 - DNA, 15 bp, Homo sapiens
atcaggtggcaacct

SEQ ID NO: 27835 - DNA, 15 bp, Homo sapiens
aatcaggtggcaacc

SEQ ID NO: 27836 - DNA, 15 bp, Homo sapiens
aaatcaggtggcaac

SEQ ID NO: 27837 - DNA, 15 bp, Homo sapiens
taaatcaggtggcaa

SEQ ID NO: 27838 - DNA, 15 bp, Homo sapiens
ataaatcaggtggca

SEQ ID NO: 27839 - DNA, 15 bp, Homo sapiens
tataaatcaggtggc

SEQ ID NO: 27840 - DNA, 15 bp, Homo sapiens
ttataaatcaggtgg

SEQ ID NO: 27841 - DNA, 15 bp, Homo sapiens
tttataaatcaggtg

SEQ ID NO: 27842 - DNA, 15 bp, Homo sapiens
ttttataaatcaggt

SEQ ID NO: 27843 - DNA, 15 bp, Homo sapiens
tttttataaatcagg

SEQ ID NO: 27844 - DNA, 15 bp, Homo sapiens
gtttttataaatcag

SEQ ID NO: 27845 - DNA, 15 bp, Homo sapiens
tgtttttataaatca

SEQ ID NO: 27846 - DNA, 15 bp, Homo sapiens
ctgtttttataaatc

SEQ ID NO: 27847 - DNA, 15 bp, Homo sapiens
tctgtttttataaat

SEQ ID NO: 27848 - DNA, 15 bp, Homo sapiens
atctgtttttataaa

SEQ ID NO: 27849 - DNA, 15 bp, Homo sapiens
aatctgtttttataa

SEQ ID NO: 27850 - DNA, 15 bp, Homo sapiens
taatctgtttttata

SEQ ID NO: 27851 - DNA, 15 bp, Homo sapiens
ataatctgtttttat

SEQ ID NO: 27852 - DNA, 15 bp, Homo sapiens
cataatctgttttta

SEQ ID NO: 27853 - DNA, 15 bp, Homo sapiens
ccataatctgttttt

SEQ ID NO: 27854 - DNA, 15 bp, Homo sapiens
tccataatctgtttt

SEQ ID NO: 27855 - DNA, 15 bp, Homo sapiens
ctccataatctgttt

SEQ ID NO: 27856 - DNA, 15 bp, Homo sapiens
tctccataatctgtt

SEQ ID NO: 27857 - DNA, 15 bp, Homo sapiens
gtctccataatctgt

SEQ ID NO: 27858 - DNA, 15 bp, Homo sapiens
tgtctccataatctg

SEQ ID NO: 27859 - DNA, 15 bp, Homo sapiens
ctgtctccataatct

SEQ ID NO: 27860 - DNA, 15 bp, Homo sapiens
actgtctccataatc

SEQ ID NO: 27861 - DNA, 15 bp, Homo sapiens
gactgtctccataat

SEQ ID NO: 27862 - DNA, 15 bp, Homo sapiens
ggactgtctccataa

SEQ ID NO: 27863 - DNA, 15 bp, Homo sapiens
tggactgtctccata

SEQ ID NO: 27864 - DNA, 15 bp, Homo sapiens
ctggactgtctccat

SEQ ID NO: 27865 - DNA, 15 bp, Homo sapiens
tctggactgtctcca

SEQ ID NO: 27866 - DNA, 15 bp, Homo sapiens
ttctggactgtctcc

SEQ ID NO: 27867 - DNA, 15 bp, Homo sapiens
tttctggactgtctc

SEQ ID NO: 27868 - DNA, 15 bp, Homo sapiens
ttttctggactgtct

SEQ ID NO: 27869 - DNA, 15 bp, Homo sapiens
tttttctggactgtc

SEQ ID NO: 27870 - DNA, 15 bp, Homo sapiens
atttttctggactgt

SEQ ID NO: 27871 - DNA, 15 bp, Homo sapiens
aatttttctggactg

SEQ ID NO: 27872 - DNA, 15 bp, Homo sapiens
taatttttctggact

SEQ ID NO: 27873 - DNA, 15 bp, Homo sapiens
gtaatttttctggac

SEQ ID NO: 27874 - DNA, 15 bp, Homo sapiens
agtaatttttctgga

SEQ ID NO: 27875 - DNA, 15 bp, Homo sapiens
gagtaatttttctgg

SEQ ID NO: 27876 - DNA, 15 bp, Homo sapiens
ggagtaatttttctg

SEQ ID NO: 27877 - DNA, 15 bp, Homo sapiens
gggagtaatttttct

SEQ ID NO: 27878 - DNA, 15 bp, Homo sapiens
agggagtaatttttc

SEQ ID NO: 27879 - DNA, 15 bp, Homo sapiens
gagggagtaattttt

SEQ ID NO: 27880 - DNA, 15 bp, Homo sapiens
agagggagtaatttt

SEQ ID NO: 27881 - DNA, 15 bp, Homo sapiens
aagagggagtaattt

SEQ ID NO: 27882 - DNA, 15 bp, Homo sapiens
aaagagggagtaatt

SEQ ID NO: 27883 - DNA, 15 bp, Homo sapiens
gaaagagggagtaat

SEQ ID NO: 27884 - DNA, 15 bp, Homo sapiens
agaaagagggagtaa

SEQ ID NO: 27885 - DNA, 15 bp, Homo sapiens
aagaaagagggagta

SEQ ID NO: 27886 - DNA, 15 bp, Homo sapiens
aaagaaagagggagt

SEQ ID NO: 27887 - DNA, 15 bp, Homo sapiens
aaaagaaagagggag

SEQ ID NO: 27888 - DNA, 15 bp, Homo sapiens
aaaaagaaagaggga

SEQ ID NO: 27889 - DNA, 15 bp, Homo sapiens
aaaaaagaaagaggg

SEQ ID NO: 27890 - DNA, 15 bp, Homo sapiens
aaaaaaagaaagagg

SEQ ID NO: 27891 - DNA, 15 bp, Homo sapiens
aaaaaaaagaaagag

SEQ ID NO: 27892 - DNA, 15 bp, Homo sapiens
taaaaaaaaaagaaa

SEQ ID NO: 27893 - DNA, 15 bp, Homo sapiens
ttaaaaaaaaaagaa

SEQ ID NO: 27894 - DNA, 15 bp, Homo sapiens
tttaaaaaaaaaaga

SEQ ID NO: 27895 - DNA, 15 bp, Homo sapiens
ctttaaaaaaaaaag

SEQ ID NO: 27896 - DNA, 15 bp, Homo sapiens
actttaaaaaaaaaa

SEQ ID NO: 27897 - DNA, 15 bp, Homo sapiens
tactttaaaaaaaaa

SEQ ID NO: 27898 - DNA, 15 bp, Homo sapiens
ttactttaaaaaaaa

SEQ ID NO: 27899 - DNA, 15 bp, Homo sapiens
attactttaaaaaaa

SEQ ID NO: 27900 - DNA, 15 bp, Homo sapiens
tattactttaaaaaa

SEQ ID NO: 27901 - DNA, 15 bp, Homo sapiens
atattactttaaaaa

SEQ ID NO: 27902 - DNA, 15 bp, Homo sapiens
aatattactttaaaa

SEQ ID NO: 27903 - DNA, 15 bp, Homo sapiens
aaatattactttaaa

SEQ ID NO: 27904 - DNA, 15 bp, Homo sapiens
aaaatattactttaa

SEQ ID NO: 27905 - DNA, 15 bp, Homo sapiens
taaaatattacttta

SEQ ID NO: 27906 - DNA, 15 bp, Homo sapiens
ttaaaatattacttt

SEQ ID NO: 27907 - DNA, 15 bp, Homo sapiens
tttaaaatattactt

SEQ ID NO: 27908 - DNA, 15 bp, Homo sapiens
ttttaaaatattact

SEQ ID NO: 27909 - DNA, 15 bp, Homo sapiens
attttaaaatattac

SEQ ID NO: 27910 - DNA, 15 bp, Homo sapiens
aattttaaaatatta

SEQ ID NO: 27911 - DNA, 15 bp, Homo sapiens
gaattttaaaatatt

SEQ ID NO: 27912 - DNA, 15 bp, Homo sapiens
ggaattttaaaatat

SEQ ID NO: 27913 - DNA, 15 bp, Homo sapiens
aggaattttaaaata

SEQ ID NO: 27914 - DNA, 15 bp, Homo sapiens
aaggaattttaaaat

SEQ ID NO: 27915 - DNA, 15 bp, Homo sapiens
aaaggaattttaaaa

SEQ ID NO: 27916 - DNA, 15 bp, Homo sapiens
gaaaggaattttaaa

SEQ ID NO: 27917 - DNA, 15 bp, Homo sapiens
agaaaggaattttaa

SEQ ID NO: 27918 - DNA, 15 bp, Homo sapiens
aagaaaggaatttta

SEQ ID NO: 27919 - DNA, 15 bp, Homo sapiens
aaagaaaggaatttt

SEQ ID NO: 27920 - DNA, 15 bp, Homo sapiens
aaaagaaaggaattt

SEQ ID NO: 27921 - DNA, 15 bp, Homo sapiens
aaaaagaaaggaatt

SEQ ID NO: 27922 - DNA, 15 bp, Homo sapiens
caaaaagaaaggaat

SEQ ID NO: 27923 - DNA, 15 bp, Homo sapiens
tcaaaaagaaaggaa

SEQ ID NO: 27924 - DNA, 15 bp, Homo sapiens
ttcaaaaagaaagga

SEQ ID NO: 27925 - DNA, 15 bp, Homo sapiens
cttcaaaaagaaagg

SEQ ID NO: 27926 - DNA, 15 bp, Homo sapiens
acttcaaaaagaaag

SEQ ID NO: 27927 - DNA, 15 bp, Homo sapiens
tacttcaaaaagaaa

SEQ ID NO: 27928 - DNA, 15 bp, Homo sapiens
atacttcaaaaagaa

SEQ ID NO: 27929 - DNA, 15 bp, Homo sapiens
aatacttcaaaaaga

SEQ ID NO: 27930 - DNA, 15 bp, Homo sapiens
aaatacttcaaaaag

SEQ ID NO: 27931 - DNA, 15 bp, Homo sapiens
caaatacttcaaaaa

SEQ ID NO: 27932 - DNA, 15 bp, Homo sapiens
ccaaatacttcaaaa

SEQ ID NO: 27933 - DNA, 15 bp, Homo sapiens
cccaaatacttcaaa

SEQ ID NO: 27934 - DNA, 15 bp, Homo sapiens
acccaaatacttcaa

SEQ ID NO: 27935 - DNA, 15 bp, Homo sapiens
aacccaaatacttca

SEQ ID NO: 27936 - DNA, 15 bp, Homo sapiens
caacccaaatacttc

SEQ ID NO: 27937 - DNA, 15 bp, Homo sapiens
acaacccaaatactt

SEQ ID NO: 27938 - DNA, 15 bp, Homo sapiens
aacaacccaaatact

SEQ ID NO: 27939 - DNA, 15 bp, Homo sapiens
aaacaacccaaatac

SEQ ID NO: 27940 - DNA, 15 bp, Homo sapiens
aaaacaacccaaata

SEQ ID NO: 27941 - DNA, 15 bp, Homo sapiens
aaaaacaacccaaat

SEQ ID NO: 27942 - DNA, 15 bp, Homo sapiens
taaaaacaacccaaa

SEQ ID NO: 27943 - DNA, 15 bp, Homo sapiens
ataaaaacaacccaa

SEQ ID NO: 27944 - DNA, 15 bp, Homo sapiens
gataaaaacaaccca

SEQ ID NO: 27945 - DNA, 15 bp, Homo sapiens
tgataaaaacaaccc

SEQ ID NO: 27946 - DNA, 15 bp, Homo sapiens
ttgataaaaacaacc

SEQ ID NO: 27947 - DNA, 15 bp, Homo sapiens
attgataaaaacaac

SEQ ID NO: 27948 - DNA, 15 bp, Homo sapiens
aattgataaaaacaa

SEQ ID NO: 27949 - DNA, 15 bp, Homo sapiens
aaattgataaaaaca

SEQ ID NO: 27950 - DNA, 15 bp, Homo sapiens
gaaattgataaaaac

SEQ ID NO: 27951 - DNA, 15 bp, Homo sapiens
cgaaattgataaaaa

SEQ ID NO: 27952 - DNA, 15 bp, Homo sapiens
acgaaattgataaaa

SEQ ID NO: 27953 - DNA, 15 bp, Homo sapiens
aacgaaattgataaa

SEQ ID NO: 27954 - DNA, 15 bp, Homo sapiens
gaacgaaattgataa

SEQ ID NO: 27955 - DNA, 15 bp, Homo sapiens
tgaacgaaattgata

SEQ ID NO: 27956 - DNA, 15 bp, Homo sapiens
gtgaacgaaattgat

SEQ ID NO: 27957 - DNA, 15 bp, Homo sapiens
agtgaacgaaattga

SEQ ID NO: 27958 - DNA, 15 bp, Homo sapiens
cagtgaacgaaattg

SEQ ID NO: 27959 - DNA, 15 bp, Homo sapiens
acagtgaacgaaatt

SEQ ID NO: 27960 - DNA, 15 bp, Homo sapiens
aacagtgaacgaaat

SEQ ID NO: 27961 - DNA, 15 bp, Homo sapiens
caacagtgaacgaaa

SEQ ID NO: 27962 - DNA, 15 bp, Homo sapiens
gcaacagtgaacgaa

SEQ ID NO: 27963 - DNA, 15 bp, Homo sapiens
ggcaacagtgaacga

SEQ ID NO: 27964 - DNA, 15 bp, Homo sapiens
aggcaacagtgaacg

SEQ ID NO: 27965 - DNA, 15 bp, Homo sapiens
aaggcaacagtgaac

SEQ ID NO: 27966 - DNA, 15 bp, Homo sapiens
taaggcaacagtgaa

SEQ ID NO: 27967 - DNA, 15 bp, Homo sapiens
ttaaggcaacagtga

SEQ ID NO: 27968 - DNA, 15 bp, Homo sapiens
tttaaggcaacagtg

SEQ ID NO: 27969 - DNA, 15 bp, Homo sapiens
atttaaggcaacagt

SEQ ID NO: 27970 - DNA, 15 bp, Homo sapiens
catttaaggcaacag

SEQ ID NO: 27971 - DNA, 15 bp, Homo sapiens
tcatttaaggcaaca

SEQ ID NO: 27972 - DNA, 15 bp, Homo sapiens
gtcatttaaggcaac

SEQ ID NO: 27973 - DNA, 15 bp, Homo sapiens
tgtcatttaaggcaa

SEQ ID NO: 27974 - DNA, 15 bp, Homo sapiens
ttgtcatttaaggca

SEQ ID NO: 27975 - DNA, 15 bp, Homo sapiens
attgtcatttaaggc

SEQ ID NO: 27976 - DNA, 15 bp, Homo sapiens
aattgtcatttaagg

SEQ ID NO: 27977 - DNA, 15 bp, Homo sapiens
gaattgtcatttaag

SEQ ID NO: 27978 - DNA, 15 bp, Homo sapiens
agaattgtcatttaa

SEQ ID NO: 27979 - DNA, 15 bp, Homo sapiens
aagaattgtcattta

SEQ ID NO: 27980 - DNA, 15 bp, Homo sapiens
caagaattgtcattt

SEQ ID NO: 27981 - DNA, 15 bp, Homo sapiens
gcaagaattgtcatt

SEQ ID NO: 27982 - DNA, 15 bp, Homo sapiens
ggcaagaattgtcat

SEQ ID NO: 27983 - DNA, 15 bp, Homo sapiens
aggcaagaattgtca

SEQ ID NO: 27984 - DNA, 15 bp, Homo sapiens
gaggcaagaattgtc

SEQ ID NO: 27985 - DNA, 15 bp, Homo sapiens
ggaggcaagaattgt

SEQ ID NO: 27986 - DNA, 15 bp, Homo sapiens
gggaggcaagaattg

SEQ ID NO: 27987 - DNA, 15 bp, Homo sapiens
agggaggcaagaatt

SEQ ID NO: 27988 - DNA, 15 bp, Homo sapiens
cagggaggcaagaat

SEQ ID NO: 27989 - DNA, 15 bp, Homo sapiens
tcagggaggcaagaa

SEQ ID NO: 27990 - DNA, 15 bp, Homo sapiens
ttcagggaggcaaga

SEQ ID NO: 27991 - DNA, 15 bp, Homo sapiens
cttcagggaggcaag

SEQ ID NO: 27992 - DNA, 15 bp, Homo sapiens
tcttcagggaggcaa

SEQ ID NO: 27993 - DNA, 15 bp, Homo sapiens
ttcttcagggaggca

SEQ ID NO: 27994 - DNA, 15 bp, Homo sapiens
gttcttcagggaggc

SEQ ID NO: 27995 - DNA, 15 bp, Homo sapiens
agttcttcagggagg

SEQ ID NO: 27996 - DNA, 15 bp, Homo sapiens
gagttcttcagggag

SEQ ID NO: 27997 - DNA, 15 bp, Homo sapiens
agagttcttcaggga

SEQ ID NO: 27998 - DNA, 15 bp, Homo sapiens
aagagttcttcaggg

SEQ ID NO: 27999 - DNA, 15 bp, Homo sapiens
caagagttcttcagg

SEQ ID NO: 28000 - DNA, 15 bp, Homo sapiens
ccaagagttcttcag

SEQ ID NO: 28001 - DNA, 15 bp, Homo sapiens
gccaagagttcttca

SEQ ID NO: 28002 - DNA, 15 bp, Homo sapiens
ggccaagagttcttc

SEQ ID NO: 28003 - DNA, 15 bp, Homo sapiens
aggccaagagttctt

SEQ ID NO: 28004 - DNA, 15 bp, Homo sapiens
aaggccaagagttct

SEQ ID NO: 28005 - DNA, 15 bp, Homo sapiens
gaaggccaagagttc

SEQ ID NO: 28006 - DNA, 15 bp, Homo sapiens
tgaaggccaagagtt

SEQ ID NO: 28007 - DNA, 15 bp, Homo sapiens
atgaaggccaagagt

SEQ ID NO: 28008 - DNA, 15 bp, Homo sapiens
aatgaaggccaagag

SEQ ID NO: 28009 - DNA, 15 bp, Homo sapiens
gaatgaaggccaaga

SEQ ID NO: 28010 - DNA, 15 bp, Homo sapiens
ggaatgaaggccaag

SEQ ID NO: 28011 - DNA, 15 bp, Homo sapiens
aggaatgaaggccaa

SEQ ID NO: 28012 - DNA, 15 bp, Homo sapiens
caggaatgaaggcca

SEQ ID NO: 28013 - DNA, 15 bp, Homo sapiens
gcaggaatgaaggcc

SEQ ID NO: 28014 - DNA, 15 bp, Homo sapiens
ggcaggaatgaaggc

SEQ ID NO: 28015 - DNA, 15 bp, Homo sapiens
tggcaggaatgaagg

SEQ ID NO: 28016 - DNA, 15 bp, Homo sapiens
gtggcaggaatgaag

SEQ ID NO: 28017 - DNA, 15 bp, Homo sapiens
agtggcaggaatgaa

SEQ ID NO: 28018 - DNA, 15 bp, Homo sapiens
tagtggcaggaatga

SEQ ID NO: 28019 - DNA, 15 bp, Homo sapiens
gtagtggcaggaatg

SEQ ID NO: 28020 - DNA, 15 bp, Homo sapiens
tgtagtggcaggaat

SEQ ID NO: 28021 - DNA, 15 bp, Homo sapiens
ctgtagtggcaggaa

SEQ ID NO: 28022 - DNA, 15 bp, Homo sapiens
actgtagtggcagga

SEQ ID NO: 28023 - DNA, 15 bp, Homo sapiens
cactgtagtggcagg

SEQ ID NO: 28024 - DNA, 15 bp, Homo sapiens
tcactgtagtggcag

SEQ ID NO: 28025 - DNA, 15 bp, Homo sapiens
ctcactgtagtggca

SEQ ID NO: 28026 - DNA, 15 bp, Homo sapiens
tctcactgtagtggc

SEQ ID NO: 28027 - DNA, 15 bp, Homo sapiens
ttctcactgtagtgg

SEQ ID NO: 28028 - DNA, 15 bp, Homo sapiens
cttctcactgtagtg

SEQ ID NO: 28029 - DNA, 15 bp, Homo sapiens
acttctcactgtagt

SEQ ID NO: 28030 - DNA, 15 bp, Homo sapiens
aacttctcactgtag

SEQ ID NO: 28031 - DNA, 15 bp, Homo sapiens
gaacttctcactgta

SEQ ID NO: 28032 - DNA, 15 bp, Homo sapiens
agaacttctcactgt

SEQ ID NO: 28033 - DNA, 15 bp, Homo sapiens
tagaacttctcactg

SEQ ID NO: 28034 - DNA, 15 bp, Homo sapiens
ttagaacttctcact

SEQ ID NO: 28035 - DNA, 15 bp, Homo sapiens
cttagaacttctcac

SEQ ID NO: 28036 - DNA, 15 bp, Homo sapiens
gcttagaacttctca

SEQ ID NO: 28037 - DNA, 15 bp, Homo sapiens
agcttagaacttctc

SEQ ID NO: 28038 - DNA, 15 bp, Homo sapiens
cagcttagaacttct

SEQ ID NO: 28039 - DNA, 15 bp, Homo sapiens
ccagcttagaacttc

SEQ ID NO: 28040 - DNA, 15 bp, Homo sapiens
tccagcttagaactt

SEQ ID NO: 28041 - DNA, 15 bp, Homo sapiens
ttccagcttagaact

SEQ ID NO: 28042 - DNA, 15 bp, Homo sapiens
cttccagcttagaac

SEQ ID NO: 28043 - DNA, 15 bp, Homo sapiens
ccttccagcttagaa

SEQ ID NO: 28044 - DNA, 15 bp, Homo sapiens
cccttccagcttaga

SEQ ID NO: 28045 - DNA, 15 bp, Homo sapiens
gcccttccagcttag

SEQ ID NO: 28046 - DNA, 15 bp, Homo sapiens
ggcccttccagctta

SEQ ID NO: 28047 - DNA, 15 bp, Homo sapiens
tggcccttccagctt

SEQ ID NO: 28048 - DNA, 15 bp, Homo sapiens
atggcccttccagct

SEQ ID NO: 28049 - DNA, 15 bp, Homo sapiens
gatggcccttccagc

SEQ ID NO: 28050 - DNA, 15 bp, Homo sapiens
ggatggcccttccag

SEQ ID NO: 28051 - DNA, 15 bp, Homo sapiens
gggatggcccttcca

SEQ ID NO: 28052 - DNA, 15 bp, Homo sapiens
tgggatggcccttcc

SEQ ID NO: 28053 - DNA, 15 bp, Homo sapiens
cctgggatggccctt

SEQ ID NO: 28054 - DNA, 15 bp, Homo sapiens
ccctgggatggccct

SEQ ID NO: 28055 - DNA, 15 bp, Homo sapiens
tccctgggatggccc

SEQ ID NO: 28056 - DNA, 15 bp, Homo sapiens
atccctgggatggcc

SEQ ID NO: 28057 - DNA, 15 bp, Homo sapiens
catccctgggatggc

SEQ ID NO: 28058 - DNA, 15 bp, Homo sapiens
tcatccctgggatgg

SEQ ID NO: 28059 - DNA, 15 bp, Homo sapiens
gtcatccctgggatg

SEQ ID NO: 28060 - DNA, 15 bp, Homo sapiens
agtcatccctgggat

SEQ ID NO: 28061 - DNA, 15 bp, Homo sapiens
cagtcatccctggga

SEQ ID NO: 28062 - DNA, 15 bp, Homo sapiens
gcagtcatccctggg

SEQ ID NO: 28063 - DNA, 15 bp, Homo sapiens
agcagtcatccctgg

SEQ ID NO: 28064 - DNA, 15 bp, Homo sapiens
aagcagtcatccctg

SEQ ID NO: 28065 - DNA, 15 bp, Homo sapiens
aaagcagtcatccct

SEQ ID NO: 28066 - DNA, 15 bp, Homo sapiens
taaagcagtcatccc

SEQ ID NO: 28067 - DNA, 15 bp, Homo sapiens
ttaaagcagtcatcc

SEQ ID NO: 28068 - DNA, 15 bp, Homo sapiens
cttaaagcagtcatc

SEQ ID NO: 28069 - DNA, 15 bp, Homo sapiens
gcttaaagcagtcat

SEQ ID NO: 28070 - DNA, 15 bp, Homo sapiens
tgcttaaagcagtca

SEQ ID NO: 28071 - DNA, 15 bp, Homo sapiens
ctgcttaaagcagtc

SEQ ID NO: 28072 - DNA, 15 bp, Homo sapiens
gctgcttaaagcagt

SEQ ID NO: 28073 - DNA, 15 bp, Homo sapiens
ggctgcttaaagcag

SEQ ID NO: 28074 - DNA, 15 bp, Homo sapiens
tggctgcttaaagca

SEQ ID NO: 28075 - DNA, 15 bp, Homo sapiens
ctggctgcttaaagc

SEQ ID NO: 28076 - DNA, 15 bp, Homo sapiens
actggctgcttaaag

SEQ ID NO: 28077 - DNA, 15 bp, Homo sapiens
gactggctgcttaaa

SEQ ID NO: 28078 - DNA, 15 bp, Homo sapiens
tgactggctgcttaa

SEQ ID NO: 28079 - DNA, 15 bp, Homo sapiens
atgactggctgctta

SEQ ID NO: 28080 - DNA, 15 bp, Homo sapiens
catgactggctgctt

SEQ ID NO: 28081 - DNA, 15 bp, Homo sapiens
acatgactggctgct

SEQ ID NO: 28082 - DNA, 15 bp, Homo sapiens
tacatgactggctgc

SEQ ID NO: 28083 - DNA, 15 bp, Homo sapiens
ctacatgactggctg

SEQ ID NO: 28084 - DNA, 15 bp, Homo sapiens
cctacatgactggct

SEQ ID NO: 28085 - DNA, 15 bp, Homo sapiens
ccctacatgactggc

SEQ ID NO: 28086 - DNA, 15 bp, Homo sapiens
accctacatgactgg

SEQ ID NO: 28087 - DNA, 15 bp, Homo sapiens
aaccctacatgactg

SEQ ID NO: 28088 - DNA, 15 bp, Homo sapiens
caaccctacatgact

SEQ ID NO: 28089 - DNA, 15 bp, Homo sapiens
gcaaccctacatgac

SEQ ID NO: 28090 - DNA, 15 bp, Homo sapiens
cgcaaccctacatga

SEQ ID NO: 28091 - DNA, 15 bp, Homo sapiens
gcgcaaccctacatg

SEQ ID NO: 28092 - DNA, 15 bp, Homo sapiens
ggcgcaaccctacat

SEQ ID NO: 28093 - DNA, 15 bp, Homo sapiens
aggcgcaaccctaca

SEQ ID NO: 28094 - DNA, 15 bp, Homo sapiens
caggcgcaaccctac

SEQ ID NO: 28095 - DNA, 15 bp, Homo sapiens
acaggcgcaacccta

SEQ ID NO: 28096 - DNA, 15 bp, Homo sapiens
cacaggcgcaaccct

SEQ ID NO: 28097 - DNA, 15 bp, Homo sapiens
ccacaggcgcaaccc

SEQ ID NO: 28098 - DNA, 15 bp, Homo sapiens
gccacaggcgcaacc

SEQ ID NO: 28099 - DNA, 15 bp, Homo sapiens
ggccacaggcgcaac

SEQ ID NO: 28100 - DNA, 15 bp, Homo sapiens
gggccacaggcgcaa

SEQ ID NO: 28101 - DNA, 15 bp, Homo sapiens
agggccacaggcgca

SEQ ID NO: 28102 - DNA, 15 bp, Homo sapiens
cagggccacaggcgc

SEQ ID NO: 28103 - DNA, 15 bp, Homo sapiens
ccagggccacaggcg

SEQ ID NO: 28104 - DNA, 15 bp, Homo sapiens
gccagggccacaggc

SEQ ID NO: 28105 - DNA, 15 bp, Homo sapiens
tgccagggccacagg

SEQ ID NO: 28106 - DNA, 15 bp, Homo sapiens
ctgccagggccacag

SEQ ID NO: 28107 - DNA, 15 bp, Homo sapiens
tctgccagggccaca

SEQ ID NO: 28108 - DNA, 15 bp, Homo sapiens
atctgccagggccac

SEQ ID NO: 28109 - DNA, 15 bp, Homo sapiens
aatctgccagggcca

SEQ ID NO: 28110 - DNA, 15 bp, Homo sapiens
caatctgccagggcc

SEQ ID NO: 28111 - DNA, 15 bp, Homo sapiens
ccaatctgccagggc

SEQ ID NO: 28112 - DNA, 15 bp, Homo sapiens
tccaatctgccaggg

SEQ ID NO: 28113 - DNA, 15 bp, Homo sapiens
gtccaatctgccagg

SEQ ID NO: 28114 - DNA, 15 bp, Homo sapiens
ggtccaatctgccag

SEQ ID NO: 28115 - DNA, 15 bp, Homo sapiens
gggtccaatctgcca

SEQ ID NO: 28116 - DNA, 15 bp, Homo sapiens
agggtccaatctgcc

SEQ ID NO: 28117 - DNA, 15 bp, Homo sapiens
cagggtccaatctgc

SEQ ID NO: 28118 - DNA, 15 bp, Homo sapiens
acagggtccaatctg

SEQ ID NO: 28119 - DNA, 15 bp, Homo sapiens
aacagggtccaatct

SEQ ID NO: 28120 - DNA, 15 bp, Homo sapiens
aaacagggtccaatc

SEQ ID NO: 28121 - DNA, 15 bp, Homo sapiens
gaaacagggtccaat

SEQ ID NO: 28122 - DNA, 15 bp, Homo sapiens
agaaacagggtccaa

SEQ ID NO: 28123 - DNA, 15 bp, Homo sapiens
tagaaacagggtcca

SEQ ID NO: 28124 - DNA, 15 bp, Homo sapiens
gtagaaacagggtcc

SEQ ID NO: 28125 - DNA, 15 bp, Homo sapiens
ggtagaaacagggtc

SEQ ID NO: 28126 - DNA, 15 bp, Homo sapiens
tggtagaaacagggt

SEQ ID NO: 28127 - DNA, 15 bp, Homo sapiens
ttggtagaaacaggg

SEQ ID NO: 28128 - DNA, 15 bp, Homo sapiens
cttggtagaaacagg

SEQ ID NO: 28129 - DNA, 15 bp, Homo sapiens
acttggtagaaacag

SEQ ID NO: 28130 - DNA, 15 bp, Homo sapiens
cacttggtagaaaca

SEQ ID NO: 28131 - DNA, 15 bp, Homo sapiens
ccacttggtagaaac

SEQ ID NO: 28132 - DNA, 15 bp, Homo sapiens
accacttggtagaaa

SEQ ID NO: 28133 - DNA, 15 bp, Homo sapiens
caccacttggtagaa

SEQ ID NO: 28134 - DNA, 15 bp, Homo sapiens
ccaccacttggtaga

SEQ ID NO: 28135 - DNA, 15 bp, Homo sapiens
gccaccacttggtag

SEQ ID NO: 28136 - DNA, 15 bp, Homo sapiens
tgccaccacttggta

SEQ ID NO: 28137 - DNA, 15 bp, Homo sapiens
atgccaccacttggt

SEQ ID NO: 28138 - DNA, 15 bp, Homo sapiens
gatgccaccacttgg

SEQ ID NO: 28139 - DNA, 15 bp, Homo sapiens
tgatgccaccacttg

SEQ ID NO: 28140 - DNA, 15 bp, Homo sapiens
gtgatgccaccactt

SEQ ID NO: 28141 - DNA, 15 bp, Homo sapiens
agtgatgccaccact

SEQ ID NO: 28142 - DNA, 15 bp, Homo sapiens
aagtgatgccaccac

SEQ ID NO: 28143 - DNA, 15 bp, Homo sapiens
caagtgatgccacca

SEQ ID NO: 28144 - DNA, 15 bp, Homo sapiens
ccaagtgatgccacc

SEQ ID NO: 28145 - DNA, 15 bp, Homo sapiens
gccaagtgatgccac

SEQ ID NO: 28146 - DNA, 15 bp, Homo sapiens
agccaagtgatgcca

SEQ ID NO: 28147 - DNA, 15 bp, Homo sapiens
aagccaagtgatgcc

SEQ ID NO: 28148 - DNA, 15 bp, Homo sapiens
gaagccaagtgatgc

SEQ ID NO: 28149 - DNA, 15 bp, Homo sapiens
ggaagccaagtgatg

SEQ ID NO: 28150 - DNA, 15 bp, Homo sapiens
tggaagccaagtgat

SEQ ID NO: 28151 - DNA, 15 bp, Homo sapiens
atggaagccaagtga

SEQ ID NO: 28152 - DNA, 15 bp, Homo sapiens
catggaagccaagtg

SEQ ID NO: 28153 - DNA, 15 bp, Homo sapiens
acatggaagccaagt

SEQ ID NO: 28154 - DNA, 15 bp, Homo sapiens
tacatggaagccaag

SEQ ID NO: 28155 - DNA, 15 bp, Homo sapiens
ctacatggaagccaa

SEQ ID NO: 28156 - DNA, 15 bp, Homo sapiens
actacatggaagcca

SEQ ID NO: 28157 - DNA, 15 bp, Homo sapiens
cactacatggaagcc

SEQ ID NO: 28158 - DNA, 15 bp, Homo sapiens
acactacatggaagc

SEQ ID NO: 28159 - DNA, 15 bp, Homo sapiens
aacactacatggaag

SEQ ID NO: 28160 - DNA, 15 bp, Homo sapiens
aaacactacatggaa

SEQ ID NO: 28161 - DNA, 15 bp, Homo sapiens
aaaacactacatgga

SEQ ID NO: 28162 - DNA, 15 bp, Homo sapiens
aaaaacactacatgg

SEQ ID NO: 28163 - DNA, 15 bp, Homo sapiens
gaaaaacactacatg

SEQ ID NO: 28164 - DNA, 15 bp, Homo sapiens
agaaaaacactacat

SEQ ID NO: 28165 - DNA, 15 bp, Homo sapiens
cagaaaaacactaca

SEQ ID NO: 28166 - DNA, 15 bp, Homo sapiens
acagaaaaacactac

SEQ ID NO: 28167 - DNA, 15 bp, Homo sapiens
aacagaaaaacacta

SEQ ID NO: 28168 - DNA, 15 bp, Homo sapiens
gaacagaaaaacact

SEQ ID NO: 28169 - DNA, 15 bp, Homo sapiens
agaacagaaaaacac

SEQ ID NO: 28170 - DNA, 15 bp, Homo sapiens
gagaacagaaaaaca

SEQ ID NO: 28171 - DNA, 15 bp, Homo sapiens
ggagaacagaaaaac

SEQ ID NO: 28172 - DNA, 15 bp, Homo sapiens
aggagaacagaaaaa

SEQ ID NO: 28173 - DNA, 15 bp, Homo sapiens
caggagaacagaaaa

SEQ ID NO: 28174 - DNA, 15 bp, Homo sapiens
gcaggagaacagaaa

SEQ ID NO: 28175 - DNA, 15 bp, Homo sapiens
tgcaggagaacagaa

SEQ ID NO: 28176 - DNA, 15 bp, Homo sapiens
ctgcaggagaacaga

SEQ ID NO: 28177 - DNA, 15 bp, Homo sapiens
tctgcaggagaacag

SEQ ID NO: 28178 - DNA, 15 bp, Homo sapiens
atctgcaggagaaca

SEQ ID NO: 28179 - DNA, 15 bp, Homo sapiens
gatctgcaggagaac

SEQ ID NO: 28180 - DNA, 15 bp, Homo sapiens
cgatctgcaggagaa

SEQ ID NO: 28181 - DNA, 15 bp, Homo sapiens
gcgatctgcaggaga

SEQ ID NO: 28182 - DNA, 15 bp, Homo sapiens
agcgatctgcaggag

SEQ ID NO: 28183 - DNA, 15 bp, Homo sapiens
cagcgatctgcagga

SEQ ID NO: 28184 - DNA, 15 bp, Homo sapiens
acagcgatctgcagg

SEQ ID NO: 28185 - DNA, 15 bp, Homo sapiens
gacagcgatctgcag

SEQ ID NO: 28186 - DNA, 15 bp, Homo sapiens
tgacagcgatctgca

SEQ ID NO: 28187 - DNA, 15 bp, Homo sapiens
ctgacagcgatctgc

SEQ ID NO: 28188 - DNA, 15 bp, Homo sapiens
gctgacagcgatctg

SEQ ID NO: 28189 - DNA, 15 bp, Homo sapiens
ggctgacagcgatct

SEQ ID NO: 28190 - DNA, 15 bp, Homo sapiens
tggctgacagcgatc

SEQ ID NO: 28191 - DNA, 15 bp, Homo sapiens
gtggctgacagcgat

SEQ ID NO: 28192 - DNA, 15 bp, Homo sapiens
agtggctgacagcga

SEQ ID NO: 28193 - DNA, 15 bp, Homo sapiens
cagtggctgacagcg

SEQ ID NO: 28194 - DNA, 15 bp, Homo sapiens
ccagtggctgacagc

SEQ ID NO: 28195 - DNA, 15 bp, Homo sapiens
tccagtggctgacag

SEQ ID NO: 28196 - DNA, 15 bp, Homo sapiens
ctccagtggctgaca

SEQ ID NO: 28197 - DNA, 15 bp, Homo sapiens
cctccagtggctgac

SEQ ID NO: 28198 - DNA, 15 bp, Homo sapiens
gcctccagtggctga

SEQ ID NO: 28199 - DNA, 15 bp, Homo sapiens
ggcctccagtggctg

SEQ ID NO: 28200 - DNA, 15 bp, Homo sapiens
aggcctccagtggct

SEQ ID NO: 28201 - DNA, 15 bp, Homo sapiens
gaggcctccagtggc

SEQ ID NO: 28202 - DNA, 15 bp, Homo sapiens
tgaggcctccagtgg

SEQ ID NO: 28203 - DNA, 15 bp, Homo sapiens
gtgaggcctccagtg

SEQ ID NO: 28204 - DNA, 15 bp, Homo sapiens
ggtgaggcctccagt

SEQ ID NO: 28205 - DNA, 15 bp, Homo sapiens
gggtgaggcctccag

SEQ ID NO: 28206 - DNA, 15 bp, Homo sapiens
tgggtgaggcctcca

SEQ ID NO: 28207 - DNA, 15 bp, Homo sapiens
gtgggtgaggcctcc

SEQ ID NO: 28208 - DNA, 15 bp, Homo sapiens
agtgggtgaggcctc

SEQ ID NO: 28209 - DNA, 15 bp, Homo sapiens
cagtgggtgaggcct

SEQ ID NO: 28210 - DNA, 15 bp, Homo sapiens
ccagtgggtgaggcc

SEQ ID NO: 28211 - DNA, 15 bp, Homo sapiens
cccagtgggtgaggc

SEQ ID NO: 28212 - DNA, 15 bp, Homo sapiens
acccagtgggtgagg

SEQ ID NO: 28213 - DNA, 15 bp, Homo sapiens
aacccagtgggtgag

SEQ ID NO: 28214 - DNA, 15 bp, Homo sapiens
gaacccagtgggtga

SEQ ID NO: 28215 - DNA, 15 bp, Homo sapiens
ggaacccagtgggtg

SEQ ID NO: 28216 - DNA, 15 bp, Homo sapiens
tggaacccagtgggt

SEQ ID NO: 28217 - DNA, 15 bp, Homo sapiens
ctggaacccagtggg

SEQ ID NO: 28218 - DNA, 15 bp, Homo sapiens
tctggaacccagtgg

SEQ ID NO: 28219 - DNA, 15 bp, Homo sapiens
gtctggaacccagtg

SEQ ID NO: 28220 - DNA, 15 bp, Homo sapiens
tgtctggaacccagt

SEQ ID NO: 28221 - DNA, 15 bp, Homo sapiens
ctgtctggaacccag

SEQ ID NO: 28222 - DNA, 15 bp, Homo sapiens
gctgtctggaaccca

SEQ ID NO: 28223 - DNA, 15 bp, Homo sapiens
agctgtctggaaccc

SEQ ID NO: 28224 - DNA, 15 bp, Homo sapiens
cagctgtctggaacc

SEQ ID NO: 28225 - DNA, 15 bp, Homo sapiens
gcagctgtctggaac

SEQ ID NO: 28226 - DNA, 15 bp, Homo sapiens
ggcagctgtctggaa

SEQ ID NO: 28227 - DNA, 15 bp, Homo sapiens
tggcagctgtctgga

SEQ ID NO: 28228 - DNA, 15 bp, Homo sapiens
gtggcagctgtctgg

SEQ ID NO: 28229 - DNA, 15 bp, Homo sapiens
agtggcagctgtctg

SEQ ID NO: 28230 - DNA, 15 bp, Homo sapiens
aagtggcagctgtct

SEQ ID NO: 28231 - DNA, 15 bp, Homo sapiens
gaagtggcagctgtc

SEQ ID NO: 28232 - DNA, 15 bp, Homo sapiens
agaagtggcagctgt

SEQ ID NO: 28233 - DNA, 15 bp, Homo sapiens
cagaagtggcagctg

SEQ ID NO: 28234 - DNA, 15 bp, Homo sapiens
acagaagtggcagct

SEQ ID NO: 28235 - DNA, 15 bp, Homo sapiens
aacagaagtggcagc

SEQ ID NO: 28236 - DNA, 15 bp, Homo sapiens
aaacagaagtggcag

SEQ ID NO: 28237 - DNA, 15 bp, Homo sapiens
taaacagaagtggca

SEQ ID NO: 28238 - DNA, 15 bp, Homo sapiens
ctaaacagaagtggc

SEQ ID NO: 28239 - DNA, 15 bp, Homo sapiens
tctaaacagaagtgg

SEQ ID NO: 28240 - DNA, 15 bp, Homo sapiens
ttctaaacagaagtg

SEQ ID NO: 28241 - DNA, 15 bp, Homo sapiens
cttctaaacagaagt

SEQ ID NO: 28242 - DNA, 15 bp, Homo sapiens
gcttctaaacagaag

SEQ ID NO: 28243 - DNA, 15 bp, Homo sapiens
tgcttctaaacagaa

SEQ ID NO: 28244 - DNA, 15 bp, Homo sapiens
ttgcttctaaacaga

SEQ ID NO: 28245 - DNA, 15 bp, Homo sapiens
gttgcttctaaacag

SEQ ID NO: 28246 - DNA, 15 bp, Homo sapiens
tgttgcttctaaaca

SEQ ID NO: 28247 - DNA, 15 bp, Homo sapiens
gtgttgcttctaaac

SEQ ID NO: 28248 - DNA, 15 bp, Homo sapiens
agtgttgcttctaaa

SEQ ID NO: 28249 - DNA, 15 bp, Homo sapiens
cagtgttgcttctaa

SEQ ID NO: 28250 - DNA, 15 bp, Homo sapiens
gcagtgttgcttcta

SEQ ID NO: 28251 - DNA, 15 bp, Homo sapiens
ggcagtgttgcttct

SEQ ID NO: 28252 - DNA, 15 bp, Homo sapiens
tggcagtgttgcttc

SEQ ID NO: 28253 - DNA, 15 bp, Homo sapiens
ctggcagtgttgctt

SEQ ID NO: 28254 - DNA, 15 bp, Homo sapiens
actggcagtgttgct

SEQ ID NO: 28255 - DNA, 15 bp, Homo sapiens
cactggcagtgttgc

SEQ ID NO: 28256 - DNA, 15 bp, Homo sapiens
tcactggcagtgttg

SEQ ID NO: 28257 - DNA, 15 bp, Homo sapiens
ctcactggcagtgtt

SEQ ID NO: 28258 - DNA, 15 bp, Homo sapiens
tctcactggcagtgt

SEQ ID NO: 28259 - DNA, 15 bp, Homo sapiens
ttctcactggcagtg

SEQ ID NO: 28260 - DNA, 15 bp, Homo sapiens
tttctcactggcagt

SEQ ID NO: 28261 - DNA, 15 bp, Homo sapiens
gtttctcactggcag

SEQ ID NO: 28262 - DNA, 15 bp, Homo sapiens
ggtttctcactggca

SEQ ID NO: 28263 - DNA, 15 bp, Homo sapiens
gggtttctcactggc

SEQ ID NO: 28264 - DNA, 15 bp, Homo sapiens
agggtttctcactgg

SEQ ID NO: 28265 - DNA, 15 bp, Homo sapiens
cagggtttctcactg

SEQ ID NO: 28266 - DNA, 15 bp, Homo sapiens
gcagggtttctcact

SEQ ID NO: 28267 - DNA, 15 bp, Homo sapiens
ggcagggtttctcac

SEQ ID NO: 28268 - DNA, 15 bp, Homo sapiens
tggcagggtttctca

SEQ ID NO: 28269 - DNA, 15 bp, Homo sapiens
gtggcagggtttctc

SEQ ID NO: 28270 - DNA, 15 bp, Homo sapiens
tgtggcagggtttct

SEQ ID NO: 28271 - DNA, 15 bp, Homo sapiens
gtgtggcagggtttc

SEQ ID NO: 28272 - DNA, 15 bp, Homo sapiens
tgtgtggcagggttt

SEQ ID NO: 28273 - DNA, 15 bp, Homo sapiens
gtgtgtggcagggtt

SEQ ID NO: 28274 - DNA, 15 bp, Homo sapiens
tgtgtgtggcagggt

SEQ ID NO: 28275 - DNA, 15 bp, Homo sapiens
ttgtgtgtggcaggg

SEQ ID NO: 28276 - DNA, 15 bp, Homo sapiens
gttgtgtgtggcagg

SEQ ID NO: 28277 - DNA, 15 bp, Homo sapiens
tgttgtgtgtggcag

SEQ ID NO: 28278 - DNA, 15 bp, Homo sapiens
gtgttgtgtgtggca

SEQ ID NO: 28279 - DNA, 15 bp, Homo sapiens
tgtgttgtgtgtggc

SEQ ID NO: 28280 - DNA, 15 bp, Homo sapiens
gtgtgttgtgtgtgg

SEQ ID NO: 28281 - DNA, 15 bp, Homo sapiens
tgtgtgttgtgtgtg

SEQ ID NO: 28282 - DNA, 15 bp, Homo sapiens
gtgtgtgttgtgtgt

SEQ ID NO: 28283 - DNA, 15 bp, Homo sapiens
tgtgtgtgttgtgtg

SEQ ID NO: 28284 - DNA, 15 bp, Homo sapiens
ctgtgtgtgttgtgt

SEQ ID NO: 28285 - DNA, 15 bp, Homo sapiens
tctgtgtgtgttgtg

SEQ ID NO: 28286 - DNA, 15 bp, Homo sapiens
gtctgtgtgtgttgt

SEQ ID NO: 28287 - DNA, 15 bp, Homo sapiens
tgtctgtgtgtgttg

SEQ ID NO: 28288 - DNA, 15 bp, Homo sapiens
gtgtctgtgtgtgtt

SEQ ID NO: 28289 - DNA, 15 bp, Homo sapiens
tgtgtctgtgtgtgt

SEQ ID NO: 28290 - DNA, 15 bp, Homo sapiens
gtgtgtctgtgtgtg

SEQ ID NO: 28291 - DNA, 15 bp, Homo sapiens
tgtgtgtctgtgtgt

SEQ ID NO: 28292 - DNA, 15 bp, Homo sapiens
gtgtgtgtctgtgtg

SEQ ID NO: 28293 - DNA, 15 bp, Homo sapiens
tgtgtgtgtctgtgt

SEQ ID NO: 28294 - DNA, 15 bp, Homo sapiens
gtgtgtgtgtctgtg

SEQ ID NO: 28295 - DNA, 15 bp, Homo sapiens
tgtgtgtgtgtctgt

SEQ ID NO: 28296 - DNA, 15 bp, Homo sapiens
gtgtgtgtgtgtctg

SEQ ID NO: 28297 - DNA, 15 bp, Homo sapiens
tgtgtgtgtgtgtct

SEQ ID NO: 28298 - DNA, 15 bp, Homo sapiens
ctgtgtgtgtgtgtc

SEQ ID NO: 28299 - DNA, 15 bp, Homo sapiens
tctgtgtgtgtgtgt

SEQ ID NO: 28300 - DNA, 15 bp, Homo sapiens
gtctgtgtgtgtgtg

SEQ ID NO: 28301 - DNA, 15 bp, Homo sapiens
agtctgtgtgtgtgt

SEQ ID NO: 28302 - DNA, 15 bp, Homo sapiens
gagtctgtgtgtgtg

SEQ ID NO: 28303 - DNA, 15 bp, Homo sapiens
tgagtctgtgtgtgt

SEQ ID NO: 28304 - DNA, 15 bp, Homo sapiens
gtgagtctgtgtgtg

SEQ ID NO: 28305 - DNA, 15 bp, Homo sapiens
tgtgagtctgtgtgt

SEQ ID NO: 28306 - DNA, 15 bp, Homo sapiens
gtgtgagtctgtgtg

SEQ ID NO: 28307 - DNA, 15 bp, Homo sapiens
tgtgtgagtctgtgt

SEQ ID NO: 28308 - DNA, 15 bp, Homo sapiens
gtgtgtgagtctgtg

SEQ ID NO: 28309 - DNA, 15 bp, Homo sapiens
tgtgtgtgagtctgt

SEQ ID NO: 28310 - DNA, 15 bp, Homo sapiens
ctgtgtgtgagtctg

SEQ ID NO: 28311 - DNA, 15 bp, Homo sapiens
tctgtgtgtgagtct

SEQ ID NO: 28312 - DNA, 15 bp, Homo sapiens
ctctgtgtgtgagtc

SEQ ID NO: 28313 - DNA, 15 bp, Homo sapiens
tctctgtgtgtgagt

SEQ ID NO: 28314 - DNA, 15 bp, Homo sapiens
gtctctgtgtgtgag

SEQ ID NO: 28315 - DNA, 15 bp, Homo sapiens
tgtctctgtgtgtga

SEQ ID NO: 28316 - DNA, 15 bp, Homo sapiens
gtgtctctgtgtgtg

SEQ ID NO: 28317 - DNA, 15 bp, Homo sapiens
tgtgtctctgtgtgt

SEQ ID NO: 28318 - DNA, 15 bp, Homo sapiens
gtgtgtctctgtgtg

SEQ ID NO: 28319 - DNA, 15 bp, Homo sapiens
tgtgtgtctctgtgt

SEQ ID NO: 28320 - DNA, 15 bp, Homo sapiens
gtgtgtgtctctgtg

SEQ ID NO: 28321 - DNA, 15 bp, Homo sapiens
tgtgtgtgtctctgt

SEQ ID NO: 28322 - DNA, 15 bp, Homo sapiens
gtgtgtgtgtctctg

SEQ ID NO: 28323 - DNA, 15 bp, Homo sapiens
tgtgtgtgtgtctct

SEQ ID NO: 28324 - DNA, 15 bp, Homo sapiens
gtgtgtgtgtgtctc

SEQ ID NO: 28325 - DNA, 15 bp, Homo sapiens
tgtctgtgtgtgtgt

SEQ ID NO: 28326 - DNA, 15 bp, Homo sapiens
gtgtctgtgtgtgtg

SEQ ID NO: 28327 - DNA, 15 bp, Homo sapiens
gtgtgtgtgtgtgtc

SEQ ID NO: 28328 - DNA, 15 bp, Homo sapiens
tggtgtgtgtgtgtg

SEQ ID NO: 28329 - DNA, 15 bp, Homo sapiens
gtggtgtgtgtgtgt

SEQ ID NO: 28330 - DNA, 15 bp, Homo sapiens
tgtggtgtgtgtgtg

SEQ ID NO: 28331 - DNA, 15 bp, Homo sapiens
gtgtggtgtgtgtgt

SEQ ID NO: 28332 - DNA, 15 bp, Homo sapiens
tgtgtggtgtgtgtg

SEQ ID NO: 28333 - DNA, 15 bp, Homo sapiens
gtgtgtggtgtgtgt

SEQ ID NO: 28334 - DNA, 15 bp, Homo sapiens
tgtgtgtggtgtgtg

SEQ ID NO: 28335 - DNA, 15 bp, Homo sapiens
gtgtgtgtggtgtgt

SEQ ID NO: 28336 - DNA, 15 bp, Homo sapiens
tgtgtgtgtggtgtg

SEQ ID NO: 28337 - DNA, 15 bp, Homo sapiens
gtgtgtgtgtggtgt

SEQ ID NO: 28338 - DNA, 15 bp, Homo sapiens
tgtgtgtgtgtggtg

SEQ ID NO: 28339 - DNA, 15 bp, Homo sapiens
gtgtgtgtgtgtggt

SEQ ID NO: 28340 - DNA, 15 bp, Homo sapiens
tgtgtgtgtgtgtgg

SEQ ID NO: 28341 - DNA, 15 bp, Homo sapiens
atgtgtgtgtgtgtg

SEQ ID NO: 28342 - DNA, 15 bp, Homo sapiens
catgtgtgtgtgtgt

SEQ ID NO: 28343 - DNA, 15 bp, Homo sapiens
acatgtgtgtgtgtg

SEQ ID NO: 28344 - DNA, 15 bp, Homo sapiens
cacatgtgtgtgtgt

SEQ ID NO: 28345 - DNA, 15 bp, Homo sapiens
tcacatgtgtgtgtg

SEQ ID NO: 28346 - DNA, 15 bp, Homo sapiens
ctcacatgtgtgtgt

SEQ ID NO: 28347 - DNA, 15 bp, Homo sapiens
tctcacatgtgtgtg

SEQ ID NO: 28348 - DNA, 15 bp, Homo sapiens
ctctcacatgtgtgt

SEQ ID NO: 28349 - DNA, 15 bp, Homo sapiens
cctctcacatgtgtg

SEQ ID NO: 28350 - DNA, 15 bp, Homo sapiens
tcctctcacatgtgt

SEQ ID NO: 28351 - DNA, 15 bp, Homo sapiens
ctcctctcacatgtg

SEQ ID NO: 28352 - DNA, 15 bp, Homo sapiens
cctcctctcacatgt

SEQ ID NO: 28353 - DNA, 15 bp, Homo sapiens
ccctcctctcacatg

SEQ ID NO: 28354 - DNA, 15 bp, Homo sapiens
gccctcctctcacat

SEQ ID NO: 28355 - DNA, 15 bp, Homo sapiens
ggccctcctctcaca

SEQ ID NO: 28356 - DNA, 15 bp, Homo sapiens
tggccctcctctcac

SEQ ID NO: 28357 - DNA, 15 bp, Homo sapiens
gtggccctcctctca

SEQ ID NO: 28358 - DNA, 15 bp, Homo sapiens
ggtggccctcctctc

SEQ ID NO: 28359 - DNA, 15 bp, Homo sapiens
gggtggccctcctct

SEQ ID NO: 28360 - DNA, 15 bp, Homo sapiens
agggtggccctcctc

SEQ ID NO: 28361 - DNA, 15 bp, Homo sapiens
cagggtggccctcct

SEQ ID NO: 28362 - DNA, 15 bp, Homo sapiens
ccagggtggccctcc

SEQ ID NO: 28363 - DNA, 15 bp, Homo sapiens
cccagggtggccctc

SEQ ID NO: 28364 - DNA, 15 bp, Homo sapiens
tcccagggtggccct

SEQ ID NO: 28365 - DNA, 15 bp, Homo sapiens
ctcccagggtggccc

SEQ ID NO: 28366 - DNA, 15 bp, Homo sapiens
cctcccagggtggcc

SEQ ID NO: 28367 - DNA, 15 bp, Homo sapiens
tcctcccagggtggc

SEQ ID NO: 28368 - DNA, 15 bp, Homo sapiens
ttcctcccagggtgg

SEQ ID NO: 28369 - DNA, 15 bp, Homo sapiens
tttcctcccagggtg

SEQ ID NO: 28370 - DNA, 15 bp, Homo sapiens
gtttcctcccagggt

SEQ ID NO: 28371 - DNA, 15 bp, Homo sapiens
ggtttcctcccaggg

SEQ ID NO: 28372 - DNA, 15 bp, Homo sapiens
gggtttcctcccagg

SEQ ID NO: 28373 - DNA, 15 bp, Homo sapiens
agggtttcctcccag

SEQ ID NO: 28374 - DNA, 15 bp, Homo sapiens
cagggtttcctccca

SEQ ID NO: 28375 - DNA, 15 bp, Homo sapiens
tcagggtttcctccc

SEQ ID NO: 28376 - DNA, 15 bp, Homo sapiens
ttcagggtttcctcc

SEQ ID NO: 28377 - DNA, 15 bp, Homo sapiens
attcagggtttcctc

SEQ ID NO: 28378 - DNA, 15 bp, Homo sapiens
aattcagggtttcct

SEQ ID NO: 28379 - DNA, 15 bp, Homo sapiens
gaattcagggtttcc

SEQ ID NO: 28380 - DNA, 15 bp, Homo sapiens
agaattcagggtttc

SEQ ID NO: 28381 - DNA, 15 bp, Homo sapiens
gagaattcagggttt

SEQ ID NO: 28382 - DNA, 15 bp, Homo sapiens
ggagaattcagggtt

SEQ ID NO: 28383 - DNA, 15 bp, Homo sapiens
gggagaattcagggt

SEQ ID NO: 28384 - DNA, 15 bp, Homo sapiens
ggggagaattcaggg

SEQ ID NO: 28385 - DNA, 15 bp, Homo sapiens
aggggagaattcagg

SEQ ID NO: 28386 - DNA, 15 bp, Homo sapiens
gaggggagaattcag

SEQ ID NO: 28387 - DNA, 15 bp, Homo sapiens
agaggggagaattca

SEQ ID NO: 28388 - DNA, 15 bp, Homo sapiens
aagaggggagaattc

SEQ ID NO: 28389 - DNA, 15 bp, Homo sapiens
taagaggggagaatt

SEQ ID NO: 28390 - DNA, 15 bp, Homo sapiens
ctaagaggggagaat

SEQ ID NO: 28391 - DNA, 15 bp, Homo sapiens
gctaagaggggagaa

SEQ ID NO: 28392 - DNA, 15 bp, Homo sapiens
tgctaagaggggaga

SEQ ID NO: 28393 - DNA, 15 bp, Homo sapiens
gtgctaagaggggag

SEQ ID NO: 28394 - DNA, 15 bp, Homo sapiens
tgtgctaagagggga

SEQ ID NO: 28395 - DNA, 15 bp, Homo sapiens
gtgtgctaagagggg

SEQ ID NO: 28396 - DNA, 15 bp, Homo sapiens
agtgtgctaagaggg

SEQ ID NO: 28397 - DNA, 15 bp, Homo sapiens
gagtgtgctaagagg

SEQ ID NO: 28398 - DNA, 15 bp, Homo sapiens
ggagtgtgctaagag

SEQ ID NO: 28399 - DNA, 15 bp, Homo sapiens
aggagtgtgctaaga

SEQ ID NO: 28400 - DNA, 15 bp, Homo sapiens
aaggagtgtgctaag

SEQ ID NO: 28401 - DNA, 15 bp, Homo sapiens
gaaggagtgtgctaa

SEQ ID NO: 28402 - DNA, 15 bp, Homo sapiens
agaaggagtgtgcta

SEQ ID NO: 28403 - DNA, 15 bp, Homo sapiens
tagaaggagtgtgct

SEQ ID NO: 28404 - DNA, 15 bp, Homo sapiens
atagaaggagtgtgc

SEQ ID NO: 28405 - DNA, 15 bp, Homo sapiens
gatagaaggagtgtg

SEQ ID NO: 28406 - DNA, 15 bp, Homo sapiens
agatagaaggagtgt

SEQ ID NO: 28407 - DNA, 15 bp, Homo sapiens
tagatagaaggagtg

SEQ ID NO: 28408 - DNA, 15 bp, Homo sapiens
gtagatagaaggagt

SEQ ID NO: 28409 - DNA, 15 bp, Homo sapiens
agtagatagaaggag

SEQ ID NO: 28410 - DNA, 15 bp, Homo sapiens
gagtagatagaagga

SEQ ID NO: 28411 - DNA, 15 bp, Homo sapiens
ggagtagatagaagg

SEQ ID NO: 28412 - DNA, 15 bp, Homo sapiens
aggagtagatagaag

SEQ ID NO: 28413 - DNA, 15 bp, Homo sapiens
aaggagtagatagaa

SEQ ID NO: 28414 - DNA, 15 bp, Homo sapiens
gaaggagtagataga

SEQ ID NO: 28415 - DNA, 15 bp, Homo sapiens
agaaggagtagatag

SEQ ID NO: 28416 - DNA, 15 bp, Homo sapiens
tagaaggagtagata

SEQ ID NO: 28417 - DNA, 15 bp, Homo sapiens
atagaaggagtagat

SEQ ID NO: 28418 - DNA, 15 bp, Homo sapiens
gatagaaggagtaga

SEQ ID NO: 28419 - DNA, 15 bp, Homo sapiens
agatagaaggagtag

SEQ ID NO: 28420 - DNA, 15 bp, Homo sapiens
gagatagaaggagta

SEQ ID NO: 28421 - DNA, 15 bp, Homo sapiens
ggagatagaaggagt

SEQ ID NO: 28422 - DNA, 15 bp, Homo sapiens
aggagatagaaggag

SEQ ID NO: 28423 - DNA, 15 bp, Homo sapiens
caggagatagaagga

SEQ ID NO: 28424 - DNA, 15 bp, Homo sapiens
ccaggagatagaagg

SEQ ID NO: 28425 - DNA, 15 bp, Homo sapiens
accaggagatagaag

SEQ ID NO: 28426 - DNA, 15 bp, Homo sapiens
taccaggagatagaa

SEQ ID NO: 28427 - DNA, 15 bp, Homo sapiens
ctaccaggagataga

SEQ ID NO: 28428 - DNA, 15 bp, Homo sapiens
tctaccaggagatag

SEQ ID NO: 28429 - DNA, 15 bp, Homo sapiens
ctctaccaggagata

SEQ ID NO: 28430 - DNA, 15 bp, Homo sapiens
cctctaccaggagat

SEQ ID NO: 28431 - DNA, 15 bp, Homo sapiens
ccctctaccaggaga

SEQ ID NO: 28432 - DNA, 15 bp, Homo sapiens
tccctctaccaggag

SEQ ID NO: 28433 - DNA, 15 bp, Homo sapiens
ctccctctaccagga

SEQ ID NO: 28434 - DNA, 15 bp, Homo sapiens
tctccctctaccagg

SEQ ID NO: 28435 - DNA, 15 bp, Homo sapiens
ttctccctctaccag

SEQ ID NO: 28436 - DNA, 15 bp, Homo sapiens
cttctccctctacca

SEQ ID NO: 28437 - DNA, 15 bp, Homo sapiens
gcttctccctctacc

SEQ ID NO: 28438 - DNA, 15 bp, Homo sapiens
agcttctccctctac

SEQ ID NO: 28439 - DNA, 15 bp, Homo sapiens
cagcttctccctcta

SEQ ID NO: 28440 - DNA, 15 bp, Homo sapiens
acagcttctccctct

SEQ ID NO: 28441 - DNA, 15 bp, Homo sapiens
cacagcttctccctc

SEQ ID NO: 28442 - DNA, 15 bp, Homo sapiens
acacagcttctccct

SEQ ID NO: 28443 - DNA, 15 bp, Homo sapiens
cacacagcttctccc

SEQ ID NO: 28444 - DNA, 15 bp, Homo sapiens
gcacacagcttctcc

SEQ ID NO: 28445 - DNA, 15 bp, Homo sapiens
ggcacacagcttctc

SEQ ID NO: 28446 - DNA, 15 bp, Homo sapiens
gggcacacagcttct

SEQ ID NO: 28447 - DNA, 15 bp, Homo sapiens
ggggcacacagcttc

SEQ ID NO: 28448 - DNA, 15 bp, Homo sapiens
aggggcacacagctt

SEQ ID NO: 28449 - DNA, 15 bp, Homo sapiens
taggggcacacagct

SEQ ID NO: 28450 - DNA, 15 bp, Homo sapiens
ataggggcacacagc

SEQ ID NO: 28451 - DNA, 15 bp, Homo sapiens
aataggggcacacag

SEQ ID NO: 28452 - DNA, 15 bp, Homo sapiens
taataggggcacaca

SEQ ID NO: 28453 - DNA, 15 bp, Homo sapiens
gtaataggggcacac

SEQ ID NO: 28454 - DNA, 15 bp, Homo sapiens
agtaataggggcaca

SEQ ID NO: 28455 - DNA, 15 bp, Homo sapiens
tagtaataggggcac

SEQ ID NO: 28456 - DNA, 15 bp, Homo sapiens
gtagtaataggggca

SEQ ID NO: 28457 - DNA, 15 bp, Homo sapiens
ggtagtaataggggc

SEQ ID NO: 28458 - DNA, 15 bp, Homo sapiens
aggtagtaatagggg

SEQ ID NO: 28459 - DNA, 15 bp, Homo sapiens
gaggtagtaataggg

SEQ ID NO: 28460 - DNA, 15 bp, Homo sapiens
agaggtagtaatagg

SEQ ID NO: 28461 - DNA, 15 bp, Homo sapiens
gagaggtagtaatag

SEQ ID NO: 28462 - DNA, 15 bp, Homo sapiens
agagaggtagtaata

SEQ ID NO: 28463 - DNA, 15 bp, Homo sapiens
aagagaggtagtaat

SEQ ID NO: 28464 - DNA, 15 bp, Homo sapiens
aaagagaggtagtaa

SEQ ID NO: 28465 - DNA, 15 bp, Homo sapiens
taaagagaggtagta

SEQ ID NO: 28466 - DNA, 15 bp, Homo sapiens
gtaaagagaggtagt

SEQ ID NO: 28467 - DNA, 15 bp, Homo sapiens
ggtaaagagaggtag

SEQ ID NO: 28468 - DNA, 15 bp, Homo sapiens
aggtaaagagaggta

SEQ ID NO: 28469 - DNA, 15 bp, Homo sapiens
gaggtaaagagaggt

SEQ ID NO: 28470 - DNA, 15 bp, Homo sapiens
ggaggtaaagagagg

SEQ ID NO: 28471 - DNA, 15 bp, Homo sapiens
aggaggtaaagagag

SEQ ID NO: 28472 - DNA, 15 bp, Homo sapiens
gaggaggtaaagaga

SEQ ID NO: 28473 - DNA, 15 bp, Homo sapiens
tgaggaggtaaagag

SEQ ID NO: 28474 - DNA, 15 bp, Homo sapiens
atgaggaggtaaaga

SEQ ID NO: 28475 - DNA, 15 bp, Homo sapiens
aatgaggaggtaaag

SEQ ID NO: 28476 - DNA, 15 bp, Homo sapiens
taatgaggaggtaaa

SEQ ID NO: 28477 - DNA, 15 bp, Homo sapiens
ttaatgaggaggtaa

SEQ ID NO: 28478 - DNA, 15 bp, Homo sapiens
cttaatgaggaggta

SEQ ID NO: 28479 - DNA, 15 bp, Homo sapiens
ccttaatgaggaggt

SEQ ID NO: 28480 - DNA, 15 bp, Homo sapiens
cccttaatgaggagg

SEQ ID NO: 28481 - DNA, 15 bp, Homo sapiens
gcccttaatgaggag

SEQ ID NO: 28482 - DNA, 15 bp, Homo sapiens
agcccttaatgagga

SEQ ID NO: 28483 - DNA, 15 bp, Homo sapiens
aagcccttaatgagg

SEQ ID NO: 28484 - DNA, 15 bp, Homo sapiens
aaagcccttaatgag

SEQ ID NO: 28485 - DNA, 15 bp, Homo sapiens
caaagcccttaatga

SEQ ID NO: 28486 - DNA, 15 bp, Homo sapiens
ccaaagcccttaatg

SEQ ID NO: 28487 - DNA, 15 bp, Homo sapiens
accaaagcccttaat

SEQ ID NO: 28488 - DNA, 15 bp, Homo sapiens
caccaaagcccttaa

SEQ ID NO: 28489 - DNA, 15 bp, Homo sapiens
gcaccaaagccctta

SEQ ID NO: 28490 - DNA, 15 bp, Homo sapiens
cgcaccaaagccctt

SEQ ID NO: 28491 - DNA, 15 bp, Homo sapiens
tcgcaccaaagccct

SEQ ID NO: 28492 - DNA, 15 bp, Homo sapiens
atcgcaccaaagccc

SEQ ID NO: 28493 - DNA, 15 bp, Homo sapiens
aatcgcaccaaagcc

SEQ ID NO: 28494 - DNA, 15 bp, Homo sapiens
taatcgcaccaaagc

SEQ ID NO: 28495 - DNA, 15 bp, Homo sapiens
ataatcgcaccaaag

SEQ ID NO: 28496 - DNA, 15 bp, Homo sapiens
aataatcgcaccaaa

SEQ ID NO: 28497 - DNA, 15 bp, Homo sapiens
caataatcgcaccaa

SEQ ID NO: 28498 - DNA, 15 bp, Homo sapiens
acaataatcgcacca

SEQ ID NO: 28499 - DNA, 15 bp, Homo sapiens
gacaataatcgcacc

SEQ ID NO: 28500 - DNA, 15 bp, Homo sapiens
agacaataatcgcac

SEQ ID NO: 28501 - DNA, 15 bp, Homo sapiens
gagacaataatcgca

SEQ ID NO: 28502 - DNA, 15 bp, Homo sapiens
ggagacaataatcgc

SEQ ID NO: 28503 - DNA, 15 bp, Homo sapiens
gggagacaataatcg

SEQ ID NO: 28504 - DNA, 15 bp, Homo sapiens
agggagacaataatc

SEQ ID NO: 28505 - DNA, 15 bp, Homo sapiens
aagggagacaataat

SEQ ID NO: 28506 - DNA, 15 bp, Homo sapiens
aaagggagacaataa

SEQ ID NO: 28507 - DNA, 15 bp, Homo sapiens
aaaagggagacaata

SEQ ID NO: 28508 - DNA, 15 bp, Homo sapiens
taaaagggagacaat

SEQ ID NO: 28509 - DNA, 15 bp, Homo sapiens
ttaaaagggagacaa

SEQ ID NO: 28510 - DNA, 15 bp, Homo sapiens
attaaaagggagaca

SEQ ID NO: 28511 - DNA, 15 bp, Homo sapiens
gattaaaagggagac

SEQ ID NO: 28512 - DNA, 15 bp, Homo sapiens
agattaaaagggaga

SEQ ID NO: 28513 - DNA, 15 bp, Homo sapiens
gagattaaaagggag

SEQ ID NO: 28514 - DNA, 15 bp, Homo sapiens
tgagattaaaaggga

SEQ ID NO: 28515 - DNA, 15 bp, Homo sapiens
gtgagattaaaaggg

SEQ ID NO: 28516 - DNA, 15 bp, Homo sapiens
agtgagattaaaagg

SEQ ID NO: 28517 - DNA, 15 bp, Homo sapiens
tagtgagattaaaag

SEQ ID NO: 28518 - DNA, 15 bp, Homo sapiens
gtagtgagattaaaa

SEQ ID NO: 28519 - DNA, 15 bp, Homo sapiens
agtagtgagattaaa

SEQ ID NO: 28520 - DNA, 15 bp, Homo sapiens
aagtagtgagattaa

SEQ ID NO: 28521 - DNA, 15 bp, Homo sapiens
caagtagtgagatta

SEQ ID NO: 28522 - DNA, 15 bp, Homo sapiens
gcaagtagtgagatt

SEQ ID NO: 28523 - DNA, 15 bp, Homo sapiens
tgcaagtagtgagat

SEQ ID NO: 28524 - DNA, 15 bp, Homo sapiens
atgcaagtagtgaga

SEQ ID NO: 28525 - DNA, 15 bp, Homo sapiens
catgcaagtagtgag

SEQ ID NO: 28526 - DNA, 15 bp, Homo sapiens
gcatgcaagtagtga

SEQ ID NO: 28527 - DNA, 15 bp, Homo sapiens
tgcatgcaagtagtg

SEQ ID NO: 28528 - DNA, 15 bp, Homo sapiens
ctgcatgcaagtagt

SEQ ID NO: 28529 - DNA, 15 bp, Homo sapiens
gctgcatgcaagtag

SEQ ID NO: 28530 - DNA, 15 bp, Homo sapiens
agctgcatgcaagta

SEQ ID NO: 28531 - DNA, 15 bp, Homo sapiens
aagctgcatgcaagt

SEQ ID NO: 28532 - DNA, 15 bp, Homo sapiens
aaagctgcatgcaag

SEQ ID NO: 28533 - DNA, 15 bp, Homo sapiens
gaaagctgcatgcaa

SEQ ID NO: 28534 - DNA, 15 bp, Homo sapiens
agaaagctgcatgca

SEQ ID NO: 28535 - DNA, 15 bp, Homo sapiens
aagaaagctgcatgc

SEQ ID NO: 28536 - DNA, 15 bp, Homo sapiens
caagaaagctgcatg

SEQ ID NO: 28537 - DNA, 15 bp, Homo sapiens
tcaagaaagctgcat

SEQ ID NO: 28538 - DNA, 15 bp, Homo sapiens
ctcaagaaagctgca

SEQ ID NO: 28539 - DNA, 15 bp, Homo sapiens
tctcaagaaagctgc

SEQ ID NO: 28540 - DNA, 15 bp, Homo sapiens
ttctcaagaaagctg

SEQ ID NO: 28541 - DNA, 15 bp, Homo sapiens
tttctcaagaaagct

SEQ ID NO: 28542 - DNA, 15 bp, Homo sapiens
ctttctcaagaaagc

SEQ ID NO: 28543 - DNA, 15 bp, Homo sapiens
cctttctcaagaaag

SEQ ID NO: 28544 - DNA, 15 bp, Homo sapiens
acctttctcaagaaa

SEQ ID NO: 28545 - DNA, 15 bp, Homo sapiens
aacctttctcaagaa

SEQ ID NO: 28546 - DNA, 15 bp, Homo sapiens
taacctttctcaaga

SEQ ID NO: 28547 - DNA, 15 bp, Homo sapiens
ataacctttctcaag

SEQ ID NO: 28548 - DNA, 15 bp, Homo sapiens
tataacctttctcaa

SEQ ID NO: 28549 - DNA, 15 bp, Homo sapiens
ttataacctttctca

SEQ ID NO: 28550 - DNA, 15 bp, Homo sapiens
attataacctttctc

SEQ ID NO: 28551 - DNA, 15 bp, Homo sapiens
aattataacctttct

SEQ ID NO: 28552 - DNA, 15 bp, Homo sapiens
aaattataacctttc

SEQ ID NO: 28553 - DNA, 15 bp, Homo sapiens
taaattataaccttt

SEQ ID NO: 28554 - DNA, 15 bp, Homo sapiens
ttaaattataacctt

SEQ ID NO: 28555 - DNA, 15 bp, Homo sapiens
attaaattataacct

SEQ ID NO: 28556 - DNA, 15 bp, Homo sapiens
gattaaattataacc

SEQ ID NO: 28557 - DNA, 15 bp, Homo sapiens
ggattaaattataac

SEQ ID NO: 28558 - DNA, 15 bp, Homo sapiens
aggattaaattataa

SEQ ID NO: 28559 - DNA, 15 bp, Homo sapiens
caggattaaattata

SEQ ID NO: 28560 - DNA, 15 bp, Homo sapiens
tcaggattaaattat

SEQ ID NO: 28561 - DNA, 15 bp, Homo sapiens
ttcaggattaaatta

SEQ ID NO: 28562 - DNA, 15 bp, Homo sapiens
tttcaggattaaatt

SEQ ID NO: 28563 - DNA, 15 bp, Homo sapiens
atttcaggattaaat

SEQ ID NO: 28564 - DNA, 15 bp, Homo sapiens
tatttcaggattaaa

SEQ ID NO: 28565 - DNA, 15 bp, Homo sapiens
gtatttcaggattaa

SEQ ID NO: 28566 - DNA, 15 bp, Homo sapiens
tgtatttcaggatta

SEQ ID NO: 28567 - DNA, 15 bp, Homo sapiens
ttgtatttcaggatt

SEQ ID NO: 28568 - DNA, 15 bp, Homo sapiens
gttgtatttcaggat

SEQ ID NO: 28569 - DNA, 15 bp, Homo sapiens
agttgtatttcagga

SEQ ID NO: 28570 - DNA, 15 bp, Homo sapiens
aagttgtatttcagg

SEQ ID NO: 28571 - DNA, 15 bp, Homo sapiens
gaagttgtatttcag

SEQ ID NO: 28572 - DNA, 15 bp, Homo sapiens
agaagttgtatttca

SEQ ID NO: 28573 - DNA, 15 bp, Homo sapiens
tagaagttgtatttc

SEQ ID NO: 28574 - DNA, 15 bp, Homo sapiens
ctagaagttgtattt

SEQ ID NO: 28575 - DNA, 15 bp, Homo sapiens
cctagaagttgtatt

SEQ ID NO: 28576 - DNA, 15 bp, Homo sapiens
tcctagaagttgtat

SEQ ID NO: 28577 - DNA, 15 bp, Homo sapiens
ctcctagaagttgta

SEQ ID NO: 28578 - DNA, 15 bp, Homo sapiens
actcctagaagttgt

SEQ ID NO: 28579 - DNA, 15 bp, Homo sapiens
aactcctagaagttg

SEQ ID NO: 28580 - DNA, 15 bp, Homo sapiens
aaactcctagaagtt

SEQ ID NO: 28581 - DNA, 15 bp, Homo sapiens
aaaactcctagaagt

SEQ ID NO: 28582 - DNA, 15 bp, Homo sapiens
gaaaactcctagaag

SEQ ID NO: 28583 - DNA, 15 bp, Homo sapiens
agaaaactcctagaa

SEQ ID NO: 28584 - DNA, 15 bp, Homo sapiens
aagaaaactcctaga

SEQ ID NO: 28585 - DNA, 15 bp, Homo sapiens
aaagaaaactcctag

SEQ ID NO: 28586 - DNA, 15 bp, Homo sapiens
aaaagaaaactccta

SEQ ID NO: 28587 - DNA, 15 bp, Homo sapiens
aaaaagaaaactcct

SEQ ID NO: 28588 - DNA, 15 bp, Homo sapiens
taaaaagaaaactcc

SEQ ID NO: 28589 - DNA, 15 bp, Homo sapiens
ttaaaaagaaaactc

SEQ ID NO: 28590 - DNA, 15 bp, Homo sapiens
attaaaaagaaaact

SEQ ID NO: 28591 - DNA, 15 bp, Homo sapiens
aattaaaaagaaaac

SEQ ID NO: 28592 - DNA, 15 bp, Homo sapiens
gaattaaaaagaaaa

SEQ ID NO: 28593 - DNA, 15 bp, Homo sapiens
tgaattaaaaagaaa

SEQ ID NO: 28594 - DNA, 15 bp, Homo sapiens
atgaattaaaaagaa

SEQ ID NO: 28595 - DNA, 15 bp, Homo sapiens
gatgaattaaaaaga

SEQ ID NO: 28596 - DNA, 15 bp, Homo sapiens
tgatgaattaaaaag

SEQ ID NO: 28597 - DNA, 15 bp, Homo sapiens
atgatgaattaaaaa

SEQ ID NO: 28598 - DNA, 15 bp, Homo sapiens
aatgatgaattaaaa

SEQ ID NO: 28599 - DNA, 15 bp, Homo sapiens
gaatgatgaattaaa

SEQ ID NO: 28600 - DNA, 15 bp, Homo sapiens
ggaatgatgaattaa

SEQ ID NO: 28601 - DNA, 15 bp, Homo sapiens
tggaatgatgaatta

SEQ ID NO: 28602 - DNA, 15 bp, Homo sapiens
ttggaatgatgaatt

SEQ ID NO: 28603 - DNA, 15 bp, Homo sapiens
cttggaatgatgaat

SEQ ID NO: 28604 - DNA, 15 bp, Homo sapiens
acttggaatgatgaa

SEQ ID NO: 28605 - DNA, 15 bp, Homo sapiens
tacttggaatgatga

SEQ ID NO: 28606 - DNA, 15 bp, Homo sapiens
ctacttggaatgatg

SEQ ID NO: 28607 - DNA, 15 bp, Homo sapiens
cctacttggaatgat

SEQ ID NO: 28608 - DNA, 15 bp, Homo sapiens
acctacttggaatga

SEQ ID NO: 28609 - DNA, 15 bp, Homo sapiens
cacctacttggaatg

SEQ ID NO: 28610 - DNA, 15 bp, Homo sapiens
acacctacttggaat

SEQ ID NO: 28611 - DNA, 15 bp, Homo sapiens
gacacctacttggaa

SEQ ID NO: 28612 - DNA, 15 bp, Homo sapiens
agacacctacttgga

SEQ ID NO: 28613 - DNA, 15 bp, Homo sapiens
aagacacctacttgg

SEQ ID NO: 28614 - DNA, 15 bp, Homo sapiens
aaagacacctacttg

SEQ ID NO: 28615 - DNA, 15 bp, Homo sapiens
caaagacacctactt

SEQ ID NO: 28616 - DNA, 15 bp, Homo sapiens
acaaagacacctact

SEQ ID NO: 28617 - DNA, 15 bp, Homo sapiens
gacaaagacacctac

SEQ ID NO: 28618 - DNA, 15 bp, Homo sapiens
agacaaagacaccta

SEQ ID NO: 28619 - DNA, 15 bp, Homo sapiens
cagacaaagacacct

SEQ ID NO: 28620 - DNA, 15 bp, Homo sapiens
acagacaaagacacc

SEQ ID NO: 28621 - DNA, 15 bp, Homo sapiens
aacagacaaagacac

SEQ ID NO: 28622 - DNA, 15 bp, Homo sapiens
aaacagacaaagaca

SEQ ID NO: 28623 - DNA, 15 bp, Homo sapiens
gaaacagacaaagac

SEQ ID NO: 28624 - DNA, 15 bp, Homo sapiens
ggaaacagacaaaga

SEQ ID NO: 28625 - DNA, 15 bp, Homo sapiens
tggaaacagacaaag

SEQ ID NO: 28626 - DNA, 15 bp, Homo sapiens
gtggaaacagacaaa

SEQ ID NO: 28627 - DNA, 15 bp, Homo sapiens
tgtggaaacagacaa

SEQ ID NO: 28628 - DNA, 15 bp, Homo sapiens
atgtggaaacagaca

SEQ ID NO: 28629 - DNA, 15 bp, Homo sapiens
aatgtggaaacagac

SEQ ID NO: 28630 - DNA, 15 bp, Homo sapiens
taatgtggaaacaga

SEQ ID NO: 28631 - DNA, 15 bp, Homo sapiens
ctaatgtggaaacag

SEQ ID NO: 28632 - DNA, 15 bp, Homo sapiens
tctaatgtggaaaca

SEQ ID NO: 28633 - DNA, 15 bp, Homo sapiens
ttctaatgtggaaac

SEQ ID NO: 28634 - DNA, 15 bp, Homo sapiens
tttctaatgtggaaa

SEQ ID NO: 28635 - DNA, 15 bp, Homo sapiens
ttttctaatgtggaa

SEQ ID NO: 28636 - DNA, 15 bp, Homo sapiens
attttctaatgtgga

SEQ ID NO: 28637 - DNA, 15 bp, Homo sapiens
cattttctaatgtgg

SEQ ID NO: 28638 - DNA, 15 bp, Homo sapiens
tcattttctaatgtg

SEQ ID NO: 28639 - DNA, 15 bp, Homo sapiens
ttcattttctaatgt

SEQ ID NO: 28640 - DNA, 15 bp, Homo sapiens
tttcattttctaatg

SEQ ID NO: 28641 - DNA, 15 bp, Homo sapiens
gtttcattttctaat

SEQ ID NO: 28642 - DNA, 15 bp, Homo sapiens
ggtttcattttctaa

SEQ ID NO: 28643 - DNA, 15 bp, Homo sapiens
tggtttcattttcta

SEQ ID NO: 28644 - DNA, 15 bp, Homo sapiens
ttggtttcattttct

SEQ ID NO: 28645 - DNA, 15 bp, Homo sapiens
attggtttcattttc

SEQ ID NO: 28646 - DNA, 15 bp, Homo sapiens
tattggtttcatttt

SEQ ID NO: 28647 - DNA, 15 bp, Homo sapiens
gtattggtttcattt

SEQ ID NO: 28648 - DNA, 15 bp, Homo sapiens
agtattggtttcatt

SEQ ID NO: 28649 - DNA, 15 bp, Homo sapiens
aagtattggtttcat

SEQ ID NO: 28650 - DNA, 15 bp, Homo sapiens
taagtattggtttca

SEQ ID NO: 28651 - DNA, 15 bp, Homo sapiens
ttaagtattggtttc

SEQ ID NO: 28652 - DNA, 15 bp, Homo sapiens
tttaagtattggttt

SEQ ID NO: 28653 - DNA, 15 bp, Homo sapiens
atttaagtattggtt

SEQ ID NO: 28654 - DNA, 15 bp, Homo sapiens
tatttaagtattggt

SEQ ID NO: 28655 - DNA, 15 bp, Homo sapiens
atatttaagtattgg

SEQ ID NO: 28656 - DNA, 15 bp, Homo sapiens
catatttaagtattg

SEQ ID NO: 28657 - DNA, 15 bp, Homo sapiens
tcatatttaagtatt

SEQ ID NO: 28658 - DNA, 15 bp, Homo sapiens
atcatatttaagtat

SEQ ID NO: 28659 - DNA, 15 bp, Homo sapiens
aatcatatttaagta

SEQ ID NO: 28660 - DNA, 15 bp, Homo sapiens
aaatcatatttaagt

SEQ ID NO: 28661 - DNA, 15 bp, Homo sapiens
gaaatcatatttaag

SEQ ID NO: 28662 - DNA, 15 bp, Homo sapiens
ggaaatcatatttaa

SEQ ID NO: 28663 - DNA, 15 bp, Homo sapiens
gggaaatcatattta

SEQ ID NO: 28664 - DNA, 15 bp, Homo sapiens
agggaaatcatattt

SEQ ID NO: 28665 - DNA, 15 bp, Homo sapiens
cagggaaatcatatt

SEQ ID NO: 28666 - DNA, 15 bp, Homo sapiens
gcagggaaatcatat

SEQ ID NO: 28667 - DNA, 15 bp, Homo sapiens
agcagggaaatcata

SEQ ID NO: 28668 - DNA, 15 bp, Homo sapiens
aagcagggaaatcat

SEQ ID NO: 28669 - DNA, 15 bp, Homo sapiens
aaagcagggaaatca

SEQ ID NO: 28670 - DNA, 15 bp, Homo sapiens
aaaagcagggaaatc

SEQ ID NO: 28671 - DNA, 15 bp, Homo sapiens
taaaagcagggaaat

SEQ ID NO: 28672 - DNA, 15 bp, Homo sapiens
ataaaagcagggaaa

SEQ ID NO: 28673 - DNA, 15 bp, Homo sapiens
aataaaagcagggaa

SEQ ID NO: 28674 - DNA, 15 bp, Homo sapiens
caataaaagcaggga

SEQ ID NO: 28675 - DNA, 15 bp, Homo sapiens
ccaataaaagcaggg

SEQ ID NO: 28676 - DNA, 15 bp, Homo sapiens
gccaataaaagcagg

SEQ ID NO: 28677 - DNA, 15 bp, Homo sapiens
tgccaataaaagcag

SEQ ID NO: 28678 - DNA, 15 bp, Homo sapiens
ctgccaataaaagca

SEQ ID NO: 28679 - DNA, 15 bp, Homo sapiens
gctgccaataaaagc

SEQ ID NO: 28680 - DNA, 15 bp, Homo sapiens
agctgccaataaaag

SEQ ID NO: 28681 - DNA, 15 bp, Homo sapiens
tagctgccaataaaa

SEQ ID NO: 28682 - DNA, 15 bp, Homo sapiens
atagctgccaataaa

SEQ ID NO: 28683 - DNA, 15 bp, Homo sapiens
aatagctgccaataa

SEQ ID NO: 28684 - DNA, 15 bp, Homo sapiens
aaatagctgccaata

SEQ ID NO: 28685 - DNA, 15 bp, Homo sapiens
taaatagctgccaat

SEQ ID NO: 28686 - DNA, 15 bp, Homo sapiens
ttaaatagctgccaa

SEQ ID NO: 28687 - DNA, 15 bp, Homo sapiens
cttaaatagctgcca

SEQ ID NO: 28688 - DNA, 15 bp, Homo sapiens
tcttaaatagctgcc

SEQ ID NO: 28689 - DNA, 15 bp, Homo sapiens
atcttaaatagctgc

SEQ ID NO: 28690 - DNA, 15 bp, Homo sapiens
gatcttaaatagctg

SEQ ID NO: 28691 - DNA, 15 bp, Homo sapiens
agatcttaaatagct

SEQ ID NO: 28692 - DNA, 15 bp, Homo sapiens
tagatcttaaatagc

SEQ ID NO: 28693 - DNA, 15 bp, Homo sapiens
atagatcttaaatag

SEQ ID NO: 28694 - DNA, 15 bp, Homo sapiens
catagatcttaaata

SEQ ID NO: 28695 - DNA, 15 bp, Homo sapiens
acatagatcttaaat

SEQ ID NO: 28696 - DNA, 15 bp, Homo sapiens
gacatagatcttaaa

SEQ ID NO: 28697 - DNA, 15 bp, Homo sapiens
agacatagatcttaa

SEQ ID NO: 28698 - DNA, 15 bp, Homo sapiens
cagacatagatctta

SEQ ID NO: 28699 - DNA, 15 bp, Homo sapiens
tcagacatagatctt

SEQ ID NO: 28700 - DNA, 15 bp, Homo sapiens
ctcagacatagatct

SEQ ID NO: 28701 - DNA, 15 bp, Homo sapiens
cctcagacatagatc

SEQ ID NO: 28702 - DNA, 15 bp, Homo sapiens
acctcagacatagat

SEQ ID NO: 28703 - DNA, 15 bp, Homo sapiens
gacctcagacataga

SEQ ID NO: 28704 - DNA, 15 bp, Homo sapiens
agacctcagacatag

SEQ ID NO: 28705 - DNA, 15 bp, Homo sapiens
cagacctcagacata

SEQ ID NO: 28706 - DNA, 15 bp, Homo sapiens
ccagacctcagacat

SEQ ID NO: 28707 - DNA, 15 bp, Homo sapiens
gccagacctcagaca

SEQ ID NO: 28708 - DNA, 15 bp, Homo sapiens
agccagacctcagac

SEQ ID NO: 28709 - DNA, 15 bp, Homo sapiens
gagccagacctcaga

SEQ ID NO: 28710 - DNA, 15 bp, Homo sapiens
ggagccagacctcag

SEQ ID NO: 28711 - DNA, 15 bp, Homo sapiens
cggagccagacctca

SEQ ID NO: 28712 - DNA, 15 bp, Homo sapiens
acggagccagacctc

SEQ ID NO: 28713 - DNA, 15 bp, Homo sapiens
cacggagccagacct

SEQ ID NO: 28714 - DNA, 15 bp, Homo sapiens
acacggagccagacc

SEQ ID NO: 28715 - DNA, 15 bp, Homo sapiens
cacacggagccagac

SEQ ID NO: 28716 - DNA, 15 bp, Homo sapiens
ccacacggagccaga

SEQ ID NO: 28717 - DNA, 15 bp, Homo sapiens
accacacggagccag

SEQ ID NO: 28718 - DNA, 15 bp, Homo sapiens
aaccacacggagcca

SEQ ID NO: 28719 - DNA, 15 bp, Homo sapiens
aaaccacacggagcc

SEQ ID NO: 28720 - DNA, 15 bp, Homo sapiens
caaaccacacggagc

SEQ ID NO: 28721 - DNA, 15 bp, Homo sapiens
ccaaaccacacggag

SEQ ID NO: 28722 - DNA, 15 bp, Homo sapiens
tccaaaccacacgga

SEQ ID NO: 28723 - DNA, 15 bp, Homo sapiens
ttccaaaccacacgg

SEQ ID NO: 28724 - DNA, 15 bp, Homo sapiens
attccaaaccacacg

SEQ ID NO: 28725 - DNA, 15 bp, Homo sapiens
tattccaaaccacac

SEQ ID NO: 28726 - DNA, 15 bp, Homo sapiens
gtattccaaaccaca

SEQ ID NO: 28727 - DNA, 15 bp, Homo sapiens
agtattccaaaccac

SEQ ID NO: 28728 - DNA, 15 bp, Homo sapiens
aagtattccaaacca

SEQ ID NO: 28729 - DNA, 15 bp, Homo sapiens
aaagtattccaaacc

SEQ ID NO: 28730 - DNA, 15 bp, Homo sapiens
taaagtattccaaac

SEQ ID NO: 28731 - DNA, 15 bp, Homo sapiens
ataaagtattccaaa

SEQ ID NO: 28732 - DNA, 15 bp, Homo sapiens
aataaagtattccaa

SEQ ID NO: 28733 - DNA, 15 bp, Homo sapiens
caataaagtattcca

SEQ ID NO: 28734 - DNA, 15 bp, Homo sapiens
acaataaagtattcc

SEQ ID NO: 28735 - DNA, 15 bp, Homo sapiens
aacaataaagtattc

SEQ ID NO: 28736 - DNA, 15 bp, Homo sapiens
taacaataaagtatt

SEQ ID NO: 28737 - DNA, 15 bp, Homo sapiens
ataacaataaagtat

SEQ ID NO: 28738 - DNA, 15 bp, Homo sapiens
aataacaataaagta

SEQ ID NO: 28739 - DNA, 15 bp, Homo sapiens
taataacaataaagt

SEQ ID NO: 28740 - DNA, 15 bp, Homo sapiens
ataataacaataaag

SEQ ID NO: 28741 - DNA, 15 bp, Homo sapiens
aataataacaataaa

SEQ ID NO: 28742 - DNA, 15 bp, Homo sapiens
taataataacaataa

SEQ ID NO: 28743 - DNA, 15 bp, Homo sapiens
ataataataacaata

SEQ ID NO: 28744 - DNA, 15 bp, Homo sapiens
aataataataacaat

SEQ ID NO: 28745 - DNA, 15 bp, Homo sapiens
ataataataataaca

SEQ ID NO: 28746 - DNA, 15 bp, Homo sapiens
aataataataataac

SEQ ID NO: 28747 - DNA, 15 bp, Homo sapiens
taataataataataa

SEQ ID NO: 28748 - DNA, 15 bp, Homo sapiens
ataataataataata

SEQ ID NO: 28749 - DNA, 15 bp, Homo sapiens
aataataataataat

SEQ ID NO: 28750 - DNA, 15 bp, Homo sapiens
aaataataataataa

SEQ ID NO: 28751 - DNA, 15 bp, Homo sapiens
aaaataataataata

SEQ ID NO: 28752 - DNA, 15 bp, Homo sapiens
caaaataataataat

SEQ ID NO: 28753 - DNA, 15 bp, Homo sapiens
tcaaaataataataa

SEQ ID NO: 28754 - DNA, 15 bp, Homo sapiens
ctcaaaataataata

SEQ ID NO: 28755 - DNA, 15 bp, Homo sapiens
tctcaaaataataat

SEQ ID NO: 28756 - DNA, 15 bp, Homo sapiens
atctcaaaataataa

SEQ ID NO: 28757 - DNA, 15 bp, Homo sapiens
catctcaaaataata

SEQ ID NO: 28758 - DNA, 15 bp, Homo sapiens
ccatctcaaaataat

SEQ ID NO: 28759 - DNA, 15 bp, Homo sapiens
tccatctcaaaataa

SEQ ID NO: 28760 - DNA, 15 bp, Homo sapiens
ctccatctcaaaata

SEQ ID NO: 28761 - DNA, 15 bp, Homo sapiens
actccatctcaaaat

SEQ ID NO: 28762 - DNA, 15 bp, Homo sapiens
agacagagcaagact

SEQ ID NO: 28763 - DNA, 15 bp, Homo sapiens
gagacagagcaagac

SEQ ID NO: 28764 - DNA, 15 bp, Homo sapiens
ggagacagagcaaga

SEQ ID NO: 28765 - DNA, 15 bp, Homo sapiens
gggagacagagcaag

SEQ ID NO: 28766 - DNA, 15 bp, Homo sapiens
tgggagacagagcaa

SEQ ID NO: 28767 - DNA, 15 bp, Homo sapiens
ctgggagacagagca

SEQ ID NO: 28768 - DNA, 15 bp, Homo sapiens
cctgggagacagagc

SEQ ID NO: 28769 - DNA, 15 bp, Homo sapiens
gcctgggagacagag

SEQ ID NO: 28770 - DNA, 15 bp, Homo sapiens
agcctgggagacaga

SEQ ID NO: 28771 - DNA, 15 bp, Homo sapiens
tagcctgggagacag

SEQ ID NO: 28772 - DNA, 15 bp, Homo sapiens
ctagcctgggagaca

SEQ ID NO: 28773 - DNA, 15 bp, Homo sapiens
tctagcctgggagac

SEQ ID NO: 28774 - DNA, 15 bp, Homo sapiens
ctctagcctgggaga

SEQ ID NO: 28775 - DNA, 15 bp, Homo sapiens
actctagcctgggag

SEQ ID NO: 28776 - DNA, 15 bp, Homo sapiens
cactctagcctggga

SEQ ID NO: 28777 - DNA, 15 bp, Homo sapiens
gcactctagcctggg

SEQ ID NO: 28778 - DNA, 15 bp, Homo sapiens
tgcactctagcctgg

SEQ ID NO: 28779 - DNA, 15 bp, Homo sapiens
ctgcactctagcctg

SEQ ID NO: 28780 - DNA, 15 bp, Homo sapiens
actgcactctagcct

SEQ ID NO: 28781 - DNA, 15 bp, Homo sapiens
cactgcactctagcc

SEQ ID NO: 28782 - DNA, 15 bp, Homo sapiens
ccactgcactctagc

SEQ ID NO: 28783 - DNA, 15 bp, Homo sapiens
accactgcactctag

SEQ ID NO: 28784 - DNA, 15 bp, Homo sapiens
caccactgcactcta

SEQ ID NO: 28785 - DNA, 15 bp, Homo sapiens
acaccactgcactct

SEQ ID NO: 28786 - DNA, 15 bp, Homo sapiens
cacaccactgcactc

SEQ ID NO: 28787 - DNA, 15 bp, Homo sapiens
tcacaccactgcact

SEQ ID NO: 28788 - DNA, 15 bp, Homo sapiens
atcacaccactgcac

SEQ ID NO: 28789 - DNA, 15 bp, Homo sapiens
gatcacaccactgca

SEQ ID NO: 28790 - DNA, 15 bp, Homo sapiens
agatcacaccactgc

SEQ ID NO: 28791 - DNA, 15 bp, Homo sapiens
gagatcacaccactg

SEQ ID NO: 28792 - DNA, 15 bp, Homo sapiens
tgagatcacaccact

SEQ ID NO: 28793 - DNA, 15 bp, Homo sapiens
ctgagatcacaccac

SEQ ID NO: 28794 - DNA, 15 bp, Homo sapiens
gctgagatcacacca

SEQ ID NO: 28795 - DNA, 15 bp, Homo sapiens
ggctgagatcacacc

SEQ ID NO: 28796 - DNA, 15 bp, Homo sapiens
gggctgagatcacac

SEQ ID NO: 28797 - DNA, 15 bp, Homo sapiens
tgggctgagatcaca

SEQ ID NO: 28798 - DNA, 15 bp, Homo sapiens
gtgggctgagatcac

SEQ ID NO: 28799 - DNA, 15 bp, Homo sapiens
agtgggctgagatca

SEQ ID NO: 28800 - DNA, 15 bp, Homo sapiens
cagtgggctgagatc

SEQ ID NO: 28801 - DNA, 15 bp, Homo sapiens
gcagtgggctgagat

SEQ ID NO: 28802 - DNA, 15 bp, Homo sapiens
tgcagtgggctgaga

SEQ ID NO: 28803 - DNA, 15 bp, Homo sapiens
ttgcagtgggctgag

SEQ ID NO: 28804 - DNA, 15 bp, Homo sapiens
gttgcagtgggctga

SEQ ID NO: 28805 - DNA, 15 bp, Homo sapiens
ggttgcagtgggctg

SEQ ID NO: 28806 - DNA, 15 bp, Homo sapiens
aggttgcagtgggct

SEQ ID NO: 28807 - DNA, 15 bp, Homo sapiens
gaggttgcagtgggc

SEQ ID NO: 28808 - DNA, 15 bp, Homo sapiens
agaggttgcagtggg

SEQ ID NO: 28809 - DNA, 15 bp, Homo sapiens
cagaggttgcagtgg

SEQ ID NO: 28810 - DNA, 15 bp, Homo sapiens
agggaggcagaggtt

SEQ ID NO: 28811 - DNA, 15 bp, Homo sapiens
cagggaggcagaggt

SEQ ID NO: 28812 - DNA, 15 bp, Homo sapiens
ccagggaggcagagg

SEQ ID NO: 28813 - DNA, 15 bp, Homo sapiens
accagggaggcagag

SEQ ID NO: 28814 - DNA, 15 bp, Homo sapiens
aaccagggaggcaga

SEQ ID NO: 28815 - DNA, 15 bp, Homo sapiens
gaaccagggaggcag

SEQ ID NO: 28816 - DNA, 15 bp, Homo sapiens
tgaaccagggaggca

SEQ ID NO: 28817 - DNA, 15 bp, Homo sapiens
ttgaaccagggaggc

SEQ ID NO: 28818 - DNA, 15 bp, Homo sapiens
cttgaaccagggagg

SEQ ID NO: 28819 - DNA, 15 bp, Homo sapiens
acttgaaccagggag

SEQ ID NO: 28820 - DNA, 15 bp, Homo sapiens
cacttgaaccaggga

SEQ ID NO: 28821 - DNA, 15 bp, Homo sapiens
tcacttgaaccaggg

SEQ ID NO: 28822 - DNA, 15 bp, Homo sapiens
atcacttgaaccagg

SEQ ID NO: 28823 - DNA, 15 bp, Homo sapiens
aatcacttgaaccag

SEQ ID NO: 28824 - DNA, 15 bp, Homo sapiens
gaatcacttgaacca

SEQ ID NO: 28825 - DNA, 15 bp, Homo sapiens
ggaatcacttgaacc

SEQ ID NO: 28826 - DNA, 15 bp, Homo sapiens
gggaatcacttgaac

SEQ ID NO: 28827 - DNA, 15 bp, Homo sapiens
tgggaatcacttgaa

SEQ ID NO: 28828 - DNA, 15 bp, Homo sapiens
atgggaatcacttga

SEQ ID NO: 28829 - DNA, 15 bp, Homo sapiens
catgggaatcacttg

SEQ ID NO: 28830 - DNA, 15 bp, Homo sapiens
gcatgggaatcactt

SEQ ID NO: 28831 - DNA, 15 bp, Homo sapiens
ggcatgggaatcact

SEQ ID NO: 28832 - DNA, 15 bp, Homo sapiens
aggcatgggaatcac

SEQ ID NO: 28833 - DNA, 15 bp, Homo sapiens
gaggcatgggaatca

SEQ ID NO: 28834 - DNA, 15 bp, Homo sapiens
tgaggcatgggaatc

SEQ ID NO: 28835 - DNA, 15 bp, Homo sapiens
gtgaggcatgggaat

SEQ ID NO: 28836 - DNA, 15 bp, Homo sapiens
ggtgaggcatgggaa

SEQ ID NO: 28837 - DNA, 15 bp, Homo sapiens
gggtgaggcatggga

SEQ ID NO: 28838 - DNA, 15 bp, Homo sapiens
agggtgaggcatggg

SEQ ID NO: 28839 - DNA, 15 bp, Homo sapiens
gagggtgaggcatgg

SEQ ID NO: 28840 - DNA, 15 bp, Homo sapiens
ggagggtgaggcatg

SEQ ID NO: 28841 - DNA, 15 bp, Homo sapiens
aggagggtgaggcat

SEQ ID NO: 28842 - DNA, 15 bp, Homo sapiens
caggagggtgaggca

SEQ ID NO: 28843 - DNA, 15 bp, Homo sapiens
tcaggagggtgaggc

SEQ ID NO: 28844 - DNA, 15 bp, Homo sapiens
ttcaggagggtgagg

SEQ ID NO: 28845 - DNA, 15 bp, Homo sapiens
attcaggagggtgag

SEQ ID NO: 28846 - DNA, 15 bp, Homo sapiens
tattcaggagggtga

SEQ ID NO: 28847 - DNA, 15 bp, Homo sapiens
ctattcaggagggtg

SEQ ID NO: 28848 - DNA, 15 bp, Homo sapiens
gctattcaggagggt

SEQ ID NO: 28849 - DNA, 15 bp, Homo sapiens
agctattcaggaggg

SEQ ID NO: 28850 - DNA, 15 bp, Homo sapiens
cagctattcaggagg

SEQ ID NO: 28851 - DNA, 15 bp, Homo sapiens
ccagctattcaggag

SEQ ID NO: 28852 - DNA, 15 bp, Homo sapiens
cccagctattcagga

SEQ ID NO: 28853 - DNA, 15 bp, Homo sapiens
tcccagctattcagg

SEQ ID NO: 28854 - DNA, 15 bp, Homo sapiens
atcccagctattcag

SEQ ID NO: 28855 - DNA, 15 bp, Homo sapiens
aatcccagctattca

SEQ ID NO: 28856 - DNA, 15 bp, Homo sapiens
taatcccagctattc

SEQ ID NO: 28857 - DNA, 15 bp, Homo sapiens
cgtggtggcgtgtgc

SEQ ID NO: 28858 - DNA, 15 bp, Homo sapiens
gcgtggtggcgtgtg

SEQ ID NO: 28859 - DNA, 15 bp, Homo sapiens
ggcgtggtggcgtgt

SEQ ID NO: 28860 - DNA, 15 bp, Homo sapiens
aggcgtggtggcgtg

SEQ ID NO: 28861 - DNA, 15 bp, Homo sapiens
caggcgtggtggcgt

SEQ ID NO: 28862 - DNA, 15 bp, Homo sapiens
ccaggcgtggtggcg

SEQ ID NO: 28863 - DNA, 15 bp, Homo sapiens
ctacaaaaattagcc

SEQ ID NO: 28864 - DNA, 15 bp, Homo sapiens
actacaaaaattagc

SEQ ID NO: 28865 - DNA, 15 bp, Homo sapiens
aactacaaaaattag

SEQ ID NO: 28866 - DNA, 15 bp, Homo sapiens
aaactacaaaaatta

SEQ ID NO: 28867 - DNA, 15 bp, Homo sapiens
aaaactacaaaaatt

SEQ ID NO: 28868 - DNA, 15 bp, Homo sapiens
taaaactacaaaaat

SEQ ID NO: 28869 - DNA, 15 bp, Homo sapiens
ctaaaactacaaaaa

SEQ ID NO: 28870 - DNA, 15 bp, Homo sapiens
actaaaactacaaaa

SEQ ID NO: 28871 - DNA, 15 bp, Homo sapiens
tactaaaactacaaa

SEQ ID NO: 28872 - DNA, 15 bp, Homo sapiens
ctactaaaactacaa

SEQ ID NO: 28873 - DNA, 15 bp, Homo sapiens
tctactaaaactaca

SEQ ID NO: 28874 - DNA, 15 bp, Homo sapiens
ctctactaaaactac

SEQ ID NO: 28875 - DNA, 15 bp, Homo sapiens
tctctactaaaacta

SEQ ID NO: 28876 - DNA, 15 bp, Homo sapiens
atctctactaaaact

SEQ ID NO: 28877 - DNA, 15 bp, Homo sapiens
catctctactaaaac

SEQ ID NO: 28878 - DNA, 15 bp, Homo sapiens
tccatctctactaaa

SEQ ID NO: 28879 - DNA, 15 bp, Homo sapiens
ctccatctctactaa

SEQ ID NO: 28880 - DNA, 15 bp, Homo sapiens
actccatctctacta

SEQ ID NO: 28881 - DNA, 15 bp, Homo sapiens
gactccatctctact

SEQ ID NO: 28882 - DNA, 15 bp, Homo sapiens
agactccatctctac

SEQ ID NO: 28883 - DNA, 15 bp, Homo sapiens
aagactccatctcta

SEQ ID NO: 28884 - DNA, 15 bp, Homo sapiens
taagactccatctct

SEQ ID NO: 28885 - DNA, 15 bp, Homo sapiens
gtaagactccatctc

SEQ ID NO: 28886 - DNA, 15 bp, Homo sapiens
ggtaagactccatct

SEQ ID NO: 28887 - DNA, 15 bp, Homo sapiens
tggtaagactccatc

SEQ ID NO: 28888 - DNA, 15 bp, Homo sapiens
atggtaagactccat

SEQ ID NO: 28889 - DNA, 15 bp, Homo sapiens
catggtaagactcca

SEQ ID NO: 28890 - DNA, 15 bp, Homo sapiens
acatggtaagactcc

SEQ ID NO: 28891 - DNA, 15 bp, Homo sapiens
aacatggtaagactc

SEQ ID NO: 28892 - DNA, 15 bp, Homo sapiens
caacatggtaagact

SEQ ID NO: 28893 - DNA, 15 bp, Homo sapiens
ccaacatggtaagac

SEQ ID NO: 28894 - DNA, 15 bp, Homo sapiens
gccaacatggtaaga

SEQ ID NO: 28895 - DNA, 15 bp, Homo sapiens
ggccaacatggtaag

SEQ ID NO: 28896 - DNA, 15 bp, Homo sapiens
tgaggcgggtggatc

SEQ ID NO: 28897 - DNA, 15 bp, Homo sapiens
ctgaggcgggtggat

SEQ ID NO: 28898 - DNA, 15 bp, Homo sapiens
gctgaggcgggtgga

SEQ ID NO: 28899 - DNA, 15 bp, Homo sapiens
agctgaggcgggtgg

SEQ ID NO: 28900 - DNA, 15 bp, Homo sapiens
aagctgaggcgggtg

SEQ ID NO: 28901 - DNA, 15 bp, Homo sapiens
gaagctgaggcgggt

SEQ ID NO: 28902 - DNA, 15 bp, Homo sapiens
ggaagctgaggcggg

SEQ ID NO: 28903 - DNA, 15 bp, Homo sapiens
aggaagctgaggcgg

SEQ ID NO: 28904 - DNA, 15 bp, Homo sapiens
taggaagctgaggcg

SEQ ID NO: 28905 - DNA, 15 bp, Homo sapiens
ttaggaagctgaggc

SEQ ID NO: 28906 - DNA, 15 bp, Homo sapiens
tttaggaagctgagg

SEQ ID NO: 28907 - DNA, 15 bp, Homo sapiens
ctttaggaagctgag

SEQ ID NO: 28908 - DNA, 15 bp, Homo sapiens
actttaggaagctga

SEQ ID NO: 28909 - DNA, 15 bp, Homo sapiens
cactttaggaagctg

SEQ ID NO: 28910 - DNA, 15 bp, Homo sapiens
gcactttaggaagct

SEQ ID NO: 28911 - DNA, 15 bp, Homo sapiens
agcactttaggaagc

SEQ ID NO: 28912 - DNA, 15 bp, Homo sapiens
cagcactttaggaag

SEQ ID NO: 28913 - DNA, 15 bp, Homo sapiens
ccagcactttaggaa

SEQ ID NO: 28914 - DNA, 15 bp, Homo sapiens
cccagcactttagga

SEQ ID NO: 28915 - DNA, 15 bp, Homo sapiens
tcccagcactttagg

SEQ ID NO: 28916 - DNA, 15 bp, Homo sapiens
atcccagcactttag

SEQ ID NO: 28917 - DNA, 15 bp, Homo sapiens
aatcccagcacttta

SEQ ID NO: 28918 - DNA, 15 bp, Homo sapiens
tcatgcctataatcc

SEQ ID NO: 28919 - DNA, 15 bp, Homo sapiens
ctcatgcctataatc

SEQ ID NO: 28920 - DNA, 15 bp, Homo sapiens
gctcatgcctataat

SEQ ID NO: 28921 - DNA, 15 bp, Homo sapiens
ggctcatgcctataa

SEQ ID NO: 28922 - DNA, 15 bp, Homo sapiens
tggctcatgcctata

SEQ ID NO: 28923 - DNA, 15 bp, Homo sapiens
atggctcatgcctat

SEQ ID NO: 28924 - DNA, 15 bp, Homo sapiens
aatggctcatgccta

SEQ ID NO: 28925 - DNA, 15 bp, Homo sapiens
caatggctcatgcct

SEQ ID NO: 28926 - DNA, 15 bp, Homo sapiens
gcaatggctcatgcc

SEQ ID NO: 28927 - DNA, 15 bp, Homo sapiens
cgcaatggctcatgc

SEQ ID NO: 28928 - DNA, 15 bp, Homo sapiens
gcgcaatggctcatg

SEQ ID NO: 28929 - DNA, 15 bp, Homo sapiens
ggcgcaatggctcat

SEQ ID NO: 28930 - DNA, 15 bp, Homo sapiens
gggcgcaatggctca

SEQ ID NO: 28931 - DNA, 15 bp, Homo sapiens
tgggcgcaatggctc

SEQ ID NO: 28932 - DNA, 15 bp, Homo sapiens
ctgggcgcaatggct

SEQ ID NO: 28933 - DNA, 15 bp, Homo sapiens
gctgggcgcaatggc

SEQ ID NO: 28934 - DNA, 15 bp, Homo sapiens
ggctgggcgcaatgg

SEQ ID NO: 28935 - DNA, 15 bp, Homo sapiens
aggctgggcgcaatg

SEQ ID NO: 28936 - DNA, 15 bp, Homo sapiens
caggctgggcgcaat

SEQ ID NO: 28937 - DNA, 15 bp, Homo sapiens
ccaggctgggcgcaa

SEQ ID NO: 28938 - DNA, 15 bp, Homo sapiens
tccaggctgggcgca

SEQ ID NO: 28939 - DNA, 15 bp, Homo sapiens
ttccaggctgggcgc

SEQ ID NO: 28940 - DNA, 15 bp, Homo sapiens
attccaggctgggcg

SEQ ID NO: 28941 - DNA, 15 bp, Homo sapiens
tattccaggctgggc

SEQ ID NO: 28942 - DNA, 15 bp, Homo sapiens
atattccaggctggg

SEQ ID NO: 28943 - DNA, 15 bp, Homo sapiens
aatattccaggctgg

SEQ ID NO: 28944 - DNA, 15 bp, Homo sapiens
aaatattccaggctg

SEQ ID NO: 28945 - DNA, 15 bp, Homo sapiens
aaaatattccaggct

SEQ ID NO: 28946 - DNA, 15 bp, Homo sapiens
gaaaatattccaggc

SEQ ID NO: 28947 - DNA, 15 bp, Homo sapiens
agaaaatattccagg

SEQ ID NO: 28948 - DNA, 15 bp, Homo sapiens
tagaaaatattccag

SEQ ID NO: 28949 - DNA, 15 bp, Homo sapiens
ttagaaaatattcca

SEQ ID NO: 28950 - DNA, 15 bp, Homo sapiens
cttagaaaatattcc

SEQ ID NO: 28951 - DNA, 15 bp, Homo sapiens
gcttagaaaatattc

SEQ ID NO: 28952 - DNA, 15 bp, Homo sapiens
agcttagaaaatatt

SEQ ID NO: 28953 - DNA, 15 bp, Homo sapiens
gagcttagaaaatat

SEQ ID NO: 28954 - DNA, 15 bp, Homo sapiens
agagcttagaaaata

SEQ ID NO: 28955 - DNA, 15 bp, Homo sapiens
aagagcttagaaaat

SEQ ID NO: 28956 - DNA, 15 bp, Homo sapiens
aaagagcttagaaaa

SEQ ID NO: 28957 - DNA, 15 bp, Homo sapiens
caaagagcttagaaa

SEQ ID NO: 28958 - DNA, 15 bp, Homo sapiens
tcaaagagcttagaa

SEQ ID NO: 28959 - DNA, 15 bp, Homo sapiens
atcaaagagcttaga

SEQ ID NO: 28960 - DNA, 15 bp, Homo sapiens
catcaaagagcttag

SEQ ID NO: 28961 - DNA, 15 bp, Homo sapiens
tcatcaaagagctta

SEQ ID NO: 28962 - DNA, 15 bp, Homo sapiens
atcatcaaagagctt

SEQ ID NO: 28963 - DNA, 15 bp, Homo sapiens
catcatcaaagagct

SEQ ID NO: 28964 - DNA, 15 bp, Homo sapiens
ccatcatcaaagagc

SEQ ID NO: 28965 - DNA, 15 bp, Homo sapiens
gccatcatcaaagag

SEQ ID NO: 28966 - DNA, 15 bp, Homo sapiens
cgccatcatcaaaga

SEQ ID NO: 28967 - DNA, 15 bp, Homo sapiens
ccgccatcatcaaag

SEQ ID NO: 28968 - DNA, 15 bp, Homo sapiens
gccgccatcatcaaa

SEQ ID NO: 28969 - DNA, 15 bp, Homo sapiens
agccgccatcatcaa

SEQ ID NO: 28970 - DNA, 15 bp, Homo sapiens
aagccgccatcatca

SEQ ID NO: 28971 - DNA, 15 bp, Homo sapiens
gaagccgccatcatc

SEQ ID NO: 28972 - DNA, 15 bp, Homo sapiens
cgaagccgccatcat

SEQ ID NO: 28973 - DNA, 15 bp, Homo sapiens
tcgaagccgccatca

SEQ ID NO: 28974 - DNA, 15 bp, Homo sapiens
atcgaagccgccatc

SEQ ID NO: 28975 - DNA, 15 bp, Homo sapiens
aatcgaagccgccat

SEQ ID NO: 28976 - DNA, 15 bp, Homo sapiens
aaatcgaagccgcca

SEQ ID NO: 28977 - DNA, 15 bp, Homo sapiens
taaatcgaagccgcc

SEQ ID NO: 28978 - DNA, 15 bp, Homo sapiens
ttaaatcgaagccgc

SEQ ID NO: 28979 - DNA, 15 bp, Homo sapiens
gttaaatcgaagccg

SEQ ID NO: 28980 - DNA, 15 bp, Homo sapiens
agttaaatcgaagcc

SEQ ID NO: 28981 - DNA, 15 bp, Homo sapiens
gagttaaatcgaagc

SEQ ID NO: 28982 - DNA, 15 bp, Homo sapiens
agagttaaatcgaag

SEQ ID NO: 28983 - DNA, 15 bp, Homo sapiens
gagagttaaatcgaa

SEQ ID NO: 28984 - DNA, 15 bp, Homo sapiens
agagagttaaatcga

SEQ ID NO: 28985 - DNA, 15 bp, Homo sapiens
gagagagttaaatcg

SEQ ID NO: 28986 - DNA, 15 bp, Homo sapiens
agagagagttaaatc

SEQ ID NO: 28987 - DNA, 15 bp, Homo sapiens
cagagagagttaaat

SEQ ID NO: 28988 - DNA, 15 bp, Homo sapiens
tcagagagagttaaa

SEQ ID NO: 28989 - DNA, 15 bp, Homo sapiens
gtcagagagagttaa

SEQ ID NO: 28990 - DNA, 15 bp, Homo sapiens
agtcagagagagtta

SEQ ID NO: 28991 - DNA, 15 bp, Homo sapiens
aagtcagagagagtt

SEQ ID NO: 28992 - DNA, 15 bp, Homo sapiens
taagtcagagagagt

SEQ ID NO: 28993 - DNA, 15 bp, Homo sapiens
ttaagtcagagagag

SEQ ID NO: 28994 - DNA, 15 bp, Homo sapiens
attaagtcagagaga

SEQ ID NO: 28995 - DNA, 15 bp, Homo sapiens
aattaagtcagagag

SEQ ID NO: 28996 - DNA, 15 bp, Homo sapiens
gaattaagtcagaga

SEQ ID NO: 28997 - DNA, 15 bp, Homo sapiens
agaattaagtcagag

SEQ ID NO: 28998 - DNA, 15 bp, Homo sapiens
cagaattaagtcaga

SEQ ID NO: 28999 - DNA, 15 bp, Homo sapiens
acagaattaagtcag

SEQ ID NO: 29000 - DNA, 15 bp, Homo sapiens
aacagaattaagtca

SEQ ID NO: 29001 - DNA, 15 bp, Homo sapiens
caacagaattaagtc

SEQ ID NO: 29002 - DNA, 15 bp, Homo sapiens
tcaacagaattaagt

SEQ ID NO: 29003 - DNA, 15 bp, Homo sapiens
atcaacagaattaag

SEQ ID NO: 29004 - DNA, 15 bp, Homo sapiens
aatcaacagaattaa

SEQ ID NO: 29005 - DNA, 15 bp, Homo sapiens
taatcaacagaatta

SEQ ID NO: 29006 - DNA, 15 bp, Homo sapiens
ataatcaacagaatt

SEQ ID NO: 29007 - DNA, 15 bp, Homo sapiens
tataatcaacagaat

SEQ ID NO: 29008 - DNA, 15 bp, Homo sapiens
ttataatcaacagaa

SEQ ID NO: 29009 - DNA, 15 bp, Homo sapiens
attataatcaacaga

SEQ ID NO: 29010 - DNA, 15 bp, Homo sapiens
cattataatcaacag

SEQ ID NO: 29011 - DNA, 15 bp, Homo sapiens
acattataatcaaca

SEQ ID NO: 29012 - DNA, 15 bp, Homo sapiens
gacattataatcaac

SEQ ID NO: 29013 - DNA, 15 bp, Homo sapiens
tgacattataatcaa

SEQ ID NO: 29014 - DNA, 15 bp, Homo sapiens
atgacattataatca

SEQ ID NO: 29015 - DNA, 15 bp, Homo sapiens
aatgacattataatc

SEQ ID NO: 29016 - DNA, 15 bp, Homo sapiens
gaatgacattataat

SEQ ID NO: 29017 - DNA, 15 bp, Homo sapiens
tgaatgacattataa

SEQ ID NO: 29018 - DNA, 15 bp, Homo sapiens
ttgaatgacattata

SEQ ID NO: 29019 - DNA, 15 bp, Homo sapiens
attgaatgacattat

SEQ ID NO: 29020 - DNA, 15 bp, Homo sapiens
gattgaatgacatta

SEQ ID NO: 29021 - DNA, 15 bp, Homo sapiens
ggattgaatgacatt

SEQ ID NO: 29022 - DNA, 15 bp, Homo sapiens
gggattgaatgacat

SEQ ID NO: 29023 - DNA, 15 bp, Homo sapiens
tgggattgaatgaca

SEQ ID NO: 29024 - DNA, 15 bp, Homo sapiens
atgggattgaatgac

SEQ ID NO: 29025 - DNA, 15 bp, Homo sapiens
aatgggattgaatga

SEQ ID NO: 29026 - DNA, 15 bp, Homo sapiens
taatgggattgaatg

SEQ ID NO: 29027 - DNA, 15 bp, Homo sapiens
ctaatgggattgaat

SEQ ID NO: 29028 - DNA, 15 bp, Homo sapiens
actaatgggattgaa

SEQ ID NO: 29029 - DNA, 15 bp, Homo sapiens
tactaatgggattga

SEQ ID NO: 29030 - DNA, 15 bp, Homo sapiens
atactaatgggattg

SEQ ID NO: 29031 - DNA, 15 bp, Homo sapiens
tatactaatgggatt

SEQ ID NO: 29032 - DNA, 15 bp, Homo sapiens
gtatactaatgggat

SEQ ID NO: 29033 - DNA, 15 bp, Homo sapiens
agtatactaatggga

SEQ ID NO: 29034 - DNA, 15 bp, Homo sapiens
gagtatactaatggg

SEQ ID NO: 29035 - DNA, 15 bp, Homo sapiens
tgagtatactaatgg

SEQ ID NO: 29036 - DNA, 15 bp, Homo sapiens
atgagtatactaatg

SEQ ID NO: 29037 - DNA, 15 bp, Homo sapiens
tatgagtatactaat

SEQ ID NO: 29038 - DNA, 15 bp, Homo sapiens
atatgagtatactaa

SEQ ID NO: 29039 - DNA, 15 bp, Homo sapiens
catatgagtatacta

SEQ ID NO: 29040 - DNA, 15 bp, Homo sapiens
ccatatgagtatact

SEQ ID NO: 29041 - DNA, 15 bp, Homo sapiens
tccatatgagtatac

SEQ ID NO: 29042 - DNA, 15 bp, Homo sapiens
ttccatatgagtata

SEQ ID NO: 29043 - DNA, 15 bp, Homo sapiens
tttccatatgagtat

SEQ ID NO: 29044 - DNA, 15 bp, Homo sapiens
gtttccatatgagta

SEQ ID NO: 29045 - DNA, 15 bp, Homo sapiens
tgtttccatatgagt

SEQ ID NO: 29046 - DNA, 15 bp, Homo sapiens
ttgtttccatatgag

SEQ ID NO: 29047 - DNA, 15 bp, Homo sapiens
tttgtttccatatga

SEQ ID NO: 29048 - DNA, 15 bp, Homo sapiens
ctttgtttccatatg

SEQ ID NO: 29049 - DNA, 15 bp, Homo sapiens
cctttgtttccatat

SEQ ID NO: 29050 - DNA, 15 bp, Homo sapiens
gcctttgtttccata

SEQ ID NO: 29051 - DNA, 15 bp, Homo sapiens
tgcctttgtttccat

SEQ ID NO: 29052 - DNA, 15 bp, Homo sapiens
atgcctttgtttcca

SEQ ID NO: 29053 - DNA, 15 bp, Homo sapiens
catgcctttgtttcc

SEQ ID NO: 29054 - DNA, 15 bp, Homo sapiens
tcatgcctttgtttc

SEQ ID NO: 29055 - DNA, 15 bp, Homo sapiens
atcatgcctttgttt

SEQ ID NO: 29056 - DNA, 15 bp, Homo sapiens
aatcatgcctttgtt

SEQ ID NO: 29057 - DNA, 15 bp, Homo sapiens
aaatcatgcctttgt

SEQ ID NO: 29058 - DNA, 15 bp, Homo sapiens
gaaatcatgcctttg

SEQ ID NO: 29059 - DNA, 15 bp, Homo sapiens
tgaaatcatgccttt

SEQ ID NO: 29060 - DNA, 15 bp, Homo sapiens
ctgaaatcatgcctt

SEQ ID NO: 29061 - DNA, 15 bp, Homo sapiens
tctgaaatcatgcct

SEQ ID NO: 29062 - DNA, 15 bp, Homo sapiens
atctgaaatcatgcc

SEQ ID NO: 29063 - DNA, 15 bp, Homo sapiens
aatctgaaatcatgc

SEQ ID NO: 29064 - DNA, 15 bp, Homo sapiens
aaatctgaaatcatg

SEQ ID NO: 29065 - DNA, 15 bp, Homo sapiens
aaaatctgaaatcat

SEQ ID NO: 29066 - DNA, 15 bp, Homo sapiens
taaaatctgaaatca

SEQ ID NO: 29067 - DNA, 15 bp, Homo sapiens
ataaaatctgaaatc

SEQ ID NO: 29068 - DNA, 15 bp, Homo sapiens
aataaaatctgaaat

SEQ ID NO: 29069 - DNA, 15 bp, Homo sapiens
aaataaaatctgaaa

SEQ ID NO: 29070 - DNA, 15 bp, Homo sapiens
taaataaaatctgaa

SEQ ID NO: 29071 - DNA, 15 bp, Homo sapiens
ataaataaaatctga

SEQ ID NO: 29072 - DNA, 15 bp, Homo sapiens
tataaataaaatctg

SEQ ID NO: 29073 - DNA, 15 bp, Homo sapiens
atataaataaaatct

SEQ ID NO: 29074 - DNA, 15 bp, Homo sapiens
gatataaataaaatc

SEQ ID NO: 29075 - DNA, 15 bp, Homo sapiens
agatataaataaaat

SEQ ID NO: 29076 - DNA, 15 bp, Homo sapiens
aagatataaataaaa

SEQ ID NO: 29077 - DNA, 15 bp, Homo sapiens
gaagatataaataaa

SEQ ID NO: 29078 - DNA, 15 bp, Homo sapiens
tgaagatataaataa

SEQ ID NO: 29079 - DNA, 15 bp, Homo sapiens
atgaagatataaata

SEQ ID NO: 29080 - DNA, 15 bp, Homo sapiens
catgaagatataaat

SEQ ID NO: 29081 - DNA, 15 bp, Homo sapiens
gcatgaagatataaa

SEQ ID NO: 29082 - DNA, 15 bp, Homo sapiens
agcatgaagatataa

SEQ ID NO: 29083 - DNA, 15 bp, Homo sapiens
aagcatgaagatata

SEQ ID NO: 29084 - DNA, 15 bp, Homo sapiens
aaagcatgaagatat

SEQ ID NO: 29085 - DNA, 15 bp, Homo sapiens
caaagcatgaagata

SEQ ID NO: 29086 - DNA, 15 bp, Homo sapiens
ccaaagcatgaagat

SEQ ID NO: 29087 - DNA, 15 bp, Homo sapiens
tccaaagcatgaaga

SEQ ID NO: 29088 - DNA, 15 bp, Homo sapiens
ttccaaagcatgaag

SEQ ID NO: 29089 - DNA, 15 bp, Homo sapiens
tttccaaagcatgaa

SEQ ID NO: 29090 - DNA, 15 bp, Homo sapiens
ttttccaaagcatga

SEQ ID NO: 29091 - DNA, 15 bp, Homo sapiens
tttttccaaagcatg

SEQ ID NO: 29092 - DNA, 15 bp, Homo sapiens
gtttttccaaagcat

SEQ ID NO: 29093 - DNA, 15 bp, Homo sapiens
tgtttttccaaagca

SEQ ID NO: 29094 - DNA, 15 bp, Homo sapiens
ttgtttttccaaagc

SEQ ID NO: 29095 - DNA, 15 bp, Homo sapiens
attgtttttccaaag

SEQ ID NO: 29096 - DNA, 15 bp, Homo sapiens
aattgtttttccaaa

SEQ ID NO: 29097 - DNA, 15 bp, Homo sapiens
aaattgtttttccaa

SEQ ID NO: 29098 - DNA, 15 bp, Homo sapiens
gaaattgtttttcca

SEQ ID NO: 29099 - DNA, 15 bp, Homo sapiens
tgaaattgtttttcc

SEQ ID NO: 29100 - DNA, 15 bp, Homo sapiens
atgaaattgtttttc

SEQ ID NO: 29101 - DNA, 15 bp, Homo sapiens
catgaaattgttttt

SEQ ID NO: 29102 - DNA, 15 bp, Homo sapiens
tcatgaaattgtttt

SEQ ID NO: 29103 - DNA, 15 bp, Homo sapiens
ctcatgaaattgttt

SEQ ID NO: 29104 - DNA, 15 bp, Homo sapiens
tctcatgaaattgtt

SEQ ID NO: 29105 - DNA, 15 bp, Homo sapiens
ttctcatgaaattgt

SEQ ID NO: 29106 - DNA, 15 bp, Homo sapiens
tttctcatgaaattg

SEQ ID NO: 29107 - DNA, 15 bp, Homo sapiens
atttctcatgaaatt

SEQ ID NO: 29108 - DNA, 15 bp, Homo sapiens
gatttctcatgaaat

SEQ ID NO: 29109 - DNA, 15 bp, Homo sapiens
tgatttctcatgaaa

SEQ ID NO: 29110 - DNA, 15 bp, Homo sapiens
gtgatttctcatgaa

SEQ ID NO: 29111 - DNA, 15 bp, Homo sapiens
agtgatttctcatga

SEQ ID NO: 29112 - DNA, 15 bp, Homo sapiens
gagtgatttctcatg

SEQ ID NO: 29113 - DNA, 15 bp, Homo sapiens
tgagtgatttctcat

SEQ ID NO: 29114 - DNA, 15 bp, Homo sapiens
ctgagtgatttctca

SEQ ID NO: 29115 - DNA, 15 bp, Homo sapiens
gctgagtgatttctc

SEQ ID NO: 29116 - DNA, 15 bp, Homo sapiens
ggctgagtgatttct

SEQ ID NO: 29117 - DNA, 15 bp, Homo sapiens
gggctgagtgatttc

SEQ ID NO: 29118 - DNA, 15 bp, Homo sapiens
tgggctgagtgattt

SEQ ID NO: 29119 - DNA, 15 bp, Homo sapiens
atgggctgagtgatt

SEQ ID NO: 29120 - DNA, 15 bp, Homo sapiens
catgggctgagtgat

SEQ ID NO: 29121 - DNA, 15 bp, Homo sapiens
tcatgggctgagtga

SEQ ID NO: 29122 - DNA, 15 bp, Homo sapiens
ttcatgggctgagtg

SEQ ID NO: 29123 - DNA, 15 bp, Homo sapiens
cttcatgggctgagt

SEQ ID NO: 29124 - DNA, 15 bp, Homo sapiens
acttcatgggctgag

SEQ ID NO: 29125 - DNA, 15 bp, Homo sapiens
tacttcatgggctga

SEQ ID NO: 29126 - DNA, 15 bp, Homo sapiens
gtacttcatgggctg

SEQ ID NO: 29127 - DNA, 15 bp, Homo sapiens
ggtacttcatgggct

SEQ ID NO: 29128 - DNA, 15 bp, Homo sapiens
tggtacttcatgggc

SEQ ID NO: 29129 - DNA, 15 bp, Homo sapiens
atggtacttcatggg

SEQ ID NO: 29130 - DNA, 15 bp, Homo sapiens
gatggtacttcatgg

SEQ ID NO: 29131 - DNA, 15 bp, Homo sapiens
ggatggtacttcatg

SEQ ID NO: 29132 - DNA, 15 bp, Homo sapiens
aggatggtacttcat

SEQ ID NO: 29133 - DNA, 15 bp, Homo sapiens
aaggatggtacttca

SEQ ID NO: 29134 - DNA, 15 bp, Homo sapiens
caaggatggtacttc

SEQ ID NO: 29135 - DNA, 15 bp, Homo sapiens
tcaaggatggtactt

SEQ ID NO: 29136 - DNA, 15 bp, Homo sapiens
gtcaaggatggtact

SEQ ID NO: 29137 - DNA, 15 bp, Homo sapiens
tgtcaaggatggtac

SEQ ID NO: 29138 - DNA, 15 bp, Homo sapiens
atgtcaaggatggta

SEQ ID NO: 29139 - DNA, 15 bp, Homo sapiens
aatgtcaaggatggt

SEQ ID NO: 29140 - DNA, 15 bp, Homo sapiens
taatgtcaaggatgg

SEQ ID NO: 29141 - DNA, 15 bp, Homo sapiens
gtaatgtcaaggatg

SEQ ID NO: 29142 - DNA, 15 bp, Homo sapiens
agtaatgtcaaggat

SEQ ID NO: 29143 - DNA, 15 bp, Homo sapiens
aagtaatgtcaagga

SEQ ID NO: 29144 - DNA, 15 bp, Homo sapiens
aaagtaatgtcaagg

SEQ ID NO: 29145 - DNA, 15 bp, Homo sapiens
aaaagtaatgtcaag

SEQ ID NO: 29146 - DNA, 15 bp, Homo sapiens
aaaaagtaatgtcaa

SEQ ID NO: 29147 - DNA, 15 bp, Homo sapiens
aaaaaagtaatgtca

SEQ ID NO: 29148 - DNA, 15 bp, Homo sapiens
caaaaaagtaatgtc

SEQ ID NO: 29149 - DNA, 15 bp, Homo sapiens
ccaaaaaagtaatgt

SEQ ID NO: 29150 - DNA, 15 bp, Homo sapiens
cccaaaaaagtaatg

SEQ ID NO: 29151 - DNA, 15 bp, Homo sapiens
acccaaaaaagtaat

SEQ ID NO: 29152 - DNA, 15 bp, Homo sapiens
aacccaaaaaagtaa

SEQ ID NO: 29153 - DNA, 15 bp, Homo sapiens
aaacccaaaaaagta

SEQ ID NO: 29154 - DNA, 15 bp, Homo sapiens
caaacccaaaaaagt

SEQ ID NO: 29155 - DNA, 15 bp, Homo sapiens
gcaaacccaaaaaag

SEQ ID NO: 29156 - DNA, 15 bp, Homo sapiens
agcaaacccaaaaaa

SEQ ID NO: 29157 - DNA, 15 bp, Homo sapiens
aagcaaacccaaaaa

SEQ ID NO: 29158 - DNA, 15 bp, Homo sapiens
caagcaaacccaaaa

SEQ ID NO: 29159 - DNA, 15 bp, Homo sapiens
acaagcaaacccaaa

SEQ ID NO: 29160 - DNA, 15 bp, Homo sapiens
aacaagcaaacccaa

SEQ ID NO: 29161 - DNA, 15 bp, Homo sapiens
aaacaagcaaaccca

SEQ ID NO: 29162 - DNA, 15 bp, Homo sapiens
aaaacaagcaaaccc

SEQ ID NO: 29163 - DNA, 15 bp, Homo sapiens
aaaaacaagcaaacc

SEQ ID NO: 29164 - DNA, 15 bp, Homo sapiens
taaaaacaagcaaac

SEQ ID NO: 29165 - DNA, 15 bp, Homo sapiens
ttaaaaacaagcaaa

SEQ ID NO: 29166 - DNA, 15 bp, Homo sapiens
tttaaaaacaagcaa

SEQ ID NO: 29167 - DNA, 15 bp, Homo sapiens
ttttaaaaacaagca

SEQ ID NO: 29168 - DNA, 15 bp, Homo sapiens
gttttaaaaacaagc

SEQ ID NO: 29169 - DNA, 15 bp, Homo sapiens
tgttttaaaaacaag

SEQ ID NO: 29170 - DNA, 15 bp, Homo sapiens
ctgttttaaaaacaa

SEQ ID NO: 29171 - DNA, 15 bp, Homo sapiens
actgttttaaaaaca

SEQ ID NO: 29172 - DNA, 15 bp, Homo sapiens
aactgttttaaaaac

SEQ ID NO: 29173 - DNA, 15 bp, Homo sapiens
aaactgttttaaaaa

SEQ ID NO: 29174 - DNA, 15 bp, Homo sapiens
aaaactgttttaaaa

SEQ ID NO: 29175 - DNA, 15 bp, Homo sapiens
aaaaactgttttaaa

SEQ ID NO: 29176 - DNA, 15 bp, Homo sapiens
taaaaactgttttaa

SEQ ID NO: 29177 - DNA, 15 bp, Homo sapiens
ataaaaactgtttta

SEQ ID NO: 29178 - DNA, 15 bp, Homo sapiens
aataaaaactgtttt

SEQ ID NO: 29179 - DNA, 15 bp, Homo sapiens
caataaaaactgttt

SEQ ID NO: 29180 - DNA, 15 bp, Homo sapiens
ccaataaaaactgtt

SEQ ID NO: 29181 - DNA, 15 bp, Homo sapiens
gccaataaaaactgt

SEQ ID NO: 29182 - DNA, 15 bp, Homo sapiens
agccaataaaaactg

SEQ ID NO: 29183 - DNA, 15 bp, Homo sapiens
aagccaataaaaact

SEQ ID NO: 29184 - DNA, 15 bp, Homo sapiens
aaagccaataaaaac

SEQ ID NO: 29185 - DNA, 15 bp, Homo sapiens
aaaagccaataaaaa

SEQ ID NO: 29186 - DNA, 15 bp, Homo sapiens
caaaagccaataaaa

SEQ ID NO: 29187 - DNA, 15 bp, Homo sapiens
gcaaaagccaataaa

SEQ ID NO: 29188 - DNA, 15 bp, Homo sapiens
agcaaaagccaataa

SEQ ID NO: 29189 - DNA, 15 bp, Homo sapiens
aagcaaaagccaata

SEQ ID NO: 29190 - DNA, 15 bp, Homo sapiens
aaagcaaaagccaat

SEQ ID NO: 29191 - DNA, 15 bp, Homo sapiens
aaaagcaaaagccaa

SEQ ID NO: 29192 - DNA, 15 bp, Homo sapiens
aaaaagcaaaagcca

SEQ ID NO: 29193 - DNA, 15 bp, Homo sapiens
taaaaagcaaaagcc

SEQ ID NO: 29194 - DNA, 15 bp, Homo sapiens
ataaaaagcaaaagc

SEQ ID NO: 29195 - DNA, 15 bp, Homo sapiens
tataaaaagcaaaag

SEQ ID NO: 29196 - DNA, 15 bp, Homo sapiens
ttataaaaagcaaaa

SEQ ID NO: 29197 - DNA, 15 bp, Homo sapiens
attataaaaagcaaa

SEQ ID NO: 29198 - DNA, 15 bp, Homo sapiens
aattataaaaagcaa

SEQ ID NO: 29199 - DNA, 15 bp, Homo sapiens
aaattataaaaagca

SEQ ID NO: 29200 - DNA, 15 bp, Homo sapiens
aaaattataaaaagc

SEQ ID NO: 29201 - DNA, 15 bp, Homo sapiens
aaaaattataaaaag

SEQ ID NO: 29202 - DNA, 15 bp, Homo sapiens
aaaaaattataaaaa

SEQ ID NO: 29203 - DNA, 15 bp, Homo sapiens
caaaaaattataaaa

SEQ ID NO: 29204 - DNA, 15 bp, Homo sapiens
tcaaaaaattataaa

SEQ ID NO: 29205 - DNA, 15 bp, Homo sapiens
ttcaaaaaattataa

SEQ ID NO: 29206 - DNA, 15 bp, Homo sapiens
gttcaaaaaattata

SEQ ID NO: 29207 - DNA, 15 bp, Homo sapiens
ggttcaaaaaattat

SEQ ID NO: 29208 - DNA, 15 bp, Homo sapiens
tggttcaaaaaatta

SEQ ID NO: 29209 - DNA, 15 bp, Homo sapiens
atggttcaaaaaatt

SEQ ID NO: 29210 - DNA, 15 bp, Homo sapiens
tatggttcaaaaaat

SEQ ID NO: 29211 - DNA, 15 bp, Homo sapiens
gtatggttcaaaaaa

SEQ ID NO: 29212 - DNA, 15 bp, Homo sapiens
ggtatggttcaaaaa

SEQ ID NO: 29213 - DNA, 15 bp, Homo sapiens
tggtatggttcaaaa

SEQ ID NO: 29214 - DNA, 15 bp, Homo sapiens
ttggtatggttcaaa

SEQ ID NO: 29215 - DNA, 15 bp, Homo sapiens
gttggtatggttcaa

SEQ ID NO: 29216 - DNA, 15 bp, Homo sapiens
tgttggtatggttca

SEQ ID NO: 29217 - DNA, 15 bp, Homo sapiens
ctgttggtatggttc

SEQ ID NO: 29218 - DNA, 15 bp, Homo sapiens
actgttggtatggtt

SEQ ID NO: 29219 - DNA, 15 bp, Homo sapiens
gactgttggtatggt

SEQ ID NO: 29220 - DNA, 15 bp, Homo sapiens
cgactgttggtatgg

SEQ ID NO: 29221 - DNA, 15 bp, Homo sapiens
gcgactgttggtatg

SEQ ID NO: 29222 - DNA, 15 bp, Homo sapiens
tgcgactgttggtat

SEQ ID NO: 29223 - DNA, 15 bp, Homo sapiens
atgcgactgttggta

SEQ ID NO: 29224 - DNA, 15 bp, Homo sapiens
tatgcgactgttggt

SEQ ID NO: 29225 - DNA, 15 bp, Homo sapiens
ttatgcgactgttgg

SEQ ID NO: 29226 - DNA, 15 bp, Homo sapiens
attatgcgactgttg

SEQ ID NO: 29227 - DNA, 15 bp, Homo sapiens
cattatgcgactgtt

SEQ ID NO: 29228 - DNA, 15 bp, Homo sapiens
tcattatgcgactgt

SEQ ID NO: 29229 - DNA, 15 bp, Homo sapiens
ctcattatgcgactg

SEQ ID NO: 29230 - DNA, 15 bp, Homo sapiens
actcattatgcgact

SEQ ID NO: 29231 - DNA, 15 bp, Homo sapiens
tactcattatgcgac

SEQ ID NO: 29232 - DNA, 15 bp, Homo sapiens
atactcattatgcga

SEQ ID NO: 29233 - DNA, 15 bp, Homo sapiens
aatactcattatgcg

SEQ ID NO: 29234 - DNA, 15 bp, Homo sapiens
aaatactcattatgc

SEQ ID NO: 29235 - DNA, 15 bp, Homo sapiens
aaaatactcattatg

SEQ ID NO: 29236 - DNA, 15 bp, Homo sapiens
aaaaatactcattat

SEQ ID NO: 29237 - DNA, 15 bp, Homo sapiens
taaaaatactcatta

SEQ ID NO: 29238 - DNA, 15 bp, Homo sapiens
ctaaaaatactcatt

SEQ ID NO: 29239 - DNA, 15 bp, Homo sapiens
tctaaaaatactcat

SEQ ID NO: 29240 - DNA, 15 bp, Homo sapiens
gtctaaaaatactca

SEQ ID NO: 29241 - DNA, 15 bp, Homo sapiens
tgtctaaaaatactc

SEQ ID NO: 29242 - DNA, 15 bp, Homo sapiens
atgtctaaaaatact

SEQ ID NO: 29243 - DNA, 15 bp, Homo sapiens
catgtctaaaaatac

SEQ ID NO: 29244 - DNA, 15 bp, Homo sapiens
acatgtctaaaaata

SEQ ID NO: 29245 - DNA, 15 bp, Homo sapiens
cacatgtctaaaaat

SEQ ID NO: 29246 - DNA, 15 bp, Homo sapiens
gcacatgtctaaaaa

SEQ ID NO: 29247 - DNA, 15 bp, Homo sapiens
agcacatgtctaaaa

SEQ ID NO: 29248 - DNA, 15 bp, Homo sapiens
aagcacatgtctaaa

SEQ ID NO: 29249 - DNA, 15 bp, Homo sapiens
aaagcacatgtctaa

SEQ ID NO: 29250 - DNA, 15 bp, Homo sapiens
aaaagcacatgtcta

SEQ ID NO: 29251 - DNA, 15 bp, Homo sapiens
taaaagcacatgtct

SEQ ID NO: 29252 - DNA, 15 bp, Homo sapiens
ttaaaagcacatgtc

SEQ ID NO: 29253 - DNA, 15 bp, Homo sapiens
tttaaaagcacatgt

SEQ ID NO: 29254 - DNA, 15 bp, Homo sapiens
ttttaaaagcacatg

SEQ ID NO: 29255 - DNA, 15 bp, Homo sapiens
attttaaaagcacat

SEQ ID NO: 29256 - DNA, 15 bp, Homo sapiens
gattttaaaagcaca

SEQ ID NO: 29257 - DNA, 15 bp, Homo sapiens
tgattttaaaagcac

SEQ ID NO: 29258 - DNA, 15 bp, Homo sapiens
atgattttaaaagca

SEQ ID NO: 29259 - DNA, 15 bp, Homo sapiens
catgattttaaaagc

SEQ ID NO: 29260 - DNA, 15 bp, Homo sapiens
acatgattttaaaag

SEQ ID NO: 29261 - DNA, 15 bp, Homo sapiens
cacatgattttaaaa

SEQ ID NO: 29262 - DNA, 15 bp, Homo sapiens
tcacatgattttaaa

SEQ ID NO: 29263 - DNA, 15 bp, Homo sapiens
ttcacatgattttaa

SEQ ID NO: 29264 - DNA, 15 bp, Homo sapiens
tttcacatgatttta

SEQ ID NO: 29265 - DNA, 15 bp, Homo sapiens
ttttcacatgatttt

SEQ ID NO: 29266 - DNA, 15 bp, Homo sapiens
attttcacatgattt

SEQ ID NO: 29267 - DNA, 15 bp, Homo sapiens
aattttcacatgatt

SEQ ID NO: 29268 - DNA, 15 bp, Homo sapiens
gaattttcacatgat

SEQ ID NO: 29269 - DNA, 15 bp, Homo sapiens
agaattttcacatga

SEQ ID NO: 29270 - DNA, 15 bp, Homo sapiens
aagaattttcacatg

SEQ ID NO: 29271 - DNA, 15 bp, Homo sapiens
aaagaattttcacat

SEQ ID NO: 29272 - DNA, 15 bp, Homo sapiens
aaaagaattttcaca

SEQ ID NO: 29273 - DNA, 15 bp, Homo sapiens
taaaagaattttcac

SEQ ID NO: 29274 - DNA, 15 bp, Homo sapiens
ttaaaagaattttca

SEQ ID NO: 29275 - DNA, 15 bp, Homo sapiens
attaaaagaattttc

SEQ ID NO: 29276 - DNA, 15 bp, Homo sapiens
cattaaaagaatttt

SEQ ID NO: 29277 - DNA, 15 bp, Homo sapiens
acattaaaagaattt

SEQ ID NO: 29278 - DNA, 15 bp, Homo sapiens
gacattaaaagaatt

SEQ ID NO: 29279 - DNA, 15 bp, Homo sapiens
tgacattaaaagaat

SEQ ID NO: 29280 - DNA, 15 bp, Homo sapiens
ttgacattaaaagaa

SEQ ID NO: 29281 - DNA, 15 bp, Homo sapiens
gttgacattaaaaga

SEQ ID NO: 29282 - DNA, 15 bp, Homo sapiens
tgttgacattaaaag

SEQ ID NO: 29283 - DNA, 15 bp, Homo sapiens
atgttgacattaaaa

SEQ ID NO: 29284 - DNA, 15 bp, Homo sapiens
catgttgacattaaa

SEQ ID NO: 29285 - DNA, 15 bp, Homo sapiens
tcatgttgacattaa

SEQ ID NO: 29286 - DNA, 15 bp, Homo sapiens
ttcatgttgacatta

SEQ ID NO: 29287 - DNA, 15 bp, Homo sapiens
cttcatgttgacatt

SEQ ID NO: 29288 - DNA, 15 bp, Homo sapiens
tcttcatgttgacat

SEQ ID NO: 29289 - DNA, 15 bp, Homo sapiens
ctcttcatgttgaca

SEQ ID NO: 29290 - DNA, 15 bp, Homo sapiens
actcttcatgttgac

SEQ ID NO: 29291 - DNA, 15 bp, Homo sapiens
aactcttcatgttga

SEQ ID NO: 29292 - DNA, 15 bp, Homo sapiens
aaactcttcatgttg

SEQ ID NO: 29293 - DNA, 15 bp, Homo sapiens
aaaactcttcatgtt

SEQ ID NO: 29294 - DNA, 15 bp, Homo sapiens
caaaactcttcatgt

SEQ ID NO: 29295 - DNA, 15 bp, Homo sapiens
acaaaactcttcatg

SEQ ID NO: 29296 - DNA, 15 bp, Homo sapiens
aacaaaactcttcat

SEQ ID NO: 29297 - DNA, 15 bp, Homo sapiens
aaacaaaactcttca

SEQ ID NO: 29298 - DNA, 15 bp, Homo sapiens
taaacaaaactcttc

SEQ ID NO: 29299 - DNA, 15 bp, Homo sapiens
ataaacaaaactctt

SEQ ID NO: 29300 - DNA, 15 bp, Homo sapiens
tataaacaaaactct

SEQ ID NO: 29301 - DNA, 15 bp, Homo sapiens
ttataaacaaaactc

SEQ ID NO: 29302 - DNA, 15 bp, Homo sapiens
attataaacaaaact

SEQ ID NO: 29303 - DNA, 15 bp, Homo sapiens
gattataaacaaaac

SEQ ID NO: 29304 - DNA, 15 bp, Homo sapiens
tgattataaacaaaa

SEQ ID NO: 29305 - DNA, 15 bp, Homo sapiens
atgattataaacaaa

SEQ ID NO: 29306 - DNA, 15 bp, Homo sapiens
aatgattataaacaa

SEQ ID NO: 29307 - DNA, 15 bp, Homo sapiens
caatgattataaaca

SEQ ID NO: 29308 - DNA, 15 bp, Homo sapiens
gcaatgattataaac

SEQ ID NO: 29309 - DNA, 15 bp, Homo sapiens
agcaatgattataaa

SEQ ID NO: 29310 - DNA, 15 bp, Homo sapiens
cagcaatgattataa

SEQ ID NO: 29311 - DNA, 15 bp, Homo sapiens
acagcaatgattata

SEQ ID NO: 29312 - DNA, 15 bp, Homo sapiens
cacagcaatgattat

SEQ ID NO: 29313 - DNA, 15 bp, Homo sapiens
tcacagcaatgatta

SEQ ID NO: 29314 - DNA, 15 bp, Homo sapiens
atcacagcaatgatt

SEQ ID NO: 29315 - DNA, 15 bp, Homo sapiens
gatcacagcaatgat

SEQ ID NO: 29316 - DNA, 15 bp, Homo sapiens
tgatcacagcaatga

SEQ ID NO: 29317 - DNA, 15 bp, Homo sapiens
ttgatcacagcaatg

SEQ ID NO: 29318 - DNA, 15 bp, Homo sapiens
cttgatcacagcaat

SEQ ID NO: 29319 - DNA, 15 bp, Homo sapiens
tcttgatcacagcaa

SEQ ID NO: 29320 - DNA, 15 bp, Homo sapiens
ttcttgatcacagca

SEQ ID NO: 29321 - DNA, 15 bp, Homo sapiens
gttcttgatcacagc

SEQ ID NO: 29322 - DNA, 15 bp, Homo sapiens
agttcttgatcacag

SEQ ID NO: 29323 - DNA, 15 bp, Homo sapiens
cagttcttgatcaca

SEQ ID NO: 29324 - DNA, 15 bp, Homo sapiens
tcagttcttgatcac

SEQ ID NO: 29325 - DNA, 15 bp, Homo sapiens
ctcagttcttgatca

SEQ ID NO: 29326 - DNA, 15 bp, Homo sapiens
cctcagttcttgatc

SEQ ID NO: 29327 - DNA, 15 bp, Homo sapiens
acctcagttcttgat

SEQ ID NO: 29328 - DNA, 15 bp, Homo sapiens
tacctcagttcttga

SEQ ID NO: 29329 - DNA, 15 bp, Homo sapiens
ctacctcagttcttg

SEQ ID NO: 29330 - DNA, 15 bp, Homo sapiens
tctacctcagttctt

SEQ ID NO: 29331 - DNA, 15 bp, Homo sapiens
ttctacctcagttct

SEQ ID NO: 29332 - DNA, 15 bp, Homo sapiens
attctacctcagttc

SEQ ID NO: 29333 - DNA, 15 bp, Homo sapiens
aattctacctcagtt

SEQ ID NO: 29334 - DNA, 15 bp, Homo sapiens
aaattctacctcagt

SEQ ID NO: 29335 - DNA, 15 bp, Homo sapiens
gaaattctacctcag

SEQ ID NO: 29336 - DNA, 15 bp, Homo sapiens
ggaaattctacctca

SEQ ID NO: 29337 - DNA, 15 bp, Homo sapiens
aggaaattctacctc

SEQ ID NO: 29338 - DNA, 15 bp, Homo sapiens
taggaaattctacct

SEQ ID NO: 29339 - DNA, 15 bp, Homo sapiens
ctaggaaattctacc

SEQ ID NO: 29340 - DNA, 15 bp, Homo sapiens
gctaggaaattctac

SEQ ID NO: 29341 - DNA, 15 bp, Homo sapiens
agctaggaaattcta

SEQ ID NO: 29342 - DNA, 15 bp, Homo sapiens
cagctaggaaattct

SEQ ID NO: 29343 - DNA, 15 bp, Homo sapiens
ccagctaggaaattc

SEQ ID NO: 29344 - DNA, 15 bp, Homo sapiens
tccagctaggaaatt

SEQ ID NO: 29345 - DNA, 15 bp, Homo sapiens
gtccagctaggaaat

SEQ ID NO: 29346 - DNA, 15 bp, Homo sapiens
tgtccagctaggaaa

SEQ ID NO: 29347 - DNA, 15 bp, Homo sapiens
gtgtccagctaggaa

SEQ ID NO: 29348 - DNA, 15 bp, Homo sapiens
tgtgtccagctagga

SEQ ID NO: 29349 - DNA, 15 bp, Homo sapiens
ttgtgtccagctagg

SEQ ID NO: 29350 - DNA, 15 bp, Homo sapiens
tttgtgtccagctag

SEQ ID NO: 29351 - DNA, 15 bp, Homo sapiens
atttgtgtccagcta

SEQ ID NO: 29352 - DNA, 15 bp, Homo sapiens
catttgtgtccagct

SEQ ID NO: 29353 - DNA, 15 bp, Homo sapiens
ccatttgtgtccagc

SEQ ID NO: 29354 - DNA, 15 bp, Homo sapiens
cccatttgtgtccag

SEQ ID NO: 29355 - DNA, 15 bp, Homo sapiens
acccatttgtgtcca

SEQ ID NO: 29356 - DNA, 15 bp, Homo sapiens
aacccatttgtgtcc

SEQ ID NO: 29357 - DNA, 15 bp, Homo sapiens
taacccatttgtgtc

SEQ ID NO: 29358 - DNA, 15 bp, Homo sapiens
ttaacccatttgtgt

SEQ ID NO: 29359 - DNA, 15 bp, Homo sapiens
tttaacccatttgtg

SEQ ID NO: 29360 - DNA, 15 bp, Homo sapiens
ttttaacccatttgt

SEQ ID NO: 29361 - DNA, 15 bp, Homo sapiens
tttttaacccatttg

SEQ ID NO: 29362 - DNA, 15 bp, Homo sapiens
ttttttaacccattt

SEQ ID NO: 29363 - DNA, 15 bp, Homo sapiens
tttttttaacccatt

SEQ ID NO: 29364 - DNA, 15 bp, Homo sapiens
ttttttttaacccat

SEQ ID NO: 29365 - DNA, 15 bp, Homo sapiens
tttttttttaaccca

SEQ ID NO: 29366 - DNA, 15 bp, Homo sapiens
ttttttttttaaccc

SEQ ID NO: 29367 - DNA, 15 bp, Homo sapiens
gttttttttttaacc

SEQ ID NO: 29368 - DNA, 15 bp, Homo sapiens
ggttttttttttaac

SEQ ID NO: 29369 - DNA, 15 bp, Homo sapiens
gggttttttttttaa

SEQ ID NO: 29370 - DNA, 15 bp, Homo sapiens
cgggtttttttttta

SEQ ID NO: 29371 - DNA, 15 bp, Homo sapiens
tcgggtttttttttt

SEQ ID NO: 29372 - DNA, 15 bp, Homo sapiens
gtcgggttttttttt

SEQ ID NO: 29373 - DNA, 15 bp, Homo sapiens
tgtcgggtttttttt

SEQ ID NO: 29374 - DNA, 15 bp, Homo sapiens
atgtcgggttttttt

SEQ ID NO: 29375 - DNA, 15 bp, Homo sapiens
catgtcgggtttttt

SEQ ID NO: 29376 - DNA, 15 bp, Homo sapiens
gcatgtcgggttttt

SEQ ID NO: 29377 - DNA, 15 bp, Homo sapiens
agcatgtcgggtttt

SEQ ID NO: 29378 - DNA, 15 bp, Homo sapiens
gagcatgtcgggttt

SEQ ID NO: 29379 - DNA, 15 bp, Homo sapiens
agagcatgtcgggtt

SEQ ID NO: 29380 - DNA, 15 bp, Homo sapiens
aagagcatgtcgggt

SEQ ID NO: 29381 - DNA, 15 bp, Homo sapiens
aaagagcatgtcggg

SEQ ID NO: 29382 - DNA, 15 bp, Homo sapiens
caaagagcatgtcgg

SEQ ID NO: 29383 - DNA, 15 bp, Homo sapiens
tcaaagagcatgtcg

SEQ ID NO: 29384 - DNA, 15 bp, Homo sapiens
atcaaagagcatgtc

SEQ ID NO: 29385 - DNA, 15 bp, Homo sapiens
aatcaaagagcatgt

SEQ ID NO: 29386 - DNA, 15 bp, Homo sapiens
taatcaaagagcatg

SEQ ID NO: 29387 - DNA, 15 bp, Homo sapiens
ataatcaaagagcat

SEQ ID NO: 29388 - DNA, 15 bp, Homo sapiens
aataatcaaagagca

SEQ ID NO: 29389 - DNA, 15 bp, Homo sapiens
caataatcaaagagc

SEQ ID NO: 29390 - DNA, 15 bp, Homo sapiens
ccaataatcaaagag

SEQ ID NO: 29391 - DNA, 15 bp, Homo sapiens
tccaataatcaaaga

SEQ ID NO: 29392 - DNA, 15 bp, Homo sapiens
atccaataatcaaag

SEQ ID NO: 29393 - DNA, 15 bp, Homo sapiens
tatccaataatcaaa

SEQ ID NO: 29394 - DNA, 15 bp, Homo sapiens
ttatccaataatcaa

SEQ ID NO: 29395 - DNA, 15 bp, Homo sapiens
cttatccaataatca

SEQ ID NO: 29396 - DNA, 15 bp, Homo sapiens
acttatccaataatc

SEQ ID NO: 29397 - DNA, 15 bp, Homo sapiens
aacttatccaataat

SEQ ID NO: 29398 - DNA, 15 bp, Homo sapiens
caacttatccaataa

SEQ ID NO: 29399 - DNA, 15 bp, Homo sapiens
acaacttatccaata

SEQ ID NO: 29400 - DNA, 15 bp, Homo sapiens
tacaacttatccaat

SEQ ID NO: 29401 - DNA, 15 bp, Homo sapiens
atacaacttatccaa

SEQ ID NO: 29402 - DNA, 15 bp, Homo sapiens
aatacaacttatcca

SEQ ID NO: 29403 - DNA, 15 bp, Homo sapiens
gaatacaacttatcc

SEQ ID NO: 29404 - DNA, 15 bp, Homo sapiens
agaatacaacttatc

SEQ ID NO: 29405 - DNA, 15 bp, Homo sapiens
tagaatacaacttat

SEQ ID NO: 29406 - DNA, 15 bp, Homo sapiens
ttagaatacaactta

SEQ ID NO: 29407 - DNA, 15 bp, Homo sapiens
tttagaatacaactt

SEQ ID NO: 29408 - DNA, 15 bp, Homo sapiens
gtttagaatacaact

SEQ ID NO: 29409 - DNA, 15 bp, Homo sapiens
tgtttagaatacaac

SEQ ID NO: 29410 - DNA, 15 bp, Homo sapiens
ttgtttagaatacaa

SEQ ID NO: 29411 - DNA, 15 bp, Homo sapiens
attgtttagaataca

SEQ ID NO: 29412 - DNA, 15 bp, Homo sapiens
tattgtttagaatac

SEQ ID NO: 29413 - DNA, 15 bp, Homo sapiens
atattgtttagaata

SEQ ID NO: 29414 - DNA, 15 bp, Homo sapiens
aatattgtttagaat

SEQ ID NO: 29415 - DNA, 15 bp, Homo sapiens
taatattgtttagaa

SEQ ID NO: 29416 - DNA, 15 bp, Homo sapiens
gtaatattgtttaga

SEQ ID NO: 29417 - DNA, 15 bp, Homo sapiens
agtaatattgtttag

SEQ ID NO: 29418 - DNA, 15 bp, Homo sapiens
gagtaatattgttta

SEQ ID NO: 29419 - DNA, 15 bp, Homo sapiens
agagtaatattgttt

SEQ ID NO: 29420 - DNA, 15 bp, Homo sapiens
cagagtaatattgtt

SEQ ID NO: 29421 - DNA, 15 bp, Homo sapiens
tcagagtaatattgt

SEQ ID NO: 29422 - DNA, 15 bp, Homo sapiens
atcagagtaatattg

SEQ ID NO: 29423 - DNA, 15 bp, Homo sapiens
catcagagtaatatt

SEQ ID NO: 29424 - DNA, 15 bp, Homo sapiens
tcatcagagtaatat

SEQ ID NO: 29425 - DNA, 15 bp, Homo sapiens
ttcatcagagtaata

SEQ ID NO: 29426 - DNA, 15 bp, Homo sapiens
cttcatcagagtaat

SEQ ID NO: 29427 - DNA, 15 bp, Homo sapiens
tcttcatcagagtaa

SEQ ID NO: 29428 - DNA, 15 bp, Homo sapiens
atcttcatcagagta

SEQ ID NO: 29429 - DNA, 15 bp, Homo sapiens
tatcttcatcagagt

SEQ ID NO: 29430 - DNA, 15 bp, Homo sapiens
atatcttcatcagag

SEQ ID NO: 29431 - DNA, 15 bp, Homo sapiens
aatatcttcatcaga

SEQ ID NO: 29432 - DNA, 15 bp, Homo sapiens
taatatcttcatcag

SEQ ID NO: 29433 - DNA, 15 bp, Homo sapiens
ttaatatcttcatca

SEQ ID NO: 29434 - DNA, 15 bp, Homo sapiens
cttaatatcttcatc

SEQ ID NO: 29435 - DNA, 15 bp, Homo sapiens
ccttaatatcttcat

SEQ ID NO: 29436 - DNA, 15 bp, Homo sapiens
cccttaatatcttca

SEQ ID NO: 29437 - DNA, 15 bp, Homo sapiens
ccccttaatatcttc

SEQ ID NO: 29438 - DNA, 15 bp, Homo sapiens
tccccttaatatctt

SEQ ID NO: 29439 - DNA, 15 bp, Homo sapiens
ctccccttaatatct

SEQ ID NO: 29440 - DNA, 15 bp, Homo sapiens
actccccttaatatc

SEQ ID NO: 29441 - DNA, 15 bp, Homo sapiens
aactccccttaatat

SEQ ID NO: 29442 - DNA, 15 bp, Homo sapiens
taactccccttaata

SEQ ID NO: 29443 - DNA, 15 bp, Homo sapiens
ttaactccccttaat

SEQ ID NO: 29444 - DNA, 15 bp, Homo sapiens
attaactccccttaa

SEQ ID NO: 29445 - DNA, 15 bp, Homo sapiens
aattaactcccctta

SEQ ID NO: 29446 - DNA, 15 bp, Homo sapiens
taattaactcccctt

SEQ ID NO: 29447 - DNA, 15 bp, Homo sapiens
ctaattaactcccct

SEQ ID NO: 29448 - DNA, 15 bp, Homo sapiens
tctaattaactcccc

SEQ ID NO: 29449 - DNA, 15 bp, Homo sapiens
atctaattaactccc

SEQ ID NO: 29450 - DNA, 15 bp, Homo sapiens
aatctaattaactcc

SEQ ID NO: 29451 - DNA, 15 bp, Homo sapiens
caatctaattaactc

SEQ ID NO: 29452 - DNA, 15 bp, Homo sapiens
acaatctaattaact

SEQ ID NO: 29453 - DNA, 15 bp, Homo sapiens
cacaatctaattaac

SEQ ID NO: 29454 - DNA, 15 bp, Homo sapiens
tcacaatctaattaa

SEQ ID NO: 29455 - DNA, 15 bp, Homo sapiens
ctcacaatctaatta

SEQ ID NO: 29456 - DNA, 15 bp, Homo sapiens
tctcacaatctaatt

SEQ ID NO: 29457 - DNA, 15 bp, Homo sapiens
gtctcacaatctaat

SEQ ID NO: 29458 - DNA, 15 bp, Homo sapiens
agtctcacaatctaa

SEQ ID NO: 29459 - DNA, 15 bp, Homo sapiens
gagtctcacaatcta

SEQ ID NO: 29460 - DNA, 15 bp, Homo sapiens
agagtctcacaatct

SEQ ID NO: 29461 - DNA, 15 bp, Homo sapiens
aagagtctcacaatc

SEQ ID NO: 29462 - DNA, 15 bp, Homo sapiens
caagagtctcacaat

SEQ ID NO: 29463 - DNA, 15 bp, Homo sapiens
tcaagagtctcacaa

SEQ ID NO: 29464 - DNA, 15 bp, Homo sapiens
ctcaagagtctcaca

SEQ ID NO: 29465 - DNA, 15 bp, Homo sapiens
cctcaagagtctcac

SEQ ID NO: 29466 - DNA, 15 bp, Homo sapiens
tcctcaagagtctca

SEQ ID NO: 29467 - DNA, 15 bp, Homo sapiens
gtcctcaagagtctc

SEQ ID NO: 29468 - DNA, 15 bp, Homo sapiens
tgtcctcaagagtct

SEQ ID NO: 29469 - DNA, 15 bp, Homo sapiens
ctgtcctcaagagtc

SEQ ID NO: 29470 - DNA, 15 bp, Homo sapiens
actgtcctcaagagt

SEQ ID NO: 29471 - DNA, 15 bp, Homo sapiens
aactgtcctcaagag

SEQ ID NO: 29472 - DNA, 15 bp, Homo sapiens
caactgtcctcaaga

SEQ ID NO: 29473 - DNA, 15 bp, Homo sapiens
tcaactgtcctcaag

SEQ ID NO: 29474 - DNA, 15 bp, Homo sapiens
atcaactgtcctcaa

SEQ ID NO: 29475 - DNA, 15 bp, Homo sapiens
catcaactgtcctca

SEQ ID NO: 29476 - DNA, 15 bp, Homo sapiens
gcatcaactgtcctc

SEQ ID NO: 29477 - DNA, 15 bp, Homo sapiens
ggcatcaactgtcct

SEQ ID NO: 29478 - DNA, 15 bp, Homo sapiens
aggcatcaactgtcc

SEQ ID NO: 29479 - DNA, 15 bp, Homo sapiens
aaggcatcaactgtc

SEQ ID NO: 29480 - DNA, 15 bp, Homo sapiens
aaaggcatcaactgt

SEQ ID NO: 29481 - DNA, 15 bp, Homo sapiens
aaaaggcatcaactg

SEQ ID NO: 29482 - DNA, 15 bp, Homo sapiens
aaaaaggcatcaact

SEQ ID NO: 29483 - DNA, 15 bp, Homo sapiens
gaaaaaggcatcaac

SEQ ID NO: 29484 - DNA, 15 bp, Homo sapiens
tgaaaaaggcatcaa

SEQ ID NO: 29485 - DNA, 15 bp, Homo sapiens
atgaaaaaggcatca

SEQ ID NO: 29486 - DNA, 15 bp, Homo sapiens
aatgaaaaaggcatc

SEQ ID NO: 29487 - DNA, 15 bp, Homo sapiens
aaatgaaaaaggcat

SEQ ID NO: 29488 - DNA, 15 bp, Homo sapiens
aaaatgaaaaaggca

SEQ ID NO: 29489 - DNA, 15 bp, Homo sapiens
aaaaatgaaaaaggc

SEQ ID NO: 29490 - DNA, 15 bp, Homo sapiens
caaaaatgaaaaagg

SEQ ID NO: 29491 - DNA, 15 bp, Homo sapiens
gcaaaaatgaaaaag

SEQ ID NO: 29492 - DNA, 15 bp, Homo sapiens
tgcaaaaatgaaaaa

SEQ ID NO: 29493 - DNA, 15 bp, Homo sapiens
atgcaaaaatgaaaa

SEQ ID NO: 29494 - DNA, 15 bp, Homo sapiens
aatgcaaaaatgaaa

SEQ ID NO: 29495 - DNA, 15 bp, Homo sapiens
gaatgcaaaaatgaa

SEQ ID NO: 29496 - DNA, 15 bp, Homo sapiens
agaatgcaaaaatga

SEQ ID NO: 29497 - DNA, 15 bp, Homo sapiens
aagaatgcaaaaatg

SEQ ID NO: 29498 - DNA, 15 bp, Homo sapiens
gaagaatgcaaaaat

SEQ ID NO: 29499 - DNA, 15 bp, Homo sapiens
agaagaatgcaaaaa

SEQ ID NO: 29500 - DNA, 15 bp, Homo sapiens
aagaagaatgcaaaa

SEQ ID NO: 29501 - DNA, 15 bp, Homo sapiens
caagaagaatgcaaa

SEQ ID NO: 29502 - DNA, 15 bp, Homo sapiens
ccaagaagaatgcaa

SEQ ID NO: 29503 - DNA, 15 bp, Homo sapiens
cccaagaagaatgca

SEQ ID NO: 29504 - DNA, 15 bp, Homo sapiens
acccaagaagaatgc

SEQ ID NO: 29505 - DNA, 15 bp, Homo sapiens
cacccaagaagaatg

SEQ ID NO: 29506 - DNA, 15 bp, Homo sapiens
gcacccaagaagaat

SEQ ID NO: 29507 - DNA, 15 bp, Homo sapiens
ggcacccaagaagaa

SEQ ID NO: 29508 - DNA, 15 bp, Homo sapiens
cggcacccaagaaga

SEQ ID NO: 29509 - DNA, 15 bp, Homo sapiens
acggcacccaagaag

SEQ ID NO: 29510 - DNA, 15 bp, Homo sapiens
cacggcacccaagaa

SEQ ID NO: 29511 - DNA, 15 bp, Homo sapiens
acacggcacccaaga

SEQ ID NO: 29512 - DNA, 15 bp, Homo sapiens
tacacggcacccaag

SEQ ID NO: 29513 - DNA, 15 bp, Homo sapiens
ctacacggcacccaa

SEQ ID NO: 29514 - DNA, 15 bp, Homo sapiens
actacacggcaccca

SEQ ID NO: 29515 - DNA, 15 bp, Homo sapiens
aactacacggcaccc

SEQ ID NO: 29516 - DNA, 15 bp, Homo sapiens
caactacacggcacc

SEQ ID NO: 29517 - DNA, 15 bp, Homo sapiens
tcaactacacggcac

SEQ ID NO: 29518 - DNA, 15 bp, Homo sapiens
atcaactacacggca

SEQ ID NO: 29519 - DNA, 15 bp, Homo sapiens
gatcaactacacggc

SEQ ID NO: 29520 - DNA, 15 bp, Homo sapiens
tgatcaactacacgg

SEQ ID NO: 29521 - DNA, 15 bp, Homo sapiens
ctgatcaactacacg

SEQ ID NO: 29522 - DNA, 15 bp, Homo sapiens
actgatcaactacac

SEQ ID NO: 29523 - DNA, 15 bp, Homo sapiens
tactgatcaactaca

SEQ ID NO: 29524 - DNA, 15 bp, Homo sapiens
atactgatcaactac

SEQ ID NO: 29525 - DNA, 15 bp, Homo sapiens
tatactgatcaacta

SEQ ID NO: 29526 - DNA, 15 bp, Homo sapiens
ctatactgatcaact

SEQ ID NO: 29527 - DNA, 15 bp, Homo sapiens
actatactgatcaac

SEQ ID NO: 29528 - DNA, 15 bp, Homo sapiens
gactatactgatcaa

SEQ ID NO: 29529 - DNA, 15 bp, Homo sapiens
tgactatactgatca

SEQ ID NO: 29530 - DNA, 15 bp, Homo sapiens
atgactatactgatc

SEQ ID NO: 29531 - DNA, 15 bp, Homo sapiens
catgactatactgat

SEQ ID NO: 29532 - DNA, 15 bp, Homo sapiens
ccatgactatactga

SEQ ID NO: 29533 - DNA, 15 bp, Homo sapiens
cccatgactatactg

SEQ ID NO: 29534 - DNA, 15 bp, Homo sapiens
tcccatgactatact

SEQ ID NO: 29535 - DNA, 15 bp, Homo sapiens
gtcccatgactatac

SEQ ID NO: 29536 - DNA, 15 bp, Homo sapiens
agtcccatgactata

SEQ ID NO: 29537 - DNA, 15 bp, Homo sapiens
aagtcccatgactat

SEQ ID NO: 29538 - DNA, 15 bp, Homo sapiens
taagtcccatgacta

SEQ ID NO: 29539 - DNA, 15 bp, Homo sapiens
ctaagtcccatgact

SEQ ID NO: 29540 - DNA, 15 bp, Homo sapiens
actaagtcccatgac

SEQ ID NO: 29541 - DNA, 15 bp, Homo sapiens
aactaagtcccatga

SEQ ID NO: 29542 - DNA, 15 bp, Homo sapiens
gaactaagtcccatg

SEQ ID NO: 29543 - DNA, 15 bp, Homo sapiens
agaactaagtcccat

SEQ ID NO: 29544 - DNA, 15 bp, Homo sapiens
cagaactaagtccca

SEQ ID NO: 29545 - DNA, 15 bp, Homo sapiens
tcagaactaagtccc

SEQ ID NO: 29546 - DNA, 15 bp, Homo sapiens
atcagaactaagtcc

SEQ ID NO: 29547 - DNA, 15 bp, Homo sapiens
aatcagaactaagtc

SEQ ID NO: 29548 - DNA, 15 bp, Homo sapiens
caatcagaactaagt

SEQ ID NO: 29549 - DNA, 15 bp, Homo sapiens
acaatcagaactaag

SEQ ID NO: 29550 - DNA, 15 bp, Homo sapiens
tacaatcagaactaa

SEQ ID NO: 29551 - DNA, 15 bp, Homo sapiens
ctacaatcagaacta

SEQ ID NO: 29552 - DNA, 15 bp, Homo sapiens
cctacaatcagaact

SEQ ID NO: 29553 - DNA, 15 bp, Homo sapiens
ccctacaatcagaac

SEQ ID NO: 29554 - DNA, 15 bp, Homo sapiens
tccctacaatcagaa

SEQ ID NO: 29555 - DNA, 15 bp, Homo sapiens
ctccctacaatcaga

SEQ ID NO: 29556 - DNA, 15 bp, Homo sapiens
gctccctacaatcag

SEQ ID NO: 29557 - DNA, 15 bp, Homo sapiens
agctccctacaatca

SEQ ID NO: 29558 - DNA, 15 bp, Homo sapiens
cagctccctacaatc

SEQ ID NO: 29559 - DNA, 15 bp, Homo sapiens
acagctccctacaat

SEQ ID NO: 29560 - DNA, 15 bp, Homo sapiens
cacagctccctacaa

SEQ ID NO: 29561 - DNA, 15 bp, Homo sapiens
acacagctccctaca

SEQ ID NO: 29562 - DNA, 15 bp, Homo sapiens
cacacagctccctac

SEQ ID NO: 29563 - DNA, 15 bp, Homo sapiens
tcacacagctcccta

SEQ ID NO: 29564 - DNA, 15 bp, Homo sapiens
ttcacacagctccct

SEQ ID NO: 29565 - DNA, 15 bp, Homo sapiens
gttcacacagctccc

SEQ ID NO: 29566 - DNA, 15 bp, Homo sapiens
agttcacacagctcc

SEQ ID NO: 29567 - DNA, 15 bp, Homo sapiens
cagttcacacagctc

SEQ ID NO: 29568 - DNA, 15 bp, Homo sapiens
gcagttcacacagct

SEQ ID NO: 29569 - DNA, 15 bp, Homo sapiens
tgcagttcacacagc

SEQ ID NO: 29570 - DNA, 15 bp, Homo sapiens
atgcagttcacacag

SEQ ID NO: 29571 - DNA, 15 bp, Homo sapiens
catgcagttcacaca

SEQ ID NO: 29572 - DNA, 15 bp, Homo sapiens
tcatgcagttcacac

SEQ ID NO: 29573 - DNA, 15 bp, Homo sapiens
ttcatgcagttcaca

SEQ ID NO: 29574 - DNA, 15 bp, Homo sapiens
cttcatgcagttcac

SEQ ID NO: 29575 - DNA, 15 bp, Homo sapiens
gcttcatgcagttca

SEQ ID NO: 29576 - DNA, 15 bp, Homo sapiens
tgcttcatgcagttc

SEQ ID NO: 29577 - DNA, 15 bp, Homo sapiens
ctgcttcatgcagtt

SEQ ID NO: 29578 - DNA, 15 bp, Homo sapiens
tctgcttcatgcagt

SEQ ID NO: 29579 - DNA, 15 bp, Homo sapiens
gtctgcttcatgcag

SEQ ID NO: 29580 - DNA, 15 bp, Homo sapiens
cgtctgcttcatgca

SEQ ID NO: 29581 - DNA, 15 bp, Homo sapiens
tcgtctgcttcatgc

SEQ ID NO: 29582 - DNA, 15 bp, Homo sapiens
ctcgtctgcttcatg

SEQ ID NO: 29583 - DNA, 15 bp, Homo sapiens
tctcgtctgcttcat

SEQ ID NO: 29584 - DNA, 15 bp, Homo sapiens
gtctcgtctgcttca

SEQ ID NO: 29585 - DNA, 15 bp, Homo sapiens
agtctcgtctgcttc

SEQ ID NO: 29586 - DNA, 15 bp, Homo sapiens
gagtctcgtctgctt

SEQ ID NO: 29587 - DNA, 15 bp, Homo sapiens
ggagtctcgtctgct

SEQ ID NO: 29588 - DNA, 15 bp, Homo sapiens
tggagtctcgtctgc

SEQ ID NO: 29589 - DNA, 15 bp, Homo sapiens
atggagtctcgtctg

SEQ ID NO: 29590 - DNA, 15 bp, Homo sapiens
gatggagtctcgtct

SEQ ID NO: 29591 - DNA, 15 bp, Homo sapiens
ggatggagtctcgtc

SEQ ID NO: 29592 - DNA, 15 bp, Homo sapiens
aggatggagtctcgt

SEQ ID NO: 29593 - DNA, 15 bp, Homo sapiens
gaggatggagtctcg

SEQ ID NO: 29594 - DNA, 15 bp, Homo sapiens
cgaggatggagtctc

SEQ ID NO: 29595 - DNA, 15 bp, Homo sapiens
gcgaggatggagtct

SEQ ID NO: 29596 - DNA, 15 bp, Homo sapiens
tgcgaggatggagtc

SEQ ID NO: 29597 - DNA, 15 bp, Homo sapiens
atgcgaggatggagt

SEQ ID NO: 29598 - DNA, 15 bp, Homo sapiens
catgcgaggatggag

SEQ ID NO: 29599 - DNA, 15 bp, Homo sapiens
ccatgcgaggatgga

SEQ ID NO: 29600 - DNA, 15 bp, Homo sapiens
cccatgcgaggatgg

SEQ ID NO: 29601 - DNA, 15 bp, Homo sapiens
tcccatgcgaggatg

SEQ ID NO: 29602 - DNA, 15 bp, Homo sapiens
ttcccatgcgaggat

SEQ ID NO: 29603 - DNA, 15 bp, Homo sapiens
tttcccatgcgagga

SEQ ID NO: 29604 - DNA, 15 bp, Homo sapiens
gtttcccatgcgagg

SEQ ID NO: 29605 - DNA, 15 bp, Homo sapiens
ggtttcccatgcgag

SEQ ID NO: 29606 - DNA, 15 bp, Homo sapiens
aggtttcccatgcga

SEQ ID NO: 29607 - DNA, 15 bp, Homo sapiens
aaggtttcccatgcg

SEQ ID NO: 29608 - DNA, 15 bp, Homo sapiens
aaaggtttcccatgc

SEQ ID NO: 29609 - DNA, 15 bp, Homo sapiens
taaaggtttcccatg

SEQ ID NO: 29610 - DNA, 15 bp, Homo sapiens
ttaaaggtttcccat

SEQ ID NO: 29611 - DNA, 15 bp, Homo sapiens
cttaaaggtttccca

SEQ ID NO: 29612 - DNA, 15 bp, Homo sapiens
ccttaaaggtttccc

SEQ ID NO: 29613 - DNA, 15 bp, Homo sapiens
tccttaaaggtttcc

SEQ ID NO: 29614 - DNA, 15 bp, Homo sapiens
atccttaaaggtttc

SEQ ID NO: 29615 - DNA, 15 bp, Homo sapiens
aatccttaaaggttt

SEQ ID NO: 29616 - DNA, 15 bp, Homo sapiens
aaatccttaaaggtt

SEQ ID NO: 29617 - DNA, 15 bp, Homo sapiens
aaaatccttaaaggt

SEQ ID NO: 29618 - DNA, 15 bp, Homo sapiens
caaaatccttaaagg

SEQ ID NO: 29619 - DNA, 15 bp, Homo sapiens
tcaaaatccttaaag

SEQ ID NO: 29620 - DNA, 15 bp, Homo sapiens
ttcaaaatccttaaa

SEQ ID NO: 29621 - DNA, 15 bp, Homo sapiens
cttcaaaatccttaa

SEQ ID NO: 29622 - DNA, 15 bp, Homo sapiens
gcttcaaaatcctta

SEQ ID NO: 29623 - DNA, 15 bp, Homo sapiens
agcttcaaaatcctt

SEQ ID NO: 29624 - DNA, 15 bp, Homo sapiens
cagcttcaaaatcct

SEQ ID NO: 29625 - DNA, 15 bp, Homo sapiens
ccagcttcaaaatcc

SEQ ID NO: 29626 - DNA, 15 bp, Homo sapiens
cccagcttcaaaatc

SEQ ID NO: 29627 - DNA, 15 bp, Homo sapiens
gcccagcttcaaaat

SEQ ID NO: 29628 - DNA, 15 bp, Homo sapiens
tgcccagcttcaaaa

SEQ ID NO: 29629 - DNA, 15 bp, Homo sapiens
ctgcccagcttcaaa

SEQ ID NO: 29630 - DNA, 15 bp, Homo sapiens
cctgcccagcttcaa

SEQ ID NO: 29631 - DNA, 15 bp, Homo sapiens
acctgcccagcttca

SEQ ID NO: 29632 - DNA, 15 bp, Homo sapiens
cacctgcccagcttc

SEQ ID NO: 29633 - DNA, 15 bp, Homo sapiens
gcacctgcccagctt

SEQ ID NO: 29634 - DNA, 15 bp, Homo sapiens
tgcacctgcccagct

SEQ ID NO: 29635 - DNA, 15 bp, Homo sapiens
ctgcacctgcccagc

SEQ ID NO: 29636 - DNA, 15 bp, Homo sapiens
cctgcacctgcccag

SEQ ID NO: 29637 - DNA, 15 bp, Homo sapiens
acctgcacctgccca

SEQ ID NO: 29638 - DNA, 15 bp, Homo sapiens
aacctgcacctgccc

SEQ ID NO: 29639 - DNA, 15 bp, Homo sapiens
taacctgcacctgcc

SEQ ID NO: 29640 - DNA, 15 bp, Homo sapiens
ttaacctgcacctgc

SEQ ID NO: 29641 - DNA, 15 bp, Homo sapiens
attaacctgcacctg

SEQ ID NO: 29642 - DNA, 15 bp, Homo sapiens
tattaacctgcacct

SEQ ID NO: 29643 - DNA, 15 bp, Homo sapiens
ctattaacctgcacc

SEQ ID NO: 29644 - DNA, 15 bp, Homo sapiens
tctattaacctgcac

SEQ ID NO: 29645 - DNA, 15 bp, Homo sapiens
ttctattaacctgca

SEQ ID NO: 29646 - DNA, 15 bp, Homo sapiens
tttctattaacctgc

SEQ ID NO: 29647 - DNA, 15 bp, Homo sapiens
ctttctattaacctg

SEQ ID NO: 29648 - DNA, 15 bp, Homo sapiens
tctttctattaacct

SEQ ID NO: 29649 - DNA, 15 bp, Homo sapiens
atctttctattaacc

SEQ ID NO: 29650 - DNA, 15 bp, Homo sapiens
gatctttctattaac

SEQ ID NO: 29651 - DNA, 15 bp, Homo sapiens
tgatctttctattaa

SEQ ID NO: 29652 - DNA, 15 bp, Homo sapiens
gtgatctttctatta

SEQ ID NO: 29653 - DNA, 15 bp, Homo sapiens
agtgatctttctatt

SEQ ID NO: 29654 - DNA, 15 bp, Homo sapiens
gagtgatctttctat

SEQ ID NO: 29655 - DNA, 15 bp, Homo sapiens
agagtgatctttcta

SEQ ID NO: 29656 - DNA, 15 bp, Homo sapiens
cagagtgatctttct

SEQ ID NO: 29657 - DNA, 15 bp, Homo sapiens
ccagagtgatctttc

SEQ ID NO: 29658 - DNA, 15 bp, Homo sapiens
cccagagtgatcttt

SEQ ID NO: 29659 - DNA, 15 bp, Homo sapiens
gcccagagtgatctt

SEQ ID NO: 29660 - DNA, 15 bp, Homo sapiens
agcccagagtgatct

SEQ ID NO: 29661 - DNA, 15 bp, Homo sapiens
gagcccagagtgatc

SEQ ID NO: 29662 - DNA, 15 bp, Homo sapiens
agagcccagagtgat

SEQ ID NO: 29663 - DNA, 15 bp, Homo sapiens
cagagcccagagtga

SEQ ID NO: 29664 - DNA, 15 bp, Homo sapiens
acagagcccagagtg

SEQ ID NO: 29665 - DNA, 15 bp, Homo sapiens
tacagagcccagagt

SEQ ID NO: 29666 - DNA, 15 bp, Homo sapiens
ctacagagcccagag

SEQ ID NO: 29667 - DNA, 15 bp, Homo sapiens
cctacagagcccaga

SEQ ID NO: 29668 - DNA, 15 bp, Homo sapiens
tcctacagagcccag

SEQ ID NO: 29669 - DNA, 15 bp, Homo sapiens
ctcctacagagccca

SEQ ID NO: 29670 - DNA, 15 bp, Homo sapiens
tctcctacagagccc

SEQ ID NO: 29671 - DNA, 15 bp, Homo sapiens
ctctcctacagagcc

SEQ ID NO: 29672 - DNA, 15 bp, Homo sapiens
actctcctacagagc

SEQ ID NO: 29673 - DNA, 15 bp, Homo sapiens
cactctcctacagag

SEQ ID NO: 29674 - DNA, 15 bp, Homo sapiens
tcactctcctacaga

SEQ ID NO: 29675 - DNA, 15 bp, Homo sapiens
atcactctcctacag

SEQ ID NO: 29676 - DNA, 15 bp, Homo sapiens
aatcactctcctaca

SEQ ID NO: 29677 - DNA, 15 bp, Homo sapiens
aaatcactctcctac

SEQ ID NO: 29678 - DNA, 15 bp, Homo sapiens
caaatcactctccta

SEQ ID NO: 29679 - DNA, 15 bp, Homo sapiens
ccaaatcactctcct

SEQ ID NO: 29680 - DNA, 15 bp, Homo sapiens
tccaaatcactctcc

SEQ ID NO: 29681 - DNA, 15 bp, Homo sapiens
ctccaaatcactctc

SEQ ID NO: 29682 - DNA, 15 bp, Homo sapiens
tctccaaatcactct

SEQ ID NO: 29683 - DNA, 15 bp, Homo sapiens
ctctccaaatcactc

SEQ ID NO: 29684 - DNA, 15 bp, Homo sapiens
tctctccaaatcact

SEQ ID NO: 29685 - DNA, 15 bp, Homo sapiens
ttctctccaaatcac

SEQ ID NO: 29686 - DNA, 15 bp, Homo sapiens
cttctctccaaatca

SEQ ID NO: 29687 - DNA, 15 bp, Homo sapiens
tcttctctccaaatc

SEQ ID NO: 29688 - DNA, 15 bp, Homo sapiens
ctcttctctccaaat

SEQ ID NO: 29689 - DNA, 15 bp, Homo sapiens
gctcttctctccaaa

SEQ ID NO: 29690 - DNA, 15 bp, Homo sapiens
ggctcttctctccaa

SEQ ID NO: 29691 - DNA, 15 bp, Homo sapiens
gggctcttctctcca

SEQ ID NO: 29692 - DNA, 15 bp, Homo sapiens
ggggctcttctctcc

SEQ ID NO: 29693 - DNA, 15 bp, Homo sapiens
aggggctcttctctc

SEQ ID NO: 29694 - DNA, 15 bp, Homo sapiens
taggggctcttctct

SEQ ID NO: 29695 - DNA, 15 bp, Homo sapiens
ctaggggctcttctc

SEQ ID NO: 29696 - DNA, 15 bp, Homo sapiens
tctaggggctcttct

SEQ ID NO: 29697 - DNA, 15 bp, Homo sapiens
ctctaggggctcttc

SEQ ID NO: 29698 - DNA, 15 bp, Homo sapiens
cctctaggggctctt

SEQ ID NO: 29699 - DNA, 15 bp, Homo sapiens
gcctctaggggctct

SEQ ID NO: 29700 - DNA, 15 bp, Homo sapiens
ggcctctaggggctc

SEQ ID NO: 29701 - DNA, 15 bp, Homo sapiens
gggcctctaggggct

SEQ ID NO: 29702 - DNA, 15 bp, Homo sapiens
tgggcctctaggggc

SEQ ID NO: 29703 - DNA, 15 bp, Homo sapiens
ctgggcctctagggg

SEQ ID NO: 29704 - DNA, 15 bp, Homo sapiens
cctgggcctctaggg

SEQ ID NO: 29705 - DNA, 15 bp, Homo sapiens
ccctgggcctctagg

SEQ ID NO: 29706 - DNA, 15 bp, Homo sapiens
tccctgggcctctag

SEQ ID NO: 29707 - DNA, 15 bp, Homo sapiens
ttccctgggcctcta

SEQ ID NO: 29708 - DNA, 15 bp, Homo sapiens
gttccctgggcctct

SEQ ID NO: 29709 - DNA, 15 bp, Homo sapiens
tgttccctgggcctc

SEQ ID NO: 29710 - DNA, 15 bp, Homo sapiens
atgttccctgggcct

SEQ ID NO: 29711 - DNA, 15 bp, Homo sapiens
aatgttccctgggcc

SEQ ID NO: 29712 - DNA, 15 bp, Homo sapiens
caatgttccctgggc

SEQ ID NO: 29713 - DNA, 15 bp, Homo sapiens
gcaatgttccctggg

SEQ ID NO: 29714 - DNA, 15 bp, Homo sapiens
tgcaatgttccctgg

SEQ ID NO: 29715 - DNA, 15 bp, Homo sapiens
ctgcaatgttccctg

SEQ ID NO: 29716 - DNA, 15 bp, Homo sapiens
cctgcaatgttccct

SEQ ID NO: 29717 - DNA, 15 bp, Homo sapiens
acctgcaatgttccc

SEQ ID NO: 29718 - DNA, 15 bp, Homo sapiens
cacctgcaatgttcc

SEQ ID NO: 29719 - DNA, 15 bp, Homo sapiens
ccacctgcaatgttc

SEQ ID NO: 29720 - DNA, 15 bp, Homo sapiens
gccacctgcaatgtt

SEQ ID NO: 29721 - DNA, 15 bp, Homo sapiens
agccacctgcaatgt

SEQ ID NO: 29722 - DNA, 15 bp, Homo sapiens
gagccacctgcaatg

SEQ ID NO: 29723 - DNA, 15 bp, Homo sapiens
agagccacctgcaat

SEQ ID NO: 29724 - DNA, 15 bp, Homo sapiens
cagagccacctgcaa

SEQ ID NO: 29725 - DNA, 15 bp, Homo sapiens
gcagagccacctgca

SEQ ID NO: 29726 - DNA, 15 bp, Homo sapiens
ggcagagccacctgc

SEQ ID NO: 29727 - DNA, 15 bp, Homo sapiens
tggcagagccacctg

SEQ ID NO: 29728 - DNA, 15 bp, Homo sapiens
ctggcagagccacct

SEQ ID NO: 29729 - DNA, 15 bp, Homo sapiens
cctggcagagccacc

SEQ ID NO: 29730 - DNA, 15 bp, Homo sapiens
tcctggcagagccac

SEQ ID NO: 29731 - DNA, 15 bp, Homo sapiens
ctcctggcagagcca

SEQ ID NO: 29732 - DNA, 15 bp, Homo sapiens
tctcctggcagagcc

SEQ ID NO: 29733 - DNA, 15 bp, Homo sapiens
gtctcctggcagagc

SEQ ID NO: 29734 - DNA, 15 bp, Homo sapiens
ggtctcctggcagag

SEQ ID NO: 29735 - DNA, 15 bp, Homo sapiens
tggtctcctggcaga

SEQ ID NO: 29736 - DNA, 15 bp, Homo sapiens
ctggtctcctggcag

SEQ ID NO: 29737 - DNA, 15 bp, Homo sapiens
cctggtctcctggca

SEQ ID NO: 29738 - DNA, 15 bp, Homo sapiens
acctggtctcctggc

SEQ ID NO: 29739 - DNA, 15 bp, Homo sapiens
tacctggtctcctgg

SEQ ID NO: 29740 - DNA, 15 bp, Homo sapiens
ctacctggtctcctg

SEQ ID NO: 29741 - DNA, 15 bp, Homo sapiens
tctacctggtctcct

SEQ ID NO: 29742 - DNA, 15 bp, Homo sapiens
ttctacctggtctcc

SEQ ID NO: 29743 - DNA, 15 bp, Homo sapiens
cttctacctggtctc

SEQ ID NO: 29744 - DNA, 15 bp, Homo sapiens
tcttctacctggtct

SEQ ID NO: 29745 - DNA, 15 bp, Homo sapiens
atcttctacctggtc

SEQ ID NO: 29746 - DNA, 15 bp, Homo sapiens
catcttctacctggt

SEQ ID NO: 29747 - DNA, 15 bp, Homo sapiens
acatcttctacctgg

SEQ ID NO: 29748 - DNA, 15 bp, Homo sapiens
cacatcttctacctg

SEQ ID NO: 29749 - DNA, 15 bp, Homo sapiens
ccacatcttctacct

SEQ ID NO: 29750 - DNA, 15 bp, Homo sapiens
accacatcttctacc

SEQ ID NO: 29751 - DNA, 15 bp, Homo sapiens
caccacatcttctac

SEQ ID NO: 29752 - DNA, 15 bp, Homo sapiens
tcaccacatcttcta

SEQ ID NO: 29753 - DNA, 15 bp, Homo sapiens
ctcaccacatcttct

SEQ ID NO: 29754 - DNA, 15 bp, Homo sapiens
cctcaccacatcttc

SEQ ID NO: 29755 - DNA, 15 bp, Homo sapiens
ccctcaccacatctt

SEQ ID NO: 29756 - DNA, 15 bp, Homo sapiens
accctcaccacatct

SEQ ID NO: 29757 - DNA, 15 bp, Homo sapiens
caccctcaccacatc

SEQ ID NO: 29758 - DNA, 15 bp, Homo sapiens
ccaccctcaccacat

SEQ ID NO: 29759 - DNA, 15 bp, Homo sapiens
cccaccctcaccaca

SEQ ID NO: 29760 - DNA, 15 bp, Homo sapiens
gcccaccctcaccac

SEQ ID NO: 29761 - DNA, 15 bp, Homo sapiens
cgcccaccctcacca

SEQ ID NO: 29762 - DNA, 15 bp, Homo sapiens
ccgcccaccctcacc

SEQ ID NO: 29763 - DNA, 15 bp, Homo sapiens
cccgcccaccctcac

SEQ ID NO: 29764 - DNA, 15 bp, Homo sapiens
tcccgcccaccctca

SEQ ID NO: 29765 - DNA, 15 bp, Homo sapiens
ctcccgcccaccctc

SEQ ID NO: 29766 - DNA, 15 bp, Homo sapiens
tctcccgcccaccct

SEQ ID NO: 29767 - DNA, 15 bp, Homo sapiens
atctcccgcccaccc

SEQ ID NO: 29768 - DNA, 15 bp, Homo sapiens
catctcccgcccacc

SEQ ID NO: 29769 - DNA, 15 bp, Homo sapiens
ccatctcccgcccac

SEQ ID NO: 29770 - DNA, 15 bp, Homo sapiens
tccatctcccgccca

SEQ ID NO: 29771 - DNA, 15 bp, Homo sapiens
atccatctcccgccc

SEQ ID NO: 29772 - DNA, 15 bp, Homo sapiens
catccatctcccgcc

SEQ ID NO: 29773 - DNA, 15 bp, Homo sapiens
tcatccatctcccgc

SEQ ID NO: 29774 - DNA, 15 bp, Homo sapiens
ttcatccatctcccg

SEQ ID NO: 29775 - DNA, 15 bp, Homo sapiens
tttcatccatctccc

SEQ ID NO: 29776 - DNA, 15 bp, Homo sapiens
gtttcatccatctcc

SEQ ID NO: 29777 - DNA, 15 bp, Homo sapiens
agtttcatccatctc

SEQ ID NO: 29778 - DNA, 15 bp, Homo sapiens
cagtttcatccatct

SEQ ID NO: 29779 - DNA, 15 bp, Homo sapiens
acagtttcatccatc

SEQ ID NO: 29780 - DNA, 15 bp, Homo sapiens
cacagtttcatccat

SEQ ID NO: 29781 - DNA, 15 bp, Homo sapiens
ccacagtttcatcca

SEQ ID NO: 29782 - DNA, 15 bp, Homo sapiens
tccacagtttcatcc

SEQ ID NO: 29783 - DNA, 15 bp, Homo sapiens
atccacagtttcatc

SEQ ID NO: 29784 - DNA, 15 bp, Homo sapiens
aatccacagtttcat

SEQ ID NO: 29785 - DNA, 15 bp, Homo sapiens
aaatccacagtttca

SEQ ID NO: 29786 - DNA, 15 bp, Homo sapiens
gaaatccacagtttc

SEQ ID NO: 29787 - DNA, 15 bp, Homo sapiens
cgaaatccacagttt

SEQ ID NO: 29788 - DNA, 15 bp, Homo sapiens
acgaaatccacagtt

SEQ ID NO: 29789 - DNA, 15 bp, Homo sapiens
tacgaaatccacagt

SEQ ID NO: 29790 - DNA, 15 bp, Homo sapiens
ctacgaaatccacag

SEQ ID NO: 29791 - DNA, 15 bp, Homo sapiens
cctacgaaatccaca

SEQ ID NO: 29792 - DNA, 15 bp, Homo sapiens
acctacgaaatccac

SEQ ID NO: 29793 - DNA, 15 bp, Homo sapiens
tacctacgaaatcca

SEQ ID NO: 29794 - DNA, 15 bp, Homo sapiens
gtacctacgaaatcc

SEQ ID NO: 29795 - DNA, 15 bp, Homo sapiens
tgtacctacgaaatc

SEQ ID NO: 29796 - DNA, 15 bp, Homo sapiens
ctgtacctacgaaat

SEQ ID NO: 29797 - DNA, 15 bp, Homo sapiens
tctgtacctacgaaa

SEQ ID NO: 29798 - DNA, 15 bp, Homo sapiens
atctgtacctacgaa

SEQ ID NO: 29799 - DNA, 15 bp, Homo sapiens
aatctgtacctacga

SEQ ID NO: 29800 - DNA, 15 bp, Homo sapiens
gaatctgtacctacg

SEQ ID NO: 29801 - DNA, 15 bp, Homo sapiens
tgaatctgtacctac

SEQ ID NO: 29802 - DNA, 15 bp, Homo sapiens
atgaatctgtaccta

SEQ ID NO: 29803 - DNA, 15 bp, Homo sapiens
gatgaatctgtacct

SEQ ID NO: 29804 - DNA, 15 bp, Homo sapiens
tgatgaatctgtacc

SEQ ID NO: 29805 - DNA, 15 bp, Homo sapiens
atgatgaatctgtac

SEQ ID NO: 29806 - DNA, 15 bp, Homo sapiens
gatgatgaatctgta

SEQ ID NO: 29807 - DNA, 15 bp, Homo sapiens
ggatgatgaatctgt

SEQ ID NO: 29808 - DNA, 15 bp, Homo sapiens
aggatgatgaatctg

SEQ ID NO: 29809 - DNA, 15 bp, Homo sapiens
aaggatgatgaatct

SEQ ID NO: 29810 - DNA, 15 bp, Homo sapiens
gaaggatgatgaatc

SEQ ID NO: 29811 - DNA, 15 bp, Homo sapiens
tgaaggatgatgaat

SEQ ID NO: 29812 - DNA, 15 bp, Homo sapiens
atgaaggatgatgaa

SEQ ID NO: 29813 - DNA, 15 bp, Homo sapiens
gatgaaggatgatga

SEQ ID NO: 29814 - DNA, 15 bp, Homo sapiens
agatgaaggatgatg

SEQ ID NO: 29815 - DNA, 15 bp, Homo sapiens
cagatgaaggatgat

SEQ ID NO: 29816 - DNA, 15 bp, Homo sapiens
acagatgaaggatga

SEQ ID NO: 29817 - DNA, 15 bp, Homo sapiens
tacagatgaaggatg

SEQ ID NO: 29818 - DNA, 15 bp, Homo sapiens
ctacagatgaaggat

SEQ ID NO: 29819 - DNA, 15 bp, Homo sapiens
gctacagatgaagga

SEQ ID NO: 29820 - DNA, 15 bp, Homo sapiens
agctacagatgaagg

SEQ ID NO: 29821 - DNA, 15 bp, Homo sapiens
tagctacagatgaag

SEQ ID NO: 29822 - DNA, 15 bp, Homo sapiens
gtagctacagatgaa

SEQ ID NO: 29823 - DNA, 15 bp, Homo sapiens
tgtagctacagatga

SEQ ID NO: 29824 - DNA, 15 bp, Homo sapiens
gtgtagctacagatg

SEQ ID NO: 29825 - DNA, 15 bp, Homo sapiens
agtgtagctacagat

SEQ ID NO: 29826 - DNA, 15 bp, Homo sapiens
tagtgtagctacaga

SEQ ID NO: 29827 - DNA, 15 bp, Homo sapiens
atagtgtagctacag

SEQ ID NO: 29828 - DNA, 15 bp, Homo sapiens
aatagtgtagctaca

SEQ ID NO: 29829 - DNA, 15 bp, Homo sapiens
caatagtgtagctac

SEQ ID NO: 29830 - DNA, 15 bp, Homo sapiens
tcaatagtgtagcta

SEQ ID NO: 29831 - DNA, 15 bp, Homo sapiens
ttcaatagtgtagct

SEQ ID NO: 29832 - DNA, 15 bp, Homo sapiens
cttcaatagtgtagc

SEQ ID NO: 29833 - DNA, 15 bp, Homo sapiens
tcttcaatagtgtag

SEQ ID NO: 29834 - DNA, 15 bp, Homo sapiens
ttcttcaatagtgta

SEQ ID NO: 29835 - DNA, 15 bp, Homo sapiens
cttcttcaatagtgt

SEQ ID NO: 29836 - DNA, 15 bp, Homo sapiens
tcttcttcaatagtg

SEQ ID NO: 29837 - DNA, 15 bp, Homo sapiens
gtcttcttcaatagt

SEQ ID NO: 29838 - DNA, 15 bp, Homo sapiens
ggtcttcttcaatag

SEQ ID NO: 29839 - DNA, 15 bp, Homo sapiens
aggtcttcttcaata

SEQ ID NO: 29840 - DNA, 15 bp, Homo sapiens
gaggtcttcttcaat

SEQ ID NO: 29841 - DNA, 15 bp, Homo sapiens
ggaggtcttcttcaa

SEQ ID NO: 29842 - DNA, 15 bp, Homo sapiens
cggaggtcttcttca

SEQ ID NO: 29843 - DNA, 15 bp, Homo sapiens
tcggaggtcttcttc

SEQ ID NO: 29844 - DNA, 15 bp, Homo sapiens
ttcggaggtcttctt

SEQ ID NO: 29845 - DNA, 15 bp, Homo sapiens
tttcggaggtcttct

SEQ ID NO: 29846 - DNA, 15 bp, Homo sapiens
ttttcggaggtcttc

SEQ ID NO: 29847 - DNA, 15 bp, Homo sapiens
gttttcggaggtctt

SEQ ID NO: 29848 - DNA, 15 bp, Homo sapiens
ggttttcggaggtct

SEQ ID NO: 29849 - DNA, 15 bp, Homo sapiens
tggttttcggaggtc

SEQ ID NO: 29850 - DNA, 15 bp, Homo sapiens
ctggttttcggaggt

SEQ ID NO: 29851 - DNA, 15 bp, Homo sapiens
tctggttttcggagg

SEQ ID NO: 29852 - DNA, 15 bp, Homo sapiens
ttctggttttcggag

SEQ ID NO: 29853 - DNA, 15 bp, Homo sapiens
cttctggttttcgga

SEQ ID NO: 29854 - DNA, 15 bp, Homo sapiens
ccttctggttttcgg

SEQ ID NO: 29855 - DNA, 15 bp, Homo sapiens
accttctggttttcg

SEQ ID NO: 29856 - DNA, 15 bp, Homo sapiens
caccttctggttttc

SEQ ID NO: 29857 - DNA, 15 bp, Homo sapiens
acaccttctggtttt

SEQ ID NO: 29858 - DNA, 15 bp, Homo sapiens
aacaccttctggttt

SEQ ID NO: 29859 - DNA, 15 bp, Homo sapiens
aaacaccttctggtt

SEQ ID NO: 29860 - DNA, 15 bp, Homo sapiens
aaaacaccttctggt

SEQ ID NO: 29861 - DNA, 15 bp, Homo sapiens
taaaacaccttctgg

SEQ ID NO: 29862 - DNA, 15 bp, Homo sapiens
ataaaacaccttctg

SEQ ID NO: 29863 - DNA, 15 bp, Homo sapiens
aataaaacaccttct

SEQ ID NO: 29864 - DNA, 15 bp, Homo sapiens
aaataaaacaccttc

SEQ ID NO: 29865 - DNA, 15 bp, Homo sapiens
caaataaaacacctt

SEQ ID NO: 29866 - DNA, 15 bp, Homo sapiens
acaaataaaacacct

SEQ ID NO: 29867 - DNA, 15 bp, Homo sapiens
tacaaataaaacacc

SEQ ID NO: 29868 - DNA, 15 bp, Homo sapiens
ctacaaataaaacac

SEQ ID NO: 29869 - DNA, 15 bp, Homo sapiens
actacaaataaaaca

SEQ ID NO: 29870 - DNA, 15 bp, Homo sapiens
aactacaaataaaac

SEQ ID NO: 29871 - DNA, 15 bp, Homo sapiens
gaactacaaataaaa

SEQ ID NO: 29872 - DNA, 15 bp, Homo sapiens
tgaactacaaataaa

SEQ ID NO: 29873 - DNA, 15 bp, Homo sapiens
atgaactacaaataa

SEQ ID NO: 29874 - DNA, 15 bp, Homo sapiens
aatgaactacaaata

SEQ ID NO: 29875 - DNA, 15 bp, Homo sapiens
aaatgaactacaaat

SEQ ID NO: 29876 - DNA, 15 bp, Homo sapiens
caaatgaactacaaa

SEQ ID NO: 29877 - DNA, 15 bp, Homo sapiens
ccaaatgaactacaa

SEQ ID NO: 29878 - DNA, 15 bp, Homo sapiens
gccaaatgaactaca

SEQ ID NO: 29879 - DNA, 15 bp, Homo sapiens
tgccaaatgaactac

SEQ ID NO: 29880 - DNA, 15 bp, Homo sapiens
ttgccaaatgaacta

SEQ ID NO: 29881 - DNA, 15 bp, Homo sapiens
cttgccaaatgaact

SEQ ID NO: 29882 - DNA, 15 bp, Homo sapiens
tcttgccaaatgaac

SEQ ID NO: 29883 - DNA, 15 bp, Homo sapiens
ttcttgccaaatgaa

SEQ ID NO: 29884 - DNA, 15 bp, Homo sapiens
tttcttgccaaatga

SEQ ID NO: 29885 - DNA, 15 bp, Homo sapiens
ttttcttgccaaatg

SEQ ID NO: 29886 - DNA, 15 bp, Homo sapiens
gttttcttgccaaat

SEQ ID NO: 29887 - DNA, 15 bp, Homo sapiens
agttttcttgccaaa

SEQ ID NO: 29888 - DNA, 15 bp, Homo sapiens
aagttttcttgccaa

SEQ ID NO: 29889 - DNA, 15 bp, Homo sapiens
caagttttcttgcca

SEQ ID NO: 29890 - DNA, 15 bp, Homo sapiens
tcaagttttcttgcc

SEQ ID NO: 29891 - DNA, 15 bp, Homo sapiens
ctcaagttttcttgc

SEQ ID NO: 29892 - DNA, 15 bp, Homo sapiens
actcaagttttcttg

SEQ ID NO: 29893 - DNA, 15 bp, Homo sapiens
aactcaagttttctt

SEQ ID NO: 29894 - DNA, 15 bp, Homo sapiens
aaactcaagttttct

SEQ ID NO: 29895 - DNA, 15 bp, Homo sapiens
caaactcaagttttc

SEQ ID NO: 29896 - DNA, 15 bp, Homo sapiens
tcaaactcaagtttt

SEQ ID NO: 29897 - DNA, 15 bp, Homo sapiens
gtcaaactcaagttt

SEQ ID NO: 29898 - DNA, 15 bp, Homo sapiens
ggtcaaactcaagtt

SEQ ID NO: 29899 - DNA, 15 bp, Homo sapiens
aggtcaaactcaagt

SEQ ID NO: 29900 - DNA, 15 bp, Homo sapiens
caggtcaaactcaag

SEQ ID NO: 29901 - DNA, 15 bp, Homo sapiens
tcaggtcaaactcaa

SEQ ID NO: 29902 - DNA, 15 bp, Homo sapiens
ttcaggtcaaactca

SEQ ID NO: 29903 - DNA, 15 bp, Homo sapiens
gttcaggtcaaactc

SEQ ID NO: 29904 - DNA, 15 bp, Homo sapiens
agttcaggtcaaact

SEQ ID NO: 29905 - DNA, 15 bp, Homo sapiens
gagttcaggtcaaac

SEQ ID NO: 29906 - DNA, 15 bp, Homo sapiens
tgagttcaggtcaaa

SEQ ID NO: 29907 - DNA, 15 bp, Homo sapiens
atgagttcaggtcaa

SEQ ID NO: 29908 - DNA, 15 bp, Homo sapiens
aatgagttcaggtca

SEQ ID NO: 29909 - DNA, 15 bp, Homo sapiens
aaatgagttcaggtc

SEQ ID NO: 29910 - DNA, 15 bp, Homo sapiens
caaatgagttcaggt

SEQ ID NO: 29911 - DNA, 15 bp, Homo sapiens
ccaaatgagttcagg

SEQ ID NO: 29912 - DNA, 15 bp, Homo sapiens
accaaatgagttcag

SEQ ID NO: 29913 - DNA, 15 bp, Homo sapiens
caccaaatgagttca

SEQ ID NO: 29914 - DNA, 15 bp, Homo sapiens
acaccaaatgagttc

SEQ ID NO: 29915 - DNA, 15 bp, Homo sapiens
aacaccaaatgagtt

SEQ ID NO: 29916 - DNA, 15 bp, Homo sapiens
caacaccaaatgagt

SEQ ID NO: 29917 - DNA, 15 bp, Homo sapiens
tcaacaccaaatgag

SEQ ID NO: 29918 - DNA, 15 bp, Homo sapiens
ttcaacaccaaatga

SEQ ID NO: 29919 - DNA, 15 bp, Homo sapiens
cttcaacaccaaatg

SEQ ID NO: 29920 - DNA, 15 bp, Homo sapiens
gcttcaacaccaaat

SEQ ID NO: 29921 - DNA, 15 bp, Homo sapiens
ggcttcaacaccaaa

SEQ ID NO: 29922 - DNA, 15 bp, Homo sapiens
aggcttcaacaccaa

SEQ ID NO: 29923 - DNA, 15 bp, Homo sapiens
caggcttcaacacca

SEQ ID NO: 29924 - DNA, 15 bp, Homo sapiens
tcaggcttcaacacc

SEQ ID NO: 29925 - DNA, 15 bp, Homo sapiens
gtcaggcttcaacac

SEQ ID NO: 29926 - DNA, 15 bp, Homo sapiens
agtcaggcttcaaca

SEQ ID NO: 29927 - DNA, 15 bp, Homo sapiens
aagtcaggcttcaac

SEQ ID NO: 29928 - DNA, 15 bp, Homo sapiens
caagtcaggcttcaa

SEQ ID NO: 29929 - DNA, 15 bp, Homo sapiens
tcaagtcaggcttca

SEQ ID NO: 29930 - DNA, 15 bp, Homo sapiens
ttcaagtcaggcttc

SEQ ID NO: 29931 - DNA, 15 bp, Homo sapiens
gttcaagtcaggctt

SEQ ID NO: 29932 - DNA, 15 bp, Homo sapiens
tgttcaagtcaggct

SEQ ID NO: 29933 - DNA, 15 bp, Homo sapiens
ctgttcaagtcaggc

SEQ ID NO: 29934 - DNA, 15 bp, Homo sapiens
gctgttcaagtcagg

SEQ ID NO: 29935 - DNA, 15 bp, Homo sapiens
agctgttcaagtcag

SEQ ID NO: 29936 - DNA, 15 bp, Homo sapiens
cagctgttcaagtca

SEQ ID NO: 29937 - DNA, 15 bp, Homo sapiens
ccagctgttcaagtc

SEQ ID NO: 29938 - DNA, 15 bp, Homo sapiens
cccagctgttcaagt

SEQ ID NO: 29939 - DNA, 15 bp, Homo sapiens
tcccagctgttcaag

SEQ ID NO: 29940 - DNA, 15 bp, Homo sapiens
gtcccagctgttcaa

SEQ ID NO: 29941 - DNA, 15 bp, Homo sapiens
agtcccagctgttca

SEQ ID NO: 29942 - DNA, 15 bp, Homo sapiens
gagtcccagctgttc

SEQ ID NO: 29943 - DNA, 15 bp, Homo sapiens
agagtcccagctgtt

SEQ ID NO: 29944 - DNA, 15 bp, Homo sapiens
aagagtcccagctgt

SEQ ID NO: 29945 - DNA, 15 bp, Homo sapiens
aaagagtcccagctg

SEQ ID NO: 29946 - DNA, 15 bp, Homo sapiens
aaaagagtcccagct

SEQ ID NO: 29947 - DNA, 15 bp, Homo sapiens
taaaagagtcccagc

SEQ ID NO: 29948 - DNA, 15 bp, Homo sapiens
ttaaaagagtcccag

SEQ ID NO: 29949 - DNA, 15 bp, Homo sapiens
tttaaaagagtccca

SEQ ID NO: 29950 - DNA, 15 bp, Homo sapiens
ctttaaaagagtccc

SEQ ID NO: 29951 - DNA, 15 bp, Homo sapiens
actttaaaagagtcc

SEQ ID NO: 29952 - DNA, 15 bp, Homo sapiens
gactttaaaagagtc

SEQ ID NO: 29953 - DNA, 15 bp, Homo sapiens
ggactttaaaagagt

SEQ ID NO: 29954 - DNA, 15 bp, Homo sapiens
aggactttaaaagag

SEQ ID NO: 29955 - DNA, 15 bp, Homo sapiens
aaggactttaaaaga

SEQ ID NO: 29956 - DNA, 15 bp, Homo sapiens
taaggactttaaaag

SEQ ID NO: 29957 - DNA, 15 bp, Homo sapiens
ataaggactttaaaa

SEQ ID NO: 29958 - DNA, 15 bp, Homo sapiens
cataaggactttaaa

SEQ ID NO: 29959 - DNA, 15 bp, Homo sapiens
acataaggactttaa

SEQ ID NO: 29960 - DNA, 15 bp, Homo sapiens
tacataaggacttta

SEQ ID NO: 29961 - DNA, 15 bp, Homo sapiens
atacataaggacttt

SEQ ID NO: 29962 - DNA, 15 bp, Homo sapiens
catacataaggactt

SEQ ID NO: 29963 - DNA, 15 bp, Homo sapiens
acatacataaggact

SEQ ID NO: 29964 - DNA, 15 bp, Homo sapiens
gacatacataaggac

SEQ ID NO: 29965 - DNA, 15 bp, Homo sapiens
tgacatacataagga

SEQ ID NO: 29966 - DNA, 15 bp, Homo sapiens
ctgacatacataagg

SEQ ID NO: 29967 - DNA, 15 bp, Homo sapiens
cctgacatacataag

SEQ ID NO: 29968 - DNA, 15 bp, Homo sapiens
gcctgacatacataa

SEQ ID NO: 29969 - DNA, 15 bp, Homo sapiens
tgcctgacatacata

SEQ ID NO: 29970 - DNA, 15 bp, Homo sapiens
atgcctgacatacat

SEQ ID NO: 29971 - DNA, 15 bp, Homo sapiens
gatgcctgacataca

SEQ ID NO: 29972 - DNA, 15 bp, Homo sapiens
ggatgcctgacatac

SEQ ID NO: 29973 - DNA, 15 bp, Homo sapiens
aggatgcctgacata

SEQ ID NO: 29974 - DNA, 15 bp, Homo sapiens
aaggatgcctgacat

SEQ ID NO: 29975 - DNA, 15 bp, Homo sapiens
gaaggatgcctgaca

SEQ ID NO: 29976 - DNA, 15 bp, Homo sapiens
tgaaggatgcctgac

SEQ ID NO: 29977 - DNA, 15 bp, Homo sapiens
atgaaggatgcctga

SEQ ID NO: 29978 - DNA, 15 bp, Homo sapiens
tatgaaggatgcctg

SEQ ID NO: 29979 - DNA, 15 bp, Homo sapiens
ttatgaaggatgcct

SEQ ID NO: 29980 - DNA, 15 bp, Homo sapiens
tttatgaaggatgcc

SEQ ID NO: 29981 - DNA, 15 bp, Homo sapiens
gtttatgaaggatgc

SEQ ID NO: 29982 - DNA, 15 bp, Homo sapiens
tgtttatgaaggatg

SEQ ID NO: 29983 - DNA, 15 bp, Homo sapiens
atgtttatgaaggat

SEQ ID NO: 29984 - DNA, 15 bp, Homo sapiens
tatgtttatgaagga

SEQ ID NO: 29985 - DNA, 15 bp, Homo sapiens
atatgtttatgaagg

SEQ ID NO: 29986 - DNA, 15 bp, Homo sapiens
catatgtttatgaag

SEQ ID NO: 29987 - DNA, 15 bp, Homo sapiens
acatatgtttatgaa

SEQ ID NO: 29988 - DNA, 15 bp, Homo sapiens
tacatatgtttatga

SEQ ID NO: 29989 - DNA, 15 bp, Homo sapiens
atacatatgtttatg

SEQ ID NO: 29990 - DNA, 15 bp, Homo sapiens
aatacatatgtttat

SEQ ID NO: 29991 - DNA, 15 bp, Homo sapiens
aaatacatatgttta

SEQ ID NO: 29992 - DNA, 15 bp, Homo sapiens
taaatacatatgttt

SEQ ID NO: 29993 - DNA, 15 bp, Homo sapiens
gtaaatacatatgtt

SEQ ID NO: 29994 - DNA, 15 bp, Homo sapiens
agtaaatacatatgt

SEQ ID NO: 29995 - DNA, 15 bp, Homo sapiens
cagtaaatacatatg

SEQ ID NO: 29996 - DNA, 15 bp, Homo sapiens
gcagtaaatacatat

SEQ ID NO: 29997 - DNA, 15 bp, Homo sapiens
tgcagtaaatacata

SEQ ID NO: 29998 - DNA, 15 bp, Homo sapiens
ctgcagtaaatacat

SEQ ID NO: 29999 - DNA, 15 bp, Homo sapiens
cctgcagtaaataca

SEQ ID NO: 30000 - DNA, 15 bp, Homo sapiens
ccctgcagtaaatac

SEQ ID NO: 30001 - DNA, 15 bp, Homo sapiens
gccctgcagtaaata

SEQ ID NO: 30002 - DNA, 15 bp, Homo sapiens
agccctgcagtaaat

SEQ ID NO: 30003 - DNA, 15 bp, Homo sapiens
tagccctgcagtaaa

SEQ ID NO: 30004 - DNA, 15 bp, Homo sapiens
atagccctgcagtaa

SEQ ID NO: 30005 - DNA, 15 bp, Homo sapiens
aatagccctgcagta

SEQ ID NO: 30006 - DNA, 15 bp, Homo sapiens
taatagccctgcagt

SEQ ID NO: 30007 - DNA, 15 bp, Homo sapiens
ttaatagccctgcag

SEQ ID NO: 30008 - DNA, 15 bp, Homo sapiens
attaatagccctgca

SEQ ID NO: 30009 - DNA, 15 bp, Homo sapiens
cattaatagccctgc

SEQ ID NO: 30010 - DNA, 15 bp, Homo sapiens
acattaatagccctg

SEQ ID NO: 30011 - DNA, 15 bp, Homo sapiens
cacattaatagccct

SEQ ID NO: 30012 - DNA, 15 bp, Homo sapiens
acacattaatagccc

SEQ ID NO: 30013 - DNA, 15 bp, Homo sapiens
aacacattaatagcc

SEQ ID NO: 30014 - DNA, 15 bp, Homo sapiens
aaacacattaatagc

SEQ ID NO: 30015 - DNA, 15 bp, Homo sapiens
caaacacattaatag

SEQ ID NO: 30016 - DNA, 15 bp, Homo sapiens
tcaaacacattaata

SEQ ID NO: 30017 - DNA, 15 bp, Homo sapiens
atcaaacacattaat

SEQ ID NO: 30018 - DNA, 15 bp, Homo sapiens
aatcaaacacattaa

SEQ ID NO: 30019 - DNA, 15 bp, Homo sapiens
taatcaaacacatta

SEQ ID NO: 30020 - DNA, 15 bp, Homo sapiens
ctaatcaaacacatt

SEQ ID NO: 30021 - DNA, 15 bp, Homo sapiens
cctaatcaaacacat

SEQ ID NO: 30022 - DNA, 15 bp, Homo sapiens
ccctaatcaaacaca

SEQ ID NO: 30023 - DNA, 15 bp, Homo sapiens
cccctaatcaaacac

SEQ ID NO: 30024 - DNA, 15 bp, Homo sapiens
tcccctaatcaaaca

SEQ ID NO: 30025 - DNA, 15 bp, Homo sapiens
ttcccctaatcaaac

SEQ ID NO: 30026 - DNA, 15 bp, Homo sapiens
tttcccctaatcaaa

SEQ ID NO: 30027 - DNA, 15 bp, Homo sapiens
atttcccctaatcaa

SEQ ID NO: 30028 - DNA, 15 bp, Homo sapiens
aatttcccctaatca

SEQ ID NO: 30029 - DNA, 15 bp, Homo sapiens
caatttcccctaatc

SEQ ID NO: 30030 - DNA, 15 bp, Homo sapiens
gcaatttcccctaat

SEQ ID NO: 30031 - DNA, 15 bp, Homo sapiens
ggcaatttcccctaa

SEQ ID NO: 30032 - DNA, 15 bp, Homo sapiens
gggcaatttccccta

SEQ ID NO: 30033 - DNA, 15 bp, Homo sapiens
agggcaatttcccct

SEQ ID NO: 30034 - DNA, 15 bp, Homo sapiens
cagggcaatttcccc

SEQ ID NO: 30035 - DNA, 15 bp, Homo sapiens
ccagggcaatttccc

SEQ ID NO: 30036 - DNA, 15 bp, Homo sapiens
tccagggcaatttcc

SEQ ID NO: 30037 - DNA, 15 bp, Homo sapiens
atccagggcaatttc

SEQ ID NO: 30038 - DNA, 15 bp, Homo sapiens
gatccagggcaattt

SEQ ID NO: 30039 - DNA, 15 bp, Homo sapiens
agatccagggcaatt

SEQ ID NO: 30040 - DNA, 15 bp, Homo sapiens
aagatccagggcaat

SEQ ID NO: 30041 - DNA, 15 bp, Homo sapiens
caagatccagggcaa

SEQ ID NO: 30042 - DNA, 15 bp, Homo sapiens
gcaagatccagggca

SEQ ID NO: 30043 - DNA, 15 bp, Homo sapiens
agcaagatccagggc

SEQ ID NO: 30044 - DNA, 15 bp, Homo sapiens
cagcaagatccaggg

SEQ ID NO: 30045 - DNA, 15 bp, Homo sapiens
acagcaagatccagg

SEQ ID NO: 30046 - DNA, 15 bp, Homo sapiens
aacagcaagatccag

SEQ ID NO: 30047 - DNA, 15 bp, Homo sapiens
aaacagcaagatcca

SEQ ID NO: 30048 - DNA, 15 bp, Homo sapiens
aaaacagcaagatcc

SEQ ID NO: 30049 - DNA, 15 bp, Homo sapiens
aaaaacagcaagatc

SEQ ID NO: 30050 - DNA, 15 bp, Homo sapiens
aaaaaacagcaagat

SEQ ID NO: 30051 - DNA, 15 bp, Homo sapiens
caaaaaacagcaaga

SEQ ID NO: 30052 - DNA, 15 bp, Homo sapiens
acaaaaaacagcaag

SEQ ID NO: 30053 - DNA, 15 bp, Homo sapiens
aacaaaaaacagcaa

SEQ ID NO: 30054 - DNA, 15 bp, Homo sapiens
aaacaaaaaacagca

SEQ ID NO: 30055 - DNA, 15 bp, Homo sapiens
aaaacaaaaaacagc

SEQ ID NO: 30056 - DNA, 15 bp, Homo sapiens
gaaaacaaaaaacag

SEQ ID NO: 30057 - DNA, 15 bp, Homo sapiens
tgaaaacaaaaaaca

SEQ ID NO: 30058 - DNA, 15 bp, Homo sapiens
gtgaaaacaaaaaac

SEQ ID NO: 30059 - DNA, 15 bp, Homo sapiens
agtgaaaacaaaaaa

SEQ ID NO: 30060 - DNA, 15 bp, Homo sapiens
cagtgaaaacaaaaa

SEQ ID NO: 30061 - DNA, 15 bp, Homo sapiens
acagtgaaaacaaaa

SEQ ID NO: 30062 - DNA, 15 bp, Homo sapiens
tacagtgaaaacaaa

SEQ ID NO: 30063 - DNA, 15 bp, Homo sapiens
ttacagtgaaaacaa

SEQ ID NO: 30064 - DNA, 15 bp, Homo sapiens
attacagtgaaaaca

SEQ ID NO: 30065 - DNA, 15 bp, Homo sapiens
tattacagtgaaaac

SEQ ID NO: 30066 - DNA, 15 bp, Homo sapiens
atattacagtgaaaa

SEQ ID NO: 30067 - DNA, 15 bp, Homo sapiens
tatattacagtgaaa

SEQ ID NO: 30068 - DNA, 15 bp, Homo sapiens
atatattacagtgaa

SEQ ID NO: 30069 - DNA, 15 bp, Homo sapiens
catatattacagtga

SEQ ID NO: 30070 - DNA, 15 bp, Homo sapiens
tcatatattacagtg

SEQ ID NO: 30071 - DNA, 15 bp, Homo sapiens
gtcatatattacagt

SEQ ID NO: 30072 - DNA, 15 bp, Homo sapiens
agtcatatattacag

SEQ ID NO: 30073 - DNA, 15 bp, Homo sapiens
aagtcatatattaca

SEQ ID NO: 30074 - DNA, 15 bp, Homo sapiens
caagtcatatattac

SEQ ID NO: 30075 - DNA, 15 bp, Homo sapiens
acaagtcatatatta

SEQ ID NO: 30076 - DNA, 15 bp, Homo sapiens
cacaagtcatatatt

SEQ ID NO: 30077 - DNA, 15 bp, Homo sapiens
gcacaagtcatatat

SEQ ID NO: 30078 - DNA, 15 bp, Homo sapiens
agcacaagtcatata

SEQ ID NO: 30079 - DNA, 15 bp, Homo sapiens
tagcacaagtcatat

SEQ ID NO: 30080 - DNA, 15 bp, Homo sapiens
atagcacaagtcata

SEQ ID NO: 30081 - DNA, 15 bp, Homo sapiens
tatagcacaagtcat

SEQ ID NO: 30082 - DNA, 15 bp, Homo sapiens
atatagcacaagtca

SEQ ID NO: 30083 - DNA, 15 bp, Homo sapiens
tatatagcacaagtc

SEQ ID NO: 30084 - DNA, 15 bp, Homo sapiens
ttatatagcacaagt

SEQ ID NO: 30085 - DNA, 15 bp, Homo sapiens
gttatatagcacaag

SEQ ID NO: 30086 - DNA, 15 bp, Homo sapiens
agttatatagcacaa

SEQ ID NO: 30087 - DNA, 15 bp, Homo sapiens
aagttatatagcaca

SEQ ID NO: 30088 - DNA, 15 bp, Homo sapiens
aaagttatatagcac

SEQ ID NO: 30089 - DNA, 15 bp, Homo sapiens
aaaagttatatagca

SEQ ID NO: 30090 - DNA, 15 bp, Homo sapiens
gaaaagttatatagc

SEQ ID NO: 30091 - DNA, 15 bp, Homo sapiens
agaaaagttatatag

SEQ ID NO: 30092 - DNA, 15 bp, Homo sapiens
gagaaaagttatata

SEQ ID NO: 30093 - DNA, 15 bp, Homo sapiens
tgagaaaagttatat

SEQ ID NO: 30094 - DNA, 15 bp, Homo sapiens
ttgagaaaagttata

SEQ ID NO: 30095 - DNA, 15 bp, Homo sapiens
tttgagaaaagttat

SEQ ID NO: 30096 - DNA, 15 bp, Homo sapiens
atttgagaaaagtta

SEQ ID NO: 30097 - DNA, 15 bp, Homo sapiens
catttgagaaaagtt

SEQ ID NO: 30098 - DNA, 15 bp, Homo sapiens
ccatttgagaaaagt

SEQ ID NO: 30099 - DNA, 15 bp, Homo sapiens
cccatttgagaaaag

SEQ ID NO: 30100 - DNA, 15 bp, Homo sapiens
tcccatttgagaaaa

SEQ ID NO: 30101 - DNA, 15 bp, Homo sapiens
ttcccatttgagaaa

SEQ ID NO: 30102 - DNA, 15 bp, Homo sapiens
cttcccatttgagaa

SEQ ID NO: 30103 - DNA, 15 bp, Homo sapiens
tcttcccatttgaga

SEQ ID NO: 30104 - DNA, 15 bp, Homo sapiens
ctcttcccatttgag

SEQ ID NO: 30105 - DNA, 15 bp, Homo sapiens
actcttcccatttga

SEQ ID NO: 30106 - DNA, 15 bp, Homo sapiens
aactcttcccatttg

SEQ ID NO: 30107 - DNA, 15 bp, Homo sapiens
gaactcttcccattt

SEQ ID NO: 30108 - DNA, 15 bp, Homo sapiens
agaactcttcccatt

SEQ ID NO: 30109 - DNA, 15 bp, Homo sapiens
cagaactcttcccat

SEQ ID NO: 30110 - DNA, 15 bp, Homo sapiens
ccagaactcttccca

SEQ ID NO: 30111 - DNA, 15 bp, Homo sapiens
accagaactcttccc

SEQ ID NO: 30112 - DNA, 15 bp, Homo sapiens
aaccagaactcttcc

SEQ ID NO: 30113 - DNA, 15 bp, Homo sapiens
gaaccagaactcttc

SEQ ID NO: 30114 - DNA, 15 bp, Homo sapiens
tgaaccagaactctt

SEQ ID NO: 30115 - DNA, 15 bp, Homo sapiens
ctgaaccagaactct

SEQ ID NO: 30116 - DNA, 15 bp, Homo sapiens
gctgaaccagaactc

SEQ ID NO: 30117 - DNA, 15 bp, Homo sapiens
tgctgaaccagaact

SEQ ID NO: 30118 - DNA, 15 bp, Homo sapiens
ctgctgaaccagaac

SEQ ID NO: 30119 - DNA, 15 bp, Homo sapiens
gctgctgaaccagaa

SEQ ID NO: 30120 - DNA, 15 bp, Homo sapiens
tgctgctgaaccaga

SEQ ID NO: 30121 - DNA, 15 bp, Homo sapiens
gtgctgctgaaccag

SEQ ID NO: 30122 - DNA, 15 bp, Homo sapiens
ggtgctgctgaacca

SEQ ID NO: 30123 - DNA, 15 bp, Homo sapiens
aggtgctgctgaacc

SEQ ID NO: 30124 - DNA, 15 bp, Homo sapiens
gaggtgctgctgaac

SEQ ID NO: 30125 - DNA, 15 bp, Homo sapiens
agaggtgctgctgaa

SEQ ID NO: 30126 - DNA, 15 bp, Homo sapiens
cagaggtgctgctga

SEQ ID NO: 30127 - DNA, 15 bp, Homo sapiens
ccagaggtgctgctg

SEQ ID NO: 30128 - DNA, 15 bp, Homo sapiens
gccagaggtgctgct

SEQ ID NO: 30129 - DNA, 15 bp, Homo sapiens
ggccagaggtgctgc

SEQ ID NO: 30130 - DNA, 15 bp, Homo sapiens
gggccagaggtgctg

SEQ ID NO: 30131 - DNA, 15 bp, Homo sapiens
agggccagaggtgct

SEQ ID NO: 30132 - DNA, 15 bp, Homo sapiens
tagggccagaggtgc

SEQ ID NO: 30133 - DNA, 15 bp, Homo sapiens
ctagggccagaggtg

SEQ ID NO: 30134 - DNA, 15 bp, Homo sapiens
cctagggccagaggt

SEQ ID NO: 30135 - DNA, 15 bp, Homo sapiens
ccctagggccagagg

SEQ ID NO: 30136 - DNA, 15 bp, Homo sapiens
accctagggccagag

SEQ ID NO: 30137 - DNA, 15 bp, Homo sapiens
aaccctagggccaga

SEQ ID NO: 30138 - DNA, 15 bp, Homo sapiens
aaaccctagggccag

SEQ ID NO: 30139 - DNA, 15 bp, Homo sapiens
aaaaccctagggcca

SEQ ID NO: 30140 - DNA, 15 bp, Homo sapiens
caaaaccctagggcc

SEQ ID NO: 30141 - DNA, 15 bp, Homo sapiens
ccaaaaccctagggc

SEQ ID NO: 30142 - DNA, 15 bp, Homo sapiens
tccaaaaccctaggg

SEQ ID NO: 30143 - DNA, 15 bp, Homo sapiens
ttccaaaaccctagg

SEQ ID NO: 30144 - DNA, 15 bp, Homo sapiens
tttccaaaaccctag

SEQ ID NO: 30145 - DNA, 15 bp, Homo sapiens
ttttccaaaacccta

SEQ ID NO: 30146 - DNA, 15 bp, Homo sapiens
cttttccaaaaccct

SEQ ID NO: 30147 - DNA, 15 bp, Homo sapiens
tcttttccaaaaccc

SEQ ID NO: 30148 - DNA, 15 bp, Homo sapiens
ctcttttccaaaacc

SEQ ID NO: 30149 - DNA, 15 bp, Homo sapiens
cctcttttccaaaac

SEQ ID NO: 30150 - DNA, 15 bp, Homo sapiens
acctcttttccaaaa

SEQ ID NO: 30151 - DNA, 15 bp, Homo sapiens
aacctcttttccaaa

SEQ ID NO: 30152 - DNA, 15 bp, Homo sapiens
caacctcttttccaa

SEQ ID NO: 30153 - DNA, 15 bp, Homo sapiens
acaacctcttttcca

SEQ ID NO: 30154 - DNA, 15 bp, Homo sapiens
cacaacctcttttcc

SEQ ID NO: 30155 - DNA, 15 bp, Homo sapiens
tcacaacctcttttc

SEQ ID NO: 30156 - DNA, 15 bp, Homo sapiens
ttcacaacctctttt

SEQ ID NO: 30157 - DNA, 15 bp, Homo sapiens
tttcacaacctcttt

SEQ ID NO: 30158 - DNA, 15 bp, Homo sapiens
gtttcacaacctctt

SEQ ID NO: 30159 - DNA, 15 bp, Homo sapiens
agtttcacaacctct

SEQ ID NO: 30160 - DNA, 15 bp, Homo sapiens
gagtttcacaacctc

SEQ ID NO: 30161 - DNA, 15 bp, Homo sapiens
agagtttcacaacct

SEQ ID NO: 30162 - DNA, 15 bp, Homo sapiens
aagagtttcacaacc

SEQ ID NO: 30163 - DNA, 15 bp, Homo sapiens
aaagagtttcacaac

SEQ ID NO: 30164 - DNA, 15 bp, Homo sapiens
caaagagtttcacaa

SEQ ID NO: 30165 - DNA, 15 bp, Homo sapiens
tcaaagagtttcaca

SEQ ID NO: 30166 - DNA, 15 bp, Homo sapiens
gtcaaagagtttcac

SEQ ID NO: 30167 - DNA, 15 bp, Homo sapiens
tgtcaaagagtttca

SEQ ID NO: 30168 - DNA, 15 bp, Homo sapiens
atgtcaaagagtttc

SEQ ID NO: 30169 - DNA, 15 bp, Homo sapiens
catgtcaaagagttt

SEQ ID NO: 30170 - DNA, 15 bp, Homo sapiens
acatgtcaaagagtt

SEQ ID NO: 30171 - DNA, 15 bp, Homo sapiens
cacatgtcaaagagt

SEQ ID NO: 30172 - DNA, 15 bp, Homo sapiens
acacatgtcaaagag

SEQ ID NO: 30173 - DNA, 15 bp, Homo sapiens
aacacatgtcaaaga

SEQ ID NO: 30174 - DNA, 15 bp, Homo sapiens
aaacacatgtcaaag

SEQ ID NO: 30175 - DNA, 15 bp, Homo sapiens
taaacacatgtcaaa

SEQ ID NO: 30176 - DNA, 15 bp, Homo sapiens
gtaaacacatgtcaa

SEQ ID NO: 30177 - DNA, 15 bp, Homo sapiens
tgtaaacacatgtca

SEQ ID NO: 30178 - DNA, 15 bp, Homo sapiens
ctgtaaacacatgtc

SEQ ID NO: 30179 - DNA, 15 bp, Homo sapiens
cctgtaaacacatgt

SEQ ID NO: 30180 - DNA, 15 bp, Homo sapiens
tcctgtaaacacatg

SEQ ID NO: 30181 - DNA, 15 bp, Homo sapiens
atcctgtaaacacat

SEQ ID NO: 30182 - DNA, 15 bp, Homo sapiens
tatcctgtaaacaca

SEQ ID NO: 30183 - DNA, 15 bp, Homo sapiens
ttatcctgtaaacac

SEQ ID NO: 30184 - DNA, 15 bp, Homo sapiens
cttatcctgtaaaca

SEQ ID NO: 30185 - DNA, 15 bp, Homo sapiens
ccttatcctgtaaac

SEQ ID NO: 30186 - DNA, 15 bp, Homo sapiens
accttatcctgtaaa

SEQ ID NO: 30187 - DNA, 15 bp, Homo sapiens
aaccttatcctgtaa

SEQ ID NO: 30188 - DNA, 15 bp, Homo sapiens
caaccttatcctgta

SEQ ID NO: 30189 - DNA, 15 bp, Homo sapiens
tcaaccttatcctgt

SEQ ID NO: 30190 - DNA, 15 bp, Homo sapiens
atcaaccttatcctg

SEQ ID NO: 30191 - DNA, 15 bp, Homo sapiens
catcaaccttatcct

SEQ ID NO: 30192 - DNA, 15 bp, Homo sapiens
tcatcaaccttatcc

SEQ ID NO: 30193 - DNA, 15 bp, Homo sapiens
ttcatcaaccttatc

SEQ ID NO: 30194 - DNA, 15 bp, Homo sapiens
tttcatcaaccttat

SEQ ID NO: 30195 - DNA, 15 bp, Homo sapiens
gtttcatcaacctta

SEQ ID NO: 30196 - DNA, 15 bp, Homo sapiens
agtttcatcaacctt

SEQ ID NO: 30197 - DNA, 15 bp, Homo sapiens
cagtttcatcaacct

SEQ ID NO: 30198 - DNA, 15 bp, Homo sapiens
tcagtttcatcaacc

SEQ ID NO: 30199 - DNA, 15 bp, Homo sapiens
gtcagtttcatcaac

SEQ ID NO: 30200 - DNA, 15 bp, Homo sapiens
agtcagtttcatcaa

SEQ ID NO: 30201 - DNA, 15 bp, Homo sapiens
attccaggaattgac

SEQ ID NO: 30202 - DNA, 15 bp, Homo sapiens
aattccaggaattga

SEQ ID NO: 30203 - DNA, 15 bp, Homo sapiens
aaattccaggaattg

SEQ ID NO: 30204 - DNA, 15 bp, Homo sapiens
aaaattccaggaatt

SEQ ID NO: 30205 - DNA, 15 bp, Homo sapiens
aaaaattccaggaat

SEQ ID NO: 30206 - DNA, 15 bp, Homo sapiens
aaaaaattccaggaa

SEQ ID NO: 30207 - DNA, 15 bp, Homo sapiens
aaaaaaattccagga

SEQ ID NO: 30208 - DNA, 15 bp, Homo sapiens
aaaaaaaattccagg

SEQ ID NO: 30209 - DNA, 15 bp, Homo sapiens
aaaaaaaaattccag

SEQ ID NO: 30210 - DNA, 15 bp, Homo sapiens
gaaaaaaaaattcca

SEQ ID NO: 30211 - DNA, 15 bp, Homo sapiens
ggaaaaaaaaattcc

SEQ ID NO: 30212 - DNA, 15 bp, Homo sapiens
aggaaaaaaaaattc

SEQ ID NO: 30213 - DNA, 15 bp, Homo sapiens
aaggaaaaaaaaatt

SEQ ID NO: 30214 - DNA, 15 bp, Homo sapiens
aaaggaaaaaaaaat

SEQ ID NO: 30215 - DNA, 15 bp, Homo sapiens
aaaaggaaaaaaaaa

SEQ ID NO: 30216 - DNA, 15 bp, Homo sapiens
aaaaaggaaaaaaaa

SEQ ID NO: 30217 - DNA, 15 bp, Homo sapiens
caaaaaggaaaaaaa

SEQ ID NO: 30218 - DNA, 15 bp, Homo sapiens
gcaaaaaggaaaaaa

SEQ ID NO: 30219 - DNA, 15 bp, Homo sapiens
agcaaaaaggaaaaa

SEQ ID NO: 30220 - DNA, 15 bp, Homo sapiens
cagcaaaaaggaaaa

SEQ ID NO: 30221 - DNA, 15 bp, Homo sapiens
gcagcaaaaaggaaa

SEQ ID NO: 30222 - DNA, 15 bp, Homo sapiens
ggcagcaaaaaggaa

SEQ ID NO: 30223 - DNA, 15 bp, Homo sapiens
tggcagcaaaaagga

SEQ ID NO: 30224 - DNA, 15 bp, Homo sapiens
gtggcagcaaaaagg

SEQ ID NO: 30225 - DNA, 15 bp, Homo sapiens
agtggcagcaaaaag

SEQ ID NO: 30226 - DNA, 15 bp, Homo sapiens
aagtggcagcaaaaa

SEQ ID NO: 30227 - DNA, 15 bp, Homo sapiens
aaagtggcagcaaaa

SEQ ID NO: 30228 - DNA, 15 bp, Homo sapiens
gaaagtggcagcaaa

SEQ ID NO: 30229 - DNA, 15 bp, Homo sapiens
agaaagtggcagcaa

SEQ ID NO: 30230 - DNA, 15 bp, Homo sapiens
aagaaagtggcagca

SEQ ID NO: 30231 - DNA, 15 bp, Homo sapiens
taagaaagtggcagc

SEQ ID NO: 30232 - DNA, 15 bp, Homo sapiens
gtaagaaagtggcag

SEQ ID NO: 30233 - DNA, 15 bp, Homo sapiens
agtaagaaagtggca

SEQ ID NO: 30234 - DNA, 15 bp, Homo sapiens
aagtaagaaagtggc

SEQ ID NO: 30235 - DNA, 15 bp, Homo sapiens
taagtaagaaagtgg

SEQ ID NO: 30236 - DNA, 15 bp, Homo sapiens
ttaagtaagaaagtg

SEQ ID NO: 30237 - DNA, 15 bp, Homo sapiens
tttaagtaagaaagt

SEQ ID NO: 30238 - DNA, 15 bp, Homo sapiens
ttttaagtaagaaag

SEQ ID NO: 30239 - DNA, 15 bp, Homo sapiens
cttttaagtaagaaa

SEQ ID NO: 30240 - DNA, 15 bp, Homo sapiens
tcttttaagtaagaa

SEQ ID NO: 30241 - DNA, 15 bp, Homo sapiens
ttcttttaagtaaga

SEQ ID NO: 30242 - DNA, 15 bp, Homo sapiens
attcttttaagtaag

SEQ ID NO: 30243 - DNA, 15 bp, Homo sapiens
tattcttttaagtaa

SEQ ID NO: 30244 - DNA, 15 bp, Homo sapiens
ttattcttttaagta

SEQ ID NO: 30245 - DNA, 15 bp, Homo sapiens
tttattcttttaagt

SEQ ID NO: 30246 - DNA, 15 bp, Homo sapiens
ttttattcttttaag

SEQ ID NO: 30247 - DNA, 15 bp, Homo sapiens
tttttattcttttaa

SEQ ID NO: 30248 - DNA, 15 bp, Homo sapiens
atttttattctttta

SEQ ID NO: 30249 - DNA, 15 bp, Homo sapiens
gatttttattctttt

SEQ ID NO: 30250 - DNA, 15 bp, Homo sapiens
tgatttttattcttt

SEQ ID NO: 30251 - DNA, 15 bp, Homo sapiens
ttgatttttattctt

SEQ ID NO: 30252 - DNA, 15 bp, Homo sapiens
tttgatttttattct

SEQ ID NO: 30253 - DNA, 15 bp, Homo sapiens
ctttgatttttattc

SEQ ID NO: 30254 - DNA, 15 bp, Homo sapiens
gctttgatttttatt

SEQ ID NO: 30255 - DNA, 15 bp, Homo sapiens
ggctttgatttttat

SEQ ID NO: 30256 - DNA, 15 bp, Homo sapiens
tggctttgattttta

SEQ ID NO: 30257 - DNA, 15 bp, Homo sapiens
ttggctttgattttt

SEQ ID NO: 30258 - DNA, 15 bp, Homo sapiens
tttggctttgatttt

SEQ ID NO: 30259 - DNA, 15 bp, Homo sapiens
atttggctttgattt

SEQ ID NO: 30260 - DNA, 15 bp, Homo sapiens
aatttggctttgatt

SEQ ID NO: 30261 - DNA, 15 bp, Homo sapiens
gaatttggctttgat

SEQ ID NO: 30262 - DNA, 15 bp, Homo sapiens
tgaatttggctttga

SEQ ID NO: 30263 - DNA, 15 bp, Homo sapiens
atgaatttggctttg

SEQ ID NO: 30264 - DNA, 15 bp, Homo sapiens
gatgaatttggcttt

SEQ ID NO: 30265 - DNA, 15 bp, Homo sapiens
tgatgaatttggctt

SEQ ID NO: 30266 - DNA, 15 bp, Homo sapiens
atgatgaatttggct

SEQ ID NO: 30267 - DNA, 15 bp, Homo sapiens
tatgatgaatttggc

SEQ ID NO: 30268 - DNA, 15 bp, Homo sapiens
ctatgatgaatttgg

SEQ ID NO: 30269 - DNA, 15 bp, Homo sapiens
actatgatgaatttg

SEQ ID NO: 30270 - DNA, 15 bp, Homo sapiens
tactatgatgaattt

SEQ ID NO: 30271 - DNA, 15 bp, Homo sapiens
ttactatgatgaatt

SEQ ID NO: 30272 - DNA, 15 bp, Homo sapiens
attactatgatgaat

SEQ ID NO: 30273 - DNA, 15 bp, Homo sapiens
gattactatgatgaa

SEQ ID NO: 30274 - DNA, 15 bp, Homo sapiens
tgattactatgatga

SEQ ID NO: 30275 - DNA, 15 bp, Homo sapiens
atgattactatgatg

SEQ ID NO: 30276 - DNA, 15 bp, Homo sapiens
tatgattactatgat

SEQ ID NO: 30277 - DNA, 15 bp, Homo sapiens
ttatgattactatga

SEQ ID NO: 30278 - DNA, 15 bp, Homo sapiens
attatgattactatg

SEQ ID NO: 30279 - DNA, 15 bp, Homo sapiens
tattatgattactat

SEQ ID NO: 30280 - DNA, 15 bp, Homo sapiens
ttattatgattacta

SEQ ID NO: 30281 - DNA, 15 bp, Homo sapiens
attattatgattact

SEQ ID NO: 30282 - DNA, 15 bp, Homo sapiens
cattattatgattac

SEQ ID NO: 30283 - DNA, 15 bp, Homo sapiens
ccattattatgatta

SEQ ID NO: 30284 - DNA, 15 bp, Homo sapiens
gccattattatgatt

SEQ ID NO: 30285 - DNA, 15 bp, Homo sapiens
tgccattattatgat

SEQ ID NO: 30286 - DNA, 15 bp, Homo sapiens
ttgccattattatga

SEQ ID NO: 30287 - DNA, 15 bp, Homo sapiens
gttgccattattatg

SEQ ID NO: 30288 - DNA, 15 bp, Homo sapiens
tgttgccattattat

SEQ ID NO: 30289 - DNA, 15 bp, Homo sapiens
ttgttgccattatta

SEQ ID NO: 30290 - DNA, 15 bp, Homo sapiens
gttgttgccattatt

SEQ ID NO: 30291 - DNA, 15 bp, Homo sapiens
tgttgttgccattat

SEQ ID NO: 30292 - DNA, 15 bp, Homo sapiens
ttgttgttgccatta

SEQ ID NO: 30293 - DNA, 15 bp, Homo sapiens
gttgttgttgccatt

SEQ ID NO: 30294 - DNA, 15 bp, Homo sapiens
tgttgttgttgccat

SEQ ID NO: 30295 - DNA, 15 bp, Homo sapiens
ttgttgttgttgcca

SEQ ID NO: 30296 - DNA, 15 bp, Homo sapiens
tttgttgttgttgcc

SEQ ID NO: 30297 - DNA, 15 bp, Homo sapiens
ttttgttgttgttgc

SEQ ID NO: 30298 - DNA, 15 bp, Homo sapiens
tttttgttgttgttg

SEQ ID NO: 30299 - DNA, 15 bp, Homo sapiens
ttttttgttgttgtt

SEQ ID NO: 30300 - DNA, 15 bp, Homo sapiens
tttttttgttgttgt

SEQ ID NO: 30301 - DNA, 15 bp, Homo sapiens
ctttttttgttgttg

SEQ ID NO: 30302 - DNA, 15 bp, Homo sapiens
cctttttttgttgtt

SEQ ID NO: 30303 - DNA, 15 bp, Homo sapiens
tcctttttttgttgt

SEQ ID NO: 30304 - DNA, 15 bp, Homo sapiens
ctcctttttttgttg

SEQ ID NO: 30305 - DNA, 15 bp, Homo sapiens
actcctttttttgtt

SEQ ID NO: 30306 - DNA, 15 bp, Homo sapiens
tactcctttttttgt

SEQ ID NO: 30307 - DNA, 15 bp, Homo sapiens
ttactcctttttttg

SEQ ID NO: 30308 - DNA, 15 bp, Homo sapiens
tttactccttttttt

SEQ ID NO: 30309 - DNA, 15 bp, Homo sapiens
ttttactcctttttt

SEQ ID NO: 30310 - DNA, 15 bp, Homo sapiens
attttactccttttt

SEQ ID NO: 30311 - DNA, 15 bp, Homo sapiens
tattttactcctttt

SEQ ID NO: 30312 - DNA, 15 bp, Homo sapiens
ctattttactccttt

SEQ ID NO: 30313 - DNA, 15 bp, Homo sapiens
tctattttactcctt

SEQ ID NO: 30314 - DNA, 15 bp, Homo sapiens
ctctattttactcct

SEQ ID NO: 30315 - DNA, 15 bp, Homo sapiens
actctattttactcc

SEQ ID NO: 30316 - DNA, 15 bp, Homo sapiens
aactctattttactc

SEQ ID NO: 30317 - DNA, 15 bp, Homo sapiens
caactctattttact

SEQ ID NO: 30318 - DNA, 15 bp, Homo sapiens
acaactctattttac

SEQ ID NO: 30319 - DNA, 15 bp, Homo sapiens
cacaactctatttta

SEQ ID NO: 30320 - DNA, 15 bp, Homo sapiens
tcacaactctatttt

SEQ ID NO: 30321 - DNA, 15 bp, Homo sapiens
ttcacaactctattt

SEQ ID NO: 30322 - DNA, 15 bp, Homo sapiens
attcacaactctatt

SEQ ID NO: 30323 - DNA, 15 bp, Homo sapiens
cattcacaactctat

SEQ ID NO: 30324 - DNA, 15 bp, Homo sapiens
acattcacaactcta

SEQ ID NO: 30325 - DNA, 15 bp, Homo sapiens
aacattcacaactct

SEQ ID NO: 30326 - DNA, 15 bp, Homo sapiens
aaacattcacaactc

SEQ ID NO: 30327 - DNA, 15 bp, Homo sapiens
caaacattcacaact

SEQ ID NO: 30328 - DNA, 15 bp, Homo sapiens
gcaaacattcacaac

SEQ ID NO: 30329 - DNA, 15 bp, Homo sapiens
agcaaacattcacaa

SEQ ID NO: 30330 - DNA, 15 bp, Homo sapiens
aagcaaacattcaca

SEQ ID NO: 30331 - DNA, 15 bp, Homo sapiens
aaagcaaacattcac

SEQ ID NO: 30332 - DNA, 15 bp, Homo sapiens
caaagcaaacattca

SEQ ID NO: 30333 - DNA, 15 bp, Homo sapiens
acaaagcaaacattc

SEQ ID NO: 30334 - DNA, 15 bp, Homo sapiens
aacaaagcaaacatt

SEQ ID NO: 30335 - DNA, 15 bp, Homo sapiens
taacaaagcaaacat

SEQ ID NO: 30336 - DNA, 15 bp, Homo sapiens
ataacaaagcaaaca

SEQ ID NO: 30337 - DNA, 15 bp, Homo sapiens
aataacaaagcaaac

SEQ ID NO: 30338 - DNA, 15 bp, Homo sapiens
taataacaaagcaaa

SEQ ID NO: 30339 - DNA, 15 bp, Homo sapiens
ttaataacaaagcaa

SEQ ID NO: 30340 - DNA, 15 bp, Homo sapiens
tttaataacaaagca

SEQ ID NO: 30341 - DNA, 15 bp, Homo sapiens
gtttaataacaaagc

SEQ ID NO: 30342 - DNA, 15 bp, Homo sapiens
tgtttaataacaaag

SEQ ID NO: 30343 - DNA, 15 bp, Homo sapiens
atgtttaataacaaa

SEQ ID NO: 30344 - DNA, 15 bp, Homo sapiens
tatgtttaataacaa

SEQ ID NO: 30345 - DNA, 15 bp, Homo sapiens
atatgtttaataaca

SEQ ID NO: 30346 - DNA, 15 bp, Homo sapiens
gatatgtttaataac

SEQ ID NO: 30347 - DNA, 15 bp, Homo sapiens
tgatatgtttaataa

SEQ ID NO: 30348 - DNA, 15 bp, Homo sapiens
ttgatatgtttaata

SEQ ID NO: 30349 - DNA, 15 bp, Homo sapiens
gttgatatgtttaat

SEQ ID NO: 30350 - DNA, 15 bp, Homo sapiens
agttgatatgtttaa

SEQ ID NO: 30351 - DNA, 15 bp, Homo sapiens
gagttgatatgttta

SEQ ID NO: 30352 - DNA, 15 bp, Homo sapiens
tgagttgatatgttt

SEQ ID NO: 30353 - DNA, 15 bp, Homo sapiens
atgagttgatatgtt

SEQ ID NO: 30354 - DNA, 15 bp, Homo sapiens
aatgagttgatatgt

SEQ ID NO: 30355 - DNA, 15 bp, Homo sapiens
caatgagttgatatg

SEQ ID NO: 30356 - DNA, 15 bp, Homo sapiens
ccaatgagttgatat

SEQ ID NO: 30357 - DNA, 15 bp, Homo sapiens
tccaatgagttgata

SEQ ID NO: 30358 - DNA, 15 bp, Homo sapiens
ctccaatgagttgat

SEQ ID NO: 30359 - DNA, 15 bp, Homo sapiens
gctccaatgagttga

SEQ ID NO: 30360 - DNA, 15 bp, Homo sapiens
agctccaatgagttg

SEQ ID NO: 30361 - DNA, 15 bp, Homo sapiens
cagctccaatgagtt

SEQ ID NO: 30362 - DNA, 15 bp, Homo sapiens
tcagctccaatgagt

SEQ ID NO: 30363 - DNA, 15 bp, Homo sapiens
atcagctccaatgag

SEQ ID NO: 30364 - DNA, 15 bp, Homo sapiens
aatcagctccaatga

SEQ ID NO: 30365 - DNA, 15 bp, Homo sapiens
aaatcagctccaatg

SEQ ID NO: 30366 - DNA, 15 bp, Homo sapiens
taaatcagctccaat

SEQ ID NO: 30367 - DNA, 15 bp, Homo sapiens
ataaatcagctccaa

SEQ ID NO: 30368 - DNA, 15 bp, Homo sapiens
tataaatcagctcca

SEQ ID NO: 30369 - DNA, 15 bp, Homo sapiens
atataaatcagctcc

SEQ ID NO: 30370 - DNA, 15 bp, Homo sapiens
tatataaatcagctc

SEQ ID NO: 30371 - DNA, 15 bp, Homo sapiens
ttatataaatcagct

SEQ ID NO: 30372 - DNA, 15 bp, Homo sapiens
tttatataaatcagc

SEQ ID NO: 30373 - DNA, 15 bp, Homo sapiens
ctttatataaatcag

SEQ ID NO: 30374 - DNA, 15 bp, Homo sapiens
actttatataaatca

SEQ ID NO: 30375 - DNA, 15 bp, Homo sapiens
aactttatataaatc

SEQ ID NO: 30376 - DNA, 15 bp, Homo sapiens
taactttatataaat

SEQ ID NO: 30377 - DNA, 15 bp, Homo sapiens
ttaactttatataaa

SEQ ID NO: 30378 - DNA, 15 bp, Homo sapiens
tttaactttatataa

SEQ ID NO: 30379 - DNA, 15 bp, Homo sapiens
atttaactttatata

SEQ ID NO: 30380 - DNA, 15 bp, Homo sapiens
gatttaactttatat

SEQ ID NO: 30381 - DNA, 15 bp, Homo sapiens
ggatttaactttata

SEQ ID NO: 30382 - DNA, 15 bp, Homo sapiens
aggatttaactttat

SEQ ID NO: 30383 - DNA, 15 bp, Homo sapiens
caggatttaacttta

SEQ ID NO: 30384 - DNA, 15 bp, Homo sapiens
gcaggatttaacttt

SEQ ID NO: 30385 - DNA, 15 bp, Homo sapiens
agcaggatttaactt

SEQ ID NO: 30386 - DNA, 15 bp, Homo sapiens
tagcaggatttaact

SEQ ID NO: 30387 - DNA, 15 bp, Homo sapiens
ctagcaggatttaac

SEQ ID NO: 30388 - DNA, 15 bp, Homo sapiens
tctagcaggatttaa

SEQ ID NO: 30389 - DNA, 15 bp, Homo sapiens
ttctagcaggattta

SEQ ID NO: 30390 - DNA, 15 bp, Homo sapiens
attctagcaggattt

SEQ ID NO: 30391 - DNA, 15 bp, Homo sapiens
tattctagcaggatt

SEQ ID NO: 30392 - DNA, 15 bp, Homo sapiens
ctattctagcaggat

SEQ ID NO: 30393 - DNA, 15 bp, Homo sapiens
gctattctagcagga

SEQ ID NO: 30394 - DNA, 15 bp, Homo sapiens
agctattctagcagg

SEQ ID NO: 30395 - DNA, 15 bp, Homo sapiens
cagctattctagcag

SEQ ID NO: 30396 - DNA, 15 bp, Homo sapiens
ccagctattctagca

SEQ ID NO: 30397 - DNA, 15 bp, Homo sapiens
tccagctattctagc

SEQ ID NO: 30398 - DNA, 15 bp, Homo sapiens
atccagctattctag

SEQ ID NO: 30399 - DNA, 15 bp, Homo sapiens
aatccagctattcta

SEQ ID NO: 30400 - DNA, 15 bp, Homo sapiens
gaatccagctattct

SEQ ID NO: 30401 - DNA, 15 bp, Homo sapiens
ggaatccagctattc

SEQ ID NO: 30402 - DNA, 15 bp, Homo sapiens
aggaatccagctatt

SEQ ID NO: 30403 - DNA, 15 bp, Homo sapiens
aaggaatccagctat

SEQ ID NO: 30404 - DNA, 15 bp, Homo sapiens
gaaggaatccagcta

SEQ ID NO: 30405 - DNA, 15 bp, Homo sapiens
ggaaggaatccagct

SEQ ID NO: 30406 - DNA, 15 bp, Homo sapiens
aggaaggaatccagc

SEQ ID NO: 30407 - DNA, 15 bp, Homo sapiens
taggaaggaatccag

SEQ ID NO: 30408 - DNA, 15 bp, Homo sapiens
gtaggaaggaatcca

SEQ ID NO: 30409 - DNA, 15 bp, Homo sapiens
tgtaggaaggaatcc

SEQ ID NO: 30410 - DNA, 15 bp, Homo sapiens
atgtaggaaggaatc

SEQ ID NO: 30411 - DNA, 15 bp, Homo sapiens
catgtaggaaggaat

SEQ ID NO: 30412 - DNA, 15 bp, Homo sapiens
ccatgtaggaaggaa

SEQ ID NO: 30413 - DNA, 15 bp, Homo sapiens
cccatgtaggaagga

SEQ ID NO: 30414 - DNA, 15 bp, Homo sapiens
acccatgtaggaagg

SEQ ID NO: 30415 - DNA, 15 bp, Homo sapiens
cacccatgtaggaag

SEQ ID NO: 30416 - DNA, 15 bp, Homo sapiens
ccacccatgtaggaa

SEQ ID NO: 30417 - DNA, 15 bp, Homo sapiens
cccacccatgtagga

SEQ ID NO: 30418 - DNA, 15 bp, Homo sapiens
ccccacccatgtagg

SEQ ID NO: 30419 - DNA, 15 bp, Homo sapiens
accccacccatgtag

SEQ ID NO: 30420 - DNA, 15 bp, Homo sapiens
caccccacccatgta

SEQ ID NO: 30421 - DNA, 15 bp, Homo sapiens
ccaccccacccatgt

SEQ ID NO: 30422 - DNA, 15 bp, Homo sapiens
cccaccccacccatg

SEQ ID NO: 30423 - DNA, 15 bp, Homo sapiens
tcccaccccacccat

SEQ ID NO: 30424 - DNA, 15 bp, Homo sapiens
ttcccaccccaccca

SEQ ID NO: 30425 - DNA, 15 bp, Homo sapiens
attcccaccccaccc

SEQ ID NO: 30426 - DNA, 15 bp, Homo sapiens
cattcccaccccacc

SEQ ID NO: 30427 - DNA, 15 bp, Homo sapiens
gcattcccaccccac

SEQ ID NO: 30428 - DNA, 15 bp, Homo sapiens
agcattcccacccca

SEQ ID NO: 30429 - DNA, 15 bp, Homo sapiens
cagcattcccacccc

SEQ ID NO: 30430 - DNA, 15 bp, Homo sapiens
tcagcattcccaccc

SEQ ID NO: 30431 - DNA, 15 bp, Homo sapiens
ctcagcattcccacc

SEQ ID NO: 30432 - DNA, 15 bp, Homo sapiens
tctcagcattcccac

SEQ ID NO: 30433 - DNA, 15 bp, Homo sapiens
atctcagcattccca

SEQ ID NO: 30434 - DNA, 15 bp, Homo sapiens
gatctcagcattccc

SEQ ID NO: 30435 - DNA, 15 bp, Homo sapiens
ggatctcagcattcc

SEQ ID NO: 30436 - DNA, 15 bp, Homo sapiens
aggatctcagcattc

SEQ ID NO: 30437 - DNA, 15 bp, Homo sapiens
caggatctcagcatt

SEQ ID NO: 30438 - DNA, 15 bp, Homo sapiens
ccaggatctcagcat

SEQ ID NO: 30439 - DNA, 15 bp, Homo sapiens
accaggatctcagca

SEQ ID NO: 30440 - DNA, 15 bp, Homo sapiens
caccaggatctcagc

SEQ ID NO: 30441 - DNA, 15 bp, Homo sapiens
acaccaggatctcag

SEQ ID NO: 30442 - DNA, 15 bp, Homo sapiens
cacaccaggatctca

SEQ ID NO: 30443 - DNA, 15 bp, Homo sapiens
ccacaccaggatctc

SEQ ID NO: 30444 - DNA, 15 bp, Homo sapiens
cccacaccaggatct

SEQ ID NO: 30445 - DNA, 15 bp, Homo sapiens
gcccacaccaggatc

SEQ ID NO: 30446 - DNA, 15 bp, Homo sapiens
tgcccacaccaggat

SEQ ID NO: 30447 - DNA, 15 bp, Homo sapiens
atgcccacaccagga

SEQ ID NO: 30448 - DNA, 15 bp, Homo sapiens
aatgcccacaccagg

SEQ ID NO: 30449 - DNA, 15 bp, Homo sapiens
gaatgcccacaccag

SEQ ID NO: 30450 - DNA, 15 bp, Homo sapiens
ggaatgcccacacca

SEQ ID NO: 30451 - DNA, 15 bp, Homo sapiens
tggaatgcccacacc

SEQ ID NO: 30452 - DNA, 15 bp, Homo sapiens
atggaatgcccacac

SEQ ID NO: 30453 - DNA, 15 bp, Homo sapiens
catggaatgcccaca

SEQ ID NO: 30454 - DNA, 15 bp, Homo sapiens
gcatggaatgcccac

SEQ ID NO: 30455 - DNA, 15 bp, Homo sapiens
ggcatggaatgccca

SEQ ID NO: 30456 - DNA, 15 bp, Homo sapiens
tggcatggaatgccc

SEQ ID NO: 30457 - DNA, 15 bp, Homo sapiens
ctggcatggaatgcc

SEQ ID NO: 30458 - DNA, 15 bp, Homo sapiens
cctggcatggaatgc

SEQ ID NO: 30459 - DNA, 15 bp, Homo sapiens
ccctggcatggaatg

SEQ ID NO: 30460 - DNA, 15 bp, Homo sapiens
accctggcatggaat

SEQ ID NO: 30461 - DNA, 15 bp, Homo sapiens
taccctggcatggaa

SEQ ID NO: 30462 - DNA, 15 bp, Homo sapiens
ctaccctggcatgga

SEQ ID NO: 30463 - DNA, 15 bp, Homo sapiens
tctaccctggcatgg

SEQ ID NO: 30464 - DNA, 15 bp, Homo sapiens
ttctaccctggcatg

SEQ ID NO: 30465 - DNA, 15 bp, Homo sapiens
tttctaccctggcat

SEQ ID NO: 30466 - DNA, 15 bp, Homo sapiens
atttctaccctggca

SEQ ID NO: 30467 - DNA, 15 bp, Homo sapiens
aatttctaccctggc

SEQ ID NO: 30468 - DNA, 15 bp, Homo sapiens
aaatttctaccctgg

SEQ ID NO: 30469 - DNA, 15 bp, Homo sapiens
gaaatttctaccctg

SEQ ID NO: 30470 - DNA, 15 bp, Homo sapiens
ggaaatttctaccct

SEQ ID NO: 30471 - DNA, 15 bp, Homo sapiens
aggaaatttctaccc

SEQ ID NO: 30472 - DNA, 15 bp, Homo sapiens
caggaaatttctacc

SEQ ID NO: 30473 - DNA, 15 bp, Homo sapiens
gcaggaaatttctac

SEQ ID NO: 30474 - DNA, 15 bp, Homo sapiens
agcaggaaatttcta

SEQ ID NO: 30475 - DNA, 15 bp, Homo sapiens
gagcaggaaatttct

SEQ ID NO: 30476 - DNA, 15 bp, Homo sapiens
tgagcaggaaatttc

SEQ ID NO: 30477 - DNA, 15 bp, Homo sapiens
ctgagcaggaaattt

SEQ ID NO: 30478 - DNA, 15 bp, Homo sapiens
cctgagcaggaaatt

SEQ ID NO: 30479 - DNA, 15 bp, Homo sapiens
gcctgagcaggaaat

SEQ ID NO: 30480 - DNA, 15 bp, Homo sapiens
tgcctgagcaggaaa

SEQ ID NO: 30481 - DNA, 15 bp, Homo sapiens
gtgcctgagcaggaa

SEQ ID NO: 30482 - DNA, 15 bp, Homo sapiens
agtgcctgagcagga

SEQ ID NO: 30483 - DNA, 15 bp, Homo sapiens
aagtgcctgagcagg

SEQ ID NO: 30484 - DNA, 15 bp, Homo sapiens
taagtgcctgagcag

SEQ ID NO: 30485 - DNA, 15 bp, Homo sapiens
ctaagtgcctgagca

SEQ ID NO: 30486 - DNA, 15 bp, Homo sapiens
actaagtgcctgagc

SEQ ID NO: 30487 - DNA, 15 bp, Homo sapiens
cactaagtgcctgag

SEQ ID NO: 30488 - DNA, 15 bp, Homo sapiens
tcactaagtgcctga

SEQ ID NO: 30489 - DNA, 15 bp, Homo sapiens
ttcactaagtgcctg

SEQ ID NO: 30490 - DNA, 15 bp, Homo sapiens
cttcactaagtgcct

SEQ ID NO: 30491 - DNA, 15 bp, Homo sapiens
ccttcactaagtgcc

SEQ ID NO: 30492 - DNA, 15 bp, Homo sapiens
tccttcactaagtgc

SEQ ID NO: 30493 - DNA, 15 bp, Homo sapiens
ctccttcactaagtg

SEQ ID NO: 30494 - DNA, 15 bp, Homo sapiens
gctccttcactaagt

SEQ ID NO: 30495 - DNA, 15 bp, Homo sapiens
ggctccttcactaag

SEQ ID NO: 30496 - DNA, 15 bp, Homo sapiens
tggctccttcactaa

SEQ ID NO: 30497 - DNA, 15 bp, Homo sapiens
ttggctccttcacta

SEQ ID NO: 30498 - DNA, 15 bp, Homo sapiens
gttggctccttcact

SEQ ID NO: 30499 - DNA, 15 bp, Homo sapiens
agttggctccttcac

SEQ ID NO: 30500 - DNA, 15 bp, Homo sapiens
cagttggctccttca

SEQ ID NO: 30501 - DNA, 15 bp, Homo sapiens
tcagttggctccttc

SEQ ID NO: 30502 - DNA, 15 bp, Homo sapiens
ctcagttggctcctt

SEQ ID NO: 30503 - DNA, 15 bp, Homo sapiens
cctcagttggctcct

SEQ ID NO: 30504 - DNA, 15 bp, Homo sapiens
ccctcagttggctcc

SEQ ID NO: 30505 - DNA, 15 bp, Homo sapiens
tccctcagttggctc

SEQ ID NO: 30506 - DNA, 15 bp, Homo sapiens
ctccctcagttggct

SEQ ID NO: 30507 - DNA, 15 bp, Homo sapiens
cctccctcagttggc

SEQ ID NO: 30508 - DNA, 15 bp, Homo sapiens
tcctccctcagttgg

SEQ ID NO: 30509 - DNA, 15 bp, Homo sapiens
atcctccctcagttg

SEQ ID NO: 30510 - DNA, 15 bp, Homo sapiens
tatcctccctcagtt

SEQ ID NO: 30511 - DNA, 15 bp, Homo sapiens
ctatcctccctcagt

SEQ ID NO: 30512 - DNA, 15 bp, Homo sapiens
cctatcctccctcag

SEQ ID NO: 30513 - DNA, 15 bp, Homo sapiens
acctatcctccctca

SEQ ID NO: 30514 - DNA, 15 bp, Homo sapiens
cacctatcctccctc

SEQ ID NO: 30515 - DNA, 15 bp, Homo sapiens
tcacctatcctccct

SEQ ID NO: 30516 - DNA, 15 bp, Homo sapiens
atcacctatcctccc

SEQ ID NO: 30517 - DNA, 15 bp, Homo sapiens
catcacctatcctcc

SEQ ID NO: 30518 - DNA, 15 bp, Homo sapiens
acatcacctatcctc

SEQ ID NO: 30519 - DNA, 15 bp, Homo sapiens
cacatcacctatcct

SEQ ID NO: 30520 - DNA, 15 bp, Homo sapiens
gcacatcacctatcc

SEQ ID NO: 30521 - DNA, 15 bp, Homo sapiens
ggcacatcacctatc

SEQ ID NO: 30522 - DNA, 15 bp, Homo sapiens
gggcacatcacctat

SEQ ID NO: 30523 - DNA, 15 bp, Homo sapiens
cgggcacatcaccta

SEQ ID NO: 30524 - DNA, 15 bp, Homo sapiens
gcgggcacatcacct

SEQ ID NO: 30525 - DNA, 15 bp, Homo sapiens
ggcgggcacatcacc

SEQ ID NO: 30526 - DNA, 15 bp, Homo sapiens
gggcgggcacatcac

SEQ ID NO: 30527 - DNA, 15 bp, Homo sapiens
tgggcgggcacatca

SEQ ID NO: 30528 - DNA, 15 bp, Homo sapiens
atgggcgggcacatc

SEQ ID NO: 30529 - DNA, 15 bp, Homo sapiens
gatgggcgggcacat

SEQ ID NO: 30530 - DNA, 15 bp, Homo sapiens
ggatgggcgggcaca

SEQ ID NO: 30531 - DNA, 15 bp, Homo sapiens
cggatgggcgggcac

SEQ ID NO: 30532 - DNA, 15 bp, Homo sapiens
ccggatgggcgggca

SEQ ID NO: 30533 - DNA, 15 bp, Homo sapiens
accggatgggcgggc

SEQ ID NO: 30534 - DNA, 15 bp, Homo sapiens
caccggatgggcggg

SEQ ID NO: 30535 - DNA, 15 bp, Homo sapiens
ccaccggatgggcgg

SEQ ID NO: 30536 - DNA, 15 bp, Homo sapiens
gccaccggatgggcg

SEQ ID NO: 30537 - DNA, 15 bp, Homo sapiens
tgccaccggatgggc

SEQ ID NO: 30538 - DNA, 15 bp, Homo sapiens
gtgccaccggatggg

SEQ ID NO: 30539 - DNA, 15 bp, Homo sapiens
ggtgccaccggatgg

SEQ ID NO: 30540 - DNA, 15 bp, Homo sapiens
gggtgccaccggatg

SEQ ID NO: 30541 - DNA, 15 bp, Homo sapiens
tgggtgccaccggat

SEQ ID NO: 30542 - DNA, 15 bp, Homo sapiens
ctgggtgccaccgga

SEQ ID NO: 30543 - DNA, 15 bp, Homo sapiens
actgggtgccaccgg

SEQ ID NO: 30544 - DNA, 15 bp, Homo sapiens
cactgggtgccaccg

SEQ ID NO: 30545 - DNA, 15 bp, Homo sapiens
tcactgggtgccacc

SEQ ID NO: 30546 - DNA, 15 bp, Homo sapiens
gtcactgggtgccac

SEQ ID NO: 30547 - DNA, 15 bp, Homo sapiens
ggtcactgggtgcca

SEQ ID NO: 30548 - DNA, 15 bp, Homo sapiens
aggtcactgggtgcc

SEQ ID NO: 30549 - DNA, 15 bp, Homo sapiens
caggtcactgggtgc

SEQ ID NO: 30550 - DNA, 15 bp, Homo sapiens
acaggtcactgggtg

SEQ ID NO: 30551 - DNA, 15 bp, Homo sapiens
cacaggtcactgggt

SEQ ID NO: 30552 - DNA, 15 bp, Homo sapiens
gcacaggtcactggg

SEQ ID NO: 30553 - DNA, 15 bp, Homo sapiens
tgcacaggtcactgg

SEQ ID NO: 30554 - DNA, 15 bp, Homo sapiens
gtgcacaggtcactg

SEQ ID NO: 30555 - DNA, 15 bp, Homo sapiens
tgtgcacaggtcact

SEQ ID NO: 30556 - DNA, 15 bp, Homo sapiens
gtgtgcacaggtcac

SEQ ID NO: 30557 - DNA, 15 bp, Homo sapiens
ggtgtgcacaggtca

SEQ ID NO: 30558 - DNA, 15 bp, Homo sapiens
tggtgtgcacaggtc

SEQ ID NO: 30559 - DNA, 15 bp, Homo sapiens
gtggtgtgcacaggt

SEQ ID NO: 30560 - DNA, 15 bp, Homo sapiens
ggtggtgtgcacagg

SEQ ID NO: 30561 - DNA, 15 bp, Homo sapiens
gggtggtgtgcacag

SEQ ID NO: 30562 - DNA, 15 bp, Homo sapiens
ggggtggtgtgcaca

SEQ ID NO: 30563 - DNA, 15 bp, Homo sapiens
gggggtggtgtgcac

SEQ ID NO: 30564 - DNA, 15 bp, Homo sapiens
ggggggtggtgtgca

SEQ ID NO: 30565 - DNA, 15 bp, Homo sapiens
tggggggtggtgtgc

SEQ ID NO: 30566 - DNA, 15 bp, Homo sapiens
atggggggtggtgtg

SEQ ID NO: 30567 - DNA, 15 bp, Homo sapiens
gatggggggtggtgt

SEQ ID NO: 30568 - DNA, 15 bp, Homo sapiens
agatggggggtggtg

SEQ ID NO: 30569 - DNA, 15 bp, Homo sapiens
cagatggggggtggt

SEQ ID NO: 30570 - DNA, 15 bp, Homo sapiens
gcagatggggggtgg

SEQ ID NO: 30571 - DNA, 15 bp, Homo sapiens
ggcagatggggggtg

SEQ ID NO: 30572 - DNA, 15 bp, Homo sapiens
gggcagatggggggt

SEQ ID NO: 30573 - DNA, 15 bp, Homo sapiens
tgggcagatgggggg

SEQ ID NO: 30574 - DNA, 15 bp, Homo sapiens
ctgggcagatggggg

SEQ ID NO: 30575 - DNA, 15 bp, Homo sapiens
cctgggcagatgggg

SEQ ID NO: 30576 - DNA, 15 bp, Homo sapiens
tcctgggcagatggg

SEQ ID NO: 30577 - DNA, 15 bp, Homo sapiens
gtcctgggcagatgg

SEQ ID NO: 30578 - DNA, 15 bp, Homo sapiens
ggtcctgggcagatg

SEQ ID NO: 30579 - DNA, 15 bp, Homo sapiens
gggtcctgggcagat

SEQ ID NO: 30580 - DNA, 15 bp, Homo sapiens
tgggtcctgggcaga

SEQ ID NO: 30581 - DNA, 15 bp, Homo sapiens
ctgggtcctgggcag

SEQ ID NO: 30582 - DNA, 15 bp, Homo sapiens
gctgggtcctgggca

SEQ ID NO: 30583 - DNA, 15 bp, Homo sapiens
ggctgggtcctgggc

SEQ ID NO: 30584 - DNA, 15 bp, Homo sapiens
tggctgggtcctggg

SEQ ID NO: 30585 - DNA, 15 bp, Homo sapiens
atggctgggtcctgg

SEQ ID NO: 30586 - DNA, 15 bp, Homo sapiens
catggctgggtcctg

SEQ ID NO: 30587 - DNA, 15 bp, Homo sapiens
acatggctgggtcct

SEQ ID NO: 30588 - DNA, 15 bp, Homo sapiens
aacatggctgggtcc

SEQ ID NO: 30589 - DNA, 15 bp, Homo sapiens
caacatggctgggtc

SEQ ID NO: 30590 - DNA, 15 bp, Homo sapiens
acaacatggctgggt

SEQ ID NO: 30591 - DNA, 15 bp, Homo sapiens
aacaacatggctggg

SEQ ID NO: 30592 - DNA, 15 bp, Homo sapiens
gaacaacatggctgg

SEQ ID NO: 30593 - DNA, 15 bp, Homo sapiens
tgaacaacatggctg

SEQ ID NO: 30594 - DNA, 15 bp, Homo sapiens
atgaacaacatggct

SEQ ID NO: 30595 - DNA, 15 bp, Homo sapiens
aatgaacaacatggc

SEQ ID NO: 30596 - DNA, 15 bp, Homo sapiens
caatgaacaacatgg

SEQ ID NO: 30597 - DNA, 15 bp, Homo sapiens
acaatgaacaacatg

SEQ ID NO: 30598 - DNA, 15 bp, Homo sapiens
tacaatgaacaacat

SEQ ID NO: 30599 - DNA, 15 bp, Homo sapiens
gtacaatgaacaaca

SEQ ID NO: 30600 - DNA, 15 bp, Homo sapiens
ggtacaatgaacaac

SEQ ID NO: 30601 - DNA, 15 bp, Homo sapiens
gggtacaatgaacaa

SEQ ID NO: 30602 - DNA, 15 bp, Homo sapiens
agggtacaatgaaca

SEQ ID NO: 30603 - DNA, 15 bp, Homo sapiens
aagggtacaatgaac

SEQ ID NO: 30604 - DNA, 15 bp, Homo sapiens
aaagggtacaatgaa

SEQ ID NO: 30605 - DNA, 15 bp, Homo sapiens
aaaagggtacaatga

SEQ ID NO: 30606 - DNA, 15 bp, Homo sapiens
gaaaagggtacaatg

SEQ ID NO: 30607 - DNA, 15 bp, Homo sapiens
tgaaaagggtacaat

SEQ ID NO: 30608 - DNA, 15 bp, Homo sapiens
ctgaaaagggtacaa

SEQ ID NO: 30609 - DNA, 15 bp, Homo sapiens
tctgaaaagggtaca

SEQ ID NO: 30610 - DNA, 15 bp, Homo sapiens
gtctgaaaagggtac

SEQ ID NO: 30611 - DNA, 15 bp, Homo sapiens
agtctgaaaagggta

SEQ ID NO: 30612 - DNA, 15 bp, Homo sapiens
cagtctgaaaagggt

SEQ ID NO: 30613 - DNA, 15 bp, Homo sapiens
gcagtctgaaaaggg

SEQ ID NO: 30614 - DNA, 15 bp, Homo sapiens
agcagtctgaaaagg

SEQ ID NO: 30615 - DNA, 15 bp, Homo sapiens
cagcagtctgaaaag

SEQ ID NO: 30616 - DNA, 15 bp, Homo sapiens
tcagcagtctgaaaa

SEQ ID NO: 30617 - DNA, 15 bp, Homo sapiens
gtcagcagtctgaaa

SEQ ID NO: 30618 - DNA, 15 bp, Homo sapiens
ggtcagcagtctgaa

SEQ ID NO: 30619 - DNA, 15 bp, Homo sapiens
aggtcagcagtctga

SEQ ID NO: 30620 - DNA, 15 bp, Homo sapiens
gaggtcagcagtctg

SEQ ID NO: 30621 - DNA, 15 bp, Homo sapiens
ggaggtcagcagtct

SEQ ID NO: 30622 - DNA, 15 bp, Homo sapiens
tggaggtcagcagtc

SEQ ID NO: 30623 - DNA, 15 bp, Homo sapiens
ctggaggtcagcagt

SEQ ID NO: 30624 - DNA, 15 bp, Homo sapiens
cctggaggtcagcag

SEQ ID NO: 30625 - DNA, 15 bp, Homo sapiens
tcctggaggtcagca

SEQ ID NO: 30626 - DNA, 15 bp, Homo sapiens
ctcctggaggtcagc

SEQ ID NO: 30627 - DNA, 15 bp, Homo sapiens
gctcctggaggtcag

SEQ ID NO: 30628 - DNA, 15 bp, Homo sapiens
tgctcctggaggtca

SEQ ID NO: 30629 - DNA, 15 bp, Homo sapiens
gtgctcctggaggtc

SEQ ID NO: 30630 - DNA, 15 bp, Homo sapiens
agtgctcctggaggt

SEQ ID NO: 30631 - DNA, 15 bp, Homo sapiens
aagtgctcctggagg

SEQ ID NO: 30632 - DNA, 15 bp, Homo sapiens
caagtgctcctggag

SEQ ID NO: 30633 - DNA, 15 bp, Homo sapiens
acaagtgctcctgga

SEQ ID NO: 30634 - DNA, 15 bp, Homo sapiens
gacaagtgctcctgg

SEQ ID NO: 30635 - DNA, 15 bp, Homo sapiens
agacaagtgctcctg

SEQ ID NO: 30636 - DNA, 15 bp, Homo sapiens
aagacaagtgctcct

SEQ ID NO: 30637 - DNA, 15 bp, Homo sapiens
taagacaagtgctcc

SEQ ID NO: 30638 - DNA, 15 bp, Homo sapiens
ttaagacaagtgctc

SEQ ID NO: 30639 - DNA, 15 bp, Homo sapiens
tttaagacaagtgct

SEQ ID NO: 30640 - DNA, 15 bp, Homo sapiens
ctttaagacaagtgc

SEQ ID NO: 30641 - DNA, 15 bp, Homo sapiens
actttaagacaagtg

SEQ ID NO: 30642 - DNA, 15 bp, Homo sapiens
gactttaagacaagt

SEQ ID NO: 30643 - DNA, 15 bp, Homo sapiens
tgactttaagacaag

SEQ ID NO: 30644 - DNA, 15 bp, Homo sapiens
gtgactttaagacaa

SEQ ID NO: 30645 - DNA, 15 bp, Homo sapiens
tgtgactttaagaca

SEQ ID NO: 30646 - DNA, 15 bp, Homo sapiens
atgtgactttaagac

SEQ ID NO: 30647 - DNA, 15 bp, Homo sapiens
tatgtgactttaaga

SEQ ID NO: 30648 - DNA, 15 bp, Homo sapiens
ctatgtgactttaag

SEQ ID NO: 30649 - DNA, 15 bp, Homo sapiens
gctatgtgactttaa

SEQ ID NO: 30650 - DNA, 15 bp, Homo sapiens
agctatgtgacttta

SEQ ID NO: 30651 - DNA, 15 bp, Homo sapiens
cagctatgtgacttt

SEQ ID NO: 30652 - DNA, 15 bp, Homo sapiens
acagctatgtgactt

SEQ ID NO: 30653 - DNA, 15 bp, Homo sapiens
tacagctatgtgact

SEQ ID NO: 30654 - DNA, 15 bp, Homo sapiens
atacagctatgtgac

SEQ ID NO: 30655 - DNA, 15 bp, Homo sapiens
aatacagctatgtga

SEQ ID NO: 30656 - DNA, 15 bp, Homo sapiens
aaatacagctatgtg

SEQ ID NO: 30657 - DNA, 15 bp, Homo sapiens
aaaatacagctatgt

SEQ ID NO: 30658 - DNA, 15 bp, Homo sapiens
aaaaatacagctatg

SEQ ID NO: 30659 - DNA, 15 bp, Homo sapiens
gaaaaatacagctat

SEQ ID NO: 30660 - DNA, 15 bp, Homo sapiens
ggaaaaatacagcta

SEQ ID NO: 30661 - DNA, 15 bp, Homo sapiens
aggaaaaatacagct

SEQ ID NO: 30662 - DNA, 15 bp, Homo sapiens
gaggaaaaatacagc

SEQ ID NO: 30663 - DNA, 15 bp, Homo sapiens
agaggaaaaatacag

SEQ ID NO: 30664 - DNA, 15 bp, Homo sapiens
gagaggaaaaataca

SEQ ID NO: 30665 - DNA, 15 bp, Homo sapiens
ggagaggaaaaatac

SEQ ID NO: 30666 - DNA, 15 bp, Homo sapiens
tggagaggaaaaata

SEQ ID NO: 30667 - DNA, 15 bp, Homo sapiens
ctggagaggaaaaat

SEQ ID NO: 30668 - DNA, 15 bp, Homo sapiens
tctggagaggaaaaa

SEQ ID NO: 30669 - DNA, 15 bp, Homo sapiens
ttctggagaggaaaa

SEQ ID NO: 30670 - DNA, 15 bp, Homo sapiens
tttctggagaggaaa

SEQ ID NO: 30671 - DNA, 15 bp, Homo sapiens
ttttctggagaggaa

SEQ ID NO: 30672 - DNA, 15 bp, Homo sapiens
tttttctggagagga

SEQ ID NO: 30673 - DNA, 15 bp, Homo sapiens
atttttctggagagg

SEQ ID NO: 30674 - DNA, 15 bp, Homo sapiens
aatttttctggagag

SEQ ID NO: 30675 - DNA, 15 bp, Homo sapiens
aaatttttctggaga

SEQ ID NO: 30676 - DNA, 15 bp, Homo sapiens
aaaatttttctggag

SEQ ID NO: 30677 - DNA, 15 bp, Homo sapiens
caaaatttttctgga

SEQ ID NO: 30678 - DNA, 15 bp, Homo sapiens
tcaaaatttttctgg

SEQ ID NO: 30679 - DNA, 15 bp, Homo sapiens
ttcaaaatttttctg

SEQ ID NO: 30680 - DNA, 15 bp, Homo sapiens
attcaaaatttttct

SEQ ID NO: 30681 - DNA, 15 bp, Homo sapiens
cattcaaaatttttc

SEQ ID NO: 30682 - DNA, 15 bp, Homo sapiens
acattcaaaattttt

SEQ ID NO: 30683 - DNA, 15 bp, Homo sapiens
tacattcaaaatttt

SEQ ID NO: 30684 - DNA, 15 bp, Homo sapiens
atacattcaaaattt

SEQ ID NO: 30685 - DNA, 15 bp, Homo sapiens
aatacattcaaaatt

SEQ ID NO: 30686 - DNA, 15 bp, Homo sapiens
aaatacattcaaaat

SEQ ID NO: 30687 - DNA, 15 bp, Homo sapiens
aaaatacattcaaaa

SEQ ID NO: 30688 - DNA, 15 bp, Homo sapiens
gaaaatacattcaaa

SEQ ID NO: 30689 - DNA, 15 bp, Homo sapiens
agaaaatacattcaa

SEQ ID NO: 30690 - DNA, 15 bp, Homo sapiens
tagaaaatacattca

SEQ ID NO: 30691 - DNA, 15 bp, Homo sapiens
ttagaaaatacattc

SEQ ID NO: 30692 - DNA, 15 bp, Homo sapiens
tttagaaaatacatt

SEQ ID NO: 30693 - DNA, 15 bp, Homo sapiens
atttagaaaatacat

SEQ ID NO: 30694 - DNA, 15 bp, Homo sapiens
tatttagaaaataca

SEQ ID NO: 30695 - DNA, 15 bp, Homo sapiens
ctatttagaaaatac

SEQ ID NO: 30696 - DNA, 15 bp, Homo sapiens
gctatttagaaaata

SEQ ID NO: 30697 - DNA, 15 bp, Homo sapiens
agctatttagaaaat

SEQ ID NO: 30698 - DNA, 15 bp, Homo sapiens
cagctatttagaaaa

SEQ ID NO: 30699 - DNA, 15 bp, Homo sapiens
tcagctatttagaaa

SEQ ID NO: 30700 - DNA, 15 bp, Homo sapiens
ctcagctatttagaa

SEQ ID NO: 30701 - DNA, 15 bp, Homo sapiens
cctcagctatttaga

SEQ ID NO: 30702 - DNA, 15 bp, Homo sapiens
acctcagctatttag

SEQ ID NO: 30703 - DNA, 15 bp, Homo sapiens
gacctcagctattta

SEQ ID NO: 30704 - DNA, 15 bp, Homo sapiens
tgacctcagctattt

SEQ ID NO: 30705 - DNA, 15 bp, Homo sapiens
atgacctcagctatt

SEQ ID NO: 30706 - DNA, 15 bp, Homo sapiens
aatgacctcagctat

SEQ ID NO: 30707 - DNA, 15 bp, Homo sapiens
caatgacctcagcta

SEQ ID NO: 30708 - DNA, 15 bp, Homo sapiens
gcaatgacctcagct

SEQ ID NO: 30709 - DNA, 15 bp, Homo sapiens
tgcaatgacctcagc

SEQ ID NO: 30710 - DNA, 15 bp, Homo sapiens
atgcaatgacctcag

SEQ ID NO: 30711 - DNA, 15 bp, Homo sapiens
catgcaatgacctca

SEQ ID NO: 30712 - DNA, 15 bp, Homo sapiens
ccatgcaatgacctc

SEQ ID NO: 30713 - DNA, 15 bp, Homo sapiens
accatgcaatgacct

SEQ ID NO: 30714 - DNA, 15 bp, Homo sapiens
gaccatgcaatgacc

SEQ ID NO: 30715 - DNA, 15 bp, Homo sapiens
agaccatgcaatgac

SEQ ID NO: 30716 - DNA, 15 bp, Homo sapiens
aagaccatgcaatga

SEQ ID NO: 30717 - DNA, 15 bp, Homo sapiens
gaagaccatgcaatg

SEQ ID NO: 30718 - DNA, 15 bp, Homo sapiens
tgaagaccatgcaat

SEQ ID NO: 30719 - DNA, 15 bp, Homo sapiens
ctgaagaccatgcaa

SEQ ID NO: 30720 - DNA, 15 bp, Homo sapiens
actgaagaccatgca

SEQ ID NO: 30721 - DNA, 15 bp, Homo sapiens
cactgaagaccatgc

SEQ ID NO: 30722 - DNA, 15 bp, Homo sapiens
tcactgaagaccatg

SEQ ID NO: 30723 - DNA, 15 bp, Homo sapiens
ttcactgaagaccat

SEQ ID NO: 30724 - DNA, 15 bp, Homo sapiens
gttcactgaagacca

SEQ ID NO: 30725 - DNA, 15 bp, Homo sapiens
agttcactgaagacc

SEQ ID NO: 30726 - DNA, 15 bp, Homo sapiens
aagttcactgaagac

SEQ ID NO: 30727 - DNA, 15 bp, Homo sapiens
taagttcactgaaga

SEQ ID NO: 30728 - DNA, 15 bp, Homo sapiens
ctaagttcactgaag

SEQ ID NO: 30729 - DNA, 15 bp, Homo sapiens
gctaagttcactgaa

SEQ ID NO: 30730 - DNA, 15 bp, Homo sapiens
agctaagttcactga

SEQ ID NO: 30731 - DNA, 15 bp, Homo sapiens
tagctaagttcactg

SEQ ID NO: 30732 - DNA, 15 bp, Homo sapiens
gtagctaagttcact

SEQ ID NO: 30733 - DNA, 15 bp, Homo sapiens
tgtagctaagttcac

SEQ ID NO: 30734 - DNA, 15 bp, Homo sapiens
ttgtagctaagttca

SEQ ID NO: 30735 - DNA, 15 bp, Homo sapiens
cttgtagctaagttc

SEQ ID NO: 30736 - DNA, 15 bp, Homo sapiens
acttgtagctaagtt

SEQ ID NO: 30737 - DNA, 15 bp, Homo sapiens
cacttgtagctaagt

SEQ ID NO: 30738 - DNA, 15 bp, Homo sapiens
tcacttgtagctaag

SEQ ID NO: 30739 - DNA, 15 bp, Homo sapiens
ttcacttgtagctaa

SEQ ID NO: 30740 - DNA, 15 bp, Homo sapiens
attcacttgtagcta

SEQ ID NO: 30741 - DNA, 15 bp, Homo sapiens
cattcacttgtagct

SEQ ID NO: 30742 - DNA, 15 bp, Homo sapiens
acattcacttgtagc

SEQ ID NO: 30743 - DNA, 15 bp, Homo sapiens
cacattcacttgtag

SEQ ID NO: 30744 - DNA, 15 bp, Homo sapiens
tcacattcacttgta

SEQ ID NO: 30745 - DNA, 15 bp, Homo sapiens
gtcacattcacttgt

SEQ ID NO: 30746 - DNA, 15 bp, Homo sapiens
ggtcacattcacttg

SEQ ID NO: 30747 - DNA, 15 bp, Homo sapiens
aggtcacattcactt

SEQ ID NO: 30748 - DNA, 15 bp, Homo sapiens
caggtcacattcact

SEQ ID NO: 30749 - DNA, 15 bp, Homo sapiens
ccaggtcacattcac

SEQ ID NO: 30750 - DNA, 15 bp, Homo sapiens
tccaggtcacattca

SEQ ID NO: 30751 - DNA, 15 bp, Homo sapiens
ctccaggtcacattc

SEQ ID NO: 30752 - DNA, 15 bp, Homo sapiens
actccaggtcacatt

SEQ ID NO: 30753 - DNA, 15 bp, Homo sapiens
cactccaggtcacat

SEQ ID NO: 30754 - DNA, 15 bp, Homo sapiens
tcactccaggtcaca

SEQ ID NO: 30755 - DNA, 15 bp, Homo sapiens
gtcactccaggtcac

SEQ ID NO: 30756 - DNA, 15 bp, Homo sapiens
ggtcactccaggtca

SEQ ID NO: 30757 - DNA, 15 bp, Homo sapiens
gggtcactccaggtc

SEQ ID NO: 30758 - DNA, 15 bp, Homo sapiens
tgggtcactccaggt

SEQ ID NO: 30759 - DNA, 15 bp, Homo sapiens
ctgggtcactccagg

SEQ ID NO: 30760 - DNA, 15 bp, Homo sapiens
tctgggtcactccag

SEQ ID NO: 30761 - DNA, 15 bp, Homo sapiens
ctctgggtcactcca

SEQ ID NO: 30762 - DNA, 15 bp, Homo sapiens
actctgggtcactcc

SEQ ID NO: 30763 - DNA, 15 bp, Homo sapiens
cactctgggtcactc

SEQ ID NO: 30764 - DNA, 15 bp, Homo sapiens
tcactctgggtcact

SEQ ID NO: 30765 - DNA, 15 bp, Homo sapiens
ctcactctgggtcac

SEQ ID NO: 30766 - DNA, 15 bp, Homo sapiens
actcactctgggtca

SEQ ID NO: 30767 - DNA, 15 bp, Homo sapiens
cactcactctgggtc

SEQ ID NO: 30768 - DNA, 15 bp, Homo sapiens
gcactcactctgggt

SEQ ID NO: 30769 - DNA, 15 bp, Homo sapiens
agcactcactctggg

SEQ ID NO: 30770 - DNA, 15 bp, Homo sapiens
cagcactcactctgg

SEQ ID NO: 30771 - DNA, 15 bp, Homo sapiens
ccagcactcactctg

SEQ ID NO: 30772 - DNA, 15 bp, Homo sapiens
gccagcactcactct

SEQ ID NO: 30773 - DNA, 15 bp, Homo sapiens
ggccagcactcactc

SEQ ID NO: 30774 - DNA, 15 bp, Homo sapiens
tggccagcactcact

SEQ ID NO: 30775 - DNA, 15 bp, Homo sapiens
ctggccagcactcac

SEQ ID NO: 30776 - DNA, 15 bp, Homo sapiens
gctggccagcactca

SEQ ID NO: 30777 - DNA, 15 bp, Homo sapiens
tgctggccagcactc

SEQ ID NO: 30778 - DNA, 15 bp, Homo sapiens
atgctggccagcact

SEQ ID NO: 30779 - DNA, 15 bp, Homo sapiens
tatgctggccagcac

SEQ ID NO: 30780 - DNA, 15 bp, Homo sapiens
ctatgctggccagca

SEQ ID NO: 30781 - DNA, 15 bp, Homo sapiens
cctatgctggccagc

SEQ ID NO: 30782 - DNA, 15 bp, Homo sapiens
acctatgctggccag

SEQ ID NO: 30783 - DNA, 15 bp, Homo sapiens
aacctatgctggcca

SEQ ID NO: 30784 - DNA, 15 bp, Homo sapiens
aaacctatgctggcc

SEQ ID NO: 30785 - DNA, 15 bp, Homo sapiens
gaaacctatgctggc

SEQ ID NO: 30786 - DNA, 15 bp, Homo sapiens
tgaaacctatgctgg

SEQ ID NO: 30787 - DNA, 15 bp, Homo sapiens
gtgaaacctatgctg

SEQ ID NO: 30788 - DNA, 15 bp, Homo sapiens
tgtgaaacctatgct

SEQ ID NO: 30789 - DNA, 15 bp, Homo sapiens
atgtgaaacctatgc

SEQ ID NO: 30790 - DNA, 15 bp, Homo sapiens
aatgtgaaacctatg

SEQ ID NO: 30791 - DNA, 15 bp, Homo sapiens
aaatgtgaaacctat

SEQ ID NO: 30792 - DNA, 15 bp, Homo sapiens
aaaatgtgaaaccta

SEQ ID NO: 30793 - DNA, 15 bp, Homo sapiens
gaaaatgtgaaacct

SEQ ID NO: 30794 - DNA, 15 bp, Homo sapiens
agaaaatgtgaaacc

SEQ ID NO: 30795 - DNA, 15 bp, Homo sapiens
cagaaaatgtgaaac

SEQ ID NO: 30796 - DNA, 15 bp, Homo sapiens
acagaaaatgtgaaa

SEQ ID NO: 30797 - DNA, 15 bp, Homo sapiens
cacagaaaatgtgaa

SEQ ID NO: 30798 - DNA, 15 bp, Homo sapiens
acacagaaaatgtga

SEQ ID NO: 30799 - DNA, 15 bp, Homo sapiens
cacacagaaaatgtg

SEQ ID NO: 30800 - DNA, 15 bp, Homo sapiens
tcacacagaaaatgt

SEQ ID NO: 30801 - DNA, 15 bp, Homo sapiens
ttcacacagaaaatg

SEQ ID NO: 30802 - DNA, 15 bp, Homo sapiens
tttcacacagaaaat

SEQ ID NO: 30803 - DNA, 15 bp, Homo sapiens
ctttcacacagaaaa

SEQ ID NO: 30804 - DNA, 15 bp, Homo sapiens
actttcacacagaaa

SEQ ID NO: 30805 - DNA, 15 bp, Homo sapiens
aactttcacacagaa

SEQ ID NO: 30806 - DNA, 15 bp, Homo sapiens
gaactttcacacaga

SEQ ID NO: 30807 - DNA, 15 bp, Homo sapiens
agaactttcacacag

SEQ ID NO: 30808 - DNA, 15 bp, Homo sapiens
aagaactttcacaca

SEQ ID NO: 30809 - DNA, 15 bp, Homo sapiens
gaagaactttcacac

SEQ ID NO: 30810 - DNA, 15 bp, Homo sapiens
agaagaactttcaca

SEQ ID NO: 30811 - DNA, 15 bp, Homo sapiens
aagaagaactttcac

SEQ ID NO: 30812 - DNA, 15 bp, Homo sapiens
aaagaagaactttca

SEQ ID NO: 30813 - DNA, 15 bp, Homo sapiens
aaaagaagaactttc

SEQ ID NO: 30814 - DNA, 15 bp, Homo sapiens
caaaagaagaacttt

SEQ ID NO: 30815 - DNA, 15 bp, Homo sapiens
acaaaagaagaactt

SEQ ID NO: 30816 - DNA, 15 bp, Homo sapiens
aacaaaagaagaact

SEQ ID NO: 30817 - DNA, 15 bp, Homo sapiens
caacaaaagaagaac

SEQ ID NO: 30818 - DNA, 15 bp, Homo sapiens
acaacaaaagaagaa

SEQ ID NO: 30819 - DNA, 15 bp, Homo sapiens
aacaacaaaagaaga

SEQ ID NO: 30820 - DNA, 15 bp, Homo sapiens
aaacaacaaaagaag

SEQ ID NO: 30821 - DNA, 15 bp, Homo sapiens
caaacaacaaaagaa

SEQ ID NO: 30822 - DNA, 15 bp, Homo sapiens
acaaacaacaaaaga

SEQ ID NO: 30823 - DNA, 15 bp, Homo sapiens
cacaaacaacaaaag

SEQ ID NO: 30824 - DNA, 15 bp, Homo sapiens
tcacaaacaacaaaa

SEQ ID NO: 30825 - DNA, 15 bp, Homo sapiens
atcacaaacaacaaa

SEQ ID NO: 30826 - DNA, 15 bp, Homo sapiens
aatcacaaacaacaa

SEQ ID NO: 30827 - DNA, 15 bp, Homo sapiens
taatcacaaacaaca

SEQ ID NO: 30828 - DNA, 15 bp, Homo sapiens
ttaatcacaaacaac

SEQ ID NO: 30829 - DNA, 15 bp, Homo sapiens
attaatcacaaacaa

SEQ ID NO: 30830 - DNA, 15 bp, Homo sapiens
tattaatcacaaaca

SEQ ID NO: 30831 - DNA, 15 bp, Homo sapiens
ttattaatcacaaac

SEQ ID NO: 30832 - DNA, 15 bp, Homo sapiens
gttattaatcacaaa

SEQ ID NO: 30833 - DNA, 15 bp, Homo sapiens
agttattaatcacaa

SEQ ID NO: 30834 - DNA, 15 bp, Homo sapiens
cagttattaatcaca

SEQ ID NO: 30835 - DNA, 15 bp, Homo sapiens
ccagttattaatcac

SEQ ID NO: 30836 - DNA, 15 bp, Homo sapiens
tccagttattaatca

SEQ ID NO: 30837 - DNA, 15 bp, Homo sapiens
atccagttattaatc

SEQ ID NO: 30838 - DNA, 15 bp, Homo sapiens
catccagttattaat

SEQ ID NO: 30839 - DNA, 15 bp, Homo sapiens
ccatccagttattaa

SEQ ID NO: 30840 - DNA, 15 bp, Homo sapiens
cccatccagttatta

SEQ ID NO: 30841 - DNA, 15 bp, Homo sapiens
tcccatccagttatt

SEQ ID NO: 30842 - DNA, 15 bp, Homo sapiens
atcccatccagttat

SEQ ID NO: 30843 - DNA, 15 bp, Homo sapiens
atatcccatccagtt

SEQ ID NO: 30844 - DNA, 15 bp, Homo sapiens
tatatcccatccagt

SEQ ID NO: 30845 - DNA, 15 bp, Homo sapiens
ttatatcccatccag

SEQ ID NO: 30846 - DNA, 15 bp, Homo sapiens
tttatatcccatcca

SEQ ID NO: 30847 - DNA, 15 bp, Homo sapiens
ctttatatcccatcc

SEQ ID NO: 30848 - DNA, 15 bp, Homo sapiens
gctttatatcccatc

SEQ ID NO: 30849 - DNA, 15 bp, Homo sapiens
ggctttatatcccat

SEQ ID NO: 30850 - DNA, 15 bp, Homo sapiens
tggctttatatccca

SEQ ID NO: 30851 - DNA, 15 bp, Homo sapiens
ttggctttatatccc

SEQ ID NO: 30852 - DNA, 15 bp, Homo sapiens
tttggctttatatcc

SEQ ID NO: 30853 - DNA, 15 bp, Homo sapiens
atttggctttatatc

SEQ ID NO: 30854 - DNA, 15 bp, Homo sapiens
catttggctttatat

SEQ ID NO: 30855 - DNA, 15 bp, Homo sapiens
tcatttggctttata

SEQ ID NO: 30856 - DNA, 15 bp, Homo sapiens
atcatttggctttat

SEQ ID NO: 30857 - DNA, 15 bp, Homo sapiens
aatcatttggcttta

SEQ ID NO: 30858 - DNA, 15 bp, Homo sapiens
aaatcatttggcttt

SEQ ID NO: 30859 - DNA, 15 bp, Homo sapiens
gaaatcatttggctt

SEQ ID NO: 30860 - DNA, 15 bp, Homo sapiens
tgaaatcatttggct

SEQ ID NO: 30861 - DNA, 15 bp, Homo sapiens
atgaaatcatttggc

SEQ ID NO: 30862 - DNA, 15 bp, Homo sapiens
aatgaaatcatttgg

SEQ ID NO: 30863 - DNA, 15 bp, Homo sapiens
caatgaaatcatttg

SEQ ID NO: 30864 - DNA, 15 bp, Homo sapiens
acaatgaaatcattt

SEQ ID NO: 30865 - DNA, 15 bp, Homo sapiens
aacaatgaaatcatt

SEQ ID NO: 30866 - DNA, 15 bp, Homo sapiens
caacaatgaaatcat

SEQ ID NO: 30867 - DNA, 15 bp, Homo sapiens
tcaacaatgaaatca

SEQ ID NO: 30868 - DNA, 15 bp, Homo sapiens
ttcaacaatgaaatc

SEQ ID NO: 30869 - DNA, 15 bp, Homo sapiens
gttcaacaatgaaat

SEQ ID NO: 30870 - DNA, 15 bp, Homo sapiens
tgttcaacaatgaaa

SEQ ID NO: 30871 - DNA, 15 bp, Homo sapiens
gtgttcaacaatgaa

SEQ ID NO: 30872 - DNA, 15 bp, Homo sapiens
tgtgttcaacaatga

SEQ ID NO: 30873 - DNA, 15 bp, Homo sapiens
ctgtgttcaacaatg

SEQ ID NO: 30874 - DNA, 15 bp, Homo sapiens
tctgtgttcaacaat

SEQ ID NO: 30875 - DNA, 15 bp, Homo sapiens
gtctgtgttcaacaa

SEQ ID NO: 30876 - DNA, 15 bp, Homo sapiens
agtctgtgttcaaca

SEQ ID NO: 30877 - DNA, 15 bp, Homo sapiens
aagtctgtgttcaac

SEQ ID NO: 30878 - DNA, 15 bp, Homo sapiens
caagtctgtgttcaa

SEQ ID NO: 30879 - DNA, 15 bp, Homo sapiens
tcaagtctgtgttca

SEQ ID NO: 30880 - DNA, 15 bp, Homo sapiens
ttcaagtctgtgttc

SEQ ID NO: 30881 - DNA, 15 bp, Homo sapiens
cttcaagtctgtgtt

SEQ ID NO: 30882 - DNA, 15 bp, Homo sapiens
ccttcaagtctgtgt

SEQ ID NO: 30883 - DNA, 15 bp, Homo sapiens
accttcaagtctgtg

SEQ ID NO: 30884 - DNA, 15 bp, Homo sapiens
gaccttcaagtctgt

SEQ ID NO: 30885 - DNA, 15 bp, Homo sapiens
tgaccttcaagtctg

SEQ ID NO: 30886 - DNA, 15 bp, Homo sapiens
atgaccttcaagtct

SEQ ID NO: 30887 - DNA, 15 bp, Homo sapiens
catgaccttcaagtc

SEQ ID NO: 30888 - DNA, 15 bp, Homo sapiens
tcatgaccttcaagt

SEQ ID NO: 30889 - DNA, 15 bp, Homo sapiens
ctcatgaccttcaag

SEQ ID NO: 30890 - DNA, 15 bp, Homo sapiens
tctcatgaccttcaa

SEQ ID NO: 30891 - DNA, 15 bp, Homo sapiens
ttctcatgaccttca

SEQ ID NO: 30892 - DNA, 15 bp, Homo sapiens
tttctcatgaccttc

SEQ ID NO: 30893 - DNA, 15 bp, Homo sapiens
gtttctcatgacctt

SEQ ID NO: 30894 - DNA, 15 bp, Homo sapiens
agtttctcatgacct

SEQ ID NO: 30895 - DNA, 15 bp, Homo sapiens
cagtttctcatgacc

SEQ ID NO: 30896 - DNA, 15 bp, Homo sapiens
gcagtttctcatgac

SEQ ID NO: 30897 - DNA, 15 bp, Homo sapiens
ggcagtttctcatga

SEQ ID NO: 30898 - DNA, 15 bp, Homo sapiens
aggcagtttctcatg

SEQ ID NO: 30899 - DNA, 15 bp, Homo sapiens
caggcagtttctcat

SEQ ID NO: 30900 - DNA, 15 bp, Homo sapiens
acaggcagtttctca

SEQ ID NO: 30901 - DNA, 15 bp, Homo sapiens
aacaggcagtttctc

SEQ ID NO: 30902 - DNA, 15 bp, Homo sapiens
gaacaggcagtttct

SEQ ID NO: 30903 - DNA, 15 bp, Homo sapiens
tgaacaggcagtttc

SEQ ID NO: 30904 - DNA, 15 bp, Homo sapiens
ttgaacaggcagttt

SEQ ID NO: 30905 - DNA, 15 bp, Homo sapiens
tttgaacaggcagtt

SEQ ID NO: 30906 - DNA, 15 bp, Homo sapiens
atttgaacaggcagt

SEQ ID NO: 30907 - DNA, 15 bp, Homo sapiens
aatttgaacaggcag

SEQ ID NO: 30908 - DNA, 15 bp, Homo sapiens
taatttgaacaggca

SEQ ID NO: 30909 - DNA, 15 bp, Homo sapiens
gtaatttgaacaggc

SEQ ID NO: 30910 - DNA, 15 bp, Homo sapiens
tgtaatttgaacagg

SEQ ID NO: 30911 - DNA, 15 bp, Homo sapiens
gtgtaatttgaacag

SEQ ID NO: 30912 - DNA, 15 bp, Homo sapiens
agtgtaatttgaaca

SEQ ID NO: 30913 - DNA, 15 bp, Homo sapiens
aagtgtaatttgaac

SEQ ID NO: 30914 - DNA, 15 bp, Homo sapiens
aaagtgtaatttgaa

SEQ ID NO: 30915 - DNA, 15 bp, Homo sapiens
caaagtgtaatttga

SEQ ID NO: 30916 - DNA, 15 bp, Homo sapiens
gcaaagtgtaatttg

SEQ ID NO: 30917 - DNA, 15 bp, Homo sapiens
ggcaaagtgtaattt

SEQ ID NO: 30918 - DNA, 15 bp, Homo sapiens
tggcaaagtgtaatt

SEQ ID NO: 30919 - DNA, 15 bp, Homo sapiens
ttggcaaagtgtaat

SEQ ID NO: 30920 - DNA, 15 bp, Homo sapiens
cttggcaaagtgtaa

SEQ ID NO: 30921 - DNA, 15 bp, Homo sapiens
tcttggcaaagtgta

SEQ ID NO: 30922 - DNA, 15 bp, Homo sapiens
gtcttggcaaagtgt

SEQ ID NO: 30923 - DNA, 15 bp, Homo sapiens
tgtcttggcaaagtg

SEQ ID NO: 30924 - DNA, 15 bp, Homo sapiens
atgtcttggcaaagt

SEQ ID NO: 30925 - DNA, 15 bp, Homo sapiens
catgtcttggcaaag

SEQ ID NO: 30926 - DNA, 15 bp, Homo sapiens
ccatgtcttggcaaa

SEQ ID NO: 30927 - DNA, 15 bp, Homo sapiens
tccatgtcttggcaa

SEQ ID NO: 30928 - DNA, 15 bp, Homo sapiens
ttccatgtcttggca

SEQ ID NO: 30929 - DNA, 15 bp, Homo sapiens
tttccatgtcttggc

SEQ ID NO: 30930 - DNA, 15 bp, Homo sapiens
ttttccatgtcttgg

SEQ ID NO: 30931 - DNA, 15 bp, Homo sapiens
tttttccatgtcttg

SEQ ID NO: 30932 - DNA, 15 bp, Homo sapiens
ctttttccatgtctt

SEQ ID NO: 30933 - DNA, 15 bp, Homo sapiens
cctttttccatgtct

SEQ ID NO: 30934 - DNA, 15 bp, Homo sapiens
acctttttccatgtc

SEQ ID NO: 30935 - DNA, 15 bp, Homo sapiens
gacctttttccatgt

SEQ ID NO: 30936 - DNA, 15 bp, Homo sapiens
agacctttttccatg

SEQ ID NO: 30937 - DNA, 15 bp, Homo sapiens
cagacctttttccat

SEQ ID NO: 30938 - DNA, 15 bp, Homo sapiens
gcagacctttttcca

SEQ ID NO: 30939 - DNA, 15 bp, Homo sapiens
tgcagacctttttcc

SEQ ID NO: 30940 - DNA, 15 bp, Homo sapiens
atgcagacctttttc

SEQ ID NO: 30941 - DNA, 15 bp, Homo sapiens
gatgcagaccttttt

SEQ ID NO: 30942 - DNA, 15 bp, Homo sapiens
tgatgcagacctttt

SEQ ID NO: 30943 - DNA, 15 bp, Homo sapiens
ttgatgcagaccttt

SEQ ID NO: 30944 - DNA, 15 bp, Homo sapiens
gttgatgcagacctt

SEQ ID NO: 30945 - DNA, 15 bp, Homo sapiens
tgttgatgcagacct

SEQ ID NO: 30946 - DNA, 15 bp, Homo sapiens
gtgttgatgcagacc

SEQ ID NO: 30947 - DNA, 15 bp, Homo sapiens
ggtgttgatgcagac

SEQ ID NO: 30948 - DNA, 15 bp, Homo sapiens
aggtgttgatgcaga

SEQ ID NO: 30949 - DNA, 15 bp, Homo sapiens
caggtgttgatgcag

SEQ ID NO: 30950 - DNA, 15 bp, Homo sapiens
tcaggtgttgatgca

SEQ ID NO: 30951 - DNA, 15 bp, Homo sapiens
ttcaggtgttgatgc

SEQ ID NO: 30952 - DNA, 15 bp, Homo sapiens
attcaggtgttgatg

SEQ ID NO: 30953 - DNA, 15 bp, Homo sapiens
tattcaggtgttgat

SEQ ID NO: 30954 - DNA, 15 bp, Homo sapiens
ctattcaggtgttga

SEQ ID NO: 30955 - DNA, 15 bp, Homo sapiens
actattcaggtgttg

SEQ ID NO: 30956 - DNA, 15 bp, Homo sapiens
aactattcaggtgtt

SEQ ID NO: 30957 - DNA, 15 bp, Homo sapiens
aaactattcaggtgt

SEQ ID NO: 30958 - DNA, 15 bp, Homo sapiens
aaaactattcaggtg

SEQ ID NO: 30959 - DNA, 15 bp, Homo sapiens
taaaactattcaggt

SEQ ID NO: 30960 - DNA, 15 bp, Homo sapiens
ctaaaactattcagg

SEQ ID NO: 30961 - DNA, 15 bp, Homo sapiens
tctaaaactattcag

SEQ ID NO: 30962 - DNA, 15 bp, Homo sapiens
ttctaaaactattca

SEQ ID NO: 30963 - DNA, 15 bp, Homo sapiens
tttctaaaactattc

SEQ ID NO: 30964 - DNA, 15 bp, Homo sapiens
atttctaaaactatt

SEQ ID NO: 30965 - DNA, 15 bp, Homo sapiens
tatttctaaaactat

SEQ ID NO: 30966 - DNA, 15 bp, Homo sapiens
gtatttctaaaacta

SEQ ID NO: 30967 - DNA, 15 bp, Homo sapiens
cgtatttctaaaact

SEQ ID NO: 30968 - DNA, 15 bp, Homo sapiens
ccgtatttctaaaac

SEQ ID NO: 30969 - DNA, 15 bp, Homo sapiens
accgtatttctaaaa

SEQ ID NO: 30970 - DNA, 15 bp, Homo sapiens
taccgtatttctaaa

SEQ ID NO: 30971 - DNA, 15 bp, Homo sapiens
ctaccgtatttctaa

SEQ ID NO: 30972 - DNA, 15 bp, Homo sapiens
tctaccgtatttcta

SEQ ID NO: 30973 - DNA, 15 bp, Homo sapiens
ctctaccgtatttct

SEQ ID NO: 30974 - DNA, 15 bp, Homo sapiens
tctctaccgtatttc

SEQ ID NO: 30975 - DNA, 15 bp, Homo sapiens
ttctctaccgtattt

SEQ ID NO: 30976 - DNA, 15 bp, Homo sapiens
cttctctaccgtatt

SEQ ID NO: 30977 - DNA, 15 bp, Homo sapiens
ccttctctaccgtat

SEQ ID NO: 30978 - DNA, 15 bp, Homo sapiens
tccttctctaccgta

SEQ ID NO: 30979 - DNA, 15 bp, Homo sapiens
ttccttctctaccgt

SEQ ID NO: 30980 - DNA, 15 bp, Homo sapiens
tttccttctctaccg

SEQ ID NO: 30981 - DNA, 15 bp, Homo sapiens
ttttccttctctacc

SEQ ID NO: 30982 - DNA, 15 bp, Homo sapiens
tttttccttctctac

SEQ ID NO: 30983 - DNA, 15 bp, Homo sapiens
ttttttccttctcta

SEQ ID NO: 30984 - DNA, 15 bp, Homo sapiens
tttttttccttctct

SEQ ID NO: 30985 - DNA, 15 bp, Homo sapiens
atttttttccttctc

SEQ ID NO: 30986 - DNA, 15 bp, Homo sapiens
catttttttccttct

SEQ ID NO: 30987 - DNA, 15 bp, Homo sapiens
tcatttttttccttc

SEQ ID NO: 30988 - DNA, 15 bp, Homo sapiens
gtcatttttttcctt

SEQ ID NO: 30989 - DNA, 15 bp, Homo sapiens
tgtcatttttttcct

SEQ ID NO: 30990 - DNA, 15 bp, Homo sapiens
atgtcatttttttcc

SEQ ID NO: 30991 - DNA, 15 bp, Homo sapiens
catgtcatttttttc

SEQ ID NO: 30992 - DNA, 15 bp, Homo sapiens
gcatgtcattttttt

SEQ ID NO: 30993 - DNA, 15 bp, Homo sapiens
ggcatgtcatttttt

SEQ ID NO: 30994 - DNA, 15 bp, Homo sapiens
tggcatgtcattttt

SEQ ID NO: 30995 - DNA, 15 bp, Homo sapiens
gtggcatgtcatttt

SEQ ID NO: 30996 - DNA, 15 bp, Homo sapiens
agtggcatgtcattt

SEQ ID NO: 30997 - DNA, 15 bp, Homo sapiens
aagtggcatgtcatt

SEQ ID NO: 30998 - DNA, 15 bp, Homo sapiens
caagtggcatgtcat

SEQ ID NO: 30999 - DNA, 15 bp, Homo sapiens
acaagtggcatgtca

SEQ ID NO: 31000 - DNA, 15 bp, Homo sapiens
aacaagtggcatgtc

SEQ ID NO: 31001 - DNA, 15 bp, Homo sapiens
taacaagtggcatgt

SEQ ID NO: 31002 - DNA, 15 bp, Homo sapiens
ataacaagtggcatg

SEQ ID NO: 31003 - DNA, 15 bp, Homo sapiens
cataacaagtggcat

SEQ ID NO: 31004 - DNA, 15 bp, Homo sapiens
acataacaagtggca

SEQ ID NO: 31005 - DNA, 15 bp, Homo sapiens
cacataacaagtggc

SEQ ID NO: 31006 - DNA, 15 bp, Homo sapiens
tcacataacaagtgg

SEQ ID NO: 31007 - DNA, 15 bp, Homo sapiens
atcacataacaagtg

SEQ ID NO: 31008 - DNA, 15 bp, Homo sapiens
catcacataacaagt

SEQ ID NO: 31009 - DNA, 15 bp, Homo sapiens
acatcacataacaag

SEQ ID NO: 31010 - DNA, 15 bp, Homo sapiens
cacatcacataacaa

SEQ ID NO: 31011 - DNA, 15 bp, Homo sapiens
tcacatcacataaca

SEQ ID NO: 31012 - DNA, 15 bp, Homo sapiens
ttcacatcacataac

SEQ ID NO: 31013 - DNA, 15 bp, Homo sapiens
tttcacatcacataa

SEQ ID NO: 31014 - DNA, 15 bp, Homo sapiens
ctttcacatcacata

SEQ ID NO: 31015 - DNA, 15 bp, Homo sapiens
actttcacatcacat

SEQ ID NO: 31016 - DNA, 15 bp, Homo sapiens
aactttcacatcaca

SEQ ID NO: 31017 - DNA, 15 bp, Homo sapiens
caactttcacatcac

SEQ ID NO: 31018 - DNA, 15 bp, Homo sapiens
tcaactttcacatca

SEQ ID NO: 31019 - DNA, 15 bp, Homo sapiens
atcaactttcacatc

SEQ ID NO: 31020 - DNA, 15 bp, Homo sapiens
aatcaactttcacat

SEQ ID NO: 31021 - DNA, 15 bp, Homo sapiens
aaatcaactttcaca

SEQ ID NO: 31022 - DNA, 15 bp, Homo sapiens
gaaatcaactttcac

SEQ ID NO: 31023 - DNA, 15 bp, Homo sapiens
ggaaatcaactttca

SEQ ID NO: 31024 - DNA, 15 bp, Homo sapiens
tggaaatcaactttc

SEQ ID NO: 31025 - DNA, 15 bp, Homo sapiens
gtggaaatcaacttt

SEQ ID NO: 31026 - DNA, 15 bp, Homo sapiens
cgtggaaatcaactt

SEQ ID NO: 31027 - DNA, 15 bp, Homo sapiens
gcgtggaaatcaact

SEQ ID NO: 31028 - DNA, 15 bp, Homo sapiens
cgcgtggaaatcaac

SEQ ID NO: 31029 - DNA, 15 bp, Homo sapiens
tcgcgtggaaatcaa

SEQ ID NO: 31030 - DNA, 15 bp, Homo sapiens
atcgcgtggaaatca

SEQ ID NO: 31031 - DNA, 15 bp, Homo sapiens
catcgcgtggaaatc

SEQ ID NO: 31032 - DNA, 15 bp, Homo sapiens
gcatcgcgtggaaat

SEQ ID NO: 31033 - DNA, 15 bp, Homo sapiens
tgcatcgcgtggaaa

SEQ ID NO: 31034 - DNA, 15 bp, Homo sapiens
ttgcatcgcgtggaa

SEQ ID NO: 31035 - DNA, 15 bp, Homo sapiens
attgcatcgcgtgga

SEQ ID NO: 31036 - DNA, 15 bp, Homo sapiens
tattgcatcgcgtgg

SEQ ID NO: 31037 - DNA, 15 bp, Homo sapiens
atattgcatcgcgtg

SEQ ID NO: 31038 - DNA, 15 bp, Homo sapiens
gatattgcatcgcgt

SEQ ID NO: 31039 - DNA, 15 bp, Homo sapiens
agatattgcatcgcg

SEQ ID NO: 31040 - DNA, 15 bp, Homo sapiens
aagatattgcatcgc

SEQ ID NO: 31041 - DNA, 15 bp, Homo sapiens
caagatattgcatcg

SEQ ID NO: 31042 - DNA, 15 bp, Homo sapiens
ccaagatattgcatc

SEQ ID NO: 31043 - DNA, 15 bp, Homo sapiens
cccaagatattgcat

SEQ ID NO: 31044 - DNA, 15 bp, Homo sapiens
acccaagatattgca

SEQ ID NO: 31045 - DNA, 15 bp, Homo sapiens
gacccaagatattgc

SEQ ID NO: 31046 - DNA, 15 bp, Homo sapiens
ggacccaagatattg

SEQ ID NO: 31047 - DNA, 15 bp, Homo sapiens
aggacccaagatatt

SEQ ID NO: 31048 - DNA, 15 bp, Homo sapiens
aaggacccaagatat

SEQ ID NO: 31049 - DNA, 15 bp, Homo sapiens
taaggacccaagata

SEQ ID NO: 31050 - DNA, 15 bp, Homo sapiens
gtaaggacccaagat

SEQ ID NO: 31051 - DNA, 15 bp, Homo sapiens
tgtaaggacccaaga

SEQ ID NO: 31052 - DNA, 15 bp, Homo sapiens
ttgtaaggacccaag

SEQ ID NO: 31053 - DNA, 15 bp, Homo sapiens
gttgtaaggacccaa

SEQ ID NO: 31054 - DNA, 15 bp, Homo sapiens
tgttgtaaggaccca

SEQ ID NO: 31055 - DNA, 15 bp, Homo sapiens
atgttgtaaggaccc

SEQ ID NO: 31056 - DNA, 15 bp, Homo sapiens
gatgttgtaaggacc

SEQ ID NO: 31057 - DNA, 15 bp, Homo sapiens
agatgttgtaaggac

SEQ ID NO: 31058 - DNA, 15 bp, Homo sapiens
cagatgttgtaagga

SEQ ID NO: 31059 - DNA, 15 bp, Homo sapiens
tcagatgttgtaagg

SEQ ID NO: 31060 - DNA, 15 bp, Homo sapiens
gtcagatgttgtaag

SEQ ID NO: 31061 - DNA, 15 bp, Homo sapiens
ggtcagatgttgtaa

SEQ ID NO: 31062 - DNA, 15 bp, Homo sapiens
aggtcagatgttgta

SEQ ID NO: 31063 - DNA, 15 bp, Homo sapiens
taggtcagatgttgt

SEQ ID NO: 31064 - DNA, 15 bp, Homo sapiens
ataggtcagatgttg

SEQ ID NO: 31065 - DNA, 15 bp, Homo sapiens
cataggtcagatgtt

SEQ ID NO: 31066 - DNA, 15 bp, Homo sapiens
tcataggtcagatgt

SEQ ID NO: 31067 - DNA, 15 bp, Homo sapiens
ctcataggtcagatg

SEQ ID NO: 31068 - DNA, 15 bp, Homo sapiens
cctcataggtcagat

SEQ ID NO: 31069 - DNA, 15 bp, Homo sapiens
gcctcataggtcaga

SEQ ID NO: 31070 - DNA, 15 bp, Homo sapiens
agcctcataggtcag

SEQ ID NO: 31071 - DNA, 15 bp, Homo sapiens
cagcctcataggtca

SEQ ID NO: 31072 - DNA, 15 bp, Homo sapiens
tcagcctcataggtc

SEQ ID NO: 31073 - DNA, 15 bp, Homo sapiens
atcagcctcataggt

SEQ ID NO: 31074 - DNA, 15 bp, Homo sapiens
catcagcctcatagg

SEQ ID NO: 31075 - DNA, 15 bp, Homo sapiens
tcatcagcctcatag

SEQ ID NO: 31076 - DNA, 15 bp, Homo sapiens
ctcatcagcctcata

SEQ ID NO: 31077 - DNA, 15 bp, Homo sapiens
actcatcagcctcat

SEQ ID NO: 31078 - DNA, 15 bp, Homo sapiens
aactcatcagcctca

SEQ ID NO: 31079 - DNA, 15 bp, Homo sapiens
aaactcatcagcctc

SEQ ID NO: 31080 - DNA, 15 bp, Homo sapiens
caaactcatcagcct

SEQ ID NO: 31081 - DNA, 15 bp, Homo sapiens
gcaaactcatcagcc

SEQ ID NO: 31082 - DNA, 15 bp, Homo sapiens
tgcaaactcatcagc

SEQ ID NO: 31083 - DNA, 15 bp, Homo sapiens
gtgcaaactcatcag

SEQ ID NO: 31084 - DNA, 15 bp, Homo sapiens
agtgcaaactcatca

SEQ ID NO: 31085 - DNA, 15 bp, Homo sapiens
cagtgcaaactcatc

SEQ ID NO: 31086 - DNA, 15 bp, Homo sapiens
tcagtgcaaactcat

SEQ ID NO: 31087 - DNA, 15 bp, Homo sapiens
ctcagtgcaaactca

SEQ ID NO: 31088 - DNA, 15 bp, Homo sapiens
actcagtgcaaactc

SEQ ID NO: 31089 - DNA, 15 bp, Homo sapiens
gactcagtgcaaact

SEQ ID NO: 31090 - DNA, 15 bp, Homo sapiens
tgactcagtgcaaac

SEQ ID NO: 31091 - DNA, 15 bp, Homo sapiens
ctgactcagtgcaaa

SEQ ID NO: 31092 - DNA, 15 bp, Homo sapiens
cctgactcagtgcaa

SEQ ID NO: 31093 - DNA, 15 bp, Homo sapiens
tcctgactcagtgca

SEQ ID NO: 31094 - DNA, 15 bp, Homo sapiens
gtcctgactcagtgc

SEQ ID NO: 31095 - DNA, 15 bp, Homo sapiens
agtcctgactcagtg

SEQ ID NO: 31096 - DNA, 15 bp, Homo sapiens
aagtcctgactcagt

SEQ ID NO: 31097 - DNA, 15 bp, Homo sapiens
aaagtcctgactcag

SEQ ID NO: 31098 - DNA, 15 bp, Homo sapiens
taaagtcctgactca

SEQ ID NO: 31099 - DNA, 15 bp, Homo sapiens
ttaaagtcctgactc

SEQ ID NO: 31100 - DNA, 15 bp, Homo sapiens
tttaaagtcctgact

SEQ ID NO: 31101 - DNA, 15 bp, Homo sapiens
ttttaaagtcctgac

SEQ ID NO: 31102 - DNA, 15 bp, Homo sapiens
gttttaaagtcctga

SEQ ID NO: 31103 - DNA, 15 bp, Homo sapiens
tgttttaaagtcctg

SEQ ID NO: 31104 - DNA, 15 bp, Homo sapiens
ttgttttaaagtcct

SEQ ID NO: 31105 - DNA, 15 bp, Homo sapiens
tttgttttaaagtcc

SEQ ID NO: 31106 - DNA, 15 bp, Homo sapiens
ctttgttttaaagtc

SEQ ID NO: 31107 - DNA, 15 bp, Homo sapiens
cctttgttttaaagt

SEQ ID NO: 31108 - DNA, 15 bp, Homo sapiens
acctttgttttaaag

SEQ ID NO: 31109 - DNA, 15 bp, Homo sapiens
cacctttgttttaaa

SEQ ID NO: 31110 - DNA, 15 bp, Homo sapiens
acacctttgttttaa

SEQ ID NO: 31111 - DNA, 15 bp, Homo sapiens
tacacctttgtttta

SEQ ID NO: 31112 - DNA, 15 bp, Homo sapiens
atacacctttgtttt

SEQ ID NO: 31113 - DNA, 15 bp, Homo sapiens
aatacacctttgttt

SEQ ID NO: 31114 - DNA, 15 bp, Homo sapiens
caatacacctttgtt

SEQ ID NO: 31115 - DNA, 15 bp, Homo sapiens
tcaatacacctttgt

SEQ ID NO: 31116 - DNA, 15 bp, Homo sapiens
ctcaatacacctttg

SEQ ID NO: 31117 - DNA, 15 bp, Homo sapiens
cctcaatacaccttt

SEQ ID NO: 31118 - DNA, 15 bp, Homo sapiens
tcctcaatacacctt

SEQ ID NO: 31119 - DNA, 15 bp, Homo sapiens
gtcctcaatacacct

SEQ ID NO: 31120 - DNA, 15 bp, Homo sapiens
ggtcctcaatacacc

SEQ ID NO: 31121 - DNA, 15 bp, Homo sapiens
aggtcctcaatacac

SEQ ID NO: 31122 - DNA, 15 bp, Homo sapiens
taggtcctcaataca

SEQ ID NO: 31123 - DNA, 15 bp, Homo sapiens
gtaggtcctcaatac

SEQ ID NO: 31124 - DNA, 15 bp, Homo sapiens
agtaggtcctcaata

SEQ ID NO: 31125 - DNA, 15 bp, Homo sapiens
cagtaggtcctcaat

SEQ ID NO: 31126 - DNA, 15 bp, Homo sapiens
acagtaggtcctcaa

SEQ ID NO: 31127 - DNA, 15 bp, Homo sapiens
cacagtaggtcctca

SEQ ID NO: 31128 - DNA, 15 bp, Homo sapiens
acacagtaggtcctc

SEQ ID NO: 31129 - DNA, 15 bp, Homo sapiens
cacacagtaggtcct

SEQ ID NO: 31130 - DNA, 15 bp, Homo sapiens
gcacacagtaggtcc

SEQ ID NO: 31131 - DNA, 15 bp, Homo sapiens
ggcacacagtaggtc

SEQ ID NO: 31132 - DNA, 15 bp, Homo sapiens
tggcacacagtaggt

SEQ ID NO: 31133 - DNA, 15 bp, Homo sapiens
ctggcacacagtagg

SEQ ID NO: 31134 - DNA, 15 bp, Homo sapiens
cctggcacacagtag

SEQ ID NO: 31135 - DNA, 15 bp, Homo sapiens
acctggcacacagta

SEQ ID NO: 31136 - DNA, 15 bp, Homo sapiens
gacctggcacacagt

SEQ ID NO: 31137 - DNA, 15 bp, Homo sapiens
tgacctggcacacag

SEQ ID NO: 31138 - DNA, 15 bp, Homo sapiens
atgacctggcacaca

SEQ ID NO: 31139 - DNA, 15 bp, Homo sapiens
aatgacctggcacac

SEQ ID NO: 31140 - DNA, 15 bp, Homo sapiens
aaatgacctggcaca

SEQ ID NO: 31141 - DNA, 15 bp, Homo sapiens
taaatgacctggcac

SEQ ID NO: 31142 - DNA, 15 bp, Homo sapiens
ctaaatgacctggca

SEQ ID NO: 31143 - DNA, 15 bp, Homo sapiens
tctaaatgacctggc

SEQ ID NO: 31144 - DNA, 15 bp, Homo sapiens
ttctaaatgacctgg

SEQ ID NO: 31145 - DNA, 15 bp, Homo sapiens
attctaaatgacctg

SEQ ID NO: 31146 - DNA, 15 bp, Homo sapiens
cattctaaatgacct

SEQ ID NO: 31147 - DNA, 15 bp, Homo sapiens
tcattctaaatgacc

SEQ ID NO: 31148 - DNA, 15 bp, Homo sapiens
ctcattctaaatgac

SEQ ID NO: 31149 - DNA, 15 bp, Homo sapiens
actcattctaaatga

SEQ ID NO: 31150 - DNA, 15 bp, Homo sapiens
aactcattctaaatg

SEQ ID NO: 31151 - DNA, 15 bp, Homo sapiens
aaactcattctaaat

SEQ ID NO: 31152 - DNA, 15 bp, Homo sapiens
aaaactcattctaaa

SEQ ID NO: 31153 - DNA, 15 bp, Homo sapiens
aaaaactcattctaa

SEQ ID NO: 31154 - DNA, 15 bp, Homo sapiens
taaaaactcattcta

SEQ ID NO: 31155 - DNA, 15 bp, Homo sapiens
ataaaaactcattct

SEQ ID NO: 31156 - DNA, 15 bp, Homo sapiens
cataaaaactcattc

SEQ ID NO: 31157 - DNA, 15 bp, Homo sapiens
gcataaaaactcatt

SEQ ID NO: 31158 - DNA, 15 bp, Homo sapiens
agcataaaaactcat

SEQ ID NO: 31159 - DNA, 15 bp, Homo sapiens
tagcataaaaactca

SEQ ID NO: 31160 - DNA, 15 bp, Homo sapiens
ttagcataaaaactc

SEQ ID NO: 31161 - DNA, 15 bp, Homo sapiens
cttagcataaaaact

SEQ ID NO: 31162 - DNA, 15 bp, Homo sapiens
acttagcataaaaac

SEQ ID NO: 31163 - DNA, 15 bp, Homo sapiens
tacttagcataaaaa

SEQ ID NO: 31164 - DNA, 15 bp, Homo sapiens
ttacttagcataaaa

SEQ ID NO: 31165 - DNA, 15 bp, Homo sapiens
attacttagcataaa

SEQ ID NO: 31166 - DNA, 15 bp, Homo sapiens
cattacttagcataa

SEQ ID NO: 31167 - DNA, 15 bp, Homo sapiens
acattacttagcata

SEQ ID NO: 31168 - DNA, 15 bp, Homo sapiens
cacattacttagcat

SEQ ID NO: 31169 - DNA, 15 bp, Homo sapiens
acacattacttagca

SEQ ID NO: 31170 - DNA, 15 bp, Homo sapiens
aacacattacttagc

SEQ ID NO: 31171 - DNA, 15 bp, Homo sapiens
taacacattacttag

SEQ ID NO: 31172 - DNA, 15 bp, Homo sapiens
ataacacattactta

SEQ ID NO: 31173 - DNA, 15 bp, Homo sapiens
tataacacattactt

SEQ ID NO: 31174 - DNA, 15 bp, Homo sapiens
atataacacattact

SEQ ID NO: 31175 - DNA, 15 bp, Homo sapiens
aatataacacattac

SEQ ID NO: 31176 - DNA, 15 bp, Homo sapiens
aaatataacacatta

SEQ ID NO: 31177 - DNA, 15 bp, Homo sapiens
taaatataacacatt

SEQ ID NO: 31178 - DNA, 15 bp, Homo sapiens
ataaatataacacat

SEQ ID NO: 31179 - DNA, 15 bp, Homo sapiens
cataaatataacaca

SEQ ID NO: 31180 - DNA, 15 bp, Homo sapiens
gcataaatataacac

SEQ ID NO: 31181 - DNA, 15 bp, Homo sapiens
agcataaatataaca

SEQ ID NO: 31182 - DNA, 15 bp, Homo sapiens
aagcataaatataac

SEQ ID NO: 31183 - DNA, 15 bp, Homo sapiens
taagcataaatataa

SEQ ID NO: 31184 - DNA, 15 bp, Homo sapiens
ataagcataaatata

SEQ ID NO: 31185 - DNA, 15 bp, Homo sapiens
aataagcataaatat

SEQ ID NO: 31186 - DNA, 15 bp, Homo sapiens
aaataagcataaata

SEQ ID NO: 31187 - DNA, 15 bp, Homo sapiens
aaaataagcataaat

SEQ ID NO: 31188 - DNA, 15 bp, Homo sapiens
caaaataagcataaa

SEQ ID NO: 31189 - DNA, 15 bp, Homo sapiens
acaaaataagcataa

SEQ ID NO: 31190 - DNA, 15 bp, Homo sapiens
aacaaaataagcata

SEQ ID NO: 31191 - DNA, 15 bp, Homo sapiens
taacaaaataagcat

SEQ ID NO: 31192 - DNA, 15 bp, Homo sapiens
ttaacaaaataagca

SEQ ID NO: 31193 - DNA, 15 bp, Homo sapiens
cttaacaaaataagc

SEQ ID NO: 31194 - DNA, 15 bp, Homo sapiens
acttaacaaaataag

SEQ ID NO: 31195 - DNA, 15 bp, Homo sapiens
cacttaacaaaataa

SEQ ID NO: 31196 - DNA, 15 bp, Homo sapiens
gcacttaacaaaata

SEQ ID NO: 31197 - DNA, 15 bp, Homo sapiens
agcacttaacaaaat

SEQ ID NO: 31198 - DNA, 15 bp, Homo sapiens
gagcacttaacaaaa

SEQ ID NO: 31199 - DNA, 15 bp, Homo sapiens
tgagcacttaacaaa

SEQ ID NO: 31200 - DNA, 15 bp, Homo sapiens
ctgagcacttaacaa

SEQ ID NO: 31201 - DNA, 15 bp, Homo sapiens
actgagcacttaaca

SEQ ID NO: 31202 - DNA, 15 bp, Homo sapiens
aactgagcacttaac

SEQ ID NO: 31203 - DNA, 15 bp, Homo sapiens
aaactgagcacttaa

SEQ ID NO: 31204 - DNA, 15 bp, Homo sapiens
gaaactgagcactta

SEQ ID NO: 31205 - DNA, 15 bp, Homo sapiens
agaaactgagcactt

SEQ ID NO: 31206 - DNA, 15 bp, Homo sapiens
gagaaactgagcact

SEQ ID NO: 31207 - DNA, 15 bp, Homo sapiens
agagaaactgagcac

SEQ ID NO: 31208 - DNA, 15 bp, Homo sapiens
aagagaaactgagca

SEQ ID NO: 31209 - DNA, 15 bp, Homo sapiens
taagagaaactgagc

SEQ ID NO: 31210 - DNA, 15 bp, Homo sapiens
ctaagagaaactgag

SEQ ID NO: 31211 - DNA, 15 bp, Homo sapiens
cctaagagaaactga

SEQ ID NO: 31212 - DNA, 15 bp, Homo sapiens
acctaagagaaactg

SEQ ID NO: 31213 - DNA, 15 bp, Homo sapiens
aacctaagagaaact

SEQ ID NO: 31214 - DNA, 15 bp, Homo sapiens
aaacctaagagaaac

SEQ ID NO: 31215 - DNA, 15 bp, Homo sapiens
aaaacctaagagaaa

SEQ ID NO: 31216 - DNA, 15 bp, Homo sapiens
caaaacctaagagaa

SEQ ID NO: 31217 - DNA, 15 bp, Homo sapiens
acaaaacctaagaga

SEQ ID NO: 31218 - DNA, 15 bp, Homo sapiens
tacaaaacctaagag

SEQ ID NO: 31219 - DNA, 15 bp, Homo sapiens
atacaaaacctaaga

SEQ ID NO: 31220 - DNA, 15 bp, Homo sapiens
aatacaaaacctaag

SEQ ID NO: 31221 - DNA, 15 bp, Homo sapiens
taatacaaaacctaa

SEQ ID NO: 31222 - DNA, 15 bp, Homo sapiens
ataatacaaaaccta

SEQ ID NO: 31223 - DNA, 15 bp, Homo sapiens
cataatacaaaacct

SEQ ID NO: 31224 - DNA, 15 bp, Homo sapiens
acataatacaaaacc

SEQ ID NO: 31225 - DNA, 15 bp, Homo sapiens
cacataatacaaaac

SEQ ID NO: 31226 - DNA, 15 bp, Homo sapiens
ccacataatacaaaa

SEQ ID NO: 31227 - DNA, 15 bp, Homo sapiens
cccacataatacaaa

SEQ ID NO: 31228 - DNA, 15 bp, Homo sapiens
acccacataatacaa

SEQ ID NO: 31229 - DNA, 15 bp, Homo sapiens
aacccacataataca

SEQ ID NO: 31230 - DNA, 15 bp, Homo sapiens
aaacccacataatac

SEQ ID NO: 31231 - DNA, 15 bp, Homo sapiens
caaacccacataata

SEQ ID NO: 31232 - DNA, 15 bp, Homo sapiens
gcaaacccacataat

SEQ ID NO: 31233 - DNA, 15 bp, Homo sapiens
agcaaacccacataa

SEQ ID NO: 31234 - DNA, 15 bp, Homo sapiens
tagcaaacccacata

SEQ ID NO: 31235 - DNA, 15 bp, Homo sapiens
atagcaaacccacat

SEQ ID NO: 31236 - DNA, 15 bp, Homo sapiens
aatagcaaacccaca

SEQ ID NO: 31237 - DNA, 15 bp, Homo sapiens
aaatagcaaacccac

SEQ ID NO: 31238 - DNA, 15 bp, Homo sapiens
aaaatagcaaaccca

SEQ ID NO: 31239 - DNA, 15 bp, Homo sapiens
aaaaatagcaaaccc

SEQ ID NO: 31240 - DNA, 15 bp, Homo sapiens
aaaaaatagcaaacc

SEQ ID NO: 31241 - DNA, 15 bp, Homo sapiens
taaaaaatagcaaac

SEQ ID NO: 31242 - DNA, 15 bp, Homo sapiens
ttaaaaaatagcaaa

SEQ ID NO: 31243 - DNA, 15 bp, Homo sapiens
tttaaaaaatagcaa

SEQ ID NO: 31244 - DNA, 15 bp, Homo sapiens
ttttaaaaaatagca

SEQ ID NO: 31245 - DNA, 15 bp, Homo sapiens
tttttaaaaaatagc

SEQ ID NO: 31246 - DNA, 15 bp, Homo sapiens
ttttttaaaaaatag

SEQ ID NO: 31247 - DNA, 15 bp, Homo sapiens
tttttttaaaaaata

SEQ ID NO: 31248 - DNA, 15 bp, Homo sapiens
atttttttaaaaaat

SEQ ID NO: 31249 - DNA, 15 bp, Homo sapiens
tatttttttaaaaaa

SEQ ID NO: 31250 - DNA, 15 bp, Homo sapiens
atatttttttaaaaa

SEQ ID NO: 31251 - DNA, 15 bp, Homo sapiens
aatatttttttaaaa

SEQ ID NO: 31252 - DNA, 15 bp, Homo sapiens
aaatatttttttaaa

SEQ ID NO: 31253 - DNA, 15 bp, Homo sapiens
aaaatatttttttaa

SEQ ID NO: 31254 - DNA, 15 bp, Homo sapiens
aaaaatattttttta

SEQ ID NO: 31255 - DNA, 15 bp, Homo sapiens
taaaaatattttttt

SEQ ID NO: 31256 - DNA, 15 bp, Homo sapiens
ttaaaaatatttttt

SEQ ID NO: 31257 - DNA, 15 bp, Homo sapiens
attaaaaatattttt

SEQ ID NO: 31258 - DNA, 15 bp, Homo sapiens
aaattaaaaatattt

SEQ ID NO: 31259 - DNA, 15 bp, Homo sapiens
aaaattaaaaatatt

SEQ ID NO: 31260 - DNA, 15 bp, Homo sapiens
aaaaattaaaaatat

SEQ ID NO: 31261 - DNA, 15 bp, Homo sapiens
aaaaaattaaaaata

SEQ ID NO: 31262 - DNA, 15 bp, Homo sapiens
caaaaaattaaaaat

SEQ ID NO: 31263 - DNA, 15 bp, Homo sapiens
ccaaaaaattaaaaa

SEQ ID NO: 31264 - DNA, 15 bp, Homo sapiens
cccaaaaaattaaaa

SEQ ID NO: 31265 - DNA, 15 bp, Homo sapiens
acccaaaaaattaaa

SEQ ID NO: 31266 - DNA, 15 bp, Homo sapiens
tacccaaaaaattaa

SEQ ID NO: 31267 - DNA, 15 bp, Homo sapiens
atacccaaaaaatta

SEQ ID NO: 31268 - DNA, 15 bp, Homo sapiens
catacccaaaaaatt

SEQ ID NO: 31269 - DNA, 15 bp, Homo sapiens
ccatacccaaaaaat

SEQ ID NO: 31270 - DNA, 15 bp, Homo sapiens
accatacccaaaaaa

SEQ ID NO: 31271 - DNA, 15 bp, Homo sapiens
aaccatacccaaaaa

SEQ ID NO: 31272 - DNA, 15 bp, Homo sapiens
aaaccatacccaaaa

SEQ ID NO: 31273 - DNA, 15 bp, Homo sapiens
caaaccatacccaaa

SEQ ID NO: 31274 - DNA, 15 bp, Homo sapiens
gcaaaccatacccaa

SEQ ID NO: 31275 - DNA, 15 bp, Homo sapiens
agcaaaccataccca

SEQ ID NO: 31276 - DNA, 15 bp, Homo sapiens
tagcaaaccataccc

SEQ ID NO: 31277 - DNA, 15 bp, Homo sapiens
atagcaaaccatacc

SEQ ID NO: 31278 - DNA, 15 bp, Homo sapiens
aatagcaaaccatac

SEQ ID NO: 31279 - DNA, 15 bp, Homo sapiens
aaatagcaaaccata

SEQ ID NO: 31280 - DNA, 15 bp, Homo sapiens
caaatagcaaaccat

SEQ ID NO: 31281 - DNA, 15 bp, Homo sapiens
tcaaatagcaaacca

SEQ ID NO: 31282 - DNA, 15 bp, Homo sapiens
ttcaaatagcaaacc

SEQ ID NO: 31283 - DNA, 15 bp, Homo sapiens
tttcaaatagcaaac

SEQ ID NO: 31284 - DNA, 15 bp, Homo sapiens
atttcaaatagcaaa

SEQ ID NO: 31285 - DNA, 15 bp, Homo sapiens
tatttcaaatagcaa

SEQ ID NO: 31286 - DNA, 15 bp, Homo sapiens
atatttcaaatagca

SEQ ID NO: 31287 - DNA, 15 bp, Homo sapiens
catatttcaaatagc

SEQ ID NO: 31288 - DNA, 15 bp, Homo sapiens
tcatatttcaaatag

SEQ ID NO: 31289 - DNA, 15 bp, Homo sapiens
atcatatttcaaata

SEQ ID NO: 31290 - DNA, 15 bp, Homo sapiens
aatcatatttcaaat

SEQ ID NO: 31291 - DNA, 15 bp, Homo sapiens
aaatcatatttcaaa

SEQ ID NO: 31292 - DNA, 15 bp, Homo sapiens
aaaatcatatttcaa

SEQ ID NO: 31293 - DNA, 15 bp, Homo sapiens
caaaatcatatttca

SEQ ID NO: 31294 - DNA, 15 bp, Homo sapiens
tcaaaatcatatttc

SEQ ID NO: 31295 - DNA, 15 bp, Homo sapiens
ttcaaaatcatattt

SEQ ID NO: 31296 - DNA, 15 bp, Homo sapiens
attcaaaatcatatt

SEQ ID NO: 31297 - DNA, 15 bp, Homo sapiens
tattcaaaatcatat

SEQ ID NO: 31298 - DNA, 15 bp, Homo sapiens
ttattcaaaatcata

SEQ ID NO: 31299 - DNA, 15 bp, Homo sapiens
cttattcaaaatcat

SEQ ID NO: 31300 - DNA, 15 bp, Homo sapiens
acttattcaaaatca

SEQ ID NO: 31301 - DNA, 15 bp, Homo sapiens
aacttattcaaaatc

SEQ ID NO: 31302 - DNA, 15 bp, Homo sapiens
aaacttattcaaaat

SEQ ID NO: 31303 - DNA, 15 bp, Homo sapiens
gaaacttattcaaaa

SEQ ID NO: 31304 - DNA, 15 bp, Homo sapiens
agaaacttattcaaa

SEQ ID NO: 31305 - DNA, 15 bp, Homo sapiens
gagaaacttattcaa

SEQ ID NO: 31306 - DNA, 15 bp, Homo sapiens
tgagaaacttattca

SEQ ID NO: 31307 - DNA, 15 bp, Homo sapiens
ctgagaaacttattc

SEQ ID NO: 31308 - DNA, 15 bp, Homo sapiens
actgagaaacttatt

SEQ ID NO: 31309 - DNA, 15 bp, Homo sapiens
tactgagaaacttat

SEQ ID NO: 31310 - DNA, 15 bp, Homo sapiens
gtactgagaaactta

SEQ ID NO: 31311 - DNA, 15 bp, Homo sapiens
tgtactgagaaactt

SEQ ID NO: 31312 - DNA, 15 bp, Homo sapiens
atgtactgagaaact

SEQ ID NO: 31313 - DNA, 15 bp, Homo sapiens
tatgtactgagaaac

SEQ ID NO: 31314 - DNA, 15 bp, Homo sapiens
ctatgtactgagaaa

SEQ ID NO: 31315 - DNA, 15 bp, Homo sapiens
gctatgtactgagaa

SEQ ID NO: 31316 - DNA, 15 bp, Homo sapiens
tgctatgtactgaga

SEQ ID NO: 31317 - DNA, 15 bp, Homo sapiens
gtgctatgtactgag

SEQ ID NO: 31318 - DNA, 15 bp, Homo sapiens
agtgctatgtactga

SEQ ID NO: 31319 - DNA, 15 bp, Homo sapiens
aagtgctatgtactg

SEQ ID NO: 31320 - DNA, 15 bp, Homo sapiens
aaagtgctatgtact

SEQ ID NO: 31321 - DNA, 15 bp, Homo sapiens
aaaagtgctatgtac

SEQ ID NO: 31322 - DNA, 15 bp, Homo sapiens
taaaagtgctatgta

SEQ ID NO: 31323 - DNA, 15 bp, Homo sapiens
ttaaaagtgctatgt

SEQ ID NO: 31324 - DNA, 15 bp, Homo sapiens
attaaaagtgctatg

SEQ ID NO: 31325 - DNA, 15 bp, Homo sapiens
aattaaaagtgctat

SEQ ID NO: 31326 - DNA, 15 bp, Homo sapiens
aaattaaaagtgcta

SEQ ID NO: 31327 - DNA, 15 bp, Homo sapiens
aaaattaaaagtgct

SEQ ID NO: 31328 - DNA, 15 bp, Homo sapiens
taaaattaaaagtgc

SEQ ID NO: 31329 - DNA, 15 bp, Homo sapiens
ataaaattaaaagtg

SEQ ID NO: 31330 - DNA, 15 bp, Homo sapiens
cataaaattaaaagt

SEQ ID NO: 31331 - DNA, 15 bp, Homo sapiens
acataaaattaaaag

SEQ ID NO: 31332 - DNA, 15 bp, Homo sapiens
aacataaaattaaaa

SEQ ID NO: 31333 - DNA, 15 bp, Homo sapiens
aaacataaaattaaa

SEQ ID NO: 31334 - DNA, 15 bp, Homo sapiens
aaaacataaaattaa

SEQ ID NO: 31335 - DNA, 15 bp, Homo sapiens
aaaaacataaaatta

SEQ ID NO: 31336 - DNA, 15 bp, Homo sapiens
taaaaacataaaatt

SEQ ID NO: 31337 - DNA, 15 bp, Homo sapiens
ttaaaaacataaaat

SEQ ID NO: 31338 - DNA, 15 bp, Homo sapiens
tttaaaaacataaaa

SEQ ID NO: 31339 - DNA, 15 bp, Homo sapiens
ttttaaaaacataaa

SEQ ID NO: 31340 - DNA, 15 bp, Homo sapiens
cttttaaaaacataa

SEQ ID NO: 31341 - DNA, 15 bp, Homo sapiens
tcttttaaaaacata

SEQ ID NO: 31342 - DNA, 15 bp, Homo sapiens
atcttttaaaaacat

SEQ ID NO: 31343 - DNA, 15 bp, Homo sapiens
aatcttttaaaaaca

SEQ ID NO: 31344 - DNA, 15 bp, Homo sapiens
aaatcttttaaaaac

SEQ ID NO: 31345 - DNA, 15 bp, Homo sapiens
aaaatcttttaaaaa

SEQ ID NO: 31346 - DNA, 15 bp, Homo sapiens
aaaaatcttttaaaa

SEQ ID NO: 31347 - DNA, 15 bp, Homo sapiens
aaaaaatcttttaaa

SEQ ID NO: 31348 - DNA, 15 bp, Homo sapiens
taaaaaatcttttaa

SEQ ID NO: 31349 - DNA, 15 bp, Homo sapiens
ttaaaaaatctttta

SEQ ID NO: 31350 - DNA, 15 bp, Homo sapiens
attaaaaaatctttt

SEQ ID NO: 31351 - DNA, 15 bp, Homo sapiens
cattaaaaaatcttt

SEQ ID NO: 31352 - DNA, 15 bp, Homo sapiens
ccattaaaaaatctt

SEQ ID NO: 31353 - DNA, 15 bp, Homo sapiens
accattaaaaaatct

SEQ ID NO: 31354 - DNA, 15 bp, Homo sapiens
aaccattaaaaaatc

SEQ ID NO: 31355 - DNA, 15 bp, Homo sapiens
taaccattaaaaaat

SEQ ID NO: 31356 - DNA, 15 bp, Homo sapiens
ataaccattaaaaaa

SEQ ID NO: 31357 - DNA, 15 bp, Homo sapiens
tataaccattaaaaa

SEQ ID NO: 31358 - DNA, 15 bp, Homo sapiens
gtataaccattaaaa

SEQ ID NO: 31359 - DNA, 15 bp, Homo sapiens
tgtataaccattaaa

SEQ ID NO: 31360 - DNA, 15 bp, Homo sapiens
atgtataaccattaa

SEQ ID NO: 31361 - DNA, 15 bp, Homo sapiens
tatgtataaccatta

SEQ ID NO: 31362 - DNA, 15 bp, Homo sapiens
ttatgtataaccatt

SEQ ID NO: 31363 - DNA, 15 bp, Homo sapiens
attatgtataaccat

SEQ ID NO: 31364 - DNA, 15 bp, Homo sapiens
tattatgtataacca

SEQ ID NO: 31365 - DNA, 15 bp, Homo sapiens
ttattatgtataacc

SEQ ID NO: 31366 - DNA, 15 bp, Homo sapiens
attattatgtataac

SEQ ID NO: 31367 - DNA, 15 bp, Homo sapiens
aattattatgtataa

SEQ ID NO: 31368 - DNA, 15 bp, Homo sapiens
caattattatgtata

SEQ ID NO: 31369 - DNA, 15 bp, Homo sapiens
tcaattattatgtat

SEQ ID NO: 31370 - DNA, 15 bp, Homo sapiens
atcaattattatgta

SEQ ID NO: 31371 - DNA, 15 bp, Homo sapiens
catcaattattatgt

SEQ ID NO: 31372 - DNA, 15 bp, Homo sapiens
ccatcaattattatg

SEQ ID NO: 31373 - DNA, 15 bp, Homo sapiens
tccatcaattattat

SEQ ID NO: 31374 - DNA, 15 bp, Homo sapiens
gtccatcaattatta

SEQ ID NO: 31375 - DNA, 15 bp, Homo sapiens
tgtccatcaattatt

SEQ ID NO: 31376 - DNA, 15 bp, Homo sapiens
gtgtccatcaattat

SEQ ID NO: 31377 - DNA, 15 bp, Homo sapiens
tgtgtccatcaatta

SEQ ID NO: 31378 - DNA, 15 bp, Homo sapiens
gtgtgtccatcaatt

SEQ ID NO: 31379 - DNA, 15 bp, Homo sapiens
tgtgtgtccatcaat

SEQ ID NO: 31380 - DNA, 15 bp, Homo sapiens
ttgtgtgtccatcaa

SEQ ID NO: 31381 - DNA, 15 bp, Homo sapiens
attgtgtgtccatca

SEQ ID NO: 31382 - DNA, 15 bp, Homo sapiens
tattgtgtgtccatc

SEQ ID NO: 31383 - DNA, 15 bp, Homo sapiens
ctattgtgtgtccat

SEQ ID NO: 31384 - DNA, 15 bp, Homo sapiens
actattgtgtgtcca

SEQ ID NO: 31385 - DNA, 15 bp, Homo sapiens
tactattgtgtgtcc

SEQ ID NO: 31386 - DNA, 15 bp, Homo sapiens
atactattgtgtgtc

SEQ ID NO: 31387 - DNA, 15 bp, Homo sapiens
aatactattgtgtgt

SEQ ID NO: 31388 - DNA, 15 bp, Homo sapiens
aaatactattgtgtg

SEQ ID NO: 31389 - DNA, 15 bp, Homo sapiens
taaatactattgtgt

SEQ ID NO: 31390 - DNA, 15 bp, Homo sapiens
ttaaatactattgtg

SEQ ID NO: 31391 - DNA, 15 bp, Homo sapiens
tttaaatactattgt

SEQ ID NO: 31392 - DNA, 15 bp, Homo sapiens
atttaaatactattg

SEQ ID NO: 31393 - DNA, 15 bp, Homo sapiens
gatttaaatactatt

SEQ ID NO: 31394 - DNA, 15 bp, Homo sapiens
agatttaaatactat

SEQ ID NO: 31395 - DNA, 15 bp, Homo sapiens
tagatttaaatacta

SEQ ID NO: 31396 - DNA, 15 bp, Homo sapiens
ttagatttaaatact

SEQ ID NO: 31397 - DNA, 15 bp, Homo sapiens
tttagatttaaatac

SEQ ID NO: 31398 - DNA, 15 bp, Homo sapiens
ttttagatttaaata

SEQ ID NO: 31399 - DNA, 15 bp, Homo sapiens
tttttagatttaaat

SEQ ID NO: 31400 - DNA, 15 bp, Homo sapiens
atttttagatttaaa

SEQ ID NO: 31401 - DNA, 15 bp, Homo sapiens
tatttttagatttaa

SEQ ID NO: 31402 - DNA, 15 bp, Homo sapiens
ctatttttagattta

SEQ ID NO: 31403 - DNA, 15 bp, Homo sapiens
tctatttttagattt

SEQ ID NO: 31404 - DNA, 15 bp, Homo sapiens
ctctatttttagatt

SEQ ID NO: 31405 - DNA, 15 bp, Homo sapiens
tctctatttttagat

SEQ ID NO: 31406 - DNA, 15 bp, Homo sapiens
ttctctatttttaga

SEQ ID NO: 31407 - DNA, 15 bp, Homo sapiens
tttctctatttttag

SEQ ID NO: 31408 - DNA, 15 bp, Homo sapiens
gtttctctattttta

SEQ ID NO: 31409 - DNA, 15 bp, Homo sapiens
ggtttctctattttt

SEQ ID NO: 31410 - DNA, 15 bp, Homo sapiens
tggtttctctatttt

SEQ ID NO: 31411 - DNA, 15 bp, Homo sapiens
atggtttctctattt

SEQ ID NO: 31412 - DNA, 15 bp, Homo sapiens
catggtttctctatt

SEQ ID NO: 31413 - DNA, 15 bp, Homo sapiens
ccatggtttctctat

SEQ ID NO: 31414 - DNA, 15 bp, Homo sapiens
gccatggtttctcta

SEQ ID NO: 31415 - DNA, 15 bp, Homo sapiens
tgccatggtttctct

SEQ ID NO: 31416 - DNA, 15 bp, Homo sapiens
gtgccatggtttctc

SEQ ID NO: 31417 - DNA, 15 bp, Homo sapiens
tgtgccatggtttct

SEQ ID NO: 31418 - DNA, 15 bp, Homo sapiens
gtgtgccatggtttc

SEQ ID NO: 31419 - DNA, 15 bp, Homo sapiens
tgtgtgccatggttt

SEQ ID NO: 31420 - DNA, 15 bp, Homo sapiens
ttgtgtgccatggtt

SEQ ID NO: 31421 - DNA, 15 bp, Homo sapiens
tttgtgtgccatggt

SEQ ID NO: 31422 - DNA, 15 bp, Homo sapiens
ttttgtgtgccatgg

SEQ ID NO: 31423 - DNA, 15 bp, Homo sapiens
gttttgtgtgccatg

SEQ ID NO: 31424 - DNA, 15 bp, Homo sapiens
tgttttgtgtgccat

SEQ ID NO: 31425 - DNA, 15 bp, Homo sapiens
gtgttttgtgtgcca

SEQ ID NO: 31426 - DNA, 15 bp, Homo sapiens
tgtgttttgtgtgcc

SEQ ID NO: 31427 - DNA, 15 bp, Homo sapiens
ctgtgttttgtgtgc

SEQ ID NO: 31428 - DNA, 15 bp, Homo sapiens
actgtgttttgtgtg

SEQ ID NO: 31429 - DNA, 15 bp, Homo sapiens
tactgtgttttgtgt

SEQ ID NO: 31430 - DNA, 15 bp, Homo sapiens
atactgtgttttgtg

SEQ ID NO: 31431 - DNA, 15 bp, Homo sapiens
gatactgtgttttgt

SEQ ID NO: 31432 - DNA, 15 bp, Homo sapiens
agatactgtgttttg

SEQ ID NO: 31433 - DNA, 15 bp, Homo sapiens
aagatactgtgtttt

SEQ ID NO: 31434 - DNA, 15 bp, Homo sapiens
taagatactgtgttt

SEQ ID NO: 31435 - DNA, 15 bp, Homo sapiens
gtaagatactgtgtt

SEQ ID NO: 31436 - DNA, 15 bp, Homo sapiens
tgtaagatactgtgt

SEQ ID NO: 31437 - DNA, 15 bp, Homo sapiens
ctgtaagatactgtg

SEQ ID NO: 31438 - DNA, 15 bp, Homo sapiens
tctgtaagatactgt

SEQ ID NO: 31439 - DNA, 15 bp, Homo sapiens
ttctgtaagatactg

SEQ ID NO: 31440 - DNA, 15 bp, Homo sapiens
gttctgtaagatact

SEQ ID NO: 31441 - DNA, 15 bp, Homo sapiens
agttctgtaagatac

SEQ ID NO: 31442 - DNA, 15 bp, Homo sapiens
cagttctgtaagata

SEQ ID NO: 31443 - DNA, 15 bp, Homo sapiens
acagttctgtaagat

SEQ ID NO: 31444 - DNA, 15 bp, Homo sapiens
tacagttctgtaaga

SEQ ID NO: 31445 - DNA, 15 bp, Homo sapiens
atacagttctgtaag

SEQ ID NO: 31446 - DNA, 15 bp, Homo sapiens
aatacagttctgtaa

SEQ ID NO: 31447 - DNA, 15 bp, Homo sapiens
taatacagttctgta

SEQ ID NO: 31448 - DNA, 15 bp, Homo sapiens
ataatacagttctgt

SEQ ID NO: 31449 - DNA, 15 bp, Homo sapiens
aataatacagttctg

SEQ ID NO: 31450 - DNA, 15 bp, Homo sapiens
aaataatacagttct

SEQ ID NO: 31451 - DNA, 15 bp, Homo sapiens
caaataatacagttc

SEQ ID NO: 31452 - DNA, 15 bp, Homo sapiens
gcaaataatacagtt

SEQ ID NO: 31453 - DNA, 15 bp, Homo sapiens
agcaaataatacagt

SEQ ID NO: 31454 - DNA, 15 bp, Homo sapiens
aagcaaataatacag

SEQ ID NO: 31455 - DNA, 15 bp, Homo sapiens
gaagcaaataataca

SEQ ID NO: 31456 - DNA, 15 bp, Homo sapiens
agaagcaaataatac

SEQ ID NO: 31457 - DNA, 15 bp, Homo sapiens
aagaagcaaataata

SEQ ID NO: 31458 - DNA, 15 bp, Homo sapiens
aaagaagcaaataat

SEQ ID NO: 31459 - DNA, 15 bp, Homo sapiens
aaaagaagcaaataa

SEQ ID NO: 31460 - DNA, 15 bp, Homo sapiens
gaaaagaagcaaata

SEQ ID NO: 31461 - DNA, 15 bp, Homo sapiens
agaaaagaagcaaat

SEQ ID NO: 31462 - DNA, 15 bp, Homo sapiens
tagaaaagaagcaaa

SEQ ID NO: 31463 - DNA, 15 bp, Homo sapiens
atagaaaagaagcaa

SEQ ID NO: 31464 - DNA, 15 bp, Homo sapiens
catagaaaagaagca

SEQ ID NO: 31465 - DNA, 15 bp, Homo sapiens
acatagaaaagaagc

SEQ ID NO: 31466 - DNA, 15 bp, Homo sapiens
cacatagaaaagaag

SEQ ID NO: 31467 - DNA, 15 bp, Homo sapiens
acacatagaaaagaa

SEQ ID NO: 31468 - DNA, 15 bp, Homo sapiens
aacacatagaaaaga

SEQ ID NO: 31469 - DNA, 15 bp, Homo sapiens
aaacacatagaaaag

SEQ ID NO: 31470 - DNA, 15 bp, Homo sapiens
aaaacacatagaaaa

SEQ ID NO: 31471 - DNA, 15 bp, Homo sapiens
gaaaacacatagaaa

SEQ ID NO: 31472 - DNA, 15 bp, Homo sapiens
agaaaacacatagaa

SEQ ID NO: 31473 - DNA, 15 bp, Homo sapiens
tagaaaacacataga

SEQ ID NO: 31474 - DNA, 15 bp, Homo sapiens
ctagaaaacacatag

SEQ ID NO: 31475 - DNA, 15 bp, Homo sapiens
cctagaaaacacata

SEQ ID NO: 31476 - DNA, 15 bp, Homo sapiens
gcctagaaaacacat

SEQ ID NO: 31477 - DNA, 15 bp, Homo sapiens
agcctagaaaacaca

SEQ ID NO: 31478 - DNA, 15 bp, Homo sapiens
aagcctagaaaacac

SEQ ID NO: 31479 - DNA, 15 bp, Homo sapiens
aaagcctagaaaaca

SEQ ID NO: 31480 - DNA, 15 bp, Homo sapiens
aaaagcctagaaaac

SEQ ID NO: 31481 - DNA, 15 bp, Homo sapiens
caaaagcctagaaaa

SEQ ID NO: 31482 - DNA, 15 bp, Homo sapiens
tcaaaagcctagaaa

SEQ ID NO: 31483 - DNA, 15 bp, Homo sapiens
ctcaaaagcctagaa

SEQ ID NO: 31484 - DNA, 15 bp, Homo sapiens
actcaaaagcctaga

SEQ ID NO: 31485 - DNA, 15 bp, Homo sapiens
gactcaaaagcctag

SEQ ID NO: 31486 - DNA, 15 bp, Homo sapiens
tgactcaaaagccta

SEQ ID NO: 31487 - DNA, 15 bp, Homo sapiens
ctgactcaaaagcct

SEQ ID NO: 31488 - DNA, 15 bp, Homo sapiens
tctgactcaaaagcc

SEQ ID NO: 31489 - DNA, 15 bp, Homo sapiens
atctgactcaaaagc

SEQ ID NO: 31490 - DNA, 15 bp, Homo sapiens
catctgactcaaaag

SEQ ID NO: 31491 - DNA, 15 bp, Homo sapiens
acatctgactcaaaa

SEQ ID NO: 31492 - DNA, 15 bp, Homo sapiens
aacatctgactcaaa

SEQ ID NO: 31493 - DNA, 15 bp, Homo sapiens
taacatctgactcaa

SEQ ID NO: 31494 - DNA, 15 bp, Homo sapiens
ctaacatctgactca

SEQ ID NO: 31495 - DNA, 15 bp, Homo sapiens
cctaacatctgactc

SEQ ID NO: 31496 - DNA, 15 bp, Homo sapiens
tcctaacatctgact

SEQ ID NO: 31497 - DNA, 15 bp, Homo sapiens
ttcctaacatctgac

SEQ ID NO: 31498 - DNA, 15 bp, Homo sapiens
tttcctaacatctga

SEQ ID NO: 31499 - DNA, 15 bp, Homo sapiens
ctttcctaacatctg

SEQ ID NO: 31500 - DNA, 15 bp, Homo sapiens
tctttcctaacatct

SEQ ID NO: 31501 - DNA, 15 bp, Homo sapiens
ctctttcctaacatc

SEQ ID NO: 31502 - DNA, 15 bp, Homo sapiens
actctttcctaacat

SEQ ID NO: 31503 - DNA, 15 bp, Homo sapiens
gactctttcctaaca

SEQ ID NO: 31504 - DNA, 15 bp, Homo sapiens
agactctttcctaac

SEQ ID NO: 31505 - DNA, 15 bp, Homo sapiens
cagactctttcctaa

SEQ ID NO: 31506 - DNA, 15 bp, Homo sapiens
acagactctttccta

SEQ ID NO: 31507 - DNA, 15 bp, Homo sapiens
gacagactctttcct

SEQ ID NO: 31508 - DNA, 15 bp, Homo sapiens
ggacagactctttcc

SEQ ID NO: 31509 - DNA, 15 bp, Homo sapiens
tggacagactctttc

SEQ ID NO: 31510 - DNA, 15 bp, Homo sapiens
atggacagactcttt

SEQ ID NO: 31511 - DNA, 15 bp, Homo sapiens
gatggacagactctt

SEQ ID NO: 31512 - DNA, 15 bp, Homo sapiens
agatggacagactct

SEQ ID NO: 31513 - DNA, 15 bp, Homo sapiens
aagatggacagactc

SEQ ID NO: 31514 - DNA, 15 bp, Homo sapiens
aaagatggacagact

SEQ ID NO: 31515 - DNA, 15 bp, Homo sapiens
taaagatggacagac

SEQ ID NO: 31516 - DNA, 15 bp, Homo sapiens
ttaaagatggacaga

SEQ ID NO: 31517 - DNA, 15 bp, Homo sapiens
attaaagatggacag

SEQ ID NO: 31518 - DNA, 15 bp, Homo sapiens
aattaaagatggaca

SEQ ID NO: 31519 - DNA, 15 bp, Homo sapiens
aaattaaagatggac

SEQ ID NO: 31520 - DNA, 15 bp, Homo sapiens
aaaattaaagatgga

SEQ ID NO: 31521 - DNA, 15 bp, Homo sapiens
gaaaattaaagatgg

SEQ ID NO: 31522 - DNA, 15 bp, Homo sapiens
agaaaattaaagatg

SEQ ID NO: 31523 - DNA, 15 bp, Homo sapiens
gagaaaattaaagat

SEQ ID NO: 31524 - DNA, 15 bp, Homo sapiens
tgagaaaattaaaga

SEQ ID NO: 31525 - DNA, 15 bp, Homo sapiens
gtgagaaaattaaag

SEQ ID NO: 31526 - DNA, 15 bp, Homo sapiens
agtgagaaaattaaa

SEQ ID NO: 31527 - DNA, 15 bp, Homo sapiens
aagtgagaaaattaa

SEQ ID NO: 31528 - DNA, 15 bp, Homo sapiens
gaagtgagaaaatta

SEQ ID NO: 31529 - DNA, 15 bp, Homo sapiens
cgaagtgagaaaatt

SEQ ID NO: 31530 - DNA, 15 bp, Homo sapiens
tcgaagtgagaaaat

SEQ ID NO: 31531 - DNA, 15 bp, Homo sapiens
ctcgaagtgagaaaa

SEQ ID NO: 31532 - DNA, 15 bp, Homo sapiens
tctcgaagtgagaaa

SEQ ID NO: 31533 - DNA, 15 bp, Homo sapiens
ttctcgaagtgagaa

SEQ ID NO: 31534 - DNA, 15 bp, Homo sapiens
cttctcgaagtgaga

SEQ ID NO: 31535 - DNA, 15 bp, Homo sapiens
gcttctcgaagtgag

SEQ ID NO: 31536 - DNA, 15 bp, Homo sapiens
tgcttctcgaagtga

SEQ ID NO: 31537 - DNA, 15 bp, Homo sapiens
gtgcttctcgaagtg

SEQ ID NO: 31538 - DNA, 15 bp, Homo sapiens
agtgcttctcgaagt

SEQ ID NO: 31539 - DNA, 15 bp, Homo sapiens
cagtgcttctcgaag

SEQ ID NO: 31540 - DNA, 15 bp, Homo sapiens
tcagtgcttctcgaa

SEQ ID NO: 31541 - DNA, 15 bp, Homo sapiens
ttcagtgcttctcga

SEQ ID NO: 31542 - DNA, 15 bp, Homo sapiens
tttcagtgcttctcg

SEQ ID NO: 31543 - DNA, 15 bp, Homo sapiens
atttcagtgcttctc

SEQ ID NO: 31544 - DNA, 15 bp, Homo sapiens
tatttcagtgcttct

SEQ ID NO: 31545 - DNA, 15 bp, Homo sapiens
atatttcagtgcttc

SEQ ID NO: 31546 - DNA, 15 bp, Homo sapiens
aatatttcagtgctt

SEQ ID NO: 31547 - DNA, 15 bp, Homo sapiens
aaatatttcagtgct

SEQ ID NO: 31548 - DNA, 15 bp, Homo sapiens
gaaatatttcagtgc

SEQ ID NO: 31549 - DNA, 15 bp, Homo sapiens
agaaatatttcagtg

SEQ ID NO: 31550 - DNA, 15 bp, Homo sapiens
tagaaatatttcagt

SEQ ID NO: 31551 - DNA, 15 bp, Homo sapiens
atagaaatatttcag

SEQ ID NO: 31552 - DNA, 15 bp, Homo sapiens
tatagaaatatttca

SEQ ID NO: 31553 - DNA, 15 bp, Homo sapiens
gtatagaaatatttc

SEQ ID NO: 31554 - DNA, 15 bp, Homo sapiens
tgtatagaaatattt

SEQ ID NO: 31555 - DNA, 15 bp, Homo sapiens
atgtatagaaatatt

SEQ ID NO: 31556 - DNA, 15 bp, Homo sapiens
tatgtatagaaatat

SEQ ID NO: 31557 - DNA, 15 bp, Homo sapiens
atatgtatagaaata

SEQ ID NO: 31558 - DNA, 15 bp, Homo sapiens
catatgtatagaaat

SEQ ID NO: 31559 - DNA, 15 bp, Homo sapiens
acatatgtatagaaa

SEQ ID NO: 31560 - DNA, 15 bp, Homo sapiens
gacatatgtatagaa

SEQ ID NO: 31561 - DNA, 15 bp, Homo sapiens
ggacatatgtataga

SEQ ID NO: 31562 - DNA, 15 bp, Homo sapiens
tggacatatgtatag

SEQ ID NO: 31563 - DNA, 15 bp, Homo sapiens
atggacatatgtata

SEQ ID NO: 31564 - DNA, 15 bp, Homo sapiens
aatggacatatgtat

SEQ ID NO: 31565 - DNA, 15 bp, Homo sapiens
caatggacatatgta

SEQ ID NO: 31566 - DNA, 15 bp, Homo sapiens
ccaatggacatatgt

SEQ ID NO: 31567 - DNA, 15 bp, Homo sapiens
accaatggacatatg

SEQ ID NO: 31568 - DNA, 15 bp, Homo sapiens
taccaatggacatat

SEQ ID NO: 31569 - DNA, 15 bp, Homo sapiens
ataccaatggacata

SEQ ID NO: 31570 - DNA, 15 bp, Homo sapiens
tataccaatggacat

SEQ ID NO: 31571 - DNA, 15 bp, Homo sapiens
ctataccaatggaca

SEQ ID NO: 31572 - DNA, 15 bp, Homo sapiens
gctataccaatggac

SEQ ID NO: 31573 - DNA, 15 bp, Homo sapiens
cgctataccaatgga

SEQ ID NO: 31574 - DNA, 15 bp, Homo sapiens
tcgctataccaatgg

SEQ ID NO: 31575 - DNA, 15 bp, Homo sapiens
gtcgctataccaatg

SEQ ID NO: 31576 - DNA, 15 bp, Homo sapiens
ggtcgctataccaat

SEQ ID NO: 31577 - DNA, 15 bp, Homo sapiens
aggtcgctataccaa

SEQ ID NO: 31578 - DNA, 15 bp, Homo sapiens
taggtcgctatacca

SEQ ID NO: 31579 - DNA, 15 bp, Homo sapiens
ttaggtcgctatacc

SEQ ID NO: 31580 - DNA, 15 bp, Homo sapiens
gttaggtcgctatac

SEQ ID NO: 31581 - DNA, 15 bp, Homo sapiens
tgttaggtcgctata

SEQ ID NO: 31582 - DNA, 15 bp, Homo sapiens
gtgttaggtcgctat

SEQ ID NO: 31583 - DNA, 15 bp, Homo sapiens
tgtgttaggtcgcta

SEQ ID NO: 31584 - DNA, 15 bp, Homo sapiens
ttgtgttaggtcgct

SEQ ID NO: 31585 - DNA, 15 bp, Homo sapiens
gttgtgttaggtcgc

SEQ ID NO: 31586 - DNA, 15 bp, Homo sapiens
agttgtgttaggtcg

SEQ ID NO: 31587 - DNA, 15 bp, Homo sapiens
aagttgtgttaggtc

SEQ ID NO: 31588 - DNA, 15 bp, Homo sapiens
aaagttgtgttaggt

SEQ ID NO: 31589 - DNA, 15 bp, Homo sapiens
taaagttgtgttagg

SEQ ID NO: 31590 - DNA, 15 bp, Homo sapiens
ttaaagttgtgttag

SEQ ID NO: 31591 - DNA, 15 bp, Homo sapiens
tttaaagttgtgtta

SEQ ID NO: 31592 - DNA, 15 bp, Homo sapiens
ttttaaagttgtgtt

SEQ ID NO: 31593 - DNA, 15 bp, Homo sapiens
attttaaagttgtgt

SEQ ID NO: 31594 - DNA, 15 bp, Homo sapiens
gattttaaagttgtg

SEQ ID NO: 31595 - DNA, 15 bp, Homo sapiens
tgattttaaagttgt

SEQ ID NO: 31596 - DNA, 15 bp, Homo sapiens
atgattttaaagttg

SEQ ID NO: 31597 - DNA, 15 bp, Homo sapiens
aatgattttaaagtt

SEQ ID NO: 31598 - DNA, 15 bp, Homo sapiens
aaatgattttaaagt

SEQ ID NO: 31599 - DNA, 15 bp, Homo sapiens
aaaatgattttaaag

SEQ ID NO: 31600 - DNA, 15 bp, Homo sapiens
caaaatgattttaaa

SEQ ID NO: 31601 - DNA, 15 bp, Homo sapiens
tcaaaatgattttaa

SEQ ID NO: 31602 - DNA, 15 bp, Homo sapiens
ttcaaaatgatttta

SEQ ID NO: 31603 - DNA, 15 bp, Homo sapiens
tttcaaaatgatttt

SEQ ID NO: 31604 - DNA, 15 bp, Homo sapiens
atttcaaaatgattt

SEQ ID NO: 31605 - DNA, 15 bp, Homo sapiens
aatttcaaaatgatt

SEQ ID NO: 31606 - DNA, 15 bp, Homo sapiens
caatttcaaaatgat

SEQ ID NO: 31607 - DNA, 15 bp, Homo sapiens
tcaatttcaaaatga

SEQ ID NO: 31608 - DNA, 15 bp, Homo sapiens
gtcaatttcaaaatg

SEQ ID NO: 31609 - DNA, 15 bp, Homo sapiens
cgtcaatttcaaaat

SEQ ID NO: 31610 - DNA, 15 bp, Homo sapiens
gcgtcaatttcaaaa

SEQ ID NO: 31611 - DNA, 15 bp, Homo sapiens
tgcgtcaatttcaaa

SEQ ID NO: 31612 - DNA, 15 bp, Homo sapiens
gtgcgtcaatttcaa

SEQ ID NO: 31613 - DNA, 15 bp, Homo sapiens
tgtgcgtcaatttca

SEQ ID NO: 31614 - DNA, 15 bp, Homo sapiens
ctgtgcgtcaatttc

SEQ ID NO: 31615 - DNA, 15 bp, Homo sapiens
tctgtgcgtcaattt

SEQ ID NO: 31616 - DNA, 15 bp, Homo sapiens
ctctgtgcgtcaatt

SEQ ID NO: 31617 - DNA, 15 bp, Homo sapiens
tctctgtgcgtcaat

SEQ ID NO: 31618 - DNA, 15 bp, Homo sapiens
ctctctgtgcgtcaa

SEQ ID NO: 31619 - DNA, 15 bp, Homo sapiens
gctctctgtgcgtca

SEQ ID NO: 31620 - DNA, 15 bp, Homo sapiens
agctctctgtgcgtc

SEQ ID NO: 31621 - DNA, 15 bp, Homo sapiens
aagctctctgtgcgt

SEQ ID NO: 31622 - DNA, 15 bp, Homo sapiens
caagctctctgtgcg

SEQ ID NO: 31623 - DNA, 15 bp, Homo sapiens
ccaagctctctgtgc

SEQ ID NO: 31624 - DNA, 15 bp, Homo sapiens
accaagctctctgtg

SEQ ID NO: 31625 - DNA, 15 bp, Homo sapiens
aaccaagctctctgt

SEQ ID NO: 31626 - DNA, 15 bp, Homo sapiens
aaaccaagctctctg

SEQ ID NO: 31627 - DNA, 15 bp, Homo sapiens
aaaaccaagctctct

SEQ ID NO: 31628 - DNA, 15 bp, Homo sapiens
gaaaaccaagctctc

SEQ ID NO: 31629 - DNA, 15 bp, Homo sapiens
ggaaaaccaagctct

SEQ ID NO: 31630 - DNA, 15 bp, Homo sapiens
tggaaaaccaagctc

SEQ ID NO: 31631 - DNA, 15 bp, Homo sapiens
ctggaaaaccaagct

SEQ ID NO: 31632 - DNA, 15 bp, Homo sapiens
tctggaaaaccaagc

SEQ ID NO: 31633 - DNA, 15 bp, Homo sapiens
ttctggaaaaccaag

SEQ ID NO: 31634 - DNA, 15 bp, Homo sapiens
gttctggaaaaccaa

SEQ ID NO: 31635 - DNA, 15 bp, Homo sapiens
agttctggaaaacca

SEQ ID NO: 31636 - DNA, 15 bp, Homo sapiens
cagttctggaaaacc

SEQ ID NO: 31637 - DNA, 15 bp, Homo sapiens
ccagttctggaaaac

SEQ ID NO: 31638 - DNA, 15 bp, Homo sapiens
accagttctggaaaa

SEQ ID NO: 31639 - DNA, 15 bp, Homo sapiens
caccagttctggaaa

SEQ ID NO: 31640 - DNA, 15 bp, Homo sapiens
tcaccagttctggaa

SEQ ID NO: 31641 - DNA, 15 bp, Homo sapiens
ctcaccagttctgga

SEQ ID NO: 31642 - DNA, 15 bp, Homo sapiens
cctcaccagttctgg

SEQ ID NO: 31643 - DNA, 15 bp, Homo sapiens
acctcaccagttctg

SEQ ID NO: 31644 - DNA, 15 bp, Homo sapiens
cacctcaccagttct

SEQ ID NO: 31645 - DNA, 15 bp, Homo sapiens
acacctcaccagttc

SEQ ID NO: 31646 - DNA, 15 bp, Homo sapiens
tacacctcaccagtt

SEQ ID NO: 31647 - DNA, 15 bp, Homo sapiens
ttacacctcaccagt

SEQ ID NO: 31648 - DNA, 15 bp, Homo sapiens
cttacacctcaccag

SEQ ID NO: 31649 - DNA, 15 bp, Homo sapiens
tcttacacctcacca

SEQ ID NO: 31650 - DNA, 15 bp, Homo sapiens
atcttacacctcacc

SEQ ID NO: 31651 - DNA, 15 bp, Homo sapiens
catcttacacctcac

SEQ ID NO: 31652 - DNA, 15 bp, Homo sapiens
ccatcttacacctca

SEQ ID NO: 31653 - DNA, 15 bp, Homo sapiens
accatcttacacctc

SEQ ID NO: 31654 - DNA, 15 bp, Homo sapiens
aaccatcttacacct

SEQ ID NO: 31655 - DNA, 15 bp, Homo sapiens
caaccatcttacacc

SEQ ID NO: 31656 - DNA, 15 bp, Homo sapiens
tcaaccatcttacac

SEQ ID NO: 31657 - DNA, 15 bp, Homo sapiens
ctcaaccatcttaca

SEQ ID NO: 31658 - DNA, 15 bp, Homo sapiens
cctcaaccatcttac

SEQ ID NO: 31659 - DNA, 15 bp, Homo sapiens
tcctcaaccatctta

SEQ ID NO: 31660 - DNA, 15 bp, Homo sapiens
gtcctcaaccatctt

SEQ ID NO: 31661 - DNA, 15 bp, Homo sapiens
agtcctcaaccatct

SEQ ID NO: 31662 - DNA, 15 bp, Homo sapiens
cagtcctcaaccatc

SEQ ID NO: 31663 - DNA, 15 bp, Homo sapiens
tcagtcctcaaccat

SEQ ID NO: 31664 - DNA, 15 bp, Homo sapiens
gtcagtcctcaacca

SEQ ID NO: 31665 - DNA, 15 bp, Homo sapiens
agtcagtcctcaacc

SEQ ID NO: 31666 - DNA, 15 bp, Homo sapiens
aagtcagtcctcaac

SEQ ID NO: 31667 - DNA, 15 bp, Homo sapiens
caagtcagtcctcaa

SEQ ID NO: 31668 - DNA, 15 bp, Homo sapiens
ccaagtcagtcctca

SEQ ID NO: 31669 - DNA, 15 bp, Homo sapiens
gccaagtcagtcctc

SEQ ID NO: 31670 - DNA, 15 bp, Homo sapiens
ggccaagtcagtcct

SEQ ID NO: 31671 - DNA, 15 bp, Homo sapiens
aggccaagtcagtcc

SEQ ID NO: 31672 - DNA, 15 bp, Homo sapiens
caggccaagtcagtc

SEQ ID NO: 31673 - DNA, 15 bp, Homo sapiens
ccaggccaagtcagt

SEQ ID NO: 31674 - DNA, 15 bp, Homo sapiens
accaggccaagtcag

SEQ ID NO: 31675 - DNA, 15 bp, Homo sapiens
gaccaggccaagtca

SEQ ID NO: 31676 - DNA, 15 bp, Homo sapiens
cgaccaggccaagtc

SEQ ID NO: 31677 - DNA, 15 bp, Homo sapiens
ccgaccaggccaagt

SEQ ID NO: 31678 - DNA, 15 bp, Homo sapiens
tccgaccaggccaag

SEQ ID NO: 31679 - DNA, 15 bp, Homo sapiens
gtccgaccaggccaa

SEQ ID NO: 31680 - DNA, 15 bp, Homo sapiens
ggtccgaccaggcca

SEQ ID NO: 31681 - DNA, 15 bp, Homo sapiens
aggtccgaccaggcc

SEQ ID NO: 31682 - DNA, 15 bp, Homo sapiens
caggtccgaccaggc

SEQ ID NO: 31683 - DNA, 15 bp, Homo sapiens
acaggtccgaccagg

SEQ ID NO: 31684 - DNA, 15 bp, Homo sapiens
aacaggtccgaccag

SEQ ID NO: 31685 - DNA, 15 bp, Homo sapiens
aaacaggtccgacca

SEQ ID NO: 31686 - DNA, 15 bp, Homo sapiens
gaaacaggtccgacc

SEQ ID NO: 31687 - DNA, 15 bp, Homo sapiens
agaaacaggtccgac

SEQ ID NO: 31688 - DNA, 15 bp, Homo sapiens
aagaaacaggtccga

SEQ ID NO: 31689 - DNA, 15 bp, Homo sapiens
aaagaaacaggtccg

SEQ ID NO: 31690 - DNA, 15 bp, Homo sapiens
caaagaaacaggtcc

SEQ ID NO: 31691 - DNA, 15 bp, Homo sapiens
acaaagaaacaggtc

SEQ ID NO: 31692 - DNA, 15 bp, Homo sapiens
tacaaagaaacaggt

SEQ ID NO: 31693 - DNA, 15 bp, Homo sapiens
ctacaaagaaacagg

SEQ ID NO: 31694 - DNA, 15 bp, Homo sapiens
gctacaaagaaacag

SEQ ID NO: 31695 - DNA, 15 bp, Homo sapiens
tgctacaaagaaaca

SEQ ID NO: 31696 - DNA, 15 bp, Homo sapiens
atgctacaaagaaac

SEQ ID NO: 31697 - DNA, 15 bp, Homo sapiens
aatgctacaaagaaa

SEQ ID NO: 31698 - DNA, 15 bp, Homo sapiens
taatgctacaaagaa

SEQ ID NO: 31699 - DNA, 15 bp, Homo sapiens
ataatgctacaaaga

SEQ ID NO: 31700 - DNA, 15 bp, Homo sapiens
aataatgctacaaag

SEQ ID NO: 31701 - DNA, 15 bp, Homo sapiens
taataatgctacaaa

SEQ ID NO: 31702 - DNA, 15 bp, Homo sapiens
gtaataatgctacaa

SEQ ID NO: 31703 - DNA, 15 bp, Homo sapiens
agtaataatgctaca

SEQ ID NO: 31704 - DNA, 15 bp, Homo sapiens
tagtaataatgctac

SEQ ID NO: 31705 - DNA, 15 bp, Homo sapiens
atagtaataatgcta

SEQ ID NO: 31706 - DNA, 15 bp, Homo sapiens
aatagtaataatgct

SEQ ID NO: 31707 - DNA, 15 bp, Homo sapiens
aaatagtaataatgc

SEQ ID NO: 31708 - DNA, 15 bp, Homo sapiens
caaatagtaataatg

SEQ ID NO: 31709 - DNA, 15 bp, Homo sapiens
acaaatagtaataat

SEQ ID NO: 31710 - DNA, 15 bp, Homo sapiens
aacaaatagtaataa

SEQ ID NO: 31711 - DNA, 15 bp, Homo sapiens
aaacaaatagtaata

SEQ ID NO: 31712 - DNA, 15 bp, Homo sapiens
taaacaaatagtaat

SEQ ID NO: 31713 - DNA, 15 bp, Homo sapiens
ataaacaaatagtaa

SEQ ID NO: 31714 - DNA, 15 bp, Homo sapiens
aataaacaaatagta

SEQ ID NO: 31715 - DNA, 15 bp, Homo sapiens
aaataaacaaatagt

SEQ ID NO: 31716 - DNA, 15 bp, Homo sapiens
aaaataaacaaatag

SEQ ID NO: 31717 - DNA, 15 bp, Homo sapiens
gaaaataaacaaata

SEQ ID NO: 31718 - DNA, 15 bp, Homo sapiens
ggaaaataaacaaat

SEQ ID NO: 31719 - DNA, 15 bp, Homo sapiens
tggaaaataaacaaa

SEQ ID NO: 31720 - DNA, 15 bp, Homo sapiens
gtggaaaataaacaa

SEQ ID NO: 31721 - DNA, 15 bp, Homo sapiens
ggtggaaaataaaca

SEQ ID NO: 31722 - DNA, 15 bp, Homo sapiens
aggtggaaaataaac

SEQ ID NO: 31723 - DNA, 15 bp, Homo sapiens
caggtggaaaataaa

SEQ ID NO: 31724 - DNA, 15 bp, Homo sapiens
ccaggtggaaaataa

SEQ ID NO: 31725 - DNA, 15 bp, Homo sapiens
cccaggtggaaaata

SEQ ID NO: 31726 - DNA, 15 bp, Homo sapiens
gcccaggtggaaaat

SEQ ID NO: 31727 - DNA, 15 bp, Homo sapiens
ggcccaggtggaaaa

SEQ ID NO: 31728 - DNA, 15 bp, Homo sapiens
aggcccaggtggaaa

SEQ ID NO: 31729 - DNA, 15 bp, Homo sapiens
aaggcccaggtggaa

SEQ ID NO: 31730 - DNA, 15 bp, Homo sapiens
taaggcccaggtgga

SEQ ID NO: 31731 - DNA, 15 bp, Homo sapiens
gtaaggcccaggtgg

SEQ ID NO: 31732 - DNA, 15 bp, Homo sapiens
tgtaaggcccaggtg

SEQ ID NO: 31733 - DNA, 15 bp, Homo sapiens
atgtaaggcccaggt

SEQ ID NO: 31734 - DNA, 15 bp, Homo sapiens
gatgtaaggcccagg

SEQ ID NO: 31735 - DNA, 15 bp, Homo sapiens
agatgtaaggcccag

SEQ ID NO: 31736 - DNA, 15 bp, Homo sapiens
aagatgtaaggccca

SEQ ID NO: 31737 - DNA, 15 bp, Homo sapiens
gaagatgtaaggccc

SEQ ID NO: 31738 - DNA, 15 bp, Homo sapiens
ggaagatgtaaggcc

SEQ ID NO: 31739 - DNA, 15 bp, Homo sapiens
gggaagatgtaaggc

SEQ ID NO: 31740 - DNA, 15 bp, Homo sapiens
agggaagatgtaagg

SEQ ID NO: 31741 - DNA, 15 bp, Homo sapiens
gagggaagatgtaag

SEQ ID NO: 31742 - DNA, 15 bp, Homo sapiens
agagggaagatgtaa

SEQ ID NO: 31743 - DNA, 15 bp, Homo sapiens
gagagggaagatgta

SEQ ID NO: 31744 - DNA, 15 bp, Homo sapiens
tgagagggaagatgt

SEQ ID NO: 31745 - DNA, 15 bp, Homo sapiens
ttgagagggaagatg

SEQ ID NO: 31746 - DNA, 15 bp, Homo sapiens
cttgagagggaagat

SEQ ID NO: 31747 - DNA, 15 bp, Homo sapiens
tcttgagagggaaga

SEQ ID NO: 31748 - DNA, 15 bp, Homo sapiens
gtcttgagagggaag

SEQ ID NO: 31749 - DNA, 15 bp, Homo sapiens
tgtcttgagagggaa

SEQ ID NO: 31750 - DNA, 15 bp, Homo sapiens
ctgtcttgagaggga

SEQ ID NO: 31751 - DNA, 15 bp, Homo sapiens
gctgtcttgagaggg

SEQ ID NO: 31752 - DNA, 15 bp, Homo sapiens
cgctgtcttgagagg

SEQ ID NO: 31753 - DNA, 15 bp, Homo sapiens
acgctgtcttgagag

SEQ ID NO: 31754 - DNA, 15 bp, Homo sapiens
gacgctgtcttgaga

SEQ ID NO: 31755 - DNA, 15 bp, Homo sapiens
agacgctgtcttgag

SEQ ID NO: 31756 - DNA, 15 bp, Homo sapiens
tagacgctgtcttga

SEQ ID NO: 31757 - DNA, 15 bp, Homo sapiens
ctagacgctgtcttg

SEQ ID NO: 31758 - DNA, 15 bp, Homo sapiens
cctagacgctgtctt

SEQ ID NO: 31759 - DNA, 15 bp, Homo sapiens
acctagacgctgtct

SEQ ID NO: 31760 - DNA, 15 bp, Homo sapiens
gacctagacgctgtc

SEQ ID NO: 31761 - DNA, 15 bp, Homo sapiens
ggacctagacgctgt

SEQ ID NO: 31762 - DNA, 15 bp, Homo sapiens
gggacctagacgctg

SEQ ID NO: 31763 - DNA, 15 bp, Homo sapiens
tgggacctagacgct

SEQ ID NO: 31764 - DNA, 15 bp, Homo sapiens
ttgggacctagacgc

SEQ ID NO: 31765 - DNA, 15 bp, Homo sapiens
gttgggacctagacg

SEQ ID NO: 31766 - DNA, 15 bp, Homo sapiens
agttgggacctagac

SEQ ID NO: 31767 - DNA, 15 bp, Homo sapiens
gagttgggacctaga

SEQ ID NO: 31768 - DNA, 15 bp, Homo sapiens
tgagttgggacctag

SEQ ID NO: 31769 - DNA, 15 bp, Homo sapiens
ctgagttgggaccta

SEQ ID NO: 31770 - DNA, 15 bp, Homo sapiens
actgagttgggacct

SEQ ID NO: 31771 - DNA, 15 bp, Homo sapiens
aactgagttgggacc

SEQ ID NO: 31772 - DNA, 15 bp, Homo sapiens
caactgagttgggac

SEQ ID NO: 31773 - DNA, 15 bp, Homo sapiens
ccaactgagttggga

SEQ ID NO: 31774 - DNA, 15 bp, Homo sapiens
accaactgagttggg

SEQ ID NO: 31775 - DNA, 15 bp, Homo sapiens
taccaactgagttgg

SEQ ID NO: 31776 - DNA, 15 bp, Homo sapiens
ctaccaactgagttg

SEQ ID NO: 31777 - DNA, 15 bp, Homo sapiens
cctaccaactgagtt

SEQ ID NO: 31778 - DNA, 15 bp, Homo sapiens
tcctaccaactgagt

SEQ ID NO: 31779 - DNA, 15 bp, Homo sapiens
ttcctaccaactgag

SEQ ID NO: 31780 - DNA, 15 bp, Homo sapiens
attcctaccaactga

SEQ ID NO: 31781 - DNA, 15 bp, Homo sapiens
aattcctaccaactg

SEQ ID NO: 31782 - DNA, 15 bp, Homo sapiens
aaattcctaccaact

SEQ ID NO: 31783 - DNA, 15 bp, Homo sapiens
caaattcctaccaac

SEQ ID NO: 31784 - DNA, 15 bp, Homo sapiens
acaaattcctaccaa

SEQ ID NO: 31785 - DNA, 15 bp, Homo sapiens
cacaaattcctacca

SEQ ID NO: 31786 - DNA, 15 bp, Homo sapiens
gcacaaattcctacc

SEQ ID NO: 31787 - DNA, 15 bp, Homo sapiens
tgcacaaattcctac

SEQ ID NO: 31788 - DNA, 15 bp, Homo sapiens
ctgcacaaattccta

SEQ ID NO: 31789 - DNA, 15 bp, Homo sapiens
actgcacaaattcct

SEQ ID NO: 31790 - DNA, 15 bp, Homo sapiens
tactgcacaaattcc

SEQ ID NO: 31791 - DNA, 15 bp, Homo sapiens
ctactgcacaaattc

SEQ ID NO: 31792 - DNA, 15 bp, Homo sapiens
gctactgcacaaatt

SEQ ID NO: 31793 - DNA, 15 bp, Homo sapiens
tgctactgcacaaat

SEQ ID NO: 31794 - DNA, 15 bp, Homo sapiens
ttgctactgcacaaa

SEQ ID NO: 31795 - DNA, 15 bp, Homo sapiens
tttgctactgcacaa

SEQ ID NO: 31796 - DNA, 15 bp, Homo sapiens
gtttgctactgcaca

SEQ ID NO: 31797 - DNA, 15 bp, Homo sapiens
ggtttgctactgcac

SEQ ID NO: 31798 - DNA, 15 bp, Homo sapiens
aggtttgctactgca

SEQ ID NO: 31799 - DNA, 15 bp, Homo sapiens
caggtttgctactgc

SEQ ID NO: 31800 - DNA, 15 bp, Homo sapiens
gcaggtttgctactg

SEQ ID NO: 31801 - DNA, 15 bp, Homo sapiens
tgcaggtttgctact

SEQ ID NO: 31802 - DNA, 15 bp, Homo sapiens
ctgcaggtttgctac

SEQ ID NO: 31803 - DNA, 15 bp, Homo sapiens
tctgcaggtttgcta

SEQ ID NO: 31804 - DNA, 15 bp, Homo sapiens
atctgcaggtttgct

SEQ ID NO: 31805 - DNA, 15 bp, Homo sapiens
catctgcaggtttgc

SEQ ID NO: 31806 - DNA, 15 bp, Homo sapiens
ccatctgcaggtttg

SEQ ID NO: 31807 - DNA, 15 bp, Homo sapiens
cccatctgcaggttt

SEQ ID NO: 31808 - DNA, 15 bp, Homo sapiens
gcccatctgcaggtt

SEQ ID NO: 31809 - DNA, 15 bp, Homo sapiens
tgcccatctgcaggt

SEQ ID NO: 31810 - DNA, 15 bp, Homo sapiens
ctgcccatctgcagg

SEQ ID NO: 31811 - DNA, 15 bp, Homo sapiens
tctgcccatctgcag

SEQ ID NO: 31812 - DNA, 15 bp, Homo sapiens
ctctgcccatctgca

SEQ ID NO: 31813 - DNA, 15 bp, Homo sapiens
tctctgcccatctgc

SEQ ID NO: 31814 - DNA, 15 bp, Homo sapiens
atctctgcccatctg

SEQ ID NO: 31815 - DNA, 15 bp, Homo sapiens
tatctctgcccatct

SEQ ID NO: 31816 - DNA, 15 bp, Homo sapiens
gtatctctgcccatc

SEQ ID NO: 31817 - DNA, 15 bp, Homo sapiens
tgtatctctgcccat

SEQ ID NO: 31818 - DNA, 15 bp, Homo sapiens
ttgtatctctgccca

SEQ ID NO: 31819 - DNA, 15 bp, Homo sapiens
tttgtatctctgccc

SEQ ID NO: 31820 - DNA, 15 bp, Homo sapiens
gtttgtatctctgcc

SEQ ID NO: 31821 - DNA, 15 bp, Homo sapiens
agtttgtatctctgc

SEQ ID NO: 31822 - DNA, 15 bp, Homo sapiens
gagtttgtatctctg

SEQ ID NO: 31823 - DNA, 15 bp, Homo sapiens
tgagtttgtatctct

SEQ ID NO: 31824 - DNA, 15 bp, Homo sapiens
gtgagtttgtatctc

SEQ ID NO: 31825 - DNA, 15 bp, Homo sapiens
agtgagtttgtatct

SEQ ID NO: 31826 - DNA, 15 bp, Homo sapiens
gagtgagtttgtatc

SEQ ID NO: 31827 - DNA, 15 bp, Homo sapiens
tgagtgagtttgtat

SEQ ID NO: 31828 - DNA, 15 bp, Homo sapiens
ttgagtgagtttgta

SEQ ID NO: 31829 - DNA, 15 bp, Homo sapiens
gttgagtgagtttgt

SEQ ID NO: 31830 - DNA, 15 bp, Homo sapiens
agttgagtgagtttg

SEQ ID NO: 31831 - DNA, 15 bp, Homo sapiens
gagttgagtgagttt

SEQ ID NO: 31832 - DNA, 15 bp, Homo sapiens
tgagttgagtgagtt

SEQ ID NO: 31833 - DNA, 15 bp, Homo sapiens
gtgagttgagtgagt

SEQ ID NO: 31834 - DNA, 15 bp, Homo sapiens
tgtgagttgagtgag

SEQ ID NO: 31835 - DNA, 15 bp, Homo sapiens
atgtgagttgagtga

SEQ ID NO: 31836 - DNA, 15 bp, Homo sapiens
aatgtgagttgagtg

SEQ ID NO: 31837 - DNA, 15 bp, Homo sapiens
taatgtgagttgagt

SEQ ID NO: 31838 - DNA, 15 bp, Homo sapiens
gtaatgtgagttgag

SEQ ID NO: 31839 - DNA, 15 bp, Homo sapiens
tgtaatgtgagttga

SEQ ID NO: 31840 - DNA, 15 bp, Homo sapiens
ctgtaatgtgagttg

SEQ ID NO: 31841 - DNA, 15 bp, Homo sapiens
actgtaatgtgagtt

SEQ ID NO: 31842 - DNA, 15 bp, Homo sapiens
gactgtaatgtgagt

SEQ ID NO: 31843 - DNA, 15 bp, Homo sapiens
agactgtaatgtgag

SEQ ID NO: 31844 - DNA, 15 bp, Homo sapiens
aagactgtaatgtga

SEQ ID NO: 31845 - DNA, 15 bp, Homo sapiens
aaagactgtaatgtg

SEQ ID NO: 31846 - DNA, 15 bp, Homo sapiens
gaaagactgtaatgt

SEQ ID NO: 31847 - DNA, 15 bp, Homo sapiens
ggaaagactgtaatg

SEQ ID NO: 31848 - DNA, 15 bp, Homo sapiens
gggaaagactgtaat

SEQ ID NO: 31849 - DNA, 15 bp, Homo sapiens
agggaaagactgtaa

SEQ ID NO: 31850 - DNA, 15 bp, Homo sapiens
cagggaaagactgta

SEQ ID NO: 31851 - DNA, 15 bp, Homo sapiens
acagggaaagactgt

SEQ ID NO: 31852 - DNA, 15 bp, Homo sapiens
gacagggaaagactg

SEQ ID NO: 31853 - DNA, 15 bp, Homo sapiens
agacagggaaagact

SEQ ID NO: 31854 - DNA, 15 bp, Homo sapiens
tagacagggaaagac

SEQ ID NO: 31855 - DNA, 15 bp, Homo sapiens
ttagacagggaaaga

SEQ ID NO: 31856 - DNA, 15 bp, Homo sapiens
tttagacagggaaag

SEQ ID NO: 31857 - DNA, 15 bp, Homo sapiens
ttttagacagggaaa

SEQ ID NO: 31858 - DNA, 15 bp, Homo sapiens
gttttagacagggaa

SEQ ID NO: 31859 - DNA, 15 bp, Homo sapiens
tgttttagacaggga

SEQ ID NO: 31860 - DNA, 15 bp, Homo sapiens
ttgttttagacaggg

SEQ ID NO: 31861 - DNA, 15 bp, Homo sapiens
tttgttttagacagg

SEQ ID NO: 31862 - DNA, 15 bp, Homo sapiens
cttgtttgttttaga

SEQ ID NO: 31863 - DNA, 15 bp, Homo sapiens
tcttgtttgttttag

SEQ ID NO: 31864 - DNA, 15 bp, Homo sapiens
ttcttgtttgtttta

SEQ ID NO: 31865 - DNA, 15 bp, Homo sapiens
tttcttgtttgtttt

SEQ ID NO: 31866 - DNA, 15 bp, Homo sapiens
ttttcttgtttgttt

SEQ ID NO: 31867 - DNA, 15 bp, Homo sapiens
gttttcttgtttgtt

SEQ ID NO: 31868 - DNA, 15 bp, Homo sapiens
tgttttcttgtttgt

SEQ ID NO: 31869 - DNA, 15 bp, Homo sapiens
ttgttttcttgtttg

SEQ ID NO: 31870 - DNA, 15 bp, Homo sapiens
tttgttttcttgttt

SEQ ID NO: 31871 - DNA, 15 bp, Homo sapiens
ttttgttttcttgtt

SEQ ID NO: 31872 - DNA, 15 bp, Homo sapiens
gttttgttttcttgt

SEQ ID NO: 31873 - DNA, 15 bp, Homo sapiens
tgttttgttttcttg

SEQ ID NO: 31874 - DNA, 15 bp, Homo sapiens
ttgttttgttttctt

SEQ ID NO: 31875 - DNA, 15 bp, Homo sapiens
tttgttttgttttct

SEQ ID NO: 31876 - DNA, 15 bp, Homo sapiens
ttttgttttgttttc

SEQ ID NO: 31877 - DNA, 15 bp, Homo sapiens
tttttgttttgtttt

SEQ ID NO: 31878 - DNA, 15 bp, Homo sapiens
cttttttgttttgtt

SEQ ID NO: 31879 - DNA, 15 bp, Homo sapiens
ccttttttgttttgt

SEQ ID NO: 31880 - DNA, 15 bp, Homo sapiens
cccttttttgttttg

SEQ ID NO: 31881 - DNA, 15 bp, Homo sapiens
tcccttttttgtttt

SEQ ID NO: 31882 - DNA, 15 bp, Homo sapiens
ctcccttttttgttt

SEQ ID NO: 31883 - DNA, 15 bp, Homo sapiens
tctcccttttttgtt

SEQ ID NO: 31884 - DNA, 15 bp, Homo sapiens
ctctcccttttttgt

SEQ ID NO: 31885 - DNA, 15 bp, Homo sapiens
tctctcccttttttg

SEQ ID NO: 31886 - DNA, 15 bp, Homo sapiens
atctctccctttttt

SEQ ID NO: 31887 - DNA, 15 bp, Homo sapiens
gatctctcccttttt

SEQ ID NO: 31888 - DNA, 15 bp, Homo sapiens
tgatctctccctttt

SEQ ID NO: 31889 - DNA, 15 bp, Homo sapiens
atgatctctcccttt

SEQ ID NO: 31890 - DNA, 15 bp, Homo sapiens
tatgatctctccctt

SEQ ID NO: 31891 - DNA, 15 bp, Homo sapiens
atatgatctctccct

SEQ ID NO: 31892 - DNA, 15 bp, Homo sapiens
tatatgatctctccc

SEQ ID NO: 31893 - DNA, 15 bp, Homo sapiens
ctatatgatctctcc

SEQ ID NO: 31894 - DNA, 15 bp, Homo sapiens
cctatatgatctctc

SEQ ID NO: 31895 - DNA, 15 bp, Homo sapiens
gcctatatgatctct

SEQ ID NO: 31896 - DNA, 15 bp, Homo sapiens
cgcctatatgatctc

SEQ ID NO: 31897 - DNA, 15 bp, Homo sapiens
acgcctatatgatct

SEQ ID NO: 31898 - DNA, 15 bp, Homo sapiens
cacgcctatatgatc

SEQ ID NO: 31899 - DNA, 15 bp, Homo sapiens
acacgcctatatgat

SEQ ID NO: 31900 - DNA, 15 bp, Homo sapiens
tacacgcctatatga

SEQ ID NO: 31901 - DNA, 15 bp, Homo sapiens
atacacgcctatatg

SEQ ID NO: 31902 - DNA, 15 bp, Homo sapiens
tatacacgcctatat

SEQ ID NO: 31903 - DNA, 15 bp, Homo sapiens
atatacacgcctata

SEQ ID NO: 31904 - DNA, 15 bp, Homo sapiens
tatatacacgcctat

SEQ ID NO: 31905 - DNA, 15 bp, Homo sapiens
atatatacacgccta

SEQ ID NO: 31906 - DNA, 15 bp, Homo sapiens
tatatatacacgcct

SEQ ID NO: 31907 - DNA, 15 bp, Homo sapiens
gtatatatacacgcc

SEQ ID NO: 31908 - DNA, 15 bp, Homo sapiens
tgtatatatacacgc

SEQ ID NO: 31909 - DNA, 15 bp, Homo sapiens
ttgtatatatacacg

SEQ ID NO: 31910 - DNA, 15 bp, Homo sapiens
attgtatatatacac

SEQ ID NO: 31911 - DNA, 15 bp, Homo sapiens
tattgtatatataca

SEQ ID NO: 31912 - DNA, 15 bp, Homo sapiens
atattgtatatatac

SEQ ID NO: 31913 - DNA, 15 bp, Homo sapiens
aatattgtatatata

SEQ ID NO: 31914 - DNA, 15 bp, Homo sapiens
aaatattgtatatat

SEQ ID NO: 31915 - DNA, 15 bp, Homo sapiens
aaaatattgtatata

SEQ ID NO: 31916 - DNA, 15 bp, Homo sapiens
caaaatattgtatat

SEQ ID NO: 31917 - DNA, 15 bp, Homo sapiens
acaaaatattgtata

SEQ ID NO: 31918 - DNA, 15 bp, Homo sapiens
aacaaaatattgtat

SEQ ID NO: 31919 - DNA, 15 bp, Homo sapiens
taacaaaatattgta

SEQ ID NO: 31920 - DNA, 15 bp, Homo sapiens
ataacaaaatattgt

SEQ ID NO: 31921 - DNA, 15 bp, Homo sapiens
tataacaaaatattg

SEQ ID NO: 31922 - DNA, 15 bp, Homo sapiens
ctataacaaaatatt

SEQ ID NO: 31923 - DNA, 15 bp, Homo sapiens
tctataacaaaatat

SEQ ID NO: 31924 - DNA, 15 bp, Homo sapiens
atctataacaaaata

SEQ ID NO: 31925 - DNA, 15 bp, Homo sapiens
tatctataacaaaat

SEQ ID NO: 31926 - DNA, 15 bp, Homo sapiens
ttatctataacaaaa

SEQ ID NO: 31927 - DNA, 15 bp, Homo sapiens
cttatctataacaaa

SEQ ID NO: 31928 - DNA, 15 bp, Homo sapiens
ccttatctataacaa

SEQ ID NO: 31929 - DNA, 15 bp, Homo sapiens
tccttatctataaca

SEQ ID NO: 31930 - DNA, 15 bp, Homo sapiens
ttccttatctataac

SEQ ID NO: 31931 - DNA, 15 bp, Homo sapiens
gttccttatctataa

SEQ ID NO: 31932 - DNA, 15 bp, Homo sapiens
tgttccttatctata

SEQ ID NO: 31933 - DNA, 15 bp, Homo sapiens
ttgttccttatctat

SEQ ID NO: 31934 - DNA, 15 bp, Homo sapiens
tttgttccttatcta

SEQ ID NO: 31935 - DNA, 15 bp, Homo sapiens
ctttgttccttatct

SEQ ID NO: 31936 - DNA, 15 bp, Homo sapiens
actttgttccttatc

SEQ ID NO: 31937 - DNA, 15 bp, Homo sapiens
tactttgttccttat

SEQ ID NO: 31938 - DNA, 15 bp, Homo sapiens
gtactttgttcctta

SEQ ID NO: 31939 - DNA, 15 bp, Homo sapiens
ggtactttgttcctt

SEQ ID NO: 31940 - DNA, 15 bp, Homo sapiens
tggtactttgttcct

SEQ ID NO: 31941 - DNA, 15 bp, Homo sapiens
atggtactttgttcc

SEQ ID NO: 31942 - DNA, 15 bp, Homo sapiens
tatggtactttgttc

SEQ ID NO: 31943 - DNA, 15 bp, Homo sapiens
atatggtactttgtt

SEQ ID NO: 31944 - DNA, 15 bp, Homo sapiens
catatggtactttgt

SEQ ID NO: 31945 - DNA, 15 bp, Homo sapiens
tcatatggtactttg

SEQ ID NO: 31946 - DNA, 15 bp, Homo sapiens
ttcatatggtacttt

SEQ ID NO: 31947 - DNA, 15 bp, Homo sapiens
attcatatggtactt

SEQ ID NO: 31948 - DNA, 15 bp, Homo sapiens
aattcatatggtact

SEQ ID NO: 31949 - DNA, 15 bp, Homo sapiens
gaattcatatggtac

SEQ ID NO: 31950 - DNA, 15 bp, Homo sapiens
tgaattcatatggta

SEQ ID NO: 31951 - DNA, 15 bp, Homo sapiens
ttgaattcatatggt

SEQ ID NO: 31952 - DNA, 15 bp, Homo sapiens
tttgaattcatatgg

SEQ ID NO: 31953 - DNA, 15 bp, Homo sapiens
ttttgaattcatatg

SEQ ID NO: 31954 - DNA, 15 bp, Homo sapiens
cttttgaattcatat

SEQ ID NO: 31955 - DNA, 15 bp, Homo sapiens
ccttttgaattcata

SEQ ID NO: 31956 - DNA, 15 bp, Homo sapiens
accttttgaattcat

SEQ ID NO: 31957 - DNA, 15 bp, Homo sapiens
caccttttgaattca

SEQ ID NO: 31958 - DNA, 15 bp, Homo sapiens
tcaccttttgaattc

SEQ ID NO: 31959 - DNA, 15 bp, Homo sapiens
ctcaccttttgaatt

SEQ ID NO: 31960 - DNA, 15 bp, Homo sapiens
cctcaccttttgaat

SEQ ID NO: 31961 - DNA, 15 bp, Homo sapiens
ccctcaccttttgaa

SEQ ID NO: 31962 - DNA, 15 bp, Homo sapiens
accctcaccttttga

SEQ ID NO: 31963 - DNA, 15 bp, Homo sapiens
caccctcaccttttg

SEQ ID NO: 31964 - DNA, 15 bp, Homo sapiens
ccaccctcacctttt

SEQ ID NO: 31965 - DNA, 15 bp, Homo sapiens
cccaccctcaccttt

SEQ ID NO: 31966 - DNA, 15 bp, Homo sapiens
tcccaccctcacctt

SEQ ID NO: 31967 - DNA, 15 bp, Homo sapiens
atcccaccctcacct

SEQ ID NO: 31968 - DNA, 15 bp, Homo sapiens
catcccaccctcacc

SEQ ID NO: 31969 - DNA, 15 bp, Homo sapiens
ccatcccaccctcac

SEQ ID NO: 31970 - DNA, 15 bp, Homo sapiens
cccatcccaccctca

SEQ ID NO: 31971 - DNA, 15 bp, Homo sapiens
acccatcccaccctc

SEQ ID NO: 31972 - DNA, 15 bp, Homo sapiens
aacccatcccaccct

SEQ ID NO: 31973 - DNA, 15 bp, Homo sapiens
aaacccatcccaccc

SEQ ID NO: 31974 - DNA, 15 bp, Homo sapiens
taaacccatcccacc

SEQ ID NO: 31975 - DNA, 15 bp, Homo sapiens
ctaaacccatcccac

SEQ ID NO: 31976 - DNA, 15 bp, Homo sapiens
tctaaacccatccca

SEQ ID NO: 31977 - DNA, 15 bp, Homo sapiens
ctctaaacccatccc

SEQ ID NO: 31978 - DNA, 15 bp, Homo sapiens
gctctaaacccatcc

SEQ ID NO: 31979 - DNA, 15 bp, Homo sapiens
agctctaaacccatc

SEQ ID NO: 31980 - DNA, 15 bp, Homo sapiens
cagctctaaacccat

SEQ ID NO: 31981 - DNA, 15 bp, Homo sapiens
ccagctctaaaccca

SEQ ID NO: 31982 - DNA, 15 bp, Homo sapiens
cccagctctaaaccc

SEQ ID NO: 31983 - DNA, 15 bp, Homo sapiens
tcccagctctaaacc

SEQ ID NO: 31984 - DNA, 15 bp, Homo sapiens
ctcccagctctaaac

SEQ ID NO: 31985 - DNA, 15 bp, Homo sapiens
tctcccagctctaaa

SEQ ID NO: 31986 - DNA, 15 bp, Homo sapiens
ctctcccagctctaa

SEQ ID NO: 31987 - DNA, 15 bp, Homo sapiens
tctctcccagctcta

SEQ ID NO: 31988 - DNA, 15 bp, Homo sapiens
ttctctcccagctct

SEQ ID NO: 31989 - DNA, 15 bp, Homo sapiens
tttctctcccagctc

SEQ ID NO: 31990 - DNA, 15 bp, Homo sapiens
gtttctctcccagct

SEQ ID NO: 31991 - DNA, 15 bp, Homo sapiens
ggtttctctcccagc

SEQ ID NO: 31992 - DNA, 15 bp, Homo sapiens
tggtttctctcccag

SEQ ID NO: 31993 - DNA, 15 bp, Homo sapiens
atggtttctctccca

SEQ ID NO: 31994 - DNA, 15 bp, Homo sapiens
gatggtttctctccc

SEQ ID NO: 31995 - DNA, 15 bp, Homo sapiens
agatggtttctctcc

SEQ ID NO: 31996 - DNA, 15 bp, Homo sapiens
tagatggtttctctc

SEQ ID NO: 31997 - DNA, 15 bp, Homo sapiens
ttagatggtttctct

SEQ ID NO: 31998 - DNA, 15 bp, Homo sapiens
tttagatggtttctc

SEQ ID NO: 31999 - DNA, 15 bp, Homo sapiens
ctttagatggtttct

SEQ ID NO: 32000 - DNA, 15 bp, Homo sapiens
gctttagatggtttc

SEQ ID NO: 32001 - DNA, 15 bp, Homo sapiens
ggctttagatggttt

SEQ ID NO: 32002 - DNA, 15 bp, Homo sapiens
aggctttagatggtt

SEQ ID NO: 32003 - DNA, 15 bp, Homo sapiens
aaggctttagatggt

SEQ ID NO: 32004 - DNA, 15 bp, Homo sapiens
gaaggctttagatgg

SEQ ID NO: 32005 - DNA, 15 bp, Homo sapiens
tgaaggctttagatg

SEQ ID NO: 32006 - DNA, 15 bp, Homo sapiens
atgaaggctttagat

SEQ ID NO: 32007 - DNA, 15 bp, Homo sapiens
catgaaggctttaga

SEQ ID NO: 32008 - DNA, 15 bp, Homo sapiens
tcatgaaggctttag

SEQ ID NO: 32009 - DNA, 15 bp, Homo sapiens
ttcatgaaggcttta

SEQ ID NO: 32010 - DNA, 15 bp, Homo sapiens
tttcatgaaggcttt

SEQ ID NO: 32011 - DNA, 15 bp, Homo sapiens
ctttcatgaaggctt

SEQ ID NO: 32012 - DNA, 15 bp, Homo sapiens
cctttcatgaaggct

SEQ ID NO: 32013 - DNA, 15 bp, Homo sapiens
ccctttcatgaaggc

SEQ ID NO: 32014 - DNA, 15 bp, Homo sapiens
cccctttcatgaagg

SEQ ID NO: 32015 - DNA, 15 bp, Homo sapiens
ccccctttcatgaag

SEQ ID NO: 32016 - DNA, 15 bp, Homo sapiens
accccctttcatgaa

SEQ ID NO: 32017 - DNA, 15 bp, Homo sapiens
taccccctttcatga

SEQ ID NO: 32018 - DNA, 15 bp, Homo sapiens
gtaccccctttcatg

SEQ ID NO: 32019 - DNA, 15 bp, Homo sapiens
ggtaccccctttcat

SEQ ID NO: 32020 - DNA, 15 bp, Homo sapiens
tggtaccccctttca

SEQ ID NO: 32021 - DNA, 15 bp, Homo sapiens
atggtaccccctttc

SEQ ID NO: 32022 - DNA, 15 bp, Homo sapiens
aatggtacccccttt

SEQ ID NO: 32023 - DNA, 15 bp, Homo sapiens
aaatggtaccccctt

SEQ ID NO: 32024 - DNA, 15 bp, Homo sapiens
caaatggtaccccct

SEQ ID NO: 32025 - DNA, 15 bp, Homo sapiens
gcaaatggtaccccc

SEQ ID NO: 32026 - DNA, 15 bp, Homo sapiens
agcaaatggtacccc

SEQ ID NO: 32027 - DNA, 15 bp, Homo sapiens
cagcaaatggtaccc

SEQ ID NO: 32028 - DNA, 15 bp, Homo sapiens
acagcaaatggtacc

SEQ ID NO: 32029 - DNA, 15 bp, Homo sapiens
cacagcaaatggtac

SEQ ID NO: 32030 - DNA, 15 bp, Homo sapiens
ccacagcaaatggta

SEQ ID NO: 32031 - DNA, 15 bp, Homo sapiens
tccacagcaaatggt

SEQ ID NO: 32032 - DNA, 15 bp, Homo sapiens
atccacagcaaatgg

SEQ ID NO: 32033 - DNA, 15 bp, Homo sapiens
tatccacagcaaatg

SEQ ID NO: 32034 - DNA, 15 bp, Homo sapiens
gtatccacagcaaat

SEQ ID NO: 32035 - DNA, 15 bp, Homo sapiens
agtatccacagcaaa

SEQ ID NO: 32036 - DNA, 15 bp, Homo sapiens
cagtatccacagcaa

SEQ ID NO: 32037 - DNA, 15 bp, Homo sapiens
tcagtatccacagca

SEQ ID NO: 32038 - DNA, 15 bp, Homo sapiens
atcagtatccacagc

SEQ ID NO: 32039 - DNA, 15 bp, Homo sapiens
catcagtatccacag

SEQ ID NO: 32040 - DNA, 15 bp, Homo sapiens
ccatcagtatccaca

SEQ ID NO: 32041 - DNA, 15 bp, Homo sapiens
gccatcagtatccac

SEQ ID NO: 32042 - DNA, 15 bp, Homo sapiens
tgccatcagtatcca

SEQ ID NO: 32043 - DNA, 15 bp, Homo sapiens
ttgccatcagtatcc

SEQ ID NO: 32044 - DNA, 15 bp, Homo sapiens
attgccatcagtatc

SEQ ID NO: 32045 - DNA, 15 bp, Homo sapiens
cattgccatcagtat

SEQ ID NO: 32046 - DNA, 15 bp, Homo sapiens
acattgccatcagta

SEQ ID NO: 32047 - DNA, 15 bp, Homo sapiens
aacattgccatcagt

SEQ ID NO: 32048 - DNA, 15 bp, Homo sapiens
caacattgccatcag

SEQ ID NO: 32049 - DNA, 15 bp, Homo sapiens
ccaacattgccatca

SEQ ID NO: 32050 - DNA, 15 bp, Homo sapiens
cccaacattgccatc

SEQ ID NO: 32051 - DNA, 15 bp, Homo sapiens
ccccaacattgccat

SEQ ID NO: 32052 - DNA, 15 bp, Homo sapiens
gccccaacattgcca

SEQ ID NO: 32053 - DNA, 15 bp, Homo sapiens
agccccaacattgcc

SEQ ID NO: 32054 - DNA, 15 bp, Homo sapiens
cagccccaacattgc

SEQ ID NO: 32055 - DNA, 15 bp, Homo sapiens
ccagccccaacattg

SEQ ID NO: 32056 - DNA, 15 bp, Homo sapiens
tccagccccaacatt

SEQ ID NO: 32057 - DNA, 15 bp, Homo sapiens
ctccagccccaacat

SEQ ID NO: 32058 - DNA, 15 bp, Homo sapiens
cctccagccccaaca

SEQ ID NO: 32059 - DNA, 15 bp, Homo sapiens
tcctccagccccaac

SEQ ID NO: 32060 - DNA, 15 bp, Homo sapiens
ttcctccagccccaa

SEQ ID NO: 32061 - DNA, 15 bp, Homo sapiens
tttcctccagcccca

SEQ ID NO: 32062 - DNA, 15 bp, Homo sapiens
ttttcctccagcccc

SEQ ID NO: 32063 - DNA, 15 bp, Homo sapiens
attttcctccagccc

SEQ ID NO: 32064 - DNA, 15 bp, Homo sapiens
cattttcctccagcc

SEQ ID NO: 32065 - DNA, 15 bp, Homo sapiens
acattttcctccagc

SEQ ID NO: 32066 - DNA, 15 bp, Homo sapiens
aacattttcctccag

SEQ ID NO: 32067 - DNA, 15 bp, Homo sapiens
gaacattttcctcca

SEQ ID NO: 32068 - DNA, 15 bp, Homo sapiens
ggaacattttcctcc

SEQ ID NO: 32069 - DNA, 15 bp, Homo sapiens
tggaacattttcctc

SEQ ID NO: 32070 - DNA, 15 bp, Homo sapiens
ctggaacattttcct

SEQ ID NO: 32071 - DNA, 15 bp, Homo sapiens
cctggaacattttcc

SEQ ID NO: 32072 - DNA, 15 bp, Homo sapiens
acctggaacattttc

SEQ ID NO: 32073 - DNA, 15 bp, Homo sapiens
tacctggaacatttt

SEQ ID NO: 32074 - DNA, 15 bp, Homo sapiens
ctacctggaacattt

SEQ ID NO: 32075 - DNA, 15 bp, Homo sapiens
tctacctggaacatt

SEQ ID NO: 32076 - DNA, 15 bp, Homo sapiens
ctctacctggaacat

SEQ ID NO: 32077 - DNA, 15 bp, Homo sapiens
cctctacctggaaca

SEQ ID NO: 32078 - DNA, 15 bp, Homo sapiens
ccctctacctggaac

SEQ ID NO: 32079 - DNA, 15 bp, Homo sapiens
gccctctacctggaa

SEQ ID NO: 32080 - DNA, 15 bp, Homo sapiens
tgccctctacctgga

SEQ ID NO: 32081 - DNA, 15 bp, Homo sapiens
gtgccctctacctgg

SEQ ID NO: 32082 - DNA, 15 bp, Homo sapiens
tgtgccctctacctg

SEQ ID NO: 32083 - DNA, 15 bp, Homo sapiens
ctgtgccctctacct

SEQ ID NO: 32084 - DNA, 15 bp, Homo sapiens
tctgtgccctctacc

SEQ ID NO: 32085 - DNA, 15 bp, Homo sapiens
ttctgtgccctctac

SEQ ID NO: 32086 - DNA, 15 bp, Homo sapiens
attctgtgccctcta

SEQ ID NO: 32087 - DNA, 15 bp, Homo sapiens
aattctgtgccctct

SEQ ID NO: 32088 - DNA, 15 bp, Homo sapiens
taattctgtgccctc

SEQ ID NO: 32089 - DNA, 15 bp, Homo sapiens
ttaattctgtgccct

SEQ ID NO: 32090 - DNA, 15 bp, Homo sapiens
attaattctgtgccc

SEQ ID NO: 32091 - DNA, 15 bp, Homo sapiens
tattaattctgtgcc

SEQ ID NO: 32092 - DNA, 15 bp, Homo sapiens
ctattaattctgtgc

SEQ ID NO: 32093 - DNA, 15 bp, Homo sapiens
cctattaattctgtg

SEQ ID NO: 32094 - DNA, 15 bp, Homo sapiens
ccctattaattctgt

SEQ ID NO: 32095 - DNA, 15 bp, Homo sapiens
cccctattaattctg

SEQ ID NO: 32096 - DNA, 15 bp, Homo sapiens
ccccctattaattct

SEQ ID NO: 32097 - DNA, 15 bp, Homo sapiens
accccctattaattc

SEQ ID NO: 32098 - DNA, 15 bp, Homo sapiens
taccccctattaatt

SEQ ID NO: 32099 - DNA, 15 bp, Homo sapiens
ctaccccctattaat

SEQ ID NO: 32100 - DNA, 15 bp, Homo sapiens
gctaccccctattaa

SEQ ID NO: 32101 - DNA, 15 bp, Homo sapiens
agctaccccctatta

SEQ ID NO: 32102 - DNA, 15 bp, Homo sapiens
tagctaccccctatt

SEQ ID NO: 32103 - DNA, 15 bp, Homo sapiens
atagctaccccctat

SEQ ID NO: 32104 - DNA, 15 bp, Homo sapiens
tatagctacccccta

SEQ ID NO: 32105 - DNA, 15 bp, Homo sapiens
ttatagctaccccct

SEQ ID NO: 32106 - DNA, 15 bp, Homo sapiens
tttatagctaccccc

SEQ ID NO: 32107 - DNA, 15 bp, Homo sapiens
ttttatagctacccc

SEQ ID NO: 32108 - DNA, 15 bp, Homo sapiens
tttttatagctaccc

SEQ ID NO: 32109 - DNA, 15 bp, Homo sapiens
ctttttatagctacc

SEQ ID NO: 32110 - DNA, 15 bp, Homo sapiens
gctttttatagctac

SEQ ID NO: 32111 - DNA, 15 bp, Homo sapiens
tgctttttatagcta

SEQ ID NO: 32112 - DNA, 15 bp, Homo sapiens
atgctttttatagct

SEQ ID NO: 32113 - DNA, 15 bp, Homo sapiens
catgctttttatagc

SEQ ID NO: 32114 - DNA, 15 bp, Homo sapiens
gcatgctttttatag

SEQ ID NO: 32115 - DNA, 15 bp, Homo sapiens
agcatgctttttata

SEQ ID NO: 32116 - DNA, 15 bp, Homo sapiens
cagcatgctttttat

SEQ ID NO: 32117 - DNA, 15 bp, Homo sapiens
tcagcatgcttttta

SEQ ID NO: 32118 - DNA, 15 bp, Homo sapiens
ttcagcatgcttttt

SEQ ID NO: 32119 - DNA, 15 bp, Homo sapiens
attcagcatgctttt

SEQ ID NO: 32120 - DNA, 15 bp, Homo sapiens
tattcagcatgcttt

SEQ ID NO: 32121 - DNA, 15 bp, Homo sapiens
gtattcagcatgctt

SEQ ID NO: 32122 - DNA, 15 bp, Homo sapiens
ggtattcagcatgct

SEQ ID NO: 32123 - DNA, 15 bp, Homo sapiens
tggtattcagcatgc

SEQ ID NO: 32124 - DNA, 15 bp, Homo sapiens
atggtattcagcatg

SEQ ID NO: 32125 - DNA, 15 bp, Homo sapiens
catggtattcagcat

SEQ ID NO: 32126 - DNA, 15 bp, Homo sapiens
gcatggtattcagca

SEQ ID NO: 32127 - DNA, 15 bp, Homo sapiens
agcatggtattcagc

SEQ ID NO: 32128 - DNA, 15 bp, Homo sapiens
tagcatggtattcag

SEQ ID NO: 32129 - DNA, 15 bp, Homo sapiens
ctagcatggtattca

SEQ ID NO: 32130 - DNA, 15 bp, Homo sapiens
cctagcatggtattc

SEQ ID NO: 32131 - DNA, 15 bp, Homo sapiens
acctagcatggtatt

SEQ ID NO: 32132 - DNA, 15 bp, Homo sapiens
tacctagcatggtat

SEQ ID NO: 32133 - DNA, 15 bp, Homo sapiens
ctacctagcatggta

SEQ ID NO: 32134 - DNA, 15 bp, Homo sapiens
cctacctagcatggt

SEQ ID NO: 32135 - DNA, 15 bp, Homo sapiens
gcctacctagcatgg

SEQ ID NO: 32136 - DNA, 15 bp, Homo sapiens
tgcctacctagcatg

SEQ ID NO: 32137 - DNA, 15 bp, Homo sapiens
atgcctacctagcat

SEQ ID NO: 32138 - DNA, 15 bp, Homo sapiens
aatgcctacctagca

SEQ ID NO: 32139 - DNA, 15 bp, Homo sapiens
aaatgcctacctagc

SEQ ID NO: 32140 - DNA, 15 bp, Homo sapiens
taaatgcctacctag

SEQ ID NO: 32141 - DNA, 15 bp, Homo sapiens
ctaaatgcctaccta

SEQ ID NO: 32142 - DNA, 15 bp, Homo sapiens
gctaaatgcctacct

SEQ ID NO: 32143 - DNA, 15 bp, Homo sapiens
ggctaaatgcctacc

SEQ ID NO: 32144 - DNA, 15 bp, Homo sapiens
gggctaaatgcctac

SEQ ID NO: 32145 - DNA, 15 bp, Homo sapiens
agggctaaatgccta

SEQ ID NO: 32146 - DNA, 15 bp, Homo sapiens
cagggctaaatgcct

SEQ ID NO: 32147 - DNA, 15 bp, Homo sapiens
acagggctaaatgcc

SEQ ID NO: 32148 - DNA, 15 bp, Homo sapiens
tacagggctaaatgc

SEQ ID NO: 32149 - DNA, 15 bp, Homo sapiens
ctacagggctaaatg

SEQ ID NO: 32150 - DNA, 15 bp, Homo sapiens
gctacagggctaaat

SEQ ID NO: 32151 - DNA, 15 bp, Homo sapiens
tgctacagggctaaa

SEQ ID NO: 32152 - DNA, 15 bp, Homo sapiens
atgctacagggctaa

SEQ ID NO: 32153 - DNA, 15 bp, Homo sapiens
tatgctacagggcta

SEQ ID NO: 32154 - DNA, 15 bp, Homo sapiens
atatgctacagggct

SEQ ID NO: 32155 - DNA, 15 bp, Homo sapiens
tatatgctacagggc

SEQ ID NO: 32156 - DNA, 15 bp, Homo sapiens
ctatatgctacaggg

SEQ ID NO: 32157 - DNA, 15 bp, Homo sapiens
tctatatgctacagg

SEQ ID NO: 32158 - DNA, 15 bp, Homo sapiens
atctatatgctacag

SEQ ID NO: 32159 - DNA, 15 bp, Homo sapiens
catctatatgctaca

SEQ ID NO: 32160 - DNA, 15 bp, Homo sapiens
acatctatatgctac

SEQ ID NO: 32161 - DNA, 15 bp, Homo sapiens
tacatctatatgcta

SEQ ID NO: 32162 - DNA, 15 bp, Homo sapiens
atacatctatatgct

SEQ ID NO: 32163 - DNA, 15 bp, Homo sapiens
gatacatctatatgc

SEQ ID NO: 32164 - DNA, 15 bp, Homo sapiens
agatacatctatatg

SEQ ID NO: 32165 - DNA, 15 bp, Homo sapiens
cagatacatctatat

SEQ ID NO: 32166 - DNA, 15 bp, Homo sapiens
tcagatacatctata

SEQ ID NO: 32167 - DNA, 15 bp, Homo sapiens
ttcagatacatctat

SEQ ID NO: 32168 - DNA, 15 bp, Homo sapiens
attcagatacatcta

SEQ ID NO: 32169 - DNA, 15 bp, Homo sapiens
aattcagatacatct

SEQ ID NO: 32170 - DNA, 15 bp, Homo sapiens
aaattcagatacatc

SEQ ID NO: 32171 - DNA, 15 bp, Homo sapiens
taaattcagatacat

SEQ ID NO: 32172 - DNA, 15 bp, Homo sapiens
ttaaattcagataca

SEQ ID NO: 32173 - DNA, 15 bp, Homo sapiens
tttaaattcagatac

SEQ ID NO: 32174 - DNA, 15 bp, Homo sapiens
ctttaaattcagata

SEQ ID NO: 32175 - DNA, 15 bp, Homo sapiens
cctttaaattcagat

SEQ ID NO: 32176 - DNA, 15 bp, Homo sapiens
gcctttaaattcaga

SEQ ID NO: 32177 - DNA, 15 bp, Homo sapiens
tgcctttaaattcag

SEQ ID NO: 32178 - DNA, 15 bp, Homo sapiens
ctgcctttaaattca

SEQ ID NO: 32179 - DNA, 15 bp, Homo sapiens
actgcctttaaattc

SEQ ID NO: 32180 - DNA, 15 bp, Homo sapiens
cactgcctttaaatt

SEQ ID NO: 32181 - DNA, 15 bp, Homo sapiens
ccactgcctttaaat

SEQ ID NO: 32182 - DNA, 15 bp, Homo sapiens
cccactgcctttaaa

SEQ ID NO: 32183 - DNA, 15 bp, Homo sapiens
acccactgcctttaa

SEQ ID NO: 32184 - DNA, 15 bp, Homo sapiens
cacccactgccttta

SEQ ID NO: 32185 - DNA, 15 bp, Homo sapiens
tcacccactgccttt

SEQ ID NO: 32186 - DNA, 15 bp, Homo sapiens
atcacccactgcctt

SEQ ID NO: 32187 - DNA, 15 bp, Homo sapiens
catcacccactgcct

SEQ ID NO: 32188 - DNA, 15 bp, Homo sapiens
acatcacccactgcc

SEQ ID NO: 32189 - DNA, 15 bp, Homo sapiens
aacatcacccactgc

SEQ ID NO: 32190 - DNA, 15 bp, Homo sapiens
gaacatcacccactg

SEQ ID NO: 32191 - DNA, 15 bp, Homo sapiens
cgaacatcacccact

SEQ ID NO: 32192 - DNA, 15 bp, Homo sapiens
ccgaacatcacccac

SEQ ID NO: 32193 - DNA, 15 bp, Homo sapiens
tccgaacatcaccca

SEQ ID NO: 32194 - DNA, 15 bp, Homo sapiens
ctccgaacatcaccc

SEQ ID NO: 32195 - DNA, 15 bp, Homo sapiens
cctccgaacatcacc

SEQ ID NO: 32196 - DNA, 15 bp, Homo sapiens
acctccgaacatcac

SEQ ID NO: 32197 - DNA, 15 bp, Homo sapiens
aacctccgaacatca

SEQ ID NO: 32198 - DNA, 15 bp, Homo sapiens
aaacctccgaacatc

SEQ ID NO: 32199 - DNA, 15 bp, Homo sapiens
caaacctccgaacat

SEQ ID NO: 32200 - DNA, 15 bp, Homo sapiens
ccaaacctccgaaca

SEQ ID NO: 32201 - DNA, 15 bp, Homo sapiens
tccaaacctccgaac

SEQ ID NO: 32202 - DNA, 15 bp, Homo sapiens
ctccaaacctccgaa

SEQ ID NO: 32203 - DNA, 15 bp, Homo sapiens
gctccaaacctccga

SEQ ID NO: 32204 - DNA, 15 bp, Homo sapiens
tgctccaaacctccg

SEQ ID NO: 32205 - DNA, 15 bp, Homo sapiens
atgctccaaacctcc

SEQ ID NO: 32206 - DNA, 15 bp, Homo sapiens
tatgctccaaacctc

SEQ ID NO: 32207 - DNA, 15 bp, Homo sapiens
ttatgctccaaacct

SEQ ID NO: 32208 - DNA, 15 bp, Homo sapiens
cttatgctccaaacc

SEQ ID NO: 32209 - DNA, 15 bp, Homo sapiens
tcttatgctccaaac

SEQ ID NO: 32210 - DNA, 15 bp, Homo sapiens
atcttatgctccaaa

SEQ ID NO: 32211 - DNA, 15 bp, Homo sapiens
tatcttatgctccaa

SEQ ID NO: 32212 - DNA, 15 bp, Homo sapiens
atatcttatgctcca

SEQ ID NO: 32213 - DNA, 15 bp, Homo sapiens
aatatcttatgctcc

SEQ ID NO: 32214 - DNA, 15 bp, Homo sapiens
aaatatcttatgctc

SEQ ID NO: 32215 - DNA, 15 bp, Homo sapiens
aaaatatcttatgct

SEQ ID NO: 32216 - DNA, 15 bp, Homo sapiens
caaaatatcttatgc

SEQ ID NO: 32217 - DNA, 15 bp, Homo sapiens
acaaaatatcttatg

SEQ ID NO: 32218 - DNA, 15 bp, Homo sapiens
cacaaaatatcttat

SEQ ID NO: 32219 - DNA, 15 bp, Homo sapiens
tcacaaaatatctta

SEQ ID NO: 32220 - DNA, 15 bp, Homo sapiens
atcacaaaatatctt

SEQ ID NO: 32221 - DNA, 15 bp, Homo sapiens
gatcacaaaatatct

SEQ ID NO: 32222 - DNA, 15 bp, Homo sapiens
tgatcacaaaatatc

SEQ ID NO: 32223 - DNA, 15 bp, Homo sapiens
ctgatcacaaaatat

SEQ ID NO: 32224 - DNA, 15 bp, Homo sapiens
tctgatcacaaaata

SEQ ID NO: 32225 - DNA, 15 bp, Homo sapiens
ttctgatcacaaaat

SEQ ID NO: 32226 - DNA, 15 bp, Homo sapiens
cttctgatcacaaaa

SEQ ID NO: 32227 - DNA, 15 bp, Homo sapiens
tcttctgatcacaaa

SEQ ID NO: 32228 - DNA, 15 bp, Homo sapiens
ttcttctgatcacaa

SEQ ID NO: 32229 - DNA, 15 bp, Homo sapiens
cttcttctgatcaca

SEQ ID NO: 32230 - DNA, 15 bp, Homo sapiens
ccttcttctgatcac

SEQ ID NO: 32231 - DNA, 15 bp, Homo sapiens
accttcttctgatca

SEQ ID NO: 32232 - DNA, 15 bp, Homo sapiens
caccttcttctgatc

SEQ ID NO: 32233 - DNA, 15 bp, Homo sapiens
tcaccttcttctgat

SEQ ID NO: 32234 - DNA, 15 bp, Homo sapiens
ttcaccttcttctga

SEQ ID NO: 32235 - DNA, 15 bp, Homo sapiens
attcaccttcttctg

SEQ ID NO: 32236 - DNA, 15 bp, Homo sapiens
gattcaccttcttct

SEQ ID NO: 32237 - DNA, 15 bp, Homo sapiens
agattcaccttcttc

SEQ ID NO: 32238 - DNA, 15 bp, Homo sapiens
cagattcaccttctt

SEQ ID NO: 32239 - DNA, 15 bp, Homo sapiens
acagattcaccttct

SEQ ID NO: 32240 - DNA, 15 bp, Homo sapiens
gacagattcaccttc

SEQ ID NO: 32241 - DNA, 15 bp, Homo sapiens
tgacagattcacctt

SEQ ID NO: 32242 - DNA, 15 bp, Homo sapiens
ctgacagattcacct

SEQ ID NO: 32243 - DNA, 15 bp, Homo sapiens
tctgacagattcacc

SEQ ID NO: 32244 - DNA, 15 bp, Homo sapiens
ctctgacagattcac

SEQ ID NO: 32245 - DNA, 15 bp, Homo sapiens
cctctgacagattca

SEQ ID NO: 32246 - DNA, 15 bp, Homo sapiens
acctctgacagattc

SEQ ID NO: 32247 - DNA, 15 bp, Homo sapiens
cacctctgacagatt

SEQ ID NO: 32248 - DNA, 15 bp, Homo sapiens
acacctctgacagat

SEQ ID NO: 32249 - DNA, 15 bp, Homo sapiens
aacacctctgacaga

SEQ ID NO: 32250 - DNA, 15 bp, Homo sapiens
aaacacctctgacag

SEQ ID NO: 32251 - DNA, 15 bp, Homo sapiens
taaacacctctgaca

SEQ ID NO: 32252 - DNA, 15 bp, Homo sapiens
ctaaacacctctgac

SEQ ID NO: 32253 - DNA, 15 bp, Homo sapiens
cctaaacacctctga

SEQ ID NO: 32254 - DNA, 15 bp, Homo sapiens
tcctaaacacctctg

SEQ ID NO: 32255 - DNA, 15 bp, Homo sapiens
ttcctaaacacctct

SEQ ID NO: 32256 - DNA, 15 bp, Homo sapiens
cttcctaaacacctc

SEQ ID NO: 32257 - DNA, 15 bp, Homo sapiens
gcttcctaaacacct

SEQ ID NO: 32258 - DNA, 15 bp, Homo sapiens
tgcttcctaaacacc

SEQ ID NO: 32259 - DNA, 15 bp, Homo sapiens
ttgcttcctaaacac

SEQ ID NO: 32260 - DNA, 15 bp, Homo sapiens
tttgcttcctaaaca

SEQ ID NO: 32261 - DNA, 15 bp, Homo sapiens
atttgcttcctaaac

SEQ ID NO: 32262 - DNA, 15 bp, Homo sapiens
tatttgcttcctaaa

SEQ ID NO: 32263 - DNA, 15 bp, Homo sapiens
gtatttgcttcctaa

SEQ ID NO: 32264 - DNA, 15 bp, Homo sapiens
tgtatttgcttccta

SEQ ID NO: 32265 - DNA, 15 bp, Homo sapiens
ttgtatttgcttcct

SEQ ID NO: 32266 - DNA, 15 bp, Homo sapiens
cttgtatttgcttcc

SEQ ID NO: 32267 - DNA, 15 bp, Homo sapiens
ccttgtatttgcttc

SEQ ID NO: 32268 - DNA, 15 bp, Homo sapiens
cccttgtatttgctt

SEQ ID NO: 32269 - DNA, 15 bp, Homo sapiens
acccttgtatttgct

SEQ ID NO: 32270 - DNA, 15 bp, Homo sapiens
tacccttgtatttgc

SEQ ID NO: 32271 - DNA, 15 bp, Homo sapiens
ctacccttgtatttg

SEQ ID NO: 32272 - DNA, 15 bp, Homo sapiens
tctacccttgtattt

SEQ ID NO: 32273 - DNA, 15 bp, Homo sapiens
atctacccttgtatt

SEQ ID NO: 32274 - DNA, 15 bp, Homo sapiens
tatctacccttgtat

SEQ ID NO: 32275 - DNA, 15 bp, Homo sapiens
ctatctacccttgta

SEQ ID NO: 32276 - DNA, 15 bp, Homo sapiens
actatctacccttgt

SEQ ID NO: 32277 - DNA, 15 bp, Homo sapiens
tactatctacccttg

SEQ ID NO: 32278 - DNA, 15 bp, Homo sapiens
atactatctaccctt

SEQ ID NO: 32279 - DNA, 15 bp, Homo sapiens
catactatctaccct

SEQ ID NO: 32280 - DNA, 15 bp, Homo sapiens
ccatactatctaccc

SEQ ID NO: 32281 - DNA, 15 bp, Homo sapiens
cccatactatctacc

SEQ ID NO: 32282 - DNA, 15 bp, Homo sapiens
tcccatactatctac

SEQ ID NO: 32283 - DNA, 15 bp, Homo sapiens
ctcccatactatcta

SEQ ID NO: 32284 - DNA, 15 bp, Homo sapiens
cctcccatactatct

SEQ ID NO: 32285 - DNA, 15 bp, Homo sapiens
acctcccatactatc

SEQ ID NO: 32286 - DNA, 15 bp, Homo sapiens
aacctcccatactat

SEQ ID NO: 32287 - DNA, 15 bp, Homo sapiens
taacctcccatacta

SEQ ID NO: 32288 - DNA, 15 bp, Homo sapiens
ataacctcccatact

SEQ ID NO: 32289 - DNA, 15 bp, Homo sapiens
aataacctcccatac

SEQ ID NO: 32290 - DNA, 15 bp, Homo sapiens
caataacctcccata

SEQ ID NO: 32291 - DNA, 15 bp, Homo sapiens
acaataacctcccat

SEQ ID NO: 32292 - DNA, 15 bp, Homo sapiens
tacaataacctccca

SEQ ID NO: 32293 - DNA, 15 bp, Homo sapiens
ctacaataacctccc

SEQ ID NO: 32294 - DNA, 15 bp, Homo sapiens
actacaataacctcc

SEQ ID NO: 32295 - DNA, 15 bp, Homo sapiens
tactacaataacctc

SEQ ID NO: 32296 - DNA, 15 bp, Homo sapiens
gtactacaataacct

SEQ ID NO: 32297 - DNA, 15 bp, Homo sapiens
ggtactacaataacc

SEQ ID NO: 32298 - DNA, 15 bp, Homo sapiens
aggtactacaataac

SEQ ID NO: 32299 - DNA, 15 bp, Homo sapiens
aaggtactacaataa

SEQ ID NO: 32300 - DNA, 15 bp, Homo sapiens
caaggtactacaata

SEQ ID NO: 32301 - DNA, 15 bp, Homo sapiens
tcaaggtactacaat

SEQ ID NO: 32302 - DNA, 15 bp, Homo sapiens
ctcaaggtactacaa

SEQ ID NO: 32303 - DNA, 15 bp, Homo sapiens
tctcaaggtactaca

SEQ ID NO: 32304 - DNA, 15 bp, Homo sapiens
ctctcaaggtactac

SEQ ID NO: 32305 - DNA, 15 bp, Homo sapiens
tctctcaaggtacta

SEQ ID NO: 32306 - DNA, 15 bp, Homo sapiens
ttctctcaaggtact

SEQ ID NO: 32307 - DNA, 15 bp, Homo sapiens
attctctcaaggtac

SEQ ID NO: 32308 - DNA, 15 bp, Homo sapiens
cattctctcaaggta

SEQ ID NO: 32309 - DNA, 15 bp, Homo sapiens
gcattctctcaaggt

SEQ ID NO: 32310 - DNA, 15 bp, Homo sapiens
agcattctctcaagg

SEQ ID NO: 32311 - DNA, 15 bp, Homo sapiens
tagcattctctcaag

SEQ ID NO: 32312 - DNA, 15 bp, Homo sapiens
atagcattctctcaa

SEQ ID NO: 32313 - DNA, 15 bp, Homo sapiens
aatagcattctctca

SEQ ID NO: 32314 - DNA, 15 bp, Homo sapiens
caatagcattctctc

SEQ ID NO: 32315 - DNA, 15 bp, Homo sapiens
tcaatagcattctct

SEQ ID NO: 32316 - DNA, 15 bp, Homo sapiens
ctcaatagcattctc

SEQ ID NO: 32317 - DNA, 15 bp, Homo sapiens
cctcaatagcattct

SEQ ID NO: 32318 - DNA, 15 bp, Homo sapiens
tcctcaatagcattc

SEQ ID NO: 32319 - DNA, 15 bp, Homo sapiens
gtcctcaatagcatt

SEQ ID NO: 32320 - DNA, 15 bp, Homo sapiens
ggtcctcaatagcat

SEQ ID NO: 32321 - DNA, 15 bp, Homo sapiens
aggtcctcaatagca

SEQ ID NO: 32322 - DNA, 15 bp, Homo sapiens
caggtcctcaatagc

SEQ ID NO: 32323 - DNA, 15 bp, Homo sapiens
ccaggtcctcaatag

SEQ ID NO: 32324 - DNA, 15 bp, Homo sapiens
tccaggtcctcaata

SEQ ID NO: 32325 - DNA, 15 bp, Homo sapiens
atccaggtcctcaat

SEQ ID NO: 32326 - DNA, 15 bp, Homo sapiens
catccaggtcctcaa

SEQ ID NO: 32327 - DNA, 15 bp, Homo sapiens
acatccaggtcctca

SEQ ID NO: 32328 - DNA, 15 bp, Homo sapiens
aacatccaggtcctc

SEQ ID NO: 32329 - DNA, 15 bp, Homo sapiens
caacatccaggtcct

SEQ ID NO: 32330 - DNA, 15 bp, Homo sapiens
tcaacatccaggtcc

SEQ ID NO: 32331 - DNA, 15 bp, Homo sapiens
ctcaacatccaggtc

SEQ ID NO: 32332 - DNA, 15 bp, Homo sapiens
cctcaacatccaggt

SEQ ID NO: 32333 - DNA, 15 bp, Homo sapiens
acctcaacatccagg

SEQ ID NO: 32334 - DNA, 15 bp, Homo sapiens
aacctcaacatccag

SEQ ID NO: 32335 - DNA, 15 bp, Homo sapiens
caacctcaacatcca

SEQ ID NO: 32336 - DNA, 15 bp, Homo sapiens
ccaacctcaacatcc

SEQ ID NO: 32337 - DNA, 15 bp, Homo sapiens
accaacctcaacatc

SEQ ID NO: 32338 - DNA, 15 bp, Homo sapiens
taccaacctcaacat

SEQ ID NO: 32339 - DNA, 15 bp, Homo sapiens
ctaccaacctcaaca

SEQ ID NO: 32340 - DNA, 15 bp, Homo sapiens
gctaccaacctcaac

SEQ ID NO: 32341 - DNA, 15 bp, Homo sapiens
ggctaccaacctcaa

SEQ ID NO: 32342 - DNA, 15 bp, Homo sapiens
aggctaccaacctca

SEQ ID NO: 32343 - DNA, 15 bp, Homo sapiens
caggctaccaacctc

SEQ ID NO: 32344 - DNA, 15 bp, Homo sapiens
ccaggctaccaacct

SEQ ID NO: 32345 - DNA, 15 bp, Homo sapiens
cccaggctaccaacc

SEQ ID NO: 32346 - DNA, 15 bp, Homo sapiens
tcccaggctaccaac

SEQ ID NO: 32347 - DNA, 15 bp, Homo sapiens
ttcccaggctaccaa

SEQ ID NO: 32348 - DNA, 15 bp, Homo sapiens
attcccaggctacca

SEQ ID NO: 32349 - DNA, 15 bp, Homo sapiens
tattcccaggctacc

SEQ ID NO: 32350 - DNA, 15 bp, Homo sapiens
atattcccaggctac

SEQ ID NO: 32351 - DNA, 15 bp, Homo sapiens
gatattcccaggcta

SEQ ID NO: 32352 - DNA, 15 bp, Homo sapiens
agatattcccaggct

SEQ ID NO: 32353 - DNA, 15 bp, Homo sapiens
cagatattcccaggc

SEQ ID NO: 32354 - DNA, 15 bp, Homo sapiens
ccagatattcccagg

SEQ ID NO: 32355 - DNA, 15 bp, Homo sapiens
cccagatattcccag

SEQ ID NO: 32356 - DNA, 15 bp, Homo sapiens
gcccagatattccca

SEQ ID NO: 32357 - DNA, 15 bp, Homo sapiens
agcccagatattccc

SEQ ID NO: 32358 - DNA, 15 bp, Homo sapiens
gagcccagatattcc

SEQ ID NO: 32359 - DNA, 15 bp, Homo sapiens
agagcccagatattc

SEQ ID NO: 32360 - DNA, 15 bp, Homo sapiens
cagagcccagatatt

SEQ ID NO: 32361 - DNA, 15 bp, Homo sapiens
acagagcccagatat

SEQ ID NO: 32362 - DNA, 15 bp, Homo sapiens
aacagagcccagata

SEQ ID NO: 32363 - DNA, 15 bp, Homo sapiens
caacagagcccagat

SEQ ID NO: 32364 - DNA, 15 bp, Homo sapiens
tcaacagagcccaga

SEQ ID NO: 32365 - DNA, 15 bp, Homo sapiens
atcaacagagcccag

SEQ ID NO: 32366 - DNA, 15 bp, Homo sapiens
catcaacagagccca

SEQ ID NO: 32367 - DNA, 15 bp, Homo sapiens
tcatcaacagagccc

SEQ ID NO: 32368 - DNA, 15 bp, Homo sapiens
ttcatcaacagagcc

SEQ ID NO: 32369 - DNA, 15 bp, Homo sapiens
attcatcaacagagc

SEQ ID NO: 32370 - DNA, 15 bp, Homo sapiens
aattcatcaacagag

SEQ ID NO: 32371 - DNA, 15 bp, Homo sapiens
taattcatcaacaga

SEQ ID NO: 32372 - DNA, 15 bp, Homo sapiens
ttaattcatcaacag

SEQ ID NO: 32373 - DNA, 15 bp, Homo sapiens
tttaattcatcaaca

SEQ ID NO: 32374 - DNA, 15 bp, Homo sapiens
atttaattcatcaac

SEQ ID NO: 32375 - DNA, 15 bp, Homo sapiens
aatttaattcatcaa

SEQ ID NO: 32376 - DNA, 15 bp, Homo sapiens
caatttaattcatca

SEQ ID NO: 32377 - DNA, 15 bp, Homo sapiens
tcaatttaattcatc

SEQ ID NO: 32378 - DNA, 15 bp, Homo sapiens
ctcaatttaattcat

SEQ ID NO: 32379 - DNA, 15 bp, Homo sapiens
actcaatttaattca

SEQ ID NO: 32380 - DNA, 15 bp, Homo sapiens
aactcaatttaattc

SEQ ID NO: 32381 - DNA, 15 bp, Homo sapiens
taactcaatttaatt

SEQ ID NO: 32382 - DNA, 15 bp, Homo sapiens
ataactcaatttaat

SEQ ID NO: 32383 - DNA, 15 bp, Homo sapiens
cataactcaatttaa

SEQ ID NO: 32384 - DNA, 15 bp, Homo sapiens
ccataactcaattta

SEQ ID NO: 32385 - DNA, 15 bp, Homo sapiens
gccataactcaattt

SEQ ID NO: 32386 - DNA, 15 bp, Homo sapiens
tgccataactcaatt

SEQ ID NO: 32387 - DNA, 15 bp, Homo sapiens
ttgccataactcaat

SEQ ID NO: 32388 - DNA, 15 bp, Homo sapiens
tttgccataactcaa

SEQ ID NO: 32389 - DNA, 15 bp, Homo sapiens
ctttgccataactca

SEQ ID NO: 32390 - DNA, 15 bp, Homo sapiens
gctttgccataactc

SEQ ID NO: 32391 - DNA, 15 bp, Homo sapiens
agctttgccataact

SEQ ID NO: 32392 - DNA, 15 bp, Homo sapiens
gagctttgccataac

SEQ ID NO: 32393 - DNA, 15 bp, Homo sapiens
agagctttgccataa

SEQ ID NO: 32394 - DNA, 15 bp, Homo sapiens
gagagctttgccata

SEQ ID NO: 32395 - DNA, 15 bp, Homo sapiens
agagagctttgccat

SEQ ID NO: 32396 - DNA, 15 bp, Homo sapiens
aagagagctttgcca

SEQ ID NO: 32397 - DNA, 15 bp, Homo sapiens
gaagagagctttgcc

SEQ ID NO: 32398 - DNA, 15 bp, Homo sapiens
cgaagagagctttgc

SEQ ID NO: 32399 - DNA, 15 bp, Homo sapiens
acgaagagagctttg

SEQ ID NO: 32400 - DNA, 15 bp, Homo sapiens
cacgaagagagcttt

SEQ ID NO: 32401 - DNA, 15 bp, Homo sapiens
ccacgaagagagctt

SEQ ID NO: 32402 - DNA, 15 bp, Homo sapiens
tccacgaagagagct

SEQ ID NO: 32403 - DNA, 15 bp, Homo sapiens
atccacgaagagagc

SEQ ID NO: 32404 - DNA, 15 bp, Homo sapiens
aatccacgaagagag

SEQ ID NO: 32405 - DNA, 15 bp, Homo sapiens
aaatccacgaagaga

SEQ ID NO: 32406 - DNA, 15 bp, Homo sapiens
gaaatccacgaagag

SEQ ID NO: 32407 - DNA, 15 bp, Homo sapiens
tgaaatccacgaaga

SEQ ID NO: 32408 - DNA, 15 bp, Homo sapiens
ttgaaatccacgaag

SEQ ID NO: 32409 - DNA, 15 bp, Homo sapiens
attgaaatccacgaa

SEQ ID NO: 32410 - DNA, 15 bp, Homo sapiens
tattgaaatccacga

SEQ ID NO: 32411 - DNA, 15 bp, Homo sapiens
atattgaaatccacg

SEQ ID NO: 32412 - DNA, 15 bp, Homo sapiens
aatattgaaatccac

SEQ ID NO: 32413 - DNA, 15 bp, Homo sapiens
aaatattgaaatcca

SEQ ID NO: 32414 - DNA, 15 bp, Homo sapiens
caaatattgaaatcc

SEQ ID NO: 32415 - DNA, 15 bp, Homo sapiens
gcaaatattgaaatc

SEQ ID NO: 32416 - DNA, 15 bp, Homo sapiens
cgcaaatattgaaat

SEQ ID NO: 32417 - DNA, 15 bp, Homo sapiens
tcgcaaatattgaaa

SEQ ID NO: 32418 - DNA, 15 bp, Homo sapiens
atcgcaaatattgaa

SEQ ID NO: 32419 - DNA, 15 bp, Homo sapiens
aatcgcaaatattga

SEQ ID NO: 32420 - DNA, 15 bp, Homo sapiens
gaatcgcaaatattg

SEQ ID NO: 32421 - DNA, 15 bp, Homo sapiens
ggaatcgcaaatatt

SEQ ID NO: 32422 - DNA, 15 bp, Homo sapiens
tggaatcgcaaatat

SEQ ID NO: 32423 - DNA, 15 bp, Homo sapiens
gtggaatcgcaaata

SEQ ID NO: 32424 - DNA, 15 bp, Homo sapiens
agtggaatcgcaaat

SEQ ID NO: 32425 - DNA, 15 bp, Homo sapiens
cagtggaatcgcaaa

SEQ ID NO: 32426 - DNA, 15 bp, Homo sapiens
gcagtggaatcgcaa

SEQ ID NO: 32427 - DNA, 15 bp, Homo sapiens
agcagtggaatcgca

SEQ ID NO: 32428 - DNA, 15 bp, Homo sapiens
aagcagtggaatcgc

SEQ ID NO: 32429 - DNA, 15 bp, Homo sapiens
taagcagtggaatcg

SEQ ID NO: 32430 - DNA, 15 bp, Homo sapiens
ttaagcagtggaatc

SEQ ID NO: 32431 - DNA, 15 bp, Homo sapiens
tttaagcagtggaat

SEQ ID NO: 32432 - DNA, 15 bp, Homo sapiens
ctttaagcagtggaa

SEQ ID NO: 32433 - DNA, 15 bp, Homo sapiens
gctttaagcagtgga

SEQ ID NO: 32434 - DNA, 15 bp, Homo sapiens
agctttaagcagtgg

SEQ ID NO: 32435 - DNA, 15 bp, Homo sapiens
cagctttaagcagtg

SEQ ID NO: 32436 - DNA, 15 bp, Homo sapiens
tcagctttaagcagt

SEQ ID NO: 32437 - DNA, 15 bp, Homo sapiens
ctcagctttaagcag

SEQ ID NO: 32438 - DNA, 15 bp, Homo sapiens
gctcagctttaagca

SEQ ID NO: 32439 - DNA, 15 bp, Homo sapiens
agctcagctttaagc

SEQ ID NO: 32440 - DNA, 15 bp, Homo sapiens
gagctcagctttaag

SEQ ID NO: 32441 - DNA, 15 bp, Homo sapiens
tgagctcagctttaa

SEQ ID NO: 32442 - DNA, 15 bp, Homo sapiens
gtgagctcagcttta

SEQ ID NO: 32443 - DNA, 15 bp, Homo sapiens
agtgagctcagcttt

SEQ ID NO: 32444 - DNA, 15 bp, Homo sapiens
gagtgagctcagctt

SEQ ID NO: 32445 - DNA, 15 bp, Homo sapiens
agagtgagctcagct

SEQ ID NO: 32446 - DNA, 15 bp, Homo sapiens
aagagtgagctcagc

SEQ ID NO: 32447 - DNA, 15 bp, Homo sapiens
gaagagtgagctcag

SEQ ID NO: 32448 - DNA, 15 bp, Homo sapiens
agaagagtgagctca

SEQ ID NO: 32449 - DNA, 15 bp, Homo sapiens
aagaagagtgagctc

SEQ ID NO: 32450 - DNA, 15 bp, Homo sapiens
aaagaagagtgagct

SEQ ID NO: 32451 - DNA, 15 bp, Homo sapiens
aaaagaagagtgagc

SEQ ID NO: 32452 - DNA, 15 bp, Homo sapiens
gaaaagaagagtgag

SEQ ID NO: 32453 - DNA, 15 bp, Homo sapiens
cgaaaagaagagtga

SEQ ID NO: 32454 - DNA, 15 bp, Homo sapiens
ccgaaaagaagagtg

SEQ ID NO: 32455 - DNA, 15 bp, Homo sapiens
accgaaaagaagagt

SEQ ID NO: 32456 - DNA, 15 bp, Homo sapiens
caccgaaaagaagag

SEQ ID NO: 32457 - DNA, 15 bp, Homo sapiens
acaccgaaaagaaga

SEQ ID NO: 32458 - DNA, 15 bp, Homo sapiens
tacaccgaaaagaag

SEQ ID NO: 32459 - DNA, 15 bp, Homo sapiens
ttacaccgaaaagaa

SEQ ID NO: 32460 - DNA, 15 bp, Homo sapiens
gttacaccgaaaaga

SEQ ID NO: 32461 - DNA, 15 bp, Homo sapiens
agttacaccgaaaag

SEQ ID NO: 32462 - DNA, 15 bp, Homo sapiens
cagttacaccgaaaa

SEQ ID NO: 32463 - DNA, 15 bp, Homo sapiens
acagttacaccgaaa

SEQ ID NO: 32464 - DNA, 15 bp, Homo sapiens
cacagttacaccgaa

SEQ ID NO: 32465 - DNA, 15 bp, Homo sapiens
tcacagttacaccga

SEQ ID NO: 32466 - DNA, 15 bp, Homo sapiens
atcacagttacaccg

SEQ ID NO: 32467 - DNA, 15 bp, Homo sapiens
catcacagttacacc

SEQ ID NO: 32468 - DNA, 15 bp, Homo sapiens
ccatcacagttacac

SEQ ID NO: 32469 - DNA, 15 bp, Homo sapiens
tccatcacagttaca

SEQ ID NO: 32470 - DNA, 15 bp, Homo sapiens
ttccatcacagttac

SEQ ID NO: 32471 - DNA, 15 bp, Homo sapiens
cttccatcacagtta

SEQ ID NO: 32472 - DNA, 15 bp, Homo sapiens
ccttccatcacagtt

SEQ ID NO: 32473 - DNA, 15 bp, Homo sapiens
tccttccatcacagt

SEQ ID NO: 32474 - DNA, 15 bp, Homo sapiens
ttccttccatcacag

SEQ ID NO: 32475 - DNA, 15 bp, Homo sapiens
gttccttccatcaca

SEQ ID NO: 32476 - DNA, 15 bp, Homo sapiens
agttccttccatcac

SEQ ID NO: 32477 - DNA, 15 bp, Homo sapiens
aagttccttccatca

SEQ ID NO: 32478 - DNA, 15 bp, Homo sapiens
caagttccttccatc

SEQ ID NO: 32479 - DNA, 15 bp, Homo sapiens
gcaagttccttccat

SEQ ID NO: 32480 - DNA, 15 bp, Homo sapiens
cgcaagttccttcca

SEQ ID NO: 32481 - DNA, 15 bp, Homo sapiens
acgcaagttccttcc

SEQ ID NO: 32482 - DNA, 15 bp, Homo sapiens
cacgcaagttccttc

SEQ ID NO: 32483 - DNA, 15 bp, Homo sapiens
acacgcaagttcctt

SEQ ID NO: 32484 - DNA, 15 bp, Homo sapiens
cacacgcaagttcct

SEQ ID NO: 32485 - DNA, 15 bp, Homo sapiens
tcacacgcaagttcc

SEQ ID NO: 32486 - DNA, 15 bp, Homo sapiens
ctcacacgcaagttc

SEQ ID NO: 32487 - DNA, 15 bp, Homo sapiens
tctcacacgcaagtt

SEQ ID NO: 32488 - DNA, 15 bp, Homo sapiens
ctctcacacgcaagt

SEQ ID NO: 32489 - DNA, 15 bp, Homo sapiens
actctcacacgcaag

SEQ ID NO: 32490 - DNA, 15 bp, Homo sapiens
gactctcacacgcaa

SEQ ID NO: 32491 - DNA, 15 bp, Homo sapiens
agactctcacacgca

SEQ ID NO: 32492 - DNA, 15 bp, Homo sapiens
gagactctcacacgc

SEQ ID NO: 32493 - DNA, 15 bp, Homo sapiens
ggagactctcacacg

SEQ ID NO: 32494 - DNA, 15 bp, Homo sapiens
gggagactctcacac

SEQ ID NO: 32495 - DNA, 15 bp, Homo sapiens
agggagactctcaca

SEQ ID NO: 32496 - DNA, 15 bp, Homo sapiens
gagggagactctcac

SEQ ID NO: 32497 - DNA, 15 bp, Homo sapiens
agagggagactctca

SEQ ID NO: 32498 - DNA, 15 bp, Homo sapiens
aagagggagactctc

SEQ ID NO: 32499 - DNA, 15 bp, Homo sapiens
caagagggagactct

SEQ ID NO: 32500 - DNA, 15 bp, Homo sapiens
acaagagggagactc

SEQ ID NO: 32501 - DNA, 15 bp, Homo sapiens
aacaagagggagact

SEQ ID NO: 32502 - DNA, 15 bp, Homo sapiens
caacaagagggagac

SEQ ID NO: 32503 - DNA, 15 bp, Homo sapiens
ccaacaagagggaga

SEQ ID NO: 32504 - DNA, 15 bp, Homo sapiens
cccaacaagagggag

SEQ ID NO: 32505 - DNA, 15 bp, Homo sapiens
acccaacaagaggga

SEQ ID NO: 32506 - DNA, 15 bp, Homo sapiens
gacccaacaagaggg

SEQ ID NO: 32507 - DNA, 15 bp, Homo sapiens
agacccaacaagagg

SEQ ID NO: 32508 - DNA, 15 bp, Homo sapiens
cagacccaacaagag

SEQ ID NO: 32509 - DNA, 15 bp, Homo sapiens
acagacccaacaaga

SEQ ID NO: 32510 - DNA, 15 bp, Homo sapiens
cacagacccaacaag

SEQ ID NO: 32511 - DNA, 15 bp, Homo sapiens
gcacagacccaacaa

SEQ ID NO: 32512 - DNA, 15 bp, Homo sapiens
agcacagacccaaca

SEQ ID NO: 32513 - DNA, 15 bp, Homo sapiens
tagcacagacccaac

SEQ ID NO: 32514 - DNA, 15 bp, Homo sapiens
atagcacagacccaa

SEQ ID NO: 32515 - DNA, 15 bp, Homo sapiens
aatagcacagaccca

SEQ ID NO: 32516 - DNA, 15 bp, Homo sapiens
caatagcacagaccc

SEQ ID NO: 32517 - DNA, 15 bp, Homo sapiens
ccaatagcacagacc

SEQ ID NO: 32518 - DNA, 15 bp, Homo sapiens
accaatagcacagac

SEQ ID NO: 32519 - DNA, 15 bp, Homo sapiens
aaccaatagcacaga

SEQ ID NO: 32520 - DNA, 15 bp, Homo sapiens
aaaccaatagcacag

SEQ ID NO: 32521 - DNA, 15 bp, Homo sapiens
caaaccaatagcaca

SEQ ID NO: 32522 - DNA, 15 bp, Homo sapiens
acaaaccaatagcac

SEQ ID NO: 32523 - DNA, 15 bp, Homo sapiens
aacaaaccaatagca

SEQ ID NO: 32524 - DNA, 15 bp, Homo sapiens
caacaaaccaatagc

SEQ ID NO: 32525 - DNA, 15 bp, Homo sapiens
tcaacaaaccaatag

SEQ ID NO: 32526 - DNA, 15 bp, Homo sapiens
atcaacaaaccaata

SEQ ID NO: 32527 - DNA, 15 bp, Homo sapiens
aatcaacaaaccaat

SEQ ID NO: 32528 - DNA, 15 bp, Homo sapiens
taatcaacaaaccaa

SEQ ID NO: 32529 - DNA, 15 bp, Homo sapiens
ctaatcaacaaacca

SEQ ID NO: 32530 - DNA, 15 bp, Homo sapiens
cctaatcaacaaacc

SEQ ID NO: 32531 - DNA, 15 bp, Homo sapiens
tcctaatcaacaaac

SEQ ID NO: 32532 - DNA, 15 bp, Homo sapiens
ttcctaatcaacaaa

SEQ ID NO: 32533 - DNA, 15 bp, Homo sapiens
gttcctaatcaacaa

SEQ ID NO: 32534 - DNA, 15 bp, Homo sapiens
agttcctaatcaaca

SEQ ID NO: 32535 - DNA, 15 bp, Homo sapiens
gagttcctaatcaac

SEQ ID NO: 32536 - DNA, 15 bp, Homo sapiens
tgagttcctaatcaa

SEQ ID NO: 32537 - DNA, 15 bp, Homo sapiens
ttgagttcctaatca

SEQ ID NO: 32538 - DNA, 15 bp, Homo sapiens
attgagttcctaatc

SEQ ID NO: 32539 - DNA, 15 bp, Homo sapiens
aattgagttcctaat

SEQ ID NO: 32540 - DNA, 15 bp, Homo sapiens
caattgagttcctaa

SEQ ID NO: 32541 - DNA, 15 bp, Homo sapiens
ccaattgagttccta

SEQ ID NO: 32542 - DNA, 15 bp, Homo sapiens
accaattgagttcct

SEQ ID NO: 32543 - DNA, 15 bp, Homo sapiens
taccaattgagttcc

SEQ ID NO: 32544 - DNA, 15 bp, Homo sapiens
gtaccaattgagttc

SEQ ID NO: 32545 - DNA, 15 bp, Homo sapiens
ggtaccaattgagtt

SEQ ID NO: 32546 - DNA, 15 bp, Homo sapiens
aggtaccaattgagt

SEQ ID NO: 32547 - DNA, 15 bp, Homo sapiens
caggtaccaattgag

SEQ ID NO: 32548 - DNA, 15 bp, Homo sapiens
gcaggtaccaattga

SEQ ID NO: 32549 - DNA, 15 bp, Homo sapiens
tgcaggtaccaattg

SEQ ID NO: 32550 - DNA, 15 bp, Homo sapiens
ctgcaggtaccaatt

SEQ ID NO: 32551 - DNA, 15 bp, Homo sapiens
tctgcaggtaccaat

SEQ ID NO: 32552 - DNA, 15 bp, Homo sapiens
ttctgcaggtaccaa

SEQ ID NO: 32553 - DNA, 15 bp, Homo sapiens
tttctgcaggtacca

SEQ ID NO: 32554 - DNA, 15 bp, Homo sapiens
atttctgcaggtacc

SEQ ID NO: 32555 - DNA, 15 bp, Homo sapiens
aatttctgcaggtac

SEQ ID NO: 32556 - DNA, 15 bp, Homo sapiens
aggcaatttctgcag

SEQ ID NO: 32557 - DNA, 15 bp, Homo sapiens
gaggcaatttctgca

SEQ ID NO: 32558 - DNA, 15 bp, Homo sapiens
agaggcaatttctgc

SEQ ID NO: 32559 - DNA, 15 bp, Homo sapiens
cagaggcaatttctg

SEQ ID NO: 32560 - DNA, 15 bp, Homo sapiens
tcagaggcaatttct

SEQ ID NO: 32561 - DNA, 15 bp, Homo sapiens
atcagaggcaatttc

SEQ ID NO: 32562 - DNA, 15 bp, Homo sapiens
aatcagaggcaattt

SEQ ID NO: 32563 - DNA, 15 bp, Homo sapiens
caatcagaggcaatt

SEQ ID NO: 32564 - DNA, 15 bp, Homo sapiens
ccaatcagaggcaat

SEQ ID NO: 32565 - DNA, 15 bp, Homo sapiens
cccaatcagaggcaa

SEQ ID NO: 32566 - DNA, 15 bp, Homo sapiens
tcccaatcagaggca

SEQ ID NO: 32567 - DNA, 15 bp, Homo sapiens
gtcccaatcagaggc

SEQ ID NO: 32568 - DNA, 15 bp, Homo sapiens
ggtcccaatcagagg

SEQ ID NO: 32569 - DNA, 15 bp, Homo sapiens
aggtcccaatcagag

SEQ ID NO: 32570 - DNA, 15 bp, Homo sapiens
caggtcccaatcaga

SEQ ID NO: 32571 - DNA, 15 bp, Homo sapiens
gcaggtcccaatcag

SEQ ID NO: 32572 - DNA, 15 bp, Homo sapiens
agcaggtcccaatca

SEQ ID NO: 32573 - DNA, 15 bp, Homo sapiens
aagcaggtcccaatc

SEQ ID NO: 32574 - DNA, 15 bp, Homo sapiens
gaagcaggtcccaat

SEQ ID NO: 32575 - DNA, 15 bp, Homo sapiens
agaagcaggtcccaa

SEQ ID NO: 32576 - DNA, 15 bp, Homo sapiens
gagaagcaggtccca

SEQ ID NO: 32577 - DNA, 15 bp, Homo sapiens
ggagaagcaggtccc

SEQ ID NO: 32578 - DNA, 15 bp, Homo sapiens
gggagaagcaggtcc

SEQ ID NO: 32579 - DNA, 15 bp, Homo sapiens
ggggagaagcaggtc

SEQ ID NO: 32580 - DNA, 15 bp, Homo sapiens
tggggagaagcaggt

SEQ ID NO: 32581 - DNA, 15 bp, Homo sapiens
gtggggagaagcagg

SEQ ID NO: 32582 - DNA, 15 bp, Homo sapiens
agtggggagaagcag

SEQ ID NO: 32583 - DNA, 15 bp, Homo sapiens
cagtggggagaagca

SEQ ID NO: 32584 - DNA, 15 bp, Homo sapiens
acagtggggagaagc

SEQ ID NO: 32585 - DNA, 15 bp, Homo sapiens
gacagtggggagaag

SEQ ID NO: 32586 - DNA, 15 bp, Homo sapiens
agacagtggggagaa

SEQ ID NO: 32587 - DNA, 15 bp, Homo sapiens
gagacagtggggaga

SEQ ID NO: 32588 - DNA, 15 bp, Homo sapiens
ggagacagtggggag

SEQ ID NO: 32589 - DNA, 15 bp, Homo sapiens
gggagacagtgggga

SEQ ID NO: 32590 - DNA, 15 bp, Homo sapiens
agggagacagtgggg

SEQ ID NO: 32591 - DNA, 15 bp, Homo sapiens
aagggagacagtggg

SEQ ID NO: 32592 - DNA, 15 bp, Homo sapiens
taagggagacagtgg

SEQ ID NO: 32593 - DNA, 15 bp, Homo sapiens
ataagggagacagtg

SEQ ID NO: 32594 - DNA, 15 bp, Homo sapiens
cataagggagacagt

SEQ ID NO: 32595 - DNA, 15 bp, Homo sapiens
acataagggagacag

SEQ ID NO: 32596 - DNA, 15 bp, Homo sapiens
aacataagggagaca

SEQ ID NO: 32597 - DNA, 15 bp, Homo sapiens
aaacataagggagac

SEQ ID NO: 32598 - DNA, 15 bp, Homo sapiens
gaaacataagggaga

SEQ ID NO: 32599 - DNA, 15 bp, Homo sapiens
ggaaacataagggag

SEQ ID NO: 32600 - DNA, 15 bp, Homo sapiens
gggaaacataaggga

SEQ ID NO: 32601 - DNA, 15 bp, Homo sapiens
ggggaaacataaggg

SEQ ID NO: 32602 - DNA, 15 bp, Homo sapiens
gggggaaacataagg

SEQ ID NO: 32603 - DNA, 15 bp, Homo sapiens
agggggaaacataag

SEQ ID NO: 32604 - DNA, 15 bp, Homo sapiens
cagggggaaacataa

SEQ ID NO: 32605 - DNA, 15 bp, Homo sapiens
tcagggggaaacata

SEQ ID NO: 32606 - DNA, 15 bp, Homo sapiens
ctcagggggaaacat

SEQ ID NO: 32607 - DNA, 15 bp, Homo sapiens
tctcagggggaaaca

SEQ ID NO: 32608 - DNA, 15 bp, Homo sapiens
ctctcagggggaaac

SEQ ID NO: 32609 - DNA, 15 bp, Homo sapiens
cctctcagggggaaa

SEQ ID NO: 32610 - DNA, 15 bp, Homo sapiens
acctctcagggggaa

SEQ ID NO: 32611 - DNA, 15 bp, Homo sapiens
tacctctcaggggga

SEQ ID NO: 32612 - DNA, 15 bp, Homo sapiens
ttacctctcaggggg

SEQ ID NO: 32613 - DNA, 15 bp, Homo sapiens
tttacctctcagggg

SEQ ID NO: 32614 - DNA, 15 bp, Homo sapiens
ttttacctctcaggg

SEQ ID NO: 32615 - DNA, 15 bp, Homo sapiens
cttttacctctcagg

SEQ ID NO: 32616 - DNA, 15 bp, Homo sapiens
ccttttacctctcag

SEQ ID NO: 32617 - DNA, 15 bp, Homo sapiens
tccttttacctctca

SEQ ID NO: 32618 - DNA, 15 bp, Homo sapiens
ctccttttacctctc

SEQ ID NO: 32619 - DNA, 15 bp, Homo sapiens
actccttttacctct

SEQ ID NO: 32620 - DNA, 15 bp, Homo sapiens
cactccttttacctc

SEQ ID NO: 32621 - DNA, 15 bp, Homo sapiens
tcactccttttacct

SEQ ID NO: 32622 - DNA, 15 bp, Homo sapiens
atcactccttttacc

SEQ ID NO: 32623 - DNA, 15 bp, Homo sapiens
aatcactccttttac

SEQ ID NO: 32624 - DNA, 15 bp, Homo sapiens
aaatcactcctttta

SEQ ID NO: 32625 - DNA, 15 bp, Homo sapiens
caaatcactcctttt

SEQ ID NO: 32626 - DNA, 15 bp, Homo sapiens
ccaaatcactccttt

SEQ ID NO: 32627 - DNA, 15 bp, Homo sapiens
cccaaatcactcctt

SEQ ID NO: 32628 - DNA, 15 bp, Homo sapiens
acccaaatcactcct

SEQ ID NO: 32629 - DNA, 15 bp, Homo sapiens
gacccaaatcactcc

SEQ ID NO: 32630 - DNA, 15 bp, Homo sapiens
tgacccaaatcactc

SEQ ID NO: 32631 - DNA, 15 bp, Homo sapiens
ttgacccaaatcact

SEQ ID NO: 32632 - DNA, 15 bp, Homo sapiens
tttgacccaaatcac

SEQ ID NO: 32633 - DNA, 15 bp, Homo sapiens
atttgacccaaatca

SEQ ID NO: 32634 - DNA, 15 bp, Homo sapiens
catttgacccaaatc

SEQ ID NO: 32635 - DNA, 15 bp, Homo sapiens
acatttgacccaaat

SEQ ID NO: 32636 - DNA, 15 bp, Homo sapiens
gacatttgacccaaa

SEQ ID NO: 32637 - DNA, 15 bp, Homo sapiens
ggacatttgacccaa

SEQ ID NO: 32638 - DNA, 15 bp, Homo sapiens
aggacatttgaccca

SEQ ID NO: 32639 - DNA, 15 bp, Homo sapiens
aaggacatttgaccc

SEQ ID NO: 32640 - DNA, 15 bp, Homo sapiens
aaaggacatttgacc

SEQ ID NO: 32641 - DNA, 15 bp, Homo sapiens
caaaggacatttgac

SEQ ID NO: 32642 - DNA, 15 bp, Homo sapiens
acaaaggacatttga

SEQ ID NO: 32643 - DNA, 15 bp, Homo sapiens
aacaaaggacatttg

SEQ ID NO: 32644 - DNA, 15 bp, Homo sapiens
aaacaaaggacattt

SEQ ID NO: 32645 - DNA, 15 bp, Homo sapiens
aaaacaaaggacatt

SEQ ID NO: 32646 - DNA, 15 bp, Homo sapiens
caaaacaaaggacat

SEQ ID NO: 32647 - DNA, 15 bp, Homo sapiens
ccaaaacaaaggaca

SEQ ID NO: 32648 - DNA, 15 bp, Homo sapiens
cccaaaacaaaggac

SEQ ID NO: 32649 - DNA, 15 bp, Homo sapiens
acccaaaacaaagga

SEQ ID NO: 32650 - DNA, 15 bp, Homo sapiens
aacccaaaacaaagg

SEQ ID NO: 32651 - DNA, 15 bp, Homo sapiens
caacccaaaacaaag

SEQ ID NO: 32652 - DNA, 15 bp, Homo sapiens
ccaacccaaaacaaa

SEQ ID NO: 32653 - DNA, 15 bp, Homo sapiens
accaacccaaaacaa

SEQ ID NO: 32654 - DNA, 15 bp, Homo sapiens
aaccaacccaaaaca

SEQ ID NO: 32655 - DNA, 15 bp, Homo sapiens
aaaccaacccaaaac

SEQ ID NO: 32656 - DNA, 15 bp, Homo sapiens
caaaccaacccaaaa

SEQ ID NO: 32657 - DNA, 15 bp, Homo sapiens
acaaaccaacccaaa

SEQ ID NO: 32658 - DNA, 15 bp, Homo sapiens
cacaaaccaacccaa

SEQ ID NO: 32659 - DNA, 15 bp, Homo sapiens
acacaaaccaaccca

SEQ ID NO: 32660 - DNA, 15 bp, Homo sapiens
cacacaaaccaaccc

SEQ ID NO: 32661 - DNA, 15 bp, Homo sapiens
ccacacaaaccaacc

SEQ ID NO: 32662 - DNA, 15 bp, Homo sapiens
cccacacaaaccaac

SEQ ID NO: 32663 - DNA, 15 bp, Homo sapiens
tcccacacaaaccaa

SEQ ID NO: 32664 - DNA, 15 bp, Homo sapiens
atcccacacaaacca

SEQ ID NO: 32665 - DNA, 15 bp, Homo sapiens
catcccacacaaacc

SEQ ID NO: 32666 - DNA, 15 bp, Homo sapiens
tcatcccacacaaac

SEQ ID NO: 32667 - DNA, 15 bp, Homo sapiens
gtcatcccacacaaa

SEQ ID NO: 32668 - DNA, 15 bp, Homo sapiens
agtcatcccacacaa

SEQ ID NO: 32669 - DNA, 15 bp, Homo sapiens
gagtcatcccacaca

SEQ ID NO: 32670 - DNA, 15 bp, Homo sapiens
ggagtcatcccacac

SEQ ID NO: 32671 - DNA, 15 bp, Homo sapiens
aggagtcatcccaca

SEQ ID NO: 32672 - DNA, 15 bp, Homo sapiens
caggagtcatcccac

SEQ ID NO: 32673 - DNA, 15 bp, Homo sapiens
ccaggagtcatccca

SEQ ID NO: 32674 - DNA, 15 bp, Homo sapiens
accaggagtcatccc

SEQ ID NO: 32675 - DNA, 15 bp, Homo sapiens
caccaggagtcatcc

SEQ ID NO: 32676 - DNA, 15 bp, Homo sapiens
acaccaggagtcatc

SEQ ID NO: 32677 - DNA, 15 bp, Homo sapiens
tacaccaggagtcat

SEQ ID NO: 32678 - DNA, 15 bp, Homo sapiens
ctacaccaggagtca

SEQ ID NO: 32679 - DNA, 15 bp, Homo sapiens
tctacaccaggagtc

SEQ ID NO: 32680 - DNA, 15 bp, Homo sapiens
atctacaccaggagt

SEQ ID NO: 32681 - DNA, 15 bp, Homo sapiens
aatctacaccaggag

SEQ ID NO: 32682 - DNA, 15 bp, Homo sapiens
aaatctacaccagga

SEQ ID NO: 32683 - DNA, 15 bp, Homo sapiens
aaaatctacaccagg

SEQ ID NO: 32684 - DNA, 15 bp, Homo sapiens
caaaatctacaccag

SEQ ID NO: 32685 - DNA, 15 bp, Homo sapiens
acaaaatctacacca

SEQ ID NO: 32686 - DNA, 15 bp, Homo sapiens
cacaaaatctacacc

SEQ ID NO: 32687 - DNA, 15 bp, Homo sapiens
acacaaaatctacac

SEQ ID NO: 32688 - DNA, 15 bp, Homo sapiens
cacacaaaatctaca

SEQ ID NO: 32689 - DNA, 15 bp, Homo sapiens
acacacaaaatctac

SEQ ID NO: 32690 - DNA, 15 bp, Homo sapiens
cacacacaaaatcta

SEQ ID NO: 32691 - DNA, 15 bp, Homo sapiens
ccacacacaaaatct

SEQ ID NO: 32692 - DNA, 15 bp, Homo sapiens
cccacacacaaaatc

SEQ ID NO: 32693 - DNA, 15 bp, Homo sapiens
acccacacacaaaat

SEQ ID NO: 32694 - DNA, 15 bp, Homo sapiens
cacccacacacaaaa

SEQ ID NO: 32695 - DNA, 15 bp, Homo sapiens
gcacccacacacaaa

SEQ ID NO: 32696 - DNA, 15 bp, Homo sapiens
agcacccacacacaa

SEQ ID NO: 32697 - DNA, 15 bp, Homo sapiens
tagcacccacacaca

SEQ ID NO: 32698 - DNA, 15 bp, Homo sapiens
ttagcacccacacac

SEQ ID NO: 32699 - DNA, 15 bp, Homo sapiens
attagcacccacaca

SEQ ID NO: 32700 - DNA, 15 bp, Homo sapiens
cattagcacccacac

SEQ ID NO: 32701 - DNA, 15 bp, Homo sapiens
acattagcacccaca

SEQ ID NO: 32702 - DNA, 15 bp, Homo sapiens
tacattagcacccac

SEQ ID NO: 32703 - DNA, 15 bp, Homo sapiens
gtacattagcaccca

SEQ ID NO: 32704 - DNA, 15 bp, Homo sapiens
agtacattagcaccc

SEQ ID NO: 32705 - DNA, 15 bp, Homo sapiens
aagtacattagcacc

SEQ ID NO: 32706 - DNA, 15 bp, Homo sapiens
taagtacattagcac

SEQ ID NO: 32707 - DNA, 15 bp, Homo sapiens
ataagtacattagca

SEQ ID NO: 32708 - DNA, 15 bp, Homo sapiens
tataagtacattagc

SEQ ID NO: 32709 - DNA, 15 bp, Homo sapiens
ctataagtacattag

SEQ ID NO: 32710 - DNA, 15 bp, Homo sapiens
gctataagtacatta

SEQ ID NO: 32711 - DNA, 15 bp, Homo sapiens
ggctataagtacatt

SEQ ID NO: 32712 - DNA, 15 bp, Homo sapiens
tggctataagtacat

SEQ ID NO: 32713 - DNA, 15 bp, Homo sapiens
ctggctataagtaca

SEQ ID NO: 32714 - DNA, 15 bp, Homo sapiens
gctggctataagtac

SEQ ID NO: 32715 - DNA, 15 bp, Homo sapiens
agctggctataagta

SEQ ID NO: 32716 - DNA, 15 bp, Homo sapiens
cagctggctataagt

SEQ ID NO: 32717 - DNA, 15 bp, Homo sapiens
ccagctggctataag

SEQ ID NO: 32718 - DNA, 15 bp, Homo sapiens
cccagctggctataa

SEQ ID NO: 32719 - DNA, 15 bp, Homo sapiens
ccccagctggctata

SEQ ID NO: 32720 - DNA, 15 bp, Homo sapiens
gccccagctggctat

SEQ ID NO: 32721 - DNA, 15 bp, Homo sapiens
agccccagctggcta

SEQ ID NO: 32722 - DNA, 15 bp, Homo sapiens
tagccccagctggct

SEQ ID NO: 32723 - DNA, 15 bp, Homo sapiens
ctagccccagctggc

SEQ ID NO: 32724 - DNA, 15 bp, Homo sapiens
tctagccccagctgg

SEQ ID NO: 32725 - DNA, 15 bp, Homo sapiens
ttctagccccagctg

SEQ ID NO: 32726 - DNA, 15 bp, Homo sapiens
cttctagccccagct

SEQ ID NO: 32727 - DNA, 15 bp, Homo sapiens
gcttctagccccagc

SEQ ID NO: 32728 - DNA, 15 bp, Homo sapiens
agcttctagccccag

SEQ ID NO: 32729 - DNA, 15 bp, Homo sapiens
gagcttctagcccca

SEQ ID NO: 32730 - DNA, 15 bp, Homo sapiens
tgagcttctagcccc

SEQ ID NO: 32731 - DNA, 15 bp, Homo sapiens
ctgagcttctagccc

SEQ ID NO: 32732 - DNA, 15 bp, Homo sapiens
cctgagcttctagcc

SEQ ID NO: 32733 - DNA, 15 bp, Homo sapiens
gcctgagcttctagc

SEQ ID NO: 32734 - DNA, 15 bp, Homo sapiens
tgcctgagcttctag

SEQ ID NO: 32735 - DNA, 15 bp, Homo sapiens
gtgcctgagcttcta

SEQ ID NO: 32736 - DNA, 15 bp, Homo sapiens
ggtgcctgagcttct

SEQ ID NO: 32737 - DNA, 15 bp, Homo sapiens
gggtgcctgagcttc

SEQ ID NO: 32738 - DNA, 15 bp, Homo sapiens
tgggtgcctgagctt

SEQ ID NO: 32739 - DNA, 15 bp, Homo sapiens
gtgggtgcctgagct

SEQ ID NO: 32740 - DNA, 15 bp, Homo sapiens
tgtgggtgcctgagc

SEQ ID NO: 32741 - DNA, 15 bp, Homo sapiens
ctgtgggtgcctgag

SEQ ID NO: 32742 - DNA, 15 bp, Homo sapiens
gctgtgggtgcctga

SEQ ID NO: 32743 - DNA, 15 bp, Homo sapiens
agctgtgggtgcctg

SEQ ID NO: 32744 - DNA, 15 bp, Homo sapiens
aagctgtgggtgcct

SEQ ID NO: 32745 - DNA, 15 bp, Homo sapiens
aaagctgtgggtgcc

SEQ ID NO: 32746 - DNA, 15 bp, Homo sapiens
caaagctgtgggtgc

SEQ ID NO: 32747 - DNA, 15 bp, Homo sapiens
gcaaagctgtgggtg

SEQ ID NO: 32748 - DNA, 15 bp, Homo sapiens
agcaaagctgtgggt

SEQ ID NO: 32749 - DNA, 15 bp, Homo sapiens
gagcaaagctgtggg

SEQ ID NO: 32750 - DNA, 15 bp, Homo sapiens
agagcaaagctgtgg

SEQ ID NO: 32751 - DNA, 15 bp, Homo sapiens
gagagcaaagctgtg

SEQ ID NO: 32752 - DNA, 15 bp, Homo sapiens
ggagagcaaagctgt

SEQ ID NO: 32753 - DNA, 15 bp, Homo sapiens
gggagagcaaagctg

SEQ ID NO: 32754 - DNA, 15 bp, Homo sapiens
ggggagagcaaagct

SEQ ID NO: 32755 - DNA, 15 bp, Homo sapiens
tggggagagcaaagc

SEQ ID NO: 32756 - DNA, 15 bp, Homo sapiens
gtggggagagcaaag

SEQ ID NO: 32757 - DNA, 15 bp, Homo sapiens
agtggggagagcaaa

SEQ ID NO: 32758 - DNA, 15 bp, Homo sapiens
aagtggggagagcaa

SEQ ID NO: 32759 - DNA, 15 bp, Homo sapiens
gaagtggggagagca

SEQ ID NO: 32760 - DNA, 15 bp, Homo sapiens
cgaagtggggagagc

SEQ ID NO: 32761 - DNA, 15 bp, Homo sapiens
gcgaagtggggagag

SEQ ID NO: 32762 - DNA, 15 bp, Homo sapiens
cgcgaagtggggaga

SEQ ID NO: 32763 - DNA, 15 bp, Homo sapiens
acgcgaagtggggag

SEQ ID NO: 32764 - DNA, 15 bp, Homo sapiens
aacgcgaagtgggga

SEQ ID NO: 32765 - DNA, 15 bp, Homo sapiens
aaacgcgaagtgggg

SEQ ID NO: 32766 - DNA, 15 bp, Homo sapiens
aaaacgcgaagtggg

SEQ ID NO: 32767 - DNA, 15 bp, Homo sapiens
aaaaacgcgaagtgg

SEQ ID NO: 32768 - DNA, 15 bp, Homo sapiens
taaaaacgcgaagtg

SEQ ID NO: 32769 - DNA, 15 bp, Homo sapiens
gtaaaaacgcgaagt

SEQ ID NO: 32770 - DNA, 15 bp, Homo sapiens
agtaaaaacgcgaag

SEQ ID NO: 32771 - DNA, 15 bp, Homo sapiens
aagtaaaaacgcgaa

SEQ ID NO: 32772 - DNA, 15 bp, Homo sapiens
gaagtaaaaacgcga

SEQ ID NO: 32773 - DNA, 15 bp, Homo sapiens
agaagtaaaaacgcg

SEQ ID NO: 32774 - DNA, 15 bp, Homo sapiens
cagaagtaaaaacgc

SEQ ID NO: 32775 - DNA, 15 bp, Homo sapiens
tcagaagtaaaaacg

SEQ ID NO: 32776 - DNA, 15 bp, Homo sapiens
atcagaagtaaaaac

SEQ ID NO: 32777 - DNA, 15 bp, Homo sapiens
aatcagaagtaaaaa

SEQ ID NO: 32778 - DNA, 15 bp, Homo sapiens
aaatcagaagtaaaa

SEQ ID NO: 32779 - DNA, 15 bp, Homo sapiens
aaaatcagaagtaaa

SEQ ID NO: 32780 - DNA, 15 bp, Homo sapiens
gaaaatcagaagtaa

SEQ ID NO: 32781 - DNA, 15 bp, Homo sapiens
agaaaatcagaagta

SEQ ID NO: 32782 - DNA, 15 bp, Homo sapiens
cagaaaatcagaagt

SEQ ID NO: 32783 - DNA, 15 bp, Homo sapiens
acagaaaatcagaag

SEQ ID NO: 32784 - DNA, 15 bp, Homo sapiens
aacagaaaatcagaa

SEQ ID NO: 32785 - DNA, 15 bp, Homo sapiens
aaacagaaaatcaga

SEQ ID NO: 32786 - DNA, 15 bp, Homo sapiens
gaaacagaaaatcag

SEQ ID NO: 32787 - DNA, 15 bp, Homo sapiens
ggaaacagaaaatca

SEQ ID NO: 32788 - DNA, 15 bp, Homo sapiens
gggaaacagaaaatc

SEQ ID NO: 32789 - DNA, 15 bp, Homo sapiens
tgggaaacagaaaat

SEQ ID NO: 32790 - DNA, 15 bp, Homo sapiens
ttgggaaacagaaaa

SEQ ID NO: 32791 - DNA, 15 bp, Homo sapiens
attgggaaacagaaa

SEQ ID NO: 32792 - DNA, 15 bp, Homo sapiens
aattgggaaacagaa

SEQ ID NO: 32793 - DNA, 15 bp, Homo sapiens
aaattgggaaacaga

SEQ ID NO: 32794 - DNA, 15 bp, Homo sapiens
caaattgggaaacag

SEQ ID NO: 32795 - DNA, 15 bp, Homo sapiens
acaaattgggaaaca

SEQ ID NO: 32796 - DNA, 15 bp, Homo sapiens
cacaaattgggaaac

SEQ ID NO: 32797 - DNA, 15 bp, Homo sapiens
tcacaaattgggaaa

SEQ ID NO: 32798 - DNA, 15 bp, Homo sapiens
atcacaaattgggaa

SEQ ID NO: 32799 - DNA, 15 bp, Homo sapiens
aatcacaaattggga

SEQ ID NO: 32800 - DNA, 15 bp, Homo sapiens
gaatcacaaattggg

SEQ ID NO: 32801 - DNA, 15 bp, Homo sapiens
tgaatcacaaattgg

SEQ ID NO: 32802 - DNA, 15 bp, Homo sapiens
gtgaatcacaaattg

SEQ ID NO: 32803 - DNA, 15 bp, Homo sapiens
tgtgaatcacaaatt

SEQ ID NO: 32804 - DNA, 15 bp, Homo sapiens
ctgtgaatcacaaat

SEQ ID NO: 32805 - DNA, 15 bp, Homo sapiens
cctgtgaatcacaaa

SEQ ID NO: 32806 - DNA, 15 bp, Homo sapiens
gcctgtgaatcacaa

SEQ ID NO: 32807 - DNA, 15 bp, Homo sapiens
tgcctgtgaatcaca

SEQ ID NO: 32808 - DNA, 15 bp, Homo sapiens
ctgcctgtgaatcac

SEQ ID NO: 32809 - DNA, 15 bp, Homo sapiens
cctgcctgtgaatca

SEQ ID NO: 32810 - DNA, 15 bp, Homo sapiens
ccctgcctgtgaatc

SEQ ID NO: 32811 - DNA, 15 bp, Homo sapiens
tccctgcctgtgaat

SEQ ID NO: 32812 - DNA, 15 bp, Homo sapiens
atccctgcctgtgaa

SEQ ID NO: 32813 - DNA, 15 bp, Homo sapiens
catccctgcctgtga

SEQ ID NO: 32814 - DNA, 15 bp, Homo sapiens
tcatccctgcctgtg

SEQ ID NO: 32815 - DNA, 15 bp, Homo sapiens
gtcatccctgcctgt

SEQ ID NO: 32816 - DNA, 15 bp, Homo sapiens
agtcatccctgcctg

SEQ ID NO: 32817 - DNA, 15 bp, Homo sapiens
cagtcatccctgcct

SEQ ID NO: 32818 - DNA, 15 bp, Homo sapiens
tcagtcatccctgcc

SEQ ID NO: 32819 - DNA, 15 bp, Homo sapiens
gtcagtcatccctgc

SEQ ID NO: 32820 - DNA, 15 bp, Homo sapiens
agtcagtcatccctg

SEQ ID NO: 32821 - DNA, 15 bp, Homo sapiens
cagtcagtcatccct

SEQ ID NO: 32822 - DNA, 15 bp, Homo sapiens
tcagtcagtcatccc

SEQ ID NO: 32823 - DNA, 15 bp, Homo sapiens
ctcagtcagtcatcc

SEQ ID NO: 32824 - DNA, 15 bp, Homo sapiens
tctcagtcagtcatc

SEQ ID NO: 32825 - DNA, 15 bp, Homo sapiens
ttctcagtcagtcat

SEQ ID NO: 32826 - DNA, 15 bp, Homo sapiens
cttctcagtcagtca

SEQ ID NO: 32827 - DNA, 15 bp, Homo sapiens
gcttctcagtcagtc

SEQ ID NO: 32828 - DNA, 15 bp, Homo sapiens
cgcttctcagtcagt

SEQ ID NO: 32829 - DNA, 15 bp, Homo sapiens
acgcttctcagtcag

SEQ ID NO: 32830 - DNA, 15 bp, Homo sapiens
aacgcttctcagtca

SEQ ID NO: 32831 - DNA, 15 bp, Homo sapiens
caacgcttctcagtc

SEQ ID NO: 32832 - DNA, 15 bp, Homo sapiens
gcaacgcttctcagt

SEQ ID NO: 32833 - DNA, 15 bp, Homo sapiens
tgcaacgcttctcag

SEQ ID NO: 32834 - DNA, 15 bp, Homo sapiens
ctgcaacgcttctca

SEQ ID NO: 32835 - DNA, 15 bp, Homo sapiens
tctgcaacgcttctc

SEQ ID NO: 32836 - DNA, 15 bp, Homo sapiens
atctgcaacgcttct

SEQ ID NO: 32837 - DNA, 15 bp, Homo sapiens
catctgcaacgcttc

SEQ ID NO: 32838 - DNA, 15 bp, Homo sapiens
tcatctgcaacgctt

SEQ ID NO: 32839 - DNA, 15 bp, Homo sapiens
ctcatctgcaacgct

SEQ ID NO: 32840 - DNA, 15 bp, Homo sapiens
actcatctgcaacgc

SEQ ID NO: 32841 - DNA, 15 bp, Homo sapiens
gactcatctgcaacg

SEQ ID NO: 32842 - DNA, 15 bp, Homo sapiens
ggactcatctgcaac

SEQ ID NO: 32843 - DNA, 15 bp, Homo sapiens
cggactcatctgcaa

SEQ ID NO: 32844 - DNA, 15 bp, Homo sapiens
acggactcatctgca

SEQ ID NO: 32845 - DNA, 15 bp, Homo sapiens
cacggactcatctgc

SEQ ID NO: 32846 - DNA, 15 bp, Homo sapiens
acacggactcatctg

SEQ ID NO: 32847 - DNA, 15 bp, Homo sapiens
tacacggactcatct

SEQ ID NO: 32848 - DNA, 15 bp, Homo sapiens
atacacggactcatc

SEQ ID NO: 32849 - DNA, 15 bp, Homo sapiens
aatacacggactcat

SEQ ID NO: 32850 - DNA, 15 bp, Homo sapiens
aaatacacggactca

SEQ ID NO: 32851 - DNA, 15 bp, Homo sapiens
caaatacacggactc

SEQ ID NO: 32852 - DNA, 15 bp, Homo sapiens
acaaatacacggact

SEQ ID NO: 32853 - DNA, 15 bp, Homo sapiens
aacaaatacacggac

SEQ ID NO: 32854 - DNA, 15 bp, Homo sapiens
aaacaaatacacgga

SEQ ID NO: 32855 - DNA, 15 bp, Homo sapiens
gaaacaaatacacgg

SEQ ID NO: 32856 - DNA, 15 bp, Homo sapiens
tgaaacaaatacacg

SEQ ID NO: 32857 - DNA, 15 bp, Homo sapiens
atgaaacaaatacac

SEQ ID NO: 32858 - DNA, 15 bp, Homo sapiens
aatgaaacaaataca

SEQ ID NO: 32859 - DNA, 15 bp, Homo sapiens
aaatgaaacaaatac

SEQ ID NO: 32860 - DNA, 15 bp, Homo sapiens
aaaatgaaacaaata

SEQ ID NO: 32861 - DNA, 15 bp, Homo sapiens
caaaatgaaacaaat

SEQ ID NO: 32862 - DNA, 15 bp, Homo sapiens
acaaaatgaaacaaa

SEQ ID NO: 32863 - DNA, 15 bp, Homo sapiens
cacaaaatgaaacaa

SEQ ID NO: 32864 - DNA, 15 bp, Homo sapiens
tcacaaaatgaaaca

SEQ ID NO: 32865 - DNA, 15 bp, Homo sapiens
atcacaaaatgaaac

SEQ ID NO: 32866 - DNA, 15 bp, Homo sapiens
aatcacaaaatgaaa

SEQ ID NO: 32867 - DNA, 15 bp, Homo sapiens
caatcacaaaatgaa

SEQ ID NO: 32868 - DNA, 15 bp, Homo sapiens
acaatcacaaaatga

SEQ ID NO: 32869 - DNA, 15 bp, Homo sapiens
aacaatcacaaaatg

SEQ ID NO: 32870 - DNA, 15 bp, Homo sapiens
aaacaatcacaaaat

SEQ ID NO: 32871 - DNA, 15 bp, Homo sapiens
gaaacaatcacaaaa

SEQ ID NO: 32872 - DNA, 15 bp, Homo sapiens
tgaaacaatcacaaa

SEQ ID NO: 32873 - DNA, 15 bp, Homo sapiens
ttgaaacaatcacaa

SEQ ID NO: 32874 - DNA, 15 bp, Homo sapiens
tttgaaacaatcaca

SEQ ID NO: 32875 - DNA, 15 bp, Homo sapiens
atttgaaacaatcac

SEQ ID NO: 32876 - DNA, 15 bp, Homo sapiens
aatttgaaacaatca

SEQ ID NO: 32877 - DNA, 15 bp, Homo sapiens
taatttgaaacaatc

SEQ ID NO: 32878 - DNA, 15 bp, Homo sapiens
ctaatttgaaacaat

SEQ ID NO: 32879 - DNA, 15 bp, Homo sapiens
gctaatttgaaacaa

SEQ ID NO: 32880 - DNA, 15 bp, Homo sapiens
tgctaatttgaaaca

SEQ ID NO: 32881 - DNA, 15 bp, Homo sapiens
gtgctaatttgaaac

SEQ ID NO: 32882 - DNA, 15 bp, Homo sapiens
tgtgctaatttgaaa

SEQ ID NO: 32883 - DNA, 15 bp, Homo sapiens
ttgtgctaatttgaa

SEQ ID NO: 32884 - DNA, 15 bp, Homo sapiens
tttgtgctaatttga

SEQ ID NO: 32885 - DNA, 15 bp, Homo sapiens
atttgtgctaatttg

SEQ ID NO: 32886 - DNA, 15 bp, Homo sapiens
aatttgtgctaattt

SEQ ID NO: 32887 - DNA, 15 bp, Homo sapiens
aaatttgtgctaatt

SEQ ID NO: 32888 - DNA, 15 bp, Homo sapiens
caaatttgtgctaat

SEQ ID NO: 32889 - DNA, 15 bp, Homo sapiens
tcaaatttgtgctaa

SEQ ID NO: 32890 - DNA, 15 bp, Homo sapiens
atcaaatttgtgcta

SEQ ID NO: 32891 - DNA, 15 bp, Homo sapiens
catcaaatttgtgct

SEQ ID NO: 32892 - DNA, 15 bp, Homo sapiens
ccatcaaatttgtgc

SEQ ID NO: 32893 - DNA, 15 bp, Homo sapiens
gccatcaaatttgtg

SEQ ID NO: 32894 - DNA, 15 bp, Homo sapiens
agccatcaaatttgt

SEQ ID NO: 32895 - DNA, 15 bp, Homo sapiens
aagccatcaaatttg

SEQ ID NO: 32896 - DNA, 15 bp, Homo sapiens
taagccatcaaattt

SEQ ID NO: 32897 - DNA, 15 bp, Homo sapiens
ttaagccatcaaatt

SEQ ID NO: 32898 - DNA, 15 bp, Homo sapiens
tttaagccatcaaat

SEQ ID NO: 32899 - DNA, 15 bp, Homo sapiens
ttttaagccatcaaa

SEQ ID NO: 32900 - DNA, 15 bp, Homo sapiens
gttttaagccatcaa

SEQ ID NO: 32901 - DNA, 15 bp, Homo sapiens
tgttttaagccatca

SEQ ID NO: 32902 - DNA, 15 bp, Homo sapiens
ttgttttaagccatc

SEQ ID NO: 32903 - DNA, 15 bp, Homo sapiens
gttgttttaagccat

SEQ ID NO: 32904 - DNA, 15 bp, Homo sapiens
tgttgttttaagcca

SEQ ID NO: 32905 - DNA, 15 bp, Homo sapiens
gtgttgttttaagcc

SEQ ID NO: 32906 - DNA, 15 bp, Homo sapiens
tgtgttgttttaagc

SEQ ID NO: 32907 - DNA, 15 bp, Homo sapiens
ttgtgttgttttaag

SEQ ID NO: 32908 - DNA, 15 bp, Homo sapiens
gttgtgttgttttaa

SEQ ID NO: 32909 - DNA, 15 bp, Homo sapiens
agttgtgttgtttta

SEQ ID NO: 32910 - DNA, 15 bp, Homo sapiens
aagttgtgttgtttt

SEQ ID NO: 32911 - DNA, 15 bp, Homo sapiens
aaagttgtgttgttt

SEQ ID NO: 32912 - DNA, 15 bp, Homo sapiens
taaagttgtgttgtt

SEQ ID NO: 32913 - DNA, 15 bp, Homo sapiens
gtaaagttgtgttgt

SEQ ID NO: 32914 - DNA, 15 bp, Homo sapiens
agtaaagttgtgttg

SEQ ID NO: 32915 - DNA, 15 bp, Homo sapiens
tagtaaagttgtgtt

SEQ ID NO: 32916 - DNA, 15 bp, Homo sapiens
atagtaaagttgtgt

SEQ ID NO: 32917 - DNA, 15 bp, Homo sapiens
gatagtaaagttgtg

SEQ ID NO: 32918 - DNA, 15 bp, Homo sapiens
agatagtaaagttgt

SEQ ID NO: 32919 - DNA, 15 bp, Homo sapiens
aagatagtaaagttg

SEQ ID NO: 32920 - DNA, 15 bp, Homo sapiens
taagatagtaaagtt

SEQ ID NO: 32921 - DNA, 15 bp, Homo sapiens
gtaagatagtaaagt

SEQ ID NO: 32922 - DNA, 15 bp, Homo sapiens
tgtaagatagtaaag

SEQ ID NO: 32923 - DNA, 15 bp, Homo sapiens
atgtaagatagtaaa

SEQ ID NO: 32924 - DNA, 15 bp, Homo sapiens
aatgtaagatagtaa

SEQ ID NO: 32925 - DNA, 15 bp, Homo sapiens
aaatgtaagatagta

SEQ ID NO: 32926 - DNA, 15 bp, Homo sapiens
gaaatgtaagatagt

SEQ ID NO: 32927 - DNA, 15 bp, Homo sapiens
agaaatgtaagatag

SEQ ID NO: 32928 - DNA, 15 bp, Homo sapiens
cagaaatgtaagata

SEQ ID NO: 32929 - DNA, 15 bp, Homo sapiens
tcagaaatgtaagat

SEQ ID NO: 32930 - DNA, 15 bp, Homo sapiens
ttcagaaatgtaaga

SEQ ID NO: 32931 - DNA, 15 bp, Homo sapiens
cttcagaaatgtaag

SEQ ID NO: 32932 - DNA, 15 bp, Homo sapiens
ccttcagaaatgtaa

SEQ ID NO: 32933 - DNA, 15 bp, Homo sapiens
accttcagaaatgta

SEQ ID NO: 32934 - DNA, 15 bp, Homo sapiens
aaccttcagaaatgt

SEQ ID NO: 32935 - DNA, 15 bp, Homo sapiens
taaccttcagaaatg

SEQ ID NO: 32936 - DNA, 15 bp, Homo sapiens
ctaaccttcagaaat

SEQ ID NO: 32937 - DNA, 15 bp, Homo sapiens
tctaaccttcagaaa

SEQ ID NO: 32938 - DNA, 15 bp, Homo sapiens
ttctaaccttcagaa

SEQ ID NO: 32939 - DNA, 15 bp, Homo sapiens
cttctaaccttcaga

SEQ ID NO: 32940 - DNA, 15 bp, Homo sapiens
acttctaaccttcag

SEQ ID NO: 32941 - DNA, 15 bp, Homo sapiens
gacttctaaccttca

SEQ ID NO: 32942 - DNA, 15 bp, Homo sapiens
agacttctaaccttc

SEQ ID NO: 32943 - DNA, 15 bp, Homo sapiens
cagacttctaacctt

SEQ ID NO: 32944 - DNA, 15 bp, Homo sapiens
tcagacttctaacct

SEQ ID NO: 32945 - DNA, 15 bp, Homo sapiens
gtcagacttctaacc

SEQ ID NO: 32946 - DNA, 15 bp, Homo sapiens
tgtcagacttctaac

SEQ ID NO: 32947 - DNA, 15 bp, Homo sapiens
gtgtcagacttctaa

SEQ ID NO: 32948 - DNA, 15 bp, Homo sapiens
cgtgtcagacttcta

SEQ ID NO: 32949 - DNA, 15 bp, Homo sapiens
ccgtgtcagacttct

SEQ ID NO: 32950 - DNA, 15 bp, Homo sapiens
cccgtgtcagacttc

SEQ ID NO: 32951 - DNA, 15 bp, Homo sapiens
acccgtgtcagactt

SEQ ID NO: 32952 - DNA, 15 bp, Homo sapiens
gacccgtgtcagact

SEQ ID NO: 32953 - DNA, 15 bp, Homo sapiens
agacccgtgtcagac

SEQ ID NO: 32954 - DNA, 15 bp, Homo sapiens
aagacccgtgtcaga

SEQ ID NO: 32955 - DNA, 15 bp, Homo sapiens
taagacccgtgtcag

SEQ ID NO: 32956 - DNA, 15 bp, Homo sapiens
gtaagacccgtgtca

SEQ ID NO: 32957 - DNA, 15 bp, Homo sapiens
agtaagacccgtgtc

SEQ ID NO: 32958 - DNA, 15 bp, Homo sapiens
cagtaagacccgtgt

SEQ ID NO: 32959 - DNA, 15 bp, Homo sapiens
tcagtaagacccgtg

SEQ ID NO: 32960 - DNA, 15 bp, Homo sapiens
ctcagtaagacccgt

SEQ ID NO: 32961 - DNA, 15 bp, Homo sapiens
gctcagtaagacccg

SEQ ID NO: 32962 - DNA, 15 bp, Homo sapiens
agctcagtaagaccc

SEQ ID NO: 32963 - DNA, 15 bp, Homo sapiens
tagctcagtaagacc

SEQ ID NO: 32964 - DNA, 15 bp, Homo sapiens
ttagctcagtaagac

SEQ ID NO: 32965 - DNA, 15 bp, Homo sapiens
tttagctcagtaaga

SEQ ID NO: 32966 - DNA, 15 bp, Homo sapiens
ttttagctcagtaag

SEQ ID NO: 32967 - DNA, 15 bp, Homo sapiens
attttagctcagtaa

SEQ ID NO: 32968 - DNA, 15 bp, Homo sapiens
cattttagctcagta

SEQ ID NO: 32969 - DNA, 15 bp, Homo sapiens
tcattttagctcagt

SEQ ID NO: 32970 - DNA, 15 bp, Homo sapiens
ttcattttagctcag

SEQ ID NO: 32971 - DNA, 15 bp, Homo sapiens
cttcattttagctca

SEQ ID NO: 32972 - DNA, 15 bp, Homo sapiens
ccttcattttagctc

SEQ ID NO: 32973 - DNA, 15 bp, Homo sapiens
accttcattttagct

SEQ ID NO: 32974 - DNA, 15 bp, Homo sapiens
caccttcattttagc

SEQ ID NO: 32975 - DNA, 15 bp, Homo sapiens
acaccttcattttag

SEQ ID NO: 32976 - DNA, 15 bp, Homo sapiens
aacaccttcatttta

SEQ ID NO: 32977 - DNA, 15 bp, Homo sapiens
caacaccttcatttt

SEQ ID NO: 32978 - DNA, 15 bp, Homo sapiens
tcaacaccttcattt

SEQ ID NO: 32979 - DNA, 15 bp, Homo sapiens
gtcaacaccttcatt

SEQ ID NO: 32980 - DNA, 15 bp, Homo sapiens
tgtcaacaccttcat

SEQ ID NO: 32981 - DNA, 15 bp, Homo sapiens
ctgtcaacaccttca

SEQ ID NO: 32982 - DNA, 15 bp, Homo sapiens
cctgtcaacaccttc

SEQ ID NO: 32983 - DNA, 15 bp, Homo sapiens
ccctgtcaacacctt

SEQ ID NO: 32984 - DNA, 15 bp, Homo sapiens
gccctgtcaacacct

SEQ ID NO: 32985 - DNA, 15 bp, Homo sapiens
ggccctgtcaacacc

SEQ ID NO: 32986 - DNA, 15 bp, Homo sapiens
tggccctgtcaacac

SEQ ID NO: 32987 - DNA, 15 bp, Homo sapiens
atggccctgtcaaca

SEQ ID NO: 32988 - DNA, 15 bp, Homo sapiens
catggccctgtcaac

SEQ ID NO: 32989 - DNA, 15 bp, Homo sapiens
acatggccctgtcaa

SEQ ID NO: 32990 - DNA, 15 bp, Homo sapiens
aacatggccctgtca

SEQ ID NO: 32991 - DNA, 15 bp, Homo sapiens
gaacatggccctgtc

SEQ ID NO: 32992 - DNA, 15 bp, Homo sapiens
ggaacatggccctgt

SEQ ID NO: 32993 - DNA, 15 bp, Homo sapiens
aggaacatggccctg

SEQ ID NO: 32994 - DNA, 15 bp, Homo sapiens
aaggaacatggccct

SEQ ID NO: 32995 - DNA, 15 bp, Homo sapiens
gaaggaacatggccc

SEQ ID NO: 32996 - DNA, 15 bp, Homo sapiens
agaaggaacatggcc

SEQ ID NO: 32997 - DNA, 15 bp, Homo sapiens
cagaaggaacatggc

SEQ ID NO: 32998 - DNA, 15 bp, Homo sapiens
ccagaaggaacatgg

SEQ ID NO: 32999 - DNA, 15 bp, Homo sapiens
tccagaaggaacatg

SEQ ID NO: 33000 - DNA, 15 bp, Homo sapiens
ttccagaaggaacat

SEQ ID NO: 33001 - DNA, 15 bp, Homo sapiens
cttccagaaggaaca

SEQ ID NO: 33002 - DNA, 15 bp, Homo sapiens
gcttccagaaggaac

SEQ ID NO: 33003 - DNA, 15 bp, Homo sapiens
agcttccagaaggaa

SEQ ID NO: 33004 - DNA, 15 bp, Homo sapiens
gagcttccagaagga

SEQ ID NO: 33005 - DNA, 15 bp, Homo sapiens
ggagcttccagaagg

SEQ ID NO: 33006 - DNA, 15 bp, Homo sapiens
tggagcttccagaag

SEQ ID NO: 33007 - DNA, 15 bp, Homo sapiens
ctggagcttccagaa

SEQ ID NO: 33008 - DNA, 15 bp, Homo sapiens
tctggagcttccaga

SEQ ID NO: 33009 - DNA, 15 bp, Homo sapiens
ctctggagcttccag

SEQ ID NO: 33010 - DNA, 15 bp, Homo sapiens
cctctggagcttcca

SEQ ID NO: 33011 - DNA, 15 bp, Homo sapiens
tcctctggagcttcc

SEQ ID NO: 33012 - DNA, 15 bp, Homo sapiens
ctcctctggagcttc

SEQ ID NO: 33013 - DNA, 15 bp, Homo sapiens
tctcctctggagctt

SEQ ID NO: 33014 - DNA, 15 bp, Homo sapiens
gtctcctctggagct

SEQ ID NO: 33015 - DNA, 15 bp, Homo sapiens
agtctcctctggagc

SEQ ID NO: 33016 - DNA, 15 bp, Homo sapiens
gagtctcctctggag

SEQ ID NO: 33017 - DNA, 15 bp, Homo sapiens
ggagtctcctctgga

SEQ ID NO: 33018 - DNA, 15 bp, Homo sapiens
aggagtctcctctgg

SEQ ID NO: 33019 - DNA, 15 bp, Homo sapiens
aaggagtctcctctg

SEQ ID NO: 33020 - DNA, 15 bp, Homo sapiens
aaaggagtctcctct

SEQ ID NO: 33021 - DNA, 15 bp, Homo sapiens
gaaaggagtctcctc

SEQ ID NO: 33022 - DNA, 15 bp, Homo sapiens
ggaaaggagtctcct

SEQ ID NO: 33023 - DNA, 15 bp, Homo sapiens
gggaaaggagtctcc

SEQ ID NO: 33024 - DNA, 15 bp, Homo sapiens
agggaaaggagtctc

SEQ ID NO: 33025 - DNA, 15 bp, Homo sapiens
cagggaaaggagtct

SEQ ID NO: 33026 - DNA, 15 bp, Homo sapiens
ccagggaaaggagtc

SEQ ID NO: 33027 - DNA, 15 bp, Homo sapiens
accagggaaaggagt

SEQ ID NO: 33028 - DNA, 15 bp, Homo sapiens
gaccagggaaaggag

SEQ ID NO: 33029 - DNA, 15 bp, Homo sapiens
agaccagggaaagga

SEQ ID NO: 33030 - DNA, 15 bp, Homo sapiens
aagaccagggaaagg

SEQ ID NO: 33031 - DNA, 15 bp, Homo sapiens
aaagaccagggaaag

SEQ ID NO: 33032 - DNA, 15 bp, Homo sapiens
aaaagaccagggaaa

SEQ ID NO: 33033 - DNA, 15 bp, Homo sapiens
gaaaagaccagggaa

SEQ ID NO: 33034 - DNA, 15 bp, Homo sapiens
ggaaaagaccaggga

SEQ ID NO: 33035 - DNA, 15 bp, Homo sapiens
tggaaaagaccaggg

SEQ ID NO: 33036 - DNA, 15 bp, Homo sapiens
ctggaaaagaccagg

SEQ ID NO: 33037 - DNA, 15 bp, Homo sapiens
gctggaaaagaccag

SEQ ID NO: 33038 - DNA, 15 bp, Homo sapiens
ggctggaaaagacca

SEQ ID NO: 33039 - DNA, 15 bp, Homo sapiens
aggctggaaaagacc

SEQ ID NO: 33040 - DNA, 15 bp, Homo sapiens
gaggctggaaaagac

SEQ ID NO: 33041 - DNA, 15 bp, Homo sapiens
ggaggctggaaaaga

SEQ ID NO: 33042 - DNA, 15 bp, Homo sapiens
tggaggctggaaaag

SEQ ID NO: 33043 - DNA, 15 bp, Homo sapiens
gtggaggctggaaaa

SEQ ID NO: 33044 - DNA, 15 bp, Homo sapiens
tgtggaggctggaaa

SEQ ID NO: 33045 - DNA, 15 bp, Homo sapiens
ctgtggaggctggaa

SEQ ID NO: 33046 - DNA, 15 bp, Homo sapiens
cctgtggaggctgga

SEQ ID NO: 33047 - DNA, 15 bp, Homo sapiens
gcctgtggaggctgg

SEQ ID NO: 33048 - DNA, 15 bp, Homo sapiens
agcctgtggaggctg

SEQ ID NO: 33049 - DNA, 15 bp, Homo sapiens
cagcctgtggaggct

SEQ ID NO: 33050 - DNA, 15 bp, Homo sapiens
gcagcctgtggaggc

SEQ ID NO: 33051 - DNA, 15 bp, Homo sapiens
ggcagcctgtggagg

SEQ ID NO: 33052 - DNA, 15 bp, Homo sapiens
gggcagcctgtggag

SEQ ID NO: 33053 - DNA, 15 bp, Homo sapiens
tgggcagcctgtgga

SEQ ID NO: 33054 - DNA, 15 bp, Homo sapiens
atgggcagcctgtgg

SEQ ID NO: 33055 - DNA, 15 bp, Homo sapiens
catgggcagcctgtg

SEQ ID NO: 33056 - DNA, 15 bp, Homo sapiens
acatgggcagcctgt

SEQ ID NO: 33057 - DNA, 15 bp, Homo sapiens
aacatgggcagcctg

SEQ ID NO: 33058 - DNA, 15 bp, Homo sapiens
aaacatgggcagcct

SEQ ID NO: 33059 - DNA, 15 bp, Homo sapiens
gaaacatgggcagcc

SEQ ID NO: 33060 - DNA, 15 bp, Homo sapiens
agaaacatgggcagc

SEQ ID NO: 33061 - DNA, 15 bp, Homo sapiens
aagaaacatgggcag

SEQ ID NO: 33062 - DNA, 15 bp, Homo sapiens
caagaaacatgggca

SEQ ID NO: 33063 - DNA, 15 bp, Homo sapiens
ccaagaaacatgggc

SEQ ID NO: 33064 - DNA, 15 bp, Homo sapiens
gccaagaaacatggg

SEQ ID NO: 33065 - DNA, 15 bp, Homo sapiens
agccaagaaacatgg

SEQ ID NO: 33066 - DNA, 15 bp, Homo sapiens
gagccaagaaacatg

SEQ ID NO: 33067 - DNA, 15 bp, Homo sapiens
tgagccaagaaacat

SEQ ID NO: 33068 - DNA, 15 bp, Homo sapiens
atgagccaagaaaca

SEQ ID NO: 33069 - DNA, 15 bp, Homo sapiens
catgagccaagaaac

SEQ ID NO: 33070 - DNA, 15 bp, Homo sapiens
ccatgagccaagaaa

SEQ ID NO: 33071 - DNA, 15 bp, Homo sapiens
gccatgagccaagaa

SEQ ID NO: 33072 - DNA, 15 bp, Homo sapiens
agccatgagccaaga

SEQ ID NO: 33073 - DNA, 15 bp, Homo sapiens
gagccatgagccaag

SEQ ID NO: 33074 - DNA, 15 bp, Homo sapiens
agagccatgagccaa

SEQ ID NO: 33075 - DNA, 15 bp, Homo sapiens
gagagccatgagcca

SEQ ID NO: 33076 - DNA, 15 bp, Homo sapiens
agagagccatgagcc

SEQ ID NO: 33077 - DNA, 15 bp, Homo sapiens
aagagagccatgagc

SEQ ID NO: 33078 - DNA, 15 bp, Homo sapiens
aaagagagccatgag

SEQ ID NO: 33079 - DNA, 15 bp, Homo sapiens
taaagagagccatga

SEQ ID NO: 33080 - DNA, 15 bp, Homo sapiens
ctaaagagagccatg

SEQ ID NO: 33081 - DNA, 15 bp, Homo sapiens
actaaagagagccat

SEQ ID NO: 33082 - DNA, 15 bp, Homo sapiens
gactaaagagagcca

SEQ ID NO: 33083 - DNA, 15 bp, Homo sapiens
agactaaagagagcc

SEQ ID NO: 33084 - DNA, 15 bp, Homo sapiens
aagactaaagagagc

SEQ ID NO: 33085 - DNA, 15 bp, Homo sapiens
gaagactaaagagag

SEQ ID NO: 33086 - DNA, 15 bp, Homo sapiens
tgaagactaaagaga

SEQ ID NO: 33087 - DNA, 15 bp, Homo sapiens
ttgaagactaaagag

SEQ ID NO: 33088 - DNA, 15 bp, Homo sapiens
tttgaagactaaaga

SEQ ID NO: 33089 - DNA, 15 bp, Homo sapiens
ttttgaagactaaag

SEQ ID NO: 33090 - DNA, 15 bp, Homo sapiens
gttttgaagactaaa

SEQ ID NO: 33091 - DNA, 15 bp, Homo sapiens
ggttttgaagactaa

SEQ ID NO: 33092 - DNA, 15 bp, Homo sapiens
tggttttgaagacta

SEQ ID NO: 33093 - DNA, 15 bp, Homo sapiens
ttggttttgaagact

SEQ ID NO: 33094 - DNA, 15 bp, Homo sapiens
gttggttttgaagac

SEQ ID NO: 33095 - DNA, 15 bp, Homo sapiens
tgttggttttgaaga

SEQ ID NO: 33096 - DNA, 15 bp, Homo sapiens
ctgttggttttgaag

SEQ ID NO: 33097 - DNA, 15 bp, Homo sapiens
actgttggttttgaa

SEQ ID NO: 33098 - DNA, 15 bp, Homo sapiens
cactgttggttttga

SEQ ID NO: 33099 - DNA, 15 bp, Homo sapiens
ccactgttggttttg

SEQ ID NO: 33100 - DNA, 15 bp, Homo sapiens
accactgttggtttt

SEQ ID NO: 33101 - DNA, 15 bp, Homo sapiens
caccactgttggttt

SEQ ID NO: 33102 - DNA, 15 bp, Homo sapiens
ccaccactgttggtt

SEQ ID NO: 33103 - DNA, 15 bp, Homo sapiens
cccaccactgttggt

SEQ ID NO: 33104 - DNA, 15 bp, Homo sapiens
gcccaccactgttgg

SEQ ID NO: 33105 - DNA, 15 bp, Homo sapiens
agcccaccactgttg

SEQ ID NO: 33106 - DNA, 15 bp, Homo sapiens
cagcccaccactgtt

SEQ ID NO: 33107 - DNA, 15 bp, Homo sapiens
tcagcccaccactgt

SEQ ID NO: 33108 - DNA, 15 bp, Homo sapiens
ctcagcccaccactg

SEQ ID NO: 33109 - DNA, 15 bp, Homo sapiens
actcagcccaccact

SEQ ID NO: 33110 - DNA, 15 bp, Homo sapiens
gactcagcccaccac

SEQ ID NO: 33111 - DNA, 15 bp, Homo sapiens
ggactcagcccacca

SEQ ID NO: 33112 - DNA, 15 bp, Homo sapiens
aggactcagcccacc

SEQ ID NO: 33113 - DNA, 15 bp, Homo sapiens
aaggactcagcccac

SEQ ID NO: 33114 - DNA, 15 bp, Homo sapiens
gaaggactcagccca

SEQ ID NO: 33115 - DNA, 15 bp, Homo sapiens
agaaggactcagccc

SEQ ID NO: 33116 - DNA, 15 bp, Homo sapiens
gagaaggactcagcc

SEQ ID NO: 33117 - DNA, 15 bp, Homo sapiens
tgagaaggactcagc

SEQ ID NO: 33118 - DNA, 15 bp, Homo sapiens
atgagaaggactcag

SEQ ID NO: 33119 - DNA, 15 bp, Homo sapiens
catgagaaggactca

SEQ ID NO: 33120 - DNA, 15 bp, Homo sapiens
acatgagaaggactc

SEQ ID NO: 33121 - DNA, 15 bp, Homo sapiens
cacatgagaaggact

SEQ ID NO: 33122 - DNA, 15 bp, Homo sapiens
ccacatgagaaggac

SEQ ID NO: 33123 - DNA, 15 bp, Homo sapiens
gccacatgagaagga

SEQ ID NO: 33124 - DNA, 15 bp, Homo sapiens
agccacatgagaagg

SEQ ID NO: 33125 - DNA, 15 bp, Homo sapiens
gagccacatgagaag

SEQ ID NO: 33126 - DNA, 15 bp, Homo sapiens
cgagccacatgagaa

SEQ ID NO: 33127 - DNA, 15 bp, Homo sapiens
acgagccacatgaga

SEQ ID NO: 33128 - DNA, 15 bp, Homo sapiens
aacgagccacatgag

SEQ ID NO: 33129 - DNA, 15 bp, Homo sapiens
caacgagccacatga

SEQ ID NO: 33130 - DNA, 15 bp, Homo sapiens
gcaacgagccacatg

SEQ ID NO: 33131 - DNA, 15 bp, Homo sapiens
agcaacgagccacat

SEQ ID NO: 33132 - DNA, 15 bp, Homo sapiens
gagcaacgagccaca

SEQ ID NO: 33133 - DNA, 15 bp, Homo sapiens
cgagcaacgagccac

SEQ ID NO: 33134 - DNA, 15 bp, Homo sapiens
gcgagcaacgagcca

SEQ ID NO: 33135 - DNA, 15 bp, Homo sapiens
agcgagcaacgagcc

SEQ ID NO: 33136 - DNA, 15 bp, Homo sapiens
gagcgagcaacgagc

SEQ ID NO: 33137 - DNA, 15 bp, Homo sapiens
agagcgagcaacgag

SEQ ID NO: 33138 - DNA, 15 bp, Homo sapiens
cagagcgagcaacga

SEQ ID NO: 33139 - DNA, 15 bp, Homo sapiens
gcagagcgagcaacg

SEQ ID NO: 33140 - DNA, 15 bp, Homo sapiens
agcagagcgagcaac

SEQ ID NO: 33141 - DNA, 15 bp, Homo sapiens
tagcagagcgagcaa

SEQ ID NO: 33142 - DNA, 15 bp, Homo sapiens
atagcagagcgagca

SEQ ID NO: 33143 - DNA, 15 bp, Homo sapiens
aatagcagagcgagc

SEQ ID NO: 33144 - DNA, 15 bp, Homo sapiens
gaatagcagagcgag

SEQ ID NO: 33145 - DNA, 15 bp, Homo sapiens
tgaatagcagagcga

SEQ ID NO: 33146 - DNA, 15 bp, Homo sapiens
ttgaatagcagagcg

SEQ ID NO: 33147 - DNA, 15 bp, Homo sapiens
gttgaatagcagagc

SEQ ID NO: 33148 - DNA, 15 bp, Homo sapiens
agttgaatagcagag

SEQ ID NO: 33149 - DNA, 15 bp, Homo sapiens
gagttgaatagcaga

SEQ ID NO: 33150 - DNA, 15 bp, Homo sapiens
agagttgaatagcag

SEQ ID NO: 33151 - DNA, 15 bp, Homo sapiens
gagagttgaatagca

SEQ ID NO: 33152 - DNA, 15 bp, Homo sapiens
agagagttgaatagc

SEQ ID NO: 33153 - DNA, 15 bp, Homo sapiens
aagagagttgaatag

SEQ ID NO: 33154 - DNA, 15 bp, Homo sapiens
gaagagagttgaata

SEQ ID NO: 33155 - DNA, 15 bp, Homo sapiens
ggaagagagttgaat

SEQ ID NO: 33156 - DNA, 15 bp, Homo sapiens
aggaagagagttgaa

SEQ ID NO: 33157 - DNA, 15 bp, Homo sapiens
aaggaagagagttga

SEQ ID NO: 33158 - DNA, 15 bp, Homo sapiens
aaaggaagagagttg

SEQ ID NO: 33159 - DNA, 15 bp, Homo sapiens
aaaaggaagagagtt

SEQ ID NO: 33160 - DNA, 15 bp, Homo sapiens
gaaaaggaagagagt

SEQ ID NO: 33161 - DNA, 15 bp, Homo sapiens
ggaaaaggaagagag

SEQ ID NO: 33162 - DNA, 15 bp, Homo sapiens
tggaaaaggaagaga

SEQ ID NO: 33163 - DNA, 15 bp, Homo sapiens
gtggaaaaggaagag

SEQ ID NO: 33164 - DNA, 15 bp, Homo sapiens
agtggaaaaggaaga

SEQ ID NO: 33165 - DNA, 15 bp, Homo sapiens
aagtggaaaaggaag

SEQ ID NO: 33166 - DNA, 15 bp, Homo sapiens
taagtggaaaaggaa

SEQ ID NO: 33167 - DNA, 15 bp, Homo sapiens
ctaagtggaaaagga

SEQ ID NO: 33168 - DNA, 15 bp, Homo sapiens
tctaagtggaaaagg

SEQ ID NO: 33169 - DNA, 15 bp, Homo sapiens
ttctaagtggaaaag

SEQ ID NO: 33170 - DNA, 15 bp, Homo sapiens
cttctaagtggaaaa

SEQ ID NO: 33171 - DNA, 15 bp, Homo sapiens
ccttctaagtggaaa

SEQ ID NO: 33172 - DNA, 15 bp, Homo sapiens
gccttctaagtggaa

SEQ ID NO: 33173 - DNA, 15 bp, Homo sapiens
ggccttctaagtgga

SEQ ID NO: 33174 - DNA, 15 bp, Homo sapiens
gggccttctaagtgg

SEQ ID NO: 33175 - DNA, 15 bp, Homo sapiens
ggggccttctaagtg

SEQ ID NO: 33176 - DNA, 15 bp, Homo sapiens
aggggccttctaagt

SEQ ID NO: 33177 - DNA, 15 bp, Homo sapiens
aaggggccttctaag

SEQ ID NO: 33178 - DNA, 15 bp, Homo sapiens
caaggggccttctaa

SEQ ID NO: 33179 - DNA, 15 bp, Homo sapiens
acaaggggccttcta

SEQ ID NO: 33180 - DNA, 15 bp, Homo sapiens
cacaaggggccttct

SEQ ID NO: 33181 - DNA, 15 bp, Homo sapiens
tcacaaggggccttc

SEQ ID NO: 33182 - DNA, 15 bp, Homo sapiens
atcacaaggggcctt

SEQ ID NO: 33183 - DNA, 15 bp, Homo sapiens
aatcacaaggggcct

SEQ ID NO: 33184 - DNA, 15 bp, Homo sapiens
aaatcacaaggggcc

SEQ ID NO: 33185 - DNA, 15 bp, Homo sapiens
gaaatcacaaggggc

SEQ ID NO: 33186 - DNA, 15 bp, Homo sapiens
tgaaatcacaagggg

SEQ ID NO: 33187 - DNA, 15 bp, Homo sapiens
gtgaaatcacaaggg

SEQ ID NO: 33188 - DNA, 15 bp, Homo sapiens
agtgaaatcacaagg

SEQ ID NO: 33189 - DNA, 15 bp, Homo sapiens
cagtgaaatcacaag

SEQ ID NO: 33190 - DNA, 15 bp, Homo sapiens
ccagtgaaatcacaa

SEQ ID NO: 33191 - DNA, 15 bp, Homo sapiens
cccagtgaaatcaca

SEQ ID NO: 33192 - DNA, 15 bp, Homo sapiens
gcccagtgaaatcac

SEQ ID NO: 33193 - DNA, 15 bp, Homo sapiens
tgcccagtgaaatca

SEQ ID NO: 33194 - DNA, 15 bp, Homo sapiens
gtgcccagtgaaatc

SEQ ID NO: 33195 - DNA, 15 bp, Homo sapiens
tgtgcccagtgaaat

SEQ ID NO: 33196 - DNA, 15 bp, Homo sapiens
gtgtgcccagtgaaa

SEQ ID NO: 33197 - DNA, 15 bp, Homo sapiens
ggtgtgcccagtgaa

SEQ ID NO: 33198 - DNA, 15 bp, Homo sapiens
tggtgtgcccagtga

SEQ ID NO: 33199 - DNA, 15 bp, Homo sapiens
ctggtgtgcccagtg

SEQ ID NO: 33200 - DNA, 15 bp, Homo sapiens
cctggtgtgcccagt

SEQ ID NO: 33201 - DNA, 15 bp, Homo sapiens
gcctggtgtgcccag

SEQ ID NO: 33202 - DNA, 15 bp, Homo sapiens
agcctggtgtgccca

SEQ ID NO: 33203 - DNA, 15 bp, Homo sapiens
tagcctggtgtgccc

SEQ ID NO: 33204 - DNA, 15 bp, Homo sapiens
ttagcctggtgtgcc

SEQ ID NO: 33205 - DNA, 15 bp, Homo sapiens
gttagcctggtgtgc

SEQ ID NO: 33206 - DNA, 15 bp, Homo sapiens
ggttagcctggtgtg

SEQ ID NO: 33207 - DNA, 15 bp, Homo sapiens
gggttagcctggtgt

SEQ ID NO: 33208 - DNA, 15 bp, Homo sapiens
tgggttagcctggtg

SEQ ID NO: 33209 - DNA, 15 bp, Homo sapiens
ttgggttagcctggt

SEQ ID NO: 33210 - DNA, 15 bp, Homo sapiens
cttgggttagcctgg

SEQ ID NO: 33211 - DNA, 15 bp, Homo sapiens
tcttgggttagcctg

SEQ ID NO: 33212 - DNA, 15 bp, Homo sapiens
atcttgggttagcct

SEQ ID NO: 33213 - DNA, 15 bp, Homo sapiens
tatcttgggttagcc

SEQ ID NO: 33214 - DNA, 15 bp, Homo sapiens
ttatcttgggttagc

SEQ ID NO: 33215 - DNA, 15 bp, Homo sapiens
gttatcttgggttag

SEQ ID NO: 33216 - DNA, 15 bp, Homo sapiens
ggttatcttgggtta

SEQ ID NO: 33217 - DNA, 15 bp, Homo sapiens
aggttatcttgggtt

SEQ ID NO: 33218 - DNA, 15 bp, Homo sapiens
aaggttatcttgggt

SEQ ID NO: 33219 - DNA, 15 bp, Homo sapiens
gaaggttatcttggg

SEQ ID NO: 33220 - DNA, 15 bp, Homo sapiens
agaaggttatcttgg

SEQ ID NO: 33221 - DNA, 15 bp, Homo sapiens
tagaaggttatcttg

SEQ ID NO: 33222 - DNA, 15 bp, Homo sapiens
atagaaggttatctt

SEQ ID NO: 33223 - DNA, 15 bp, Homo sapiens
gatagaaggttatct

SEQ ID NO: 33224 - DNA, 15 bp, Homo sapiens
ggatagaaggttatc

SEQ ID NO: 33225 - DNA, 15 bp, Homo sapiens
aggatagaaggttat

SEQ ID NO: 33226 - DNA, 15 bp, Homo sapiens
taggatagaaggtta

SEQ ID NO: 33227 - DNA, 15 bp, Homo sapiens
ttaggatagaaggtt

SEQ ID NO: 33228 - DNA, 15 bp, Homo sapiens
tttaggatagaaggt

SEQ ID NO: 33229 - DNA, 15 bp, Homo sapiens
ctttaggatagaagg

SEQ ID NO: 33230 - DNA, 15 bp, Homo sapiens
actttaggatagaag

SEQ ID NO: 33231 - DNA, 15 bp, Homo sapiens
gactttaggatagaa

SEQ ID NO: 33232 - DNA, 15 bp, Homo sapiens
tgactttaggataga

SEQ ID NO: 33233 - DNA, 15 bp, Homo sapiens
ctgactttaggatag

SEQ ID NO: 33234 - DNA, 15 bp, Homo sapiens
actgactttaggata

SEQ ID NO: 33235 - DNA, 15 bp, Homo sapiens
aactgactttaggat

SEQ ID NO: 33236 - DNA, 15 bp, Homo sapiens
caactgactttagga

SEQ ID NO: 33237 - DNA, 15 bp, Homo sapiens
tcaactgactttagg

SEQ ID NO: 33238 - DNA, 15 bp, Homo sapiens
atcaactgactttag

SEQ ID NO: 33239 - DNA, 15 bp, Homo sapiens
aatcaactgacttta

SEQ ID NO: 33240 - DNA, 15 bp, Homo sapiens
taatcaactgacttt

SEQ ID NO: 33241 - DNA, 15 bp, Homo sapiens
ctaatcaactgactt

SEQ ID NO: 33242 - DNA, 15 bp, Homo sapiens
gctaatcaactgact

SEQ ID NO: 33243 - DNA, 15 bp, Homo sapiens
tgctaatcaactgac

SEQ ID NO: 33244 - DNA, 15 bp, Homo sapiens
ttgctaatcaactga

SEQ ID NO: 33245 - DNA, 15 bp, Homo sapiens
tttgctaatcaactg

SEQ ID NO: 33246 - DNA, 15 bp, Homo sapiens
gtttgctaatcaact

SEQ ID NO: 33247 - DNA, 15 bp, Homo sapiens
tgtttgctaatcaac

SEQ ID NO: 33248 - DNA, 15 bp, Homo sapiens
ttgtttgctaatcaa

SEQ ID NO: 33249 - DNA, 15 bp, Homo sapiens
attgtttgctaatca

SEQ ID NO: 33250 - DNA, 15 bp, Homo sapiens
tattgtttgctaatc

SEQ ID NO: 33251 - DNA, 15 bp, Homo sapiens
gtattgtttgctaat

SEQ ID NO: 33252 - DNA, 15 bp, Homo sapiens
agtattgtttgctaa

SEQ ID NO: 33253 - DNA, 15 bp, Homo sapiens
aagtattgtttgcta

SEQ ID NO: 33254 - DNA, 15 bp, Homo sapiens
aaagtattgtttgct

SEQ ID NO: 33255 - DNA, 15 bp, Homo sapiens
gaaagtattgtttgc

SEQ ID NO: 33256 - DNA, 15 bp, Homo sapiens
tgaaagtattgtttg

SEQ ID NO: 33257 - DNA, 15 bp, Homo sapiens
atgaaagtattgttt

SEQ ID NO: 33258 - DNA, 15 bp, Homo sapiens
gatgaaagtattgtt

SEQ ID NO: 33259 - DNA, 15 bp, Homo sapiens
agatgaaagtattgt

SEQ ID NO: 33260 - DNA, 15 bp, Homo sapiens
cagatgaaagtattg

SEQ ID NO: 33261 - DNA, 15 bp, Homo sapiens
gcagatgaaagtatt

SEQ ID NO: 33262 - DNA, 15 bp, Homo sapiens
tgcagatgaaagtat

SEQ ID NO: 33263 - DNA, 15 bp, Homo sapiens
ttgcagatgaaagta

SEQ ID NO: 33264 - DNA, 15 bp, Homo sapiens
gttgcagatgaaagt

SEQ ID NO: 33265 - DNA, 15 bp, Homo sapiens
ggttgcagatgaaag

SEQ ID NO: 33266 - DNA, 15 bp, Homo sapiens
aggttgcagatgaaa

SEQ ID NO: 33267 - DNA, 15 bp, Homo sapiens
gaggttgcagatgaa

SEQ ID NO: 33268 - DNA, 15 bp, Homo sapiens
tgaggttgcagatga

SEQ ID NO: 33269 - DNA, 15 bp, Homo sapiens
ttgaggttgcagatg

SEQ ID NO: 33270 - DNA, 15 bp, Homo sapiens
attgaggttgcagat

SEQ ID NO: 33271 - DNA, 15 bp, Homo sapiens
aattgaggttgcaga

SEQ ID NO: 33272 - DNA, 15 bp, Homo sapiens
aaattgaggttgcag

SEQ ID NO: 33273 - DNA, 15 bp, Homo sapiens
taaattgaggttgca

SEQ ID NO: 33274 - DNA, 15 bp, Homo sapiens
gtaaattgaggttgc

SEQ ID NO: 33275 - DNA, 15 bp, Homo sapiens
ggtaaattgaggttg

SEQ ID NO: 33276 - DNA, 15 bp, Homo sapiens
gggtaaattgaggtt

SEQ ID NO: 33277 - DNA, 15 bp, Homo sapiens
ggggtaaattgaggt

SEQ ID NO: 33278 - DNA, 15 bp, Homo sapiens
aggggtaaattgagg

SEQ ID NO: 33279 - DNA, 15 bp, Homo sapiens
aaggggtaaattgag

SEQ ID NO: 33280 - DNA, 15 bp, Homo sapiens
caaggggtaaattga

SEQ ID NO: 33281 - DNA, 15 bp, Homo sapiens
gcaaggggtaaattg

SEQ ID NO: 33282 - DNA, 15 bp, Homo sapiens
agcaaggggtaaatt

SEQ ID NO: 33283 - DNA, 15 bp, Homo sapiens
cagcaaggggtaaat

SEQ ID NO: 33284 - DNA, 15 bp, Homo sapiens
acagcaaggggtaaa

SEQ ID NO: 33285 - DNA, 15 bp, Homo sapiens
cacagcaaggggtaa

SEQ ID NO: 33286 - DNA, 15 bp, Homo sapiens
acacagcaaggggta

SEQ ID NO: 33287 - DNA, 15 bp, Homo sapiens
tacacagcaaggggt

SEQ ID NO: 33288 - DNA, 15 bp, Homo sapiens
ttacacagcaagggg

SEQ ID NO: 33289 - DNA, 15 bp, Homo sapiens
gttacacagcaaggg

SEQ ID NO: 33290 - DNA, 15 bp, Homo sapiens
ggttacacagcaagg

SEQ ID NO: 33291 - DNA, 15 bp, Homo sapiens
aggttacacagcaag

SEQ ID NO: 33292 - DNA, 15 bp, Homo sapiens
taggttacacagcaa

SEQ ID NO: 33293 - DNA, 15 bp, Homo sapiens
ttaggttacacagca

SEQ ID NO: 33294 - DNA, 15 bp, Homo sapiens
cttaggttacacagc

SEQ ID NO: 33295 - DNA, 15 bp, Homo sapiens
ccttaggttacacag

SEQ ID NO: 33296 - DNA, 15 bp, Homo sapiens
accttaggttacaca

SEQ ID NO: 33297 - DNA, 15 bp, Homo sapiens
taccttaggttacac

SEQ ID NO: 33298 - DNA, 15 bp, Homo sapiens
gtaccttaggttaca

SEQ ID NO: 33299 - DNA, 15 bp, Homo sapiens
agtaccttaggttac

SEQ ID NO: 33300 - DNA, 15 bp, Homo sapiens
gagtaccttaggtta

SEQ ID NO: 33301 - DNA, 15 bp, Homo sapiens
tgagtaccttaggtt

SEQ ID NO: 33302 - DNA, 15 bp, Homo sapiens
gtgagtaccttaggt

SEQ ID NO: 33303 - DNA, 15 bp, Homo sapiens
tgtgagtaccttagg

SEQ ID NO: 33304 - DNA, 15 bp, Homo sapiens
ctgtgagtaccttag

SEQ ID NO: 33305 - DNA, 15 bp, Homo sapiens
cctgtgagtacctta

SEQ ID NO: 33306 - DNA, 15 bp, Homo sapiens
tcctgtgagtacctt

SEQ ID NO: 33307 - DNA, 15 bp, Homo sapiens
gtcctgtgagtacct

SEQ ID NO: 33308 - DNA, 15 bp, Homo sapiens
tgtcctgtgagtacc

SEQ ID NO: 33309 - DNA, 15 bp, Homo sapiens
atgtcctgtgagtac

SEQ ID NO: 33310 - DNA, 15 bp, Homo sapiens
catgtcctgtgagta

SEQ ID NO: 33311 - DNA, 15 bp, Homo sapiens
ccatgtcctgtgagt

SEQ ID NO: 33312 - DNA, 15 bp, Homo sapiens
cccatgtcctgtgag

SEQ ID NO: 33313 - DNA, 15 bp, Homo sapiens
gcccatgtcctgtga

SEQ ID NO: 33314 - DNA, 15 bp, Homo sapiens
ggcccatgtcctgtg

SEQ ID NO: 33315 - DNA, 15 bp, Homo sapiens
aggcccatgtcctgt

SEQ ID NO: 33316 - DNA, 15 bp, Homo sapiens
gaggcccatgtcctg

SEQ ID NO: 33317 - DNA, 15 bp, Homo sapiens
agaggcccatgtcct

SEQ ID NO: 33318 - DNA, 15 bp, Homo sapiens
aagaggcccatgtcc

SEQ ID NO: 33319 - DNA, 15 bp, Homo sapiens
aaagaggcccatgtc

SEQ ID NO: 33320 - DNA, 15 bp, Homo sapiens
aaaagaggcccatgt

SEQ ID NO: 33321 - DNA, 15 bp, Homo sapiens
caaaagaggcccatg

SEQ ID NO: 33322 - DNA, 15 bp, Homo sapiens
gcaaaagaggcccat

SEQ ID NO: 33323 - DNA, 15 bp, Homo sapiens
tgcaaaagaggccca

SEQ ID NO: 33324 - DNA, 15 bp, Homo sapiens
ttgcaaaagaggccc

SEQ ID NO: 33325 - DNA, 15 bp, Homo sapiens
cttgcaaaagaggcc

SEQ ID NO: 33326 - DNA, 15 bp, Homo sapiens
acttgcaaaagaggc

SEQ ID NO: 33327 - DNA, 15 bp, Homo sapiens
cacttgcaaaagagg

SEQ ID NO: 33328 - DNA, 15 bp, Homo sapiens
ccacttgcaaaagag

SEQ ID NO: 33329 - DNA, 15 bp, Homo sapiens
tccacttgcaaaaga

SEQ ID NO: 33330 - DNA, 15 bp, Homo sapiens
ctccacttgcaaaag

SEQ ID NO: 33331 - DNA, 15 bp, Homo sapiens
tctccacttgcaaaa

SEQ ID NO: 33332 - DNA, 15 bp, Homo sapiens
ctctccacttgcaaa

SEQ ID NO: 33333 - DNA, 15 bp, Homo sapiens
cctctccacttgcaa

SEQ ID NO: 33334 - DNA, 15 bp, Homo sapiens
tcctctccacttgca

SEQ ID NO: 33335 - DNA, 15 bp, Homo sapiens
ttcctctccacttgc

SEQ ID NO: 33336 - DNA, 15 bp, Homo sapiens
cttcctctccacttg

SEQ ID NO: 33337 - DNA, 15 bp, Homo sapiens
tcttcctctccactt

SEQ ID NO: 33338 - DNA, 15 bp, Homo sapiens
ttcttcctctccact

SEQ ID NO: 33339 - DNA, 15 bp, Homo sapiens
cttcttcctctccac

SEQ ID NO: 33340 - DNA, 15 bp, Homo sapiens
tcttcttcctctcca

SEQ ID NO: 33341 - DNA, 15 bp, Homo sapiens
atcttcttcctctcc

SEQ ID NO: 33342 - DNA, 15 bp, Homo sapiens
catcttcttcctctc

SEQ ID NO: 33343 - DNA, 15 bp, Homo sapiens
acatcttcttcctct

SEQ ID NO: 33344 - DNA, 15 bp, Homo sapiens
tacatcttcttcctc

SEQ ID NO: 33345 - DNA, 15 bp, Homo sapiens
atacatcttcttcct

SEQ ID NO: 33346 - DNA, 15 bp, Homo sapiens
aatacatcttcttcc

SEQ ID NO: 33347 - DNA, 15 bp, Homo sapiens
taatacatcttcttc

SEQ ID NO: 33348 - DNA, 15 bp, Homo sapiens
ataatacatcttctt

SEQ ID NO: 33349 - DNA, 15 bp, Homo sapiens
aataatacatcttct

SEQ ID NO: 33350 - DNA, 15 bp, Homo sapiens
gaataatacatcttc

SEQ ID NO: 33351 - DNA, 15 bp, Homo sapiens
agaataatacatctt

SEQ ID NO: 33352 - DNA, 15 bp, Homo sapiens
cagaataatacatct

SEQ ID NO: 33353 - DNA, 15 bp, Homo sapiens
gcagaataatacatc

SEQ ID NO: 33354 - DNA, 15 bp, Homo sapiens
agcagaataatacat

SEQ ID NO: 33355 - DNA, 15 bp, Homo sapiens
aagcagaataataca

SEQ ID NO: 33356 - DNA, 15 bp, Homo sapiens
caagcagaataatac

SEQ ID NO: 33357 - DNA, 15 bp, Homo sapiens
gcaagcagaataata

SEQ ID NO: 33358 - DNA, 15 bp, Homo sapiens
ggcaagcagaataat

SEQ ID NO: 33359 - DNA, 15 bp, Homo sapiens
tggcaagcagaataa

SEQ ID NO: 33360 - DNA, 15 bp, Homo sapiens
gtggcaagcagaata

SEQ ID NO: 33361 - DNA, 15 bp, Homo sapiens
tgtggcaagcagaat

SEQ ID NO: 33362 - DNA, 15 bp, Homo sapiens
atgtggcaagcagaa

SEQ ID NO: 33363 - DNA, 15 bp, Homo sapiens
aatgtggcaagcaga

SEQ ID NO: 33364 - DNA, 15 bp, Homo sapiens
caatgtggcaagcag

SEQ ID NO: 33365 - DNA, 15 bp, Homo sapiens
gcaatgtggcaagca

SEQ ID NO: 33366 - DNA, 15 bp, Homo sapiens
cgcaatgtggcaagc

SEQ ID NO: 33367 - DNA, 15 bp, Homo sapiens
acgcaatgtggcaag

SEQ ID NO: 33368 - DNA, 15 bp, Homo sapiens
tacgcaatgtggcaa

SEQ ID NO: 33369 - DNA, 15 bp, Homo sapiens
ctacgcaatgtggca

SEQ ID NO: 33370 - DNA, 15 bp, Homo sapiens
gctacgcaatgtggc

SEQ ID NO: 33371 - DNA, 15 bp, Homo sapiens
agctacgcaatgtgg

SEQ ID NO: 33372 - DNA, 15 bp, Homo sapiens
gagctacgcaatgtg

SEQ ID NO: 33373 - DNA, 15 bp, Homo sapiens
agagctacgcaatgt

SEQ ID NO: 33374 - DNA, 15 bp, Homo sapiens
aagagctacgcaatg

SEQ ID NO: 33375 - DNA, 15 bp, Homo sapiens
caagagctacgcaat

SEQ ID NO: 33376 - DNA, 15 bp, Homo sapiens
tcaagagctacgcaa

SEQ ID NO: 33377 - DNA, 15 bp, Homo sapiens
atcaagagctacgca

SEQ ID NO: 33378 - DNA, 15 bp, Homo sapiens
aatcaagagctacgc

SEQ ID NO: 33379 - DNA, 15 bp, Homo sapiens
aaatcaagagctacg

SEQ ID NO: 33380 - DNA, 15 bp, Homo sapiens
aaaatcaagagctac

SEQ ID NO: 33381 - DNA, 15 bp, Homo sapiens
gaaaatcaagagcta

SEQ ID NO: 33382 - DNA, 15 bp, Homo sapiens
tgaaaatcaagagct

SEQ ID NO: 33383 - DNA, 15 bp, Homo sapiens
gtgaaaatcaagagc

SEQ ID NO: 33384 - DNA, 15 bp, Homo sapiens
agtgaaaatcaagag

SEQ ID NO: 33385 - DNA, 15 bp, Homo sapiens
aagtgaaaatcaaga

SEQ ID NO: 33386 - DNA, 15 bp, Homo sapiens
gaagtgaaaatcaag

SEQ ID NO: 33387 - DNA, 15 bp, Homo sapiens
agaagtgaaaatcaa

SEQ ID NO: 33388 - DNA, 15 bp, Homo sapiens
aagaagtgaaaatca

SEQ ID NO: 33389 - DNA, 15 bp, Homo sapiens
aaagaagtgaaaatc

SEQ ID NO: 33390 - DNA, 15 bp, Homo sapiens
aaaagaagtgaaaat

SEQ ID NO: 33391 - DNA, 15 bp, Homo sapiens
taaaagaagtgaaaa

SEQ ID NO: 33392 - DNA, 15 bp, Homo sapiens
ttaaaagaagtgaaa

SEQ ID NO: 33393 - DNA, 15 bp, Homo sapiens
tttaaaagaagtgaa

SEQ ID NO: 33394 - DNA, 15 bp, Homo sapiens
ttttaaaagaagtga

SEQ ID NO: 33395 - DNA, 15 bp, Homo sapiens
tttttaaaagaagtg

SEQ ID NO: 33396 - DNA, 15 bp, Homo sapiens
ttttttaaaagaagt

SEQ ID NO: 33397 - DNA, 15 bp, Homo sapiens
cttttttaaaagaag

SEQ ID NO: 33398 - DNA, 15 bp, Homo sapiens
tcttttttaaaagaa

SEQ ID NO: 33399 - DNA, 15 bp, Homo sapiens
ttcttttttaaaaga

SEQ ID NO: 33400 - DNA, 15 bp, Homo sapiens
gttcttttttaaaag

SEQ ID NO: 33401 - DNA, 15 bp, Homo sapiens
tgttcttttttaaaa

SEQ ID NO: 33402 - DNA, 15 bp, Homo sapiens
atgttcttttttaaa

SEQ ID NO: 33403 - DNA, 15 bp, Homo sapiens
gatgttcttttttaa

SEQ ID NO: 33404 - DNA, 15 bp, Homo sapiens
agatgttctttttta

SEQ ID NO: 33405 - DNA, 15 bp, Homo sapiens
cagatgttctttttt

SEQ ID NO: 33406 - DNA, 15 bp, Homo sapiens
gcagatgttcttttt

SEQ ID NO: 33407 - DNA, 15 bp, Homo sapiens
tgcagatgttctttt

SEQ ID NO: 33408 - DNA, 15 bp, Homo sapiens
ctgcagatgttcttt

SEQ ID NO: 33409 - DNA, 15 bp, Homo sapiens
tctgcagatgttctt

SEQ ID NO: 33410 - DNA, 15 bp, Homo sapiens
ttctgcagatgttct

SEQ ID NO: 33411 - DNA, 15 bp, Homo sapiens
tttctgcagatgttc

SEQ ID NO: 33412 - DNA, 15 bp, Homo sapiens
ctttctgcagatgtt

SEQ ID NO: 33413 - DNA, 15 bp, Homo sapiens
tctttctgcagatgt

SEQ ID NO: 33414 - DNA, 15 bp, Homo sapiens
ttctttctgcagatg

SEQ ID NO: 33415 - DNA, 15 bp, Homo sapiens
attctttctgcagat

SEQ ID NO: 33416 - DNA, 15 bp, Homo sapiens
aattctttctgcaga

SEQ ID NO: 33417 - DNA, 15 bp, Homo sapiens
caattctttctgcag

SEQ ID NO: 33418 - DNA, 15 bp, Homo sapiens
tcaattctttctgca

SEQ ID NO: 33419 - DNA, 15 bp, Homo sapiens
ctcaattctttctgc

SEQ ID NO: 33420 - DNA, 15 bp, Homo sapiens
tctcaattctttctg

SEQ ID NO: 33421 - DNA, 15 bp, Homo sapiens
ctctcaattctttct

SEQ ID NO: 33422 - DNA, 15 bp, Homo sapiens
actctcaattctttc

SEQ ID NO: 33423 - DNA, 15 bp, Homo sapiens
cactctcaattcttt

SEQ ID NO: 33424 - DNA, 15 bp, Homo sapiens
ccactctcaattctt

SEQ ID NO: 33425 - DNA, 15 bp, Homo sapiens
accactctcaattct

SEQ ID NO: 33426 - DNA, 15 bp, Homo sapiens
caccactctcaattc

SEQ ID NO: 33427 - DNA, 15 bp, Homo sapiens
ccaccactctcaatt

SEQ ID NO: 33428 - DNA, 15 bp, Homo sapiens
tccaccactctcaat

SEQ ID NO: 33429 - DNA, 15 bp, Homo sapiens
atccaccactctcaa

SEQ ID NO: 33430 - DNA, 15 bp, Homo sapiens
tatccaccactctca

SEQ ID NO: 33431 - DNA, 15 bp, Homo sapiens
ttatccaccactctc

SEQ ID NO: 33432 - DNA, 15 bp, Homo sapiens
attatccaccactct

SEQ ID NO: 33433 - DNA, 15 bp, Homo sapiens
aattatccaccactc

SEQ ID NO: 33434 - DNA, 15 bp, Homo sapiens
gaattatccaccact

SEQ ID NO: 33435 - DNA, 15 bp, Homo sapiens
agaattatccaccac

SEQ ID NO: 33436 - DNA, 15 bp, Homo sapiens
gagaattatccacca

SEQ ID NO: 33437 - DNA, 15 bp, Homo sapiens
ggagaattatccacc

SEQ ID NO: 33438 - DNA, 15 bp, Homo sapiens
tggagaattatccac

SEQ ID NO: 33439 - DNA, 15 bp, Homo sapiens
ttggagaattatcca

SEQ ID NO: 33440 - DNA, 15 bp, Homo sapiens
attggagaattatcc

SEQ ID NO: 33441 - DNA, 15 bp, Homo sapiens
gattggagaattatc

SEQ ID NO: 33442 - DNA, 15 bp, Homo sapiens
tgattggagaattat

SEQ ID NO: 33443 - DNA, 15 bp, Homo sapiens
atgattggagaatta

SEQ ID NO: 33444 - DNA, 15 bp, Homo sapiens
aatgattggagaatt

SEQ ID NO: 33445 - DNA, 15 bp, Homo sapiens
gaatgattggagaat

SEQ ID NO: 33446 - DNA, 15 bp, Homo sapiens
ggaatgattggagaa

SEQ ID NO: 33447 - DNA, 15 bp, Homo sapiens
aggaatgattggaga

SEQ ID NO: 33448 - DNA, 15 bp, Homo sapiens
caggaatgattggag

SEQ ID NO: 33449 - DNA, 15 bp, Homo sapiens
gcaggaatgattgga

SEQ ID NO: 33450 - DNA, 15 bp, Homo sapiens
agcaggaatgattgg

SEQ ID NO: 33451 - DNA, 15 bp, Homo sapiens
aagcaggaatgattg

SEQ ID NO: 33452 - DNA, 15 bp, Homo sapiens
aaagcaggaatgatt

SEQ ID NO: 33453 - DNA, 15 bp, Homo sapiens
gaaagcaggaatgat

SEQ ID NO: 33454 - DNA, 15 bp, Homo sapiens
agaaagcaggaatga

SEQ ID NO: 33455 - DNA, 15 bp, Homo sapiens
gagaaagcaggaatg

SEQ ID NO: 33456 - DNA, 15 bp, Homo sapiens
ggagaaagcaggaat

SEQ ID NO: 33457 - DNA, 15 bp, Homo sapiens
aggagaaagcaggaa

SEQ ID NO: 33458 - DNA, 15 bp, Homo sapiens
caggagaaagcagga

SEQ ID NO: 33459 - DNA, 15 bp, Homo sapiens
tcaggagaaagcagg

SEQ ID NO: 33460 - DNA, 15 bp, Homo sapiens
ttcaggagaaagcag

SEQ ID NO: 33461 - DNA, 15 bp, Homo sapiens
tttcaggagaaagca

SEQ ID NO: 33462 - DNA, 15 bp, Homo sapiens
atttcaggagaaagc

SEQ ID NO: 33463 - DNA, 15 bp, Homo sapiens
tatttcaggagaaag

SEQ ID NO: 33464 - DNA, 15 bp, Homo sapiens
ttatttcaggagaaa

SEQ ID NO: 33465 - DNA, 15 bp, Homo sapiens
tttatttcaggagaa

SEQ ID NO: 33466 - DNA, 15 bp, Homo sapiens
atttatttcaggaga

SEQ ID NO: 33467 - DNA, 15 bp, Homo sapiens
aatttatttcaggag

SEQ ID NO: 33468 - DNA, 15 bp, Homo sapiens
aaatttatttcagga

SEQ ID NO: 33469 - DNA, 15 bp, Homo sapiens
gaaatttatttcagg

SEQ ID NO: 33470 - DNA, 15 bp, Homo sapiens
tgaaatttatttcag

SEQ ID NO: 33471 - DNA, 15 bp, Homo sapiens
atgaaatttatttca

SEQ ID NO: 33472 - DNA, 15 bp, Homo sapiens
catgaaatttatttc

SEQ ID NO: 33473 - DNA, 15 bp, Homo sapiens
gcatgaaatttattt

SEQ ID NO: 33474 - DNA, 15 bp, Homo sapiens
ggcatgaaatttatt

SEQ ID NO: 33475 - DNA, 15 bp, Homo sapiens
aggcatgaaatttat

SEQ ID NO: 33476 - DNA, 15 bp, Homo sapiens
aaggcatgaaattta

SEQ ID NO: 33477 - DNA, 15 bp, Homo sapiens
aaaggcatgaaattt

SEQ ID NO: 33478 - DNA, 15 bp, Homo sapiens
gaaaggcatgaaatt

SEQ ID NO: 33479 - DNA, 15 bp, Homo sapiens
agaaaggcatgaaat

SEQ ID NO: 33480 - DNA, 15 bp, Homo sapiens
aagaaaggcatgaaa

SEQ ID NO: 33481 - DNA, 15 bp, Homo sapiens
aaagaaaggcatgaa

SEQ ID NO: 33482 - DNA, 15 bp, Homo sapiens
aaaagaaaggcatga

SEQ ID NO: 33483 - DNA, 15 bp, Homo sapiens
taaaagaaaggcatg

SEQ ID NO: 33484 - DNA, 15 bp, Homo sapiens
ctaaaagaaaggcat

SEQ ID NO: 33485 - DNA, 15 bp, Homo sapiens
gctaaaagaaaggca

SEQ ID NO: 33486 - DNA, 15 bp, Homo sapiens
tgctaaaagaaaggc

SEQ ID NO: 33487 - DNA, 15 bp, Homo sapiens
ctgctaaaagaaagg

SEQ ID NO: 33488 - DNA, 15 bp, Homo sapiens
actgctaaaagaaag

SEQ ID NO: 33489 - DNA, 15 bp, Homo sapiens
aactgctaaaagaaa

SEQ ID NO: 33490 - DNA, 15 bp, Homo sapiens
caactgctaaaagaa

SEQ ID NO: 33491 - DNA, 15 bp, Homo sapiens
tcaactgctaaaaga

SEQ ID NO: 33492 - DNA, 15 bp, Homo sapiens
atcaactgctaaaag

SEQ ID NO: 33493 - DNA, 15 bp, Homo sapiens
aatcaactgctaaaa

SEQ ID NO: 33494 - DNA, 15 bp, Homo sapiens
aaatcaactgctaaa

SEQ ID NO: 33495 - DNA, 15 bp, Homo sapiens
taaatcaactgctaa

SEQ ID NO: 33496 - DNA, 15 bp, Homo sapiens
ttaaatcaactgcta

SEQ ID NO: 33497 - DNA, 15 bp, Homo sapiens
attaaatcaactgct

SEQ ID NO: 33498 - DNA, 15 bp, Homo sapiens
tattaaatcaactgc

SEQ ID NO: 33499 - DNA, 15 bp, Homo sapiens
ttattaaatcaactg

SEQ ID NO: 33500 - DNA, 15 bp, Homo sapiens
attattaaatcaact

SEQ ID NO: 33501 - DNA, 15 bp, Homo sapiens
aattattaaatcaac

SEQ ID NO: 33502 - DNA, 15 bp, Homo sapiens
taattattaaatcaa

SEQ ID NO: 33503 - DNA, 15 bp, Homo sapiens
ttaattattaaatca

SEQ ID NO: 33504 - DNA, 15 bp, Homo sapiens
attaattattaaatc

SEQ ID NO: 33505 - DNA, 15 bp, Homo sapiens
aattaattattaaat

SEQ ID NO: 33506 - DNA, 15 bp, Homo sapiens
aaattaattattaaa

SEQ ID NO: 33507 - DNA, 15 bp, Homo sapiens
aaaattaattattaa

SEQ ID NO: 33508 - DNA, 15 bp, Homo sapiens
taaaattaattatta

SEQ ID NO: 33509 - DNA, 15 bp, Homo sapiens
ttaaaattaattatt

SEQ ID NO: 33510 - DNA, 15 bp, Homo sapiens
tttaaaattaattat

SEQ ID NO: 33511 - DNA, 15 bp, Homo sapiens
ttttaaaattaatta

SEQ ID NO: 33512 - DNA, 15 bp, Homo sapiens
tttttaaaattaatt

SEQ ID NO: 33513 - DNA, 15 bp, Homo sapiens
atttttaaaattaat

SEQ ID NO: 33514 - DNA, 15 bp, Homo sapiens
tatttttaaaattaa

SEQ ID NO: 33515 - DNA, 15 bp, Homo sapiens
ttatttttaaaatta

SEQ ID NO: 33516 - DNA, 15 bp, Homo sapiens
attatttttaaaatt

SEQ ID NO: 33517 - DNA, 15 bp, Homo sapiens
cattatttttaaaat

SEQ ID NO: 33518 - DNA, 15 bp, Homo sapiens
acattatttttaaaa

SEQ ID NO: 33519 - DNA, 15 bp, Homo sapiens
aacattatttttaaa

SEQ ID NO: 33520 - DNA, 15 bp, Homo sapiens
taacattatttttaa

SEQ ID NO: 33521 - DNA, 15 bp, Homo sapiens
ctaacattattttta

SEQ ID NO: 33522 - DNA, 15 bp, Homo sapiens
tctaacattattttt

SEQ ID NO: 33523 - DNA, 15 bp, Homo sapiens
ttctaacattatttt

SEQ ID NO: 33524 - DNA, 15 bp, Homo sapiens
cttctaacattattt

SEQ ID NO: 33525 - DNA, 15 bp, Homo sapiens
tcttctaacattatt

SEQ ID NO: 33526 - DNA, 15 bp, Homo sapiens
ttcttctaacattat

SEQ ID NO: 33527 - DNA, 15 bp, Homo sapiens
cttcttctaacatta

SEQ ID NO: 33528 - DNA, 15 bp, Homo sapiens
gcttcttctaacatt

SEQ ID NO: 33529 - DNA, 15 bp, Homo sapiens
agcttcttctaacat

SEQ ID NO: 33530 - DNA, 15 bp, Homo sapiens
aagcttcttctaaca

SEQ ID NO: 33531 - DNA, 15 bp, Homo sapiens
aaagcttcttctaac

SEQ ID NO: 33532 - DNA, 15 bp, Homo sapiens
aaaagcttcttctaa

SEQ ID NO: 33533 - DNA, 15 bp, Homo sapiens
gaaaagcttcttcta

SEQ ID NO: 33534 - DNA, 15 bp, Homo sapiens
ggaaaagcttcttct

SEQ ID NO: 33535 - DNA, 15 bp, Homo sapiens
aggaaaagcttcttc

SEQ ID NO: 33536 - DNA, 15 bp, Homo sapiens
caggaaaagcttctt

SEQ ID NO: 33537 - DNA, 15 bp, Homo sapiens
acaggaaaagcttct

SEQ ID NO: 33538 - DNA, 15 bp, Homo sapiens
aacaggaaaagcttc

SEQ ID NO: 33539 - DNA, 15 bp, Homo sapiens
gaacaggaaaagctt

SEQ ID NO: 33540 - DNA, 15 bp, Homo sapiens
tgaacaggaaaagct

SEQ ID NO: 33541 - DNA, 15 bp, Homo sapiens
atgaacaggaaaagc

SEQ ID NO: 33542 - DNA, 15 bp, Homo sapiens
catgaacaggaaaag

SEQ ID NO: 33543 - DNA, 15 bp, Homo sapiens
acatgaacaggaaaa

SEQ ID NO: 33544 - DNA, 15 bp, Homo sapiens
cacatgaacaggaaa

SEQ ID NO: 33545 - DNA, 15 bp, Homo sapiens
acacatgaacaggaa

SEQ ID NO: 33546 - DNA, 15 bp, Homo sapiens
cacacatgaacagga

SEQ ID NO: 33547 - DNA, 15 bp, Homo sapiens
acacacatgaacagg

SEQ ID NO: 33548 - DNA, 15 bp, Homo sapiens
cacacacatgaacag

SEQ ID NO: 33549 - DNA, 15 bp, Homo sapiens
acacacacatgaaca

SEQ ID NO: 33550 - DNA, 15 bp, Homo sapiens
aacacacacatgaac

SEQ ID NO: 33551 - DNA, 15 bp, Homo sapiens
taacacacacatgaa

SEQ ID NO: 33552 - DNA, 15 bp, Homo sapiens
ataacacacacatga

SEQ ID NO: 33553 - DNA, 15 bp, Homo sapiens
cataacacacacatg

SEQ ID NO: 33554 - DNA, 15 bp, Homo sapiens
tcataacacacacat

SEQ ID NO: 33555 - DNA, 15 bp, Homo sapiens
atcataacacacaca

SEQ ID NO: 33556 - DNA, 15 bp, Homo sapiens
catcataacacacac

SEQ ID NO: 33557 - DNA, 15 bp, Homo sapiens
gcatcataacacaca

SEQ ID NO: 33558 - DNA, 15 bp, Homo sapiens
tgcatcataacacac

SEQ ID NO: 33559 - DNA, 15 bp, Homo sapiens
atgcatcataacaca

SEQ ID NO: 33560 - DNA, 15 bp, Homo sapiens
tatgcatcataacac

SEQ ID NO: 33561 - DNA, 15 bp, Homo sapiens
atatgcatcataaca

SEQ ID NO: 33562 - DNA, 15 bp, Homo sapiens
catatgcatcataac

SEQ ID NO: 33563 - DNA, 15 bp, Homo sapiens
acatatgcatcataa

SEQ ID NO: 33564 - DNA, 15 bp, Homo sapiens
aacatatgcatcata

SEQ ID NO: 33565 - DNA, 15 bp, Homo sapiens
aaacatatgcatcat

SEQ ID NO: 33566 - DNA, 15 bp, Homo sapiens
caaacatatgcatca

SEQ ID NO: 33567 - DNA, 15 bp, Homo sapiens
acaaacatatgcatc

SEQ ID NO: 33568 - DNA, 15 bp, Homo sapiens
gacaaacatatgcat

SEQ ID NO: 33569 - DNA, 15 bp, Homo sapiens
agacaaacatatgca

SEQ ID NO: 33570 - DNA, 15 bp, Homo sapiens
cagacaaacatatgc

SEQ ID NO: 33571 - DNA, 15 bp, Homo sapiens
tcagacaaacatatg

SEQ ID NO: 33572 - DNA, 15 bp, Homo sapiens
atcagacaaacatat

SEQ ID NO: 33573 - DNA, 15 bp, Homo sapiens
catcagacaaacata

SEQ ID NO: 33574 - DNA, 15 bp, Homo sapiens
tcatcagacaaacat

SEQ ID NO: 33575 - DNA, 15 bp, Homo sapiens
ttcatcagacaaaca

SEQ ID NO: 33576 - DNA, 15 bp, Homo sapiens
cttcatcagacaaac

SEQ ID NO: 33577 - DNA, 15 bp, Homo sapiens
ccttcatcagacaaa

SEQ ID NO: 33578 - DNA, 15 bp, Homo sapiens
cccttcatcagacaa

SEQ ID NO: 33579 - DNA, 15 bp, Homo sapiens
ccccttcatcagaca

SEQ ID NO: 33580 - DNA, 15 bp, Homo sapiens
tccccttcatcagac

SEQ ID NO: 33581 - DNA, 15 bp, Homo sapiens
ttccccttcatcaga

SEQ ID NO: 33582 - DNA, 15 bp, Homo sapiens
tttccccttcatcag

SEQ ID NO: 33583 - DNA, 15 bp, Homo sapiens
ttttccccttcatca

SEQ ID NO: 33584 - DNA, 15 bp, Homo sapiens
tttttccccttcatc

SEQ ID NO: 33585 - DNA, 15 bp, Homo sapiens
ctttttccccttcat

SEQ ID NO: 33586 - DNA, 15 bp, Homo sapiens
cctttttccccttca

SEQ ID NO: 33587 - DNA, 15 bp, Homo sapiens
ccctttttccccttc

SEQ ID NO: 33588 - DNA, 15 bp, Homo sapiens
tccctttttcccctt

SEQ ID NO: 33589 - DNA, 15 bp, Homo sapiens
ttccctttttcccct

SEQ ID NO: 33590 - DNA, 15 bp, Homo sapiens
cttccctttttcccc

SEQ ID NO: 33591 - DNA, 15 bp, Homo sapiens
ccttccctttttccc

SEQ ID NO: 33592 - DNA, 15 bp, Homo sapiens
tccttccctttttcc

SEQ ID NO: 33593 - DNA, 15 bp, Homo sapiens
ttccttccctttttc

SEQ ID NO: 33594 - DNA, 15 bp, Homo sapiens
attccttcccttttt

SEQ ID NO: 33595 - DNA, 15 bp, Homo sapiens
cattccttccctttt

SEQ ID NO: 33596 - DNA, 15 bp, Homo sapiens
tcattccttcccttt

SEQ ID NO: 33597 - DNA, 15 bp, Homo sapiens
gtcattccttccctt

SEQ ID NO: 33598 - DNA, 15 bp, Homo sapiens
agtcattccttccct

SEQ ID NO: 33599 - DNA, 15 bp, Homo sapiens
gagtcattccttccc

SEQ ID NO: 33600 - DNA, 15 bp, Homo sapiens
tgagtcattccttcc

SEQ ID NO: 33601 - DNA, 15 bp, Homo sapiens
ttgagtcattccttc

SEQ ID NO: 33602 - DNA, 15 bp, Homo sapiens
cttgagtcattcctt

SEQ ID NO: 33603 - DNA, 15 bp, Homo sapiens
acttgagtcattcct

SEQ ID NO: 33604 - DNA, 15 bp, Homo sapiens
tacttgagtcattcc

SEQ ID NO: 33605 - DNA, 15 bp, Homo sapiens
gtacttgagtcattc

SEQ ID NO: 33606 - DNA, 15 bp, Homo sapiens
agtacttgagtcatt

SEQ ID NO: 33607 - DNA, 15 bp, Homo sapiens
aagtacttgagtcat

SEQ ID NO: 33608 - DNA, 15 bp, Homo sapiens
aaagtacttgagtca

SEQ ID NO: 33609 - DNA, 15 bp, Homo sapiens
gaaagtacttgagtc

SEQ ID NO: 33610 - DNA, 15 bp, Homo sapiens
tgaaagtacttgagt

SEQ ID NO: 33611 - DNA, 15 bp, Homo sapiens
ttgaaagtacttgag

SEQ ID NO: 33612 - DNA, 15 bp, Homo sapiens
gttgaaagtacttga

SEQ ID NO: 33613 - DNA, 15 bp, Homo sapiens
agttgaaagtacttg

SEQ ID NO: 33614 - DNA, 15 bp, Homo sapiens
aagttgaaagtactt

SEQ ID NO: 33615 - DNA, 15 bp, Homo sapiens
aaagttgaaagtact

SEQ ID NO: 33616 - DNA, 15 bp, Homo sapiens
taaagttgaaagtac

SEQ ID NO: 33617 - DNA, 15 bp, Homo sapiens
ctaaagttgaaagta

SEQ ID NO: 33618 - DNA, 15 bp, Homo sapiens
cctaaagttgaaagt

SEQ ID NO: 33619 - DNA, 15 bp, Homo sapiens
ccctaaagttgaaag

SEQ ID NO: 33620 - DNA, 15 bp, Homo sapiens
gccctaaagttgaaa

SEQ ID NO: 33621 - DNA, 15 bp, Homo sapiens
ggccctaaagttgaa

SEQ ID NO: 33622 - DNA, 15 bp, Homo sapiens
tggccctaaagttga

SEQ ID NO: 33623 - DNA, 15 bp, Homo sapiens
ctggccctaaagttg

SEQ ID NO: 33624 - DNA, 15 bp, Homo sapiens
gctggccctaaagtt

SEQ ID NO: 33625 - DNA, 15 bp, Homo sapiens
ggctggccctaaagt

SEQ ID NO: 33626 - DNA, 15 bp, Homo sapiens
aggctggccctaaag

SEQ ID NO: 33627 - DNA, 15 bp, Homo sapiens
taggctggccctaaa

SEQ ID NO: 33628 - DNA, 15 bp, Homo sapiens
ctaggctggccctaa

SEQ ID NO: 33629 - DNA, 15 bp, Homo sapiens
cctaggctggcccta

SEQ ID NO: 33630 - DNA, 15 bp, Homo sapiens
tcctaggctggccct

SEQ ID NO: 33631 - DNA, 15 bp, Homo sapiens
atcctaggctggccc

SEQ ID NO: 33632 - DNA, 15 bp, Homo sapiens
aatcctaggctggcc

SEQ ID NO: 33633 - DNA, 15 bp, Homo sapiens
caatcctaggctggc

SEQ ID NO: 33634 - DNA, 15 bp, Homo sapiens
ccaatcctaggctgg

SEQ ID NO: 33635 - DNA, 15 bp, Homo sapiens
tccaatcctaggctg

SEQ ID NO: 33636 - DNA, 15 bp, Homo sapiens
ttccaatcctaggct

SEQ ID NO: 33637 - DNA, 15 bp, Homo sapiens
attccaatcctaggc

SEQ ID NO: 33638 - DNA, 15 bp, Homo sapiens
aattccaatcctagg

SEQ ID NO: 33639 - DNA, 15 bp, Homo sapiens
gaattccaatcctag

SEQ ID NO: 33640 - DNA, 15 bp, Homo sapiens
agaattccaatccta

SEQ ID NO: 33641 - DNA, 15 bp, Homo sapiens
cagaattccaatcct

SEQ ID NO: 33642 - DNA, 15 bp, Homo sapiens
ccagaattccaatcc

SEQ ID NO: 33643 - DNA, 15 bp, Homo sapiens
tccagaattccaatc

SEQ ID NO: 33644 - DNA, 15 bp, Homo sapiens
ctccagaattccaat

SEQ ID NO: 33645 - DNA, 15 bp, Homo sapiens
actccagaattccaa

SEQ ID NO: 33646 - DNA, 15 bp, Homo sapiens
tactccagaattcca

SEQ ID NO: 33647 - DNA, 15 bp, Homo sapiens
ctactccagaattcc

SEQ ID NO: 33648 - DNA, 15 bp, Homo sapiens
tctactccagaattc

SEQ ID NO: 33649 - DNA, 15 bp, Homo sapiens
atctactccagaatt

SEQ ID NO: 33650 - DNA, 15 bp, Homo sapiens
gatctactccagaat

SEQ ID NO: 33651 - DNA, 15 bp, Homo sapiens
tgatctactccagaa

SEQ ID NO: 33652 - DNA, 15 bp, Homo sapiens
atgatctactccaga

SEQ ID NO: 33653 - DNA, 15 bp, Homo sapiens
catgatctactccag

SEQ ID NO: 33654 - DNA, 15 bp, Homo sapiens
tcatgatctactcca

SEQ ID NO: 33655 - DNA, 15 bp, Homo sapiens
ctcatgatctactcc

SEQ ID NO: 33656 - DNA, 15 bp, Homo sapiens
cctcatgatctactc

SEQ ID NO: 33657 - DNA, 15 bp, Homo sapiens
tcctcatgatctact

SEQ ID NO: 33658 - DNA, 15 bp, Homo sapiens
ctcctcatgatctac

SEQ ID NO: 33659 - DNA, 15 bp, Homo sapiens
cctcctcatgatcta

SEQ ID NO: 33660 - DNA, 15 bp, Homo sapiens
tcctcctcatgatct

SEQ ID NO: 33661 - DNA, 15 bp, Homo sapiens
ctcctcctcatgatc

SEQ ID NO: 33662 - DNA, 15 bp, Homo sapiens
tctcctcctcatgat

SEQ ID NO: 33663 - DNA, 15 bp, Homo sapiens
atctcctcctcatga

SEQ ID NO: 33664 - DNA, 15 bp, Homo sapiens
catctcctcctcatg

SEQ ID NO: 33665 - DNA, 15 bp, Homo sapiens
ccatctcctcctcat

SEQ ID NO: 33666 - DNA, 15 bp, Homo sapiens
accatctcctcctca

SEQ ID NO: 33667 - DNA, 15 bp, Homo sapiens
gaccatctcctcctc

SEQ ID NO: 33668 - DNA, 15 bp, Homo sapiens
tgaccatctcctcct

SEQ ID NO: 33669 - DNA, 15 bp, Homo sapiens
ttgaccatctcctcc

SEQ ID NO: 33670 - DNA, 15 bp, Homo sapiens
gttgaccatctcctc

SEQ ID NO: 33671 - DNA, 15 bp, Homo sapiens
agttgaccatctcct

SEQ ID NO: 33672 - DNA, 15 bp, Homo sapiens
aagttgaccatctcc

SEQ ID NO: 33673 - DNA, 15 bp, Homo sapiens
aaagttgaccatctc

SEQ ID NO: 33674 - DNA, 15 bp, Homo sapiens
gaaagttgaccatct

SEQ ID NO: 33675 - DNA, 15 bp, Homo sapiens
agaaagttgaccatc

SEQ ID NO: 33676 - DNA, 15 bp, Homo sapiens
aagaaagttgaccat

SEQ ID NO: 33677 - DNA, 15 bp, Homo sapiens
caagaaagttgacca

SEQ ID NO: 33678 - DNA, 15 bp, Homo sapiens
acaagaaagttgacc

SEQ ID NO: 33679 - DNA, 15 bp, Homo sapiens
cacaagaaagttgac

SEQ ID NO: 33680 - DNA, 15 bp, Homo sapiens
tcacaagaaagttga

SEQ ID NO: 33681 - DNA, 15 bp, Homo sapiens
gtcacaagaaagttg

SEQ ID NO: 33682 - DNA, 15 bp, Homo sapiens
tgtcacaagaaagtt

SEQ ID NO: 33683 - DNA, 15 bp, Homo sapiens
ttgtcacaagaaagt

SEQ ID NO: 33684 - DNA, 15 bp, Homo sapiens
tttgtcacaagaaag

SEQ ID NO: 33685 - DNA, 15 bp, Homo sapiens
ttttgtcacaagaaa

SEQ ID NO: 33686 - DNA, 15 bp, Homo sapiens
cttttgtcacaagaa

SEQ ID NO: 33687 - DNA, 15 bp, Homo sapiens
gcttttgtcacaaga

SEQ ID NO: 33688 - DNA, 15 bp, Homo sapiens
tgcttttgtcacaag

SEQ ID NO: 33689 - DNA, 15 bp, Homo sapiens
atgcttttgtcacaa

SEQ ID NO: 33690 - DNA, 15 bp, Homo sapiens
catgcttttgtcaca

SEQ ID NO: 33691 - DNA, 15 bp, Homo sapiens
acatgcttttgtcac

SEQ ID NO: 33692 - DNA, 15 bp, Homo sapiens
tacatgcttttgtca

SEQ ID NO: 33693 - DNA, 15 bp, Homo sapiens
gtacatgcttttgtc

SEQ ID NO: 33694 - DNA, 15 bp, Homo sapiens
tgtacatgcttttgt

SEQ ID NO: 33695 - DNA, 15 bp, Homo sapiens
atgtacatgcttttg

SEQ ID NO: 33696 - DNA, 15 bp, Homo sapiens
tatgtacatgctttt

SEQ ID NO: 33697 - DNA, 15 bp, Homo sapiens
ttatgtacatgcttt

SEQ ID NO: 33698 - DNA, 15 bp, Homo sapiens
tttatgtacatgctt

SEQ ID NO: 33699 - DNA, 15 bp, Homo sapiens
gtttatgtacatgct

SEQ ID NO: 33700 - DNA, 15 bp, Homo sapiens
ggtttatgtacatgc

SEQ ID NO: 33701 - DNA, 15 bp, Homo sapiens
tggtttatgtacatg

SEQ ID NO: 33702 - DNA, 15 bp, Homo sapiens
gtggtttatgtacat

SEQ ID NO: 33703 - DNA, 15 bp, Homo sapiens
agtggtttatgtaca

SEQ ID NO: 33704 - DNA, 15 bp, Homo sapiens
aagtggtttatgtac

SEQ ID NO: 33705 - DNA, 15 bp, Homo sapiens
taagtggtttatgta

SEQ ID NO: 33706 - DNA, 15 bp, Homo sapiens
ctaagtggtttatgt

SEQ ID NO: 33707 - DNA, 15 bp, Homo sapiens
cctaagtggtttatg

SEQ ID NO: 33708 - DNA, 15 bp, Homo sapiens
tcctaagtggtttat

SEQ ID NO: 33709 - DNA, 15 bp, Homo sapiens
atcctaagtggttta

SEQ ID NO: 33710 - DNA, 15 bp, Homo sapiens
aatcctaagtggttt

SEQ ID NO: 33711 - DNA, 15 bp, Homo sapiens
gaatcctaagtggtt

SEQ ID NO: 33712 - DNA, 15 bp, Homo sapiens
agaatcctaagtggt

SEQ ID NO: 33713 - DNA, 15 bp, Homo sapiens
gagaatcctaagtgg

SEQ ID NO: 33714 - DNA, 15 bp, Homo sapiens
ggagaatcctaagtg

SEQ ID NO: 33715 - DNA, 15 bp, Homo sapiens
tggagaatcctaagt

SEQ ID NO: 33716 - DNA, 15 bp, Homo sapiens
gtggagaatcctaag

SEQ ID NO: 33717 - DNA, 15 bp, Homo sapiens
agtggagaatcctaa

SEQ ID NO: 33718 - DNA, 15 bp, Homo sapiens
aagtggagaatccta

SEQ ID NO: 33719 - DNA, 15 bp, Homo sapiens
aaagtggagaatcct

SEQ ID NO: 33720 - DNA, 15 bp, Homo sapiens
aaaagtggagaatcc

SEQ ID NO: 33721 - DNA, 15 bp, Homo sapiens
gaaaagtggagaatc

SEQ ID NO: 33722 - DNA, 15 bp, Homo sapiens
tgaaaagtggagaat

SEQ ID NO: 33723 - DNA, 15 bp, Homo sapiens
gtgaaaagtggagaa

SEQ ID NO: 33724 - DNA, 15 bp, Homo sapiens
tgtgaaaagtggaga

SEQ ID NO: 33725 - DNA, 15 bp, Homo sapiens
atgtgaaaagtggag

SEQ ID NO: 33726 - DNA, 15 bp, Homo sapiens
aatgtgaaaagtgga

SEQ ID NO: 33727 - DNA, 15 bp, Homo sapiens
aaatgtgaaaagtgg

SEQ ID NO: 33728 - DNA, 15 bp, Homo sapiens
aaaatgtgaaaagtg

SEQ ID NO: 33729 - DNA, 15 bp, Homo sapiens
taaaatgtgaaaagt

SEQ ID NO: 33730 - DNA, 15 bp, Homo sapiens
ataaaatgtgaaaag

SEQ ID NO: 33731 - DNA, 15 bp, Homo sapiens
aataaaatgtgaaaa

SEQ ID NO: 33732 - DNA, 15 bp, Homo sapiens
gaataaaatgtgaaa

SEQ ID NO: 33733 - DNA, 15 bp, Homo sapiens
agaataaaatgtgaa

SEQ ID NO: 33734 - DNA, 15 bp, Homo sapiens
cagaataaaatgtga

SEQ ID NO: 33735 - DNA, 15 bp, Homo sapiens
tcagaataaaatgtg

SEQ ID NO: 33736 - DNA, 15 bp, Homo sapiens
ttcagaataaaatgt

SEQ ID NO: 33737 - DNA, 15 bp, Homo sapiens
tttcagaataaaatg

SEQ ID NO: 33738 - DNA, 15 bp, Homo sapiens
atttcagaataaaat

SEQ ID NO: 33739 - DNA, 15 bp, Homo sapiens
aatttcagaataaaa

SEQ ID NO: 33740 - DNA, 15 bp, Homo sapiens
caatttcagaataaa

SEQ ID NO: 33741 - DNA, 15 bp, Homo sapiens
gcaatttcagaataa

SEQ ID NO: 33742 - DNA, 15 bp, Homo sapiens
tgcaatttcagaata

SEQ ID NO: 33743 - DNA, 15 bp, Homo sapiens
atgcaatttcagaat

SEQ ID NO: 33744 - DNA, 15 bp, Homo sapiens
catgcaatttcagaa

SEQ ID NO: 33745 - DNA, 15 bp, Homo sapiens
gcatgcaatttcaga

SEQ ID NO: 33746 - DNA, 15 bp, Homo sapiens
agcatgcaatttcag

SEQ ID NO: 33747 - DNA, 15 bp, Homo sapiens
aagcatgcaatttca

SEQ ID NO: 33748 - DNA, 15 bp, Homo sapiens
gaagcatgcaatttc

SEQ ID NO: 33749 - DNA, 15 bp, Homo sapiens
tgaagcatgcaattt

SEQ ID NO: 33750 - DNA, 15 bp, Homo sapiens
ctgaagcatgcaatt

SEQ ID NO: 33751 - DNA, 15 bp, Homo sapiens
actgaagcatgcaat

SEQ ID NO: 33752 - DNA, 15 bp, Homo sapiens
aactgaagcatgcaa

SEQ ID NO: 33753 - DNA, 15 bp, Homo sapiens
taactgaagcatgca

SEQ ID NO: 33754 - DNA, 15 bp, Homo sapiens
ttaactgaagcatgc

SEQ ID NO: 33755 - DNA, 15 bp, Homo sapiens
attaactgaagcatg

SEQ ID NO: 33756 - DNA, 15 bp, Homo sapiens
cattaactgaagcat

SEQ ID NO: 33757 - DNA, 15 bp, Homo sapiens
acattaactgaagca

SEQ ID NO: 33758 - DNA, 15 bp, Homo sapiens
cacattaactgaagc

SEQ ID NO: 33759 - DNA, 15 bp, Homo sapiens
tcacattaactgaag

SEQ ID NO: 33760 - DNA, 15 bp, Homo sapiens
atcacattaactgaa

SEQ ID NO: 33761 - DNA, 15 bp, Homo sapiens
aatcacattaactga

SEQ ID NO: 33762 - DNA, 15 bp, Homo sapiens
aaatcacattaactg

SEQ ID NO: 33763 - DNA, 15 bp, Homo sapiens
taaatcacattaact

SEQ ID NO: 33764 - DNA, 15 bp, Homo sapiens
ttaaatcacattaac

SEQ ID NO: 33765 - DNA, 15 bp, Homo sapiens
attaaatcacattaa

SEQ ID NO: 33766 - DNA, 15 bp, Homo sapiens
cattaaatcacatta

SEQ ID NO: 33767 - DNA, 15 bp, Homo sapiens
ccattaaatcacatt

SEQ ID NO: 33768 - DNA, 15 bp, Homo sapiens
accattaaatcacat

SEQ ID NO: 33769 - DNA, 15 bp, Homo sapiens
aaccattaaatcaca

SEQ ID NO: 33770 - DNA, 15 bp, Homo sapiens
aaaccattaaatcac

SEQ ID NO: 33771 - DNA, 15 bp, Homo sapiens
aaaaccattaaatca

SEQ ID NO: 33772 - DNA, 15 bp, Homo sapiens
gaaaaccattaaatc

SEQ ID NO: 33773 - DNA, 15 bp, Homo sapiens
agaaaaccattaaat

SEQ ID NO: 33774 - DNA, 15 bp, Homo sapiens
gagaaaaccattaaa

SEQ ID NO: 33775 - DNA, 15 bp, Homo sapiens
agagaaaaccattaa

SEQ ID NO: 33776 - DNA, 15 bp, Homo sapiens
gagagaaaaccatta

SEQ ID NO: 33777 - DNA, 15 bp, Homo sapiens
tgagagaaaaccatt

SEQ ID NO: 33778 - DNA, 15 bp, Homo sapiens
ctgagagaaaaccat

SEQ ID NO: 33779 - DNA, 15 bp, Homo sapiens
actgagagaaaacca

SEQ ID NO: 33780 - DNA, 15 bp, Homo sapiens
cactgagagaaaacc

SEQ ID NO: 33781 - DNA, 15 bp, Homo sapiens
acactgagagaaaac

SEQ ID NO: 33782 - DNA, 15 bp, Homo sapiens
gacactgagagaaaa

SEQ ID NO: 33783 - DNA, 15 bp, Homo sapiens
tgacactgagagaaa

SEQ ID NO: 33784 - DNA, 15 bp, Homo sapiens
atgacactgagagaa

SEQ ID NO: 33785 - DNA, 15 bp, Homo sapiens
aatgacactgagaga

SEQ ID NO: 33786 - DNA, 15 bp, Homo sapiens
caatgacactgagag

SEQ ID NO: 33787 - DNA, 15 bp, Homo sapiens
ccaatgacactgaga

SEQ ID NO: 33788 - DNA, 15 bp, Homo sapiens
gccaatgacactgag

SEQ ID NO: 33789 - DNA, 15 bp, Homo sapiens
tgccaatgacactga

SEQ ID NO: 33790 - DNA, 15 bp, Homo sapiens
ctgccaatgacactg

SEQ ID NO: 33791 - DNA, 15 bp, Homo sapiens
cctgccaatgacact

SEQ ID NO: 33792 - DNA, 15 bp, Homo sapiens
tcctgccaatgacac

SEQ ID NO: 33793 - DNA, 15 bp, Homo sapiens
atcctgccaatgaca

SEQ ID NO: 33794 - DNA, 15 bp, Homo sapiens
aatcctgccaatgac

SEQ ID NO: 33795 - DNA, 15 bp, Homo sapiens
caatcctgccaatga

SEQ ID NO: 33796 - DNA, 15 bp, Homo sapiens
acaatcctgccaatg

SEQ ID NO: 33797 - DNA, 15 bp, Homo sapiens
aacaatcctgccaat

SEQ ID NO: 33798 - DNA, 15 bp, Homo sapiens
taacaatcctgccaa

SEQ ID NO: 33799 - DNA, 15 bp, Homo sapiens
gtaacaatcctgcca

SEQ ID NO: 33800 - DNA, 15 bp, Homo sapiens
agtaacaatcctgcc

SEQ ID NO: 33801 - DNA, 15 bp, Homo sapiens
tagtaacaatcctgc

SEQ ID NO: 33802 - DNA, 15 bp, Homo sapiens
ttagtaacaatcctg

SEQ ID NO: 33803 - DNA, 15 bp, Homo sapiens
cttagtaacaatcct

SEQ ID NO: 33804 - DNA, 15 bp, Homo sapiens
gcttagtaacaatcc

SEQ ID NO: 33805 - DNA, 15 bp, Homo sapiens
cgcttagtaacaatc

SEQ ID NO: 33806 - DNA, 15 bp, Homo sapiens
tcgcttagtaacaat

SEQ ID NO: 33807 - DNA, 15 bp, Homo sapiens
gtcgcttagtaacaa

SEQ ID NO: 33808 - DNA, 15 bp, Homo sapiens
tgtcgcttagtaaca

SEQ ID NO: 33809 - DNA, 15 bp, Homo sapiens
ttgtcgcttagtaac

SEQ ID NO: 33810 - DNA, 15 bp, Homo sapiens
tttgtcgcttagtaa

SEQ ID NO: 33811 - DNA, 15 bp, Homo sapiens
gtttgtcgcttagta

SEQ ID NO: 33812 - DNA, 15 bp, Homo sapiens
tgtttgtcgcttagt

SEQ ID NO: 33813 - DNA, 15 bp, Homo sapiens
atgtttgtcgcttag

SEQ ID NO: 33814 - DNA, 15 bp, Homo sapiens
aatgtttgtcgctta

SEQ ID NO: 33815 - DNA, 15 bp, Homo sapiens
gaatgtttgtcgctt

SEQ ID NO: 33816 - DNA, 15 bp, Homo sapiens
tgaatgtttgtcgct

SEQ ID NO: 33817 - DNA, 15 bp, Homo sapiens
gtgaatgtttgtcgc

SEQ ID NO: 33818 - DNA, 15 bp, Homo sapiens
ggtgaatgtttgtcg

SEQ ID NO: 33819 - DNA, 15 bp, Homo sapiens
tggtgaatgtttgtc

SEQ ID NO: 33820 - DNA, 15 bp, Homo sapiens
gtggtgaatgtttgt

SEQ ID NO: 33821 - DNA, 15 bp, Homo sapiens
tgtggtgaatgtttg

SEQ ID NO: 33822 - DNA, 15 bp, Homo sapiens
ctgtggtgaatgttt

SEQ ID NO: 33823 - DNA, 15 bp, Homo sapiens
actgtggtgaatgtt

SEQ ID NO: 33824 - DNA, 15 bp, Homo sapiens
cactgtggtgaatgt

SEQ ID NO: 33825 - DNA, 15 bp, Homo sapiens
acactgtggtgaatg

SEQ ID NO: 33826 - DNA, 15 bp, Homo sapiens
aacactgtggtgaat

SEQ ID NO: 33827 - DNA, 15 bp, Homo sapiens
gaacactgtggtgaa

SEQ ID NO: 33828 - DNA, 15 bp, Homo sapiens
tgaacactgtggtga

SEQ ID NO: 33829 - DNA, 15 bp, Homo sapiens
ttgaacactgtggtg

SEQ ID NO: 33830 - DNA, 15 bp, Homo sapiens
tttgaacactgtggt

SEQ ID NO: 33831 - DNA, 15 bp, Homo sapiens
atttgaacactgtgg

SEQ ID NO: 33832 - DNA, 15 bp, Homo sapiens
catttgaacactgtg

SEQ ID NO: 33833 - DNA, 15 bp, Homo sapiens
acatttgaacactgt

SEQ ID NO: 33834 - DNA, 15 bp, Homo sapiens
tacatttgaacactg

SEQ ID NO: 33835 - DNA, 15 bp, Homo sapiens
gtacatttgaacact

SEQ ID NO: 33836 - DNA, 15 bp, Homo sapiens
agtacatttgaacac

SEQ ID NO: 33837 - DNA, 15 bp, Homo sapiens
aagtacatttgaaca

SEQ ID NO: 33838 - DNA, 15 bp, Homo sapiens
caagtacatttgaac

SEQ ID NO: 33839 - DNA, 15 bp, Homo sapiens
ccaagtacatttgaa

SEQ ID NO: 33840 - DNA, 15 bp, Homo sapiens
cccaagtacatttga

SEQ ID NO: 33841 - DNA, 15 bp, Homo sapiens
tcccaagtacatttg

SEQ ID NO: 33842 - DNA, 15 bp, Homo sapiens
ttcccaagtacattt

SEQ ID NO: 33843 - DNA, 15 bp, Homo sapiens
cttcccaagtacatt

SEQ ID NO: 33844 - DNA, 15 bp, Homo sapiens
tcttcccaagtacat

SEQ ID NO: 33845 - DNA, 15 bp, Homo sapiens
ttcttcccaagtaca

SEQ ID NO: 33846 - DNA, 15 bp, Homo sapiens
tttcttcccaagtac

SEQ ID NO: 33847 - DNA, 15 bp, Homo sapiens
ttttcttcccaagta

SEQ ID NO: 33848 - DNA, 15 bp, Homo sapiens
attttcttcccaagt

SEQ ID NO: 33849 - DNA, 15 bp, Homo sapiens
cattttcttcccaag

SEQ ID NO: 33850 - DNA, 15 bp, Homo sapiens
tcattttcttcccaa

SEQ ID NO: 33851 - DNA, 15 bp, Homo sapiens
ctcattttcttccca

SEQ ID NO: 33852 - DNA, 15 bp, Homo sapiens
actcattttcttccc

SEQ ID NO: 33853 - DNA, 15 bp, Homo sapiens
tactcattttcttcc

SEQ ID NO: 33854 - DNA, 15 bp, Homo sapiens
ctactcattttcttc

SEQ ID NO: 33855 - DNA, 15 bp, Homo sapiens
gctactcattttctt

SEQ ID NO: 33856 - DNA, 15 bp, Homo sapiens
ggctactcattttct

SEQ ID NO: 33857 - DNA, 15 bp, Homo sapiens
tggctactcattttc

SEQ ID NO: 33858 - DNA, 15 bp, Homo sapiens
ttggctactcatttt

SEQ ID NO: 33859 - DNA, 15 bp, Homo sapiens
tttggctactcattt

SEQ ID NO: 33860 - DNA, 15 bp, Homo sapiens
gtttggctactcatt

SEQ ID NO: 33861 - DNA, 15 bp, Homo sapiens
agtttggctactcat

SEQ ID NO: 33862 - DNA, 15 bp, Homo sapiens
tagtttggctactca

SEQ ID NO: 33863 - DNA, 15 bp, Homo sapiens
ttagtttggctactc

SEQ ID NO: 33864 - DNA, 15 bp, Homo sapiens
tttagtttggctact

SEQ ID NO: 33865 - DNA, 15 bp, Homo sapiens
ttttagtttggctac

SEQ ID NO: 33866 - DNA, 15 bp, Homo sapiens
cttttagtttggcta

SEQ ID NO: 33867 - DNA, 15 bp, Homo sapiens
acttttagtttggct

SEQ ID NO: 33868 - DNA, 15 bp, Homo sapiens
cacttttagtttggc

SEQ ID NO: 33869 - DNA, 15 bp, Homo sapiens
ccacttttagtttgg

SEQ ID NO: 33870 - DNA, 15 bp, Homo sapiens
cccacttttagtttg

SEQ ID NO: 33871 - DNA, 15 bp, Homo sapiens
tcccacttttagttt

SEQ ID NO: 33872 - DNA, 15 bp, Homo sapiens
atcccacttttagtt

SEQ ID NO: 33873 - DNA, 15 bp, Homo sapiens
aatcccacttttagt

SEQ ID NO: 33874 - DNA, 15 bp, Homo sapiens
aaatcccacttttag

SEQ ID NO: 33875 - DNA, 15 bp, Homo sapiens
taaatcccactttta

SEQ ID NO: 33876 - DNA, 15 bp, Homo sapiens
ttaaatcccactttt

SEQ ID NO: 33877 - DNA, 15 bp, Homo sapiens
tttaaatcccacttt

SEQ ID NO: 33878 - DNA, 15 bp, Homo sapiens
atttaaatcccactt

SEQ ID NO: 33879 - DNA, 15 bp, Homo sapiens
tatttaaatcccact

SEQ ID NO: 33880 - DNA, 15 bp, Homo sapiens
ttatttaaatcccac

SEQ ID NO: 33881 - DNA, 15 bp, Homo sapiens
gttatttaaatccca

SEQ ID NO: 33882 - DNA, 15 bp, Homo sapiens
agttatttaaatccc

SEQ ID NO: 33883 - DNA, 15 bp, Homo sapiens
gagttatttaaatcc

SEQ ID NO: 33884 - DNA, 15 bp, Homo sapiens
ggagttatttaaatc

SEQ ID NO: 33885 - DNA, 15 bp, Homo sapiens
tggagttatttaaat

SEQ ID NO: 33886 - DNA, 15 bp, Homo sapiens
ttggagttatttaaa

SEQ ID NO: 33887 - DNA, 15 bp, Homo sapiens
attggagttatttaa

SEQ ID NO: 33888 - DNA, 15 bp, Homo sapiens
aattggagttattta

SEQ ID NO: 33889 - DNA, 15 bp, Homo sapiens
aaattggagttattt

SEQ ID NO: 33890 - DNA, 15 bp, Homo sapiens
aaaattggagttatt

SEQ ID NO: 33891 - DNA, 15 bp, Homo sapiens
taaaattggagttat

SEQ ID NO: 33892 - DNA, 15 bp, Homo sapiens
ataaaattggagtta

SEQ ID NO: 33893 - DNA, 15 bp, Homo sapiens
cataaaattggagtt

SEQ ID NO: 33894 - DNA, 15 bp, Homo sapiens
tcataaaattggagt

SEQ ID NO: 33895 - DNA, 15 bp, Homo sapiens
ttcataaaattggag

SEQ ID NO: 33896 - DNA, 15 bp, Homo sapiens
tttcataaaattgga

SEQ ID NO: 33897 - DNA, 15 bp, Homo sapiens
ttttcataaaattgg

SEQ ID NO: 33898 - DNA, 15 bp, Homo sapiens
cttttcataaaattg

SEQ ID NO: 33899 - DNA, 15 bp, Homo sapiens
acttttcataaaatt

SEQ ID NO: 33900 - DNA, 15 bp, Homo sapiens
cacttttcataaaat

SEQ ID NO: 33901 - DNA, 15 bp, Homo sapiens
tcacttttcataaaa

SEQ ID NO: 33902 - DNA, 15 bp, Homo sapiens
ttcacttttcataaa

SEQ ID NO: 33903 - DNA, 15 bp, Homo sapiens
cttcacttttcataa

SEQ ID NO: 33904 - DNA, 15 bp, Homo sapiens
tcttcacttttcata

SEQ ID NO: 33905 - DNA, 15 bp, Homo sapiens
ttcttcacttttcat

SEQ ID NO: 33906 - DNA, 15 bp, Homo sapiens
cttcttcacttttca

SEQ ID NO: 33907 - DNA, 15 bp, Homo sapiens
acttcttcacttttc

SEQ ID NO: 33908 - DNA, 15 bp, Homo sapiens
aacttcttcactttt

SEQ ID NO: 33909 - DNA, 15 bp, Homo sapiens
gaacttcttcacttt

SEQ ID NO: 33910 - DNA, 15 bp, Homo sapiens
tgaacttcttcactt

SEQ ID NO: 33911 - DNA, 15 bp, Homo sapiens
ctgaacttcttcact

SEQ ID NO: 33912 - DNA, 15 bp, Homo sapiens
tctgaacttcttcac

SEQ ID NO: 33913 - DNA, 15 bp, Homo sapiens
ctctgaacttcttca

SEQ ID NO: 33914 - DNA, 15 bp, Homo sapiens
tctctgaacttcttc

SEQ ID NO: 33915 - DNA, 15 bp, Homo sapiens
atctctgaacttctt

SEQ ID NO: 33916 - DNA, 15 bp, Homo sapiens
aatctctgaacttct

SEQ ID NO: 33917 - DNA, 15 bp, Homo sapiens
taatctctgaacttc

SEQ ID NO: 33918 - DNA, 15 bp, Homo sapiens
gtaatctctgaactt

SEQ ID NO: 33919 - DNA, 15 bp, Homo sapiens
agtaatctctgaact

SEQ ID NO: 33920 - DNA, 15 bp, Homo sapiens
aagtaatctctgaac

SEQ ID NO: 33921 - DNA, 15 bp, Homo sapiens
taagtaatctctgaa

SEQ ID NO: 33922 - DNA, 15 bp, Homo sapiens
ttaagtaatctctga

SEQ ID NO: 33923 - DNA, 15 bp, Homo sapiens
cttaagtaatctctg

SEQ ID NO: 33924 - DNA, 15 bp, Homo sapiens
ccttaagtaatctct

SEQ ID NO: 33925 - DNA, 15 bp, Homo sapiens
accttaagtaatctc

SEQ ID NO: 33926 - DNA, 15 bp, Homo sapiens
taccttaagtaatct

SEQ ID NO: 33927 - DNA, 15 bp, Homo sapiens
ataccttaagtaatc

SEQ ID NO: 33928 - DNA, 15 bp, Homo sapiens
aataccttaagtaat

SEQ ID NO: 33929 - DNA, 15 bp, Homo sapiens
aaataccttaagtaa

SEQ ID NO: 33930 - DNA, 15 bp, Homo sapiens
aaaataccttaagta

SEQ ID NO: 33931 - DNA, 15 bp, Homo sapiens
aaaaataccttaagt

SEQ ID NO: 33932 - DNA, 15 bp, Homo sapiens
aaaaaataccttaag

SEQ ID NO: 33933 - DNA, 15 bp, Homo sapiens
aaaaaaataccttaa

SEQ ID NO: 33934 - DNA, 15 bp, Homo sapiens
caaaaaaatacctta

SEQ ID NO: 33935 - DNA, 15 bp, Homo sapiens
ccaaaaaaatacctt

SEQ ID NO: 33936 - DNA, 15 bp, Homo sapiens
accaaaaaaatacct

SEQ ID NO: 33937 - DNA, 15 bp, Homo sapiens
caccaaaaaaatacc

SEQ ID NO: 33938 - DNA, 15 bp, Homo sapiens
tcaccaaaaaaatac

SEQ ID NO: 33939 - DNA, 15 bp, Homo sapiens
atcaccaaaaaaata

SEQ ID NO: 33940 - DNA, 15 bp, Homo sapiens
gatcaccaaaaaaat

SEQ ID NO: 33941 - DNA, 15 bp, Homo sapiens
agatcaccaaaaaaa

SEQ ID NO: 33942 - DNA, 15 bp, Homo sapiens
cagatcaccaaaaaa

SEQ ID NO: 33943 - DNA, 15 bp, Homo sapiens
acagatcaccaaaaa

SEQ ID NO: 33944 - DNA, 15 bp, Homo sapiens
cacagatcaccaaaa

SEQ ID NO: 33945 - DNA, 15 bp, Homo sapiens
ccacagatcaccaaa

SEQ ID NO: 33946 - DNA, 15 bp, Homo sapiens
tccacagatcaccaa

SEQ ID NO: 33947 - DNA, 15 bp, Homo sapiens
atccacagatcacca

SEQ ID NO: 33948 - DNA, 15 bp, Homo sapiens
aatccacagatcacc

SEQ ID NO: 33949 - DNA, 15 bp, Homo sapiens
gaatccacagatcac

SEQ ID NO: 33950 - DNA, 15 bp, Homo sapiens
tgaatccacagatca

SEQ ID NO: 33951 - DNA, 15 bp, Homo sapiens
ttgaatccacagatc

SEQ ID NO: 33952 - DNA, 15 bp, Homo sapiens
attgaatccacagat

SEQ ID NO: 33953 - DNA, 15 bp, Homo sapiens
cattgaatccacaga

SEQ ID NO: 33954 - DNA, 15 bp, Homo sapiens
tcattgaatccacag

SEQ ID NO: 33955 - DNA, 15 bp, Homo sapiens
atcattgaatccaca

SEQ ID NO: 33956 - DNA, 15 bp, Homo sapiens
gatcattgaatccac

SEQ ID NO: 33957 - DNA, 15 bp, Homo sapiens
tgatcattgaatcca

SEQ ID NO: 33958 - DNA, 15 bp, Homo sapiens
atgatcattgaatcc

SEQ ID NO: 33959 - DNA, 15 bp, Homo sapiens
aatgatcattgaatc

SEQ ID NO: 33960 - DNA, 15 bp, Homo sapiens
aaatgatcattgaat

SEQ ID NO: 33961 - DNA, 15 bp, Homo sapiens
gaaatgatcattgaa

SEQ ID NO: 33962 - DNA, 15 bp, Homo sapiens
cgaaatgatcattga

SEQ ID NO: 33963 - DNA, 15 bp, Homo sapiens
acgaaatgatcattg

SEQ ID NO: 33964 - DNA, 15 bp, Homo sapiens
aacgaaatgatcatt

SEQ ID NO: 33965 - DNA, 15 bp, Homo sapiens
gaacgaaatgatcat

SEQ ID NO: 33966 - DNA, 15 bp, Homo sapiens
tgaacgaaatgatca

SEQ ID NO: 33967 - DNA, 15 bp, Homo sapiens
atgaacgaaatgatc

SEQ ID NO: 33968 - DNA, 15 bp, Homo sapiens
catgaacgaaatgat

SEQ ID NO: 33969 - DNA, 15 bp, Homo sapiens
ccatgaacgaaatga

SEQ ID NO: 33970 - DNA, 15 bp, Homo sapiens
tccatgaacgaaatg

SEQ ID NO: 33971 - DNA, 15 bp, Homo sapiens
ttccatgaacgaaat

SEQ ID NO: 33972 - DNA, 15 bp, Homo sapiens
cttccatgaacgaaa

SEQ ID NO: 33973 - DNA, 15 bp, Homo sapiens
ccttccatgaacgaa

SEQ ID NO: 33974 - DNA, 15 bp, Homo sapiens
tccttccatgaacga

SEQ ID NO: 33975 - DNA, 15 bp, Homo sapiens
ttccttccatgaacg

SEQ ID NO: 33976 - DNA, 15 bp, Homo sapiens
cttccttccatgaac

SEQ ID NO: 33977 - DNA, 15 bp, Homo sapiens
acttccttccatgaa

SEQ ID NO: 33978 - DNA, 15 bp, Homo sapiens
aacttccttccatga

SEQ ID NO: 33979 - DNA, 15 bp, Homo sapiens
aaacttccttccatg

SEQ ID NO: 33980 - DNA, 15 bp, Homo sapiens
aaaacttccttccat

SEQ ID NO: 33981 - DNA, 15 bp, Homo sapiens
taaaacttccttcca

SEQ ID NO: 33982 - DNA, 15 bp, Homo sapiens
ataaaacttccttcc

SEQ ID NO: 33983 - DNA, 15 bp, Homo sapiens
aataaaacttccttc

SEQ ID NO: 33984 - DNA, 15 bp, Homo sapiens
aaataaaacttcctt

SEQ ID NO: 33985 - DNA, 15 bp, Homo sapiens
aaaataaaacttcct

SEQ ID NO: 33986 - DNA, 15 bp, Homo sapiens
aaaaataaaacttcc

SEQ ID NO: 33987 - DNA, 15 bp, Homo sapiens
taaaaataaaacttc

SEQ ID NO: 33988 - DNA, 15 bp, Homo sapiens
ataaaaataaaactt

SEQ ID NO: 33989 - DNA, 15 bp, Homo sapiens
aataaaaataaaact

SEQ ID NO: 33990 - DNA, 15 bp, Homo sapiens
aaataaaaataaaac

SEQ ID NO: 33991 - DNA, 15 bp, Homo sapiens
aaaataaaaataaaa

SEQ ID NO: 33992 - DNA, 15 bp, Homo sapiens
aaaaataaaaataaa

SEQ ID NO: 33993 - DNA, 15 bp, Homo sapiens
aaaaaaataaaaata

SEQ ID NO: 33994 - DNA, 15 bp, Homo sapiens
gaaaaaaataaaaat

SEQ ID NO: 33995 - DNA, 15 bp, Homo sapiens
agaaaaaaataaaaa

SEQ ID NO: 33996 - DNA, 15 bp, Homo sapiens
cagaaaaaaataaaa

SEQ ID NO: 33997 - DNA, 15 bp, Homo sapiens
tcagaaaaaaataaa

SEQ ID NO: 33998 - DNA, 15 bp, Homo sapiens
ctcagaaaaaaataa

SEQ ID NO: 33999 - DNA, 15 bp, Homo sapiens
tctcagaaaaaaata

SEQ ID NO: 34000 - DNA, 15 bp, Homo sapiens
gtctcagaaaaaaat

SEQ ID NO: 34001 - DNA, 15 bp, Homo sapiens
agtctcagaaaaaaa

SEQ ID NO: 34002 - DNA, 15 bp, Homo sapiens
cagtctcagaaaaaa

SEQ ID NO: 34003 - DNA, 15 bp, Homo sapiens
tcagtctcagaaaaa

SEQ ID NO: 34004 - DNA, 15 bp, Homo sapiens
ctcagtctcagaaaa

SEQ ID NO: 34005 - DNA, 15 bp, Homo sapiens
actcagtctcagaaa

SEQ ID NO: 34006 - DNA, 15 bp, Homo sapiens
gactcagtctcagaa

SEQ ID NO: 34007 - DNA, 15 bp, Homo sapiens
agactcagtctcaga

SEQ ID NO: 34008 - DNA, 15 bp, Homo sapiens
aagactcagtctcag

SEQ ID NO: 34009 - DNA, 15 bp, Homo sapiens
caagactcagtctca

SEQ ID NO: 34010 - DNA, 15 bp, Homo sapiens
gcaagactcagtctc

SEQ ID NO: 34011 - DNA, 15 bp, Homo sapiens
agcaagactcagtct

SEQ ID NO: 34012 - DNA, 15 bp, Homo sapiens
gagcaagactcagtc

SEQ ID NO: 34013 - DNA, 15 bp, Homo sapiens
agagcaagactcagt

SEQ ID NO: 34014 - DNA, 15 bp, Homo sapiens
cagagcaagactcag

SEQ ID NO: 34015 - DNA, 15 bp, Homo sapiens
acagagcaagactca

SEQ ID NO: 34016 - DNA, 15 bp, Homo sapiens
acccaggaggcggag

SEQ ID NO: 34017 - DNA, 15 bp, Homo sapiens
aacccaggaggcgga

SEQ ID NO: 34018 - DNA, 15 bp, Homo sapiens
gaacccaggaggcgg

SEQ ID NO: 34019 - DNA, 15 bp, Homo sapiens
tgaacccaggaggcg

SEQ ID NO: 34020 - DNA, 15 bp, Homo sapiens
ttgaacccaggaggc

SEQ ID NO: 34021 - DNA, 15 bp, Homo sapiens
cttgaacccaggagg

SEQ ID NO: 34022 - DNA, 15 bp, Homo sapiens
acttgaacccaggag

SEQ ID NO: 34023 - DNA, 15 bp, Homo sapiens
cacttgaacccagga

SEQ ID NO: 34024 - DNA, 15 bp, Homo sapiens
tcacttgaacccagg

SEQ ID NO: 34025 - DNA, 15 bp, Homo sapiens
aatcacttgaaccca

SEQ ID NO: 34026 - DNA, 15 bp, Homo sapiens
agcaggagaatcact

SEQ ID NO: 34027 - DNA, 15 bp, Homo sapiens
aagcaggagaatcac

SEQ ID NO: 34028 - DNA, 15 bp, Homo sapiens
gaagcaggagaatca

SEQ ID NO: 34029 - DNA, 15 bp, Homo sapiens
cgaagcaggagaatc

SEQ ID NO: 34030 - DNA, 15 bp, Homo sapiens
ccgaagcaggagaat

SEQ ID NO: 34031 - DNA, 15 bp, Homo sapiens
gccgaagcaggagaa

SEQ ID NO: 34032 - DNA, 15 bp, Homo sapiens
ggccgaagcaggaga

SEQ ID NO: 34033 - DNA, 15 bp, Homo sapiens
aggccgaagcaggag

SEQ ID NO: 34034 - DNA, 15 bp, Homo sapiens
gaggccgaagcagga

SEQ ID NO: 34035 - DNA, 15 bp, Homo sapiens
ggaggccgaagcagg

SEQ ID NO: 34036 - DNA, 15 bp, Homo sapiens
aggaggccgaagcag

SEQ ID NO: 34037 - DNA, 15 bp, Homo sapiens
caggaggccgaagca

SEQ ID NO: 34038 - DNA, 15 bp, Homo sapiens
gcaggaggccgaagc

SEQ ID NO: 34039 - DNA, 15 bp, Homo sapiens
tgcaggaggccgaag

SEQ ID NO: 34040 - DNA, 15 bp, Homo sapiens
atgcaggaggccgaa

SEQ ID NO: 34041 - DNA, 15 bp, Homo sapiens
tatgcaggaggccga

SEQ ID NO: 34042 - DNA, 15 bp, Homo sapiens
ctatgcaggaggccg

SEQ ID NO: 34043 - DNA, 15 bp, Homo sapiens
gctatgcaggaggcc

SEQ ID NO: 34044 - DNA, 15 bp, Homo sapiens
agctatgcaggaggc

SEQ ID NO: 34045 - DNA, 15 bp, Homo sapiens
cagctatgcaggagg

SEQ ID NO: 34046 - DNA, 15 bp, Homo sapiens
ccagctatgcaggag

SEQ ID NO: 34047 - DNA, 15 bp, Homo sapiens
cccagctatgcagga

SEQ ID NO: 34048 - DNA, 15 bp, Homo sapiens
tcccagctatgcagg

SEQ ID NO: 34049 - DNA, 15 bp, Homo sapiens
gtcccagctatgcag

SEQ ID NO: 34050 - DNA, 15 bp, Homo sapiens
agtcccagctatgca

SEQ ID NO: 34051 - DNA, 15 bp, Homo sapiens
cagtcccagctatgc

SEQ ID NO: 34052 - DNA, 15 bp, Homo sapiens
gcagtcccagctatg

SEQ ID NO: 34053 - DNA, 15 bp, Homo sapiens
tgcagtcccagctat

SEQ ID NO: 34054 - DNA, 15 bp, Homo sapiens
ctgcagtcccagcta

SEQ ID NO: 34055 - DNA, 15 bp, Homo sapiens
cctgcagtcccagct

SEQ ID NO: 34056 - DNA, 15 bp, Homo sapiens
gcctgcagtcccagc

SEQ ID NO: 34057 - DNA, 15 bp, Homo sapiens
tgcctgcagtcccag

SEQ ID NO: 34058 - DNA, 15 bp, Homo sapiens
atgcctgcagtccca

SEQ ID NO: 34059 - DNA, 15 bp, Homo sapiens
catgcctgcagtccc

SEQ ID NO: 34060 - DNA, 15 bp, Homo sapiens
acatgcctgcagtcc

SEQ ID NO: 34061 - DNA, 15 bp, Homo sapiens
cacatgcctgcagtc

SEQ ID NO: 34062 - DNA, 15 bp, Homo sapiens
acacatgcctgcagt

SEQ ID NO: 34063 - DNA, 15 bp, Homo sapiens
gacacatgcctgcag

SEQ ID NO: 34064 - DNA, 15 bp, Homo sapiens
tgacacatgcctgca

SEQ ID NO: 34065 - DNA, 15 bp, Homo sapiens
atgacacatgcctgc

SEQ ID NO: 34066 - DNA, 15 bp, Homo sapiens
gatgacacatgcctg

SEQ ID NO: 34067 - DNA, 15 bp, Homo sapiens
tgatgacacatgcct

SEQ ID NO: 34068 - DNA, 15 bp, Homo sapiens
gtgatgacacatgcc

SEQ ID NO: 34069 - DNA, 15 bp, Homo sapiens
cgtgatgacacatgc

SEQ ID NO: 34070 - DNA, 15 bp, Homo sapiens
gcgtgatgacacatg

SEQ ID NO: 34071 - DNA, 15 bp, Homo sapiens
ggcgtgatgacacat

SEQ ID NO: 34072 - DNA, 15 bp, Homo sapiens
aggcgtgatgacaca

SEQ ID NO: 34073 - DNA, 15 bp, Homo sapiens
caggcgtgatgacac

SEQ ID NO: 34074 - DNA, 15 bp, Homo sapiens
ccaggcgtgatgaca

SEQ ID NO: 34075 - DNA, 15 bp, Homo sapiens
gccaggcgtgatgac

SEQ ID NO: 34076 - DNA, 15 bp, Homo sapiens
agccaggcgtgatga

SEQ ID NO: 34077 - DNA, 15 bp, Homo sapiens
tagccaggcgtgatg

SEQ ID NO: 34078 - DNA, 15 bp, Homo sapiens
ttagccaggcgtgat

SEQ ID NO: 34079 - DNA, 15 bp, Homo sapiens
attagccaggcgtga

SEQ ID NO: 34080 - DNA, 15 bp, Homo sapiens
agtctctactaaaaa

SEQ ID NO: 34081 - DNA, 15 bp, Homo sapiens
cagtctctactaaaa

SEQ ID NO: 34082 - DNA, 15 bp, Homo sapiens
ccagtctctactaaa

SEQ ID NO: 34083 - DNA, 15 bp, Homo sapiens
cccagtctctactaa

SEQ ID NO: 34084 - DNA, 15 bp, Homo sapiens
acccagtctctacta

SEQ ID NO: 34085 - DNA, 15 bp, Homo sapiens
aacccagtctctact

SEQ ID NO: 34086 - DNA, 15 bp, Homo sapiens
aaacccagtctctac

SEQ ID NO: 34087 - DNA, 15 bp, Homo sapiens
gaaacccagtctcta

SEQ ID NO: 34088 - DNA, 15 bp, Homo sapiens
cgaaacccagtctct

SEQ ID NO: 34089 - DNA, 15 bp, Homo sapiens
gcgaaacccagtctc

SEQ ID NO: 34090 - DNA, 15 bp, Homo sapiens
ggcgaaacccagtct

SEQ ID NO: 34091 - DNA, 15 bp, Homo sapiens
tggcgaaacccagtc

SEQ ID NO: 34092 - DNA, 15 bp, Homo sapiens
atggcgaaacccagt

SEQ ID NO: 34093 - DNA, 15 bp, Homo sapiens
catggcgaaacccag

SEQ ID NO: 34094 - DNA, 15 bp, Homo sapiens
acatggcgaaaccca

SEQ ID NO: 34095 - DNA, 15 bp, Homo sapiens
tagcctggccaacat

SEQ ID NO: 34096 - DNA, 15 bp, Homo sapiens
ctagcctggccaaca

SEQ ID NO: 34097 - DNA, 15 bp, Homo sapiens
actagcctggccaac

SEQ ID NO: 34098 - DNA, 15 bp, Homo sapiens
gactagcctggccaa

SEQ ID NO: 34099 - DNA, 15 bp, Homo sapiens
agactagcctggcca

SEQ ID NO: 34100 - DNA, 15 bp, Homo sapiens
aagactagcctggcc

SEQ ID NO: 34101 - DNA, 15 bp, Homo sapiens
caagactagcctggc

SEQ ID NO: 34102 - DNA, 15 bp, Homo sapiens
tcaagactagcctgg

SEQ ID NO: 34103 - DNA, 15 bp, Homo sapiens
ttcaagactagcctg

SEQ ID NO: 34104 - DNA, 15 bp, Homo sapiens
gttcaagactagcct

SEQ ID NO: 34105 - DNA, 15 bp, Homo sapiens
acacctgaggtcagg

SEQ ID NO: 34106 - DNA, 15 bp, Homo sapiens
aacacctgaggtcag

SEQ ID NO: 34107 - DNA, 15 bp, Homo sapiens
gaacacctgaggtca

SEQ ID NO: 34108 - DNA, 15 bp, Homo sapiens
ggaacacctgaggtc

SEQ ID NO: 34109 - DNA, 15 bp, Homo sapiens
tggaacacctgaggt

SEQ ID NO: 34110 - DNA, 15 bp, Homo sapiens
gtggaacacctgagg

SEQ ID NO: 34111 - DNA, 15 bp, Homo sapiens
ggtggaacacctgag

SEQ ID NO: 34112 - DNA, 15 bp, Homo sapiens
gggtggaacacctga

SEQ ID NO: 34113 - DNA, 15 bp, Homo sapiens
cgggtggaacacctg

SEQ ID NO: 34114 - DNA, 15 bp, Homo sapiens
acgggtggaacacct

SEQ ID NO: 34115 - DNA, 15 bp, Homo sapiens
gacgggtggaacacc

SEQ ID NO: 34116 - DNA, 15 bp, Homo sapiens
agacgggtggaacac

SEQ ID NO: 34117 - DNA, 15 bp, Homo sapiens
gagacgggtggaaca

SEQ ID NO: 34118 - DNA, 15 bp, Homo sapiens
cgagacgggtggaac

SEQ ID NO: 34119 - DNA, 15 bp, Homo sapiens
ccgagacgggtggaa

SEQ ID NO: 34120 - DNA, 15 bp, Homo sapiens
tttgttaggtggagg

SEQ ID NO: 34121 - DNA, 15 bp, Homo sapiens
ttttgttaggtggag

SEQ ID NO: 34122 - DNA, 15 bp, Homo sapiens
gttttgttaggtgga

SEQ ID NO: 34123 - DNA, 15 bp, Homo sapiens
tgttttgttaggtgg

SEQ ID NO: 34124 - DNA, 15 bp, Homo sapiens
gtgttttgttaggtg

SEQ ID NO: 34125 - DNA, 15 bp, Homo sapiens
ggtgttttgttaggt

SEQ ID NO: 34126 - DNA, 15 bp, Homo sapiens
gggtgttttgttagg

SEQ ID NO: 34127 - DNA, 15 bp, Homo sapiens
tgggtgttttgttag

SEQ ID NO: 34128 - DNA, 15 bp, Homo sapiens
gtgggtgttttgtta

SEQ ID NO: 34129 - DNA, 15 bp, Homo sapiens
agtgggtgttttgtt

SEQ ID NO: 34130 - DNA, 15 bp, Homo sapiens
cagtgggtgttttgt

SEQ ID NO: 34131 - DNA, 15 bp, Homo sapiens
acagtgggtgttttg

SEQ ID NO: 34132 - DNA, 15 bp, Homo sapiens
cacagtgggtgtttt

SEQ ID NO: 34133 - DNA, 15 bp, Homo sapiens
tcacagtgggtgttt

SEQ ID NO: 34134 - DNA, 15 bp, Homo sapiens
gtcacagtgggtgtt

SEQ ID NO: 34135 - DNA, 15 bp, Homo sapiens
agtcacagtgggtgt

SEQ ID NO: 34136 - DNA, 15 bp, Homo sapiens
tagtcacagtgggtg

SEQ ID NO: 34137 - DNA, 15 bp, Homo sapiens
atagtcacagtgggt

SEQ ID NO: 34138 - DNA, 15 bp, Homo sapiens
aatagtcacagtggg

SEQ ID NO: 34139 - DNA, 15 bp, Homo sapiens
aaatagtcacagtgg

SEQ ID NO: 34140 - DNA, 15 bp, Homo sapiens
taaatagtcacagtg

SEQ ID NO: 34141 - DNA, 15 bp, Homo sapiens
gtaaatagtcacagt

SEQ ID NO: 34142 - DNA, 15 bp, Homo sapiens
tgtaaatagtcacag

SEQ ID NO: 34143 - DNA, 15 bp, Homo sapiens
ttgtaaatagtcaca

SEQ ID NO: 34144 - DNA, 15 bp, Homo sapiens
attgtaaatagtcac

SEQ ID NO: 34145 - DNA, 15 bp, Homo sapiens
cattgtaaatagtca

SEQ ID NO: 34146 - DNA, 15 bp, Homo sapiens
acattgtaaatagtc

SEQ ID NO: 34147 - DNA, 15 bp, Homo sapiens
aacattgtaaatagt

SEQ ID NO: 34148 - DNA, 15 bp, Homo sapiens
aaacattgtaaatag

SEQ ID NO: 34149 - DNA, 15 bp, Homo sapiens
caaacattgtaaata

SEQ ID NO: 34150 - DNA, 15 bp, Homo sapiens
gcaaacattgtaaat

SEQ ID NO: 34151 - DNA, 15 bp, Homo sapiens
tgcaaacattgtaaa

SEQ ID NO: 34152 - DNA, 15 bp, Homo sapiens
atgcaaacattgtaa

SEQ ID NO: 34153 - DNA, 15 bp, Homo sapiens
gatgcaaacattgta

SEQ ID NO: 34154 - DNA, 15 bp, Homo sapiens
agatgcaaacattgt

SEQ ID NO: 34155 - DNA, 15 bp, Homo sapiens
gagatgcaaacattg

SEQ ID NO: 34156 - DNA, 15 bp, Homo sapiens
tgagatgcaaacatt

SEQ ID NO: 34157 - DNA, 15 bp, Homo sapiens
ctgagatgcaaacat

SEQ ID NO: 34158 - DNA, 15 bp, Homo sapiens
gctgagatgcaaaca

SEQ ID NO: 34159 - DNA, 15 bp, Homo sapiens
tgctgagatgcaaac

SEQ ID NO: 34160 - DNA, 15 bp, Homo sapiens
ttgctgagatgcaaa

SEQ ID NO: 34161 - DNA, 15 bp, Homo sapiens
tttgctgagatgcaa

SEQ ID NO: 34162 - DNA, 15 bp, Homo sapiens
ttttgctgagatgca

SEQ ID NO: 34163 - DNA, 15 bp, Homo sapiens
tttttgctgagatgc

SEQ ID NO: 34164 - DNA, 15 bp, Homo sapiens
atttttgctgagatg

SEQ ID NO: 34165 - DNA, 15 bp, Homo sapiens
tatttttgctgagat

SEQ ID NO: 34166 - DNA, 15 bp, Homo sapiens
gtatttttgctgaga

SEQ ID NO: 34167 - DNA, 15 bp, Homo sapiens
ggtatttttgctgag

SEQ ID NO: 34168 - DNA, 15 bp, Homo sapiens
tggtatttttgctga

SEQ ID NO: 34169 - DNA, 15 bp, Homo sapiens
atggtatttttgctg

SEQ ID NO: 34170 - DNA, 15 bp, Homo sapiens
aatggtatttttgct

SEQ ID NO: 34171 - DNA, 15 bp, Homo sapiens
aaatggtatttttgc

SEQ ID NO: 34172 - DNA, 15 bp, Homo sapiens
caaatggtatttttg

SEQ ID NO: 34173 - DNA, 15 bp, Homo sapiens
acaaatggtattttt

SEQ ID NO: 34174 - DNA, 15 bp, Homo sapiens
tacaaatggtatttt

SEQ ID NO: 34175 - DNA, 15 bp, Homo sapiens
atacaaatggtattt

SEQ ID NO: 34176 - DNA, 15 bp, Homo sapiens
aatacaaatggtatt

SEQ ID NO: 34177 - DNA, 15 bp, Homo sapiens
gaatacaaatggtat

SEQ ID NO: 34178 - DNA, 15 bp, Homo sapiens
agaatacaaatggta

SEQ ID NO: 34179 - DNA, 15 bp, Homo sapiens
cagaatacaaatggt

SEQ ID NO: 34180 - DNA, 15 bp, Homo sapiens
tcagaatacaaatgg

SEQ ID NO: 34181 - DNA, 15 bp, Homo sapiens
ttcagaatacaaatg

SEQ ID NO: 34182 - DNA, 15 bp, Homo sapiens
attcagaatacaaat

SEQ ID NO: 34183 - DNA, 15 bp, Homo sapiens
aattcagaatacaaa

SEQ ID NO: 34184 - DNA, 15 bp, Homo sapiens
gaattcagaatacaa

SEQ ID NO: 34185 - DNA, 15 bp, Homo sapiens
ggaattcagaataca

SEQ ID NO: 34186 - DNA, 15 bp, Homo sapiens
aggaattcagaatac

SEQ ID NO: 34187 - DNA, 15 bp, Homo sapiens
aaggaattcagaata

SEQ ID NO: 34188 - DNA, 15 bp, Homo sapiens
aaaggaattcagaat

SEQ ID NO: 34189 - DNA, 15 bp, Homo sapiens
acaaaggaattcaga

SEQ ID NO: 34190 - DNA, 15 bp, Homo sapiens
aacaaaggaattcag

SEQ ID NO: 34191 - DNA, 15 bp, Homo sapiens
aaacaaaggaattca

SEQ ID NO: 34192 - DNA, 15 bp, Homo sapiens
gaaacaaaggaattc

SEQ ID NO: 34193 - DNA, 15 bp, Homo sapiens
tgaaacaaaggaatt

SEQ ID NO: 34194 - DNA, 15 bp, Homo sapiens
ttgaaacaaaggaat

SEQ ID NO: 34195 - DNA, 15 bp, Homo sapiens
gttgaaacaaaggaa

SEQ ID NO: 34196 - DNA, 15 bp, Homo sapiens
agttgaaacaaagga

SEQ ID NO: 34197 - DNA, 15 bp, Homo sapiens
tagttgaaacaaagg

SEQ ID NO: 34198 - DNA, 15 bp, Homo sapiens
gtagttgaaacaaag

SEQ ID NO: 34199 - DNA, 15 bp, Homo sapiens
tgtagttgaaacaaa

SEQ ID NO: 34200 - DNA, 15 bp, Homo sapiens
atgtagttgaaacaa

SEQ ID NO: 34201 - DNA, 15 bp, Homo sapiens
tatgtagttgaaaca

SEQ ID NO: 34202 - DNA, 15 bp, Homo sapiens
ttatgtagttgaaac

SEQ ID NO: 34203 - DNA, 15 bp, Homo sapiens
gttatgtagttgaaa

SEQ ID NO: 34204 - DNA, 15 bp, Homo sapiens
agttatgtagttgaa

SEQ ID NO: 34205 - DNA, 15 bp, Homo sapiens
gagttatgtagttga

SEQ ID NO: 34206 - DNA, 15 bp, Homo sapiens
tgagttatgtagttg

SEQ ID NO: 34207 - DNA, 15 bp, Homo sapiens
ttgagttatgtagtt

SEQ ID NO: 34208 - DNA, 15 bp, Homo sapiens
attgagttatgtagt

SEQ ID NO: 34209 - DNA, 15 bp, Homo sapiens
tattgagttatgtag

SEQ ID NO: 34210 - DNA, 15 bp, Homo sapiens
ttattgagttatgta

SEQ ID NO: 34211 - DNA, 15 bp, Homo sapiens
cttattgagttatgt

SEQ ID NO: 34212 - DNA, 15 bp, Homo sapiens
tcttattgagttatg

SEQ ID NO: 34213 - DNA, 15 bp, Homo sapiens
ttcttattgagttat

SEQ ID NO: 34214 - DNA, 15 bp, Homo sapiens
tttcttattgagtta

SEQ ID NO: 34215 - DNA, 15 bp, Homo sapiens
ctttcttattgagtt

SEQ ID NO: 34216 - DNA, 15 bp, Homo sapiens
tctttcttattgagt

SEQ ID NO: 34217 - DNA, 15 bp, Homo sapiens
ttctttcttattgag

SEQ ID NO: 34218 - DNA, 15 bp, Homo sapiens
tttctttcttattga

SEQ ID NO: 34219 - DNA, 15 bp, Homo sapiens
ctttctttcttattg

SEQ ID NO: 34220 - DNA, 15 bp, Homo sapiens
actttctttcttatt

SEQ ID NO: 34221 - DNA, 15 bp, Homo sapiens
aactttctttcttat

SEQ ID NO: 34222 - DNA, 15 bp, Homo sapiens
aaactttctttctta

SEQ ID NO: 34223 - DNA, 15 bp, Homo sapiens
gaaactttctttctt

SEQ ID NO: 34224 - DNA, 15 bp, Homo sapiens
ggaaactttctttct

SEQ ID NO: 34225 - DNA, 15 bp, Homo sapiens
aggaaactttctttc

SEQ ID NO: 34226 - DNA, 15 bp, Homo sapiens
taggaaactttcttt

SEQ ID NO: 34227 - DNA, 15 bp, Homo sapiens
gtaggaaactttctt

SEQ ID NO: 34228 - DNA, 15 bp, Homo sapiens
tgtaggaaactttct

SEQ ID NO: 34229 - DNA, 15 bp, Homo sapiens
ttgtaggaaactttc

SEQ ID NO: 34230 - DNA, 15 bp, Homo sapiens
attgtaggaaacttt

SEQ ID NO: 34231 - DNA, 15 bp, Homo sapiens
aattgtaggaaactt

SEQ ID NO: 34232 - DNA, 15 bp, Homo sapiens
caattgtaggaaact

SEQ ID NO: 34233 - DNA, 15 bp, Homo sapiens
tcaattgtaggaaac

SEQ ID NO: 34234 - DNA, 15 bp, Homo sapiens
ttcaattgtaggaaa

SEQ ID NO: 34235 - DNA, 15 bp, Homo sapiens
tttcaattgtaggaa

SEQ ID NO: 34236 - DNA, 15 bp, Homo sapiens
ttttcaattgtagga

SEQ ID NO: 34237 - DNA, 15 bp, Homo sapiens
cttttcaattgtagg

SEQ ID NO: 34238 - DNA, 15 bp, Homo sapiens
tcttttcaattgtag

SEQ ID NO: 34239 - DNA, 15 bp, Homo sapiens
ttcttttcaattgta

SEQ ID NO: 34240 - DNA, 15 bp, Homo sapiens
attcttttcaattgt

SEQ ID NO: 34241 - DNA, 15 bp, Homo sapiens
tattcttttcaattg

SEQ ID NO: 34242 - DNA, 15 bp, Homo sapiens
ctattcttttcaatt

SEQ ID NO: 34243 - DNA, 15 bp, Homo sapiens
tctattcttttcaat

SEQ ID NO: 34244 - DNA, 15 bp, Homo sapiens
gtctattcttttcaa

SEQ ID NO: 34245 - DNA, 15 bp, Homo sapiens
tgtctattcttttca

SEQ ID NO: 34246 - DNA, 15 bp, Homo sapiens
ctgtctattcttttc

SEQ ID NO: 34247 - DNA, 15 bp, Homo sapiens
actgtctattctttt

SEQ ID NO: 34248 - DNA, 15 bp, Homo sapiens
cactgtctattcttt

SEQ ID NO: 34249 - DNA, 15 bp, Homo sapiens
acactgtctattctt

SEQ ID NO: 34250 - DNA, 15 bp, Homo sapiens
aacactgtctattct

SEQ ID NO: 34251 - DNA, 15 bp, Homo sapiens
aaacactgtctattc

SEQ ID NO: 34252 - DNA, 15 bp, Homo sapiens
taaacactgtctatt

SEQ ID NO: 34253 - DNA, 15 bp, Homo sapiens
ttaaacactgtctat

SEQ ID NO: 34254 - DNA, 15 bp, Homo sapiens
tttaaacactgtcta

SEQ ID NO: 34255 - DNA, 15 bp, Homo sapiens
ctttaaacactgtct

SEQ ID NO: 34256 - DNA, 15 bp, Homo sapiens
cctttaaacactgtc

SEQ ID NO: 34257 - DNA, 15 bp, Homo sapiens
gcctttaaacactgt

SEQ ID NO: 34258 - DNA, 15 bp, Homo sapiens
ggcctttaaacactg

SEQ ID NO: 34259 - DNA, 15 bp, Homo sapiens
tggcctttaaacact

SEQ ID NO: 34260 - DNA, 15 bp, Homo sapiens
ttggcctttaaacac

SEQ ID NO: 34261 - DNA, 15 bp, Homo sapiens
cttggcctttaaaca

SEQ ID NO: 34262 - DNA, 15 bp, Homo sapiens
acttggcctttaaac

SEQ ID NO: 34263 - DNA, 15 bp, Homo sapiens
aacttggcctttaaa

SEQ ID NO: 34264 - DNA, 15 bp, Homo sapiens
aaacttggcctttaa

SEQ ID NO: 34265 - DNA, 15 bp, Homo sapiens
aaaacttggccttta

SEQ ID NO: 34266 - DNA, 15 bp, Homo sapiens
caaaacttggccttt

SEQ ID NO: 34267 - DNA, 15 bp, Homo sapiens
gcaaaacttggcctt

SEQ ID NO: 34268 - DNA, 15 bp, Homo sapiens
ggcaaaacttggcct

SEQ ID NO: 34269 - DNA, 15 bp, Homo sapiens
aggcaaaacttggcc

SEQ ID NO: 34270 - DNA, 15 bp, Homo sapiens
aaggcaaaacttggc

SEQ ID NO: 34271 - DNA, 15 bp, Homo sapiens
gaaggcaaaacttgg

SEQ ID NO: 34272 - DNA, 15 bp, Homo sapiens
ggaaggcaaaacttg

SEQ ID NO: 34273 - DNA, 15 bp, Homo sapiens
aggaaggcaaaactt

SEQ ID NO: 34274 - DNA, 15 bp, Homo sapiens
aaggaaggcaaaact

SEQ ID NO: 34275 - DNA, 15 bp, Homo sapiens
aaaggaaggcaaaac

SEQ ID NO: 34276 - DNA, 15 bp, Homo sapiens
aaaaggaaggcaaaa

SEQ ID NO: 34277 - DNA, 15 bp, Homo sapiens
taaaaggaaggcaaa

SEQ ID NO: 34278 - DNA, 15 bp, Homo sapiens
ttaaaaggaaggcaa

SEQ ID NO: 34279 - DNA, 15 bp, Homo sapiens
cttaaaaggaaggca

SEQ ID NO: 34280 - DNA, 15 bp, Homo sapiens
ccttaaaaggaaggc

SEQ ID NO: 34281 - DNA, 15 bp, Homo sapiens
gccttaaaaggaagg

SEQ ID NO: 34282 - DNA, 15 bp, Homo sapiens
agccttaaaaggaag

SEQ ID NO: 34283 - DNA, 15 bp, Homo sapiens
cagccttaaaaggaa

SEQ ID NO: 34284 - DNA, 15 bp, Homo sapiens
tcagccttaaaagga

SEQ ID NO: 34285 - DNA, 15 bp, Homo sapiens
ttcagccttaaaagg

SEQ ID NO: 34286 - DNA, 15 bp, Homo sapiens
attcagccttaaaag

SEQ ID NO: 34287 - DNA, 15 bp, Homo sapiens
cattcagccttaaaa

SEQ ID NO: 34288 - DNA, 15 bp, Homo sapiens
acattcagccttaaa

SEQ ID NO: 34289 - DNA, 15 bp, Homo sapiens
cacattcagccttaa

SEQ ID NO: 34290 - DNA, 15 bp, Homo sapiens
gcacattcagcctta

SEQ ID NO: 34291 - DNA, 15 bp, Homo sapiens
agcacattcagcctt

SEQ ID NO: 34292 - DNA, 15 bp, Homo sapiens
aagcacattcagcct

SEQ ID NO: 34293 - DNA, 15 bp, Homo sapiens
aaagcacattcagcc

SEQ ID NO: 34294 - DNA, 15 bp, Homo sapiens
taaagcacattcagc

SEQ ID NO: 34295 - DNA, 15 bp, Homo sapiens
ataaagcacattcag

SEQ ID NO: 34296 - DNA, 15 bp, Homo sapiens
aataaagcacattca

SEQ ID NO: 34297 - DNA, 15 bp, Homo sapiens
aaataaagcacattc

SEQ ID NO: 34298 - DNA, 15 bp, Homo sapiens
aaaataaagcacatt

SEQ ID NO: 34299 - DNA, 15 bp, Homo sapiens
taaaataaagcacat

SEQ ID NO: 34300 - DNA, 15 bp, Homo sapiens
ttaaaataaagcaca

SEQ ID NO: 34301 - DNA, 15 bp, Homo sapiens
cttaaaataaagcac

SEQ ID NO: 34302 - DNA, 15 bp, Homo sapiens
gcttaaaataaagca

SEQ ID NO: 34303 - DNA, 15 bp, Homo sapiens
ggcttaaaataaagc

SEQ ID NO: 34304 - DNA, 15 bp, Homo sapiens
tggcttaaaataaag

SEQ ID NO: 34305 - DNA, 15 bp, Homo sapiens
gtggcttaaaataaa

SEQ ID NO: 34306 - DNA, 15 bp, Homo sapiens
agtggcttaaaataa

SEQ ID NO: 34307 - DNA, 15 bp, Homo sapiens
gagtggcttaaaata

SEQ ID NO: 34308 - DNA, 15 bp, Homo sapiens
agagtggcttaaaat

SEQ ID NO: 34309 - DNA, 15 bp, Homo sapiens
aagagtggcttaaaa

SEQ ID NO: 34310 - DNA, 15 bp, Homo sapiens
gaagagtggcttaaa

SEQ ID NO: 34311 - DNA, 15 bp, Homo sapiens
ggaagagtggcttaa

SEQ ID NO: 34312 - DNA, 15 bp, Homo sapiens
aggaagagtggctta

SEQ ID NO: 34313 - DNA, 15 bp, Homo sapiens
gaggaagagtggctt

SEQ ID NO: 34314 - DNA, 15 bp, Homo sapiens
ggaggaagagtggct

SEQ ID NO: 34315 - DNA, 15 bp, Homo sapiens
aggaggaagagtggc

SEQ ID NO: 34316 - DNA, 15 bp, Homo sapiens
gaggaggaagagtgg

SEQ ID NO: 34317 - DNA, 15 bp, Homo sapiens
tgaggaggaagagtg

SEQ ID NO: 34318 - DNA, 15 bp, Homo sapiens
ttgaggaggaagagt

SEQ ID NO: 34319 - DNA, 15 bp, Homo sapiens
cttgaggaggaagag

SEQ ID NO: 34320 - DNA, 15 bp, Homo sapiens
acttgaggaggaaga

SEQ ID NO: 34321 - DNA, 15 bp, Homo sapiens
aacttgaggaggaag

SEQ ID NO: 34322 - DNA, 15 bp, Homo sapiens
taacttgaggaggaa

SEQ ID NO: 34323 - DNA, 15 bp, Homo sapiens
ttaacttgaggagga

SEQ ID NO: 34324 - DNA, 15 bp, Homo sapiens
cttaacttgaggagg

SEQ ID NO: 34325 - DNA, 15 bp, Homo sapiens
tcttaacttgaggag

SEQ ID NO: 34326 - DNA, 15 bp, Homo sapiens
ttcttaacttgagga

SEQ ID NO: 34327 - DNA, 15 bp, Homo sapiens
cttcttaacttgagg

SEQ ID NO: 34328 - DNA, 15 bp, Homo sapiens
ccttcttaacttgag

SEQ ID NO: 34329 - DNA, 15 bp, Homo sapiens
cccttcttaacttga

SEQ ID NO: 34330 - DNA, 15 bp, Homo sapiens
gcccttcttaacttg

SEQ ID NO: 34331 - DNA, 15 bp, Homo sapiens
ggcccttcttaactt

SEQ ID NO: 34332 - DNA, 15 bp, Homo sapiens
aggcccttcttaact

SEQ ID NO: 34333 - DNA, 15 bp, Homo sapiens
aaggcccttcttaac

SEQ ID NO: 34334 - DNA, 15 bp, Homo sapiens
gaaggcccttcttaa

SEQ ID NO: 34335 - DNA, 15 bp, Homo sapiens
agaaggcccttctta

SEQ ID NO: 34336 - DNA, 15 bp, Homo sapiens
cagaaggcccttctt

SEQ ID NO: 34337 - DNA, 15 bp, Homo sapiens
ccagaaggcccttct

SEQ ID NO: 34338 - DNA, 15 bp, Homo sapiens
accagaaggcccttc

SEQ ID NO: 34339 - DNA, 15 bp, Homo sapiens
taccagaaggccctt

SEQ ID NO: 34340 - DNA, 15 bp, Homo sapiens
ataccagaaggccct

SEQ ID NO: 34341 - DNA, 15 bp, Homo sapiens
aataccagaaggccc

SEQ ID NO: 34342 - DNA, 15 bp, Homo sapiens
aaataccagaaggcc

SEQ ID NO: 34343 - DNA, 15 bp, Homo sapiens
gaaataccagaaggc

SEQ ID NO: 34344 - DNA, 15 bp, Homo sapiens
agaaataccagaagg

SEQ ID NO: 34345 - DNA, 15 bp, Homo sapiens
cagaaataccagaag

SEQ ID NO: 34346 - DNA, 15 bp, Homo sapiens
acagaaataccagaa

SEQ ID NO: 34347 - DNA, 15 bp, Homo sapiens
cacagaaataccaga

SEQ ID NO: 34348 - DNA, 15 bp, Homo sapiens
gcacagaaataccag

SEQ ID NO: 34349 - DNA, 15 bp, Homo sapiens
tgcacagaaatacca

SEQ ID NO: 34350 - DNA, 15 bp, Homo sapiens
ttgcacagaaatacc

SEQ ID NO: 34351 - DNA, 15 bp, Homo sapiens
tttgcacagaaatac

SEQ ID NO: 34352 - DNA, 15 bp, Homo sapiens
ctttgcacagaaata

SEQ ID NO: 34353 - DNA, 15 bp, Homo sapiens
gctttgcacagaaat

SEQ ID NO: 34354 - DNA, 15 bp, Homo sapiens
tgctttgcacagaaa

SEQ ID NO: 34355 - DNA, 15 bp, Homo sapiens
gtgctttgcacagaa

SEQ ID NO: 34356 - DNA, 15 bp, Homo sapiens
ggtgctttgcacaga

SEQ ID NO: 34357 - DNA, 15 bp, Homo sapiens
tggtgctttgcacag

SEQ ID NO: 34358 - DNA, 15 bp, Homo sapiens
ctggtgctttgcaca

SEQ ID NO: 34359 - DNA, 15 bp, Homo sapiens
actggtgctttgcac

SEQ ID NO: 34360 - DNA, 15 bp, Homo sapiens
tactggtgctttgca

SEQ ID NO: 34361 - DNA, 15 bp, Homo sapiens
ttactggtgctttgc

SEQ ID NO: 34362 - DNA, 15 bp, Homo sapiens
attactggtgctttg

SEQ ID NO: 34363 - DNA, 15 bp, Homo sapiens
tattactggtgcttt

SEQ ID NO: 34364 - DNA, 15 bp, Homo sapiens
gtattactggtgctt

SEQ ID NO: 34365 - DNA, 15 bp, Homo sapiens
agtattactggtgct

SEQ ID NO: 34366 - DNA, 15 bp, Homo sapiens
cagtattactggtgc

SEQ ID NO: 34367 - DNA, 15 bp, Homo sapiens
acagtattactggtg

SEQ ID NO: 34368 - DNA, 15 bp, Homo sapiens
aacagtattactggt

SEQ ID NO: 34369 - DNA, 15 bp, Homo sapiens
aaacagtattactgg

SEQ ID NO: 34370 - DNA, 15 bp, Homo sapiens
gaaacagtattactg

SEQ ID NO: 34371 - DNA, 15 bp, Homo sapiens
agaaacagtattact

SEQ ID NO: 34372 - DNA, 15 bp, Homo sapiens
aagaaacagtattac

SEQ ID NO: 34373 - DNA, 15 bp, Homo sapiens
aaagaaacagtatta

SEQ ID NO: 34374 - DNA, 15 bp, Homo sapiens
aaaagaaacagtatt

SEQ ID NO: 34375 - DNA, 15 bp, Homo sapiens
aaaaagaaacagtat

SEQ ID NO: 34376 - DNA, 15 bp, Homo sapiens
taaaaagaaacagta

SEQ ID NO: 34377 - DNA, 15 bp, Homo sapiens
ttaaaaagaaacagt

SEQ ID NO: 34378 - DNA, 15 bp, Homo sapiens
cttaaaaagaaacag

SEQ ID NO: 34379 - DNA, 15 bp, Homo sapiens
acttaaaaagaaaca

SEQ ID NO: 34380 - DNA, 15 bp, Homo sapiens
aacttaaaaagaaac

SEQ ID NO: 34381 - DNA, 15 bp, Homo sapiens
taacttaaaaagaaa

SEQ ID NO: 34382 - DNA, 15 bp, Homo sapiens
ttaacttaaaaagaa

SEQ ID NO: 34383 - DNA, 15 bp, Homo sapiens
attaacttaaaaaga

SEQ ID NO: 34384 - DNA, 15 bp, Homo sapiens
gattaacttaaaaag

SEQ ID NO: 34385 - DNA, 15 bp, Homo sapiens
tgattaacttaaaaa

SEQ ID NO: 34386 - DNA, 15 bp, Homo sapiens
atgattaacttaaaa

SEQ ID NO: 34387 - DNA, 15 bp, Homo sapiens
aatgattaacttaaa

SEQ ID NO: 34388 - DNA, 15 bp, Homo sapiens
aaatgattaacttaa

SEQ ID NO: 34389 - DNA, 15 bp, Homo sapiens
aaaatgattaactta

SEQ ID NO: 34390 - DNA, 15 bp, Homo sapiens
aaaaatgattaactt

SEQ ID NO: 34391 - DNA, 15 bp, Homo sapiens
taaaaatgattaact

SEQ ID NO: 34392 - DNA, 15 bp, Homo sapiens
ttaaaaatgattaac

SEQ ID NO: 34393 - DNA, 15 bp, Homo sapiens
attaaaaatgattaa

SEQ ID NO: 34394 - DNA, 15 bp, Homo sapiens
gattaaaaatgatta

SEQ ID NO: 34395 - DNA, 15 bp, Homo sapiens
ggattaaaaatgatt

SEQ ID NO: 34396 - DNA, 15 bp, Homo sapiens
aggattaaaaatgat

SEQ ID NO: 34397 - DNA, 15 bp, Homo sapiens
caggattaaaaatga

SEQ ID NO: 34398 - DNA, 15 bp, Homo sapiens
gcaggattaaaaatg

SEQ ID NO: 34399 - DNA, 15 bp, Homo sapiens
agcaggattaaaaat

SEQ ID NO: 34400 - DNA, 15 bp, Homo sapiens
aagcaggattaaaaa

SEQ ID NO: 34401 - DNA, 15 bp, Homo sapiens
taagcaggattaaaa

SEQ ID NO: 34402 - DNA, 15 bp, Homo sapiens
ataagcaggattaaa

SEQ ID NO: 34403 - DNA, 15 bp, Homo sapiens
aataagcaggattaa

SEQ ID NO: 34404 - DNA, 15 bp, Homo sapiens
aaataagcaggatta

SEQ ID NO: 34405 - DNA, 15 bp, Homo sapiens
aaaataagcaggatt

SEQ ID NO: 34406 - DNA, 15 bp, Homo sapiens
taaaataagcaggat

SEQ ID NO: 34407 - DNA, 15 bp, Homo sapiens
ataaaataagcagga

SEQ ID NO: 34408 - DNA, 15 bp, Homo sapiens
aataaaataagcagg

SEQ ID NO: 34409 - DNA, 15 bp, Homo sapiens
aaataaaataagcag

SEQ ID NO: 34410 - DNA, 15 bp, Homo sapiens
taaataaaataagca

SEQ ID NO: 34411 - DNA, 15 bp, Homo sapiens
ctaaataaaataagc

SEQ ID NO: 34412 - DNA, 15 bp, Homo sapiens
actaaataaaataag

SEQ ID NO: 34413 - DNA, 15 bp, Homo sapiens
cactaaataaaataa

SEQ ID NO: 34414 - DNA, 15 bp, Homo sapiens
gcactaaataaaata

SEQ ID NO: 34415 - DNA, 15 bp, Homo sapiens
ggcactaaataaaat

SEQ ID NO: 34416 - DNA, 15 bp, Homo sapiens
aggcactaaataaaa

SEQ ID NO: 34417 - DNA, 15 bp, Homo sapiens
taggcactaaataaa

SEQ ID NO: 34418 - DNA, 15 bp, Homo sapiens
ataggcactaaataa

SEQ ID NO: 34419 - DNA, 15 bp, Homo sapiens
aataggcactaaata

SEQ ID NO: 34420 - DNA, 15 bp, Homo sapiens
caataggcactaaat

SEQ ID NO: 34421 - DNA, 15 bp, Homo sapiens
gcaataggcactaaa

SEQ ID NO: 34422 - DNA, 15 bp, Homo sapiens
agcaataggcactaa

SEQ ID NO: 34423 - DNA, 15 bp, Homo sapiens
tagcaataggcacta

SEQ ID NO: 34424 - DNA, 15 bp, Homo sapiens
atagcaataggcact

SEQ ID NO: 34425 - DNA, 15 bp, Homo sapiens
tatagcaataggcac

SEQ ID NO: 34426 - DNA, 15 bp, Homo sapiens
ctatagcaataggca

SEQ ID NO: 34427 - DNA, 15 bp, Homo sapiens
gctatagcaataggc

SEQ ID NO: 34428 - DNA, 15 bp, Homo sapiens
tgctatagcaatagg

SEQ ID NO: 34429 - DNA, 15 bp, Homo sapiens
atgctatagcaatag

SEQ ID NO: 34430 - DNA, 15 bp, Homo sapiens
gatgctatagcaata

SEQ ID NO: 34431 - DNA, 15 bp, Homo sapiens
agatgctatagcaat

SEQ ID NO: 34432 - DNA, 15 bp, Homo sapiens
tagatgctatagcaa

SEQ ID NO: 34433 - DNA, 15 bp, Homo sapiens
ttagatgctatagca

SEQ ID NO: 34434 - DNA, 15 bp, Homo sapiens
attagatgctatagc

SEQ ID NO: 34435 - DNA, 15 bp, Homo sapiens
cattagatgctatag

SEQ ID NO: 34436 - DNA, 15 bp, Homo sapiens
tcattagatgctata

SEQ ID NO: 34437 - DNA, 15 bp, Homo sapiens
ctcattagatgctat

SEQ ID NO: 34438 - DNA, 15 bp, Homo sapiens
gctcattagatgcta

SEQ ID NO: 34439 - DNA, 15 bp, Homo sapiens
agctcattagatgct

SEQ ID NO: 34440 - DNA, 15 bp, Homo sapiens
gagctcattagatgc

SEQ ID NO: 34441 - DNA, 15 bp, Homo sapiens
tgagctcattagatg

SEQ ID NO: 34442 - DNA, 15 bp, Homo sapiens
ctgagctcattagat

SEQ ID NO: 34443 - DNA, 15 bp, Homo sapiens
gctgagctcattaga

SEQ ID NO: 34444 - DNA, 15 bp, Homo sapiens
cgctgagctcattag

SEQ ID NO: 34445 - DNA, 15 bp, Homo sapiens
gcgctgagctcatta

SEQ ID NO: 34446 - DNA, 15 bp, Homo sapiens
agcgctgagctcatt

SEQ ID NO: 34447 - DNA, 15 bp, Homo sapiens
aagcgctgagctcat

SEQ ID NO: 34448 - DNA, 15 bp, Homo sapiens
gaagcgctgagctca

SEQ ID NO: 34449 - DNA, 15 bp, Homo sapiens
agaagcgctgagctc

SEQ ID NO: 34450 - DNA, 15 bp, Homo sapiens
cagaagcgctgagct

SEQ ID NO: 34451 - DNA, 15 bp, Homo sapiens
tcagaagcgctgagc

SEQ ID NO: 34452 - DNA, 15 bp, Homo sapiens
gtcagaagcgctgag

SEQ ID NO: 34453 - DNA, 15 bp, Homo sapiens
tgtcagaagcgctga

SEQ ID NO: 34454 - DNA, 15 bp, Homo sapiens
ctgtcagaagcgctg

SEQ ID NO: 34455 - DNA, 15 bp, Homo sapiens
actgtcagaagcgct

SEQ ID NO: 34456 - DNA, 15 bp, Homo sapiens
tactgtcagaagcgc

SEQ ID NO: 34457 - DNA, 15 bp, Homo sapiens
atactgtcagaagcg

SEQ ID NO: 34458 - DNA, 15 bp, Homo sapiens
catactgtcagaagc

SEQ ID NO: 34459 - DNA, 15 bp, Homo sapiens
acatactgtcagaag

SEQ ID NO: 34460 - DNA, 15 bp, Homo sapiens
gacatactgtcagaa

SEQ ID NO: 34461 - DNA, 15 bp, Homo sapiens
ggacatactgtcaga

SEQ ID NO: 34462 - DNA, 15 bp, Homo sapiens
aggacatactgtcag

SEQ ID NO: 34463 - DNA, 15 bp, Homo sapiens
taggacatactgtca

SEQ ID NO: 34464 - DNA, 15 bp, Homo sapiens
ataggacatactgtc

SEQ ID NO: 34465 - DNA, 15 bp, Homo sapiens
cataggacatactgt

SEQ ID NO: 34466 - DNA, 15 bp, Homo sapiens
ccataggacatactg

SEQ ID NO: 34467 - DNA, 15 bp, Homo sapiens
tccataggacatact

SEQ ID NO: 34468 - DNA, 15 bp, Homo sapiens
atccataggacatac

SEQ ID NO: 34469 - DNA, 15 bp, Homo sapiens
catccataggacata

SEQ ID NO: 34470 - DNA, 15 bp, Homo sapiens
gcatccataggacat

SEQ ID NO: 34471 - DNA, 15 bp, Homo sapiens
ggcatccataggaca

SEQ ID NO: 34472 - DNA, 15 bp, Homo sapiens
aggcatccataggac

SEQ ID NO: 34473 - DNA, 15 bp, Homo sapiens
caggcatccatagga

SEQ ID NO: 34474 - DNA, 15 bp, Homo sapiens
ccaggcatccatagg

SEQ ID NO: 34475 - DNA, 15 bp, Homo sapiens
cccaggcatccatag

SEQ ID NO: 34476 - DNA, 15 bp, Homo sapiens
ccccaggcatccata

SEQ ID NO: 34477 - DNA, 15 bp, Homo sapiens
cccccaggcatccat

SEQ ID NO: 34478 - DNA, 15 bp, Homo sapiens
gcccccaggcatcca

SEQ ID NO: 34479 - DNA, 15 bp, Homo sapiens
tgcccccaggcatcc

SEQ ID NO: 34480 - DNA, 15 bp, Homo sapiens
ctgcccccaggcatc

SEQ ID NO: 34481 - DNA, 15 bp, Homo sapiens
tctgcccccaggcat

SEQ ID NO: 34482 - DNA, 15 bp, Homo sapiens
atctgcccccaggca

SEQ ID NO: 34483 - DNA, 15 bp, Homo sapiens
aatctgcccccaggc

SEQ ID NO: 34484 - DNA, 15 bp, Homo sapiens
caatctgcccccagg

SEQ ID NO: 34485 - DNA, 15 bp, Homo sapiens
gcaatctgcccccag

SEQ ID NO: 34486 - DNA, 15 bp, Homo sapiens
ggcaatctgccccca

SEQ ID NO: 34487 - DNA, 15 bp, Homo sapiens
aggcaatctgccccc

SEQ ID NO: 34488 - DNA, 15 bp, Homo sapiens
caggcaatctgcccc

SEQ ID NO: 34489 - DNA, 15 bp, Homo sapiens
ccaggcaatctgccc

SEQ ID NO: 34490 - DNA, 15 bp, Homo sapiens
cccaggcaatctgcc

SEQ ID NO: 34491 - DNA, 15 bp, Homo sapiens
acccaggcaatctgc

SEQ ID NO: 34492 - DNA, 15 bp, Homo sapiens
aacccaggcaatctg

SEQ ID NO: 34493 - DNA, 15 bp, Homo sapiens
caacccaggcaatct

SEQ ID NO: 34494 - DNA, 15 bp, Homo sapiens
ccaacccaggcaatc

SEQ ID NO: 34495 - DNA, 15 bp, Homo sapiens
tccaacccaggcaat

SEQ ID NO: 34496 - DNA, 15 bp, Homo sapiens
gtccaacccaggcaa

SEQ ID NO: 34497 - DNA, 15 bp, Homo sapiens
agtccaacccaggca

SEQ ID NO: 34498 - DNA, 15 bp, Homo sapiens
gagtccaacccaggc

SEQ ID NO: 34499 - DNA, 15 bp, Homo sapiens
agagtccaacccagg

SEQ ID NO: 34500 - DNA, 15 bp, Homo sapiens
cagagtccaacccag

SEQ ID NO: 34501 - DNA, 15 bp, Homo sapiens
gcagagtccaaccca

SEQ ID NO: 34502 - DNA, 15 bp, Homo sapiens
agcagagtccaaccc

SEQ ID NO: 34503 - DNA, 15 bp, Homo sapiens
gagcagagtccaacc

SEQ ID NO: 34504 - DNA, 15 bp, Homo sapiens
ggagcagagtccaac

SEQ ID NO: 34505 - DNA, 15 bp, Homo sapiens
tggagcagagtccaa

SEQ ID NO: 34506 - DNA, 15 bp, Homo sapiens
ctggagcagagtcca

SEQ ID NO: 34507 - DNA, 15 bp, Homo sapiens
actggagcagagtcc

SEQ ID NO: 34508 - DNA, 15 bp, Homo sapiens
aactggagcagagtc

SEQ ID NO: 34509 - DNA, 15 bp, Homo sapiens
gaactggagcagagt

SEQ ID NO: 34510 - DNA, 15 bp, Homo sapiens
agaactggagcagag

SEQ ID NO: 34511 - DNA, 15 bp, Homo sapiens
aagaactggagcaga

SEQ ID NO: 34512 - DNA, 15 bp, Homo sapiens
taagaactggagcag

SEQ ID NO: 34513 - DNA, 15 bp, Homo sapiens
ataagaactggagca

SEQ ID NO: 34514 - DNA, 15 bp, Homo sapiens
aataagaactggagc

SEQ ID NO: 34515 - DNA, 15 bp, Homo sapiens
taataagaactggag

SEQ ID NO: 34516 - DNA, 15 bp, Homo sapiens
ctaataagaactgga

SEQ ID NO: 34517 - DNA, 15 bp, Homo sapiens
actaataagaactgg

SEQ ID NO: 34518 - DNA, 15 bp, Homo sapiens
aactaataagaactg

SEQ ID NO: 34519 - DNA, 15 bp, Homo sapiens
caactaataagaact

SEQ ID NO: 34520 - DNA, 15 bp, Homo sapiens
acaactaataagaac

SEQ ID NO: 34521 - DNA, 15 bp, Homo sapiens
cacaactaataagaa

SEQ ID NO: 34522 - DNA, 15 bp, Homo sapiens
acacaactaataaga

SEQ ID NO: 34523 - DNA, 15 bp, Homo sapiens
tacacaactaataag

SEQ ID NO: 34524 - DNA, 15 bp, Homo sapiens
atacacaactaataa

SEQ ID NO: 34525 - DNA, 15 bp, Homo sapiens
catacacaactaata

SEQ ID NO: 34526 - DNA, 15 bp, Homo sapiens
acatacacaactaat

SEQ ID NO: 34527 - DNA, 15 bp, Homo sapiens
gacatacacaactaa

SEQ ID NO: 34528 - DNA, 15 bp, Homo sapiens
tgacatacacaacta

SEQ ID NO: 34529 - DNA, 15 bp, Homo sapiens
ctgacatacacaact

SEQ ID NO: 34530 - DNA, 15 bp, Homo sapiens
gctgacatacacaac

SEQ ID NO: 34531 - DNA, 15 bp, Homo sapiens
agctgacatacacaa

SEQ ID NO: 34532 - DNA, 15 bp, Homo sapiens
gagctgacatacaca

SEQ ID NO: 34533 - DNA, 15 bp, Homo sapiens
agagctgacatacac

SEQ ID NO: 34534 - DNA, 15 bp, Homo sapiens
cagagctgacataca

SEQ ID NO: 34535 - DNA, 15 bp, Homo sapiens
acagagctgacatac

SEQ ID NO: 34536 - DNA, 15 bp, Homo sapiens
aacagagctgacata

SEQ ID NO: 34537 - DNA, 15 bp, Homo sapiens
aaacagagctgacat

SEQ ID NO: 34538 - DNA, 15 bp, Homo sapiens
aaaacagagctgaca

SEQ ID NO: 34539 - DNA, 15 bp, Homo sapiens
gaaaacagagctgac

SEQ ID NO: 34540 - DNA, 15 bp, Homo sapiens
ggaaaacagagctga

SEQ ID NO: 34541 - DNA, 15 bp, Homo sapiens
gggaaaacagagctg

SEQ ID NO: 34542 - DNA, 15 bp, Homo sapiens
tgggaaaacagagct

SEQ ID NO: 34543 - DNA, 15 bp, Homo sapiens
atgggaaaacagagc

SEQ ID NO: 34544 - DNA, 15 bp, Homo sapiens
gatgggaaaacagag

SEQ ID NO: 34545 - DNA, 15 bp, Homo sapiens
agatgggaaaacaga

SEQ ID NO: 34546 - DNA, 15 bp, Homo sapiens
cagatgggaaaacag

SEQ ID NO: 34547 - DNA, 15 bp, Homo sapiens
acagatgggaaaaca

SEQ ID NO: 34548 - DNA, 15 bp, Homo sapiens
aacagatgggaaaac

SEQ ID NO: 34549 - DNA, 15 bp, Homo sapiens
taacagatgggaaaa

SEQ ID NO: 34550 - DNA, 15 bp, Homo sapiens
ttaacagatgggaaa

SEQ ID NO: 34551 - DNA, 15 bp, Homo sapiens
tttaacagatgggaa

SEQ ID NO: 34552 - DNA, 15 bp, Homo sapiens
atttaacagatggga

SEQ ID NO: 34553 - DNA, 15 bp, Homo sapiens
catttaacagatggg

SEQ ID NO: 34554 - DNA, 15 bp, Homo sapiens
ccatttaacagatgg

SEQ ID NO: 34555 - DNA, 15 bp, Homo sapiens
cccatttaacagatg

SEQ ID NO: 34556 - DNA, 15 bp, Homo sapiens
tcccatttaacagat

SEQ ID NO: 34557 - DNA, 15 bp, Homo sapiens
atcccatttaacaga

SEQ ID NO: 34558 - DNA, 15 bp, Homo sapiens
tatcccatttaacag

SEQ ID NO: 34559 - DNA, 15 bp, Homo sapiens
ctatcccatttaaca

SEQ ID NO: 34560 - DNA, 15 bp, Homo sapiens
actatcccatttaac

SEQ ID NO: 34561 - DNA, 15 bp, Homo sapiens
tactatcccatttaa

SEQ ID NO: 34562 - DNA, 15 bp, Homo sapiens
ttactatcccattta

SEQ ID NO: 34563 - DNA, 15 bp, Homo sapiens
attactatcccattt

SEQ ID NO: 34564 - DNA, 15 bp, Homo sapiens
tattactatcccatt

SEQ ID NO: 34565 - DNA, 15 bp, Homo sapiens
ctattactatcccat

SEQ ID NO: 34566 - DNA, 15 bp, Homo sapiens
gctattactatccca

SEQ ID NO: 34567 - DNA, 15 bp, Homo sapiens
ggctattactatccc

SEQ ID NO: 34568 - DNA, 15 bp, Homo sapiens
tggctattactatcc

SEQ ID NO: 34569 - DNA, 15 bp, Homo sapiens
gtggctattactatc

SEQ ID NO: 34570 - DNA, 15 bp, Homo sapiens
tgtggctattactat

SEQ ID NO: 34571 - DNA, 15 bp, Homo sapiens
ttgtggctattacta

SEQ ID NO: 34572 - DNA, 15 bp, Homo sapiens
attgtggctattact

SEQ ID NO: 34573 - DNA, 15 bp, Homo sapiens
tattgtggctattac

SEQ ID NO: 34574 - DNA, 15 bp, Homo sapiens
ttattgtggctatta

SEQ ID NO: 34575 - DNA, 15 bp, Homo sapiens
attattgtggctatt

SEQ ID NO: 34576 - DNA, 15 bp, Homo sapiens
tattattgtggctat

SEQ ID NO: 34577 - DNA, 15 bp, Homo sapiens
gtattattgtggcta

SEQ ID NO: 34578 - DNA, 15 bp, Homo sapiens
ggtattattgtggct

SEQ ID NO: 34579 - DNA, 15 bp, Homo sapiens
aggtattattgtggc

SEQ ID NO: 34580 - DNA, 15 bp, Homo sapiens
gaggtattattgtgg

SEQ ID NO: 34581 - DNA, 15 bp, Homo sapiens
tgaggtattattgtg

SEQ ID NO: 34582 - DNA, 15 bp, Homo sapiens
atgaggtattattgt

SEQ ID NO: 34583 - DNA, 15 bp, Homo sapiens
catgaggtattattg

SEQ ID NO: 34584 - DNA, 15 bp, Homo sapiens
ccatgaggtattatt

SEQ ID NO: 34585 - DNA, 15 bp, Homo sapiens
gccatgaggtattat

SEQ ID NO: 34586 - DNA, 15 bp, Homo sapiens
agccatgaggtatta

SEQ ID NO: 34587 - DNA, 15 bp, Homo sapiens
cagccatgaggtatt

SEQ ID NO: 34588 - DNA, 15 bp, Homo sapiens
acagccatgaggtat

SEQ ID NO: 34589 - DNA, 15 bp, Homo sapiens
aacagccatgaggta

SEQ ID NO: 34590 - DNA, 15 bp, Homo sapiens
caacagccatgaggt

SEQ ID NO: 34591 - DNA, 15 bp, Homo sapiens
acaacagccatgagg

SEQ ID NO: 34592 - DNA, 15 bp, Homo sapiens
cacaacagccatgag

SEQ ID NO: 34593 - DNA, 15 bp, Homo sapiens
tcacaacagccatga

SEQ ID NO: 34594 - DNA, 15 bp, Homo sapiens
ctcacaacagccatg

SEQ ID NO: 34595 - DNA, 15 bp, Homo sapiens
cctcacaacagccat

SEQ ID NO: 34596 - DNA, 15 bp, Homo sapiens
tcctcacaacagcca

SEQ ID NO: 34597 - DNA, 15 bp, Homo sapiens
atcctcacaacagcc

SEQ ID NO: 34598 - DNA, 15 bp, Homo sapiens
aatcctcacaacagc

SEQ ID NO: 34599 - DNA, 15 bp, Homo sapiens
taatcctcacaacag

SEQ ID NO: 34600 - DNA, 15 bp, Homo sapiens
ttaatcctcacaaca

SEQ ID NO: 34601 - DNA, 15 bp, Homo sapiens
tttaatcctcacaac

SEQ ID NO: 34602 - DNA, 15 bp, Homo sapiens
ttttaatcctcacaa

SEQ ID NO: 34603 - DNA, 15 bp, Homo sapiens
attttaatcctcaca

SEQ ID NO: 34604 - DNA, 15 bp, Homo sapiens
tattttaatcctcac

SEQ ID NO: 34605 - DNA, 15 bp, Homo sapiens
ttattttaatcctca

SEQ ID NO: 34606 - DNA, 15 bp, Homo sapiens
cttattttaatcctc

SEQ ID NO: 34607 - DNA, 15 bp, Homo sapiens
tcttattttaatcct

SEQ ID NO: 34608 - DNA, 15 bp, Homo sapiens
ttcttattttaatcc

SEQ ID NO: 34609 - DNA, 15 bp, Homo sapiens
tttcttattttaatc

SEQ ID NO: 34610 - DNA, 15 bp, Homo sapiens
ttttcttattttaat

SEQ ID NO: 34611 - DNA, 15 bp, Homo sapiens
attttcttattttaa

SEQ ID NO: 34612 - DNA, 15 bp, Homo sapiens
cattttcttatttta

SEQ ID NO: 34613 - DNA, 15 bp, Homo sapiens
gcattttcttatttt

SEQ ID NO: 34614 - DNA, 15 bp, Homo sapiens
tgcattttcttattt

SEQ ID NO: 34615 - DNA, 15 bp, Homo sapiens
ttgcattttcttatt

SEQ ID NO: 34616 - DNA, 15 bp, Homo sapiens
cttgcattttcttat

SEQ ID NO: 34617 - DNA, 15 bp, Homo sapiens
acttgcattttctta

SEQ ID NO: 34618 - DNA, 15 bp, Homo sapiens
ttcacttgcattttc

SEQ ID NO: 34619 - DNA, 15 bp, Homo sapiens
tttcacttgcatttt

SEQ ID NO: 34620 - DNA, 15 bp, Homo sapiens
ctttcacttgcattt

SEQ ID NO: 34621 - DNA, 15 bp, Homo sapiens
tctttcacttgcatt

SEQ ID NO: 34622 - DNA, 15 bp, Homo sapiens
gtctttcacttgcat

SEQ ID NO: 34623 - DNA, 15 bp, Homo sapiens
tgtctttcacttgca

SEQ ID NO: 34624 - DNA, 15 bp, Homo sapiens
ctgtctttcacttgc

SEQ ID NO: 34625 - DNA, 15 bp, Homo sapiens
actgtctttcacttg

SEQ ID NO: 34626 - DNA, 15 bp, Homo sapiens
gactgtctttcactt

SEQ ID NO: 34627 - DNA, 15 bp, Homo sapiens
ggactgtctttcact

SEQ ID NO: 34628 - DNA, 15 bp, Homo sapiens
tggactgtctttcac

SEQ ID NO: 34629 - DNA, 15 bp, Homo sapiens
ctggactgtctttca

SEQ ID NO: 34630 - DNA, 15 bp, Homo sapiens
tctggactgtctttc

SEQ ID NO: 34631 - DNA, 15 bp, Homo sapiens
ctctggactgtcttt

SEQ ID NO: 34632 - DNA, 15 bp, Homo sapiens
cctctggactgtctt

SEQ ID NO: 34633 - DNA, 15 bp, Homo sapiens
tcctctggactgtct

SEQ ID NO: 34634 - DNA, 15 bp, Homo sapiens
atcctctggactgtc

SEQ ID NO: 34635 - DNA, 15 bp, Homo sapiens
catcctctggactgt

SEQ ID NO: 34636 - DNA, 15 bp, Homo sapiens
ccatcctctggactg

SEQ ID NO: 34637 - DNA, 15 bp, Homo sapiens
cccatcctctggact

SEQ ID NO: 34638 - DNA, 15 bp, Homo sapiens
tcccatcctctggac

SEQ ID NO: 34639 - DNA, 15 bp, Homo sapiens
ctcccatcctctgga

SEQ ID NO: 34640 - DNA, 15 bp, Homo sapiens
tctcccatcctctgg

SEQ ID NO: 34641 - DNA, 15 bp, Homo sapiens
ttctcccatcctctg

SEQ ID NO: 34642 - DNA, 15 bp, Homo sapiens
tttctcccatcctct

SEQ ID NO: 34643 - DNA, 15 bp, Homo sapiens
ttttctcccatcctc

SEQ ID NO: 34644 - DNA, 15 bp, Homo sapiens
attttctcccatcct

SEQ ID NO: 34645 - DNA, 15 bp, Homo sapiens
tattttctcccatcc

SEQ ID NO: 34646 - DNA, 15 bp, Homo sapiens
atattttctcccatc

SEQ ID NO: 34647 - DNA, 15 bp, Homo sapiens
aatattttctcccat

SEQ ID NO: 34648 - DNA, 15 bp, Homo sapiens
aaatattttctccca

SEQ ID NO: 34649 - DNA, 15 bp, Homo sapiens
caaatattttctccc

SEQ ID NO: 34650 - DNA, 15 bp, Homo sapiens
gcaaatattttctcc

SEQ ID NO: 34651 - DNA, 15 bp, Homo sapiens
tgcaaatattttctc

SEQ ID NO: 34652 - DNA, 15 bp, Homo sapiens
ttgcaaatattttct

SEQ ID NO: 34653 - DNA, 15 bp, Homo sapiens
tttgcaaatattttc

SEQ ID NO: 34654 - DNA, 15 bp, Homo sapiens
atttgcaaatatttt

SEQ ID NO: 34655 - DNA, 15 bp, Homo sapiens
aatttgcaaatattt

SEQ ID NO: 34656 - DNA, 15 bp, Homo sapiens
taatttgcaaatatt

SEQ ID NO: 34657 - DNA, 15 bp, Homo sapiens
ctaatttgcaaatat

SEQ ID NO: 34658 - DNA, 15 bp, Homo sapiens
cctaatttgcaaata

SEQ ID NO: 34659 - DNA, 15 bp, Homo sapiens
acctaatttgcaaat

SEQ ID NO: 34660 - DNA, 15 bp, Homo sapiens
tacctaatttgcaaa

SEQ ID NO: 34661 - DNA, 15 bp, Homo sapiens
atacctaatttgcaa

SEQ ID NO: 34662 - DNA, 15 bp, Homo sapiens
gatacctaatttgca

SEQ ID NO: 34663 - DNA, 15 bp, Homo sapiens
agatacctaatttgc

SEQ ID NO: 34664 - DNA, 15 bp, Homo sapiens
cagatacctaatttg

SEQ ID NO: 34665 - DNA, 15 bp, Homo sapiens
gcagatacctaattt

SEQ ID NO: 34666 - DNA, 15 bp, Homo sapiens
agcagatacctaatt

SEQ ID NO: 34667 - DNA, 15 bp, Homo sapiens
tagcagatacctaat

SEQ ID NO: 34668 - DNA, 15 bp, Homo sapiens
ttagcagatacctaa

SEQ ID NO: 34669 - DNA, 15 bp, Homo sapiens
tttagcagataccta

SEQ ID NO: 34670 - DNA, 15 bp, Homo sapiens
ctttagcagatacct

SEQ ID NO: 34671 - DNA, 15 bp, Homo sapiens
cctttagcagatacc

SEQ ID NO: 34672 - DNA, 15 bp, Homo sapiens
acctttagcagatac

SEQ ID NO: 34673 - DNA, 15 bp, Homo sapiens
gacctttagcagata

SEQ ID NO: 34674 - DNA, 15 bp, Homo sapiens
agacctttagcagat

SEQ ID NO: 34675 - DNA, 15 bp, Homo sapiens
tagacctttagcaga

SEQ ID NO: 34676 - DNA, 15 bp, Homo sapiens
ctagacctttagcag

SEQ ID NO: 34677 - DNA, 15 bp, Homo sapiens
actagacctttagca

SEQ ID NO: 34678 - DNA, 15 bp, Homo sapiens
tactagacctttagc

SEQ ID NO: 34679 - DNA, 15 bp, Homo sapiens
atactagacctttag

SEQ ID NO: 34680 - DNA, 15 bp, Homo sapiens
gatactagaccttta

SEQ ID NO: 34681 - DNA, 15 bp, Homo sapiens
ggatactagaccttt

SEQ ID NO: 34682 - DNA, 15 bp, Homo sapiens
cggatactagacctt

SEQ ID NO: 34683 - DNA, 15 bp, Homo sapiens
gcggatactagacct

SEQ ID NO: 34684 - DNA, 15 bp, Homo sapiens
tgcggatactagacc

SEQ ID NO: 34685 - DNA, 15 bp, Homo sapiens
ttgcggatactagac

SEQ ID NO: 34686 - DNA, 15 bp, Homo sapiens
attgcggatactaga

SEQ ID NO: 34687 - DNA, 15 bp, Homo sapiens
tattgcggatactag

SEQ ID NO: 34688 - DNA, 15 bp, Homo sapiens
ctattgcggatacta

SEQ ID NO: 34689 - DNA, 15 bp, Homo sapiens
tctattgcggatact

SEQ ID NO: 34690 - DNA, 15 bp, Homo sapiens
atctattgcggatac

SEQ ID NO: 34691 - DNA, 15 bp, Homo sapiens
tatctattgcggata

SEQ ID NO: 34692 - DNA, 15 bp, Homo sapiens
ttatctattgcggat

SEQ ID NO: 34693 - DNA, 15 bp, Homo sapiens
tttatctattgcgga

SEQ ID NO: 34694 - DNA, 15 bp, Homo sapiens
ctttatctattgcgg

SEQ ID NO: 34695 - DNA, 15 bp, Homo sapiens
tctttatctattgcg

SEQ ID NO: 34696 - DNA, 15 bp, Homo sapiens
ttctttatctattgc

SEQ ID NO: 34697 - DNA, 15 bp, Homo sapiens
cttctttatctattg

SEQ ID NO: 34698 - DNA, 15 bp, Homo sapiens
acttctttatctatt

SEQ ID NO: 34699 - DNA, 15 bp, Homo sapiens
gacttctttatctat

SEQ ID NO: 34700 - DNA, 15 bp, Homo sapiens
agacttctttatcta

SEQ ID NO: 34701 - DNA, 15 bp, Homo sapiens
aagacttctttatct

SEQ ID NO: 34702 - DNA, 15 bp, Homo sapiens
aaagacttctttatc

SEQ ID NO: 34703 - DNA, 15 bp, Homo sapiens
aaaagacttctttat

SEQ ID NO: 34704 - DNA, 15 bp, Homo sapiens
aaaaagacttcttta

SEQ ID NO: 34705 - DNA, 15 bp, Homo sapiens
taaaaagacttcttt

SEQ ID NO: 34706 - DNA, 15 bp, Homo sapiens
ataaaaagacttctt

SEQ ID NO: 34707 - DNA, 15 bp, Homo sapiens
aataaaaagacttct

SEQ ID NO: 34708 - DNA, 15 bp, Homo sapiens
aaataaaaagacttc

SEQ ID NO: 34709 - DNA, 15 bp, Homo sapiens
aaaataaaaagactt

SEQ ID NO: 34710 - DNA, 15 bp, Homo sapiens
aaaaataaaaagact

SEQ ID NO: 34711 - DNA, 15 bp, Homo sapiens
aaaaaataaaaagac

SEQ ID NO: 34712 - DNA, 15 bp, Homo sapiens
taaaaaataaaaaga

SEQ ID NO: 34713 - DNA, 15 bp, Homo sapiens
ataaaaaataaaaag

SEQ ID NO: 34714 - DNA, 15 bp, Homo sapiens
aataaaaaataaaaa

SEQ ID NO: 34715 - DNA, 15 bp, Homo sapiens
aaataaaaaataaaa

SEQ ID NO: 34716 - DNA, 15 bp, Homo sapiens
aaaataaaaaataaa

SEQ ID NO: 34717 - DNA, 15 bp, Homo sapiens
taaaataaaaaataa

SEQ ID NO: 34718 - DNA, 15 bp, Homo sapiens
ataaaataaaaaata

SEQ ID NO: 34719 - DNA, 15 bp, Homo sapiens
aataaaataaaaaat

SEQ ID NO: 34720 - DNA, 15 bp, Homo sapiens
aaataaaataaaaaa

SEQ ID NO: 34721 - DNA, 15 bp, Homo sapiens
aaaaaataaaataaa

SEQ ID NO: 34722 - DNA, 15 bp, Homo sapiens
aaaaaaataaaataa

SEQ ID NO: 34723 - DNA, 15 bp, Homo sapiens
aaaaaaaataaaata

SEQ ID NO: 34724 - DNA, 15 bp, Homo sapiens
aaaaaaaaataaaat

SEQ ID NO: 34725 - DNA, 15 bp, Homo sapiens
caaaaaaaaataaaa

SEQ ID NO: 34726 - DNA, 15 bp, Homo sapiens
tcaaaaaaaaataaa

SEQ ID NO: 34727 - DNA, 15 bp, Homo sapiens
ctcaaaaaaaaataa

SEQ ID NO: 34728 - DNA, 15 bp, Homo sapiens
tctcaaaaaaaaata

SEQ ID NO: 34729 - DNA, 15 bp, Homo sapiens
atctcaaaaaaaaat

SEQ ID NO: 34730 - DNA, 15 bp, Homo sapiens
aagcaagactccatc

SEQ ID NO: 34731 - DNA, 15 bp, Homo sapiens
aaagcaagactccat

SEQ ID NO: 34732 - DNA, 15 bp, Homo sapiens
caaagcaagactcca

SEQ ID NO: 34733 - DNA, 15 bp, Homo sapiens
acaaagcaagactcc

SEQ ID NO: 34734 - DNA, 15 bp, Homo sapiens
gacaaagcaagactc

SEQ ID NO: 34735 - DNA, 15 bp, Homo sapiens
tgacaaagcaagact

SEQ ID NO: 34736 - DNA, 15 bp, Homo sapiens
gtgacaaagcaagac

SEQ ID NO: 34737 - DNA, 15 bp, Homo sapiens
ggtgacaaagcaaga

SEQ ID NO: 34738 - DNA, 15 bp, Homo sapiens
gggtgacaaagcaag

SEQ ID NO: 34739 - DNA, 15 bp, Homo sapiens
tgggtgacaaagcaa

SEQ ID NO: 34740 - DNA, 15 bp, Homo sapiens
ctgggtgacaaagca

SEQ ID NO: 34741 - DNA, 15 bp, Homo sapiens
tctgggtgacaaagc

SEQ ID NO: 34742 - DNA, 15 bp, Homo sapiens
gtctgggtgacaaag

SEQ ID NO: 34743 - DNA, 15 bp, Homo sapiens
agtctgggtgacaaa

SEQ ID NO: 34744 - DNA, 15 bp, Homo sapiens
cagtctgggtgacaa

SEQ ID NO: 34745 - DNA, 15 bp, Homo sapiens
acaccactgcactcc

SEQ ID NO: 34746 - DNA, 15 bp, Homo sapiens
cgagatcacaccact

SEQ ID NO: 34747 - DNA, 15 bp, Homo sapiens
ccgagatcacaccac

SEQ ID NO: 34748 - DNA, 15 bp, Homo sapiens
gaggagaatcgcttg

SEQ ID NO: 34749 - DNA, 15 bp, Homo sapiens
ggaggagaatcgctt

SEQ ID NO: 34750 - DNA, 15 bp, Homo sapiens
gggaggagaatcgct

SEQ ID NO: 34751 - DNA, 15 bp, Homo sapiens
agggaggagaatcgc

SEQ ID NO: 34752 - DNA, 15 bp, Homo sapiens
gagggaggagaatcg

SEQ ID NO: 34753 - DNA, 15 bp, Homo sapiens
tgagggaggagaatc

SEQ ID NO: 34754 - DNA, 15 bp, Homo sapiens
ttgagggaggagaat

SEQ ID NO: 34755 - DNA, 15 bp, Homo sapiens
gttgagggaggagaa

SEQ ID NO: 34756 - DNA, 15 bp, Homo sapiens
ggttgagggaggaga

SEQ ID NO: 34757 - DNA, 15 bp, Homo sapiens
aggttgagggaggag

SEQ ID NO: 34758 - DNA, 15 bp, Homo sapiens
gaggttgagggagga

SEQ ID NO: 34759 - DNA, 15 bp, Homo sapiens
ggaggttgagggagg

SEQ ID NO: 34760 - DNA, 15 bp, Homo sapiens
gggaggttgagggag

SEQ ID NO: 34761 - DNA, 15 bp, Homo sapiens
tgggaggttgaggga

SEQ ID NO: 34762 - DNA, 15 bp, Homo sapiens
ttgggaggttgaggg

SEQ ID NO: 34763 - DNA, 15 bp, Homo sapiens
accagctacttggga

SEQ ID NO: 34764 - DNA, 15 bp, Homo sapiens
taccagctacttggg

SEQ ID NO: 34765 - DNA, 15 bp, Homo sapiens
ataccagctacttgg

SEQ ID NO: 34766 - DNA, 15 bp, Homo sapiens
aataccagctacttg

SEQ ID NO: 34767 - DNA, 15 bp, Homo sapiens
taataccagctactt

SEQ ID NO: 34768 - DNA, 15 bp, Homo sapiens
gtaataccagctact

SEQ ID NO: 34769 - DNA, 15 bp, Homo sapiens
tgtaataccagctac

SEQ ID NO: 34770 - DNA, 15 bp, Homo sapiens
ctgtaataccagcta

SEQ ID NO: 34771 - DNA, 15 bp, Homo sapiens
cctgtaataccagct

SEQ ID NO: 34772 - DNA, 15 bp, Homo sapiens
gcctgtaataccagc

SEQ ID NO: 34773 - DNA, 15 bp, Homo sapiens
tgcctgtaataccag

SEQ ID NO: 34774 - DNA, 15 bp, Homo sapiens
atgcctgtaatacca

SEQ ID NO: 34775 - DNA, 15 bp, Homo sapiens
catgcctgtaatacc

SEQ ID NO: 34776 - DNA, 15 bp, Homo sapiens
gcatgcctgtaatac

SEQ ID NO: 34777 - DNA, 15 bp, Homo sapiens
tgcatgcctgtaata

SEQ ID NO: 34778 - DNA, 15 bp, Homo sapiens
gtgcatgcctgtaat

SEQ ID NO: 34779 - DNA, 15 bp, Homo sapiens
ggtgcatgcctgtaa

SEQ ID NO: 34780 - DNA, 15 bp, Homo sapiens
tggtgcatgcctgta

SEQ ID NO: 34781 - DNA, 15 bp, Homo sapiens
gtggtgcatgcctgt

SEQ ID NO: 34782 - DNA, 15 bp, Homo sapiens
ggtggtgcatgcctg

SEQ ID NO: 34783 - DNA, 15 bp, Homo sapiens
gcatggtggtgcatg

SEQ ID NO: 34784 - DNA, 15 bp, Homo sapiens
ggcatggtggtgcat

SEQ ID NO: 34785 - DNA, 15 bp, Homo sapiens
aggcatggtggtgca

SEQ ID NO: 34786 - DNA, 15 bp, Homo sapiens
caggcatggtggtgc

SEQ ID NO: 34787 - DNA, 15 bp, Homo sapiens
caaaattagccaggc

SEQ ID NO: 34788 - DNA, 15 bp, Homo sapiens
ccaaaattagccagg

SEQ ID NO: 34789 - DNA, 15 bp, Homo sapiens
gccaaaattagccag

SEQ ID NO: 34790 - DNA, 15 bp, Homo sapiens
agccaaaattagcca

SEQ ID NO: 34791 - DNA, 15 bp, Homo sapiens
tagccaaaattagcc

SEQ ID NO: 34792 - DNA, 15 bp, Homo sapiens
ttagccaaaattagc

SEQ ID NO: 34793 - DNA, 15 bp, Homo sapiens
attagccaaaattag

SEQ ID NO: 34794 - DNA, 15 bp, Homo sapiens
aattagccaaaatta

SEQ ID NO: 34795 - DNA, 15 bp, Homo sapiens
aaattagccaaaatt

SEQ ID NO: 34796 - DNA, 15 bp, Homo sapiens
aaaattagccaaaat

SEQ ID NO: 34797 - DNA, 15 bp, Homo sapiens
aaaaattagccaaaa

SEQ ID NO: 34798 - DNA, 15 bp, Homo sapiens
gaaaaattagccaaa

SEQ ID NO: 34799 - DNA, 15 bp, Homo sapiens
agaaaaattagccaa

SEQ ID NO: 34800 - DNA, 15 bp, Homo sapiens
tagaaaaattagcca

SEQ ID NO: 34801 - DNA, 15 bp, Homo sapiens
atagaaaaattagcc

SEQ ID NO: 34802 - DNA, 15 bp, Homo sapiens
aatagaaaaattagc

SEQ ID NO: 34803 - DNA, 15 bp, Homo sapiens
aaatagaaaaattag

SEQ ID NO: 34804 - DNA, 15 bp, Homo sapiens
aaaatagaaaaatta

SEQ ID NO: 34805 - DNA, 15 bp, Homo sapiens
aaaaatagaaaaatt

SEQ ID NO: 34806 - DNA, 15 bp, Homo sapiens
caaaaatagaaaaat

SEQ ID NO: 34807 - DNA, 15 bp, Homo sapiens
acaaaaatagaaaaa

SEQ ID NO: 34808 - DNA, 15 bp, Homo sapiens
tacaaaaatagaaaa

SEQ ID NO: 34809 - DNA, 15 bp, Homo sapiens
ctacaaaaatagaaa

SEQ ID NO: 34810 - DNA, 15 bp, Homo sapiens
tctacaaaaatagaa

SEQ ID NO: 34811 - DNA, 15 bp, Homo sapiens
ctctacaaaaataga

SEQ ID NO: 34812 - DNA, 15 bp, Homo sapiens
tctctacaaaaatag

SEQ ID NO: 34813 - DNA, 15 bp, Homo sapiens
gtctctacaaaaata

SEQ ID NO: 34814 - DNA, 15 bp, Homo sapiens
cgtctctacaaaaat

SEQ ID NO: 34815 - DNA, 15 bp, Homo sapiens
acgtctctacaaaaa

SEQ ID NO: 34816 - DNA, 15 bp, Homo sapiens
cacgtctctacaaaa

SEQ ID NO: 34817 - DNA, 15 bp, Homo sapiens
acacgtctctacaaa

SEQ ID NO: 34818 - DNA, 15 bp, Homo sapiens
aacacgtctctacaa

SEQ ID NO: 34819 - DNA, 15 bp, Homo sapiens
aaacacgtctctaca

SEQ ID NO: 34820 - DNA, 15 bp, Homo sapiens
gaaacacgtctctac

SEQ ID NO: 34821 - DNA, 15 bp, Homo sapiens
tgaaacacgtctcta

SEQ ID NO: 34822 - DNA, 15 bp, Homo sapiens
ctgaaacacgtctct

SEQ ID NO: 34823 - DNA, 15 bp, Homo sapiens
gctgaaacacgtctc

SEQ ID NO: 34824 - DNA, 15 bp, Homo sapiens
tgctgaaacacgtct

SEQ ID NO: 34825 - DNA, 15 bp, Homo sapiens
atgctgaaacacgtc

SEQ ID NO: 34826 - DNA, 15 bp, Homo sapiens
catgctgaaacacgt

SEQ ID NO: 34827 - DNA, 15 bp, Homo sapiens
acatgctgaaacacg

SEQ ID NO: 34828 - DNA, 15 bp, Homo sapiens
aacatgctgaaacac

SEQ ID NO: 34829 - DNA, 15 bp, Homo sapiens
caacatgctgaaaca

SEQ ID NO: 34830 - DNA, 15 bp, Homo sapiens
ccaacatgctgaaac

SEQ ID NO: 34831 - DNA, 15 bp, Homo sapiens
gccaacatgctgaaa

SEQ ID NO: 34832 - DNA, 15 bp, Homo sapiens
ggccaacatgctgaa

SEQ ID NO: 34833 - DNA, 15 bp, Homo sapiens
gggccaacatgctga

SEQ ID NO: 34834 - DNA, 15 bp, Homo sapiens
cgggccaacatgctg

SEQ ID NO: 34835 - DNA, 15 bp, Homo sapiens
ccgggccaacatgct

SEQ ID NO: 34836 - DNA, 15 bp, Homo sapiens
gccgggccaacatgc

SEQ ID NO: 34837 - DNA, 15 bp, Homo sapiens
agccgggccaacatg

SEQ ID NO: 34838 - DNA, 15 bp, Homo sapiens
cagccgggccaacat

SEQ ID NO: 34839 - DNA, 15 bp, Homo sapiens
ccagccgggccaaca

SEQ ID NO: 34840 - DNA, 15 bp, Homo sapiens
accagccgggccaac

SEQ ID NO: 34841 - DNA, 15 bp, Homo sapiens
gaccagccgggccaa

SEQ ID NO: 34842 - DNA, 15 bp, Homo sapiens
agaccagccgggcca

SEQ ID NO: 34843 - DNA, 15 bp, Homo sapiens
aagaccagccgggcc

SEQ ID NO: 34844 - DNA, 15 bp, Homo sapiens
caagaccagccgggc

SEQ ID NO: 34845 - DNA, 15 bp, Homo sapiens
tcaagaccagccggg

SEQ ID NO: 34846 - DNA, 15 bp, Homo sapiens
ttcaagaccagccgg

SEQ ID NO: 34847 - DNA, 15 bp, Homo sapiens
gttcaagaccagccg

SEQ ID NO: 34848 - DNA, 15 bp, Homo sapiens
agagttcaagaccag

SEQ ID NO: 34849 - DNA, 15 bp, Homo sapiens
ctgaggtccagagtt

SEQ ID NO: 34850 - DNA, 15 bp, Homo sapiens
cctgaggtccagagt

SEQ ID NO: 34851 - DNA, 15 bp, Homo sapiens
acctgaggtccagag

SEQ ID NO: 34852 - DNA, 15 bp, Homo sapiens
cacctgaggtccaga

SEQ ID NO: 34853 - DNA, 15 bp, Homo sapiens
tcacctgaggtccag

SEQ ID NO: 34854 - DNA, 15 bp, Homo sapiens
atcacctgaggtcca

SEQ ID NO: 34855 - DNA, 15 bp, Homo sapiens
tatcacctgaggtcc

SEQ ID NO: 34856 - DNA, 15 bp, Homo sapiens
atatcacctgaggtc

SEQ ID NO: 34857 - DNA, 15 bp, Homo sapiens
catatcacctgaggt

SEQ ID NO: 34858 - DNA, 15 bp, Homo sapiens
gcatatcacctgagg

SEQ ID NO: 34859 - DNA, 15 bp, Homo sapiens
agcatatcacctgag

SEQ ID NO: 34860 - DNA, 15 bp, Homo sapiens
gagcatatcacctga

SEQ ID NO: 34861 - DNA, 15 bp, Homo sapiens
tgagcatatcacctg

SEQ ID NO: 34862 - DNA, 15 bp, Homo sapiens
gtgagcatatcacct

SEQ ID NO: 34863 - DNA, 15 bp, Homo sapiens
ggtgagcatatcacc

SEQ ID NO: 34864 - DNA, 15 bp, Homo sapiens
aggtgagcatatcac

SEQ ID NO: 34865 - DNA, 15 bp, Homo sapiens
aaggtgagcatatca

SEQ ID NO: 34866 - DNA, 15 bp, Homo sapiens
taaggtgagcatatc

SEQ ID NO: 34867 - DNA, 15 bp, Homo sapiens
ctaaggtgagcatat

SEQ ID NO: 34868 - DNA, 15 bp, Homo sapiens
gctaaggtgagcata

SEQ ID NO: 34869 - DNA, 15 bp, Homo sapiens
ggctaaggtgagcat

SEQ ID NO: 34870 - DNA, 15 bp, Homo sapiens
aggctaaggtgagca

SEQ ID NO: 34871 - DNA, 15 bp, Homo sapiens
gaggctaaggtgagc

SEQ ID NO: 34872 - DNA, 15 bp, Homo sapiens
agaggctaaggtgag

SEQ ID NO: 34873 - DNA, 15 bp, Homo sapiens
aagaggctaaggtga

SEQ ID NO: 34874 - DNA, 15 bp, Homo sapiens
taagaggctaaggtg

SEQ ID NO: 34875 - DNA, 15 bp, Homo sapiens
ttaagaggctaaggt

SEQ ID NO: 34876 - DNA, 15 bp, Homo sapiens
tttaagaggctaagg

SEQ ID NO: 34877 - DNA, 15 bp, Homo sapiens
ctttaagaggctaag

SEQ ID NO: 34878 - DNA, 15 bp, Homo sapiens
actttaagaggctaa

SEQ ID NO: 34879 - DNA, 15 bp, Homo sapiens
cactttaagaggcta

SEQ ID NO: 34880 - DNA, 15 bp, Homo sapiens
gcactttaagaggct

SEQ ID NO: 34881 - DNA, 15 bp, Homo sapiens
agcactttaagaggc

SEQ ID NO: 34882 - DNA, 15 bp, Homo sapiens
cagcactttaagagg

SEQ ID NO: 34883 - DNA, 15 bp, Homo sapiens
tcagcactttaagag

SEQ ID NO: 34884 - DNA, 15 bp, Homo sapiens
ctcagcactttaaga

SEQ ID NO: 34885 - DNA, 15 bp, Homo sapiens
tctcagcactttaag

SEQ ID NO: 34886 - DNA, 15 bp, Homo sapiens
atctcagcactttaa

SEQ ID NO: 34887 - DNA, 15 bp, Homo sapiens
aatctcagcacttta

SEQ ID NO: 34888 - DNA, 15 bp, Homo sapiens
ataatctcagcactt

SEQ ID NO: 34889 - DNA, 15 bp, Homo sapiens
tataatctcagcact

SEQ ID NO: 34890 - DNA, 15 bp, Homo sapiens
ctataatctcagcac

SEQ ID NO: 34891 - DNA, 15 bp, Homo sapiens
cctataatctcagca

SEQ ID NO: 34892 - DNA, 15 bp, Homo sapiens
gcctataatctcagc

SEQ ID NO: 34893 - DNA, 15 bp, Homo sapiens
cgcctataatctcag

SEQ ID NO: 34894 - DNA, 15 bp, Homo sapiens
acgcctataatctca

SEQ ID NO: 34895 - DNA, 15 bp, Homo sapiens
cacgcctataatctc

SEQ ID NO: 34896 - DNA, 15 bp, Homo sapiens
tcacgcctataatct

SEQ ID NO: 34897 - DNA, 15 bp, Homo sapiens
ctcacgcctataatc

SEQ ID NO: 34898 - DNA, 15 bp, Homo sapiens
actcacgcctataat

SEQ ID NO: 34899 - DNA, 15 bp, Homo sapiens
gactcacgcctataa

SEQ ID NO: 34900 - DNA, 15 bp, Homo sapiens
tgactcacgcctata

SEQ ID NO: 34901 - DNA, 15 bp, Homo sapiens
atgactcacgcctat

SEQ ID NO: 34902 - DNA, 15 bp, Homo sapiens
gatgactcacgccta

SEQ ID NO: 34903 - DNA, 15 bp, Homo sapiens
tgatgactcacgcct

SEQ ID NO: 34904 - DNA, 15 bp, Homo sapiens
atgatgactcacgcc

SEQ ID NO: 34905 - DNA, 15 bp, Homo sapiens
catgatgactcacgc

SEQ ID NO: 34906 - DNA, 15 bp, Homo sapiens
acatgatgactcacg

SEQ ID NO: 34907 - DNA, 15 bp, Homo sapiens
gacatgatgactcac

SEQ ID NO: 34908 - DNA, 15 bp, Homo sapiens
ggacatgatgactca

SEQ ID NO: 34909 - DNA, 15 bp, Homo sapiens
tggacatgatgactc

SEQ ID NO: 34910 - DNA, 15 bp, Homo sapiens
ctggacatgatgact

SEQ ID NO: 34911 - DNA, 15 bp, Homo sapiens
gctggacatgatgac

SEQ ID NO: 34912 - DNA, 15 bp, Homo sapiens
ggctggacatgatga

SEQ ID NO: 34913 - DNA, 15 bp, Homo sapiens
tggctggacatgatg

SEQ ID NO: 34914 - DNA, 15 bp, Homo sapiens
ttggctggacatgat

SEQ ID NO: 34915 - DNA, 15 bp, Homo sapiens
cttggctggacatga

SEQ ID NO: 34916 - DNA, 15 bp, Homo sapiens
tcttggctggacatg

SEQ ID NO: 34917 - DNA, 15 bp, Homo sapiens
ttcttggctggacat

SEQ ID NO: 34918 - DNA, 15 bp, Homo sapiens
attcttggctggaca

SEQ ID NO: 34919 - DNA, 15 bp, Homo sapiens
aattcttggctggac

SEQ ID NO: 34920 - DNA, 15 bp, Homo sapiens
gaattcttggctgga

SEQ ID NO: 34921 - DNA, 15 bp, Homo sapiens
agaattcttggctgg

SEQ ID NO: 34922 - DNA, 15 bp, Homo sapiens
aagaattcttggctg

SEQ ID NO: 34923 - DNA, 15 bp, Homo sapiens
taagaattcttggct

SEQ ID NO: 34924 - DNA, 15 bp, Homo sapiens
ataagaattcttggc

SEQ ID NO: 34925 - DNA, 15 bp, Homo sapiens
tataagaattcttgg

SEQ ID NO: 34926 - DNA, 15 bp, Homo sapiens
ttataagaattcttg

SEQ ID NO: 34927 - DNA, 15 bp, Homo sapiens
gttataagaattctt

SEQ ID NO: 34928 - DNA, 15 bp, Homo sapiens
agttataagaattct

SEQ ID NO: 34929 - DNA, 15 bp, Homo sapiens
gagttataagaattc

SEQ ID NO: 34930 - DNA, 15 bp, Homo sapiens
tgagttataagaatt

SEQ ID NO: 34931 - DNA, 15 bp, Homo sapiens
ttgagttataagaat

SEQ ID NO: 34932 - DNA, 15 bp, Homo sapiens
gttgagttataagaa

SEQ ID NO: 34933 - DNA, 15 bp, Homo sapiens
tgttgagttataaga

SEQ ID NO: 34934 - DNA, 15 bp, Homo sapiens
ttgttgagttataag

SEQ ID NO: 34935 - DNA, 15 bp, Homo sapiens
attgttgagttataa

SEQ ID NO: 34936 - DNA, 15 bp, Homo sapiens
gattgttgagttata

SEQ ID NO: 34937 - DNA, 15 bp, Homo sapiens
agattgttgagttat

SEQ ID NO: 34938 - DNA, 15 bp, Homo sapiens
tagattgttgagtta

SEQ ID NO: 34939 - DNA, 15 bp, Homo sapiens
ttagattgttgagtt

SEQ ID NO: 34940 - DNA, 15 bp, Homo sapiens
tttagattgttgagt

SEQ ID NO: 34941 - DNA, 15 bp, Homo sapiens
ctttagattgttgag

SEQ ID NO: 34942 - DNA, 15 bp, Homo sapiens
tctttagattgttga

SEQ ID NO: 34943 - DNA, 15 bp, Homo sapiens
gtctttagattgttg

SEQ ID NO: 34944 - DNA, 15 bp, Homo sapiens
tgtctttagattgtt

SEQ ID NO: 34945 - DNA, 15 bp, Homo sapiens
ttgtctttagattgt

SEQ ID NO: 34946 - DNA, 15 bp, Homo sapiens
gttgtctttagattg

SEQ ID NO: 34947 - DNA, 15 bp, Homo sapiens
ggttgtctttagatt

SEQ ID NO: 34948 - DNA, 15 bp, Homo sapiens
gggttgtctttagat

SEQ ID NO: 34949 - DNA, 15 bp, Homo sapiens
tgggttgtctttaga

SEQ ID NO: 34950 - DNA, 15 bp, Homo sapiens
ttgggttgtctttag

SEQ ID NO: 34951 - DNA, 15 bp, Homo sapiens
attgggttgtcttta

SEQ ID NO: 34952 - DNA, 15 bp, Homo sapiens
aattgggttgtcttt

SEQ ID NO: 34953 - DNA, 15 bp, Homo sapiens
caattgggttgtctt

SEQ ID NO: 34954 - DNA, 15 bp, Homo sapiens
tcaattgggttgtct

SEQ ID NO: 34955 - DNA, 15 bp, Homo sapiens
ttcaattgggttgtc

SEQ ID NO: 34956 - DNA, 15 bp, Homo sapiens
tttcaattgggttgt

SEQ ID NO: 34957 - DNA, 15 bp, Homo sapiens
ttttcaattgggttg

SEQ ID NO: 34958 - DNA, 15 bp, Homo sapiens
tttttcaattgggtt

SEQ ID NO: 34959 - DNA, 15 bp, Homo sapiens
atttttcaattgggt

SEQ ID NO: 34960 - DNA, 15 bp, Homo sapiens
catttttcaattggg

SEQ ID NO: 34961 - DNA, 15 bp, Homo sapiens
tcatttttcaattgg

SEQ ID NO: 34962 - DNA, 15 bp, Homo sapiens
ctcatttttcaattg

SEQ ID NO: 34963 - DNA, 15 bp, Homo sapiens
gctcatttttcaatt

SEQ ID NO: 34964 - DNA, 15 bp, Homo sapiens
tgctcatttttcaat

SEQ ID NO: 34965 - DNA, 15 bp, Homo sapiens
ttgctcatttttcaa

SEQ ID NO: 34966 - DNA, 15 bp, Homo sapiens
tttgctcatttttca

SEQ ID NO: 34967 - DNA, 15 bp, Homo sapiens
ctttgctcatttttc

SEQ ID NO: 34968 - DNA, 15 bp, Homo sapiens
cctttgctcattttt

SEQ ID NO: 34969 - DNA, 15 bp, Homo sapiens
tcctttgctcatttt

SEQ ID NO: 34970 - DNA, 15 bp, Homo sapiens
ttcctttgctcattt

SEQ ID NO: 34971 - DNA, 15 bp, Homo sapiens
attcctttgctcatt

SEQ ID NO: 34972 - DNA, 15 bp, Homo sapiens
tattcctttgctcat

SEQ ID NO: 34973 - DNA, 15 bp, Homo sapiens
ctattcctttgctca

SEQ ID NO: 34974 - DNA, 15 bp, Homo sapiens
tctattcctttgctc

SEQ ID NO: 34975 - DNA, 15 bp, Homo sapiens
atctattcctttgct

SEQ ID NO: 34976 - DNA, 15 bp, Homo sapiens
tatctattcctttgc

SEQ ID NO: 34977 - DNA, 15 bp, Homo sapiens
atatctattcctttg

SEQ ID NO: 34978 - DNA, 15 bp, Homo sapiens
aatatctattccttt

SEQ ID NO: 34979 - DNA, 15 bp, Homo sapiens
aaatatctattcctt

SEQ ID NO: 34980 - DNA, 15 bp, Homo sapiens
gaaatatctattcct

SEQ ID NO: 34981 - DNA, 15 bp, Homo sapiens
agaaatatctattcc

SEQ ID NO: 34982 - DNA, 15 bp, Homo sapiens
gagaaatatctattc

SEQ ID NO: 34983 - DNA, 15 bp, Homo sapiens
ggagaaatatctatt

SEQ ID NO: 34984 - DNA, 15 bp, Homo sapiens
tggagaaatatctat

SEQ ID NO: 34985 - DNA, 15 bp, Homo sapiens
ctggagaaatatcta

SEQ ID NO: 34986 - DNA, 15 bp, Homo sapiens
tctggagaaatatct

SEQ ID NO: 34987 - DNA, 15 bp, Homo sapiens
ttctggagaaatatc

SEQ ID NO: 34988 - DNA, 15 bp, Homo sapiens
tttctggagaaatat

SEQ ID NO: 34989 - DNA, 15 bp, Homo sapiens
ttttctggagaaata

SEQ ID NO: 34990 - DNA, 15 bp, Homo sapiens
cttttctggagaaat

SEQ ID NO: 34991 - DNA, 15 bp, Homo sapiens
tcttttctggagaaa

SEQ ID NO: 34992 - DNA, 15 bp, Homo sapiens
atcttttctggagaa

SEQ ID NO: 34993 - DNA, 15 bp, Homo sapiens
tatcttttctggaga

SEQ ID NO: 34994 - DNA, 15 bp, Homo sapiens
ttatcttttctggag

SEQ ID NO: 34995 - DNA, 15 bp, Homo sapiens
tttatcttttctgga

SEQ ID NO: 34996 - DNA, 15 bp, Homo sapiens
gtttatcttttctgg

SEQ ID NO: 34997 - DNA, 15 bp, Homo sapiens
tgtttatcttttctg

SEQ ID NO: 34998 - DNA, 15 bp, Homo sapiens
ttgtttatcttttct

SEQ ID NO: 34999 - DNA, 15 bp, Homo sapiens
attgtttatcttttc

SEQ ID NO: 35000 - DNA, 15 bp, Homo sapiens
aattgtttatctttt

SEQ ID NO: 35001 - DNA, 15 bp, Homo sapiens
caattgtttatcttt

SEQ ID NO: 35002 - DNA, 15 bp, Homo sapiens
ccaattgtttatctt

SEQ ID NO: 35003 - DNA, 15 bp, Homo sapiens
gccaattgtttatct

SEQ ID NO: 35004 - DNA, 15 bp, Homo sapiens
agccaattgtttatc

SEQ ID NO: 35005 - DNA, 15 bp, Homo sapiens
tagccaattgtttat

SEQ ID NO: 35006 - DNA, 15 bp, Homo sapiens
ttagccaattgttta

SEQ ID NO: 35007 - DNA, 15 bp, Homo sapiens
attagccaattgttt

SEQ ID NO: 35008 - DNA, 15 bp, Homo sapiens
tattagccaattgtt

SEQ ID NO: 35009 - DNA, 15 bp, Homo sapiens
ttattagccaattgt

SEQ ID NO: 35010 - DNA, 15 bp, Homo sapiens
attattagccaattg

SEQ ID NO: 35011 - DNA, 15 bp, Homo sapiens
aattattagccaatt

SEQ ID NO: 35012 - DNA, 15 bp, Homo sapiens
taattattagccaat

SEQ ID NO: 35013 - DNA, 15 bp, Homo sapiens
ataattattagccaa

SEQ ID NO: 35014 - DNA, 15 bp, Homo sapiens
aataattattagcca

SEQ ID NO: 35015 - DNA, 15 bp, Homo sapiens
caataattattagcc

SEQ ID NO: 35016 - DNA, 15 bp, Homo sapiens
gcaataattattagc

SEQ ID NO: 35017 - DNA, 15 bp, Homo sapiens
ggcaataattattag

SEQ ID NO: 35018 - DNA, 15 bp, Homo sapiens
gggcaataattatta

SEQ ID NO: 35019 - DNA, 15 bp, Homo sapiens
tgggcaataattatt

SEQ ID NO: 35020 - DNA, 15 bp, Homo sapiens
atgggcaataattat

SEQ ID NO: 35021 - DNA, 15 bp, Homo sapiens
catgggcaataatta

SEQ ID NO: 35022 - DNA, 15 bp, Homo sapiens
tcatgggcaataatt

SEQ ID NO: 35023 - DNA, 15 bp, Homo sapiens
ttcatgggcaataat

SEQ ID NO: 35024 - DNA, 15 bp, Homo sapiens
tttcatgggcaataa

SEQ ID NO: 35025 - DNA, 15 bp, Homo sapiens
ttttcatgggcaata

SEQ ID NO: 35026 - DNA, 15 bp, Homo sapiens
cttttcatgggcaat

SEQ ID NO: 35027 - DNA, 15 bp, Homo sapiens
tcttttcatgggcaa

SEQ ID NO: 35028 - DNA, 15 bp, Homo sapiens
atcttttcatgggca

SEQ ID NO: 35029 - DNA, 15 bp, Homo sapiens
catcttttcatgggc

SEQ ID NO: 35030 - DNA, 15 bp, Homo sapiens
ccatcttttcatggg

SEQ ID NO: 35031 - DNA, 15 bp, Homo sapiens
accatcttttcatgg

SEQ ID NO: 35032 - DNA, 15 bp, Homo sapiens
gaccatcttttcatg

SEQ ID NO: 35033 - DNA, 15 bp, Homo sapiens
tgaccatcttttcat

SEQ ID NO: 35034 - DNA, 15 bp, Homo sapiens
ttgaccatcttttca

SEQ ID NO: 35035 - DNA, 15 bp, Homo sapiens
gttgaccatcttttc

SEQ ID NO: 35036 - DNA, 15 bp, Homo sapiens
tgttgaccatctttt

SEQ ID NO: 35037 - DNA, 15 bp, Homo sapiens
atgttgaccatcttt

SEQ ID NO: 35038 - DNA, 15 bp, Homo sapiens
gatgttgaccatctt

SEQ ID NO: 35039 - DNA, 15 bp, Homo sapiens
tgatgttgaccatct

SEQ ID NO: 35040 - DNA, 15 bp, Homo sapiens
atgatgttgaccatc

SEQ ID NO: 35041 - DNA, 15 bp, Homo sapiens
aatgatgttgaccat

SEQ ID NO: 35042 - DNA, 15 bp, Homo sapiens
taatgatgttgacca

SEQ ID NO: 35043 - DNA, 15 bp, Homo sapiens
ctaatgatgttgacc

SEQ ID NO: 35044 - DNA, 15 bp, Homo sapiens
actaatgatgttgac

SEQ ID NO: 35045 - DNA, 15 bp, Homo sapiens
gactaatgatgttga

SEQ ID NO: 35046 - DNA, 15 bp, Homo sapiens
tgactaatgatgttg

SEQ ID NO: 35047 - DNA, 15 bp, Homo sapiens
gtgactaatgatgtt

SEQ ID NO: 35048 - DNA, 15 bp, Homo sapiens
agtgactaatgatgt

SEQ ID NO: 35049 - DNA, 15 bp, Homo sapiens
aagtgactaatgatg

SEQ ID NO: 35050 - DNA, 15 bp, Homo sapiens
taagtgactaatgat

SEQ ID NO: 35051 - DNA, 15 bp, Homo sapiens
ctaagtgactaatga

SEQ ID NO: 35052 - DNA, 15 bp, Homo sapiens
cctaagtgactaatg

SEQ ID NO: 35053 - DNA, 15 bp, Homo sapiens
ccctaagtgactaat

SEQ ID NO: 35054 - DNA, 15 bp, Homo sapiens
tccctaagtgactaa

SEQ ID NO: 35055 - DNA, 15 bp, Homo sapiens
ttccctaagtgacta

SEQ ID NO: 35056 - DNA, 15 bp, Homo sapiens
tttccctaagtgact

SEQ ID NO: 35057 - DNA, 15 bp, Homo sapiens
atttccctaagtgac

SEQ ID NO: 35058 - DNA, 15 bp, Homo sapiens
catttccctaagtga

SEQ ID NO: 35059 - DNA, 15 bp, Homo sapiens
gcatttccctaagtg

SEQ ID NO: 35060 - DNA, 15 bp, Homo sapiens
tgcatttccctaagt

SEQ ID NO: 35061 - DNA, 15 bp, Homo sapiens
ttgcatttccctaag

SEQ ID NO: 35062 - DNA, 15 bp, Homo sapiens
tttgcatttccctaa

SEQ ID NO: 35063 - DNA, 15 bp, Homo sapiens
atttgcatttcccta

SEQ ID NO: 35064 - DNA, 15 bp, Homo sapiens
gatttgcatttccct

SEQ ID NO: 35065 - DNA, 15 bp, Homo sapiens
tgatttgcatttccc

SEQ ID NO: 35066 - DNA, 15 bp, Homo sapiens
ttttgatttgcattt

SEQ ID NO: 35067 - DNA, 15 bp, Homo sapiens
gttttgatttgcatt

SEQ ID NO: 35068 - DNA, 15 bp, Homo sapiens
ggttttgatttgcat

SEQ ID NO: 35069 - DNA, 15 bp, Homo sapiens
tggttttgatttgca

SEQ ID NO: 35070 - DNA, 15 bp, Homo sapiens
atggttttgatttgc

SEQ ID NO: 35071 - DNA, 15 bp, Homo sapiens
tatggttttgatttg

SEQ ID NO: 35072 - DNA, 15 bp, Homo sapiens
ctatggttttgattt

SEQ ID NO: 35073 - DNA, 15 bp, Homo sapiens
gctatggttttgatt

SEQ ID NO: 35074 - DNA, 15 bp, Homo sapiens
cgctatggttttgat

SEQ ID NO: 35075 - DNA, 15 bp, Homo sapiens
tcgctatggttttga

SEQ ID NO: 35076 - DNA, 15 bp, Homo sapiens
ttcgctatggttttg

SEQ ID NO: 35077 - DNA, 15 bp, Homo sapiens
tttcgctatggtttt

SEQ ID NO: 35078 - DNA, 15 bp, Homo sapiens
atttcgctatggttt

SEQ ID NO: 35079 - DNA, 15 bp, Homo sapiens
aatttcgctatggtt

SEQ ID NO: 35080 - DNA, 15 bp, Homo sapiens
aaatttcgctatggt

SEQ ID NO: 35081 - DNA, 15 bp, Homo sapiens
aaaatttcgctatgg

SEQ ID NO: 35082 - DNA, 15 bp, Homo sapiens
aaaaatttcgctatg

SEQ ID NO: 35083 - DNA, 15 bp, Homo sapiens
gaaaaatttcgctat

SEQ ID NO: 35084 - DNA, 15 bp, Homo sapiens
agaaaaatttcgcta

SEQ ID NO: 35085 - DNA, 15 bp, Homo sapiens
tagaaaaatttcgct

SEQ ID NO: 35086 - DNA, 15 bp, Homo sapiens
gtagaaaaatttcgc

SEQ ID NO: 35087 - DNA, 15 bp, Homo sapiens
agtagaaaaatttcg

SEQ ID NO: 35088 - DNA, 15 bp, Homo sapiens
aagtagaaaaatttc

SEQ ID NO: 35089 - DNA, 15 bp, Homo sapiens
aaagtagaaaaattt

SEQ ID NO: 35090 - DNA, 15 bp, Homo sapiens
caaagtagaaaaatt

SEQ ID NO: 35091 - DNA, 15 bp, Homo sapiens
acaaagtagaaaaat

SEQ ID NO: 35092 - DNA, 15 bp, Homo sapiens
cacaaagtagaaaaa

SEQ ID NO: 35093 - DNA, 15 bp, Homo sapiens
gcacaaagtagaaaa

SEQ ID NO: 35094 - DNA, 15 bp, Homo sapiens
ggcacaaagtagaaa

SEQ ID NO: 35095 - DNA, 15 bp, Homo sapiens
gggcacaaagtagaa

SEQ ID NO: 35096 - DNA, 15 bp, Homo sapiens
tgggcacaaagtaga

SEQ ID NO: 35097 - DNA, 15 bp, Homo sapiens
gtgggcacaaagtag

SEQ ID NO: 35098 - DNA, 15 bp, Homo sapiens
agtgggcacaaagta

SEQ ID NO: 35099 - DNA, 15 bp, Homo sapiens
cagtgggcacaaagt

SEQ ID NO: 35100 - DNA, 15 bp, Homo sapiens
ccagtgggcacaaag

SEQ ID NO: 35101 - DNA, 15 bp, Homo sapiens
accagtgggcacaaa

SEQ ID NO: 35102 - DNA, 15 bp, Homo sapiens
taccagtgggcacaa

SEQ ID NO: 35103 - DNA, 15 bp, Homo sapiens
ataccagtgggcaca

SEQ ID NO: 35104 - DNA, 15 bp, Homo sapiens
cataccagtgggcac

SEQ ID NO: 35105 - DNA, 15 bp, Homo sapiens
ccataccagtgggca

SEQ ID NO: 35106 - DNA, 15 bp, Homo sapiens
gccataccagtgggc

SEQ ID NO: 35107 - DNA, 15 bp, Homo sapiens
agccataccagtggg

SEQ ID NO: 35108 - DNA, 15 bp, Homo sapiens
cagccataccagtgg

SEQ ID NO: 35109 - DNA, 15 bp, Homo sapiens
acagccataccagtg

SEQ ID NO: 35110 - DNA, 15 bp, Homo sapiens
tacagccataccagt

SEQ ID NO: 35111 - DNA, 15 bp, Homo sapiens
ttacagccataccag

SEQ ID NO: 35112 - DNA, 15 bp, Homo sapiens
attacagccatacca

SEQ ID NO: 35113 - DNA, 15 bp, Homo sapiens
tattacagccatacc

SEQ ID NO: 35114 - DNA, 15 bp, Homo sapiens
ttattacagccatac

SEQ ID NO: 35115 - DNA, 15 bp, Homo sapiens
tttattacagccata

SEQ ID NO: 35116 - DNA, 15 bp, Homo sapiens
ttttattacagccat

SEQ ID NO: 35117 - DNA, 15 bp, Homo sapiens
tttttattacagcca

SEQ ID NO: 35118 - DNA, 15 bp, Homo sapiens
atttttattacagcc

SEQ ID NO: 35119 - DNA, 15 bp, Homo sapiens
catttttattacagc

SEQ ID NO: 35120 - DNA, 15 bp, Homo sapiens
ccatttttattacag

SEQ ID NO: 35121 - DNA, 15 bp, Homo sapiens
tccatttttattaca

SEQ ID NO: 35122 - DNA, 15 bp, Homo sapiens
ttccatttttattac

SEQ ID NO: 35123 - DNA, 15 bp, Homo sapiens
tttccatttttatta

SEQ ID NO: 35124 - DNA, 15 bp, Homo sapiens
ctttccatttttatt

SEQ ID NO: 35125 - DNA, 15 bp, Homo sapiens
tctttccatttttat

SEQ ID NO: 35126 - DNA, 15 bp, Homo sapiens
ttctttccattttta

SEQ ID NO: 35127 - DNA, 15 bp, Homo sapiens
tttctttccattttt

SEQ ID NO: 35128 - DNA, 15 bp, Homo sapiens
atttctttccatttt

SEQ ID NO: 35129 - DNA, 15 bp, Homo sapiens
tatttctttccattt

SEQ ID NO: 35130 - DNA, 15 bp, Homo sapiens
gtatttctttccatt

SEQ ID NO: 35131 - DNA, 15 bp, Homo sapiens
cgtatttctttccat

SEQ ID NO: 35132 - DNA, 15 bp, Homo sapiens
acgtatttctttcca

SEQ ID NO: 35133 - DNA, 15 bp, Homo sapiens
cacgtatttctttcc

SEQ ID NO: 35134 - DNA, 15 bp, Homo sapiens
acacgtatttctttc

SEQ ID NO: 35135 - DNA, 15 bp, Homo sapiens
aacacgtatttcttt

SEQ ID NO: 35136 - DNA, 15 bp, Homo sapiens
caacacgtatttctt

SEQ ID NO: 35137 - DNA, 15 bp, Homo sapiens
ccaacacgtatttct

SEQ ID NO: 35138 - DNA, 15 bp, Homo sapiens
gccaacacgtatttc

SEQ ID NO: 35139 - DNA, 15 bp, Homo sapiens
tgccaacacgtattt

SEQ ID NO: 35140 - DNA, 15 bp, Homo sapiens
ttgccaacacgtatt

SEQ ID NO: 35141 - DNA, 15 bp, Homo sapiens
cttgccaacacgtat

SEQ ID NO: 35142 - DNA, 15 bp, Homo sapiens
ccttgccaacacgta

SEQ ID NO: 35143 - DNA, 15 bp, Homo sapiens
tccttgccaacacgt

SEQ ID NO: 35144 - DNA, 15 bp, Homo sapiens
atccttgccaacacg

SEQ ID NO: 35145 - DNA, 15 bp, Homo sapiens
acatccttgccaaca

SEQ ID NO: 35146 - DNA, 15 bp, Homo sapiens
cacatccttgccaac

SEQ ID NO: 35147 - DNA, 15 bp, Homo sapiens
ccacatccttgccaa

SEQ ID NO: 35148 - DNA, 15 bp, Homo sapiens
cccacatccttgcca

SEQ ID NO: 35149 - DNA, 15 bp, Homo sapiens
tcccacatccttgcc

SEQ ID NO: 35150 - DNA, 15 bp, Homo sapiens
ttcccacatccttgc

SEQ ID NO: 35151 - DNA, 15 bp, Homo sapiens
tttcccacatccttg

SEQ ID NO: 35152 - DNA, 15 bp, Homo sapiens
ttttcccacatcctt

SEQ ID NO: 35153 - DNA, 15 bp, Homo sapiens
attttcccacatcct

SEQ ID NO: 35154 - DNA, 15 bp, Homo sapiens
aattttcccacatcc

SEQ ID NO: 35155 - DNA, 15 bp, Homo sapiens
taattttcccacatc

SEQ ID NO: 35156 - DNA, 15 bp, Homo sapiens
ctaattttcccacat

SEQ ID NO: 35157 - DNA, 15 bp, Homo sapiens
tctaattttcccaca

SEQ ID NO: 35158 - DNA, 15 bp, Homo sapiens
ttctaattttcccac

SEQ ID NO: 35159 - DNA, 15 bp, Homo sapiens
gttctaattttccca

SEQ ID NO: 35160 - DNA, 15 bp, Homo sapiens
ggttctaattttccc

SEQ ID NO: 35161 - DNA, 15 bp, Homo sapiens
aggttctaattttcc

SEQ ID NO: 35162 - DNA, 15 bp, Homo sapiens
aaggttctaattttc

SEQ ID NO: 35163 - DNA, 15 bp, Homo sapiens
taaggttctaatttt

SEQ ID NO: 35164 - DNA, 15 bp, Homo sapiens
ataaggttctaattt

SEQ ID NO: 35165 - DNA, 15 bp, Homo sapiens
tataaggttctaatt

SEQ ID NO: 35166 - DNA, 15 bp, Homo sapiens
atataaggttctaat

SEQ ID NO: 35167 - DNA, 15 bp, Homo sapiens
aatataaggttctaa

SEQ ID NO: 35168 - DNA, 15 bp, Homo sapiens
caatataaggttcta

SEQ ID NO: 35169 - DNA, 15 bp, Homo sapiens
gcaatataaggttct

SEQ ID NO: 35170 - DNA, 15 bp, Homo sapiens
agcaatataaggttc

SEQ ID NO: 35171 - DNA, 15 bp, Homo sapiens
aagcaatataaggtt

SEQ ID NO: 35172 - DNA, 15 bp, Homo sapiens
caagcaatataaggt

SEQ ID NO: 35173 - DNA, 15 bp, Homo sapiens
acaagcaatataagg

SEQ ID NO: 35174 - DNA, 15 bp, Homo sapiens
cacaagcaatataag

SEQ ID NO: 35175 - DNA, 15 bp, Homo sapiens
tcacaagcaatataa

SEQ ID NO: 35176 - DNA, 15 bp, Homo sapiens
ttcacaagcaatata

SEQ ID NO: 35177 - DNA, 15 bp, Homo sapiens
tttcacaagcaatat

SEQ ID NO: 35178 - DNA, 15 bp, Homo sapiens
ttttcacaagcaata

SEQ ID NO: 35179 - DNA, 15 bp, Homo sapiens
attttcacaagcaat

SEQ ID NO: 35180 - DNA, 15 bp, Homo sapiens
cattttcacaagcaa

SEQ ID NO: 35181 - DNA, 15 bp, Homo sapiens
acattttcacaagca

SEQ ID NO: 35182 - DNA, 15 bp, Homo sapiens
tacattttcacaagc

SEQ ID NO: 35183 - DNA, 15 bp, Homo sapiens
ttacattttcacaag

SEQ ID NO: 35184 - DNA, 15 bp, Homo sapiens
tttacattttcacaa

SEQ ID NO: 35185 - DNA, 15 bp, Homo sapiens
ttttacattttcaca

SEQ ID NO: 35186 - DNA, 15 bp, Homo sapiens
attttacattttcac

SEQ ID NO: 35187 - DNA, 15 bp, Homo sapiens
tattttacattttca

SEQ ID NO: 35188 - DNA, 15 bp, Homo sapiens
ctattttacattttc

SEQ ID NO: 35189 - DNA, 15 bp, Homo sapiens
actattttacatttt

SEQ ID NO: 35190 - DNA, 15 bp, Homo sapiens
cactattttacattt

SEQ ID NO: 35191 - DNA, 15 bp, Homo sapiens
acactattttacatt

SEQ ID NO: 35192 - DNA, 15 bp, Homo sapiens
tacactattttacat

SEQ ID NO: 35193 - DNA, 15 bp, Homo sapiens
ctacactattttaca

SEQ ID NO: 35194 - DNA, 15 bp, Homo sapiens
gctacactattttac

SEQ ID NO: 35195 - DNA, 15 bp, Homo sapiens
tgctacactatttta

SEQ ID NO: 35196 - DNA, 15 bp, Homo sapiens
ctgctacactatttt

SEQ ID NO: 35197 - DNA, 15 bp, Homo sapiens
actgctacactattt

SEQ ID NO: 35198 - DNA, 15 bp, Homo sapiens
aactgctacactatt

SEQ ID NO: 35199 - DNA, 15 bp, Homo sapiens
aaactgctacactat

SEQ ID NO: 35200 - DNA, 15 bp, Homo sapiens
aaaactgctacacta

SEQ ID NO: 35201 - DNA, 15 bp, Homo sapiens
caaaactgctacact

SEQ ID NO: 35202 - DNA, 15 bp, Homo sapiens
ccaaaactgctacac

SEQ ID NO: 35203 - DNA, 15 bp, Homo sapiens
tccaaaactgctaca

SEQ ID NO: 35204 - DNA, 15 bp, Homo sapiens
ttccaaaactgctac

SEQ ID NO: 35205 - DNA, 15 bp, Homo sapiens
tttccaaaactgcta

SEQ ID NO: 35206 - DNA, 15 bp, Homo sapiens
ttttccaaaactgct

SEQ ID NO: 35207 - DNA, 15 bp, Homo sapiens
attttccaaaactgc

SEQ ID NO: 35208 - DNA, 15 bp, Homo sapiens
tattttccaaaactg

SEQ ID NO: 35209 - DNA, 15 bp, Homo sapiens
atattttccaaaact

SEQ ID NO: 35210 - DNA, 15 bp, Homo sapiens
aatattttccaaaac

SEQ ID NO: 35211 - DNA, 15 bp, Homo sapiens
aaatattttccaaaa

SEQ ID NO: 35212 - DNA, 15 bp, Homo sapiens
aaaatattttccaaa

SEQ ID NO: 35213 - DNA, 15 bp, Homo sapiens
caaaatattttccaa

SEQ ID NO: 35214 - DNA, 15 bp, Homo sapiens
ccaaaatattttcca

SEQ ID NO: 35215 - DNA, 15 bp, Homo sapiens
gccaaaatattttcc

SEQ ID NO: 35216 - DNA, 15 bp, Homo sapiens
tgccaaaatattttc

SEQ ID NO: 35217 - DNA, 15 bp, Homo sapiens
ctgccaaaatatttt

SEQ ID NO: 35218 - DNA, 15 bp, Homo sapiens
actgccaaaatattt

SEQ ID NO: 35219 - DNA, 15 bp, Homo sapiens
aactgccaaaatatt

SEQ ID NO: 35220 - DNA, 15 bp, Homo sapiens
gaactgccaaaatat

SEQ ID NO: 35221 - DNA, 15 bp, Homo sapiens
agaactgccaaaata

SEQ ID NO: 35222 - DNA, 15 bp, Homo sapiens
tagaactgccaaaat

SEQ ID NO: 35223 - DNA, 15 bp, Homo sapiens
gtagaactgccaaaa

SEQ ID NO: 35224 - DNA, 15 bp, Homo sapiens
tgtagaactgccaaa

SEQ ID NO: 35225 - DNA, 15 bp, Homo sapiens
ttgtagaactgccaa

SEQ ID NO: 35226 - DNA, 15 bp, Homo sapiens
tttgtagaactgcca

SEQ ID NO: 35227 - DNA, 15 bp, Homo sapiens
ttttgtagaactgcc

SEQ ID NO: 35228 - DNA, 15 bp, Homo sapiens
tttttgtagaactgc

SEQ ID NO: 35229 - DNA, 15 bp, Homo sapiens
ctttttgtagaactg

SEQ ID NO: 35230 - DNA, 15 bp, Homo sapiens
actttttgtagaact

SEQ ID NO: 35231 - DNA, 15 bp, Homo sapiens
aactttttgtagaac

SEQ ID NO: 35232 - DNA, 15 bp, Homo sapiens
taactttttgtagaa

SEQ ID NO: 35233 - DNA, 15 bp, Homo sapiens
ttaactttttgtaga

SEQ ID NO: 35234 - DNA, 15 bp, Homo sapiens
cttaactttttgtag

SEQ ID NO: 35235 - DNA, 15 bp, Homo sapiens
gcttaactttttgta

SEQ ID NO: 35236 - DNA, 15 bp, Homo sapiens
agcttaactttttgt

SEQ ID NO: 35237 - DNA, 15 bp, Homo sapiens
aagcttaactttttg

SEQ ID NO: 35238 - DNA, 15 bp, Homo sapiens
aaagcttaacttttt

SEQ ID NO: 35239 - DNA, 15 bp, Homo sapiens
caaagcttaactttt

SEQ ID NO: 35240 - DNA, 15 bp, Homo sapiens
tcaaagcttaacttt

SEQ ID NO: 35241 - DNA, 15 bp, Homo sapiens
ctcaaagcttaactt

SEQ ID NO: 35242 - DNA, 15 bp, Homo sapiens
actcaaagcttaact

SEQ ID NO: 35243 - DNA, 15 bp, Homo sapiens
aactcaaagcttaac

SEQ ID NO: 35244 - DNA, 15 bp, Homo sapiens
taactcaaagcttaa

SEQ ID NO: 35245 - DNA, 15 bp, Homo sapiens
ataactcaaagctta

SEQ ID NO: 35246 - DNA, 15 bp, Homo sapiens
gataactcaaagctt

SEQ ID NO: 35247 - DNA, 15 bp, Homo sapiens
tgataactcaaagct

SEQ ID NO: 35248 - DNA, 15 bp, Homo sapiens
atgataactcaaagc

SEQ ID NO: 35249 - DNA, 15 bp, Homo sapiens
tatgataactcaaag

SEQ ID NO: 35250 - DNA, 15 bp, Homo sapiens
atatgataactcaaa

SEQ ID NO: 35251 - DNA, 15 bp, Homo sapiens
tatatgataactcaa

SEQ ID NO: 35252 - DNA, 15 bp, Homo sapiens
ttatatgataactca

SEQ ID NO: 35253 - DNA, 15 bp, Homo sapiens
gttatatgataactc

SEQ ID NO: 35254 - DNA, 15 bp, Homo sapiens
agttatatgataact

SEQ ID NO: 35255 - DNA, 15 bp, Homo sapiens
gagttatatgataac

SEQ ID NO: 35256 - DNA, 15 bp, Homo sapiens
tgagttatatgataa

SEQ ID NO: 35257 - DNA, 15 bp, Homo sapiens
ctgagttatatgata

SEQ ID NO: 35258 - DNA, 15 bp, Homo sapiens
actgagttatatgat

SEQ ID NO: 35259 - DNA, 15 bp, Homo sapiens
tactgagttatatga

SEQ ID NO: 35260 - DNA, 15 bp, Homo sapiens
ttactgagttatatg

SEQ ID NO: 35261 - DNA, 15 bp, Homo sapiens
attactgagttatat

SEQ ID NO: 35262 - DNA, 15 bp, Homo sapiens
aattactgagttata

SEQ ID NO: 35263 - DNA, 15 bp, Homo sapiens
aaattactgagttat

SEQ ID NO: 35264 - DNA, 15 bp, Homo sapiens
gaaattactgagtta

SEQ ID NO: 35265 - DNA, 15 bp, Homo sapiens
agaaattactgagtt

SEQ ID NO: 35266 - DNA, 15 bp, Homo sapiens
gagaaattactgagt

SEQ ID NO: 35267 - DNA, 15 bp, Homo sapiens
agagaaattactgag

SEQ ID NO: 35268 - DNA, 15 bp, Homo sapiens
gagagaaattactga

SEQ ID NO: 35269 - DNA, 15 bp, Homo sapiens
agagagaaattactg

SEQ ID NO: 35270 - DNA, 15 bp, Homo sapiens
tagagagaaattact

SEQ ID NO: 35271 - DNA, 15 bp, Homo sapiens
ttagagagaaattac

SEQ ID NO: 35272 - DNA, 15 bp, Homo sapiens
cttagagagaaatta

SEQ ID NO: 35273 - DNA, 15 bp, Homo sapiens
acttagagagaaatt

SEQ ID NO: 35274 - DNA, 15 bp, Homo sapiens
aacttagagagaaat

SEQ ID NO: 35275 - DNA, 15 bp, Homo sapiens
aaacttagagagaaa

SEQ ID NO: 35276 - DNA, 15 bp, Homo sapiens
aaaacttagagagaa

SEQ ID NO: 35277 - DNA, 15 bp, Homo sapiens
gaaaacttagagaga

SEQ ID NO: 35278 - DNA, 15 bp, Homo sapiens
agaaaacttagagag

SEQ ID NO: 35279 - DNA, 15 bp, Homo sapiens
cagaaaacttagaga

SEQ ID NO: 35280 - DNA, 15 bp, Homo sapiens
gcagaaaacttagag

SEQ ID NO: 35281 - DNA, 15 bp, Homo sapiens
ggcagaaaacttaga

SEQ ID NO: 35282 - DNA, 15 bp, Homo sapiens
gggcagaaaacttag

SEQ ID NO: 35283 - DNA, 15 bp, Homo sapiens
tgggcagaaaactta

SEQ ID NO: 35284 - DNA, 15 bp, Homo sapiens
ttgggcagaaaactt

SEQ ID NO: 35285 - DNA, 15 bp, Homo sapiens
cttgggcagaaaact

SEQ ID NO: 35286 - DNA, 15 bp, Homo sapiens
tcttgggcagaaaac

SEQ ID NO: 35287 - DNA, 15 bp, Homo sapiens
ttcttgggcagaaaa

SEQ ID NO: 35288 - DNA, 15 bp, Homo sapiens
tttcttgggcagaaa

SEQ ID NO: 35289 - DNA, 15 bp, Homo sapiens
ttttcttgggcagaa

SEQ ID NO: 35290 - DNA, 15 bp, Homo sapiens
gttttcttgggcaga

SEQ ID NO: 35291 - DNA, 15 bp, Homo sapiens
agttttcttgggcag

SEQ ID NO: 35292 - DNA, 15 bp, Homo sapiens
cagttttcttgggca

SEQ ID NO: 35293 - DNA, 15 bp, Homo sapiens
tcagttttcttgggc

SEQ ID NO: 35294 - DNA, 15 bp, Homo sapiens
ttcagttttcttggg

SEQ ID NO: 35295 - DNA, 15 bp, Homo sapiens
tttcagttttcttgg

SEQ ID NO: 35296 - DNA, 15 bp, Homo sapiens
ttttcagttttcttg

SEQ ID NO: 35297 - DNA, 15 bp, Homo sapiens
gttttcagttttctt

SEQ ID NO: 35298 - DNA, 15 bp, Homo sapiens
tgttttcagttttct

SEQ ID NO: 35299 - DNA, 15 bp, Homo sapiens
atgttttcagttttc

SEQ ID NO: 35300 - DNA, 15 bp, Homo sapiens
tatgttttcagtttt

SEQ ID NO: 35301 - DNA, 15 bp, Homo sapiens
atatgttttcagttt

SEQ ID NO: 35302 - DNA, 15 bp, Homo sapiens
catatgttttcagtt

SEQ ID NO: 35303 - DNA, 15 bp, Homo sapiens
acatatgttttcagt

SEQ ID NO: 35304 - DNA, 15 bp, Homo sapiens
aacatatgttttcag

SEQ ID NO: 35305 - DNA, 15 bp, Homo sapiens
gaacatatgttttca

SEQ ID NO: 35306 - DNA, 15 bp, Homo sapiens
tgaacatatgttttc

SEQ ID NO: 35307 - DNA, 15 bp, Homo sapiens
gtgaacatatgtttt

SEQ ID NO: 35308 - DNA, 15 bp, Homo sapiens
tgtgaacatatgttt

SEQ ID NO: 35309 - DNA, 15 bp, Homo sapiens
gtgtgaacatatgtt

SEQ ID NO: 35310 - DNA, 15 bp, Homo sapiens
tgtgtgaacatatgt

SEQ ID NO: 35311 - DNA, 15 bp, Homo sapiens
ttgtgtgaacatatg

SEQ ID NO: 35312 - DNA, 15 bp, Homo sapiens
tttgtgtgaacatat

SEQ ID NO: 35313 - DNA, 15 bp, Homo sapiens
ttttgtgtgaacata

SEQ ID NO: 35314 - DNA, 15 bp, Homo sapiens
tttttgtgtgaacat

SEQ ID NO: 35315 - DNA, 15 bp, Homo sapiens
gtttttgtgtgaaca

SEQ ID NO: 35316 - DNA, 15 bp, Homo sapiens
agtttttgtgtgaac

SEQ ID NO: 35317 - DNA, 15 bp, Homo sapiens
aagtttttgtgtgaa

SEQ ID NO: 35318 - DNA, 15 bp, Homo sapiens
caagtttttgtgtga

SEQ ID NO: 35319 - DNA, 15 bp, Homo sapiens
acaagtttttgtgtg

SEQ ID NO: 35320 - DNA, 15 bp, Homo sapiens
tacaagtttttgtgt

SEQ ID NO: 35321 - DNA, 15 bp, Homo sapiens
gtacaagtttttgtg

SEQ ID NO: 35322 - DNA, 15 bp, Homo sapiens
tgtacaagtttttgt

SEQ ID NO: 35323 - DNA, 15 bp, Homo sapiens
atgtacaagtttttg

SEQ ID NO: 35324 - DNA, 15 bp, Homo sapiens
catgtacaagttttt

SEQ ID NO: 35325 - DNA, 15 bp, Homo sapiens
ccatgtacaagtttt

SEQ ID NO: 35326 - DNA, 15 bp, Homo sapiens
tccatgtacaagttt

SEQ ID NO: 35327 - DNA, 15 bp, Homo sapiens
atccatgtacaagtt

SEQ ID NO: 35328 - DNA, 15 bp, Homo sapiens
tatccatgtacaagt

SEQ ID NO: 35329 - DNA, 15 bp, Homo sapiens
atatccatgtacaag

SEQ ID NO: 35330 - DNA, 15 bp, Homo sapiens
aatatccatgtacaa

SEQ ID NO: 35331 - DNA, 15 bp, Homo sapiens
gaatatccatgtaca

SEQ ID NO: 35332 - DNA, 15 bp, Homo sapiens
tgaatatccatgtac

SEQ ID NO: 35333 - DNA, 15 bp, Homo sapiens
atgaatatccatgta

SEQ ID NO: 35334 - DNA, 15 bp, Homo sapiens
tatgaatatccatgt

SEQ ID NO: 35335 - DNA, 15 bp, Homo sapiens
ttatgaatatccatg

SEQ ID NO: 35336 - DNA, 15 bp, Homo sapiens
gttatgaatatccat

SEQ ID NO: 35337 - DNA, 15 bp, Homo sapiens
tgttatgaatatcca

SEQ ID NO: 35338 - DNA, 15 bp, Homo sapiens
ctgttatgaatatcc

SEQ ID NO: 35339 - DNA, 15 bp, Homo sapiens
gctgttatgaatatc

SEQ ID NO: 35340 - DNA, 15 bp, Homo sapiens
tgctgttatgaatat

SEQ ID NO: 35341 - DNA, 15 bp, Homo sapiens
atgctgttatgaata

SEQ ID NO: 35342 - DNA, 15 bp, Homo sapiens
aatgctgttatgaat

SEQ ID NO: 35343 - DNA, 15 bp, Homo sapiens
taatgctgttatgaa

SEQ ID NO: 35344 - DNA, 15 bp, Homo sapiens
ataatgctgttatga

SEQ ID NO: 35345 - DNA, 15 bp, Homo sapiens
aataatgctgttatg

SEQ ID NO: 35346 - DNA, 15 bp, Homo sapiens
gaataatgctgttat

SEQ ID NO: 35347 - DNA, 15 bp, Homo sapiens
tgaataatgctgtta

SEQ ID NO: 35348 - DNA, 15 bp, Homo sapiens
atgaataatgctgtt

SEQ ID NO: 35349 - DNA, 15 bp, Homo sapiens
tatgaataatgctgt

SEQ ID NO: 35350 - DNA, 15 bp, Homo sapiens
ttatgaataatgctg

SEQ ID NO: 35351 - DNA, 15 bp, Homo sapiens
attatgaataatgct

SEQ ID NO: 35352 - DNA, 15 bp, Homo sapiens
tattatgaataatgc

SEQ ID NO: 35353 - DNA, 15 bp, Homo sapiens
ctattatgaataatg

SEQ ID NO: 35354 - DNA, 15 bp, Homo sapiens
cctattatgaataat

SEQ ID NO: 35355 - DNA, 15 bp, Homo sapiens
gcctattatgaataa

SEQ ID NO: 35356 - DNA, 15 bp, Homo sapiens
tgcctattatgaata

SEQ ID NO: 35357 - DNA, 15 bp, Homo sapiens
ttgcctattatgaat

SEQ ID NO: 35358 - DNA, 15 bp, Homo sapiens
tttgcctattatgaa

SEQ ID NO: 35359 - DNA, 15 bp, Homo sapiens
ttttgcctattatga

SEQ ID NO: 35360 - DNA, 15 bp, Homo sapiens
tttttgcctattatg

SEQ ID NO: 35361 - DNA, 15 bp, Homo sapiens
ctttttgcctattat

SEQ ID NO: 35362 - DNA, 15 bp, Homo sapiens
actttttgcctatta

SEQ ID NO: 35363 - DNA, 15 bp, Homo sapiens
cactttttgcctatt

SEQ ID NO: 35364 - DNA, 15 bp, Homo sapiens
ccactttttgcctat

SEQ ID NO: 35365 - DNA, 15 bp, Homo sapiens
tccactttttgccta

SEQ ID NO: 35366 - DNA, 15 bp, Homo sapiens
ttccactttttgcct

SEQ ID NO: 35367 - DNA, 15 bp, Homo sapiens
tttccactttttgcc

SEQ ID NO: 35368 - DNA, 15 bp, Homo sapiens
gtttccactttttgc

SEQ ID NO: 35369 - DNA, 15 bp, Homo sapiens
tgtttccactttttg

SEQ ID NO: 35370 - DNA, 15 bp, Homo sapiens
ttgtttccacttttt

SEQ ID NO: 35371 - DNA, 15 bp, Homo sapiens
gttgtttccactttt

SEQ ID NO: 35372 - DNA, 15 bp, Homo sapiens
ggttgtttccacttt

SEQ ID NO: 35373 - DNA, 15 bp, Homo sapiens
tggttgtttccactt

SEQ ID NO: 35374 - DNA, 15 bp, Homo sapiens
ttggttgtttccact

SEQ ID NO: 35375 - DNA, 15 bp, Homo sapiens
tttggttgtttccac

SEQ ID NO: 35376 - DNA, 15 bp, Homo sapiens
ttttggttgtttcca

SEQ ID NO: 35377 - DNA, 15 bp, Homo sapiens
attttggttgtttcc

SEQ ID NO: 35378 - DNA, 15 bp, Homo sapiens
cattttggttgtttc

SEQ ID NO: 35379 - DNA, 15 bp, Homo sapiens
gcattttggttgttt

SEQ ID NO: 35380 - DNA, 15 bp, Homo sapiens
ggcattttggttgtt

SEQ ID NO: 35381 - DNA, 15 bp, Homo sapiens
gggcattttggttgt

SEQ ID NO: 35382 - DNA, 15 bp, Homo sapiens
tgggcattttggttg

SEQ ID NO: 35383 - DNA, 15 bp, Homo sapiens
atgggcattttggtt

SEQ ID NO: 35384 - DNA, 15 bp, Homo sapiens
gatgggcattttggt

SEQ ID NO: 35385 - DNA, 15 bp, Homo sapiens
tgatgggcattttgg

SEQ ID NO: 35386 - DNA, 15 bp, Homo sapiens
ctgatgggcattttg

SEQ ID NO: 35387 - DNA, 15 bp, Homo sapiens
gctgatgggcatttt

SEQ ID NO: 35388 - DNA, 15 bp, Homo sapiens
ggctgatgggcattt

SEQ ID NO: 35389 - DNA, 15 bp, Homo sapiens
cggctgatgggcatt

SEQ ID NO: 35390 - DNA, 15 bp, Homo sapiens
tcggctgatgggcat

SEQ ID NO: 35391 - DNA, 15 bp, Homo sapiens
gtcggctgatgggca

SEQ ID NO: 35392 - DNA, 15 bp, Homo sapiens
cgtcggctgatgggc

SEQ ID NO: 35393 - DNA, 15 bp, Homo sapiens
tcgtcggctgatggg

SEQ ID NO: 35394 - DNA, 15 bp, Homo sapiens
ttcgtcggctgatgg

SEQ ID NO: 35395 - DNA, 15 bp, Homo sapiens
attcgtcggctgatg

SEQ ID NO: 35396 - DNA, 15 bp, Homo sapiens
cattcgtcggctgat

SEQ ID NO: 35397 - DNA, 15 bp, Homo sapiens
ccattcgtcggctga

SEQ ID NO: 35398 - DNA, 15 bp, Homo sapiens
tccattcgtcggctg

SEQ ID NO: 35399 - DNA, 15 bp, Homo sapiens
atccattcgtcggct

SEQ ID NO: 35400 - DNA, 15 bp, Homo sapiens
gatccattcgtcggc

SEQ ID NO: 35401 - DNA, 15 bp, Homo sapiens
tgatccattcgtcgg

SEQ ID NO: 35402 - DNA, 15 bp, Homo sapiens
ttgatccattcgtcg

SEQ ID NO: 35403 - DNA, 15 bp, Homo sapiens
gttgatccattcgtc

SEQ ID NO: 35404 - DNA, 15 bp, Homo sapiens
tgttgatccattcgt

SEQ ID NO: 35405 - DNA, 15 bp, Homo sapiens
ttgttgatccattcg

SEQ ID NO: 35406 - DNA, 15 bp, Homo sapiens
tttgttgatccattc

SEQ ID NO: 35407 - DNA, 15 bp, Homo sapiens
ttttgttgatccatt

SEQ ID NO: 35408 - DNA, 15 bp, Homo sapiens
attttgttgatccat

SEQ ID NO: 35409 - DNA, 15 bp, Homo sapiens
tattttgttgatcca

SEQ ID NO: 35410 - DNA, 15 bp, Homo sapiens
atattttgttgatcc

SEQ ID NO: 35411 - DNA, 15 bp, Homo sapiens
catattttgttgatc

SEQ ID NO: 35412 - DNA, 15 bp, Homo sapiens
ccatattttgttgat

SEQ ID NO: 35413 - DNA, 15 bp, Homo sapiens
accatattttgttga

SEQ ID NO: 35414 - DNA, 15 bp, Homo sapiens
gaccatattttgttg

SEQ ID NO: 35415 - DNA, 15 bp, Homo sapiens
tgaccatattttgtt

SEQ ID NO: 35416 - DNA, 15 bp, Homo sapiens
atgaccatattttgt

SEQ ID NO: 35417 - DNA, 15 bp, Homo sapiens
aatgaccatattttg

SEQ ID NO: 35418 - DNA, 15 bp, Homo sapiens
aaatgaccatatttt

SEQ ID NO: 35419 - DNA, 15 bp, Homo sapiens
gaaatgaccatattt

SEQ ID NO: 35420 - DNA, 15 bp, Homo sapiens
tgaaatgaccatatt

SEQ ID NO: 35421 - DNA, 15 bp, Homo sapiens
atgaaatgaccatat

SEQ ID NO: 35422 - DNA, 15 bp, Homo sapiens
tatgaaatgaccata

SEQ ID NO: 35423 - DNA, 15 bp, Homo sapiens
atatgaaatgaccat

SEQ ID NO: 35424 - DNA, 15 bp, Homo sapiens
tatatgaaatgacca

SEQ ID NO: 35425 - DNA, 15 bp, Homo sapiens
ttatatgaaatgacc

SEQ ID NO: 35426 - DNA, 15 bp, Homo sapiens
attatatgaaatgac

SEQ ID NO: 35427 - DNA, 15 bp, Homo sapiens
cattatatgaaatga

SEQ ID NO: 35428 - DNA, 15 bp, Homo sapiens
ccattatatgaaatg

SEQ ID NO: 35429 - DNA, 15 bp, Homo sapiens
tccattatatgaaat

SEQ ID NO: 35430 - DNA, 15 bp, Homo sapiens
ctccattatatgaaa

SEQ ID NO: 35431 - DNA, 15 bp, Homo sapiens
actccattatatgaa

SEQ ID NO: 35432 - DNA, 15 bp, Homo sapiens
tactccattatatga

SEQ ID NO: 35433 - DNA, 15 bp, Homo sapiens
atactccattatatg

SEQ ID NO: 35434 - DNA, 15 bp, Homo sapiens
aatactccattatat

SEQ ID NO: 35435 - DNA, 15 bp, Homo sapiens
taatactccattata

SEQ ID NO: 35436 - DNA, 15 bp, Homo sapiens
ataatactccattat

SEQ ID NO: 35437 - DNA, 15 bp, Homo sapiens
aataatactccatta

SEQ ID NO: 35438 - DNA, 15 bp, Homo sapiens
gaataatactccatt

SEQ ID NO: 35439 - DNA, 15 bp, Homo sapiens
tgaataatactccat

SEQ ID NO: 35440 - DNA, 15 bp, Homo sapiens
ctgaataatactcca

SEQ ID NO: 35441 - DNA, 15 bp, Homo sapiens
gctgaataatactcc

SEQ ID NO: 35442 - DNA, 15 bp, Homo sapiens
ggctgaataatactc

SEQ ID NO: 35443 - DNA, 15 bp, Homo sapiens
tggctgaataatact

SEQ ID NO: 35444 - DNA, 15 bp, Homo sapiens
atggctgaataatac

SEQ ID NO: 35445 - DNA, 15 bp, Homo sapiens
tatggctgaataata

SEQ ID NO: 35446 - DNA, 15 bp, Homo sapiens
gtatggctgaataat

SEQ ID NO: 35447 - DNA, 15 bp, Homo sapiens
tgtatggctgaataa

SEQ ID NO: 35448 - DNA, 15 bp, Homo sapiens
ctgtatggctgaata

SEQ ID NO: 35449 - DNA, 15 bp, Homo sapiens
cctgtatggctgaat

SEQ ID NO: 35450 - DNA, 15 bp, Homo sapiens
tcctgtatggctgaa

SEQ ID NO: 35451 - DNA, 15 bp, Homo sapiens
ttcctgtatggctga

SEQ ID NO: 35452 - DNA, 15 bp, Homo sapiens
tttcctgtatggctg

SEQ ID NO: 35453 - DNA, 15 bp, Homo sapiens
atttcctgtatggct

SEQ ID NO: 35454 - DNA, 15 bp, Homo sapiens
tatttcctgtatggc

SEQ ID NO: 35455 - DNA, 15 bp, Homo sapiens
gtatttcctgtatgg

SEQ ID NO: 35456 - DNA, 15 bp, Homo sapiens
tgtatttcctgtatg

SEQ ID NO: 35457 - DNA, 15 bp, Homo sapiens
ctgtatttcctgtat

SEQ ID NO: 35458 - DNA, 15 bp, Homo sapiens
cctgtatttcctgta

SEQ ID NO: 35459 - DNA, 15 bp, Homo sapiens
tcctgtatttcctgt

SEQ ID NO: 35460 - DNA, 15 bp, Homo sapiens
gtcctgtatttcctg

SEQ ID NO: 35461 - DNA, 15 bp, Homo sapiens
agtcctgtatttcct

SEQ ID NO: 35462 - DNA, 15 bp, Homo sapiens
cagtcctgtatttcc

SEQ ID NO: 35463 - DNA, 15 bp, Homo sapiens
tcagtcctgtatttc

SEQ ID NO: 35464 - DNA, 15 bp, Homo sapiens
atcagtcctgtattt

SEQ ID NO: 35465 - DNA, 15 bp, Homo sapiens
tatcagtcctgtatt

SEQ ID NO: 35466 - DNA, 15 bp, Homo sapiens
gtatcagtcctgtat

SEQ ID NO: 35467 - DNA, 15 bp, Homo sapiens
tgtatcagtcctgta

SEQ ID NO: 35468 - DNA, 15 bp, Homo sapiens
ttgtatcagtcctgt

SEQ ID NO: 35469 - DNA, 15 bp, Homo sapiens
cttgtatcagtcctg

SEQ ID NO: 35470 - DNA, 15 bp, Homo sapiens
gcttgtatcagtcct

SEQ ID NO: 35471 - DNA, 15 bp, Homo sapiens
agcttgtatcagtcc

SEQ ID NO: 35472 - DNA, 15 bp, Homo sapiens
cagcttgtatcagtc

SEQ ID NO: 35473 - DNA, 15 bp, Homo sapiens
gcagcttgtatcagt

SEQ ID NO: 35474 - DNA, 15 bp, Homo sapiens
tgcagcttgtatcag

SEQ ID NO: 35475 - DNA, 15 bp, Homo sapiens
ttgcagcttgtatca

SEQ ID NO: 35476 - DNA, 15 bp, Homo sapiens
gttgcagcttgtatc

SEQ ID NO: 35477 - DNA, 15 bp, Homo sapiens
tgttgcagcttgtat

SEQ ID NO: 35478 - DNA, 15 bp, Homo sapiens
atgttgcagcttgta

SEQ ID NO: 35479 - DNA, 15 bp, Homo sapiens
catgttgcagcttgt

SEQ ID NO: 35480 - DNA, 15 bp, Homo sapiens
gcatgttgcagcttg

SEQ ID NO: 35481 - DNA, 15 bp, Homo sapiens
tgcatgttgcagctt

SEQ ID NO: 35482 - DNA, 15 bp, Homo sapiens
atgcatgttgcagct

SEQ ID NO: 35483 - DNA, 15 bp, Homo sapiens
catgcatgttgcagc

SEQ ID NO: 35484 - DNA, 15 bp, Homo sapiens
ccatgcatgttgcag

SEQ ID NO: 35485 - DNA, 15 bp, Homo sapiens
cccatgcatgttgca

SEQ ID NO: 35486 - DNA, 15 bp, Homo sapiens
gcccatgcatgttgc

SEQ ID NO: 35487 - DNA, 15 bp, Homo sapiens
ggcccatgcatgttg

SEQ ID NO: 35488 - DNA, 15 bp, Homo sapiens
aggcccatgcatgtt

SEQ ID NO: 35489 - DNA, 15 bp, Homo sapiens
aaggcccatgcatgt

SEQ ID NO: 35490 - DNA, 15 bp, Homo sapiens
caaggcccatgcatg

SEQ ID NO: 35491 - DNA, 15 bp, Homo sapiens
tcaaggcccatgcat

SEQ ID NO: 35492 - DNA, 15 bp, Homo sapiens
ttcaaggcccatgca

SEQ ID NO: 35493 - DNA, 15 bp, Homo sapiens
tttcaaggcccatgc

SEQ ID NO: 35494 - DNA, 15 bp, Homo sapiens
ttttcaaggcccatg

SEQ ID NO: 35495 - DNA, 15 bp, Homo sapiens
gttttcaaggcccat

SEQ ID NO: 35496 - DNA, 15 bp, Homo sapiens
tgttttcaaggccca

SEQ ID NO: 35497 - DNA, 15 bp, Homo sapiens
atgttttcaaggccc

SEQ ID NO: 35498 - DNA, 15 bp, Homo sapiens
tatgttttcaaggcc

SEQ ID NO: 35499 - DNA, 15 bp, Homo sapiens
ttatgttttcaaggc

SEQ ID NO: 35500 - DNA, 15 bp, Homo sapiens
attatgttttcaagg

SEQ ID NO: 35501 - DNA, 15 bp, Homo sapiens
cattatgttttcaag

SEQ ID NO: 35502 - DNA, 15 bp, Homo sapiens
gcattatgttttcaa

SEQ ID NO: 35503 - DNA, 15 bp, Homo sapiens
agcattatgttttca

SEQ ID NO: 35504 - DNA, 15 bp, Homo sapiens
tagcattatgttttc

SEQ ID NO: 35505 - DNA, 15 bp, Homo sapiens
ttagcattatgtttt

SEQ ID NO: 35506 - DNA, 15 bp, Homo sapiens
cttagcattatgttt

SEQ ID NO: 35507 - DNA, 15 bp, Homo sapiens
acttagcattatgtt

SEQ ID NO: 35508 - DNA, 15 bp, Homo sapiens
cacttagcattatgt

SEQ ID NO: 35509 - DNA, 15 bp, Homo sapiens
tcacttagcattatg

SEQ ID NO: 35510 - DNA, 15 bp, Homo sapiens
ttcacttagcattat

SEQ ID NO: 35511 - DNA, 15 bp, Homo sapiens
tttcacttagcatta

SEQ ID NO: 35512 - DNA, 15 bp, Homo sapiens
ctttcacttagcatt

SEQ ID NO: 35513 - DNA, 15 bp, Homo sapiens
tctttcacttagcat

SEQ ID NO: 35514 - DNA, 15 bp, Homo sapiens
gtctttcacttagca

SEQ ID NO: 35515 - DNA, 15 bp, Homo sapiens
cgtctttcacttagc

SEQ ID NO: 35516 - DNA, 15 bp, Homo sapiens
acgtctttcacttag

SEQ ID NO: 35517 - DNA, 15 bp, Homo sapiens
gacgtctttcactta

SEQ ID NO: 35518 - DNA, 15 bp, Homo sapiens
agacgtctttcactt

SEQ ID NO: 35519 - DNA, 15 bp, Homo sapiens
cagacgtctttcact

SEQ ID NO: 35520 - DNA, 15 bp, Homo sapiens
ccagacgtctttcac

SEQ ID NO: 35521 - DNA, 15 bp, Homo sapiens
gccagacgtctttca

SEQ ID NO: 35522 - DNA, 15 bp, Homo sapiens
tgccagacgtctttc

SEQ ID NO: 35523 - DNA, 15 bp, Homo sapiens
gtgccagacgtcttt

SEQ ID NO: 35524 - DNA, 15 bp, Homo sapiens
tgtgccagacgtctt

SEQ ID NO: 35525 - DNA, 15 bp, Homo sapiens
ttgtgccagacgtct

SEQ ID NO: 35526 - DNA, 15 bp, Homo sapiens
tttgtgccagacgtc

SEQ ID NO: 35527 - DNA, 15 bp, Homo sapiens
ttttgtgccagacgt

SEQ ID NO: 35528 - DNA, 15 bp, Homo sapiens
cttttgtgccagacg

SEQ ID NO: 35529 - DNA, 15 bp, Homo sapiens
ccttttgtgccagac

SEQ ID NO: 35530 - DNA, 15 bp, Homo sapiens
accttttgtgccaga

SEQ ID NO: 35531 - DNA, 15 bp, Homo sapiens
caccttttgtgccag

SEQ ID NO: 35532 - DNA, 15 bp, Homo sapiens
tcaccttttgtgcca

SEQ ID NO: 35533 - DNA, 15 bp, Homo sapiens
gtcaccttttgtgcc

SEQ ID NO: 35534 - DNA, 15 bp, Homo sapiens
tgtcaccttttgtgc

SEQ ID NO: 35535 - DNA, 15 bp, Homo sapiens
atgtcaccttttgtg

SEQ ID NO: 35536 - DNA, 15 bp, Homo sapiens
tatgtcaccttttgt

SEQ ID NO: 35537 - DNA, 15 bp, Homo sapiens
atatgtcaccttttg

SEQ ID NO: 35538 - DNA, 15 bp, Homo sapiens
gatatgtcacctttt

SEQ ID NO: 35539 - DNA, 15 bp, Homo sapiens
ggatatgtcaccttt

SEQ ID NO: 35540 - DNA, 15 bp, Homo sapiens
aggatatgtcacctt

SEQ ID NO: 35541 - DNA, 15 bp, Homo sapiens
taggatatgtcacct

SEQ ID NO: 35542 - DNA, 15 bp, Homo sapiens
ataggatatgtcacc

SEQ ID NO: 35543 - DNA, 15 bp, Homo sapiens
cataggatatgtcac

SEQ ID NO: 35544 - DNA, 15 bp, Homo sapiens
tcataggatatgtca

SEQ ID NO: 35545 - DNA, 15 bp, Homo sapiens
atcataggatatgtc

SEQ ID NO: 35546 - DNA, 15 bp, Homo sapiens
aatcataggatatgt

SEQ ID NO: 35547 - DNA, 15 bp, Homo sapiens
gaatcataggatatg

SEQ ID NO: 35548 - DNA, 15 bp, Homo sapiens
ggaatcataggatat

SEQ ID NO: 35549 - DNA, 15 bp, Homo sapiens
tggaatcataggata

SEQ ID NO: 35550 - DNA, 15 bp, Homo sapiens
atggaatcataggat

SEQ ID NO: 35551 - DNA, 15 bp, Homo sapiens
aatggaatcatagga

SEQ ID NO: 35552 - DNA, 15 bp, Homo sapiens
aaatggaatcatagg

SEQ ID NO: 35553 - DNA, 15 bp, Homo sapiens
taaatggaatcatag

SEQ ID NO: 35554 - DNA, 15 bp, Homo sapiens
ataaatggaatcata

SEQ ID NO: 35555 - DNA, 15 bp, Homo sapiens
tataaatggaatcat

SEQ ID NO: 35556 - DNA, 15 bp, Homo sapiens
atataaatggaatca

SEQ ID NO: 35557 - DNA, 15 bp, Homo sapiens
catataaatggaatc

SEQ ID NO: 35558 - DNA, 15 bp, Homo sapiens
tcatataaatggaat

SEQ ID NO: 35559 - DNA, 15 bp, Homo sapiens
ttcatataaatggaa

SEQ ID NO: 35560 - DNA, 15 bp, Homo sapiens
catttcatataaatg

SEQ ID NO: 35561 - DNA, 15 bp, Homo sapiens
acatttcatataaat

SEQ ID NO: 35562 - DNA, 15 bp, Homo sapiens
gacatttcatataaa

SEQ ID NO: 35563 - DNA, 15 bp, Homo sapiens
agacatttcatataa

SEQ ID NO: 35564 - DNA, 15 bp, Homo sapiens
cagacatttcatata

SEQ ID NO: 35565 - DNA, 15 bp, Homo sapiens
gcagacatttcatat

SEQ ID NO: 35566 - DNA, 15 bp, Homo sapiens
ggcagacatttcata

SEQ ID NO: 35567 - DNA, 15 bp, Homo sapiens
tggcagacatttcat

SEQ ID NO: 35568 - DNA, 15 bp, Homo sapiens
gtggcagacatttca

SEQ ID NO: 35569 - DNA, 15 bp, Homo sapiens
agtggcagacatttc

SEQ ID NO: 35570 - DNA, 15 bp, Homo sapiens
cagtggcagacattt

SEQ ID NO: 35571 - DNA, 15 bp, Homo sapiens
ccagtggcagacatt

SEQ ID NO: 35572 - DNA, 15 bp, Homo sapiens
tccagtggcagacat

SEQ ID NO: 35573 - DNA, 15 bp, Homo sapiens
ttccagtggcagaca

SEQ ID NO: 35574 - DNA, 15 bp, Homo sapiens
tttccagtggcagac

SEQ ID NO: 35575 - DNA, 15 bp, Homo sapiens
ttttccagtggcaga

SEQ ID NO: 35576 - DNA, 15 bp, Homo sapiens
attttccagtggcag

SEQ ID NO: 35577 - DNA, 15 bp, Homo sapiens
gattttccagtggca

SEQ ID NO: 35578 - DNA, 15 bp, Homo sapiens
ggattttccagtggc

SEQ ID NO: 35579 - DNA, 15 bp, Homo sapiens
tggattttccagtgg

SEQ ID NO: 35580 - DNA, 15 bp, Homo sapiens
atggattttccagtg

SEQ ID NO: 35581 - DNA, 15 bp, Homo sapiens
tatggattttccagt

SEQ ID NO: 35582 - DNA, 15 bp, Homo sapiens
ttatggattttccag

SEQ ID NO: 35583 - DNA, 15 bp, Homo sapiens
tttatggattttcca

SEQ ID NO: 35584 - DNA, 15 bp, Homo sapiens
ctttatggattttcc

SEQ ID NO: 35585 - DNA, 15 bp, Homo sapiens
tctttatggattttc

SEQ ID NO: 35586 - DNA, 15 bp, Homo sapiens
ctctttatggatttt

SEQ ID NO: 35587 - DNA, 15 bp, Homo sapiens
tctctttatggattt

SEQ ID NO: 35588 - DNA, 15 bp, Homo sapiens
ctctctttatggatt

SEQ ID NO: 35589 - DNA, 15 bp, Homo sapiens
tctctctttatggat

SEQ ID NO: 35590 - DNA, 15 bp, Homo sapiens
ttctctctttatgga

SEQ ID NO: 35591 - DNA, 15 bp, Homo sapiens
tttctctctttatgg

SEQ ID NO: 35592 - DNA, 15 bp, Homo sapiens
ctttctctctttatg

SEQ ID NO: 35593 - DNA, 15 bp, Homo sapiens
actttctctctttat

SEQ ID NO: 35594 - DNA, 15 bp, Homo sapiens
tactttctctcttta

SEQ ID NO: 35595 - DNA, 15 bp, Homo sapiens
ctactttctctcttt

SEQ ID NO: 35596 - DNA, 15 bp, Homo sapiens
cctactttctctctt

SEQ ID NO: 35597 - DNA, 15 bp, Homo sapiens
gcctactttctctct

SEQ ID NO: 35598 - DNA, 15 bp, Homo sapiens
agcctactttctctc

SEQ ID NO: 35599 - DNA, 15 bp, Homo sapiens
tagcctactttctct

SEQ ID NO: 35600 - DNA, 15 bp, Homo sapiens
ctagcctactttctc

SEQ ID NO: 35601 - DNA, 15 bp, Homo sapiens
actagcctactttct

SEQ ID NO: 35602 - DNA, 15 bp, Homo sapiens
cactagcctactttc

SEQ ID NO: 35603 - DNA, 15 bp, Homo sapiens
ccactagcctacttt

SEQ ID NO: 35604 - DNA, 15 bp, Homo sapiens
accactagcctactt

SEQ ID NO: 35605 - DNA, 15 bp, Homo sapiens
aaccactagcctact

SEQ ID NO: 35606 - DNA, 15 bp, Homo sapiens
aaaccactagcctac

SEQ ID NO: 35607 - DNA, 15 bp, Homo sapiens
taaaccactagccta

SEQ ID NO: 35608 - DNA, 15 bp, Homo sapiens
ataaaccactagcct

SEQ ID NO: 35609 - DNA, 15 bp, Homo sapiens
aataaaccactagcc

SEQ ID NO: 35610 - DNA, 15 bp, Homo sapiens
taataaaccactagc

SEQ ID NO: 35611 - DNA, 15 bp, Homo sapiens
ctaataaaccactag

SEQ ID NO: 35612 - DNA, 15 bp, Homo sapiens
cctaataaaccacta

SEQ ID NO: 35613 - DNA, 15 bp, Homo sapiens
ccctaataaaccact

SEQ ID NO: 35614 - DNA, 15 bp, Homo sapiens
gccctaataaaccac

SEQ ID NO: 35615 - DNA, 15 bp, Homo sapiens
agccctaataaacca

SEQ ID NO: 35616 - DNA, 15 bp, Homo sapiens
gagccctaataaacc

SEQ ID NO: 35617 - DNA, 15 bp, Homo sapiens
tgagccctaataaac

SEQ ID NO: 35618 - DNA, 15 bp, Homo sapiens
ctgagccctaataaa

SEQ ID NO: 35619 - DNA, 15 bp, Homo sapiens
tctgagccctaataa

SEQ ID NO: 35620 - DNA, 15 bp, Homo sapiens
ctctgagccctaata

SEQ ID NO: 35621 - DNA, 15 bp, Homo sapiens
cctctgagccctaat

SEQ ID NO: 35622 - DNA, 15 bp, Homo sapiens
gcctctgagccctaa

SEQ ID NO: 35623 - DNA, 15 bp, Homo sapiens
agcctctgagcccta

SEQ ID NO: 35624 - DNA, 15 bp, Homo sapiens
cagcctctgagccct

SEQ ID NO: 35625 - DNA, 15 bp, Homo sapiens
ccagcctctgagccc

SEQ ID NO: 35626 - DNA, 15 bp, Homo sapiens
gccagcctctgagcc

SEQ ID NO: 35627 - DNA, 15 bp, Homo sapiens
tgccagcctctgagc

SEQ ID NO: 35628 - DNA, 15 bp, Homo sapiens
ctgccagcctctgag

SEQ ID NO: 35629 - DNA, 15 bp, Homo sapiens
cctgccagcctctga

SEQ ID NO: 35630 - DNA, 15 bp, Homo sapiens
ccctgccagcctctg

SEQ ID NO: 35631 - DNA, 15 bp, Homo sapiens
tccctgccagcctct

SEQ ID NO: 35632 - DNA, 15 bp, Homo sapiens
ttccctgccagcctc

SEQ ID NO: 35633 - DNA, 15 bp, Homo sapiens
attccctgccagcct

SEQ ID NO: 35634 - DNA, 15 bp, Homo sapiens
cattccctgccagcc

SEQ ID NO: 35635 - DNA, 15 bp, Homo sapiens
ccattccctgccagc

SEQ ID NO: 35636 - DNA, 15 bp, Homo sapiens
cccattccctgccag

SEQ ID NO: 35637 - DNA, 15 bp, Homo sapiens
ccccattccctgcca

SEQ ID NO: 35638 - DNA, 15 bp, Homo sapiens
cccccattccctgcc

SEQ ID NO: 35639 - DNA, 15 bp, Homo sapiens
tcccccattccctgc

SEQ ID NO: 35640 - DNA, 15 bp, Homo sapiens
ctcccccattccctg

SEQ ID NO: 35641 - DNA, 15 bp, Homo sapiens
actcccccattccct

SEQ ID NO: 35642 - DNA, 15 bp, Homo sapiens
tactcccccattccc

SEQ ID NO: 35643 - DNA, 15 bp, Homo sapiens
ttactcccccattcc

SEQ ID NO: 35644 - DNA, 15 bp, Homo sapiens
gttactcccccattc

SEQ ID NO: 35645 - DNA, 15 bp, Homo sapiens
agttactcccccatt

SEQ ID NO: 35646 - DNA, 15 bp, Homo sapiens
cagttactcccccat

SEQ ID NO: 35647 - DNA, 15 bp, Homo sapiens
gcagttactccccca

SEQ ID NO: 35648 - DNA, 15 bp, Homo sapiens
agcagttactccccc

SEQ ID NO: 35649 - DNA, 15 bp, Homo sapiens
tagcagttactcccc

SEQ ID NO: 35650 - DNA, 15 bp, Homo sapiens
ttagcagttactccc

SEQ ID NO: 35651 - DNA, 15 bp, Homo sapiens
attagcagttactcc

SEQ ID NO: 35652 - DNA, 15 bp, Homo sapiens
cattagcagttactc

SEQ ID NO: 35653 - DNA, 15 bp, Homo sapiens
ccattagcagttact

SEQ ID NO: 35654 - DNA, 15 bp, Homo sapiens
cccattagcagttac

SEQ ID NO: 35655 - DNA, 15 bp, Homo sapiens
acccattagcagtta

SEQ ID NO: 35656 - DNA, 15 bp, Homo sapiens
aacccattagcagtt

SEQ ID NO: 35657 - DNA, 15 bp, Homo sapiens
aaacccattagcagt

SEQ ID NO: 35658 - DNA, 15 bp, Homo sapiens
gaaacccattagcag

SEQ ID NO: 35659 - DNA, 15 bp, Homo sapiens
agaaacccattagca

SEQ ID NO: 35660 - DNA, 15 bp, Homo sapiens
aagaaacccattagc

SEQ ID NO: 35661 - DNA, 15 bp, Homo sapiens
aaagaaacccattag

SEQ ID NO: 35662 - DNA, 15 bp, Homo sapiens
gaaagaaacccatta

SEQ ID NO: 35663 - DNA, 15 bp, Homo sapiens
agaaagaaacccatt

SEQ ID NO: 35664 - DNA, 15 bp, Homo sapiens
cagaaagaaacccat

SEQ ID NO: 35665 - DNA, 15 bp, Homo sapiens
ccagaaagaaaccca

SEQ ID NO: 35666 - DNA, 15 bp, Homo sapiens
cccagaaagaaaccc

SEQ ID NO: 35667 - DNA, 15 bp, Homo sapiens
ccccagaaagaaacc

SEQ ID NO: 35668 - DNA, 15 bp, Homo sapiens
accccagaaagaaac

SEQ ID NO: 35669 - DNA, 15 bp, Homo sapiens
caccccagaaagaaa

SEQ ID NO: 35670 - DNA, 15 bp, Homo sapiens
tcaccccagaaagaa

SEQ ID NO: 35671 - DNA, 15 bp, Homo sapiens
atcaccccagaaaga

SEQ ID NO: 35672 - DNA, 15 bp, Homo sapiens
catcaccccagaaag

SEQ ID NO: 35673 - DNA, 15 bp, Homo sapiens
tcatcaccccagaaa

SEQ ID NO: 35674 - DNA, 15 bp, Homo sapiens
ttcatcaccccagaa

SEQ ID NO: 35675 - DNA, 15 bp, Homo sapiens
tttcatcaccccaga

SEQ ID NO: 35676 - DNA, 15 bp, Homo sapiens
ctttcatcaccccag

SEQ ID NO: 35677 - DNA, 15 bp, Homo sapiens
actttcatcacccca

SEQ ID NO: 35678 - DNA, 15 bp, Homo sapiens
cactttcatcacccc

SEQ ID NO: 35679 - DNA, 15 bp, Homo sapiens
acactttcatcaccc

SEQ ID NO: 35680 - DNA, 15 bp, Homo sapiens
gacactttcatcacc

SEQ ID NO: 35681 - DNA, 15 bp, Homo sapiens
agacactttcatcac

SEQ ID NO: 35682 - DNA, 15 bp, Homo sapiens
cagacactttcatca

SEQ ID NO: 35683 - DNA, 15 bp, Homo sapiens
ccagacactttcatc

SEQ ID NO: 35684 - DNA, 15 bp, Homo sapiens
tccagacactttcat

SEQ ID NO: 35685 - DNA, 15 bp, Homo sapiens
ttccagacactttca

SEQ ID NO: 35686 - DNA, 15 bp, Homo sapiens
attccagacactttc

SEQ ID NO: 35687 - DNA, 15 bp, Homo sapiens
aattccagacacttt

SEQ ID NO: 35688 - DNA, 15 bp, Homo sapiens
taattccagacactt

SEQ ID NO: 35689 - DNA, 15 bp, Homo sapiens
ttaattccagacact

SEQ ID NO: 35690 - DNA, 15 bp, Homo sapiens
cttaattccagacac

SEQ ID NO: 35691 - DNA, 15 bp, Homo sapiens
tcttaattccagaca

SEQ ID NO: 35692 - DNA, 15 bp, Homo sapiens
atcttaattccagac

SEQ ID NO: 35693 - DNA, 15 bp, Homo sapiens
aatcttaattccaga

SEQ ID NO: 35694 - DNA, 15 bp, Homo sapiens
caatcttaattccag

SEQ ID NO: 35695 - DNA, 15 bp, Homo sapiens
ccaatcttaattcca

SEQ ID NO: 35696 - DNA, 15 bp, Homo sapiens
tccaatcttaattcc

SEQ ID NO: 35697 - DNA, 15 bp, Homo sapiens
atccaatcttaattc

SEQ ID NO: 35698 - DNA, 15 bp, Homo sapiens
catccaatcttaatt

SEQ ID NO: 35699 - DNA, 15 bp, Homo sapiens
tcatccaatcttaat

SEQ ID NO: 35700 - DNA, 15 bp, Homo sapiens
atcatccaatcttaa

SEQ ID NO: 35701 - DNA, 15 bp, Homo sapiens
aatcatccaatctta

SEQ ID NO: 35702 - DNA, 15 bp, Homo sapiens
caatcatccaatctt

SEQ ID NO: 35703 - DNA, 15 bp, Homo sapiens
acaatcatccaatct

SEQ ID NO: 35704 - DNA, 15 bp, Homo sapiens
gacaatcatccaatc

SEQ ID NO: 35705 - DNA, 15 bp, Homo sapiens
cgacaatcatccaat

SEQ ID NO: 35706 - DNA, 15 bp, Homo sapiens
gcgacaatcatccaa

SEQ ID NO: 35707 - DNA, 15 bp, Homo sapiens
tgcgacaatcatcca

SEQ ID NO: 35708 - DNA, 15 bp, Homo sapiens
gtgcgacaatcatcc

SEQ ID NO: 35709 - DNA, 15 bp, Homo sapiens
tgtgcgacaatcatc

SEQ ID NO: 35710 - DNA, 15 bp, Homo sapiens
ttgtgcgacaatcat

SEQ ID NO: 35711 - DNA, 15 bp, Homo sapiens
gttgtgcgacaatca

SEQ ID NO: 35712 - DNA, 15 bp, Homo sapiens
agttgtgcgacaatc

SEQ ID NO: 35713 - DNA, 15 bp, Homo sapiens
aagttgtgcgacaat

SEQ ID NO: 35714 - DNA, 15 bp, Homo sapiens
aaagttgtgcgacaa

SEQ ID NO: 35715 - DNA, 15 bp, Homo sapiens
caaagttgtgcgaca

SEQ ID NO: 35716 - DNA, 15 bp, Homo sapiens
acaaagttgtgcgac

SEQ ID NO: 35717 - DNA, 15 bp, Homo sapiens
cacaaagttgtgcga

SEQ ID NO: 35718 - DNA, 15 bp, Homo sapiens
gcacaaagttgtgcg

SEQ ID NO: 35719 - DNA, 15 bp, Homo sapiens
tgcacaaagttgtgc

SEQ ID NO: 35720 - DNA, 15 bp, Homo sapiens
atgcacaaagttgtg

SEQ ID NO: 35721 - DNA, 15 bp, Homo sapiens
tatgcacaaagttgt

SEQ ID NO: 35722 - DNA, 15 bp, Homo sapiens
gtatgcacaaagttg

SEQ ID NO: 35723 - DNA, 15 bp, Homo sapiens
tgtatgcacaaagtt

SEQ ID NO: 35724 - DNA, 15 bp, Homo sapiens
ctgtatgcacaaagt

SEQ ID NO: 35725 - DNA, 15 bp, Homo sapiens
actgtatgcacaaag

SEQ ID NO: 35726 - DNA, 15 bp, Homo sapiens
tactgtatgcacaaa

SEQ ID NO: 35727 - DNA, 15 bp, Homo sapiens
ttactgtatgcacaa

SEQ ID NO: 35728 - DNA, 15 bp, Homo sapiens
tttactgtatgcaca

SEQ ID NO: 35729 - DNA, 15 bp, Homo sapiens
ttttactgtatgcac

SEQ ID NO: 35730 - DNA, 15 bp, Homo sapiens
tttttactgtatgca

SEQ ID NO: 35731 - DNA, 15 bp, Homo sapiens
ttttttactgtatgc

SEQ ID NO: 35732 - DNA, 15 bp, Homo sapiens
gttttttactgtatg

SEQ ID NO: 35733 - DNA, 15 bp, Homo sapiens
ggttttttactgtat

SEQ ID NO: 35734 - DNA, 15 bp, Homo sapiens
tggttttttactgta

SEQ ID NO: 35735 - DNA, 15 bp, Homo sapiens
gtggttttttactgt

SEQ ID NO: 35736 - DNA, 15 bp, Homo sapiens
tgtggttttttactg

SEQ ID NO: 35737 - DNA, 15 bp, Homo sapiens
ctgtggttttttact

SEQ ID NO: 35738 - DNA, 15 bp, Homo sapiens
tctgtggttttttac

SEQ ID NO: 35739 - DNA, 15 bp, Homo sapiens
ttctgtggtttttta

SEQ ID NO: 35740 - DNA, 15 bp, Homo sapiens
attctgtggtttttt

SEQ ID NO: 35741 - DNA, 15 bp, Homo sapiens
gattctgtggttttt

SEQ ID NO: 35742 - DNA, 15 bp, Homo sapiens
cgattctgtggtttt

SEQ ID NO: 35743 - DNA, 15 bp, Homo sapiens
acgattctgtggttt

SEQ ID NO: 35744 - DNA, 15 bp, Homo sapiens
tacgattctgtggtt

SEQ ID NO: 35745 - DNA, 15 bp, Homo sapiens
gtacgattctgtggt

SEQ ID NO: 35746 - DNA, 15 bp, Homo sapiens
tgtacgattctgtgg

SEQ ID NO: 35747 - DNA, 15 bp, Homo sapiens
atgtacgattctgtg

SEQ ID NO: 35748 - DNA, 15 bp, Homo sapiens
gatgtacgattctgt

SEQ ID NO: 35749 - DNA, 15 bp, Homo sapiens
ggatgtacgattctg

SEQ ID NO: 35750 - DNA, 15 bp, Homo sapiens
cggatgtacgattct

SEQ ID NO: 35751 - DNA, 15 bp, Homo sapiens
acggatgtacgattc

SEQ ID NO: 35752 - DNA, 15 bp, Homo sapiens
aacggatgtacgatt

SEQ ID NO: 35753 - DNA, 15 bp, Homo sapiens
taacggatgtacgat

SEQ ID NO: 35754 - DNA, 15 bp, Homo sapiens
ttaacggatgtacga

SEQ ID NO: 35755 - DNA, 15 bp, Homo sapiens
tttaacggatgtacg

SEQ ID NO: 35756 - DNA, 15 bp, Homo sapiens
atttaacggatgtac

SEQ ID NO: 35757 - DNA, 15 bp, Homo sapiens
gatttaacggatgta

SEQ ID NO: 35758 - DNA, 15 bp, Homo sapiens
ggatttaacggatgt

SEQ ID NO: 35759 - DNA, 15 bp, Homo sapiens
cggatttaacggatg

SEQ ID NO: 35760 - DNA, 15 bp, Homo sapiens
ccggatttaacggat

SEQ ID NO: 35761 - DNA, 15 bp, Homo sapiens
tccggatttaacgga

SEQ ID NO: 35762 - DNA, 15 bp, Homo sapiens
atccggatttaacgg

SEQ ID NO: 35763 - DNA, 15 bp, Homo sapiens
catccggatttaacg

SEQ ID NO: 35764 - DNA, 15 bp, Homo sapiens
ccatccggatttaac

SEQ ID NO: 35765 - DNA, 15 bp, Homo sapiens
tccatccggatttaa

SEQ ID NO: 35766 - DNA, 15 bp, Homo sapiens
atccatccggattta

SEQ ID NO: 35767 - DNA, 15 bp, Homo sapiens
aatccatccggattt

SEQ ID NO: 35768 - DNA, 15 bp, Homo sapiens
aaatccatccggatt

SEQ ID NO: 35769 - DNA, 15 bp, Homo sapiens
aaaatccatccggat

SEQ ID NO: 35770 - DNA, 15 bp, Homo sapiens
taaaatccatccgga

SEQ ID NO: 35771 - DNA, 15 bp, Homo sapiens
ataaaatccatccgg

SEQ ID NO: 35772 - DNA, 15 bp, Homo sapiens
cataaaatccatccg

SEQ ID NO: 35773 - DNA, 15 bp, Homo sapiens
ccataaaatccatcc

SEQ ID NO: 35774 - DNA, 15 bp, Homo sapiens
gccataaaatccatc

SEQ ID NO: 35775 - DNA, 15 bp, Homo sapiens
cgccataaaatccat

SEQ ID NO: 35776 - DNA, 15 bp, Homo sapiens
acgccataaaatcca

SEQ ID NO: 35777 - DNA, 15 bp, Homo sapiens
cacgccataaaatcc

SEQ ID NO: 35778 - DNA, 15 bp, Homo sapiens
acacgccataaaatc

SEQ ID NO: 35779 - DNA, 15 bp, Homo sapiens
cacacgccataaaat

SEQ ID NO: 35780 - DNA, 15 bp, Homo sapiens
tcacacgccataaaa

SEQ ID NO: 35781 - DNA, 15 bp, Homo sapiens
ttcacacgccataaa

SEQ ID NO: 35782 - DNA, 15 bp, Homo sapiens
attcacacgccataa

SEQ ID NO: 35783 - DNA, 15 bp, Homo sapiens
aattcacacgccata

SEQ ID NO: 35784 - DNA, 15 bp, Homo sapiens
taattcacacgccat

SEQ ID NO: 35785 - DNA, 15 bp, Homo sapiens
gtaattcacacgcca

SEQ ID NO: 35786 - DNA, 15 bp, Homo sapiens
tgtaattcacacgcc

SEQ ID NO: 35787 - DNA, 15 bp, Homo sapiens
atgtaattcacacgc

SEQ ID NO: 35788 - DNA, 15 bp, Homo sapiens
gatgtaattcacacg

SEQ ID NO: 35789 - DNA, 15 bp, Homo sapiens
ggatgtaattcacac

SEQ ID NO: 35790 - DNA, 15 bp, Homo sapiens
gggatgtaattcaca

SEQ ID NO: 35791 - DNA, 15 bp, Homo sapiens
tgggatgtaattcac

SEQ ID NO: 35792 - DNA, 15 bp, Homo sapiens
ttgggatgtaattca

SEQ ID NO: 35793 - DNA, 15 bp, Homo sapiens
attgggatgtaattc

SEQ ID NO: 35794 - DNA, 15 bp, Homo sapiens
cattgggatgtaatt

SEQ ID NO: 35795 - DNA, 15 bp, Homo sapiens
tcattgggatgtaat

SEQ ID NO: 35796 - DNA, 15 bp, Homo sapiens
gtcattgggatgtaa

SEQ ID NO: 35797 - DNA, 15 bp, Homo sapiens
tgtcattgggatgta

SEQ ID NO: 35798 - DNA, 15 bp, Homo sapiens
ttgtcattgggatgt

SEQ ID NO: 35799 - DNA, 15 bp, Homo sapiens
tttgtcattgggatg

SEQ ID NO: 35800 - DNA, 15 bp, Homo sapiens
ttttgtcattgggat

SEQ ID NO: 35801 - DNA, 15 bp, Homo sapiens
tttttgtcattggga

SEQ ID NO: 35802 - DNA, 15 bp, Homo sapiens
ttttttgtcattggg

SEQ ID NO: 35803 - DNA, 15 bp, Homo sapiens
attttttgtcattgg

SEQ ID NO: 35804 - DNA, 15 bp, Homo sapiens
tattttttgtcattg

SEQ ID NO: 35805 - DNA, 15 bp, Homo sapiens
ctattttttgtcatt

SEQ ID NO: 35806 - DNA, 15 bp, Homo sapiens
cctattttttgtcat

SEQ ID NO: 35807 - DNA, 15 bp, Homo sapiens
tcctattttttgtca

SEQ ID NO: 35808 - DNA, 15 bp, Homo sapiens
atcctattttttgtc

SEQ ID NO: 35809 - DNA, 15 bp, Homo sapiens
tatcctattttttgt

SEQ ID NO: 35810 - DNA, 15 bp, Homo sapiens
ttatcctattttttg

SEQ ID NO: 35811 - DNA, 15 bp, Homo sapiens
attatcctatttttt

SEQ ID NO: 35812 - DNA, 15 bp, Homo sapiens
tattatcctattttt

SEQ ID NO: 35813 - DNA, 15 bp, Homo sapiens
ctattatcctatttt

SEQ ID NO: 35814 - DNA, 15 bp, Homo sapiens
gctattatcctattt

SEQ ID NO: 35815 - DNA, 15 bp, Homo sapiens
agctattatcctatt

SEQ ID NO: 35816 - DNA, 15 bp, Homo sapiens
cagctattatcctat

SEQ ID NO: 35817 - DNA, 15 bp, Homo sapiens
ccagctattatccta

SEQ ID NO: 35818 - DNA, 15 bp, Homo sapiens
cccagctattatcct

SEQ ID NO: 35819 - DNA, 15 bp, Homo sapiens
tcccagctattatcc

SEQ ID NO: 35820 - DNA, 15 bp, Homo sapiens
ctcccagctattatc

SEQ ID NO: 35821 - DNA, 15 bp, Homo sapiens
cctcccagctattat

SEQ ID NO: 35822 - DNA, 15 bp, Homo sapiens
acctcccagctatta

SEQ ID NO: 35823 - DNA, 15 bp, Homo sapiens
cacctcccagctatt

SEQ ID NO: 35824 - DNA, 15 bp, Homo sapiens
ccacctcccagctat

SEQ ID NO: 35825 - DNA, 15 bp, Homo sapiens
accacctcccagcta

SEQ ID NO: 35826 - DNA, 15 bp, Homo sapiens
taccacctcccagct

SEQ ID NO: 35827 - DNA, 15 bp, Homo sapiens
gtaccacctcccagc

SEQ ID NO: 35828 - DNA, 15 bp, Homo sapiens
ggtaccacctcccag

SEQ ID NO: 35829 - DNA, 15 bp, Homo sapiens
tggtaccacctccca

SEQ ID NO: 35830 - DNA, 15 bp, Homo sapiens
atggtaccacctccc

SEQ ID NO: 35831 - DNA, 15 bp, Homo sapiens
catggtaccacctcc

SEQ ID NO: 35832 - DNA, 15 bp, Homo sapiens
gcatggtaccacctc

SEQ ID NO: 35833 - DNA, 15 bp, Homo sapiens
ggcatggtaccacct

SEQ ID NO: 35834 - DNA, 15 bp, Homo sapiens
gggcatggtaccacc

SEQ ID NO: 35835 - DNA, 15 bp, Homo sapiens
ggggcatggtaccac

SEQ ID NO: 35836 - DNA, 15 bp, Homo sapiens
aggggcatggtacca

SEQ ID NO: 35837 - DNA, 15 bp, Homo sapiens
taggggcatggtacc

SEQ ID NO: 35838 - DNA, 15 bp, Homo sapiens
ttaggggcatggtac

SEQ ID NO: 35839 - DNA, 15 bp, Homo sapiens
gttaggggcatggta

SEQ ID NO: 35840 - DNA, 15 bp, Homo sapiens
tgttaggggcatggt

SEQ ID NO: 35841 - DNA, 15 bp, Homo sapiens
atgttaggggcatgg

SEQ ID NO: 35842 - DNA, 15 bp, Homo sapiens
catgttaggggcatg

SEQ ID NO: 35843 - DNA, 15 bp, Homo sapiens
ccatgttaggggcat

SEQ ID NO: 35844 - DNA, 15 bp, Homo sapiens
accatgttaggggca

SEQ ID NO: 35845 - DNA, 15 bp, Homo sapiens
taccatgttaggggc

SEQ ID NO: 35846 - DNA, 15 bp, Homo sapiens
ttaccatgttagggg

SEQ ID NO: 35847 - DNA, 15 bp, Homo sapiens
cttaccatgttaggg

SEQ ID NO: 35848 - DNA, 15 bp, Homo sapiens
gcttaccatgttagg

SEQ ID NO: 35849 - DNA, 15 bp, Homo sapiens
tgcttaccatgttag

SEQ ID NO: 35850 - DNA, 15 bp, Homo sapiens
gtgcttaccatgtta

SEQ ID NO: 35851 - DNA, 15 bp, Homo sapiens
agtgcttaccatgtt

SEQ ID NO: 35852 - DNA, 15 bp, Homo sapiens
gagtgcttaccatgt

SEQ ID NO: 35853 - DNA, 15 bp, Homo sapiens
agagtgcttaccatg

SEQ ID NO: 35854 - DNA, 15 bp, Homo sapiens
tagagtgcttaccat

SEQ ID NO: 35855 - DNA, 15 bp, Homo sapiens
atagagtgcttacca

SEQ ID NO: 35856 - DNA, 15 bp, Homo sapiens
catagagtgcttacc

SEQ ID NO: 35857 - DNA, 15 bp, Homo sapiens
acatagagtgcttac

SEQ ID NO: 35858 - DNA, 15 bp, Homo sapiens
cacatagagtgctta

SEQ ID NO: 35859 - DNA, 15 bp, Homo sapiens
acacatagagtgctt

SEQ ID NO: 35860 - DNA, 15 bp, Homo sapiens
aacacatagagtgct

SEQ ID NO: 35861 - DNA, 15 bp, Homo sapiens
taacacatagagtgc

SEQ ID NO: 35862 - DNA, 15 bp, Homo sapiens
ctaacacatagagtg

SEQ ID NO: 35863 - DNA, 15 bp, Homo sapiens
actaacacatagagt

SEQ ID NO: 35864 - DNA, 15 bp, Homo sapiens
aactaacacatagag

SEQ ID NO: 35865 - DNA, 15 bp, Homo sapiens
taactaacacataga

SEQ ID NO: 35866 - DNA, 15 bp, Homo sapiens
ataactaacacatag

SEQ ID NO: 35867 - DNA, 15 bp, Homo sapiens
aataactaacacata

SEQ ID NO: 35868 - DNA, 15 bp, Homo sapiens
aaataactaacacat

SEQ ID NO: 35869 - DNA, 15 bp, Homo sapiens
gaaataactaacaca

SEQ ID NO: 35870 - DNA, 15 bp, Homo sapiens
agaaataactaacac

SEQ ID NO: 35871 - DNA, 15 bp, Homo sapiens
cagaaataactaaca

SEQ ID NO: 35872 - DNA, 15 bp, Homo sapiens
gcagaaataactaac

SEQ ID NO: 35873 - DNA, 15 bp, Homo sapiens
agcagaaataactaa

SEQ ID NO: 35874 - DNA, 15 bp, Homo sapiens
cagcagaaataacta

SEQ ID NO: 35875 - DNA, 15 bp, Homo sapiens
gcagcagaaataact

SEQ ID NO: 35876 - DNA, 15 bp, Homo sapiens
agcagcagaaataac

SEQ ID NO: 35877 - DNA, 15 bp, Homo sapiens
cagcagcagaaataa

SEQ ID NO: 35878 - DNA, 15 bp, Homo sapiens
gcagcagcagaaata

SEQ ID NO: 35879 - DNA, 15 bp, Homo sapiens
agcagcagcagaaat

SEQ ID NO: 35880 - DNA, 15 bp, Homo sapiens
cagcagcagcagaaa

SEQ ID NO: 35881 - DNA, 15 bp, Homo sapiens
acagcagcagcagaa

SEQ ID NO: 35882 - DNA, 15 bp, Homo sapiens
gacagcagcagcaga

SEQ ID NO: 35883 - DNA, 15 bp, Homo sapiens
tgacagcagcagcag

SEQ ID NO: 35884 - DNA, 15 bp, Homo sapiens
atgacagcagcagca

SEQ ID NO: 35885 - DNA, 15 bp, Homo sapiens
gatgacagcagcagc

SEQ ID NO: 35886 - DNA, 15 bp, Homo sapiens
tgatgacagcagcag

SEQ ID NO: 35887 - DNA, 15 bp, Homo sapiens
atgatgacagcagca

SEQ ID NO: 35888 - DNA, 15 bp, Homo sapiens
aatgatgacagcagc

SEQ ID NO: 35889 - DNA, 15 bp, Homo sapiens
aaatgatgacagcag

SEQ ID NO: 35890 - DNA, 15 bp, Homo sapiens
aaaatgatgacagca

SEQ ID NO: 35891 - DNA, 15 bp, Homo sapiens
gaaaatgatgacagc

SEQ ID NO: 35892 - DNA, 15 bp, Homo sapiens
tgaaaatgatgacag

SEQ ID NO: 35893 - DNA, 15 bp, Homo sapiens
atgaaaatgatgaca

SEQ ID NO: 35894 - DNA, 15 bp, Homo sapiens
aatgaaaatgatgac

SEQ ID NO: 35895 - DNA, 15 bp, Homo sapiens
caatgaaaatgatga

SEQ ID NO: 35896 - DNA, 15 bp, Homo sapiens
acaatgaaaatgatg

SEQ ID NO: 35897 - DNA, 15 bp, Homo sapiens
aacaatgaaaatgat

SEQ ID NO: 35898 - DNA, 15 bp, Homo sapiens
taacaatgaaaatga

SEQ ID NO: 35899 - DNA, 15 bp, Homo sapiens
gtaacaatgaaaatg

SEQ ID NO: 35900 - DNA, 15 bp, Homo sapiens
agtaacaatgaaaat

SEQ ID NO: 35901 - DNA, 15 bp, Homo sapiens
tagtaacaatgaaaa

SEQ ID NO: 35902 - DNA, 15 bp, Homo sapiens
gtagtaacaatgaaa

SEQ ID NO: 35903 - DNA, 15 bp, Homo sapiens
tgtagtaacaatgaa

SEQ ID NO: 35904 - DNA, 15 bp, Homo sapiens
ttgtagtaacaatga

SEQ ID NO: 35905 - DNA, 15 bp, Homo sapiens
tttgtagtaacaatg

SEQ ID NO: 35906 - DNA, 15 bp, Homo sapiens
ttttgtagtaacaat

SEQ ID NO: 35907 - DNA, 15 bp, Homo sapiens
attttgtagtaacaa

SEQ ID NO: 35908 - DNA, 15 bp, Homo sapiens
gattttgtagtaaca

SEQ ID NO: 35909 - DNA, 15 bp, Homo sapiens
tgattttgtagtaac

SEQ ID NO: 35910 - DNA, 15 bp, Homo sapiens
ttgattttgtagtaa

SEQ ID NO: 35911 - DNA, 15 bp, Homo sapiens
attgattttgtagta

SEQ ID NO: 35912 - DNA, 15 bp, Homo sapiens
aattgattttgtagt

SEQ ID NO: 35913 - DNA, 15 bp, Homo sapiens
gaattgattttgtag

SEQ ID NO: 35914 - DNA, 15 bp, Homo sapiens
ggaattgattttgta

SEQ ID NO: 35915 - DNA, 15 bp, Homo sapiens
tggaattgattttgt

SEQ ID NO: 35916 - DNA, 15 bp, Homo sapiens
atggaattgattttg

SEQ ID NO: 35917 - DNA, 15 bp, Homo sapiens
aatggaattgatttt

SEQ ID NO: 35918 - DNA, 15 bp, Homo sapiens
gaatggaattgattt

SEQ ID NO: 35919 - DNA, 15 bp, Homo sapiens
tgaatggaattgatt

SEQ ID NO: 35920 - DNA, 15 bp, Homo sapiens
atgaatggaattgat

SEQ ID NO: 35921 - DNA, 15 bp, Homo sapiens
aatgaatggaattga

SEQ ID NO: 35922 - DNA, 15 bp, Homo sapiens
taatgaatggaattg

SEQ ID NO: 35923 - DNA, 15 bp, Homo sapiens
ataatgaatggaatt

SEQ ID NO: 35924 - DNA, 15 bp, Homo sapiens
aataatgaatggaat

SEQ ID NO: 35925 - DNA, 15 bp, Homo sapiens
gaataatgaatggaa

SEQ ID NO: 35926 - DNA, 15 bp, Homo sapiens
ggaataatgaatgga

SEQ ID NO: 35927 - DNA, 15 bp, Homo sapiens
aggaataatgaatgg

SEQ ID NO: 35928 - DNA, 15 bp, Homo sapiens
taggaataatgaatg

SEQ ID NO: 35929 - DNA, 15 bp, Homo sapiens
ttaggaataatgaat

SEQ ID NO: 35930 - DNA, 15 bp, Homo sapiens
tttaggaataatgaa

SEQ ID NO: 35931 - DNA, 15 bp, Homo sapiens
ttttaggaataatga

SEQ ID NO: 35932 - DNA, 15 bp, Homo sapiens
tttttaggaataatg

SEQ ID NO: 35933 - DNA, 15 bp, Homo sapiens
atttttaggaataat

SEQ ID NO: 35934 - DNA, 15 bp, Homo sapiens
tatttttaggaataa

SEQ ID NO: 35935 - DNA, 15 bp, Homo sapiens
atatttttaggaata

SEQ ID NO: 35936 - DNA, 15 bp, Homo sapiens
gatatttttaggaat

SEQ ID NO: 35937 - DNA, 15 bp, Homo sapiens
tgatatttttaggaa

SEQ ID NO: 35938 - DNA, 15 bp, Homo sapiens
ttgatatttttagga

SEQ ID NO: 35939 - DNA, 15 bp, Homo sapiens
attgatatttttagg

SEQ ID NO: 35940 - DNA, 15 bp, Homo sapiens
aattgatatttttag

SEQ ID NO: 35941 - DNA, 15 bp, Homo sapiens
aaattgatattttta

SEQ ID NO: 35942 - DNA, 15 bp, Homo sapiens
gaaattgatattttt

SEQ ID NO: 35943 - DNA, 15 bp, Homo sapiens
agaaattgatatttt

SEQ ID NO: 35944 - DNA, 15 bp, Homo sapiens
aagaaattgatattt

SEQ ID NO: 35945 - DNA, 15 bp, Homo sapiens
taagaaattgatatt

SEQ ID NO: 35946 - DNA, 15 bp, Homo sapiens
ataagaaattgatat

SEQ ID NO: 35947 - DNA, 15 bp, Homo sapiens
cataagaaattgata

SEQ ID NO: 35948 - DNA, 15 bp, Homo sapiens
ccataagaaattgat

SEQ ID NO: 35949 - DNA, 15 bp, Homo sapiens
accataagaaattga

SEQ ID NO: 35950 - DNA, 15 bp, Homo sapiens
aaccataagaaattg

SEQ ID NO: 35951 - DNA, 15 bp, Homo sapiens
taaccataagaaatt

SEQ ID NO: 35952 - DNA, 15 bp, Homo sapiens
ataaccataagaaat

SEQ ID NO: 35953 - DNA, 15 bp, Homo sapiens
tataaccataagaaa

SEQ ID NO: 35954 - DNA, 15 bp, Homo sapiens
atataaccataagaa

SEQ ID NO: 35955 - DNA, 15 bp, Homo sapiens
aatataaccataaga

SEQ ID NO: 35956 - DNA, 15 bp, Homo sapiens
taatataaccataag

SEQ ID NO: 35957 - DNA, 15 bp, Homo sapiens
ataatataaccataa

SEQ ID NO: 35958 - DNA, 15 bp, Homo sapiens
aataatataaccata

SEQ ID NO: 35959 - DNA, 15 bp, Homo sapiens
aaataatataaccat

SEQ ID NO: 35960 - DNA, 15 bp, Homo sapiens
gaaataatataacca

SEQ ID NO: 35961 - DNA, 15 bp, Homo sapiens
agaaataatataacc

SEQ ID NO: 35962 - DNA, 15 bp, Homo sapiens
tagaaataatataac

SEQ ID NO: 35963 - DNA, 15 bp, Homo sapiens
ctagaaataatataa

SEQ ID NO: 35964 - DNA, 15 bp, Homo sapiens
actagaaataatata

SEQ ID NO: 35965 - DNA, 15 bp, Homo sapiens
aactagaaataatat

SEQ ID NO: 35966 - DNA, 15 bp, Homo sapiens
gaactagaaataata

SEQ ID NO: 35967 - DNA, 15 bp, Homo sapiens
agaactagaaataat

SEQ ID NO: 35968 - DNA, 15 bp, Homo sapiens
aagaactagaaataa

SEQ ID NO: 35969 - DNA, 15 bp, Homo sapiens
aaagaactagaaata

SEQ ID NO: 35970 - DNA, 15 bp, Homo sapiens
aaaagaactagaaat

SEQ ID NO: 35971 - DNA, 15 bp, Homo sapiens
gaaaagaactagaaa

SEQ ID NO: 35972 - DNA, 15 bp, Homo sapiens
agaaaagaactagaa

SEQ ID NO: 35973 - DNA, 15 bp, Homo sapiens
aagaaaagaactaga

SEQ ID NO: 35974 - DNA, 15 bp, Homo sapiens
gaagaaaagaactag

SEQ ID NO: 35975 - DNA, 15 bp, Homo sapiens
tgaagaaaagaacta

SEQ ID NO: 35976 - DNA, 15 bp, Homo sapiens
ttgaagaaaagaact

SEQ ID NO: 35977 - DNA, 15 bp, Homo sapiens
tttgaagaaaagaac

SEQ ID NO: 35978 - DNA, 15 bp, Homo sapiens
atttgaagaaaagaa

SEQ ID NO: 35979 - DNA, 15 bp, Homo sapiens
aatttgaagaaaaga

SEQ ID NO: 35980 - DNA, 15 bp, Homo sapiens
taatttgaagaaaag

SEQ ID NO: 35981 - DNA, 15 bp, Homo sapiens
gtaatttgaagaaaa

SEQ ID NO: 35982 - DNA, 15 bp, Homo sapiens
tgtaatttgaagaaa

SEQ ID NO: 35983 - DNA, 15 bp, Homo sapiens
gtgtaatttgaagaa

SEQ ID NO: 35984 - DNA, 15 bp, Homo sapiens
tgtgtaatttgaaga

SEQ ID NO: 35985 - DNA, 15 bp, Homo sapiens
ttgtgtaatttgaag

SEQ ID NO: 35986 - DNA, 15 bp, Homo sapiens
tttgtgtaatttgaa

SEQ ID NO: 35987 - DNA, 15 bp, Homo sapiens
atttgtgtaatttga

SEQ ID NO: 35988 - DNA, 15 bp, Homo sapiens
tatttgtgtaatttg

SEQ ID NO: 35989 - DNA, 15 bp, Homo sapiens
atatttgtgtaattt

SEQ ID NO: 35990 - DNA, 15 bp, Homo sapiens
aatatttgtgtaatt

SEQ ID NO: 35991 - DNA, 15 bp, Homo sapiens
taatatttgtgtaat

SEQ ID NO: 35992 - DNA, 15 bp, Homo sapiens
ctaatatttgtgtaa

SEQ ID NO: 35993 - DNA, 15 bp, Homo sapiens
gctaatatttgtgta

SEQ ID NO: 35994 - DNA, 15 bp, Homo sapiens
ggctaatatttgtgt

SEQ ID NO: 35995 - DNA, 15 bp, Homo sapiens
tggctaatatttgtg

SEQ ID NO: 35996 - DNA, 15 bp, Homo sapiens
gtggctaatatttgt

SEQ ID NO: 35997 - DNA, 15 bp, Homo sapiens
agtggctaatatttg

SEQ ID NO: 35998 - DNA, 15 bp, Homo sapiens
gagtggctaatattt

SEQ ID NO: 35999 - DNA, 15 bp, Homo sapiens
tgagtggctaatatt

SEQ ID NO: 36000 - DNA, 15 bp, Homo sapiens
ctgagtggctaatat

SEQ ID NO: 36001 - DNA, 15 bp, Homo sapiens
actgagtggctaata

SEQ ID NO: 36002 - DNA, 15 bp, Homo sapiens
cactgagtggctaat

SEQ ID NO: 36003 - DNA, 15 bp, Homo sapiens
gcactgagtggctaa

SEQ ID NO: 36004 - DNA, 15 bp, Homo sapiens
agcactgagtggcta

SEQ ID NO: 36005 - DNA, 15 bp, Homo sapiens
aagcactgagtggct

SEQ ID NO: 36006 - DNA, 15 bp, Homo sapiens
caagcactgagtggc

SEQ ID NO: 36007 - DNA, 15 bp, Homo sapiens
gcaagcactgagtgg

SEQ ID NO: 36008 - DNA, 15 bp, Homo sapiens
tgcaagcactgagtg

SEQ ID NO: 36009 - DNA, 15 bp, Homo sapiens
ctgcaagcactgagt

SEQ ID NO: 36010 - DNA, 15 bp, Homo sapiens
tctgcaagcactgag

SEQ ID NO: 36011 - DNA, 15 bp, Homo sapiens
ttctgcaagcactga

SEQ ID NO: 36012 - DNA, 15 bp, Homo sapiens
attctgcaagcactg

SEQ ID NO: 36013 - DNA, 15 bp, Homo sapiens
tattctgcaagcact

SEQ ID NO: 36014 - DNA, 15 bp, Homo sapiens
atattctgcaagcac

SEQ ID NO: 36015 - DNA, 15 bp, Homo sapiens
aatattctgcaagca

SEQ ID NO: 36016 - DNA, 15 bp, Homo sapiens
aaatattctgcaagc

SEQ ID NO: 36017 - DNA, 15 bp, Homo sapiens
aaaatattctgcaag

SEQ ID NO: 36018 - DNA, 15 bp, Homo sapiens
gaaaatattctgcaa

SEQ ID NO: 36019 - DNA, 15 bp, Homo sapiens
tgaaaatattctgca

SEQ ID NO: 36020 - DNA, 15 bp, Homo sapiens
ttgaaaatattctgc

SEQ ID NO: 36021 - DNA, 15 bp, Homo sapiens
tttgaaaatattctg

SEQ ID NO: 36022 - DNA, 15 bp, Homo sapiens
ctttgaaaatattct

SEQ ID NO: 36023 - DNA, 15 bp, Homo sapiens
cctttgaaaatattc

SEQ ID NO: 36024 - DNA, 15 bp, Homo sapiens
acctttgaaaatatt

SEQ ID NO: 36025 - DNA, 15 bp, Homo sapiens
gacctttgaaaatat

SEQ ID NO: 36026 - DNA, 15 bp, Homo sapiens
agacctttgaaaata

SEQ ID NO: 36027 - DNA, 15 bp, Homo sapiens
cagacctttgaaaat

SEQ ID NO: 36028 - DNA, 15 bp, Homo sapiens
gcagacctttgaaaa

SEQ ID NO: 36029 - DNA, 15 bp, Homo sapiens
tgcagacctttgaaa

SEQ ID NO: 36030 - DNA, 15 bp, Homo sapiens
atgcagacctttgaa

SEQ ID NO: 36031 - DNA, 15 bp, Homo sapiens
aatgcagacctttga

SEQ ID NO: 36032 - DNA, 15 bp, Homo sapiens
aaatgcagacctttg

SEQ ID NO: 36033 - DNA, 15 bp, Homo sapiens
caaatgcagaccttt

SEQ ID NO: 36034 - DNA, 15 bp, Homo sapiens
acaaatgcagacctt

SEQ ID NO: 36035 - DNA, 15 bp, Homo sapiens
cacaaatgcagacct

SEQ ID NO: 36036 - DNA, 15 bp, Homo sapiens
tcacaaatgcagacc

SEQ ID NO: 36037 - DNA, 15 bp, Homo sapiens
ttcacaaatgcagac

SEQ ID NO: 36038 - DNA, 15 bp, Homo sapiens
gttcacaaatgcaga

SEQ ID NO: 36039 - DNA, 15 bp, Homo sapiens
tgttcacaaatgcag

SEQ ID NO: 36040 - DNA, 15 bp, Homo sapiens
ctgttcacaaatgca

SEQ ID NO: 36041 - DNA, 15 bp, Homo sapiens
cctgttcacaaatgc

SEQ ID NO: 36042 - DNA, 15 bp, Homo sapiens
acctgttcacaaatg

SEQ ID NO: 36043 - DNA, 15 bp, Homo sapiens
gacctgttcacaaat

SEQ ID NO: 36044 - DNA, 15 bp, Homo sapiens
ggacctgttcacaaa

SEQ ID NO: 36045 - DNA, 15 bp, Homo sapiens
aggacctgttcacaa

SEQ ID NO: 36046 - DNA, 15 bp, Homo sapiens
caggacctgttcaca

SEQ ID NO: 36047 - DNA, 15 bp, Homo sapiens
ccaggacctgttcac

SEQ ID NO: 36048 - DNA, 15 bp, Homo sapiens
cccaggacctgttca

SEQ ID NO: 36049 - DNA, 15 bp, Homo sapiens
tcccaggacctgttc

SEQ ID NO: 36050 - DNA, 15 bp, Homo sapiens
atcccaggacctgtt

SEQ ID NO: 36051 - DNA, 15 bp, Homo sapiens
catcccaggacctgt

SEQ ID NO: 36052 - DNA, 15 bp, Homo sapiens
ccatcccaggacctg

SEQ ID NO: 36053 - DNA, 15 bp, Homo sapiens
tccatcccaggacct

SEQ ID NO: 36054 - DNA, 15 bp, Homo sapiens
ctccatcccaggacc

SEQ ID NO: 36055 - DNA, 15 bp, Homo sapiens
tctccatcccaggac

SEQ ID NO: 36056 - DNA, 15 bp, Homo sapiens
ctctccatcccagga

SEQ ID NO: 36057 - DNA, 15 bp, Homo sapiens
gctctccatcccagg

SEQ ID NO: 36058 - DNA, 15 bp, Homo sapiens
ggctctccatcccag

SEQ ID NO: 36059 - DNA, 15 bp, Homo sapiens
aggctctccatccca

SEQ ID NO: 36060 - DNA, 15 bp, Homo sapiens
aaggctctccatccc

SEQ ID NO: 36061 - DNA, 15 bp, Homo sapiens
aaaggctctccatcc

SEQ ID NO: 36062 - DNA, 15 bp, Homo sapiens
caaaggctctccatc

SEQ ID NO: 36063 - DNA, 15 bp, Homo sapiens
tcaaaggctctccat

SEQ ID NO: 36064 - DNA, 15 bp, Homo sapiens
ttcaaaggctctcca

SEQ ID NO: 36065 - DNA, 15 bp, Homo sapiens
attcaaaggctctcc

SEQ ID NO: 36066 - DNA, 15 bp, Homo sapiens
aattcaaaggctctc

SEQ ID NO: 36067 - DNA, 15 bp, Homo sapiens
taattcaaaggctct

SEQ ID NO: 36068 - DNA, 15 bp, Homo sapiens
gtaattcaaaggctc

SEQ ID NO: 36069 - DNA, 15 bp, Homo sapiens
ggtaattcaaaggct

SEQ ID NO: 36070 - DNA, 15 bp, Homo sapiens
cggtaattcaaaggc

SEQ ID NO: 36071 - DNA, 15 bp, Homo sapiens
acggtaattcaaagg

SEQ ID NO: 36072 - DNA, 15 bp, Homo sapiens
cacggtaattcaaag

SEQ ID NO: 36073 - DNA, 15 bp, Homo sapiens
ccacggtaattcaaa

SEQ ID NO: 36074 - DNA, 15 bp, Homo sapiens
cccacggtaattcaa

SEQ ID NO: 36075 - DNA, 15 bp, Homo sapiens
acccacggtaattca

SEQ ID NO: 36076 - DNA, 15 bp, Homo sapiens
cacccacggtaattc

SEQ ID NO: 36077 - DNA, 15 bp, Homo sapiens
acacccacggtaatt

SEQ ID NO: 36078 - DNA, 15 bp, Homo sapiens
tacacccacggtaat

SEQ ID NO: 36079 - DNA, 15 bp, Homo sapiens
atacacccacggtaa

SEQ ID NO: 36080 - DNA, 15 bp, Homo sapiens
catacacccacggta

SEQ ID NO: 36081 - DNA, 15 bp, Homo sapiens
acatacacccacggt

SEQ ID NO: 36082 - DNA, 15 bp, Homo sapiens
cacatacacccacgg

SEQ ID NO: 36083 - DNA, 15 bp, Homo sapiens
acacatacacccacg

SEQ ID NO: 36084 - DNA, 15 bp, Homo sapiens
aacacatacacccac

SEQ ID NO: 36085 - DNA, 15 bp, Homo sapiens
taacacatacaccca

SEQ ID NO: 36086 - DNA, 15 bp, Homo sapiens
ataacacatacaccc

SEQ ID NO: 36087 - DNA, 15 bp, Homo sapiens
gataacacatacacc

SEQ ID NO: 36088 - DNA, 15 bp, Homo sapiens
ggataacacatacac

SEQ ID NO: 36089 - DNA, 15 bp, Homo sapiens
tggataacacataca

SEQ ID NO: 36090 - DNA, 15 bp, Homo sapiens
atggataacacatac

SEQ ID NO: 36091 - DNA, 15 bp, Homo sapiens
aatggataacacata

SEQ ID NO: 36092 - DNA, 15 bp, Homo sapiens
aaatggataacacat

SEQ ID NO: 36093 - DNA, 15 bp, Homo sapiens
caaatggataacaca

SEQ ID NO: 36094 - DNA, 15 bp, Homo sapiens
gcaaatggataacac

SEQ ID NO: 36095 - DNA, 15 bp, Homo sapiens
agcaaatggataaca

SEQ ID NO: 36096 - DNA, 15 bp, Homo sapiens
aagcaaatggataac

SEQ ID NO: 36097 - DNA, 15 bp, Homo sapiens
taagcaaatggataa

SEQ ID NO: 36098 - DNA, 15 bp, Homo sapiens
gtaagcaaatggata

SEQ ID NO: 36099 - DNA, 15 bp, Homo sapiens
tgtaagcaaatggat

SEQ ID NO: 36100 - DNA, 15 bp, Homo sapiens
gtgtaagcaaatgga

SEQ ID NO: 36101 - DNA, 15 bp, Homo sapiens
agtgtaagcaaatgg

SEQ ID NO: 36102 - DNA, 15 bp, Homo sapiens
cagtgtaagcaaatg

SEQ ID NO: 36103 - DNA, 15 bp, Homo sapiens
gcagtgtaagcaaat

SEQ ID NO: 36104 - DNA, 15 bp, Homo sapiens
tgcagtgtaagcaaa

SEQ ID NO: 36105 - DNA, 15 bp, Homo sapiens
atgcagtgtaagcaa

SEQ ID NO: 36106 - DNA, 15 bp, Homo sapiens
gatgcagtgtaagca

SEQ ID NO: 36107 - DNA, 15 bp, Homo sapiens
agatgcagtgtaagc

SEQ ID NO: 36108 - DNA, 15 bp, Homo sapiens
aagatgcagtgtaag

SEQ ID NO: 36109 - DNA, 15 bp, Homo sapiens
gaagatgcagtgtaa

SEQ ID NO: 36110 - DNA, 15 bp, Homo sapiens
agaagatgcagtgta

SEQ ID NO: 36111 - DNA, 15 bp, Homo sapiens
aagaagatgcagtgt

SEQ ID NO: 36112 - DNA, 15 bp, Homo sapiens
taagaagatgcagtg

SEQ ID NO: 36113 - DNA, 15 bp, Homo sapiens
gtaagaagatgcagt

SEQ ID NO: 36114 - DNA, 15 bp, Homo sapiens
agtaagaagatgcag

SEQ ID NO: 36115 - DNA, 15 bp, Homo sapiens
tagtaagaagatgca

SEQ ID NO: 36116 - DNA, 15 bp, Homo sapiens
atagtaagaagatgc

SEQ ID NO: 36117 - DNA, 15 bp, Homo sapiens
tatagtaagaagatg

SEQ ID NO: 36118 - DNA, 15 bp, Homo sapiens
ttatagtaagaagat

SEQ ID NO: 36119 - DNA, 15 bp, Homo sapiens
tttatagtaagaaga

SEQ ID NO: 36120 - DNA, 15 bp, Homo sapiens
ttttatagtaagaag

SEQ ID NO: 36121 - DNA, 15 bp, Homo sapiens
attttatagtaagaa

SEQ ID NO: 36122 - DNA, 15 bp, Homo sapiens
tattttatagtaaga

SEQ ID NO: 36123 - DNA, 15 bp, Homo sapiens
ttattttatagtaag

SEQ ID NO: 36124 - DNA, 15 bp, Homo sapiens
tttattttatagtaa

SEQ ID NO: 36125 - DNA, 15 bp, Homo sapiens
ctttattttatagta

SEQ ID NO: 36126 - DNA, 15 bp, Homo sapiens
actttattttatagt

SEQ ID NO: 36127 - DNA, 15 bp, Homo sapiens
tactttattttatag

SEQ ID NO: 36128 - DNA, 15 bp, Homo sapiens
gtactttattttata

SEQ ID NO: 36129 - DNA, 15 bp, Homo sapiens
agtactttattttat

SEQ ID NO: 36130 - DNA, 15 bp, Homo sapiens
aagtactttatttta

SEQ ID NO: 36131 - DNA, 15 bp, Homo sapiens
gaagtactttatttt

SEQ ID NO: 36132 - DNA, 15 bp, Homo sapiens
agaagtactttattt

SEQ ID NO: 36133 - DNA, 15 bp, Homo sapiens
aagaagtactttatt

SEQ ID NO: 36134 - DNA, 15 bp, Homo sapiens
caagaagtactttat

SEQ ID NO: 36135 - DNA, 15 bp, Homo sapiens
ccaagaagtacttta

SEQ ID NO: 36136 - DNA, 15 bp, Homo sapiens
gccaagaagtacttt

SEQ ID NO: 36137 - DNA, 15 bp, Homo sapiens
tgccaagaagtactt

SEQ ID NO: 36138 - DNA, 15 bp, Homo sapiens
ctgccaagaagtact

SEQ ID NO: 36139 - DNA, 15 bp, Homo sapiens
tctgccaagaagtac

SEQ ID NO: 36140 - DNA, 15 bp, Homo sapiens
atctgccaagaagta

SEQ ID NO: 36141 - DNA, 15 bp, Homo sapiens
gatctgccaagaagt

SEQ ID NO: 36142 - DNA, 15 bp, Homo sapiens
tgatctgccaagaag

SEQ ID NO: 36143 - DNA, 15 bp, Homo sapiens
atgatctgccaagaa

SEQ ID NO: 36144 - DNA, 15 bp, Homo sapiens
tatgatctgccaaga

SEQ ID NO: 36145 - DNA, 15 bp, Homo sapiens
atatgatctgccaag

SEQ ID NO: 36146 - DNA, 15 bp, Homo sapiens
catatgatctgccaa

SEQ ID NO: 36147 - DNA, 15 bp, Homo sapiens
ccatatgatctgcca

SEQ ID NO: 36148 - DNA, 15 bp, Homo sapiens
gccatatgatctgcc

SEQ ID NO: 36149 - DNA, 15 bp, Homo sapiens
tgccatatgatctgc

SEQ ID NO: 36150 - DNA, 15 bp, Homo sapiens
atgccatatgatctg

SEQ ID NO: 36151 - DNA, 15 bp, Homo sapiens
aatgccatatgatct

SEQ ID NO: 36152 - DNA, 15 bp, Homo sapiens
aaatgccatatgatc

SEQ ID NO: 36153 - DNA, 15 bp, Homo sapiens
taaatgccatatgat

SEQ ID NO: 36154 - DNA, 15 bp, Homo sapiens
ataaatgccatatga

SEQ ID NO: 36155 - DNA, 15 bp, Homo sapiens
tataaatgccatatg

SEQ ID NO: 36156 - DNA, 15 bp, Homo sapiens
ctataaatgccatat

SEQ ID NO: 36157 - DNA, 15 bp, Homo sapiens
tctataaatgccata

SEQ ID NO: 36158 - DNA, 15 bp, Homo sapiens
atctataaatgccat

SEQ ID NO: 36159 - DNA, 15 bp, Homo sapiens
aatctataaatgcca

SEQ ID NO: 36160 - DNA, 15 bp, Homo sapiens
aaatctataaatgcc

SEQ ID NO: 36161 - DNA, 15 bp, Homo sapiens
aaaatctataaatgc

SEQ ID NO: 36162 - DNA, 15 bp, Homo sapiens
aaaaatctataaatg

SEQ ID NO: 36163 - DNA, 15 bp, Homo sapiens
gaaaaatctataaat

SEQ ID NO: 36164 - DNA, 15 bp, Homo sapiens
agaaaaatctataaa

SEQ ID NO: 36165 - DNA, 15 bp, Homo sapiens
aagaaaaatctataa

SEQ ID NO: 36166 - DNA, 15 bp, Homo sapiens
gaagaaaaatctata

SEQ ID NO: 36167 - DNA, 15 bp, Homo sapiens
agaagaaaaatctat

SEQ ID NO: 36168 - DNA, 15 bp, Homo sapiens
aagaagaaaaatcta

SEQ ID NO: 36169 - DNA, 15 bp, Homo sapiens
taagaagaaaaatct

SEQ ID NO: 36170 - DNA, 15 bp, Homo sapiens
gtaagaagaaaaatc

SEQ ID NO: 36171 - DNA, 15 bp, Homo sapiens
agtaagaagaaaaat

SEQ ID NO: 36172 - DNA, 15 bp, Homo sapiens
aagtaagaagaaaaa

SEQ ID NO: 36173 - DNA, 15 bp, Homo sapiens
aaagtaagaagaaaa

SEQ ID NO: 36174 - DNA, 15 bp, Homo sapiens
gaaagtaagaagaaa

SEQ ID NO: 36175 - DNA, 15 bp, Homo sapiens
agaaagtaagaagaa

SEQ ID NO: 36176 - DNA, 15 bp, Homo sapiens
aagaaagtaagaaga

SEQ ID NO: 36177 - DNA, 15 bp, Homo sapiens
aaagaaagtaagaag

SEQ ID NO: 36178 - DNA, 15 bp, Homo sapiens
aaaagaaagtaagaa

SEQ ID NO: 36179 - DNA, 15 bp, Homo sapiens
taaaagaaagtaaga

SEQ ID NO: 36180 - DNA, 15 bp, Homo sapiens
ataaaagaaagtaag

SEQ ID NO: 36181 - DNA, 15 bp, Homo sapiens
aataaaagaaagtaa

SEQ ID NO: 36182 - DNA, 15 bp, Homo sapiens
aaataaaagaaagta

SEQ ID NO: 36183 - DNA, 15 bp, Homo sapiens
caaataaaagaaagt

SEQ ID NO: 36184 - DNA, 15 bp, Homo sapiens
tcaaataaaagaaag

SEQ ID NO: 36185 - DNA, 15 bp, Homo sapiens
atcaaataaaagaaa

SEQ ID NO: 36186 - DNA, 15 bp, Homo sapiens
aatcaaataaaagaa

SEQ ID NO: 36187 - DNA, 15 bp, Homo sapiens
aaatcaaataaaaga

SEQ ID NO: 36188 - DNA, 15 bp, Homo sapiens
taaatcaaataaaag

SEQ ID NO: 36189 - DNA, 15 bp, Homo sapiens
ataaatcaaataaaa

SEQ ID NO: 36190 - DNA, 15 bp, Homo sapiens
tataaatcaaataaa

SEQ ID NO: 36191 - DNA, 15 bp, Homo sapiens
atataaatcaaataa

SEQ ID NO: 36192 - DNA, 15 bp, Homo sapiens
tatataaatcaaata

SEQ ID NO: 36193 - DNA, 15 bp, Homo sapiens
ttatataaatcaaat

SEQ ID NO: 36194 - DNA, 15 bp, Homo sapiens
attatataaatcaaa

SEQ ID NO: 36195 - DNA, 15 bp, Homo sapiens
aattatataaatcaa

SEQ ID NO: 36196 - DNA, 15 bp, Homo sapiens
caattatataaatca

SEQ ID NO: 36197 - DNA, 15 bp, Homo sapiens
ccaattatataaatc

SEQ ID NO: 36198 - DNA, 15 bp, Homo sapiens
cccaattatataaat

SEQ ID NO: 36199 - DNA, 15 bp, Homo sapiens
acccaattatataaa

SEQ ID NO: 36200 - DNA, 15 bp, Homo sapiens
tacccaattatataa

SEQ ID NO: 36201 - DNA, 15 bp, Homo sapiens
gtacccaattatata

SEQ ID NO: 36202 - DNA, 15 bp, Homo sapiens
agtacccaattatat

SEQ ID NO: 36203 - DNA, 15 bp, Homo sapiens
gagtacccaattata

SEQ ID NO: 36204 - DNA, 15 bp, Homo sapiens
agagtacccaattat

SEQ ID NO: 36205 - DNA, 15 bp, Homo sapiens
gagagtacccaatta

SEQ ID NO: 36206 - DNA, 15 bp, Homo sapiens
tgagagtacccaatt

SEQ ID NO: 36207 - DNA, 15 bp, Homo sapiens
ttgagagtacccaat

SEQ ID NO: 36208 - DNA, 15 bp, Homo sapiens
gttgagagtacccaa

SEQ ID NO: 36209 - DNA, 15 bp, Homo sapiens
agttgagagtaccca

SEQ ID NO: 36210 - DNA, 15 bp, Homo sapiens
gagttgagagtaccc

SEQ ID NO: 36211 - DNA, 15 bp, Homo sapiens
ggagttgagagtacc

SEQ ID NO: 36212 - DNA, 15 bp, Homo sapiens
gggagttgagagtac

SEQ ID NO: 36213 - DNA, 15 bp, Homo sapiens
cgggagttgagagta

SEQ ID NO: 36214 - DNA, 15 bp, Homo sapiens
acgggagttgagagt

SEQ ID NO: 36215 - DNA, 15 bp, Homo sapiens
cacgggagttgagag

SEQ ID NO: 36216 - DNA, 15 bp, Homo sapiens
tcacgggagttgaga

SEQ ID NO: 36217 - DNA, 15 bp, Homo sapiens
atcacgggagttgag

SEQ ID NO: 36218 - DNA, 15 bp, Homo sapiens
catcacgggagttga

SEQ ID NO: 36219 - DNA, 15 bp, Homo sapiens
ccatcacgggagttg

SEQ ID NO: 36220 - DNA, 15 bp, Homo sapiens
tccatcacgggagtt

SEQ ID NO: 36221 - DNA, 15 bp, Homo sapiens
ctccatcacgggagt

SEQ ID NO: 36222 - DNA, 15 bp, Homo sapiens
tctccatcacgggag

SEQ ID NO: 36223 - DNA, 15 bp, Homo sapiens
ctctccatcacggga

SEQ ID NO: 36224 - DNA, 15 bp, Homo sapiens
tctctccatcacggg

SEQ ID NO: 36225 - DNA, 15 bp, Homo sapiens
ttctctccatcacgg

SEQ ID NO: 36226 - DNA, 15 bp, Homo sapiens
tttctctccatcacg

SEQ ID NO: 36227 - DNA, 15 bp, Homo sapiens
ctttctctccatcac

SEQ ID NO: 36228 - DNA, 15 bp, Homo sapiens
gctttctctccatca

SEQ ID NO: 36229 - DNA, 15 bp, Homo sapiens
tgctttctctccatc

SEQ ID NO: 36230 - DNA, 15 bp, Homo sapiens
ttgctttctctccat

SEQ ID NO: 36231 - DNA, 15 bp, Homo sapiens
tttgctttctctcca

SEQ ID NO: 36232 - DNA, 15 bp, Homo sapiens
ctttgctttctctcc

SEQ ID NO: 36233 - DNA, 15 bp, Homo sapiens
tctttgctttctctc

SEQ ID NO: 36234 - DNA, 15 bp, Homo sapiens
ttctttgctttctct

SEQ ID NO: 36235 - DNA, 15 bp, Homo sapiens
tttctttgctttctc

SEQ ID NO: 36236 - DNA, 15 bp, Homo sapiens
gtttctttgctttct

SEQ ID NO: 36237 - DNA, 15 bp, Homo sapiens
ggtttctttgctttc

SEQ ID NO: 36238 - DNA, 15 bp, Homo sapiens
tggtttctttgcttt

SEQ ID NO: 36239 - DNA, 15 bp, Homo sapiens
ttggtttctttgctt

SEQ ID NO: 36240 - DNA, 15 bp, Homo sapiens
cttggtttctttgct

SEQ ID NO: 36241 - DNA, 15 bp, Homo sapiens
tcttggtttctttgc

SEQ ID NO: 36242 - DNA, 15 bp, Homo sapiens
ttcttggtttctttg

SEQ ID NO: 36243 - DNA, 15 bp, Homo sapiens
attcttggtttcttt

SEQ ID NO: 36244 - DNA, 15 bp, Homo sapiens
tattcttggtttctt

SEQ ID NO: 36245 - DNA, 15 bp, Homo sapiens
ctattcttggtttct

SEQ ID NO: 36246 - DNA, 15 bp, Homo sapiens
cctattcttggtttc

SEQ ID NO: 36247 - DNA, 15 bp, Homo sapiens
tcctattcttggttt

SEQ ID NO: 36248 - DNA, 15 bp, Homo sapiens
atcctattcttggtt

SEQ ID NO: 36249 - DNA, 15 bp, Homo sapiens
tatcctattcttggt

SEQ ID NO: 36250 - DNA, 15 bp, Homo sapiens
ttatcctattcttgg

SEQ ID NO: 36251 - DNA, 15 bp, Homo sapiens
gttatcctattcttg

SEQ ID NO: 36252 - DNA, 15 bp, Homo sapiens
cgttatcctattctt

SEQ ID NO: 36253 - DNA, 15 bp, Homo sapiens
gcgttatcctattct

SEQ ID NO: 36254 - DNA, 15 bp, Homo sapiens
agcgttatcctattc

SEQ ID NO: 36255 - DNA, 15 bp, Homo sapiens
tagcgttatcctatt

SEQ ID NO: 36256 - DNA, 15 bp, Homo sapiens
atagcgttatcctat

SEQ ID NO: 36257 - DNA, 15 bp, Homo sapiens
catagcgttatccta

SEQ ID NO: 36258 - DNA, 15 bp, Homo sapiens
ccatagcgttatcct

SEQ ID NO: 36259 - DNA, 15 bp, Homo sapiens
tccatagcgttatcc

SEQ ID NO: 36260 - DNA, 15 bp, Homo sapiens
ttccatagcgttatc

SEQ ID NO: 36261 - DNA, 15 bp, Homo sapiens
attccatagcgttat

SEQ ID NO: 36262 - DNA, 15 bp, Homo sapiens
cattccatagcgtta

SEQ ID NO: 36263 - DNA, 15 bp, Homo sapiens
gcattccatagcgtt

SEQ ID NO: 36264 - DNA, 15 bp, Homo sapiens
ggcattccatagcgt

SEQ ID NO: 36265 - DNA, 15 bp, Homo sapiens
aggcattccatagcg

SEQ ID NO: 36266 - DNA, 15 bp, Homo sapiens
gaggcattccatagc

SEQ ID NO: 36267 - DNA, 15 bp, Homo sapiens
tgaggcattccatag

SEQ ID NO: 36268 - DNA, 15 bp, Homo sapiens
ttgaggcattccata

SEQ ID NO: 36269 - DNA, 15 bp, Homo sapiens
attgaggcattccat

SEQ ID NO: 36270 - DNA, 15 bp, Homo sapiens
gattgaggcattcca

SEQ ID NO: 36271 - DNA, 15 bp, Homo sapiens
agattgaggcattcc

SEQ ID NO: 36272 - DNA, 15 bp, Homo sapiens
aagattgaggcattc

SEQ ID NO: 36273 - DNA, 15 bp, Homo sapiens
gaagattgaggcatt

SEQ ID NO: 36274 - DNA, 15 bp, Homo sapiens
agaagattgaggcat

SEQ ID NO: 36275 - DNA, 15 bp, Homo sapiens
aagaagattgaggca

SEQ ID NO: 36276 - DNA, 15 bp, Homo sapiens
aaagaagattgaggc

SEQ ID NO: 36277 - DNA, 15 bp, Homo sapiens
aaaagaagattgagg

SEQ ID NO: 36278 - DNA, 15 bp, Homo sapiens
taaaagaagattgag

SEQ ID NO: 36279 - DNA, 15 bp, Homo sapiens
ctaaaagaagattga

SEQ ID NO: 36280 - DNA, 15 bp, Homo sapiens
actaaaagaagattg

SEQ ID NO: 36281 - DNA, 15 bp, Homo sapiens
aactaaaagaagatt

SEQ ID NO: 36282 - DNA, 15 bp, Homo sapiens
aaactaaaagaagat

SEQ ID NO: 36283 - DNA, 15 bp, Homo sapiens
aaaactaaaagaaga

SEQ ID NO: 36284 - DNA, 15 bp, Homo sapiens
aaaaactaaaagaag

SEQ ID NO: 36285 - DNA, 15 bp, Homo sapiens
aaaaaactaaaagaa

SEQ ID NO: 36286 - DNA, 15 bp, Homo sapiens
taaaaaactaaaaga

SEQ ID NO: 36287 - DNA, 15 bp, Homo sapiens
ataaaaaactaaaag

SEQ ID NO: 36288 - DNA, 15 bp, Homo sapiens
aataaaaaactaaaa

SEQ ID NO: 36289 - DNA, 15 bp, Homo sapiens
aaataaaaaactaaa

SEQ ID NO: 36290 - DNA, 15 bp, Homo sapiens
aaaataaaaaactaa

SEQ ID NO: 36291 - DNA, 15 bp, Homo sapiens
aaaaataaaaaacta

SEQ ID NO: 36292 - DNA, 15 bp, Homo sapiens
caaaaataaaaaact

SEQ ID NO: 36293 - DNA, 15 bp, Homo sapiens
ccaaaaataaaaaac

SEQ ID NO: 36294 - DNA, 15 bp, Homo sapiens
accaaaaataaaaaa

SEQ ID NO: 36295 - DNA, 15 bp, Homo sapiens
aaccaaaaataaaaa

SEQ ID NO: 36296 - DNA, 15 bp, Homo sapiens
caaccaaaaataaaa

SEQ ID NO: 36297 - DNA, 15 bp, Homo sapiens
tcaaccaaaaataaa

SEQ ID NO: 36298 - DNA, 15 bp, Homo sapiens
ttcaaccaaaaataa

SEQ ID NO: 36299 - DNA, 15 bp, Homo sapiens
attcaaccaaaaata

SEQ ID NO: 36300 - DNA, 15 bp, Homo sapiens
tattcaaccaaaaat

SEQ ID NO: 36301 - DNA, 15 bp, Homo sapiens
ttattcaaccaaaaa

SEQ ID NO: 36302 - DNA, 15 bp, Homo sapiens
attattcaaccaaaa

SEQ ID NO: 36303 - DNA, 15 bp, Homo sapiens
aattattcaaccaaa

SEQ ID NO: 36304 - DNA, 15 bp, Homo sapiens
aaattattcaaccaa

SEQ ID NO: 36305 - DNA, 15 bp, Homo sapiens
aaaattattcaacca

SEQ ID NO: 36306 - DNA, 15 bp, Homo sapiens
taaaattattcaacc

SEQ ID NO: 36307 - DNA, 15 bp, Homo sapiens
ctaaaattattcaac

SEQ ID NO: 36308 - DNA, 15 bp, Homo sapiens
actaaaattattcaa

SEQ ID NO: 36309 - DNA, 15 bp, Homo sapiens
aactaaaattattca

SEQ ID NO: 36310 - DNA, 15 bp, Homo sapiens
aaactaaaattattc

SEQ ID NO: 36311 - DNA, 15 bp, Homo sapiens
taaactaaaattatt

SEQ ID NO: 36312 - DNA, 15 bp, Homo sapiens
ctaaactaaaattat

SEQ ID NO: 36313 - DNA, 15 bp, Homo sapiens
actaaactaaaatta

SEQ ID NO: 36314 - DNA, 15 bp, Homo sapiens
aactaaactaaaatt

SEQ ID NO: 36315 - DNA, 15 bp, Homo sapiens
gaactaaactaaaat

SEQ ID NO: 36316 - DNA, 15 bp, Homo sapiens
tgaactaaactaaaa

SEQ ID NO: 36317 - DNA, 15 bp, Homo sapiens
atgaactaaactaaa

SEQ ID NO: 36318 - DNA, 15 bp, Homo sapiens
catgaactaaactaa

SEQ ID NO: 36319 - DNA, 15 bp, Homo sapiens
ccatgaactaaacta

SEQ ID NO: 36320 - DNA, 15 bp, Homo sapiens
tccatgaactaaact

SEQ ID NO: 36321 - DNA, 15 bp, Homo sapiens
ttccatgaactaaac

SEQ ID NO: 36322 - DNA, 15 bp, Homo sapiens
attccatgaactaaa

SEQ ID NO: 36323 - DNA, 15 bp, Homo sapiens
tattccatgaactaa

SEQ ID NO: 36324 - DNA, 15 bp, Homo sapiens
ttattccatgaacta

SEQ ID NO: 36325 - DNA, 15 bp, Homo sapiens
cttattccatgaact

SEQ ID NO: 36326 - DNA, 15 bp, Homo sapiens
ccttattccatgaac

SEQ ID NO: 36327 - DNA, 15 bp, Homo sapiens
accttattccatgaa

SEQ ID NO: 36328 - DNA, 15 bp, Homo sapiens
taccttattccatga

SEQ ID NO: 36329 - DNA, 15 bp, Homo sapiens
ttaccttattccatg

SEQ ID NO: 36330 - DNA, 15 bp, Homo sapiens
tttaccttattccat

SEQ ID NO: 36331 - DNA, 15 bp, Homo sapiens
atttaccttattcca

SEQ ID NO: 36332 - DNA, 15 bp, Homo sapiens
tatttaccttattcc

SEQ ID NO: 36333 - DNA, 15 bp, Homo sapiens
atatttaccttattc

SEQ ID NO: 36334 - DNA, 15 bp, Homo sapiens
aatatttaccttatt

SEQ ID NO: 36335 - DNA, 15 bp, Homo sapiens
aaatatttaccttat

SEQ ID NO: 36336 - DNA, 15 bp, Homo sapiens
aaaatatttacctta

SEQ ID NO: 36337 - DNA, 15 bp, Homo sapiens
taaaatatttacctt

SEQ ID NO: 36338 - DNA, 15 bp, Homo sapiens
gtaaaatatttacct

SEQ ID NO: 36339 - DNA, 15 bp, Homo sapiens
tgtaaaatatttacc

SEQ ID NO: 36340 - DNA, 15 bp, Homo sapiens
atgtaaaatatttac

SEQ ID NO: 36341 - DNA, 15 bp, Homo sapiens
aatgtaaaatattta

SEQ ID NO: 36342 - DNA, 15 bp, Homo sapiens
aaatgtaaaatattt

SEQ ID NO: 36343 - DNA, 15 bp, Homo sapiens
caaatgtaaaatatt

SEQ ID NO: 36344 - DNA, 15 bp, Homo sapiens
acaaatgtaaaatat

SEQ ID NO: 36345 - DNA, 15 bp, Homo sapiens
aacaaatgtaaaata

SEQ ID NO: 36346 - DNA, 15 bp, Homo sapiens
taacaaatgtaaaat

SEQ ID NO: 36347 - DNA, 15 bp, Homo sapiens
ttaacaaatgtaaaa

SEQ ID NO: 36348 - DNA, 15 bp, Homo sapiens
attaacaaatgtaaa

SEQ ID NO: 36349 - DNA, 15 bp, Homo sapiens
tattaacaaatgtaa

SEQ ID NO: 36350 - DNA, 15 bp, Homo sapiens
ttattaacaaatgta

SEQ ID NO: 36351 - DNA, 15 bp, Homo sapiens
gttattaacaaatgt

SEQ ID NO: 36352 - DNA, 15 bp, Homo sapiens
agttattaacaaatg

SEQ ID NO: 36353 - DNA, 15 bp, Homo sapiens
gagttattaacaaat

SEQ ID NO: 36354 - DNA, 15 bp, Homo sapiens
ggagttattaacaaa

SEQ ID NO: 36355 - DNA, 15 bp, Homo sapiens
tggagttattaacaa

SEQ ID NO: 36356 - DNA, 15 bp, Homo sapiens
atggagttattaaca

SEQ ID NO: 36357 - DNA, 15 bp, Homo sapiens
tatggagttattaac

SEQ ID NO: 36358 - DNA, 15 bp, Homo sapiens
gtatggagttattaa

SEQ ID NO: 36359 - DNA, 15 bp, Homo sapiens
agtatggagttatta

SEQ ID NO: 36360 - DNA, 15 bp, Homo sapiens
aagtatggagttatt

SEQ ID NO: 36361 - DNA, 15 bp, Homo sapiens
aaagtatggagttat

SEQ ID NO: 36362 - DNA, 15 bp, Homo sapiens
caaagtatggagtta

SEQ ID NO: 36363 - DNA, 15 bp, Homo sapiens
acaaagtatggagtt

SEQ ID NO: 36364 - DNA, 15 bp, Homo sapiens
aacaaagtatggagt

SEQ ID NO: 36365 - DNA, 15 bp, Homo sapiens
gaacaaagtatggag

SEQ ID NO: 36366 - DNA, 15 bp, Homo sapiens
agaacaaagtatgga

SEQ ID NO: 36367 - DNA, 15 bp, Homo sapiens
tagaacaaagtatgg

SEQ ID NO: 36368 - DNA, 15 bp, Homo sapiens
ctagaacaaagtatg

SEQ ID NO: 36369 - DNA, 15 bp, Homo sapiens
cctagaacaaagtat

SEQ ID NO: 36370 - DNA, 15 bp, Homo sapiens
acctagaacaaagta

SEQ ID NO: 36371 - DNA, 15 bp, Homo sapiens
aacctagaacaaagt

SEQ ID NO: 36372 - DNA, 15 bp, Homo sapiens
gaacctagaacaaag

SEQ ID NO: 36373 - DNA, 15 bp, Homo sapiens
tgaacctagaacaaa

SEQ ID NO: 36374 - DNA, 15 bp, Homo sapiens
ctgaacctagaacaa

SEQ ID NO: 36375 - DNA, 15 bp, Homo sapiens
actgaacctagaaca

SEQ ID NO: 36376 - DNA, 15 bp, Homo sapiens
cactgaacctagaac

SEQ ID NO: 36377 - DNA, 15 bp, Homo sapiens
ccactgaacctagaa

SEQ ID NO: 36378 - DNA, 15 bp, Homo sapiens
gccactgaacctaga

SEQ ID NO: 36379 - DNA, 15 bp, Homo sapiens
agccactgaacctag

SEQ ID NO: 36380 - DNA, 15 bp, Homo sapiens
aagccactgaaccta

SEQ ID NO: 36381 - DNA, 15 bp, Homo sapiens
taagccactgaacct

SEQ ID NO: 36382 - DNA, 15 bp, Homo sapiens
gtaagccactgaacc

SEQ ID NO: 36383 - DNA, 15 bp, Homo sapiens
tgtaagccactgaac

SEQ ID NO: 36384 - DNA, 15 bp, Homo sapiens
ttgtaagccactgaa

SEQ ID NO: 36385 - DNA, 15 bp, Homo sapiens
tttgtaagccactga

SEQ ID NO: 36386 - DNA, 15 bp, Homo sapiens
ttttgtaagccactg

SEQ ID NO: 36387 - DNA, 15 bp, Homo sapiens
tttttgtaagccact

SEQ ID NO: 36388 - DNA, 15 bp, Homo sapiens
atttttgtaagccac

SEQ ID NO: 36389 - DNA, 15 bp, Homo sapiens
tatttttgtaagcca

SEQ ID NO: 36390 - DNA, 15 bp, Homo sapiens
atatttttgtaagcc

SEQ ID NO: 36391 - DNA, 15 bp, Homo sapiens
catatttttgtaagc

SEQ ID NO: 36392 - DNA, 15 bp, Homo sapiens
acatatttttgtaag

SEQ ID NO: 36393 - DNA, 15 bp, Homo sapiens
tacatatttttgtaa

SEQ ID NO: 36394 - DNA, 15 bp, Homo sapiens
atacatatttttgta

SEQ ID NO: 36395 - DNA, 15 bp, Homo sapiens
tatacatatttttgt

SEQ ID NO: 36396 - DNA, 15 bp, Homo sapiens
ttatacatatttttg

SEQ ID NO: 36397 - DNA, 15 bp, Homo sapiens
gttatacatattttt

SEQ ID NO: 36398 - DNA, 15 bp, Homo sapiens
tgttatacatatttt

SEQ ID NO: 36399 - DNA, 15 bp, Homo sapiens
ttgttatacatattt

SEQ ID NO: 36400 - DNA, 15 bp, Homo sapiens
tttgttatacatatt

SEQ ID NO: 36401 - DNA, 15 bp, Homo sapiens
ttttgttatacatat

SEQ ID NO: 36402 - DNA, 15 bp, Homo sapiens
gttttgttatacata

SEQ ID NO: 36403 - DNA, 15 bp, Homo sapiens
tgttttgttatacat

SEQ ID NO: 36404 - DNA, 15 bp, Homo sapiens
ttgttttgttataca

SEQ ID NO: 36405 - DNA, 15 bp, Homo sapiens
tttgttttgttatac

SEQ ID NO: 36406 - DNA, 15 bp, Homo sapiens
ttttgttttgttata

SEQ ID NO: 36407 - DNA, 15 bp, Homo sapiens
attttgttttgttat

SEQ ID NO: 36408 - DNA, 15 bp, Homo sapiens
aattttgttttgtta

SEQ ID NO: 36409 - DNA, 15 bp, Homo sapiens
taattttgttttgtt

SEQ ID NO: 36410 - DNA, 15 bp, Homo sapiens
ttaattttgttttgt

SEQ ID NO: 36411 - DNA, 15 bp, Homo sapiens
tttaattttgttttg

SEQ ID NO: 36412 - DNA, 15 bp, Homo sapiens
ttttaattttgtttt

SEQ ID NO: 36413 - DNA, 15 bp, Homo sapiens
tttttaattttgttt

SEQ ID NO: 36414 - DNA, 15 bp, Homo sapiens
ttttttaattttgtt

SEQ ID NO: 36415 - DNA, 15 bp, Homo sapiens
attttttaattttgt

SEQ ID NO: 36416 - DNA, 15 bp, Homo sapiens
cattttttaattttg

SEQ ID NO: 36417 - DNA, 15 bp, Homo sapiens
tcattttttaatttt

SEQ ID NO: 36418 - DNA, 15 bp, Homo sapiens
gattcattttttaat

SEQ ID NO: 36419 - DNA, 15 bp, Homo sapiens
tgattcattttttaa

SEQ ID NO: 36420 - DNA, 15 bp, Homo sapiens
ctgattcatttttta

SEQ ID NO: 36421 - DNA, 15 bp, Homo sapiens
actgattcatttttt

SEQ ID NO: 36422 - DNA, 15 bp, Homo sapiens
tactgattcattttt

SEQ ID NO: 36423 - DNA, 15 bp, Homo sapiens
ctactgattcatttt

SEQ ID NO: 36424 - DNA, 15 bp, Homo sapiens
tctactgattcattt

SEQ ID NO: 36425 - DNA, 15 bp, Homo sapiens
ctctactgattcatt

SEQ ID NO: 36426 - DNA, 15 bp, Homo sapiens
tctctactgattcat

SEQ ID NO: 36427 - DNA, 15 bp, Homo sapiens
gtctctactgattca

SEQ ID NO: 36428 - DNA, 15 bp, Homo sapiens
tgtctctactgattc

SEQ ID NO: 36429 - DNA, 15 bp, Homo sapiens
ttgtctctactgatt

SEQ ID NO: 36430 - DNA, 15 bp, Homo sapiens
tttgtctctactgat

SEQ ID NO: 36431 - DNA, 15 bp, Homo sapiens
ttttgtctctactga

SEQ ID NO: 36432 - DNA, 15 bp, Homo sapiens
tttttgtctctactg

SEQ ID NO: 36433 - DNA, 15 bp, Homo sapiens
ctttttgtctctact

SEQ ID NO: 36434 - DNA, 15 bp, Homo sapiens
tctttttgtctctac

SEQ ID NO: 36435 - DNA, 15 bp, Homo sapiens
ctctttttgtctcta

SEQ ID NO: 36436 - DNA, 15 bp, Homo sapiens
gctctttttgtctct

SEQ ID NO: 36437 - DNA, 15 bp, Homo sapiens
tgctctttttgtctc

SEQ ID NO: 36438 - DNA, 15 bp, Homo sapiens
atgctctttttgtct

SEQ ID NO: 36439 - DNA, 15 bp, Homo sapiens
catgctctttttgtc

SEQ ID NO: 36440 - DNA, 15 bp, Homo sapiens
ccatgctctttttgt

SEQ ID NO: 36441 - DNA, 15 bp, Homo sapiens
tccatgctctttttg

SEQ ID NO: 36442 - DNA, 15 bp, Homo sapiens
atccatgctcttttt

SEQ ID NO: 36443 - DNA, 15 bp, Homo sapiens
catccatgctctttt

SEQ ID NO: 36444 - DNA, 15 bp, Homo sapiens
acatccatgctcttt

SEQ ID NO: 36445 - DNA, 15 bp, Homo sapiens
aacatccatgctctt

SEQ ID NO: 36446 - DNA, 15 bp, Homo sapiens
taacatccatgctct

SEQ ID NO: 36447 - DNA, 15 bp, Homo sapiens
ttaacatccatgctc

SEQ ID NO: 36448 - DNA, 15 bp, Homo sapiens
tttaacatccatgct

SEQ ID NO: 36449 - DNA, 15 bp, Homo sapiens
ttttaacatccatgc

SEQ ID NO: 36450 - DNA, 15 bp, Homo sapiens
attttaacatccatg

SEQ ID NO: 36451 - DNA, 15 bp, Homo sapiens
cattttaacatccat

SEQ ID NO: 36452 - DNA, 15 bp, Homo sapiens
acattttaacatcca

SEQ ID NO: 36453 - DNA, 15 bp, Homo sapiens
tacattttaacatcc

SEQ ID NO: 36454 - DNA, 15 bp, Homo sapiens
ttacattttaacatc

SEQ ID NO: 36455 - DNA, 15 bp, Homo sapiens
gttacattttaacat

SEQ ID NO: 36456 - DNA, 15 bp, Homo sapiens
agttacattttaaca

SEQ ID NO: 36457 - DNA, 15 bp, Homo sapiens
tagttacattttaac

SEQ ID NO: 36458 - DNA, 15 bp, Homo sapiens
ttagttacattttaa

SEQ ID NO: 36459 - DNA, 15 bp, Homo sapiens
tttagttacatttta

SEQ ID NO: 36460 - DNA, 15 bp, Homo sapiens
cttttagttacattt

SEQ ID NO: 36461 - DNA, 15 bp, Homo sapiens
tcttttagttacatt

SEQ ID NO: 36462 - DNA, 15 bp, Homo sapiens
atcttttagttacat

SEQ ID NO: 36463 - DNA, 15 bp, Homo sapiens
catcttttagttaca

SEQ ID NO: 36464 - DNA, 15 bp, Homo sapiens
gcatcttttagttac

SEQ ID NO: 36465 - DNA, 15 bp, Homo sapiens
ggcatcttttagtta

SEQ ID NO: 36466 - DNA, 15 bp, Homo sapiens
gggcatcttttagtt

SEQ ID NO: 36467 - DNA, 15 bp, Homo sapiens
agggcatcttttagt

SEQ ID NO: 36468 - DNA, 15 bp, Homo sapiens
cagggcatcttttag

SEQ ID NO: 36469 - DNA, 15 bp, Homo sapiens
gcagggcatctttta

SEQ ID NO: 36470 - DNA, 15 bp, Homo sapiens
tgcagggcatctttt

SEQ ID NO: 36471 - DNA, 15 bp, Homo sapiens
gtgcagggcatcttt

SEQ ID NO: 36472 - DNA, 15 bp, Homo sapiens
cgtgcagggcatctt

SEQ ID NO: 36473 - DNA, 15 bp, Homo sapiens
ccgtgcagggcatct

SEQ ID NO: 36474 - DNA, 15 bp, Homo sapiens
accgtgcagggcatc

SEQ ID NO: 36475 - DNA, 15 bp, Homo sapiens
caccgtgcagggcat

SEQ ID NO: 36476 - DNA, 15 bp, Homo sapiens
ccaccgtgcagggca

SEQ ID NO: 36477 - DNA, 15 bp, Homo sapiens
gccaccgtgcagggc

SEQ ID NO: 36478 - DNA, 15 bp, Homo sapiens
agccaccgtgcaggg

SEQ ID NO: 36479 - DNA, 15 bp, Homo sapiens
gagccaccgtgcagg

SEQ ID NO: 36480 - DNA, 15 bp, Homo sapiens
tgagccaccgtgcag

SEQ ID NO: 36481 - DNA, 15 bp, Homo sapiens
gtgagccaccgtgca

SEQ ID NO: 36482 - DNA, 15 bp, Homo sapiens
agtgagccaccgtgc

SEQ ID NO: 36483 - DNA, 15 bp, Homo sapiens
gagtgagccaccgtg

SEQ ID NO: 36484 - DNA, 15 bp, Homo sapiens
ggagtgagccaccgt

SEQ ID NO: 36485 - DNA, 15 bp, Homo sapiens
aggagtgagccaccg

SEQ ID NO: 36486 - DNA, 15 bp, Homo sapiens
caggagtgagccacc

SEQ ID NO: 36487 - DNA, 15 bp, Homo sapiens
acaggagtgagccac

SEQ ID NO: 36488 - DNA, 15 bp, Homo sapiens
tacaggagtgagcca

SEQ ID NO: 36489 - DNA, 15 bp, Homo sapiens
ttacaggagtgagcc

SEQ ID NO: 36490 - DNA, 15 bp, Homo sapiens
attacaggagtgagc

SEQ ID NO: 36491 - DNA, 15 bp, Homo sapiens
gattacaggagtgag

SEQ ID NO: 36492 - DNA, 15 bp, Homo sapiens
ggattacaggagtga

SEQ ID NO: 36493 - DNA, 15 bp, Homo sapiens
gggattacaggagtg

SEQ ID NO: 36494 - DNA, 15 bp, Homo sapiens
tgggattacaggagt

SEQ ID NO: 36495 - DNA, 15 bp, Homo sapiens
ctgggattacaggag

SEQ ID NO: 36496 - DNA, 15 bp, Homo sapiens
gctgggattacagga

SEQ ID NO: 36497 - DNA, 15 bp, Homo sapiens
tggcctcccaaagtg

SEQ ID NO: 36498 - DNA, 15 bp, Homo sapiens
gccttggcctcccaa

SEQ ID NO: 36499 - DNA, 15 bp, Homo sapiens
cgccttggcctccca

SEQ ID NO: 36500 - DNA, 15 bp, Homo sapiens
ccgccttggcctccc

SEQ ID NO: 36501 - DNA, 15 bp, Homo sapiens
cccgccttggcctcc

SEQ ID NO: 36502 - DNA, 15 bp, Homo sapiens
gcccgccttggcctc

SEQ ID NO: 36503 - DNA, 15 bp, Homo sapiens
tatccgcccgccttg

SEQ ID NO: 36504 - DNA, 15 bp, Homo sapiens
ttatccgcccgcctt

SEQ ID NO: 36505 - DNA, 15 bp, Homo sapiens
gttatccgcccgcct

SEQ ID NO: 36506 - DNA, 15 bp, Homo sapiens
agttatccgcccgcc

SEQ ID NO: 36507 - DNA, 15 bp, Homo sapiens
aagttatccgcccgc

SEQ ID NO: 36508 - DNA, 15 bp, Homo sapiens
caagttatccgcccg

SEQ ID NO: 36509 - DNA, 15 bp, Homo sapiens
tcaagttatccgccc

SEQ ID NO: 36510 - DNA, 15 bp, Homo sapiens
ctcaagttatccgcc

SEQ ID NO: 36511 - DNA, 15 bp, Homo sapiens
cctcaagttatccgc

SEQ ID NO: 36512 - DNA, 15 bp, Homo sapiens
acctcaagttatccg

SEQ ID NO: 36513 - DNA, 15 bp, Homo sapiens
gacctcaagttatcc

SEQ ID NO: 36514 - DNA, 15 bp, Homo sapiens
tgacctcaagttatc

SEQ ID NO: 36515 - DNA, 15 bp, Homo sapiens
ctgacctcaagttat

SEQ ID NO: 36516 - DNA, 15 bp, Homo sapiens
cctgacctcaagtta

SEQ ID NO: 36517 - DNA, 15 bp, Homo sapiens
tcctgacctcaagtt

SEQ ID NO: 36518 - DNA, 15 bp, Homo sapiens
ccaggctggtctcaa

SEQ ID NO: 36519 - DNA, 15 bp, Homo sapiens
gccaggctggtctca

SEQ ID NO: 36520 - DNA, 15 bp, Homo sapiens
attggccaggctggt

SEQ ID NO: 36521 - DNA, 15 bp, Homo sapiens
tattggccaggctgg

SEQ ID NO: 36522 - DNA, 15 bp, Homo sapiens
atattggccaggctg

SEQ ID NO: 36523 - DNA, 15 bp, Homo sapiens
catattggccaggct

SEQ ID NO: 36524 - DNA, 15 bp, Homo sapiens
ccatattggccaggc

SEQ ID NO: 36525 - DNA, 15 bp, Homo sapiens
accatattggccagg

SEQ ID NO: 36526 - DNA, 15 bp, Homo sapiens
caccatattggccag

SEQ ID NO: 36527 - DNA, 15 bp, Homo sapiens
tcaccatattggcca

SEQ ID NO: 36528 - DNA, 15 bp, Homo sapiens
ttcaccatattggcc

SEQ ID NO: 36529 - DNA, 15 bp, Homo sapiens
tttcaccatattggc

SEQ ID NO: 36530 - DNA, 15 bp, Homo sapiens
gtttcaccatattgg

SEQ ID NO: 36531 - DNA, 15 bp, Homo sapiens
ggtttcaccatattg

SEQ ID NO: 36532 - DNA, 15 bp, Homo sapiens
gggtttcaccatatt

SEQ ID NO: 36533 - DNA, 15 bp, Homo sapiens
ggggtttcaccatat

SEQ ID NO: 36534 - DNA, 15 bp, Homo sapiens
tggggtttcaccata

SEQ ID NO: 36535 - DNA, 15 bp, Homo sapiens
tagtagagatggggt

SEQ ID NO: 36536 - DNA, 15 bp, Homo sapiens
ttagtagagatgggg

SEQ ID NO: 36537 - DNA, 15 bp, Homo sapiens
tttagtagagatggg

SEQ ID NO: 36538 - DNA, 15 bp, Homo sapiens
ttttagtagagatgg

SEQ ID NO: 36539 - DNA, 15 bp, Homo sapiens
tttttagtagagatg

SEQ ID NO: 36540 - DNA, 15 bp, Homo sapiens
gtttttagtagagat

SEQ ID NO: 36541 - DNA, 15 bp, Homo sapiens
tgtttttagtagaga

SEQ ID NO: 36542 - DNA, 15 bp, Homo sapiens
gtgtttttagtagag

SEQ ID NO: 36543 - DNA, 15 bp, Homo sapiens
tgtgtttttagtaga

SEQ ID NO: 36544 - DNA, 15 bp, Homo sapiens
ttgtgtttttagtag

SEQ ID NO: 36545 - DNA, 15 bp, Homo sapiens
attgtgtttttagta

SEQ ID NO: 36546 - DNA, 15 bp, Homo sapiens
aattgtgtttttagt

SEQ ID NO: 36547 - DNA, 15 bp, Homo sapiens
aaattgtgtttttag

SEQ ID NO: 36548 - DNA, 15 bp, Homo sapiens
aaaattgtgttttta

SEQ ID NO: 36549 - DNA, 15 bp, Homo sapiens
aaaaattgtgttttt

SEQ ID NO: 36550 - DNA, 15 bp, Homo sapiens
aaaaaattgtgtttt

SEQ ID NO: 36551 - DNA, 15 bp, Homo sapiens
aaaaaaattgtgttt

SEQ ID NO: 36552 - DNA, 15 bp, Homo sapiens
aaaaaaaattgtgtt

SEQ ID NO: 36553 - DNA, 15 bp, Homo sapiens
aaaaaaaaattgtgt

SEQ ID NO: 36554 - DNA, 15 bp, Homo sapiens
aaaaaaaaaattgtg

SEQ ID NO: 36555 - DNA, 15 bp, Homo sapiens
aaaaaaaaaaattgt

SEQ ID NO: 36556 - DNA, 15 bp, Homo sapiens
ctaaaaaaaaaaaaa

SEQ ID NO: 36557 - DNA, 15 bp, Homo sapiens
acctaaaaaaaaaaa

SEQ ID NO: 36558 - DNA, 15 bp, Homo sapiens
cacctaaaaaaaaaa

SEQ ID NO: 36559 - DNA, 15 bp, Homo sapiens
ccacctaaaaaaaaa

SEQ ID NO: 36560 - DNA, 15 bp, Homo sapiens
tccacctaaaaaaaa

SEQ ID NO: 36561 - DNA, 15 bp, Homo sapiens
ctccacctaaaaaaa

SEQ ID NO: 36562 - DNA, 15 bp, Homo sapiens
actccacctaaaaaa

SEQ ID NO: 36563 - DNA, 15 bp, Homo sapiens
gactccacctaaaaa

SEQ ID NO: 36564 - DNA, 15 bp, Homo sapiens
agactccacctaaaa

SEQ ID NO: 36565 - DNA, 15 bp, Homo sapiens
gagactccacctaaa

SEQ ID NO: 36566 - DNA, 15 bp, Homo sapiens
tgagactccacctaa

SEQ ID NO: 36567 - DNA, 15 bp, Homo sapiens
gtgagactccaccta

SEQ ID NO: 36568 - DNA, 15 bp, Homo sapiens
agtgagactccacct

SEQ ID NO: 36569 - DNA, 15 bp, Homo sapiens
gagtgagactccacc

SEQ ID NO: 36570 - DNA, 15 bp, Homo sapiens
agagtgagactccac

SEQ ID NO: 36571 - DNA, 15 bp, Homo sapiens
tggtgacagagtgag

SEQ ID NO: 36572 - DNA, 15 bp, Homo sapiens
ctggtgacagagtga

SEQ ID NO: 36573 - DNA, 15 bp, Homo sapiens
cctggtgacagagtg

SEQ ID NO: 36574 - DNA, 15 bp, Homo sapiens
gcctggtgacagagt

SEQ ID NO: 36575 - DNA, 15 bp, Homo sapiens
gcactccagcctggt

SEQ ID NO: 36576 - DNA, 15 bp, Homo sapiens
atgagccgagatcac

SEQ ID NO: 36577 - DNA, 15 bp, Homo sapiens
aatgagccgagatca

SEQ ID NO: 36578 - DNA, 15 bp, Homo sapiens
gaggttgcaatgagc

SEQ ID NO: 36579 - DNA, 15 bp, Homo sapiens
cgggaggcggaggtt

SEQ ID NO: 36580 - DNA, 15 bp, Homo sapiens
ccgggaggcggaggt

SEQ ID NO: 36581 - DNA, 15 bp, Homo sapiens
cccgggaggcggagg

SEQ ID NO: 36582 - DNA, 15 bp, Homo sapiens
gcccgggaggcggag

SEQ ID NO: 36583 - DNA, 15 bp, Homo sapiens
agcccgggaggcgga

SEQ ID NO: 36584 - DNA, 15 bp, Homo sapiens
gagcccgggaggcgg

SEQ ID NO: 36585 - DNA, 15 bp, Homo sapiens
tgagcccgggaggcg

SEQ ID NO: 36586 - DNA, 15 bp, Homo sapiens
ttgagcccgggaggc

SEQ ID NO: 36587 - DNA, 15 bp, Homo sapiens
cttgagcccgggagg

SEQ ID NO: 36588 - DNA, 15 bp, Homo sapiens
acttgagcccgggag

SEQ ID NO: 36589 - DNA, 15 bp, Homo sapiens
cacttgagcccggga

SEQ ID NO: 36590 - DNA, 15 bp, Homo sapiens
tcacttgagcccggg

SEQ ID NO: 36591 - DNA, 15 bp, Homo sapiens
aatcacttgagcccg

SEQ ID NO: 36592 - DNA, 15 bp, Homo sapiens
gaatcacttgagccc

SEQ ID NO: 36593 - DNA, 15 bp, Homo sapiens
agaatcacttgagcc

SEQ ID NO: 36594 - DNA, 15 bp, Homo sapiens
gagaatcacttgagc

SEQ ID NO: 36595 - DNA, 15 bp, Homo sapiens
agagaatcacttgag

SEQ ID NO: 36596 - DNA, 15 bp, Homo sapiens
aagagaatcacttga

SEQ ID NO: 36597 - DNA, 15 bp, Homo sapiens
caagagaatcacttg

SEQ ID NO: 36598 - DNA, 15 bp, Homo sapiens
gcaagagaatcactt

SEQ ID NO: 36599 - DNA, 15 bp, Homo sapiens
ggcaagagaatcact

SEQ ID NO: 36600 - DNA, 15 bp, Homo sapiens
aggcaagagaatcac

SEQ ID NO: 36601 - DNA, 15 bp, Homo sapiens
gaggcaagagaatca

SEQ ID NO: 36602 - DNA, 15 bp, Homo sapiens
tgaggcaagagaatc

SEQ ID NO: 36603 - DNA, 15 bp, Homo sapiens
ctgaggcaagagaat

SEQ ID NO: 36604 - DNA, 15 bp, Homo sapiens
gctgaggcaagagaa

SEQ ID NO: 36605 - DNA, 15 bp, Homo sapiens
agctgaggcaagaga

SEQ ID NO: 36606 - DNA, 15 bp, Homo sapiens
gagctgaggcaagag

SEQ ID NO: 36607 - DNA, 15 bp, Homo sapiens
ggagctgaggcaaga

SEQ ID NO: 36608 - DNA, 15 bp, Homo sapiens
gggagctgaggcaag

SEQ ID NO: 36609 - DNA, 15 bp, Homo sapiens
tgggagctgaggcaa

SEQ ID NO: 36610 - DNA, 15 bp, Homo sapiens
ctgggagctgaggca

SEQ ID NO: 36611 - DNA, 15 bp, Homo sapiens
tctgggagctgaggc

SEQ ID NO: 36612 - DNA, 15 bp, Homo sapiens
ctctgggagctgagg

SEQ ID NO: 36613 - DNA, 15 bp, Homo sapiens
actctgggagctgag

SEQ ID NO: 36614 - DNA, 15 bp, Homo sapiens
tactctgggagctga

SEQ ID NO: 36615 - DNA, 15 bp, Homo sapiens
ctactctgggagctg

SEQ ID NO: 36616 - DNA, 15 bp, Homo sapiens
gctactctgggagct

SEQ ID NO: 36617 - DNA, 15 bp, Homo sapiens
agctactctgggagc

SEQ ID NO: 36618 - DNA, 15 bp, Homo sapiens
cagctactctgggag

SEQ ID NO: 36619 - DNA, 15 bp, Homo sapiens
ccagctactctggga

SEQ ID NO: 36620 - DNA, 15 bp, Homo sapiens
cccagctactctggg

SEQ ID NO: 36621 - DNA, 15 bp, Homo sapiens
cagtcccagctactc

SEQ ID NO: 36622 - DNA, 15 bp, Homo sapiens
gcagtcccagctact

SEQ ID NO: 36623 - DNA, 15 bp, Homo sapiens
tgcagtcccagctac

SEQ ID NO: 36624 - DNA, 15 bp, Homo sapiens
gtgcctgcagtccca

SEQ ID NO: 36625 - DNA, 15 bp, Homo sapiens
cgtgcctgcagtccc

SEQ ID NO: 36626 - DNA, 15 bp, Homo sapiens
acgtgcctgcagtcc

SEQ ID NO: 36627 - DNA, 15 bp, Homo sapiens
cacgtgcctgcagtc

SEQ ID NO: 36628 - DNA, 15 bp, Homo sapiens
gcacgtgcctgcagt

SEQ ID NO: 36629 - DNA, 15 bp, Homo sapiens
ggcacgtgcctgcag

SEQ ID NO: 36630 - DNA, 15 bp, Homo sapiens
tggcacgtgcctgca

SEQ ID NO: 36631 - DNA, 15 bp, Homo sapiens
gtggcacgtgcctgc

SEQ ID NO: 36632 - DNA, 15 bp, Homo sapiens
tgtggtggcacgtgc

SEQ ID NO: 36633 - DNA, 15 bp, Homo sapiens
gtgtggtggcacgtg

SEQ ID NO: 36634 - DNA, 15 bp, Homo sapiens
ggtgtggtggcacgt

SEQ ID NO: 36635 - DNA, 15 bp, Homo sapiens
gggtgtggtggcacg

SEQ ID NO: 36636 - DNA, 15 bp, Homo sapiens
tgggtgtggtggcac

SEQ ID NO: 36637 - DNA, 15 bp, Homo sapiens
tcatctctactaaaa

SEQ ID NO: 36638 - DNA, 15 bp, Homo sapiens
ctcatctctactaaa

SEQ ID NO: 36639 - DNA, 15 bp, Homo sapiens
cctcatctctactaa

SEQ ID NO: 36640 - DNA, 15 bp, Homo sapiens
acctcatctctacta

SEQ ID NO: 36641 - DNA, 15 bp, Homo sapiens
aacctcatctctact

SEQ ID NO: 36642 - DNA, 15 bp, Homo sapiens
aaacctcatctctac

SEQ ID NO: 36643 - DNA, 15 bp, Homo sapiens
gaaacctcatctcta

SEQ ID NO: 36644 - DNA, 15 bp, Homo sapiens
tgaaacctcatctct

SEQ ID NO: 36645 - DNA, 15 bp, Homo sapiens
gtgaaacctcatctc

SEQ ID NO: 36646 - DNA, 15 bp, Homo sapiens
ggtgaaacctcatct

SEQ ID NO: 36647 - DNA, 15 bp, Homo sapiens
tggtgaaacctcatc

SEQ ID NO: 36648 - DNA, 15 bp, Homo sapiens
atggtgaaacctcat

SEQ ID NO: 36649 - DNA, 15 bp, Homo sapiens
catggtgaaacctca

SEQ ID NO: 36650 - DNA, 15 bp, Homo sapiens
gaccagcctgaccaa

SEQ ID NO: 36651 - DNA, 15 bp, Homo sapiens
agaccagcctgacca

SEQ ID NO: 36652 - DNA, 15 bp, Homo sapiens
aagaccagcctgacc

SEQ ID NO: 36653 - DNA, 15 bp, Homo sapiens
taagaccagcctgac

SEQ ID NO: 36654 - DNA, 15 bp, Homo sapiens
ttaagaccagcctga

SEQ ID NO: 36655 - DNA, 15 bp, Homo sapiens
attaagaccagcctg

SEQ ID NO: 36656 - DNA, 15 bp, Homo sapiens
gattaagaccagcct

SEQ ID NO: 36657 - DNA, 15 bp, Homo sapiens
agattaagaccagcc

SEQ ID NO: 36658 - DNA, 15 bp, Homo sapiens
gagattaagaccagc

SEQ ID NO: 36659 - DNA, 15 bp, Homo sapiens
ggagattaagaccag

SEQ ID NO: 36660 - DNA, 15 bp, Homo sapiens
aggagattaagacca

SEQ ID NO: 36661 - DNA, 15 bp, Homo sapiens
caggagattaagacc

SEQ ID NO: 36662 - DNA, 15 bp, Homo sapiens
tcaggagattaagac

SEQ ID NO: 36663 - DNA, 15 bp, Homo sapiens
gtcaggagattaaga

SEQ ID NO: 36664 - DNA, 15 bp, Homo sapiens
ggtcaggagattaag

SEQ ID NO: 36665 - DNA, 15 bp, Homo sapiens
aggtcaggagattaa

SEQ ID NO: 36666 - DNA, 15 bp, Homo sapiens
gaggtcaggagatta

SEQ ID NO: 36667 - DNA, 15 bp, Homo sapiens
cgaggtcaggagatt

SEQ ID NO: 36668 - DNA, 15 bp, Homo sapiens
ccgaggtcaggagat

SEQ ID NO: 36669 - DNA, 15 bp, Homo sapiens
cccgaggtcaggaga

SEQ ID NO: 36670 - DNA, 15 bp, Homo sapiens
tcccgaggtcaggag

SEQ ID NO: 36671 - DNA, 15 bp, Homo sapiens
atcccgaggtcagga

SEQ ID NO: 36672 - DNA, 15 bp, Homo sapiens
gatcccgaggtcagg

SEQ ID NO: 36673 - DNA, 15 bp, Homo sapiens
ggatcccgaggtcag

SEQ ID NO: 36674 - DNA, 15 bp, Homo sapiens
cggatcccgaggtca

SEQ ID NO: 36675 - DNA, 15 bp, Homo sapiens
gcggatcccgaggtc

SEQ ID NO: 36676 - DNA, 15 bp, Homo sapiens
ggcggatcccgaggt

SEQ ID NO: 36677 - DNA, 15 bp, Homo sapiens
gggcggatcccgagg

SEQ ID NO: 36678 - DNA, 15 bp, Homo sapiens
cgggcggatcccgag

SEQ ID NO: 36679 - DNA, 15 bp, Homo sapiens
gcgggcggatcccga

SEQ ID NO: 36680 - DNA, 15 bp, Homo sapiens
ggcgggcggatcccg

SEQ ID NO: 36681 - DNA, 15 bp, Homo sapiens
gggcgggcggatccc

SEQ ID NO: 36682 - DNA, 15 bp, Homo sapiens
ggggcgggcggatcc

SEQ ID NO: 36683 - DNA, 15 bp, Homo sapiens
aggggcgggcggatc

SEQ ID NO: 36684 - DNA, 15 bp, Homo sapiens
caggggcgggcggat

SEQ ID NO: 36685 - DNA, 15 bp, Homo sapiens
gcaggggcgggcgga

SEQ ID NO: 36686 - DNA, 15 bp, Homo sapiens
ggcaggggcgggcgg

SEQ ID NO: 36687 - DNA, 15 bp, Homo sapiens
aggcaggggcgggcg

SEQ ID NO: 36688 - DNA, 15 bp, Homo sapiens
gaggcaggggcgggc

SEQ ID NO: 36689 - DNA, 15 bp, Homo sapiens
ggaggcaggggcggg

SEQ ID NO: 36690 - DNA, 15 bp, Homo sapiens
gggaggcaggggcgg

SEQ ID NO: 36691 - DNA, 15 bp, Homo sapiens
tgggaggcaggggcg

SEQ ID NO: 36692 - DNA, 15 bp, Homo sapiens
ttgggaggcaggggc

SEQ ID NO: 36693 - DNA, 15 bp, Homo sapiens
tttgggaggcagggg

SEQ ID NO: 36694 - DNA, 15 bp, Homo sapiens
ctttgggaggcaggg

SEQ ID NO: 36695 - DNA, 15 bp, Homo sapiens
actttgggaggcagg

SEQ ID NO: 36696 - DNA, 15 bp, Homo sapiens
actgtaatcccagca

SEQ ID NO: 36697 - DNA, 15 bp, Homo sapiens
acaactgtaatccca

SEQ ID NO: 36698 - DNA, 15 bp, Homo sapiens
cacaactgtaatccc

SEQ ID NO: 36699 - DNA, 15 bp, Homo sapiens
tcacaactgtaatcc

SEQ ID NO: 36700 - DNA, 15 bp, Homo sapiens
ctcacaactgtaatc

SEQ ID NO: 36701 - DNA, 15 bp, Homo sapiens
gctcacaactgtaat

SEQ ID NO: 36702 - DNA, 15 bp, Homo sapiens
agctcacaactgtaa

SEQ ID NO: 36703 - DNA, 15 bp, Homo sapiens
tagctcacaactgta

SEQ ID NO: 36704 - DNA, 15 bp, Homo sapiens
gtagctcacaactgt

SEQ ID NO: 36705 - DNA, 15 bp, Homo sapiens
ggtagctcacaactg

SEQ ID NO: 36706 - DNA, 15 bp, Homo sapiens
cggtagctcacaact

SEQ ID NO: 36707 - DNA, 15 bp, Homo sapiens
gcggtagctcacaac

SEQ ID NO: 36708 - DNA, 15 bp, Homo sapiens
cgcggtagctcacaa

SEQ ID NO: 36709 - DNA, 15 bp, Homo sapiens
gcgcggtagctcaca

SEQ ID NO: 36710 - DNA, 15 bp, Homo sapiens
ggcgcggtagctcac

SEQ ID NO: 36711 - DNA, 15 bp, Homo sapiens
gggcgcggtagctca

SEQ ID NO: 36712 - DNA, 15 bp, Homo sapiens
tgggcgcggtagctc

SEQ ID NO: 36713 - DNA, 15 bp, Homo sapiens
ctgggcgcggtagct

SEQ ID NO: 36714 - DNA, 15 bp, Homo sapiens
gctgggcgcggtagc

SEQ ID NO: 36715 - DNA, 15 bp, Homo sapiens
ggctgggcgcggtag

SEQ ID NO: 36716 - DNA, 15 bp, Homo sapiens
aggctgggcgcggta

SEQ ID NO: 36717 - DNA, 15 bp, Homo sapiens
aaggctgggcgcggt

SEQ ID NO: 36718 - DNA, 15 bp, Homo sapiens
taaggctgggcgcgg

SEQ ID NO: 36719 - DNA, 15 bp, Homo sapiens
ttaaggctgggcgcg

SEQ ID NO: 36720 - DNA, 15 bp, Homo sapiens
tttaaggctgggcgc

SEQ ID NO: 36721 - DNA, 15 bp, Homo sapiens
ttttaaggctgggcg

SEQ ID NO: 36722 - DNA, 15 bp, Homo sapiens
tttttaaggctgggc

SEQ ID NO: 36723 - DNA, 15 bp, Homo sapiens
atttttaaggctggg

SEQ ID NO: 36724 - DNA, 15 bp, Homo sapiens
tatttttaaggctgg

SEQ ID NO: 36725 - DNA, 15 bp, Homo sapiens
gtatttttaaggctg

SEQ ID NO: 36726 - DNA, 15 bp, Homo sapiens
tgtatttttaaggct

SEQ ID NO: 36727 - DNA, 15 bp, Homo sapiens
ttgtatttttaaggc

SEQ ID NO: 36728 - DNA, 15 bp, Homo sapiens
tttgtatttttaagg

SEQ ID NO: 36729 - DNA, 15 bp, Homo sapiens
ttttgtatttttaag

SEQ ID NO: 36730 - DNA, 15 bp, Homo sapiens
ttaatttttgtattt

SEQ ID NO: 36731 - DNA, 15 bp, Homo sapiens
gttaatttttgtatt

SEQ ID NO: 36732 - DNA, 15 bp, Homo sapiens
agttaatttttgtat

SEQ ID NO: 36733 - DNA, 15 bp, Homo sapiens
cagttaatttttgta

SEQ ID NO: 36734 - DNA, 15 bp, Homo sapiens
ccagttaatttttgt

SEQ ID NO: 36735 - DNA, 15 bp, Homo sapiens
cccagttaatttttg

SEQ ID NO: 36736 - DNA, 15 bp, Homo sapiens
acccagttaattttt

SEQ ID NO: 36737 - DNA, 15 bp, Homo sapiens
cacccagttaatttt

SEQ ID NO: 36738 - DNA, 15 bp, Homo sapiens
acacccagttaattt

SEQ ID NO: 36739 - DNA, 15 bp, Homo sapiens
cacacccagttaatt

SEQ ID NO: 36740 - DNA, 15 bp, Homo sapiens
ccacacccagttaat

SEQ ID NO: 36741 - DNA, 15 bp, Homo sapiens
accacacccagttaa

SEQ ID NO: 36742 - DNA, 15 bp, Homo sapiens
caccacacccagtta

SEQ ID NO: 36743 - DNA, 15 bp, Homo sapiens
ccaccacacccagtt

SEQ ID NO: 36744 - DNA, 15 bp, Homo sapiens
gccaccacacccagt

SEQ ID NO: 36745 - DNA, 15 bp, Homo sapiens
ggccaccacacccag

SEQ ID NO: 36746 - DNA, 15 bp, Homo sapiens
aggccaccacaccca

SEQ ID NO: 36747 - DNA, 15 bp, Homo sapiens
caggccaccacaccc

SEQ ID NO: 36748 - DNA, 15 bp, Homo sapiens
gcaggccaccacacc

SEQ ID NO: 36749 - DNA, 15 bp, Homo sapiens
cgcaggccaccacac

SEQ ID NO: 36750 - DNA, 15 bp, Homo sapiens
gcgcaggccaccaca

SEQ ID NO: 36751 - DNA, 15 bp, Homo sapiens
ggcgcaggccaccac

SEQ ID NO: 36752 - DNA, 15 bp, Homo sapiens
aggcgcaggccacca

SEQ ID NO: 36753 - DNA, 15 bp, Homo sapiens
caggcgcaggccacc

SEQ ID NO: 36754 - DNA, 15 bp, Homo sapiens
acaggcgcaggccac

SEQ ID NO: 36755 - DNA, 15 bp, Homo sapiens
tacaggcgcaggcca

SEQ ID NO: 36756 - DNA, 15 bp, Homo sapiens
ttacaggcgcaggcc

SEQ ID NO: 36757 - DNA, 15 bp, Homo sapiens
attacaggcgcaggc

SEQ ID NO: 36758 - DNA, 15 bp, Homo sapiens
gattacaggcgcagg

SEQ ID NO: 36759 - DNA, 15 bp, Homo sapiens
ggattacaggcgcag

SEQ ID NO: 36760 - DNA, 15 bp, Homo sapiens
gggattacaggcgca

SEQ ID NO: 36761 - DNA, 15 bp, Homo sapiens
tgggattacaggcgc

SEQ ID NO: 36762 - DNA, 15 bp, Homo sapiens
cctgggattacaggc

SEQ ID NO: 36763 - DNA, 15 bp, Homo sapiens
acctgggattacagg

SEQ ID NO: 36764 - DNA, 15 bp, Homo sapiens
tacctgggattacag

SEQ ID NO: 36765 - DNA, 15 bp, Homo sapiens
gtacctgggattaca

SEQ ID NO: 36766 - DNA, 15 bp, Homo sapiens
agtacctgggattac

SEQ ID NO: 36767 - DNA, 15 bp, Homo sapiens
aagtacctgggatta

SEQ ID NO: 36768 - DNA, 15 bp, Homo sapiens
caagtacctgggatt

SEQ ID NO: 36769 - DNA, 15 bp, Homo sapiens
ccaagtacctgggat

SEQ ID NO: 36770 - DNA, 15 bp, Homo sapiens
cccaagtacctggga

SEQ ID NO: 36771 - DNA, 15 bp, Homo sapiens
acccaagtacctggg

SEQ ID NO: 36772 - DNA, 15 bp, Homo sapiens
cacccaagtacctgg

SEQ ID NO: 36773 - DNA, 15 bp, Homo sapiens
tcacccaagtacctg

SEQ ID NO: 36774 - DNA, 15 bp, Homo sapiens
gtcacccaagtacct

SEQ ID NO: 36775 - DNA, 15 bp, Homo sapiens
agtcacccaagtacc

SEQ ID NO: 36776 - DNA, 15 bp, Homo sapiens
cagtcacccaagtac

SEQ ID NO: 36777 - DNA, 15 bp, Homo sapiens
tcagtcacccaagta

SEQ ID NO: 36778 - DNA, 15 bp, Homo sapiens
ctcagtcacccaagt

SEQ ID NO: 36779 - DNA, 15 bp, Homo sapiens
cctcagtcacccaag

SEQ ID NO: 36780 - DNA, 15 bp, Homo sapiens
gcctcagtcacccaa

SEQ ID NO: 36781 - DNA, 15 bp, Homo sapiens
tgcctcagtcaccca

SEQ ID NO: 36782 - DNA, 15 bp, Homo sapiens
ctgcctcagtcaccc

SEQ ID NO: 36783 - DNA, 15 bp, Homo sapiens
cctgcctcagtcacc

SEQ ID NO: 36784 - DNA, 15 bp, Homo sapiens
tcctgcctcagtcac

SEQ ID NO: 36785 - DNA, 15 bp, Homo sapiens
ctcctgcctcagtca

SEQ ID NO: 36786 - DNA, 15 bp, Homo sapiens
ttctcctgcctcagt

SEQ ID NO: 36787 - DNA, 15 bp, Homo sapiens
aggcacaatctcagc

SEQ ID NO: 36788 - DNA, 15 bp, Homo sapiens
gaggcacaatctcag

SEQ ID NO: 36789 - DNA, 15 bp, Homo sapiens
agaggcacaatctca

SEQ ID NO: 36790 - DNA, 15 bp, Homo sapiens
cagaggcacaatctc

SEQ ID NO: 36791 - DNA, 15 bp, Homo sapiens
gcagaggcacaatct

SEQ ID NO: 36792 - DNA, 15 bp, Homo sapiens
tgcagaggcacaatc

SEQ ID NO: 36793 - DNA, 15 bp, Homo sapiens
gtgcagaggcacaat

SEQ ID NO: 36794 - DNA, 15 bp, Homo sapiens
agtgcagaggcacaa

SEQ ID NO: 36795 - DNA, 15 bp, Homo sapiens
gagtgcagaggcaca

SEQ ID NO: 36796 - DNA, 15 bp, Homo sapiens
ggagtgcagaggcac

SEQ ID NO: 36797 - DNA, 15 bp, Homo sapiens
tggagtgcagaggca

SEQ ID NO: 36798 - DNA, 15 bp, Homo sapiens
ctggagtgcagaggc

SEQ ID NO: 36799 - DNA, 15 bp, Homo sapiens
gctggagtgcagagg

SEQ ID NO: 36800 - DNA, 15 bp, Homo sapiens
ggctggagtgcagag

SEQ ID NO: 36801 - DNA, 15 bp, Homo sapiens
aggctggagtgcaga

SEQ ID NO: 36802 - DNA, 15 bp, Homo sapiens
acttttttttttttt

SEQ ID NO: 36803 - DNA, 15 bp, Homo sapiens
tactttttttttttt

SEQ ID NO: 36804 - DNA, 15 bp, Homo sapiens
ttacttttttttttt

SEQ ID NO: 36805 - DNA, 15 bp, Homo sapiens
gttactttttttttt

SEQ ID NO: 36806 - DNA, 15 bp, Homo sapiens
agttacttttttttt

SEQ ID NO: 36807 - DNA, 15 bp, Homo sapiens
tagttactttttttt

SEQ ID NO: 36808 - DNA, 15 bp, Homo sapiens
ttagttacttttttt

SEQ ID NO: 36809 - DNA, 15 bp, Homo sapiens
tttagttactttttt

SEQ ID NO: 36810 - DNA, 15 bp, Homo sapiens
ttttagttacttttt

SEQ ID NO: 36811 - DNA, 15 bp, Homo sapiens
cttttagttactttt

SEQ ID NO: 36812 - DNA, 15 bp, Homo sapiens
ccttttagttacttt

SEQ ID NO: 36813 - DNA, 15 bp, Homo sapiens
tccttttagttactt

SEQ ID NO: 36814 - DNA, 15 bp, Homo sapiens
ttccttttagttact

SEQ ID NO: 36815 - DNA, 15 bp, Homo sapiens
tttccttttagttac

SEQ ID NO: 36816 - DNA, 15 bp, Homo sapiens
atttccttttagtta

SEQ ID NO: 36817 - DNA, 15 bp, Homo sapiens
tatttccttttagtt

SEQ ID NO: 36818 - DNA, 15 bp, Homo sapiens
gtatttccttttagt

SEQ ID NO: 36819 - DNA, 15 bp, Homo sapiens
agtatttccttttag

SEQ ID NO: 36820 - DNA, 15 bp, Homo sapiens
aagtatttcctttta

SEQ ID NO: 36821 - DNA, 15 bp, Homo sapiens
taagtatttcctttt

SEQ ID NO: 36822 - DNA, 15 bp, Homo sapiens
ttaagtatttccttt

SEQ ID NO: 36823 - DNA, 15 bp, Homo sapiens
tttaagtatttcctt

SEQ ID NO: 36824 - DNA, 15 bp, Homo sapiens
ttttaagtatttcct

SEQ ID NO: 36825 - DNA, 15 bp, Homo sapiens
tttttaagtatttcc

SEQ ID NO: 36826 - DNA, 15 bp, Homo sapiens
ttttttaagtatttc

SEQ ID NO: 36827 - DNA, 15 bp, Homo sapiens
attttttaagtattt

SEQ ID NO: 36828 - DNA, 15 bp, Homo sapiens
tattttttaagtatt

SEQ ID NO: 36829 - DNA, 15 bp, Homo sapiens
gtattttttaagtat

SEQ ID NO: 36830 - DNA, 15 bp, Homo sapiens
agtattttttaagta

SEQ ID NO: 36831 - DNA, 15 bp, Homo sapiens
cagtattttttaagt

SEQ ID NO: 36832 - DNA, 15 bp, Homo sapiens
ccagtattttttaag

SEQ ID NO: 36833 - DNA, 15 bp, Homo sapiens
tccagtattttttaa

SEQ ID NO: 36834 - DNA, 15 bp, Homo sapiens
ttccagtatttttta

SEQ ID NO: 36835 - DNA, 15 bp, Homo sapiens
attccagtatttttt

SEQ ID NO: 36836 - DNA, 15 bp, Homo sapiens
aattccagtattttt

SEQ ID NO: 36837 - DNA, 15 bp, Homo sapiens
gaattccagtatttt

SEQ ID NO: 36838 - DNA, 15 bp, Homo sapiens
ggaattccagtattt

SEQ ID NO: 36839 - DNA, 15 bp, Homo sapiens
aggaattccagtatt

SEQ ID NO: 36840 - DNA, 15 bp, Homo sapiens
gaggaattccagtat

SEQ ID NO: 36841 - DNA, 15 bp, Homo sapiens
tgaggaattccagta

SEQ ID NO: 36842 - DNA, 15 bp, Homo sapiens
ttgaggaattccagt

SEQ ID NO: 36843 - DNA, 15 bp, Homo sapiens
attgaggaattccag

SEQ ID NO: 36844 - DNA, 15 bp, Homo sapiens
gattgaggaattcca

SEQ ID NO: 36845 - DNA, 15 bp, Homo sapiens
agattgaggaattcc

SEQ ID NO: 36846 - DNA, 15 bp, Homo sapiens
aagattgaggaattc

SEQ ID NO: 36847 - DNA, 15 bp, Homo sapiens
caagattgaggaatt

SEQ ID NO: 36848 - DNA, 15 bp, Homo sapiens
tcaagattgaggaat

SEQ ID NO: 36849 - DNA, 15 bp, Homo sapiens
atcaagattgaggaa

SEQ ID NO: 36850 - DNA, 15 bp, Homo sapiens
catcaagattgagga

SEQ ID NO: 36851 - DNA, 15 bp, Homo sapiens
tcatcaagattgagg

SEQ ID NO: 36852 - DNA, 15 bp, Homo sapiens
ttcatcaagattgag

SEQ ID NO: 36853 - DNA, 15 bp, Homo sapiens
gttcatcaagattga

SEQ ID NO: 36854 - DNA, 15 bp, Homo sapiens
agttcatcaagattg

SEQ ID NO: 36855 - DNA, 15 bp, Homo sapiens
tagttcatcaagatt

SEQ ID NO: 36856 - DNA, 15 bp, Homo sapiens
atagttcatcaagat

SEQ ID NO: 36857 - DNA, 15 bp, Homo sapiens
gatagttcatcaaga

SEQ ID NO: 36858 - DNA, 15 bp, Homo sapiens
ggatagttcatcaag

SEQ ID NO: 36859 - DNA, 15 bp, Homo sapiens
aggatagttcatcaa

SEQ ID NO: 36860 - DNA, 15 bp, Homo sapiens
aaggatagttcatca

SEQ ID NO: 36861 - DNA, 15 bp, Homo sapiens
aaaggatagttcatc

SEQ ID NO: 36862 - DNA, 15 bp, Homo sapiens
gaaaggatagttcat

SEQ ID NO: 36863 - DNA, 15 bp, Homo sapiens
ggaaaggatagttca

SEQ ID NO: 36864 - DNA, 15 bp, Homo sapiens
tggaaaggatagttc

SEQ ID NO: 36865 - DNA, 15 bp, Homo sapiens
atggaaaggatagtt

SEQ ID NO: 36866 - DNA, 15 bp, Homo sapiens
catggaaaggatagt

SEQ ID NO: 36867 - DNA, 15 bp, Homo sapiens
acatggaaaggatag

SEQ ID NO: 36868 - DNA, 15 bp, Homo sapiens
aacatggaaaggata

SEQ ID NO: 36869 - DNA, 15 bp, Homo sapiens
aaacatggaaaggat

SEQ ID NO: 36870 - DNA, 15 bp, Homo sapiens
aaaacatggaaagga

SEQ ID NO: 36871 - DNA, 15 bp, Homo sapiens
gaaaacatggaaagg

SEQ ID NO: 36872 - DNA, 15 bp, Homo sapiens
agaaaacatggaaag

SEQ ID NO: 36873 - DNA, 15 bp, Homo sapiens
gagaaaacatggaaa

SEQ ID NO: 36874 - DNA, 15 bp, Homo sapiens
ggagaaaacatggaa

SEQ ID NO: 36875 - DNA, 15 bp, Homo sapiens
gggagaaaacatgga

SEQ ID NO: 36876 - DNA, 15 bp, Homo sapiens
tgggagaaaacatgg

SEQ ID NO: 36877 - DNA, 15 bp, Homo sapiens
atgggagaaaacatg

SEQ ID NO: 36878 - DNA, 15 bp, Homo sapiens
tatgggagaaaacat

SEQ ID NO: 36879 - DNA, 15 bp, Homo sapiens
ctatgggagaaaaca

SEQ ID NO: 36880 - DNA, 15 bp, Homo sapiens
actatgggagaaaac

SEQ ID NO: 36881 - DNA, 15 bp, Homo sapiens
aactatgggagaaaa

SEQ ID NO: 36882 - DNA, 15 bp, Homo sapiens
taactatgggagaaa

SEQ ID NO: 36883 - DNA, 15 bp, Homo sapiens
ttaactatgggagaa

SEQ ID NO: 36884 - DNA, 15 bp, Homo sapiens
tttaactatgggaga

SEQ ID NO: 36885 - DNA, 15 bp, Homo sapiens
gtttaactatgggag

SEQ ID NO: 36886 - DNA, 15 bp, Homo sapiens
tgtttaactatggga

SEQ ID NO: 36887 - DNA, 15 bp, Homo sapiens
ttgtttaactatggg

SEQ ID NO: 36888 - DNA, 15 bp, Homo sapiens
cttgtttaactatgg

SEQ ID NO: 36889 - DNA, 15 bp, Homo sapiens
ccttgtttaactatg

SEQ ID NO: 36890 - DNA, 15 bp, Homo sapiens
tccttgtttaactat

SEQ ID NO: 36891 - DNA, 15 bp, Homo sapiens
ctccttgtttaacta

SEQ ID NO: 36892 - DNA, 15 bp, Homo sapiens
actccttgtttaact

SEQ ID NO: 36893 - DNA, 15 bp, Homo sapiens
aactccttgtttaac

SEQ ID NO: 36894 - DNA, 15 bp, Homo sapiens
aaactccttgtttaa

SEQ ID NO: 36895 - DNA, 15 bp, Homo sapiens
aaaactccttgttta

SEQ ID NO: 36896 - DNA, 15 bp, Homo sapiens
aaaaactccttgttt

SEQ ID NO: 36897 - DNA, 15 bp, Homo sapiens
taaaaactccttgtt

SEQ ID NO: 36898 - DNA, 15 bp, Homo sapiens
gtaaaaactccttgt

SEQ ID NO: 36899 - DNA, 15 bp, Homo sapiens
agtaaaaactccttg

SEQ ID NO: 36900 - DNA, 15 bp, Homo sapiens
aagtaaaaactcctt

SEQ ID NO: 36901 - DNA, 15 bp, Homo sapiens
gaagtaaaaactcct

SEQ ID NO: 36902 - DNA, 15 bp, Homo sapiens
agaagtaaaaactcc

SEQ ID NO: 36903 - DNA, 15 bp, Homo sapiens
aagaagtaaaaactc

SEQ ID NO: 36904 - DNA, 15 bp, Homo sapiens
aaagaagtaaaaact

SEQ ID NO: 36905 - DNA, 15 bp, Homo sapiens
aaaagaagtaaaaac

SEQ ID NO: 36906 - DNA, 15 bp, Homo sapiens
caaaagaagtaaaaa

SEQ ID NO: 36907 - DNA, 15 bp, Homo sapiens
ccaaaagaagtaaaa

SEQ ID NO: 36908 - DNA, 15 bp, Homo sapiens
cccaaaagaagtaaa

SEQ ID NO: 36909 - DNA, 15 bp, Homo sapiens
gcccaaaagaagtaa

SEQ ID NO: 36910 - DNA, 15 bp, Homo sapiens
tgcccaaaagaagta

SEQ ID NO: 36911 - DNA, 15 bp, Homo sapiens
ctgcccaaaagaagt

SEQ ID NO: 36912 - DNA, 15 bp, Homo sapiens
actgcccaaaagaag

SEQ ID NO: 36913 - DNA, 15 bp, Homo sapiens
tactgcccaaaagaa

SEQ ID NO: 36914 - DNA, 15 bp, Homo sapiens
ctactgcccaaaaga

SEQ ID NO: 36915 - DNA, 15 bp, Homo sapiens
gctactgcccaaaag

SEQ ID NO: 36916 - DNA, 15 bp, Homo sapiens
agctactgcccaaaa

SEQ ID NO: 36917 - DNA, 15 bp, Homo sapiens
tagctactgcccaaa

SEQ ID NO: 36918 - DNA, 15 bp, Homo sapiens
gtagctactgcccaa

SEQ ID NO: 36919 - DNA, 15 bp, Homo sapiens
tgtagctactgccca

SEQ ID NO: 36920 - DNA, 15 bp, Homo sapiens
atgtagctactgccc

SEQ ID NO: 36921 - DNA, 15 bp, Homo sapiens
tatgtagctactgcc

SEQ ID NO: 36922 - DNA, 15 bp, Homo sapiens
ctatgtagctactgc

SEQ ID NO: 36923 - DNA, 15 bp, Homo sapiens
actatgtagctactg

SEQ ID NO: 36924 - DNA, 15 bp, Homo sapiens
tactatgtagctact

SEQ ID NO: 36925 - DNA, 15 bp, Homo sapiens
atactatgtagctac

SEQ ID NO: 36926 - DNA, 15 bp, Homo sapiens
catactatgtagcta

SEQ ID NO: 36927 - DNA, 15 bp, Homo sapiens
tcatactatgtagct

SEQ ID NO: 36928 - DNA, 15 bp, Homo sapiens
ctcatactatgtagc

SEQ ID NO: 36929 - DNA, 15 bp, Homo sapiens
tctcatactatgtag

SEQ ID NO: 36930 - DNA, 15 bp, Homo sapiens
gtctcatactatgta

SEQ ID NO: 36931 - DNA, 15 bp, Homo sapiens
agtctcatactatgt

SEQ ID NO: 36932 - DNA, 15 bp, Homo sapiens
aagtctcatactatg

SEQ ID NO: 36933 - DNA, 15 bp, Homo sapiens
gaagtctcatactat

SEQ ID NO: 36934 - DNA, 15 bp, Homo sapiens
agaagtctcatacta

SEQ ID NO: 36935 - DNA, 15 bp, Homo sapiens
tagaagtctcatact

SEQ ID NO: 36936 - DNA, 15 bp, Homo sapiens
ctagaagtctcatac

SEQ ID NO: 36937 - DNA, 15 bp, Homo sapiens
actagaagtctcata

SEQ ID NO: 36938 - DNA, 15 bp, Homo sapiens
tactagaagtctcat

SEQ ID NO: 36939 - DNA, 15 bp, Homo sapiens
ctactagaagtctca

SEQ ID NO: 36940 - DNA, 15 bp, Homo sapiens
actactagaagtctc

SEQ ID NO: 36941 - DNA, 15 bp, Homo sapiens
cactactagaagtct

SEQ ID NO: 36942 - DNA, 15 bp, Homo sapiens
gcactactagaagtc

SEQ ID NO: 36943 - DNA, 15 bp, Homo sapiens
tgcactactagaagt

SEQ ID NO: 36944 - DNA, 15 bp, Homo sapiens
gtgcactactagaag

SEQ ID NO: 36945 - DNA, 15 bp, Homo sapiens
agtgcactactagaa

SEQ ID NO: 36946 - DNA, 15 bp, Homo sapiens
tagtgcactactaga

SEQ ID NO: 36947 - DNA, 15 bp, Homo sapiens
atagtgcactactag

SEQ ID NO: 36948 - DNA, 15 bp, Homo sapiens
catagtgcactacta

SEQ ID NO: 36949 - DNA, 15 bp, Homo sapiens
gcatagtgcactact

SEQ ID NO: 36950 - DNA, 15 bp, Homo sapiens
agcatagtgcactac

SEQ ID NO: 36951 - DNA, 15 bp, Homo sapiens
tagcatagtgcacta

SEQ ID NO: 36952 - DNA, 15 bp, Homo sapiens
ttagcatagtgcact

SEQ ID NO: 36953 - DNA, 15 bp, Homo sapiens
gttagcatagtgcac

SEQ ID NO: 36954 - DNA, 15 bp, Homo sapiens
tgttagcatagtgca

SEQ ID NO: 36955 - DNA, 15 bp, Homo sapiens
atgttagcatagtgc

SEQ ID NO: 36956 - DNA, 15 bp, Homo sapiens
gatgttagcatagtg

SEQ ID NO: 36957 - DNA, 15 bp, Homo sapiens
tgatgttagcatagt

SEQ ID NO: 36958 - DNA, 15 bp, Homo sapiens
atgatgttagcatag

SEQ ID NO: 36959 - DNA, 15 bp, Homo sapiens
gatgatgttagcata

SEQ ID NO: 36960 - DNA, 15 bp, Homo sapiens
tgatgatgttagcat

SEQ ID NO: 36961 - DNA, 15 bp, Homo sapiens
gtgatgatgttagca

SEQ ID NO: 36962 - DNA, 15 bp, Homo sapiens
tgtgatgatgttagc

SEQ ID NO: 36963 - DNA, 15 bp, Homo sapiens
gtgtgatgatgttag

SEQ ID NO: 36964 - DNA, 15 bp, Homo sapiens
agtgtgatgatgtta

SEQ ID NO: 36965 - DNA, 15 bp, Homo sapiens
aagtgtgatgatgtt

SEQ ID NO: 36966 - DNA, 15 bp, Homo sapiens
caagtgtgatgatgt

SEQ ID NO: 36967 - DNA, 15 bp, Homo sapiens
tcaagtgtgatgatg

SEQ ID NO: 36968 - DNA, 15 bp, Homo sapiens
ttcaagtgtgatgat

SEQ ID NO: 36969 - DNA, 15 bp, Homo sapiens
attcaagtgtgatga

SEQ ID NO: 36970 - DNA, 15 bp, Homo sapiens
cattcaagtgtgatg

SEQ ID NO: 36971 - DNA, 15 bp, Homo sapiens
acattcaagtgtgat

SEQ ID NO: 36972 - DNA, 15 bp, Homo sapiens
aacattcaagtgtga

SEQ ID NO: 36973 - DNA, 15 bp, Homo sapiens
aaacattcaagtgtg

SEQ ID NO: 36974 - DNA, 15 bp, Homo sapiens
aaaacattcaagtgt

SEQ ID NO: 36975 - DNA, 15 bp, Homo sapiens
aaaaacattcaagtg

SEQ ID NO: 36976 - DNA, 15 bp, Homo sapiens
aaaaaacattcaagt

SEQ ID NO: 36977 - DNA, 15 bp, Homo sapiens
caaaaaacattcaag

SEQ ID NO: 36978 - DNA, 15 bp, Homo sapiens
tcaaaaaacattcaa

SEQ ID NO: 36979 - DNA, 15 bp, Homo sapiens
ttcaaaaaacattca

SEQ ID NO: 36980 - DNA, 15 bp, Homo sapiens
tttcaaaaaacattc

SEQ ID NO: 36981 - DNA, 15 bp, Homo sapiens
ttttcaaaaaacatt

SEQ ID NO: 36982 - DNA, 15 bp, Homo sapiens
attttcaaaaaacat

SEQ ID NO: 36983 - DNA, 15 bp, Homo sapiens
tattttcaaaaaaca

SEQ ID NO: 36984 - DNA, 15 bp, Homo sapiens
atattttcaaaaaac

SEQ ID NO: 36985 - DNA, 15 bp, Homo sapiens
aatattttcaaaaaa

SEQ ID NO: 36986 - DNA, 15 bp, Homo sapiens
aaatattttcaaaaa

SEQ ID NO: 36987 - DNA, 15 bp, Homo sapiens
aaaatattttcaaaa

SEQ ID NO: 36988 - DNA, 15 bp, Homo sapiens
taaaatattttcaaa

SEQ ID NO: 36989 - DNA, 15 bp, Homo sapiens
gtaaaatattttcaa

SEQ ID NO: 36990 - DNA, 15 bp, Homo sapiens
cgtaaaatattttca

SEQ ID NO: 36991 - DNA, 15 bp, Homo sapiens
acgtaaaatattttc

SEQ ID NO: 36992 - DNA, 15 bp, Homo sapiens
tacgtaaaatatttt

SEQ ID NO: 36993 - DNA, 15 bp, Homo sapiens
ttacgtaaaatattt

SEQ ID NO: 36994 - DNA, 15 bp, Homo sapiens
tttacgtaaaatatt

SEQ ID NO: 36995 - DNA, 15 bp, Homo sapiens
ttttacgtaaaatat

SEQ ID NO: 36996 - DNA, 15 bp, Homo sapiens
gtattttacgtaaaa

SEQ ID NO: 36997 - DNA, 15 bp, Homo sapiens
tgtattttacgtaaa

SEQ ID NO: 36998 - DNA, 15 bp, Homo sapiens
atgtattttacgtaa

SEQ ID NO: 36999 - DNA, 15 bp, Homo sapiens
catgtattttacgta

SEQ ID NO: 37000 - DNA, 15 bp, Homo sapiens
acatgtattttacgt

SEQ ID NO: 37001 - DNA, 15 bp, Homo sapiens
gacatgtattttacg

SEQ ID NO: 37002 - DNA, 15 bp, Homo sapiens
ggacatgtattttac

SEQ ID NO: 37003 - DNA, 15 bp, Homo sapiens
gggacatgtatttta

SEQ ID NO: 37004 - DNA, 15 bp, Homo sapiens
tgggacatgtatttt

SEQ ID NO: 37005 - DNA, 15 bp, Homo sapiens
ctgggacatgtattt

SEQ ID NO: 37006 - DNA, 15 bp, Homo sapiens
tctgggacatgtatt

SEQ ID NO: 37007 - DNA, 15 bp, Homo sapiens
atctgggacatgtat

SEQ ID NO: 37008 - DNA, 15 bp, Homo sapiens
catctgggacatgta

SEQ ID NO: 37009 - DNA, 15 bp, Homo sapiens
ccatctgggacatgt

SEQ ID NO: 37010 - DNA, 15 bp, Homo sapiens
tccatctgggacatg

SEQ ID NO: 37011 - DNA, 15 bp, Homo sapiens
gtccatctgggacat

SEQ ID NO: 37012 - DNA, 15 bp, Homo sapiens
agtccatctgggaca

SEQ ID NO: 37013 - DNA, 15 bp, Homo sapiens
gagtccatctgggac

SEQ ID NO: 37014 - DNA, 15 bp, Homo sapiens
agagtccatctggga

SEQ ID NO: 37015 - DNA, 15 bp, Homo sapiens
tagagtccatctggg

SEQ ID NO: 37016 - DNA, 15 bp, Homo sapiens
atagagtccatctgg

SEQ ID NO: 37017 - DNA, 15 bp, Homo sapiens
aatagagtccatctg

SEQ ID NO: 37018 - DNA, 15 bp, Homo sapiens
gaatagagtccatct

SEQ ID NO: 37019 - DNA, 15 bp, Homo sapiens
agaatagagtccatc

SEQ ID NO: 37020 - DNA, 15 bp, Homo sapiens
aagaatagagtccat

SEQ ID NO: 37021 - DNA, 15 bp, Homo sapiens
aaagaatagagtcca

SEQ ID NO: 37022 - DNA, 15 bp, Homo sapiens
taaagaatagagtcc

SEQ ID NO: 37023 - DNA, 15 bp, Homo sapiens
ctaaagaatagagtc

SEQ ID NO: 37024 - DNA, 15 bp, Homo sapiens
actaaagaatagagt

SEQ ID NO: 37025 - DNA, 15 bp, Homo sapiens
aactaaagaatagag

SEQ ID NO: 37026 - DNA, 15 bp, Homo sapiens
caactaaagaataga

SEQ ID NO: 37027 - DNA, 15 bp, Homo sapiens
ccaactaaagaatag

SEQ ID NO: 37028 - DNA, 15 bp, Homo sapiens
accaactaaagaata

SEQ ID NO: 37029 - DNA, 15 bp, Homo sapiens
aaccaactaaagaat

SEQ ID NO: 37030 - DNA, 15 bp, Homo sapiens
taaccaactaaagaa

SEQ ID NO: 37031 - DNA, 15 bp, Homo sapiens
ataaccaactaaaga

SEQ ID NO: 37032 - DNA, 15 bp, Homo sapiens
gataaccaactaaag

SEQ ID NO: 37033 - DNA, 15 bp, Homo sapiens
agataaccaactaaa

SEQ ID NO: 37034 - DNA, 15 bp, Homo sapiens
tagataaccaactaa

SEQ ID NO: 37035 - DNA, 15 bp, Homo sapiens
ctagataaccaacta

SEQ ID NO: 37036 - DNA, 15 bp, Homo sapiens
tctagataaccaact

SEQ ID NO: 37037 - DNA, 15 bp, Homo sapiens
ttctagataaccaac

SEQ ID NO: 37038 - DNA, 15 bp, Homo sapiens
attctagataaccaa

SEQ ID NO: 37039 - DNA, 15 bp, Homo sapiens
aattctagataacca

SEQ ID NO: 37040 - DNA, 15 bp, Homo sapiens
taattctagataacc

SEQ ID NO: 37041 - DNA, 15 bp, Homo sapiens
ttaattctagataac

SEQ ID NO: 37042 - DNA, 15 bp, Homo sapiens
gttaattctagataa

SEQ ID NO: 37043 - DNA, 15 bp, Homo sapiens
tgttaattctagata

SEQ ID NO: 37044 - DNA, 15 bp, Homo sapiens
atgttaattctagat

SEQ ID NO: 37045 - DNA, 15 bp, Homo sapiens
aatgttaattctaga

SEQ ID NO: 37046 - DNA, 15 bp, Homo sapiens
aaatgttaattctag

SEQ ID NO: 37047 - DNA, 15 bp, Homo sapiens
caaatgttaattcta

SEQ ID NO: 37048 - DNA, 15 bp, Homo sapiens
ccaaatgttaattct

SEQ ID NO: 37049 - DNA, 15 bp, Homo sapiens
tccaaatgttaattc

SEQ ID NO: 37050 - DNA, 15 bp, Homo sapiens
atccaaatgttaatt

SEQ ID NO: 37051 - DNA, 15 bp, Homo sapiens
aatccaaatgttaat

SEQ ID NO: 37052 - DNA, 15 bp, Homo sapiens
taatccaaatgttaa

SEQ ID NO: 37053 - DNA, 15 bp, Homo sapiens
ataatccaaatgtta

SEQ ID NO: 37054 - DNA, 15 bp, Homo sapiens
cataatccaaatgtt

SEQ ID NO: 37055 - DNA, 15 bp, Homo sapiens
acataatccaaatgt

SEQ ID NO: 37056 - DNA, 15 bp, Homo sapiens
aacataatccaaatg

SEQ ID NO: 37057 - DNA, 15 bp, Homo sapiens
aaacataatccaaat

SEQ ID NO: 37058 - DNA, 15 bp, Homo sapiens
caaacataatccaaa

SEQ ID NO: 37059 - DNA, 15 bp, Homo sapiens
gcaaacataatccaa

SEQ ID NO: 37060 - DNA, 15 bp, Homo sapiens
agcaaacataatcca

SEQ ID NO: 37061 - DNA, 15 bp, Homo sapiens
tagcaaacataatcc

SEQ ID NO: 37062 - DNA, 15 bp, Homo sapiens
ttagcaaacataatc

SEQ ID NO: 37063 - DNA, 15 bp, Homo sapiens
tttagcaaacataat

SEQ ID NO: 37064 - DNA, 15 bp, Homo sapiens
atttagcaaacataa

SEQ ID NO: 37065 - DNA, 15 bp, Homo sapiens
catttagcaaacata

SEQ ID NO: 37066 - DNA, 15 bp, Homo sapiens
gcatttagcaaacat

SEQ ID NO: 37067 - DNA, 15 bp, Homo sapiens
cgcatttagcaaaca

SEQ ID NO: 37068 - DNA, 15 bp, Homo sapiens
acgcatttagcaaac

SEQ ID NO: 37069 - DNA, 15 bp, Homo sapiens
gacgcatttagcaaa

SEQ ID NO: 37070 - DNA, 15 bp, Homo sapiens
tgacgcatttagcaa

SEQ ID NO: 37071 - DNA, 15 bp, Homo sapiens
ctgacgcatttagca

SEQ ID NO: 37072 - DNA, 15 bp, Homo sapiens
gctgacgcatttagc

SEQ ID NO: 37073 - DNA, 15 bp, Homo sapiens
ggctgacgcatttag

SEQ ID NO: 37074 - DNA, 15 bp, Homo sapiens
tggctgacgcattta

SEQ ID NO: 37075 - DNA, 15 bp, Homo sapiens
atggctgacgcattt

SEQ ID NO: 37076 - DNA, 15 bp, Homo sapiens
tatggctgacgcatt

SEQ ID NO: 37077 - DNA, 15 bp, Homo sapiens
atatggctgacgcat

SEQ ID NO: 37078 - DNA, 15 bp, Homo sapiens
gatatggctgacgca

SEQ ID NO: 37079 - DNA, 15 bp, Homo sapiens
ggatatggctgacgc

SEQ ID NO: 37080 - DNA, 15 bp, Homo sapiens
aggatatggctgacg

SEQ ID NO: 37081 - DNA, 15 bp, Homo sapiens
taggatatggctgac

SEQ ID NO: 37082 - DNA, 15 bp, Homo sapiens
ttaggatatggctga

SEQ ID NO: 37083 - DNA, 15 bp, Homo sapiens
cttaggatatggctg

SEQ ID NO: 37084 - DNA, 15 bp, Homo sapiens
gcttaggatatggct

SEQ ID NO: 37085 - DNA, 15 bp, Homo sapiens
cgcttaggatatggc

SEQ ID NO: 37086 - DNA, 15 bp, Homo sapiens
gcgcttaggatatgg

SEQ ID NO: 37087 - DNA, 15 bp, Homo sapiens
agcgcttaggatatg

SEQ ID NO: 37088 - DNA, 15 bp, Homo sapiens
cagcgcttaggatat

SEQ ID NO: 37089 - DNA, 15 bp, Homo sapiens
acagcgcttaggata

SEQ ID NO: 37090 - DNA, 15 bp, Homo sapiens
cacagcgcttaggat

SEQ ID NO: 37091 - DNA, 15 bp, Homo sapiens
tcacagcgcttagga

SEQ ID NO: 37092 - DNA, 15 bp, Homo sapiens
atcacagcgcttagg

SEQ ID NO: 37093 - DNA, 15 bp, Homo sapiens
gatcacagcgcttag

SEQ ID NO: 37094 - DNA, 15 bp, Homo sapiens
ggatcacagcgctta

SEQ ID NO: 37095 - DNA, 15 bp, Homo sapiens
aggatcacagcgctt

SEQ ID NO: 37096 - DNA, 15 bp, Homo sapiens
aaggatcacagcgct

SEQ ID NO: 37097 - DNA, 15 bp, Homo sapiens
aaaggatcacagcgc

SEQ ID NO: 37098 - DNA, 15 bp, Homo sapiens
aaaaggatcacagcg

SEQ ID NO: 37099 - DNA, 15 bp, Homo sapiens
taaaaggatcacagc

SEQ ID NO: 37100 - DNA, 15 bp, Homo sapiens
ctaaaaggatcacag

SEQ ID NO: 37101 - DNA, 15 bp, Homo sapiens
tctaaaaggatcaca

SEQ ID NO: 37102 - DNA, 15 bp, Homo sapiens
ttctaaaaggatcac

SEQ ID NO: 37103 - DNA, 15 bp, Homo sapiens
gttctaaaaggatca

SEQ ID NO: 37104 - DNA, 15 bp, Homo sapiens
agttctaaaaggatc

SEQ ID NO: 37105 - DNA, 15 bp, Homo sapiens
tagttctaaaaggat

SEQ ID NO: 37106 - DNA, 15 bp, Homo sapiens
atagttctaaaagga

SEQ ID NO: 37107 - DNA, 15 bp, Homo sapiens
aatagttctaaaagg

SEQ ID NO: 37108 - DNA, 15 bp, Homo sapiens
taatagttctaaaag

SEQ ID NO: 37109 - DNA, 15 bp, Homo sapiens
ttaatagttctaaaa

SEQ ID NO: 37110 - DNA, 15 bp, Homo sapiens
gttaatagttctaaa

SEQ ID NO: 37111 - DNA, 15 bp, Homo sapiens
tgttaatagttctaa

SEQ ID NO: 37112 - DNA, 15 bp, Homo sapiens
ctgttaatagttcta

SEQ ID NO: 37113 - DNA, 15 bp, Homo sapiens
tctgttaatagttct

SEQ ID NO: 37114 - DNA, 15 bp, Homo sapiens
atctgttaatagttc

SEQ ID NO: 37115 - DNA, 15 bp, Homo sapiens
catctgttaatagtt

SEQ ID NO: 37116 - DNA, 15 bp, Homo sapiens
tcatctgttaatagt

SEQ ID NO: 37117 - DNA, 15 bp, Homo sapiens
ctcatctgttaatag

SEQ ID NO: 37118 - DNA, 15 bp, Homo sapiens
tctcatctgttaata

SEQ ID NO: 37119 - DNA, 15 bp, Homo sapiens
gtctcatctgttaat

SEQ ID NO: 37120 - DNA, 15 bp, Homo sapiens
agtctcatctgttaa

SEQ ID NO: 37121 - DNA, 15 bp, Homo sapiens
cagtctcatctgtta

SEQ ID NO: 37122 - DNA, 15 bp, Homo sapiens
ccagtctcatctgtt

SEQ ID NO: 37123 - DNA, 15 bp, Homo sapiens
cccagtctcatctgt

SEQ ID NO: 37124 - DNA, 15 bp, Homo sapiens
ccccagtctcatctg

SEQ ID NO: 37125 - DNA, 15 bp, Homo sapiens
cccccagtctcatct

SEQ ID NO: 37126 - DNA, 15 bp, Homo sapiens
ccccccagtctcatc

SEQ ID NO: 37127 - DNA, 15 bp, Homo sapiens
gccccccagtctcat

SEQ ID NO: 37128 - DNA, 15 bp, Homo sapiens
tgccccccagtctca

SEQ ID NO: 37129 - DNA, 15 bp, Homo sapiens
atgccccccagtctc

SEQ ID NO: 37130 - DNA, 15 bp, Homo sapiens
aatgccccccagtct

SEQ ID NO: 37131 - DNA, 15 bp, Homo sapiens
aaatgccccccagtc

SEQ ID NO: 37132 - DNA, 15 bp, Homo sapiens
aaaatgccccccagt

SEQ ID NO: 37133 - DNA, 15 bp, Homo sapiens
taaaatgccccccag

SEQ ID NO: 37134 - DNA, 15 bp, Homo sapiens
ataaaatgcccccca

SEQ ID NO: 37135 - DNA, 15 bp, Homo sapiens
cataaaatgcccccc

SEQ ID NO: 37136 - DNA, 15 bp, Homo sapiens
ccataaaatgccccc

SEQ ID NO: 37137 - DNA, 15 bp, Homo sapiens
accataaaatgcccc

SEQ ID NO: 37138 - DNA, 15 bp, Homo sapiens
aaccataaaatgccc

SEQ ID NO: 37139 - DNA, 15 bp, Homo sapiens
taaccataaaatgcc

SEQ ID NO: 37140 - DNA, 15 bp, Homo sapiens
ataaccataaaatgc

SEQ ID NO: 37141 - DNA, 15 bp, Homo sapiens
tataaccataaaatg

SEQ ID NO: 37142 - DNA, 15 bp, Homo sapiens
ttataaccataaaat

SEQ ID NO: 37143 - DNA, 15 bp, Homo sapiens
cttataaccataaaa

SEQ ID NO: 37144 - DNA, 15 bp, Homo sapiens
tcttataaccataaa

SEQ ID NO: 37145 - DNA, 15 bp, Homo sapiens
ctcttataaccataa

SEQ ID NO: 37146 - DNA, 15 bp, Homo sapiens
gctcttataaccata

SEQ ID NO: 37147 - DNA, 15 bp, Homo sapiens
agctcttataaccat

SEQ ID NO: 37148 - DNA, 15 bp, Homo sapiens
tagctcttataacca

SEQ ID NO: 37149 - DNA, 15 bp, Homo sapiens
ttagctcttataacc

SEQ ID NO: 37150 - DNA, 15 bp, Homo sapiens
tttagctcttataac

SEQ ID NO: 37151 - DNA, 15 bp, Homo sapiens
atttagctcttataa

SEQ ID NO: 37152 - DNA, 15 bp, Homo sapiens
catttagctcttata

SEQ ID NO: 37153 - DNA, 15 bp, Homo sapiens
tcatttagctcttat

SEQ ID NO: 37154 - DNA, 15 bp, Homo sapiens
atcatttagctctta

SEQ ID NO: 37155 - DNA, 15 bp, Homo sapiens
tatcatttagctctt

SEQ ID NO: 37156 - DNA, 15 bp, Homo sapiens
atatcatttagctct

SEQ ID NO: 37157 - DNA, 15 bp, Homo sapiens
aatatcatttagctc

SEQ ID NO: 37158 - DNA, 15 bp, Homo sapiens
aaatatcatttagct

SEQ ID NO: 37159 - DNA, 15 bp, Homo sapiens
taaatatcatttagc

SEQ ID NO: 37160 - DNA, 15 bp, Homo sapiens
ataaatatcatttag

SEQ ID NO: 37161 - DNA, 15 bp, Homo sapiens
cataaatatcattta

SEQ ID NO: 37162 - DNA, 15 bp, Homo sapiens
gcataaatatcattt

SEQ ID NO: 37163 - DNA, 15 bp, Homo sapiens
tgcataaatatcatt

SEQ ID NO: 37164 - DNA, 15 bp, Homo sapiens
ttgcataaatatcat

SEQ ID NO: 37165 - DNA, 15 bp, Homo sapiens
cttgcataaatatca

SEQ ID NO: 37166 - DNA, 15 bp, Homo sapiens
acttgcataaatatc

SEQ ID NO: 37167 - DNA, 15 bp, Homo sapiens
cacttgcataaatat

SEQ ID NO: 37168 - DNA, 15 bp, Homo sapiens
acacttgcataaata

SEQ ID NO: 37169 - DNA, 15 bp, Homo sapiens
cacacttgcataaat

SEQ ID NO: 37170 - DNA, 15 bp, Homo sapiens
acacacttgcataaa

SEQ ID NO: 37171 - DNA, 15 bp, Homo sapiens
tacacacttgcataa

SEQ ID NO: 37172 - DNA, 15 bp, Homo sapiens
ttacacacttgcata

SEQ ID NO: 37173 - DNA, 15 bp, Homo sapiens
tttacacacttgcat

SEQ ID NO: 37174 - DNA, 15 bp, Homo sapiens
gtttacacacttgca

SEQ ID NO: 37175 - DNA, 15 bp, Homo sapiens
tgtttacacacttgc

SEQ ID NO: 37176 - DNA, 15 bp, Homo sapiens
atgtttacacacttg

SEQ ID NO: 37177 - DNA, 15 bp, Homo sapiens
aatgtttacacactt

SEQ ID NO: 37178 - DNA, 15 bp, Homo sapiens
taatgtttacacact

SEQ ID NO: 37179 - DNA, 15 bp, Homo sapiens
ttaatgtttacacac

SEQ ID NO: 37180 - DNA, 15 bp, Homo sapiens
attaatgtttacaca

SEQ ID NO: 37181 - DNA, 15 bp, Homo sapiens
tattaatgtttacac

SEQ ID NO: 37182 - DNA, 15 bp, Homo sapiens
ttattaatgtttaca

SEQ ID NO: 37183 - DNA, 15 bp, Homo sapiens
gttattaatgtttac

SEQ ID NO: 37184 - DNA, 15 bp, Homo sapiens
agttattaatgttta

SEQ ID NO: 37185 - DNA, 15 bp, Homo sapiens
gagttattaatgttt

SEQ ID NO: 37186 - DNA, 15 bp, Homo sapiens
tgagttattaatgtt

SEQ ID NO: 37187 - DNA, 15 bp, Homo sapiens
ctgagttattaatgt

SEQ ID NO: 37188 - DNA, 15 bp, Homo sapiens
gctgagttattaatg

SEQ ID NO: 37189 - DNA, 15 bp, Homo sapiens
cgctgagttattaat

SEQ ID NO: 37190 - DNA, 15 bp, Homo sapiens
acgctgagttattaa

SEQ ID NO: 37191 - DNA, 15 bp, Homo sapiens
aacgctgagttatta

SEQ ID NO: 37192 - DNA, 15 bp, Homo sapiens
aaacgctgagttatt

SEQ ID NO: 37193 - DNA, 15 bp, Homo sapiens
taaacgctgagttat

SEQ ID NO: 37194 - DNA, 15 bp, Homo sapiens
ataaacgctgagtta

SEQ ID NO: 37195 - DNA, 15 bp, Homo sapiens
tataaacgctgagtt

SEQ ID NO: 37196 - DNA, 15 bp, Homo sapiens
ttataaacgctgagt

SEQ ID NO: 37197 - DNA, 15 bp, Homo sapiens
cttataaacgctgag

SEQ ID NO: 37198 - DNA, 15 bp, Homo sapiens
gcttataaacgctga

SEQ ID NO: 37199 - DNA, 15 bp, Homo sapiens
tgcttataaacgctg

SEQ ID NO: 37200 - DNA, 15 bp, Homo sapiens
atgcttataaacgct

SEQ ID NO: 37201 - DNA, 15 bp, Homo sapiens
catgcttataaacgc

SEQ ID NO: 37202 - DNA, 15 bp, Homo sapiens
acatgcttataaacg

SEQ ID NO: 37203 - DNA, 15 bp, Homo sapiens
aacatgcttataaac

SEQ ID NO: 37204 - DNA, 15 bp, Homo sapiens
taacatgcttataaa

SEQ ID NO: 37205 - DNA, 15 bp, Homo sapiens
ctaacatgcttataa

SEQ ID NO: 37206 - DNA, 15 bp, Homo sapiens
tctaacatgcttata

SEQ ID NO: 37207 - DNA, 15 bp, Homo sapiens
ttctaacatgcttat

SEQ ID NO: 37208 - DNA, 15 bp, Homo sapiens
attctaacatgctta

SEQ ID NO: 37209 - DNA, 15 bp, Homo sapiens
tattctaacatgctt

SEQ ID NO: 37210 - DNA, 15 bp, Homo sapiens
atattctaacatgct

SEQ ID NO: 37211 - DNA, 15 bp, Homo sapiens
aatattctaacatgc

SEQ ID NO: 37212 - DNA, 15 bp, Homo sapiens
aaatattctaacatg

SEQ ID NO: 37213 - DNA, 15 bp, Homo sapiens
caaatattctaacat

SEQ ID NO: 37214 - DNA, 15 bp, Homo sapiens
tcaaatattctaaca

SEQ ID NO: 37215 - DNA, 15 bp, Homo sapiens
atcaaatattctaac

SEQ ID NO: 37216 - DNA, 15 bp, Homo sapiens
aatcaaatattctaa

SEQ ID NO: 37217 - DNA, 15 bp, Homo sapiens
taatcaaatattcta

SEQ ID NO: 37218 - DNA, 15 bp, Homo sapiens
ataatcaaatattct

SEQ ID NO: 37219 - DNA, 15 bp, Homo sapiens
cataatcaaatattc

SEQ ID NO: 37220 - DNA, 15 bp, Homo sapiens
ccataatcaaatatt

SEQ ID NO: 37221 - DNA, 15 bp, Homo sapiens
gccataatcaaatat

SEQ ID NO: 37222 - DNA, 15 bp, Homo sapiens
agccataatcaaata

SEQ ID NO: 37223 - DNA, 15 bp, Homo sapiens
tagccataatcaaat

SEQ ID NO: 37224 - DNA, 15 bp, Homo sapiens
ctagccataatcaaa

SEQ ID NO: 37225 - DNA, 15 bp, Homo sapiens
cctagccataatcaa

SEQ ID NO: 37226 - DNA, 15 bp, Homo sapiens
ccctagccataatca

SEQ ID NO: 37227 - DNA, 15 bp, Homo sapiens
tccctagccataatc

SEQ ID NO: 37228 - DNA, 15 bp, Homo sapiens
ttccctagccataat

SEQ ID NO: 37229 - DNA, 15 bp, Homo sapiens
tttccctagccataa

SEQ ID NO: 37230 - DNA, 15 bp, Homo sapiens
atttccctagccata

SEQ ID NO: 37231 - DNA, 15 bp, Homo sapiens
catttccctagccat

SEQ ID NO: 37232 - DNA, 15 bp, Homo sapiens
gcatttccctagcca

SEQ ID NO: 37233 - DNA, 15 bp, Homo sapiens
tgcatttccctagcc

SEQ ID NO: 37234 - DNA, 15 bp, Homo sapiens
atgcatttccctagc

SEQ ID NO: 37235 - DNA, 15 bp, Homo sapiens
tatgcatttccctag

SEQ ID NO: 37236 - DNA, 15 bp, Homo sapiens
atatgcatttcccta

SEQ ID NO: 37237 - DNA, 15 bp, Homo sapiens
aatatgcatttccct

SEQ ID NO: 37238 - DNA, 15 bp, Homo sapiens
taatatgcatttccc

SEQ ID NO: 37239 - DNA, 15 bp, Homo sapiens
ctaatatgcatttcc

SEQ ID NO: 37240 - DNA, 15 bp, Homo sapiens
gctaatatgcatttc

SEQ ID NO: 37241 - DNA, 15 bp, Homo sapiens
agctaatatgcattt

SEQ ID NO: 37242 - DNA, 15 bp, Homo sapiens
tagctaatatgcatt

SEQ ID NO: 37243 - DNA, 15 bp, Homo sapiens
atagctaatatgcat

SEQ ID NO: 37244 - DNA, 15 bp, Homo sapiens
gatagctaatatgca

SEQ ID NO: 37245 - DNA, 15 bp, Homo sapiens
agatagctaatatgc

SEQ ID NO: 37246 - DNA, 15 bp, Homo sapiens
tagatagctaatatg

SEQ ID NO: 37247 - DNA, 15 bp, Homo sapiens
ctagatagctaatat

SEQ ID NO: 37248 - DNA, 15 bp, Homo sapiens
gctagatagctaata

SEQ ID NO: 37249 - DNA, 15 bp, Homo sapiens
tgctagatagctaat

SEQ ID NO: 37250 - DNA, 15 bp, Homo sapiens
gtgctagatagctaa

SEQ ID NO: 37251 - DNA, 15 bp, Homo sapiens
tgtgctagatagcta

SEQ ID NO: 37252 - DNA, 15 bp, Homo sapiens
ctgtgctagatagct

SEQ ID NO: 37253 - DNA, 15 bp, Homo sapiens
tctgtgctagatagc

SEQ ID NO: 37254 - DNA, 15 bp, Homo sapiens
atctgtgctagatag

SEQ ID NO: 37255 - DNA, 15 bp, Homo sapiens
gatctgtgctagata

SEQ ID NO: 37256 - DNA, 15 bp, Homo sapiens
agatctgtgctagat

SEQ ID NO: 37257 - DNA, 15 bp, Homo sapiens
tagatctgtgctaga

SEQ ID NO: 37258 - DNA, 15 bp, Homo sapiens
ttagatctgtgctag

SEQ ID NO: 37259 - DNA, 15 bp, Homo sapiens
tttagatctgtgcta

SEQ ID NO: 37260 - DNA, 15 bp, Homo sapiens
ttttagatctgtgct

SEQ ID NO: 37261 - DNA, 15 bp, Homo sapiens
cttttagatctgtgc

SEQ ID NO: 37262 - DNA, 15 bp, Homo sapiens
acttttagatctgtg

SEQ ID NO: 37263 - DNA, 15 bp, Homo sapiens
cacttttagatctgt

SEQ ID NO: 37264 - DNA, 15 bp, Homo sapiens
tcacttttagatctg

SEQ ID NO: 37265 - DNA, 15 bp, Homo sapiens
atcacttttagatct

SEQ ID NO: 37266 - DNA, 15 bp, Homo sapiens
gatcacttttagatc

SEQ ID NO: 37267 - DNA, 15 bp, Homo sapiens
agatcacttttagat

SEQ ID NO: 37268 - DNA, 15 bp, Homo sapiens
cagatcacttttaga

SEQ ID NO: 37269 - DNA, 15 bp, Homo sapiens
ccagatcacttttag

SEQ ID NO: 37270 - DNA, 15 bp, Homo sapiens
cccagatcactttta

SEQ ID NO: 37271 - DNA, 15 bp, Homo sapiens
gcccagatcactttt

SEQ ID NO: 37272 - DNA, 15 bp, Homo sapiens
agcccagatcacttt

SEQ ID NO: 37273 - DNA, 15 bp, Homo sapiens
tagcccagatcactt

SEQ ID NO: 37274 - DNA, 15 bp, Homo sapiens
atagcccagatcact

SEQ ID NO: 37275 - DNA, 15 bp, Homo sapiens
tatagcccagatcac

SEQ ID NO: 37276 - DNA, 15 bp, Homo sapiens
gtatagcccagatca

SEQ ID NO: 37277 - DNA, 15 bp, Homo sapiens
ggtatagcccagatc

SEQ ID NO: 37278 - DNA, 15 bp, Homo sapiens
aggtatagcccagat

SEQ ID NO: 37279 - DNA, 15 bp, Homo sapiens
aaggtatagcccaga

SEQ ID NO: 37280 - DNA, 15 bp, Homo sapiens
aaaggtatagcccag

SEQ ID NO: 37281 - DNA, 15 bp, Homo sapiens
gaaaggtatagccca

SEQ ID NO: 37282 - DNA, 15 bp, Homo sapiens
tgaaaggtatagccc

SEQ ID NO: 37283 - DNA, 15 bp, Homo sapiens
atgaaaggtatagcc

SEQ ID NO: 37284 - DNA, 15 bp, Homo sapiens
aatgaaaggtatagc

SEQ ID NO: 37285 - DNA, 15 bp, Homo sapiens
aaatgaaaggtatag

SEQ ID NO: 37286 - DNA, 15 bp, Homo sapiens
gaaatgaaaggtata

SEQ ID NO: 37287 - DNA, 15 bp, Homo sapiens
agaaatgaaaggtat

SEQ ID NO: 37288 - DNA, 15 bp, Homo sapiens
cagaaatgaaaggta

SEQ ID NO: 37289 - DNA, 15 bp, Homo sapiens
ccagaaatgaaaggt

SEQ ID NO: 37290 - DNA, 15 bp, Homo sapiens
tccagaaatgaaagg

SEQ ID NO: 37291 - DNA, 15 bp, Homo sapiens
atccagaaatgaaag

SEQ ID NO: 37292 - DNA, 15 bp, Homo sapiens
aatccagaaatgaaa

SEQ ID NO: 37293 - DNA, 15 bp, Homo sapiens
aaatccagaaatgaa

SEQ ID NO: 37294 - DNA, 15 bp, Homo sapiens
gaaatccagaaatga

SEQ ID NO: 37295 - DNA, 15 bp, Homo sapiens
agaaatccagaaatg

SEQ ID NO: 37296 - DNA, 15 bp, Homo sapiens
aagaaatccagaaat

SEQ ID NO: 37297 - DNA, 15 bp, Homo sapiens
aaagaaatccagaaa

SEQ ID NO: 37298 - DNA, 15 bp, Homo sapiens
gaaagaaatccagaa

SEQ ID NO: 37299 - DNA, 15 bp, Homo sapiens
ggaaagaaatccaga

SEQ ID NO: 37300 - DNA, 15 bp, Homo sapiens
aggaaagaaatccag

SEQ ID NO: 37301 - DNA, 15 bp, Homo sapiens
aaggaaagaaatcca

SEQ ID NO: 37302 - DNA, 15 bp, Homo sapiens
taaggaaagaaatcc

SEQ ID NO: 37303 - DNA, 15 bp, Homo sapiens
ttaaggaaagaaatc

SEQ ID NO: 37304 - DNA, 15 bp, Homo sapiens
cttaaggaaagaaat

SEQ ID NO: 37305 - DNA, 15 bp, Homo sapiens
gcttaaggaaagaaa

SEQ ID NO: 37306 - DNA, 15 bp, Homo sapiens
agcttaaggaaagaa

SEQ ID NO: 37307 - DNA, 15 bp, Homo sapiens
aagcttaaggaaaga

SEQ ID NO: 37308 - DNA, 15 bp, Homo sapiens
taagcttaaggaaag

SEQ ID NO: 37309 - DNA, 15 bp, Homo sapiens
ttaagcttaaggaaa

SEQ ID NO: 37310 - DNA, 15 bp, Homo sapiens
tttaagcttaaggaa

SEQ ID NO: 37311 - DNA, 15 bp, Homo sapiens
ctttaagcttaagga

SEQ ID NO: 37312 - DNA, 15 bp, Homo sapiens
cctttaagcttaagg

SEQ ID NO: 37313 - DNA, 15 bp, Homo sapiens
ccctttaagcttaag

SEQ ID NO: 37314 - DNA, 15 bp, Homo sapiens
accctttaagcttaa

SEQ ID NO: 37315 - DNA, 15 bp, Homo sapiens
caccctttaagctta

SEQ ID NO: 37316 - DNA, 15 bp, Homo sapiens
acaccctttaagctt

SEQ ID NO: 37317 - DNA, 15 bp, Homo sapiens
aacaccctttaagct

SEQ ID NO: 37318 - DNA, 15 bp, Homo sapiens
gaacaccctttaagc

SEQ ID NO: 37319 - DNA, 15 bp, Homo sapiens
agaacaccctttaag

SEQ ID NO: 37320 - DNA, 15 bp, Homo sapiens
tagaacaccctttaa

SEQ ID NO: 37321 - DNA, 15 bp, Homo sapiens
ttagaacacccttta

SEQ ID NO: 37322 - DNA, 15 bp, Homo sapiens
attagaacacccttt

SEQ ID NO: 37323 - DNA, 15 bp, Homo sapiens
aattagaacaccctt

SEQ ID NO: 37324 - DNA, 15 bp, Homo sapiens
aaattagaacaccct

SEQ ID NO: 37325 - DNA, 15 bp, Homo sapiens
gaaattagaacaccc

SEQ ID NO: 37326 - DNA, 15 bp, Homo sapiens
tgaaattagaacacc

SEQ ID NO: 37327 - DNA, 15 bp, Homo sapiens
atgaaattagaacac

SEQ ID NO: 37328 - DNA, 15 bp, Homo sapiens
aatgaaattagaaca

SEQ ID NO: 37329 - DNA, 15 bp, Homo sapiens
taatgaaattagaac

SEQ ID NO: 37330 - DNA, 15 bp, Homo sapiens
ataatgaaattagaa

SEQ ID NO: 37331 - DNA, 15 bp, Homo sapiens
aataatgaaattaga

SEQ ID NO: 37332 - DNA, 15 bp, Homo sapiens
taataatgaaattag

SEQ ID NO: 37333 - DNA, 15 bp, Homo sapiens
ataataatgaaatta

SEQ ID NO: 37334 - DNA, 15 bp, Homo sapiens
gataataatgaaatt

SEQ ID NO: 37335 - DNA, 15 bp, Homo sapiens
tgataataatgaaat

SEQ ID NO: 37336 - DNA, 15 bp, Homo sapiens
ttgataataatgaaa

SEQ ID NO: 37337 - DNA, 15 bp, Homo sapiens
attgataataatgaa

SEQ ID NO: 37338 - DNA, 15 bp, Homo sapiens
gattgataataatga

SEQ ID NO: 37339 - DNA, 15 bp, Homo sapiens
agattgataataatg

SEQ ID NO: 37340 - DNA, 15 bp, Homo sapiens
gagattgataataat

SEQ ID NO: 37341 - DNA, 15 bp, Homo sapiens
tgagattgataataa

SEQ ID NO: 37342 - DNA, 15 bp, Homo sapiens
ttgagattgataata

SEQ ID NO: 37343 - DNA, 15 bp, Homo sapiens
cttgagattgataat

SEQ ID NO: 37344 - DNA, 15 bp, Homo sapiens
tcttgagattgataa

SEQ ID NO: 37345 - DNA, 15 bp, Homo sapiens
atcttgagattgata

SEQ ID NO: 37346 - DNA, 15 bp, Homo sapiens
gatcttgagattgat

SEQ ID NO: 37347 - DNA, 15 bp, Homo sapiens
tgatcttgagattga

SEQ ID NO: 37348 - DNA, 15 bp, Homo sapiens
atgatcttgagattg

SEQ ID NO: 37349 - DNA, 15 bp, Homo sapiens
aatgatcttgagatt

SEQ ID NO: 37350 - DNA, 15 bp, Homo sapiens
aaatgatcttgagat

SEQ ID NO: 37351 - DNA, 15 bp, Homo sapiens
gaaatgatcttgaga

SEQ ID NO: 37352 - DNA, 15 bp, Homo sapiens
tgaaatgatcttgag

SEQ ID NO: 37353 - DNA, 15 bp, Homo sapiens
gtgaaatgatcttga

SEQ ID NO: 37354 - DNA, 15 bp, Homo sapiens
tgtgaaatgatcttg

SEQ ID NO: 37355 - DNA, 15 bp, Homo sapiens
ctgtgaaatgatctt

SEQ ID NO: 37356 - DNA, 15 bp, Homo sapiens
actgtgaaatgatct

SEQ ID NO: 37357 - DNA, 15 bp, Homo sapiens
aactgtgaaatgatc

SEQ ID NO: 37358 - DNA, 15 bp, Homo sapiens
aaactgtgaaatgat

SEQ ID NO: 37359 - DNA, 15 bp, Homo sapiens
gaaactgtgaaatga

SEQ ID NO: 37360 - DNA, 15 bp, Homo sapiens
ggaaactgtgaaatg

SEQ ID NO: 37361 - DNA, 15 bp, Homo sapiens
aggaaactgtgaaat

SEQ ID NO: 37362 - DNA, 15 bp, Homo sapiens
caggaaactgtgaaa

SEQ ID NO: 37363 - DNA, 15 bp, Homo sapiens
ccaggaaactgtgaa

SEQ ID NO: 37364 - DNA, 15 bp, Homo sapiens
accaggaaactgtga

SEQ ID NO: 37365 - DNA, 15 bp, Homo sapiens
caccaggaaactgtg

SEQ ID NO: 37366 - DNA, 15 bp, Homo sapiens
ccaccaggaaactgt

SEQ ID NO: 37367 - DNA, 15 bp, Homo sapiens
accaccaggaaactg

SEQ ID NO: 37368 - DNA, 15 bp, Homo sapiens
aaccaccaggaaact

SEQ ID NO: 37369 - DNA, 15 bp, Homo sapiens
caaccaccaggaaac

SEQ ID NO: 37370 - DNA, 15 bp, Homo sapiens
ccaaccaccaggaaa

SEQ ID NO: 37371 - DNA, 15 bp, Homo sapiens
cccaaccaccaggaa

SEQ ID NO: 37372 - DNA, 15 bp, Homo sapiens
acccaaccaccagga

SEQ ID NO: 37373 - DNA, 15 bp, Homo sapiens
cacccaaccaccagg

SEQ ID NO: 37374 - DNA, 15 bp, Homo sapiens
acacccaaccaccag

SEQ ID NO: 37375 - DNA, 15 bp, Homo sapiens
gacacccaaccacca

SEQ ID NO: 37376 - DNA, 15 bp, Homo sapiens
tgacacccaaccacc

SEQ ID NO: 37377 - DNA, 15 bp, Homo sapiens
atgacacccaaccac

SEQ ID NO: 37378 - DNA, 15 bp, Homo sapiens
catgacacccaacca

SEQ ID NO: 37379 - DNA, 15 bp, Homo sapiens
ccatgacacccaacc

SEQ ID NO: 37380 - DNA, 15 bp, Homo sapiens
accatgacacccaac

SEQ ID NO: 37381 - DNA, 15 bp, Homo sapiens
caccatgacacccaa

SEQ ID NO: 37382 - DNA, 15 bp, Homo sapiens
tcaccatgacaccca

SEQ ID NO: 37383 - DNA, 15 bp, Homo sapiens
gtcaccatgacaccc

SEQ ID NO: 37384 - DNA, 15 bp, Homo sapiens
agtcaccatgacacc

SEQ ID NO: 37385 - DNA, 15 bp, Homo sapiens
aagtcaccatgacac

SEQ ID NO: 37386 - DNA, 15 bp, Homo sapiens
aaagtcaccatgaca

SEQ ID NO: 37387 - DNA, 15 bp, Homo sapiens
aaaagtcaccatgac

SEQ ID NO: 37388 - DNA, 15 bp, Homo sapiens
aaaaagtcaccatga

SEQ ID NO: 37389 - DNA, 15 bp, Homo sapiens
caaaaagtcaccatg

SEQ ID NO: 37390 - DNA, 15 bp, Homo sapiens
acaaaaagtcaccat

SEQ ID NO: 37391 - DNA, 15 bp, Homo sapiens
aacaaaaagtcacca

SEQ ID NO: 37392 - DNA, 15 bp, Homo sapiens
aaacaaaaagtcacc

SEQ ID NO: 37393 - DNA, 15 bp, Homo sapiens
aaaacaaaaagtcac

SEQ ID NO: 37394 - DNA, 15 bp, Homo sapiens
gaaaacaaaaagtca

SEQ ID NO: 37395 - DNA, 15 bp, Homo sapiens
ggaaaacaaaaagtc

SEQ ID NO: 37396 - DNA, 15 bp, Homo sapiens
tggaaaacaaaaagt

SEQ ID NO: 37397 - DNA, 15 bp, Homo sapiens
ctggaaaacaaaaag

SEQ ID NO: 37398 - DNA, 15 bp, Homo sapiens
cctggaaaacaaaaa

SEQ ID NO: 37399 - DNA, 15 bp, Homo sapiens
gcctggaaaacaaaa

SEQ ID NO: 37400 - DNA, 15 bp, Homo sapiens
agcctggaaaacaaa

SEQ ID NO: 37401 - DNA, 15 bp, Homo sapiens
gagcctggaaaacaa

SEQ ID NO: 37402 - DNA, 15 bp, Homo sapiens
agagcctggaaaaca

SEQ ID NO: 37403 - DNA, 15 bp, Homo sapiens
aagagcctggaaaac

SEQ ID NO: 37404 - DNA, 15 bp, Homo sapiens
aaagagcctggaaaa

SEQ ID NO: 37405 - DNA, 15 bp, Homo sapiens
caaagagcctggaaa

SEQ ID NO: 37406 - DNA, 15 bp, Homo sapiens
acaaagagcctggaa

SEQ ID NO: 37407 - DNA, 15 bp, Homo sapiens
aacaaagagcctgga

SEQ ID NO: 37408 - DNA, 15 bp, Homo sapiens
aaacaaagagcctgg

SEQ ID NO: 37409 - DNA, 15 bp, Homo sapiens
caaacaaagagcctg

SEQ ID NO: 37410 - DNA, 15 bp, Homo sapiens
ccaaacaaagagcct

SEQ ID NO: 37411 - DNA, 15 bp, Homo sapiens
tccaaacaaagagcc

SEQ ID NO: 37412 - DNA, 15 bp, Homo sapiens
atccaaacaaagagc

SEQ ID NO: 37413 - DNA, 15 bp, Homo sapiens
tatccaaacaaagag

SEQ ID NO: 37414 - DNA, 15 bp, Homo sapiens
atatccaaacaaaga

SEQ ID NO: 37415 - DNA, 15 bp, Homo sapiens
catatccaaacaaag

SEQ ID NO: 37416 - DNA, 15 bp, Homo sapiens
acatatccaaacaaa

SEQ ID NO: 37417 - DNA, 15 bp, Homo sapiens
cacatatccaaacaa

SEQ ID NO: 37418 - DNA, 15 bp, Homo sapiens
ccacatatccaaaca

SEQ ID NO: 37419 - DNA, 15 bp, Homo sapiens
gccacatatccaaac

SEQ ID NO: 37420 - DNA, 15 bp, Homo sapiens
ggccacatatccaaa

SEQ ID NO: 37421 - DNA, 15 bp, Homo sapiens
aggccacatatccaa

SEQ ID NO: 37422 - DNA, 15 bp, Homo sapiens
aaggccacatatcca

SEQ ID NO: 37423 - DNA, 15 bp, Homo sapiens
caaggccacatatcc

SEQ ID NO: 37424 - DNA, 15 bp, Homo sapiens
acaaggccacatatc

SEQ ID NO: 37425 - DNA, 15 bp, Homo sapiens
aacaaggccacatat

SEQ ID NO: 37426 - DNA, 15 bp, Homo sapiens
aaacaaggccacata

SEQ ID NO: 37427 - DNA, 15 bp, Homo sapiens
caaacaaggccacat

SEQ ID NO: 37428 - DNA, 15 bp, Homo sapiens
tcaaacaaggccaca

SEQ ID NO: 37429 - DNA, 15 bp, Homo sapiens
ctcaaacaaggccac

SEQ ID NO: 37430 - DNA, 15 bp, Homo sapiens
actcaaacaaggcca

SEQ ID NO: 37431 - DNA, 15 bp, Homo sapiens
aactcaaacaaggcc

SEQ ID NO: 37432 - DNA, 15 bp, Homo sapiens
caactcaaacaaggc

SEQ ID NO: 37433 - DNA, 15 bp, Homo sapiens
acaactcaaacaagg

SEQ ID NO: 37434 - DNA, 15 bp, Homo sapiens
gacaactcaaacaag

SEQ ID NO: 37435 - DNA, 15 bp, Homo sapiens
agacaactcaaacaa

SEQ ID NO: 37436 - DNA, 15 bp, Homo sapiens
aagacaactcaaaca

SEQ ID NO: 37437 - DNA, 15 bp, Homo sapiens
aaagacaactcaaac

SEQ ID NO: 37438 - DNA, 15 bp, Homo sapiens
caaagacaactcaaa

SEQ ID NO: 37439 - DNA, 15 bp, Homo sapiens
tcaaagacaactcaa

SEQ ID NO: 37440 - DNA, 15 bp, Homo sapiens
atcaaagacaactca

SEQ ID NO: 37441 - DNA, 15 bp, Homo sapiens
aatcaaagacaactc

SEQ ID NO: 37442 - DNA, 15 bp, Homo sapiens
caatcaaagacaact

SEQ ID NO: 37443 - DNA, 15 bp, Homo sapiens
gcaatcaaagacaac

SEQ ID NO: 37444 - DNA, 15 bp, Homo sapiens
agcaatcaaagacaa

SEQ ID NO: 37445 - DNA, 15 bp, Homo sapiens
tagcaatcaaagaca

SEQ ID NO: 37446 - DNA, 15 bp, Homo sapiens
atagcaatcaaagac

SEQ ID NO: 37447 - DNA, 15 bp, Homo sapiens
tatagcaatcaaaga

SEQ ID NO: 37448 - DNA, 15 bp, Homo sapiens
atatagcaatcaaag

SEQ ID NO: 37449 - DNA, 15 bp, Homo sapiens
tatatagcaatcaaa

SEQ ID NO: 37450 - DNA, 15 bp, Homo sapiens
atatatagcaatcaa

SEQ ID NO: 37451 - DNA, 15 bp, Homo sapiens
gatatatagcaatca

SEQ ID NO: 37452 - DNA, 15 bp, Homo sapiens
agatatatagcaatc

SEQ ID NO: 37453 - DNA, 15 bp, Homo sapiens
cagatatatagcaat

SEQ ID NO: 37454 - DNA, 15 bp, Homo sapiens
acagatatatagcaa

SEQ ID NO: 37455 - DNA, 15 bp, Homo sapiens
tacagatatatagca

SEQ ID NO: 37456 - DNA, 15 bp, Homo sapiens
gtacagatatatagc

SEQ ID NO: 37457 - DNA, 15 bp, Homo sapiens
ggtacagatatatag

SEQ ID NO: 37458 - DNA, 15 bp, Homo sapiens
gggtacagatatata

SEQ ID NO: 37459 - DNA, 15 bp, Homo sapiens
agggtacagatatat

SEQ ID NO: 37460 - DNA, 15 bp, Homo sapiens
aagggtacagatata

SEQ ID NO: 37461 - DNA, 15 bp, Homo sapiens
caagggtacagatat

SEQ ID NO: 37462 - DNA, 15 bp, Homo sapiens
acaagggtacagata

SEQ ID NO: 37463 - DNA, 15 bp, Homo sapiens
aacaagggtacagat

SEQ ID NO: 37464 - DNA, 15 bp, Homo sapiens
aaacaagggtacaga

SEQ ID NO: 37465 - DNA, 15 bp, Homo sapiens
caaacaagggtacag

SEQ ID NO: 37466 - DNA, 15 bp, Homo sapiens
gcaaacaagggtaca

SEQ ID NO: 37467 - DNA, 15 bp, Homo sapiens
agcaaacaagggtac

SEQ ID NO: 37468 - DNA, 15 bp, Homo sapiens
aagcaaacaagggta

SEQ ID NO: 37469 - DNA, 15 bp, Homo sapiens
aaagcaaacaagggt

SEQ ID NO: 37470 - DNA, 15 bp, Homo sapiens
aaaagcaaacaaggg

SEQ ID NO: 37471 - DNA, 15 bp, Homo sapiens
caaaagcaaacaagg

SEQ ID NO: 37472 - DNA, 15 bp, Homo sapiens
gcaaaagcaaacaag

SEQ ID NO: 37473 - DNA, 15 bp, Homo sapiens
ggcaaaagcaaacaa

SEQ ID NO: 37474 - DNA, 15 bp, Homo sapiens
aggcaaaagcaaaca

SEQ ID NO: 37475 - DNA, 15 bp, Homo sapiens
caggcaaaagcaaac

SEQ ID NO: 37476 - DNA, 15 bp, Homo sapiens
ccaggcaaaagcaaa

SEQ ID NO: 37477 - DNA, 15 bp, Homo sapiens
gccaggcaaaagcaa

SEQ ID NO: 37478 - DNA, 15 bp, Homo sapiens
agccaggcaaaagca

SEQ ID NO: 37479 - DNA, 15 bp, Homo sapiens
tagccaggcaaaagc

SEQ ID NO: 37480 - DNA, 15 bp, Homo sapiens
gtagccaggcaaaag

SEQ ID NO: 37481 - DNA, 15 bp, Homo sapiens
agtagccaggcaaaa

SEQ ID NO: 37482 - DNA, 15 bp, Homo sapiens
cagtagccaggcaaa

SEQ ID NO: 37483 - DNA, 15 bp, Homo sapiens
tcagtagccaggcaa

SEQ ID NO: 37484 - DNA, 15 bp, Homo sapiens
atcagtagccaggca

SEQ ID NO: 37485 - DNA, 15 bp, Homo sapiens
aatcagtagccaggc

SEQ ID NO: 37486 - DNA, 15 bp, Homo sapiens
gaatcagtagccagg

SEQ ID NO: 37487 - DNA, 15 bp, Homo sapiens
agaatcagtagccag

SEQ ID NO: 37488 - DNA, 15 bp, Homo sapiens
gagaatcagtagcca

SEQ ID NO: 37489 - DNA, 15 bp, Homo sapiens
tgagaatcagtagcc

SEQ ID NO: 37490 - DNA, 15 bp, Homo sapiens
ctgagaatcagtagc

SEQ ID NO: 37491 - DNA, 15 bp, Homo sapiens
actgagaatcagtag

SEQ ID NO: 37492 - DNA, 15 bp, Homo sapiens
cactgagaatcagta

SEQ ID NO: 37493 - DNA, 15 bp, Homo sapiens
acactgagaatcagt

SEQ ID NO: 37494 - DNA, 15 bp, Homo sapiens
aacactgagaatcag

SEQ ID NO: 37495 - DNA, 15 bp, Homo sapiens
aaacactgagaatca

SEQ ID NO: 37496 - DNA, 15 bp, Homo sapiens
gaaacactgagaatc

SEQ ID NO: 37497 - DNA, 15 bp, Homo sapiens
tgaaacactgagaat

SEQ ID NO: 37498 - DNA, 15 bp, Homo sapiens
gtgaaacactgagaa

SEQ ID NO: 37499 - DNA, 15 bp, Homo sapiens
agtgaaacactgaga

SEQ ID NO: 37500 - DNA, 15 bp, Homo sapiens
aagtgaaacactgag

SEQ ID NO: 37501 - DNA, 15 bp, Homo sapiens
aaagtgaaacactga

SEQ ID NO: 37502 - DNA, 15 bp, Homo sapiens
caaagtgaaacactg

SEQ ID NO: 37503 - DNA, 15 bp, Homo sapiens
tcaaagtgaaacact

SEQ ID NO: 37504 - DNA, 15 bp, Homo sapiens
gtcaaagtgaaacac

SEQ ID NO: 37505 - DNA, 15 bp, Homo sapiens
ggtcaaagtgaaaca

SEQ ID NO: 37506 - DNA, 15 bp, Homo sapiens
aggtcaaagtgaaac

SEQ ID NO: 37507 - DNA, 15 bp, Homo sapiens
aaggtcaaagtgaaa

SEQ ID NO: 37508 - DNA, 15 bp, Homo sapiens
aaaggtcaaagtgaa

SEQ ID NO: 37509 - DNA, 15 bp, Homo sapiens
caaaggtcaaagtga

SEQ ID NO: 37510 - DNA, 15 bp, Homo sapiens
tcaaaggtcaaagtg

SEQ ID NO: 37511 - DNA, 15 bp, Homo sapiens
atcaaaggtcaaagt

SEQ ID NO: 37512 - DNA, 15 bp, Homo sapiens
tatcaaaggtcaaag

SEQ ID NO: 37513 - DNA, 15 bp, Homo sapiens
ttatcaaaggtcaaa

SEQ ID NO: 37514 - DNA, 15 bp, Homo sapiens
tttatcaaaggtcaa

SEQ ID NO: 37515 - DNA, 15 bp, Homo sapiens
ctttatcaaaggtca

SEQ ID NO: 37516 - DNA, 15 bp, Homo sapiens
gctttatcaaaggtc

SEQ ID NO: 37517 - DNA, 15 bp, Homo sapiens
agctttatcaaaggt

SEQ ID NO: 37518 - DNA, 15 bp, Homo sapiens
cagctttatcaaagg

SEQ ID NO: 37519 - DNA, 15 bp, Homo sapiens
acagctttatcaaag

SEQ ID NO: 37520 - DNA, 15 bp, Homo sapiens
cacagctttatcaaa

SEQ ID NO: 37521 - DNA, 15 bp, Homo sapiens
tcacagctttatcaa

SEQ ID NO: 37522 - DNA, 15 bp, Homo sapiens
gtcacagctttatca

SEQ ID NO: 37523 - DNA, 15 bp, Homo sapiens
agtcacagctttatc

SEQ ID NO: 37524 - DNA, 15 bp, Homo sapiens
gagtcacagctttat

SEQ ID NO: 37525 - DNA, 15 bp, Homo sapiens
agagtcacagcttta

SEQ ID NO: 37526 - DNA, 15 bp, Homo sapiens
cagagtcacagcttt

SEQ ID NO: 37527 - DNA, 15 bp, Homo sapiens
tcagagtcacagctt

SEQ ID NO: 37528 - DNA, 15 bp, Homo sapiens
atcagagtcacagct

SEQ ID NO: 37529 - DNA, 15 bp, Homo sapiens
aatcagagtcacagc

SEQ ID NO: 37530 - DNA, 15 bp, Homo sapiens
gaatcagagtcacag

SEQ ID NO: 37531 - DNA, 15 bp, Homo sapiens
tgaatcagagtcaca

SEQ ID NO: 37532 - DNA, 15 bp, Homo sapiens
atgaatcagagtcac

SEQ ID NO: 37533 - DNA, 15 bp, Homo sapiens
aatgaatcagagtca

SEQ ID NO: 37534 - DNA, 15 bp, Homo sapiens
aaatgaatcagagtc

SEQ ID NO: 37535 - DNA, 15 bp, Homo sapiens
aaaatgaatcagagt

SEQ ID NO: 37536 - DNA, 15 bp, Homo sapiens
aaaaatgaatcagag

SEQ ID NO: 37537 - DNA, 15 bp, Homo sapiens
taaaaatgaatcaga

SEQ ID NO: 37538 - DNA, 15 bp, Homo sapiens
ctaaaaatgaatcag

SEQ ID NO: 37539 - DNA, 15 bp, Homo sapiens
cctaaaaatgaatca

SEQ ID NO: 37540 - DNA, 15 bp, Homo sapiens
ccctaaaaatgaatc

SEQ ID NO: 37541 - DNA, 15 bp, Homo sapiens
cccctaaaaatgaat

SEQ ID NO: 37542 - DNA, 15 bp, Homo sapiens
ccccctaaaaatgaa

SEQ ID NO: 37543 - DNA, 15 bp, Homo sapiens
cccccctaaaaatga

SEQ ID NO: 37544 - DNA, 15 bp, Homo sapiens
tcccccctaaaaatg

SEQ ID NO: 37545 - DNA, 15 bp, Homo sapiens
atcccccctaaaaat

SEQ ID NO: 37546 - DNA, 15 bp, Homo sapiens
aatcccccctaaaaa

SEQ ID NO: 37547 - DNA, 15 bp, Homo sapiens
gaatcccccctaaaa

SEQ ID NO: 37548 - DNA, 15 bp, Homo sapiens
tgaatcccccctaaa

SEQ ID NO: 37549 - DNA, 15 bp, Homo sapiens
gtgaatcccccctaa

SEQ ID NO: 37550 - DNA, 15 bp, Homo sapiens
ggtgaatccccccta

SEQ ID NO: 37551 - DNA, 15 bp, Homo sapiens
aggtgaatcccccct

SEQ ID NO: 37552 - DNA, 15 bp, Homo sapiens
gaggtgaatcccccc

SEQ ID NO: 37553 - DNA, 15 bp, Homo sapiens
cgaggtgaatccccc

SEQ ID NO: 37554 - DNA, 15 bp, Homo sapiens
acgaggtgaatcccc

SEQ ID NO: 37555 - DNA, 15 bp, Homo sapiens
aacgaggtgaatccc

SEQ ID NO: 37556 - DNA, 15 bp, Homo sapiens
caacgaggtgaatcc

SEQ ID NO: 37557 - DNA, 15 bp, Homo sapiens
ccaacgaggtgaatc

SEQ ID NO: 37558 - DNA, 15 bp, Homo sapiens
accaacgaggtgaat

SEQ ID NO: 37559 - DNA, 15 bp, Homo sapiens
caccaacgaggtgaa

SEQ ID NO: 37560 - DNA, 15 bp, Homo sapiens
ccaccaacgaggtga

SEQ ID NO: 37561 - DNA, 15 bp, Homo sapiens
tccaccaacgaggtg

SEQ ID NO: 37562 - DNA, 15 bp, Homo sapiens
ttccaccaacgaggt

SEQ ID NO: 37563 - DNA, 15 bp, Homo sapiens
attccaccaacgagg

SEQ ID NO: 37564 - DNA, 15 bp, Homo sapiens
gattccaccaacgag

SEQ ID NO: 37565 - DNA, 15 bp, Homo sapiens
agattccaccaacga

SEQ ID NO: 37566 - DNA, 15 bp, Homo sapiens
tagattccaccaacg

SEQ ID NO: 37567 - DNA, 15 bp, Homo sapiens
ctagattccaccaac

SEQ ID NO: 37568 - DNA, 15 bp, Homo sapiens
gctagattccaccaa

SEQ ID NO: 37569 - DNA, 15 bp, Homo sapiens
ggctagattccacca

SEQ ID NO: 37570 - DNA, 15 bp, Homo sapiens
aggctagattccacc

SEQ ID NO: 37571 - DNA, 15 bp, Homo sapiens
aaggctagattccac

SEQ ID NO: 37572 - DNA, 15 bp, Homo sapiens
caaggctagattcca

SEQ ID NO: 37573 - DNA, 15 bp, Homo sapiens
gcaaggctagattcc

SEQ ID NO: 37574 - DNA, 15 bp, Homo sapiens
ggcaaggctagattc

SEQ ID NO: 37575 - DNA, 15 bp, Homo sapiens
gggcaaggctagatt

SEQ ID NO: 37576 - DNA, 15 bp, Homo sapiens
agggcaaggctagat

SEQ ID NO: 37577 - DNA, 15 bp, Homo sapiens
cagggcaaggctaga

SEQ ID NO: 37578 - DNA, 15 bp, Homo sapiens
gcagggcaaggctag

SEQ ID NO: 37579 - DNA, 15 bp, Homo sapiens
ggcagggcaaggcta

SEQ ID NO: 37580 - DNA, 15 bp, Homo sapiens
tggcagggcaaggct

SEQ ID NO: 37581 - DNA, 15 bp, Homo sapiens
ctggcagggcaaggc

SEQ ID NO: 37582 - DNA, 15 bp, Homo sapiens
cctggcagggcaagg

SEQ ID NO: 37583 - DNA, 15 bp, Homo sapiens
gcctggcagggcaag

SEQ ID NO: 37584 - DNA, 15 bp, Homo sapiens
cgcctggcagggcaa

SEQ ID NO: 37585 - DNA, 15 bp, Homo sapiens
ccgcctggcagggca

SEQ ID NO: 37586 - DNA, 15 bp, Homo sapiens
gccgcctggcagggc

SEQ ID NO: 37587 - DNA, 15 bp, Homo sapiens
agccgcctggcaggg

SEQ ID NO: 37588 - DNA, 15 bp, Homo sapiens
cagccgcctggcagg

SEQ ID NO: 37589 - DNA, 15 bp, Homo sapiens
gcagccgcctggcag

SEQ ID NO: 37590 - DNA, 15 bp, Homo sapiens
ggcagccgcctggca

SEQ ID NO: 37591 - DNA, 15 bp, Homo sapiens
aggcagccgcctggc

SEQ ID NO: 37592 - DNA, 15 bp, Homo sapiens
caggcagccgcctgg

SEQ ID NO: 37593 - DNA, 15 bp, Homo sapiens
ccaggcagccgcctg

SEQ ID NO: 37594 - DNA, 15 bp, Homo sapiens
cccaggcagccgcct

SEQ ID NO: 37595 - DNA, 15 bp, Homo sapiens
acccaggcagccgcc

SEQ ID NO: 37596 - DNA, 15 bp, Homo sapiens
cacccaggcagccgc

SEQ ID NO: 37597 - DNA, 15 bp, Homo sapiens
acacccaggcagccg

SEQ ID NO: 37598 - DNA, 15 bp, Homo sapiens
aacacccaggcagcc

SEQ ID NO: 37599 - DNA, 15 bp, Homo sapiens
caacacccaggcagc

SEQ ID NO: 37600 - DNA, 15 bp, Homo sapiens
gcaacacccaggcag

SEQ ID NO: 37601 - DNA, 15 bp, Homo sapiens
agcaacacccaggca

SEQ ID NO: 37602 - DNA, 15 bp, Homo sapiens
aagcaacacccaggc

SEQ ID NO: 37603 - DNA, 15 bp, Homo sapiens
caagcaacacccagg

SEQ ID NO: 37604 - DNA, 15 bp, Homo sapiens
gcaagcaacacccag

SEQ ID NO: 37605 - DNA, 15 bp, Homo sapiens
agcaagcaacaccca

SEQ ID NO: 37606 - DNA, 15 bp, Homo sapiens
cagcaagcaacaccc

SEQ ID NO: 37607 - DNA, 15 bp, Homo sapiens
ccagcaagcaacacc

SEQ ID NO: 37608 - DNA, 15 bp, Homo sapiens
accagcaagcaacac

SEQ ID NO: 37609 - DNA, 15 bp, Homo sapiens
aaccagcaagcaaca

SEQ ID NO: 37610 - DNA, 15 bp, Homo sapiens
caaccagcaagcaac

SEQ ID NO: 37611 - DNA, 15 bp, Homo sapiens
ccaaccagcaagcaa

SEQ ID NO: 37612 - DNA, 15 bp, Homo sapiens
tccaaccagcaagca

SEQ ID NO: 37613 - DNA, 15 bp, Homo sapiens
ttccaaccagcaagc

SEQ ID NO: 37614 - DNA, 15 bp, Homo sapiens
attccaaccagcaag

SEQ ID NO: 37615 - DNA, 15 bp, Homo sapiens
cattccaaccagcaa

SEQ ID NO: 37616 - DNA, 15 bp, Homo sapiens
acattccaaccagca

SEQ ID NO: 37617 - DNA, 15 bp, Homo sapiens
tacattccaaccagc

SEQ ID NO: 37618 - DNA, 15 bp, Homo sapiens
atacattccaaccag

SEQ ID NO: 37619 - DNA, 15 bp, Homo sapiens
gatacattccaacca

SEQ ID NO: 37620 - DNA, 15 bp, Homo sapiens
ggatacattccaacc

SEQ ID NO: 37621 - DNA, 15 bp, Homo sapiens
tggatacattccaac

SEQ ID NO: 37622 - DNA, 15 bp, Homo sapiens
atggatacattccaa

SEQ ID NO: 37623 - DNA, 15 bp, Homo sapiens
aatggatacattcca

SEQ ID NO: 37624 - DNA, 15 bp, Homo sapiens
caatggatacattcc

SEQ ID NO: 37625 - DNA, 15 bp, Homo sapiens
tcaatggatacattc

SEQ ID NO: 37626 - DNA, 15 bp, Homo sapiens
ttcaatggatacatt

SEQ ID NO: 37627 - DNA, 15 bp, Homo sapiens
cttcaatggatacat

SEQ ID NO: 37628 - DNA, 15 bp, Homo sapiens
ccttcaatggataca

SEQ ID NO: 37629 - DNA, 15 bp, Homo sapiens
gccttcaatggatac

SEQ ID NO: 37630 - DNA, 15 bp, Homo sapiens
ggccttcaatggata

SEQ ID NO: 37631 - DNA, 15 bp, Homo sapiens
aggccttcaatggat

SEQ ID NO: 37632 - DNA, 15 bp, Homo sapiens
aaggccttcaatgga

SEQ ID NO: 37633 - DNA, 15 bp, Homo sapiens
taaggccttcaatgg

SEQ ID NO: 37634 - DNA, 15 bp, Homo sapiens
ctaaggccttcaatg

SEQ ID NO: 37635 - DNA, 15 bp, Homo sapiens
tctaaggccttcaat

SEQ ID NO: 37636 - DNA, 15 bp, Homo sapiens
atctaaggccttcaa

SEQ ID NO: 37637 - DNA, 15 bp, Homo sapiens
catctaaggccttca

SEQ ID NO: 37638 - DNA, 15 bp, Homo sapiens
acatctaaggccttc

SEQ ID NO: 37639 - DNA, 15 bp, Homo sapiens
aacatctaaggcctt

SEQ ID NO: 37640 - DNA, 15 bp, Homo sapiens
caacatctaaggcct

SEQ ID NO: 37641 - DNA, 15 bp, Homo sapiens
ccaacatctaaggcc

SEQ ID NO: 37642 - DNA, 15 bp, Homo sapiens
tccaacatctaaggc

SEQ ID NO: 37643 - DNA, 15 bp, Homo sapiens
ctccaacatctaagg

SEQ ID NO: 37644 - DNA, 15 bp, Homo sapiens
actccaacatctaag

SEQ ID NO: 37645 - DNA, 15 bp, Homo sapiens
gactccaacatctaa

SEQ ID NO: 37646 - DNA, 15 bp, Homo sapiens
ggactccaacatcta

SEQ ID NO: 37647 - DNA, 15 bp, Homo sapiens
aggactccaacatct

SEQ ID NO: 37648 - DNA, 15 bp, Homo sapiens
aaggactccaacatc

SEQ ID NO: 37649 - DNA, 15 bp, Homo sapiens
caaggactccaacat

SEQ ID NO: 37650 - DNA, 15 bp, Homo sapiens
gcaaggactccaaca

SEQ ID NO: 37651 - DNA, 15 bp, Homo sapiens
agcaaggactccaac

SEQ ID NO: 37652 - DNA, 15 bp, Homo sapiens
aagcaaggactccaa

SEQ ID NO: 37653 - DNA, 15 bp, Homo sapiens
gaagcaaggactcca

SEQ ID NO: 37654 - DNA, 15 bp, Homo sapiens
ggaagcaaggactcc

SEQ ID NO: 37655 - DNA, 15 bp, Homo sapiens
aggaagcaaggactc

SEQ ID NO: 37656 - DNA, 15 bp, Homo sapiens
taggaagcaaggact

SEQ ID NO: 37657 - DNA, 15 bp, Homo sapiens
ctaggaagcaaggac

SEQ ID NO: 37658 - DNA, 15 bp, Homo sapiens
gctaggaagcaagga

SEQ ID NO: 37659 - DNA, 15 bp, Homo sapiens
agctaggaagcaagg

SEQ ID NO: 37660 - DNA, 15 bp, Homo sapiens
gagctaggaagcaag

SEQ ID NO: 37661 - DNA, 15 bp, Homo sapiens
ggagctaggaagcaa

SEQ ID NO: 37662 - DNA, 15 bp, Homo sapiens
tggagctaggaagca

SEQ ID NO: 37663 - DNA, 15 bp, Homo sapiens
gtggagctaggaagc

SEQ ID NO: 37664 - DNA, 15 bp, Homo sapiens
ggtggagctaggaag

SEQ ID NO: 37665 - DNA, 15 bp, Homo sapiens
aggtggagctaggaa

SEQ ID NO: 37666 - DNA, 15 bp, Homo sapiens
gaggtggagctagga

SEQ ID NO: 37667 - DNA, 15 bp, Homo sapiens
agaggtggagctagg

SEQ ID NO: 37668 - DNA, 15 bp, Homo sapiens
aagaggtggagctag

SEQ ID NO: 37669 - DNA, 15 bp, Homo sapiens
aaagaggtggagcta

SEQ ID NO: 37670 - DNA, 15 bp, Homo sapiens
caaagaggtggagct

SEQ ID NO: 37671 - DNA, 15 bp, Homo sapiens
acaaagaggtggagc

SEQ ID NO: 37672 - DNA, 15 bp, Homo sapiens
aacaaagaggtggag

SEQ ID NO: 37673 - DNA, 15 bp, Homo sapiens
aaacaaagaggtgga

SEQ ID NO: 37674 - DNA, 15 bp, Homo sapiens
gaaacaaagaggtgg

SEQ ID NO: 37675 - DNA, 15 bp, Homo sapiens
tgaaacaaagaggtg

SEQ ID NO: 37676 - DNA, 15 bp, Homo sapiens
ctgaaacaaagaggt

SEQ ID NO: 37677 - DNA, 15 bp, Homo sapiens
cctgaaacaaagagg

SEQ ID NO: 37678 - DNA, 15 bp, Homo sapiens
ccctgaaacaaagag

SEQ ID NO: 37679 - DNA, 15 bp, Homo sapiens
gccctgaaacaaaga

SEQ ID NO: 37680 - DNA, 15 bp, Homo sapiens
tgccctgaaacaaag

SEQ ID NO: 37681 - DNA, 15 bp, Homo sapiens
gtgccctgaaacaaa

SEQ ID NO: 37682 - DNA, 15 bp, Homo sapiens
ggtgccctgaaacaa

SEQ ID NO: 37683 - DNA, 15 bp, Homo sapiens
tggtgccctgaaaca

SEQ ID NO: 37684 - DNA, 15 bp, Homo sapiens
gtggtgccctgaaac

SEQ ID NO: 37685 - DNA, 15 bp, Homo sapiens
agtggtgccctgaaa

SEQ ID NO: 37686 - DNA, 15 bp, Homo sapiens
gagtggtgccctgaa

SEQ ID NO: 37687 - DNA, 15 bp, Homo sapiens
agagtggtgccctga

SEQ ID NO: 37688 - DNA, 15 bp, Homo sapiens
aagagtggtgccctg

SEQ ID NO: 37689 - DNA, 15 bp, Homo sapiens
gaagagtggtgccct

SEQ ID NO: 37690 - DNA, 15 bp, Homo sapiens
agaagagtggtgccc

SEQ ID NO: 37691 - DNA, 15 bp, Homo sapiens
cagaagagtggtgcc

SEQ ID NO: 37692 - DNA, 15 bp, Homo sapiens
ccagaagagtggtgc

SEQ ID NO: 37693 - DNA, 15 bp, Homo sapiens
accagaagagtggtg

SEQ ID NO: 37694 - DNA, 15 bp, Homo sapiens
gaccagaagagtggt

SEQ ID NO: 37695 - DNA, 15 bp, Homo sapiens
agaccagaagagtgg

SEQ ID NO: 37696 - DNA, 15 bp, Homo sapiens
tagaccagaagagtg

SEQ ID NO: 37697 - DNA, 15 bp, Homo sapiens
ctagaccagaagagt

SEQ ID NO: 37698 - DNA, 15 bp, Homo sapiens
actagaccagaagag

SEQ ID NO: 37699 - DNA, 15 bp, Homo sapiens
cactagaccagaaga

SEQ ID NO: 37700 - DNA, 15 bp, Homo sapiens
gcactagaccagaag

SEQ ID NO: 37701 - DNA, 15 bp, Homo sapiens
tgcactagaccagaa

SEQ ID NO: 37702 - DNA, 15 bp, Homo sapiens
gtgcactagaccaga

SEQ ID NO: 37703 - DNA, 15 bp, Homo sapiens
tgtgcactagaccag

SEQ ID NO: 37704 - DNA, 15 bp, Homo sapiens
ctgtgcactagacca

SEQ ID NO: 37705 - DNA, 15 bp, Homo sapiens
gctgtgcactagacc

SEQ ID NO: 37706 - DNA, 15 bp, Homo sapiens
ggctgtgcactagac

SEQ ID NO: 37707 - DNA, 15 bp, Homo sapiens
aggctgtgcactaga

SEQ ID NO: 37708 - DNA, 15 bp, Homo sapiens
caggctgtgcactag

SEQ ID NO: 37709 - DNA, 15 bp, Homo sapiens
ccaggctgtgcacta

SEQ ID NO: 37710 - DNA, 15 bp, Homo sapiens
accaggctgtgcact

SEQ ID NO: 37711 - DNA, 15 bp, Homo sapiens
gaccaggctgtgcac

SEQ ID NO: 37712 - DNA, 15 bp, Homo sapiens
agaccaggctgtgca

SEQ ID NO: 37713 - DNA, 15 bp, Homo sapiens
gagaccaggctgtgc

SEQ ID NO: 37714 - DNA, 15 bp, Homo sapiens
agagaccaggctgtg

SEQ ID NO: 37715 - DNA, 15 bp, Homo sapiens
cagagaccaggctgt

SEQ ID NO: 37716 - DNA, 15 bp, Homo sapiens
acagagaccaggctg

SEQ ID NO: 37717 - DNA, 15 bp, Homo sapiens
gacagagaccaggct

SEQ ID NO: 37718 - DNA, 15 bp, Homo sapiens
tgacagagaccaggc

SEQ ID NO: 37719 - DNA, 15 bp, Homo sapiens
ttgacagagaccagg

SEQ ID NO: 37720 - DNA, 15 bp, Homo sapiens
attgacagagaccag

SEQ ID NO: 37721 - DNA, 15 bp, Homo sapiens
gattgacagagacca

SEQ ID NO: 37722 - DNA, 15 bp, Homo sapiens
tgattgacagagacc

SEQ ID NO: 37723 - DNA, 15 bp, Homo sapiens
ctgattgacagagac

SEQ ID NO: 37724 - DNA, 15 bp, Homo sapiens
gctgattgacagaga

SEQ ID NO: 37725 - DNA, 15 bp, Homo sapiens
tgctgattgacagag

SEQ ID NO: 37726 - DNA, 15 bp, Homo sapiens
gtgctgattgacaga

SEQ ID NO: 37727 - DNA, 15 bp, Homo sapiens
cgtgctgattgacag

SEQ ID NO: 37728 - DNA, 15 bp, Homo sapiens
acgtgctgattgaca

SEQ ID NO: 37729 - DNA, 15 bp, Homo sapiens
aacgtgctgattgac

SEQ ID NO: 37730 - DNA, 15 bp, Homo sapiens
gaacgtgctgattga

SEQ ID NO: 37731 - DNA, 15 bp, Homo sapiens
agaacgtgctgattg

SEQ ID NO: 37732 - DNA, 15 bp, Homo sapiens
cagaacgtgctgatt

SEQ ID NO: 37733 - DNA, 15 bp, Homo sapiens
gcagaacgtgctgat

SEQ ID NO: 37734 - DNA, 15 bp, Homo sapiens
ggcagaacgtgctga

SEQ ID NO: 37735 - DNA, 15 bp, Homo sapiens
aggcagaacgtgctg

SEQ ID NO: 37736 - DNA, 15 bp, Homo sapiens
caggcagaacgtgct

SEQ ID NO: 37737 - DNA, 15 bp, Homo sapiens
ccaggcagaacgtgc

SEQ ID NO: 37738 - DNA, 15 bp, Homo sapiens
gccaggcagaacgtg

SEQ ID NO: 37739 - DNA, 15 bp, Homo sapiens
cgccaggcagaacgt

SEQ ID NO: 37740 - DNA, 15 bp, Homo sapiens
acgccaggcagaacg

SEQ ID NO: 37741 - DNA, 15 bp, Homo sapiens
aacgccaggcagaac

SEQ ID NO: 37742 - DNA, 15 bp, Homo sapiens
aaacgccaggcagaa

SEQ ID NO: 37743 - DNA, 15 bp, Homo sapiens
aaaacgccaggcaga

SEQ ID NO: 37744 - DNA, 15 bp, Homo sapiens
taaaacgccaggcag

SEQ ID NO: 37745 - DNA, 15 bp, Homo sapiens
ataaaacgccaggca

SEQ ID NO: 37746 - DNA, 15 bp, Homo sapiens
cataaaacgccaggc

SEQ ID NO: 37747 - DNA, 15 bp, Homo sapiens
ccataaaacgccagg

SEQ ID NO: 37748 - DNA, 15 bp, Homo sapiens
gccataaaacgccag

SEQ ID NO: 37749 - DNA, 15 bp, Homo sapiens
tgccataaaacgcca

SEQ ID NO: 37750 - DNA, 15 bp, Homo sapiens
atgccataaaacgcc

SEQ ID NO: 37751 - DNA, 15 bp, Homo sapiens
catgccataaaacgc

SEQ ID NO: 37752 - DNA, 15 bp, Homo sapiens
acatgccataaaacg

SEQ ID NO: 37753 - DNA, 15 bp, Homo sapiens
aacatgccataaaac

SEQ ID NO: 37754 - DNA, 15 bp, Homo sapiens
aaacatgccataaaa

SEQ ID NO: 37755 - DNA, 15 bp, Homo sapiens
aaaacatgccataaa

SEQ ID NO: 37756 - DNA, 15 bp, Homo sapiens
gaaaacatgccataa

SEQ ID NO: 37757 - DNA, 15 bp, Homo sapiens
agaaaacatgccata

SEQ ID NO: 37758 - DNA, 15 bp, Homo sapiens
aagaaaacatgccat

SEQ ID NO: 37759 - DNA, 15 bp, Homo sapiens
gaagaaaacatgcca

SEQ ID NO: 37760 - DNA, 15 bp, Homo sapiens
ggaagaaaacatgcc

SEQ ID NO: 37761 - DNA, 15 bp, Homo sapiens
gggaagaaaacatgc

SEQ ID NO: 37762 - DNA, 15 bp, Homo sapiens
ggggaagaaaacatg

SEQ ID NO: 37763 - DNA, 15 bp, Homo sapiens
gggggaagaaaacat

SEQ ID NO: 37764 - DNA, 15 bp, Homo sapiens
ggggggaagaaaaca

SEQ ID NO: 37765 - DNA, 15 bp, Homo sapiens
gggggggaagaaaac

SEQ ID NO: 37766 - DNA, 15 bp, Homo sapiens
tgggggggaagaaaa

SEQ ID NO: 37767 - DNA, 15 bp, Homo sapiens
gtgggggggaagaaa

SEQ ID NO: 37768 - DNA, 15 bp, Homo sapiens
tgtgggggggaagaa

SEQ ID NO: 37769 - DNA, 15 bp, Homo sapiens
atgtgggggggaaga

SEQ ID NO: 37770 - DNA, 15 bp, Homo sapiens
tatgtgggggggaag

SEQ ID NO: 37771 - DNA, 15 bp, Homo sapiens
ctatgtgggggggaa

SEQ ID NO: 37772 - DNA, 15 bp, Homo sapiens
cctatgtggggggga

SEQ ID NO: 37773 - DNA, 15 bp, Homo sapiens
ccctatgtggggggg

SEQ ID NO: 37774 - DNA, 15 bp, Homo sapiens
accctatgtgggggg

SEQ ID NO: 37775 - DNA, 15 bp, Homo sapiens
taccctatgtggggg

SEQ ID NO: 37776 - DNA, 15 bp, Homo sapiens
tgcttgagtccagga

SEQ ID NO: 37777 - DNA, 15 bp, Homo sapiens
ttgcttgagtccagg

SEQ ID NO: 37778 - DNA, 15 bp, Homo sapiens
attgcttgagtccag

SEQ ID NO: 37779 - DNA, 15 bp, Homo sapiens
gattgcttgagtcca

SEQ ID NO: 37780 - DNA, 15 bp, Homo sapiens
ggattgcttgagtcc

SEQ ID NO: 37781 - DNA, 15 bp, Homo sapiens
cggattgcttgagtc

SEQ ID NO: 37782 - DNA, 15 bp, Homo sapiens
gcggattgcttgagt

SEQ ID NO: 37783 - DNA, 15 bp, Homo sapiens
ggcggattgcttgag

SEQ ID NO: 37784 - DNA, 15 bp, Homo sapiens
gggcggattgcttga

SEQ ID NO: 37785 - DNA, 15 bp, Homo sapiens
agggcggattgcttg

SEQ ID NO: 37786 - DNA, 15 bp, Homo sapiens
gagggcggattgctt

SEQ ID NO: 37787 - DNA, 15 bp, Homo sapiens
ggagggcggattgct

SEQ ID NO: 37788 - DNA, 15 bp, Homo sapiens
aggagggcggattgc

SEQ ID NO: 37789 - DNA, 15 bp, Homo sapiens
gaggagggcggattg

SEQ ID NO: 37790 - DNA, 15 bp, Homo sapiens
cgaggagggcggatt

SEQ ID NO: 37791 - DNA, 15 bp, Homo sapiens
ccgaggagggcggat

SEQ ID NO: 37792 - DNA, 15 bp, Homo sapiens
gccgaggagggcgga

SEQ ID NO: 37793 - DNA, 15 bp, Homo sapiens
ggccgaggagggcgg

SEQ ID NO: 37794 - DNA, 15 bp, Homo sapiens
aggccgaggagggcg

SEQ ID NO: 37795 - DNA, 15 bp, Homo sapiens
gaggccgaggagggc

SEQ ID NO: 37796 - DNA, 15 bp, Homo sapiens
ggaggccgaggaggg

SEQ ID NO: 37797 - DNA, 15 bp, Homo sapiens
gggaggccgaggagg

SEQ ID NO: 37798 - DNA, 15 bp, Homo sapiens
tgggaggccgaggag

SEQ ID NO: 37799 - DNA, 15 bp, Homo sapiens
agctcacacctataa

SEQ ID NO: 37800 - DNA, 15 bp, Homo sapiens
tagctcacacctata

SEQ ID NO: 37801 - DNA, 15 bp, Homo sapiens
gtagctcacacctat

SEQ ID NO: 37802 - DNA, 15 bp, Homo sapiens
ggtagctcacaccta

SEQ ID NO: 37803 - DNA, 15 bp, Homo sapiens
tggtagctcacacct

SEQ ID NO: 37804 - DNA, 15 bp, Homo sapiens
atggtagctcacacc

SEQ ID NO: 37805 - DNA, 15 bp, Homo sapiens
catggtagctcacac

SEQ ID NO: 37806 - DNA, 15 bp, Homo sapiens
gcatggtagctcaca

SEQ ID NO: 37807 - DNA, 15 bp, Homo sapiens
ggcatggtagctcac

SEQ ID NO: 37808 - DNA, 15 bp, Homo sapiens
gggcatggtagctca

SEQ ID NO: 37809 - DNA, 15 bp, Homo sapiens
tgggcatggtagctc

SEQ ID NO: 37810 - DNA, 15 bp, Homo sapiens
ctgggcatggtagct

SEQ ID NO: 37811 - DNA, 15 bp, Homo sapiens
cctgggcatggtagc

SEQ ID NO: 37812 - DNA, 15 bp, Homo sapiens
gcctgggcatggtag

SEQ ID NO: 37813 - DNA, 15 bp, Homo sapiens
agcctgggcatggta

SEQ ID NO: 37814 - DNA, 15 bp, Homo sapiens
aagcctgggcatggt

SEQ ID NO: 37815 - DNA, 15 bp, Homo sapiens
gaagcctgggcatgg

SEQ ID NO: 37816 - DNA, 15 bp, Homo sapiens
ggaagcctgggcatg

SEQ ID NO: 37817 - DNA, 15 bp, Homo sapiens
gggaagcctgggcat

SEQ ID NO: 37818 - DNA, 15 bp, Homo sapiens
tgggaagcctgggca

SEQ ID NO: 37819 - DNA, 15 bp, Homo sapiens
ctgggaagcctgggc

SEQ ID NO: 37820 - DNA, 15 bp, Homo sapiens
actgggaagcctggg

SEQ ID NO: 37821 - DNA, 15 bp, Homo sapiens
cactgggaagcctgg

SEQ ID NO: 37822 - DNA, 15 bp, Homo sapiens
acactgggaagcctg

SEQ ID NO: 37823 - DNA, 15 bp, Homo sapiens
gacactgggaagcct

SEQ ID NO: 37824 - DNA, 15 bp, Homo sapiens
tgacactgggaagcc

SEQ ID NO: 37825 - DNA, 15 bp, Homo sapiens
atgacactgggaagc

SEQ ID NO: 37826 - DNA, 15 bp, Homo sapiens
aatgacactgggaag

SEQ ID NO: 37827 - DNA, 15 bp, Homo sapiens
gaatgacactgggaa

SEQ ID NO: 37828 - DNA, 15 bp, Homo sapiens
agaatgacactggga

SEQ ID NO: 37829 - DNA, 15 bp, Homo sapiens
cagaatgacactggg

SEQ ID NO: 37830 - DNA, 15 bp, Homo sapiens
tcagaatgacactgg

SEQ ID NO: 37831 - DNA, 15 bp, Homo sapiens
atcagaatgacactg

SEQ ID NO: 37832 - DNA, 15 bp, Homo sapiens
aatcagaatgacact

SEQ ID NO: 37833 - DNA, 15 bp, Homo sapiens
aaatcagaatgacac

SEQ ID NO: 37834 - DNA, 15 bp, Homo sapiens
caaatcagaatgaca

SEQ ID NO: 37835 - DNA, 15 bp, Homo sapiens
tcaaatcagaatgac

SEQ ID NO: 37836 - DNA, 15 bp, Homo sapiens
ttcaaatcagaatga

SEQ ID NO: 37837 - DNA, 15 bp, Homo sapiens
attcaaatcagaatg

SEQ ID NO: 37838 - DNA, 15 bp, Homo sapiens
aattcaaatcagaat

SEQ ID NO: 37839 - DNA, 15 bp, Homo sapiens
aaattcaaatcagaa

SEQ ID NO: 37840 - DNA, 15 bp, Homo sapiens
aaaattcaaatcaga

SEQ ID NO: 37841 - DNA, 15 bp, Homo sapiens
aaaaattcaaatcag

SEQ ID NO: 37842 - DNA, 15 bp, Homo sapiens
gaaaaattcaaatca

SEQ ID NO: 37843 - DNA, 15 bp, Homo sapiens
agaaaaattcaaatc

SEQ ID NO: 37844 - DNA, 15 bp, Homo sapiens
tagaaaaattcaaat

SEQ ID NO: 37845 - DNA, 15 bp, Homo sapiens
ctagaaaaattcaaa

SEQ ID NO: 37846 - DNA, 15 bp, Homo sapiens
tctagaaaaattcaa

SEQ ID NO: 37847 - DNA, 15 bp, Homo sapiens
ttctagaaaaattca

SEQ ID NO: 37848 - DNA, 15 bp, Homo sapiens
tttctagaaaaattc

SEQ ID NO: 37849 - DNA, 15 bp, Homo sapiens
ctttctagaaaaatt

SEQ ID NO: 37850 - DNA, 15 bp, Homo sapiens
tctttctagaaaaat

SEQ ID NO: 37851 - DNA, 15 bp, Homo sapiens
atctttctagaaaaa

SEQ ID NO: 37852 - DNA, 15 bp, Homo sapiens
aatctttctagaaaa

SEQ ID NO: 37853 - DNA, 15 bp, Homo sapiens
aaatctttctagaaa

SEQ ID NO: 37854 - DNA, 15 bp, Homo sapiens
gaaatctttctagaa

SEQ ID NO: 37855 - DNA, 15 bp, Homo sapiens
agaaatctttctaga

SEQ ID NO: 37856 - DNA, 15 bp, Homo sapiens
tagaaatctttctag

SEQ ID NO: 37857 - DNA, 15 bp, Homo sapiens
ctagaaatctttcta

SEQ ID NO: 37858 - DNA, 15 bp, Homo sapiens
tctagaaatctttct

SEQ ID NO: 37859 - DNA, 15 bp, Homo sapiens
ttctagaaatctttc

SEQ ID NO: 37860 - DNA, 15 bp, Homo sapiens
attctagaaatcttt

SEQ ID NO: 37861 - DNA, 15 bp, Homo sapiens
aattctagaaatctt

SEQ ID NO: 37862 - DNA, 15 bp, Homo sapiens
aaattctagaaatct

SEQ ID NO: 37863 - DNA, 15 bp, Homo sapiens
aaaattctagaaatc

SEQ ID NO: 37864 - DNA, 15 bp, Homo sapiens
aaaaattctagaaat

SEQ ID NO: 37865 - DNA, 15 bp, Homo sapiens
gaaaaattctagaaa

SEQ ID NO: 37866 - DNA, 15 bp, Homo sapiens
agaaaaattctagaa

SEQ ID NO: 37867 - DNA, 15 bp, Homo sapiens
tagaaaaattctaga

SEQ ID NO: 37868 - DNA, 15 bp, Homo sapiens
ctagaaaaattctag

SEQ ID NO: 37869 - DNA, 15 bp, Homo sapiens
tctagaaaaattcta

SEQ ID NO: 37870 - DNA, 15 bp, Homo sapiens
ttctagaaaaattct

SEQ ID NO: 37871 - DNA, 15 bp, Homo sapiens
attctagaaaaattc

SEQ ID NO: 37872 - DNA, 15 bp, Homo sapiens
cattctagaaaaatt

SEQ ID NO: 37873 - DNA, 15 bp, Homo sapiens
tcattctagaaaaat

SEQ ID NO: 37874 - DNA, 15 bp, Homo sapiens
atcattctagaaaaa

SEQ ID NO: 37875 - DNA, 15 bp, Homo sapiens
aatcattctagaaaa

SEQ ID NO: 37876 - DNA, 15 bp, Homo sapiens
taatcattctagaaa

SEQ ID NO: 37877 - DNA, 15 bp, Homo sapiens
ataatcattctagaa

SEQ ID NO: 37878 - DNA, 15 bp, Homo sapiens
aataatcattctaga

SEQ ID NO: 37879 - DNA, 15 bp, Homo sapiens
caataatcattctag

SEQ ID NO: 37880 - DNA, 15 bp, Homo sapiens
acaataatcattcta

SEQ ID NO: 37881 - DNA, 15 bp, Homo sapiens
tacaataatcattct

SEQ ID NO: 37882 - DNA, 15 bp, Homo sapiens
atacaataatcattc

SEQ ID NO: 37883 - DNA, 15 bp, Homo sapiens
gatacaataatcatt

SEQ ID NO: 37884 - DNA, 15 bp, Homo sapiens
ggatacaataatcat

SEQ ID NO: 37885 - DNA, 15 bp, Homo sapiens
aggatacaataatca

SEQ ID NO: 37886 - DNA, 15 bp, Homo sapiens
taggatacaataatc

SEQ ID NO: 37887 - DNA, 15 bp, Homo sapiens
ttaggatacaataat

SEQ ID NO: 37888 - DNA, 15 bp, Homo sapiens
tttaggatacaataa

SEQ ID NO: 37889 - DNA, 15 bp, Homo sapiens
gtttaggatacaata

SEQ ID NO: 37890 - DNA, 15 bp, Homo sapiens
tgtttaggatacaat

SEQ ID NO: 37891 - DNA, 15 bp, Homo sapiens
atgtttaggatacaa

SEQ ID NO: 37892 - DNA, 15 bp, Homo sapiens
aatgtttaggataca

SEQ ID NO: 37893 - DNA, 15 bp, Homo sapiens
aaatgtttaggatac

SEQ ID NO: 37894 - DNA, 15 bp, Homo sapiens
taaatgtttaggata

SEQ ID NO: 37895 - DNA, 15 bp, Homo sapiens
ataaatgtttaggat

SEQ ID NO: 37896 - DNA, 15 bp, Homo sapiens
tataaatgtttagga

SEQ ID NO: 37897 - DNA, 15 bp, Homo sapiens
ctataaatgtttagg

SEQ ID NO: 37898 - DNA, 15 bp, Homo sapiens
gctataaatgtttag

SEQ ID NO: 37899 - DNA, 15 bp, Homo sapiens
tgctataaatgttta

SEQ ID NO: 37900 - DNA, 15 bp, Homo sapiens
atgctataaatgttt

SEQ ID NO: 37901 - DNA, 15 bp, Homo sapiens
aatgctataaatgtt

SEQ ID NO: 37902 - DNA, 15 bp, Homo sapiens
taatgctataaatgt

SEQ ID NO: 37903 - DNA, 15 bp, Homo sapiens
ataatgctataaatg

SEQ ID NO: 37904 - DNA, 15 bp, Homo sapiens
cataatgctataaat

SEQ ID NO: 37905 - DNA, 15 bp, Homo sapiens
acataatgctataaa

SEQ ID NO: 37906 - DNA, 15 bp, Homo sapiens
aacataatgctataa

SEQ ID NO: 37907 - DNA, 15 bp, Homo sapiens
gaacataatgctata

SEQ ID NO: 37908 - DNA, 15 bp, Homo sapiens
agaacataatgctat

SEQ ID NO: 37909 - DNA, 15 bp, Homo sapiens
aagaacataatgcta

SEQ ID NO: 37910 - DNA, 15 bp, Homo sapiens
aaagaacataatgct

SEQ ID NO: 37911 - DNA, 15 bp, Homo sapiens
taaagaacataatgc

SEQ ID NO: 37912 - DNA, 15 bp, Homo sapiens
gtaaagaacataatg

SEQ ID NO: 37913 - DNA, 15 bp, Homo sapiens
agtaaagaacataat

SEQ ID NO: 37914 - DNA, 15 bp, Homo sapiens
aagtaaagaacataa

SEQ ID NO: 37915 - DNA, 15 bp, Homo sapiens
aaagtaaagaacata

SEQ ID NO: 37916 - DNA, 15 bp, Homo sapiens
aaaagtaaagaacat

SEQ ID NO: 37917 - DNA, 15 bp, Homo sapiens
aaaaagtaaagaaca

SEQ ID NO: 37918 - DNA, 15 bp, Homo sapiens
taaaaagtaaagaac

SEQ ID NO: 37919 - DNA, 15 bp, Homo sapiens
ataaaaagtaaagaa

SEQ ID NO: 37920 - DNA, 15 bp, Homo sapiens
aataaaaagtaaaga

SEQ ID NO: 37921 - DNA, 15 bp, Homo sapiens
caataaaaagtaaag

SEQ ID NO: 37922 - DNA, 15 bp, Homo sapiens
gcaataaaaagtaaa

SEQ ID NO: 37923 - DNA, 15 bp, Homo sapiens
agcaataaaaagtaa

SEQ ID NO: 37924 - DNA, 15 bp, Homo sapiens
aagcaataaaaagta

SEQ ID NO: 37925 - DNA, 15 bp, Homo sapiens
taagcaataaaaagt

SEQ ID NO: 37926 - DNA, 15 bp, Homo sapiens
ctaagcaataaaaag

SEQ ID NO: 37927 - DNA, 15 bp, Homo sapiens
tctaagcaataaaaa

SEQ ID NO: 37928 - DNA, 15 bp, Homo sapiens
ttctaagcaataaaa

SEQ ID NO: 37929 - DNA, 15 bp, Homo sapiens
tttctaagcaataaa

SEQ ID NO: 37930 - DNA, 15 bp, Homo sapiens
ttttctaagcaataa

SEQ ID NO: 37931 - DNA, 15 bp, Homo sapiens
tttttctaagcaata

SEQ ID NO: 37932 - DNA, 15 bp, Homo sapiens
ttttttctaagcaat

SEQ ID NO: 37933 - DNA, 15 bp, Homo sapiens
tttttttctaagcaa

SEQ ID NO: 37934 - DNA, 15 bp, Homo sapiens
atttttttctaagca

SEQ ID NO: 37935 - DNA, 15 bp, Homo sapiens
tatttttttctaagc

SEQ ID NO: 37936 - DNA, 15 bp, Homo sapiens
ctatttttttctaag

SEQ ID NO: 37937 - DNA, 15 bp, Homo sapiens
actatttttttctaa

SEQ ID NO: 37938 - DNA, 15 bp, Homo sapiens
aactatttttttcta

SEQ ID NO: 37939 - DNA, 15 bp, Homo sapiens
aaactatttttttct

SEQ ID NO: 37940 - DNA, 15 bp, Homo sapiens
taaactatttttttc

SEQ ID NO: 37941 - DNA, 15 bp, Homo sapiens
ctaaactattttttt

SEQ ID NO: 37942 - DNA, 15 bp, Homo sapiens
actaaactatttttt

SEQ ID NO: 37943 - DNA, 15 bp, Homo sapiens
aactaaactattttt

SEQ ID NO: 37944 - DNA, 15 bp, Homo sapiens
taactaaactatttt

SEQ ID NO: 37945 - DNA, 15 bp, Homo sapiens
gtaactaaactattt

SEQ ID NO: 37946 - DNA, 15 bp, Homo sapiens
agtaactaaactatt

SEQ ID NO: 37947 - DNA, 15 bp, Homo sapiens
tagtaactaaactat

SEQ ID NO: 37948 - DNA, 15 bp, Homo sapiens
gtagtaactaaacta

SEQ ID NO: 37949 - DNA, 15 bp, Homo sapiens
agtagtaactaaact

SEQ ID NO: 37950 - DNA, 15 bp, Homo sapiens
cagtagtaactaaac

SEQ ID NO: 37951 - DNA, 15 bp, Homo sapiens
ccagtagtaactaaa

SEQ ID NO: 37952 - DNA, 15 bp, Homo sapiens
accagtagtaactaa

SEQ ID NO: 37953 - DNA, 15 bp, Homo sapiens
taccagtagtaacta

SEQ ID NO: 37954 - DNA, 15 bp, Homo sapiens
ttaccagtagtaact

SEQ ID NO: 37955 - DNA, 15 bp, Homo sapiens
attaccagtagtaac

SEQ ID NO: 37956 - DNA, 15 bp, Homo sapiens
aattaccagtagtaa

SEQ ID NO: 37957 - DNA, 15 bp, Homo sapiens
aaattaccagtagta

SEQ ID NO: 37958 - DNA, 15 bp, Homo sapiens
caaattaccagtagt

SEQ ID NO: 37959 - DNA, 15 bp, Homo sapiens
gcaaattaccagtag

SEQ ID NO: 37960 - DNA, 15 bp, Homo sapiens
tgcaaattaccagta

SEQ ID NO: 37961 - DNA, 15 bp, Homo sapiens
ttgcaaattaccagt

SEQ ID NO: 37962 - DNA, 15 bp, Homo sapiens
tttgcaaattaccag

SEQ ID NO: 37963 - DNA, 15 bp, Homo sapiens
atttgcaaattacca

SEQ ID NO: 37964 - DNA, 15 bp, Homo sapiens
aatttgcaaattacc

SEQ ID NO: 37965 - DNA, 15 bp, Homo sapiens
taatttgcaaattac

SEQ ID NO: 37966 - DNA, 15 bp, Homo sapiens
ttaatttgcaaatta

SEQ ID NO: 37967 - DNA, 15 bp, Homo sapiens
tttaatttgcaaatt

SEQ ID NO: 37968 - DNA, 15 bp, Homo sapiens
ctttaatttgcaaat

SEQ ID NO: 37969 - DNA, 15 bp, Homo sapiens
tctttaatttgcaaa

SEQ ID NO: 37970 - DNA, 15 bp, Homo sapiens
ttctttaatttgcaa

SEQ ID NO: 37971 - DNA, 15 bp, Homo sapiens
attctttaatttgca

SEQ ID NO: 37972 - DNA, 15 bp, Homo sapiens
aattctttaatttgc

SEQ ID NO: 37973 - DNA, 15 bp, Homo sapiens
taattctttaatttg

SEQ ID NO: 37974 - DNA, 15 bp, Homo sapiens
ataattctttaattt

SEQ ID NO: 37975 - DNA, 15 bp, Homo sapiens
cataattctttaatt

SEQ ID NO: 37976 - DNA, 15 bp, Homo sapiens
acataattctttaat

SEQ ID NO: 37977 - DNA, 15 bp, Homo sapiens
tacataattctttaa

SEQ ID NO: 37978 - DNA, 15 bp, Homo sapiens
atacataattcttta

SEQ ID NO: 37979 - DNA, 15 bp, Homo sapiens
tatacataattcttt

SEQ ID NO: 37980 - DNA, 15 bp, Homo sapiens
ttatacataattctt

SEQ ID NO: 37981 - DNA, 15 bp, Homo sapiens
tttatacataattct

SEQ ID NO: 37982 - DNA, 15 bp, Homo sapiens
ttttatacataattc

SEQ ID NO: 37983 - DNA, 15 bp, Homo sapiens
attttatacataatt

SEQ ID NO: 37984 - DNA, 15 bp, Homo sapiens
aattttatacataat

SEQ ID NO: 37985 - DNA, 15 bp, Homo sapiens
caattttatacataa

SEQ ID NO: 37986 - DNA, 15 bp, Homo sapiens
gcaattttatacata

SEQ ID NO: 37987 - DNA, 15 bp, Homo sapiens
agcaattttatacat

SEQ ID NO: 37988 - DNA, 15 bp, Homo sapiens
tagcaattttataca

SEQ ID NO: 37989 - DNA, 15 bp, Homo sapiens
atagcaattttatac

SEQ ID NO: 37990 - DNA, 15 bp, Homo sapiens
tatagcaattttata

SEQ ID NO: 37991 - DNA, 15 bp, Homo sapiens
ctatagcaattttat

SEQ ID NO: 37992 - DNA, 15 bp, Homo sapiens
cctatagcaatttta

SEQ ID NO: 37993 - DNA, 15 bp, Homo sapiens
acctatagcaatttt

SEQ ID NO: 37994 - DNA, 15 bp, Homo sapiens
cacctatagcaattt

SEQ ID NO: 37995 - DNA, 15 bp, Homo sapiens
gcacctatagcaatt

SEQ ID NO: 37996 - DNA, 15 bp, Homo sapiens
ggcacctatagcaat

SEQ ID NO: 37997 - DNA, 15 bp, Homo sapiens
aggcacctatagcaa

SEQ ID NO: 37998 - DNA, 15 bp, Homo sapiens
caggcacctatagca

SEQ ID NO: 37999 - DNA, 15 bp, Homo sapiens
acaggcacctatagc

SEQ ID NO: 38000 - DNA, 15 bp, Homo sapiens
cacaggcacctatag

SEQ ID NO: 38001 - DNA, 15 bp, Homo sapiens
ccacaggcacctata

SEQ ID NO: 38002 - DNA, 15 bp, Homo sapiens
accacaggcacctat

SEQ ID NO: 38003 - DNA, 15 bp, Homo sapiens
aaccacaggcaccta

SEQ ID NO: 38004 - DNA, 15 bp, Homo sapiens
taaccacaggcacct

SEQ ID NO: 38005 - DNA, 15 bp, Homo sapiens
ttaaccacaggcacc

SEQ ID NO: 38006 - DNA, 15 bp, Homo sapiens
tttaaccacaggcac

SEQ ID NO: 38007 - DNA, 15 bp, Homo sapiens
atttaaccacaggca

SEQ ID NO: 38008 - DNA, 15 bp, Homo sapiens
aatttaaccacaggc

SEQ ID NO: 38009 - DNA, 15 bp, Homo sapiens
gaatttaaccacagg

SEQ ID NO: 38010 - DNA, 15 bp, Homo sapiens
agaatttaaccacag

SEQ ID NO: 38011 - DNA, 15 bp, Homo sapiens
aagaatttaaccaca

SEQ ID NO: 38012 - DNA, 15 bp, Homo sapiens
aaagaatttaaccac

SEQ ID NO: 38013 - DNA, 15 bp, Homo sapiens
aaaagaatttaacca

SEQ ID NO: 38014 - DNA, 15 bp, Homo sapiens
taaaagaatttaacc

SEQ ID NO: 38015 - DNA, 15 bp, Homo sapiens
gtaaaagaatttaac

SEQ ID NO: 38016 - DNA, 15 bp, Homo sapiens
ggtaaaagaatttaa

SEQ ID NO: 38017 - DNA, 15 bp, Homo sapiens
tggtaaaagaattta

SEQ ID NO: 38018 - DNA, 15 bp, Homo sapiens
ttggtaaaagaattt

SEQ ID NO: 38019 - DNA, 15 bp, Homo sapiens
cttggtaaaagaatt

SEQ ID NO: 38020 - DNA, 15 bp, Homo sapiens
tcttggtaaaagaat

SEQ ID NO: 38021 - DNA, 15 bp, Homo sapiens
atcttggtaaaagaa

SEQ ID NO: 38022 - DNA, 15 bp, Homo sapiens
aatcttggtaaaaga

SEQ ID NO: 38023 - DNA, 15 bp, Homo sapiens
aaatcttggtaaaag

SEQ ID NO: 38024 - DNA, 15 bp, Homo sapiens
gaaatcttggtaaaa

SEQ ID NO: 38025 - DNA, 15 bp, Homo sapiens
tgaaatcttggtaaa

SEQ ID NO: 38026 - DNA, 15 bp, Homo sapiens
gtgaaatcttggtaa

SEQ ID NO: 38027 - DNA, 15 bp, Homo sapiens
agtgaaatcttggta

SEQ ID NO: 38028 - DNA, 15 bp, Homo sapiens
aagtgaaatcttggt

SEQ ID NO: 38029 - DNA, 15 bp, Homo sapiens
gaagtgaaatcttgg

SEQ ID NO: 38030 - DNA, 15 bp, Homo sapiens
agaagtgaaatcttg

SEQ ID NO: 38031 - DNA, 15 bp, Homo sapiens
tagaagtgaaatctt

SEQ ID NO: 38032 - DNA, 15 bp, Homo sapiens
ctagaagtgaaatct

SEQ ID NO: 38033 - DNA, 15 bp, Homo sapiens
tctagaagtgaaatc

SEQ ID NO: 38034 - DNA, 15 bp, Homo sapiens
ctctagaagtgaaat

SEQ ID NO: 38035 - DNA, 15 bp, Homo sapiens
tctctagaagtgaaa

SEQ ID NO: 38036 - DNA, 15 bp, Homo sapiens
ttctctagaagtgaa

SEQ ID NO: 38037 - DNA, 15 bp, Homo sapiens
gttctctagaagtga

SEQ ID NO: 38038 - DNA, 15 bp, Homo sapiens
agttctctagaagtg

SEQ ID NO: 38039 - DNA, 15 bp, Homo sapiens
cagttctctagaagt

SEQ ID NO: 38040 - DNA, 15 bp, Homo sapiens
tcagttctctagaag

SEQ ID NO: 38041 - DNA, 15 bp, Homo sapiens
ttcagttctctagaa

SEQ ID NO: 38042 - DNA, 15 bp, Homo sapiens
cttcagttctctaga

SEQ ID NO: 38043 - DNA, 15 bp, Homo sapiens
tcttcagttctctag

SEQ ID NO: 38044 - DNA, 15 bp, Homo sapiens
ttcttcagttctcta

SEQ ID NO: 38045 - DNA, 15 bp, Homo sapiens
attcttcagttctct

SEQ ID NO: 38046 - DNA, 15 bp, Homo sapiens
aattcttcagttctc

SEQ ID NO: 38047 - DNA, 15 bp, Homo sapiens
aaattcttcagttct

SEQ ID NO: 38048 - DNA, 15 bp, Homo sapiens
taaattcttcagttc

SEQ ID NO: 38049 - DNA, 15 bp, Homo sapiens
gtaaattcttcagtt

SEQ ID NO: 38050 - DNA, 15 bp, Homo sapiens
tttggtaaattcttc

SEQ ID NO: 38051 - DNA, 15 bp, Homo sapiens
ctttggtaaattctt

SEQ ID NO: 38052 - DNA, 15 bp, Homo sapiens
actttggtaaattct

SEQ ID NO: 38053 - DNA, 15 bp, Homo sapiens
tactttggtaaattc

SEQ ID NO: 38054 - DNA, 15 bp, Homo sapiens
ttactttggtaaatt

SEQ ID NO: 38055 - DNA, 15 bp, Homo sapiens
tttactttggtaaat

SEQ ID NO: 38056 - DNA, 15 bp, Homo sapiens
ttttactttggtaaa

SEQ ID NO: 38057 - DNA, 15 bp, Homo sapiens
tttttactttggtaa

SEQ ID NO: 38058 - DNA, 15 bp, Homo sapiens
atttttactttggta

SEQ ID NO: 38059 - DNA, 15 bp, Homo sapiens
catttttactttggt

SEQ ID NO: 38060 - DNA, 15 bp, Homo sapiens
ccatttttactttgg

SEQ ID NO: 38061 - DNA, 15 bp, Homo sapiens
accatttttactttg

SEQ ID NO: 38062 - DNA, 15 bp, Homo sapiens
gaccatttttacttt

SEQ ID NO: 38063 - DNA, 15 bp, Homo sapiens
agaccatttttactt

SEQ ID NO: 38064 - DNA, 15 bp, Homo sapiens
tagaccatttttact

SEQ ID NO: 38065 - DNA, 15 bp, Homo sapiens
ttagaccatttttac

SEQ ID NO: 38066 - DNA, 15 bp, Homo sapiens
gttagaccattttta

SEQ ID NO: 38067 - DNA, 15 bp, Homo sapiens
agttagaccattttt

SEQ ID NO: 38068 - DNA, 15 bp, Homo sapiens
aagttagaccatttt

SEQ ID NO: 38069 - DNA, 15 bp, Homo sapiens
aaagttagaccattt

SEQ ID NO: 38070 - DNA, 15 bp, Homo sapiens
taaagttagaccatt

SEQ ID NO: 38071 - DNA, 15 bp, Homo sapiens
ataaagttagaccat

SEQ ID NO: 38072 - DNA, 15 bp, Homo sapiens
aataaagttagacca

SEQ ID NO: 38073 - DNA, 15 bp, Homo sapiens
taataaagttagacc

SEQ ID NO: 38074 - DNA, 15 bp, Homo sapiens
gtaataaagttagac

SEQ ID NO: 38075 - DNA, 15 bp, Homo sapiens
agtaataaagttaga

SEQ ID NO: 38076 - DNA, 15 bp, Homo sapiens
aagtaataaagttag

SEQ ID NO: 38077 - DNA, 15 bp, Homo sapiens
caagtaataaagtta

SEQ ID NO: 38078 - DNA, 15 bp, Homo sapiens
ccaagtaataaagtt

SEQ ID NO: 38079 - DNA, 15 bp, Homo sapiens
accaagtaataaagt

SEQ ID NO: 38080 - DNA, 15 bp, Homo sapiens
aaccaagtaataaag

SEQ ID NO: 38081 - DNA, 15 bp, Homo sapiens
aaaccaagtaataaa

SEQ ID NO: 38082 - DNA, 15 bp, Homo sapiens
taaaccaagtaataa

SEQ ID NO: 38083 - DNA, 15 bp, Homo sapiens
ataaaccaagtaata

SEQ ID NO: 38084 - DNA, 15 bp, Homo sapiens
tataaaccaagtaat

SEQ ID NO: 38085 - DNA, 15 bp, Homo sapiens
ctataaaccaagtaa

SEQ ID NO: 38086 - DNA, 15 bp, Homo sapiens
tctataaaccaagta

SEQ ID NO: 38087 - DNA, 15 bp, Homo sapiens
ttctataaaccaagt

SEQ ID NO: 38088 - DNA, 15 bp, Homo sapiens
tttctataaaccaag

SEQ ID NO: 38089 - DNA, 15 bp, Homo sapiens
atttctataaaccaa

SEQ ID NO: 38090 - DNA, 15 bp, Homo sapiens
catttctataaacca

SEQ ID NO: 38091 - DNA, 15 bp, Homo sapiens
tcatttctataaacc

SEQ ID NO: 38092 - DNA, 15 bp, Homo sapiens
ttcatttctataaac

SEQ ID NO: 38093 - DNA, 15 bp, Homo sapiens
attcatttctataaa

SEQ ID NO: 38094 - DNA, 15 bp, Homo sapiens
tattcatttctataa

SEQ ID NO: 38095 - DNA, 15 bp, Homo sapiens
ttattcatttctata

SEQ ID NO: 38096 - DNA, 15 bp, Homo sapiens
tttattcatttctat

SEQ ID NO: 38097 - DNA, 15 bp, Homo sapiens
atttattcatttcta

SEQ ID NO: 38098 - DNA, 15 bp, Homo sapiens
gatttattcatttct

SEQ ID NO: 38099 - DNA, 15 bp, Homo sapiens
tgatttattcatttc

SEQ ID NO: 38100 - DNA, 15 bp, Homo sapiens
atgatttattcattt

SEQ ID NO: 38101 - DNA, 15 bp, Homo sapiens
tatgatttattcatt

SEQ ID NO: 38102 - DNA, 15 bp, Homo sapiens
ctatgatttattcat

SEQ ID NO: 38103 - DNA, 15 bp, Homo sapiens
actatgatttattca

SEQ ID NO: 38104 - DNA, 15 bp, Homo sapiens
aactatgatttattc

SEQ ID NO: 38105 - DNA, 15 bp, Homo sapiens
taactatgatttatt

SEQ ID NO: 38106 - DNA, 15 bp, Homo sapiens
ttaactatgatttat

SEQ ID NO: 38107 - DNA, 15 bp, Homo sapiens
attaactatgattta

SEQ ID NO: 38108 - DNA, 15 bp, Homo sapiens
tattaactatgattt

SEQ ID NO: 38109 - DNA, 15 bp, Homo sapiens
ctattaactatgatt

SEQ ID NO: 38110 - DNA, 15 bp, Homo sapiens
actattaactatgat

SEQ ID NO: 38111 - DNA, 15 bp, Homo sapiens
tactattaactatga

SEQ ID NO: 38112 - DNA, 15 bp, Homo sapiens
gtactattaactatg

SEQ ID NO: 38113 - DNA, 15 bp, Homo sapiens
tgtactattaactat

SEQ ID NO: 38114 - DNA, 15 bp, Homo sapiens
ctgtactattaacta

SEQ ID NO: 38115 - DNA, 15 bp, Homo sapiens
actgtactattaact

SEQ ID NO: 38116 - DNA, 15 bp, Homo sapiens
tactgtactattaac

SEQ ID NO: 38117 - DNA, 15 bp, Homo sapiens
atactgtactattaa

SEQ ID NO: 38118 - DNA, 15 bp, Homo sapiens
tatactgtactatta

SEQ ID NO: 38119 - DNA, 15 bp, Homo sapiens
atatactgtactatt

SEQ ID NO: 38120 - DNA, 15 bp, Homo sapiens
aatatactgtactat

SEQ ID NO: 38121 - DNA, 15 bp, Homo sapiens
taatatactgtacta

SEQ ID NO: 38122 - DNA, 15 bp, Homo sapiens
ttaatatactgtact

SEQ ID NO: 38123 - DNA, 15 bp, Homo sapiens
attaatatactgtac

SEQ ID NO: 38124 - DNA, 15 bp, Homo sapiens
tattaatatactgta

SEQ ID NO: 38125 - DNA, 15 bp, Homo sapiens
ttattaatatactgt

SEQ ID NO: 38126 - DNA, 15 bp, Homo sapiens
attattaatatactg

SEQ ID NO: 38127 - DNA, 15 bp, Homo sapiens
tattattaatatact

SEQ ID NO: 38128 - DNA, 15 bp, Homo sapiens
gtattattaatatac

SEQ ID NO: 38129 - DNA, 15 bp, Homo sapiens
agtattattaatata

SEQ ID NO: 38130 - DNA, 15 bp, Homo sapiens
cagtattattaatat

SEQ ID NO: 38131 - DNA, 15 bp, Homo sapiens
acagtattattaata

SEQ ID NO: 38132 - DNA, 15 bp, Homo sapiens
cacagtattattaat

SEQ ID NO: 38133 - DNA, 15 bp, Homo sapiens
gcacagtattattaa

SEQ ID NO: 38134 - DNA, 15 bp, Homo sapiens
agcacagtattatta

SEQ ID NO: 38135 - DNA, 15 bp, Homo sapiens
gagcacagtattatt

SEQ ID NO: 38136 - DNA, 15 bp, Homo sapiens
agagcacagtattat

SEQ ID NO: 38137 - DNA, 15 bp, Homo sapiens
tagagcacagtatta

SEQ ID NO: 38138 - DNA, 15 bp, Homo sapiens
ttagagcacagtatt

SEQ ID NO: 38139 - DNA, 15 bp, Homo sapiens
cttagagcacagtat

SEQ ID NO: 38140 - DNA, 15 bp, Homo sapiens
gcttagagcacagta

SEQ ID NO: 38141 - DNA, 15 bp, Homo sapiens
agcttagagcacagt

SEQ ID NO: 38142 - DNA, 15 bp, Homo sapiens
tagcttagagcacag

SEQ ID NO: 38143 - DNA, 15 bp, Homo sapiens
gtagcttagagcaca

SEQ ID NO: 38144 - DNA, 15 bp, Homo sapiens
tgtagcttagagcac

SEQ ID NO: 38145 - DNA, 15 bp, Homo sapiens
ctgtagcttagagca

SEQ ID NO: 38146 - DNA, 15 bp, Homo sapiens
tctgtagcttagagc

SEQ ID NO: 38147 - DNA, 15 bp, Homo sapiens
atctgtagcttagag

SEQ ID NO: 38148 - DNA, 15 bp, Homo sapiens
aatctgtagcttaga

SEQ ID NO: 38149 - DNA, 15 bp, Homo sapiens
taatctgtagcttag

SEQ ID NO: 38150 - DNA, 15 bp, Homo sapiens
ctaatctgtagctta

SEQ ID NO: 38151 - DNA, 15 bp, Homo sapiens
tctaatctgtagctt

SEQ ID NO: 38152 - DNA, 15 bp, Homo sapiens
ttctaatctgtagct

SEQ ID NO: 38153 - DNA, 15 bp, Homo sapiens
tttctaatctgtagc

SEQ ID NO: 38154 - DNA, 15 bp, Homo sapiens
ttttctaatctgtag

SEQ ID NO: 38155 - DNA, 15 bp, Homo sapiens
tttttctaatctgta

SEQ ID NO: 38156 - DNA, 15 bp, Homo sapiens
atttttctaatctgt

SEQ ID NO: 38157 - DNA, 15 bp, Homo sapiens
tatttttctaatctg

SEQ ID NO: 38158 - DNA, 15 bp, Homo sapiens
atatttttctaatct

SEQ ID NO: 38159 - DNA, 15 bp, Homo sapiens
catatttttctaatc

SEQ ID NO: 38160 - DNA, 15 bp, Homo sapiens
gcatatttttctaat

SEQ ID NO: 38161 - DNA, 15 bp, Homo sapiens
tgcatatttttctaa

SEQ ID NO: 38162 - DNA, 15 bp, Homo sapiens
gtgcatatttttcta

SEQ ID NO: 38163 - DNA, 15 bp, Homo sapiens
ggtgcatatttttct

SEQ ID NO: 38164 - DNA, 15 bp, Homo sapiens
gggtgcatatttttc

SEQ ID NO: 38165 - DNA, 15 bp, Homo sapiens
agggtgcatattttt

SEQ ID NO: 38166 - DNA, 15 bp, Homo sapiens
cagggtgcatatttt

SEQ ID NO: 38167 - DNA, 15 bp, Homo sapiens
acagggtgcatattt

SEQ ID NO: 38168 - DNA, 15 bp, Homo sapiens
aacagggtgcatatt

SEQ ID NO: 38169 - DNA, 15 bp, Homo sapiens
aaacagggtgcatat

SEQ ID NO: 38170 - DNA, 15 bp, Homo sapiens
caaacagggtgcata

SEQ ID NO: 38171 - DNA, 15 bp, Homo sapiens
acaaacagggtgcat

SEQ ID NO: 38172 - DNA, 15 bp, Homo sapiens
gacaaacagggtgca

SEQ ID NO: 38173 - DNA, 15 bp, Homo sapiens
tgacaaacagggtgc

SEQ ID NO: 38174 - DNA, 15 bp, Homo sapiens
gtgacaaacagggtg

SEQ ID NO: 38175 - DNA, 15 bp, Homo sapiens
tgtgacaaacagggt

SEQ ID NO: 38176 - DNA, 15 bp, Homo sapiens
ttgtgacaaacaggg

SEQ ID NO: 38177 - DNA, 15 bp, Homo sapiens
attgtgacaaacagg

SEQ ID NO: 38178 - DNA, 15 bp, Homo sapiens
tattgtgacaaacag

SEQ ID NO: 38179 - DNA, 15 bp, Homo sapiens
ttattgtgacaaaca

SEQ ID NO: 38180 - DNA, 15 bp, Homo sapiens
tttattgtgacaaac

SEQ ID NO: 38181 - DNA, 15 bp, Homo sapiens
atttattgtgacaaa

SEQ ID NO: 38182 - DNA, 15 bp, Homo sapiens
catttattgtgacaa

SEQ ID NO: 38183 - DNA, 15 bp, Homo sapiens
ccatttattgtgaca

SEQ ID NO: 38184 - DNA, 15 bp, Homo sapiens
tccatttattgtgac

SEQ ID NO: 38185 - DNA, 15 bp, Homo sapiens
ctccatttattgtga

SEQ ID NO: 38186 - DNA, 15 bp, Homo sapiens
actccatttattgtg

SEQ ID NO: 38187 - DNA, 15 bp, Homo sapiens
cactccatttattgt

SEQ ID NO: 38188 - DNA, 15 bp, Homo sapiens
tcactccatttattg

SEQ ID NO: 38189 - DNA, 15 bp, Homo sapiens
gtcactccatttatt

SEQ ID NO: 38190 - DNA, 15 bp, Homo sapiens
ggtcactccatttat

SEQ ID NO: 38191 - DNA, 15 bp, Homo sapiens
tggtcactccattta

SEQ ID NO: 38192 - DNA, 15 bp, Homo sapiens
ttggtcactccattt

SEQ ID NO: 38193 - DNA, 15 bp, Homo sapiens
tttggtcactccatt

SEQ ID NO: 38194 - DNA, 15 bp, Homo sapiens
ctttggtcactccat

SEQ ID NO: 38195 - DNA, 15 bp, Homo sapiens
gctttggtcactcca

SEQ ID NO: 38196 - DNA, 15 bp, Homo sapiens
agctttggtcactcc

SEQ ID NO: 38197 - DNA, 15 bp, Homo sapiens
tagctttggtcactc

SEQ ID NO: 38198 - DNA, 15 bp, Homo sapiens
atagctttggtcact

SEQ ID NO: 38199 - DNA, 15 bp, Homo sapiens
tatagctttggtcac

SEQ ID NO: 38200 - DNA, 15 bp, Homo sapiens
ctatagctttggtca

SEQ ID NO: 38201 - DNA, 15 bp, Homo sapiens
actatagctttggtc

SEQ ID NO: 38202 - DNA, 15 bp, Homo sapiens
tactatagctttggt

SEQ ID NO: 38203 - DNA, 15 bp, Homo sapiens
atactatagctttgg

SEQ ID NO: 38204 - DNA, 15 bp, Homo sapiens
aatactatagctttg

SEQ ID NO: 38205 - DNA, 15 bp, Homo sapiens
aaatactatagcttt

SEQ ID NO: 38206 - DNA, 15 bp, Homo sapiens
gaaatactatagctt

SEQ ID NO: 38207 - DNA, 15 bp, Homo sapiens
tgaaatactatagct

SEQ ID NO: 38208 - DNA, 15 bp, Homo sapiens
ttgaaatactatagc

SEQ ID NO: 38209 - DNA, 15 bp, Homo sapiens
tttgaaatactatag

SEQ ID NO: 38210 - DNA, 15 bp, Homo sapiens
atttgaaatactata

SEQ ID NO: 38211 - DNA, 15 bp, Homo sapiens
gatttgaaatactat

SEQ ID NO: 38212 - DNA, 15 bp, Homo sapiens
agatttgaaatacta

SEQ ID NO: 38213 - DNA, 15 bp, Homo sapiens
cagatttgaaatact

SEQ ID NO: 38214 - DNA, 15 bp, Homo sapiens
acagatttgaaatac

SEQ ID NO: 38215 - DNA, 15 bp, Homo sapiens
cacagatttgaaata

SEQ ID NO: 38216 - DNA, 15 bp, Homo sapiens
tcacagatttgaaat

SEQ ID NO: 38217 - DNA, 15 bp, Homo sapiens
gtcacagatttgaaa

SEQ ID NO: 38218 - DNA, 15 bp, Homo sapiens
agtcacagatttgaa

SEQ ID NO: 38219 - DNA, 15 bp, Homo sapiens
tagtcacagatttga

SEQ ID NO: 38220 - DNA, 15 bp, Homo sapiens
atagtcacagatttg

SEQ ID NO: 38221 - DNA, 15 bp, Homo sapiens
aatagtcacagattt

SEQ ID NO: 38222 - DNA, 15 bp, Homo sapiens
taatagtcacagatt

SEQ ID NO: 38223 - DNA, 15 bp, Homo sapiens
ataatagtcacagat

SEQ ID NO: 38224 - DNA, 15 bp, Homo sapiens
tataatagtcacaga

SEQ ID NO: 38225 - DNA, 15 bp, Homo sapiens
atataatagtcacag

SEQ ID NO: 38226 - DNA, 15 bp, Homo sapiens
tatataatagtcaca

SEQ ID NO: 38227 - DNA, 15 bp, Homo sapiens
atatataatagtcac

SEQ ID NO: 38228 - DNA, 15 bp, Homo sapiens
aatatataatagtca

SEQ ID NO: 38229 - DNA, 15 bp, Homo sapiens
aaatatataatagtc

SEQ ID NO: 38230 - DNA, 15 bp, Homo sapiens
aaaatatataatagt

SEQ ID NO: 38231 - DNA, 15 bp, Homo sapiens
aaaaatatataatag

SEQ ID NO: 38232 - DNA, 15 bp, Homo sapiens
gaaaaatatataata

SEQ ID NO: 38233 - DNA, 15 bp, Homo sapiens
agaaaaatatataat

SEQ ID NO: 38234 - DNA, 15 bp, Homo sapiens
tagaaaaatatataa

SEQ ID NO: 38235 - DNA, 15 bp, Homo sapiens
atagaaaaatatata

SEQ ID NO: 38236 - DNA, 15 bp, Homo sapiens
tatagaaaaatatat

SEQ ID NO: 38237 - DNA, 15 bp, Homo sapiens
gtatagaaaaatata

SEQ ID NO: 38238 - DNA, 15 bp, Homo sapiens
ggtatagaaaaatat

SEQ ID NO: 38239 - DNA, 15 bp, Homo sapiens
tggtatagaaaaata

SEQ ID NO: 38240 - DNA, 15 bp, Homo sapiens
ttggtatagaaaaat

SEQ ID NO: 38241 - DNA, 15 bp, Homo sapiens
cttggtatagaaaaa

SEQ ID NO: 38242 - DNA, 15 bp, Homo sapiens
acttggtatagaaaa

SEQ ID NO: 38243 - DNA, 15 bp, Homo sapiens
gacttggtatagaaa

SEQ ID NO: 38244 - DNA, 15 bp, Homo sapiens
tgacttggtatagaa

SEQ ID NO: 38245 - DNA, 15 bp, Homo sapiens
gtgacttggtataga

SEQ ID NO: 38246 - DNA, 15 bp, Homo sapiens
agtgacttggtatag

SEQ ID NO: 38247 - DNA, 15 bp, Homo sapiens
aagtgacttggtata

SEQ ID NO: 38248 - DNA, 15 bp, Homo sapiens
gaagtgacttggtat

SEQ ID NO: 38249 - DNA, 15 bp, Homo sapiens
agaagtgacttggta

SEQ ID NO: 38250 - DNA, 15 bp, Homo sapiens
aagaagtgacttggt

SEQ ID NO: 38251 - DNA, 15 bp, Homo sapiens
aaagaagtgacttgg

SEQ ID NO: 38252 - DNA, 15 bp, Homo sapiens
aaaagaagtgacttg

SEQ ID NO: 38253 - DNA, 15 bp, Homo sapiens
aaaaagaagtgactt

SEQ ID NO: 38254 - DNA, 15 bp, Homo sapiens
aaaaaagaagtgact

SEQ ID NO: 38255 - DNA, 15 bp, Homo sapiens
aaaaaaagaagtgac

SEQ ID NO: 38256 - DNA, 15 bp, Homo sapiens
caaaaaaagaagtga

SEQ ID NO: 38257 - DNA, 15 bp, Homo sapiens
acaaaaaaagaagtg

SEQ ID NO: 38258 - DNA, 15 bp, Homo sapiens
aacaaaaaaagaagt

SEQ ID NO: 38259 - DNA, 15 bp, Homo sapiens
aaacaaaaaaagaag

SEQ ID NO: 38260 - DNA, 15 bp, Homo sapiens
caaacaaaaaaagaa

SEQ ID NO: 38261 - DNA, 15 bp, Homo sapiens
acaaacaaaaaaaga

SEQ ID NO: 38262 - DNA, 15 bp, Homo sapiens
aacaaacaaaaaaag

SEQ ID NO: 38263 - DNA, 15 bp, Homo sapiens
aaacaaacaaaaaaa

SEQ ID NO: 38264 - DNA, 15 bp, Homo sapiens
caaacaaacaaaaaa

SEQ ID NO: 38265 - DNA, 15 bp, Homo sapiens
acaaacaaacaaaaa

SEQ ID NO: 38266 - DNA, 15 bp, Homo sapiens
aacaaacaaacaaaa

SEQ ID NO: 38267 - DNA, 15 bp, Homo sapiens
aaacaaacaaacaaa

SEQ ID NO: 38268 - DNA, 15 bp, Homo sapiens
aaaacaaacaaacaa

SEQ ID NO: 38269 - DNA, 15 bp, Homo sapiens
aaaaacaaacaaaca

SEQ ID NO: 38270 - DNA, 15 bp, Homo sapiens
caaaaacaaacaaac

SEQ ID NO: 38271 - DNA, 15 bp, Homo sapiens
ccaaaaacaaacaaa

SEQ ID NO: 38272 - DNA, 15 bp, Homo sapiens
cccaaaaacaaacaa

SEQ ID NO: 38273 - DNA, 15 bp, Homo sapiens
tcccaaaaacaaaca

SEQ ID NO: 38274 - DNA, 15 bp, Homo sapiens
gtcccaaaaacaaac

SEQ ID NO: 38275 - DNA, 15 bp, Homo sapiens
tgtcccaaaaacaaa

SEQ ID NO: 38276 - DNA, 15 bp, Homo sapiens
ctgtcccaaaaacaa

SEQ ID NO: 38277 - DNA, 15 bp, Homo sapiens
tctgtcccaaaaaca

SEQ ID NO: 38278 - DNA, 15 bp, Homo sapiens
ctctgtcccaaaaac

SEQ ID NO: 38279 - DNA, 15 bp, Homo sapiens
actctgtcccaaaaa

SEQ ID NO: 38280 - DNA, 15 bp, Homo sapiens
gactctgtcccaaaa

SEQ ID NO: 38281 - DNA, 15 bp, Homo sapiens
agactctgtcccaaa

SEQ ID NO: 38282 - DNA, 15 bp, Homo sapiens
aagactctgtcccaa

SEQ ID NO: 38283 - DNA, 15 bp, Homo sapiens
caagactctgtccca

SEQ ID NO: 38284 - DNA, 15 bp, Homo sapiens
gagcaagactctgtc

SEQ ID NO: 38285 - DNA, 15 bp, Homo sapiens
agagcaagactctgt

SEQ ID NO: 38286 - DNA, 15 bp, Homo sapiens
cagagcaagactctg

SEQ ID NO: 38287 - DNA, 15 bp, Homo sapiens
acagagcaagactct

SEQ ID NO: 38288 - DNA, 15 bp, Homo sapiens
tgagatcacaccatt

SEQ ID NO: 38289 - DNA, 15 bp, Homo sapiens
ctgagatcacaccat

SEQ ID NO: 38290 - DNA, 15 bp, Homo sapiens
agctgagatcacacc

SEQ ID NO: 38291 - DNA, 15 bp, Homo sapiens
gagctgagatcacac

SEQ ID NO: 38292 - DNA, 15 bp, Homo sapiens
tgagctgagatcaca

SEQ ID NO: 38293 - DNA, 15 bp, Homo sapiens
aaggtagaggttgca

SEQ ID NO: 38294 - DNA, 15 bp, Homo sapiens
gaaggtagaggttgc

SEQ ID NO: 38295 - DNA, 15 bp, Homo sapiens
agaaggtagaggttg

SEQ ID NO: 38296 - DNA, 15 bp, Homo sapiens
cagaaggtagaggtt

SEQ ID NO: 38297 - DNA, 15 bp, Homo sapiens
ccagaaggtagaggt

SEQ ID NO: 38298 - DNA, 15 bp, Homo sapiens
cccagaaggtagagg

SEQ ID NO: 38299 - DNA, 15 bp, Homo sapiens
acccagaaggtagag

SEQ ID NO: 38300 - DNA, 15 bp, Homo sapiens
aacccagaaggtaga

SEQ ID NO: 38301 - DNA, 15 bp, Homo sapiens
gaacccagaaggtag

SEQ ID NO: 38302 - DNA, 15 bp, Homo sapiens
tgaacccagaaggta

SEQ ID NO: 38303 - DNA, 15 bp, Homo sapiens
cgagaatcacttgaa

SEQ ID NO: 38304 - DNA, 15 bp, Homo sapiens
acgagaatcacttga

SEQ ID NO: 38305 - DNA, 15 bp, Homo sapiens
cacgagaatcacttg

SEQ ID NO: 38306 - DNA, 15 bp, Homo sapiens
gcacgagaatcactt

SEQ ID NO: 38307 - DNA, 15 bp, Homo sapiens
ggcacgagaatcact

SEQ ID NO: 38308 - DNA, 15 bp, Homo sapiens
aggcacgagaatcac

SEQ ID NO: 38309 - DNA, 15 bp, Homo sapiens
gaggcacgagaatca

SEQ ID NO: 38310 - DNA, 15 bp, Homo sapiens
gggaggctgaggcac

SEQ ID NO: 38311 - DNA, 15 bp, Homo sapiens
ggggaggctgaggca

SEQ ID NO: 38312 - DNA, 15 bp, Homo sapiens
tggggaggctgaggc

SEQ ID NO: 38313 - DNA, 15 bp, Homo sapiens
ctggggaggctgagg

SEQ ID NO: 38314 - DNA, 15 bp, Homo sapiens
actggggaggctgag

SEQ ID NO: 38315 - DNA, 15 bp, Homo sapiens
tactggggaggctga

SEQ ID NO: 38316 - DNA, 15 bp, Homo sapiens
ctactggggaggctg

SEQ ID NO: 38317 - DNA, 15 bp, Homo sapiens
tcagctactggggag

SEQ ID NO: 38318 - DNA, 15 bp, Homo sapiens
ctcagctactgggga

SEQ ID NO: 38319 - DNA, 15 bp, Homo sapiens
tctcagctactgggg

SEQ ID NO: 38320 - DNA, 15 bp, Homo sapiens
atctcagctactggg

SEQ ID NO: 38321 - DNA, 15 bp, Homo sapiens
aatctcagctactgg

SEQ ID NO: 38322 - DNA, 15 bp, Homo sapiens
taatctcagctactg

SEQ ID NO: 38323 - DNA, 15 bp, Homo sapiens
ttgtaatctcagcta

SEQ ID NO: 38324 - DNA, 15 bp, Homo sapiens
cttgtaatctcagct

SEQ ID NO: 38325 - DNA, 15 bp, Homo sapiens
gcttgtaatctcagc

SEQ ID NO: 38326 - DNA, 15 bp, Homo sapiens
cgcttgtaatctcag

SEQ ID NO: 38327 - DNA, 15 bp, Homo sapiens
acgcttgtaatctca

SEQ ID NO: 38328 - DNA, 15 bp, Homo sapiens
cacgcttgtaatctc

SEQ ID NO: 38329 - DNA, 15 bp, Homo sapiens
gcacgcttgtaatct

SEQ ID NO: 38330 - DNA, 15 bp, Homo sapiens
tgcacgcttgtaatc

SEQ ID NO: 38331 - DNA, 15 bp, Homo sapiens
gtgcacgcttgtaat

SEQ ID NO: 38332 - DNA, 15 bp, Homo sapiens
ggtgcacgcttgtaa

SEQ ID NO: 38333 - DNA, 15 bp, Homo sapiens
tggtgcacgcttgta

SEQ ID NO: 38334 - DNA, 15 bp, Homo sapiens
gtggtgcacgcttgt

SEQ ID NO: 38335 - DNA, 15 bp, Homo sapiens
ggtggtgcacgcttg

SEQ ID NO: 38336 - DNA, 15 bp, Homo sapiens
tggtggtgcacgctt

SEQ ID NO: 38337 - DNA, 15 bp, Homo sapiens
gtggtggtgcacgct

SEQ ID NO: 38338 - DNA, 15 bp, Homo sapiens
tgtggtggtgcacgc

SEQ ID NO: 38339 - DNA, 15 bp, Homo sapiens
gtgtggtggtgcacg

SEQ ID NO: 38340 - DNA, 15 bp, Homo sapiens
ggtgtggtggtgcac

SEQ ID NO: 38341 - DNA, 15 bp, Homo sapiens
aggtgtggtggtgca

SEQ ID NO: 38342 - DNA, 15 bp, Homo sapiens
gaaatacaaaaatta

SEQ ID NO: 38343 - DNA, 15 bp, Homo sapiens
tgaaatacaaaaatt

SEQ ID NO: 38344 - DNA, 15 bp, Homo sapiens
ttgaaatacaaaaat

SEQ ID NO: 38345 - DNA, 15 bp, Homo sapiens
attgaaatacaaaaa

SEQ ID NO: 38346 - DNA, 15 bp, Homo sapiens
tattgaaatacaaaa

SEQ ID NO: 38347 - DNA, 15 bp, Homo sapiens
ctattgaaatacaaa

SEQ ID NO: 38348 - DNA, 15 bp, Homo sapiens
tctattgaaatacaa

SEQ ID NO: 38349 - DNA, 15 bp, Homo sapiens
ctctattgaaataca

SEQ ID NO: 38350 - DNA, 15 bp, Homo sapiens
tctctattgaaatac

SEQ ID NO: 38351 - DNA, 15 bp, Homo sapiens
ttctctattgaaata

SEQ ID NO: 38352 - DNA, 15 bp, Homo sapiens
tttctctattgaaat

SEQ ID NO: 38353 - DNA, 15 bp, Homo sapiens
ctttctctattgaaa

SEQ ID NO: 38354 - DNA, 15 bp, Homo sapiens
cctttctctattgaa

SEQ ID NO: 38355 - DNA, 15 bp, Homo sapiens
ccctttctctattga

SEQ ID NO: 38356 - DNA, 15 bp, Homo sapiens
accctttctctattg

SEQ ID NO: 38357 - DNA, 15 bp, Homo sapiens
aaccctttctctatt

SEQ ID NO: 38358 - DNA, 15 bp, Homo sapiens
aaaccctttctctat

SEQ ID NO: 38359 - DNA, 15 bp, Homo sapiens
gaaaccctttctcta

SEQ ID NO: 38360 - DNA, 15 bp, Homo sapiens
tgaaaccctttctct

SEQ ID NO: 38361 - DNA, 15 bp, Homo sapiens
atgaaaccctttctc

SEQ ID NO: 38362 - DNA, 15 bp, Homo sapiens
gatgaaaccctttct

SEQ ID NO: 38363 - DNA, 15 bp, Homo sapiens
tgatgaaaccctttc

SEQ ID NO: 38364 - DNA, 15 bp, Homo sapiens
atgatgaaacccttt

SEQ ID NO: 38365 - DNA, 15 bp, Homo sapiens
catgatgaaaccctt

SEQ ID NO: 38366 - DNA, 15 bp, Homo sapiens
acatgatgaaaccct

SEQ ID NO: 38367 - DNA, 15 bp, Homo sapiens
gtcaagaccagcctg

SEQ ID NO: 38368 - DNA, 15 bp, Homo sapiens
ggtcaagaccagcct

SEQ ID NO: 38369 - DNA, 15 bp, Homo sapiens
aggtcaagaccagcc

SEQ ID NO: 38370 - DNA, 15 bp, Homo sapiens
gaggtcaagaccagc

SEQ ID NO: 38371 - DNA, 15 bp, Homo sapiens
ggaggtcaagaccag

SEQ ID NO: 38372 - DNA, 15 bp, Homo sapiens
aggaggtcaagacca

SEQ ID NO: 38373 - DNA, 15 bp, Homo sapiens
caggaggtcaagacc

SEQ ID NO: 38374 - DNA, 15 bp, Homo sapiens
ccaggaggtcaagac

SEQ ID NO: 38375 - DNA, 15 bp, Homo sapiens
gccaggaggtcaaga

SEQ ID NO: 38376 - DNA, 15 bp, Homo sapiens
ggccaggaggtcaag

SEQ ID NO: 38377 - DNA, 15 bp, Homo sapiens
aggccaggaggtcaa

SEQ ID NO: 38378 - DNA, 15 bp, Homo sapiens
gaggccaggaggtca

SEQ ID NO: 38379 - DNA, 15 bp, Homo sapiens
tgaggccaggaggtc

SEQ ID NO: 38380 - DNA, 15 bp, Homo sapiens
ttgaggccaggaggt

SEQ ID NO: 38381 - DNA, 15 bp, Homo sapiens
cttgaggccaggagg

SEQ ID NO: 38382 - DNA, 15 bp, Homo sapiens
acttgaggccaggag

SEQ ID NO: 38383 - DNA, 15 bp, Homo sapiens
agatcacttgaggcc

SEQ ID NO: 38384 - DNA, 15 bp, Homo sapiens
tagatcacttgaggc

SEQ ID NO: 38385 - DNA, 15 bp, Homo sapiens
aggtagatcacttga

SEQ ID NO: 38386 - DNA, 15 bp, Homo sapiens
caggtagatcacttg

SEQ ID NO: 38387 - DNA, 15 bp, Homo sapiens
gcaggtagatcactt

SEQ ID NO: 38388 - DNA, 15 bp, Homo sapiens
ggcaggtagatcact

SEQ ID NO: 38389 - DNA, 15 bp, Homo sapiens
aggcaggtagatcac

SEQ ID NO: 38390 - DNA, 15 bp, Homo sapiens
gaggcaggtagatca

SEQ ID NO: 38391 - DNA, 15 bp, Homo sapiens
tgaggcaggtagatc

SEQ ID NO: 38392 - DNA, 15 bp, Homo sapiens
ctgaggcaggtagat

SEQ ID NO: 38393 - DNA, 15 bp, Homo sapiens
gctgaggcaggtaga

SEQ ID NO: 38394 - DNA, 15 bp, Homo sapiens
ggctgaggcaggtag

SEQ ID NO: 38395 - DNA, 15 bp, Homo sapiens
aggctgaggcaggta

SEQ ID NO: 38396 - DNA, 15 bp, Homo sapiens
cgtggctcacacctg

SEQ ID NO: 38397 - DNA, 15 bp, Homo sapiens
ccgtggctcacacct

SEQ ID NO: 38398 - DNA, 15 bp, Homo sapiens
accgtggctcacacc

SEQ ID NO: 38399 - DNA, 15 bp, Homo sapiens
caccgtggctcacac

SEQ ID NO: 38400 - DNA, 15 bp, Homo sapiens
gcaccgtggctcaca

SEQ ID NO: 38401 - DNA, 15 bp, Homo sapiens
ggcaccgtggctcac

SEQ ID NO: 38402 - DNA, 15 bp, Homo sapiens
gggcaccgtggctca

SEQ ID NO: 38403 - DNA, 15 bp, Homo sapiens
cgggcaccgtggctc

SEQ ID NO: 38404 - DNA, 15 bp, Homo sapiens
ccgggcaccgtggct

SEQ ID NO: 38405 - DNA, 15 bp, Homo sapiens
gccgggcaccgtggc

SEQ ID NO: 38406 - DNA, 15 bp, Homo sapiens
ggccgggcaccgtgg

SEQ ID NO: 38407 - DNA, 15 bp, Homo sapiens
aggccgggcaccgtg

SEQ ID NO: 38408 - DNA, 15 bp, Homo sapiens
caggccgggcaccgt

SEQ ID NO: 38409 - DNA, 15 bp, Homo sapiens
acaggccgggcaccg

SEQ ID NO: 38410 - DNA, 15 bp, Homo sapiens
tacaggccgggcacc

SEQ ID NO: 38411 - DNA, 15 bp, Homo sapiens
gtacaggccgggcac

SEQ ID NO: 38412 - DNA, 15 bp, Homo sapiens
ggtacaggccgggca

SEQ ID NO: 38413 - DNA, 15 bp, Homo sapiens
tggtacaggccgggc

SEQ ID NO: 38414 - DNA, 15 bp, Homo sapiens
ttggtacaggccggg

SEQ ID NO: 38415 - DNA, 15 bp, Homo sapiens
cttggtacaggccgg

SEQ ID NO: 38416 - DNA, 15 bp, Homo sapiens
acttggtacaggccg

SEQ ID NO: 38417 - DNA, 15 bp, Homo sapiens
tacttggtacaggcc

SEQ ID NO: 38418 - DNA, 15 bp, Homo sapiens
ttacttggtacaggc

SEQ ID NO: 38419 - DNA, 15 bp, Homo sapiens
gttacttggtacagg

SEQ ID NO: 38420 - DNA, 15 bp, Homo sapiens
tgttacttggtacag

SEQ ID NO: 38421 - DNA, 15 bp, Homo sapiens
atgttacttggtaca

SEQ ID NO: 38422 - DNA, 15 bp, Homo sapiens
aatgttacttggtac

SEQ ID NO: 38423 - DNA, 15 bp, Homo sapiens
aaatgttacttggta

SEQ ID NO: 38424 - DNA, 15 bp, Homo sapiens
gaaatgttacttggt

SEQ ID NO: 38425 - DNA, 15 bp, Homo sapiens
agaaatgttacttgg

SEQ ID NO: 38426 - DNA, 15 bp, Homo sapiens
aagaaatgttacttg

SEQ ID NO: 38427 - DNA, 15 bp, Homo sapiens
aaagaaatgttactt

SEQ ID NO: 38428 - DNA, 15 bp, Homo sapiens
gaaagaaatgttact

SEQ ID NO: 38429 - DNA, 15 bp, Homo sapiens
agaaagaaatgttac

SEQ ID NO: 38430 - DNA, 15 bp, Homo sapiens
cagaaagaaatgtta

SEQ ID NO: 38431 - DNA, 15 bp, Homo sapiens
acagaaagaaatgtt

SEQ ID NO: 38432 - DNA, 15 bp, Homo sapiens
cacagaaagaaatgt

SEQ ID NO: 38433 - DNA, 15 bp, Homo sapiens
acacagaaagaaatg

SEQ ID NO: 38434 - DNA, 15 bp, Homo sapiens
cacacagaaagaaat

SEQ ID NO: 38435 - DNA, 15 bp, Homo sapiens
gcacacagaaagaaa

SEQ ID NO: 38436 - DNA, 15 bp, Homo sapiens
tgcacacagaaagaa

SEQ ID NO: 38437 - DNA, 15 bp, Homo sapiens
ctgcacacagaaaga

SEQ ID NO: 38438 - DNA, 15 bp, Homo sapiens
cctgcacacagaaag

SEQ ID NO: 38439 - DNA, 15 bp, Homo sapiens
tcctgcacacagaaa

SEQ ID NO: 38440 - DNA, 15 bp, Homo sapiens
ttcctgcacacagaa

SEQ ID NO: 38441 - DNA, 15 bp, Homo sapiens
attcctgcacacaga

SEQ ID NO: 38442 - DNA, 15 bp, Homo sapiens
tattcctgcacacag

SEQ ID NO: 38443 - DNA, 15 bp, Homo sapiens
atattcctgcacaca

SEQ ID NO: 38444 - DNA, 15 bp, Homo sapiens
tatattcctgcacac

SEQ ID NO: 38445 - DNA, 15 bp, Homo sapiens
gtatattcctgcaca

SEQ ID NO: 38446 - DNA, 15 bp, Homo sapiens
tgtatattcctgcac

SEQ ID NO: 38447 - DNA, 15 bp, Homo sapiens
atgtatattcctgca

SEQ ID NO: 38448 - DNA, 15 bp, Homo sapiens
catgtatattcctgc

SEQ ID NO: 38449 - DNA, 15 bp, Homo sapiens
acatgtatattcctg

SEQ ID NO: 38450 - DNA, 15 bp, Homo sapiens
cacatgtatattcct

SEQ ID NO: 38451 - DNA, 15 bp, Homo sapiens
gcacatgtatattcc

SEQ ID NO: 38452 - DNA, 15 bp, Homo sapiens
agcacatgtatattc

SEQ ID NO: 38453 - DNA, 15 bp, Homo sapiens
aagcacatgtatatt

SEQ ID NO: 38454 - DNA, 15 bp, Homo sapiens
caagcacatgtatat

SEQ ID NO: 38455 - DNA, 15 bp, Homo sapiens
acaagcacatgtata

SEQ ID NO: 38456 - DNA, 15 bp, Homo sapiens
aacaagcacatgtat

SEQ ID NO: 38457 - DNA, 15 bp, Homo sapiens
taacaagcacatgta

SEQ ID NO: 38458 - DNA, 15 bp, Homo sapiens
gtaacaagcacatgt

SEQ ID NO: 38459 - DNA, 15 bp, Homo sapiens
tgtaacaagcacatg

SEQ ID NO: 38460 - DNA, 15 bp, Homo sapiens
ctgtaacaagcacat

SEQ ID NO: 38461 - DNA, 15 bp, Homo sapiens
tctgtaacaagcaca

SEQ ID NO: 38462 - DNA, 15 bp, Homo sapiens
ctctgtaacaagcac

SEQ ID NO: 38463 - DNA, 15 bp, Homo sapiens
actctgtaacaagca

SEQ ID NO: 38464 - DNA, 15 bp, Homo sapiens
aactctgtaacaagc

SEQ ID NO: 38465 - DNA, 15 bp, Homo sapiens
caactctgtaacaag

SEQ ID NO: 38466 - DNA, 15 bp, Homo sapiens
tcaactctgtaacaa

SEQ ID NO: 38467 - DNA, 15 bp, Homo sapiens
ctcaactctgtaaca

SEQ ID NO: 38468 - DNA, 15 bp, Homo sapiens
actcaactctgtaac

SEQ ID NO: 38469 - DNA, 15 bp, Homo sapiens
aactcaactctgtaa

SEQ ID NO: 38470 - DNA, 15 bp, Homo sapiens
aaactcaactctgta

SEQ ID NO: 38471 - DNA, 15 bp, Homo sapiens
taaactcaactctgt

SEQ ID NO: 38472 - DNA, 15 bp, Homo sapiens
ataaactcaactctg

SEQ ID NO: 38473 - DNA, 15 bp, Homo sapiens
gataaactcaactct

SEQ ID NO: 38474 - DNA, 15 bp, Homo sapiens
tgataaactcaactc

SEQ ID NO: 38475 - DNA, 15 bp, Homo sapiens
atgataaactcaact

SEQ ID NO: 38476 - DNA, 15 bp, Homo sapiens
tatgataaactcaac

SEQ ID NO: 38477 - DNA, 15 bp, Homo sapiens
atatgataaactcaa

SEQ ID NO: 38478 - DNA, 15 bp, Homo sapiens
aatatgataaactca

SEQ ID NO: 38479 - DNA, 15 bp, Homo sapiens
gaatatgataaactc

SEQ ID NO: 38480 - DNA, 15 bp, Homo sapiens
agaatatgataaact

SEQ ID NO: 38481 - DNA, 15 bp, Homo sapiens
tagaatatgataaac

SEQ ID NO: 38482 - DNA, 15 bp, Homo sapiens
atagaatatgataaa

SEQ ID NO: 38483 - DNA, 15 bp, Homo sapiens
gatagaatatgataa

SEQ ID NO: 38484 - DNA, 15 bp, Homo sapiens
tgatagaatatgata

SEQ ID NO: 38485 - DNA, 15 bp, Homo sapiens
gtgatagaatatgat

SEQ ID NO: 38486 - DNA, 15 bp, Homo sapiens
ggtgatagaatatga

SEQ ID NO: 38487 - DNA, 15 bp, Homo sapiens
tggtgatagaatatg

SEQ ID NO: 38488 - DNA, 15 bp, Homo sapiens
atggtgatagaatat

SEQ ID NO: 38489 - DNA, 15 bp, Homo sapiens
catggtgatagaata

SEQ ID NO: 38490 - DNA, 15 bp, Homo sapiens
acatggtgatagaat

SEQ ID NO: 38491 - DNA, 15 bp, Homo sapiens
tacatggtgatagaa

SEQ ID NO: 38492 - DNA, 15 bp, Homo sapiens
atacatggtgataga

SEQ ID NO: 38493 - DNA, 15 bp, Homo sapiens
aatacatggtgatag

SEQ ID NO: 38494 - DNA, 15 bp, Homo sapiens
aaatacatggtgata

SEQ ID NO: 38495 - DNA, 15 bp, Homo sapiens
gaaatacatggtgat

SEQ ID NO: 38496 - DNA, 15 bp, Homo sapiens
ggaaatacatggtga

SEQ ID NO: 38497 - DNA, 15 bp, Homo sapiens
gggaaatacatggtg

SEQ ID NO: 38498 - DNA, 15 bp, Homo sapiens
tgggaaatacatggt

SEQ ID NO: 38499 - DNA, 15 bp, Homo sapiens
atgggaaatacatgg

SEQ ID NO: 38500 - DNA, 15 bp, Homo sapiens
tatgggaaatacatg

SEQ ID NO: 38501 - DNA, 15 bp, Homo sapiens
ttatgggaaatacat

SEQ ID NO: 38502 - DNA, 15 bp, Homo sapiens
tttatgggaaataca

SEQ ID NO: 38503 - DNA, 15 bp, Homo sapiens
atttatgggaaatac

SEQ ID NO: 38504 - DNA, 15 bp, Homo sapiens
gatttatgggaaata

SEQ ID NO: 38505 - DNA, 15 bp, Homo sapiens
agatttatgggaaat

SEQ ID NO: 38506 - DNA, 15 bp, Homo sapiens
tagatttatgggaaa

SEQ ID NO: 38507 - DNA, 15 bp, Homo sapiens
atagatttatgggaa

SEQ ID NO: 38508 - DNA, 15 bp, Homo sapiens
aatagatttatggga

SEQ ID NO: 38509 - DNA, 15 bp, Homo sapiens
taatagatttatggg

SEQ ID NO: 38510 - DNA, 15 bp, Homo sapiens
ttaatagatttatgg

SEQ ID NO: 38511 - DNA, 15 bp, Homo sapiens
cttaatagatttatg

SEQ ID NO: 38512 - DNA, 15 bp, Homo sapiens
acttaatagatttat

SEQ ID NO: 38513 - DNA, 15 bp, Homo sapiens
aacttaatagattta

SEQ ID NO: 38514 - DNA, 15 bp, Homo sapiens
taacttaatagattt

SEQ ID NO: 38515 - DNA, 15 bp, Homo sapiens
ttaacttaatagatt

SEQ ID NO: 38516 - DNA, 15 bp, Homo sapiens
tttaacttaatagat

SEQ ID NO: 38517 - DNA, 15 bp, Homo sapiens
ttttaacttaataga

SEQ ID NO: 38518 - DNA, 15 bp, Homo sapiens
attttaacttaatag

SEQ ID NO: 38519 - DNA, 15 bp, Homo sapiens
gattttaacttaata

SEQ ID NO: 38520 - DNA, 15 bp, Homo sapiens
agattttaacttaat

SEQ ID NO: 38521 - DNA, 15 bp, Homo sapiens
cagattttaacttaa

SEQ ID NO: 38522 - DNA, 15 bp, Homo sapiens
acagattttaactta

SEQ ID NO: 38523 - DNA, 15 bp, Homo sapiens
cacagattttaactt

SEQ ID NO: 38524 - DNA, 15 bp, Homo sapiens
gcacagattttaact

SEQ ID NO: 38525 - DNA, 15 bp, Homo sapiens
ggcacagattttaac

SEQ ID NO: 38526 - DNA, 15 bp, Homo sapiens
tggcacagattttaa

SEQ ID NO: 38527 - DNA, 15 bp, Homo sapiens
gtggcacagatttta

SEQ ID NO: 38528 - DNA, 15 bp, Homo sapiens
agtggcacagatttt

SEQ ID NO: 38529 - DNA, 15 bp, Homo sapiens
aagtggcacagattt

SEQ ID NO: 38530 - DNA, 15 bp, Homo sapiens
taagtggcacagatt

SEQ ID NO: 38531 - DNA, 15 bp, Homo sapiens
ataagtggcacagat

SEQ ID NO: 38532 - DNA, 15 bp, Homo sapiens
gataagtggcacaga

SEQ ID NO: 38533 - DNA, 15 bp, Homo sapiens
tgataagtggcacag

SEQ ID NO: 38534 - DNA, 15 bp, Homo sapiens
ttgataagtggcaca

SEQ ID NO: 38535 - DNA, 15 bp, Homo sapiens
tttgataagtggcac

SEQ ID NO: 38536 - DNA, 15 bp, Homo sapiens
ctttgataagtggca

SEQ ID NO: 38537 - DNA, 15 bp, Homo sapiens
actttgataagtggc

SEQ ID NO: 38538 - DNA, 15 bp, Homo sapiens
aactttgataagtgg

SEQ ID NO: 38539 - DNA, 15 bp, Homo sapiens
aaactttgataagtg

SEQ ID NO: 38540 - DNA, 15 bp, Homo sapiens
caaactttgataagt

SEQ ID NO: 38541 - DNA, 15 bp, Homo sapiens
ccaaactttgataag

SEQ ID NO: 38542 - DNA, 15 bp, Homo sapiens
tccaaactttgataa

SEQ ID NO: 38543 - DNA, 15 bp, Homo sapiens
ctccaaactttgata

SEQ ID NO: 38544 - DNA, 15 bp, Homo sapiens
actccaaactttgat

SEQ ID NO: 38545 - DNA, 15 bp, Homo sapiens
cactccaaactttga

SEQ ID NO: 38546 - DNA, 15 bp, Homo sapiens
tcactccaaactttg

SEQ ID NO: 38547 - DNA, 15 bp, Homo sapiens
atcactccaaacttt

SEQ ID NO: 38548 - DNA, 15 bp, Homo sapiens
aatcactccaaactt

SEQ ID NO: 38549 - DNA, 15 bp, Homo sapiens
taatcactccaaact

SEQ ID NO: 38550 - DNA, 15 bp, Homo sapiens
gtaatcactccaaac

SEQ ID NO: 38551 - DNA, 15 bp, Homo sapiens
tgtaatcactccaaa

SEQ ID NO: 38552 - DNA, 15 bp, Homo sapiens
atgtaatcactccaa

SEQ ID NO: 38553 - DNA, 15 bp, Homo sapiens
tatgtaatcactcca

SEQ ID NO: 38554 - DNA, 15 bp, Homo sapiens
atatgtaatcactcc

SEQ ID NO: 38555 - DNA, 15 bp, Homo sapiens
tatatgtaatcactc

SEQ ID NO: 38556 - DNA, 15 bp, Homo sapiens
atatatgtaatcact

SEQ ID NO: 38557 - DNA, 15 bp, Homo sapiens
tatatatgtaatcac

SEQ ID NO: 38558 - DNA, 15 bp, Homo sapiens
atatatatgtaatca

SEQ ID NO: 38559 - DNA, 15 bp, Homo sapiens
tatatatatgtaatc

SEQ ID NO: 38560 - DNA, 15 bp, Homo sapiens
gtatatatatgtaat

SEQ ID NO: 38561 - DNA, 15 bp, Homo sapiens
tgtatatatatgtaa

SEQ ID NO: 38562 - DNA, 15 bp, Homo sapiens
atgtatatatatgta

SEQ ID NO: 38563 - DNA, 15 bp, Homo sapiens
tatgtatatatatgt

SEQ ID NO: 38564 - DNA, 15 bp, Homo sapiens
ttatgtatatatatg

SEQ ID NO: 38565 - DNA, 15 bp, Homo sapiens
gttatgtatatatat

SEQ ID NO: 38566 - DNA, 15 bp, Homo sapiens
ggttatgtatatata

SEQ ID NO: 38567 - DNA, 15 bp, Homo sapiens
gggttatgtatatat

SEQ ID NO: 38568 - DNA, 15 bp, Homo sapiens
agggttatgtatata

SEQ ID NO: 38569 - DNA, 15 bp, Homo sapiens
tagggttatgtatat

SEQ ID NO: 38570 - DNA, 15 bp, Homo sapiens
atagggttatgtata

SEQ ID NO: 38571 - DNA, 15 bp, Homo sapiens
tatagggttatgtat

SEQ ID NO: 38572 - DNA, 15 bp, Homo sapiens
atatagggttatgta

SEQ ID NO: 38573 - DNA, 15 bp, Homo sapiens
catatagggttatgt

SEQ ID NO: 38574 - DNA, 15 bp, Homo sapiens
tcatatagggttatg

SEQ ID NO: 38575 - DNA, 15 bp, Homo sapiens
atcatatagggttat

SEQ ID NO: 38576 - DNA, 15 bp, Homo sapiens
gatcatatagggtta

SEQ ID NO: 38577 - DNA, 15 bp, Homo sapiens
agatcatatagggtt

SEQ ID NO: 38578 - DNA, 15 bp, Homo sapiens
aagatcatatagggt

SEQ ID NO: 38579 - DNA, 15 bp, Homo sapiens
aaagatcatataggg

SEQ ID NO: 38580 - DNA, 15 bp, Homo sapiens
caaagatcatatagg

SEQ ID NO: 38581 - DNA, 15 bp, Homo sapiens
tcaaagatcatatag

SEQ ID NO: 38582 - DNA, 15 bp, Homo sapiens
ttcaaagatcatata

SEQ ID NO: 38583 - DNA, 15 bp, Homo sapiens
attcaaagatcatat

SEQ ID NO: 38584 - DNA, 15 bp, Homo sapiens
aattcaaagatcata

SEQ ID NO: 38585 - DNA, 15 bp, Homo sapiens
gaattcaaagatcat

SEQ ID NO: 38586 - DNA, 15 bp, Homo sapiens
tgaattcaaagatca

SEQ ID NO: 38587 - DNA, 15 bp, Homo sapiens
ctgaattcaaagatc

SEQ ID NO: 38588 - DNA, 15 bp, Homo sapiens
tctgaattcaaagat

SEQ ID NO: 38589 - DNA, 15 bp, Homo sapiens
ctctgaattcaaaga

SEQ ID NO: 38590 - DNA, 15 bp, Homo sapiens
gctctgaattcaaag

SEQ ID NO: 38591 - DNA, 15 bp, Homo sapiens
ggctctgaattcaaa

SEQ ID NO: 38592 - DNA, 15 bp, Homo sapiens
aggctctgaattcaa

SEQ ID NO: 38593 - DNA, 15 bp, Homo sapiens
aaggctctgaattca

SEQ ID NO: 38594 - DNA, 15 bp, Homo sapiens
caaggctctgaattc

SEQ ID NO: 38595 - DNA, 15 bp, Homo sapiens
tcaaggctctgaatt

SEQ ID NO: 38596 - DNA, 15 bp, Homo sapiens
atcaaggctctgaat

SEQ ID NO: 38597 - DNA, 15 bp, Homo sapiens
catcaaggctctgaa

SEQ ID NO: 38598 - DNA, 15 bp, Homo sapiens
gcatcaaggctctga

SEQ ID NO: 38599 - DNA, 15 bp, Homo sapiens
agcatcaaggctctg

SEQ ID NO: 38600 - DNA, 15 bp, Homo sapiens
tagcatcaaggctct

SEQ ID NO: 38601 - DNA, 15 bp, Homo sapiens
ctagcatcaaggctc

SEQ ID NO: 38602 - DNA, 15 bp, Homo sapiens
gctagcatcaaggct

SEQ ID NO: 38603 - DNA, 15 bp, Homo sapiens
ggctagcatcaaggc

SEQ ID NO: 38604 - DNA, 15 bp, Homo sapiens
aggctagcatcaagg

SEQ ID NO: 38605 - DNA, 15 bp, Homo sapiens
caggctagcatcaag

SEQ ID NO: 38606 - DNA, 15 bp, Homo sapiens
tcaggctagcatcaa

SEQ ID NO: 38607 - DNA, 15 bp, Homo sapiens
ctcaggctagcatca

SEQ ID NO: 38608 - DNA, 15 bp, Homo sapiens
tctcaggctagcatc

SEQ ID NO: 38609 - DNA, 15 bp, Homo sapiens
ctctcaggctagcat

SEQ ID NO: 38610 - DNA, 15 bp, Homo sapiens
actctcaggctagca

SEQ ID NO: 38611 - DNA, 15 bp, Homo sapiens
gactctcaggctagc

SEQ ID NO: 38612 - DNA, 15 bp, Homo sapiens
agactctcaggctag

SEQ ID NO: 38613 - DNA, 15 bp, Homo sapiens
cagactctcaggcta

SEQ ID NO: 38614 - DNA, 15 bp, Homo sapiens
acagactctcaggct

SEQ ID NO: 38615 - DNA, 15 bp, Homo sapiens
cacagactctcaggc

SEQ ID NO: 38616 - DNA, 15 bp, Homo sapiens
acacagactctcagg

SEQ ID NO: 38617 - DNA, 15 bp, Homo sapiens
cacacagactctcag

SEQ ID NO: 38618 - DNA, 15 bp, Homo sapiens
acacacagactctca

SEQ ID NO: 38619 - DNA, 15 bp, Homo sapiens
tacacacagactctc

SEQ ID NO: 38620 - DNA, 15 bp, Homo sapiens
atacacacagactct

SEQ ID NO: 38621 - DNA, 15 bp, Homo sapiens
catacacacagactc

SEQ ID NO: 38622 - DNA, 15 bp, Homo sapiens
tcatacacacagact

SEQ ID NO: 38623 - DNA, 15 bp, Homo sapiens
ttcatacacacagac

SEQ ID NO: 38624 - DNA, 15 bp, Homo sapiens
attcatacacacaga

SEQ ID NO: 38625 - DNA, 15 bp, Homo sapiens
cattcatacacacag

SEQ ID NO: 38626 - DNA, 15 bp, Homo sapiens
gcattcatacacaca

SEQ ID NO: 38627 - DNA, 15 bp, Homo sapiens
tgcattcatacacac

SEQ ID NO: 38628 - DNA, 15 bp, Homo sapiens
ctgcattcatacaca

SEQ ID NO: 38629 - DNA, 15 bp, Homo sapiens
cctgcattcatacac

SEQ ID NO: 38630 - DNA, 15 bp, Homo sapiens
acctgcattcataca

SEQ ID NO: 38631 - DNA, 15 bp, Homo sapiens
cacctgcattcatac

SEQ ID NO: 38632 - DNA, 15 bp, Homo sapiens
ccacctgcattcata

SEQ ID NO: 38633 - DNA, 15 bp, Homo sapiens
gccacctgcattcat

SEQ ID NO: 38634 - DNA, 15 bp, Homo sapiens
tgccacctgcattca

SEQ ID NO: 38635 - DNA, 15 bp, Homo sapiens
ttgccacctgcattc

SEQ ID NO: 38636 - DNA, 15 bp, Homo sapiens
cttgccacctgcatt

SEQ ID NO: 38637 - DNA, 15 bp, Homo sapiens
tcttgccacctgcat

SEQ ID NO: 38638 - DNA, 15 bp, Homo sapiens
ctcttgccacctgca

SEQ ID NO: 38639 - DNA, 15 bp, Homo sapiens
actcttgccacctgc

SEQ ID NO: 38640 - DNA, 15 bp, Homo sapiens
cactcttgccacctg

SEQ ID NO: 38641 - DNA, 15 bp, Homo sapiens
tcactcttgccacct

SEQ ID NO: 38642 - DNA, 15 bp, Homo sapiens
ctcactcttgccacc

SEQ ID NO: 38643 - DNA, 15 bp, Homo sapiens
cctcactcttgccac

SEQ ID NO: 38644 - DNA, 15 bp, Homo sapiens
gcctcactcttgcca

SEQ ID NO: 38645 - DNA, 15 bp, Homo sapiens
tgcctcactcttgcc

SEQ ID NO: 38646 - DNA, 15 bp, Homo sapiens
atgcctcactcttgc

SEQ ID NO: 38647 - DNA, 15 bp, Homo sapiens
catgcctcactcttg

SEQ ID NO: 38648 - DNA, 15 bp, Homo sapiens
ccatgcctcactctt

SEQ ID NO: 38649 - DNA, 15 bp, Homo sapiens
tccatgcctcactct

SEQ ID NO: 38650 - DNA, 15 bp, Homo sapiens
atccatgcctcactc

SEQ ID NO: 38651 - DNA, 15 bp, Homo sapiens
aatccatgcctcact

SEQ ID NO: 38652 - DNA, 15 bp, Homo sapiens
caatccatgcctcac

SEQ ID NO: 38653 - DNA, 15 bp, Homo sapiens
acaatccatgcctca

SEQ ID NO: 38654 - DNA, 15 bp, Homo sapiens
aacaatccatgcctc

SEQ ID NO: 38655 - DNA, 15 bp, Homo sapiens
caacaatccatgcct

SEQ ID NO: 38656 - DNA, 15 bp, Homo sapiens
gcaacaatccatgcc

SEQ ID NO: 38657 - DNA, 15 bp, Homo sapiens
agcaacaatccatgc

SEQ ID NO: 38658 - DNA, 15 bp, Homo sapiens
tagcaacaatccatg

SEQ ID NO: 38659 - DNA, 15 bp, Homo sapiens
atagcaacaatccat

SEQ ID NO: 38660 - DNA, 15 bp, Homo sapiens
aatagcaacaatcca

SEQ ID NO: 38661 - DNA, 15 bp, Homo sapiens
aaatagcaacaatcc

SEQ ID NO: 38662 - DNA, 15 bp, Homo sapiens
aaaatagcaacaatc

SEQ ID NO: 38663 - DNA, 15 bp, Homo sapiens
aaaaatagcaacaat

SEQ ID NO: 38664 - DNA, 15 bp, Homo sapiens
aaaaaatagcaacaa

SEQ ID NO: 38665 - DNA, 15 bp, Homo sapiens
gaaaaaatagcaaca

SEQ ID NO: 38666 - DNA, 15 bp, Homo sapiens
agaaaaaatagcaac

SEQ ID NO: 38667 - DNA, 15 bp, Homo sapiens
tagaaaaaatagcaa

SEQ ID NO: 38668 - DNA, 15 bp, Homo sapiens
gtagaaaaaatagca

SEQ ID NO: 38669 - DNA, 15 bp, Homo sapiens
ggtagaaaaaatagc

SEQ ID NO: 38670 - DNA, 15 bp, Homo sapiens
cggtagaaaaaatag

SEQ ID NO: 38671 - DNA, 15 bp, Homo sapiens
ccggtagaaaaaata

SEQ ID NO: 38672 - DNA, 15 bp, Homo sapiens
tccggtagaaaaaat

SEQ ID NO: 38673 - DNA, 15 bp, Homo sapiens
ctccggtagaaaaaa

SEQ ID NO: 38674 - DNA, 15 bp, Homo sapiens
actccggtagaaaaa

SEQ ID NO: 38675 - DNA, 15 bp, Homo sapiens
cactccggtagaaaa

SEQ ID NO: 38676 - DNA, 15 bp, Homo sapiens
gcactccggtagaaa

SEQ ID NO: 38677 - DNA, 15 bp, Homo sapiens
ggcactccggtagaa

SEQ ID NO: 38678 - DNA, 15 bp, Homo sapiens
tggcactccggtaga

SEQ ID NO: 38679 - DNA, 15 bp, Homo sapiens
atggcactccggtag

SEQ ID NO: 38680 - DNA, 15 bp, Homo sapiens
aatggcactccggta

SEQ ID NO: 38681 - DNA, 15 bp, Homo sapiens
taatggcactccggt

SEQ ID NO: 38682 - DNA, 15 bp, Homo sapiens
ataatggcactccgg

SEQ ID NO: 38683 - DNA, 15 bp, Homo sapiens
aataatggcactccg

SEQ ID NO: 38684 - DNA, 15 bp, Homo sapiens
taataatggcactcc

SEQ ID NO: 38685 - DNA, 15 bp, Homo sapiens
ttaataatggcactc

SEQ ID NO: 38686 - DNA, 15 bp, Homo sapiens
gttaataatggcact

SEQ ID NO: 38687 - DNA, 15 bp, Homo sapiens
tgttaataatggcac

SEQ ID NO: 38688 - DNA, 15 bp, Homo sapiens
ctgttaataatggca

SEQ ID NO: 38689 - DNA, 15 bp, Homo sapiens
actgttaataatggc

SEQ ID NO: 38690 - DNA, 15 bp, Homo sapiens
aactgttaataatgg

SEQ ID NO: 38691 - DNA, 15 bp, Homo sapiens
aaactgttaataatg

SEQ ID NO: 38692 - DNA, 15 bp, Homo sapiens
gaaactgttaataat

SEQ ID NO: 38693 - DNA, 15 bp, Homo sapiens
agaaactgttaataa

SEQ ID NO: 38694 - DNA, 15 bp, Homo sapiens
aagaaactgttaata

SEQ ID NO: 38695 - DNA, 15 bp, Homo sapiens
aaagaaactgttaat

SEQ ID NO: 38696 - DNA, 15 bp, Homo sapiens
aaaagaaactgttaa

SEQ ID NO: 38697 - DNA, 15 bp, Homo sapiens
gaaaagaaactgtta

SEQ ID NO: 38698 - DNA, 15 bp, Homo sapiens
agaaaagaaactgtt

SEQ ID NO: 38699 - DNA, 15 bp, Homo sapiens
cagaaaagaaactgt

SEQ ID NO: 38700 - DNA, 15 bp, Homo sapiens
acagaaaagaaactg

SEQ ID NO: 38701 - DNA, 15 bp, Homo sapiens
tacagaaaagaaact

SEQ ID NO: 38702 - DNA, 15 bp, Homo sapiens
atacagaaaagaaac

SEQ ID NO: 38703 - DNA, 15 bp, Homo sapiens
tatacagaaaagaaa

SEQ ID NO: 38704 - DNA, 15 bp, Homo sapiens
ctatacagaaaagaa

SEQ ID NO: 38705 - DNA, 15 bp, Homo sapiens
actatacagaaaaga

SEQ ID NO: 38706 - DNA, 15 bp, Homo sapiens
gactatacagaaaag

SEQ ID NO: 38707 - DNA, 15 bp, Homo sapiens
tgactatacagaaaa

SEQ ID NO: 38708 - DNA, 15 bp, Homo sapiens
gtgactatacagaaa

SEQ ID NO: 38709 - DNA, 15 bp, Homo sapiens
agtgactatacagaa

SEQ ID NO: 38710 - DNA, 15 bp, Homo sapiens
cagtgactatacaga

SEQ ID NO: 38711 - DNA, 15 bp, Homo sapiens
acagtgactatacag

SEQ ID NO: 38712 - DNA, 15 bp, Homo sapiens
cacagtgactataca

SEQ ID NO: 38713 - DNA, 15 bp, Homo sapiens
tcacagtgactatac

SEQ ID NO: 38714 - DNA, 15 bp, Homo sapiens
ttcacagtgactata

SEQ ID NO: 38715 - DNA, 15 bp, Homo sapiens
gttcacagtgactat

SEQ ID NO: 38716 - DNA, 15 bp, Homo sapiens
tgttcacagtgacta

SEQ ID NO: 38717 - DNA, 15 bp, Homo sapiens
gtgttcacagtgact

SEQ ID NO: 38718 - DNA, 15 bp, Homo sapiens
agtgttcacagtgac

SEQ ID NO: 38719 - DNA, 15 bp, Homo sapiens
cagtgttcacagtga

SEQ ID NO: 38720 - DNA, 15 bp, Homo sapiens
acagtgttcacagtg

SEQ ID NO: 38721 - DNA, 15 bp, Homo sapiens
aacagtgttcacagt

SEQ ID NO: 38722 - DNA, 15 bp, Homo sapiens
caacagtgttcacag

SEQ ID NO: 38723 - DNA, 15 bp, Homo sapiens
acaacagtgttcaca

SEQ ID NO: 38724 - DNA, 15 bp, Homo sapiens
cacaacagtgttcac

SEQ ID NO: 38725 - DNA, 15 bp, Homo sapiens
ccacaacagtgttca

SEQ ID NO: 38726 - DNA, 15 bp, Homo sapiens
cccacaacagtgttc

SEQ ID NO: 38727 - DNA, 15 bp, Homo sapiens
ccccacaacagtgtt

SEQ ID NO: 38728 - DNA, 15 bp, Homo sapiens
gccccacaacagtgt

SEQ ID NO: 38729 - DNA, 15 bp, Homo sapiens
agccccacaacagtg

SEQ ID NO: 38730 - DNA, 15 bp, Homo sapiens
cagccccacaacagt

SEQ ID NO: 38731 - DNA, 15 bp, Homo sapiens
gcagccccacaacag

SEQ ID NO: 38732 - DNA, 15 bp, Homo sapiens
agcagccccacaaca

SEQ ID NO: 38733 - DNA, 15 bp, Homo sapiens
gagcagccccacaac

SEQ ID NO: 38734 - DNA, 15 bp, Homo sapiens
ggagcagccccacaa

SEQ ID NO: 38735 - DNA, 15 bp, Homo sapiens
gggagcagccccaca

SEQ ID NO: 38736 - DNA, 15 bp, Homo sapiens
agggagcagccccac

SEQ ID NO: 38737 - DNA, 15 bp, Homo sapiens
cagggagcagcccca

SEQ ID NO: 38738 - DNA, 15 bp, Homo sapiens
acagggagcagcccc

SEQ ID NO: 38739 - DNA, 15 bp, Homo sapiens
cacagggagcagccc

SEQ ID NO: 38740 - DNA, 15 bp, Homo sapiens
acacagggagcagcc

SEQ ID NO: 38741 - DNA, 15 bp, Homo sapiens
cacacagggagcagc

SEQ ID NO: 38742 - DNA, 15 bp, Homo sapiens
acacacagggagcag

SEQ ID NO: 38743 - DNA, 15 bp, Homo sapiens
cacacacagggagca

SEQ ID NO: 38744 - DNA, 15 bp, Homo sapiens
ccacacacagggagc

SEQ ID NO: 38745 - DNA, 15 bp, Homo sapiens
gccacacacagggag

SEQ ID NO: 38746 - DNA, 15 bp, Homo sapiens
agccacacacaggga

SEQ ID NO: 38747 - DNA, 15 bp, Homo sapiens
gagccacacacaggg

SEQ ID NO: 38748 - DNA, 15 bp, Homo sapiens
agagccacacacagg

SEQ ID NO: 38749 - DNA, 15 bp, Homo sapiens
cagagccacacacag

SEQ ID NO: 38750 - DNA, 15 bp, Homo sapiens
gcagagccacacaca

SEQ ID NO: 38751 - DNA, 15 bp, Homo sapiens
ggcagagccacacac

SEQ ID NO: 38752 - DNA, 15 bp, Homo sapiens
aggcagagccacaca

SEQ ID NO: 38753 - DNA, 15 bp, Homo sapiens
gaggcagagccacac

SEQ ID NO: 38754 - DNA, 15 bp, Homo sapiens
tgaggcagagccaca

SEQ ID NO: 38755 - DNA, 15 bp, Homo sapiens
ctgaggcagagccac

SEQ ID NO: 38756 - DNA, 15 bp, Homo sapiens
tctgaggcagagcca

SEQ ID NO: 38757 - DNA, 15 bp, Homo sapiens
ttctgaggcagagcc

SEQ ID NO: 38758 - DNA, 15 bp, Homo sapiens
gttctgaggcagagc

SEQ ID NO: 38759 - DNA, 15 bp, Homo sapiens
ggttctgaggcagag

SEQ ID NO: 38760 - DNA, 15 bp, Homo sapiens
gggttctgaggcaga

SEQ ID NO: 38761 - DNA, 15 bp, Homo sapiens
tgggttctgaggcag

SEQ ID NO: 38762 - DNA, 15 bp, Homo sapiens
gtgggttctgaggca

SEQ ID NO: 38763 - DNA, 15 bp, Homo sapiens
tgtgggttctgaggc

SEQ ID NO: 38764 - DNA, 15 bp, Homo sapiens
ctgtgggttctgagg

SEQ ID NO: 38765 - DNA, 15 bp, Homo sapiens
tctgtgggttctgag

SEQ ID NO: 38766 - DNA, 15 bp, Homo sapiens
ctctgtgggttctga

SEQ ID NO: 38767 - DNA, 15 bp, Homo sapiens
actctgtgggttctg

SEQ ID NO: 38768 - DNA, 15 bp, Homo sapiens
gactctgtgggttct

SEQ ID NO: 38769 - DNA, 15 bp, Homo sapiens
cgactctgtgggttc

SEQ ID NO: 38770 - DNA, 15 bp, Homo sapiens
ccgactctgtgggtt

SEQ ID NO: 38771 - DNA, 15 bp, Homo sapiens
gccgactctgtgggt

SEQ ID NO: 38772 - DNA, 15 bp, Homo sapiens
agccgactctgtggg

SEQ ID NO: 38773 - DNA, 15 bp, Homo sapiens
cagccgactctgtgg

SEQ ID NO: 38774 - DNA, 15 bp, Homo sapiens
ccagccgactctgtg

SEQ ID NO: 38775 - DNA, 15 bp, Homo sapiens
gccagccgactctgt

SEQ ID NO: 38776 - DNA, 15 bp, Homo sapiens
agccagccgactctg

SEQ ID NO: 38777 - DNA, 15 bp, Homo sapiens
gagccagccgactct

SEQ ID NO: 38778 - DNA, 15 bp, Homo sapiens
ggagccagccgactc

SEQ ID NO: 38779 - DNA, 15 bp, Homo sapiens
gggagccagccgact

SEQ ID NO: 38780 - DNA, 15 bp, Homo sapiens
tgggagccagccgac

SEQ ID NO: 38781 - DNA, 15 bp, Homo sapiens
ctgggagccagccga

SEQ ID NO: 38782 - DNA, 15 bp, Homo sapiens
tctgggagccagccg

SEQ ID NO: 38783 - DNA, 15 bp, Homo sapiens
gtctgggagccagcc

SEQ ID NO: 38784 - DNA, 15 bp, Homo sapiens
ggtctgggagccagc

SEQ ID NO: 38785 - DNA, 15 bp, Homo sapiens
aggtctgggagccag

SEQ ID NO: 38786 - DNA, 15 bp, Homo sapiens
taggtctgggagcca

SEQ ID NO: 38787 - DNA, 15 bp, Homo sapiens
gtaggtctgggagcc

SEQ ID NO: 38788 - DNA, 15 bp, Homo sapiens
agtaggtctgggagc

SEQ ID NO: 38789 - DNA, 15 bp, Homo sapiens
gagtaggtctgggag

SEQ ID NO: 38790 - DNA, 15 bp, Homo sapiens
agagtaggtctggga

SEQ ID NO: 38791 - DNA, 15 bp, Homo sapiens
cagagtaggtctggg

SEQ ID NO: 38792 - DNA, 15 bp, Homo sapiens
acagagtaggtctgg

SEQ ID NO: 38793 - DNA, 15 bp, Homo sapiens
gacagagtaggtctg

SEQ ID NO: 38794 - DNA, 15 bp, Homo sapiens
agacagagtaggtct

SEQ ID NO: 38795 - DNA, 15 bp, Homo sapiens
gagacagagtaggtc

SEQ ID NO: 38796 - DNA, 15 bp, Homo sapiens
agagacagagtaggt

SEQ ID NO: 38797 - DNA, 15 bp, Homo sapiens
cagagacagagtagg

SEQ ID NO: 38798 - DNA, 15 bp, Homo sapiens
ccagagacagagtag

SEQ ID NO: 38799 - DNA, 15 bp, Homo sapiens
accagagacagagta

SEQ ID NO: 38800 - DNA, 15 bp, Homo sapiens
aaccagagacagagt

SEQ ID NO: 38801 - DNA, 15 bp, Homo sapiens
taaccagagacagag

SEQ ID NO: 38802 - DNA, 15 bp, Homo sapiens
gtaaccagagacaga

SEQ ID NO: 38803 - DNA, 15 bp, Homo sapiens
tgtaaccagagacag

SEQ ID NO: 38804 - DNA, 15 bp, Homo sapiens
ttgtaaccagagaca

SEQ ID NO: 38805 - DNA, 15 bp, Homo sapiens
cttgtaaccagagac

SEQ ID NO: 38806 - DNA, 15 bp, Homo sapiens
acttgtaaccagaga

SEQ ID NO: 38807 - DNA, 15 bp, Homo sapiens
gacttgtaaccagag

SEQ ID NO: 38808 - DNA, 15 bp, Homo sapiens
tgacttgtaaccaga

SEQ ID NO: 38809 - DNA, 15 bp, Homo sapiens
ctgacttgtaaccag

SEQ ID NO: 38810 - DNA, 15 bp, Homo sapiens
actgacttgtaacca

SEQ ID NO: 38811 - DNA, 15 bp, Homo sapiens
cactgacttgtaacc

SEQ ID NO: 38812 - DNA, 15 bp, Homo sapiens
acactgacttgtaac

SEQ ID NO: 38813 - DNA, 15 bp, Homo sapiens
gacactgacttgtaa

SEQ ID NO: 38814 - DNA, 15 bp, Homo sapiens
agacactgacttgta

SEQ ID NO: 38815 - DNA, 15 bp, Homo sapiens
aagacactgacttgt

SEQ ID NO: 38816 - DNA, 15 bp, Homo sapiens
taagacactgacttg

SEQ ID NO: 38817 - DNA, 15 bp, Homo sapiens
ataagacactgactt

SEQ ID NO: 38818 - DNA, 15 bp, Homo sapiens
aataagacactgact

SEQ ID NO: 38819 - DNA, 15 bp, Homo sapiens
aaataagacactgac

SEQ ID NO: 38820 - DNA, 15 bp, Homo sapiens
taaataagacactga

SEQ ID NO: 38821 - DNA, 15 bp, Homo sapiens
gtaaataagacactg

SEQ ID NO: 38822 - DNA, 15 bp, Homo sapiens
agtaaataagacact

SEQ ID NO: 38823 - DNA, 15 bp, Homo sapiens
cagtaaataagacac

SEQ ID NO: 38824 - DNA, 15 bp, Homo sapiens
ccagtaaataagaca

SEQ ID NO: 38825 - DNA, 15 bp, Homo sapiens
tccagtaaataagac

SEQ ID NO: 38826 - DNA, 15 bp, Homo sapiens
ttccagtaaataaga

SEQ ID NO: 38827 - DNA, 15 bp, Homo sapiens
cttccagtaaataag

SEQ ID NO: 38828 - DNA, 15 bp, Homo sapiens
acttccagtaaataa

SEQ ID NO: 38829 - DNA, 15 bp, Homo sapiens
aacttccagtaaata

SEQ ID NO: 38830 - DNA, 15 bp, Homo sapiens
taacttccagtaaat

SEQ ID NO: 38831 - DNA, 15 bp, Homo sapiens
ttaacttccagtaaa

SEQ ID NO: 38832 - DNA, 15 bp, Homo sapiens
tttaacttccagtaa

SEQ ID NO: 38833 - DNA, 15 bp, Homo sapiens
ttttaacttccagta

SEQ ID NO: 38834 - DNA, 15 bp, Homo sapiens
cttttaacttccagt

SEQ ID NO: 38835 - DNA, 15 bp, Homo sapiens
tcttttaacttccag

SEQ ID NO: 38836 - DNA, 15 bp, Homo sapiens
gtcttttaacttcca

SEQ ID NO: 38837 - DNA, 15 bp, Homo sapiens
tgtcttttaacttcc

SEQ ID NO: 38838 - DNA, 15 bp, Homo sapiens
ctgtcttttaacttc

SEQ ID NO: 38839 - DNA, 15 bp, Homo sapiens
cctgtcttttaactt

SEQ ID NO: 38840 - DNA, 15 bp, Homo sapiens
ccctgtcttttaact

SEQ ID NO: 38841 - DNA, 15 bp, Homo sapiens
gccctgtcttttaac

SEQ ID NO: 38842 - DNA, 15 bp, Homo sapiens
tgccctgtcttttaa

SEQ ID NO: 38843 - DNA, 15 bp, Homo sapiens
gtgccctgtctttta

SEQ ID NO: 38844 - DNA, 15 bp, Homo sapiens
agtgccctgtctttt

SEQ ID NO: 38845 - DNA, 15 bp, Homo sapiens
cagtgccctgtcttt

SEQ ID NO: 38846 - DNA, 15 bp, Homo sapiens
acagtgccctgtctt

SEQ ID NO: 38847 - DNA, 15 bp, Homo sapiens
aacagtgccctgtct

SEQ ID NO: 38848 - DNA, 15 bp, Homo sapiens
caacagtgccctgtc

SEQ ID NO: 38849 - DNA, 15 bp, Homo sapiens
tcaacagtgccctgt

SEQ ID NO: 38850 - DNA, 15 bp, Homo sapiens
atcaacagtgccctg

SEQ ID NO: 38851 - DNA, 15 bp, Homo sapiens
aatcaacagtgccct

SEQ ID NO: 38852 - DNA, 15 bp, Homo sapiens
aaatcaacagtgccc

SEQ ID NO: 38853 - DNA, 15 bp, Homo sapiens
taaatcaacagtgcc

SEQ ID NO: 38854 - DNA, 15 bp, Homo sapiens
gtaaatcaacagtgc

SEQ ID NO: 38855 - DNA, 15 bp, Homo sapiens
tgtaaatcaacagtg

SEQ ID NO: 38856 - DNA, 15 bp, Homo sapiens
gtgtaaatcaacagt

SEQ ID NO: 38857 - DNA, 15 bp, Homo sapiens
agtgtaaatcaacag

SEQ ID NO: 38858 - DNA, 15 bp, Homo sapiens
cagtgtaaatcaaca

SEQ ID NO: 38859 - DNA, 15 bp, Homo sapiens
acagtgtaaatcaac

SEQ ID NO: 38860 - DNA, 15 bp, Homo sapiens
cacagtgtaaatcaa

SEQ ID NO: 38861 - DNA, 15 bp, Homo sapiens
gcacagtgtaaatca

SEQ ID NO: 38862 - DNA, 15 bp, Homo sapiens
agcacagtgtaaatc

SEQ ID NO: 38863 - DNA, 15 bp, Homo sapiens
aagcacagtgtaaat

SEQ ID NO: 38864 - DNA, 15 bp, Homo sapiens
gaagcacagtgtaaa

SEQ ID NO: 38865 - DNA, 15 bp, Homo sapiens
tgaagcacagtgtaa

SEQ ID NO: 38866 - DNA, 15 bp, Homo sapiens
ctgaagcacagtgta

SEQ ID NO: 38867 - DNA, 15 bp, Homo sapiens
gctgaagcacagtgt

SEQ ID NO: 38868 - DNA, 15 bp, Homo sapiens
tgctgaagcacagtg

SEQ ID NO: 38869 - DNA, 15 bp, Homo sapiens
atgctgaagcacagt

SEQ ID NO: 38870 - DNA, 15 bp, Homo sapiens
catgctgaagcacag

SEQ ID NO: 38871 - DNA, 15 bp, Homo sapiens
gcatgctgaagcaca

SEQ ID NO: 38872 - DNA, 15 bp, Homo sapiens
ggcatgctgaagcac

SEQ ID NO: 38873 - DNA, 15 bp, Homo sapiens
gggcatgctgaagca

SEQ ID NO: 38874 - DNA, 15 bp, Homo sapiens
agggcatgctgaagc

SEQ ID NO: 38875 - DNA, 15 bp, Homo sapiens
aagggcatgctgaag

SEQ ID NO: 38876 - DNA, 15 bp, Homo sapiens
taagggcatgctgaa

SEQ ID NO: 38877 - DNA, 15 bp, Homo sapiens
ataagggcatgctga

SEQ ID NO: 38878 - DNA, 15 bp, Homo sapiens
aataagggcatgctg

SEQ ID NO: 38879 - DNA, 15 bp, Homo sapiens
taataagggcatgct

SEQ ID NO: 38880 - DNA, 15 bp, Homo sapiens
ctaataagggcatgc

SEQ ID NO: 38881 - DNA, 15 bp, Homo sapiens
actaataagggcatg

SEQ ID NO: 38882 - DNA, 15 bp, Homo sapiens
tactaataagggcat

SEQ ID NO: 38883 - DNA, 15 bp, Homo sapiens
atactaataagggca

SEQ ID NO: 38884 - DNA, 15 bp, Homo sapiens
aatactaataagggc

SEQ ID NO: 38885 - DNA, 15 bp, Homo sapiens
aaatactaataaggg

SEQ ID NO: 38886 - DNA, 15 bp, Homo sapiens
gaaatactaataagg

SEQ ID NO: 38887 - DNA, 15 bp, Homo sapiens
agaaatactaataag

SEQ ID NO: 38888 - DNA, 15 bp, Homo sapiens
aagaaatactaataa

SEQ ID NO: 38889 - DNA, 15 bp, Homo sapiens
caagaaatactaata

SEQ ID NO: 38890 - DNA, 15 bp, Homo sapiens
ccaagaaatactaat

SEQ ID NO: 38891 - DNA, 15 bp, Homo sapiens
accaagaaatactaa

SEQ ID NO: 38892 - DNA, 15 bp, Homo sapiens
aaccaagaaatacta

SEQ ID NO: 38893 - DNA, 15 bp, Homo sapiens
gaaccaagaaatact

SEQ ID NO: 38894 - DNA, 15 bp, Homo sapiens
agaaccaagaaatac

SEQ ID NO: 38895 - DNA, 15 bp, Homo sapiens
aagaaccaagaaata

SEQ ID NO: 38896 - DNA, 15 bp, Homo sapiens
gaagaaccaagaaat

SEQ ID NO: 38897 - DNA, 15 bp, Homo sapiens
ggaagaaccaagaaa

SEQ ID NO: 38898 - DNA, 15 bp, Homo sapiens
tggaagaaccaagaa

SEQ ID NO: 38899 - DNA, 15 bp, Homo sapiens
atggaagaaccaaga

SEQ ID NO: 38900 - DNA, 15 bp, Homo sapiens
gatggaagaaccaag

SEQ ID NO: 38901 - DNA, 15 bp, Homo sapiens
tgatggaagaaccaa

SEQ ID NO: 38902 - DNA, 15 bp, Homo sapiens
ctgatggaagaacca

SEQ ID NO: 38903 - DNA, 15 bp, Homo sapiens
actgatggaagaacc

SEQ ID NO: 38904 - DNA, 15 bp, Homo sapiens
cactgatggaagaac

SEQ ID NO: 38905 - DNA, 15 bp, Homo sapiens
tcactgatggaagaa

SEQ ID NO: 38906 - DNA, 15 bp, Homo sapiens
ctcactgatggaaga

SEQ ID NO: 38907 - DNA, 15 bp, Homo sapiens
actcactgatggaag

SEQ ID NO: 38908 - DNA, 15 bp, Homo sapiens
gactcactgatggaa

SEQ ID NO: 38909 - DNA, 15 bp, Homo sapiens
agactcactgatgga

SEQ ID NO: 38910 - DNA, 15 bp, Homo sapiens
gagactcactgatgg

SEQ ID NO: 38911 - DNA, 15 bp, Homo sapiens
agagactcactgatg

SEQ ID NO: 38912 - DNA, 15 bp, Homo sapiens
cagagactcactgat

SEQ ID NO: 38913 - DNA, 15 bp, Homo sapiens
tcagagactcactga

SEQ ID NO: 38914 - DNA, 15 bp, Homo sapiens
atcagagactcactg

SEQ ID NO: 38915 - DNA, 15 bp, Homo sapiens
aatcagagactcact

SEQ ID NO: 38916 - DNA, 15 bp, Homo sapiens
aaatcagagactcac

SEQ ID NO: 38917 - DNA, 15 bp, Homo sapiens
gaaatcagagactca

SEQ ID NO: 38918 - DNA, 15 bp, Homo sapiens
agaaatcagagactc

SEQ ID NO: 38919 - DNA, 15 bp, Homo sapiens
aagaaatcagagact

SEQ ID NO: 38920 - DNA, 15 bp, Homo sapiens
gaagaaatcagagac

SEQ ID NO: 38921 - DNA, 15 bp, Homo sapiens
tgaagaaatcagaga

SEQ ID NO: 38922 - DNA, 15 bp, Homo sapiens
gtgaagaaatcagag

SEQ ID NO: 38923 - DNA, 15 bp, Homo sapiens
ggtgaagaaatcaga

SEQ ID NO: 38924 - DNA, 15 bp, Homo sapiens
tggtgaagaaatcag

SEQ ID NO: 38925 - DNA, 15 bp, Homo sapiens
ttggtgaagaaatca

SEQ ID NO: 38926 - DNA, 15 bp, Homo sapiens
tttggtgaagaaatc

SEQ ID NO: 38927 - DNA, 15 bp, Homo sapiens
ttttggtgaagaaat

SEQ ID NO: 38928 - DNA, 15 bp, Homo sapiens
tttttggtgaagaaa

SEQ ID NO: 38929 - DNA, 15 bp, Homo sapiens
ttttttggtgaagaa

SEQ ID NO: 38930 - DNA, 15 bp, Homo sapiens
attttttggtgaaga

SEQ ID NO: 38931 - DNA, 15 bp, Homo sapiens
tattttttggtgaag

SEQ ID NO: 38932 - DNA, 15 bp, Homo sapiens
ttattttttggtgaa

SEQ ID NO: 38933 - DNA, 15 bp, Homo sapiens
attattttttggtga

SEQ ID NO: 38934 - DNA, 15 bp, Homo sapiens
gattattttttggtg

SEQ ID NO: 38935 - DNA, 15 bp, Homo sapiens
agattattttttggt

SEQ ID NO: 38936 - DNA, 15 bp, Homo sapiens
aagattattttttgg

SEQ ID NO: 38937 - DNA, 15 bp, Homo sapiens
caagattattttttg

SEQ ID NO: 38938 - DNA, 15 bp, Homo sapiens
gcaagattatttttt

SEQ ID NO: 38939 - DNA, 15 bp, Homo sapiens
tgcaagattattttt

SEQ ID NO: 38940 - DNA, 15 bp, Homo sapiens
ctgcaagattatttt

SEQ ID NO: 38941 - DNA, 15 bp, Homo sapiens
tctgcaagattattt

SEQ ID NO: 38942 - DNA, 15 bp, Homo sapiens
ctctgcaagattatt

SEQ ID NO: 38943 - DNA, 15 bp, Homo sapiens
tctctgcaagattat

SEQ ID NO: 38944 - DNA, 15 bp, Homo sapiens
ctctctgcaagatta

SEQ ID NO: 38945 - DNA, 15 bp, Homo sapiens
actctctgcaagatt

SEQ ID NO: 38946 - DNA, 15 bp, Homo sapiens
gactctctgcaagat

SEQ ID NO: 38947 - DNA, 15 bp, Homo sapiens
tgactctctgcaaga

SEQ ID NO: 38948 - DNA, 15 bp, Homo sapiens
atgactctctgcaag

SEQ ID NO: 38949 - DNA, 15 bp, Homo sapiens
catgactctctgcaa

SEQ ID NO: 38950 - DNA, 15 bp, Homo sapiens
tcatgactctctgca

SEQ ID NO: 38951 - DNA, 15 bp, Homo sapiens
atcatgactctctgc

SEQ ID NO: 38952 - DNA, 15 bp, Homo sapiens
gatcatgactctctg

SEQ ID NO: 38953 - DNA, 15 bp, Homo sapiens
tgatcatgactctct

SEQ ID NO: 38954 - DNA, 15 bp, Homo sapiens
ttgatcatgactctc

SEQ ID NO: 38955 - DNA, 15 bp, Homo sapiens
gttgatcatgactct

SEQ ID NO: 38956 - DNA, 15 bp, Homo sapiens
ggttgatcatgactc

SEQ ID NO: 38957 - DNA, 15 bp, Homo sapiens
gggttgatcatgact

SEQ ID NO: 38958 - DNA, 15 bp, Homo sapiens
agggttgatcatgac

SEQ ID NO: 38959 - DNA, 15 bp, Homo sapiens
cagggttgatcatga

SEQ ID NO: 38960 - DNA, 15 bp, Homo sapiens
acagggttgatcatg

SEQ ID NO: 38961 - DNA, 15 bp, Homo sapiens
aacagggttgatcat

SEQ ID NO: 38962 - DNA, 15 bp, Homo sapiens
aaacagggttgatca

SEQ ID NO: 38963 - DNA, 15 bp, Homo sapiens
aaaacagggttgatc

SEQ ID NO: 38964 - DNA, 15 bp, Homo sapiens
aaaaacagggttgat

SEQ ID NO: 38965 - DNA, 15 bp, Homo sapiens
taaaaacagggttga

SEQ ID NO: 38966 - DNA, 15 bp, Homo sapiens
ataaaaacagggttg

SEQ ID NO: 38967 - DNA, 15 bp, Homo sapiens
tataaaaacagggtt

SEQ ID NO: 38968 - DNA, 15 bp, Homo sapiens
ttataaaaacagggt

SEQ ID NO: 38969 - DNA, 15 bp, Homo sapiens
tttataaaaacaggg

SEQ ID NO: 38970 - DNA, 15 bp, Homo sapiens
ttttataaaaacagg

SEQ ID NO: 38971 - DNA, 15 bp, Homo sapiens
gttttataaaaacag

SEQ ID NO: 38972 - DNA, 15 bp, Homo sapiens
tgttttataaaaaca

SEQ ID NO: 38973 - DNA, 15 bp, Homo sapiens
gtgttttataaaaac

SEQ ID NO: 38974 - DNA, 15 bp, Homo sapiens
agtgttttataaaaa

SEQ ID NO: 38975 - DNA, 15 bp, Homo sapiens
cagtgttttataaaa

SEQ ID NO: 38976 - DNA, 15 bp, Homo sapiens
tcagtgttttataaa

SEQ ID NO: 38977 - DNA, 15 bp, Homo sapiens
ctcagtgttttataa

SEQ ID NO: 38978 - DNA, 15 bp, Homo sapiens
gctcagtgttttata

SEQ ID NO: 38979 - DNA, 15 bp, Homo sapiens
agctcagtgttttat

SEQ ID NO: 38980 - DNA, 15 bp, Homo sapiens
aagctcagtgtttta

SEQ ID NO: 38981 - DNA, 15 bp, Homo sapiens
aaagctcagtgtttt

SEQ ID NO: 38982 - DNA, 15 bp, Homo sapiens
caaagctcagtgttt

SEQ ID NO: 38983 - DNA, 15 bp, Homo sapiens
ccaaagctcagtgtt

SEQ ID NO: 38984 - DNA, 15 bp, Homo sapiens
tccaaagctcagtgt

SEQ ID NO: 38985 - DNA, 15 bp, Homo sapiens
ttccaaagctcagtg

SEQ ID NO: 38986 - DNA, 15 bp, Homo sapiens
tttccaaagctcagt

SEQ ID NO: 38987 - DNA, 15 bp, Homo sapiens
ctttccaaagctcag

SEQ ID NO: 38988 - DNA, 15 bp, Homo sapiens
cctttccaaagctca

SEQ ID NO: 38989 - DNA, 15 bp, Homo sapiens
ccctttccaaagctc

SEQ ID NO: 38990 - DNA, 15 bp, Homo sapiens
tccctttccaaagct

SEQ ID NO: 38991 - DNA, 15 bp, Homo sapiens
ttccctttccaaagc

SEQ ID NO: 38992 - DNA, 15 bp, Homo sapiens
tttccctttccaaag

SEQ ID NO: 38993 - DNA, 15 bp, Homo sapiens
atttccctttccaaa

SEQ ID NO: 38994 - DNA, 15 bp, Homo sapiens
catttccctttccaa

SEQ ID NO: 38995 - DNA, 15 bp, Homo sapiens
tcatttccctttcca

SEQ ID NO: 38996 - DNA, 15 bp, Homo sapiens
atcatttccctttcc

SEQ ID NO: 38997 - DNA, 15 bp, Homo sapiens
aatcatttccctttc

SEQ ID NO: 38998 - DNA, 15 bp, Homo sapiens
taatcatttcccttt

SEQ ID NO: 38999 - DNA, 15 bp, Homo sapiens
gtaatcatttccctt

SEQ ID NO: 39000 - DNA, 15 bp, Homo sapiens
agtaatcatttccct

SEQ ID NO: 39001 - DNA, 15 bp, Homo sapiens
gagtaatcatttccc

SEQ ID NO: 39002 - DNA, 15 bp, Homo sapiens
tgagtaatcatttcc

SEQ ID NO: 39003 - DNA, 15 bp, Homo sapiens
atgagtaatcatttc

SEQ ID NO: 39004 - DNA, 15 bp, Homo sapiens
gatgagtaatcattt

SEQ ID NO: 39005 - DNA, 15 bp, Homo sapiens
tgatgagtaatcatt

SEQ ID NO: 39006 - DNA, 15 bp, Homo sapiens
gtgatgagtaatcat

SEQ ID NO: 39007 - DNA, 15 bp, Homo sapiens
tgtgatgagtaatca

SEQ ID NO: 39008 - DNA, 15 bp, Homo sapiens
ttgtgatgagtaatc

SEQ ID NO: 39009 - DNA, 15 bp, Homo sapiens
gttgtgatgagtaat

SEQ ID NO: 39010 - DNA, 15 bp, Homo sapiens
agttgtgatgagtaa

SEQ ID NO: 39011 - DNA, 15 bp, Homo sapiens
gagttgtgatgagta

SEQ ID NO: 39012 - DNA, 15 bp, Homo sapiens
agagttgtgatgagt

SEQ ID NO: 39013 - DNA, 15 bp, Homo sapiens
tagagttgtgatgag

SEQ ID NO: 39014 - DNA, 15 bp, Homo sapiens
ttagagttgtgatga

SEQ ID NO: 39015 - DNA, 15 bp, Homo sapiens
tttagagttgtgatg

SEQ ID NO: 39016 - DNA, 15 bp, Homo sapiens
gtttagagttgtgat

SEQ ID NO: 39017 - DNA, 15 bp, Homo sapiens
tgtttagagttgtga

SEQ ID NO: 39018 - DNA, 15 bp, Homo sapiens
gtgtttagagttgtg

SEQ ID NO: 39019 - DNA, 15 bp, Homo sapiens
agtgtttagagttgt

SEQ ID NO: 39020 - DNA, 15 bp, Homo sapiens
tagtgtttagagttg

SEQ ID NO: 39021 - DNA, 15 bp, Homo sapiens
ctagtgtttagagtt

SEQ ID NO: 39022 - DNA, 15 bp, Homo sapiens
cctagtgtttagagt

SEQ ID NO: 39023 - DNA, 15 bp, Homo sapiens
tcctagtgtttagag

SEQ ID NO: 39024 - DNA, 15 bp, Homo sapiens
atcctagtgtttaga

SEQ ID NO: 39025 - DNA, 15 bp, Homo sapiens
tatcctagtgtttag

SEQ ID NO: 39026 - DNA, 15 bp, Homo sapiens
ttatcctagtgttta

SEQ ID NO: 39027 - DNA, 15 bp, Homo sapiens
tttatcctagtgttt

SEQ ID NO: 39028 - DNA, 15 bp, Homo sapiens
ttttatcctagtgtt

SEQ ID NO: 39029 - DNA, 15 bp, Homo sapiens
attttatcctagtgt

SEQ ID NO: 39030 - DNA, 15 bp, Homo sapiens
cattttatcctagtg

SEQ ID NO: 39031 - DNA, 15 bp, Homo sapiens
acattttatcctagt

SEQ ID NO: 39032 - DNA, 15 bp, Homo sapiens
aacattttatcctag

SEQ ID NO: 39033 - DNA, 15 bp, Homo sapiens
gaacattttatccta

SEQ ID NO: 39034 - DNA, 15 bp, Homo sapiens
ggaacattttatcct

SEQ ID NO: 39035 - DNA, 15 bp, Homo sapiens
gggaacattttatcc

SEQ ID NO: 39036 - DNA, 15 bp, Homo sapiens
tgggaacattttatc

SEQ ID NO: 39037 - DNA, 15 bp, Homo sapiens
atgggaacattttat

SEQ ID NO: 39038 - DNA, 15 bp, Homo sapiens
aatgggaacatttta

SEQ ID NO: 39039 - DNA, 15 bp, Homo sapiens
aaatgggaacatttt

SEQ ID NO: 39040 - DNA, 15 bp, Homo sapiens
taaatgggaacattt

SEQ ID NO: 39041 - DNA, 15 bp, Homo sapiens
ctaaatgggaacatt

SEQ ID NO: 39042 - DNA, 15 bp, Homo sapiens
tctaaatgggaacat

SEQ ID NO: 39043 - DNA, 15 bp, Homo sapiens
atctaaatgggaaca

SEQ ID NO: 39044 - DNA, 15 bp, Homo sapiens
gatctaaatgggaac

SEQ ID NO: 39045 - DNA, 15 bp, Homo sapiens
tgatctaaatgggaa

SEQ ID NO: 39046 - DNA, 15 bp, Homo sapiens
ttgatctaaatggga

SEQ ID NO: 39047 - DNA, 15 bp, Homo sapiens
attgatctaaatggg

SEQ ID NO: 39048 - DNA, 15 bp, Homo sapiens
gattgatctaaatgg

SEQ ID NO: 39049 - DNA, 15 bp, Homo sapiens
tgattgatctaaatg

SEQ ID NO: 39050 - DNA, 15 bp, Homo sapiens
ctgattgatctaaat

SEQ ID NO: 39051 - DNA, 15 bp, Homo sapiens
cctgattgatctaaa

SEQ ID NO: 39052 - DNA, 15 bp, Homo sapiens
ccctgattgatctaa

SEQ ID NO: 39053 - DNA, 15 bp, Homo sapiens
cccctgattgatcta

SEQ ID NO: 39054 - DNA, 15 bp, Homo sapiens
gcccctgattgatct

SEQ ID NO: 39055 - DNA, 15 bp, Homo sapiens
ggcccctgattgatc

SEQ ID NO: 39056 - DNA, 15 bp, Homo sapiens
tggcccctgattgat

SEQ ID NO: 39057 - DNA, 15 bp, Homo sapiens
ttggcccctgattga

SEQ ID NO: 39058 - DNA, 15 bp, Homo sapiens
attggcccctgattg

SEQ ID NO: 39059 - DNA, 15 bp, Homo sapiens
aattggcccctgatt

SEQ ID NO: 39060 - DNA, 15 bp, Homo sapiens
aaattggcccctgat

SEQ ID NO: 39061 - DNA, 15 bp, Homo sapiens
taaattggcccctga

SEQ ID NO: 39062 - DNA, 15 bp, Homo sapiens
ttaaattggcccctg

SEQ ID NO: 39063 - DNA, 15 bp, Homo sapiens
attaaattggcccct

SEQ ID NO: 39064 - DNA, 15 bp, Homo sapiens
aattaaattggcccc

SEQ ID NO: 39065 - DNA, 15 bp, Homo sapiens
aaattaaattggccc

SEQ ID NO: 39066 - DNA, 15 bp, Homo sapiens
aaaattaaattggcc

SEQ ID NO: 39067 - DNA, 15 bp, Homo sapiens
gaaaattaaattggc

SEQ ID NO: 39068 - DNA, 15 bp, Homo sapiens
agaaaattaaattgg

SEQ ID NO: 39069 - DNA, 15 bp, Homo sapiens
tagaaaattaaattg

SEQ ID NO: 39070 - DNA, 15 bp, Homo sapiens
ttagaaaattaaatt

SEQ ID NO: 39071 - DNA, 15 bp, Homo sapiens
attagaaaattaaat

SEQ ID NO: 39072 - DNA, 15 bp, Homo sapiens
cattagaaaattaaa

SEQ ID NO: 39073 - DNA, 15 bp, Homo sapiens
tcattagaaaattaa

SEQ ID NO: 39074 - DNA, 15 bp, Homo sapiens
ttcattagaaaatta

SEQ ID NO: 39075 - DNA, 15 bp, Homo sapiens
gttcattagaaaatt

SEQ ID NO: 39076 - DNA, 15 bp, Homo sapiens
agttcattagaaaat

SEQ ID NO: 39077 - DNA, 15 bp, Homo sapiens
aagttcattagaaaa

SEQ ID NO: 39078 - DNA, 15 bp, Homo sapiens
aaagttcattagaaa

SEQ ID NO: 39079 - DNA, 15 bp, Homo sapiens
taaagttcattagaa

SEQ ID NO: 39080 - DNA, 15 bp, Homo sapiens
ctaaagttcattaga

SEQ ID NO: 39081 - DNA, 15 bp, Homo sapiens
tctaaagttcattag

SEQ ID NO: 39082 - DNA, 15 bp, Homo sapiens
ttctaaagttcatta

SEQ ID NO: 39083 - DNA, 15 bp, Homo sapiens
attctaaagttcatt

SEQ ID NO: 39084 - DNA, 15 bp, Homo sapiens
aattctaaagttcat

SEQ ID NO: 39085 - DNA, 15 bp, Homo sapiens
caattctaaagttca

SEQ ID NO: 39086 - DNA, 15 bp, Homo sapiens
gcaattctaaagttc

SEQ ID NO: 39087 - DNA, 15 bp, Homo sapiens
agcaattctaaagtt

SEQ ID NO: 39088 - DNA, 15 bp, Homo sapiens
aagcaattctaaagt

SEQ ID NO: 39089 - DNA, 15 bp, Homo sapiens
aaagcaattctaaag

SEQ ID NO: 39090 - DNA, 15 bp, Homo sapiens
aaaagcaattctaaa

SEQ ID NO: 39091 - DNA, 15 bp, Homo sapiens
caaaagcaattctaa

SEQ ID NO: 39092 - DNA, 15 bp, Homo sapiens
acaaaagcaattcta

SEQ ID NO: 39093 - DNA, 15 bp, Homo sapiens
cacaaaagcaattct

SEQ ID NO: 39094 - DNA, 15 bp, Homo sapiens
ccacaaaagcaattc

SEQ ID NO: 39095 - DNA, 15 bp, Homo sapiens
accacaaaagcaatt

SEQ ID NO: 39096 - DNA, 15 bp, Homo sapiens
gaccacaaaagcaat

SEQ ID NO: 39097 - DNA, 15 bp, Homo sapiens
agaccacaaaagcaa

SEQ ID NO: 39098 - DNA, 15 bp, Homo sapiens
cagaccacaaaagca

SEQ ID NO: 39099 - DNA, 15 bp, Homo sapiens
gcagaccacaaaagc

SEQ ID NO: 39100 - DNA, 15 bp, Homo sapiens
ggcagaccacaaaag

SEQ ID NO: 39101 - DNA, 15 bp, Homo sapiens
aggcagaccacaaaa

SEQ ID NO: 39102 - DNA, 15 bp, Homo sapiens
aaggcagaccacaaa

SEQ ID NO: 39103 - DNA, 15 bp, Homo sapiens
aaaggcagaccacaa

SEQ ID NO: 39104 - DNA, 15 bp, Homo sapiens
taaaggcagaccaca

SEQ ID NO: 39105 - DNA, 15 bp, Homo sapiens
ctaaaggcagaccac

SEQ ID NO: 39106 - DNA, 15 bp, Homo sapiens
cctaaaggcagacca

SEQ ID NO: 39107 - DNA, 15 bp, Homo sapiens
ccctaaaggcagacc

SEQ ID NO: 39108 - DNA, 15 bp, Homo sapiens
tccctaaaggcagac

SEQ ID NO: 39109 - DNA, 15 bp, Homo sapiens
gtccctaaaggcaga

SEQ ID NO: 39110 - DNA, 15 bp, Homo sapiens
agtccctaaaggcag

SEQ ID NO: 39111 - DNA, 15 bp, Homo sapiens
tagtccctaaaggca

SEQ ID NO: 39112 - DNA, 15 bp, Homo sapiens
atagtccctaaaggc

SEQ ID NO: 39113 - DNA, 15 bp, Homo sapiens
aatagtccctaaagg

SEQ ID NO: 39114 - DNA, 15 bp, Homo sapiens
taatagtccctaaag

SEQ ID NO: 39115 - DNA, 15 bp, Homo sapiens
ataatagtccctaaa

SEQ ID NO: 39116 - DNA, 15 bp, Homo sapiens
aataatagtccctaa

SEQ ID NO: 39117 - DNA, 15 bp, Homo sapiens
taataatagtcccta

SEQ ID NO: 39118 - DNA, 15 bp, Homo sapiens
ataataatagtccct

SEQ ID NO: 39119 - DNA, 15 bp, Homo sapiens
tataataatagtccc

SEQ ID NO: 39120 - DNA, 15 bp, Homo sapiens
gtataataatagtcc

SEQ ID NO: 39121 - DNA, 15 bp, Homo sapiens
ggtataataatagtc

SEQ ID NO: 39122 - DNA, 15 bp, Homo sapiens
tggtataataatagt

SEQ ID NO: 39123 - DNA, 15 bp, Homo sapiens
ctggtataataatag

SEQ ID NO: 39124 - DNA, 15 bp, Homo sapiens
gctggtataataata

SEQ ID NO: 39125 - DNA, 15 bp, Homo sapiens
agctggtataataat

SEQ ID NO: 39126 - DNA, 15 bp, Homo sapiens
aagctggtataataa

SEQ ID NO: 39127 - DNA, 15 bp, Homo sapiens
aaagctggtataata

SEQ ID NO: 39128 - DNA, 15 bp, Homo sapiens
aaaagctggtataat

SEQ ID NO: 39129 - DNA, 15 bp, Homo sapiens
gaaaagctggtataa

SEQ ID NO: 39130 - DNA, 15 bp, Homo sapiens
agaaaagctggtata

SEQ ID NO: 39131 - DNA, 15 bp, Homo sapiens
aagaaaagctggtat

SEQ ID NO: 39132 - DNA, 15 bp, Homo sapiens
gaagaaaagctggta

SEQ ID NO: 39133 - DNA, 15 bp, Homo sapiens
agaagaaaagctggt

SEQ ID NO: 39134 - DNA, 15 bp, Homo sapiens
aagaagaaaagctgg

SEQ ID NO: 39135 - DNA, 15 bp, Homo sapiens
aaagaagaaaagctg

SEQ ID NO: 39136 - DNA, 15 bp, Homo sapiens
aaaagaagaaaagct

SEQ ID NO: 39137 - DNA, 15 bp, Homo sapiens
aaaaagaagaaaagc

SEQ ID NO: 39138 - DNA, 15 bp, Homo sapiens
taaaaagaagaaaag

SEQ ID NO: 39139 - DNA, 15 bp, Homo sapiens
ttaaaaagaagaaaa

SEQ ID NO: 39140 - DNA, 15 bp, Homo sapiens
attaaaaagaagaaa

SEQ ID NO: 39141 - DNA, 15 bp, Homo sapiens
cattaaaaagaagaa

SEQ ID NO: 39142 - DNA, 15 bp, Homo sapiens
acattaaaaagaaga

SEQ ID NO: 39143 - DNA, 15 bp, Homo sapiens
aacattaaaaagaag

SEQ ID NO: 39144 - DNA, 15 bp, Homo sapiens
aaacattaaaaagaa

SEQ ID NO: 39145 - DNA, 15 bp, Homo sapiens
gaaacattaaaaaga

SEQ ID NO: 39146 - DNA, 15 bp, Homo sapiens
agaaacattaaaaag

SEQ ID NO: 39147 - DNA, 15 bp, Homo sapiens
tagaaacattaaaaa

SEQ ID NO: 39148 - DNA, 15 bp, Homo sapiens
ctagaaacattaaaa

SEQ ID NO: 39149 - DNA, 15 bp, Homo sapiens
tctagaaacattaaa

SEQ ID NO: 39150 - DNA, 15 bp, Homo sapiens
ttctagaaacattaa

SEQ ID NO: 39151 - DNA, 15 bp, Homo sapiens
cttctagaaacatta

SEQ ID NO: 39152 - DNA, 15 bp, Homo sapiens
acttctagaaacatt

SEQ ID NO: 39153 - DNA, 15 bp, Homo sapiens
gacttctagaaacat

SEQ ID NO: 39154 - DNA, 15 bp, Homo sapiens
tgacttctagaaaca

SEQ ID NO: 39155 - DNA, 15 bp, Homo sapiens
ttgacttctagaaac

SEQ ID NO: 39156 - DNA, 15 bp, Homo sapiens
attgacttctagaaa

SEQ ID NO: 39157 - DNA, 15 bp, Homo sapiens
aattgacttctagaa

SEQ ID NO: 39158 - DNA, 15 bp, Homo sapiens
aaattgacttctaga

SEQ ID NO: 39159 - DNA, 15 bp, Homo sapiens
aaaattgacttctag

SEQ ID NO: 39160 - DNA, 15 bp, Homo sapiens
gaaaattgacttcta

SEQ ID NO: 39161 - DNA, 15 bp, Homo sapiens
tgaaaattgacttct

SEQ ID NO: 39162 - DNA, 15 bp, Homo sapiens
atgaaaattgacttc

SEQ ID NO: 39163 - DNA, 15 bp, Homo sapiens
gatgaaaattgactt

SEQ ID NO: 39164 - DNA, 15 bp, Homo sapiens
agatgaaaattgact

SEQ ID NO: 39165 - DNA, 15 bp, Homo sapiens
aagatgaaaattgac

SEQ ID NO: 39166 - DNA, 15 bp, Homo sapiens
aaagatgaaaattga

SEQ ID NO: 39167 - DNA, 15 bp, Homo sapiens
caaagatgaaaattg

SEQ ID NO: 39168 - DNA, 15 bp, Homo sapiens
gcaaagatgaaaatt

SEQ ID NO: 39169 - DNA, 15 bp, Homo sapiens
ggcaaagatgaaaat

SEQ ID NO: 39170 - DNA, 15 bp, Homo sapiens
tggcaaagatgaaaa

SEQ ID NO: 39171 - DNA, 15 bp, Homo sapiens
ttggcaaagatgaaa

SEQ ID NO: 39172 - DNA, 15 bp, Homo sapiens
cttggcaaagatgaa

SEQ ID NO: 39173 - DNA, 15 bp, Homo sapiens
tcttggcaaagatga

SEQ ID NO: 39174 - DNA, 15 bp, Homo sapiens
ttcttggcaaagatg

SEQ ID NO: 39175 - DNA, 15 bp, Homo sapiens
attcttggcaaagat

SEQ ID NO: 39176 - DNA, 15 bp, Homo sapiens
aattcttggcaaaga

SEQ ID NO: 39177 - DNA, 15 bp, Homo sapiens
taattcttggcaaag

SEQ ID NO: 39178 - DNA, 15 bp, Homo sapiens
ttaattcttggcaaa

SEQ ID NO: 39179 - DNA, 15 bp, Homo sapiens
tttaattcttggcaa

SEQ ID NO: 39180 - DNA, 15 bp, Homo sapiens
ctttaattcttggca

SEQ ID NO: 39181 - DNA, 15 bp, Homo sapiens
cctttaattcttggc

SEQ ID NO: 39182 - DNA, 15 bp, Homo sapiens
tcctttaattcttgg

SEQ ID NO: 39183 - DNA, 15 bp, Homo sapiens
atcctttaattcttg

SEQ ID NO: 39184 - DNA, 15 bp, Homo sapiens
gatcctttaattctt

SEQ ID NO: 39185 - DNA, 15 bp, Homo sapiens
ggatcctttaattct

SEQ ID NO: 39186 - DNA, 15 bp, Homo sapiens
aggatcctttaattc

SEQ ID NO: 39187 - DNA, 15 bp, Homo sapiens
aaggatcctttaatt

SEQ ID NO: 39188 - DNA, 15 bp, Homo sapiens
taaggatcctttaat

SEQ ID NO: 39189 - DNA, 15 bp, Homo sapiens
ttaaggatcctttaa

SEQ ID NO: 39190 - DNA, 15 bp, Homo sapiens
tttaaggatccttta

SEQ ID NO: 39191 - DNA, 15 bp, Homo sapiens
gtttaaggatccttt

SEQ ID NO: 39192 - DNA, 15 bp, Homo sapiens
tgtttaaggatcctt

SEQ ID NO: 39193 - DNA, 15 bp, Homo sapiens
atgtttaaggatcct

SEQ ID NO: 39194 - DNA, 15 bp, Homo sapiens
catgtttaaggatcc

SEQ ID NO: 39195 - DNA, 15 bp, Homo sapiens
acatgtttaaggatc

SEQ ID NO: 39196 - DNA, 15 bp, Homo sapiens
cacatgtttaaggat

SEQ ID NO: 39197 - DNA, 15 bp, Homo sapiens
ccacatgtttaagga

SEQ ID NO: 39198 - DNA, 15 bp, Homo sapiens
tccacatgtttaagg

SEQ ID NO: 39199 - DNA, 15 bp, Homo sapiens
ttccacatgtttaag

SEQ ID NO: 39200 - DNA, 15 bp, Homo sapiens
tttccacatgtttaa

SEQ ID NO: 39201 - DNA, 15 bp, Homo sapiens
ttttccacatgttta

SEQ ID NO: 39202 - DNA, 15 bp, Homo sapiens
cttttccacatgttt

SEQ ID NO: 39203 - DNA, 15 bp, Homo sapiens
tcttttccacatgtt

SEQ ID NO: 39204 - DNA, 15 bp, Homo sapiens
atcttttccacatgt

SEQ ID NO: 39205 - DNA, 15 bp, Homo sapiens
catcttttccacatg

SEQ ID NO: 39206 - DNA, 15 bp, Homo sapiens
tcatcttttccacat

SEQ ID NO: 39207 - DNA, 15 bp, Homo sapiens
ctcatcttttccaca

SEQ ID NO: 39208 - DNA, 15 bp, Homo sapiens
tctcatcttttccac

SEQ ID NO: 39209 - DNA, 15 bp, Homo sapiens
ttctcatcttttcca

SEQ ID NO: 39210 - DNA, 15 bp, Homo sapiens
tttctcatcttttcc

SEQ ID NO: 39211 - DNA, 15 bp, Homo sapiens
ttttctcatcttttc

SEQ ID NO: 39212 - DNA, 15 bp, Homo sapiens
tttttctcatctttt

SEQ ID NO: 39213 - DNA, 15 bp, Homo sapiens
gtttttctcatcttt

SEQ ID NO: 39214 - DNA, 15 bp, Homo sapiens
tgtttttctcatctt

SEQ ID NO: 39215 - DNA, 15 bp, Homo sapiens
ctgtttttctcatct

SEQ ID NO: 39216 - DNA, 15 bp, Homo sapiens
actgtttttctcatc

SEQ ID NO: 39217 - DNA, 15 bp, Homo sapiens
gactgtttttctcat

SEQ ID NO: 39218 - DNA, 15 bp, Homo sapiens
tgactgtttttctca

SEQ ID NO: 39219 - DNA, 15 bp, Homo sapiens
ctgactgtttttctc

SEQ ID NO: 39220 - DNA, 15 bp, Homo sapiens
actgactgtttttct

SEQ ID NO: 39221 - DNA, 15 bp, Homo sapiens
cactgactgtttttc

SEQ ID NO: 39222 - DNA, 15 bp, Homo sapiens
ccactgactgttttt

SEQ ID NO: 39223 - DNA, 15 bp, Homo sapiens
tccactgactgtttt

SEQ ID NO: 39224 - DNA, 15 bp, Homo sapiens
atccactgactgttt

SEQ ID NO: 39225 - DNA, 15 bp, Homo sapiens
gatccactgactgtt

SEQ ID NO: 39226 - DNA, 15 bp, Homo sapiens
tgatccactgactgt

SEQ ID NO: 39227 - DNA, 15 bp, Homo sapiens
atgatccactgactg

SEQ ID NO: 39228 - DNA, 15 bp, Homo sapiens
gatgatccactgact

SEQ ID NO: 39229 - DNA, 15 bp, Homo sapiens
agatgatccactgac

SEQ ID NO: 39230 - DNA, 15 bp, Homo sapiens
aagatgatccactga

SEQ ID NO: 39231 - DNA, 15 bp, Homo sapiens
caagatgatccactg

SEQ ID NO: 39232 - DNA, 15 bp, Homo sapiens
tcaagatgatccact

SEQ ID NO: 39233 - DNA, 15 bp, Homo sapiens
atcaagatgatccac

SEQ ID NO: 39234 - DNA, 15 bp, Homo sapiens
catcaagatgatcca

SEQ ID NO: 39235 - DNA, 15 bp, Homo sapiens
tcatcaagatgatcc

SEQ ID NO: 39236 - DNA, 15 bp, Homo sapiens
atcatcaagatgatc

SEQ ID NO: 39237 - DNA, 15 bp, Homo sapiens
catcatcaagatgat

SEQ ID NO: 39238 - DNA, 15 bp, Homo sapiens
tcatcatcaagatga

SEQ ID NO: 39239 - DNA, 15 bp, Homo sapiens
atcatcatcaagatg

SEQ ID NO: 39240 - DNA, 15 bp, Homo sapiens
catcatcatcaagat

SEQ ID NO: 39241 - DNA, 15 bp, Homo sapiens
ccatcatcatcaaga

SEQ ID NO: 39242 - DNA, 15 bp, Homo sapiens
accatcatcatcaag

SEQ ID NO: 39243 - DNA, 15 bp, Homo sapiens
gaccatcatcatcaa

SEQ ID NO: 39244 - DNA, 15 bp, Homo sapiens
agaccatcatcatca

SEQ ID NO: 39245 - DNA, 15 bp, Homo sapiens
aagaccatcatcatc

SEQ ID NO: 39246 - DNA, 15 bp, Homo sapiens
caagaccatcatcat

SEQ ID NO: 39247 - DNA, 15 bp, Homo sapiens
gcaagaccatcatca

SEQ ID NO: 39248 - DNA, 15 bp, Homo sapiens
tgcaagaccatcatc

SEQ ID NO: 39249 - DNA, 15 bp, Homo sapiens
ttgcaagaccatcat

SEQ ID NO: 39250 - DNA, 15 bp, Homo sapiens
attgcaagaccatca

SEQ ID NO: 39251 - DNA, 15 bp, Homo sapiens
aattgcaagaccatc

SEQ ID NO: 39252 - DNA, 15 bp, Homo sapiens
aaattgcaagaccat

SEQ ID NO: 39253 - DNA, 15 bp, Homo sapiens
aaaattgcaagacca

SEQ ID NO: 39254 - DNA, 15 bp, Homo sapiens
caaaattgcaagacc

SEQ ID NO: 39255 - DNA, 15 bp, Homo sapiens
gcaaaattgcaagac

SEQ ID NO: 39256 - DNA, 15 bp, Homo sapiens
tgcaaaattgcaaga

SEQ ID NO: 39257 - DNA, 15 bp, Homo sapiens
ctgcaaaattgcaag

SEQ ID NO: 39258 - DNA, 15 bp, Homo sapiens
tctgcaaaattgcaa

SEQ ID NO: 39259 - DNA, 15 bp, Homo sapiens
ttctgcaaaattgca

SEQ ID NO: 39260 - DNA, 15 bp, Homo sapiens
cttctgcaaaattgc

SEQ ID NO: 39261 - DNA, 15 bp, Homo sapiens
ccttctgcaaaattg

SEQ ID NO: 39262 - DNA, 15 bp, Homo sapiens
accttctgcaaaatt

SEQ ID NO: 39263 - DNA, 15 bp, Homo sapiens
aaccttctgcaaaat

SEQ ID NO: 39264 - DNA, 15 bp, Homo sapiens
caaccttctgcaaaa

SEQ ID NO: 39265 - DNA, 15 bp, Homo sapiens
tcaaccttctgcaaa

SEQ ID NO: 39266 - DNA, 15 bp, Homo sapiens
ttcaaccttctgcaa

SEQ ID NO: 39267 - DNA, 15 bp, Homo sapiens
tttcaaccttctgca

SEQ ID NO: 39268 - DNA, 15 bp, Homo sapiens
ttttcaaccttctgc

SEQ ID NO: 39269 - DNA, 15 bp, Homo sapiens
cttttcaaccttctg

SEQ ID NO: 39270 - DNA, 15 bp, Homo sapiens
ccttttcaaccttct

SEQ ID NO: 39271 - DNA, 15 bp, Homo sapiens
gccttttcaaccttc

SEQ ID NO: 39272 - DNA, 15 bp, Homo sapiens
tgccttttcaacctt

SEQ ID NO: 39273 - DNA, 15 bp, Homo sapiens
ttgccttttcaacct

SEQ ID NO: 39274 - DNA, 15 bp, Homo sapiens
attgccttttcaacc

SEQ ID NO: 39275 - DNA, 15 bp, Homo sapiens
tattgccttttcaac

SEQ ID NO: 39276 - DNA, 15 bp, Homo sapiens
gtattgccttttcaa

SEQ ID NO: 39277 - DNA, 15 bp, Homo sapiens
tgtattgccttttca

SEQ ID NO: 39278 - DNA, 15 bp, Homo sapiens
atgtattgccttttc

SEQ ID NO: 39279 - DNA, 15 bp, Homo sapiens
tatgtattgcctttt

SEQ ID NO: 39280 - DNA, 15 bp, Homo sapiens
atatgtattgccttt

SEQ ID NO: 39281 - DNA, 15 bp, Homo sapiens
tatatgtattgcctt

SEQ ID NO: 39282 - DNA, 15 bp, Homo sapiens
ttatatgtattgcct

SEQ ID NO: 39283 - DNA, 15 bp, Homo sapiens
gttatatgtattgcc

SEQ ID NO: 39284 - DNA, 15 bp, Homo sapiens
tgttatatgtattgc

SEQ ID NO: 39285 - DNA, 15 bp, Homo sapiens
ctgttatatgtattg

SEQ ID NO: 39286 - DNA, 15 bp, Homo sapiens
tctgttatatgtatt

SEQ ID NO: 39287 - DNA, 15 bp, Homo sapiens
atctgttatatgtat

SEQ ID NO: 39288 - DNA, 15 bp, Homo sapiens
aatctgttatatgta

SEQ ID NO: 39289 - DNA, 15 bp, Homo sapiens
gaatctgttatatgt

SEQ ID NO: 39290 - DNA, 15 bp, Homo sapiens
tgaatctgttatatg

SEQ ID NO: 39291 - DNA, 15 bp, Homo sapiens
atgaatctgttatat

SEQ ID NO: 39292 - DNA, 15 bp, Homo sapiens
catgaatctgttata

SEQ ID NO: 39293 - DNA, 15 bp, Homo sapiens
acatgaatctgttat

SEQ ID NO: 39294 - DNA, 15 bp, Homo sapiens
aacatgaatctgtta

SEQ ID NO: 39295 - DNA, 15 bp, Homo sapiens
gaacatgaatctgtt

SEQ ID NO: 39296 - DNA, 15 bp, Homo sapiens
agaacatgaatctgt

SEQ ID NO: 39297 - DNA, 15 bp, Homo sapiens
aagaacatgaatctg

SEQ ID NO: 39298 - DNA, 15 bp, Homo sapiens
aaagaacatgaatct

SEQ ID NO: 39299 - DNA, 15 bp, Homo sapiens
gaaagaacatgaatc

SEQ ID NO: 39300 - DNA, 15 bp, Homo sapiens
agaaagaacatgaat

SEQ ID NO: 39301 - DNA, 15 bp, Homo sapiens
tagaaagaacatgaa

SEQ ID NO: 39302 - DNA, 15 bp, Homo sapiens
atagaaagaacatga

SEQ ID NO: 39303 - DNA, 15 bp, Homo sapiens
aatagaaagaacatg

SEQ ID NO: 39304 - DNA, 15 bp, Homo sapiens
caatagaaagaacat

SEQ ID NO: 39305 - DNA, 15 bp, Homo sapiens
tcaatagaaagaaca

SEQ ID NO: 39306 - DNA, 15 bp, Homo sapiens
ttcaatagaaagaac

SEQ ID NO: 39307 - DNA, 15 bp, Homo sapiens
tttcaatagaaagaa

SEQ ID NO: 39308 - DNA, 15 bp, Homo sapiens
atttcaatagaaaga

SEQ ID NO: 39309 - DNA, 15 bp, Homo sapiens
catttcaatagaaag

SEQ ID NO: 39310 - DNA, 15 bp, Homo sapiens
ccatttcaatagaaa

SEQ ID NO: 39311 - DNA, 15 bp, Homo sapiens
tccatttcaatagaa

SEQ ID NO: 39312 - DNA, 15 bp, Homo sapiens
gtccatttcaataga

SEQ ID NO: 39313 - DNA, 15 bp, Homo sapiens
tgtccatttcaatag

SEQ ID NO: 39314 - DNA, 15 bp, Homo sapiens
ttgtccatttcaata

SEQ ID NO: 39315 - DNA, 15 bp, Homo sapiens
cttgtccatttcaat

SEQ ID NO: 39316 - DNA, 15 bp, Homo sapiens
acttgtccatttcaa

SEQ ID NO: 39317 - DNA, 15 bp, Homo sapiens
aacttgtccatttca

SEQ ID NO: 39318 - DNA, 15 bp, Homo sapiens
taacttgtccatttc

SEQ ID NO: 39319 - DNA, 15 bp, Homo sapiens
ctaacttgtccattt

SEQ ID NO: 39320 - DNA, 15 bp, Homo sapiens
tctaacttgtccatt

SEQ ID NO: 39321 - DNA, 15 bp, Homo sapiens
ctctaacttgtccat

SEQ ID NO: 39322 - DNA, 15 bp, Homo sapiens
cctctaacttgtcca

SEQ ID NO: 39323 - DNA, 15 bp, Homo sapiens
acctctaacttgtcc

SEQ ID NO: 39324 - DNA, 15 bp, Homo sapiens
gacctctaacttgtc

SEQ ID NO: 39325 - DNA, 15 bp, Homo sapiens
agacctctaacttgt

SEQ ID NO: 39326 - DNA, 15 bp, Homo sapiens
tagacctctaacttg

SEQ ID NO: 39327 - DNA, 15 bp, Homo sapiens
ctagacctctaactt

SEQ ID NO: 39328 - DNA, 15 bp, Homo sapiens
tctagacctctaact

SEQ ID NO: 39329 - DNA, 15 bp, Homo sapiens
atctagacctctaac

SEQ ID NO: 39330 - DNA, 15 bp, Homo sapiens
aatctagacctctaa

SEQ ID NO: 39331 - DNA, 15 bp, Homo sapiens
caatctagacctcta

SEQ ID NO: 39332 - DNA, 15 bp, Homo sapiens
tcaatctagacctct

SEQ ID NO: 39333 - DNA, 15 bp, Homo sapiens
ttcaatctagacctc

SEQ ID NO: 39334 - DNA, 15 bp, Homo sapiens
attcaatctagacct

SEQ ID NO: 39335 - DNA, 15 bp, Homo sapiens
tattcaatctagacc

SEQ ID NO: 39336 - DNA, 15 bp, Homo sapiens
gtattcaatctagac

SEQ ID NO: 39337 - DNA, 15 bp, Homo sapiens
tgtattcaatctaga

SEQ ID NO: 39338 - DNA, 15 bp, Homo sapiens
gtgtattcaatctag

SEQ ID NO: 39339 - DNA, 15 bp, Homo sapiens
agtgtattcaatcta

SEQ ID NO: 39340 - DNA, 15 bp, Homo sapiens
gagtgtattcaatct

SEQ ID NO: 39341 - DNA, 15 bp, Homo sapiens
agagtgtattcaatc

SEQ ID NO: 39342 - DNA, 15 bp, Homo sapiens
cagagtgtattcaat

SEQ ID NO: 39343 - DNA, 15 bp, Homo sapiens
acagagtgtattcaa

SEQ ID NO: 39344 - DNA, 15 bp, Homo sapiens
cacagagtgtattca

SEQ ID NO: 39345 - DNA, 15 bp, Homo sapiens
acacagagtgtattc

SEQ ID NO: 39346 - DNA, 15 bp, Homo sapiens
aacacagagtgtatt

SEQ ID NO: 39347 - DNA, 15 bp, Homo sapiens
aaacacagagtgtat

SEQ ID NO: 39348 - DNA, 15 bp, Homo sapiens
taaacacagagtgta

SEQ ID NO: 39349 - DNA, 15 bp, Homo sapiens
ctaaacacagagtgt

SEQ ID NO: 39350 - DNA, 15 bp, Homo sapiens
tctaaacacagagtg

SEQ ID NO: 39351 - DNA, 15 bp, Homo sapiens
gtctaaacacagagt

SEQ ID NO: 39352 - DNA, 15 bp, Homo sapiens
agtctaaacacagag

SEQ ID NO: 39353 - DNA, 15 bp, Homo sapiens
aagtctaaacacaga

SEQ ID NO: 39354 - DNA, 15 bp, Homo sapiens
taagtctaaacacag

SEQ ID NO: 39355 - DNA, 15 bp, Homo sapiens
ttaagtctaaacaca

SEQ ID NO: 39356 - DNA, 15 bp, Homo sapiens
attaagtctaaacac

SEQ ID NO: 39357 - DNA, 15 bp, Homo sapiens
tattaagtctaaaca

SEQ ID NO: 39358 - DNA, 15 bp, Homo sapiens
ttattaagtctaaac

SEQ ID NO: 39359 - DNA, 15 bp, Homo sapiens
tttattaagtctaaa

SEQ ID NO: 39360 - DNA, 15 bp, Homo sapiens
gtttattaagtctaa

SEQ ID NO: 39361 - DNA, 15 bp, Homo sapiens
tgtttattaagtcta

SEQ ID NO: 39362 - DNA, 15 bp, Homo sapiens
gtgtttattaagtct

SEQ ID NO: 39363 - DNA, 15 bp, Homo sapiens
agtgtttattaagtc

SEQ ID NO: 39364 - DNA, 15 bp, Homo sapiens
aagtgtttattaagt

SEQ ID NO: 39365 - DNA, 15 bp, Homo sapiens
aaagtgtttattaag

SEQ ID NO: 39366 - DNA, 15 bp, Homo sapiens
gaaagtgtttattaa

SEQ ID NO: 39367 - DNA, 15 bp, Homo sapiens
tgaaagtgtttatta

SEQ ID NO: 39368 - DNA, 15 bp, Homo sapiens
ttgaaagtgtttatt

SEQ ID NO: 39369 - DNA, 15 bp, Homo sapiens
attgaaagtgtttat

SEQ ID NO: 39370 - DNA, 15 bp, Homo sapiens
tattgaaagtgttta

SEQ ID NO: 39371 - DNA, 15 bp, Homo sapiens
ttattgaaagtgttt

SEQ ID NO: 39372 - DNA, 15 bp, Homo sapiens
cttattgaaagtgtt

SEQ ID NO: 39373 - DNA, 15 bp, Homo sapiens
gcttattgaaagtgt

SEQ ID NO: 39374 - DNA, 15 bp, Homo sapiens
agcttattgaaagtg

SEQ ID NO: 39375 - DNA, 15 bp, Homo sapiens
aagcttattgaaagt

SEQ ID NO: 39376 - DNA, 15 bp, Homo sapiens
taagcttattgaaag

SEQ ID NO: 39377 - DNA, 15 bp, Homo sapiens
ataagcttattgaaa

SEQ ID NO: 39378 - DNA, 15 bp, Homo sapiens
aataagcttattgaa

SEQ ID NO: 39379 - DNA, 15 bp, Homo sapiens
gaataagcttattga

SEQ ID NO: 39380 - DNA, 15 bp, Homo sapiens
tgaataagcttattg

SEQ ID NO: 39381 - DNA, 15 bp, Homo sapiens
ttgaataagcttatt

SEQ ID NO: 39382 - DNA, 15 bp, Homo sapiens
attgaataagcttat

SEQ ID NO: 39383 - DNA, 15 bp, Homo sapiens
tattgaataagctta

SEQ ID NO: 39384 - DNA, 15 bp, Homo sapiens
atattgaataagctt

SEQ ID NO: 39385 - DNA, 15 bp, Homo sapiens
aatattgaataagct

SEQ ID NO: 39386 - DNA, 15 bp, Homo sapiens
aaatattgaataagc

SEQ ID NO: 39387 - DNA, 15 bp, Homo sapiens
aaaatattgaataag

SEQ ID NO: 39388 - DNA, 15 bp, Homo sapiens
aaaaatattgaataa

SEQ ID NO: 39389 - DNA, 15 bp, Homo sapiens
aaaaaatattgaata

SEQ ID NO: 39390 - DNA, 15 bp, Homo sapiens
taaaaaatattgaat

SEQ ID NO: 39391 - DNA, 15 bp, Homo sapiens
ttaaaaaatattgaa

SEQ ID NO: 39392 - DNA, 15 bp, Homo sapiens
tttaaaaaatattga

SEQ ID NO: 39393 - DNA, 15 bp, Homo sapiens
atttaaaaaatattg

SEQ ID NO: 39394 - DNA, 15 bp, Homo sapiens
aatttaaaaaatatt

SEQ ID NO: 39395 - DNA, 15 bp, Homo sapiens
caatttaaaaaatat

SEQ ID NO: 39396 - DNA, 15 bp, Homo sapiens
tcaatttaaaaaata

SEQ ID NO: 39397 - DNA, 15 bp, Homo sapiens
gtcaatttaaaaaat

SEQ ID NO: 39398 - DNA, 15 bp, Homo sapiens
tgtcaatttaaaaaa

SEQ ID NO: 39399 - DNA, 15 bp, Homo sapiens
ttgtcaatttaaaaa

SEQ ID NO: 39400 - DNA, 15 bp, Homo sapiens
gttgtcaatttaaaa

SEQ ID NO: 39401 - DNA, 15 bp, Homo sapiens
ggttgtcaatttaaa

SEQ ID NO: 39402 - DNA, 15 bp, Homo sapiens
aggttgtcaatttaa

SEQ ID NO: 39403 - DNA, 15 bp, Homo sapiens
caggttgtcaattta

SEQ ID NO: 39404 - DNA, 15 bp, Homo sapiens
acaggttgtcaattt

SEQ ID NO: 39405 - DNA, 15 bp, Homo sapiens
tacaggttgtcaatt

SEQ ID NO: 39406 - DNA, 15 bp, Homo sapiens
atacaggttgtcaat

SEQ ID NO: 39407 - DNA, 15 bp, Homo sapiens
aatacaggttgtcaa

SEQ ID NO: 39408 - DNA, 15 bp, Homo sapiens
caatacaggttgtca

SEQ ID NO: 39409 - DNA, 15 bp, Homo sapiens
ccaatacaggttgtc

SEQ ID NO: 39410 - DNA, 15 bp, Homo sapiens
cccaatacaggttgt

SEQ ID NO: 39411 - DNA, 15 bp, Homo sapiens
tcccaatacaggttg

SEQ ID NO: 39412 - DNA, 15 bp, Homo sapiens
ttcccaatacaggtt

SEQ ID NO: 39413 - DNA, 15 bp, Homo sapiens
gttcccaatacaggt

SEQ ID NO: 39414 - DNA, 15 bp, Homo sapiens
agttcccaatacagg

SEQ ID NO: 39415 - DNA, 15 bp, Homo sapiens
cagttcccaatacag

SEQ ID NO: 39416 - DNA, 15 bp, Homo sapiens
gcagttcccaataca

SEQ ID NO: 39417 - DNA, 15 bp, Homo sapiens
tgcagttcccaatac

SEQ ID NO: 39418 - DNA, 15 bp, Homo sapiens
atgcagttcccaata

SEQ ID NO: 39419 - DNA, 15 bp, Homo sapiens
tatgcagttcccaat

SEQ ID NO: 39420 - DNA, 15 bp, Homo sapiens
atatgcagttcccaa

SEQ ID NO: 39421 - DNA, 15 bp, Homo sapiens
tatatgcagttccca

SEQ ID NO: 39422 - DNA, 15 bp, Homo sapiens
gtatatgcagttccc

SEQ ID NO: 39423 - DNA, 15 bp, Homo sapiens
agtatatgcagttcc

SEQ ID NO: 39424 - DNA, 15 bp, Homo sapiens
tagtatatgcagttc

SEQ ID NO: 39425 - DNA, 15 bp, Homo sapiens
atagtatatgcagtt

SEQ ID NO: 39426 - DNA, 15 bp, Homo sapiens
tatagtatatgcagt

SEQ ID NO: 39427 - DNA, 15 bp, Homo sapiens
ctatagtatatgcag

SEQ ID NO: 39428 - DNA, 15 bp, Homo sapiens
tctatagtatatgca

SEQ ID NO: 39429 - DNA, 15 bp, Homo sapiens
ctctatagtatatgc

SEQ ID NO: 39430 - DNA, 15 bp, Homo sapiens
tctctatagtatatg

SEQ ID NO: 39431 - DNA, 15 bp, Homo sapiens
atctctatagtatat

SEQ ID NO: 39432 - DNA, 15 bp, Homo sapiens
gatctctatagtata

SEQ ID NO: 39433 - DNA, 15 bp, Homo sapiens
tgatctctatagtat

SEQ ID NO: 39434 - DNA, 15 bp, Homo sapiens
ttgatctctatagta

SEQ ID NO: 39435 - DNA, 15 bp, Homo sapiens
tttgatctctatagt

SEQ ID NO: 39436 - DNA, 15 bp, Homo sapiens
ctttgatctctatag

SEQ ID NO: 39437 - DNA, 15 bp, Homo sapiens
actttgatctctata

SEQ ID NO: 39438 - DNA, 15 bp, Homo sapiens
aactttgatctctat

SEQ ID NO: 39439 - DNA, 15 bp, Homo sapiens
caactttgatctcta

SEQ ID NO: 39440 - DNA, 15 bp, Homo sapiens
tcaactttgatctct

SEQ ID NO: 39441 - DNA, 15 bp, Homo sapiens
gtcaactttgatctc

SEQ ID NO: 39442 - DNA, 15 bp, Homo sapiens
tgtcaactttgatct

SEQ ID NO: 39443 - DNA, 15 bp, Homo sapiens
atgtcaactttgatc

SEQ ID NO: 39444 - DNA, 15 bp, Homo sapiens
aatgtcaactttgat

SEQ ID NO: 39445 - DNA, 15 bp, Homo sapiens
aaatgtcaactttga

SEQ ID NO: 39446 - DNA, 15 bp, Homo sapiens
gaaatgtcaactttg

SEQ ID NO: 39447 - DNA, 15 bp, Homo sapiens
agaaatgtcaacttt

SEQ ID NO: 39448 - DNA, 15 bp, Homo sapiens
aagaaatgtcaactt

SEQ ID NO: 39449 - DNA, 15 bp, Homo sapiens
caagaaatgtcaact

SEQ ID NO: 39450 - DNA, 15 bp, Homo sapiens
gcaagaaatgtcaac

SEQ ID NO: 39451 - DNA, 15 bp, Homo sapiens
ggcaagaaatgtcaa

SEQ ID NO: 39452 - DNA, 15 bp, Homo sapiens
gggcaagaaatgtca

SEQ ID NO: 39453 - DNA, 15 bp, Homo sapiens
agggcaagaaatgtc

SEQ ID NO: 39454 - DNA, 15 bp, Homo sapiens
gagggcaagaaatgt

SEQ ID NO: 39455 - DNA, 15 bp, Homo sapiens
agagggcaagaaatg

SEQ ID NO: 39456 - DNA, 15 bp, Homo sapiens
aagagggcaagaaat

SEQ ID NO: 39457 - DNA, 15 bp, Homo sapiens
caagagggcaagaaa

SEQ ID NO: 39458 - DNA, 15 bp, Homo sapiens
ccaagagggcaagaa

SEQ ID NO: 39459 - DNA, 15 bp, Homo sapiens
cccaagagggcaaga

SEQ ID NO: 39460 - DNA, 15 bp, Homo sapiens
gcccaagagggcaag

SEQ ID NO: 39461 - DNA, 15 bp, Homo sapiens
agcccaagagggcaa

SEQ ID NO: 39462 - DNA, 15 bp, Homo sapiens
aagcccaagagggca

SEQ ID NO: 39463 - DNA, 15 bp, Homo sapiens
taagcccaagagggc

SEQ ID NO: 39464 - DNA, 15 bp, Homo sapiens
gtaagcccaagaggg

SEQ ID NO: 39465 - DNA, 15 bp, Homo sapiens
ggtaagcccaagagg

SEQ ID NO: 39466 - DNA, 15 bp, Homo sapiens
gggtaagcccaagag

SEQ ID NO: 39467 - DNA, 15 bp, Homo sapiens
tgggtaagcccaaga

SEQ ID NO: 39468 - DNA, 15 bp, Homo sapiens
ttgggtaagcccaag

SEQ ID NO: 39469 - DNA, 15 bp, Homo sapiens
tttgggtaagcccaa

SEQ ID NO: 39470 - DNA, 15 bp, Homo sapiens
ttttgggtaagccca

SEQ ID NO: 39471 - DNA, 15 bp, Homo sapiens
gttttgggtaagccc

SEQ ID NO: 39472 - DNA, 15 bp, Homo sapiens
tgttttgggtaagcc

SEQ ID NO: 39473 - DNA, 15 bp, Homo sapiens
ttgttttgggtaagc

SEQ ID NO: 39474 - DNA, 15 bp, Homo sapiens
attgttttgggtaag

SEQ ID NO: 39475 - DNA, 15 bp, Homo sapiens
tattgttttgggtaa

SEQ ID NO: 39476 - DNA, 15 bp, Homo sapiens
atattgttttgggta

SEQ ID NO: 39477 - DNA, 15 bp, Homo sapiens
catattgttttgggt

SEQ ID NO: 39478 - DNA, 15 bp, Homo sapiens
acatattgttttggg

SEQ ID NO: 39479 - DNA, 15 bp, Homo sapiens
tacatattgttttgg

SEQ ID NO: 39480 - DNA, 15 bp, Homo sapiens
ttacatattgttttg

SEQ ID NO: 39481 - DNA, 15 bp, Homo sapiens
attacatattgtttt

SEQ ID NO: 39482 - DNA, 15 bp, Homo sapiens
gattacatattgttt

SEQ ID NO: 39483 - DNA, 15 bp, Homo sapiens
tgattacatattgtt

SEQ ID NO: 39484 - DNA, 15 bp, Homo sapiens
ttgattacatattgt

SEQ ID NO: 39485 - DNA, 15 bp, Homo sapiens
tttgattacatattg

SEQ ID NO: 39486 - DNA, 15 bp, Homo sapiens
atttgattacatatt

SEQ ID NO: 39487 - DNA, 15 bp, Homo sapiens
aatttgattacatat

SEQ ID NO: 39488 - DNA, 15 bp, Homo sapiens
taatttgattacata

SEQ ID NO: 39489 - DNA, 15 bp, Homo sapiens
ttaatttgattacat

SEQ ID NO: 39490 - DNA, 15 bp, Homo sapiens
cttaatttgattaca

SEQ ID NO: 39491 - DNA, 15 bp, Homo sapiens
tcttaatttgattac

SEQ ID NO: 39492 - DNA, 15 bp, Homo sapiens
atcttaatttgatta

SEQ ID NO: 39493 - DNA, 15 bp, Homo sapiens
tatcttaatttgatt

SEQ ID NO: 39494 - DNA, 15 bp, Homo sapiens
ttatcttaatttgat

SEQ ID NO: 39495 - DNA, 15 bp, Homo sapiens
cttatcttaatttga

SEQ ID NO: 39496 - DNA, 15 bp, Homo sapiens
acttatcttaatttg

SEQ ID NO: 39497 - DNA, 15 bp, Homo sapiens
tacttatcttaattt

SEQ ID NO: 39498 - DNA, 15 bp, Homo sapiens
gtacttatcttaatt

SEQ ID NO: 39499 - DNA, 15 bp, Homo sapiens
agtacttatcttaat

SEQ ID NO: 39500 - DNA, 15 bp, Homo sapiens
cagtacttatcttaa

SEQ ID NO: 39501 - DNA, 15 bp, Homo sapiens
ccagtacttatctta

SEQ ID NO: 39502 - DNA, 15 bp, Homo sapiens
cccagtacttatctt

SEQ ID NO: 39503 - DNA, 15 bp, Homo sapiens
acccagtacttatct

SEQ ID NO: 39504 - DNA, 15 bp, Homo sapiens
cacccagtacttatc

SEQ ID NO: 39505 - DNA, 15 bp, Homo sapiens
gcacccagtacttat

SEQ ID NO: 39506 - DNA, 15 bp, Homo sapiens
tgcacccagtactta

SEQ ID NO: 39507 - DNA, 15 bp, Homo sapiens
gtgcacccagtactt

SEQ ID NO: 39508 - DNA, 15 bp, Homo sapiens
tgtgcacccagtact

SEQ ID NO: 39509 - DNA, 15 bp, Homo sapiens
ttgtgcacccagtac

SEQ ID NO: 39510 - DNA, 15 bp, Homo sapiens
cttgtgcacccagta

SEQ ID NO: 39511 - DNA, 15 bp, Homo sapiens
ccttgtgcacccagt

SEQ ID NO: 39512 - DNA, 15 bp, Homo sapiens
tccttgtgcacccag

SEQ ID NO: 39513 - DNA, 15 bp, Homo sapiens
ttccttgtgcaccca

SEQ ID NO: 39514 - DNA, 15 bp, Homo sapiens
cttccttgtgcaccc

SEQ ID NO: 39515 - DNA, 15 bp, Homo sapiens
ccttccttgtgcacc

SEQ ID NO: 39516 - DNA, 15 bp, Homo sapiens
tccttccttgtgcac

SEQ ID NO: 39517 - DNA, 15 bp, Homo sapiens
ttccttccttgtgca

SEQ ID NO: 39518 - DNA, 15 bp, Homo sapiens
tttccttccttgtgc

SEQ ID NO: 39519 - DNA, 15 bp, Homo sapiens
ttttccttccttgtg

SEQ ID NO: 39520 - DNA, 15 bp, Homo sapiens
gttttccttccttgt

SEQ ID NO: 39521 - DNA, 15 bp, Homo sapiens
ctgttttccttcctt

SEQ ID NO: 39522 - DNA, 15 bp, Homo sapiens
cctgttttccttcct

SEQ ID NO: 39523 - DNA, 15 bp, Homo sapiens
acctgttttccttcc

SEQ ID NO: 39524 - DNA, 15 bp, Homo sapiens
aacctgttttccttc

SEQ ID NO: 39525 - DNA, 15 bp, Homo sapiens
caacctgttttcctt

SEQ ID NO: 39526 - DNA, 15 bp, Homo sapiens
gcaacctgttttcct

SEQ ID NO: 39527 - DNA, 15 bp, Homo sapiens
ggcaacctgttttcc

SEQ ID NO: 39528 - DNA, 15 bp, Homo sapiens
aggcaacctgttttc

SEQ ID NO: 39529 - DNA, 15 bp, Homo sapiens
aaggcaacctgtttt

SEQ ID NO: 39530 - DNA, 15 bp, Homo sapiens
aaaggcaacctgttt

SEQ ID NO: 39531 - DNA, 15 bp, Homo sapiens
taaaggcaacctgtt

SEQ ID NO: 39532 - DNA, 15 bp, Homo sapiens
ctaaaggcaacctgt

SEQ ID NO: 39533 - DNA, 15 bp, Homo sapiens
tctaaaggcaacctg

SEQ ID NO: 39534 - DNA, 15 bp, Homo sapiens
ctctaaaggcaacct

SEQ ID NO: 39535 - DNA, 15 bp, Homo sapiens
tctctaaaggcaacc

SEQ ID NO: 39536 - DNA, 15 bp, Homo sapiens
gtctctaaaggcaac

SEQ ID NO: 39537 - DNA, 15 bp, Homo sapiens
agtctctaaaggcaa

SEQ ID NO: 39538 - DNA, 15 bp, Homo sapiens
cagtctctaaaggca

SEQ ID NO: 39539 - DNA, 15 bp, Homo sapiens
ccagtctctaaaggc

SEQ ID NO: 39540 - DNA, 15 bp, Homo sapiens
tccagtctctaaagg

SEQ ID NO: 39541 - DNA, 15 bp, Homo sapiens
ctccagtctctaaag

SEQ ID NO: 39542 - DNA, 15 bp, Homo sapiens
cctccagtctctaaa

SEQ ID NO: 39543 - DNA, 15 bp, Homo sapiens
tcctccagtctctaa

SEQ ID NO: 39544 - DNA, 15 bp, Homo sapiens
ctcctccagtctcta

SEQ ID NO: 39545 - DNA, 15 bp, Homo sapiens
actcctccagtctct

SEQ ID NO: 39546 - DNA, 15 bp, Homo sapiens
gactcctccagtctc

SEQ ID NO: 39547 - DNA, 15 bp, Homo sapiens
cgactcctccagtct

SEQ ID NO: 39548 - DNA, 15 bp, Homo sapiens
acgactcctccagtc

SEQ ID NO: 39549 - DNA, 15 bp, Homo sapiens
gacgactcctccagt

SEQ ID NO: 39550 - DNA, 15 bp, Homo sapiens
ggacgactcctccag

SEQ ID NO: 39551 - DNA, 15 bp, Homo sapiens
tggacgactcctcca

SEQ ID NO: 39552 - DNA, 15 bp, Homo sapiens
ctggacgactcctcc

SEQ ID NO: 39553 - DNA, 15 bp, Homo sapiens
tctggacgactcctc

SEQ ID NO: 39554 - DNA, 15 bp, Homo sapiens
ttctggacgactcct

SEQ ID NO: 39555 - DNA, 15 bp, Homo sapiens
cttctggacgactcc

SEQ ID NO: 39556 - DNA, 15 bp, Homo sapiens
acttctggacgactc

SEQ ID NO: 39557 - DNA, 15 bp, Homo sapiens
gacttctggacgact

SEQ ID NO: 39558 - DNA, 15 bp, Homo sapiens
ggacttctggacgac

SEQ ID NO: 39559 - DNA, 15 bp, Homo sapiens
cggacttctggacga

SEQ ID NO: 39560 - DNA, 15 bp, Homo sapiens
gcggacttctggacg

SEQ ID NO: 39561 - DNA, 15 bp, Homo sapiens
agcggacttctggac

SEQ ID NO: 39562 - DNA, 15 bp, Homo sapiens
gagcggacttctgga

SEQ ID NO: 39563 - DNA, 15 bp, Homo sapiens
agagcggacttctgg

SEQ ID NO: 39564 - DNA, 15 bp, Homo sapiens
cagagcggacttctg

SEQ ID NO: 39565 - DNA, 15 bp, Homo sapiens
tcagagcggacttct

SEQ ID NO: 39566 - DNA, 15 bp, Homo sapiens
ttcagagcggacttc

SEQ ID NO: 39567 - DNA, 15 bp, Homo sapiens
cttcagagcggactt

SEQ ID NO: 39568 - DNA, 15 bp, Homo sapiens
tcttcagagcggact

SEQ ID NO: 39569 - DNA, 15 bp, Homo sapiens
ctcttcagagcggac

SEQ ID NO: 39570 - DNA, 15 bp, Homo sapiens
tctcttcagagcgga

SEQ ID NO: 39571 - DNA, 15 bp, Homo sapiens
ttctcttcagagcgg

SEQ ID NO: 39572 - DNA, 15 bp, Homo sapiens
cttctcttcagagcg

SEQ ID NO: 39573 - DNA, 15 bp, Homo sapiens
tcttctcttcagagc

SEQ ID NO: 39574 - DNA, 15 bp, Homo sapiens
atcttctcttcagag

SEQ ID NO: 39575 - DNA, 15 bp, Homo sapiens
catcttctcttcaga

SEQ ID NO: 39576 - DNA, 15 bp, Homo sapiens
acatcttctcttcag

SEQ ID NO: 39577 - DNA, 15 bp, Homo sapiens
aacatcttctcttca

SEQ ID NO: 39578 - DNA, 15 bp, Homo sapiens
aaacatcttctcttc

SEQ ID NO: 39579 - DNA, 15 bp, Homo sapiens
taaacatcttctctt

SEQ ID NO: 39580 - DNA, 15 bp, Homo sapiens
ttaaacatcttctct

SEQ ID NO: 39581 - DNA, 15 bp, Homo sapiens
tttaaacatcttctc

SEQ ID NO: 39582 - DNA, 15 bp, Homo sapiens
ttttaaacatcttct

SEQ ID NO: 39583 - DNA, 15 bp, Homo sapiens
attttaaacatcttc

SEQ ID NO: 39584 - DNA, 15 bp, Homo sapiens
aattttaaacatctt

SEQ ID NO: 39585 - DNA, 15 bp, Homo sapiens
taattttaaacatct

SEQ ID NO: 39586 - DNA, 15 bp, Homo sapiens
ttaattttaaacatc

SEQ ID NO: 39587 - DNA, 15 bp, Homo sapiens
tttaattttaaacat

SEQ ID NO: 39588 - DNA, 15 bp, Homo sapiens
gtttaattttaaaca

SEQ ID NO: 39589 - DNA, 15 bp, Homo sapiens
ggtttaattttaaac

SEQ ID NO: 39590 - DNA, 15 bp, Homo sapiens
aggtttaattttaaa

SEQ ID NO: 39591 - DNA, 15 bp, Homo sapiens
caggtttaattttaa

SEQ ID NO: 39592 - DNA, 15 bp, Homo sapiens
gcaggtttaatttta

SEQ ID NO: 39593 - DNA, 15 bp, Homo sapiens
tgcaggtttaatttt

SEQ ID NO: 39594 - DNA, 15 bp, Homo sapiens
ttgcaggtttaattt

SEQ ID NO: 39595 - DNA, 15 bp, Homo sapiens
attgcaggtttaatt

SEQ ID NO: 39596 - DNA, 15 bp, Homo sapiens
cattgcaggtttaat

SEQ ID NO: 39597 - DNA, 15 bp, Homo sapiens
acattgcaggtttaa

SEQ ID NO: 39598 - DNA, 15 bp, Homo sapiens
aacattgcaggttta

SEQ ID NO: 39599 - DNA, 15 bp, Homo sapiens
gaacattgcaggttt

SEQ ID NO: 39600 - DNA, 15 bp, Homo sapiens
cgaacattgcaggtt

SEQ ID NO: 39601 - DNA, 15 bp, Homo sapiens
acgaacattgcaggt

SEQ ID NO: 39602 - DNA, 15 bp, Homo sapiens
gacgaacattgcagg

SEQ ID NO: 39603 - DNA, 15 bp, Homo sapiens
agacgaacattgcag

SEQ ID NO: 39604 - DNA, 15 bp, Homo sapiens
cagacgaacattgca

SEQ ID NO: 39605 - DNA, 15 bp, Homo sapiens
tcagacgaacattgc

SEQ ID NO: 39606 - DNA, 15 bp, Homo sapiens
ttcagacgaacattg

SEQ ID NO: 39607 - DNA, 15 bp, Homo sapiens
attcagacgaacatt

SEQ ID NO: 39608 - DNA, 15 bp, Homo sapiens
aattcagacgaacat

SEQ ID NO: 39609 - DNA, 15 bp, Homo sapiens
taattcagacgaaca

SEQ ID NO: 39610 - DNA, 15 bp, Homo sapiens
ttaattcagacgaac

SEQ ID NO: 39611 - DNA, 15 bp, Homo sapiens
cttaattcagacgaa

SEQ ID NO: 39612 - DNA, 15 bp, Homo sapiens
gcttaattcagacga

SEQ ID NO: 39613 - DNA, 15 bp, Homo sapiens
tgcttaattcagacg

SEQ ID NO: 39614 - DNA, 15 bp, Homo sapiens
ctgcttaattcagac

SEQ ID NO: 39615 - DNA, 15 bp, Homo sapiens
cctgcttaattcaga

SEQ ID NO: 39616 - DNA, 15 bp, Homo sapiens
acctgcttaattcag

SEQ ID NO: 39617 - DNA, 15 bp, Homo sapiens
aacctgcttaattca

SEQ ID NO: 39618 - DNA, 15 bp, Homo sapiens
caacctgcttaattc

SEQ ID NO: 39619 - DNA, 15 bp, Homo sapiens
tcaacctgcttaatt

SEQ ID NO: 39620 - DNA, 15 bp, Homo sapiens
ctcaacctgcttaat

SEQ ID NO: 39621 - DNA, 15 bp, Homo sapiens
tctcaacctgcttaa

SEQ ID NO: 39622 - DNA, 15 bp, Homo sapiens
ttctcaacctgctta

SEQ ID NO: 39623 - DNA, 15 bp, Homo sapiens
gttctcaacctgctt

SEQ ID NO: 39624 - DNA, 15 bp, Homo sapiens
tgttctcaacctgct

SEQ ID NO: 39625 - DNA, 15 bp, Homo sapiens
ctgttctcaacctgc

SEQ ID NO: 39626 - DNA, 15 bp, Homo sapiens
cctgttctcaacctg

SEQ ID NO: 39627 - DNA, 15 bp, Homo sapiens
ccctgttctcaacct

SEQ ID NO: 39628 - DNA, 15 bp, Homo sapiens
accctgttctcaacc

SEQ ID NO: 39629 - DNA, 15 bp, Homo sapiens
caccctgttctcaac

SEQ ID NO: 39630 - DNA, 15 bp, Homo sapiens
tcaccctgttctcaa

SEQ ID NO: 39631 - DNA, 15 bp, Homo sapiens
ttcaccctgttctca

SEQ ID NO: 39632 - DNA, 15 bp, Homo sapiens
cttcaccctgttctc

SEQ ID NO: 39633 - DNA, 15 bp, Homo sapiens
ccttcaccctgttct

SEQ ID NO: 39634 - DNA, 15 bp, Homo sapiens
tccttcaccctgttc

SEQ ID NO: 39635 - DNA, 15 bp, Homo sapiens
ctccttcaccctgtt

SEQ ID NO: 39636 - DNA, 15 bp, Homo sapiens
cctccttcaccctgt

SEQ ID NO: 39637 - DNA, 15 bp, Homo sapiens
gcctccttcaccctg

SEQ ID NO: 39638 - DNA, 15 bp, Homo sapiens
tgcctccttcaccct

SEQ ID NO: 39639 - DNA, 15 bp, Homo sapiens
ctgcctccttcaccc

SEQ ID NO: 39640 - DNA, 15 bp, Homo sapiens
cctgcctccttcacc

SEQ ID NO: 39641 - DNA, 15 bp, Homo sapiens
gcctgcctccttcac

SEQ ID NO: 39642 - DNA, 15 bp, Homo sapiens
tgcctgcctccttca

SEQ ID NO: 39643 - DNA, 15 bp, Homo sapiens
atgcctgcctccttc

SEQ ID NO: 39644 - DNA, 15 bp, Homo sapiens
tatgcctgcctcctt

SEQ ID NO: 39645 - DNA, 15 bp, Homo sapiens
ctatgcctgcctcct

SEQ ID NO: 39646 - DNA, 15 bp, Homo sapiens
gctatgcctgcctcc

SEQ ID NO: 39647 - DNA, 15 bp, Homo sapiens
tgctatgcctgcctc

SEQ ID NO: 39648 - DNA, 15 bp, Homo sapiens
ctgctatgcctgcct

SEQ ID NO: 39649 - DNA, 15 bp, Homo sapiens
gctgctatgcctgcc

SEQ ID NO: 39650 - DNA, 15 bp, Homo sapiens
tgctgctatgcctgc

SEQ ID NO: 39651 - DNA, 15 bp, Homo sapiens
atgctgctatgcctg

SEQ ID NO: 39652 - DNA, 15 bp, Homo sapiens
catgctgctatgcct

SEQ ID NO: 39653 - DNA, 15 bp, Homo sapiens
tcatgctgctatgcc

SEQ ID NO: 39654 - DNA, 15 bp, Homo sapiens
ttcatgctgctatgc

SEQ ID NO: 39655 - DNA, 15 bp, Homo sapiens
gttcatgctgctatg

SEQ ID NO: 39656 - DNA, 15 bp, Homo sapiens
ggttcatgctgctat

SEQ ID NO: 39657 - DNA, 15 bp, Homo sapiens
tggttcatgctgcta

SEQ ID NO: 39658 - DNA, 15 bp, Homo sapiens
ttggttcatgctgct

SEQ ID NO: 39659 - DNA, 15 bp, Homo sapiens
attggttcatgctgc

SEQ ID NO: 39660 - DNA, 15 bp, Homo sapiens
tattggttcatgctg

SEQ ID NO: 39661 - DNA, 15 bp, Homo sapiens
atattggttcatgct

SEQ ID NO: 39662 - DNA, 15 bp, Homo sapiens
gatattggttcatgc

SEQ ID NO: 39663 - DNA, 15 bp, Homo sapiens
ggatattggttcatg

SEQ ID NO: 39664 - DNA, 15 bp, Homo sapiens
gggatattggttcat

SEQ ID NO: 39665 - DNA, 15 bp, Homo sapiens
cgggatattggttca

SEQ ID NO: 39666 - DNA, 15 bp, Homo sapiens
tcgggatattggttc

SEQ ID NO: 39667 - DNA, 15 bp, Homo sapiens
ctcgggatattggtt

SEQ ID NO: 39668 - DNA, 15 bp, Homo sapiens
cctcgggatattggt

SEQ ID NO: 39669 - DNA, 15 bp, Homo sapiens
gcctcgggatattgg

SEQ ID NO: 39670 - DNA, 15 bp, Homo sapiens
tgcctcgggatattg

SEQ ID NO: 39671 - DNA, 15 bp, Homo sapiens
ctgcctcgggatatt

SEQ ID NO: 39672 - DNA, 15 bp, Homo sapiens
cctgcctcgggatat

SEQ ID NO: 39673 - DNA, 15 bp, Homo sapiens
tcctgcctcgggata

SEQ ID NO: 39674 - DNA, 15 bp, Homo sapiens
ttcctgcctcgggat

SEQ ID NO: 39675 - DNA, 15 bp, Homo sapiens
tttcctgcctcggga

SEQ ID NO: 39676 - DNA, 15 bp, Homo sapiens
ctttcctgcctcggg

SEQ ID NO: 39677 - DNA, 15 bp, Homo sapiens
cctttcctgcctcgg

SEQ ID NO: 39678 - DNA, 15 bp, Homo sapiens
ccctttcctgcctcg

SEQ ID NO: 39679 - DNA, 15 bp, Homo sapiens
gccctttcctgcctc

SEQ ID NO: 39680 - DNA, 15 bp, Homo sapiens
agccctttcctgcct

SEQ ID NO: 39681 - DNA, 15 bp, Homo sapiens
cagccctttcctgcc

SEQ ID NO: 39682 - DNA, 15 bp, Homo sapiens
ccagccctttcctgc

SEQ ID NO: 39683 - DNA, 15 bp, Homo sapiens
cccagccctttcctg

SEQ ID NO: 39684 - DNA, 15 bp, Homo sapiens
acccagccctttcct

SEQ ID NO: 39685 - DNA, 15 bp, Homo sapiens
aacccagccctttcc

SEQ ID NO: 39686 - DNA, 15 bp, Homo sapiens
aaacccagccctttc

SEQ ID NO: 39687 - DNA, 15 bp, Homo sapiens
caaacccagcccttt

SEQ ID NO: 39688 - DNA, 15 bp, Homo sapiens
acaaacccagccctt

SEQ ID NO: 39689 - DNA, 15 bp, Homo sapiens
gacaaacccagccct

SEQ ID NO: 39690 - DNA, 15 bp, Homo sapiens
tgacaaacccagccc

SEQ ID NO: 39691 - DNA, 15 bp, Homo sapiens
ctgacaaacccagcc

SEQ ID NO: 39692 - DNA, 15 bp, Homo sapiens
tctgacaaacccagc

SEQ ID NO: 39693 - DNA, 15 bp, Homo sapiens
ctctgacaaacccag

SEQ ID NO: 39694 - DNA, 15 bp, Homo sapiens
actctgacaaaccca

SEQ ID NO: 39695 - DNA, 15 bp, Homo sapiens
tactctgacaaaccc

SEQ ID NO: 39696 - DNA, 15 bp, Homo sapiens
ttactctgacaaacc

SEQ ID NO: 39697 - DNA, 15 bp, Homo sapiens
gttactctgacaaac

SEQ ID NO: 39698 - DNA, 15 bp, Homo sapiens
tgttactctgacaaa

SEQ ID NO: 39699 - DNA, 15 bp, Homo sapiens
atgttactctgacaa

SEQ ID NO: 39700 - DNA, 15 bp, Homo sapiens
catgttactctgaca

SEQ ID NO: 39701 - DNA, 15 bp, Homo sapiens
tcatgttactctgac

SEQ ID NO: 39702 - DNA, 15 bp, Homo sapiens
ttcatgttactctga

SEQ ID NO: 39703 - DNA, 15 bp, Homo sapiens
cttcatgttactctg

SEQ ID NO: 39704 - DNA, 15 bp, Homo sapiens
ccttcatgttactct

SEQ ID NO: 39705 - DNA, 15 bp, Homo sapiens
accttcatgttactc

SEQ ID NO: 39706 - DNA, 15 bp, Homo sapiens
gaccttcatgttact

SEQ ID NO: 39707 - DNA, 15 bp, Homo sapiens
tgaccttcatgttac

SEQ ID NO: 39708 - DNA, 15 bp, Homo sapiens
ctgaccttcatgtta

SEQ ID NO: 39709 - DNA, 15 bp, Homo sapiens
actgaccttcatgtt

SEQ ID NO: 39710 - DNA, 15 bp, Homo sapiens
cactgaccttcatgt

SEQ ID NO: 39711 - DNA, 15 bp, Homo sapiens
acactgaccttcatg

SEQ ID NO: 39712 - DNA, 15 bp, Homo sapiens
cacactgaccttcat

SEQ ID NO: 39713 - DNA, 15 bp, Homo sapiens
gcacactgaccttca

SEQ ID NO: 39714 - DNA, 15 bp, Homo sapiens
agcacactgaccttc

SEQ ID NO: 39715 - DNA, 15 bp, Homo sapiens
cagcacactgacctt

SEQ ID NO: 39716 - DNA, 15 bp, Homo sapiens
ccagcacactgacct

SEQ ID NO: 39717 - DNA, 15 bp, Homo sapiens
tccagcacactgacc

SEQ ID NO: 39718 - DNA, 15 bp, Homo sapiens
ctccagcacactgac

SEQ ID NO: 39719 - DNA, 15 bp, Homo sapiens
gctccagcacactga

SEQ ID NO: 39720 - DNA, 15 bp, Homo sapiens
tgctccagcacactg

SEQ ID NO: 39721 - DNA, 15 bp, Homo sapiens
ttgctccagcacact

SEQ ID NO: 39722 - DNA, 15 bp, Homo sapiens
tttgctccagcacac

SEQ ID NO: 39723 - DNA, 15 bp, Homo sapiens
gtttgctccagcaca

SEQ ID NO: 39724 - DNA, 15 bp, Homo sapiens
agtttgctccagcac

SEQ ID NO: 39725 - DNA, 15 bp, Homo sapiens
cagtttgctccagca

SEQ ID NO: 39726 - DNA, 15 bp, Homo sapiens
tcagtttgctccagc

SEQ ID NO: 39727 - DNA, 15 bp, Homo sapiens
ctcagtttgctccag

SEQ ID NO: 39728 - DNA, 15 bp, Homo sapiens
cctcagtttgctcca

SEQ ID NO: 39729 - DNA, 15 bp, Homo sapiens
tcctcagtttgctcc

SEQ ID NO: 39730 - DNA, 15 bp, Homo sapiens
ctcctcagtttgctc

SEQ ID NO: 39731 - DNA, 15 bp, Homo sapiens
cctcctcagtttgct

SEQ ID NO: 39732 - DNA, 15 bp, Homo sapiens
ccctcctcagtttgc

SEQ ID NO: 39733 - DNA, 15 bp, Homo sapiens
accctcctcagtttg

SEQ ID NO: 39734 - DNA, 15 bp, Homo sapiens
caccctcctcagttt

SEQ ID NO: 39735 - DNA, 15 bp, Homo sapiens
tcaccctcctcagtt

SEQ ID NO: 39736 - DNA, 15 bp, Homo sapiens
ctcaccctcctcagt

SEQ ID NO: 39737 - DNA, 15 bp, Homo sapiens
actcaccctcctcag

SEQ ID NO: 39738 - DNA, 15 bp, Homo sapiens
cactcaccctcctca

SEQ ID NO: 39739 - DNA, 15 bp, Homo sapiens
acactcaccctcctc

SEQ ID NO: 39740 - DNA, 15 bp, Homo sapiens
aacactcaccctcct

SEQ ID NO: 39741 - DNA, 15 bp, Homo sapiens
aaacactcaccctcc

SEQ ID NO: 39742 - DNA, 15 bp, Homo sapiens
gaaacactcaccctc

SEQ ID NO: 39743 - DNA, 15 bp, Homo sapiens
tgaaacactcaccct

SEQ ID NO: 39744 - DNA, 15 bp, Homo sapiens
ttgaaacactcaccc

SEQ ID NO: 39745 - DNA, 15 bp, Homo sapiens
cttgaaacactcacc

SEQ ID NO: 39746 - DNA, 15 bp, Homo sapiens
tcttgaaacactcac

SEQ ID NO: 39747 - DNA, 15 bp, Homo sapiens
gtcttgaaacactca

SEQ ID NO: 39748 - DNA, 15 bp, Homo sapiens
tgtcttgaaacactc

SEQ ID NO: 39749 - DNA, 15 bp, Homo sapiens
ttgtcttgaaacact

SEQ ID NO: 39750 - DNA, 15 bp, Homo sapiens
cttgtcttgaaacac

SEQ ID NO: 39751 - DNA, 15 bp, Homo sapiens
ccttgtcttgaaaca

SEQ ID NO: 39752 - DNA, 15 bp, Homo sapiens
gccttgtcttgaaac

SEQ ID NO: 39753 - DNA, 15 bp, Homo sapiens
agccttgtcttgaaa

SEQ ID NO: 39754 - DNA, 15 bp, Homo sapiens
aagccttgtcttgaa

SEQ ID NO: 39755 - DNA, 15 bp, Homo sapiens
caagccttgtcttga

SEQ ID NO: 39756 - DNA, 15 bp, Homo sapiens
ccaagccttgtcttg

SEQ ID NO: 39757 - DNA, 15 bp, Homo sapiens
gccaagccttgtctt

SEQ ID NO: 39758 - DNA, 15 bp, Homo sapiens
tgccaagccttgtct

SEQ ID NO: 39759 - DNA, 15 bp, Homo sapiens
atgccaagccttgtc

SEQ ID NO: 39760 - DNA, 15 bp, Homo sapiens
tatgccaagccttgt

SEQ ID NO: 39761 - DNA, 15 bp, Homo sapiens
ctatgccaagccttg

SEQ ID NO: 39762 - DNA, 15 bp, Homo sapiens
cctatgccaagcctt

SEQ ID NO: 39763 - DNA, 15 bp, Homo sapiens
tcctatgccaagcct

SEQ ID NO: 39764 - DNA, 15 bp, Homo sapiens
ctcctatgccaagcc

SEQ ID NO: 39765 - DNA, 15 bp, Homo sapiens
actcctatgccaagc

SEQ ID NO: 39766 - DNA, 15 bp, Homo sapiens
cactcctatgccaag

SEQ ID NO: 39767 - DNA, 15 bp, Homo sapiens
ccactcctatgccaa

SEQ ID NO: 39768 - DNA, 15 bp, Homo sapiens
accactcctatgcca

SEQ ID NO: 39769 - DNA, 15 bp, Homo sapiens
gaccactcctatgcc

SEQ ID NO: 39770 - DNA, 15 bp, Homo sapiens
tgaccactcctatgc

SEQ ID NO: 39771 - DNA, 15 bp, Homo sapiens
ctgaccactcctatg

SEQ ID NO: 39772 - DNA, 15 bp, Homo sapiens
tctgaccactcctat

SEQ ID NO: 39773 - DNA, 15 bp, Homo sapiens
atctgaccactccta

SEQ ID NO: 39774 - DNA, 15 bp, Homo sapiens
catctgaccactcct

SEQ ID NO: 39775 - DNA, 15 bp, Homo sapiens
tcatctgaccactcc

SEQ ID NO: 39776 - DNA, 15 bp, Homo sapiens
atcatctgaccactc

SEQ ID NO: 39777 - DNA, 15 bp, Homo sapiens
aatcatctgaccact

SEQ ID NO: 39778 - DNA, 15 bp, Homo sapiens
gaatcatctgaccac

SEQ ID NO: 39779 - DNA, 15 bp, Homo sapiens
tgaatcatctgacca

SEQ ID NO: 39780 - DNA, 15 bp, Homo sapiens
ctgaatcatctgacc

SEQ ID NO: 39781 - DNA, 15 bp, Homo sapiens
cctgaatcatctgac

SEQ ID NO: 39782 - DNA, 15 bp, Homo sapiens
ccctgaatcatctga

SEQ ID NO: 39783 - DNA, 15 bp, Homo sapiens
gccctgaatcatctg

SEQ ID NO: 39784 - DNA, 15 bp, Homo sapiens
ggccctgaatcatct

SEQ ID NO: 39785 - DNA, 15 bp, Homo sapiens
tggccctgaatcatc

SEQ ID NO: 39786 - DNA, 15 bp, Homo sapiens
atggccctgaatcat

SEQ ID NO: 39787 - DNA, 15 bp, Homo sapiens
tatggccctgaatca

SEQ ID NO: 39788 - DNA, 15 bp, Homo sapiens
atatggccctgaatc

SEQ ID NO: 39789 - DNA, 15 bp, Homo sapiens
catatggccctgaat

SEQ ID NO: 39790 - DNA, 15 bp, Homo sapiens
tcatatggccctgaa

SEQ ID NO: 39791 - DNA, 15 bp, Homo sapiens
ttcatatggccctga

SEQ ID NO: 39792 - DNA, 15 bp, Homo sapiens
gttcatatggccctg

SEQ ID NO: 39793 - DNA, 15 bp, Homo sapiens
ggttcatatggccct

SEQ ID NO: 39794 - DNA, 15 bp, Homo sapiens
tggttcatatggccc

SEQ ID NO: 39795 - DNA, 15 bp, Homo sapiens
atggttcatatggcc

SEQ ID NO: 39796 - DNA, 15 bp, Homo sapiens
catggttcatatggc

SEQ ID NO: 39797 - DNA, 15 bp, Homo sapiens
acatggttcatatgg

SEQ ID NO: 39798 - DNA, 15 bp, Homo sapiens
aacatggttcatatg

SEQ ID NO: 39799 - DNA, 15 bp, Homo sapiens
taacatggttcatat

SEQ ID NO: 39800 - DNA, 15 bp, Homo sapiens
ttaacatggttcata

SEQ ID NO: 39801 - DNA, 15 bp, Homo sapiens
attaacatggttcat

SEQ ID NO: 39802 - DNA, 15 bp, Homo sapiens
aattaacatggttca

SEQ ID NO: 39803 - DNA, 15 bp, Homo sapiens
aaattaacatggttc

SEQ ID NO: 39804 - DNA, 15 bp, Homo sapiens
taaattaacatggtt

SEQ ID NO: 39805 - DNA, 15 bp, Homo sapiens
ctaaattaacatggt

SEQ ID NO: 39806 - DNA, 15 bp, Homo sapiens
actaaattaacatgg

SEQ ID NO: 39807 - DNA, 15 bp, Homo sapiens
aactaaattaacatg

SEQ ID NO: 39808 - DNA, 15 bp, Homo sapiens
caactaaattaacat

SEQ ID NO: 39809 - DNA, 15 bp, Homo sapiens
acaactaaattaaca

SEQ ID NO: 39810 - DNA, 15 bp, Homo sapiens
aacaactaaattaac

SEQ ID NO: 39811 - DNA, 15 bp, Homo sapiens
gaacaactaaattaa

SEQ ID NO: 39812 - DNA, 15 bp, Homo sapiens
ggaacaactaaatta

SEQ ID NO: 39813 - DNA, 15 bp, Homo sapiens
tggaacaactaaatt

SEQ ID NO: 39814 - DNA, 15 bp, Homo sapiens
ttggaacaactaaat

SEQ ID NO: 39815 - DNA, 15 bp, Homo sapiens
tttggaacaactaaa

SEQ ID NO: 39816 - DNA, 15 bp, Homo sapiens
ctttggaacaactaa

SEQ ID NO: 39817 - DNA, 15 bp, Homo sapiens
actttggaacaacta

SEQ ID NO: 39818 - DNA, 15 bp, Homo sapiens
aactttggaacaact

SEQ ID NO: 39819 - DNA, 15 bp, Homo sapiens
gaactttggaacaac

SEQ ID NO: 39820 - DNA, 15 bp, Homo sapiens
tgaactttggaacaa

SEQ ID NO: 39821 - DNA, 15 bp, Homo sapiens
ctgaactttggaaca

SEQ ID NO: 39822 - DNA, 15 bp, Homo sapiens
tctgaactttggaac

SEQ ID NO: 39823 - DNA, 15 bp, Homo sapiens
ctctgaactttggaa

SEQ ID NO: 39824 - DNA, 15 bp, Homo sapiens
tctctgaactttgga

SEQ ID NO: 39825 - DNA, 15 bp, Homo sapiens
ctctctgaactttgg

SEQ ID NO: 39826 - DNA, 15 bp, Homo sapiens
actctctgaactttg

SEQ ID NO: 39827 - DNA, 15 bp, Homo sapiens
aactctctgaacttt

SEQ ID NO: 39828 - DNA, 15 bp, Homo sapiens
caactctctgaactt

SEQ ID NO: 39829 - DNA, 15 bp, Homo sapiens
tcaactctctgaact

SEQ ID NO: 39830 - DNA, 15 bp, Homo sapiens
atcaactctctgaac

SEQ ID NO: 39831 - DNA, 15 bp, Homo sapiens
aatcaactctctgaa

SEQ ID NO: 39832 - DNA, 15 bp, Homo sapiens
taatcaactctctga

SEQ ID NO: 39833 - DNA, 15 bp, Homo sapiens
ctaatcaactctctg

SEQ ID NO: 39834 - DNA, 15 bp, Homo sapiens
tctaatcaactctct

SEQ ID NO: 39835 - DNA, 15 bp, Homo sapiens
ttctaatcaactctc

SEQ ID NO: 39836 - DNA, 15 bp, Homo sapiens
cttctaatcaactct

SEQ ID NO: 39837 - DNA, 15 bp, Homo sapiens
ccttctaatcaactc

SEQ ID NO: 39838 - DNA, 15 bp, Homo sapiens
tccttctaatcaact

SEQ ID NO: 39839 - DNA, 15 bp, Homo sapiens
ttccttctaatcaac

SEQ ID NO: 39840 - DNA, 15 bp, Homo sapiens
attccttctaatcaa

SEQ ID NO: 39841 - DNA, 15 bp, Homo sapiens
tattccttctaatca

SEQ ID NO: 39842 - DNA, 15 bp, Homo sapiens
ttattccttctaatc

SEQ ID NO: 39843 - DNA, 15 bp, Homo sapiens
cttattccttctaat

SEQ ID NO: 39844 - DNA, 15 bp, Homo sapiens
tcttattccttctaa

SEQ ID NO: 39845 - DNA, 15 bp, Homo sapiens
ttcttattccttcta

SEQ ID NO: 39846 - DNA, 15 bp, Homo sapiens
cttcttattccttct

SEQ ID NO: 39847 - DNA, 15 bp, Homo sapiens
tcttcttattccttc

SEQ ID NO: 39848 - DNA, 15 bp, Homo sapiens
ctcttcttattcctt

SEQ ID NO: 39849 - DNA, 15 bp, Homo sapiens
tctcttcttattcct

SEQ ID NO: 39850 - DNA, 15 bp, Homo sapiens
ttctcttcttattcc

SEQ ID NO: 39851 - DNA, 15 bp, Homo sapiens
attctcttcttattc

SEQ ID NO: 39852 - DNA, 15 bp, Homo sapiens
aattctcttcttatt

SEQ ID NO: 39853 - DNA, 15 bp, Homo sapiens
aaattctcttcttat

SEQ ID NO: 39854 - DNA, 15 bp, Homo sapiens
taaattctcttctta

SEQ ID NO: 39855 - DNA, 15 bp, Homo sapiens
ctaaattctcttctt

SEQ ID NO: 39856 - DNA, 15 bp, Homo sapiens
cctaaattctcttct

SEQ ID NO: 39857 - DNA, 15 bp, Homo sapiens
tcctaaattctcttc

SEQ ID NO: 39858 - DNA, 15 bp, Homo sapiens
ctcctaaattctctt

SEQ ID NO: 39859 - DNA, 15 bp, Homo sapiens
tctcctaaattctct

SEQ ID NO: 39860 - DNA, 15 bp, Homo sapiens
gtctcctaaattctc

SEQ ID NO: 39861 - DNA, 15 bp, Homo sapiens
tgtctcctaaattct

SEQ ID NO: 39862 - DNA, 15 bp, Homo sapiens
ctgtctcctaaattc

SEQ ID NO: 39863 - DNA, 15 bp, Homo sapiens
actgtctcctaaatt

SEQ ID NO: 39864 - DNA, 15 bp, Homo sapiens
cactgtctcctaaat

SEQ ID NO: 39865 - DNA, 15 bp, Homo sapiens
acactgtctcctaaa

SEQ ID NO: 39866 - DNA, 15 bp, Homo sapiens
gacactgtctcctaa

SEQ ID NO: 39867 - DNA, 15 bp, Homo sapiens
tgacactgtctccta

SEQ ID NO: 39868 - DNA, 15 bp, Homo sapiens
ctgacactgtctcct

SEQ ID NO: 39869 - DNA, 15 bp, Homo sapiens
tctgacactgtctcc

SEQ ID NO: 39870 - DNA, 15 bp, Homo sapiens
ttctgacactgtctc

SEQ ID NO: 39871 - DNA, 15 bp, Homo sapiens
cttctgacactgtct

SEQ ID NO: 39872 - DNA, 15 bp, Homo sapiens
ccttctgacactgtc

SEQ ID NO: 39873 - DNA, 15 bp, Homo sapiens
accttctgacactgt

SEQ ID NO: 39874 - DNA, 15 bp, Homo sapiens
aaccttctgacactg

SEQ ID NO: 39875 - DNA, 15 bp, Homo sapiens
taaccttctgacact

SEQ ID NO: 39876 - DNA, 15 bp, Homo sapiens
ataaccttctgacac

SEQ ID NO: 39877 - DNA, 15 bp, Homo sapiens
aataaccttctgaca

SEQ ID NO: 39878 - DNA, 15 bp, Homo sapiens
caataaccttctgac

SEQ ID NO: 39879 - DNA, 15 bp, Homo sapiens
ccaataaccttctga

SEQ ID NO: 39880 - DNA, 15 bp, Homo sapiens
gccaataaccttctg

SEQ ID NO: 39881 - DNA, 15 bp, Homo sapiens
agccaataaccttct

SEQ ID NO: 39882 - DNA, 15 bp, Homo sapiens
aagccaataaccttc

SEQ ID NO: 39883 - DNA, 15 bp, Homo sapiens
aaagccaataacctt

SEQ ID NO: 39884 - DNA, 15 bp, Homo sapiens
taaagccaataacct

SEQ ID NO: 39885 - DNA, 15 bp, Homo sapiens
ctaaagccaataacc

SEQ ID NO: 39886 - DNA, 15 bp, Homo sapiens
cctaaagccaataac

SEQ ID NO: 39887 - DNA, 15 bp, Homo sapiens
gcctaaagccaataa

SEQ ID NO: 39888 - DNA, 15 bp, Homo sapiens
agcctaaagccaata

SEQ ID NO: 39889 - DNA, 15 bp, Homo sapiens
cagcctaaagccaat

SEQ ID NO: 39890 - DNA, 15 bp, Homo sapiens
ccagcctaaagccaa

SEQ ID NO: 39891 - DNA, 15 bp, Homo sapiens
tccagcctaaagcca

SEQ ID NO: 39892 - DNA, 15 bp, Homo sapiens
ctccagcctaaagcc

SEQ ID NO: 39893 - DNA, 15 bp, Homo sapiens
cctccagcctaaagc

SEQ ID NO: 39894 - DNA, 15 bp, Homo sapiens
gcctccagcctaaag

SEQ ID NO: 39895 - DNA, 15 bp, Homo sapiens
tgcctccagcctaaa

SEQ ID NO: 39896 - DNA, 15 bp, Homo sapiens
ttgcctccagcctaa

SEQ ID NO: 39897 - DNA, 15 bp, Homo sapiens
cttgcctccagccta

SEQ ID NO: 39898 - DNA, 15 bp, Homo sapiens
tcttgcctccagcct

SEQ ID NO: 39899 - DNA, 15 bp, Homo sapiens
ctcttgcctccagcc

SEQ ID NO: 39900 - DNA, 15 bp, Homo sapiens
tctcttgcctccagc

SEQ ID NO: 39901 - DNA, 15 bp, Homo sapiens
atctcttgcctccag

SEQ ID NO: 39902 - DNA, 15 bp, Homo sapiens
catctcttgcctcca

SEQ ID NO: 39903 - DNA, 15 bp, Homo sapiens
tcatctcttgcctcc

SEQ ID NO: 39904 - DNA, 15 bp, Homo sapiens
gtcatctcttgcctc

SEQ ID NO: 39905 - DNA, 15 bp, Homo sapiens
tgtcatctcttgcct

SEQ ID NO: 39906 - DNA, 15 bp, Homo sapiens
ctgtcatctcttgcc

SEQ ID NO: 39907 - DNA, 15 bp, Homo sapiens
actgtcatctcttgc

SEQ ID NO: 39908 - DNA, 15 bp, Homo sapiens
tactgtcatctcttg

SEQ ID NO: 39909 - DNA, 15 bp, Homo sapiens
ctactgtcatctctt

SEQ ID NO: 39910 - DNA, 15 bp, Homo sapiens
gctactgtcatctct

SEQ ID NO: 39911 - DNA, 15 bp, Homo sapiens
agctactgtcatctc

SEQ ID NO: 39912 - DNA, 15 bp, Homo sapiens
aagctactgtcatct

SEQ ID NO: 39913 - DNA, 15 bp, Homo sapiens
caagctactgtcatc

SEQ ID NO: 39914 - DNA, 15 bp, Homo sapiens
ccaagctactgtcat

SEQ ID NO: 39915 - DNA, 15 bp, Homo sapiens
tccaagctactgtca

SEQ ID NO: 39916 - DNA, 15 bp, Homo sapiens
gtccaagctactgtc

SEQ ID NO: 39917 - DNA, 15 bp, Homo sapiens
agtccaagctactgt

SEQ ID NO: 39918 - DNA, 15 bp, Homo sapiens
cagtccaagctactg

SEQ ID NO: 39919 - DNA, 15 bp, Homo sapiens
ccagtccaagctact

SEQ ID NO: 39920 - DNA, 15 bp, Homo sapiens
cccagtccaagctac

SEQ ID NO: 39921 - DNA, 15 bp, Homo sapiens
ccccagtccaagcta

SEQ ID NO: 39922 - DNA, 15 bp, Homo sapiens
cccccagtccaagct

SEQ ID NO: 39923 - DNA, 15 bp, Homo sapiens
acccccagtccaagc

SEQ ID NO: 39924 - DNA, 15 bp, Homo sapiens
aacccccagtccaag

SEQ ID NO: 39925 - DNA, 15 bp, Homo sapiens
caacccccagtccaa

SEQ ID NO: 39926 - DNA, 15 bp, Homo sapiens
tcaacccccagtcca

SEQ ID NO: 39927 - DNA, 15 bp, Homo sapiens
gtcaacccccagtcc

SEQ ID NO: 39928 - DNA, 15 bp, Homo sapiens
tgtcaacccccagtc

SEQ ID NO: 39929 - DNA, 15 bp, Homo sapiens
ctgtcaacccccagt

SEQ ID NO: 39930 - DNA, 15 bp, Homo sapiens
actgtcaacccccag

SEQ ID NO: 39931 - DNA, 15 bp, Homo sapiens
cactgtcaaccccca

SEQ ID NO: 39932 - DNA, 15 bp, Homo sapiens
ccactgtcaaccccc

SEQ ID NO: 39933 - DNA, 15 bp, Homo sapiens
tccactgtcaacccc

SEQ ID NO: 39934 - DNA, 15 bp, Homo sapiens
ttccactgtcaaccc

SEQ ID NO: 39935 - DNA, 15 bp, Homo sapiens
gttccactgtcaacc

SEQ ID NO: 39936 - DNA, 15 bp, Homo sapiens
agttccactgtcaac

SEQ ID NO: 39937 - DNA, 15 bp, Homo sapiens
cagttccactgtcaa

SEQ ID NO: 39938 - DNA, 15 bp, Homo sapiens
tcagttccactgtca

SEQ ID NO: 39939 - DNA, 15 bp, Homo sapiens
ttcagttccactgtc

SEQ ID NO: 39940 - DNA, 15 bp, Homo sapiens
cttcagttccactgt

SEQ ID NO: 39941 - DNA, 15 bp, Homo sapiens
tcttcagttccactg

SEQ ID NO: 39942 - DNA, 15 bp, Homo sapiens
ctcttcagttccact

SEQ ID NO: 39943 - DNA, 15 bp, Homo sapiens
tctcttcagttccac

SEQ ID NO: 39944 - DNA, 15 bp, Homo sapiens
atctcttcagttcca

SEQ ID NO: 39945 - DNA, 15 bp, Homo sapiens
catctcttcagttcc

SEQ ID NO: 39946 - DNA, 15 bp, Homo sapiens
acatctcttcagttc

SEQ ID NO: 39947 - DNA, 15 bp, Homo sapiens
cacatctcttcagtt

SEQ ID NO: 39948 - DNA, 15 bp, Homo sapiens
ccacatctcttcagt

SEQ ID NO: 39949 - DNA, 15 bp, Homo sapiens
tccacatctcttcag

SEQ ID NO: 39950 - DNA, 15 bp, Homo sapiens
atccacatctcttca

SEQ ID NO: 39951 - DNA, 15 bp, Homo sapiens
catccacatctcttc

SEQ ID NO: 39952 - DNA, 15 bp, Homo sapiens
ccatccacatctctt

SEQ ID NO: 39953 - DNA, 15 bp, Homo sapiens
tccatccacatctct

SEQ ID NO: 39954 - DNA, 15 bp, Homo sapiens
gtccatccacatctc

SEQ ID NO: 39955 - DNA, 15 bp, Homo sapiens
agtccatccacatct

SEQ ID NO: 39956 - DNA, 15 bp, Homo sapiens
gagtccatccacatc

SEQ ID NO: 39957 - DNA, 15 bp, Homo sapiens
tgagtccatccacat

SEQ ID NO: 39958 - DNA, 15 bp, Homo sapiens
ttgagtccatccaca

SEQ ID NO: 39959 - DNA, 15 bp, Homo sapiens
cttgagtccatccac

SEQ ID NO: 39960 - DNA, 15 bp, Homo sapiens
gcttgagtccatcca

SEQ ID NO: 39961 - DNA, 15 bp, Homo sapiens
agcttgagtccatcc

SEQ ID NO: 39962 - DNA, 15 bp, Homo sapiens
cagcttgagtccatc

SEQ ID NO: 39963 - DNA, 15 bp, Homo sapiens
acagcttgagtccat

SEQ ID NO: 39964 - DNA, 15 bp, Homo sapiens
tacagcttgagtcca

SEQ ID NO: 39965 - DNA, 15 bp, Homo sapiens
atacagcttgagtcc

SEQ ID NO: 39966 - DNA, 15 bp, Homo sapiens
aatacagcttgagtc

SEQ ID NO: 39967 - DNA, 15 bp, Homo sapiens
aaatacagcttgagt

SEQ ID NO: 39968 - DNA, 15 bp, Homo sapiens
taaatacagcttgag

SEQ ID NO: 39969 - DNA, 15 bp, Homo sapiens
ctaaatacagcttga

SEQ ID NO: 39970 - DNA, 15 bp, Homo sapiens
cctaaatacagcttg

SEQ ID NO: 39971 - DNA, 15 bp, Homo sapiens
tcctaaatacagctt

SEQ ID NO: 39972 - DNA, 15 bp, Homo sapiens
ttcctaaatacagct

SEQ ID NO: 39973 - DNA, 15 bp, Homo sapiens
attcctaaatacagc

SEQ ID NO: 39974 - DNA, 15 bp, Homo sapiens
aattcctaaatacag

SEQ ID NO: 39975 - DNA, 15 bp, Homo sapiens
taattcctaaataca

SEQ ID NO: 39976 - DNA, 15 bp, Homo sapiens
ctaattcctaaatac

SEQ ID NO: 39977 - DNA, 15 bp, Homo sapiens
tctaattcctaaata

SEQ ID NO: 39978 - DNA, 15 bp, Homo sapiens
ttctaattcctaaat

SEQ ID NO: 39979 - DNA, 15 bp, Homo sapiens
gttctaattcctaaa

SEQ ID NO: 39980 - DNA, 15 bp, Homo sapiens
ggttctaattcctaa

SEQ ID NO: 39981 - DNA, 15 bp, Homo sapiens
tggttctaattccta

SEQ ID NO: 39982 - DNA, 15 bp, Homo sapiens
ttggttctaattcct

SEQ ID NO: 39983 - DNA, 15 bp, Homo sapiens
gttggttctaattcc

SEQ ID NO: 39984 - DNA, 15 bp, Homo sapiens
tgttggttctaattc

SEQ ID NO: 39985 - DNA, 15 bp, Homo sapiens
ttgttggttctaatt

SEQ ID NO: 39986 - DNA, 15 bp, Homo sapiens
tttgttggttctaat

SEQ ID NO: 39987 - DNA, 15 bp, Homo sapiens
ttttgttggttctaa

SEQ ID NO: 39988 - DNA, 15 bp, Homo sapiens
cttttgttggttcta

SEQ ID NO: 39989 - DNA, 15 bp, Homo sapiens
acttttgttggttct

SEQ ID NO: 39990 - DNA, 15 bp, Homo sapiens
aacttttgttggttc

SEQ ID NO: 39991 - DNA, 15 bp, Homo sapiens
caacttttgttggtt

SEQ ID NO: 39992 - DNA, 15 bp, Homo sapiens
tcaacttttgttggt

SEQ ID NO: 39993 - DNA, 15 bp, Homo sapiens
atcaacttttgttgg

SEQ ID NO: 39994 - DNA, 15 bp, Homo sapiens
tatcaacttttgttg

SEQ ID NO: 39995 - DNA, 15 bp, Homo sapiens
ctatcaacttttgtt

SEQ ID NO: 39996 - DNA, 15 bp, Homo sapiens
tctatcaacttttgt

SEQ ID NO: 39997 - DNA, 15 bp, Homo sapiens
ttctatcaacttttg

SEQ ID NO: 39998 - DNA, 15 bp, Homo sapiens
cttctatcaactttt

SEQ ID NO: 39999 - DNA, 15 bp, Homo sapiens
ccttctatcaacttt

SEQ ID NO: 40000 - DNA, 15 bp, Homo sapiens
cccttctatcaactt

SEQ ID NO: 40001 - DNA, 15 bp, Homo sapiens
acccttctatcaact

SEQ ID NO: 40002 - DNA, 15 bp, Homo sapiens
aacccttctatcaac

SEQ ID NO: 40003 - DNA, 15 bp, Homo sapiens
taacccttctatcaa

SEQ ID NO: 40004 - DNA, 15 bp, Homo sapiens
ctaacccttctatca

SEQ ID NO: 40005 - DNA, 15 bp, Homo sapiens
tctaacccttctatc

SEQ ID NO: 40006 - DNA, 15 bp, Homo sapiens
atctaacccttctat

SEQ ID NO: 40007 - DNA, 15 bp, Homo sapiens
aatctaacccttcta

SEQ ID NO: 40008 - DNA, 15 bp, Homo sapiens
caatctaacccttct

SEQ ID NO: 40009 - DNA, 15 bp, Homo sapiens
acaatctaacccttc

SEQ ID NO: 40010 - DNA, 15 bp, Homo sapiens
cacaatctaaccctt

SEQ ID NO: 40011 - DNA, 15 bp, Homo sapiens
ccacaatctaaccct

SEQ ID NO: 40012 - DNA, 15 bp, Homo sapiens
accacaatctaaccc

SEQ ID NO: 40013 - DNA, 15 bp, Homo sapiens
taccacaatctaacc

SEQ ID NO: 40014 - DNA, 15 bp, Homo sapiens
ataccacaatctaac

SEQ ID NO: 40015 - DNA, 15 bp, Homo sapiens
aataccacaatctaa

SEQ ID NO: 40016 - DNA, 15 bp, Homo sapiens
taataccacaatcta

SEQ ID NO: 40017 - DNA, 15 bp, Homo sapiens
ctaataccacaatct

SEQ ID NO: 40018 - DNA, 15 bp, Homo sapiens
tctaataccacaatc

SEQ ID NO: 40019 - DNA, 15 bp, Homo sapiens
ttctaataccacaat

SEQ ID NO: 40020 - DNA, 15 bp, Homo sapiens
cttctaataccacaa

SEQ ID NO: 40021 - DNA, 15 bp, Homo sapiens
tcttctaataccaca

SEQ ID NO: 40022 - DNA, 15 bp, Homo sapiens
ttcttctaataccac

SEQ ID NO: 40023 - DNA, 15 bp, Homo sapiens
tttcttctaatacca

SEQ ID NO: 40024 - DNA, 15 bp, Homo sapiens
ctttcttctaatacc

SEQ ID NO: 40025 - DNA, 15 bp, Homo sapiens
cctttcttctaatac

SEQ ID NO: 40026 - DNA, 15 bp, Homo sapiens
tcctttcttctaata

SEQ ID NO: 40027 - DNA, 15 bp, Homo sapiens
atcctttcttctaat

SEQ ID NO: 40028 - DNA, 15 bp, Homo sapiens
aatcctttcttctaa

SEQ ID NO: 40029 - DNA, 15 bp, Homo sapiens
gaatcctttcttcta

SEQ ID NO: 40030 - DNA, 15 bp, Homo sapiens
tgaatcctttcttct

SEQ ID NO: 40031 - DNA, 15 bp, Homo sapiens
atgaatcctttcttc

SEQ ID NO: 40032 - DNA, 15 bp, Homo sapiens
aatgaatcctttctt

SEQ ID NO: 40033 - DNA, 15 bp, Homo sapiens
aaatgaatcctttct

SEQ ID NO: 40034 - DNA, 15 bp, Homo sapiens
gaaatgaatcctttc

SEQ ID NO: 40035 - DNA, 15 bp, Homo sapiens
tgaaatgaatccttt

SEQ ID NO: 40036 - DNA, 15 bp, Homo sapiens
ctgaaatgaatcctt

SEQ ID NO: 40037 - DNA, 15 bp, Homo sapiens
gctgaaatgaatcct

SEQ ID NO: 40038 - DNA, 15 bp, Homo sapiens
tgctgaaatgaatcc

SEQ ID NO: 40039 - DNA, 15 bp, Homo sapiens
atgctgaaatgaatc

SEQ ID NO: 40040 - DNA, 15 bp, Homo sapiens
gatgctgaaatgaat

SEQ ID NO: 40041 - DNA, 15 bp, Homo sapiens
ggatgctgaaatgaa

SEQ ID NO: 40042 - DNA, 15 bp, Homo sapiens
aggatgctgaaatga

SEQ ID NO: 40043 - DNA, 15 bp, Homo sapiens
caggatgctgaaatg

SEQ ID NO: 40044 - DNA, 15 bp, Homo sapiens
ccaggatgctgaaat

SEQ ID NO: 40045 - DNA, 15 bp, Homo sapiens
gccaggatgctgaaa

SEQ ID NO: 40046 - DNA, 15 bp, Homo sapiens
tgccaggatgctgaa

SEQ ID NO: 40047 - DNA, 15 bp, Homo sapiens
atgccaggatgctga

SEQ ID NO: 40048 - DNA, 15 bp, Homo sapiens
catgccaggatgctg

SEQ ID NO: 40049 - DNA, 15 bp, Homo sapiens
tcatgccaggatgct

SEQ ID NO: 40050 - DNA, 15 bp, Homo sapiens
ttcatgccaggatgc

SEQ ID NO: 40051 - DNA, 15 bp, Homo sapiens
gttcatgccaggatg

SEQ ID NO: 40052 - DNA, 15 bp, Homo sapiens
ggttcatgccaggat

SEQ ID NO: 40053 - DNA, 15 bp, Homo sapiens
tggttcatgccagga

SEQ ID NO: 40054 - DNA, 15 bp, Homo sapiens
ctggttcatgccagg

SEQ ID NO: 40055 - DNA, 15 bp, Homo sapiens
actggttcatgccag

SEQ ID NO: 40056 - DNA, 15 bp, Homo sapiens
cactggttcatgcca

SEQ ID NO: 40057 - DNA, 15 bp, Homo sapiens
tcactggttcatgcc

SEQ ID NO: 40058 - DNA, 15 bp, Homo sapiens
ttcactggttcatgc

SEQ ID NO: 40059 - DNA, 15 bp, Homo sapiens
attcactggttcatg

SEQ ID NO: 40060 - DNA, 15 bp, Homo sapiens
cattcactggttcat

SEQ ID NO: 40061 - DNA, 15 bp, Homo sapiens
ccattcactggttca

SEQ ID NO: 40062 - DNA, 15 bp, Homo sapiens
tccattcactggttc

SEQ ID NO: 40063 - DNA, 15 bp, Homo sapiens
atccattcactggtt

SEQ ID NO: 40064 - DNA, 15 bp, Homo sapiens
catccattcactggt

SEQ ID NO: 40065 - DNA, 15 bp, Homo sapiens
tcatccattcactgg

SEQ ID NO: 40066 - DNA, 15 bp, Homo sapiens
ttcatccattcactg

SEQ ID NO: 40067 - DNA, 15 bp, Homo sapiens
tttcatccattcact

SEQ ID NO: 40068 - DNA, 15 bp, Homo sapiens
ctttcatccattcac

SEQ ID NO: 40069 - DNA, 15 bp, Homo sapiens
actttcatccattca

SEQ ID NO: 40070 - DNA, 15 bp, Homo sapiens
cactttcatccattc

SEQ ID NO: 40071 - DNA, 15 bp, Homo sapiens
gcactttcatccatt

SEQ ID NO: 40072 - DNA, 15 bp, Homo sapiens
agcactttcatccat

SEQ ID NO: 40073 - DNA, 15 bp, Homo sapiens
aagcactttcatcca

SEQ ID NO: 40074 - DNA, 15 bp, Homo sapiens
aaagcactttcatcc

SEQ ID NO: 40075 - DNA, 15 bp, Homo sapiens
aaaagcactttcatc

SEQ ID NO: 40076 - DNA, 15 bp, Homo sapiens
gaaaagcactttcat

SEQ ID NO: 40077 - DNA, 15 bp, Homo sapiens
ggaaaagcactttca

SEQ ID NO: 40078 - DNA, 15 bp, Homo sapiens
cggaaaagcactttc

SEQ ID NO: 40079 - DNA, 15 bp, Homo sapiens
acggaaaagcacttt

SEQ ID NO: 40080 - DNA, 15 bp, Homo sapiens
tacggaaaagcactt

SEQ ID NO: 40081 - DNA, 15 bp, Homo sapiens
ctacggaaaagcact

SEQ ID NO: 40082 - DNA, 15 bp, Homo sapiens
actacggaaaagcac

SEQ ID NO: 40083 - DNA, 15 bp, Homo sapiens
aactacggaaaagca

SEQ ID NO: 40084 - DNA, 15 bp, Homo sapiens
caactacggaaaagc

SEQ ID NO: 40085 - DNA, 15 bp, Homo sapiens
ccaactacggaaaag

SEQ ID NO: 40086 - DNA, 15 bp, Homo sapiens
cccaactacggaaaa

SEQ ID NO: 40087 - DNA, 15 bp, Homo sapiens
tcccaactacggaaa

SEQ ID NO: 40088 - DNA, 15 bp, Homo sapiens
ttcccaactacggaa

SEQ ID NO: 40089 - DNA, 15 bp, Homo sapiens
tttcccaactacgga

SEQ ID NO: 40090 - DNA, 15 bp, Homo sapiens
ctttcccaactacgg

SEQ ID NO: 40091 - DNA, 15 bp, Homo sapiens
tctttcccaactacg

SEQ ID NO: 40092 - DNA, 15 bp, Homo sapiens
gtctttcccaactac

SEQ ID NO: 40093 - DNA, 15 bp, Homo sapiens
agtctttcccaacta

SEQ ID NO: 40094 - DNA, 15 bp, Homo sapiens
tagtctttcccaact

SEQ ID NO: 40095 - DNA, 15 bp, Homo sapiens
ctagtctttcccaac

SEQ ID NO: 40096 - DNA, 15 bp, Homo sapiens
tctagtctttcccaa

SEQ ID NO: 40097 - DNA, 15 bp, Homo sapiens
ctctagtctttccca

SEQ ID NO: 40098 - DNA, 15 bp, Homo sapiens
cctctagtctttccc

SEQ ID NO: 40099 - DNA, 15 bp, Homo sapiens
gcctctagtctttcc

SEQ ID NO: 40100 - DNA, 15 bp, Homo sapiens
tgcctctagtctttc

SEQ ID NO: 40101 - DNA, 15 bp, Homo sapiens
ctgcctctagtcttt

SEQ ID NO: 40102 - DNA, 15 bp, Homo sapiens
tctgcctctagtctt

SEQ ID NO: 40103 - DNA, 15 bp, Homo sapiens
ttctgcctctagtct

SEQ ID NO: 40104 - DNA, 15 bp, Homo sapiens
attctgcctctagtc

SEQ ID NO: 40105 - DNA, 15 bp, Homo sapiens
tattctgcctctagt

SEQ ID NO: 40106 - DNA, 15 bp, Homo sapiens
ctattctgcctctag

SEQ ID NO: 40107 - DNA, 15 bp, Homo sapiens
tctattctgcctcta

SEQ ID NO: 40108 - DNA, 15 bp, Homo sapiens
atctattctgcctct

SEQ ID NO: 40109 - DNA, 15 bp, Homo sapiens
aatctattctgcctc

SEQ ID NO: 40110 - DNA, 15 bp, Homo sapiens
aaatctattctgcct

SEQ ID NO: 40111 - DNA, 15 bp, Homo sapiens
caaatctattctgcc

SEQ ID NO: 40112 - DNA, 15 bp, Homo sapiens
tcaaatctattctgc

SEQ ID NO: 40113 - DNA, 15 bp, Homo sapiens
ctcaaatctattctg

SEQ ID NO: 40114 - DNA, 15 bp, Homo sapiens
tctcaaatctattct

SEQ ID NO: 40115 - DNA, 15 bp, Homo sapiens
ctctcaaatctattc

SEQ ID NO: 40116 - DNA, 15 bp, Homo sapiens
tctctcaaatctatt

SEQ ID NO: 40117 - DNA, 15 bp, Homo sapiens
ctctctcaaatctat

SEQ ID NO: 40118 - DNA, 15 bp, Homo sapiens
tctctctcaaatcta

SEQ ID NO: 40119 - DNA, 15 bp, Homo sapiens
ttctctctcaaatct

SEQ ID NO: 40120 - DNA, 15 bp, Homo sapiens
cttctctctcaaatc

SEQ ID NO: 40121 - DNA, 15 bp, Homo sapiens
gcttctctctcaaat

SEQ ID NO: 40122 - DNA, 15 bp, Homo sapiens
tgcttctctctcaaa

SEQ ID NO: 40123 - DNA, 15 bp, Homo sapiens
ttgcttctctctcaa

SEQ ID NO: 40124 - DNA, 15 bp, Homo sapiens
gttgcttctctctca

SEQ ID NO: 40125 - DNA, 15 bp, Homo sapiens
tgttgcttctctctc

SEQ ID NO: 40126 - DNA, 15 bp, Homo sapiens
ctgttgcttctctct

SEQ ID NO: 40127 - DNA, 15 bp, Homo sapiens
actgttgcttctctc

SEQ ID NO: 40128 - DNA, 15 bp, Homo sapiens
aactgttgcttctct

SEQ ID NO: 40129 - DNA, 15 bp, Homo sapiens
gaactgttgcttctc

SEQ ID NO: 40130 - DNA, 15 bp, Homo sapiens
tgaactgttgcttct

SEQ ID NO: 40131 - DNA, 15 bp, Homo sapiens
ctgaactgttgcttc

SEQ ID NO: 40132 - DNA, 15 bp, Homo sapiens
actgaactgttgctt

SEQ ID NO: 40133 - DNA, 15 bp, Homo sapiens
aactgaactgttgct

SEQ ID NO: 40134 - DNA, 15 bp, Homo sapiens
aaactgaactgttgc

SEQ ID NO: 40135 - DNA, 15 bp, Homo sapiens
aaaactgaactgttg

SEQ ID NO: 40136 - DNA, 15 bp, Homo sapiens
aaaaactgaactgtt

SEQ ID NO: 40137 - DNA, 15 bp, Homo sapiens
aaaaaactgaactgt

SEQ ID NO: 40138 - DNA, 15 bp, Homo sapiens
caaaaaactgaactg

SEQ ID NO: 40139 - DNA, 15 bp, Homo sapiens
tcaaaaaactgaact

SEQ ID NO: 40140 - DNA, 15 bp, Homo sapiens
atcaaaaaactgaac

SEQ ID NO: 40141 - DNA, 15 bp, Homo sapiens
catcaaaaaactgaa

SEQ ID NO: 40142 - DNA, 15 bp, Homo sapiens
ccatcaaaaaactga

SEQ ID NO: 40143 - DNA, 15 bp, Homo sapiens
cccatcaaaaaactg

SEQ ID NO: 40144 - DNA, 15 bp, Homo sapiens
acccatcaaaaaact

SEQ ID NO: 40145 - DNA, 15 bp, Homo sapiens
aacccatcaaaaaac

SEQ ID NO: 40146 - DNA, 15 bp, Homo sapiens
taacccatcaaaaaa

SEQ ID NO: 40147 - DNA, 15 bp, Homo sapiens
ttaacccatcaaaaa

SEQ ID NO: 40148 - DNA, 15 bp, Homo sapiens
cttaacccatcaaaa

SEQ ID NO: 40149 - DNA, 15 bp, Homo sapiens
ccttaacccatcaaa

SEQ ID NO: 40150 - DNA, 15 bp, Homo sapiens
accttaacccatcaa

SEQ ID NO: 40151 - DNA, 15 bp, Homo sapiens
aaccttaacccatca

SEQ ID NO: 40152 - DNA, 15 bp, Homo sapiens
caaccttaacccatc

SEQ ID NO: 40153 - DNA, 15 bp, Homo sapiens
tcaaccttaacccat

SEQ ID NO: 40154 - DNA, 15 bp, Homo sapiens
ttcaaccttaaccca

SEQ ID NO: 40155 - DNA, 15 bp, Homo sapiens
tttcaaccttaaccc

SEQ ID NO: 40156 - DNA, 15 bp, Homo sapiens
atttcaaccttaacc

SEQ ID NO: 40157 - DNA, 15 bp, Homo sapiens
catttcaaccttaac

SEQ ID NO: 40158 - DNA, 15 bp, Homo sapiens
tcatttcaaccttaa

SEQ ID NO: 40159 - DNA, 15 bp, Homo sapiens
ctcatttcaacctta

SEQ ID NO: 40160 - DNA, 15 bp, Homo sapiens
actcatttcaacctt

SEQ ID NO: 40161 - DNA, 15 bp, Homo sapiens
gactcatttcaacct

SEQ ID NO: 40162 - DNA, 15 bp, Homo sapiens
agactcatttcaacc

SEQ ID NO: 40163 - DNA, 15 bp, Homo sapiens
cagactcatttcaac

SEQ ID NO: 40164 - DNA, 15 bp, Homo sapiens
acagactcatttcaa

SEQ ID NO: 40165 - DNA, 15 bp, Homo sapiens
cacagactcatttca

SEQ ID NO: 40166 - DNA, 15 bp, Homo sapiens
tcacagactcatttc

SEQ ID NO: 40167 - DNA, 15 bp, Homo sapiens
ctcacagactcattt

SEQ ID NO: 40168 - DNA, 15 bp, Homo sapiens
gctcacagactcatt

SEQ ID NO: 40169 - DNA, 15 bp, Homo sapiens
agctcacagactcat

SEQ ID NO: 40170 - DNA, 15 bp, Homo sapiens
tagctcacagactca

SEQ ID NO: 40171 - DNA, 15 bp, Homo sapiens
atagctcacagactc

SEQ ID NO: 40172 - DNA, 15 bp, Homo sapiens
gatagctcacagact

SEQ ID NO: 40173 - DNA, 15 bp, Homo sapiens
agatagctcacagac

SEQ ID NO: 40174 - DNA, 15 bp, Homo sapiens
gagatagctcacaga

SEQ ID NO: 40175 - DNA, 15 bp, Homo sapiens
tgagatagctcacag

SEQ ID NO: 40176 - DNA, 15 bp, Homo sapiens
ctgagatagctcaca

SEQ ID NO: 40177 - DNA, 15 bp, Homo sapiens
actgagatagctcac

SEQ ID NO: 40178 - DNA, 15 bp, Homo sapiens
cactgagatagctca

SEQ ID NO: 40179 - DNA, 15 bp, Homo sapiens
ccactgagatagctc

SEQ ID NO: 40180 - DNA, 15 bp, Homo sapiens
tccactgagatagct

SEQ ID NO: 40181 - DNA, 15 bp, Homo sapiens
ctccactgagatagc

SEQ ID NO: 40182 - DNA, 15 bp, Homo sapiens
tctccactgagatag

SEQ ID NO: 40183 - DNA, 15 bp, Homo sapiens
atctccactgagata

SEQ ID NO: 40184 - DNA, 15 bp, Homo sapiens
catctccactgagat

SEQ ID NO: 40185 - DNA, 15 bp, Homo sapiens
acatctccactgaga

SEQ ID NO: 40186 - DNA, 15 bp, Homo sapiens
gacatctccactgag

SEQ ID NO: 40187 - DNA, 15 bp, Homo sapiens
tgacatctccactga

SEQ ID NO: 40188 - DNA, 15 bp, Homo sapiens
ttgacatctccactg

SEQ ID NO: 40189 - DNA, 15 bp, Homo sapiens
cttgacatctccact

SEQ ID NO: 40190 - DNA, 15 bp, Homo sapiens
acttgacatctccac

SEQ ID NO: 40191 - DNA, 15 bp, Homo sapiens
tacttgacatctcca

SEQ ID NO: 40192 - DNA, 15 bp, Homo sapiens
ctacttgacatctcc

SEQ ID NO: 40193 - DNA, 15 bp, Homo sapiens
cctacttgacatctc

SEQ ID NO: 40194 - DNA, 15 bp, Homo sapiens
acctacttgacatct

SEQ ID NO: 40195 - DNA, 15 bp, Homo sapiens
cacctacttgacatc

SEQ ID NO: 40196 - DNA, 15 bp, Homo sapiens
ccacctacttgacat

SEQ ID NO: 40197 - DNA, 15 bp, Homo sapiens
accacctacttgaca

SEQ ID NO: 40198 - DNA, 15 bp, Homo sapiens
aaccacctacttgac

SEQ ID NO: 40199 - DNA, 15 bp, Homo sapiens
taaccacctacttga

SEQ ID NO: 40200 - DNA, 15 bp, Homo sapiens
ctaaccacctacttg

SEQ ID NO: 40201 - DNA, 15 bp, Homo sapiens
actaaccacctactt

SEQ ID NO: 40202 - DNA, 15 bp, Homo sapiens
aactaaccacctact

SEQ ID NO: 40203 - DNA, 15 bp, Homo sapiens
taactaaccacctac

SEQ ID NO: 40204 - DNA, 15 bp, Homo sapiens
gtaactaaccaccta

SEQ ID NO: 40205 - DNA, 15 bp, Homo sapiens
tgtaactaaccacct

SEQ ID NO: 40206 - DNA, 15 bp, Homo sapiens
atgtaactaaccacc

SEQ ID NO: 40207 - DNA, 15 bp, Homo sapiens
tatgtaactaaccac

SEQ ID NO: 40208 - DNA, 15 bp, Homo sapiens
ctatgtaactaacca

SEQ ID NO: 40209 - DNA, 15 bp, Homo sapiens
actatgtaactaacc

SEQ ID NO: 40210 - DNA, 15 bp, Homo sapiens
tactatgtaactaac

SEQ ID NO: 40211 - DNA, 15 bp, Homo sapiens
atactatgtaactaa

SEQ ID NO: 40212 - DNA, 15 bp, Homo sapiens
catactatgtaacta

SEQ ID NO: 40213 - DNA, 15 bp, Homo sapiens
acatactatgtaact

SEQ ID NO: 40214 - DNA, 15 bp, Homo sapiens
cacatactatgtaac

SEQ ID NO: 40215 - DNA, 15 bp, Homo sapiens
acacatactatgtaa

SEQ ID NO: 40216 - DNA, 15 bp, Homo sapiens
aacacatactatgta

SEQ ID NO: 40217 - DNA, 15 bp, Homo sapiens
aaacacatactatgt

SEQ ID NO: 40218 - DNA, 15 bp, Homo sapiens
taaacacatactatg

SEQ ID NO: 40219 - DNA, 15 bp, Homo sapiens
ataaacacatactat

SEQ ID NO: 40220 - DNA, 15 bp, Homo sapiens
gataaacacatacta

SEQ ID NO: 40221 - DNA, 15 bp, Homo sapiens
agataaacacatact

SEQ ID NO: 40222 - DNA, 15 bp, Homo sapiens
gagataaacacatac

SEQ ID NO: 40223 - DNA, 15 bp, Homo sapiens
agagataaacacata

SEQ ID NO: 40224 - DNA, 15 bp, Homo sapiens
aagagataaacacat

SEQ ID NO: 40225 - DNA, 15 bp, Homo sapiens
caagagataaacaca

SEQ ID NO: 40226 - DNA, 15 bp, Homo sapiens
gcaagagataaacac

SEQ ID NO: 40227 - DNA, 15 bp, Homo sapiens
agcaagagataaaca

SEQ ID NO: 40228 - DNA, 15 bp, Homo sapiens
cagcaagagataaac

SEQ ID NO: 40229 - DNA, 15 bp, Homo sapiens
gcagcaagagataaa

SEQ ID NO: 40230 - DNA, 15 bp, Homo sapiens
tgcagcaagagataa

SEQ ID NO: 40231 - DNA, 15 bp, Homo sapiens
atgcagcaagagata

SEQ ID NO: 40232 - DNA, 15 bp, Homo sapiens
tatgcagcaagagat

SEQ ID NO: 40233 - DNA, 15 bp, Homo sapiens
ttatgcagcaagaga

SEQ ID NO: 40234 - DNA, 15 bp, Homo sapiens
attatgcagcaagag

SEQ ID NO: 40235 - DNA, 15 bp, Homo sapiens
tattatgcagcaaga

SEQ ID NO: 40236 - DNA, 15 bp, Homo sapiens
ttattatgcagcaag

SEQ ID NO: 40237 - DNA, 15 bp, Homo sapiens
tttattatgcagcaa

SEQ ID NO: 40238 - DNA, 15 bp, Homo sapiens
atttattatgcagca

SEQ ID NO: 40239 - DNA, 15 bp, Homo sapiens
aatttattatgcagc

SEQ ID NO: 40240 - DNA, 15 bp, Homo sapiens
taatttattatgcag

SEQ ID NO: 40241 - DNA, 15 bp, Homo sapiens
ataatttattatgca

SEQ ID NO: 40242 - DNA, 15 bp, Homo sapiens
aataatttattatgc

SEQ ID NO: 40243 - DNA, 15 bp, Homo sapiens
taataatttattatg

SEQ ID NO: 40244 - DNA, 15 bp, Homo sapiens
ataataatttattat

SEQ ID NO: 40245 - DNA, 15 bp, Homo sapiens
cataataatttatta

SEQ ID NO: 40246 - DNA, 15 bp, Homo sapiens
tcataataatttatt

SEQ ID NO: 40247 - DNA, 15 bp, Homo sapiens
ttcataataatttat

SEQ ID NO: 40248 - DNA, 15 bp, Homo sapiens
tttcataataattta

SEQ ID NO: 40249 - DNA, 15 bp, Homo sapiens
gtttcataataattt

SEQ ID NO: 40250 - DNA, 15 bp, Homo sapiens
agtttcataataatt

SEQ ID NO: 40251 - DNA, 15 bp, Homo sapiens
aagtttcataataat

SEQ ID NO: 40252 - DNA, 15 bp, Homo sapiens
taagtttcataataa

SEQ ID NO: 40253 - DNA, 15 bp, Homo sapiens
ctaagtttcataata

SEQ ID NO: 40254 - DNA, 15 bp, Homo sapiens
gctaagtttcataat

SEQ ID NO: 40255 - DNA, 15 bp, Homo sapiens
tgctaagtttcataa

SEQ ID NO: 40256 - DNA, 15 bp, Homo sapiens
ctgctaagtttcata

SEQ ID NO: 40257 - DNA, 15 bp, Homo sapiens
gctgctaagtttcat

SEQ ID NO: 40258 - DNA, 15 bp, Homo sapiens
tgctgctaagtttca

SEQ ID NO: 40259 - DNA, 15 bp, Homo sapiens
ttgctgctaagtttc

SEQ ID NO: 40260 - DNA, 15 bp, Homo sapiens
tttgctgctaagttt

SEQ ID NO: 40261 - DNA, 15 bp, Homo sapiens
atttgctgctaagtt

SEQ ID NO: 40262 - DNA, 15 bp, Homo sapiens
gatttgctgctaagt

SEQ ID NO: 40263 - DNA, 15 bp, Homo sapiens
agatttgctgctaag

SEQ ID NO: 40264 - DNA, 15 bp, Homo sapiens
tagatttgctgctaa

SEQ ID NO: 40265 - DNA, 15 bp, Homo sapiens
atagatttgctgcta

SEQ ID NO: 40266 - DNA, 15 bp, Homo sapiens
tatagatttgctgct

SEQ ID NO: 40267 - DNA, 15 bp, Homo sapiens
atatagatttgctgc

SEQ ID NO: 40268 - DNA, 15 bp, Homo sapiens
aatatagatttgctg

SEQ ID NO: 40269 - DNA, 15 bp, Homo sapiens
taatatagatttgct

SEQ ID NO: 40270 - DNA, 15 bp, Homo sapiens
ctaatatagatttgc

SEQ ID NO: 40271 - DNA, 15 bp, Homo sapiens
actaatatagatttg

SEQ ID NO: 40272 - DNA, 15 bp, Homo sapiens
aactaatatagattt

SEQ ID NO: 40273 - DNA, 15 bp, Homo sapiens
taactaatatagatt

SEQ ID NO: 40274 - DNA, 15 bp, Homo sapiens
ataactaatatagat

SEQ ID NO: 40275 - DNA, 15 bp, Homo sapiens
gataactaatataga

SEQ ID NO: 40276 - DNA, 15 bp, Homo sapiens
agataactaatatag

SEQ ID NO: 40277 - DNA, 15 bp, Homo sapiens
tagataactaatata

SEQ ID NO: 40278 - DNA, 15 bp, Homo sapiens
atagataactaatat

SEQ ID NO: 40279 - DNA, 15 bp, Homo sapiens
aatagataactaata

SEQ ID NO: 40280 - DNA, 15 bp, Homo sapiens
caatagataactaat

SEQ ID NO: 40281 - DNA, 15 bp, Homo sapiens
gcaatagataactaa

SEQ ID NO: 40282 - DNA, 15 bp, Homo sapiens
agcaatagataacta

SEQ ID NO: 40283 - DNA, 15 bp, Homo sapiens
gagcaatagataact

SEQ ID NO: 40284 - DNA, 15 bp, Homo sapiens
agagcaatagataac

SEQ ID NO: 40285 - DNA, 15 bp, Homo sapiens
cagagcaatagataa

SEQ ID NO: 40286 - DNA, 15 bp, Homo sapiens
acagagcaatagata

SEQ ID NO: 40287 - DNA, 15 bp, Homo sapiens
tacagagcaatagat

SEQ ID NO: 40288 - DNA, 15 bp, Homo sapiens
ttacagagcaataga

SEQ ID NO: 40289 - DNA, 15 bp, Homo sapiens
gttacagagcaatag

SEQ ID NO: 40290 - DNA, 15 bp, Homo sapiens
tgttacagagcaata

SEQ ID NO: 40291 - DNA, 15 bp, Homo sapiens
ttgttacagagcaat

SEQ ID NO: 40292 - DNA, 15 bp, Homo sapiens
cttgttacagagcaa

SEQ ID NO: 40293 - DNA, 15 bp, Homo sapiens
acttgttacagagca

SEQ ID NO: 40294 - DNA, 15 bp, Homo sapiens
gacttgttacagagc

SEQ ID NO: 40295 - DNA, 15 bp, Homo sapiens
tgacttgttacagag

SEQ ID NO: 40296 - DNA, 15 bp, Homo sapiens
gtgacttgttacaga

SEQ ID NO: 40297 - DNA, 15 bp, Homo sapiens
ggtgacttgttacag

SEQ ID NO: 40298 - DNA, 15 bp, Homo sapiens
gggtgacttgttaca

SEQ ID NO: 40299 - DNA, 15 bp, Homo sapiens
ggggtgacttgttac

SEQ ID NO: 40300 - DNA, 15 bp, Homo sapiens
tggggtgacttgtta

SEQ ID NO: 40301 - DNA, 15 bp, Homo sapiens
ttggggtgacttgtt

SEQ ID NO: 40302 - DNA, 15 bp, Homo sapiens
gttggggtgacttgt

SEQ ID NO: 40303 - DNA, 15 bp, Homo sapiens
tgttggggtgacttg

SEQ ID NO: 40304 - DNA, 15 bp, Homo sapiens
atgttggggtgactt

SEQ ID NO: 40305 - DNA, 15 bp, Homo sapiens
aatgttggggtgact

SEQ ID NO: 40306 - DNA, 15 bp, Homo sapiens
caatgttggggtgac

SEQ ID NO: 40307 - DNA, 15 bp, Homo sapiens
ccaatgttggggtga

SEQ ID NO: 40308 - DNA, 15 bp, Homo sapiens
accaatgttggggtg

SEQ ID NO: 40309 - DNA, 15 bp, Homo sapiens
caccaatgttggggt

SEQ ID NO: 40310 - DNA, 15 bp, Homo sapiens
gcaccaatgttgggg

SEQ ID NO: 40311 - DNA, 15 bp, Homo sapiens
agcaccaatgttggg

SEQ ID NO: 40312 - DNA, 15 bp, Homo sapiens
aagcaccaatgttgg

SEQ ID NO: 40313 - DNA, 15 bp, Homo sapiens
aaagcaccaatgttg

SEQ ID NO: 40314 - DNA, 15 bp, Homo sapiens
taaagcaccaatgtt

SEQ ID NO: 40315 - DNA, 15 bp, Homo sapiens
ttaaagcaccaatgt

SEQ ID NO: 40316 - DNA, 15 bp, Homo sapiens
tttaaagcaccaatg

SEQ ID NO: 40317 - DNA, 15 bp, Homo sapiens
ttttaaagcaccaat

SEQ ID NO: 40318 - DNA, 15 bp, Homo sapiens
gttttaaagcaccaa

SEQ ID NO: 40319 - DNA, 15 bp, Homo sapiens
tgttttaaagcacca

SEQ ID NO: 40320 - DNA, 15 bp, Homo sapiens
ctgttttaaagcacc

SEQ ID NO: 40321 - DNA, 15 bp, Homo sapiens
gctgttttaaagcac

SEQ ID NO: 40322 - DNA, 15 bp, Homo sapiens
tgctgttttaaagca

SEQ ID NO: 40323 - DNA, 15 bp, Homo sapiens
ttgctgttttaaagc

SEQ ID NO: 40324 - DNA, 15 bp, Homo sapiens
tttgctgttttaaag

SEQ ID NO: 40325 - DNA, 15 bp, Homo sapiens
atttgctgttttaaa

SEQ ID NO: 40326 - DNA, 15 bp, Homo sapiens
tatttgctgttttaa

SEQ ID NO: 40327 - DNA, 15 bp, Homo sapiens
atatttgctgtttta

SEQ ID NO: 40328 - DNA, 15 bp, Homo sapiens
aatatttgctgtttt

SEQ ID NO: 40329 - DNA, 15 bp, Homo sapiens
aaatatttgctgttt

SEQ ID NO: 40330 - DNA, 15 bp, Homo sapiens
taaatatttgctgtt

SEQ ID NO: 40331 - DNA, 15 bp, Homo sapiens
ataaatatttgctgt

SEQ ID NO: 40332 - DNA, 15 bp, Homo sapiens
aataaatatttgctg

SEQ ID NO: 40333 - DNA, 15 bp, Homo sapiens
taataaatatttgct

SEQ ID NO: 40334 - DNA, 15 bp, Homo sapiens
ataataaatatttgc

SEQ ID NO: 40335 - DNA, 15 bp, Homo sapiens
gataataaatatttg

SEQ ID NO: 40336 - DNA, 15 bp, Homo sapiens
agataataaatattt

SEQ ID NO: 40337 - DNA, 15 bp, Homo sapiens
gagataataaatatt

SEQ ID NO: 40338 - DNA, 15 bp, Homo sapiens
tgagataataaatat

SEQ ID NO: 40339 - DNA, 15 bp, Homo sapiens
atgagataataaata

SEQ ID NO: 40340 - DNA, 15 bp, Homo sapiens
catgagataataaat

SEQ ID NO: 40341 - DNA, 15 bp, Homo sapiens
gcatgagataataaa

SEQ ID NO: 40342 - DNA, 15 bp, Homo sapiens
tgcatgagataataa

SEQ ID NO: 40343 - DNA, 15 bp, Homo sapiens
ctgcatgagataata

SEQ ID NO: 40344 - DNA, 15 bp, Homo sapiens
actgcatgagataat

SEQ ID NO: 40345 - DNA, 15 bp, Homo sapiens
aactgcatgagataa

SEQ ID NO: 40346 - DNA, 15 bp, Homo sapiens
aaactgcatgagata

SEQ ID NO: 40347 - DNA, 15 bp, Homo sapiens
gaaactgcatgagat

SEQ ID NO: 40348 - DNA, 15 bp, Homo sapiens
ggaaactgcatgaga

SEQ ID NO: 40349 - DNA, 15 bp, Homo sapiens
aggaaactgcatgag

SEQ ID NO: 40350 - DNA, 15 bp, Homo sapiens
aaggaaactgcatga

SEQ ID NO: 40351 - DNA, 15 bp, Homo sapiens
caaggaaactgcatg

SEQ ID NO: 40352 - DNA, 15 bp, Homo sapiens
ccaaggaaactgcat

SEQ ID NO: 40353 - DNA, 15 bp, Homo sapiens
gccaaggaaactgca

SEQ ID NO: 40354 - DNA, 15 bp, Homo sapiens
ggccaaggaaactgc

SEQ ID NO: 40355 - DNA, 15 bp, Homo sapiens
tggccaaggaaactg

SEQ ID NO: 40356 - DNA, 15 bp, Homo sapiens
ctggccaaggaaact

SEQ ID NO: 40357 - DNA, 15 bp, Homo sapiens
cctggccaaggaaac

SEQ ID NO: 40358 - DNA, 15 bp, Homo sapiens
tcctggccaaggaaa

SEQ ID NO: 40359 - DNA, 15 bp, Homo sapiens
ttcctggccaaggaa

SEQ ID NO: 40360 - DNA, 15 bp, Homo sapiens
attcctggccaagga

SEQ ID NO: 40361 - DNA, 15 bp, Homo sapiens
aattcctggccaagg

SEQ ID NO: 40362 - DNA, 15 bp, Homo sapiens
aaattcctggccaag

SEQ ID NO: 40363 - DNA, 15 bp, Homo sapiens
aaaattcctggccaa

SEQ ID NO: 40364 - DNA, 15 bp, Homo sapiens
caaaattcctggcca

SEQ ID NO: 40365 - DNA, 15 bp, Homo sapiens
tcaaaattcctggcc

SEQ ID NO: 40366 - DNA, 15 bp, Homo sapiens
ttcaaaattcctggc

SEQ ID NO: 40367 - DNA, 15 bp, Homo sapiens
cttcaaaattcctgg

SEQ ID NO: 40368 - DNA, 15 bp, Homo sapiens
acttcaaaattcctg

SEQ ID NO: 40369 - DNA, 15 bp, Homo sapiens
cacttcaaaattcct

SEQ ID NO: 40370 - DNA, 15 bp, Homo sapiens
ccacttcaaaattcc

SEQ ID NO: 40371 - DNA, 15 bp, Homo sapiens
accacttcaaaattc

SEQ ID NO: 40372 - DNA, 15 bp, Homo sapiens
aaccacttcaaaatt

SEQ ID NO: 40373 - DNA, 15 bp, Homo sapiens
aaaccacttcaaaat

SEQ ID NO: 40374 - DNA, 15 bp, Homo sapiens
taaaccacttcaaaa

SEQ ID NO: 40375 - DNA, 15 bp, Homo sapiens
ctaaaccacttcaaa

SEQ ID NO: 40376 - DNA, 15 bp, Homo sapiens
gctaaaccacttcaa

SEQ ID NO: 40377 - DNA, 15 bp, Homo sapiens
agctaaaccacttca

SEQ ID NO: 40378 - DNA, 15 bp, Homo sapiens
tagctaaaccacttc

SEQ ID NO: 40379 - DNA, 15 bp, Homo sapiens
ctagctaaaccactt

SEQ ID NO: 40380 - DNA, 15 bp, Homo sapiens
cctagctaaaccact

SEQ ID NO: 40381 - DNA, 15 bp, Homo sapiens
acctagctaaaccac

SEQ ID NO: 40382 - DNA, 15 bp, Homo sapiens
cacctagctaaacca

SEQ ID NO: 40383 - DNA, 15 bp, Homo sapiens
tcacctagctaaacc

SEQ ID NO: 40384 - DNA, 15 bp, Homo sapiens
atcacctagctaaac

SEQ ID NO: 40385 - DNA, 15 bp, Homo sapiens
aatcacctagctaaa

SEQ ID NO: 40386 - DNA, 15 bp, Homo sapiens
gaatcacctagctaa

SEQ ID NO: 40387 - DNA, 15 bp, Homo sapiens
ggaatcacctagcta

SEQ ID NO: 40388 - DNA, 15 bp, Homo sapiens
tggaatcacctagct

SEQ ID NO: 40389 - DNA, 15 bp, Homo sapiens
ctggaatcacctagc

SEQ ID NO: 40390 - DNA, 15 bp, Homo sapiens
actggaatcacctag

SEQ ID NO: 40391 - DNA, 15 bp, Homo sapiens
gactggaatcaccta

SEQ ID NO: 40392 - DNA, 15 bp, Homo sapiens
ggactggaatcacct

SEQ ID NO: 40393 - DNA, 15 bp, Homo sapiens
tggactggaatcacc

SEQ ID NO: 40394 - DNA, 15 bp, Homo sapiens
ctggactggaatcac

SEQ ID NO: 40395 - DNA, 15 bp, Homo sapiens
cctggactggaatca

SEQ ID NO: 40396 - DNA, 15 bp, Homo sapiens
ccctggactggaatc

SEQ ID NO: 40397 - DNA, 15 bp, Homo sapiens
accctggactggaat

SEQ ID NO: 40398 - DNA, 15 bp, Homo sapiens
gaccctggactggaa

SEQ ID NO: 40399 - DNA, 15 bp, Homo sapiens
agaccctggactgga

SEQ ID NO: 40400 - DNA, 15 bp, Homo sapiens
cagaccctggactgg

SEQ ID NO: 40401 - DNA, 15 bp, Homo sapiens
acagaccctggactg

SEQ ID NO: 40402 - DNA, 15 bp, Homo sapiens
gacagaccctggact

SEQ ID NO: 40403 - DNA, 15 bp, Homo sapiens
tgacagaccctggac

SEQ ID NO: 40404 - DNA, 15 bp, Homo sapiens
atgacagaccctgga

SEQ ID NO: 40405 - DNA, 15 bp, Homo sapiens
catgacagaccctgg

SEQ ID NO: 40406 - DNA, 15 bp, Homo sapiens
tcatgacagaccctg

SEQ ID NO: 40407 - DNA, 15 bp, Homo sapiens
ctcatgacagaccct

SEQ ID NO: 40408 - DNA, 15 bp, Homo sapiens
tctcatgacagaccc

SEQ ID NO: 40409 - DNA, 15 bp, Homo sapiens
atctcatgacagacc

SEQ ID NO: 40410 - DNA, 15 bp, Homo sapiens
aatctcatgacagac

SEQ ID NO: 40411 - DNA, 15 bp, Homo sapiens
caatctcatgacaga

SEQ ID NO: 40412 - DNA, 15 bp, Homo sapiens
gcaatctcatgacag

SEQ ID NO: 40413 - DNA, 15 bp, Homo sapiens
tgcaatctcatgaca

SEQ ID NO: 40414 - DNA, 15 bp, Homo sapiens
gtgcaatctcatgac

SEQ ID NO: 40415 - DNA, 15 bp, Homo sapiens
agtgcaatctcatga

SEQ ID NO: 40416 - DNA, 15 bp, Homo sapiens
gagtgcaatctcatg

SEQ ID NO: 40417 - DNA, 15 bp, Homo sapiens
tgagtgcaatctcat

SEQ ID NO: 40418 - DNA, 15 bp, Homo sapiens
ttgagtgcaatctca

SEQ ID NO: 40419 - DNA, 15 bp, Homo sapiens
cttgagtgcaatctc

SEQ ID NO: 40420 - DNA, 15 bp, Homo sapiens
tcttgagtgcaatct

SEQ ID NO: 40421 - DNA, 15 bp, Homo sapiens
atcttgagtgcaatc

SEQ ID NO: 40422 - DNA, 15 bp, Homo sapiens
catcttgagtgcaat

SEQ ID NO: 40423 - DNA, 15 bp, Homo sapiens
gcatcttgagtgcaa

SEQ ID NO: 40424 - DNA, 15 bp, Homo sapiens
agcatcttgagtgca

SEQ ID NO: 40425 - DNA, 15 bp, Homo sapiens
cagcatcttgagtgc

SEQ ID NO: 40426 - DNA, 15 bp, Homo sapiens
ccagcatcttgagtg

SEQ ID NO: 40427 - DNA, 15 bp, Homo sapiens
gccagcatcttgagt

SEQ ID NO: 40428 - DNA, 15 bp, Homo sapiens
ggccagcatcttgag

SEQ ID NO: 40429 - DNA, 15 bp, Homo sapiens
tggccagcatcttga

SEQ ID NO: 40430 - DNA, 15 bp, Homo sapiens
ctggccagcatcttg

SEQ ID NO: 40431 - DNA, 15 bp, Homo sapiens
cctggccagcatctt

SEQ ID NO: 40432 - DNA, 15 bp, Homo sapiens
ccctggccagcatct

SEQ ID NO: 40433 - DNA, 15 bp, Homo sapiens
accctggccagcatc

SEQ ID NO: 40434 - DNA, 15 bp, Homo sapiens
aaccctggccagcat

SEQ ID NO: 40435 - DNA, 15 bp, Homo sapiens
caaccctggccagca

SEQ ID NO: 40436 - DNA, 15 bp, Homo sapiens
gcaaccctggccagc

SEQ ID NO: 40437 - DNA, 15 bp, Homo sapiens
ggcaaccctggccag

SEQ ID NO: 40438 - DNA, 15 bp, Homo sapiens
tggcaaccctggcca

SEQ ID NO: 40439 - DNA, 15 bp, Homo sapiens
atggcaaccctggcc

SEQ ID NO: 40440 - DNA, 15 bp, Homo sapiens
gatggcaaccctggc

SEQ ID NO: 40441 - DNA, 15 bp, Homo sapiens
tgatggcaaccctgg

SEQ ID NO: 40442 - DNA, 15 bp, Homo sapiens
atgatggcaaccctg

SEQ ID NO: 40443 - DNA, 15 bp, Homo sapiens
gatgatggcaaccct

SEQ ID NO: 40444 - DNA, 15 bp, Homo sapiens
agatgatggcaaccc

SEQ ID NO: 40445 - DNA, 15 bp, Homo sapiens
cagatgatggcaacc

SEQ ID NO: 40446 - DNA, 15 bp, Homo sapiens
tcagatgatggcaac

SEQ ID NO: 40447 - DNA, 15 bp, Homo sapiens
ttcagatgatggcaa

SEQ ID NO: 40448 - DNA, 15 bp, Homo sapiens
cttcagatgatggca

SEQ ID NO: 40449 - DNA, 15 bp, Homo sapiens
gcttcagatgatggc

SEQ ID NO: 40450 - DNA, 15 bp, Homo sapiens
agcttcagatgatgg

SEQ ID NO: 40451 - DNA, 15 bp, Homo sapiens
aagcttcagatgatg

SEQ ID NO: 40452 - DNA, 15 bp, Homo sapiens
caagcttcagatgat

SEQ ID NO: 40453 - DNA, 15 bp, Homo sapiens
tcaagcttcagatga

SEQ ID NO: 40454 - DNA, 15 bp, Homo sapiens
gtcaagcttcagatg

SEQ ID NO: 40455 - DNA, 15 bp, Homo sapiens
ggtcaagcttcagat

SEQ ID NO: 40456 - DNA, 15 bp, Homo sapiens
cggtcaagcttcaga

SEQ ID NO: 40457 - DNA, 15 bp, Homo sapiens
tcggtcaagcttcag

SEQ ID NO: 40458 - DNA, 15 bp, Homo sapiens
ctcggtcaagcttca

SEQ ID NO: 40459 - DNA, 15 bp, Homo sapiens
cctcggtcaagcttc

SEQ ID NO: 40460 - DNA, 15 bp, Homo sapiens
gcctcggtcaagctt

SEQ ID NO: 40461 - DNA, 15 bp, Homo sapiens
agcctcggtcaagct

SEQ ID NO: 40462 - DNA, 15 bp, Homo sapiens
tagcctcggtcaagc

SEQ ID NO: 40463 - DNA, 15 bp, Homo sapiens
ctagcctcggtcaag

SEQ ID NO: 40464 - DNA, 15 bp, Homo sapiens
tctagcctcggtcaa

SEQ ID NO: 40465 - DNA, 15 bp, Homo sapiens
ctctagcctcggtca

SEQ ID NO: 40466 - DNA, 15 bp, Homo sapiens
cctctagcctcggtc

SEQ ID NO: 40467 - DNA, 15 bp, Homo sapiens
tcctctagcctcggt

SEQ ID NO: 40468 - DNA, 15 bp, Homo sapiens
atcctctagcctcgg

SEQ ID NO: 40469 - DNA, 15 bp, Homo sapiens
gatcctctagcctcg

SEQ ID NO: 40470 - DNA, 15 bp, Homo sapiens
agatcctctagcctc

SEQ ID NO: 40471 - DNA, 15 bp, Homo sapiens
cagatcctctagcct

SEQ ID NO: 40472 - DNA, 15 bp, Homo sapiens
tcagatcctctagcc

SEQ ID NO: 40473 - DNA, 15 bp, Homo sapiens
atcagatcctctagc

SEQ ID NO: 40474 - DNA, 15 bp, Homo sapiens
aatcagatcctctag

SEQ ID NO: 40475 - DNA, 15 bp, Homo sapiens
gaatcagatcctcta

SEQ ID NO: 40476 - DNA, 15 bp, Homo sapiens
ggaatcagatcctct

SEQ ID NO: 40477 - DNA, 15 bp, Homo sapiens
tggaatcagatcctc

SEQ ID NO: 40478 - DNA, 15 bp, Homo sapiens
ttggaatcagatcct

SEQ ID NO: 40479 - DNA, 15 bp, Homo sapiens
cttggaatcagatcc

SEQ ID NO: 40480 - DNA, 15 bp, Homo sapiens
tcttggaatcagatc

SEQ ID NO: 40481 - DNA, 15 bp, Homo sapiens
atcttggaatcagat

SEQ ID NO: 40482 - DNA, 15 bp, Homo sapiens
catcttggaatcaga

SEQ ID NO: 40483 - DNA, 15 bp, Homo sapiens
ccatcttggaatcag

SEQ ID NO: 40484 - DNA, 15 bp, Homo sapiens
gccatcttggaatca

SEQ ID NO: 40485 - DNA, 15 bp, Homo sapiens
agccatcttggaatc

SEQ ID NO: 40486 - DNA, 15 bp, Homo sapiens
aagccatcttggaat

SEQ ID NO: 40487 - DNA, 15 bp, Homo sapiens
taagccatcttggaa

SEQ ID NO: 40488 - DNA, 15 bp, Homo sapiens
ataagccatcttgga

SEQ ID NO: 40489 - DNA, 15 bp, Homo sapiens
cataagccatcttgg

SEQ ID NO: 40490 - DNA, 15 bp, Homo sapiens
acataagccatcttg

SEQ ID NO: 40491 - DNA, 15 bp, Homo sapiens
tacataagccatctt

SEQ ID NO: 40492 - DNA, 15 bp, Homo sapiens
gtacataagccatct

SEQ ID NO: 40493 - DNA, 15 bp, Homo sapiens
tgtacataagccatc

SEQ ID NO: 40494 - DNA, 15 bp, Homo sapiens
atgtacataagccat

SEQ ID NO: 40495 - DNA, 15 bp, Homo sapiens
catgtacataagcca

SEQ ID NO: 40496 - DNA, 15 bp, Homo sapiens
ccatgtacataagcc

SEQ ID NO: 40497 - DNA, 15 bp, Homo sapiens
gccatgtacataagc

SEQ ID NO: 40498 - DNA, 15 bp, Homo sapiens
agccatgtacataag

SEQ ID NO: 40499 - DNA, 15 bp, Homo sapiens
aagccatgtacataa

SEQ ID NO: 40500 - DNA, 15 bp, Homo sapiens
aaagccatgtacata

SEQ ID NO: 40501 - DNA, 15 bp, Homo sapiens
aaaagccatgtacat

SEQ ID NO: 40502 - DNA, 15 bp, Homo sapiens
caaaagccatgtaca

SEQ ID NO: 40503 - DNA, 15 bp, Homo sapiens
ccaaaagccatgtac

SEQ ID NO: 40504 - DNA, 15 bp, Homo sapiens
gccaaaagccatgta

SEQ ID NO: 40505 - DNA, 15 bp, Homo sapiens
tgccaaaagccatgt

SEQ ID NO: 40506 - DNA, 15 bp, Homo sapiens
ctgccaaaagccatg

SEQ ID NO: 40507 - DNA, 15 bp, Homo sapiens
tctgccaaaagccat

SEQ ID NO: 40508 - DNA, 15 bp, Homo sapiens
ttctgccaaaagcca

SEQ ID NO: 40509 - DNA, 15 bp, Homo sapiens
cttctgccaaaagcc

SEQ ID NO: 40510 - DNA, 15 bp, Homo sapiens
ccttctgccaaaagc

SEQ ID NO: 40511 - DNA, 15 bp, Homo sapiens
accttctgccaaaag

SEQ ID NO: 40512 - DNA, 15 bp, Homo sapiens
gaccttctgccaaaa

SEQ ID NO: 40513 - DNA, 15 bp, Homo sapiens
agaccttctgccaaa

SEQ ID NO: 40514 - DNA, 15 bp, Homo sapiens
gagaccttctgccaa

SEQ ID NO: 40515 - DNA, 15 bp, Homo sapiens
tgagaccttctgcca

SEQ ID NO: 40516 - DNA, 15 bp, Homo sapiens
ctgagaccttctgcc

SEQ ID NO: 40517 - DNA, 15 bp, Homo sapiens
actgagaccttctgc

SEQ ID NO: 40518 - DNA, 15 bp, Homo sapiens
aactgagaccttctg

SEQ ID NO: 40519 - DNA, 15 bp, Homo sapiens
gaactgagaccttct

SEQ ID NO: 40520 - DNA, 15 bp, Homo sapiens
ggaactgagaccttc

SEQ ID NO: 40521 - DNA, 15 bp, Homo sapiens
gggaactgagacctt

SEQ ID NO: 40522 - DNA, 15 bp, Homo sapiens
agggaactgagacct

SEQ ID NO: 40523 - DNA, 15 bp, Homo sapiens
cagggaactgagacc

SEQ ID NO: 40524 - DNA, 15 bp, Homo sapiens
gcagggaactgagac

SEQ ID NO: 40525 - DNA, 15 bp, Homo sapiens
agcagggaactgaga

SEQ ID NO: 40526 - DNA, 15 bp, Homo sapiens
cagcagggaactgag

SEQ ID NO: 40527 - DNA, 15 bp, Homo sapiens
ccagcagggaactga

SEQ ID NO: 40528 - DNA, 15 bp, Homo sapiens
accagcagggaactg

SEQ ID NO: 40529 - DNA, 15 bp, Homo sapiens
aaccagcagggaact

SEQ ID NO: 40530 - DNA, 15 bp, Homo sapiens
gaaccagcagggaac

SEQ ID NO: 40531 - DNA, 15 bp, Homo sapiens
agaaccagcagggaa

SEQ ID NO: 40532 - DNA, 15 bp, Homo sapiens
gagaaccagcaggga

SEQ ID NO: 40533 - DNA, 15 bp, Homo sapiens
cgagaaccagcaggg

SEQ ID NO: 40534 - DNA, 15 bp, Homo sapiens
ccgagaaccagcagg

SEQ ID NO: 40535 - DNA, 15 bp, Homo sapiens
accgagaaccagcag

SEQ ID NO: 40536 - DNA, 15 bp, Homo sapiens
gaccgagaaccagca

SEQ ID NO: 40537 - DNA, 15 bp, Homo sapiens
cgaccgagaaccagc

SEQ ID NO: 40538 - DNA, 15 bp, Homo sapiens
tcgaccgagaaccag

SEQ ID NO: 40539 - DNA, 15 bp, Homo sapiens
ttcgaccgagaacca

SEQ ID NO: 40540 - DNA, 15 bp, Homo sapiens
cttcgaccgagaacc

SEQ ID NO: 40541 - DNA, 15 bp, Homo sapiens
ccttcgaccgagaac

SEQ ID NO: 40542 - DNA, 15 bp, Homo sapiens
gccttcgaccgagaa

SEQ ID NO: 40543 - DNA, 15 bp, Homo sapiens
ggccttcgaccgaga

SEQ ID NO: 40544 - DNA, 15 bp, Homo sapiens
tggccttcgaccgag

SEQ ID NO: 40545 - DNA, 15 bp, Homo sapiens
gtggccttcgaccga

SEQ ID NO: 40546 - DNA, 15 bp, Homo sapiens
tgtggccttcgaccg

SEQ ID NO: 40547 - DNA, 15 bp, Homo sapiens
ctgtggccttcgacc

SEQ ID NO: 40548 - DNA, 15 bp, Homo sapiens
actgtggccttcgac

SEQ ID NO: 40549 - DNA, 15 bp, Homo sapiens
aactgtggccttcga

SEQ ID NO: 40550 - DNA, 15 bp, Homo sapiens
aaactgtggccttcg

SEQ ID NO: 40551 - DNA, 15 bp, Homo sapiens
gaaactgtggccttc

SEQ ID NO: 40552 - DNA, 15 bp, Homo sapiens
agaaactgtggcctt

SEQ ID NO: 40553 - DNA, 15 bp, Homo sapiens
gagaaactgtggcct

SEQ ID NO: 40554 - DNA, 15 bp, Homo sapiens
cgagaaactgtggcc

SEQ ID NO: 40555 - DNA, 15 bp, Homo sapiens
gcgagaaactgtggc

SEQ ID NO: 40556 - DNA, 15 bp, Homo sapiens
ggcgagaaactgtgg

SEQ ID NO: 40557 - DNA, 15 bp, Homo sapiens
tggcgagaaactgtg

SEQ ID NO: 40558 - DNA, 15 bp, Homo sapiens
gtggcgagaaactgt

SEQ ID NO: 40559 - DNA, 15 bp, Homo sapiens
cgtggcgagaaactg

SEQ ID NO: 40560 - DNA, 15 bp, Homo sapiens
acgtggcgagaaact

SEQ ID NO: 40561 - DNA, 15 bp, Homo sapiens
cacgtggcgagaaac

SEQ ID NO: 40562 - DNA, 15 bp, Homo sapiens
ccacgtggcgagaaa

SEQ ID NO: 40563 - DNA, 15 bp, Homo sapiens
cccacgtggcgagaa

SEQ ID NO: 40564 - DNA, 15 bp, Homo sapiens
gcccacgtggcgaga

SEQ ID NO: 40565 - DNA, 15 bp, Homo sapiens
ggcccacgtggcgag

SEQ ID NO: 40566 - DNA, 15 bp, Homo sapiens
aggcccacgtggcga

SEQ ID NO: 40567 - DNA, 15 bp, Homo sapiens
gaggcccacgtggcg

SEQ ID NO: 40568 - DNA, 15 bp, Homo sapiens
agaggcccacgtggc

SEQ ID NO: 40569 - DNA, 15 bp, Homo sapiens
gagaggcccacgtgg

SEQ ID NO: 40570 - DNA, 15 bp, Homo sapiens
agagaggcccacgtg

SEQ ID NO: 40571 - DNA, 15 bp, Homo sapiens
gagagaggcccacgt

SEQ ID NO: 40572 - DNA, 15 bp, Homo sapiens
agagagaggcccacg

SEQ ID NO: 40573 - DNA, 15 bp, Homo sapiens
tagagagaggcccac

SEQ ID NO: 40574 - DNA, 15 bp, Homo sapiens
ctagagagaggccca

SEQ ID NO: 40575 - DNA, 15 bp, Homo sapiens
cctagagagaggccc

SEQ ID NO: 40576 - DNA, 15 bp, Homo sapiens
ccctagagagaggcc

SEQ ID NO: 40577 - DNA, 15 bp, Homo sapiens
accctagagagaggc

SEQ ID NO: 40578 - DNA, 15 bp, Homo sapiens
caccctagagagagg

SEQ ID NO: 40579 - DNA, 15 bp, Homo sapiens
gcaccctagagagag

SEQ ID NO: 40580 - DNA, 15 bp, Homo sapiens
agcaccctagagaga

SEQ ID NO: 40581 - DNA, 15 bp, Homo sapiens
aagcaccctagagag

SEQ ID NO: 40582 - DNA, 15 bp, Homo sapiens
caagcaccctagaga

SEQ ID NO: 40583 - DNA, 15 bp, Homo sapiens
tcaagcaccctagag

SEQ ID NO: 40584 - DNA, 15 bp, Homo sapiens
ctcaagcaccctaga

SEQ ID NO: 40585 - DNA, 15 bp, Homo sapiens
actcaagcaccctag

SEQ ID NO: 40586 - DNA, 15 bp, Homo sapiens
cactcaagcacccta

SEQ ID NO: 40587 - DNA, 15 bp, Homo sapiens
acactcaagcaccct

SEQ ID NO: 40588 - DNA, 15 bp, Homo sapiens
gacactcaagcaccc

SEQ ID NO: 40589 - DNA, 15 bp, Homo sapiens
agacactcaagcacc

SEQ ID NO: 40590 - DNA, 15 bp, Homo sapiens
aagacactcaagcac

SEQ ID NO: 40591 - DNA, 15 bp, Homo sapiens
gaagacactcaagca

SEQ ID NO: 40592 - DNA, 15 bp, Homo sapiens
tgaagacactcaagc

SEQ ID NO: 40593 - DNA, 15 bp, Homo sapiens
atgaagacactcaag

SEQ ID NO: 40594 - DNA, 15 bp, Homo sapiens
catgaagacactcaa

SEQ ID NO: 40595 - DNA, 15 bp, Homo sapiens
tcatgaagacactca

SEQ ID NO: 40596 - DNA, 15 bp, Homo sapiens
gtcatgaagacactc

SEQ ID NO: 40597 - DNA, 15 bp, Homo sapiens
tgtcatgaagacact

SEQ ID NO: 40598 - DNA, 15 bp, Homo sapiens
atgtcatgaagacac

SEQ ID NO: 40599 - DNA, 15 bp, Homo sapiens
catgtcatgaagaca

SEQ ID NO: 40600 - DNA, 15 bp, Homo sapiens
ccatgtcatgaagac

SEQ ID NO: 40601 - DNA, 15 bp, Homo sapiens
gccatgtcatgaaga

SEQ ID NO: 40602 - DNA, 15 bp, Homo sapiens
agccatgtcatgaag

SEQ ID NO: 40603 - DNA, 15 bp, Homo sapiens
cagccatgtcatgaa

SEQ ID NO: 40604 - DNA, 15 bp, Homo sapiens
acagccatgtcatga

SEQ ID NO: 40605 - DNA, 15 bp, Homo sapiens
cacagccatgtcatg

SEQ ID NO: 40606 - DNA, 15 bp, Homo sapiens
tcacagccatgtcat

SEQ ID NO: 40607 - DNA, 15 bp, Homo sapiens
ctcacagccatgtca

SEQ ID NO: 40608 - DNA, 15 bp, Homo sapiens
gctcacagccatgtc

SEQ ID NO: 40609 - DNA, 15 bp, Homo sapiens
agctcacagccatgt

SEQ ID NO: 40610 - DNA, 15 bp, Homo sapiens
aagctcacagccatg

SEQ ID NO: 40611 - DNA, 15 bp, Homo sapiens
gaagctcacagccat

SEQ ID NO: 40612 - DNA, 15 bp, Homo sapiens
agaagctcacagcca

SEQ ID NO: 40613 - DNA, 15 bp, Homo sapiens
gagaagctcacagcc

SEQ ID NO: 40614 - DNA, 15 bp, Homo sapiens
agagaagctcacagc

SEQ ID NO: 40615 - DNA, 15 bp, Homo sapiens
aagagaagctcacag

SEQ ID NO: 40616 - DNA, 15 bp, Homo sapiens
taagagaagctcaca

SEQ ID NO: 40617 - DNA, 15 bp, Homo sapiens
ctaagagaagctcac

SEQ ID NO: 40618 - DNA, 15 bp, Homo sapiens
tctaagagaagctca

SEQ ID NO: 40619 - DNA, 15 bp, Homo sapiens
ctctaagagaagctc

SEQ ID NO: 40620 - DNA, 15 bp, Homo sapiens
actctaagagaagct

SEQ ID NO: 40621 - DNA, 15 bp, Homo sapiens
cactctaagagaagc

SEQ ID NO: 40622 - DNA, 15 bp, Homo sapiens
tcactctaagagaag

SEQ ID NO: 40623 - DNA, 15 bp, Homo sapiens
ctcactctaagagaa

SEQ ID NO: 40624 - DNA, 15 bp, Homo sapiens
tctcactctaagaga

SEQ ID NO: 40625 - DNA, 15 bp, Homo sapiens
ctctcactctaagag

SEQ ID NO: 40626 - DNA, 15 bp, Homo sapiens
tctctcactctaaga

SEQ ID NO: 40627 - DNA, 15 bp, Homo sapiens
ctctctcactctaag

SEQ ID NO: 40628 - DNA, 15 bp, Homo sapiens
tctctctcactctaa

SEQ ID NO: 40629 - DNA, 15 bp, Homo sapiens
atctctctcactcta

SEQ ID NO: 40630 - DNA, 15 bp, Homo sapiens
tatctctctcactct

SEQ ID NO: 40631 - DNA, 15 bp, Homo sapiens
atatctctctcactc

SEQ ID NO: 40632 - DNA, 15 bp, Homo sapiens
catatctctctcact

SEQ ID NO: 40633 - DNA, 15 bp, Homo sapiens
tcatatctctctcac

SEQ ID NO: 40634 - DNA, 15 bp, Homo sapiens
ttcatatctctctca

SEQ ID NO: 40635 - DNA, 15 bp, Homo sapiens
tttcatatctctctc

SEQ ID NO: 40636 - DNA, 15 bp, Homo sapiens
ctttcatatctctct

SEQ ID NO: 40637 - DNA, 15 bp, Homo sapiens
tctttcatatctctc

SEQ ID NO: 40638 - DNA, 15 bp, Homo sapiens
ttctttcatatctct

SEQ ID NO: 40639 - DNA, 15 bp, Homo sapiens
attctttcatatctc

SEQ ID NO: 40640 - DNA, 15 bp, Homo sapiens
cattctttcatatct

SEQ ID NO: 40641 - DNA, 15 bp, Homo sapiens
gcattctttcatatc

SEQ ID NO: 40642 - DNA, 15 bp, Homo sapiens
tgcattctttcatat

SEQ ID NO: 40643 - DNA, 15 bp, Homo sapiens
ttgcattctttcata

SEQ ID NO: 40644 - DNA, 15 bp, Homo sapiens
tttgcattctttcat

SEQ ID NO: 40645 - DNA, 15 bp, Homo sapiens
ctttgcattctttca

SEQ ID NO: 40646 - DNA, 15 bp, Homo sapiens
cctttgcattctttc

SEQ ID NO: 40647 - DNA, 15 bp, Homo sapiens
ccctttgcattcttt

SEQ ID NO: 40648 - DNA, 15 bp, Homo sapiens
cccctttgcattctt

SEQ ID NO: 40649 - DNA, 15 bp, Homo sapiens
tcccctttgcattct

SEQ ID NO: 40650 - DNA, 15 bp, Homo sapiens
ttcccctttgcattc

SEQ ID NO: 40651 - DNA, 15 bp, Homo sapiens
cttcccctttgcatt

SEQ ID NO: 40652 - DNA, 15 bp, Homo sapiens
gcttcccctttgcat

SEQ ID NO: 40653 - DNA, 15 bp, Homo sapiens
agcttcccctttgca

SEQ ID NO: 40654 - DNA, 15 bp, Homo sapiens
cagcttcccctttgc

SEQ ID NO: 40655 - DNA, 15 bp, Homo sapiens
acagcttcccctttg

SEQ ID NO: 40656 - DNA, 15 bp, Homo sapiens
tacagcttccccttt

SEQ ID NO: 40657 - DNA, 15 bp, Homo sapiens
ttacagcttcccctt

SEQ ID NO: 40658 - DNA, 15 bp, Homo sapiens
attacagcttcccct

SEQ ID NO: 40659 - DNA, 15 bp, Homo sapiens
tattacagcttcccc

SEQ ID NO: 40660 - DNA, 15 bp, Homo sapiens
gtattacagcttccc

SEQ ID NO: 40661 - DNA, 15 bp, Homo sapiens
agtattacagcttcc

SEQ ID NO: 40662 - DNA, 15 bp, Homo sapiens
aagtattacagcttc

SEQ ID NO: 40663 - DNA, 15 bp, Homo sapiens
aaagtattacagctt

SEQ ID NO: 40664 - DNA, 15 bp, Homo sapiens
aaaagtattacagct

SEQ ID NO: 40665 - DNA, 15 bp, Homo sapiens
taaaagtattacagc

SEQ ID NO: 40666 - DNA, 15 bp, Homo sapiens
ctaaaagtattacag

SEQ ID NO: 40667 - DNA, 15 bp, Homo sapiens
actaaaagtattaca

SEQ ID NO: 40668 - DNA, 15 bp, Homo sapiens
gactaaaagtattac

SEQ ID NO: 40669 - DNA, 15 bp, Homo sapiens
agactaaaagtatta

SEQ ID NO: 40670 - DNA, 15 bp, Homo sapiens
gagactaaaagtatt

SEQ ID NO: 40671 - DNA, 15 bp, Homo sapiens
tgagactaaaagtat

SEQ ID NO: 40672 - DNA, 15 bp, Homo sapiens
ttgagactaaaagta

SEQ ID NO: 40673 - DNA, 15 bp, Homo sapiens
tttgagactaaaagt

SEQ ID NO: 40674 - DNA, 15 bp, Homo sapiens
ttttgagactaaaag

SEQ ID NO: 40675 - DNA, 15 bp, Homo sapiens
cttttgagactaaaa

SEQ ID NO: 40676 - DNA, 15 bp, Homo sapiens
acttttgagactaaa

SEQ ID NO: 40677 - DNA, 15 bp, Homo sapiens
gacttttgagactaa

SEQ ID NO: 40678 - DNA, 15 bp, Homo sapiens
ggacttttgagacta

SEQ ID NO: 40679 - DNA, 15 bp, Homo sapiens
cggacttttgagact

SEQ ID NO: 40680 - DNA, 15 bp, Homo sapiens
tcggacttttgagac

SEQ ID NO: 40681 - DNA, 15 bp, Homo sapiens
gtcggacttttgaga

SEQ ID NO: 40682 - DNA, 15 bp, Homo sapiens
agtcggacttttgag

SEQ ID NO: 40683 - DNA, 15 bp, Homo sapiens
gagtcggacttttga

SEQ ID NO: 40684 - DNA, 15 bp, Homo sapiens
tgagtcggacttttg

SEQ ID NO: 40685 - DNA, 15 bp, Homo sapiens
atgagtcggactttt

SEQ ID NO: 40686 - DNA, 15 bp, Homo sapiens
gatgagtcggacttt

SEQ ID NO: 40687 - DNA, 15 bp, Homo sapiens
tgatgagtcggactt

SEQ ID NO: 40688 - DNA, 15 bp, Homo sapiens
gtgatgagtcggact

SEQ ID NO: 40689 - DNA, 15 bp, Homo sapiens
agtgatgagtcggac

SEQ ID NO: 40690 - DNA, 15 bp, Homo sapiens
aagtgatgagtcgga

SEQ ID NO: 40691 - DNA, 15 bp, Homo sapiens
gaagtgatgagtcgg

SEQ ID NO: 40692 - DNA, 15 bp, Homo sapiens
agaagtgatgagtcg

SEQ ID NO: 40693 - DNA, 15 bp, Homo sapiens
cagaagtgatgagtc

SEQ ID NO: 40694 - DNA, 15 bp, Homo sapiens
gcagaagtgatgagt

SEQ ID NO: 40695 - DNA, 15 bp, Homo sapiens
ggcagaagtgatgag

SEQ ID NO: 40696 - DNA, 15 bp, Homo sapiens
tggcagaagtgatga

SEQ ID NO: 40697 - DNA, 15 bp, Homo sapiens
atggcagaagtgatg

SEQ ID NO: 40698 - DNA, 15 bp, Homo sapiens
tatggcagaagtgat

SEQ ID NO: 40699 - DNA, 15 bp, Homo sapiens
atatggcagaagtga

SEQ ID NO: 40700 - DNA, 15 bp, Homo sapiens
aatatggcagaagtg

SEQ ID NO: 40701 - DNA, 15 bp, Homo sapiens
gaatatggcagaagt

SEQ ID NO: 40702 - DNA, 15 bp, Homo sapiens
agaatatggcagaag

SEQ ID NO: 40703 - DNA, 15 bp, Homo sapiens
tagaatatggcagaa

SEQ ID NO: 40704 - DNA, 15 bp, Homo sapiens
atagaatatggcaga

SEQ ID NO: 40705 - DNA, 15 bp, Homo sapiens
aatagaatatggcag

SEQ ID NO: 40706 - DNA, 15 bp, Homo sapiens
gaatagaatatggca

SEQ ID NO: 40707 - DNA, 15 bp, Homo sapiens
tgaatagaatatggc

SEQ ID NO: 40708 - DNA, 15 bp, Homo sapiens
ctgaatagaatatgg

SEQ ID NO: 40709 - DNA, 15 bp, Homo sapiens
actgaatagaatatg

SEQ ID NO: 40710 - DNA, 15 bp, Homo sapiens
tactgaatagaatat

SEQ ID NO: 40711 - DNA, 15 bp, Homo sapiens
ctactgaatagaata

SEQ ID NO: 40712 - DNA, 15 bp, Homo sapiens
tctactgaatagaat

SEQ ID NO: 40713 - DNA, 15 bp, Homo sapiens
ttctactgaatagaa

SEQ ID NO: 40714 - DNA, 15 bp, Homo sapiens
cttctactgaataga

SEQ ID NO: 40715 - DNA, 15 bp, Homo sapiens
acttctactgaatag

SEQ ID NO: 40716 - DNA, 15 bp, Homo sapiens
cacttctactgaata

SEQ ID NO: 40717 - DNA, 15 bp, Homo sapiens
tcacttctactgaat

SEQ ID NO: 40718 - DNA, 15 bp, Homo sapiens
ctcacttctactgaa

SEQ ID NO: 40719 - DNA, 15 bp, Homo sapiens
actcacttctactga

SEQ ID NO: 40720 - DNA, 15 bp, Homo sapiens
gactcacttctactg

SEQ ID NO: 40721 - DNA, 15 bp, Homo sapiens
tgactcacttctact

SEQ ID NO: 40722 - DNA, 15 bp, Homo sapiens
gtgactcacttctac

SEQ ID NO: 40723 - DNA, 15 bp, Homo sapiens
ggtgactcacttcta

SEQ ID NO: 40724 - DNA, 15 bp, Homo sapiens
tggtgactcacttct

SEQ ID NO: 40725 - DNA, 15 bp, Homo sapiens
ttggtgactcacttc

SEQ ID NO: 40726 - DNA, 15 bp, Homo sapiens
attggtgactcactt

SEQ ID NO: 40727 - DNA, 15 bp, Homo sapiens
aattggtgactcact

SEQ ID NO: 40728 - DNA, 15 bp, Homo sapiens
aaattggtgactcac

SEQ ID NO: 40729 - DNA, 15 bp, Homo sapiens
gaaattggtgactca

SEQ ID NO: 40730 - DNA, 15 bp, Homo sapiens
tgaaattggtgactc

SEQ ID NO: 40731 - DNA, 15 bp, Homo sapiens
ctgaaattggtgact

SEQ ID NO: 40732 - DNA, 15 bp, Homo sapiens
gctgaaattggtgac

SEQ ID NO: 40733 - DNA, 15 bp, Homo sapiens
ggctgaaattggtga

SEQ ID NO: 40734 - DNA, 15 bp, Homo sapiens
gggctgaaattggtg

SEQ ID NO: 40735 - DNA, 15 bp, Homo sapiens
tgggctgaaattggt

SEQ ID NO: 40736 - DNA, 15 bp, Homo sapiens
atgggctgaaattgg

SEQ ID NO: 40737 - DNA, 15 bp, Homo sapiens
tatgggctgaaattg

SEQ ID NO: 40738 - DNA, 15 bp, Homo sapiens
gtatgggctgaaatt

SEQ ID NO: 40739 - DNA, 15 bp, Homo sapiens
agtatgggctgaaat

SEQ ID NO: 40740 - DNA, 15 bp, Homo sapiens
gagtatgggctgaaa

SEQ ID NO: 40741 - DNA, 15 bp, Homo sapiens
tgagtatgggctgaa

SEQ ID NO: 40742 - DNA, 15 bp, Homo sapiens
ctgagtatgggctga

SEQ ID NO: 40743 - DNA, 15 bp, Homo sapiens
actgagtatgggctg

SEQ ID NO: 40744 - DNA, 15 bp, Homo sapiens
cactgagtatgggct

SEQ ID NO: 40745 - DNA, 15 bp, Homo sapiens
ccactgagtatgggc

SEQ ID NO: 40746 - DNA, 15 bp, Homo sapiens
cccactgagtatggg

SEQ ID NO: 40747 - DNA, 15 bp, Homo sapiens
acccactgagtatgg

SEQ ID NO: 40748 - DNA, 15 bp, Homo sapiens
cacccactgagtatg

SEQ ID NO: 40749 - DNA, 15 bp, Homo sapiens
ccacccactgagtat

SEQ ID NO: 40750 - DNA, 15 bp, Homo sapiens
cccacccactgagta

SEQ ID NO: 40751 - DNA, 15 bp, Homo sapiens
ccccacccactgagt

SEQ ID NO: 40752 - DNA, 15 bp, Homo sapiens
tccccacccactgag

SEQ ID NO: 40753 - DNA, 15 bp, Homo sapiens
ttccccacccactga

SEQ ID NO: 40754 - DNA, 15 bp, Homo sapiens
attccccacccactg

SEQ ID NO: 40755 - DNA, 15 bp, Homo sapiens
aattccccacccact

SEQ ID NO: 40756 - DNA, 15 bp, Homo sapiens
taattccccacccac

SEQ ID NO: 40757 - DNA, 15 bp, Homo sapiens
ttaattccccaccca

SEQ ID NO: 40758 - DNA, 15 bp, Homo sapiens
cttaattccccaccc

SEQ ID NO: 40759 - DNA, 15 bp, Homo sapiens
gcttaattccccacc

SEQ ID NO: 40760 - DNA, 15 bp, Homo sapiens
ggcttaattccccac

SEQ ID NO: 40761 - DNA, 15 bp, Homo sapiens
gggcttaattcccca

SEQ ID NO: 40762 - DNA, 15 bp, Homo sapiens
ggggcttaattcccc

SEQ ID NO: 40763 - DNA, 15 bp, Homo sapiens
gggggcttaattccc

SEQ ID NO: 40764 - DNA, 15 bp, Homo sapiens
ggggggcttaattcc

SEQ ID NO: 40765 - DNA, 15 bp, Homo sapiens
cggggggcttaattc

SEQ ID NO: 40766 - DNA, 15 bp, Homo sapiens
gcggggggcttaatt

SEQ ID NO: 40767 - DNA, 15 bp, Homo sapiens
agcggggggcttaat

SEQ ID NO: 40768 - DNA, 15 bp, Homo sapiens
aagcggggggcttaa

SEQ ID NO: 40769 - DNA, 15 bp, Homo sapiens
caagcggggggctta

SEQ ID NO: 40770 - DNA, 15 bp, Homo sapiens
tcaagcggggggctt

SEQ ID NO: 40771 - DNA, 15 bp, Homo sapiens
ttcaagcggggggct

SEQ ID NO: 40772 - DNA, 15 bp, Homo sapiens
attcaagcggggggc

SEQ ID NO: 40773 - DNA, 15 bp, Homo sapiens
tattcaagcgggggg

SEQ ID NO: 40774 - DNA, 15 bp, Homo sapiens
ctattcaagcggggg

SEQ ID NO: 40775 - DNA, 15 bp, Homo sapiens
tctattcaagcgggg

SEQ ID NO: 40776 - DNA, 15 bp, Homo sapiens
gtctattcaagcggg

SEQ ID NO: 40777 - DNA, 15 bp, Homo sapiens
tgtctattcaagcgg

SEQ ID NO: 40778 - DNA, 15 bp, Homo sapiens
ctgtctattcaagcg

SEQ ID NO: 40779 - DNA, 15 bp, Homo sapiens
gctgtctattcaagc

SEQ ID NO: 40780 - DNA, 15 bp, Homo sapiens
ggctgtctattcaag

SEQ ID NO: 40781 - DNA, 15 bp, Homo sapiens
tggctgtctattcaa

SEQ ID NO: 40782 - DNA, 15 bp, Homo sapiens
gtggctgtctattca

SEQ ID NO: 40783 - DNA, 15 bp, Homo sapiens
ggtggctgtctattc

SEQ ID NO: 40784 - DNA, 15 bp, Homo sapiens
tggtggctgtctatt

SEQ ID NO: 40785 - DNA, 15 bp, Homo sapiens
ttggtggctgtctat

SEQ ID NO: 40786 - DNA, 15 bp, Homo sapiens
tttggtggctgtcta

SEQ ID NO: 40787 - DNA, 15 bp, Homo sapiens
atttggtggctgtct

SEQ ID NO: 40788 - DNA, 15 bp, Homo sapiens
tatttggtggctgtc

SEQ ID NO: 40789 - DNA, 15 bp, Homo sapiens
ttatttggtggctgt

SEQ ID NO: 40790 - DNA, 15 bp, Homo sapiens
attatttggtggctg

SEQ ID NO: 40791 - DNA, 15 bp, Homo sapiens
aattatttggtggct

SEQ ID NO: 40792 - DNA, 15 bp, Homo sapiens
aaattatttggtggc

SEQ ID NO: 40793 - DNA, 15 bp, Homo sapiens
gaaattatttggtgg

SEQ ID NO: 40794 - DNA, 15 bp, Homo sapiens
agaaattatttggtg

SEQ ID NO: 40795 - DNA, 15 bp, Homo sapiens
cagaaattatttggt

SEQ ID NO: 40796 - DNA, 15 bp, Homo sapiens
tcagaaattatttgg

SEQ ID NO: 40797 - DNA, 15 bp, Homo sapiens
ttcagaaattatttg

SEQ ID NO: 40798 - DNA, 15 bp, Homo sapiens
attcagaaattattt

SEQ ID NO: 40799 - DNA, 15 bp, Homo sapiens
cattcagaaattatt

SEQ ID NO: 40800 - DNA, 15 bp, Homo sapiens
acattcagaaattat

SEQ ID NO: 40801 - DNA, 15 bp, Homo sapiens
tacattcagaaatta

SEQ ID NO: 40802 - DNA, 15 bp, Homo sapiens
atacattcagaaatt

SEQ ID NO: 40803 - DNA, 15 bp, Homo sapiens
aatacattcagaaat

SEQ ID NO: 40804 - DNA, 15 bp, Homo sapiens
aaatacattcagaaa

SEQ ID NO: 40805 - DNA, 15 bp, Homo sapiens
aaaatacattcagaa

SEQ ID NO: 40806 - DNA, 15 bp, Homo sapiens
taaaatacattcaga

SEQ ID NO: 40807 - DNA, 15 bp, Homo sapiens
ttaaaatacattcag

SEQ ID NO: 40808 - DNA, 15 bp, Homo sapiens
tttaaaatacattca

SEQ ID NO: 40809 - DNA, 15 bp, Homo sapiens
ttttaaaatacattc

SEQ ID NO: 40810 - DNA, 15 bp, Homo sapiens
gttttaaaatacatt

SEQ ID NO: 40811 - DNA, 15 bp, Homo sapiens
ggttttaaaatacat

SEQ ID NO: 40812 - DNA, 15 bp, Homo sapiens
tggttttaaaataca

SEQ ID NO: 40813 - DNA, 15 bp, Homo sapiens
gtggttttaaaatac

SEQ ID NO: 40814 - DNA, 15 bp, Homo sapiens
ggtggttttaaaata

SEQ ID NO: 40815 - DNA, 15 bp, Homo sapiens
tggtggttttaaaat

SEQ ID NO: 40816 - DNA, 15 bp, Homo sapiens
gtggtggttttaaaa

SEQ ID NO: 40817 - DNA, 15 bp, Homo sapiens
tgtggtggttttaaa

SEQ ID NO: 40818 - DNA, 15 bp, Homo sapiens
gtgtggtggttttaa

SEQ ID NO: 40819 - DNA, 15 bp, Homo sapiens
tgtgtggtggtttta

SEQ ID NO: 40820 - DNA, 15 bp, Homo sapiens
atgtgtggtggtttt

SEQ ID NO: 40821 - DNA, 15 bp, Homo sapiens
catgtgtggtggttt

SEQ ID NO: 40822 - DNA, 15 bp, Homo sapiens
tcatgtgtggtggtt

SEQ ID NO: 40823 - DNA, 15 bp, Homo sapiens
atcatgtgtggtggt

SEQ ID NO: 40824 - DNA, 15 bp, Homo sapiens
aatcatgtgtggtgg

SEQ ID NO: 40825 - DNA, 15 bp, Homo sapiens
aaatcatgtgtggtg

SEQ ID NO: 40826 - DNA, 15 bp, Homo sapiens
aaaatcatgtgtggt

SEQ ID NO: 40827 - DNA, 15 bp, Homo sapiens
caaaatcatgtgtgg

SEQ ID NO: 40828 - DNA, 15 bp, Homo sapiens
acaaaatcatgtgtg

SEQ ID NO: 40829 - DNA, 15 bp, Homo sapiens
tacaaaatcatgtgt

SEQ ID NO: 40830 - DNA, 15 bp, Homo sapiens
ttacaaaatcatgtg

SEQ ID NO: 40831 - DNA, 15 bp, Homo sapiens
attacaaaatcatgt

SEQ ID NO: 40832 - DNA, 15 bp, Homo sapiens
aattacaaaatcatg

SEQ ID NO: 40833 - DNA, 15 bp, Homo sapiens
caattacaaaatcat

SEQ ID NO: 40834 - DNA, 15 bp, Homo sapiens
tcaattacaaaatca

SEQ ID NO: 40835 - DNA, 15 bp, Homo sapiens
ctcaattacaaaatc

SEQ ID NO: 40836 - DNA, 15 bp, Homo sapiens
tctcaattacaaaat

SEQ ID NO: 40837 - DNA, 15 bp, Homo sapiens
ttctcaattacaaaa

SEQ ID NO: 40838 - DNA, 15 bp, Homo sapiens
cttctcaattacaaa

SEQ ID NO: 40839 - DNA, 15 bp, Homo sapiens
tcttctcaattacaa

SEQ ID NO: 40840 - DNA, 15 bp, Homo sapiens
ttcttctcaattaca

SEQ ID NO: 40841 - DNA, 15 bp, Homo sapiens
tttcttctcaattac

SEQ ID NO: 40842 - DNA, 15 bp, Homo sapiens
ctttcttctcaatta

SEQ ID NO: 40843 - DNA, 15 bp, Homo sapiens
cctttcttctcaatt

SEQ ID NO: 40844 - DNA, 15 bp, Homo sapiens
acctttcttctcaat

SEQ ID NO: 40845 - DNA, 15 bp, Homo sapiens
aacctttcttctcaa

SEQ ID NO: 40846 - DNA, 15 bp, Homo sapiens
aaacctttcttctca

SEQ ID NO: 40847 - DNA, 15 bp, Homo sapiens
caaacctttcttctc

SEQ ID NO: 40848 - DNA, 15 bp, Homo sapiens
ccaaacctttcttct

SEQ ID NO: 40849 - DNA, 15 bp, Homo sapiens
cccaaacctttcttc

SEQ ID NO: 40850 - DNA, 15 bp, Homo sapiens
gcccaaacctttctt

SEQ ID NO: 40851 - DNA, 15 bp, Homo sapiens
agcccaaacctttct

SEQ ID NO: 40852 - DNA, 15 bp, Homo sapiens
cagcccaaacctttc

SEQ ID NO: 40853 - DNA, 15 bp, Homo sapiens
ccagcccaaaccttt

SEQ ID NO: 40854 - DNA, 15 bp, Homo sapiens
tccagcccaaacctt

SEQ ID NO: 40855 - DNA, 15 bp, Homo sapiens
ttccagcccaaacct

SEQ ID NO: 40856 - DNA, 15 bp, Homo sapiens
tttccagcccaaacc

SEQ ID NO: 40857 - DNA, 15 bp, Homo sapiens
atttccagcccaaac

SEQ ID NO: 40858 - DNA, 15 bp, Homo sapiens
tatttccagcccaaa

SEQ ID NO: 40859 - DNA, 15 bp, Homo sapiens
ttatttccagcccaa

SEQ ID NO: 40860 - DNA, 15 bp, Homo sapiens
cttatttccagccca

SEQ ID NO: 40861 - DNA, 15 bp, Homo sapiens
tcttatttccagccc

SEQ ID NO: 40862 - DNA, 15 bp, Homo sapiens
gtcttatttccagcc

SEQ ID NO: 40863 - DNA, 15 bp, Homo sapiens
tgtcttatttccagc

SEQ ID NO: 40864 - DNA, 15 bp, Homo sapiens
atgtcttatttccag

SEQ ID NO: 40865 - DNA, 15 bp, Homo sapiens
aatgtcttatttcca

SEQ ID NO: 40866 - DNA, 15 bp, Homo sapiens
taatgtcttatttcc

SEQ ID NO: 40867 - DNA, 15 bp, Homo sapiens
ctaatgtcttatttc

SEQ ID NO: 40868 - DNA, 15 bp, Homo sapiens
cctaatgtcttattt

SEQ ID NO: 40869 - DNA, 15 bp, Homo sapiens
tcctaatgtcttatt

SEQ ID NO: 40870 - DNA, 15 bp, Homo sapiens
ctcctaatgtcttat

SEQ ID NO: 40871 - DNA, 15 bp, Homo sapiens
actcctaatgtctta

SEQ ID NO: 40872 - DNA, 15 bp, Homo sapiens
aactcctaatgtctt

SEQ ID NO: 40873 - DNA, 15 bp, Homo sapiens
aaactcctaatgtct

SEQ ID NO: 40874 - DNA, 15 bp, Homo sapiens
aaaactcctaatgtc

SEQ ID NO: 40875 - DNA, 15 bp, Homo sapiens
caaaactcctaatgt

SEQ ID NO: 40876 - DNA, 15 bp, Homo sapiens
gcaaaactcctaatg

SEQ ID NO: 40877 - DNA, 15 bp, Homo sapiens
tgcaaaactcctaat

SEQ ID NO: 40878 - DNA, 15 bp, Homo sapiens
gtgcaaaactcctaa

SEQ ID NO: 40879 - DNA, 15 bp, Homo sapiens
tgtgcaaaactccta

SEQ ID NO: 40880 - DNA, 15 bp, Homo sapiens
atgtgcaaaactcct

SEQ ID NO: 40881 - DNA, 15 bp, Homo sapiens
tatgtgcaaaactcc

SEQ ID NO: 40882 - DNA, 15 bp, Homo sapiens
ctatgtgcaaaactc

SEQ ID NO: 40883 - DNA, 15 bp, Homo sapiens
tctatgtgcaaaact

SEQ ID NO: 40884 - DNA, 15 bp, Homo sapiens
atctatgtgcaaaac

SEQ ID NO: 40885 - DNA, 15 bp, Homo sapiens
catctatgtgcaaaa

SEQ ID NO: 40886 - DNA, 15 bp, Homo sapiens
gcatctatgtgcaaa

SEQ ID NO: 40887 - DNA, 15 bp, Homo sapiens
agcatctatgtgcaa

SEQ ID NO: 40888 - DNA, 15 bp, Homo sapiens
cagcatctatgtgca

SEQ ID NO: 40889 - DNA, 15 bp, Homo sapiens
acagcatctatgtgc

SEQ ID NO: 40890 - DNA, 15 bp, Homo sapiens
cacagcatctatgtg

SEQ ID NO: 40891 - DNA, 15 bp, Homo sapiens
ccacagcatctatgt

SEQ ID NO: 40892 - DNA, 15 bp, Homo sapiens
tccacagcatctatg

SEQ ID NO: 40893 - DNA, 15 bp, Homo sapiens
ctccacagcatctat

SEQ ID NO: 40894 - DNA, 15 bp, Homo sapiens
actccacagcatcta

SEQ ID NO: 40895 - DNA, 15 bp, Homo sapiens
cactccacagcatct

SEQ ID NO: 40896 - DNA, 15 bp, Homo sapiens
tcactccacagcatc

SEQ ID NO: 40897 - DNA, 15 bp, Homo sapiens
ctcactccacagcat

SEQ ID NO: 40898 - DNA, 15 bp, Homo sapiens
actcactccacagca

SEQ ID NO: 40899 - DNA, 15 bp, Homo sapiens
tactcactccacagc

SEQ ID NO: 40900 - DNA, 15 bp, Homo sapiens
ctactcactccacag

SEQ ID NO: 40901 - DNA, 15 bp, Homo sapiens
tctactcactccaca

SEQ ID NO: 40902 - DNA, 15 bp, Homo sapiens
atctactcactccac

SEQ ID NO: 40903 - DNA, 15 bp, Homo sapiens
catctactcactcca

SEQ ID NO: 40904 - DNA, 15 bp, Homo sapiens
gcatctactcactcc

SEQ ID NO: 40905 - DNA, 15 bp, Homo sapiens
cgcatctactcactc

SEQ ID NO: 40906 - DNA, 15 bp, Homo sapiens
acgcatctactcact

SEQ ID NO: 40907 - DNA, 15 bp, Homo sapiens
cacgcatctactcac

SEQ ID NO: 40908 - DNA, 15 bp, Homo sapiens
tcacgcatctactca

SEQ ID NO: 40909 - DNA, 15 bp, Homo sapiens
gtcacgcatctactc

SEQ ID NO: 40910 - DNA, 15 bp, Homo sapiens
ggtcacgcatctact

SEQ ID NO: 40911 - DNA, 15 bp, Homo sapiens
tggtcacgcatctac

SEQ ID NO: 40912 - DNA, 15 bp, Homo sapiens
gtggtcacgcatcta

SEQ ID NO: 40913 - DNA, 15 bp, Homo sapiens
agtggtcacgcatct

SEQ ID NO: 40914 - DNA, 15 bp, Homo sapiens
aagtggtcacgcatc

SEQ ID NO: 40915 - DNA, 15 bp, Homo sapiens
taagtggtcacgcat

SEQ ID NO: 40916 - DNA, 15 bp, Homo sapiens
ctaagtggtcacgca

SEQ ID NO: 40917 - DNA, 15 bp, Homo sapiens
actaagtggtcacgc

SEQ ID NO: 40918 - DNA, 15 bp, Homo sapiens
tactaagtggtcacg

SEQ ID NO: 40919 - DNA, 15 bp, Homo sapiens
ttactaagtggtcac

SEQ ID NO: 40920 - DNA, 15 bp, Homo sapiens
tttactaagtggtca

SEQ ID NO: 40921 - DNA, 15 bp, Homo sapiens
ttttactaagtggtc

SEQ ID NO: 40922 - DNA, 15 bp, Homo sapiens
cttttactaagtggt

SEQ ID NO: 40923 - DNA, 15 bp, Homo sapiens
acttttactaagtgg

SEQ ID NO: 40924 - DNA, 15 bp, Homo sapiens
cacttttactaagtg

SEQ ID NO: 40925 - DNA, 15 bp, Homo sapiens
acacttttactaagt

SEQ ID NO: 40926 - DNA, 15 bp, Homo sapiens
cacacttttactaag

SEQ ID NO: 40927 - DNA, 15 bp, Homo sapiens
tcacacttttactaa

SEQ ID NO: 40928 - DNA, 15 bp, Homo sapiens
ttcacacttttacta

SEQ ID NO: 40929 - DNA, 15 bp, Homo sapiens
cttcacacttttact

SEQ ID NO: 40930 - DNA, 15 bp, Homo sapiens
tcttcacacttttac

SEQ ID NO: 40931 - DNA, 15 bp, Homo sapiens
ctcttcacactttta

SEQ ID NO: 40932 - DNA, 15 bp, Homo sapiens
cctcttcacactttt

SEQ ID NO: 40933 - DNA, 15 bp, Homo sapiens
acctcttcacacttt

SEQ ID NO: 40934 - DNA, 15 bp, Homo sapiens
gacctcttcacactt

SEQ ID NO: 40935 - DNA, 15 bp, Homo sapiens
ggacctcttcacact

SEQ ID NO: 40936 - DNA, 15 bp, Homo sapiens
tggacctcttcacac

SEQ ID NO: 40937 - DNA, 15 bp, Homo sapiens
ttggacctcttcaca

SEQ ID NO: 40938 - DNA, 15 bp, Homo sapiens
cttggacctcttcac

SEQ ID NO: 40939 - DNA, 15 bp, Homo sapiens
tcttggacctcttca

SEQ ID NO: 40940 - DNA, 15 bp, Homo sapiens
gtcttggacctcttc

SEQ ID NO: 40941 - DNA, 15 bp, Homo sapiens
agtcttggacctctt

SEQ ID NO: 40942 - DNA, 15 bp, Homo sapiens
cagtcttggacctct

SEQ ID NO: 40943 - DNA, 15 bp, Homo sapiens
tcagtcttggacctc

SEQ ID NO: 40944 - DNA, 15 bp, Homo sapiens
atcagtcttggacct

SEQ ID NO: 40945 - DNA, 15 bp, Homo sapiens
gatcagtcttggacc

SEQ ID NO: 40946 - DNA, 15 bp, Homo sapiens
ggatcagtcttggac

SEQ ID NO: 40947 - DNA, 15 bp, Homo sapiens
aggatcagtcttgga

SEQ ID NO: 40948 - DNA, 15 bp, Homo sapiens
aaggatcagtcttgg

SEQ ID NO: 40949 - DNA, 15 bp, Homo sapiens
aaaggatcagtcttg

SEQ ID NO: 40950 - DNA, 15 bp, Homo sapiens
taaaggatcagtctt

SEQ ID NO: 40951 - DNA, 15 bp, Homo sapiens
ctaaaggatcagtct

SEQ ID NO: 40952 - DNA, 15 bp, Homo sapiens
cctaaaggatcagtc

SEQ ID NO: 40953 - DNA, 15 bp, Homo sapiens
tcctaaaggatcagt

SEQ ID NO: 40954 - DNA, 15 bp, Homo sapiens
ttcctaaaggatcag

SEQ ID NO: 40955 - DNA, 15 bp, Homo sapiens
tttcctaaaggatca

SEQ ID NO: 40956 - DNA, 15 bp, Homo sapiens
atttcctaaaggatc

SEQ ID NO: 40957 - DNA, 15 bp, Homo sapiens
gatttcctaaaggat

SEQ ID NO: 40958 - DNA, 15 bp, Homo sapiens
agatttcctaaagga

SEQ ID NO: 40959 - DNA, 15 bp, Homo sapiens
tagatttcctaaagg

SEQ ID NO: 40960 - DNA, 15 bp, Homo sapiens
ttagatttcctaaag

SEQ ID NO: 40961 - DNA, 15 bp, Homo sapiens
gttagatttcctaaa

SEQ ID NO: 40962 - DNA, 15 bp, Homo sapiens
agttagatttcctaa

SEQ ID NO: 40963 - DNA, 15 bp, Homo sapiens
aagttagatttccta

SEQ ID NO: 40964 - DNA, 15 bp, Homo sapiens
caagttagatttcct

SEQ ID NO: 40965 - DNA, 15 bp, Homo sapiens
acaagttagatttcc

SEQ ID NO: 40966 - DNA, 15 bp, Homo sapiens
tacaagttagatttc

SEQ ID NO: 40967 - DNA, 15 bp, Homo sapiens
ctacaagttagattt

SEQ ID NO: 40968 - DNA, 15 bp, Homo sapiens
tctacaagttagatt

SEQ ID NO: 40969 - DNA, 15 bp, Homo sapiens
ctctacaagttagat

SEQ ID NO: 40970 - DNA, 15 bp, Homo sapiens
cctctacaagttaga

SEQ ID NO: 40971 - DNA, 15 bp, Homo sapiens
tcctctacaagttag

SEQ ID NO: 40972 - DNA, 15 bp, Homo sapiens
atcctctacaagtta

SEQ ID NO: 40973 - DNA, 15 bp, Homo sapiens
gatcctctacaagtt

SEQ ID NO: 40974 - DNA, 15 bp, Homo sapiens
agatcctctacaagt

SEQ ID NO: 40975 - DNA, 15 bp, Homo sapiens
cagatcctctacaag

SEQ ID NO: 40976 - DNA, 15 bp, Homo sapiens
gcagatcctctacaa

SEQ ID NO: 40977 - DNA, 15 bp, Homo sapiens
agcagatcctctaca

SEQ ID NO: 40978 - DNA, 15 bp, Homo sapiens
cagcagatcctctac

SEQ ID NO: 40979 - DNA, 15 bp, Homo sapiens
acagcagatcctcta

SEQ ID NO: 40980 - DNA, 15 bp, Homo sapiens
cacagcagatcctct

SEQ ID NO: 40981 - DNA, 15 bp, Homo sapiens
ccacagcagatcctc

SEQ ID NO: 40982 - DNA, 15 bp, Homo sapiens
tccacagcagatcct

SEQ ID NO: 40983 - DNA, 15 bp, Homo sapiens
ctccacagcagatcc

SEQ ID NO: 40984 - DNA, 15 bp, Homo sapiens
cctccacagcagatc

SEQ ID NO: 40985 - DNA, 15 bp, Homo sapiens
tcctccacagcagat

SEQ ID NO: 40986 - DNA, 15 bp, Homo sapiens
ctcctccacagcaga

SEQ ID NO: 40987 - DNA, 15 bp, Homo sapiens
actcctccacagcag

SEQ ID NO: 40988 - DNA, 15 bp, Homo sapiens
cactcctccacagca

SEQ ID NO: 40989 - DNA, 15 bp, Homo sapiens
ccactcctccacagc

SEQ ID NO: 40990 - DNA, 15 bp, Homo sapiens
tccactcctccacag

SEQ ID NO: 40991 - DNA, 15 bp, Homo sapiens
ctccactcctccaca

SEQ ID NO: 40992 - DNA, 15 bp, Homo sapiens
cctccactcctccac

SEQ ID NO: 40993 - DNA, 15 bp, Homo sapiens
tcctccactcctcca

SEQ ID NO: 40994 - DNA, 15 bp, Homo sapiens
ctcctccactcctcc

SEQ ID NO: 40995 - DNA, 15 bp, Homo sapiens
tctcctccactcctc

SEQ ID NO: 40996 - DNA, 15 bp, Homo sapiens
ttctcctccactcct

SEQ ID NO: 40997 - DNA, 15 bp, Homo sapiens
cttctcctccactcc

SEQ ID NO: 40998 - DNA, 15 bp, Homo sapiens
ccttctcctccactc

SEQ ID NO: 40999 - DNA, 15 bp, Homo sapiens
tccttctcctccact

SEQ ID NO: 41000 - DNA, 15 bp, Homo sapiens
ttccttctcctccac

SEQ ID NO: 41001 - DNA, 15 bp, Homo sapiens
cttccttctcctcca

SEQ ID NO: 41002 - DNA, 15 bp, Homo sapiens
tcttccttctcctcc

SEQ ID NO: 41003 - DNA, 15 bp, Homo sapiens
ttcttccttctcctc

SEQ ID NO: 41004 - DNA, 15 bp, Homo sapiens
tttcttccttctcct

SEQ ID NO: 41005 - DNA, 15 bp, Homo sapiens
atttcttccttctcc

SEQ ID NO: 41006 - DNA, 15 bp, Homo sapiens
catttcttccttctc

SEQ ID NO: 41007 - DNA, 15 bp, Homo sapiens
ccatttcttccttct

SEQ ID NO: 41008 - DNA, 15 bp, Homo sapiens
tccatttcttccttc

SEQ ID NO: 41009 - DNA, 15 bp, Homo sapiens
ttccatttcttcctt

SEQ ID NO: 41010 - DNA, 15 bp, Homo sapiens
attccatttcttcct

SEQ ID NO: 41011 - DNA, 15 bp, Homo sapiens
gattccatttcttcc

SEQ ID NO: 41012 - DNA, 15 bp, Homo sapiens
agattccatttcttc

SEQ ID NO: 41013 - DNA, 15 bp, Homo sapiens
cagattccatttctt

SEQ ID NO: 41014 - DNA, 15 bp, Homo sapiens
ccagattccatttct

SEQ ID NO: 41015 - DNA, 15 bp, Homo sapiens
cccagattccatttc

SEQ ID NO: 41016 - DNA, 15 bp, Homo sapiens
tcccagattccattt

SEQ ID NO: 41017 - DNA, 15 bp, Homo sapiens
ttcccagattccatt

SEQ ID NO: 41018 - DNA, 15 bp, Homo sapiens
cttcccagattccat

SEQ ID NO: 41019 - DNA, 15 bp, Homo sapiens
tcttcccagattcca

SEQ ID NO: 41020 - DNA, 15 bp, Homo sapiens
atcttcccagattcc

SEQ ID NO: 41021 - DNA, 15 bp, Homo sapiens
catcttcccagattc

SEQ ID NO: 41022 - DNA, 15 bp, Homo sapiens
tcatcttcccagatt

SEQ ID NO: 41023 - DNA, 15 bp, Homo sapiens
ctcatcttcccagat

SEQ ID NO: 41024 - DNA, 15 bp, Homo sapiens
tctcatcttcccaga

SEQ ID NO: 41025 - DNA, 15 bp, Homo sapiens
ttctcatcttcccag

SEQ ID NO: 41026 - DNA, 15 bp, Homo sapiens
cttctcatcttccca

SEQ ID NO: 41027 - DNA, 15 bp, Homo sapiens
tcttctcatcttccc

SEQ ID NO: 41028 - DNA, 15 bp, Homo sapiens
ttcttctcatcttcc

SEQ ID NO: 41029 - DNA, 15 bp, Homo sapiens
attcttctcatcttc

SEQ ID NO: 41030 - DNA, 15 bp, Homo sapiens
aattcttctcatctt

SEQ ID NO: 41031 - DNA, 15 bp, Homo sapiens
aaattcttctcatct

SEQ ID NO: 41032 - DNA, 15 bp, Homo sapiens
aaaattcttctcatc

SEQ ID NO: 41033 - DNA, 15 bp, Homo sapiens
aaaaattcttctcat

SEQ ID NO: 41034 - DNA, 15 bp, Homo sapiens
gaaaaattcttctca

SEQ ID NO: 41035 - DNA, 15 bp, Homo sapiens
tgaaaaattcttctc

SEQ ID NO: 41036 - DNA, 15 bp, Homo sapiens
ctgaaaaattcttct

SEQ ID NO: 41037 - DNA, 15 bp, Homo sapiens
cctgaaaaattcttc

SEQ ID NO: 41038 - DNA, 15 bp, Homo sapiens
gcctgaaaaattctt

SEQ ID NO: 41039 - DNA, 15 bp, Homo sapiens
tgcctgaaaaattct

SEQ ID NO: 41040 - DNA, 15 bp, Homo sapiens
ctgcctgaaaaattc

SEQ ID NO: 41041 - DNA, 15 bp, Homo sapiens
cctgcctgaaaaatt

SEQ ID NO: 41042 - DNA, 15 bp, Homo sapiens
ccctgcctgaaaaat

SEQ ID NO: 41043 - DNA, 15 bp, Homo sapiens
tccctgcctgaaaaa

SEQ ID NO: 41044 - DNA, 15 bp, Homo sapiens
ctccctgcctgaaaa

SEQ ID NO: 41045 - DNA, 15 bp, Homo sapiens
actccctgcctgaaa

SEQ ID NO: 41046 - DNA, 15 bp, Homo sapiens
cactccctgcctgaa

SEQ ID NO: 41047 - DNA, 15 bp, Homo sapiens
acactccctgcctga

SEQ ID NO: 41048 - DNA, 15 bp, Homo sapiens
aacactccctgcctg

SEQ ID NO: 41049 - DNA, 15 bp, Homo sapiens
gaacactccctgcct

SEQ ID NO: 41050 - DNA, 15 bp, Homo sapiens
agaacactccctgcc

SEQ ID NO: 41051 - DNA, 15 bp, Homo sapiens
tagaacactccctgc

SEQ ID NO: 41052 - DNA, 15 bp, Homo sapiens
atagaacactccctg

SEQ ID NO: 41053 - DNA, 15 bp, Homo sapiens
aatagaacactccct

SEQ ID NO: 41054 - DNA, 15 bp, Homo sapiens
gaatagaacactccc

SEQ ID NO: 41055 - DNA, 15 bp, Homo sapiens
agaatagaacactcc

SEQ ID NO: 41056 - DNA, 15 bp, Homo sapiens
cagaatagaacactc

SEQ ID NO: 41057 - DNA, 15 bp, Homo sapiens
acagaatagaacact

SEQ ID NO: 41058 - DNA, 15 bp, Homo sapiens
cacagaatagaacac

SEQ ID NO: 41059 - DNA, 15 bp, Homo sapiens
ccacagaatagaaca

SEQ ID NO: 41060 - DNA, 15 bp, Homo sapiens
tccacagaatagaac

SEQ ID NO: 41061 - DNA, 15 bp, Homo sapiens
ttccacagaatagaa

SEQ ID NO: 41062 - DNA, 15 bp, Homo sapiens
cttccacagaataga

SEQ ID NO: 41063 - DNA, 15 bp, Homo sapiens
gcttccacagaatag

SEQ ID NO: 41064 - DNA, 15 bp, Homo sapiens
ggcttccacagaata

SEQ ID NO: 41065 - DNA, 15 bp, Homo sapiens
aggcttccacagaat

SEQ ID NO: 41066 - DNA, 15 bp, Homo sapiens
taggcttccacagaa

SEQ ID NO: 41067 - DNA, 15 bp, Homo sapiens
gtaggcttccacaga

SEQ ID NO: 41068 - DNA, 15 bp, Homo sapiens
agtaggcttccacag

SEQ ID NO: 41069 - DNA, 15 bp, Homo sapiens
cagtaggcttccaca

SEQ ID NO: 41070 - DNA, 15 bp, Homo sapiens
ccagtaggcttccac

SEQ ID NO: 41071 - DNA, 15 bp, Homo sapiens
tccagtaggcttcca

SEQ ID NO: 41072 - DNA, 15 bp, Homo sapiens
ttccagtaggcttcc

SEQ ID NO: 41073 - DNA, 15 bp, Homo sapiens
attccagtaggcttc

SEQ ID NO: 41074 - DNA, 15 bp, Homo sapiens
cattccagtaggctt

SEQ ID NO: 41075 - DNA, 15 bp, Homo sapiens
acattccagtaggct

SEQ ID NO: 41076 - DNA, 15 bp, Homo sapiens
cacattccagtaggc

SEQ ID NO: 41077 - DNA, 15 bp, Homo sapiens
acacattccagtagg

SEQ ID NO: 41078 - DNA, 15 bp, Homo sapiens
tacacattccagtag

SEQ ID NO: 41079 - DNA, 15 bp, Homo sapiens
atacacattccagta

SEQ ID NO: 41080 - DNA, 15 bp, Homo sapiens
aatacacattccagt

SEQ ID NO: 41081 - DNA, 15 bp, Homo sapiens
aaatacacattccag

SEQ ID NO: 41082 - DNA, 15 bp, Homo sapiens
caaatacacattcca

SEQ ID NO: 41083 - DNA, 15 bp, Homo sapiens
tcaaatacacattcc

SEQ ID NO: 41084 - DNA, 15 bp, Homo sapiens
gtcaaatacacattc

SEQ ID NO: 41085 - DNA, 15 bp, Homo sapiens
agtcaaatacacatt

SEQ ID NO: 41086 - DNA, 15 bp, Homo sapiens
aagtcaaatacacat

SEQ ID NO: 41087 - DNA, 15 bp, Homo sapiens
aaagtcaaatacaca

SEQ ID NO: 41088 - DNA, 15 bp, Homo sapiens
gaaagtcaaatacac

SEQ ID NO: 41089 - DNA, 15 bp, Homo sapiens
tgaaagtcaaataca

SEQ ID NO: 41090 - DNA, 15 bp, Homo sapiens
atgaaagtcaaatac

SEQ ID NO: 41091 - DNA, 15 bp, Homo sapiens
aatgaaagtcaaata

SEQ ID NO: 41092 - DNA, 15 bp, Homo sapiens
aaatgaaagtcaaat

SEQ ID NO: 41093 - DNA, 15 bp, Homo sapiens
aaaatgaaagtcaaa

SEQ ID NO: 41094 - DNA, 15 bp, Homo sapiens
aaaaatgaaagtcaa

SEQ ID NO: 41095 - DNA, 15 bp, Homo sapiens
taaaaatgaaagtca

SEQ ID NO: 41096 - DNA, 15 bp, Homo sapiens
ttaaaaatgaaagtc

SEQ ID NO: 41097 - DNA, 15 bp, Homo sapiens
cttaaaaatgaaagt

SEQ ID NO: 41098 - DNA, 15 bp, Homo sapiens
tcttaaaaatgaaag

SEQ ID NO: 41099 - DNA, 15 bp, Homo sapiens
ttcttaaaaatgaaa

SEQ ID NO: 41100 - DNA, 15 bp, Homo sapiens
attcttaaaaatgaa

SEQ ID NO: 41101 - DNA, 15 bp, Homo sapiens
aattcttaaaaatga

SEQ ID NO: 41102 - DNA, 15 bp, Homo sapiens
aaattcttaaaaatg

SEQ ID NO: 41103 - DNA, 15 bp, Homo sapiens
taaattcttaaaaat

SEQ ID NO: 41104 - DNA, 15 bp, Homo sapiens
ataaattcttaaaaa

SEQ ID NO: 41105 - DNA, 15 bp, Homo sapiens
aataaattcttaaaa

SEQ ID NO: 41106 - DNA, 15 bp, Homo sapiens
gaataaattcttaaa

SEQ ID NO: 41107 - DNA, 15 bp, Homo sapiens
agaataaattcttaa

SEQ ID NO: 41108 - DNA, 15 bp, Homo sapiens
gagaataaattctta

SEQ ID NO: 41109 - DNA, 15 bp, Homo sapiens
agagaataaattctt

SEQ ID NO: 41110 - DNA, 15 bp, Homo sapiens
cagagaataaattct

SEQ ID NO: 41111 - DNA, 15 bp, Homo sapiens
tcagagaataaattc

SEQ ID NO: 41112 - DNA, 15 bp, Homo sapiens
ttcagagaataaatt

SEQ ID NO: 41113 - DNA, 15 bp, Homo sapiens
attcagagaataaat

SEQ ID NO: 41114 - DNA, 15 bp, Homo sapiens
cattcagagaataaa

SEQ ID NO: 41115 - DNA, 15 bp, Homo sapiens
tcattcagagaataa

SEQ ID NO: 41116 - DNA, 15 bp, Homo sapiens
ttcattcagagaata

SEQ ID NO: 41117 - DNA, 15 bp, Homo sapiens
attcattcagagaat

SEQ ID NO: 41118 - DNA, 15 bp, Homo sapiens
cattcattcagagaa

SEQ ID NO: 41119 - DNA, 15 bp, Homo sapiens
tcattcattcagaga

SEQ ID NO: 41120 - DNA, 15 bp, Homo sapiens
ttcattcattcagag

SEQ ID NO: 41121 - DNA, 15 bp, Homo sapiens
cttcattcattcaga

SEQ ID NO: 41122 - DNA, 15 bp, Homo sapiens
tcttcattcattcag

SEQ ID NO: 41123 - DNA, 15 bp, Homo sapiens
ttcttcattcattca

SEQ ID NO: 41124 - DNA, 15 bp, Homo sapiens
attcttcattcattc

SEQ ID NO: 41125 - DNA, 15 bp, Homo sapiens
cattcttcattcatt

SEQ ID NO: 41126 - DNA, 15 bp, Homo sapiens
tcattcttcattcat

SEQ ID NO: 41127 - DNA, 15 bp, Homo sapiens
ttcattcttcattca

SEQ ID NO: 41128 - DNA, 15 bp, Homo sapiens
attcattcttcattc

SEQ ID NO: 41129 - DNA, 15 bp, Homo sapiens
tattcattcttcatt

SEQ ID NO: 41130 - DNA, 15 bp, Homo sapiens
ttattcattcttcat

SEQ ID NO: 41131 - DNA, 15 bp, Homo sapiens
tttattcattcttca

SEQ ID NO: 41132 - DNA, 15 bp, Homo sapiens
atttattcattcttc

SEQ ID NO: 41133 - DNA, 15 bp, Homo sapiens
tatttattcattctt

SEQ ID NO: 41134 - DNA, 15 bp, Homo sapiens
ttatttattcattct

SEQ ID NO: 41135 - DNA, 15 bp, Homo sapiens
tttatttattcattc

SEQ ID NO: 41136 - DNA, 15 bp, Homo sapiens
atttatttattcatt

SEQ ID NO: 41137 - DNA, 15 bp, Homo sapiens
catttatttattcat

SEQ ID NO: 41138 - DNA, 15 bp, Homo sapiens
acatttatttattca

SEQ ID NO: 41139 - DNA, 15 bp, Homo sapiens
gacatttatttattc

SEQ ID NO: 41140 - DNA, 15 bp, Homo sapiens
tgacatttatttatt

SEQ ID NO: 41141 - DNA, 15 bp, Homo sapiens
atgacatttatttat

SEQ ID NO: 41142 - DNA, 15 bp, Homo sapiens
catgacatttattta

SEQ ID NO: 41143 - DNA, 15 bp, Homo sapiens
acatgacatttattt

SEQ ID NO: 41144 - DNA, 15 bp, Homo sapiens
tacatgacatttatt

SEQ ID NO: 41145 - DNA, 15 bp, Homo sapiens
atacatgacatttat

SEQ ID NO: 41146 - DNA, 15 bp, Homo sapiens
tatacatgacattta

SEQ ID NO: 41147 - DNA, 15 bp, Homo sapiens
atatacatgacattt

SEQ ID NO: 41148 - DNA, 15 bp, Homo sapiens
catatacatgacatt

SEQ ID NO: 41149 - DNA, 15 bp, Homo sapiens
acatatacatgacat

SEQ ID NO: 41150 - DNA, 15 bp, Homo sapiens
aacatatacatgaca

SEQ ID NO: 41151 - DNA, 15 bp, Homo sapiens
gaacatatacatgac

SEQ ID NO: 41152 - DNA, 15 bp, Homo sapiens
tgaacatatacatga

SEQ ID NO: 41153 - DNA, 15 bp, Homo sapiens
ttgaacatatacatg

SEQ ID NO: 41154 - DNA, 15 bp, Homo sapiens
tttgaacatatacat

SEQ ID NO: 41155 - DNA, 15 bp, Homo sapiens
ttttgaacatataca

SEQ ID NO: 41156 - DNA, 15 bp, Homo sapiens
attttgaacatatac

SEQ ID NO: 41157 - DNA, 15 bp, Homo sapiens
aattttgaacatata

SEQ ID NO: 41158 - DNA, 15 bp, Homo sapiens
aaattttgaacatat

SEQ ID NO: 41159 - DNA, 15 bp, Homo sapiens
aaaattttgaacata

SEQ ID NO: 41160 - DNA, 15 bp, Homo sapiens
taaaattttgaacat

SEQ ID NO: 41161 - DNA, 15 bp, Homo sapiens
ttaaaattttgaaca

SEQ ID NO: 41162 - DNA, 15 bp, Homo sapiens
attaaaattttgaac

SEQ ID NO: 41163 - DNA, 15 bp, Homo sapiens
aattaaaattttgaa

SEQ ID NO: 41164 - DNA, 15 bp, Homo sapiens
gaattaaaattttga

SEQ ID NO: 41165 - DNA, 15 bp, Homo sapiens
agaattaaaattttg

SEQ ID NO: 41166 - DNA, 15 bp, Homo sapiens
tagaattaaaatttt

SEQ ID NO: 41167 - DNA, 15 bp, Homo sapiens
ttagaattaaaattt

SEQ ID NO: 41168 - DNA, 15 bp, Homo sapiens
cttagaattaaaatt

SEQ ID NO: 41169 - DNA, 15 bp, Homo sapiens
acttagaattaaaat

SEQ ID NO: 41170 - DNA, 15 bp, Homo sapiens
tacttagaattaaaa

SEQ ID NO: 41171 - DNA, 15 bp, Homo sapiens
atacttagaattaaa

SEQ ID NO: 41172 - DNA, 15 bp, Homo sapiens
catacttagaattaa

SEQ ID NO: 41173 - DNA, 15 bp, Homo sapiens
tcatacttagaatta

SEQ ID NO: 41174 - DNA, 15 bp, Homo sapiens
atcatacttagaatt

SEQ ID NO: 41175 - DNA, 15 bp, Homo sapiens
aatcatacttagaat

SEQ ID NO: 41176 - DNA, 15 bp, Homo sapiens
caatcatacttagaa

SEQ ID NO: 41177 - DNA, 15 bp, Homo sapiens
acaatcatacttaga

SEQ ID NO: 41178 - DNA, 15 bp, Homo sapiens
aacaatcatacttag

SEQ ID NO: 41179 - DNA, 15 bp, Homo sapiens
taacaatcatactta

SEQ ID NO: 41180 - DNA, 15 bp, Homo sapiens
ataacaatcatactt

SEQ ID NO: 41181 - DNA, 15 bp, Homo sapiens
aataacaatcatact

SEQ ID NO: 41182 - DNA, 15 bp, Homo sapiens
caataacaatcatac

SEQ ID NO: 41183 - DNA, 15 bp, Homo sapiens
tcaataacaatcata

SEQ ID NO: 41184 - DNA, 15 bp, Homo sapiens
ttcaataacaatcat

SEQ ID NO: 41185 - DNA, 15 bp, Homo sapiens
tttcaataacaatca

SEQ ID NO: 41186 - DNA, 15 bp, Homo sapiens
atttcaataacaatc

SEQ ID NO: 41187 - DNA, 15 bp, Homo sapiens
catttcaataacaat

SEQ ID NO: 41188 - DNA, 15 bp, Homo sapiens
gcatttcaataacaa

SEQ ID NO: 41189 - DNA, 15 bp, Homo sapiens
agcatttcaataaca

SEQ ID NO: 41190 - DNA, 15 bp, Homo sapiens
aagcatttcaataac

SEQ ID NO: 41191 - DNA, 15 bp, Homo sapiens
taagcatttcaataa

SEQ ID NO: 41192 - DNA, 15 bp, Homo sapiens
ataagcatttcaata

SEQ ID NO: 41193 - DNA, 15 bp, Homo sapiens
tataagcatttcaat

SEQ ID NO: 41194 - DNA, 15 bp, Homo sapiens
ttataagcatttcaa

SEQ ID NO: 41195 - DNA, 15 bp, Homo sapiens
tttataagcatttca

SEQ ID NO: 41196 - DNA, 15 bp, Homo sapiens
ttttataagcatttc

SEQ ID NO: 41197 - DNA, 15 bp, Homo sapiens
attttataagcattt

SEQ ID NO: 41198 - DNA, 15 bp, Homo sapiens
aattttataagcatt

SEQ ID NO: 41199 - DNA, 15 bp, Homo sapiens
taattttataagcat

SEQ ID NO: 41200 - DNA, 15 bp, Homo sapiens
ttaattttataagca

SEQ ID NO: 41201 - DNA, 15 bp, Homo sapiens
cttaattttataagc

SEQ ID NO: 41202 - DNA, 15 bp, Homo sapiens
tcttaattttataag

SEQ ID NO: 41203 - DNA, 15 bp, Homo sapiens
ttcttaattttataa

SEQ ID NO: 41204 - DNA, 15 bp, Homo sapiens
attcttaattttata

SEQ ID NO: 41205 - DNA, 15 bp, Homo sapiens
cattcttaattttat

SEQ ID NO: 41206 - DNA, 15 bp, Homo sapiens
ccattcttaatttta

SEQ ID NO: 41207 - DNA, 15 bp, Homo sapiens
tccattcttaatttt

SEQ ID NO: 41208 - DNA, 15 bp, Homo sapiens
ttccattcttaattt

SEQ ID NO: 41209 - DNA, 15 bp, Homo sapiens
tttccattcttaatt

SEQ ID NO: 41210 - DNA, 15 bp, Homo sapiens
atttccattcttaat

SEQ ID NO: 41211 - DNA, 15 bp, Homo sapiens
gatttccattcttaa

SEQ ID NO: 41212 - DNA, 15 bp, Homo sapiens
tgatttccattctta

SEQ ID NO: 41213 - DNA, 15 bp, Homo sapiens
ctgatttccattctt

SEQ ID NO: 41214 - DNA, 15 bp, Homo sapiens
gctgatttccattct

SEQ ID NO: 41215 - DNA, 15 bp, Homo sapiens
tgctgatttccattc

SEQ ID NO: 41216 - DNA, 15 bp, Homo sapiens
atgctgatttccatt

SEQ ID NO: 41217 - DNA, 15 bp, Homo sapiens
aatgctgatttccat

SEQ ID NO: 41218 - DNA, 15 bp, Homo sapiens
taatgctgatttcca

SEQ ID NO: 41219 - DNA, 15 bp, Homo sapiens
ctaatgctgatttcc

SEQ ID NO: 41220 - DNA, 15 bp, Homo sapiens
cctaatgctgatttc

SEQ ID NO: 41221 - DNA, 15 bp, Homo sapiens
tcctaatgctgattt

SEQ ID NO: 41222 - DNA, 15 bp, Homo sapiens
ttcctaatgctgatt

SEQ ID NO: 41223 - DNA, 15 bp, Homo sapiens
attcctaatgctgat

SEQ ID NO: 41224 - DNA, 15 bp, Homo sapiens
cattcctaatgctga

SEQ ID NO: 41225 - DNA, 15 bp, Homo sapiens
gcattcctaatgctg

SEQ ID NO: 41226 - DNA, 15 bp, Homo sapiens
tgcattcctaatgct

SEQ ID NO: 41227 - DNA, 15 bp, Homo sapiens
atgcattcctaatgc

SEQ ID NO: 41228 - DNA, 15 bp, Homo sapiens
tatgcattcctaatg

SEQ ID NO: 41229 - DNA, 15 bp, Homo sapiens
ttatgcattcctaat

SEQ ID NO: 41230 - DNA, 15 bp, Homo sapiens
attatgcattcctaa

SEQ ID NO: 41231 - DNA, 15 bp, Homo sapiens
tattatgcattccta

SEQ ID NO: 41232 - DNA, 15 bp, Homo sapiens
ttattatgcattcct

SEQ ID NO: 41233 - DNA, 15 bp, Homo sapiens
gttattatgcattcc

SEQ ID NO: 41234 - DNA, 15 bp, Homo sapiens
tgttattatgcattc

SEQ ID NO: 41235 - DNA, 15 bp, Homo sapiens
ctgttattatgcatt

SEQ ID NO: 41236 - DNA, 15 bp, Homo sapiens
tctgttattatgcat

SEQ ID NO: 41237 - DNA, 15 bp, Homo sapiens
ctctgttattatgca

SEQ ID NO: 41238 - DNA, 15 bp, Homo sapiens
actctgttattatgc

SEQ ID NO: 41239 - DNA, 15 bp, Homo sapiens
cactctgttattatg

SEQ ID NO: 41240 - DNA, 15 bp, Homo sapiens
ccactctgttattat

SEQ ID NO: 41241 - DNA, 15 bp, Homo sapiens
cccactctgttatta

SEQ ID NO: 41242 - DNA, 15 bp, Homo sapiens
tcccactctgttatt

SEQ ID NO: 41243 - DNA, 15 bp, Homo sapiens
ctcccactctgttat

SEQ ID NO: 41244 - DNA, 15 bp, Homo sapiens
tctcccactctgtta

SEQ ID NO: 41245 - DNA, 15 bp, Homo sapiens
atctcccactctgtt

SEQ ID NO: 41246 - DNA, 15 bp, Homo sapiens
tatctcccactctgt

SEQ ID NO: 41247 - DNA, 15 bp, Homo sapiens
atatctcccactctg

SEQ ID NO: 41248 - DNA, 15 bp, Homo sapiens
aatatctcccactct

SEQ ID NO: 41249 - DNA, 15 bp, Homo sapiens
caatatctcccactc

SEQ ID NO: 41250 - DNA, 15 bp, Homo sapiens
ccaatatctcccact

SEQ ID NO: 41251 - DNA, 15 bp, Homo sapiens
accaatatctcccac

SEQ ID NO: 41252 - DNA, 15 bp, Homo sapiens
taccaatatctccca

SEQ ID NO: 41253 - DNA, 15 bp, Homo sapiens
ttaccaatatctccc

SEQ ID NO: 41254 - DNA, 15 bp, Homo sapiens
tttaccaatatctcc

SEQ ID NO: 41255 - DNA, 15 bp, Homo sapiens
ttttaccaatatctc

SEQ ID NO: 41256 - DNA, 15 bp, Homo sapiens
tttttaccaatatct

SEQ ID NO: 41257 - DNA, 15 bp, Homo sapiens
ttttttaccaatatc

SEQ ID NO: 41258 - DNA, 15 bp, Homo sapiens
attttttaccaatat

SEQ ID NO: 41259 - DNA, 15 bp, Homo sapiens
aattttttaccaata

SEQ ID NO: 41260 - DNA, 15 bp, Homo sapiens
taattttttaccaat

SEQ ID NO: 41261 - DNA, 15 bp, Homo sapiens
ataattttttaccaa

SEQ ID NO: 41262 - DNA, 15 bp, Homo sapiens
aataattttttacca

SEQ ID NO: 41263 - DNA, 15 bp, Homo sapiens
aaataattttttacc

SEQ ID NO: 41264 - DNA, 15 bp, Homo sapiens
taaataattttttac

SEQ ID NO: 41265 - DNA, 15 bp, Homo sapiens
ttaaataatttttta

SEQ ID NO: 41266 - DNA, 15 bp, Homo sapiens
attaaataatttttt

SEQ ID NO: 41267 - DNA, 15 bp, Homo sapiens
cattaaataattttt

SEQ ID NO: 41268 - DNA, 15 bp, Homo sapiens
acattaaataatttt

SEQ ID NO: 41269 - DNA, 15 bp, Homo sapiens
gacattaaataattt

SEQ ID NO: 41270 - DNA, 15 bp, Homo sapiens
ggacattaaataatt

SEQ ID NO: 41271 - DNA, 15 bp, Homo sapiens
tggacattaaataat

SEQ ID NO: 41272 - DNA, 15 bp, Homo sapiens
ctggacattaaataa

SEQ ID NO: 41273 - DNA, 15 bp, Homo sapiens
tctggacattaaata

SEQ ID NO: 41274 - DNA, 15 bp, Homo sapiens
gtctggacattaaat

SEQ ID NO: 41275 - DNA, 15 bp, Homo sapiens
tgtctggacattaaa

SEQ ID NO: 41276 - DNA, 15 bp, Homo sapiens
ttgtctggacattaa

SEQ ID NO: 41277 - DNA, 15 bp, Homo sapiens
attgtctggacatta

SEQ ID NO: 41278 - DNA, 15 bp, Homo sapiens
tattgtctggacatt

SEQ ID NO: 41279 - DNA, 15 bp, Homo sapiens
ttattgtctggacat

SEQ ID NO: 41280 - DNA, 15 bp, Homo sapiens
tttattgtctggaca

SEQ ID NO: 41281 - DNA, 15 bp, Homo sapiens
ttttattgtctggac

SEQ ID NO: 41282 - DNA, 15 bp, Homo sapiens
attttattgtctgga

SEQ ID NO: 41283 - DNA, 15 bp, Homo sapiens
tattttattgtctgg

SEQ ID NO: 41284 - DNA, 15 bp, Homo sapiens
gtattttattgtctg

SEQ ID NO: 41285 - DNA, 15 bp, Homo sapiens
ggtattttattgtct

SEQ ID NO: 41286 - DNA, 15 bp, Homo sapiens
aggtattttattgtc

SEQ ID NO: 41287 - DNA, 15 bp, Homo sapiens
taggtattttattgt

SEQ ID NO: 41288 - DNA, 15 bp, Homo sapiens
ataggtattttattg

SEQ ID NO: 41289 - DNA, 15 bp, Homo sapiens
cataggtattttatt

SEQ ID NO: 41290 - DNA, 15 bp, Homo sapiens
tcataggtattttat

SEQ ID NO: 41291 - DNA, 15 bp, Homo sapiens
ttcataggtatttta

SEQ ID NO: 41292 - DNA, 15 bp, Homo sapiens
cttcataggtatttt

SEQ ID NO: 41293 - DNA, 15 bp, Homo sapiens
gcttcataggtattt

SEQ ID NO: 41294 - DNA, 15 bp, Homo sapiens
agcttcataggtatt

SEQ ID NO: 41295 - DNA, 15 bp, Homo sapiens
aagcttcataggtat

SEQ ID NO: 41296 - DNA, 15 bp, Homo sapiens
aaagcttcataggta

SEQ ID NO: 41297 - DNA, 15 bp, Homo sapiens
taaagcttcataggt

SEQ ID NO: 41298 - DNA, 15 bp, Homo sapiens
ttaaagcttcatagg

SEQ ID NO: 41299 - DNA, 15 bp, Homo sapiens
tttaaagcttcatag

SEQ ID NO: 41300 - DNA, 15 bp, Homo sapiens
ttttaaagcttcata

SEQ ID NO: 41301 - DNA, 15 bp, Homo sapiens
attttaaagcttcat

SEQ ID NO: 41302 - DNA, 15 bp, Homo sapiens
cattttaaagcttca

SEQ ID NO: 41303 - DNA, 15 bp, Homo sapiens
tcattttaaagcttc

SEQ ID NO: 41304 - DNA, 15 bp, Homo sapiens
gtcattttaaagctt

SEQ ID NO: 41305 - DNA, 15 bp, Homo sapiens
tgtcattttaaagct

SEQ ID NO: 41306 - DNA, 15 bp, Homo sapiens
atgtcattttaaagc

SEQ ID NO: 41307 - DNA, 15 bp, Homo sapiens
aatgtcattttaaag

SEQ ID NO: 41308 - DNA, 15 bp, Homo sapiens
taatgtcattttaaa

SEQ ID NO: 41309 - DNA, 15 bp, Homo sapiens
ataatgtcattttaa

SEQ ID NO: 41310 - DNA, 15 bp, Homo sapiens
aataatgtcatttta

SEQ ID NO: 41311 - DNA, 15 bp, Homo sapiens
taataatgtcatttt

SEQ ID NO: 41312 - DNA, 15 bp, Homo sapiens
ttaataatgtcattt

SEQ ID NO: 41313 - DNA, 15 bp, Homo sapiens
tttaataatgtcatt

SEQ ID NO: 41314 - DNA, 15 bp, Homo sapiens
ctttaataatgtcat

SEQ ID NO: 41315 - DNA, 15 bp, Homo sapiens
tctttaataatgtca

SEQ ID NO: 41316 - DNA, 15 bp, Homo sapiens
ttctttaataatgtc

SEQ ID NO: 41317 - DNA, 15 bp, Homo sapiens
attctttaataatgt

SEQ ID NO: 41318 - DNA, 15 bp, Homo sapiens
cattctttaataatg

SEQ ID NO: 41319 - DNA, 15 bp, Homo sapiens
acattctttaataat

SEQ ID NO: 41320 - DNA, 15 bp, Homo sapiens
cacattctttaataa

SEQ ID NO: 41321 - DNA, 15 bp, Homo sapiens
gcacattctttaata

SEQ ID NO: 41322 - DNA, 15 bp, Homo sapiens
tgcacattctttaat

SEQ ID NO: 41323 - DNA, 15 bp, Homo sapiens
gtgcacattctttaa

SEQ ID NO: 41324 - DNA, 15 bp, Homo sapiens
agtgcacattcttta

SEQ ID NO: 41325 - DNA, 15 bp, Homo sapiens
cagtgcacattcttt

SEQ ID NO: 41326 - DNA, 15 bp, Homo sapiens
acagtgcacattctt

SEQ ID NO: 41327 - DNA, 15 bp, Homo sapiens
tacagtgcacattct

SEQ ID NO: 41328 - DNA, 15 bp, Homo sapiens
ttacagtgcacattc

SEQ ID NO: 41329 - DNA, 15 bp, Homo sapiens
attacagtgcacatt

SEQ ID NO: 41330 - DNA, 15 bp, Homo sapiens
tattacagtgcacat

SEQ ID NO: 41331 - DNA, 15 bp, Homo sapiens
ttattacagtgcaca

SEQ ID NO: 41332 - DNA, 15 bp, Homo sapiens
tttattacagtgcac

SEQ ID NO: 41333 - DNA, 15 bp, Homo sapiens
ttttattacagtgca

SEQ ID NO: 41334 - DNA, 15 bp, Homo sapiens
tttttattacagtgc

SEQ ID NO: 41335 - DNA, 15 bp, Homo sapiens
gtttttattacagtg

SEQ ID NO: 41336 - DNA, 15 bp, Homo sapiens
tgtttttattacagt

SEQ ID NO: 41337 - DNA, 15 bp, Homo sapiens
ctgtttttattacag

SEQ ID NO: 41338 - DNA, 15 bp, Homo sapiens
tctgtttttattaca

SEQ ID NO: 41339 - DNA, 15 bp, Homo sapiens
atctgtttttattac

SEQ ID NO: 41340 - DNA, 15 bp, Homo sapiens
aatctgtttttatta

SEQ ID NO: 41341 - DNA, 15 bp, Homo sapiens
aaatctgtttttatt

SEQ ID NO: 41342 - DNA, 15 bp, Homo sapiens
taaatctgtttttat

SEQ ID NO: 41343 - DNA, 15 bp, Homo sapiens
ataaatctgttttta

SEQ ID NO: 41344 - DNA, 15 bp, Homo sapiens
tataaatctgttttt

SEQ ID NO: 41345 - DNA, 15 bp, Homo sapiens
ttataaatctgtttt

SEQ ID NO: 41346 - DNA, 15 bp, Homo sapiens
tttataaatctgttt

SEQ ID NO: 41347 - DNA, 15 bp, Homo sapiens
ctttataaatctgtt

SEQ ID NO: 41348 - DNA, 15 bp, Homo sapiens
actttataaatctgt

SEQ ID NO: 41349 - DNA, 15 bp, Homo sapiens
tactttataaatctg

SEQ ID NO: 41350 - DNA, 15 bp, Homo sapiens
atactttataaatct

SEQ ID NO: 41351 - DNA, 15 bp, Homo sapiens
aatactttataaatc

SEQ ID NO: 41352 - DNA, 15 bp, Homo sapiens
aaatactttataaat

SEQ ID NO: 41353 - DNA, 15 bp, Homo sapiens
aaaatactttataaa

SEQ ID NO: 41354 - DNA, 15 bp, Homo sapiens
taaaatactttataa

SEQ ID NO: 41355 - DNA, 15 bp, Homo sapiens
ttaaaatactttata

SEQ ID NO: 41356 - DNA, 15 bp, Homo sapiens
tttaaaatactttat

SEQ ID NO: 41357 - DNA, 15 bp, Homo sapiens
atttaaaatacttta

SEQ ID NO: 41358 - DNA, 15 bp, Homo sapiens
tatttaaaatacttt

SEQ ID NO: 41359 - DNA, 15 bp, Homo sapiens
ttatttaaaatactt

SEQ ID NO: 41360 - DNA, 15 bp, Homo sapiens
tttatttaaaatact

SEQ ID NO: 41361 - DNA, 15 bp, Homo sapiens
atttatttaaaatac

SEQ ID NO: 41362 - DNA, 15 bp, Homo sapiens
tatttatttaaaata

SEQ ID NO: 41363 - DNA, 15 bp, Homo sapiens
atatttatttaaaat

SEQ ID NO: 41364 - DNA, 15 bp, Homo sapiens
tatatttatttaaaa

SEQ ID NO: 41365 - DNA, 15 bp, Homo sapiens
ttatatttatttaaa

SEQ ID NO: 41366 - DNA, 15 bp, Homo sapiens
tttatatttatttaa

SEQ ID NO: 41367 - DNA, 15 bp, Homo sapiens
ttttatatttattta

SEQ ID NO: 41368 - DNA, 15 bp, Homo sapiens
attttatatttattt

SEQ ID NO: 41369 - DNA, 15 bp, Homo sapiens
tattttatatttatt

SEQ ID NO: 41370 - DNA, 15 bp, Homo sapiens
gtattttatatttat

SEQ ID NO: 41371 - DNA, 15 bp, Homo sapiens
agtattttatattta

SEQ ID NO: 41372 - DNA, 15 bp, Homo sapiens
tagtattttatattt

SEQ ID NO: 41373 - DNA, 15 bp, Homo sapiens
atagtattttatatt

SEQ ID NO: 41374 - DNA, 15 bp, Homo sapiens
catagtattttatat

SEQ ID NO: 41375 - DNA, 15 bp, Homo sapiens
acatagtattttata

SEQ ID NO: 41376 - DNA, 15 bp, Homo sapiens
tacatagtattttat

SEQ ID NO: 41377 - DNA, 15 bp, Homo sapiens
ttacatagtatttta

SEQ ID NO: 41378 - DNA, 15 bp, Homo sapiens
cttacatagtatttt

SEQ ID NO: 41379 - DNA, 15 bp, Homo sapiens
ccttacatagtattt

SEQ ID NO: 41380 - DNA, 15 bp, Homo sapiens
tccttacatagtatt

SEQ ID NO: 41381 - DNA, 15 bp, Homo sapiens
ttccttacatagtat

SEQ ID NO: 41382 - DNA, 15 bp, Homo sapiens
cttccttacatagta

SEQ ID NO: 41383 - DNA, 15 bp, Homo sapiens
tcttccttacatagt

SEQ ID NO: 41384 - DNA, 15 bp, Homo sapiens
ttcttccttacatag

SEQ ID NO: 41385 - DNA, 15 bp, Homo sapiens
cttcttccttacata

SEQ ID NO: 41386 - DNA, 15 bp, Homo sapiens
gcttcttccttacat

SEQ ID NO: 41387 - DNA, 15 bp, Homo sapiens
tgcttcttccttaca

SEQ ID NO: 41388 - DNA, 15 bp, Homo sapiens
ctgcttcttccttac

SEQ ID NO: 41389 - DNA, 15 bp, Homo sapiens
tctgcttcttcctta

SEQ ID NO: 41390 - DNA, 15 bp, Homo sapiens
gtctgcttcttcctt

SEQ ID NO: 41391 - DNA, 15 bp, Homo sapiens
tgtctgcttcttcct

SEQ ID NO: 41392 - DNA, 15 bp, Homo sapiens
ttgtctgcttcttcc

SEQ ID NO: 41393 - DNA, 15 bp, Homo sapiens
tttgtctgcttcttc

SEQ ID NO: 41394 - DNA, 15 bp, Homo sapiens
ttttgtctgcttctt

SEQ ID NO: 41395 - DNA, 15 bp, Homo sapiens
tttttgtctgcttct

SEQ ID NO: 41396 - DNA, 15 bp, Homo sapiens
atttttgtctgcttc

SEQ ID NO: 41397 - DNA, 15 bp, Homo sapiens
catttttgtctgctt

SEQ ID NO: 41398 - DNA, 15 bp, Homo sapiens
acatttttgtctgct

SEQ ID NO: 41399 - DNA, 15 bp, Homo sapiens
gacatttttgtctgc

SEQ ID NO: 41400 - DNA, 15 bp, Homo sapiens
agacatttttgtctg

SEQ ID NO: 41401 - DNA, 15 bp, Homo sapiens
tagacatttttgtct

SEQ ID NO: 41402 - DNA, 15 bp, Homo sapiens
ctagacatttttgtc

SEQ ID NO: 41403 - DNA, 15 bp, Homo sapiens
cctagacatttttgt

SEQ ID NO: 41404 - DNA, 15 bp, Homo sapiens
tcctagacatttttg

SEQ ID NO: 41405 - DNA, 15 bp, Homo sapiens
ctcctagacattttt

SEQ ID NO: 41406 - DNA, 15 bp, Homo sapiens
cctcctagacatttt

SEQ ID NO: 41407 - DNA, 15 bp, Homo sapiens
tcctcctagacattt

SEQ ID NO: 41408 - DNA, 15 bp, Homo sapiens
atcctcctagacatt

SEQ ID NO: 41409 - DNA, 15 bp, Homo sapiens
catcctcctagacat

SEQ ID NO: 41410 - DNA, 15 bp, Homo sapiens
acatcctcctagaca

SEQ ID NO: 41411 - DNA, 15 bp, Homo sapiens
tacatcctcctagac

SEQ ID NO: 41412 - DNA, 15 bp, Homo sapiens
atacatcctcctaga

SEQ ID NO: 41413 - DNA, 15 bp, Homo sapiens
tatacatcctcctag

SEQ ID NO: 41414 - DNA, 15 bp, Homo sapiens
atatacatcctccta

SEQ ID NO: 41415 - DNA, 15 bp, Homo sapiens
tatatacatcctcct

SEQ ID NO: 41416 - DNA, 15 bp, Homo sapiens
ttatatacatcctcc

SEQ ID NO: 41417 - DNA, 15 bp, Homo sapiens
tttatatacatcctc

SEQ ID NO: 41418 - DNA, 15 bp, Homo sapiens
gtttatatacatcct

SEQ ID NO: 41419 - DNA, 15 bp, Homo sapiens
ggtttatatacatcc

SEQ ID NO: 41420 - DNA, 15 bp, Homo sapiens
aggtttatatacatc

SEQ ID NO: 41421 - DNA, 15 bp, Homo sapiens
caggtttatatacat

SEQ ID NO: 41422 - DNA, 15 bp, Homo sapiens
acaggtttatataca

SEQ ID NO: 41423 - DNA, 15 bp, Homo sapiens
aacaggtttatatac

SEQ ID NO: 41424 - DNA, 15 bp, Homo sapiens
taacaggtttatata

SEQ ID NO: 41425 - DNA, 15 bp, Homo sapiens
ttaacaggtttatat

SEQ ID NO: 41426 - DNA, 15 bp, Homo sapiens
attaacaggtttata

SEQ ID NO: 41427 - DNA, 15 bp, Homo sapiens
tattaacaggtttat

SEQ ID NO: 41428 - DNA, 15 bp, Homo sapiens
gtattaacaggttta

SEQ ID NO: 41429 - DNA, 15 bp, Homo sapiens
agtattaacaggttt

SEQ ID NO: 41430 - DNA, 15 bp, Homo sapiens
cagtattaacaggtt

SEQ ID NO: 41431 - DNA, 15 bp, Homo sapiens
ccagtattaacaggt

SEQ ID NO: 41432 - DNA, 15 bp, Homo sapiens
accagtattaacagg

SEQ ID NO: 41433 - DNA, 15 bp, Homo sapiens
aaccagtattaacag

SEQ ID NO: 41434 - DNA, 15 bp, Homo sapiens
taaccagtattaaca

SEQ ID NO: 41435 - DNA, 15 bp, Homo sapiens
ataaccagtattaac

SEQ ID NO: 41436 - DNA, 15 bp, Homo sapiens
gataaccagtattaa

SEQ ID NO: 41437 - DNA, 15 bp, Homo sapiens
agataaccagtatta

SEQ ID NO: 41438 - DNA, 15 bp, Homo sapiens
gagataaccagtatt

SEQ ID NO: 41439 - DNA, 15 bp, Homo sapiens
agagataaccagtat

SEQ ID NO: 41440 - DNA, 15 bp, Homo sapiens
cagagataaccagta

SEQ ID NO: 41441 - DNA, 15 bp, Homo sapiens
ccagagataaccagt

SEQ ID NO: 41442 - DNA, 15 bp, Homo sapiens
cccagagataaccag

SEQ ID NO: 41443 - DNA, 15 bp, Homo sapiens
gcccagagataacca

SEQ ID NO: 41444 - DNA, 15 bp, Homo sapiens
tgcccagagataacc

SEQ ID NO: 41445 - DNA, 15 bp, Homo sapiens
ctgcccagagataac

SEQ ID NO: 41446 - DNA, 15 bp, Homo sapiens
tctgcccagagataa

SEQ ID NO: 41447 - DNA, 15 bp, Homo sapiens
ctctgcccagagata

SEQ ID NO: 41448 - DNA, 15 bp, Homo sapiens
cctctgcccagagat

SEQ ID NO: 41449 - DNA, 15 bp, Homo sapiens
ccctctgcccagaga

SEQ ID NO: 41450 - DNA, 15 bp, Homo sapiens
tccctctgcccagag

SEQ ID NO: 41451 - DNA, 15 bp, Homo sapiens
ttccctctgcccaga

SEQ ID NO: 41452 - DNA, 15 bp, Homo sapiens
tttccctctgcccag

SEQ ID NO: 41453 - DNA, 15 bp, Homo sapiens
ttttccctctgccca

SEQ ID NO: 41454 - DNA, 15 bp, Homo sapiens
attttccctctgccc

SEQ ID NO: 41455 - DNA, 15 bp, Homo sapiens
cattttccctctgcc

SEQ ID NO: 41456 - DNA, 15 bp, Homo sapiens
ccattttccctctgc

SEQ ID NO: 41457 - DNA, 15 bp, Homo sapiens
cccattttccctctg

SEQ ID NO: 41458 - DNA, 15 bp, Homo sapiens
acccattttccctct

SEQ ID NO: 41459 - DNA, 15 bp, Homo sapiens
cacccattttccctc

SEQ ID NO: 41460 - DNA, 15 bp, Homo sapiens
ccacccattttccct

SEQ ID NO: 41461 - DNA, 15 bp, Homo sapiens
accacccattttccc

SEQ ID NO: 41462 - DNA, 15 bp, Homo sapiens
aaccacccattttcc

SEQ ID NO: 41463 - DNA, 15 bp, Homo sapiens
aaaccacccattttc

SEQ ID NO: 41464 - DNA, 15 bp, Homo sapiens
taaaccacccatttt

SEQ ID NO: 41465 - DNA, 15 bp, Homo sapiens
ttaaaccacccattt

SEQ ID NO: 41466 - DNA, 15 bp, Homo sapiens
cttaaaccacccatt

SEQ ID NO: 41467 - DNA, 15 bp, Homo sapiens
acttaaaccacccat

SEQ ID NO: 41468 - DNA, 15 bp, Homo sapiens
aacttaaaccaccca

SEQ ID NO: 41469 - DNA, 15 bp, Homo sapiens
aaacttaaaccaccc

SEQ ID NO: 41470 - DNA, 15 bp, Homo sapiens
gaaacttaaaccacc

SEQ ID NO: 41471 - DNA, 15 bp, Homo sapiens
ggaaacttaaaccac

SEQ ID NO: 41472 - DNA, 15 bp, Homo sapiens
aggaaacttaaacca

SEQ ID NO: 41473 - DNA, 15 bp, Homo sapiens
aaggaaacttaaacc

SEQ ID NO: 41474 - DNA, 15 bp, Homo sapiens
gaaggaaacttaaac

SEQ ID NO: 41475 - DNA, 15 bp, Homo sapiens
ggaaggaaacttaaa

SEQ ID NO: 41476 - DNA, 15 bp, Homo sapiens
aggaaggaaacttaa

SEQ ID NO: 41477 - DNA, 15 bp, Homo sapiens
aaggaaggaaactta

SEQ ID NO: 41478 - DNA, 15 bp, Homo sapiens
aaaggaaggaaactt

SEQ ID NO: 41479 - DNA, 15 bp, Homo sapiens
caaaggaaggaaact

SEQ ID NO: 41480 - DNA, 15 bp, Homo sapiens
ccaaaggaaggaaac

SEQ ID NO: 41481 - DNA, 15 bp, Homo sapiens
accaaaggaaggaaa

SEQ ID NO: 41482 - DNA, 15 bp, Homo sapiens
aaccaaaggaaggaa

SEQ ID NO: 41483 - DNA, 15 bp, Homo sapiens
aaaccaaaggaagga

SEQ ID NO: 41484 - DNA, 15 bp, Homo sapiens
caaaccaaaggaagg

SEQ ID NO: 41485 - DNA, 15 bp, Homo sapiens
acaaaccaaaggaag

SEQ ID NO: 41486 - DNA, 15 bp, Homo sapiens
gacaaaccaaaggaa

SEQ ID NO: 41487 - DNA, 15 bp, Homo sapiens
agacaaaccaaagga

SEQ ID NO: 41488 - DNA, 15 bp, Homo sapiens
tagacaaaccaaagg

SEQ ID NO: 41489 - DNA, 15 bp, Homo sapiens
ttagacaaaccaaag

SEQ ID NO: 41490 - DNA, 15 bp, Homo sapiens
tttagacaaaccaaa

SEQ ID NO: 41491 - DNA, 15 bp, Homo sapiens
atttagacaaaccaa

SEQ ID NO: 41492 - DNA, 15 bp, Homo sapiens
gatttagacaaacca

SEQ ID NO: 41493 - DNA, 15 bp, Homo sapiens
agatttagacaaacc

SEQ ID NO: 41494 - DNA, 15 bp, Homo sapiens
aagatttagacaaac

SEQ ID NO: 41495 - DNA, 15 bp, Homo sapiens
gaagatttagacaaa

SEQ ID NO: 41496 - DNA, 15 bp, Homo sapiens
ggaagatttagacaa

SEQ ID NO: 41497 - DNA, 15 bp, Homo sapiens
aggaagatttagaca

SEQ ID NO: 41498 - DNA, 15 bp, Homo sapiens
aaggaagatttagac

SEQ ID NO: 41499 - DNA, 15 bp, Homo sapiens
taaggaagatttaga

SEQ ID NO: 41500 - DNA, 15 bp, Homo sapiens
ttaaggaagatttag

SEQ ID NO: 41501 - DNA, 15 bp, Homo sapiens
attaaggaagattta

SEQ ID NO: 41502 - DNA, 15 bp, Homo sapiens
tattaaggaagattt

SEQ ID NO: 41503 - DNA, 15 bp, Homo sapiens
ttattaaggaagatt

SEQ ID NO: 41504 - DNA, 15 bp, Homo sapiens
tttattaaggaagat

SEQ ID NO: 41505 - DNA, 15 bp, Homo sapiens
atttattaaggaaga

SEQ ID NO: 41506 - DNA, 15 bp, Homo sapiens
catttattaaggaag

SEQ ID NO: 41507 - DNA, 15 bp, Homo sapiens
ccatttattaaggaa

SEQ ID NO: 41508 - DNA, 15 bp, Homo sapiens
tccatttattaagga

SEQ ID NO: 41509 - DNA, 15 bp, Homo sapiens
ttccatttattaagg

SEQ ID NO: 41510 - DNA, 15 bp, Homo sapiens
tttccatttattaag

SEQ ID NO: 41511 - DNA, 15 bp, Homo sapiens
atttccatttattaa

SEQ ID NO: 41512 - DNA, 15 bp, Homo sapiens
aatttccatttatta

SEQ ID NO: 41513 - DNA, 15 bp, Homo sapiens
caatttccatttatt

SEQ ID NO: 41514 - DNA, 15 bp, Homo sapiens
gcaatttccatttat

SEQ ID NO: 41515 - DNA, 15 bp, Homo sapiens
agcaatttccattta

SEQ ID NO: 41516 - DNA, 15 bp, Homo sapiens
aagcaatttccattt

SEQ ID NO: 41517 - DNA, 15 bp, Homo sapiens
aaagcaatttccatt

SEQ ID NO: 41518 - DNA, 15 bp, Homo sapiens
aaaagcaatttccat

SEQ ID NO: 41519 - DNA, 15 bp, Homo sapiens
caaaagcaatttcca

SEQ ID NO: 41520 - DNA, 15 bp, Homo sapiens
acaaaagcaatttcc

SEQ ID NO: 41521 - DNA, 15 bp, Homo sapiens
tacaaaagcaatttc

SEQ ID NO: 41522 - DNA, 15 bp, Homo sapiens
ttacaaaagcaattt

SEQ ID NO: 41523 - DNA, 15 bp, Homo sapiens
attacaaaagcaatt

SEQ ID NO: 41524 - DNA, 15 bp, Homo sapiens
tattacaaaagcaat

SEQ ID NO: 41525 - DNA, 15 bp, Homo sapiens
ttattacaaaagcaa

SEQ ID NO: 41526 - DNA, 15 bp, Homo sapiens
tttattacaaaagca

SEQ ID NO: 41527 - DNA, 15 bp, Homo sapiens
ttttattacaaaagc

SEQ ID NO: 41528 - DNA, 15 bp, Homo sapiens
attttattacaaaag

SEQ ID NO: 41529 - DNA, 15 bp, Homo sapiens
cattttattacaaaa

SEQ ID NO: 41530 - DNA, 15 bp, Homo sapiens
acattttattacaaa

SEQ ID NO: 41531 - DNA, 15 bp, Homo sapiens
aacattttattacaa

SEQ ID NO: 41532 - DNA, 15 bp, Homo sapiens
aaacattttattaca

SEQ ID NO: 41533 - DNA, 15 bp, Homo sapiens
caaacattttattac

SEQ ID NO: 41534 - DNA, 15 bp, Homo sapiens
tcaaacattttatta

SEQ ID NO: 41535 - DNA, 15 bp, Homo sapiens
ttcaaacattttatt

SEQ ID NO: 41536 - DNA, 15 bp, Homo sapiens
tttcaaacattttat

SEQ ID NO: 41537 - DNA, 15 bp, Homo sapiens
ttttcaaacatttta

SEQ ID NO: 41538 - DNA, 15 bp, Homo sapiens
attttcaaacatttt

SEQ ID NO: 41539 - DNA, 15 bp, Homo sapiens
tattttcaaacattt

SEQ ID NO: 41540 - DNA, 15 bp, Homo sapiens
atattttcaaacatt

SEQ ID NO: 41541 - DNA, 15 bp, Homo sapiens
gatattttcaaacat

SEQ ID NO: 41542 - DNA, 15 bp, Homo sapiens
ggatattttcaaaca

SEQ ID NO: 41543 - DNA, 15 bp, Homo sapiens
gggatattttcaaac

SEQ ID NO: 41544 - DNA, 15 bp, Homo sapiens
ggggatattttcaaa

SEQ ID NO: 41545 - DNA, 15 bp, Homo sapiens
aggggatattttcaa

SEQ ID NO: 41546 - DNA, 15 bp, Homo sapiens
gaggggatattttca

SEQ ID NO: 41547 - DNA, 15 bp, Homo sapiens
ggaggggatattttc

SEQ ID NO: 41548 - DNA, 15 bp, Homo sapiens
gggaggggatatttt

SEQ ID NO: 41549 - DNA, 15 bp, Homo sapiens
tgggaggggatattt

SEQ ID NO: 41550 - DNA, 15 bp, Homo sapiens
ttgggaggggatatt

SEQ ID NO: 41551 - DNA, 15 bp, Homo sapiens
tttgggaggggatat

SEQ ID NO: 41552 - DNA, 15 bp, Homo sapiens
ttttgggaggggata

SEQ ID NO: 41553 - DNA, 15 bp, Homo sapiens
attttgggaggggat

SEQ ID NO: 41554 - DNA, 15 bp, Homo sapiens
tattttgggagggga

SEQ ID NO: 41555 - DNA, 15 bp, Homo sapiens
ttattttgggagggg

SEQ ID NO: 41556 - DNA, 15 bp, Homo sapiens
tttattttgggaggg

SEQ ID NO: 41557 - DNA, 15 bp, Homo sapiens
ctttattttgggagg

SEQ ID NO: 41558 - DNA, 15 bp, Homo sapiens
tctttattttgggag

SEQ ID NO: 41559 - DNA, 15 bp, Homo sapiens
ttctttattttggga

SEQ ID NO: 41560 - DNA, 15 bp, Homo sapiens
tttctttattttggg

SEQ ID NO: 41561 - DNA, 15 bp, Homo sapiens
ttttctttattttgg

SEQ ID NO: 41562 - DNA, 15 bp, Homo sapiens
tttttctttattttg

SEQ ID NO: 41563 - DNA, 15 bp, Homo sapiens
atttttctttatttt

SEQ ID NO: 41564 - DNA, 15 bp, Homo sapiens
tatttttctttattt

SEQ ID NO: 41565 - DNA, 15 bp, Homo sapiens
ttatttttctttatt

SEQ ID NO: 41566 - DNA, 15 bp, Homo sapiens
attatttttctttat

SEQ ID NO: 41567 - DNA, 15 bp, Homo sapiens
cattatttttcttta

SEQ ID NO: 41568 - DNA, 15 bp, Homo sapiens
tcattatttttcttt

SEQ ID NO: 41569 - DNA, 15 bp, Homo sapiens
ttcattatttttctt

SEQ ID NO: 41570 - DNA, 15 bp, Homo sapiens
tttcattatttttct

SEQ ID NO: 41571 - DNA, 15 bp, Homo sapiens
ttttcattatttttc

SEQ ID NO: 41572 - DNA, 15 bp, Homo sapiens
attttcattattttt

SEQ ID NO: 41573 - DNA, 15 bp, Homo sapiens
tattttcattatttt

SEQ ID NO: 41574 - DNA, 15 bp, Homo sapiens
ttattttcattattt

SEQ ID NO: 41575 - DNA, 15 bp, Homo sapiens
attattttcattatt

SEQ ID NO: 41576 - DNA, 15 bp, Homo sapiens
cattattttcattat

SEQ ID NO: 41577 - DNA, 15 bp, Homo sapiens
tcattattttcatta

SEQ ID NO: 41578 - DNA, 15 bp, Homo sapiens
atcattattttcatt

SEQ ID NO: 41579 - DNA, 15 bp, Homo sapiens
tatcattattttcat

SEQ ID NO: 41580 - DNA, 15 bp, Homo sapiens
ctatcattattttca

SEQ ID NO: 41581 - DNA, 15 bp, Homo sapiens
actatcattattttc

SEQ ID NO: 41582 - DNA, 15 bp, Homo sapiens
aactatcattatttt

SEQ ID NO: 41583 - DNA, 15 bp, Homo sapiens
caactatcattattt

SEQ ID NO: 41584 - DNA, 15 bp, Homo sapiens
tcaactatcattatt

SEQ ID NO: 41585 - DNA, 15 bp, Homo sapiens
ttcaactatcattat

SEQ ID NO: 41586 - DNA, 15 bp, Homo sapiens
tttcaactatcatta

SEQ ID NO: 41587 - DNA, 15 bp, Homo sapiens
gtttcaactatcatt

SEQ ID NO: 41588 - DNA, 15 bp, Homo sapiens
agtttcaactatcat

SEQ ID NO: 41589 - DNA, 15 bp, Homo sapiens
gagtttcaactatca

SEQ ID NO: 41590 - DNA, 15 bp, Homo sapiens
tgagtttcaactatc

SEQ ID NO: 41591 - DNA, 15 bp, Homo sapiens
ttgagtttcaactat

SEQ ID NO: 41592 - DNA, 15 bp, Homo sapiens
attgagtttcaacta

SEQ ID NO: 41593 - DNA, 15 bp, Homo sapiens
aattgagtttcaact

SEQ ID NO: 41594 - DNA, 15 bp, Homo sapiens
caattgagtttcaac

SEQ ID NO: 41595 - DNA, 15 bp, Homo sapiens
tcaattgagtttcaa

SEQ ID NO: 41596 - DNA, 15 bp, Homo sapiens
ctcaattgagtttca

SEQ ID NO: 41597 - DNA, 15 bp, Homo sapiens
cctcaattgagtttc

SEQ ID NO: 41598 - DNA, 15 bp, Homo sapiens
ccctcaattgagttt

SEQ ID NO: 41599 - DNA, 15 bp, Homo sapiens
cccctcaattgagtt

SEQ ID NO: 41600 - DNA, 15 bp, Homo sapiens
gcccctcaattgagt

SEQ ID NO: 41601 - DNA, 15 bp, Homo sapiens
ggcccctcaattgag

SEQ ID NO: 41602 - DNA, 15 bp, Homo sapiens
gggcccctcaattga

SEQ ID NO: 41603 - DNA, 15 bp, Homo sapiens
cgggcccctcaattg

SEQ ID NO: 41604 - DNA, 15 bp, Homo sapiens
ccgggcccctcaatt

SEQ ID NO: 41605 - DNA, 15 bp, Homo sapiens
gccgggcccctcaat

SEQ ID NO: 41606 - DNA, 15 bp, Homo sapiens
tgccgggcccctcaa

SEQ ID NO: 41607 - DNA, 15 bp, Homo sapiens
atgccgggcccctca

SEQ ID NO: 41608 - DNA, 15 bp, Homo sapiens
tatgccgggcccctc

SEQ ID NO: 41609 - DNA, 15 bp, Homo sapiens
atatgccgggcccct

SEQ ID NO: 41610 - DNA, 15 bp, Homo sapiens
aatatgccgggcccc

SEQ ID NO: 41611 - DNA, 15 bp, Homo sapiens
caatatgccgggccc

SEQ ID NO: 41612 - DNA, 15 bp, Homo sapiens
ccaatatgccgggcc

SEQ ID NO: 41613 - DNA, 15 bp, Homo sapiens
gccaatatgccgggc

SEQ ID NO: 41614 - DNA, 15 bp, Homo sapiens
agccaatatgccggg

SEQ ID NO: 41615 - DNA, 15 bp, Homo sapiens
gagccaatatgccgg

SEQ ID NO: 41616 - DNA, 15 bp, Homo sapiens
tgagccaatatgccg

SEQ ID NO: 41617 - DNA, 15 bp, Homo sapiens
atgagccaatatgcc

SEQ ID NO: 41618 - DNA, 15 bp, Homo sapiens
catgagccaatatgc

SEQ ID NO: 41619 - DNA, 15 bp, Homo sapiens
gcatgagccaatatg

SEQ ID NO: 41620 - DNA, 15 bp, Homo sapiens
ggcatgagccaatat

SEQ ID NO: 41621 - DNA, 15 bp, Homo sapiens
aggcatgagccaata

SEQ ID NO: 41622 - DNA, 15 bp, Homo sapiens
caggcatgagccaat

SEQ ID NO: 41623 - DNA, 15 bp, Homo sapiens
gcaggcatgagccaa

SEQ ID NO: 41624 - DNA, 15 bp, Homo sapiens
tgcaggcatgagcca

SEQ ID NO: 41625 - DNA, 15 bp, Homo sapiens
ttgcaggcatgagcc

SEQ ID NO: 41626 - DNA, 15 bp, Homo sapiens
attgcaggcatgagc

SEQ ID NO: 41627 - DNA, 15 bp, Homo sapiens
gattgcaggcatgag

SEQ ID NO: 41628 - DNA, 15 bp, Homo sapiens
ggattgcaggcatga

SEQ ID NO: 41629 - DNA, 15 bp, Homo sapiens
gggattgcaggcatg

SEQ ID NO: 41630 - DNA, 15 bp, Homo sapiens
tgggattgcaggcat

SEQ ID NO: 41631 - DNA, 15 bp, Homo sapiens
ctgggattgcaggca

SEQ ID NO: 41632 - DNA, 15 bp, Homo sapiens
gctgggattgcaggc

SEQ ID NO: 41633 - DNA, 15 bp, Homo sapiens
tgctgggattgcagg

SEQ ID NO: 41634 - DNA, 15 bp, Homo sapiens
gtgctgggattgcag

SEQ ID NO: 41635 - DNA, 15 bp, Homo sapiens
ggtgctgggattgca

SEQ ID NO: 41636 - DNA, 15 bp, Homo sapiens
aggtgctgggattgc

SEQ ID NO: 41637 - DNA, 15 bp, Homo sapiens
aaggtgctgggattg

SEQ ID NO: 41638 - DNA, 15 bp, Homo sapiens
caaggtgctgggatt

SEQ ID NO: 41639 - DNA, 15 bp, Homo sapiens
tcaaggtgctgggat

SEQ ID NO: 41640 - DNA, 15 bp, Homo sapiens
ctcaaggtgctggga

SEQ ID NO: 41641 - DNA, 15 bp, Homo sapiens
tctcaaggtgctggg

SEQ ID NO: 41642 - DNA, 15 bp, Homo sapiens
ctctcaaggtgctgg

SEQ ID NO: 41643 - DNA, 15 bp, Homo sapiens
cctctcaaggtgctg

SEQ ID NO: 41644 - DNA, 15 bp, Homo sapiens
gcctctcaaggtgct

SEQ ID NO: 41645 - DNA, 15 bp, Homo sapiens
agcctctcaaggtgc

SEQ ID NO: 41646 - DNA, 15 bp, Homo sapiens
cagcctctcaaggtg

SEQ ID NO: 41647 - DNA, 15 bp, Homo sapiens
tgtcttgacaaagat

SEQ ID NO: 41648 - DNA, 15 bp, Homo sapiens
gtgtcttgacaaaga

SEQ ID NO: 41649 - DNA, 15 bp, Homo sapiens
ggtgtcttgacaaag

SEQ ID NO: 41650 - DNA, 15 bp, Homo sapiens
gggtgtcttgacaaa

SEQ ID NO: 41651 - DNA, 15 bp, Homo sapiens
agggtgtcttgacaa

SEQ ID NO: 41652 - DNA, 15 bp, Homo sapiens
cagggtgtcttgaca

SEQ ID NO: 41653 - DNA, 15 bp, Homo sapiens
gcagggtgtcttgac

SEQ ID NO: 41654 - DNA, 15 bp, Homo sapiens
agcagggtgtcttga

SEQ ID NO: 41655 - DNA, 15 bp, Homo sapiens
aagcagggtgtcttg

SEQ ID NO: 41656 - DNA, 15 bp, Homo sapiens
aaagcagggtgtctt

SEQ ID NO: 41657 - DNA, 15 bp, Homo sapiens
taaagcagggtgtct

SEQ ID NO: 41658 - DNA, 15 bp, Homo sapiens
ataaagcagggtgtc

SEQ ID NO: 41659 - DNA, 15 bp, Homo sapiens
cataaagcagggtgt

SEQ ID NO: 41660 - DNA, 15 bp, Homo sapiens
gcataaagcagggtg

SEQ ID NO: 41661 - DNA, 15 bp, Homo sapiens
ggcataaagcagggt

SEQ ID NO: 41662 - DNA, 15 bp, Homo sapiens
aggcataaagcaggg

SEQ ID NO: 41663 - DNA, 15 bp, Homo sapiens
caggcataaagcagg

SEQ ID NO: 41664 - DNA, 15 bp, Homo sapiens
ccaggcataaagcag

SEQ ID NO: 41665 - DNA, 15 bp, Homo sapiens
accaggcataaagca

SEQ ID NO: 41666 - DNA, 15 bp, Homo sapiens
gaccaggcataaagc

SEQ ID NO: 41667 - DNA, 15 bp, Homo sapiens
ggaccaggcataaag

SEQ ID NO: 41668 - DNA, 15 bp, Homo sapiens
gggaccaggcataaa

SEQ ID NO: 41669 - DNA, 15 bp, Homo sapiens
ggggaccaggcataa

SEQ ID NO: 41670 - DNA, 15 bp, Homo sapiens
tggggaccaggcata

SEQ ID NO: 41671 - DNA, 15 bp, Homo sapiens
ttggggaccaggcat

SEQ ID NO: 41672 - DNA, 15 bp, Homo sapiens
tttggggaccaggca

SEQ ID NO: 41673 - DNA, 15 bp, Homo sapiens
ctttggggaccaggc

SEQ ID NO: 41674 - DNA, 15 bp, Homo sapiens
actttggggaccagg

SEQ ID NO: 41675 - DNA, 15 bp, Homo sapiens
cactttggggaccag

SEQ ID NO: 41676 - DNA, 15 bp, Homo sapiens
tcactttggggacca

SEQ ID NO: 41677 - DNA, 15 bp, Homo sapiens
ctcactttggggacc

SEQ ID NO: 41678 - DNA, 15 bp, Homo sapiens
gctcactttggggac

SEQ ID NO: 41679 - DNA, 15 bp, Homo sapiens
tgctcactttgggga

SEQ ID NO: 41680 - DNA, 15 bp, Homo sapiens
ctgctcactttgggg

SEQ ID NO: 41681 - DNA, 15 bp, Homo sapiens
tctgctcactttggg

SEQ ID NO: 41682 - DNA, 15 bp, Homo sapiens
ttctgctcactttgg

SEQ ID NO: 41683 - DNA, 15 bp, Homo sapiens
cttctgctcactttg

SEQ ID NO: 41684 - DNA, 15 bp, Homo sapiens
acttctgctcacttt

SEQ ID NO: 41685 - DNA, 15 bp, Homo sapiens
cacttctgctcactt

SEQ ID NO: 41686 - DNA, 15 bp, Homo sapiens
tcacttctgctcact

SEQ ID NO: 41687 - DNA, 15 bp, Homo sapiens
ctcacttctgctcac

SEQ ID NO: 41688 - DNA, 15 bp, Homo sapiens
cctcacttctgctca

SEQ ID NO: 41689 - DNA, 15 bp, Homo sapiens
gcctcacttctgctc

SEQ ID NO: 41690 - DNA, 15 bp, Homo sapiens
tgcctcacttctgct

SEQ ID NO: 41691 - DNA, 15 bp, Homo sapiens
gtgcctcacttctgc

SEQ ID NO: 41692 - DNA, 15 bp, Homo sapiens
ggtgcctcacttctg

SEQ ID NO: 41693 - DNA, 15 bp, Homo sapiens
aggtgcctcacttct

SEQ ID NO: 41694 - DNA, 15 bp, Homo sapiens
aaggtgcctcacttc

SEQ ID NO: 41695 - DNA, 15 bp, Homo sapiens
caaggtgcctcactt

SEQ ID NO: 41696 - DNA, 15 bp, Homo sapiens
gcaaggtgcctcact

SEQ ID NO: 41697 - DNA, 15 bp, Homo sapiens
ggcaaggtgcctcac

SEQ ID NO: 41698 - DNA, 15 bp, Homo sapiens
gggcaaggtgcctca

SEQ ID NO: 41699 - DNA, 15 bp, Homo sapiens
agggcaaggtgcctc

SEQ ID NO: 41700 - DNA, 15 bp, Homo sapiens
gagggcaaggtgcct

SEQ ID NO: 41701 - DNA, 15 bp, Homo sapiens
agagggcaaggtgcc

SEQ ID NO: 41702 - DNA, 15 bp, Homo sapiens
tagagggcaaggtgc

SEQ ID NO: 41703 - DNA, 15 bp, Homo sapiens
ttagagggcaaggtg

SEQ ID NO: 41704 - DNA, 15 bp, Homo sapiens
tttagagggcaaggt

SEQ ID NO: 41705 - DNA, 15 bp, Homo sapiens
ctttagagggcaagg

SEQ ID NO: 41706 - DNA, 15 bp, Homo sapiens
gctttagagggcaag

SEQ ID NO: 41707 - DNA, 15 bp, Homo sapiens
tgctttagagggcaa

SEQ ID NO: 41708 - DNA, 15 bp, Homo sapiens
ttgctttagagggca

SEQ ID NO: 41709 - DNA, 15 bp, Homo sapiens
attgctttagagggc

SEQ ID NO: 41710 - DNA, 15 bp, Homo sapiens
aattgctttagaggg

SEQ ID NO: 41711 - DNA, 15 bp, Homo sapiens
gaattgctttagagg

SEQ ID NO: 41712 - DNA, 15 bp, Homo sapiens
ggaattgctttagag

SEQ ID NO: 41713 - DNA, 15 bp, Homo sapiens
aggaattgctttaga

SEQ ID NO: 41714 - DNA, 15 bp, Homo sapiens
aaggaattgctttag

SEQ ID NO: 41715 - DNA, 15 bp, Homo sapiens
aaaggaattgcttta

SEQ ID NO: 41716 - DNA, 15 bp, Homo sapiens
gaaaggaattgcttt

SEQ ID NO: 41717 - DNA, 15 bp, Homo sapiens
agaaaggaattgctt

SEQ ID NO: 41718 - DNA, 15 bp, Homo sapiens
aagaaaggaattgct

SEQ ID NO: 41719 - DNA, 15 bp, Homo sapiens
aaagaaaggaattgc

SEQ ID NO: 41720 - DNA, 15 bp, Homo sapiens
aaaagaaaggaattg

SEQ ID NO: 41721 - DNA, 15 bp, Homo sapiens
aaaaaagaaaggaat

SEQ ID NO: 41722 - DNA, 15 bp, Homo sapiens
aaaaaaagaaaggaa

SEQ ID NO: 41723 - DNA, 15 bp, Homo sapiens
gaaaaaaagaaagga

SEQ ID NO: 41724 - DNA, 15 bp, Homo sapiens
agaaaaaaagaaagg

SEQ ID NO: 41725 - DNA, 15 bp, Homo sapiens
aagaaaaaaagaaag

SEQ ID NO: 41726 - DNA, 15 bp, Homo sapiens
gaaagaaaaaaagaa

SEQ ID NO: 41727 - DNA, 15 bp, Homo sapiens
agaaagaaaaaaaga

SEQ ID NO: 41728 - DNA, 15 bp, Homo sapiens
aagaaagaaaaaaag

SEQ ID NO: 41729 - DNA, 15 bp, Homo sapiens
aaagaaagaaaaaaa

SEQ ID NO: 41730 - DNA, 15 bp, Homo sapiens
aaaagaaagaaaaaa

SEQ ID NO: 41731 - DNA, 15 bp, Homo sapiens
aaaaagaaagaaaaa

SEQ ID NO: 41732 - DNA, 15 bp, Homo sapiens
gaaaaaaaaaaagaa

SEQ ID NO: 41733 - DNA, 15 bp, Homo sapiens
tgaaaaaaaaaaaga

SEQ ID NO: 41734 - DNA, 15 bp, Homo sapiens
atgaaaaaaaaaaag

SEQ ID NO: 41735 - DNA, 15 bp, Homo sapiens
aatgaaaaaaaaaaa

SEQ ID NO: 41736 - DNA, 15 bp, Homo sapiens
aaatgaaaaaaaaaa

SEQ ID NO: 41737 - DNA, 15 bp, Homo sapiens
caaatgaaaaaaaaa

SEQ ID NO: 41738 - DNA, 15 bp, Homo sapiens
tcaaatgaaaaaaaa

SEQ ID NO: 41739 - DNA, 15 bp, Homo sapiens
ttcaaatgaaaaaaa

SEQ ID NO: 41740 - DNA, 15 bp, Homo sapiens
cttcaaatgaaaaaa

SEQ ID NO: 41741 - DNA, 15 bp, Homo sapiens
ccttcaaatgaaaaa

SEQ ID NO: 41742 - DNA, 15 bp, Homo sapiens
tccttcaaatgaaaa

SEQ ID NO: 41743 - DNA, 15 bp, Homo sapiens
atccttcaaatgaaa

SEQ ID NO: 41744 - DNA, 15 bp, Homo sapiens
aatccttcaaatgaa

SEQ ID NO: 41745 - DNA, 15 bp, Homo sapiens
aaatccttcaaatga

SEQ ID NO: 41746 - DNA, 15 bp, Homo sapiens
gaaatccttcaaatg

SEQ ID NO: 41747 - DNA, 15 bp, Homo sapiens
agaaatccttcaaat

SEQ ID NO: 41748 - DNA, 15 bp, Homo sapiens
aagaaatccttcaaa

SEQ ID NO: 41749 - DNA, 15 bp, Homo sapiens
aaagaaatccttcaa

SEQ ID NO: 41750 - DNA, 15 bp, Homo sapiens
aaaagaaatccttca

SEQ ID NO: 41751 - DNA, 15 bp, Homo sapiens
aaaaagaaatccttc

SEQ ID NO: 41752 - DNA, 15 bp, Homo sapiens
aaaaaagaaatcctt

SEQ ID NO: 41753 - DNA, 15 bp, Homo sapiens
taaaaaagaaatcct

SEQ ID NO: 41754 - DNA, 15 bp, Homo sapiens
ttaaaaaagaaatcc

SEQ ID NO: 41755 - DNA, 15 bp, Homo sapiens
tttaaaaaagaaatc

SEQ ID NO: 41756 - DNA, 15 bp, Homo sapiens
gtttaaaaaagaaat

SEQ ID NO: 41757 - DNA, 15 bp, Homo sapiens
agtttaaaaaagaaa

SEQ ID NO: 41758 - DNA, 15 bp, Homo sapiens
aagtttaaaaaagaa

SEQ ID NO: 41759 - DNA, 15 bp, Homo sapiens
aaagtttaaaaaaga

SEQ ID NO: 41760 - DNA, 15 bp, Homo sapiens
aaaagtttaaaaaag

SEQ ID NO: 41761 - DNA, 15 bp, Homo sapiens
taaaagtttaaaaaa

SEQ ID NO: 41762 - DNA, 15 bp, Homo sapiens
ataaaagtttaaaaa

SEQ ID NO: 41763 - DNA, 15 bp, Homo sapiens
aataaaagtttaaaa

SEQ ID NO: 41764 - DNA, 15 bp, Homo sapiens
aaataaaagtttaaa

SEQ ID NO: 41765 - DNA, 15 bp, Homo sapiens
aaaataaaagtttaa

SEQ ID NO: 41766 - DNA, 15 bp, Homo sapiens
taaaataaaagttta

SEQ ID NO: 41767 - DNA, 15 bp, Homo sapiens
ttaaaataaaagttt

SEQ ID NO: 41768 - DNA, 15 bp, Homo sapiens
cttaaaataaaagtt

SEQ ID NO: 41769 - DNA, 15 bp, Homo sapiens
acttaaaataaaagt

SEQ ID NO: 41770 - DNA, 15 bp, Homo sapiens
aacttaaaataaaag

SEQ ID NO: 41771 - DNA, 15 bp, Homo sapiens
taacttaaaataaaa

SEQ ID NO: 41772 - DNA, 15 bp, Homo sapiens
ttaacttaaaataaa

SEQ ID NO: 41773 - DNA, 15 bp, Homo sapiens
cttaacttaaaataa

SEQ ID NO: 41774 - DNA, 15 bp, Homo sapiens
ccttaacttaaaata

SEQ ID NO: 41775 - DNA, 15 bp, Homo sapiens
cccttaacttaaaat

SEQ ID NO: 41776 - DNA, 15 bp, Homo sapiens
ccccttaacttaaaa

SEQ ID NO: 41777 - DNA, 15 bp, Homo sapiens
accccttaacttaaa

SEQ ID NO: 41778 - DNA, 15 bp, Homo sapiens
taccccttaacttaa

SEQ ID NO: 41779 - DNA, 15 bp, Homo sapiens
gtaccccttaactta

SEQ ID NO: 41780 - DNA, 15 bp, Homo sapiens
tgtaccccttaactt

SEQ ID NO: 41781 - DNA, 15 bp, Homo sapiens
atgtaccccttaact

SEQ ID NO: 41782 - DNA, 15 bp, Homo sapiens
catgtaccccttaac

SEQ ID NO: 41783 - DNA, 15 bp, Homo sapiens
acatgtaccccttaa

SEQ ID NO: 41784 - DNA, 15 bp, Homo sapiens
cacatgtacccctta

SEQ ID NO: 41785 - DNA, 15 bp, Homo sapiens
acacatgtacccctt

SEQ ID NO: 41786 - DNA, 15 bp, Homo sapiens
tacacatgtacccct

SEQ ID NO: 41787 - DNA, 15 bp, Homo sapiens
ctacacatgtacccc

SEQ ID NO: 41788 - DNA, 15 bp, Homo sapiens
cctacacatgtaccc

SEQ ID NO: 41789 - DNA, 15 bp, Homo sapiens
acctacacatgtacc

SEQ ID NO: 41790 - DNA, 15 bp, Homo sapiens
aacctacacatgtac

SEQ ID NO: 41791 - DNA, 15 bp, Homo sapiens
aaacctacacatgta

SEQ ID NO: 41792 - DNA, 15 bp, Homo sapiens
caaacctacacatgt

SEQ ID NO: 41793 - DNA, 15 bp, Homo sapiens
acaaacctacacatg

SEQ ID NO: 41794 - DNA, 15 bp, Homo sapiens
aacaaacctacacat

SEQ ID NO: 41795 - DNA, 15 bp, Homo sapiens
aaacaaacctacaca

SEQ ID NO: 41796 - DNA, 15 bp, Homo sapiens
gaaacaaacctacac

SEQ ID NO: 41797 - DNA, 15 bp, Homo sapiens
tgaaacaaacctaca

SEQ ID NO: 41798 - DNA, 15 bp, Homo sapiens
atgaaacaaacctac

SEQ ID NO: 41799 - DNA, 15 bp, Homo sapiens
catgaaacaaaccta

SEQ ID NO: 41800 - DNA, 15 bp, Homo sapiens
ccatgaaacaaacct

SEQ ID NO: 41801 - DNA, 15 bp, Homo sapiens
cccatgaaacaaacc

SEQ ID NO: 41802 - DNA, 15 bp, Homo sapiens
acccatgaaacaaac

SEQ ID NO: 41803 - DNA, 15 bp, Homo sapiens
tacccatgaaacaaa

SEQ ID NO: 41804 - DNA, 15 bp, Homo sapiens
ttacccatgaaacaa

SEQ ID NO: 41805 - DNA, 15 bp, Homo sapiens
tttacccatgaaaca

SEQ ID NO: 41806 - DNA, 15 bp, Homo sapiens
atttacccatgaaac

SEQ ID NO: 41807 - DNA, 15 bp, Homo sapiens
catttacccatgaaa

SEQ ID NO: 41808 - DNA, 15 bp, Homo sapiens
acatttacccatgaa

SEQ ID NO: 41809 - DNA, 15 bp, Homo sapiens
cacatttacccatga

SEQ ID NO: 41810 - DNA, 15 bp, Homo sapiens
acacatttacccatg

SEQ ID NO: 41811 - DNA, 15 bp, Homo sapiens
cacacatttacccat

SEQ ID NO: 41812 - DNA, 15 bp, Homo sapiens
acacacatttaccca

SEQ ID NO: 41813 - DNA, 15 bp, Homo sapiens
gacacacatttaccc

SEQ ID NO: 41814 - DNA, 15 bp, Homo sapiens
tgacacacatttacc

SEQ ID NO: 41815 - DNA, 15 bp, Homo sapiens
gtgacacacatttac

SEQ ID NO: 41816 - DNA, 15 bp, Homo sapiens
tgtgacacacattta

SEQ ID NO: 41817 - DNA, 15 bp, Homo sapiens
ctgtgacacacattt

SEQ ID NO: 41818 - DNA, 15 bp, Homo sapiens
cctgtgacacacatt

SEQ ID NO: 41819 - DNA, 15 bp, Homo sapiens
tcctgtgacacacat

SEQ ID NO: 41820 - DNA, 15 bp, Homo sapiens
atcctgtgacacaca

SEQ ID NO: 41821 - DNA, 15 bp, Homo sapiens
catcctgtgacacac

SEQ ID NO: 41822 - DNA, 15 bp, Homo sapiens
ccatcctgtgacaca

SEQ ID NO: 41823 - DNA, 15 bp, Homo sapiens
cccatcctgtgacac

SEQ ID NO: 41824 - DNA, 15 bp, Homo sapiens
ccccatcctgtgaca

SEQ ID NO: 41825 - DNA, 15 bp, Homo sapiens
cccccatcctgtgac

SEQ ID NO: 41826 - DNA, 15 bp, Homo sapiens
acccccatcctgtga

SEQ ID NO: 41827 - DNA, 15 bp, Homo sapiens
aacccccatcctgtg

SEQ ID NO: 41828 - DNA, 15 bp, Homo sapiens
aaacccccatcctgt

SEQ ID NO: 41829 - DNA, 15 bp, Homo sapiens
caaacccccatcctg

SEQ ID NO: 41830 - DNA, 15 bp, Homo sapiens
acaaacccccatcct

SEQ ID NO: 41831 - DNA, 15 bp, Homo sapiens
aacaaacccccatcc

SEQ ID NO: 41832 - DNA, 15 bp, Homo sapiens
aaacaaacccccatc

SEQ ID NO: 41833 - DNA, 15 bp, Homo sapiens
taaacaaacccccat

SEQ ID NO: 41834 - DNA, 15 bp, Homo sapiens
gtaaacaaaccccca

SEQ ID NO: 41835 - DNA, 15 bp, Homo sapiens
cgtaaacaaaccccc

SEQ ID NO: 41836 - DNA, 15 bp, Homo sapiens
ccgtaaacaaacccc

SEQ ID NO: 41837 - DNA, 15 bp, Homo sapiens
tccgtaaacaaaccc

SEQ ID NO: 41838 - DNA, 15 bp, Homo sapiens
atccgtaaacaaacc

SEQ ID NO: 41839 - DNA, 15 bp, Homo sapiens
aatccgtaaacaaac

SEQ ID NO: 41840 - DNA, 15 bp, Homo sapiens
taatccgtaaacaaa

SEQ ID NO: 41841 - DNA, 15 bp, Homo sapiens
ataatccgtaaacaa

SEQ ID NO: 41842 - DNA, 15 bp, Homo sapiens
aataatccgtaaaca

SEQ ID NO: 41843 - DNA, 15 bp, Homo sapiens
aaataatccgtaaac

SEQ ID NO: 41844 - DNA, 15 bp, Homo sapiens
gaaataatccgtaaa

SEQ ID NO: 41845 - DNA, 15 bp, Homo sapiens
tgaaataatccgtaa

SEQ ID NO: 41846 - DNA, 15 bp, Homo sapiens
atgaaataatccgta

SEQ ID NO: 41847 - DNA, 15 bp, Homo sapiens
gatgaaataatccgt

SEQ ID NO: 41848 - DNA, 15 bp, Homo sapiens
tgatgaaataatccg

SEQ ID NO: 41849 - DNA, 15 bp, Homo sapiens
atgatgaaataatcc

SEQ ID NO: 41850 - DNA, 15 bp, Homo sapiens
gatgatgaaataatc

SEQ ID NO: 41851 - DNA, 15 bp, Homo sapiens
ggatgatgaaataat

SEQ ID NO: 41852 - DNA, 15 bp, Homo sapiens
tggatgatgaaataa

SEQ ID NO: 41853 - DNA, 15 bp, Homo sapiens
ctggatgatgaaata

SEQ ID NO: 41854 - DNA, 15 bp, Homo sapiens
cctggatgatgaaat

SEQ ID NO: 41855 - DNA, 15 bp, Homo sapiens
acctggatgatgaaa

SEQ ID NO: 41856 - DNA, 15 bp, Homo sapiens
tacctggatgatgaa

SEQ ID NO: 41857 - DNA, 15 bp, Homo sapiens
atacctggatgatga

SEQ ID NO: 41858 - DNA, 15 bp, Homo sapiens
aatacctggatgatg

SEQ ID NO: 41859 - DNA, 15 bp, Homo sapiens
taatacctggatgat

SEQ ID NO: 41860 - DNA, 15 bp, Homo sapiens
ttaatacctggatga

SEQ ID NO: 41861 - DNA, 15 bp, Homo sapiens
cttaatacctggatg

SEQ ID NO: 41862 - DNA, 15 bp, Homo sapiens
gcttaatacctggat

SEQ ID NO: 41863 - DNA, 15 bp, Homo sapiens
ggcttaatacctgga

SEQ ID NO: 41864 - DNA, 15 bp, Homo sapiens
aggcttaatacctgg

SEQ ID NO: 41865 - DNA, 15 bp, Homo sapiens
taggcttaatacctg

SEQ ID NO: 41866 - DNA, 15 bp, Homo sapiens
ctaggcttaatacct

SEQ ID NO: 41867 - DNA, 15 bp, Homo sapiens
actaggcttaatacc

SEQ ID NO: 41868 - DNA, 15 bp, Homo sapiens
tactaggcttaatac

SEQ ID NO: 41869 - DNA, 15 bp, Homo sapiens
atactaggcttaata

SEQ ID NO: 41870 - DNA, 15 bp, Homo sapiens
gatactaggcttaat

SEQ ID NO: 41871 - DNA, 15 bp, Homo sapiens
ggatactaggcttaa

SEQ ID NO: 41872 - DNA, 15 bp, Homo sapiens
tggatactaggctta

SEQ ID NO: 41873 - DNA, 15 bp, Homo sapiens
atggatactaggctt

SEQ ID NO: 41874 - DNA, 15 bp, Homo sapiens
aatggatactaggct

SEQ ID NO: 41875 - DNA, 15 bp, Homo sapiens
taatggatactaggc

SEQ ID NO: 41876 - DNA, 15 bp, Homo sapiens
ctaatggatactagg

SEQ ID NO: 41877 - DNA, 15 bp, Homo sapiens
actaatggatactag

SEQ ID NO: 41878 - DNA, 15 bp, Homo sapiens
aactaatggatacta

SEQ ID NO: 41879 - DNA, 15 bp, Homo sapiens
taactaatggatact

SEQ ID NO: 41880 - DNA, 15 bp, Homo sapiens
ataactaatggatac

SEQ ID NO: 41881 - DNA, 15 bp, Homo sapiens
aataactaatggata

SEQ ID NO: 41882 - DNA, 15 bp, Homo sapiens
aaataactaatggat

SEQ ID NO: 41883 - DNA, 15 bp, Homo sapiens
aaaataactaatgga

SEQ ID NO: 41884 - DNA, 15 bp, Homo sapiens
aaaaataactaatgg

SEQ ID NO: 41885 - DNA, 15 bp, Homo sapiens
gaaaaataactaatg

SEQ ID NO: 41886 - DNA, 15 bp, Homo sapiens
cgaaaaataactaat

SEQ ID NO: 41887 - DNA, 15 bp, Homo sapiens
acgaaaaataactaa

SEQ ID NO: 41888 - DNA, 15 bp, Homo sapiens
cacgaaaaataacta

SEQ ID NO: 41889 - DNA, 15 bp, Homo sapiens
tcacgaaaaataact

SEQ ID NO: 41890 - DNA, 15 bp, Homo sapiens
atcacgaaaaataac

SEQ ID NO: 41891 - DNA, 15 bp, Homo sapiens
gatcacgaaaaataa

SEQ ID NO: 41892 - DNA, 15 bp, Homo sapiens
cgatcacgaaaaata

SEQ ID NO: 41893 - DNA, 15 bp, Homo sapiens
acgatcacgaaaaat

SEQ ID NO: 41894 - DNA, 15 bp, Homo sapiens
aacgatcacgaaaaa

SEQ ID NO: 41895 - DNA, 15 bp, Homo sapiens
aaacgatcacgaaaa

SEQ ID NO: 41896 - DNA, 15 bp, Homo sapiens
gaaacgatcacgaaa

SEQ ID NO: 41897 - DNA, 15 bp, Homo sapiens
ggaaacgatcacgaa

SEQ ID NO: 41898 - DNA, 15 bp, Homo sapiens
gggaaacgatcacga

SEQ ID NO: 41899 - DNA, 15 bp, Homo sapiens
agggaaacgatcacg

SEQ ID NO: 41900 - DNA, 15 bp, Homo sapiens
gagggaaacgatcac

SEQ ID NO: 41901 - DNA, 15 bp, Homo sapiens
ggagggaaacgatca

SEQ ID NO: 41902 - DNA, 15 bp, Homo sapiens
gggagggaaacgatc

SEQ ID NO: 41903 - DNA, 15 bp, Homo sapiens
ggggagggaaacgat

SEQ ID NO: 41904 - DNA, 15 bp, Homo sapiens
gggggagggaaacga

SEQ ID NO: 41905 - DNA, 15 bp, Homo sapiens
ggggggagggaaacg

SEQ ID NO: 41906 - DNA, 15 bp, Homo sapiens
tggggggagggaaac

SEQ ID NO: 41907 - DNA, 15 bp, Homo sapiens
ttggggggagggaaa

SEQ ID NO: 41908 - DNA, 15 bp, Homo sapiens
gttggggggagggaa

SEQ ID NO: 41909 - DNA, 15 bp, Homo sapiens
ggttggggggaggga

SEQ ID NO: 41910 - DNA, 15 bp, Homo sapiens
aggttggggggaggg

SEQ ID NO: 41911 - DNA, 15 bp, Homo sapiens
gaggttggggggagg

SEQ ID NO: 41912 - DNA, 15 bp, Homo sapiens
ggaggttggggggag

SEQ ID NO: 41913 - DNA, 15 bp, Homo sapiens
tggaggttgggggga

SEQ ID NO: 41914 - DNA, 15 bp, Homo sapiens
gtggaggttgggggg

SEQ ID NO: 41915 - DNA, 15 bp, Homo sapiens
ggtggaggttggggg

SEQ ID NO: 41916 - DNA, 15 bp, Homo sapiens
gggtggaggttgggg

SEQ ID NO: 41917 - DNA, 15 bp, Homo sapiens
agggtggaggttggg

SEQ ID NO: 41918 - DNA, 15 bp, Homo sapiens
gagggtggaggttgg

SEQ ID NO: 41919 - DNA, 15 bp, Homo sapiens
ggagggtggaggttg

SEQ ID NO: 41920 - DNA, 15 bp, Homo sapiens
tggagggtggaggtt

SEQ ID NO: 41921 - DNA, 15 bp, Homo sapiens
ttggagggtggaggt

SEQ ID NO: 41922 - DNA, 15 bp, Homo sapiens
attggagggtggagg

SEQ ID NO: 41923 - DNA, 15 bp, Homo sapiens
tattggagggtggag

SEQ ID NO: 41924 - DNA, 15 bp, Homo sapiens
ctattggagggtgga

SEQ ID NO: 41925 - DNA, 15 bp, Homo sapiens
tctattggagggtgg

SEQ ID NO: 41926 - DNA, 15 bp, Homo sapiens
gtctattggagggtg

SEQ ID NO: 41927 - DNA, 15 bp, Homo sapiens
ggtctattggagggt

SEQ ID NO: 41928 - DNA, 15 bp, Homo sapiens
gggtctattggaggg

SEQ ID NO: 41929 - DNA, 15 bp, Homo sapiens
ggggtctattggagg

SEQ ID NO: 41930 - DNA, 15 bp, Homo sapiens
tggggtctattggag

SEQ ID NO: 41931 - DNA, 15 bp, Homo sapiens
ctggggtctattgga

SEQ ID NO: 41932 - DNA, 15 bp, Homo sapiens
actggggtctattgg

SEQ ID NO: 41933 - DNA, 15 bp, Homo sapiens
cactggggtctattg

SEQ ID NO: 41934 - DNA, 15 bp, Homo sapiens
acactggggtctatt

SEQ ID NO: 41935 - DNA, 15 bp, Homo sapiens
tacactggggtctat

SEQ ID NO: 41936 - DNA, 15 bp, Homo sapiens
atacactggggtcta

SEQ ID NO: 41937 - DNA, 15 bp, Homo sapiens
tatacactggggtct

SEQ ID NO: 41938 - DNA, 15 bp, Homo sapiens
atatacactggggtc

SEQ ID NO: 41939 - DNA, 15 bp, Homo sapiens
aatatacactggggt

SEQ ID NO: 41940 - DNA, 15 bp, Homo sapiens
caatatacactgggg

SEQ ID NO: 41941 - DNA, 15 bp, Homo sapiens
acaatatacactggg

SEQ ID NO: 41942 - DNA, 15 bp, Homo sapiens
aacaatatacactgg

SEQ ID NO: 41943 - DNA, 15 bp, Homo sapiens
gaacaatatacactg

SEQ ID NO: 41944 - DNA, 15 bp, Homo sapiens
ggaacaatatacact

SEQ ID NO: 41945 - DNA, 15 bp, Homo sapiens
gggaacaatatacac

SEQ ID NO: 41946 - DNA, 15 bp, Homo sapiens
agggaacaatataca

SEQ ID NO: 41947 - DNA, 15 bp, Homo sapiens
cagggaacaatatac

SEQ ID NO: 41948 - DNA, 15 bp, Homo sapiens
gcagggaacaatata

SEQ ID NO: 41949 - DNA, 15 bp, Homo sapiens
agcagggaacaatat

SEQ ID NO: 41950 - DNA, 15 bp, Homo sapiens
tagcagggaacaata

SEQ ID NO: 41951 - DNA, 15 bp, Homo sapiens
atagcagggaacaat

SEQ ID NO: 41952 - DNA, 15 bp, Homo sapiens
tatagcagggaacaa

SEQ ID NO: 41953 - DNA, 15 bp, Homo sapiens
atatagcagggaaca

SEQ ID NO: 41954 - DNA, 15 bp, Homo sapiens
tatatagcagggaac

SEQ ID NO: 41955 - DNA, 15 bp, Homo sapiens
atatatagcagggaa

SEQ ID NO: 41956 - DNA, 15 bp, Homo sapiens
gatatatagcaggga

SEQ ID NO: 41957 - DNA, 15 bp, Homo sapiens
ggatatatagcaggg

SEQ ID NO: 41958 - DNA, 15 bp, Homo sapiens
tggatatatagcagg

SEQ ID NO: 41959 - DNA, 15 bp, Homo sapiens
atggatatatagcag

SEQ ID NO: 41960 - DNA, 15 bp, Homo sapiens
catggatatatagca

SEQ ID NO: 41961 - DNA, 15 bp, Homo sapiens
acatggatatatagc

SEQ ID NO: 41962 - DNA, 15 bp, Homo sapiens
cacatggatatatag

SEQ ID NO: 41963 - DNA, 15 bp, Homo sapiens
acacatggatatata

SEQ ID NO: 41964 - DNA, 15 bp, Homo sapiens
aacacatggatatat

SEQ ID NO: 41965 - DNA, 15 bp, Homo sapiens
caacacatggatata

SEQ ID NO: 41966 - DNA, 15 bp, Homo sapiens
acaacacatggatat

SEQ ID NO: 41967 - DNA, 15 bp, Homo sapiens
gacaacacatggata

SEQ ID NO: 41968 - DNA, 15 bp, Homo sapiens
tgacaacacatggat

SEQ ID NO: 41969 - DNA, 15 bp, Homo sapiens
atgacaacacatgga

SEQ ID NO: 41970 - DNA, 15 bp, Homo sapiens
gatgacaacacatgg

SEQ ID NO: 41971 - DNA, 15 bp, Homo sapiens
tgatgacaacacatg

SEQ ID NO: 41972 - DNA, 15 bp, Homo sapiens
atgatgacaacacat

SEQ ID NO: 41973 - DNA, 15 bp, Homo sapiens
aatgatgacaacaca

SEQ ID NO: 41974 - DNA, 15 bp, Homo sapiens
aaatgatgacaacac

SEQ ID NO: 41975 - DNA, 15 bp, Homo sapiens
taaatgatgacaaca

SEQ ID NO: 41976 - DNA, 15 bp, Homo sapiens
ctaaatgatgacaac

SEQ ID NO: 41977 - DNA, 15 bp, Homo sapiens
gctaaatgatgacaa

SEQ ID NO: 41978 - DNA, 15 bp, Homo sapiens
agctaaatgatgaca

SEQ ID NO: 41979 - DNA, 15 bp, Homo sapiens
gagctaaatgatgac

SEQ ID NO: 41980 - DNA, 15 bp, Homo sapiens
ggagctaaatgatga

SEQ ID NO: 41981 - DNA, 15 bp, Homo sapiens
gggagctaaatgatg

SEQ ID NO: 41982 - DNA, 15 bp, Homo sapiens
tgggagctaaatgat

SEQ ID NO: 41983 - DNA, 15 bp, Homo sapiens
gtgggagctaaatga

SEQ ID NO: 41984 - DNA, 15 bp, Homo sapiens
agtgggagctaaatg

SEQ ID NO: 41985 - DNA, 15 bp, Homo sapiens
aagtgggagctaaat

SEQ ID NO: 41986 - DNA, 15 bp, Homo sapiens
taagtgggagctaaa

SEQ ID NO: 41987 - DNA, 15 bp, Homo sapiens
ttaagtgggagctaa

SEQ ID NO: 41988 - DNA, 15 bp, Homo sapiens
tttaagtgggagcta

SEQ ID NO: 41989 - DNA, 15 bp, Homo sapiens
ttttaagtgggagct

SEQ ID NO: 41990 - DNA, 15 bp, Homo sapiens
cttttaagtgggagc

SEQ ID NO: 41991 - DNA, 15 bp, Homo sapiens
acttttaagtgggag

SEQ ID NO: 41992 - DNA, 15 bp, Homo sapiens
cacttttaagtggga

SEQ ID NO: 41993 - DNA, 15 bp, Homo sapiens
tcacttttaagtggg

SEQ ID NO: 41994 - DNA, 15 bp, Homo sapiens
ctcacttttaagtgg

SEQ ID NO: 41995 - DNA, 15 bp, Homo sapiens
tctcacttttaagtg

SEQ ID NO: 41996 - DNA, 15 bp, Homo sapiens
ttctcacttttaagt

SEQ ID NO: 41997 - DNA, 15 bp, Homo sapiens
tttctcacttttaag

SEQ ID NO: 41998 - DNA, 15 bp, Homo sapiens
atttctcacttttaa

SEQ ID NO: 41999 - DNA, 15 bp, Homo sapiens
catttctcactttta

SEQ ID NO: 42000 - DNA, 15 bp, Homo sapiens
acatttctcactttt

SEQ ID NO: 42001 - DNA, 15 bp, Homo sapiens
cacatttctcacttt

SEQ ID NO: 42002 - DNA, 15 bp, Homo sapiens
ccacatttctcactt

SEQ ID NO: 42003 - DNA, 15 bp, Homo sapiens
accacatttctcact

SEQ ID NO: 42004 - DNA, 15 bp, Homo sapiens
taccacatttctcac

SEQ ID NO: 42005 - DNA, 15 bp, Homo sapiens
ataccacatttctca

SEQ ID NO: 42006 - DNA, 15 bp, Homo sapiens
aataccacatttctc

SEQ ID NO: 42007 - DNA, 15 bp, Homo sapiens
aaataccacatttct

SEQ ID NO: 42008 - DNA, 15 bp, Homo sapiens
caaataccacatttc

SEQ ID NO: 42009 - DNA, 15 bp, Homo sapiens
ccaaataccacattt

SEQ ID NO: 42010 - DNA, 15 bp, Homo sapiens
gccaaataccacatt

SEQ ID NO: 42011 - DNA, 15 bp, Homo sapiens
agccaaataccacat

SEQ ID NO: 42012 - DNA, 15 bp, Homo sapiens
aagccaaataccaca

SEQ ID NO: 42013 - DNA, 15 bp, Homo sapiens
aaagccaaataccac

SEQ ID NO: 42014 - DNA, 15 bp, Homo sapiens
gaaagccaaatacca

SEQ ID NO: 42015 - DNA, 15 bp, Homo sapiens
agaaagccaaatacc

SEQ ID NO: 42016 - DNA, 15 bp, Homo sapiens
cagaaagccaaatac

SEQ ID NO: 42017 - DNA, 15 bp, Homo sapiens
acagaaagccaaata

SEQ ID NO: 42018 - DNA, 15 bp, Homo sapiens
aacagaaagccaaat

SEQ ID NO: 42019 - DNA, 15 bp, Homo sapiens
gaacagaaagccaaa

SEQ ID NO: 42020 - DNA, 15 bp, Homo sapiens
tgaacagaaagccaa

SEQ ID NO: 42021 - DNA, 15 bp, Homo sapiens
atgaacagaaagcca

SEQ ID NO: 42022 - DNA, 15 bp, Homo sapiens
tatgaacagaaagcc

SEQ ID NO: 42023 - DNA, 15 bp, Homo sapiens
atatgaacagaaagc

SEQ ID NO: 42024 - DNA, 15 bp, Homo sapiens
catatgaacagaaag

SEQ ID NO: 42025 - DNA, 15 bp, Homo sapiens
acatatgaacagaaa

SEQ ID NO: 42026 - DNA, 15 bp, Homo sapiens
aacatatgaacagaa

SEQ ID NO: 42027 - DNA, 15 bp, Homo sapiens
taacatatgaacaga

SEQ ID NO: 42028 - DNA, 15 bp, Homo sapiens
ttaacatatgaacag

SEQ ID NO: 42029 - DNA, 15 bp, Homo sapiens
attaacatatgaaca

SEQ ID NO: 42030 - DNA, 15 bp, Homo sapiens
aattaacatatgaac

SEQ ID NO: 42031 - DNA, 15 bp, Homo sapiens
aaattaacatatgaa

SEQ ID NO: 42032 - DNA, 15 bp, Homo sapiens
caaattaacatatga

SEQ ID NO: 42033 - DNA, 15 bp, Homo sapiens
gcaaattaacatatg

SEQ ID NO: 42034 - DNA, 15 bp, Homo sapiens
agcaaattaacatat

SEQ ID NO: 42035 - DNA, 15 bp, Homo sapiens
tagcaaattaacata

SEQ ID NO: 42036 - DNA, 15 bp, Homo sapiens
ttagcaaattaacat

SEQ ID NO: 42037 - DNA, 15 bp, Homo sapiens
cttagcaaattaaca

SEQ ID NO: 42038 - DNA, 15 bp, Homo sapiens
ccttagcaaattaac

SEQ ID NO: 42039 - DNA, 15 bp, Homo sapiens
tccttagcaaattaa

SEQ ID NO: 42040 - DNA, 15 bp, Homo sapiens
atccttagcaaatta

SEQ ID NO: 42041 - DNA, 15 bp, Homo sapiens
tatccttagcaaatt

SEQ ID NO: 42042 - DNA, 15 bp, Homo sapiens
ttatccttagcaaat

SEQ ID NO: 42043 - DNA, 15 bp, Homo sapiens
attatccttagcaaa

SEQ ID NO: 42044 - DNA, 15 bp, Homo sapiens
cattatccttagcaa

SEQ ID NO: 42045 - DNA, 15 bp, Homo sapiens
ccattatccttagca

SEQ ID NO: 42046 - DNA, 15 bp, Homo sapiens
gccattatccttagc

SEQ ID NO: 42047 - DNA, 15 bp, Homo sapiens
ggccattatccttag

SEQ ID NO: 42048 - DNA, 15 bp, Homo sapiens
aggccattatcctta

SEQ ID NO: 42049 - DNA, 15 bp, Homo sapiens
gaggccattatcctt

SEQ ID NO: 42050 - DNA, 15 bp, Homo sapiens
ggaggccattatcct

SEQ ID NO: 42051 - DNA, 15 bp, Homo sapiens
tggaggccattatcc

SEQ ID NO: 42052 - DNA, 15 bp, Homo sapiens
ctggaggccattatc

SEQ ID NO: 42053 - DNA, 15 bp, Homo sapiens
gctggaggccattat

SEQ ID NO: 42054 - DNA, 15 bp, Homo sapiens
agctggaggccatta

SEQ ID NO: 42055 - DNA, 15 bp, Homo sapiens
gagctggaggccatt

SEQ ID NO: 42056 - DNA, 15 bp, Homo sapiens
ggagctggaggccat

SEQ ID NO: 42057 - DNA, 15 bp, Homo sapiens
tggagctggaggcca

SEQ ID NO: 42058 - DNA, 15 bp, Homo sapiens
atggagctggaggcc

SEQ ID NO: 42059 - DNA, 15 bp, Homo sapiens
gatggagctggaggc

SEQ ID NO: 42060 - DNA, 15 bp, Homo sapiens
ggatggagctggagg

SEQ ID NO: 42061 - DNA, 15 bp, Homo sapiens
tggatggagctggag

SEQ ID NO: 42062 - DNA, 15 bp, Homo sapiens
atggatggagctgga

SEQ ID NO: 42063 - DNA, 15 bp, Homo sapiens
catggatggagctgg

SEQ ID NO: 42064 - DNA, 15 bp, Homo sapiens
acatggatggagctg

SEQ ID NO: 42065 - DNA, 15 bp, Homo sapiens
gacatggatggagct

SEQ ID NO: 42066 - DNA, 15 bp, Homo sapiens
ggacatggatggagc

SEQ ID NO: 42067 - DNA, 15 bp, Homo sapiens
gggacatggatggag

SEQ ID NO: 42068 - DNA, 15 bp, Homo sapiens
agggacatggatgga

SEQ ID NO: 42069 - DNA, 15 bp, Homo sapiens
cagggacatggatgg

SEQ ID NO: 42070 - DNA, 15 bp, Homo sapiens
gcagggacatggatg

SEQ ID NO: 42071 - DNA, 15 bp, Homo sapiens
tgcagggacatggat

SEQ ID NO: 42072 - DNA, 15 bp, Homo sapiens
ttgcagggacatgga

SEQ ID NO: 42073 - DNA, 15 bp, Homo sapiens
tttgcagggacatgg

SEQ ID NO: 42074 - DNA, 15 bp, Homo sapiens
gtttgcagggacatg

SEQ ID NO: 42075 - DNA, 15 bp, Homo sapiens
tgtttgcagggacat

SEQ ID NO: 42076 - DNA, 15 bp, Homo sapiens
ttgtttgcagggaca

SEQ ID NO: 42077 - DNA, 15 bp, Homo sapiens
gttgtttgcagggac

SEQ ID NO: 42078 - DNA, 15 bp, Homo sapiens
tgttgtttgcaggga

SEQ ID NO: 42079 - DNA, 15 bp, Homo sapiens
atgttgtttgcaggg

SEQ ID NO: 42080 - DNA, 15 bp, Homo sapiens
catgttgtttgcagg

SEQ ID NO: 42081 - DNA, 15 bp, Homo sapiens
tcatgttgtttgcag

SEQ ID NO: 42082 - DNA, 15 bp, Homo sapiens
atcatgttgtttgca

SEQ ID NO: 42083 - DNA, 15 bp, Homo sapiens
gatcatgttgtttgc

SEQ ID NO: 42084 - DNA, 15 bp, Homo sapiens
agatcatgttgtttg

SEQ ID NO: 42085 - DNA, 15 bp, Homo sapiens
gagatcatgttgttt

SEQ ID NO: 42086 - DNA, 15 bp, Homo sapiens
tgagatcatgttgtt

SEQ ID NO: 42087 - DNA, 15 bp, Homo sapiens
atgagatcatgttgt

SEQ ID NO: 42088 - DNA, 15 bp, Homo sapiens
aatgagatcatgttg

SEQ ID NO: 42089 - DNA, 15 bp, Homo sapiens
ggaatgagatcatgt

SEQ ID NO: 42090 - DNA, 15 bp, Homo sapiens
tggaatgagatcatg

SEQ ID NO: 42091 - DNA, 15 bp, Homo sapiens
atggaatgagatcat

SEQ ID NO: 42092 - DNA, 15 bp, Homo sapiens
aatggaatgagatca

SEQ ID NO: 42093 - DNA, 15 bp, Homo sapiens
aaatggaatgagatc

SEQ ID NO: 42094 - DNA, 15 bp, Homo sapiens
aaaatggaatgagat

SEQ ID NO: 42095 - DNA, 15 bp, Homo sapiens
taaaatggaatgaga

SEQ ID NO: 42096 - DNA, 15 bp, Homo sapiens
ataaaatggaatgag

SEQ ID NO: 42097 - DNA, 15 bp, Homo sapiens
cataaaatggaatga

SEQ ID NO: 42098 - DNA, 15 bp, Homo sapiens
ccataaaatggaatg

SEQ ID NO: 42099 - DNA, 15 bp, Homo sapiens
gccataaaatggaat

SEQ ID NO: 42100 - DNA, 15 bp, Homo sapiens
agccataaaatggaa

SEQ ID NO: 42101 - DNA, 15 bp, Homo sapiens
cagccataaaatgga

SEQ ID NO: 42102 - DNA, 15 bp, Homo sapiens
gcagccataaaatgg

SEQ ID NO: 42103 - DNA, 15 bp, Homo sapiens
tgcagccataaaatg

SEQ ID NO: 42104 - DNA, 15 bp, Homo sapiens
atgcagccataaaat

SEQ ID NO: 42105 - DNA, 15 bp, Homo sapiens
atactatgcagccat

SEQ ID NO: 42106 - DNA, 15 bp, Homo sapiens
aatactatgcagcca

SEQ ID NO: 42107 - DNA, 15 bp, Homo sapiens
gaatactatgcagcc

SEQ ID NO: 42108 - DNA, 15 bp, Homo sapiens
ggaatactatgcagc

SEQ ID NO: 42109 - DNA, 15 bp, Homo sapiens
tggaatactatgcag

SEQ ID NO: 42110 - DNA, 15 bp, Homo sapiens
atggaatactatgca

SEQ ID NO: 42111 - DNA, 15 bp, Homo sapiens
tatggaatactatgc

SEQ ID NO: 42112 - DNA, 15 bp, Homo sapiens
ctatggaatactatg

SEQ ID NO: 42113 - DNA, 15 bp, Homo sapiens
actatggaatactat

SEQ ID NO: 42114 - DNA, 15 bp, Homo sapiens
cactatggaatacta

SEQ ID NO: 42115 - DNA, 15 bp, Homo sapiens
acactatggaatact

SEQ ID NO: 42116 - DNA, 15 bp, Homo sapiens
cacactatggaatac

SEQ ID NO: 42117 - DNA, 15 bp, Homo sapiens
acacactatggaata

SEQ ID NO: 42118 - DNA, 15 bp, Homo sapiens
tacacactatggaat

SEQ ID NO: 42119 - DNA, 15 bp, Homo sapiens
atacacactatggaa

SEQ ID NO: 42120 - DNA, 15 bp, Homo sapiens
tatacacactatgga

SEQ ID NO: 42121 - DNA, 15 bp, Homo sapiens
atatacacactatgg

SEQ ID NO: 42122 - DNA, 15 bp, Homo sapiens
catatacacactatg

SEQ ID NO: 42123 - DNA, 15 bp, Homo sapiens
gcatatacacactat

SEQ ID NO: 42124 - DNA, 15 bp, Homo sapiens
ggcatatacacacta

SEQ ID NO: 42125 - DNA, 15 bp, Homo sapiens
tggcatatacacact

SEQ ID NO: 42126 - DNA, 15 bp, Homo sapiens
gtggcatatacacac

SEQ ID NO: 42127 - DNA, 15 bp, Homo sapiens
tgtggcatatacaca

SEQ ID NO: 42128 - DNA, 15 bp, Homo sapiens
atgtggcatatacac

SEQ ID NO: 42129 - DNA, 15 bp, Homo sapiens
aatgtggcatataca

SEQ ID NO: 42130 - DNA, 15 bp, Homo sapiens
aaatgtggcatatac

SEQ ID NO: 42131 - DNA, 15 bp, Homo sapiens
aaaatgtggcatata

SEQ ID NO: 42132 - DNA, 15 bp, Homo sapiens
gaaaatgtggcatat

SEQ ID NO: 42133 - DNA, 15 bp, Homo sapiens
agaaaatgtggcata

SEQ ID NO: 42134 - DNA, 15 bp, Homo sapiens
aagaaaatgtggcat

SEQ ID NO: 42135 - DNA, 15 bp, Homo sapiens
aaagaaaatgtggca

SEQ ID NO: 42136 - DNA, 15 bp, Homo sapiens
taaagaaaatgtggc

SEQ ID NO: 42137 - DNA, 15 bp, Homo sapiens
ataaagaaaatgtgg

SEQ ID NO: 42138 - DNA, 15 bp, Homo sapiens
ttggataaagaaaat

SEQ ID NO: 42139 - DNA, 15 bp, Homo sapiens
attggataaagaaaa

SEQ ID NO: 42140 - DNA, 15 bp, Homo sapiens
gattggataaagaaa

SEQ ID NO: 42141 - DNA, 15 bp, Homo sapiens
ggattggataaagaa

SEQ ID NO: 42142 - DNA, 15 bp, Homo sapiens
tggattggataaaga

SEQ ID NO: 42143 - DNA, 15 bp, Homo sapiens
gtggattggataaag

SEQ ID NO: 42144 - DNA, 15 bp, Homo sapiens
ggtggattggataaa

SEQ ID NO: 42145 - DNA, 15 bp, Homo sapiens
tggtggattggataa

SEQ ID NO: 42146 - DNA, 15 bp, Homo sapiens
gtggtggattggata

SEQ ID NO: 42147 - DNA, 15 bp, Homo sapiens
agtggtggattggat

SEQ ID NO: 42148 - DNA, 15 bp, Homo sapiens
tagtggtggattgga

SEQ ID NO: 42149 - DNA, 15 bp, Homo sapiens
ttagtggtggattgg

SEQ ID NO: 42150 - DNA, 15 bp, Homo sapiens
attagtggtggattg

SEQ ID NO: 42151 - DNA, 15 bp, Homo sapiens
cattagtggtggatt

SEQ ID NO: 42152 - DNA, 15 bp, Homo sapiens
ccattagtggtggat

SEQ ID NO: 42153 - DNA, 15 bp, Homo sapiens
cccattagtggtgga

SEQ ID NO: 42154 - DNA, 15 bp, Homo sapiens
gcccattagtggtgg

SEQ ID NO: 42155 - DNA, 15 bp, Homo sapiens
tgcccattagtggtg

SEQ ID NO: 42156 - DNA, 15 bp, Homo sapiens
atgcccattagtggt

SEQ ID NO: 42157 - DNA, 15 bp, Homo sapiens
aatgcccattagtgg

SEQ ID NO: 42158 - DNA, 15 bp, Homo sapiens
aaatgcccattagtg

SEQ ID NO: 42159 - DNA, 15 bp, Homo sapiens
taaatgcccattagt

SEQ ID NO: 42160 - DNA, 15 bp, Homo sapiens
ctaaatgcccattag

SEQ ID NO: 42161 - DNA, 15 bp, Homo sapiens
cctaaatgcccatta

SEQ ID NO: 42162 - DNA, 15 bp, Homo sapiens
acctaaatgcccatt

SEQ ID NO: 42163 - DNA, 15 bp, Homo sapiens
atcaacctaaatgcc

SEQ ID NO: 42164 - DNA, 15 bp, Homo sapiens
aatcaacctaaatgc

SEQ ID NO: 42165 - DNA, 15 bp, Homo sapiens
gaatcaacctaaatg

SEQ ID NO: 42166 - DNA, 15 bp, Homo sapiens
tgaatcaacctaaat

SEQ ID NO: 42167 - DNA, 15 bp, Homo sapiens
ttgaatcaacctaaa

SEQ ID NO: 42168 - DNA, 15 bp, Homo sapiens
tttgaatcaacctaa

SEQ ID NO: 42169 - DNA, 15 bp, Homo sapiens
ctttgaatcaaccta

SEQ ID NO: 42170 - DNA, 15 bp, Homo sapiens
actttgaatcaacct

SEQ ID NO: 42171 - DNA, 15 bp, Homo sapiens
gactttgaatcaacc

SEQ ID NO: 42172 - DNA, 15 bp, Homo sapiens
agactttgaatcaac

SEQ ID NO: 42173 - DNA, 15 bp, Homo sapiens
aagactttgaatcaa

SEQ ID NO: 42174 - DNA, 15 bp, Homo sapiens
aaagactttgaatca

SEQ ID NO: 42175 - DNA, 15 bp, Homo sapiens
caaagactttgaatc

SEQ ID NO: 42176 - DNA, 15 bp, Homo sapiens
acaaagactttgaat

SEQ ID NO: 42177 - DNA, 15 bp, Homo sapiens
aacaaagactttgaa

SEQ ID NO: 42178 - DNA, 15 bp, Homo sapiens
taacaaagactttga

SEQ ID NO: 42179 - DNA, 15 bp, Homo sapiens
gtaacaaagactttg

SEQ ID NO: 42180 - DNA, 15 bp, Homo sapiens
agtaacaaagacttt

SEQ ID NO: 42181 - DNA, 15 bp, Homo sapiens
cagtaacaaagactt

SEQ ID NO: 42182 - DNA, 15 bp, Homo sapiens
acagtaacaaagact

SEQ ID NO: 42183 - DNA, 15 bp, Homo sapiens
cacagtaacaaagac

SEQ ID NO: 42184 - DNA, 15 bp, Homo sapiens
gcacagtaacaaaga

SEQ ID NO: 42185 - DNA, 15 bp, Homo sapiens
agcacagtaacaaag

SEQ ID NO: 42186 - DNA, 15 bp, Homo sapiens
cagcacagtaacaaa

SEQ ID NO: 42187 - DNA, 15 bp, Homo sapiens
gcagcacagtaacaa

SEQ ID NO: 42188 - DNA, 15 bp, Homo sapiens
tgcagcacagtaaca

SEQ ID NO: 42189 - DNA, 15 bp, Homo sapiens
ttgcagcacagtaac

SEQ ID NO: 42190 - DNA, 15 bp, Homo sapiens
attgcagcacagtaa

SEQ ID NO: 42191 - DNA, 15 bp, Homo sapiens
cattgcagcacagta

SEQ ID NO: 42192 - DNA, 15 bp, Homo sapiens
acattgcagcacagt

SEQ ID NO: 42193 - DNA, 15 bp, Homo sapiens
gacattgcagcacag

SEQ ID NO: 42194 - DNA, 15 bp, Homo sapiens
agacattgcagcaca

SEQ ID NO: 42195 - DNA, 15 bp, Homo sapiens
aagacattgcagcac

SEQ ID NO: 42196 - DNA, 15 bp, Homo sapiens
aaagacattgcagca

SEQ ID NO: 42197 - DNA, 15 bp, Homo sapiens
caaagacattgcagc

SEQ ID NO: 42198 - DNA, 15 bp, Homo sapiens
acaaagacattgcag

SEQ ID NO: 42199 - DNA, 15 bp, Homo sapiens
tacaaagacattgca

SEQ ID NO: 42200 - DNA, 15 bp, Homo sapiens
ttacaaagacattgc

SEQ ID NO: 42201 - DNA, 15 bp, Homo sapiens
gttacaaagacattg

SEQ ID NO: 42202 - DNA, 15 bp, Homo sapiens
tgttacaaagacatt

SEQ ID NO: 42203 - DNA, 15 bp, Homo sapiens
ctgttacaaagacat

SEQ ID NO: 42204 - DNA, 15 bp, Homo sapiens
tctgttacaaagaca

SEQ ID NO: 42205 - DNA, 15 bp, Homo sapiens
ctctgttacaaagac

SEQ ID NO: 42206 - DNA, 15 bp, Homo sapiens
gctctgttacaaaga

SEQ ID NO: 42207 - DNA, 15 bp, Homo sapiens
tgctctgttacaaag

SEQ ID NO: 42208 - DNA, 15 bp, Homo sapiens
ttgctctgttacaaa

SEQ ID NO: 42209 - DNA, 15 bp, Homo sapiens
attgctctgttacaa

SEQ ID NO: 42210 - DNA, 15 bp, Homo sapiens
aattgctctgttaca

SEQ ID NO: 42211 - DNA, 15 bp, Homo sapiens
aaattgctctgttac

SEQ ID NO: 42212 - DNA, 15 bp, Homo sapiens
taaattgctctgtta

SEQ ID NO: 42213 - DNA, 15 bp, Homo sapiens
ataaattgctctgtt

SEQ ID NO: 42214 - DNA, 15 bp, Homo sapiens
tataaattgctctgt

SEQ ID NO: 42215 - DNA, 15 bp, Homo sapiens
atataaattgctctg

SEQ ID NO: 42216 - DNA, 15 bp, Homo sapiens
aatataaattgctct

SEQ ID NO: 42217 - DNA, 15 bp, Homo sapiens
gaatataaattgctc

SEQ ID NO: 42218 - DNA, 15 bp, Homo sapiens
ggaatataaattgct

SEQ ID NO: 42219 - DNA, 15 bp, Homo sapiens
aggaatataaattgc

SEQ ID NO: 42220 - DNA, 15 bp, Homo sapiens
aaggaatataaattg

SEQ ID NO: 42221 - DNA, 15 bp, Homo sapiens
aaaggaatataaatt

SEQ ID NO: 42222 - DNA, 15 bp, Homo sapiens
cacccaaaggaatat

SEQ ID NO: 42223 - DNA, 15 bp, Homo sapiens
acacccaaaggaata

SEQ ID NO: 42224 - DNA, 15 bp, Homo sapiens
tacacccaaaggaat

SEQ ID NO: 42225 - DNA, 15 bp, Homo sapiens
atacacccaaaggaa

SEQ ID NO: 42226 - DNA, 15 bp, Homo sapiens
tatacacccaaagga

SEQ ID NO: 42227 - DNA, 15 bp, Homo sapiens
gtatacacccaaagg

SEQ ID NO: 42228 - DNA, 15 bp, Homo sapiens
ggtatacacccaaag

SEQ ID NO: 42229 - DNA, 15 bp, Homo sapiens
gggtatacacccaaa

SEQ ID NO: 42230 - DNA, 15 bp, Homo sapiens
agggtatacacccaa

SEQ ID NO: 42231 - DNA, 15 bp, Homo sapiens
cagggtatacaccca

SEQ ID NO: 42232 - DNA, 15 bp, Homo sapiens
tcagggtatacaccc

SEQ ID NO: 42233 - DNA, 15 bp, Homo sapiens
atcagggtatacacc

SEQ ID NO: 42234 - DNA, 15 bp, Homo sapiens
tatcagggtatacac

SEQ ID NO: 42235 - DNA, 15 bp, Homo sapiens
atatcagggtataca

SEQ ID NO: 42236 - DNA, 15 bp, Homo sapiens
catatcagggtatac

SEQ ID NO: 42237 - DNA, 15 bp, Homo sapiens
ccatatcagggtata

SEQ ID NO: 42238 - DNA, 15 bp, Homo sapiens
gccatatcagggtat

SEQ ID NO: 42239 - DNA, 15 bp, Homo sapiens
agccatatcagggta

SEQ ID NO: 42240 - DNA, 15 bp, Homo sapiens
aagccatatcagggt

SEQ ID NO: 42241 - DNA, 15 bp, Homo sapiens
caagccatatcaggg

SEQ ID NO: 42242 - DNA, 15 bp, Homo sapiens
acaagccatatcagg

SEQ ID NO: 42243 - DNA, 15 bp, Homo sapiens
gacaagccatatcag

SEQ ID NO: 42244 - DNA, 15 bp, Homo sapiens
agacaagccatatca

SEQ ID NO: 42245 - DNA, 15 bp, Homo sapiens
cagacaagccatatc

SEQ ID NO: 42246 - DNA, 15 bp, Homo sapiens
acagacaagccatat

SEQ ID NO: 42247 - DNA, 15 bp, Homo sapiens
cacagacaagccata

SEQ ID NO: 42248 - DNA, 15 bp, Homo sapiens
acacagacaagccat

SEQ ID NO: 42249 - DNA, 15 bp, Homo sapiens
gacacagacaagcca

SEQ ID NO: 42250 - DNA, 15 bp, Homo sapiens
agacacagacaagcc

SEQ ID NO: 42251 - DNA, 15 bp, Homo sapiens
gagacacagacaagc

SEQ ID NO: 42252 - DNA, 15 bp, Homo sapiens
ggagacacagacaag

SEQ ID NO: 42253 - DNA, 15 bp, Homo sapiens
tggagacacagacaa

SEQ ID NO: 42254 - DNA, 15 bp, Homo sapiens
gtggagacacagaca

SEQ ID NO: 42255 - DNA, 15 bp, Homo sapiens
ggtggagacacagac

SEQ ID NO: 42256 - DNA, 15 bp, Homo sapiens
gggtggagacacaga

SEQ ID NO: 42257 - DNA, 15 bp, Homo sapiens
tgggtggagacacag

SEQ ID NO: 42258 - DNA, 15 bp, Homo sapiens
ttgggtggagacaca

SEQ ID NO: 42259 - DNA, 15 bp, Homo sapiens
tttgggtggagacac

SEQ ID NO: 42260 - DNA, 15 bp, Homo sapiens
atttgggtggagaca

SEQ ID NO: 42261 - DNA, 15 bp, Homo sapiens
gatttgggtggagac

SEQ ID NO: 42262 - DNA, 15 bp, Homo sapiens
agatttgggtggaga

SEQ ID NO: 42263 - DNA, 15 bp, Homo sapiens
gagatttgggtggag

SEQ ID NO: 42264 - DNA, 15 bp, Homo sapiens
tgagatttgggtgga

SEQ ID NO: 42265 - DNA, 15 bp, Homo sapiens
caagatgagatttgg

SEQ ID NO: 42266 - DNA, 15 bp, Homo sapiens
gaattcaagatgaga

SEQ ID NO: 42267 - DNA, 15 bp, Homo sapiens
ggaattcaagatgag

SEQ ID NO: 42268 - DNA, 15 bp, Homo sapiens
gggaattcaagatga

SEQ ID NO: 42269 - DNA, 15 bp, Homo sapiens
tgggaattcaagatg

SEQ ID NO: 42270 - DNA, 15 bp, Homo sapiens
ctgggaattcaagat

SEQ ID NO: 42271 - DNA, 15 bp, Homo sapiens
cctgggaattcaaga

SEQ ID NO: 42272 - DNA, 15 bp, Homo sapiens
acctgggaattcaag

SEQ ID NO: 42273 - DNA, 15 bp, Homo sapiens
tacctgggaattcaa

SEQ ID NO: 42274 - DNA, 15 bp, Homo sapiens
atacctgggaattca

SEQ ID NO: 42275 - DNA, 15 bp, Homo sapiens
aatacctgggaattc

SEQ ID NO: 42276 - DNA, 15 bp, Homo sapiens
taatacctgggaatt

SEQ ID NO: 42277 - DNA, 15 bp, Homo sapiens
ataatacctgggaat

SEQ ID NO: 42278 - DNA, 15 bp, Homo sapiens
cataatacctgggaa

SEQ ID NO: 42279 - DNA, 15 bp, Homo sapiens
ccataatacctggga

SEQ ID NO: 42280 - DNA, 15 bp, Homo sapiens
cccataatacctggg

SEQ ID NO: 42281 - DNA, 15 bp, Homo sapiens
tcccataatacctgg

SEQ ID NO: 42282 - DNA, 15 bp, Homo sapiens
ctcccataatacctg

SEQ ID NO: 42283 - DNA, 15 bp, Homo sapiens
cctcccataatacct

SEQ ID NO: 42284 - DNA, 15 bp, Homo sapiens
ccctcccataatacc

SEQ ID NO: 42285 - DNA, 15 bp, Homo sapiens
tccctcccataatac

SEQ ID NO: 42286 - DNA, 15 bp, Homo sapiens
gtccctcccataata

SEQ ID NO: 42287 - DNA, 15 bp, Homo sapiens
ggtccctcccataat

SEQ ID NO: 42288 - DNA, 15 bp, Homo sapiens
gggtccctcccataa

SEQ ID NO: 42289 - DNA, 15 bp, Homo sapiens
tgggtccctcccata

SEQ ID NO: 42290 - DNA, 15 bp, Homo sapiens
ctgggtccctcccat

SEQ ID NO: 42291 - DNA, 15 bp, Homo sapiens
actgggtccctccca

SEQ ID NO: 42292 - DNA, 15 bp, Homo sapiens
actcccactgggtcc

SEQ ID NO: 42293 - DNA, 15 bp, Homo sapiens
tactcccactgggtc

SEQ ID NO: 42294 - DNA, 15 bp, Homo sapiens
ttactcccactgggt

SEQ ID NO: 42295 - DNA, 15 bp, Homo sapiens
attactcccactggg

SEQ ID NO: 42296 - DNA, 15 bp, Homo sapiens
aattactcccactgg

SEQ ID NO: 42297 - DNA, 15 bp, Homo sapiens
caattactcccactg

SEQ ID NO: 42298 - DNA, 15 bp, Homo sapiens
tcaattactcccact

SEQ ID NO: 42299 - DNA, 15 bp, Homo sapiens
ttcaattactcccac

SEQ ID NO: 42300 - DNA, 15 bp, Homo sapiens
attcaattactccca

SEQ ID NO: 42301 - DNA, 15 bp, Homo sapiens
gattcaattactccc

SEQ ID NO: 42302 - DNA, 15 bp, Homo sapiens
tgattcaattactcc

SEQ ID NO: 42303 - DNA, 15 bp, Homo sapiens
atgattcaattactc

SEQ ID NO: 42304 - DNA, 15 bp, Homo sapiens
catgattcaattact

SEQ ID NO: 42305 - DNA, 15 bp, Homo sapiens
ccatgattcaattac

SEQ ID NO: 42306 - DNA, 15 bp, Homo sapiens
tccatgattcaatta

SEQ ID NO: 42307 - DNA, 15 bp, Homo sapiens
ctccatgattcaatt

SEQ ID NO: 42308 - DNA, 15 bp, Homo sapiens
cctccatgattcaat

SEQ ID NO: 42309 - DNA, 15 bp, Homo sapiens
gcctccatgattcaa

SEQ ID NO: 42310 - DNA, 15 bp, Homo sapiens
tgcctccatgattca

SEQ ID NO: 42311 - DNA, 15 bp, Homo sapiens
ttgcctccatgattc

SEQ ID NO: 42312 - DNA, 15 bp, Homo sapiens
cttgcctccatgatt

SEQ ID NO: 42313 - DNA, 15 bp, Homo sapiens
acttgcctccatgat

SEQ ID NO: 42314 - DNA, 15 bp, Homo sapiens
gacttgcctccatga

SEQ ID NO: 42315 - DNA, 15 bp, Homo sapiens
agacttgcctccatg

SEQ ID NO: 42316 - DNA, 15 bp, Homo sapiens
aagacttgcctccat

SEQ ID NO: 42317 - DNA, 15 bp, Homo sapiens
aaagacttgcctcca

SEQ ID NO: 42318 - DNA, 15 bp, Homo sapiens
gaaagacttgcctcc

SEQ ID NO: 42319 - DNA, 15 bp, Homo sapiens
ggaaagacttgcctc

SEQ ID NO: 42320 - DNA, 15 bp, Homo sapiens
gggaaagacttgcct

SEQ ID NO: 42321 - DNA, 15 bp, Homo sapiens
tgggaaagacttgcc

SEQ ID NO: 42322 - DNA, 15 bp, Homo sapiens
atgggaaagacttgc

SEQ ID NO: 42323 - DNA, 15 bp, Homo sapiens
catgggaaagacttg

SEQ ID NO: 42324 - DNA, 15 bp, Homo sapiens
gcatgggaaagactt

SEQ ID NO: 42325 - DNA, 15 bp, Homo sapiens
agcatgggaaagact

SEQ ID NO: 42326 - DNA, 15 bp, Homo sapiens
cagcatgggaaagac

SEQ ID NO: 42327 - DNA, 15 bp, Homo sapiens
acagcatgggaaaga

SEQ ID NO: 42328 - DNA, 15 bp, Homo sapiens
aacagcatgggaaag

SEQ ID NO: 42329 - DNA, 15 bp, Homo sapiens
gaacagcatgggaaa

SEQ ID NO: 42330 - DNA, 15 bp, Homo sapiens
agaacagcatgggaa

SEQ ID NO: 42331 - DNA, 15 bp, Homo sapiens
aagaacagcatggga

SEQ ID NO: 42332 - DNA, 15 bp, Homo sapiens
caagaacagcatggg

SEQ ID NO: 42333 - DNA, 15 bp, Homo sapiens
acaagaacagcatgg

SEQ ID NO: 42334 - DNA, 15 bp, Homo sapiens
cacaagaacagcatg

SEQ ID NO: 42335 - DNA, 15 bp, Homo sapiens
tcacaagaacagcat

SEQ ID NO: 42336 - DNA, 15 bp, Homo sapiens
atcacaagaacagca

SEQ ID NO: 42337 - DNA, 15 bp, Homo sapiens
tatcacaagaacagc

SEQ ID NO: 42338 - DNA, 15 bp, Homo sapiens
ctatcacaagaacag

SEQ ID NO: 42339 - DNA, 15 bp, Homo sapiens
actatcacaagaaca

SEQ ID NO: 42340 - DNA, 15 bp, Homo sapiens
cactatcacaagaac

SEQ ID NO: 42341 - DNA, 15 bp, Homo sapiens
tcactatcacaagaa

SEQ ID NO: 42342 - DNA, 15 bp, Homo sapiens
ttcactatcacaaga

SEQ ID NO: 42343 - DNA, 15 bp, Homo sapiens
attcactatcacaag

SEQ ID NO: 42344 - DNA, 15 bp, Homo sapiens
tattcactatcacaa

SEQ ID NO: 42345 - DNA, 15 bp, Homo sapiens
ttattcactatcaca

SEQ ID NO: 42346 - DNA, 15 bp, Homo sapiens
cttattcactatcac

SEQ ID NO: 42347 - DNA, 15 bp, Homo sapiens
acttattcactatca

SEQ ID NO: 42348 - DNA, 15 bp, Homo sapiens
gacttattcactatc

SEQ ID NO: 42349 - DNA, 15 bp, Homo sapiens
agacttattcactat

SEQ ID NO: 42350 - DNA, 15 bp, Homo sapiens
gagacttattcacta

SEQ ID NO: 42351 - DNA, 15 bp, Homo sapiens
tgagacttattcact

SEQ ID NO: 42352 - DNA, 15 bp, Homo sapiens
gtgagacttattcac

SEQ ID NO: 42353 - DNA, 15 bp, Homo sapiens
cgtgagacttattca

SEQ ID NO: 42354 - DNA, 15 bp, Homo sapiens
tcgtgagacttattc

SEQ ID NO: 42355 - DNA, 15 bp, Homo sapiens
ctcgtgagacttatt

SEQ ID NO: 42356 - DNA, 15 bp, Homo sapiens
tctcgtgagacttat

SEQ ID NO: 42357 - DNA, 15 bp, Homo sapiens
ttctcgtgagactta

SEQ ID NO: 42358 - DNA, 15 bp, Homo sapiens
gttctcgtgagactt

SEQ ID NO: 42359 - DNA, 15 bp, Homo sapiens
agttctcgtgagact

SEQ ID NO: 42360 - DNA, 15 bp, Homo sapiens
cagttctcgtgagac

SEQ ID NO: 42361 - DNA, 15 bp, Homo sapiens
tcagttctcgtgaga

SEQ ID NO: 42362 - DNA, 15 bp, Homo sapiens
atcagttctcgtgag

SEQ ID NO: 42363 - DNA, 15 bp, Homo sapiens
catcagttctcgtga

SEQ ID NO: 42364 - DNA, 15 bp, Homo sapiens
ccatcagttctcgtg

SEQ ID NO: 42365 - DNA, 15 bp, Homo sapiens
accatcagttctcgt

SEQ ID NO: 42366 - DNA, 15 bp, Homo sapiens
aaccatcagttctcg

SEQ ID NO: 42367 - DNA, 15 bp, Homo sapiens
aaaccatcagttctc

SEQ ID NO: 42368 - DNA, 15 bp, Homo sapiens
aaaaccatcagttct

SEQ ID NO: 42369 - DNA, 15 bp, Homo sapiens
taaaaccatcagttc

SEQ ID NO: 42370 - DNA, 15 bp, Homo sapiens
ataaaaccatcagtt

SEQ ID NO: 42371 - DNA, 15 bp, Homo sapiens
tataaaaccatcagt

SEQ ID NO: 42372 - DNA, 15 bp, Homo sapiens
ttataaaaccatcag

SEQ ID NO: 42373 - DNA, 15 bp, Homo sapiens
tttataaaaccatca

SEQ ID NO: 42374 - DNA, 15 bp, Homo sapiens
ctttataaaaccatc

SEQ ID NO: 42375 - DNA, 15 bp, Homo sapiens
tctttataaaaccat

SEQ ID NO: 42376 - DNA, 15 bp, Homo sapiens
ctctttataaaacca

SEQ ID NO: 42377 - DNA, 15 bp, Homo sapiens
cctctttataaaacc

SEQ ID NO: 42378 - DNA, 15 bp, Homo sapiens
gcctctttataaaac

SEQ ID NO: 42379 - DNA, 15 bp, Homo sapiens
cgcctctttataaaa

SEQ ID NO: 42380 - DNA, 15 bp, Homo sapiens
acgcctctttataaa

SEQ ID NO: 42381 - DNA, 15 bp, Homo sapiens
aacgcctctttataa

SEQ ID NO: 42382 - DNA, 15 bp, Homo sapiens
aaacgcctctttata

SEQ ID NO: 42383 - DNA, 15 bp, Homo sapiens
gaaacgcctctttat

SEQ ID NO: 42384 - DNA, 15 bp, Homo sapiens
ggaaacgcctcttta

SEQ ID NO: 42385 - DNA, 15 bp, Homo sapiens
gggaaacgcctcttt

SEQ ID NO: 42386 - DNA, 15 bp, Homo sapiens
agggaaacgcctctt

SEQ ID NO: 42387 - DNA, 15 bp, Homo sapiens
cagggaaacgcctct

SEQ ID NO: 42388 - DNA, 15 bp, Homo sapiens
gcagggaaacgcctc

SEQ ID NO: 42389 - DNA, 15 bp, Homo sapiens
tgcagggaaacgcct

SEQ ID NO: 42390 - DNA, 15 bp, Homo sapiens
gtgcagggaaacgcc

SEQ ID NO: 42391 - DNA, 15 bp, Homo sapiens
tgtgcagggaaacgc

SEQ ID NO: 42392 - DNA, 15 bp, Homo sapiens
ttgtgcagggaaacg

SEQ ID NO: 42393 - DNA, 15 bp, Homo sapiens
cttgtgcagggaaac

SEQ ID NO: 42394 - DNA, 15 bp, Homo sapiens
gcttgtgcagggaaa

SEQ ID NO: 42395 - DNA, 15 bp, Homo sapiens
agcttgtgcagggaa

SEQ ID NO: 42396 - DNA, 15 bp, Homo sapiens
gagcttgtgcaggga

SEQ ID NO: 42397 - DNA, 15 bp, Homo sapiens
agagcttgtgcaggg

SEQ ID NO: 42398 - DNA, 15 bp, Homo sapiens
gagagcttgtgcagg

SEQ ID NO: 42399 - DNA, 15 bp, Homo sapiens
agagagcttgtgcag

SEQ ID NO: 42400 - DNA, 15 bp, Homo sapiens
gagagagcttgtgca

SEQ ID NO: 42401 - DNA, 15 bp, Homo sapiens
agagagagcttgtgc

SEQ ID NO: 42402 - DNA, 15 bp, Homo sapiens
aagagagagcttgtg

SEQ ID NO: 42403 - DNA, 15 bp, Homo sapiens
aaagagagagcttgt

SEQ ID NO: 42404 - DNA, 15 bp, Homo sapiens
caaagagagagcttg

SEQ ID NO: 42405 - DNA, 15 bp, Homo sapiens
gcaaagagagagctt

SEQ ID NO: 42406 - DNA, 15 bp, Homo sapiens
ggcaaagagagagct

SEQ ID NO: 42407 - DNA, 15 bp, Homo sapiens
aggcaaagagagagc

SEQ ID NO: 42408 - DNA, 15 bp, Homo sapiens
caggcaaagagagag

SEQ ID NO: 42409 - DNA, 15 bp, Homo sapiens
gcaggcaaagagaga

SEQ ID NO: 42410 - DNA, 15 bp, Homo sapiens
agcaggcaaagagag

SEQ ID NO: 42411 - DNA, 15 bp, Homo sapiens
cagcaggcaaagaga

SEQ ID NO: 42412 - DNA, 15 bp, Homo sapiens
gcagcaggcaaagag

SEQ ID NO: 42413 - DNA, 15 bp, Homo sapiens
ggcagcaggcaaaga

SEQ ID NO: 42414 - DNA, 15 bp, Homo sapiens
tggcagcaggcaaag

SEQ ID NO: 42415 - DNA, 15 bp, Homo sapiens
atggcagcaggcaaa

SEQ ID NO: 42416 - DNA, 15 bp, Homo sapiens
gatggcagcaggcaa

SEQ ID NO: 42417 - DNA, 15 bp, Homo sapiens
ggatggcagcaggca

SEQ ID NO: 42418 - DNA, 15 bp, Homo sapiens
tggatggcagcaggc

SEQ ID NO: 42419 - DNA, 15 bp, Homo sapiens
atggatggcagcagg

SEQ ID NO: 42420 - DNA, 15 bp, Homo sapiens
catggatggcagcag

SEQ ID NO: 42421 - DNA, 15 bp, Homo sapiens
acatggatggcagca

SEQ ID NO: 42422 - DNA, 15 bp, Homo sapiens
tacatggatggcagc

SEQ ID NO: 42423 - DNA, 15 bp, Homo sapiens
ttacatggatggcag

SEQ ID NO: 42424 - DNA, 15 bp, Homo sapiens
cttacatggatggca

SEQ ID NO: 42425 - DNA, 15 bp, Homo sapiens
tcttacatggatggc

SEQ ID NO: 42426 - DNA, 15 bp, Homo sapiens
atcttacatggatgg

SEQ ID NO: 42427 - DNA, 15 bp, Homo sapiens
catcttacatggatg

SEQ ID NO: 42428 - DNA, 15 bp, Homo sapiens
acatcttacatggat

SEQ ID NO: 42429 - DNA, 15 bp, Homo sapiens
cacatcttacatgga

SEQ ID NO: 42430 - DNA, 15 bp, Homo sapiens
tcacatcttacatgg

SEQ ID NO: 42431 - DNA, 15 bp, Homo sapiens
gtcacatcttacatg

SEQ ID NO: 42432 - DNA, 15 bp, Homo sapiens
agtcacatcttacat

SEQ ID NO: 42433 - DNA, 15 bp, Homo sapiens
aagtcacatcttaca

SEQ ID NO: 42434 - DNA, 15 bp, Homo sapiens
caagtcacatcttac

SEQ ID NO: 42435 - DNA, 15 bp, Homo sapiens
gcaagtcacatctta

SEQ ID NO: 42436 - DNA, 15 bp, Homo sapiens
agcaagtcacatctt

SEQ ID NO: 42437 - DNA, 15 bp, Homo sapiens
gagcaagtcacatct

SEQ ID NO: 42438 - DNA, 15 bp, Homo sapiens
ggagcaagtcacatc

SEQ ID NO: 42439 - DNA, 15 bp, Homo sapiens
aggagcaagtcacat

SEQ ID NO: 42440 - DNA, 15 bp, Homo sapiens
gaggagcaagtcaca

SEQ ID NO: 42441 - DNA, 15 bp, Homo sapiens
ggaggagcaagtcac

SEQ ID NO: 42442 - DNA, 15 bp, Homo sapiens
aggaggagcaagtca

SEQ ID NO: 42443 - DNA, 15 bp, Homo sapiens
aaggaggagcaagtc

SEQ ID NO: 42444 - DNA, 15 bp, Homo sapiens
caaggaggagcaagt

SEQ ID NO: 42445 - DNA, 15 bp, Homo sapiens
gcaaggaggagcaag

SEQ ID NO: 42446 - DNA, 15 bp, Homo sapiens
ggcaaggaggagcaa

SEQ ID NO: 42447 - DNA, 15 bp, Homo sapiens
aggcaaggaggagca

SEQ ID NO: 42448 - DNA, 15 bp, Homo sapiens
aaggcaaggaggagc

SEQ ID NO: 42449 - DNA, 15 bp, Homo sapiens
gaaggcaaggaggag

SEQ ID NO: 42450 - DNA, 15 bp, Homo sapiens
ggaaggcaaggagga

SEQ ID NO: 42451 - DNA, 15 bp, Homo sapiens
tggaaggcaaggagg

SEQ ID NO: 42452 - DNA, 15 bp, Homo sapiens
gtggaaggcaaggag

SEQ ID NO: 42453 - DNA, 15 bp, Homo sapiens
ggtggaaggcaagga

SEQ ID NO: 42454 - DNA, 15 bp, Homo sapiens
tggtggaaggcaagg

SEQ ID NO: 42455 - DNA, 15 bp, Homo sapiens
atggtggaaggcaag

SEQ ID NO: 42456 - DNA, 15 bp, Homo sapiens
aatcatggtggaagg

SEQ ID NO: 42457 - DNA, 15 bp, Homo sapiens
caatcatggtggaag

SEQ ID NO: 42458 - DNA, 15 bp, Homo sapiens
acaatcatggtggaa

SEQ ID NO: 42459 - DNA, 15 bp, Homo sapiens
cacaatcatggtgga

SEQ ID NO: 42460 - DNA, 15 bp, Homo sapiens
tcacaatcatggtgg

SEQ ID NO: 42461 - DNA, 15 bp, Homo sapiens
ctcacaatcatggtg

SEQ ID NO: 42462 - DNA, 15 bp, Homo sapiens
cctcacaatcatggt

SEQ ID NO: 42463 - DNA, 15 bp, Homo sapiens
gcctcacaatcatgg

SEQ ID NO: 42464 - DNA, 15 bp, Homo sapiens
agcctcacaatcatg

SEQ ID NO: 42465 - DNA, 15 bp, Homo sapiens
aagcctcacaatcat

SEQ ID NO: 42466 - DNA, 15 bp, Homo sapiens
gaagcctcacaatca

SEQ ID NO: 42467 - DNA, 15 bp, Homo sapiens
ggaagcctcacaatc

SEQ ID NO: 42468 - DNA, 15 bp, Homo sapiens
gggaagcctcacaat

SEQ ID NO: 42469 - DNA, 15 bp, Homo sapiens
ggggaagcctcacaa

SEQ ID NO: 42470 - DNA, 15 bp, Homo sapiens
tggggaagcctcaca

SEQ ID NO: 42471 - DNA, 15 bp, Homo sapiens
ctggggaagcctcac

SEQ ID NO: 42472 - DNA, 15 bp, Homo sapiens
gctggggaagcctca

SEQ ID NO: 42473 - DNA, 15 bp, Homo sapiens
ggctggggaagcctc

SEQ ID NO: 42474 - DNA, 15 bp, Homo sapiens
tggctggggaagcct

SEQ ID NO: 42475 - DNA, 15 bp, Homo sapiens
gtggctggggaagcc

SEQ ID NO: 42476 - DNA, 15 bp, Homo sapiens
tgtggctggggaagc

SEQ ID NO: 42477 - DNA, 15 bp, Homo sapiens
atgtggctggggaag

SEQ ID NO: 42478 - DNA, 15 bp, Homo sapiens
catgtggctggggaa

SEQ ID NO: 42479 - DNA, 15 bp, Homo sapiens
ccatgtggctgggga

SEQ ID NO: 42480 - DNA, 15 bp, Homo sapiens
tccatgtggctgggg

SEQ ID NO: 42481 - DNA, 15 bp, Homo sapiens
ttccatgtggctggg

SEQ ID NO: 42482 - DNA, 15 bp, Homo sapiens
gttccatgtggctgg

SEQ ID NO: 42483 - DNA, 15 bp, Homo sapiens
agttccatgtggctg

SEQ ID NO: 42484 - DNA, 15 bp, Homo sapiens
cagttccatgtggct

SEQ ID NO: 42485 - DNA, 15 bp, Homo sapiens
acagttccatgtggc

SEQ ID NO: 42486 - DNA, 15 bp, Homo sapiens
tacagttccatgtgg

SEQ ID NO: 42487 - DNA, 15 bp, Homo sapiens
ttacagttccatgtg

SEQ ID NO: 42488 - DNA, 15 bp, Homo sapiens
cttacagttccatgt

SEQ ID NO: 42489 - DNA, 15 bp, Homo sapiens
acttacagttccatg

SEQ ID NO: 42490 - DNA, 15 bp, Homo sapiens
gacttacagttccat

SEQ ID NO: 42491 - DNA, 15 bp, Homo sapiens
ggacttacagttcca

SEQ ID NO: 42492 - DNA, 15 bp, Homo sapiens
tggacttacagttcc

SEQ ID NO: 42493 - DNA, 15 bp, Homo sapiens
atggacttacagttc

SEQ ID NO: 42494 - DNA, 15 bp, Homo sapiens
aatggacttacagtt

SEQ ID NO: 42495 - DNA, 15 bp, Homo sapiens
taatggacttacagt

SEQ ID NO: 42496 - DNA, 15 bp, Homo sapiens
ttaatggacttacag

SEQ ID NO: 42497 - DNA, 15 bp, Homo sapiens
tttaatggacttaca

SEQ ID NO: 42498 - DNA, 15 bp, Homo sapiens
atttaatggacttac

SEQ ID NO: 42499 - DNA, 15 bp, Homo sapiens
gatttaatggactta

SEQ ID NO: 42500 - DNA, 15 bp, Homo sapiens
agatttaatggactt

SEQ ID NO: 42501 - DNA, 15 bp, Homo sapiens
gagatttaatggact

SEQ ID NO: 42502 - DNA, 15 bp, Homo sapiens
agagatttaatggac

SEQ ID NO: 42503 - DNA, 15 bp, Homo sapiens
aagagatttaatgga

SEQ ID NO: 42504 - DNA, 15 bp, Homo sapiens
aaagagatttaatgg

SEQ ID NO: 42505 - DNA, 15 bp, Homo sapiens
gaaagagatttaatg

SEQ ID NO: 42506 - DNA, 15 bp, Homo sapiens
agaaagagatttaat

SEQ ID NO: 42507 - DNA, 15 bp, Homo sapiens
aagaaagagatttaa

SEQ ID NO: 42508 - DNA, 15 bp, Homo sapiens
aaagaaagagattta

SEQ ID NO: 42509 - DNA, 15 bp, Homo sapiens
caaagaaagagattt

SEQ ID NO: 42510 - DNA, 15 bp, Homo sapiens
ccaaagaaagagatt

SEQ ID NO: 42511 - DNA, 15 bp, Homo sapiens
accaaagaaagagat

SEQ ID NO: 42512 - DNA, 15 bp, Homo sapiens
taccaaagaaagaga

SEQ ID NO: 42513 - DNA, 15 bp, Homo sapiens
ttaccaaagaaagag

SEQ ID NO: 42514 - DNA, 15 bp, Homo sapiens
tttaccaaagaaaga

SEQ ID NO: 42515 - DNA, 15 bp, Homo sapiens
atttaccaaagaaag

SEQ ID NO: 42516 - DNA, 15 bp, Homo sapiens
aatttaccaaagaaa

SEQ ID NO: 42517 - DNA, 15 bp, Homo sapiens
caatttaccaaagaa

SEQ ID NO: 42518 - DNA, 15 bp, Homo sapiens
gcaatttaccaaaga

SEQ ID NO: 42519 - DNA, 15 bp, Homo sapiens
ggcaatttaccaaag

SEQ ID NO: 42520 - DNA, 15 bp, Homo sapiens
gggcaatttaccaaa

SEQ ID NO: 42521 - DNA, 15 bp, Homo sapiens
tgggcaatttaccaa

SEQ ID NO: 42522 - DNA, 15 bp, Homo sapiens
ctgggcaatttacca

SEQ ID NO: 42523 - DNA, 15 bp, Homo sapiens
actgggcaatttacc

SEQ ID NO: 42524 - DNA, 15 bp, Homo sapiens
gactgggcaatttac

SEQ ID NO: 42525 - DNA, 15 bp, Homo sapiens
agactgggcaattta

SEQ ID NO: 42526 - DNA, 15 bp, Homo sapiens
aagactgggcaattt

SEQ ID NO: 42527 - DNA, 15 bp, Homo sapiens
caagactgggcaatt

SEQ ID NO: 42528 - DNA, 15 bp, Homo sapiens
ccaagactgggcaat

SEQ ID NO: 42529 - DNA, 15 bp, Homo sapiens
cccaagactgggcaa

SEQ ID NO: 42530 - DNA, 15 bp, Homo sapiens
acccaagactgggca

SEQ ID NO: 42531 - DNA, 15 bp, Homo sapiens
tacccaagactgggc

SEQ ID NO: 42532 - DNA, 15 bp, Homo sapiens
tatacccaagactgg

SEQ ID NO: 42533 - DNA, 15 bp, Homo sapiens
atatacccaagactg

SEQ ID NO: 42534 - DNA, 15 bp, Homo sapiens
catatacccaagact

SEQ ID NO: 42535 - DNA, 15 bp, Homo sapiens
acatatacccaagac

SEQ ID NO: 42536 - DNA, 15 bp, Homo sapiens
aacatatacccaaga

SEQ ID NO: 42537 - DNA, 15 bp, Homo sapiens
aaacatatacccaag

SEQ ID NO: 42538 - DNA, 15 bp, Homo sapiens
taaacatatacccaa

SEQ ID NO: 42539 - DNA, 15 bp, Homo sapiens
ataaacatataccca

SEQ ID NO: 42540 - DNA, 15 bp, Homo sapiens
gataaacatataccc

SEQ ID NO: 42541 - DNA, 15 bp, Homo sapiens
tgataaacatatacc

SEQ ID NO: 42542 - DNA, 15 bp, Homo sapiens
ctgataaacatatac

SEQ ID NO: 42543 - DNA, 15 bp, Homo sapiens
gctgataaacatata

SEQ ID NO: 42544 - DNA, 15 bp, Homo sapiens
tgctgataaacatat

SEQ ID NO: 42545 - DNA, 15 bp, Homo sapiens
ctgctgataaacata

SEQ ID NO: 42546 - DNA, 15 bp, Homo sapiens
actgctgataaacat

SEQ ID NO: 42547 - DNA, 15 bp, Homo sapiens
cactgctgataaaca

SEQ ID NO: 42548 - DNA, 15 bp, Homo sapiens
acactgctgataaac

SEQ ID NO: 42549 - DNA, 15 bp, Homo sapiens
cacactgctgataaa

SEQ ID NO: 42550 - DNA, 15 bp, Homo sapiens
tcacactgctgataa

SEQ ID NO: 42551 - DNA, 15 bp, Homo sapiens
ttcacactgctgata

SEQ ID NO: 42552 - DNA, 15 bp, Homo sapiens
tttcacactgctgat

SEQ ID NO: 42553 - DNA, 15 bp, Homo sapiens
ctttcacactgctga

SEQ ID NO: 42554 - DNA, 15 bp, Homo sapiens
gctttcacactgctg

SEQ ID NO: 42555 - DNA, 15 bp, Homo sapiens
tgctttcacactgct

SEQ ID NO: 42556 - DNA, 15 bp, Homo sapiens
ctgctttcacactgc

SEQ ID NO: 42557 - DNA, 15 bp, Homo sapiens
tctgctttcacactg

SEQ ID NO: 42558 - DNA, 15 bp, Homo sapiens
gtctgctttcacact

SEQ ID NO: 42559 - DNA, 15 bp, Homo sapiens
agtctgctttcacac

SEQ ID NO: 42560 - DNA, 15 bp, Homo sapiens
tagtctgctttcaca

SEQ ID NO: 42561 - DNA, 15 bp, Homo sapiens
ttagtctgctttcac

SEQ ID NO: 42562 - DNA, 15 bp, Homo sapiens
attagtctgctttca

SEQ ID NO: 42563 - DNA, 15 bp, Homo sapiens
tattagtctgctttc

SEQ ID NO: 42564 - DNA, 15 bp, Homo sapiens
gtattagtctgcttt

SEQ ID NO: 42565 - DNA, 15 bp, Homo sapiens
tgtattagtctgctt

SEQ ID NO: 42566 - DNA, 15 bp, Homo sapiens
atgtattagtctgct

SEQ ID NO: 42567 - DNA, 15 bp, Homo sapiens
tatgtattagtctgc

SEQ ID NO: 42568 - DNA, 15 bp, Homo sapiens
gtatgtattagtctg

SEQ ID NO: 42569 - DNA, 15 bp, Homo sapiens
agtatgtattagtct

SEQ ID NO: 42570 - DNA, 15 bp, Homo sapiens
gagtatgtattagtc

SEQ ID NO: 42571 - DNA, 15 bp, Homo sapiens
tgagtatgtattagt

SEQ ID NO: 42572 - DNA, 15 bp, Homo sapiens
ctgagtatgtattag

SEQ ID NO: 42573 - DNA, 15 bp, Homo sapiens
actgagtatgtatta

SEQ ID NO: 42574 - DNA, 15 bp, Homo sapiens
tactgagtatgtatt

SEQ ID NO: 42575 - DNA, 15 bp, Homo sapiens
ttactgagtatgtat

SEQ ID NO: 42576 - DNA, 15 bp, Homo sapiens
attactgagtatgta

SEQ ID NO: 42577 - DNA, 15 bp, Homo sapiens
cattactgagtatgt

SEQ ID NO: 42578 - DNA, 15 bp, Homo sapiens
ccattactgagtatg

SEQ ID NO: 42579 - DNA, 15 bp, Homo sapiens
cccattactgagtat

SEQ ID NO: 42580 - DNA, 15 bp, Homo sapiens
tcccattactgagta

SEQ ID NO: 42581 - DNA, 15 bp, Homo sapiens
atcccattactgagt

SEQ ID NO: 42582 - DNA, 15 bp, Homo sapiens
aatcccattactgag

SEQ ID NO: 42583 - DNA, 15 bp, Homo sapiens
caatcccattactga

SEQ ID NO: 42584 - DNA, 15 bp, Homo sapiens
gcaatcccattactg

SEQ ID NO: 42585 - DNA, 15 bp, Homo sapiens
agcaatcccattact

SEQ ID NO: 42586 - DNA, 15 bp, Homo sapiens
cagcaatcccattac

SEQ ID NO: 42587 - DNA, 15 bp, Homo sapiens
ccagcaatcccatta

SEQ ID NO: 42588 - DNA, 15 bp, Homo sapiens
cccagcaatcccatt

SEQ ID NO: 42589 - DNA, 15 bp, Homo sapiens
acccagcaatcccat

SEQ ID NO: 42590 - DNA, 15 bp, Homo sapiens
gacccagcaatccca

SEQ ID NO: 42591 - DNA, 15 bp, Homo sapiens
tgacccagcaatccc

SEQ ID NO: 42592 - DNA, 15 bp, Homo sapiens
ttgacccagcaatcc

SEQ ID NO: 42593 - DNA, 15 bp, Homo sapiens
tttgacccagcaatc

SEQ ID NO: 42594 - DNA, 15 bp, Homo sapiens
atttgacccagcaat

SEQ ID NO: 42595 - DNA, 15 bp, Homo sapiens
tatttgacccagcaa

SEQ ID NO: 42596 - DNA, 15 bp, Homo sapiens
ctatttgacccagca

SEQ ID NO: 42597 - DNA, 15 bp, Homo sapiens
actatttgacccagc

SEQ ID NO: 42598 - DNA, 15 bp, Homo sapiens
tactatttgacccag

SEQ ID NO: 42599 - DNA, 15 bp, Homo sapiens
atactatttgaccca

SEQ ID NO: 42600 - DNA, 15 bp, Homo sapiens
aatactatttgaccc

SEQ ID NO: 42601 - DNA, 15 bp, Homo sapiens
aaatactatttgacc

SEQ ID NO: 42602 - DNA, 15 bp, Homo sapiens
gaaatactatttgac

SEQ ID NO: 42603 - DNA, 15 bp, Homo sapiens
agaaatactatttga

SEQ ID NO: 42604 - DNA, 15 bp, Homo sapiens
cagaaatactatttg

SEQ ID NO: 42605 - DNA, 15 bp, Homo sapiens
acagaaatactattt

SEQ ID NO: 42606 - DNA, 15 bp, Homo sapiens
gacagaaatactatt

SEQ ID NO: 42607 - DNA, 15 bp, Homo sapiens
agacagaaatactat

SEQ ID NO: 42608 - DNA, 15 bp, Homo sapiens
aagacagaaatacta

SEQ ID NO: 42609 - DNA, 15 bp, Homo sapiens
aaagacagaaatact

SEQ ID NO: 42610 - DNA, 15 bp, Homo sapiens
taaagacagaaatac

SEQ ID NO: 42611 - DNA, 15 bp, Homo sapiens
ctaaagacagaaata

SEQ ID NO: 42612 - DNA, 15 bp, Homo sapiens
cctaaagacagaaat

SEQ ID NO: 42613 - DNA, 15 bp, Homo sapiens
acctaaagacagaaa

SEQ ID NO: 42614 - DNA, 15 bp, Homo sapiens
gacctaaagacagaa

SEQ ID NO: 42615 - DNA, 15 bp, Homo sapiens
agacctaaagacaga

SEQ ID NO: 42616 - DNA, 15 bp, Homo sapiens
aagacctaaagacag

SEQ ID NO: 42617 - DNA, 15 bp, Homo sapiens
aaagacctaaagaca

SEQ ID NO: 42618 - DNA, 15 bp, Homo sapiens
caaagacctaaagac

SEQ ID NO: 42619 - DNA, 15 bp, Homo sapiens
tcaaagacctaaaga

SEQ ID NO: 42620 - DNA, 15 bp, Homo sapiens
ctcaaagacctaaag

SEQ ID NO: 42621 - DNA, 15 bp, Homo sapiens
cctcaaagacctaaa

SEQ ID NO: 42622 - DNA, 15 bp, Homo sapiens
agcaattcctcaaag

SEQ ID NO: 42623 - DNA, 15 bp, Homo sapiens
tagcaattcctcaaa

SEQ ID NO: 42624 - DNA, 15 bp, Homo sapiens
atagcaattcctcaa

SEQ ID NO: 42625 - DNA, 15 bp, Homo sapiens
catagcaattcctca

SEQ ID NO: 42626 - DNA, 15 bp, Homo sapiens
acatagcaattcctc

SEQ ID NO: 42627 - DNA, 15 bp, Homo sapiens
aacatagcaattcct

SEQ ID NO: 42628 - DNA, 15 bp, Homo sapiens
caacatagcaattcc

SEQ ID NO: 42629 - DNA, 15 bp, Homo sapiens
acaacatagcaattc

SEQ ID NO: 42630 - DNA, 15 bp, Homo sapiens
gacaacatagcaatt

SEQ ID NO: 42631 - DNA, 15 bp, Homo sapiens
agacaacatagcaat

SEQ ID NO: 42632 - DNA, 15 bp, Homo sapiens
aagacaacatagcaa

SEQ ID NO: 42633 - DNA, 15 bp, Homo sapiens
gaagacaacatagca

SEQ ID NO: 42634 - DNA, 15 bp, Homo sapiens
ggaagacaacatagc

SEQ ID NO: 42635 - DNA, 15 bp, Homo sapiens
tggaagacaacatag

SEQ ID NO: 42636 - DNA, 15 bp, Homo sapiens
gtggaagacaacata

SEQ ID NO: 42637 - DNA, 15 bp, Homo sapiens
tgtggaagacaacat

SEQ ID NO: 42638 - DNA, 15 bp, Homo sapiens
ctgtggaagacaaca

SEQ ID NO: 42639 - DNA, 15 bp, Homo sapiens
actgtggaagacaac

SEQ ID NO: 42640 - DNA, 15 bp, Homo sapiens
cactgtggaagacaa

SEQ ID NO: 42641 - DNA, 15 bp, Homo sapiens
acactgtggaagaca

SEQ ID NO: 42642 - DNA, 15 bp, Homo sapiens
aacactgtggaagac

SEQ ID NO: 42643 - DNA, 15 bp, Homo sapiens
aaacactgtggaaga

SEQ ID NO: 42644 - DNA, 15 bp, Homo sapiens
caaacactgtggaag

SEQ ID NO: 42645 - DNA, 15 bp, Homo sapiens
tcaaacactgtggaa

SEQ ID NO: 42646 - DNA, 15 bp, Homo sapiens
ttcaaacactgtgga

SEQ ID NO: 42647 - DNA, 15 bp, Homo sapiens
gttcaaacactgtgg

SEQ ID NO: 42648 - DNA, 15 bp, Homo sapiens
agttcaaacactgtg

SEQ ID NO: 42649 - DNA, 15 bp, Homo sapiens
tagttcaaacactgt

SEQ ID NO: 42650 - DNA, 15 bp, Homo sapiens
ttagttcaaacactg

SEQ ID NO: 42651 - DNA, 15 bp, Homo sapiens
attagttcaaacact

SEQ ID NO: 42652 - DNA, 15 bp, Homo sapiens
aattagttcaaacac

SEQ ID NO: 42653 - DNA, 15 bp, Homo sapiens
aaattagttcaaaca

SEQ ID NO: 42654 - DNA, 15 bp, Homo sapiens
taaattagttcaaac

SEQ ID NO: 42655 - DNA, 15 bp, Homo sapiens
gtaaattagttcaaa

SEQ ID NO: 42656 - DNA, 15 bp, Homo sapiens
tgtaaattagttcaa

SEQ ID NO: 42657 - DNA, 15 bp, Homo sapiens
gtgtaaattagttca

SEQ ID NO: 42658 - DNA, 15 bp, Homo sapiens
agtgtaaattagttc

SEQ ID NO: 42659 - DNA, 15 bp, Homo sapiens
gagtgtaaattagtt

SEQ ID NO: 42660 - DNA, 15 bp, Homo sapiens
gggagtgtaaattag

SEQ ID NO: 42661 - DNA, 15 bp, Homo sapiens
tgggagtgtaaatta

SEQ ID NO: 42662 - DNA, 15 bp, Homo sapiens
gtgggagtgtaaatt

SEQ ID NO: 42663 - DNA, 15 bp, Homo sapiens
ggtgggagtgtaaat

SEQ ID NO: 42664 - DNA, 15 bp, Homo sapiens
tggtgggagtgtaaa

SEQ ID NO: 42665 - DNA, 15 bp, Homo sapiens
ttggtgggagtgtaa

SEQ ID NO: 42666 - DNA, 15 bp, Homo sapiens
gttggtgggagtgta

SEQ ID NO: 42667 - DNA, 15 bp, Homo sapiens
tgttggtgggagtgt

SEQ ID NO: 42668 - DNA, 15 bp, Homo sapiens
ctgttggtgggagtg

SEQ ID NO: 42669 - DNA, 15 bp, Homo sapiens
actgttggtgggagt

SEQ ID NO: 42670 - DNA, 15 bp, Homo sapiens
cactgttggtgggag

SEQ ID NO: 42671 - DNA, 15 bp, Homo sapiens
acactgttggtggga

SEQ ID NO: 42672 - DNA, 15 bp, Homo sapiens
cacactgttggtggg

SEQ ID NO: 42673 - DNA, 15 bp, Homo sapiens
acacactgttggtgg

SEQ ID NO: 42674 - DNA, 15 bp, Homo sapiens
tacacactgttggtg

SEQ ID NO: 42675 - DNA, 15 bp, Homo sapiens
ttacacactgttggt

SEQ ID NO: 42676 - DNA, 15 bp, Homo sapiens
cttacacactgttgg

SEQ ID NO: 42677 - DNA, 15 bp, Homo sapiens
acttacacactgttg

SEQ ID NO: 42678 - DNA, 15 bp, Homo sapiens
cacttacacactgtt

SEQ ID NO: 42679 - DNA, 15 bp, Homo sapiens
acacttacacactgt

SEQ ID NO: 42680 - DNA, 15 bp, Homo sapiens
aacacttacacactg

SEQ ID NO: 42681 - DNA, 15 bp, Homo sapiens
gaacacttacacact

SEQ ID NO: 42682 - DNA, 15 bp, Homo sapiens
ggaacacttacacac

SEQ ID NO: 42683 - DNA, 15 bp, Homo sapiens
aggaacacttacaca

SEQ ID NO: 42684 - DNA, 15 bp, Homo sapiens
aaggaacacttacac

SEQ ID NO: 42685 - DNA, 15 bp, Homo sapiens
aaaggaacacttaca

SEQ ID NO: 42686 - DNA, 15 bp, Homo sapiens
aaaaggaacacttac

SEQ ID NO: 42687 - DNA, 15 bp, Homo sapiens
aaaaaggaacactta

SEQ ID NO: 42688 - DNA, 15 bp, Homo sapiens
aaaaaaggaacactt

SEQ ID NO: 42689 - DNA, 15 bp, Homo sapiens
aaaaaaaggaacact

SEQ ID NO: 42690 - DNA, 15 bp, Homo sapiens
gaaaaaaaggaacac

SEQ ID NO: 42691 - DNA, 15 bp, Homo sapiens
agaaaaaaaggaaca

SEQ ID NO: 42692 - DNA, 15 bp, Homo sapiens
aagaaaaaaaggaac

SEQ ID NO: 42693 - DNA, 15 bp, Homo sapiens
gaagaaaaaaaggaa

SEQ ID NO: 42694 - DNA, 15 bp, Homo sapiens
tgaagaaaaaaagga

SEQ ID NO: 42695 - DNA, 15 bp, Homo sapiens
ttgaagaaaaaaagg

SEQ ID NO: 42696 - DNA, 15 bp, Homo sapiens
gttgaagaaaaaaag

SEQ ID NO: 42697 - DNA, 15 bp, Homo sapiens
ggttgaagaaaaaaa

SEQ ID NO: 42698 - DNA, 15 bp, Homo sapiens
aggttgaagaaaaaa

SEQ ID NO: 42699 - DNA, 15 bp, Homo sapiens
gaggttgaagaaaaa

SEQ ID NO: 42700 - DNA, 15 bp, Homo sapiens
cgaggttgaagaaaa

SEQ ID NO: 42701 - DNA, 15 bp, Homo sapiens
gcgaggttgaagaaa

SEQ ID NO: 42702 - DNA, 15 bp, Homo sapiens
agcgaggttgaagaa

SEQ ID NO: 42703 - DNA, 15 bp, Homo sapiens
tagcgaggttgaaga

SEQ ID NO: 42704 - DNA, 15 bp, Homo sapiens
ctagcgaggttgaag

SEQ ID NO: 42705 - DNA, 15 bp, Homo sapiens
gctagcgaggttgaa

SEQ ID NO: 42706 - DNA, 15 bp, Homo sapiens
tgctagcgaggttga

SEQ ID NO: 42707 - DNA, 15 bp, Homo sapiens
atgctagcgaggttg

SEQ ID NO: 42708 - DNA, 15 bp, Homo sapiens
gatgctagcgaggtt

SEQ ID NO: 42709 - DNA, 15 bp, Homo sapiens
agatgctagcgaggt

SEQ ID NO: 42710 - DNA, 15 bp, Homo sapiens
aagatgctagcgagg

SEQ ID NO: 42711 - DNA, 15 bp, Homo sapiens
aaagatgctagcgag

SEQ ID NO: 42712 - DNA, 15 bp, Homo sapiens
aaaagatgctagcga

SEQ ID NO: 42713 - DNA, 15 bp, Homo sapiens
taaaagatgctagcg

SEQ ID NO: 42714 - DNA, 15 bp, Homo sapiens
ataaaagatgctagc

SEQ ID NO: 42715 - DNA, 15 bp, Homo sapiens
aataaaagatgctag

SEQ ID NO: 42716 - DNA, 15 bp, Homo sapiens
aaataaaagatgcta

SEQ ID NO: 42717 - DNA, 15 bp, Homo sapiens
aaaataaaagatgct

SEQ ID NO: 42718 - DNA, 15 bp, Homo sapiens
aaaaataaaagatgc

SEQ ID NO: 42719 - DNA, 15 bp, Homo sapiens
aaaaaataaaagatg

SEQ ID NO: 42720 - DNA, 15 bp, Homo sapiens
caaaaaataaaagat

SEQ ID NO: 42721 - DNA, 15 bp, Homo sapiens
gcaaaaaataaaaga

SEQ ID NO: 42722 - DNA, 15 bp, Homo sapiens
ggcaaaaaataaaag

SEQ ID NO: 42723 - DNA, 15 bp, Homo sapiens
aggcaaaaaataaaa

SEQ ID NO: 42724 - DNA, 15 bp, Homo sapiens
aaggcaaaaaataaa

SEQ ID NO: 42725 - DNA, 15 bp, Homo sapiens
aaaggcaaaaaataa

SEQ ID NO: 42726 - DNA, 15 bp, Homo sapiens
aaaaggcaaaaaata

SEQ ID NO: 42727 - DNA, 15 bp, Homo sapiens
aaaaaggcaaaaaat

SEQ ID NO: 42728 - DNA, 15 bp, Homo sapiens
taaaaaggcaaaaaa

SEQ ID NO: 42729 - DNA, 15 bp, Homo sapiens
ttaaaaaggcaaaaa

SEQ ID NO: 42730 - DNA, 15 bp, Homo sapiens
attaaaaaggcaaaa

SEQ ID NO: 42731 - DNA, 15 bp, Homo sapiens
tattaaaaaggcaaa

SEQ ID NO: 42732 - DNA, 15 bp, Homo sapiens
ttattaaaaaggcaa

SEQ ID NO: 42733 - DNA, 15 bp, Homo sapiens
attattaaaaaggca

SEQ ID NO: 42734 - DNA, 15 bp, Homo sapiens
tattattaaaaaggc

SEQ ID NO: 42735 - DNA, 15 bp, Homo sapiens
ctattattaaaaagg

SEQ ID NO: 42736 - DNA, 15 bp, Homo sapiens
gctattattaaaaag

SEQ ID NO: 42737 - DNA, 15 bp, Homo sapiens
ggctattattaaaaa

SEQ ID NO: 42738 - DNA, 15 bp, Homo sapiens
tggctattattaaaa

SEQ ID NO: 42739 - DNA, 15 bp, Homo sapiens
atggctattattaaa

SEQ ID NO: 42740 - DNA, 15 bp, Homo sapiens
aatggctattattaa

SEQ ID NO: 42741 - DNA, 15 bp, Homo sapiens
gaatggctattatta

SEQ ID NO: 42742 - DNA, 15 bp, Homo sapiens
agaatggctattatt

SEQ ID NO: 42743 - DNA, 15 bp, Homo sapiens
gtcagaatggctatt

SEQ ID NO: 42744 - DNA, 15 bp, Homo sapiens
agtcagaatggctat

SEQ ID NO: 42745 - DNA, 15 bp, Homo sapiens
cagtcagaatggcta

SEQ ID NO: 42746 - DNA, 15 bp, Homo sapiens
ccagtcagaatggct

SEQ ID NO: 42747 - DNA, 15 bp, Homo sapiens
accagtcagaatggc

SEQ ID NO: 42748 - DNA, 15 bp, Homo sapiens
caccagtcagaatgg

SEQ ID NO: 42749 - DNA, 15 bp, Homo sapiens
acaccagtcagaatg

SEQ ID NO: 42750 - DNA, 15 bp, Homo sapiens
cacaccagtcagaat

SEQ ID NO: 42751 - DNA, 15 bp, Homo sapiens
tcacaccagtcagaa

SEQ ID NO: 42752 - DNA, 15 bp, Homo sapiens
ttcacaccagtcaga

SEQ ID NO: 42753 - DNA, 15 bp, Homo sapiens
tttcacaccagtcag

SEQ ID NO: 42754 - DNA, 15 bp, Homo sapiens
atttcacaccagtca

SEQ ID NO: 42755 - DNA, 15 bp, Homo sapiens
aatttcacaccagtc

SEQ ID NO: 42756 - DNA, 15 bp, Homo sapiens
aaatttcacaccagt

SEQ ID NO: 42757 - DNA, 15 bp, Homo sapiens
taaatttcacaccag

SEQ ID NO: 42758 - DNA, 15 bp, Homo sapiens
ataaatttcacacca

SEQ ID NO: 42759 - DNA, 15 bp, Homo sapiens
tataaatttcacacc

SEQ ID NO: 42760 - DNA, 15 bp, Homo sapiens
atataaatttcacac

SEQ ID NO: 42761 - DNA, 15 bp, Homo sapiens
gatataaatttcaca

SEQ ID NO: 42762 - DNA, 15 bp, Homo sapiens
tgatataaatttcac

SEQ ID NO: 42763 - DNA, 15 bp, Homo sapiens
atgatataaatttca

SEQ ID NO: 42764 - DNA, 15 bp, Homo sapiens
aatgatataaatttc

SEQ ID NO: 42765 - DNA, 15 bp, Homo sapiens
caatgatataaattt

SEQ ID NO: 42766 - DNA, 15 bp, Homo sapiens
acaatgatataaatt

SEQ ID NO: 42767 - DNA, 15 bp, Homo sapiens
cacaatgatataaat

SEQ ID NO: 42768 - DNA, 15 bp, Homo sapiens
acacaatgatataaa

SEQ ID NO: 42769 - DNA, 15 bp, Homo sapiens
aacacaatgatataa

SEQ ID NO: 42770 - DNA, 15 bp, Homo sapiens
aaacacaatgatata

SEQ ID NO: 42771 - DNA, 15 bp, Homo sapiens
aaaacacaatgatat

SEQ ID NO: 42772 - DNA, 15 bp, Homo sapiens
aaaaacacaatgata

SEQ ID NO: 42773 - DNA, 15 bp, Homo sapiens
caaaaacacaatgat

SEQ ID NO: 42774 - DNA, 15 bp, Homo sapiens
ccaaaaacacaatga

SEQ ID NO: 42775 - DNA, 15 bp, Homo sapiens
accaaaaacacaatg

SEQ ID NO: 42776 - DNA, 15 bp, Homo sapiens
aaccaaaaacacaat

SEQ ID NO: 42777 - DNA, 15 bp, Homo sapiens
caaccaaaaacacaa

SEQ ID NO: 42778 - DNA, 15 bp, Homo sapiens
ccaaccaaaaacaca

SEQ ID NO: 42779 - DNA, 15 bp, Homo sapiens
gccaaccaaaaacac

SEQ ID NO: 42780 - DNA, 15 bp, Homo sapiens
tgccaaccaaaaaca

SEQ ID NO: 42781 - DNA, 15 bp, Homo sapiens
atgccaaccaaaaac

SEQ ID NO: 42782 - DNA, 15 bp, Homo sapiens
aatgccaaccaaaaa

SEQ ID NO: 42783 - DNA, 15 bp, Homo sapiens
aaatgccaaccaaaa

SEQ ID NO: 42784 - DNA, 15 bp, Homo sapiens
gaaatgccaaccaaa

SEQ ID NO: 42785 - DNA, 15 bp, Homo sapiens
agaaatgccaaccaa

SEQ ID NO: 42786 - DNA, 15 bp, Homo sapiens
gagaaatgccaacca

SEQ ID NO: 42787 - DNA, 15 bp, Homo sapiens
agagaaatgccaacc

SEQ ID NO: 42788 - DNA, 15 bp, Homo sapiens
tagagaaatgccaac

SEQ ID NO: 42789 - DNA, 15 bp, Homo sapiens
ttagagaaatgccaa

SEQ ID NO: 42790 - DNA, 15 bp, Homo sapiens
attagagaaatgcca

SEQ ID NO: 42791 - DNA, 15 bp, Homo sapiens
cattagagaaatgcc

SEQ ID NO: 42792 - DNA, 15 bp, Homo sapiens
tcattagagaaatgc

SEQ ID NO: 42793 - DNA, 15 bp, Homo sapiens
atcattagagaaatg

SEQ ID NO: 42794 - DNA, 15 bp, Homo sapiens
tatcattagagaaat

SEQ ID NO: 42795 - DNA, 15 bp, Homo sapiens
ctatcattagagaaa

SEQ ID NO: 42796 - DNA, 15 bp, Homo sapiens
actatcattagagaa

SEQ ID NO: 42797 - DNA, 15 bp, Homo sapiens
cactatcattagaga

SEQ ID NO: 42798 - DNA, 15 bp, Homo sapiens
tcactatcattagag

SEQ ID NO: 42799 - DNA, 15 bp, Homo sapiens
atcactatcattaga

SEQ ID NO: 42800 - DNA, 15 bp, Homo sapiens
catcactatcattag

SEQ ID NO: 42801 - DNA, 15 bp, Homo sapiens
acatcactatcatta

SEQ ID NO: 42802 - DNA, 15 bp, Homo sapiens
aacatcactatcatt

SEQ ID NO: 42803 - DNA, 15 bp, Homo sapiens
caacatcactatcat

SEQ ID NO: 42804 - DNA, 15 bp, Homo sapiens
tcaacatcactatca

SEQ ID NO: 42805 - DNA, 15 bp, Homo sapiens
ctcaacatcactatc

SEQ ID NO: 42806 - DNA, 15 bp, Homo sapiens
gctcaacatcactat

SEQ ID NO: 42807 - DNA, 15 bp, Homo sapiens
agctcaacatcacta

SEQ ID NO: 42808 - DNA, 15 bp, Homo sapiens
aagctcaacatcact

SEQ ID NO: 42809 - DNA, 15 bp, Homo sapiens
aaagctcaacatcac

SEQ ID NO: 42810 - DNA, 15 bp, Homo sapiens
aaaagctcaacatca

SEQ ID NO: 42811 - DNA, 15 bp, Homo sapiens
aaaaagctcaacatc

SEQ ID NO: 42812 - DNA, 15 bp, Homo sapiens
aaaaaagctcaacat

SEQ ID NO: 42813 - DNA, 15 bp, Homo sapiens
aaaaaaagctcaaca

SEQ ID NO: 42814 - DNA, 15 bp, Homo sapiens
taaaaaaagctcaac

SEQ ID NO: 42815 - DNA, 15 bp, Homo sapiens
ttaaaaaaagctcaa

SEQ ID NO: 42816 - DNA, 15 bp, Homo sapiens
attaaaaaaagctca

SEQ ID NO: 42817 - DNA, 15 bp, Homo sapiens
tattaaaaaaagctc

SEQ ID NO: 42818 - DNA, 15 bp, Homo sapiens
atattaaaaaaagct

SEQ ID NO: 42819 - DNA, 15 bp, Homo sapiens
catattaaaaaaagc

SEQ ID NO: 42820 - DNA, 15 bp, Homo sapiens
gcatattaaaaaaag

SEQ ID NO: 42821 - DNA, 15 bp, Homo sapiens
agcatattaaaaaaa

SEQ ID NO: 42822 - DNA, 15 bp, Homo sapiens
aagcatattaaaaaa

SEQ ID NO: 42823 - DNA, 15 bp, Homo sapiens
caagcatattaaaaa

SEQ ID NO: 42824 - DNA, 15 bp, Homo sapiens
ccaagcatattaaaa

SEQ ID NO: 42825 - DNA, 15 bp, Homo sapiens
gccaagcatattaaa

SEQ ID NO: 42826 - DNA, 15 bp, Homo sapiens
ggccaagcatattaa

SEQ ID NO: 42827 - DNA, 15 bp, Homo sapiens
tggccaagcatatta

SEQ ID NO: 42828 - DNA, 15 bp, Homo sapiens
gtggccaagcatatt

SEQ ID NO: 42829 - DNA, 15 bp, Homo sapiens
tgtggccaagcatat

SEQ ID NO: 42830 - DNA, 15 bp, Homo sapiens
atgtggccaagcata

SEQ ID NO: 42831 - DNA, 15 bp, Homo sapiens
catgtggccaagcat

SEQ ID NO: 42832 - DNA, 15 bp, Homo sapiens
acatgtggccaagca

SEQ ID NO: 42833 - DNA, 15 bp, Homo sapiens
tacatgtggccaagc

SEQ ID NO: 42834 - DNA, 15 bp, Homo sapiens
atacatgtggccaag

SEQ ID NO: 42835 - DNA, 15 bp, Homo sapiens
catacatgtggccaa

SEQ ID NO: 42836 - DNA, 15 bp, Homo sapiens
acatacatgtggcca

SEQ ID NO: 42837 - DNA, 15 bp, Homo sapiens
gacatacatgtggcc

SEQ ID NO: 42838 - DNA, 15 bp, Homo sapiens
agacatacatgtggc

SEQ ID NO: 42839 - DNA, 15 bp, Homo sapiens
aagacatacatgtgg

SEQ ID NO: 42840 - DNA, 15 bp, Homo sapiens
gaagacatacatgtg

SEQ ID NO: 42841 - DNA, 15 bp, Homo sapiens
agaagacatacatgt

SEQ ID NO: 42842 - DNA, 15 bp, Homo sapiens
aagaagacatacatg

SEQ ID NO: 42843 - DNA, 15 bp, Homo sapiens
aaagaagacatacat

SEQ ID NO: 42844 - DNA, 15 bp, Homo sapiens
aaaagaagacataca

SEQ ID NO: 42845 - DNA, 15 bp, Homo sapiens
taaaagaagacatac

SEQ ID NO: 42846 - DNA, 15 bp, Homo sapiens
ataaaagaagacata

SEQ ID NO: 42847 - DNA, 15 bp, Homo sapiens
aataaaagaagacat

SEQ ID NO: 42848 - DNA, 15 bp, Homo sapiens
aaataaaagaagaca

SEQ ID NO: 42849 - DNA, 15 bp, Homo sapiens
taaataaaagaagac

SEQ ID NO: 42850 - DNA, 15 bp, Homo sapiens
ttaaataaaagaaga

SEQ ID NO: 42851 - DNA, 15 bp, Homo sapiens
tttaaataaaagaag

SEQ ID NO: 42852 - DNA, 15 bp, Homo sapiens
ctttaaataaaagaa

SEQ ID NO: 42853 - DNA, 15 bp, Homo sapiens
gctttaaataaaaga

SEQ ID NO: 42854 - DNA, 15 bp, Homo sapiens
tgctttaaataaaag

SEQ ID NO: 42855 - DNA, 15 bp, Homo sapiens
ttgctttaaataaaa

SEQ ID NO: 42856 - DNA, 15 bp, Homo sapiens
attgctttaaataaa

SEQ ID NO: 42857 - DNA, 15 bp, Homo sapiens
aattgctttaaataa

SEQ ID NO: 42858 - DNA, 15 bp, Homo sapiens
aaattgctttaaata

SEQ ID NO: 42859 - DNA, 15 bp, Homo sapiens
gaaattgctttaaat

SEQ ID NO: 42860 - DNA, 15 bp, Homo sapiens
tgaaattgctttaaa

SEQ ID NO: 42861 - DNA, 15 bp, Homo sapiens
gtgaaattgctttaa

SEQ ID NO: 42862 - DNA, 15 bp, Homo sapiens
tgtgaaattgcttta

SEQ ID NO: 42863 - DNA, 15 bp, Homo sapiens
atgtgaaattgcttt

SEQ ID NO: 42864 - DNA, 15 bp, Homo sapiens
tatgtgaaattgctt

SEQ ID NO: 42865 - DNA, 15 bp, Homo sapiens
ttatgtgaaattgct

SEQ ID NO: 42866 - DNA, 15 bp, Homo sapiens
cttatgtgaaattgc

SEQ ID NO: 42867 - DNA, 15 bp, Homo sapiens
gcttatgtgaaattg

SEQ ID NO: 42868 - DNA, 15 bp, Homo sapiens
agcttatgtgaaatt

SEQ ID NO: 42869 - DNA, 15 bp, Homo sapiens
tagcttatgtgaaat

SEQ ID NO: 42870 - DNA, 15 bp, Homo sapiens
gtagcttatgtgaaa

SEQ ID NO: 42871 - DNA, 15 bp, Homo sapiens
tgtagcttatgtgaa

SEQ ID NO: 42872 - DNA, 15 bp, Homo sapiens
ctgtagcttatgtga

SEQ ID NO: 42873 - DNA, 15 bp, Homo sapiens
gctgtagcttatgtg

SEQ ID NO: 42874 - DNA, 15 bp, Homo sapiens
cgctgtagcttatgt

SEQ ID NO: 42875 - DNA, 15 bp, Homo sapiens
tcgctgtagcttatg

SEQ ID NO: 42876 - DNA, 15 bp, Homo sapiens
atcgctgtagcttat

SEQ ID NO: 42877 - DNA, 15 bp, Homo sapiens
catcgctgtagctta

SEQ ID NO: 42878 - DNA, 15 bp, Homo sapiens
acatcgctgtagctt

SEQ ID NO: 42879 - DNA, 15 bp, Homo sapiens
aacatcgctgtagct

SEQ ID NO: 42880 - DNA, 15 bp, Homo sapiens
gaacatcgctgtagc

SEQ ID NO: 42881 - DNA, 15 bp, Homo sapiens
agaacatcgctgtag

SEQ ID NO: 42882 - DNA, 15 bp, Homo sapiens
aagaacatcgctgta

SEQ ID NO: 42883 - DNA, 15 bp, Homo sapiens
taagaacatcgctgt

SEQ ID NO: 42884 - DNA, 15 bp, Homo sapiens
ttaagaacatcgctg

SEQ ID NO: 42885 - DNA, 15 bp, Homo sapiens
cttaagaacatcgct

SEQ ID NO: 42886 - DNA, 15 bp, Homo sapiens
acttaagaacatcgc

SEQ ID NO: 42887 - DNA, 15 bp, Homo sapiens
gacttaagaacatcg

SEQ ID NO: 42888 - DNA, 15 bp, Homo sapiens
agacttaagaacatc

SEQ ID NO: 42889 - DNA, 15 bp, Homo sapiens
aagacttaagaacat

SEQ ID NO: 42890 - DNA, 15 bp, Homo sapiens
caagacttaagaaca

SEQ ID NO: 42891 - DNA, 15 bp, Homo sapiens
ccaagacttaagaac

SEQ ID NO: 42892 - DNA, 15 bp, Homo sapiens
cccaagacttaagaa

SEQ ID NO: 42893 - DNA, 15 bp, Homo sapiens
tcccaagacttaaga

SEQ ID NO: 42894 - DNA, 15 bp, Homo sapiens
ttcccaagacttaag

SEQ ID NO: 42895 - DNA, 15 bp, Homo sapiens
tttcccaagacttaa

SEQ ID NO: 42896 - DNA, 15 bp, Homo sapiens
ttttcccaagactta

SEQ ID NO: 42897 - DNA, 15 bp, Homo sapiens
gttttcccaagactt

SEQ ID NO: 42898 - DNA, 15 bp, Homo sapiens
tgttttcccaagact

SEQ ID NO: 42899 - DNA, 15 bp, Homo sapiens
ctgttttcccaagac

SEQ ID NO: 42900 - DNA, 15 bp, Homo sapiens
tctgttttcccaaga

SEQ ID NO: 42901 - DNA, 15 bp, Homo sapiens
ctctgttttcccaag

SEQ ID NO: 42902 - DNA, 15 bp, Homo sapiens
cctctgttttcccaa

SEQ ID NO: 42903 - DNA, 15 bp, Homo sapiens
ccctctgttttccca

SEQ ID NO: 42904 - DNA, 15 bp, Homo sapiens
gccctctgttttccc

SEQ ID NO: 42905 - DNA, 15 bp, Homo sapiens
tgccctctgttttcc

SEQ ID NO: 42906 - DNA, 15 bp, Homo sapiens
atgccctctgttttc

SEQ ID NO: 42907 - DNA, 15 bp, Homo sapiens
tatgccctctgtttt

SEQ ID NO: 42908 - DNA, 15 bp, Homo sapiens
gtatgccctctgttt

SEQ ID NO: 42909 - DNA, 15 bp, Homo sapiens
agtatgccctctgtt

SEQ ID NO: 42910 - DNA, 15 bp, Homo sapiens
aagtatgccctctgt

SEQ ID NO: 42911 - DNA, 15 bp, Homo sapiens
aaagtatgccctctg

SEQ ID NO: 42912 - DNA, 15 bp, Homo sapiens
taaagtatgccctct

SEQ ID NO: 42913 - DNA, 15 bp, Homo sapiens
ttaaagtatgccctc

SEQ ID NO: 42914 - DNA, 15 bp, Homo sapiens
tttaaagtatgccct

SEQ ID NO: 42915 - DNA, 15 bp, Homo sapiens
ttttaaagtatgccc

SEQ ID NO: 42916 - DNA, 15 bp, Homo sapiens
attttaaagtatgcc

SEQ ID NO: 42917 - DNA, 15 bp, Homo sapiens
cattttaaagtatgc

SEQ ID NO: 42918 - DNA, 15 bp, Homo sapiens
acattttaaagtatg

SEQ ID NO: 42919 - DNA, 15 bp, Homo sapiens
tacattttaaagtat

SEQ ID NO: 42920 - DNA, 15 bp, Homo sapiens
ctacattttaaagta

SEQ ID NO: 42921 - DNA, 15 bp, Homo sapiens
cctacattttaaagt

SEQ ID NO: 42922 - DNA, 15 bp, Homo sapiens
acctacattttaaag

SEQ ID NO: 42923 - DNA, 15 bp, Homo sapiens
aacctacattttaaa

SEQ ID NO: 42924 - DNA, 15 bp, Homo sapiens
gaacctacattttaa

SEQ ID NO: 42925 - DNA, 15 bp, Homo sapiens
agaacctacatttta

SEQ ID NO: 42926 - DNA, 15 bp, Homo sapiens
cagaacctacatttt

SEQ ID NO: 42927 - DNA, 15 bp, Homo sapiens
acagaacctacattt

SEQ ID NO: 42928 - DNA, 15 bp, Homo sapiens
cacagaacctacatt

SEQ ID NO: 42929 - DNA, 15 bp, Homo sapiens
tcacagaacctacat

SEQ ID NO: 42930 - DNA, 15 bp, Homo sapiens
ttcacagaacctaca

SEQ ID NO: 42931 - DNA, 15 bp, Homo sapiens
cttcacagaacctac

SEQ ID NO: 42932 - DNA, 15 bp, Homo sapiens
ccttcacagaaccta

SEQ ID NO: 42933 - DNA, 15 bp, Homo sapiens
gccttcacagaacct

SEQ ID NO: 42934 - DNA, 15 bp, Homo sapiens
tgccttcacagaacc

SEQ ID NO: 42935 - DNA, 15 bp, Homo sapiens
ctgccttcacagaac

SEQ ID NO: 42936 - DNA, 15 bp, Homo sapiens
actgccttcacagaa

SEQ ID NO: 42937 - DNA, 15 bp, Homo sapiens
aactgccttcacaga

SEQ ID NO: 42938 - DNA, 15 bp, Homo sapiens
caactgccttcacag

SEQ ID NO: 42939 - DNA, 15 bp, Homo sapiens
acaactgccttcaca

SEQ ID NO: 42940 - DNA, 15 bp, Homo sapiens
cacaactgccttcac

SEQ ID NO: 42941 - DNA, 15 bp, Homo sapiens
gcacaactgccttca

SEQ ID NO: 42942 - DNA, 15 bp, Homo sapiens
tgcacaactgccttc

SEQ ID NO: 42943 - DNA, 15 bp, Homo sapiens
ctgcacaactgcctt

SEQ ID NO: 42944 - DNA, 15 bp, Homo sapiens
cctgcacaactgcct

SEQ ID NO: 42945 - DNA, 15 bp, Homo sapiens
gcctgcacaactgcc

SEQ ID NO: 42946 - DNA, 15 bp, Homo sapiens
tgcctgcacaactgc

SEQ ID NO: 42947 - DNA, 15 bp, Homo sapiens
gtgcctgcacaactg

SEQ ID NO: 42948 - DNA, 15 bp, Homo sapiens
tgtgcctgcacaact

SEQ ID NO: 42949 - DNA, 15 bp, Homo sapiens
ctgtgcctgcacaac

SEQ ID NO: 42950 - DNA, 15 bp, Homo sapiens
cctgtgcctgcacaa

SEQ ID NO: 42951 - DNA, 15 bp, Homo sapiens
ccctgtgcctgcaca

SEQ ID NO: 42952 - DNA, 15 bp, Homo sapiens
accctgtgcctgcac

SEQ ID NO: 42953 - DNA, 15 bp, Homo sapiens
taccctgtgcctgca

SEQ ID NO: 42954 - DNA, 15 bp, Homo sapiens
ctaccctgtgcctgc

SEQ ID NO: 42955 - DNA, 15 bp, Homo sapiens
tctaccctgtgcctg

SEQ ID NO: 42956 - DNA, 15 bp, Homo sapiens
atctaccctgtgcct

SEQ ID NO: 42957 - DNA, 15 bp, Homo sapiens
aatctaccctgtgcc

SEQ ID NO: 42958 - DNA, 15 bp, Homo sapiens
gaatctaccctgtgc

SEQ ID NO: 42959 - DNA, 15 bp, Homo sapiens
ggaatctaccctgtg

SEQ ID NO: 42960 - DNA, 15 bp, Homo sapiens
aggaatctaccctgt

SEQ ID NO: 42961 - DNA, 15 bp, Homo sapiens
taggaatctaccctg

SEQ ID NO: 42962 - DNA, 15 bp, Homo sapiens
ataggaatctaccct

SEQ ID NO: 42963 - DNA, 15 bp, Homo sapiens
tataggaatctaccc

SEQ ID NO: 42964 - DNA, 15 bp, Homo sapiens
atataggaatctacc

SEQ ID NO: 42965 - DNA, 15 bp, Homo sapiens
catataggaatctac

SEQ ID NO: 42966 - DNA, 15 bp, Homo sapiens
acatataggaatcta

SEQ ID NO: 42967 - DNA, 15 bp, Homo sapiens
cacatataggaatct

SEQ ID NO: 42968 - DNA, 15 bp, Homo sapiens
ccacatataggaatc

SEQ ID NO: 42969 - DNA, 15 bp, Homo sapiens
gccacatataggaat

SEQ ID NO: 42970 - DNA, 15 bp, Homo sapiens
agccacatataggaa

SEQ ID NO: 42971 - DNA, 15 bp, Homo sapiens
aagccacatatagga

SEQ ID NO: 42972 - DNA, 15 bp, Homo sapiens
taagccacatatagg

SEQ ID NO: 42973 - DNA, 15 bp, Homo sapiens
ctaagccacatatag

SEQ ID NO: 42974 - DNA, 15 bp, Homo sapiens
cctaagccacatata

SEQ ID NO: 42975 - DNA, 15 bp, Homo sapiens
acctaagccacatat

SEQ ID NO: 42976 - DNA, 15 bp, Homo sapiens
tacctaagccacata

SEQ ID NO: 42977 - DNA, 15 bp, Homo sapiens
ttacctaagccacat

SEQ ID NO: 42978 - DNA, 15 bp, Homo sapiens
cttacctaagccaca

SEQ ID NO: 42979 - DNA, 15 bp, Homo sapiens
gcttacctaagccac

SEQ ID NO: 42980 - DNA, 15 bp, Homo sapiens
agcttacctaagcca

SEQ ID NO: 42981 - DNA, 15 bp, Homo sapiens
aagcttacctaagcc

SEQ ID NO: 42982 - DNA, 15 bp, Homo sapiens
aaagcttacctaagc

SEQ ID NO: 42983 - DNA, 15 bp, Homo sapiens
caaagcttacctaag

SEQ ID NO: 42984 - DNA, 15 bp, Homo sapiens
acaaagcttacctaa

SEQ ID NO: 42985 - DNA, 15 bp, Homo sapiens
cacaaagcttaccta

SEQ ID NO: 42986 - DNA, 15 bp, Homo sapiens
tcacaaagcttacct

SEQ ID NO: 42987 - DNA, 15 bp, Homo sapiens
atcacaaagcttacc

SEQ ID NO: 42988 - DNA, 15 bp, Homo sapiens
catcacaaagcttac

SEQ ID NO: 42989 - DNA, 15 bp, Homo sapiens
tcatcacaaagctta

SEQ ID NO: 42990 - DNA, 15 bp, Homo sapiens
atcatcacaaagctt

SEQ ID NO: 42991 - DNA, 15 bp, Homo sapiens
aatcatcacaaagct

SEQ ID NO: 42992 - DNA, 15 bp, Homo sapiens
aaatcatcacaaagc

SEQ ID NO: 42993 - DNA, 15 bp, Homo sapiens
caaatcatcacaaag

SEQ ID NO: 42994 - DNA, 15 bp, Homo sapiens
ccaaatcatcacaaa

SEQ ID NO: 42995 - DNA, 15 bp, Homo sapiens
accaaatcatcacaa

SEQ ID NO: 42996 - DNA, 15 bp, Homo sapiens
taccaaatcatcaca

SEQ ID NO: 42997 - DNA, 15 bp, Homo sapiens
ataccaaatcatcac

SEQ ID NO: 42998 - DNA, 15 bp, Homo sapiens
tataccaaatcatca

SEQ ID NO: 42999 - DNA, 15 bp, Homo sapiens
ttataccaaatcatc

SEQ ID NO: 43000 - DNA, 15 bp, Homo sapiens
gttataccaaatcat

SEQ ID NO: 43001 - DNA, 15 bp, Homo sapiens
tgttataccaaatca

SEQ ID NO: 43002 - DNA, 15 bp, Homo sapiens
ttgttataccaaatc

SEQ ID NO: 43003 - DNA, 15 bp, Homo sapiens
tttgttataccaaat

SEQ ID NO: 43004 - DNA, 15 bp, Homo sapiens
ctttgttataccaaa

SEQ ID NO: 43005 - DNA, 15 bp, Homo sapiens
actttgttataccaa

SEQ ID NO: 43006 - DNA, 15 bp, Homo sapiens
cactttgttatacca

SEQ ID NO: 43007 - DNA, 15 bp, Homo sapiens
ccactttgttatacc

SEQ ID NO: 43008 - DNA, 15 bp, Homo sapiens
accactttgttatac

SEQ ID NO: 43009 - DNA, 15 bp, Homo sapiens
taccactttgttata

SEQ ID NO: 43010 - DNA, 15 bp, Homo sapiens
ttaccactttgttat

SEQ ID NO: 43011 - DNA, 15 bp, Homo sapiens
tttaccactttgtta

SEQ ID NO: 43012 - DNA, 15 bp, Homo sapiens
ctttaccactttgtt

SEQ ID NO: 43013 - DNA, 15 bp, Homo sapiens
actttaccactttgt

SEQ ID NO: 43014 - DNA, 15 bp, Homo sapiens
aactttaccactttg

SEQ ID NO: 43015 - DNA, 15 bp, Homo sapiens
aaactttaccacttt

SEQ ID NO: 43016 - DNA, 15 bp, Homo sapiens
aaaactttaccactt

SEQ ID NO: 43017 - DNA, 15 bp, Homo sapiens
aaaaactttaccact

SEQ ID NO: 43018 - DNA, 15 bp, Homo sapiens
taaaaactttaccac

SEQ ID NO: 43019 - DNA, 15 bp, Homo sapiens
ataaaaactttacca

SEQ ID NO: 43020 - DNA, 15 bp, Homo sapiens
aataaaaactttacc

SEQ ID NO: 43021 - DNA, 15 bp, Homo sapiens
taataaaaactttac

SEQ ID NO: 43022 - DNA, 15 bp, Homo sapiens
ataataaaaacttta

SEQ ID NO: 43023 - DNA, 15 bp, Homo sapiens
gataataaaaacttt

SEQ ID NO: 43024 - DNA, 15 bp, Homo sapiens
agataataaaaactt

SEQ ID NO: 43025 - DNA, 15 bp, Homo sapiens
aagataataaaaact

SEQ ID NO: 43026 - DNA, 15 bp, Homo sapiens
caagataataaaaac

SEQ ID NO: 43027 - DNA, 15 bp, Homo sapiens
tcaagataataaaaa

SEQ ID NO: 43028 - DNA, 15 bp, Homo sapiens
ctcaagataataaaa

SEQ ID NO: 43029 - DNA, 15 bp, Homo sapiens
tctcaagataataaa

SEQ ID NO: 43030 - DNA, 15 bp, Homo sapiens
ttctcaagataataa

SEQ ID NO: 43031 - DNA, 15 bp, Homo sapiens
attctcaagataata

SEQ ID NO: 43032 - DNA, 15 bp, Homo sapiens
tattctcaagataat

SEQ ID NO: 43033 - DNA, 15 bp, Homo sapiens
gtattctcaagataa

SEQ ID NO: 43034 - DNA, 15 bp, Homo sapiens
tgtattctcaagata

SEQ ID NO: 43035 - DNA, 15 bp, Homo sapiens
ctgtattctcaagat

SEQ ID NO: 43036 - DNA, 15 bp, Homo sapiens
gctgtattctcaaga

SEQ ID NO: 43037 - DNA, 15 bp, Homo sapiens
tgctgtattctcaag

SEQ ID NO: 43038 - DNA, 15 bp, Homo sapiens
ctgctgtattctcaa

SEQ ID NO: 43039 - DNA, 15 bp, Homo sapiens
actgctgtattctca

SEQ ID NO: 43040 - DNA, 15 bp, Homo sapiens
aactgctgtattctc

SEQ ID NO: 43041 - DNA, 15 bp, Homo sapiens
caactgctgtattct

SEQ ID NO: 43042 - DNA, 15 bp, Homo sapiens
ccaactgctgtattc

SEQ ID NO: 43043 - DNA, 15 bp, Homo sapiens
accaactgctgtatt

SEQ ID NO: 43044 - DNA, 15 bp, Homo sapiens
taccaactgctgtat

SEQ ID NO: 43045 - DNA, 15 bp, Homo sapiens
ataccaactgctgta

SEQ ID NO: 43046 - DNA, 15 bp, Homo sapiens
aataccaactgctgt

SEQ ID NO: 43047 - DNA, 15 bp, Homo sapiens
gaataccaactgctg

SEQ ID NO: 43048 - DNA, 15 bp, Homo sapiens
ggaataccaactgct

SEQ ID NO: 43049 - DNA, 15 bp, Homo sapiens
gggaataccaactgc

SEQ ID NO: 43050 - DNA, 15 bp, Homo sapiens
agggaataccaactg

SEQ ID NO: 43051 - DNA, 15 bp, Homo sapiens
aagggaataccaact

SEQ ID NO: 43052 - DNA, 15 bp, Homo sapiens
taagggaataccaac

SEQ ID NO: 43053 - DNA, 15 bp, Homo sapiens
ctaagggaataccaa

SEQ ID NO: 43054 - DNA, 15 bp, Homo sapiens
tctaagggaatacca

SEQ ID NO: 43055 - DNA, 15 bp, Homo sapiens
gtctaagggaatacc

SEQ ID NO: 43056 - DNA, 15 bp, Homo sapiens
ggtctaagggaatac

SEQ ID NO: 43057 - DNA, 15 bp, Homo sapiens
tggtctaagggaata

SEQ ID NO: 43058 - DNA, 15 bp, Homo sapiens
ctggtctaagggaat

SEQ ID NO: 43059 - DNA, 15 bp, Homo sapiens
tctggtctaagggaa

SEQ ID NO: 43060 - DNA, 15 bp, Homo sapiens
atctggtctaaggga

SEQ ID NO: 43061 - DNA, 15 bp, Homo sapiens
aatctggtctaaggg

SEQ ID NO: 43062 - DNA, 15 bp, Homo sapiens
gaatctggtctaagg

SEQ ID NO: 43063 - DNA, 15 bp, Homo sapiens
ggaatctggtctaag

SEQ ID NO: 43064 - DNA, 15 bp, Homo sapiens
aggaatctggtctaa

SEQ ID NO: 43065 - DNA, 15 bp, Homo sapiens
aaggaatctggtcta

SEQ ID NO: 43066 - DNA, 15 bp, Homo sapiens
gaaggaatctggtct

SEQ ID NO: 43067 - DNA, 15 bp, Homo sapiens
tgaaggaatctggtc

SEQ ID NO: 43068 - DNA, 15 bp, Homo sapiens
gtgaaggaatctggt

SEQ ID NO: 43069 - DNA, 15 bp, Homo sapiens
tgtgaaggaatctgg

SEQ ID NO: 43070 - DNA, 15 bp, Homo sapiens
atgtgaaggaatctg

SEQ ID NO: 43071 - DNA, 15 bp, Homo sapiens
gatgtgaaggaatct

SEQ ID NO: 43072 - DNA, 15 bp, Homo sapiens
agatgtgaaggaatc

SEQ ID NO: 43073 - DNA, 15 bp, Homo sapiens
gagatgtgaaggaat

SEQ ID NO: 43074 - DNA, 15 bp, Homo sapiens
agagatgtgaaggaa

SEQ ID NO: 43075 - DNA, 15 bp, Homo sapiens
cagagatgtgaagga

SEQ ID NO: 43076 - DNA, 15 bp, Homo sapiens
ccagagatgtgaagg

SEQ ID NO: 43077 - DNA, 15 bp, Homo sapiens
tccagagatgtgaag

SEQ ID NO: 43078 - DNA, 15 bp, Homo sapiens
atccagagatgtgaa

SEQ ID NO: 43079 - DNA, 15 bp, Homo sapiens
catccagagatgtga

SEQ ID NO: 43080 - DNA, 15 bp, Homo sapiens
tcatccagagatgtg

SEQ ID NO: 43081 - DNA, 15 bp, Homo sapiens
gtcatccagagatgt

SEQ ID NO: 43082 - DNA, 15 bp, Homo sapiens
agtcatccagagatg

SEQ ID NO: 43083 - DNA, 15 bp, Homo sapiens
cagtcatccagagat

SEQ ID NO: 43084 - DNA, 15 bp, Homo sapiens
ccagtcatccagaga

SEQ ID NO: 43085 - DNA, 15 bp, Homo sapiens
cccagtcatccagag

SEQ ID NO: 43086 - DNA, 15 bp, Homo sapiens
gcccagtcatccaga

SEQ ID NO: 43087 - DNA, 15 bp, Homo sapiens
agcccagtcatccag

SEQ ID NO: 43088 - DNA, 15 bp, Homo sapiens
cagcccagtcatcca

SEQ ID NO: 43089 - DNA, 15 bp, Homo sapiens
gcagcccagtcatcc

SEQ ID NO: 43090 - DNA, 15 bp, Homo sapiens
tgcagcccagtcatc

SEQ ID NO: 43091 - DNA, 15 bp, Homo sapiens
gtgcagcccagtcat

SEQ ID NO: 43092 - DNA, 15 bp, Homo sapiens
ggtgcagcccagtca

SEQ ID NO: 43093 - DNA, 15 bp, Homo sapiens
aggtgcagcccagtc

SEQ ID NO: 43094 - DNA, 15 bp, Homo sapiens
caggtgcagcccagt

SEQ ID NO: 43095 - DNA, 15 bp, Homo sapiens
tcaggtgcagcccag

SEQ ID NO: 43096 - DNA, 15 bp, Homo sapiens
atcaggtgcagccca

SEQ ID NO: 43097 - DNA, 15 bp, Homo sapiens
aatcaggtgcagccc

SEQ ID NO: 43098 - DNA, 15 bp, Homo sapiens
gaatcaggtgcagcc

SEQ ID NO: 43099 - DNA, 15 bp, Homo sapiens
ggaatcaggtgcagc

SEQ ID NO: 43100 - DNA, 15 bp, Homo sapiens
aggaatcaggtgcag

SEQ ID NO: 43101 - DNA, 15 bp, Homo sapiens
aaggaatcaggtgca

SEQ ID NO: 43102 - DNA, 15 bp, Homo sapiens
taaggaatcaggtgc

SEQ ID NO: 43103 - DNA, 15 bp, Homo sapiens
ttaaggaatcaggtg

SEQ ID NO: 43104 - DNA, 15 bp, Homo sapiens
cttaaggaatcaggt

SEQ ID NO: 43105 - DNA, 15 bp, Homo sapiens
gcttaaggaatcagg

SEQ ID NO: 43106 - DNA, 15 bp, Homo sapiens
ggcttaaggaatcag

SEQ ID NO: 43107 - DNA, 15 bp, Homo sapiens
aggcttaaggaatca

SEQ ID NO: 43108 - DNA, 15 bp, Homo sapiens
caggcttaaggaatc

SEQ ID NO: 43109 - DNA, 15 bp, Homo sapiens
ccaggcttaaggaat

SEQ ID NO: 43110 - DNA, 15 bp, Homo sapiens
gccaggcttaaggaa

SEQ ID NO: 43111 - DNA, 15 bp, Homo sapiens
agccaggcttaagga

SEQ ID NO: 43112 - DNA, 15 bp, Homo sapiens
cagccaggcttaagg

SEQ ID NO: 43113 - DNA, 15 bp, Homo sapiens
ccagccaggcttaag

SEQ ID NO: 43114 - DNA, 15 bp, Homo sapiens
tccagccaggcttaa

SEQ ID NO: 43115 - DNA, 15 bp, Homo sapiens
ctccagccaggctta

SEQ ID NO: 43116 - DNA, 15 bp, Homo sapiens
actccagccaggctt

SEQ ID NO: 43117 - DNA, 15 bp, Homo sapiens
gactccagccaggct

SEQ ID NO: 43118 - DNA, 15 bp, Homo sapiens
tgactccagccaggc

SEQ ID NO: 43119 - DNA, 15 bp, Homo sapiens
ttgactccagccagg

SEQ ID NO: 43120 - DNA, 15 bp, Homo sapiens
cttgactccagccag

SEQ ID NO: 43121 - DNA, 15 bp, Homo sapiens
ccttgactccagcca

SEQ ID NO: 43122 - DNA, 15 bp, Homo sapiens
tccttgactccagcc

SEQ ID NO: 43123 - DNA, 15 bp, Homo sapiens
ctccttgactccagc

SEQ ID NO: 43124 - DNA, 15 bp, Homo sapiens
actccttgactccag

SEQ ID NO: 43125 - DNA, 15 bp, Homo sapiens
gactccttgactcca

SEQ ID NO: 43126 - DNA, 15 bp, Homo sapiens
agactccttgactcc

SEQ ID NO: 43127 - DNA, 15 bp, Homo sapiens
cagactccttgactc

SEQ ID NO: 43128 - DNA, 15 bp, Homo sapiens
acagactccttgact

SEQ ID NO: 43129 - DNA, 15 bp, Homo sapiens
tacagactccttgac

SEQ ID NO: 43130 - DNA, 15 bp, Homo sapiens
atacagactccttga

SEQ ID NO: 43131 - DNA, 15 bp, Homo sapiens
aatacagactccttg

SEQ ID NO: 43132 - DNA, 15 bp, Homo sapiens
gaatacagactcctt

SEQ ID NO: 43133 - DNA, 15 bp, Homo sapiens
agaatacagactcct

SEQ ID NO: 43134 - DNA, 15 bp, Homo sapiens
tagaatacagactcc

SEQ ID NO: 43135 - DNA, 15 bp, Homo sapiens
ttagaatacagactc

SEQ ID NO: 43136 - DNA, 15 bp, Homo sapiens
cttagaatacagact

SEQ ID NO: 43137 - DNA, 15 bp, Homo sapiens
tcttagaatacagac

SEQ ID NO: 43138 - DNA, 15 bp, Homo sapiens
gtcttagaatacaga

SEQ ID NO: 43139 - DNA, 15 bp, Homo sapiens
tgtcttagaatacag

SEQ ID NO: 43140 - DNA, 15 bp, Homo sapiens
ttgtcttagaataca

SEQ ID NO: 43141 - DNA, 15 bp, Homo sapiens
attgtcttagaatac

SEQ ID NO: 43142 - DNA, 15 bp, Homo sapiens
aattgtcttagaata

SEQ ID NO: 43143 - DNA, 15 bp, Homo sapiens
gaattgtcttagaat

SEQ ID NO: 43144 - DNA, 15 bp, Homo sapiens
agaattgtcttagaa

SEQ ID NO: 43145 - DNA, 15 bp, Homo sapiens
gagaattgtcttaga

SEQ ID NO: 43146 - DNA, 15 bp, Homo sapiens
ggagaattgtcttag

SEQ ID NO: 43147 - DNA, 15 bp, Homo sapiens
tggagaattgtctta

SEQ ID NO: 43148 - DNA, 15 bp, Homo sapiens
ctggagaattgtctt

SEQ ID NO: 43149 - DNA, 15 bp, Homo sapiens
cctggagaattgtct

SEQ ID NO: 43150 - DNA, 15 bp, Homo sapiens
ccctggagaattgtc

SEQ ID NO: 43151 - DNA, 15 bp, Homo sapiens
cccctggagaattgt

SEQ ID NO: 43152 - DNA, 15 bp, Homo sapiens
tcccctggagaattg

SEQ ID NO: 43153 - DNA, 15 bp, Homo sapiens
atcccctggagaatt

SEQ ID NO: 43154 - DNA, 15 bp, Homo sapiens
aatcccctggagaat

SEQ ID NO: 43155 - DNA, 15 bp, Homo sapiens
gaatcccctggagaa

SEQ ID NO: 43156 - DNA, 15 bp, Homo sapiens
agaatcccctggaga

SEQ ID NO: 43157 - DNA, 15 bp, Homo sapiens
cagaatcccctggag

SEQ ID NO: 43158 - DNA, 15 bp, Homo sapiens
tcagaatcccctgga

SEQ ID NO: 43159 - DNA, 15 bp, Homo sapiens
atcagaatcccctgg

SEQ ID NO: 43160 - DNA, 15 bp, Homo sapiens
catcagaatcccctg

SEQ ID NO: 43161 - DNA, 15 bp, Homo sapiens
acatcagaatcccct

SEQ ID NO: 43162 - DNA, 15 bp, Homo sapiens
aacatcagaatcccc

SEQ ID NO: 43163 - DNA, 15 bp, Homo sapiens
aaacatcagaatccc

SEQ ID NO: 43164 - DNA, 15 bp, Homo sapiens
aaaacatcagaatcc

SEQ ID NO: 43165 - DNA, 15 bp, Homo sapiens
caaaacatcagaatc

SEQ ID NO: 43166 - DNA, 15 bp, Homo sapiens
gcaaaacatcagaat

SEQ ID NO: 43167 - DNA, 15 bp, Homo sapiens
agcaaaacatcagaa

SEQ ID NO: 43168 - DNA, 15 bp, Homo sapiens
tagcaaaacatcaga

SEQ ID NO: 43169 - DNA, 15 bp, Homo sapiens
gtagcaaaacatcag

SEQ ID NO: 43170 - DNA, 15 bp, Homo sapiens
tgtagcaaaacatca

SEQ ID NO: 43171 - DNA, 15 bp, Homo sapiens
atgtagcaaaacatc

SEQ ID NO: 43172 - DNA, 15 bp, Homo sapiens
gatgtagcaaaacat

SEQ ID NO: 43173 - DNA, 15 bp, Homo sapiens
agatgtagcaaaaca

SEQ ID NO: 43174 - DNA, 15 bp, Homo sapiens
cagatgtagcaaaac

SEQ ID NO: 43175 - DNA, 15 bp, Homo sapiens
ccagatgtagcaaaa

SEQ ID NO: 43176 - DNA, 15 bp, Homo sapiens
cccagatgtagcaaa

SEQ ID NO: 43177 - DNA, 15 bp, Homo sapiens
tcccagatgtagcaa

SEQ ID NO: 43178 - DNA, 15 bp, Homo sapiens
ttcccagatgtagca

SEQ ID NO: 43179 - DNA, 15 bp, Homo sapiens
attcccagatgtagc

SEQ ID NO: 43180 - DNA, 15 bp, Homo sapiens
aattcccagatgtag

SEQ ID NO: 43181 - DNA, 15 bp, Homo sapiens
aaattcccagatgta

SEQ ID NO: 43182 - DNA, 15 bp, Homo sapiens
caaattcccagatgt

SEQ ID NO: 43183 - DNA, 15 bp, Homo sapiens
acaaattcccagatg

SEQ ID NO: 43184 - DNA, 15 bp, Homo sapiens
cacaaattcccagat

SEQ ID NO: 43185 - DNA, 15 bp, Homo sapiens
gcacaaattcccaga

SEQ ID NO: 43186 - DNA, 15 bp, Homo sapiens
tgcacaaattcccag

SEQ ID NO: 43187 - DNA, 15 bp, Homo sapiens
ctgcacaaattccca

SEQ ID NO: 43188 - DNA, 15 bp, Homo sapiens
actgcacaaattccc

SEQ ID NO: 43189 - DNA, 15 bp, Homo sapiens
cactgcacaaattcc

SEQ ID NO: 43190 - DNA, 15 bp, Homo sapiens
acactgcacaaattc

SEQ ID NO: 43191 - DNA, 15 bp, Homo sapiens
tacactgcacaaatt

SEQ ID NO: 43192 - DNA, 15 bp, Homo sapiens
gtacactgcacaaat

SEQ ID NO: 43193 - DNA, 15 bp, Homo sapiens
agtacactgcacaaa

SEQ ID NO: 43194 - DNA, 15 bp, Homo sapiens
tagtacactgcacaa

SEQ ID NO: 43195 - DNA, 15 bp, Homo sapiens
atagtacactgcaca

SEQ ID NO: 43196 - DNA, 15 bp, Homo sapiens
aatagtacactgcac

SEQ ID NO: 43197 - DNA, 15 bp, Homo sapiens
gaatagtacactgca

SEQ ID NO: 43198 - DNA, 15 bp, Homo sapiens
agaatagtacactgc

SEQ ID NO: 43199 - DNA, 15 bp, Homo sapiens
aagaatagtacactg

SEQ ID NO: 43200 - DNA, 15 bp, Homo sapiens
aaagaatagtacact

SEQ ID NO: 43201 - DNA, 15 bp, Homo sapiens
aaaagaatagtacac

SEQ ID NO: 43202 - DNA, 15 bp, Homo sapiens
aaaaagaatagtaca

SEQ ID NO: 43203 - DNA, 15 bp, Homo sapiens
caaaaagaatagtac

SEQ ID NO: 43204 - DNA, 15 bp, Homo sapiens
tcaaaaagaatagta

SEQ ID NO: 43205 - DNA, 15 bp, Homo sapiens
gtcaaaaagaatagt

SEQ ID NO: 43206 - DNA, 15 bp, Homo sapiens
ggtcaaaaagaatag

SEQ ID NO: 43207 - DNA, 15 bp, Homo sapiens
tggtcaaaaagaata

SEQ ID NO: 43208 - DNA, 15 bp, Homo sapiens
atggtcaaaaagaat

SEQ ID NO: 43209 - DNA, 15 bp, Homo sapiens
catggtcaaaaagaa

SEQ ID NO: 43210 - DNA, 15 bp, Homo sapiens
tcatggtcaaaaaga

SEQ ID NO: 43211 - DNA, 15 bp, Homo sapiens
atcatggtcaaaaag

SEQ ID NO: 43212 - DNA, 15 bp, Homo sapiens
catcatggtcaaaaa

SEQ ID NO: 43213 - DNA, 15 bp, Homo sapiens
tcatcatggtcaaaa

SEQ ID NO: 43214 - DNA, 15 bp, Homo sapiens
gtcatcatggtcaaa

SEQ ID NO: 43215 - DNA, 15 bp, Homo sapiens
tgtcatcatggtcaa

SEQ ID NO: 43216 - DNA, 15 bp, Homo sapiens
ctgtcatcatggtca

SEQ ID NO: 43217 - DNA, 15 bp, Homo sapiens
actgtcatcatggtc

SEQ ID NO: 43218 - DNA, 15 bp, Homo sapiens
aactgtcatcatggt

SEQ ID NO: 43219 - DNA, 15 bp, Homo sapiens
caactgtcatcatgg

SEQ ID NO: 43220 - DNA, 15 bp, Homo sapiens
ccaactgtcatcatg

SEQ ID NO: 43221 - DNA, 15 bp, Homo sapiens
cccaactgtcatcat

SEQ ID NO: 43222 - DNA, 15 bp, Homo sapiens
acccaactgtcatca

SEQ ID NO: 43223 - DNA, 15 bp, Homo sapiens
aacccaactgtcatc

SEQ ID NO: 43224 - DNA, 15 bp, Homo sapiens
aaacccaactgtcat

SEQ ID NO: 43225 - DNA, 15 bp, Homo sapiens
aaaacccaactgtca

SEQ ID NO: 43226 - DNA, 15 bp, Homo sapiens
taaaacccaactgtc

SEQ ID NO: 43227 - DNA, 15 bp, Homo sapiens
ataaaacccaactgt

SEQ ID NO: 43228 - DNA, 15 bp, Homo sapiens
aataaaacccaactg

SEQ ID NO: 43229 - DNA, 15 bp, Homo sapiens
caataaaacccaact

SEQ ID NO: 43230 - DNA, 15 bp, Homo sapiens
tcaataaaacccaac

SEQ ID NO: 43231 - DNA, 15 bp, Homo sapiens
ctcaataaaacccaa

SEQ ID NO: 43232 - DNA, 15 bp, Homo sapiens
tctcaataaaaccca

SEQ ID NO: 43233 - DNA, 15 bp, Homo sapiens
ttctcaataaaaccc

SEQ ID NO: 43234 - DNA, 15 bp, Homo sapiens
attctcaataaaacc

SEQ ID NO: 43235 - DNA, 15 bp, Homo sapiens
aattctcaataaaac

SEQ ID NO: 43236 - DNA, 15 bp, Homo sapiens
taattctcaataaaa

SEQ ID NO: 43237 - DNA, 15 bp, Homo sapiens
ttaattctcaataaa

SEQ ID NO: 43238 - DNA, 15 bp, Homo sapiens
gttaattctcaataa

SEQ ID NO: 43239 - DNA, 15 bp, Homo sapiens
ggttaattctcaata

SEQ ID NO: 43240 - DNA, 15 bp, Homo sapiens
tggttaattctcaat

SEQ ID NO: 43241 - DNA, 15 bp, Homo sapiens
atggttaattctcaa

SEQ ID NO: 43242 - DNA, 15 bp, Homo sapiens
catggttaattctca

SEQ ID NO: 43243 - DNA, 15 bp, Homo sapiens
acatggttaattctc

SEQ ID NO: 43244 - DNA, 15 bp, Homo sapiens
cacatggttaattct

SEQ ID NO: 43245 - DNA, 15 bp, Homo sapiens
ccacatggttaattc

SEQ ID NO: 43246 - DNA, 15 bp, Homo sapiens
gccacatggttaatt

SEQ ID NO: 43247 - DNA, 15 bp, Homo sapiens
agccacatggttaat

SEQ ID NO: 43248 - DNA, 15 bp, Homo sapiens
gagccacatggttaa

SEQ ID NO: 43249 - DNA, 15 bp, Homo sapiens
agagccacatggtta

SEQ ID NO: 43250 - DNA, 15 bp, Homo sapiens
aagagccacatggtt

SEQ ID NO: 43251 - DNA, 15 bp, Homo sapiens
caagagccacatggt

SEQ ID NO: 43252 - DNA, 15 bp, Homo sapiens
gcaagagccacatgg

SEQ ID NO: 43253 - DNA, 15 bp, Homo sapiens
ggcaagagccacatg

SEQ ID NO: 43254 - DNA, 15 bp, Homo sapiens
cggcaagagccacat

SEQ ID NO: 43255 - DNA, 15 bp, Homo sapiens
gcggcaagagccaca

SEQ ID NO: 43256 - DNA, 15 bp, Homo sapiens
tgcggcaagagccac

SEQ ID NO: 43257 - DNA, 15 bp, Homo sapiens
atgcggcaagagcca

SEQ ID NO: 43258 - DNA, 15 bp, Homo sapiens
catgcggcaagagcc

SEQ ID NO: 43259 - DNA, 15 bp, Homo sapiens
gcatgcggcaagagc

SEQ ID NO: 43260 - DNA, 15 bp, Homo sapiens
agcatgcggcaagag

SEQ ID NO: 43261 - DNA, 15 bp, Homo sapiens
cagcatgcggcaaga

SEQ ID NO: 43262 - DNA, 15 bp, Homo sapiens
tcagcatgcggcaag

SEQ ID NO: 43263 - DNA, 15 bp, Homo sapiens
atcagcatgcggcaa

SEQ ID NO: 43264 - DNA, 15 bp, Homo sapiens
aatcagcatgcggca

SEQ ID NO: 43265 - DNA, 15 bp, Homo sapiens
taatcagcatgcggc

SEQ ID NO: 43266 - DNA, 15 bp, Homo sapiens
ataatcagcatgcgg

SEQ ID NO: 43267 - DNA, 15 bp, Homo sapiens
aataatcagcatgcg

SEQ ID NO: 43268 - DNA, 15 bp, Homo sapiens
taataatcagcatgc

SEQ ID NO: 43269 - DNA, 15 bp, Homo sapiens
ataataatcagcatg

SEQ ID NO: 43270 - DNA, 15 bp, Homo sapiens
gataataatcagcat

SEQ ID NO: 43271 - DNA, 15 bp, Homo sapiens
agataataatcagca

SEQ ID NO: 43272 - DNA, 15 bp, Homo sapiens
aagataataatcagc

SEQ ID NO: 43273 - DNA, 15 bp, Homo sapiens
aaagataataatcag

SEQ ID NO: 43274 - DNA, 15 bp, Homo sapiens
taaagataataatca

SEQ ID NO: 43275 - DNA, 15 bp, Homo sapiens
ttaaagataataatc

SEQ ID NO: 43276 - DNA, 15 bp, Homo sapiens
attaaagataataat

SEQ ID NO: 43277 - DNA, 15 bp, Homo sapiens
aattaaagataataa

SEQ ID NO: 43278 - DNA, 15 bp, Homo sapiens
gaattaaagataata

SEQ ID NO: 43279 - DNA, 15 bp, Homo sapiens
agaattaaagataat

SEQ ID NO: 43280 - DNA, 15 bp, Homo sapiens
gagaattaaagataa

SEQ ID NO: 43281 - DNA, 15 bp, Homo sapiens
tgagaattaaagata

SEQ ID NO: 43282 - DNA, 15 bp, Homo sapiens
atgagaattaaagat

SEQ ID NO: 43283 - DNA, 15 bp, Homo sapiens
tatgagaattaaaga

SEQ ID NO: 43284 - DNA, 15 bp, Homo sapiens
ttatgagaattaaag

SEQ ID NO: 43285 - DNA, 15 bp, Homo sapiens
gttatgagaattaaa

SEQ ID NO: 43286 - DNA, 15 bp, Homo sapiens
tgttatgagaattaa

SEQ ID NO: 43287 - DNA, 15 bp, Homo sapiens
ttgttatgagaatta

SEQ ID NO: 43288 - DNA, 15 bp, Homo sapiens
attgttatgagaatt

SEQ ID NO: 43289 - DNA, 15 bp, Homo sapiens
aattgttatgagaat

SEQ ID NO: 43290 - DNA, 15 bp, Homo sapiens
caattgttatgagaa

SEQ ID NO: 43291 - DNA, 15 bp, Homo sapiens
acaattgttatgaga

SEQ ID NO: 43292 - DNA, 15 bp, Homo sapiens
aacaattgttatgag

SEQ ID NO: 43293 - DNA, 15 bp, Homo sapiens
aaacaattgttatga

SEQ ID NO: 43294 - DNA, 15 bp, Homo sapiens
taaacaattgttatg

SEQ ID NO: 43295 - DNA, 15 bp, Homo sapiens
ttaaacaattgttat

SEQ ID NO: 43296 - DNA, 15 bp, Homo sapiens
cttaaacaattgtta

SEQ ID NO: 43297 - DNA, 15 bp, Homo sapiens
ccttaaacaattgtt

SEQ ID NO: 43298 - DNA, 15 bp, Homo sapiens
cccttaaacaattgt

SEQ ID NO: 43299 - DNA, 15 bp, Homo sapiens
acccttaaacaattg

SEQ ID NO: 43300 - DNA, 15 bp, Homo sapiens
aacccttaaacaatt

SEQ ID NO: 43301 - DNA, 15 bp, Homo sapiens
caacccttaaacaat

SEQ ID NO: 43302 - DNA, 15 bp, Homo sapiens
gcaacccttaaacaa

SEQ ID NO: 43303 - DNA, 15 bp, Homo sapiens
tgcaacccttaaaca

SEQ ID NO: 43304 - DNA, 15 bp, Homo sapiens
atgcaacccttaaac

SEQ ID NO: 43305 - DNA, 15 bp, Homo sapiens
aatgcaacccttaaa

SEQ ID NO: 43306 - DNA, 15 bp, Homo sapiens
aaatgcaacccttaa

SEQ ID NO: 43307 - DNA, 15 bp, Homo sapiens
aaaatgcaaccctta

SEQ ID NO: 43308 - DNA, 15 bp, Homo sapiens
aaaaatgcaaccctt

SEQ ID NO: 43309 - DNA, 15 bp, Homo sapiens
taaaaatgcaaccct

SEQ ID NO: 43310 - DNA, 15 bp, Homo sapiens
gtaaaaatgcaaccc

SEQ ID NO: 43311 - DNA, 15 bp, Homo sapiens
ggtaaaaatgcaacc

SEQ ID NO: 43312 - DNA, 15 bp, Homo sapiens
gggtaaaaatgcaac

SEQ ID NO: 43313 - DNA, 15 bp, Homo sapiens
agggtaaaaatgcaa

SEQ ID NO: 43314 - DNA, 15 bp, Homo sapiens
gagggtaaaaatgca

SEQ ID NO: 43315 - DNA, 15 bp, Homo sapiens
agagggtaaaaatgc

SEQ ID NO: 43316 - DNA, 15 bp, Homo sapiens
aagagggtaaaaatg

SEQ ID NO: 43317 - DNA, 15 bp, Homo sapiens
aaagagggtaaaaat

SEQ ID NO: 43318 - DNA, 15 bp, Homo sapiens
caaagagggtaaaaa

SEQ ID NO: 43319 - DNA, 15 bp, Homo sapiens
acaaagagggtaaaa

SEQ ID NO: 43320 - DNA, 15 bp, Homo sapiens
tacaaagagggtaaa

SEQ ID NO: 43321 - DNA, 15 bp, Homo sapiens
atacaaagagggtaa

SEQ ID NO: 43322 - DNA, 15 bp, Homo sapiens
tatacaaagagggta

SEQ ID NO: 43323 - DNA, 15 bp, Homo sapiens
atatacaaagagggt

SEQ ID NO: 43324 - DNA, 15 bp, Homo sapiens
tatatacaaagaggg

SEQ ID NO: 43325 - DNA, 15 bp, Homo sapiens
ctatatacaaagagg

SEQ ID NO: 43326 - DNA, 15 bp, Homo sapiens
cctatatacaaagag

SEQ ID NO: 43327 - DNA, 15 bp, Homo sapiens
tcctatatacaaaga

SEQ ID NO: 43328 - DNA, 15 bp, Homo sapiens
ctcctatatacaaag

SEQ ID NO: 43329 - DNA, 15 bp, Homo sapiens
tctcctatatacaaa

SEQ ID NO: 43330 - DNA, 15 bp, Homo sapiens
ttctcctatatacaa

SEQ ID NO: 43331 - DNA, 15 bp, Homo sapiens
tttctcctatataca

SEQ ID NO: 43332 - DNA, 15 bp, Homo sapiens
ttttctcctatatac

SEQ ID NO: 43333 - DNA, 15 bp, Homo sapiens
tttttctcctatata

SEQ ID NO: 43334 - DNA, 15 bp, Homo sapiens
atttttctcctatat

SEQ ID NO: 43335 - DNA, 15 bp, Homo sapiens
tatttttctcctata

SEQ ID NO: 43336 - DNA, 15 bp, Homo sapiens
ttatttttctcctat

SEQ ID NO: 43337 - DNA, 15 bp, Homo sapiens
tttatttttctccta

SEQ ID NO: 43338 - DNA, 15 bp, Homo sapiens
atttatttttctcct

SEQ ID NO: 43339 - DNA, 15 bp, Homo sapiens
aatttatttttctcc

SEQ ID NO: 43340 - DNA, 15 bp, Homo sapiens
caatttatttttctc

SEQ ID NO: 43341 - DNA, 15 bp, Homo sapiens
acaatttatttttct

SEQ ID NO: 43342 - DNA, 15 bp, Homo sapiens
aacaatttatttttc

SEQ ID NO: 43343 - DNA, 15 bp, Homo sapiens
gaacaatttattttt

SEQ ID NO: 43344 - DNA, 15 bp, Homo sapiens
tgaacaatttatttt

SEQ ID NO: 43345 - DNA, 15 bp, Homo sapiens
ttgaacaatttattt

SEQ ID NO: 43346 - DNA, 15 bp, Homo sapiens
cttgaacaatttatt

SEQ ID NO: 43347 - DNA, 15 bp, Homo sapiens
tcttgaacaatttat

SEQ ID NO: 43348 - DNA, 15 bp, Homo sapiens
gtcttgaacaattta

SEQ ID NO: 43349 - DNA, 15 bp, Homo sapiens
tgtcttgaacaattt

SEQ ID NO: 43350 - DNA, 15 bp, Homo sapiens
atgtcttgaacaatt

SEQ ID NO: 43351 - DNA, 15 bp, Homo sapiens
tatgtcttgaacaat

SEQ ID NO: 43352 - DNA, 15 bp, Homo sapiens
ttatgtcttgaacaa

SEQ ID NO: 43353 - DNA, 15 bp, Homo sapiens
tttatgtcttgaaca

SEQ ID NO: 43354 - DNA, 15 bp, Homo sapiens
ctttatgtcttgaac

SEQ ID NO: 43355 - DNA, 15 bp, Homo sapiens
gctttatgtcttgaa

SEQ ID NO: 43356 - DNA, 15 bp, Homo sapiens
tgctttatgtcttga

SEQ ID NO: 43357 - DNA, 15 bp, Homo sapiens
ctgctttatgtcttg

SEQ ID NO: 43358 - DNA, 15 bp, Homo sapiens
actgctttatgtctt

SEQ ID NO: 43359 - DNA, 15 bp, Homo sapiens
gactgctttatgtct

SEQ ID NO: 43360 - DNA, 15 bp, Homo sapiens
tgactgctttatgtc

SEQ ID NO: 43361 - DNA, 15 bp, Homo sapiens
ttgactgctttatgt

SEQ ID NO: 43362 - DNA, 15 bp, Homo sapiens
tttgactgctttatg

SEQ ID NO: 43363 - DNA, 15 bp, Homo sapiens
ttttgactgctttat

SEQ ID NO: 43364 - DNA, 15 bp, Homo sapiens
tttttgactgcttta

SEQ ID NO: 43365 - DNA, 15 bp, Homo sapiens
ctttttgactgcttt

SEQ ID NO: 43366 - DNA, 15 bp, Homo sapiens
gctttttgactgctt

SEQ ID NO: 43367 - DNA, 15 bp, Homo sapiens
tgctttttgactgct

SEQ ID NO: 43368 - DNA, 15 bp, Homo sapiens
ctgctttttgactgc

SEQ ID NO: 43369 - DNA, 15 bp, Homo sapiens
actgctttttgactg

SEQ ID NO: 43370 - DNA, 15 bp, Homo sapiens
aactgctttttgact

SEQ ID NO: 43371 - DNA, 15 bp, Homo sapiens
gaactgctttttgac

SEQ ID NO: 43372 - DNA, 15 bp, Homo sapiens
ggaactgctttttga

SEQ ID NO: 43373 - DNA, 15 bp, Homo sapiens
tggaactgctttttg

SEQ ID NO: 43374 - DNA, 15 bp, Homo sapiens
atggaactgcttttt

SEQ ID NO: 43375 - DNA, 15 bp, Homo sapiens
tatggaactgctttt

SEQ ID NO: 43376 - DNA, 15 bp, Homo sapiens
ttatggaactgcttt

SEQ ID NO: 43377 - DNA, 15 bp, Homo sapiens
tttatggaactgctt

SEQ ID NO: 43378 - DNA, 15 bp, Homo sapiens
ctttatggaactgct

SEQ ID NO: 43379 - DNA, 15 bp, Homo sapiens
actttatggaactgc

SEQ ID NO: 43380 - DNA, 15 bp, Homo sapiens
tactttatggaactg

SEQ ID NO: 43381 - DNA, 15 bp, Homo sapiens
ctactttatggaact

SEQ ID NO: 43382 - DNA, 15 bp, Homo sapiens
actactttatggaac

SEQ ID NO: 43383 - DNA, 15 bp, Homo sapiens
aactactttatggaa

SEQ ID NO: 43384 - DNA, 15 bp, Homo sapiens
caactactttatgga

SEQ ID NO: 43385 - DNA, 15 bp, Homo sapiens
ccaactactttatgg

SEQ ID NO: 43386 - DNA, 15 bp, Homo sapiens
cccaactactttatg

SEQ ID NO: 43387 - DNA, 15 bp, Homo sapiens
tcccaactactttat

SEQ ID NO: 43388 - DNA, 15 bp, Homo sapiens
ctcccaactacttta

SEQ ID NO: 43389 - DNA, 15 bp, Homo sapiens
gctcccaactacttt

SEQ ID NO: 43390 - DNA, 15 bp, Homo sapiens
agctcccaactactt

SEQ ID NO: 43391 - DNA, 15 bp, Homo sapiens
cagctcccaactact

SEQ ID NO: 43392 - DNA, 15 bp, Homo sapiens
tcagctcccaactac

SEQ ID NO: 43393 - DNA, 15 bp, Homo sapiens
ctcagctcccaacta

SEQ ID NO: 43394 - DNA, 15 bp, Homo sapiens
actcagctcccaact

SEQ ID NO: 43395 - DNA, 15 bp, Homo sapiens
aactcagctcccaac

SEQ ID NO: 43396 - DNA, 15 bp, Homo sapiens
aaactcagctcccaa

SEQ ID NO: 43397 - DNA, 15 bp, Homo sapiens
aaaactcagctccca

SEQ ID NO: 43398 - DNA, 15 bp, Homo sapiens
taaaactcagctccc

SEQ ID NO: 43399 - DNA, 15 bp, Homo sapiens
gtaaaactcagctcc

SEQ ID NO: 43400 - DNA, 15 bp, Homo sapiens
ggtaaaactcagctc

SEQ ID NO: 43401 - DNA, 15 bp, Homo sapiens
aggtaaaactcagct

SEQ ID NO: 43402 - DNA, 15 bp, Homo sapiens
aaggtaaaactcagc

SEQ ID NO: 43403 - DNA, 15 bp, Homo sapiens
taaggtaaaactcag

SEQ ID NO: 43404 - DNA, 15 bp, Homo sapiens
ataaggtaaaactca

SEQ ID NO: 43405 - DNA, 15 bp, Homo sapiens
tataaggtaaaactc

SEQ ID NO: 43406 - DNA, 15 bp, Homo sapiens
ttataaggtaaaact

SEQ ID NO: 43407 - DNA, 15 bp, Homo sapiens
cttataaggtaaaac

SEQ ID NO: 43408 - DNA, 15 bp, Homo sapiens
ccttataaggtaaaa

SEQ ID NO: 43409 - DNA, 15 bp, Homo sapiens
gccttataaggtaaa

SEQ ID NO: 43410 - DNA, 15 bp, Homo sapiens
agccttataaggtaa

SEQ ID NO: 43411 - DNA, 15 bp, Homo sapiens
cagccttataaggta

SEQ ID NO: 43412 - DNA, 15 bp, Homo sapiens
acagccttataaggt

SEQ ID NO: 43413 - DNA, 15 bp, Homo sapiens
aacagccttataagg

SEQ ID NO: 43414 - DNA, 15 bp, Homo sapiens
caacagccttataag

SEQ ID NO: 43415 - DNA, 15 bp, Homo sapiens
ccaacagccttataa

SEQ ID NO: 43416 - DNA, 15 bp, Homo sapiens
cccaacagccttata

SEQ ID NO: 43417 - DNA, 15 bp, Homo sapiens
tcccaacagccttat

SEQ ID NO: 43418 - DNA, 15 bp, Homo sapiens
atcccaacagcctta

SEQ ID NO: 43419 - DNA, 15 bp, Homo sapiens
gatcccaacagcctt

SEQ ID NO: 43420 - DNA, 15 bp, Homo sapiens
tgatcccaacagcct

SEQ ID NO: 43421 - DNA, 15 bp, Homo sapiens
ttgatcccaacagcc

SEQ ID NO: 43422 - DNA, 15 bp, Homo sapiens
tttgatcccaacagc

SEQ ID NO: 43423 - DNA, 15 bp, Homo sapiens
atttgatcccaacag

SEQ ID NO: 43424 - DNA, 15 bp, Homo sapiens
catttgatcccaaca

SEQ ID NO: 43425 - DNA, 15 bp, Homo sapiens
tcatttgatcccaac

SEQ ID NO: 43426 - DNA, 15 bp, Homo sapiens
ctcatttgatcccaa

SEQ ID NO: 43427 - DNA, 15 bp, Homo sapiens
tctcatttgatccca

SEQ ID NO: 43428 - DNA, 15 bp, Homo sapiens
atctcatttgatccc

SEQ ID NO: 43429 - DNA, 15 bp, Homo sapiens
tatctcatttgatcc

SEQ ID NO: 43430 - DNA, 15 bp, Homo sapiens
ttatctcatttgatc

SEQ ID NO: 43431 - DNA, 15 bp, Homo sapiens
attatctcatttgat

SEQ ID NO: 43432 - DNA, 15 bp, Homo sapiens
cattatctcatttga

SEQ ID NO: 43433 - DNA, 15 bp, Homo sapiens
acattatctcatttg

SEQ ID NO: 43434 - DNA, 15 bp, Homo sapiens
cacattatctcattt

SEQ ID NO: 43435 - DNA, 15 bp, Homo sapiens
acacattatctcatt

SEQ ID NO: 43436 - DNA, 15 bp, Homo sapiens
tacacattatctcat

SEQ ID NO: 43437 - DNA, 15 bp, Homo sapiens
gtacacattatctca

SEQ ID NO: 43438 - DNA, 15 bp, Homo sapiens
tgtacacattatctc

SEQ ID NO: 43439 - DNA, 15 bp, Homo sapiens
ttgtacacattatct

SEQ ID NO: 43440 - DNA, 15 bp, Homo sapiens
tttgtacacattatc

SEQ ID NO: 43441 - DNA, 15 bp, Homo sapiens
ctttgtacacattat

SEQ ID NO: 43442 - DNA, 15 bp, Homo sapiens
actttgtacacatta

SEQ ID NO: 43443 - DNA, 15 bp, Homo sapiens
cactttgtacacatt

SEQ ID NO: 43444 - DNA, 15 bp, Homo sapiens
ccactttgtacacat

SEQ ID NO: 43445 - DNA, 15 bp, Homo sapiens
accactttgtacaca

SEQ ID NO: 43446 - DNA, 15 bp, Homo sapiens
aaccactttgtacac

SEQ ID NO: 43447 - DNA, 15 bp, Homo sapiens
taaccactttgtaca

SEQ ID NO: 43448 - DNA, 15 bp, Homo sapiens
ctaaccactttgtac

SEQ ID NO: 43449 - DNA, 15 bp, Homo sapiens
gctaaccactttgta

SEQ ID NO: 43450 - DNA, 15 bp, Homo sapiens
ggctaaccactttgt

SEQ ID NO: 43451 - DNA, 15 bp, Homo sapiens
gggctaaccactttg

SEQ ID NO: 43452 - DNA, 15 bp, Homo sapiens
agggctaaccacttt

SEQ ID NO: 43453 - DNA, 15 bp, Homo sapiens
cagggctaaccactt

SEQ ID NO: 43454 - DNA, 15 bp, Homo sapiens
acagggctaaccact

SEQ ID NO: 43455 - DNA, 15 bp, Homo sapiens
cacagggctaaccac

SEQ ID NO: 43456 - DNA, 15 bp, Homo sapiens
acacagggctaacca

SEQ ID NO: 43457 - DNA, 15 bp, Homo sapiens
gacacagggctaacc

SEQ ID NO: 43458 - DNA, 15 bp, Homo sapiens
agacacagggctaac

SEQ ID NO: 43459 - DNA, 15 bp, Homo sapiens
cagacacagggctaa

SEQ ID NO: 43460 - DNA, 15 bp, Homo sapiens
ccagacacagggcta

SEQ ID NO: 43461 - DNA, 15 bp, Homo sapiens
gccagacacagggct

SEQ ID NO: 43462 - DNA, 15 bp, Homo sapiens
tgccagacacagggc

SEQ ID NO: 43463 - DNA, 15 bp, Homo sapiens
gtgccagacacaggg

SEQ ID NO: 43464 - DNA, 15 bp, Homo sapiens
tgtgccagacacagg

SEQ ID NO: 43465 - DNA, 15 bp, Homo sapiens
atgtgccagacacag

SEQ ID NO: 43466 - DNA, 15 bp, Homo sapiens
tatgtgccagacaca

SEQ ID NO: 43467 - DNA, 15 bp, Homo sapiens
ctatgtgccagacac

SEQ ID NO: 43468 - DNA, 15 bp, Homo sapiens
tctatgtgccagaca

SEQ ID NO: 43469 - DNA, 15 bp, Homo sapiens
ttctatgtgccagac

SEQ ID NO: 43470 - DNA, 15 bp, Homo sapiens
tttctatgtgccaga

SEQ ID NO: 43471 - DNA, 15 bp, Homo sapiens
ctttctatgtgccag

SEQ ID NO: 43472 - DNA, 15 bp, Homo sapiens
actttctatgtgcca

SEQ ID NO: 43473 - DNA, 15 bp, Homo sapiens
cactttctatgtgcc

SEQ ID NO: 43474 - DNA, 15 bp, Homo sapiens
acactttctatgtgc

SEQ ID NO: 43475 - DNA, 15 bp, Homo sapiens
aacactttctatgtg

SEQ ID NO: 43476 - DNA, 15 bp, Homo sapiens
aaacactttctatgt

SEQ ID NO: 43477 - DNA, 15 bp, Homo sapiens
taaacactttctatg

SEQ ID NO: 43478 - DNA, 15 bp, Homo sapiens
ttaaacactttctat

SEQ ID NO: 43479 - DNA, 15 bp, Homo sapiens
attaaacactttcta

SEQ ID NO: 43480 - DNA, 15 bp, Homo sapiens
tattaaacactttct

SEQ ID NO: 43481 - DNA, 15 bp, Homo sapiens
atttattaaacactt

SEQ ID NO: 43482 - DNA, 15 bp, Homo sapiens
catttattaaacact

SEQ ID NO: 43483 - DNA, 15 bp, Homo sapiens
acatttattaaacac

SEQ ID NO: 43484 - DNA, 15 bp, Homo sapiens
gacatttattaaaca

SEQ ID NO: 43485 - DNA, 15 bp, Homo sapiens
tgacatttattaaac

SEQ ID NO: 43486 - DNA, 15 bp, Homo sapiens
ctgacatttattaaa

SEQ ID NO: 43487 - DNA, 15 bp, Homo sapiens
actgacatttattaa

SEQ ID NO: 43488 - DNA, 15 bp, Homo sapiens
aactgacatttatta

SEQ ID NO: 43489 - DNA, 15 bp, Homo sapiens
aaactgacatttatt

SEQ ID NO: 43490 - DNA, 15 bp, Homo sapiens
aaaactgacatttat

SEQ ID NO: 43491 - DNA, 15 bp, Homo sapiens
taaaactgacattta

SEQ ID NO: 43492 - DNA, 15 bp, Homo sapiens
ataaaactgacattt

SEQ ID NO: 43493 - DNA, 15 bp, Homo sapiens
aataaaactgacatt

SEQ ID NO: 43494 - DNA, 15 bp, Homo sapiens
taataaaactgacat

SEQ ID NO: 43495 - DNA, 15 bp, Homo sapiens
ataataaaactgaca

SEQ ID NO: 43496 - DNA, 15 bp, Homo sapiens
cataataaaactgac

SEQ ID NO: 43497 - DNA, 15 bp, Homo sapiens
tcataataaaactga

SEQ ID NO: 43498 - DNA, 15 bp, Homo sapiens
ctcataataaaactg

SEQ ID NO: 43499 - DNA, 15 bp, Homo sapiens
tctcataataaaact

SEQ ID NO: 43500 - DNA, 15 bp, Homo sapiens
ttctcataataaaac

SEQ ID NO: 43501 - DNA, 15 bp, Homo sapiens
tttctcataataaaa

SEQ ID NO: 43502 - DNA, 15 bp, Homo sapiens
ttttctcataataaa

SEQ ID NO: 43503 - DNA, 15 bp, Homo sapiens
gttttctcataataa

SEQ ID NO: 43504 - DNA, 15 bp, Homo sapiens
tgttttctcataata

SEQ ID NO: 43505 - DNA, 15 bp, Homo sapiens
atgttttctcataat

SEQ ID NO: 43506 - DNA, 15 bp, Homo sapiens
catgttttctcataa

SEQ ID NO: 43507 - DNA, 15 bp, Homo sapiens
tcatgttttctcata

SEQ ID NO: 43508 - DNA, 15 bp, Homo sapiens
atcatgttttctcat

SEQ ID NO: 43509 - DNA, 15 bp, Homo sapiens
aatcatgttttctca

SEQ ID NO: 43510 - DNA, 15 bp, Homo sapiens
gaatcatgttttctc

SEQ ID NO: 43511 - DNA, 15 bp, Homo sapiens
tgaatcatgttttct

SEQ ID NO: 43512 - DNA, 15 bp, Homo sapiens
atgaatcatgttttc

SEQ ID NO: 43513 - DNA, 15 bp, Homo sapiens
catgaatcatgtttt

SEQ ID NO: 43514 - DNA, 15 bp, Homo sapiens
ccatgaatcatgttt

SEQ ID NO: 43515 - DNA, 15 bp, Homo sapiens
tccatgaatcatgtt

SEQ ID NO: 43516 - DNA, 15 bp, Homo sapiens
atccatgaatcatgt

SEQ ID NO: 43517 - DNA, 15 bp, Homo sapiens
catccatgaatcatg

SEQ ID NO: 43518 - DNA, 15 bp, Homo sapiens
ccatccatgaatcat

SEQ ID NO: 43519 - DNA, 15 bp, Homo sapiens
tccatccatgaatca

SEQ ID NO: 43520 - DNA, 15 bp, Homo sapiens
ctccatccatgaatc

SEQ ID NO: 43521 - DNA, 15 bp, Homo sapiens
tctccatccatgaat

SEQ ID NO: 43522 - DNA, 15 bp, Homo sapiens
gtctccatccatgaa

SEQ ID NO: 43523 - DNA, 15 bp, Homo sapiens
agtctccatccatga

SEQ ID NO: 43524 - DNA, 15 bp, Homo sapiens
gagtctccatccatg

SEQ ID NO: 43525 - DNA, 15 bp, Homo sapiens
agagtctccatccat

SEQ ID NO: 43526 - DNA, 15 bp, Homo sapiens
cagagtctccatcca

SEQ ID NO: 43527 - DNA, 15 bp, Homo sapiens
tcagagtctccatcc

SEQ ID NO: 43528 - DNA, 15 bp, Homo sapiens
atcagagtctccatc

SEQ ID NO: 43529 - DNA, 15 bp, Homo sapiens
tatcagagtctccat

SEQ ID NO: 43530 - DNA, 15 bp, Homo sapiens
ctatcagagtctcca

SEQ ID NO: 43531 - DNA, 15 bp, Homo sapiens
gctatcagagtctcc

SEQ ID NO: 43532 - DNA, 15 bp, Homo sapiens
tgctatcagagtctc

SEQ ID NO: 43533 - DNA, 15 bp, Homo sapiens
atgctatcagagtct

SEQ ID NO: 43534 - DNA, 15 bp, Homo sapiens
gatgctatcagagtc

SEQ ID NO: 43535 - DNA, 15 bp, Homo sapiens
ggatgctatcagagt

SEQ ID NO: 43536 - DNA, 15 bp, Homo sapiens
aggatgctatcagag

SEQ ID NO: 43537 - DNA, 15 bp, Homo sapiens
aaggatgctatcaga

SEQ ID NO: 43538 - DNA, 15 bp, Homo sapiens
taaggatgctatcag

SEQ ID NO: 43539 - DNA, 15 bp, Homo sapiens
ctaaggatgctatca

SEQ ID NO: 43540 - DNA, 15 bp, Homo sapiens
actaaggatgctatc

SEQ ID NO: 43541 - DNA, 15 bp, Homo sapiens
cactaaggatgctat

SEQ ID NO: 43542 - DNA, 15 bp, Homo sapiens
gcactaaggatgcta

SEQ ID NO: 43543 - DNA, 15 bp, Homo sapiens
tgcactaaggatgct

SEQ ID NO: 43544 - DNA, 15 bp, Homo sapiens
atgcactaaggatgc

SEQ ID NO: 43545 - DNA, 15 bp, Homo sapiens
catgcactaaggatg

SEQ ID NO: 43546 - DNA, 15 bp, Homo sapiens
gcatgcactaaggat

SEQ ID NO: 43547 - DNA, 15 bp, Homo sapiens
tgcatgcactaagga

SEQ ID NO: 43548 - DNA, 15 bp, Homo sapiens
atgcatgcactaagg

SEQ ID NO: 43549 - DNA, 15 bp, Homo sapiens
gatgcatgcactaag

SEQ ID NO: 43550 - DNA, 15 bp, Homo sapiens
agatgcatgcactaa

SEQ ID NO: 43551 - DNA, 15 bp, Homo sapiens
gagatgcatgcacta

SEQ ID NO: 43552 - DNA, 15 bp, Homo sapiens
ggagatgcatgcact

SEQ ID NO: 43553 - DNA, 15 bp, Homo sapiens
gggagatgcatgcac

SEQ ID NO: 43554 - DNA, 15 bp, Homo sapiens
agggagatgcatgca

SEQ ID NO: 43555 - DNA, 15 bp, Homo sapiens
tagggagatgcatgc

SEQ ID NO: 43556 - DNA, 15 bp, Homo sapiens
atagggagatgcatg

SEQ ID NO: 43557 - DNA, 15 bp, Homo sapiens
aatagggagatgcat

SEQ ID NO: 43558 - DNA, 15 bp, Homo sapiens
gaatagggagatgca

SEQ ID NO: 43559 - DNA, 15 bp, Homo sapiens
ggaatagggagatgc

SEQ ID NO: 43560 - DNA, 15 bp, Homo sapiens
tggaatagggagatg

SEQ ID NO: 43561 - DNA, 15 bp, Homo sapiens
ctggaatagggagat

SEQ ID NO: 43562 - DNA, 15 bp, Homo sapiens
actggaatagggaga

SEQ ID NO: 43563 - DNA, 15 bp, Homo sapiens
gactggaatagggag

SEQ ID NO: 43564 - DNA, 15 bp, Homo sapiens
tgactggaataggga

SEQ ID NO: 43565 - DNA, 15 bp, Homo sapiens
atgactggaataggg

SEQ ID NO: 43566 - DNA, 15 bp, Homo sapiens
gatgactggaatagg

SEQ ID NO: 43567 - DNA, 15 bp, Homo sapiens
agatgactggaatag

SEQ ID NO: 43568 - DNA, 15 bp, Homo sapiens
cagatgactggaata

SEQ ID NO: 43569 - DNA, 15 bp, Homo sapiens
acagatgactggaat

SEQ ID NO: 43570 - DNA, 15 bp, Homo sapiens
gacagatgactggaa

SEQ ID NO: 43571 - DNA, 15 bp, Homo sapiens
ggacagatgactgga

SEQ ID NO: 43572 - DNA, 15 bp, Homo sapiens
aggacagatgactgg

SEQ ID NO: 43573 - DNA, 15 bp, Homo sapiens
aaggacagatgactg

SEQ ID NO: 43574 - DNA, 15 bp, Homo sapiens
gaaggacagatgact

SEQ ID NO: 43575 - DNA, 15 bp, Homo sapiens
tgaaggacagatgac

SEQ ID NO: 43576 - DNA, 15 bp, Homo sapiens
ctgaaggacagatga

SEQ ID NO: 43577 - DNA, 15 bp, Homo sapiens
actgaaggacagatg

SEQ ID NO: 43578 - DNA, 15 bp, Homo sapiens
cactgaaggacagat

SEQ ID NO: 43579 - DNA, 15 bp, Homo sapiens
acactgaaggacaga

SEQ ID NO: 43580 - DNA, 15 bp, Homo sapiens
aacactgaaggacag

SEQ ID NO: 43581 - DNA, 15 bp, Homo sapiens
taacactgaaggaca

SEQ ID NO: 43582 - DNA, 15 bp, Homo sapiens
gtaacactgaaggac

SEQ ID NO: 43583 - DNA, 15 bp, Homo sapiens
cgtaacactgaagga

SEQ ID NO: 43584 - DNA, 15 bp, Homo sapiens
acgtaacactgaagg

SEQ ID NO: 43585 - DNA, 15 bp, Homo sapiens
aacgtaacactgaag

SEQ ID NO: 43586 - DNA, 15 bp, Homo sapiens
aaacgtaacactgaa

SEQ ID NO: 43587 - DNA, 15 bp, Homo sapiens
aaaacgtaacactga

SEQ ID NO: 43588 - DNA, 15 bp, Homo sapiens
taaaacgtaacactg

SEQ ID NO: 43589 - DNA, 15 bp, Homo sapiens
ctaaaacgtaacact

SEQ ID NO: 43590 - DNA, 15 bp, Homo sapiens
tctaaaacgtaacac

SEQ ID NO: 43591 - DNA, 15 bp, Homo sapiens
atctaaaacgtaaca

SEQ ID NO: 43592 - DNA, 15 bp, Homo sapiens
gatctaaaacgtaac

SEQ ID NO: 43593 - DNA, 15 bp, Homo sapiens
tgatctaaaacgtaa

SEQ ID NO: 43594 - DNA, 15 bp, Homo sapiens
ctgatctaaaacgta

SEQ ID NO: 43595 - DNA, 15 bp, Homo sapiens
tctgatctaaaacgt

SEQ ID NO: 43596 - DNA, 15 bp, Homo sapiens
ctctgatctaaaacg

SEQ ID NO: 43597 - DNA, 15 bp, Homo sapiens
actctgatctaaaac

SEQ ID NO: 43598 - DNA, 15 bp, Homo sapiens
aactctgatctaaaa

SEQ ID NO: 43599 - DNA, 15 bp, Homo sapiens
taactctgatctaaa

SEQ ID NO: 43600 - DNA, 15 bp, Homo sapiens
ataactctgatctaa

SEQ ID NO: 43601 - DNA, 15 bp, Homo sapiens
tataactctgatcta

SEQ ID NO: 43602 - DNA, 15 bp, Homo sapiens
ctataactctgatct

SEQ ID NO: 43603 - DNA, 15 bp, Homo sapiens
cctataactctgatc

SEQ ID NO: 43604 - DNA, 15 bp, Homo sapiens
tcctataactctgat

SEQ ID NO: 43605 - DNA, 15 bp, Homo sapiens
gtcctataactctga

SEQ ID NO: 43606 - DNA, 15 bp, Homo sapiens
tgtcctataactctg

SEQ ID NO: 43607 - DNA, 15 bp, Homo sapiens
atgtcctataactct

SEQ ID NO: 43608 - DNA, 15 bp, Homo sapiens
catgtcctataactc

SEQ ID NO: 43609 - DNA, 15 bp, Homo sapiens
acatgtcctataact

SEQ ID NO: 43610 - DNA, 15 bp, Homo sapiens
gacatgtcctataac

SEQ ID NO: 43611 - DNA, 15 bp, Homo sapiens
tgacatgtcctataa

SEQ ID NO: 43612 - DNA, 15 bp, Homo sapiens
ctgacatgtcctata

SEQ ID NO: 43613 - DNA, 15 bp, Homo sapiens
cctgacatgtcctat

SEQ ID NO: 43614 - DNA, 15 bp, Homo sapiens
gcctgacatgtccta

SEQ ID NO: 43615 - DNA, 15 bp, Homo sapiens
agcctgacatgtcct

SEQ ID NO: 43616 - DNA, 15 bp, Homo sapiens
aagcctgacatgtcc

SEQ ID NO: 43617 - DNA, 15 bp, Homo sapiens
taagcctgacatgtc

SEQ ID NO: 43618 - DNA, 15 bp, Homo sapiens
ataagcctgacatgt

SEQ ID NO: 43619 - DNA, 15 bp, Homo sapiens
aataagcctgacatg

SEQ ID NO: 43620 - DNA, 15 bp, Homo sapiens
aaataagcctgacat

SEQ ID NO: 43621 - DNA, 15 bp, Homo sapiens
aaaataagcctgaca

SEQ ID NO: 43622 - DNA, 15 bp, Homo sapiens
taaaataagcctgac

SEQ ID NO: 43623 - DNA, 15 bp, Homo sapiens
ataaaataagcctga

SEQ ID NO: 43624 - DNA, 15 bp, Homo sapiens
gataaaataagcctg

SEQ ID NO: 43625 - DNA, 15 bp, Homo sapiens
agataaaataagcct

SEQ ID NO: 43626 - DNA, 15 bp, Homo sapiens
aagataaaataagcc

SEQ ID NO: 43627 - DNA, 15 bp, Homo sapiens
taagataaaataagc

SEQ ID NO: 43628 - DNA, 15 bp, Homo sapiens
ataagataaaataag

SEQ ID NO: 43629 - DNA, 15 bp, Homo sapiens
aataagataaaataa

SEQ ID NO: 43630 - DNA, 15 bp, Homo sapiens
aaataagataaaata

SEQ ID NO: 43631 - DNA, 15 bp, Homo sapiens
aaaataagataaaat

SEQ ID NO: 43632 - DNA, 15 bp, Homo sapiens
gaaaataagataaaa

SEQ ID NO: 43633 - DNA, 15 bp, Homo sapiens
agaaaataagataaa

SEQ ID NO: 43634 - DNA, 15 bp, Homo sapiens
aagaaaataagataa

SEQ ID NO: 43635 - DNA, 15 bp, Homo sapiens
aaagaaaataagata

SEQ ID NO: 43636 - DNA, 15 bp, Homo sapiens
aaaagaaaataagat

SEQ ID NO: 43637 - DNA, 15 bp, Homo sapiens
taaaagaaaataaga

SEQ ID NO: 43638 - DNA, 15 bp, Homo sapiens
ataaaagaaaataag

SEQ ID NO: 43639 - DNA, 15 bp, Homo sapiens
cataaaagaaaataa

SEQ ID NO: 43640 - DNA, 15 bp, Homo sapiens
tcataaaagaaaata

SEQ ID NO: 43641 - DNA, 15 bp, Homo sapiens
ctcataaaagaaaat

SEQ ID NO: 43642 - DNA, 15 bp, Homo sapiens
tctcataaaagaaaa

SEQ ID NO: 43643 - DNA, 15 bp, Homo sapiens
gtctcataaaagaaa

SEQ ID NO: 43644 - DNA, 15 bp, Homo sapiens
tgtctcataaaagaa

SEQ ID NO: 43645 - DNA, 15 bp, Homo sapiens
ctgtctcataaaaga

SEQ ID NO: 43646 - DNA, 15 bp, Homo sapiens
cctgtctcataaaag

SEQ ID NO: 43647 - DNA, 15 bp, Homo sapiens
acctgtctcataaaa

SEQ ID NO: 43648 - DNA, 15 bp, Homo sapiens
aacctgtctcataaa

SEQ ID NO: 43649 - DNA, 15 bp, Homo sapiens
gaacctgtctcataa

SEQ ID NO: 43650 - DNA, 15 bp, Homo sapiens
agaacctgtctcata

SEQ ID NO: 43651 - DNA, 15 bp, Homo sapiens
gagaacctgtctcat

SEQ ID NO: 43652 - DNA, 15 bp, Homo sapiens
tgagaacctgtctca

SEQ ID NO: 43653 - DNA, 15 bp, Homo sapiens
gtgagaacctgtctc

SEQ ID NO: 43654 - DNA, 15 bp, Homo sapiens
agtgagaacctgtct

SEQ ID NO: 43655 - DNA, 15 bp, Homo sapiens
gagtgagaacctgtc

SEQ ID NO: 43656 - DNA, 15 bp, Homo sapiens
agagtgagaacctgt

SEQ ID NO: 43657 - DNA, 15 bp, Homo sapiens
cagagtgagaacctg

SEQ ID NO: 43658 - DNA, 15 bp, Homo sapiens
acagagtgagaacct

SEQ ID NO: 43659 - DNA, 15 bp, Homo sapiens
gacagagtgagaacc

SEQ ID NO: 43660 - DNA, 15 bp, Homo sapiens
agacagagtgagaac

SEQ ID NO: 43661 - DNA, 15 bp, Homo sapiens
gagacagagtgagaa

SEQ ID NO: 43662 - DNA, 15 bp, Homo sapiens
ggagacagagtgaga

SEQ ID NO: 43663 - DNA, 15 bp, Homo sapiens
gggagacagagtgag

SEQ ID NO: 43664 - DNA, 15 bp, Homo sapiens
tgggagacagagtga

SEQ ID NO: 43665 - DNA, 15 bp, Homo sapiens
ctgggagacagagtg

SEQ ID NO: 43666 - DNA, 15 bp, Homo sapiens
cctgggagacagagt

SEQ ID NO: 43667 - DNA, 15 bp, Homo sapiens
ttagcctgggagaca

SEQ ID NO: 43668 - DNA, 15 bp, Homo sapiens
tttagcctgggagac

SEQ ID NO: 43669 - DNA, 15 bp, Homo sapiens
ctttagcctgggaga

SEQ ID NO: 43670 - DNA, 15 bp, Homo sapiens
actttagcctgggag

SEQ ID NO: 43671 - DNA, 15 bp, Homo sapiens
cactttagcctggga

SEQ ID NO: 43672 - DNA, 15 bp, Homo sapiens
gcactttagcctggg

SEQ ID NO: 43673 - DNA, 15 bp, Homo sapiens
tgcactttagcctgg

SEQ ID NO: 43674 - DNA, 15 bp, Homo sapiens
ctgcactttagcctg

SEQ ID NO: 43675 - DNA, 15 bp, Homo sapiens
actgcactttagcct

SEQ ID NO: 43676 - DNA, 15 bp, Homo sapiens
cactgcactttagcc

SEQ ID NO: 43677 - DNA, 15 bp, Homo sapiens
ccactgcactttagc

SEQ ID NO: 43678 - DNA, 15 bp, Homo sapiens
accactgcactttag

SEQ ID NO: 43679 - DNA, 15 bp, Homo sapiens
caccactgcacttta

SEQ ID NO: 43680 - DNA, 15 bp, Homo sapiens
acaccactgcacttt

SEQ ID NO: 43681 - DNA, 15 bp, Homo sapiens
cacaccactgcactt

SEQ ID NO: 43682 - DNA, 15 bp, Homo sapiens
tgatcacaccactgc

SEQ ID NO: 43683 - DNA, 15 bp, Homo sapiens
atgatcacaccactg

SEQ ID NO: 43684 - DNA, 15 bp, Homo sapiens
catgatcacaccact

SEQ ID NO: 43685 - DNA, 15 bp, Homo sapiens
ccatgatcacaccac

SEQ ID NO: 43686 - DNA, 15 bp, Homo sapiens
gccatgatcacacca

SEQ ID NO: 43687 - DNA, 15 bp, Homo sapiens
agccatgatcacacc

SEQ ID NO: 43688 - DNA, 15 bp, Homo sapiens
gagccatgatcacac

SEQ ID NO: 43689 - DNA, 15 bp, Homo sapiens
tgagccatgatcaca

SEQ ID NO: 43690 - DNA, 15 bp, Homo sapiens
gtgagccatgatcac

SEQ ID NO: 43691 - DNA, 15 bp, Homo sapiens
agtgagccatgatca

SEQ ID NO: 43692 - DNA, 15 bp, Homo sapiens
cagtgagccatgatc

SEQ ID NO: 43693 - DNA, 15 bp, Homo sapiens
gcagtgagccatgat

SEQ ID NO: 43694 - DNA, 15 bp, Homo sapiens
tgcagtgagccatga

SEQ ID NO: 43695 - DNA, 15 bp, Homo sapiens
ctgcagtgagccatg

SEQ ID NO: 43696 - DNA, 15 bp, Homo sapiens
gctgcagtgagccat

SEQ ID NO: 43697 - DNA, 15 bp, Homo sapiens
ggctgcagtgagcca

SEQ ID NO: 43698 - DNA, 15 bp, Homo sapiens
cgaggctgcagtgag

SEQ ID NO: 43699 - DNA, 15 bp, Homo sapiens
tcgaggctgcagtga

SEQ ID NO: 43700 - DNA, 15 bp, Homo sapiens
ttcgaggctgcagtg

SEQ ID NO: 43701 - DNA, 15 bp, Homo sapiens
gttcgaggctgcagt

SEQ ID NO: 43702 - DNA, 15 bp, Homo sapiens
agttcgaggctgcag

SEQ ID NO: 43703 - DNA, 15 bp, Homo sapiens
gagttcgaggctgca

SEQ ID NO: 43704 - DNA, 15 bp, Homo sapiens
agagttcgaggctgc

SEQ ID NO: 43705 - DNA, 15 bp, Homo sapiens
aagagttcgaggctg

SEQ ID NO: 43706 - DNA, 15 bp, Homo sapiens
caagagttcgaggct

SEQ ID NO: 43707 - DNA, 15 bp, Homo sapiens
ccaagagttcgaggc

SEQ ID NO: 43708 - DNA, 15 bp, Homo sapiens
cccaagagttcgagg

SEQ ID NO: 43709 - DNA, 15 bp, Homo sapiens
acccaagagttcgag

SEQ ID NO: 43710 - DNA, 15 bp, Homo sapiens
aacccaagagttcga

SEQ ID NO: 43711 - DNA, 15 bp, Homo sapiens
gaacccaagagttcg

SEQ ID NO: 43712 - DNA, 15 bp, Homo sapiens
tgaacccaagagttc

SEQ ID NO: 43713 - DNA, 15 bp, Homo sapiens
ttgaacccaagagtt

SEQ ID NO: 43714 - DNA, 15 bp, Homo sapiens
cttgaacccaagagt

SEQ ID NO: 43715 - DNA, 15 bp, Homo sapiens
acttgaacccaagag

SEQ ID NO: 43716 - DNA, 15 bp, Homo sapiens
cacttgaacccaaga

SEQ ID NO: 43717 - DNA, 15 bp, Homo sapiens
tcacttgaacccaag

SEQ ID NO: 43718 - DNA, 15 bp, Homo sapiens
atcacttgaacccaa

SEQ ID NO: 43719 - DNA, 15 bp, Homo sapiens
gggtgggaggatcac

SEQ ID NO: 43720 - DNA, 15 bp, Homo sapiens
ggggtgggaggatca

SEQ ID NO: 43721 - DNA, 15 bp, Homo sapiens
tggggtgggaggatc

SEQ ID NO: 43722 - DNA, 15 bp, Homo sapiens
gtggggtgggaggat

SEQ ID NO: 43723 - DNA, 15 bp, Homo sapiens
ggtggggtgggagga

SEQ ID NO: 43724 - DNA, 15 bp, Homo sapiens
gggtggggtgggagg

SEQ ID NO: 43725 - DNA, 15 bp, Homo sapiens
agggtggggtgggag

SEQ ID NO: 43726 - DNA, 15 bp, Homo sapiens
gagggtggggtggga

SEQ ID NO: 43727 - DNA, 15 bp, Homo sapiens
ggagggtggggtggg

SEQ ID NO: 43728 - DNA, 15 bp, Homo sapiens
gggagggtggggtgg

SEQ ID NO: 43729 - DNA, 15 bp, Homo sapiens
tgggagggtggggtg

SEQ ID NO: 43730 - DNA, 15 bp, Homo sapiens
ttgggagggtggggt

SEQ ID NO: 43731 - DNA, 15 bp, Homo sapiens
cttgggagggtgggg

SEQ ID NO: 43732 - DNA, 15 bp, Homo sapiens
acttgggagggtggg

SEQ ID NO: 43733 - DNA, 15 bp, Homo sapiens
tacttgggagggtgg

SEQ ID NO: 43734 - DNA, 15 bp, Homo sapiens
ctacttgggagggtg

SEQ ID NO: 43735 - DNA, 15 bp, Homo sapiens
gctacttgggagggt

SEQ ID NO: 43736 - DNA, 15 bp, Homo sapiens
agctacttgggaggg

SEQ ID NO: 43737 - DNA, 15 bp, Homo sapiens
atgcctgtggtccca

SEQ ID NO: 43738 - DNA, 15 bp, Homo sapiens
tatgcctgtggtccc

SEQ ID NO: 43739 - DNA, 15 bp, Homo sapiens
atatgcctgtggtcc

SEQ ID NO: 43740 - DNA, 15 bp, Homo sapiens
catatgcctgtggtc

SEQ ID NO: 43741 - DNA, 15 bp, Homo sapiens
gcatatgcctgtggt

SEQ ID NO: 43742 - DNA, 15 bp, Homo sapiens
ggcatatgcctgtgg

SEQ ID NO: 43743 - DNA, 15 bp, Homo sapiens
tggcatatgcctgtg

SEQ ID NO: 43744 - DNA, 15 bp, Homo sapiens
gtggcatatgcctgt

SEQ ID NO: 43745 - DNA, 15 bp, Homo sapiens
ggtggcatatgcctg

SEQ ID NO: 43746 - DNA, 15 bp, Homo sapiens
tggtggcatatgcct

SEQ ID NO: 43747 - DNA, 15 bp, Homo sapiens
gtggtggcatatgcc

SEQ ID NO: 43748 - DNA, 15 bp, Homo sapiens
tgtggtggcatatgc

SEQ ID NO: 43749 - DNA, 15 bp, Homo sapiens
gtgtggtggcatatg

SEQ ID NO: 43750 - DNA, 15 bp, Homo sapiens
ggtgtggtggcatat

SEQ ID NO: 43751 - DNA, 15 bp, Homo sapiens
gggtgtggtggcata

SEQ ID NO: 43752 - DNA, 15 bp, Homo sapiens
tgggtgtggtggcat

SEQ ID NO: 43753 - DNA, 15 bp, Homo sapiens
gtacaaaaattagct

SEQ ID NO: 43754 - DNA, 15 bp, Homo sapiens
agtacaaaaattagc

SEQ ID NO: 43755 - DNA, 15 bp, Homo sapiens
aagtacaaaaattag

SEQ ID NO: 43756 - DNA, 15 bp, Homo sapiens
aaagtacaaaaatta

SEQ ID NO: 43757 - DNA, 15 bp, Homo sapiens
aaaagtacaaaaatt

SEQ ID NO: 43758 - DNA, 15 bp, Homo sapiens
aaaaagtacaaaaat

SEQ ID NO: 43759 - DNA, 15 bp, Homo sapiens
caaaaagtacaaaaa

SEQ ID NO: 43760 - DNA, 15 bp, Homo sapiens
acaaaaagtacaaaa

SEQ ID NO: 43761 - DNA, 15 bp, Homo sapiens
tacaaaaagtacaaa

SEQ ID NO: 43762 - DNA, 15 bp, Homo sapiens
ctacaaaaagtacaa

SEQ ID NO: 43763 - DNA, 15 bp, Homo sapiens
tctacaaaaagtaca

SEQ ID NO: 43764 - DNA, 15 bp, Homo sapiens
ctctacaaaaagtac

SEQ ID NO: 43765 - DNA, 15 bp, Homo sapiens
tctctacaaaaagta

SEQ ID NO: 43766 - DNA, 15 bp, Homo sapiens
gtctctacaaaaagt

SEQ ID NO: 43767 - DNA, 15 bp, Homo sapiens
tgtctctacaaaaag

SEQ ID NO: 43768 - DNA, 15 bp, Homo sapiens
cctgtctctacaaaa

SEQ ID NO: 43769 - DNA, 15 bp, Homo sapiens
ccctgtctctacaaa

SEQ ID NO: 43770 - DNA, 15 bp, Homo sapiens
accctgtctctacaa

SEQ ID NO: 43771 - DNA, 15 bp, Homo sapiens
aaccctgtctctaca

SEQ ID NO: 43772 - DNA, 15 bp, Homo sapiens
aaaaccctgtctcta

SEQ ID NO: 43773 - DNA, 15 bp, Homo sapiens
taaaaccctgtctct

SEQ ID NO: 43774 - DNA, 15 bp, Homo sapiens
gtaaaaccctgtctc

SEQ ID NO: 43775 - DNA, 15 bp, Homo sapiens
ggtaaaaccctgtct

SEQ ID NO: 43776 - DNA, 15 bp, Homo sapiens
tggtaaaaccctgtc

SEQ ID NO: 43777 - DNA, 15 bp, Homo sapiens
atggtaaaaccctgt

SEQ ID NO: 43778 - DNA, 15 bp, Homo sapiens
aatggtaaaaccctg

SEQ ID NO: 43779 - DNA, 15 bp, Homo sapiens
aaatggtaaaaccct

SEQ ID NO: 43780 - DNA, 15 bp, Homo sapiens
aaaatggtaaaaccc

SEQ ID NO: 43781 - DNA, 15 bp, Homo sapiens
caaaatggtaaaacc

SEQ ID NO: 43782 - DNA, 15 bp, Homo sapiens
gcaaaatggtaaaac

SEQ ID NO: 43783 - DNA, 15 bp, Homo sapiens
ggcaaaatggtaaaa

SEQ ID NO: 43784 - DNA, 15 bp, Homo sapiens
gggcaaaatggtaaa

SEQ ID NO: 43785 - DNA, 15 bp, Homo sapiens
tgggcaaaatggtaa

SEQ ID NO: 43786 - DNA, 15 bp, Homo sapiens
ctgggcaaaatggta

SEQ ID NO: 43787 - DNA, 15 bp, Homo sapiens
cctgggcaaaatggt

SEQ ID NO: 43788 - DNA, 15 bp, Homo sapiens
gcctgggcaaaatgg

SEQ ID NO: 43789 - DNA, 15 bp, Homo sapiens
agcctgggcaaaatg

SEQ ID NO: 43790 - DNA, 15 bp, Homo sapiens
cagcctgggcaaaat

SEQ ID NO: 43791 - DNA, 15 bp, Homo sapiens
accagcctgggcaaa

SEQ ID NO: 43792 - DNA, 15 bp, Homo sapiens
cgagaccagcctggg

SEQ ID NO: 43793 - DNA, 15 bp, Homo sapiens
ccaggagttcgagac

SEQ ID NO: 43794 - DNA, 15 bp, Homo sapiens
cccaggagttcgaga

SEQ ID NO: 43795 - DNA, 15 bp, Homo sapiens
gcccaggagttcgag

SEQ ID NO: 43796 - DNA, 15 bp, Homo sapiens
agcccaggagttcga

SEQ ID NO: 43797 - DNA, 15 bp, Homo sapiens
gagcccaggagttcg

SEQ ID NO: 43798 - DNA, 15 bp, Homo sapiens
tggatcacttgagcc

SEQ ID NO: 43799 - DNA, 15 bp, Homo sapiens
gtggatcacttgagc

SEQ ID NO: 43800 - DNA, 15 bp, Homo sapiens
agtggatcacttgag

SEQ ID NO: 43801 - DNA, 15 bp, Homo sapiens
gagtggatcacttga

SEQ ID NO: 43802 - DNA, 15 bp, Homo sapiens
cgagtggatcacttg

SEQ ID NO: 43803 - DNA, 15 bp, Homo sapiens
gcgagtggatcactt

SEQ ID NO: 43804 - DNA, 15 bp, Homo sapiens
ggcgagtggatcact

SEQ ID NO: 43805 - DNA, 15 bp, Homo sapiens
aggcgagtggatcac

SEQ ID NO: 43806 - DNA, 15 bp, Homo sapiens
aaggcgagtggatca

SEQ ID NO: 43807 - DNA, 15 bp, Homo sapiens
taaggcgagtggatc

SEQ ID NO: 43808 - DNA, 15 bp, Homo sapiens
ctaaggcgagtggat

SEQ ID NO: 43809 - DNA, 15 bp, Homo sapiens
gctaaggcgagtgga

SEQ ID NO: 43810 - DNA, 15 bp, Homo sapiens
ggctaaggcgagtgg

SEQ ID NO: 43811 - DNA, 15 bp, Homo sapiens
aggctaaggcgagtg

SEQ ID NO: 43812 - DNA, 15 bp, Homo sapiens
gaggctaaggcgagt

SEQ ID NO: 43813 - DNA, 15 bp, Homo sapiens
ggaggctaaggcgag

SEQ ID NO: 43814 - DNA, 15 bp, Homo sapiens
gggaggctaaggcga

SEQ ID NO: 43815 - DNA, 15 bp, Homo sapiens
tgggaggctaaggcg

SEQ ID NO: 43816 - DNA, 15 bp, Homo sapiens
ttgggaggctaaggc

SEQ ID NO: 43817 - DNA, 15 bp, Homo sapiens
tttgggaggctaagg

SEQ ID NO: 43818 - DNA, 15 bp, Homo sapiens
ctttgggaggctaag

SEQ ID NO: 43819 - DNA, 15 bp, Homo sapiens
actttgggaggctaa

SEQ ID NO: 43820 - DNA, 15 bp, Homo sapiens
cactttgggaggcta

SEQ ID NO: 43821 - DNA, 15 bp, Homo sapiens
acactttgggaggct

SEQ ID NO: 43822 - DNA, 15 bp, Homo sapiens
tctgtaatcccaaca

SEQ ID NO: 43823 - DNA, 15 bp, Homo sapiens
gtctgtaatcccaac

SEQ ID NO: 43824 - DNA, 15 bp, Homo sapiens
tgtctgtaatcccaa

SEQ ID NO: 43825 - DNA, 15 bp, Homo sapiens
atgtctgtaatccca

SEQ ID NO: 43826 - DNA, 15 bp, Homo sapiens
catgtctgtaatccc

SEQ ID NO: 43827 - DNA, 15 bp, Homo sapiens
tcatgtctgtaatcc

SEQ ID NO: 43828 - DNA, 15 bp, Homo sapiens
ctcatgtctgtaatc

SEQ ID NO: 43829 - DNA, 15 bp, Homo sapiens
actcatgtctgtaat

SEQ ID NO: 43830 - DNA, 15 bp, Homo sapiens
gactcatgtctgtaa

SEQ ID NO: 43831 - DNA, 15 bp, Homo sapiens
tgactcatgtctgta

SEQ ID NO: 43832 - DNA, 15 bp, Homo sapiens
atgactcatgtctgt

SEQ ID NO: 43833 - DNA, 15 bp, Homo sapiens
aatgactcatgtctg

SEQ ID NO: 43834 - DNA, 15 bp, Homo sapiens
caatgactcatgtct

SEQ ID NO: 43835 - DNA, 15 bp, Homo sapiens
gcaatgactcatgtc

SEQ ID NO: 43836 - DNA, 15 bp, Homo sapiens
cgcaatgactcatgt

SEQ ID NO: 43837 - DNA, 15 bp, Homo sapiens
gcgcaatgactcatg

SEQ ID NO: 43838 - DNA, 15 bp, Homo sapiens
ggcgcaatgactcat

SEQ ID NO: 43839 - DNA, 15 bp, Homo sapiens
gggcgcaatgactca

SEQ ID NO: 43840 - DNA, 15 bp, Homo sapiens
tgggcgcaatgactc

SEQ ID NO: 43841 - DNA, 15 bp, Homo sapiens
ctgggcgcaatgact

SEQ ID NO: 43842 - DNA, 15 bp, Homo sapiens
cctgggcgcaatgac

SEQ ID NO: 43843 - DNA, 15 bp, Homo sapiens
gcctgggcgcaatga

SEQ ID NO: 43844 - DNA, 15 bp, Homo sapiens
ggcctgggcgcaatg

SEQ ID NO: 43845 - DNA, 15 bp, Homo sapiens
tggcctgggcgcaat

SEQ ID NO: 43846 - DNA, 15 bp, Homo sapiens
atggcctgggcgcaa

SEQ ID NO: 43847 - DNA, 15 bp, Homo sapiens
aatggcctgggcgca

SEQ ID NO: 43848 - DNA, 15 bp, Homo sapiens
aaatggcctgggcgc

SEQ ID NO: 43849 - DNA, 15 bp, Homo sapiens
gaaatggcctgggcg

SEQ ID NO: 43850 - DNA, 15 bp, Homo sapiens
tgaaatggcctgggc

SEQ ID NO: 43851 - DNA, 15 bp, Homo sapiens
ctgaaatggcctggg

SEQ ID NO: 43852 - DNA, 15 bp, Homo sapiens
gctgaaatggcctgg

SEQ ID NO: 43853 - DNA, 15 bp, Homo sapiens
ggctgaaatggcctg

SEQ ID NO: 43854 - DNA, 15 bp, Homo sapiens
aggctgaaatggcct

SEQ ID NO: 43855 - DNA, 15 bp, Homo sapiens
caggctgaaatggcc

SEQ ID NO: 43856 - DNA, 15 bp, Homo sapiens
acaggctgaaatggc

SEQ ID NO: 43857 - DNA, 15 bp, Homo sapiens
aacaggctgaaatgg

SEQ ID NO: 43858 - DNA, 15 bp, Homo sapiens
aaacaggctgaaatg

SEQ ID NO: 43859 - DNA, 15 bp, Homo sapiens
taaacaggctgaaat

SEQ ID NO: 43860 - DNA, 15 bp, Homo sapiens
ttaaacaggctgaaa

SEQ ID NO: 43861 - DNA, 15 bp, Homo sapiens
gttaaacaggctgaa

SEQ ID NO: 43862 - DNA, 15 bp, Homo sapiens
tgttaaacaggctga

SEQ ID NO: 43863 - DNA, 15 bp, Homo sapiens
atgttaaacaggctg

SEQ ID NO: 43864 - DNA, 15 bp, Homo sapiens
aatgttaaacaggct

SEQ ID NO: 43865 - DNA, 15 bp, Homo sapiens
gaatgttaaacaggc

SEQ ID NO: 43866 - DNA, 15 bp, Homo sapiens
ggaatgttaaacagg

SEQ ID NO: 43867 - DNA, 15 bp, Homo sapiens
aggaatgttaaacag

SEQ ID NO: 43868 - DNA, 15 bp, Homo sapiens
aaggaatgttaaaca

SEQ ID NO: 43869 - DNA, 15 bp, Homo sapiens
aaaggaatgttaaac

SEQ ID NO: 43870 - DNA, 15 bp, Homo sapiens
aaaaggaatgttaaa

SEQ ID NO: 43871 - DNA, 15 bp, Homo sapiens
caaaaggaatgttaa

SEQ ID NO: 43872 - DNA, 15 bp, Homo sapiens
gcaaaaggaatgtta

SEQ ID NO: 43873 - DNA, 15 bp, Homo sapiens
tgcaaaaggaatgtt

SEQ ID NO: 43874 - DNA, 15 bp, Homo sapiens
ctgcaaaaggaatgt

SEQ ID NO: 43875 - DNA, 15 bp, Homo sapiens
tctgcaaaaggaatg

SEQ ID NO: 43876 - DNA, 15 bp, Homo sapiens
ctctgcaaaaggaat

SEQ ID NO: 43877 - DNA, 15 bp, Homo sapiens
gctctgcaaaaggaa

SEQ ID NO: 43878 - DNA, 15 bp, Homo sapiens
agctctgcaaaagga

SEQ ID NO: 43879 - DNA, 15 bp, Homo sapiens
cagctctgcaaaagg

SEQ ID NO: 43880 - DNA, 15 bp, Homo sapiens
ccagctctgcaaaag

SEQ ID NO: 43881 - DNA, 15 bp, Homo sapiens
tccagctctgcaaaa

SEQ ID NO: 43882 - DNA, 15 bp, Homo sapiens
ttccagctctgcaaa

SEQ ID NO: 43883 - DNA, 15 bp, Homo sapiens
gttccagctctgcaa

SEQ ID NO: 43884 - DNA, 15 bp, Homo sapiens
tgttccagctctgca

SEQ ID NO: 43885 - DNA, 15 bp, Homo sapiens
atgttccagctctgc

SEQ ID NO: 43886 - DNA, 15 bp, Homo sapiens
gatgttccagctctg

SEQ ID NO: 43887 - DNA, 15 bp, Homo sapiens
ggatgttccagctct

SEQ ID NO: 43888 - DNA, 15 bp, Homo sapiens
tggatgttccagctc

SEQ ID NO: 43889 - DNA, 15 bp, Homo sapiens
ttggatgttccagct

SEQ ID NO: 43890 - DNA, 15 bp, Homo sapiens
gttggatgttccagc

SEQ ID NO: 43891 - DNA, 15 bp, Homo sapiens
agttggatgttccag

SEQ ID NO: 43892 - DNA, 15 bp, Homo sapiens
gagttggatgttcca

SEQ ID NO: 43893 - DNA, 15 bp, Homo sapiens
ggagttggatgttcc

SEQ ID NO: 43894 - DNA, 15 bp, Homo sapiens
tggagttggatgttc

SEQ ID NO: 43895 - DNA, 15 bp, Homo sapiens
ttggagttggatgtt

SEQ ID NO: 43896 - DNA, 15 bp, Homo sapiens
gttggagttggatgt

SEQ ID NO: 43897 - DNA, 15 bp, Homo sapiens
agttggagttggatg

SEQ ID NO: 43898 - DNA, 15 bp, Homo sapiens
aagttggagttggat

SEQ ID NO: 43899 - DNA, 15 bp, Homo sapiens
caagttggagttgga

SEQ ID NO: 43900 - DNA, 15 bp, Homo sapiens
acaagttggagttgg

SEQ ID NO: 43901 - DNA, 15 bp, Homo sapiens
tacaagttggagttg

SEQ ID NO: 43902 - DNA, 15 bp, Homo sapiens
ctacaagttggagtt

SEQ ID NO: 43903 - DNA, 15 bp, Homo sapiens
tctacaagttggagt

SEQ ID NO: 43904 - DNA, 15 bp, Homo sapiens
gtctacaagttggag

SEQ ID NO: 43905 - DNA, 15 bp, Homo sapiens
ggtctacaagttgga

SEQ ID NO: 43906 - DNA, 15 bp, Homo sapiens
tggtctacaagttgg

SEQ ID NO: 43907 - DNA, 15 bp, Homo sapiens
ctggtctacaagttg

SEQ ID NO: 43908 - DNA, 15 bp, Homo sapiens
tctggtctacaagtt

SEQ ID NO: 43909 - DNA, 15 bp, Homo sapiens
ttctggtctacaagt

SEQ ID NO: 43910 - DNA, 15 bp, Homo sapiens
tttctggtctacaag

SEQ ID NO: 43911 - DNA, 15 bp, Homo sapiens
atttctggtctacaa

SEQ ID NO: 43912 - DNA, 15 bp, Homo sapiens
tatttctggtctaca

SEQ ID NO: 43913 - DNA, 15 bp, Homo sapiens
gtatttctggtctac

SEQ ID NO: 43914 - DNA, 15 bp, Homo sapiens
agtatttctggtcta

SEQ ID NO: 43915 - DNA, 15 bp, Homo sapiens
gagtatttctggtct

SEQ ID NO: 43916 - DNA, 15 bp, Homo sapiens
ggagtatttctggtc

SEQ ID NO: 43917 - DNA, 15 bp, Homo sapiens
aggagtatttctggt

SEQ ID NO: 43918 - DNA, 15 bp, Homo sapiens
caggagtatttctgg

SEQ ID NO: 43919 - DNA, 15 bp, Homo sapiens
tcaggagtatttctg

SEQ ID NO: 43920 - DNA, 15 bp, Homo sapiens
ttcaggagtatttct

SEQ ID NO: 43921 - DNA, 15 bp, Homo sapiens
attcaggagtatttc

SEQ ID NO: 43922 - DNA, 15 bp, Homo sapiens
aattcaggagtattt

SEQ ID NO: 43923 - DNA, 15 bp, Homo sapiens
aaattcaggagtatt

SEQ ID NO: 43924 - DNA, 15 bp, Homo sapiens
gaaattcaggagtat

SEQ ID NO: 43925 - DNA, 15 bp, Homo sapiens
agaaattcaggagta

SEQ ID NO: 43926 - DNA, 15 bp, Homo sapiens
aagaaattcaggagt

SEQ ID NO: 43927 - DNA, 15 bp, Homo sapiens
aaagaaattcaggag

SEQ ID NO: 43928 - DNA, 15 bp, Homo sapiens
gaaagaaattcagga

SEQ ID NO: 43929 - DNA, 15 bp, Homo sapiens
ggaaagaaattcagg

SEQ ID NO: 43930 - DNA, 15 bp, Homo sapiens
aggaaagaaattcag

SEQ ID NO: 43931 - DNA, 15 bp, Homo sapiens
gaggaaagaaattca

SEQ ID NO: 43932 - DNA, 15 bp, Homo sapiens
tgaggaaagaaattc

SEQ ID NO: 43933 - DNA, 15 bp, Homo sapiens
ctgaggaaagaaatt

SEQ ID NO: 43934 - DNA, 15 bp, Homo sapiens
tctgaggaaagaaat

SEQ ID NO: 43935 - DNA, 15 bp, Homo sapiens
gtctgaggaaagaaa

SEQ ID NO: 43936 - DNA, 15 bp, Homo sapiens
agtctgaggaaagaa

SEQ ID NO: 43937 - DNA, 15 bp, Homo sapiens
aagtctgaggaaaga

SEQ ID NO: 43938 - DNA, 15 bp, Homo sapiens
taagtctgaggaaag

SEQ ID NO: 43939 - DNA, 15 bp, Homo sapiens
ataagtctgaggaaa

SEQ ID NO: 43940 - DNA, 15 bp, Homo sapiens
gataagtctgaggaa

SEQ ID NO: 43941 - DNA, 15 bp, Homo sapiens
agataagtctgagga

SEQ ID NO: 43942 - DNA, 15 bp, Homo sapiens
gagataagtctgagg

SEQ ID NO: 43943 - DNA, 15 bp, Homo sapiens
tgagataagtctgag

SEQ ID NO: 43944 - DNA, 15 bp, Homo sapiens
ctgagataagtctga

SEQ ID NO: 43945 - DNA, 15 bp, Homo sapiens
actgagataagtctg

SEQ ID NO: 43946 - DNA, 15 bp, Homo sapiens
cactgagataagtct

SEQ ID NO: 43947 - DNA, 15 bp, Homo sapiens
ccactgagataagtc

SEQ ID NO: 43948 - DNA, 15 bp, Homo sapiens
gccactgagataagt

SEQ ID NO: 43949 - DNA, 15 bp, Homo sapiens
tgccactgagataag

SEQ ID NO: 43950 - DNA, 15 bp, Homo sapiens
gtgccactgagataa

SEQ ID NO: 43951 - DNA, 15 bp, Homo sapiens
ggtgccactgagata

SEQ ID NO: 43952 - DNA, 15 bp, Homo sapiens
tggtgccactgagat

SEQ ID NO: 43953 - DNA, 15 bp, Homo sapiens
ctggtgccactgaga

SEQ ID NO: 43954 - DNA, 15 bp, Homo sapiens
tctggtgccactgag

SEQ ID NO: 43955 - DNA, 15 bp, Homo sapiens
atctggtgccactga

SEQ ID NO: 43956 - DNA, 15 bp, Homo sapiens
aatctggtgccactg

SEQ ID NO: 43957 - DNA, 15 bp, Homo sapiens
caatctggtgccact

SEQ ID NO: 43958 - DNA, 15 bp, Homo sapiens
tcaatctggtgccac

SEQ ID NO: 43959 - DNA, 15 bp, Homo sapiens
ctcaatctggtgcca

SEQ ID NO: 43960 - DNA, 15 bp, Homo sapiens
actcaatctggtgcc

SEQ ID NO: 43961 - DNA, 15 bp, Homo sapiens
aactcaatctggtgc

SEQ ID NO: 43962 - DNA, 15 bp, Homo sapiens
taactcaatctggtg

SEQ ID NO: 43963 - DNA, 15 bp, Homo sapiens
ctaactcaatctggt

SEQ ID NO: 43964 - DNA, 15 bp, Homo sapiens
cctaactcaatctgg

SEQ ID NO: 43965 - DNA, 15 bp, Homo sapiens
tcctaactcaatctg

SEQ ID NO: 43966 - DNA, 15 bp, Homo sapiens
atcctaactcaatct

SEQ ID NO: 43967 - DNA, 15 bp, Homo sapiens
aatcctaactcaatc

SEQ ID NO: 43968 - DNA, 15 bp, Homo sapiens
caatcctaactcaat

SEQ ID NO: 43969 - DNA, 15 bp, Homo sapiens
tcaatcctaactcaa

SEQ ID NO: 43970 - DNA, 15 bp, Homo sapiens
ctcaatcctaactca

SEQ ID NO: 43971 - DNA, 15 bp, Homo sapiens
actcaatcctaactc

SEQ ID NO: 43972 - DNA, 15 bp, Homo sapiens
aactcaatcctaact

SEQ ID NO: 43973 - DNA, 15 bp, Homo sapiens
aaactcaatcctaac

SEQ ID NO: 43974 - DNA, 15 bp, Homo sapiens
taaactcaatcctaa

SEQ ID NO: 43975 - DNA, 15 bp, Homo sapiens
ctaaactcaatccta

SEQ ID NO: 43976 - DNA, 15 bp, Homo sapiens
gctaaactcaatcct

SEQ ID NO: 43977 - DNA, 15 bp, Homo sapiens
agctaaactcaatcc

SEQ ID NO: 43978 - DNA, 15 bp, Homo sapiens
cagctaaactcaatc

SEQ ID NO: 43979 - DNA, 15 bp, Homo sapiens
gcagctaaactcaat

SEQ ID NO: 43980 - DNA, 15 bp, Homo sapiens
tgcagctaaactcaa

SEQ ID NO: 43981 - DNA, 15 bp, Homo sapiens
ttgcagctaaactca

SEQ ID NO: 43982 - DNA, 15 bp, Homo sapiens
cttgcagctaaactc

SEQ ID NO: 43983 - DNA, 15 bp, Homo sapiens
acttgcagctaaact

SEQ ID NO: 43984 - DNA, 15 bp, Homo sapiens
tacttgcagctaaac

SEQ ID NO: 43985 - DNA, 15 bp, Homo sapiens
ttacttgcagctaaa

SEQ ID NO: 43986 - DNA, 15 bp, Homo sapiens
cttacttgcagctaa

SEQ ID NO: 43987 - DNA, 15 bp, Homo sapiens
tcttacttgcagcta

SEQ ID NO: 43988 - DNA, 15 bp, Homo sapiens
ctcttacttgcagct

SEQ ID NO: 43989 - DNA, 15 bp, Homo sapiens
tctcttacttgcagc

SEQ ID NO: 43990 - DNA, 15 bp, Homo sapiens
ttctcttacttgcag

SEQ ID NO: 43991 - DNA, 15 bp, Homo sapiens
tttctcttacttgca

SEQ ID NO: 43992 - DNA, 15 bp, Homo sapiens
gtttctcttacttgc

SEQ ID NO: 43993 - DNA, 15 bp, Homo sapiens
ggtttctcttacttg

SEQ ID NO: 43994 - DNA, 15 bp, Homo sapiens
gggtttctcttactt

SEQ ID NO: 43995 - DNA, 15 bp, Homo sapiens
agggtttctcttact

SEQ ID NO: 43996 - DNA, 15 bp, Homo sapiens
aagggtttctcttac

SEQ ID NO: 43997 - DNA, 15 bp, Homo sapiens
aaagggtttctctta

SEQ ID NO: 43998 - DNA, 15 bp, Homo sapiens
aaaagggtttctctt

SEQ ID NO: 43999 - DNA, 15 bp, Homo sapiens
taaaagggtttctct

SEQ ID NO: 44000 - DNA, 15 bp, Homo sapiens
gtaaaagggtttctc

SEQ ID NO: 44001 - DNA, 15 bp, Homo sapiens
cgtaaaagggtttct

SEQ ID NO: 44002 - DNA, 15 bp, Homo sapiens
tcgtaaaagggtttc

SEQ ID NO: 44003 - DNA, 15 bp, Homo sapiens
atcgtaaaagggttt

SEQ ID NO: 44004 - DNA, 15 bp, Homo sapiens
tatcgtaaaagggtt

SEQ ID NO: 44005 - DNA, 15 bp, Homo sapiens
ctatcgtaaaagggt

SEQ ID NO: 44006 - DNA, 15 bp, Homo sapiens
tctatcgtaaaaggg

SEQ ID NO: 44007 - DNA, 15 bp, Homo sapiens
atctatcgtaaaagg

SEQ ID NO: 44008 - DNA, 15 bp, Homo sapiens
aatctatcgtaaaag

SEQ ID NO: 44009 - DNA, 15 bp, Homo sapiens
taatctatcgtaaaa

SEQ ID NO: 44010 - DNA, 15 bp, Homo sapiens
ttaatctatcgtaaa

SEQ ID NO: 44011 - DNA, 15 bp, Homo sapiens
gttaatctatcgtaa

SEQ ID NO: 44012 - DNA, 15 bp, Homo sapiens
agttaatctatcgta

SEQ ID NO: 44013 - DNA, 15 bp, Homo sapiens
tagttaatctatcgt

SEQ ID NO: 44014 - DNA, 15 bp, Homo sapiens
ttagttaatctatcg

SEQ ID NO: 44015 - DNA, 15 bp, Homo sapiens
cttagttaatctatc

SEQ ID NO: 44016 - DNA, 15 bp, Homo sapiens
tcttagttaatctat

SEQ ID NO: 44017 - DNA, 15 bp, Homo sapiens
ttcttagttaatcta

SEQ ID NO: 44018 - DNA, 15 bp, Homo sapiens
tttcttagttaatct

SEQ ID NO: 44019 - DNA, 15 bp, Homo sapiens
ctttcttagttaatc

SEQ ID NO: 44020 - DNA, 15 bp, Homo sapiens
tctttcttagttaat

SEQ ID NO: 44021 - DNA, 15 bp, Homo sapiens
ttctttcttagttaa

SEQ ID NO: 44022 - DNA, 15 bp, Homo sapiens
gttctttcttagtta

SEQ ID NO: 44023 - DNA, 15 bp, Homo sapiens
agttctttcttagtt

SEQ ID NO: 44024 - DNA, 15 bp, Homo sapiens
gagttctttcttagt

SEQ ID NO: 44025 - DNA, 15 bp, Homo sapiens
tgagttctttcttag

SEQ ID NO: 44026 - DNA, 15 bp, Homo sapiens
atgagttctttctta

SEQ ID NO: 44027 - DNA, 15 bp, Homo sapiens
aatgagttctttctt

SEQ ID NO: 44028 - DNA, 15 bp, Homo sapiens
aaatgagttctttct

SEQ ID NO: 44029 - DNA, 15 bp, Homo sapiens
aaaatgagttctttc

SEQ ID NO: 44030 - DNA, 15 bp, Homo sapiens
aaaaatgagttcttt

SEQ ID NO: 44031 - DNA, 15 bp, Homo sapiens
gaaaaatgagttctt

SEQ ID NO: 44032 - DNA, 15 bp, Homo sapiens
agaaaaatgagttct

SEQ ID NO: 44033 - DNA, 15 bp, Homo sapiens
gagaaaaatgagttc

SEQ ID NO: 44034 - DNA, 15 bp, Homo sapiens
tgagaaaaatgagtt

SEQ ID NO: 44035 - DNA, 15 bp, Homo sapiens
ttgagaaaaatgagt

SEQ ID NO: 44036 - DNA, 15 bp, Homo sapiens
cttgagaaaaatgag

SEQ ID NO: 44037 - DNA, 15 bp, Homo sapiens
acttgagaaaaatga

SEQ ID NO: 44038 - DNA, 15 bp, Homo sapiens
tacttgagaaaaatg

SEQ ID NO: 44039 - DNA, 15 bp, Homo sapiens
ttacttgagaaaaat

SEQ ID NO: 44040 - DNA, 15 bp, Homo sapiens
cttacttgagaaaaa

SEQ ID NO: 44041 - DNA, 15 bp, Homo sapiens
gcttacttgagaaaa

SEQ ID NO: 44042 - DNA, 15 bp, Homo sapiens
agcttacttgagaaa

SEQ ID NO: 44043 - DNA, 15 bp, Homo sapiens
aagcttacttgagaa

SEQ ID NO: 44044 - DNA, 15 bp, Homo sapiens
gaagcttacttgaga

SEQ ID NO: 44045 - DNA, 15 bp, Homo sapiens
tgaagcttacttgag

SEQ ID NO: 44046 - DNA, 15 bp, Homo sapiens
ctgaagcttacttga

SEQ ID NO: 44047 - DNA, 15 bp, Homo sapiens
actgaagcttacttg

SEQ ID NO: 44048 - DNA, 15 bp, Homo sapiens
gactgaagcttactt

SEQ ID NO: 44049 - DNA, 15 bp, Homo sapiens
agactgaagcttact

SEQ ID NO: 44050 - DNA, 15 bp, Homo sapiens
cagactgaagcttac

SEQ ID NO: 44051 - DNA, 15 bp, Homo sapiens
acagactgaagctta

SEQ ID NO: 44052 - DNA, 15 bp, Homo sapiens
tacagactgaagctt

SEQ ID NO: 44053 - DNA, 15 bp, Homo sapiens
ctacagactgaagct

SEQ ID NO: 44054 - DNA, 15 bp, Homo sapiens
cctacagactgaagc

SEQ ID NO: 44055 - DNA, 15 bp, Homo sapiens
acctacagactgaag

SEQ ID NO: 44056 - DNA, 15 bp, Homo sapiens
tacctacagactgaa

SEQ ID NO: 44057 - DNA, 15 bp, Homo sapiens
ctacctacagactga

SEQ ID NO: 44058 - DNA, 15 bp, Homo sapiens
cctacctacagactg

SEQ ID NO: 44059 - DNA, 15 bp, Homo sapiens
gcctacctacagact

SEQ ID NO: 44060 - DNA, 15 bp, Homo sapiens
tgcctacctacagac

SEQ ID NO: 44061 - DNA, 15 bp, Homo sapiens
ttgcctacctacaga

SEQ ID NO: 44062 - DNA, 15 bp, Homo sapiens
gttgcctacctacag

SEQ ID NO: 44063 - DNA, 15 bp, Homo sapiens
ggttgcctacctaca

SEQ ID NO: 44064 - DNA, 15 bp, Homo sapiens
gggttgcctacctac

SEQ ID NO: 44065 - DNA, 15 bp, Homo sapiens
tgggttgcctaccta

SEQ ID NO: 44066 - DNA, 15 bp, Homo sapiens
ctgggttgcctacct

SEQ ID NO: 44067 - DNA, 15 bp, Homo sapiens
cctgggttgcctacc

SEQ ID NO: 44068 - DNA, 15 bp, Homo sapiens
ccctgggttgcctac

SEQ ID NO: 44069 - DNA, 15 bp, Homo sapiens
gccctgggttgccta

SEQ ID NO: 44070 - DNA, 15 bp, Homo sapiens
agccctgggttgcct

SEQ ID NO: 44071 - DNA, 15 bp, Homo sapiens
cagccctgggttgcc

SEQ ID NO: 44072 - DNA, 15 bp, Homo sapiens
ccagccctgggttgc

SEQ ID NO: 44073 - DNA, 15 bp, Homo sapiens
accagccctgggttg

SEQ ID NO: 44074 - DNA, 15 bp, Homo sapiens
aaccagccctgggtt

SEQ ID NO: 44075 - DNA, 15 bp, Homo sapiens
taaccagccctgggt

SEQ ID NO: 44076 - DNA, 15 bp, Homo sapiens
gtaaccagccctggg

SEQ ID NO: 44077 - DNA, 15 bp, Homo sapiens
ggtaaccagccctgg

SEQ ID NO: 44078 - DNA, 15 bp, Homo sapiens
aggtaaccagccctg

SEQ ID NO: 44079 - DNA, 15 bp, Homo sapiens
caggtaaccagccct

SEQ ID NO: 44080 - DNA, 15 bp, Homo sapiens
gcaggtaaccagccc

SEQ ID NO: 44081 - DNA, 15 bp, Homo sapiens
agcaggtaaccagcc

SEQ ID NO: 44082 - DNA, 15 bp, Homo sapiens
gagcaggtaaccagc

SEQ ID NO: 44083 - DNA, 15 bp, Homo sapiens
tgagcaggtaaccag

SEQ ID NO: 44084 - DNA, 15 bp, Homo sapiens
ctgagcaggtaacca

SEQ ID NO: 44085 - DNA, 15 bp, Homo sapiens
cctgagcaggtaacc

SEQ ID NO: 44086 - DNA, 15 bp, Homo sapiens
ccctgagcaggtaac

SEQ ID NO: 44087 - DNA, 15 bp, Homo sapiens
tccctgagcaggtaa

SEQ ID NO: 44088 - DNA, 15 bp, Homo sapiens
ttccctgagcaggta

SEQ ID NO: 44089 - DNA, 15 bp, Homo sapiens
tttccctgagcaggt

SEQ ID NO: 44090 - DNA, 15 bp, Homo sapiens
gtttccctgagcagg

SEQ ID NO: 44091 - DNA, 15 bp, Homo sapiens
agtttccctgagcag

SEQ ID NO: 44092 - DNA, 15 bp, Homo sapiens
cagtttccctgagca

SEQ ID NO: 44093 - DNA, 15 bp, Homo sapiens
ccagtttccctgagc

SEQ ID NO: 44094 - DNA, 15 bp, Homo sapiens
gccagtttccctgag

SEQ ID NO: 44095 - DNA, 15 bp, Homo sapiens
tgccagtttccctga

SEQ ID NO: 44096 - DNA, 15 bp, Homo sapiens
ctgccagtttccctg

SEQ ID NO: 44097 - DNA, 15 bp, Homo sapiens
gctgccagtttccct

SEQ ID NO: 44098 - DNA, 15 bp, Homo sapiens
agctgccagtttccc

SEQ ID NO: 44099 - DNA, 15 bp, Homo sapiens
aagctgccagtttcc

SEQ ID NO: 44100 - DNA, 15 bp, Homo sapiens
gaagctgccagtttc

SEQ ID NO: 44101 - DNA, 15 bp, Homo sapiens
agaagctgccagttt

SEQ ID NO: 44102 - DNA, 15 bp, Homo sapiens
cagaagctgccagtt

SEQ ID NO: 44103 - DNA, 15 bp, Homo sapiens
acagaagctgccagt

SEQ ID NO: 44104 - DNA, 15 bp, Homo sapiens
gacagaagctgccag

SEQ ID NO: 44105 - DNA, 15 bp, Homo sapiens
agacagaagctgcca

SEQ ID NO: 44106 - DNA, 15 bp, Homo sapiens
aagacagaagctgcc

SEQ ID NO: 44107 - DNA, 15 bp, Homo sapiens
gaagacagaagctgc

SEQ ID NO: 44108 - DNA, 15 bp, Homo sapiens
ggaagacagaagctg

SEQ ID NO: 44109 - DNA, 15 bp, Homo sapiens
aggaagacagaagct

SEQ ID NO: 44110 - DNA, 15 bp, Homo sapiens
caggaagacagaagc

SEQ ID NO: 44111 - DNA, 15 bp, Homo sapiens
ccaggaagacagaag

SEQ ID NO: 44112 - DNA, 15 bp, Homo sapiens
tccaggaagacagaa

SEQ ID NO: 44113 - DNA, 15 bp, Homo sapiens
ctccaggaagacaga

SEQ ID NO: 44114 - DNA, 15 bp, Homo sapiens
cctccaggaagacag

SEQ ID NO: 44115 - DNA, 15 bp, Homo sapiens
tcctccaggaagaca

SEQ ID NO: 44116 - DNA, 15 bp, Homo sapiens
ttcctccaggaagac

SEQ ID NO: 44117 - DNA, 15 bp, Homo sapiens
cttcctccaggaaga

SEQ ID NO: 44118 - DNA, 15 bp, Homo sapiens
gcttcctccaggaag

SEQ ID NO: 44119 - DNA, 15 bp, Homo sapiens
tgcttcctccaggaa

SEQ ID NO: 44120 - DNA, 15 bp, Homo sapiens
ctgcttcctccagga

SEQ ID NO: 44121 - DNA, 15 bp, Homo sapiens
tctgcttcctccagg

SEQ ID NO: 44122 - DNA, 15 bp, Homo sapiens
ttctgcttcctccag

SEQ ID NO: 44123 - DNA, 15 bp, Homo sapiens
tttctgcttcctcca

SEQ ID NO: 44124 - DNA, 15 bp, Homo sapiens
ctttctgcttcctcc

SEQ ID NO: 44125 - DNA, 15 bp, Homo sapiens
cctttctgcttcctc

SEQ ID NO: 44126 - DNA, 15 bp, Homo sapiens
gcctttctgcttcct

SEQ ID NO: 44127 - DNA, 15 bp, Homo sapiens
ggcctttctgcttcc

SEQ ID NO: 44128 - DNA, 15 bp, Homo sapiens
gggcctttctgcttc

SEQ ID NO: 44129 - DNA, 15 bp, Homo sapiens
tgggcctttctgctt

SEQ ID NO: 44130 - DNA, 15 bp, Homo sapiens
ctgggcctttctgct

SEQ ID NO: 44131 - DNA, 15 bp, Homo sapiens
cctgggcctttctgc

SEQ ID NO: 44132 - DNA, 15 bp, Homo sapiens
ccctgggcctttctg

SEQ ID NO: 44133 - DNA, 15 bp, Homo sapiens
gccctgggcctttct

SEQ ID NO: 44134 - DNA, 15 bp, Homo sapiens
tgccctgggcctttc

SEQ ID NO: 44135 - DNA, 15 bp, Homo sapiens
ttgccctgggccttt

SEQ ID NO: 44136 - DNA, 15 bp, Homo sapiens
cttgccctgggcctt

SEQ ID NO: 44137 - DNA, 15 bp, Homo sapiens
tcttgccctgggcct

SEQ ID NO: 44138 - DNA, 15 bp, Homo sapiens
atcttgccctgggcc

SEQ ID NO: 44139 - DNA, 15 bp, Homo sapiens
catcttgccctgggc

SEQ ID NO: 44140 - DNA, 15 bp, Homo sapiens
acatcttgccctggg

SEQ ID NO: 44141 - DNA, 15 bp, Homo sapiens
aacatcttgccctgg

SEQ ID NO: 44142 - DNA, 15 bp, Homo sapiens
gaacatcttgccctg

SEQ ID NO: 44143 - DNA, 15 bp, Homo sapiens
tgaacatcttgccct

SEQ ID NO: 44144 - DNA, 15 bp, Homo sapiens
atgaacatcttgccc

SEQ ID NO: 44145 - DNA, 15 bp, Homo sapiens
catgaacatcttgcc

SEQ ID NO: 44146 - DNA, 15 bp, Homo sapiens
gcatgaacatcttgc

SEQ ID NO: 44147 - DNA, 15 bp, Homo sapiens
ggcatgaacatcttg

SEQ ID NO: 44148 - DNA, 15 bp, Homo sapiens
tggcatgaacatctt

SEQ ID NO: 44149 - DNA, 15 bp, Homo sapiens
ctggcatgaacatct

SEQ ID NO: 44150 - DNA, 15 bp, Homo sapiens
gctggcatgaacatc

SEQ ID NO: 44151 - DNA, 15 bp, Homo sapiens
ggctggcatgaacat

SEQ ID NO: 44152 - DNA, 15 bp, Homo sapiens
tggctggcatgaaca

SEQ ID NO: 44153 - DNA, 15 bp, Homo sapiens
ttggctggcatgaac

SEQ ID NO: 44154 - DNA, 15 bp, Homo sapiens
cttggctggcatgaa

SEQ ID NO: 44155 - DNA, 15 bp, Homo sapiens
acttggctggcatga

SEQ ID NO: 44156 - DNA, 15 bp, Homo sapiens
gacttggctggcatg

SEQ ID NO: 44157 - DNA, 15 bp, Homo sapiens
agacttggctggcat

SEQ ID NO: 44158 - DNA, 15 bp, Homo sapiens
cagacttggctggca

SEQ ID NO: 44159 - DNA, 15 bp, Homo sapiens
acagacttggctggc

SEQ ID NO: 44160 - DNA, 15 bp, Homo sapiens
aacagacttggctgg

SEQ ID NO: 44161 - DNA, 15 bp, Homo sapiens
taacagacttggctg

SEQ ID NO: 44162 - DNA, 15 bp, Homo sapiens
ttaacagacttggct

SEQ ID NO: 44163 - DNA, 15 bp, Homo sapiens
attaacagacttggc

SEQ ID NO: 44164 - DNA, 15 bp, Homo sapiens
aattaacagacttgg

SEQ ID NO: 44165 - DNA, 15 bp, Homo sapiens
aaattaacagacttg

SEQ ID NO: 44166 - DNA, 15 bp, Homo sapiens
aaaattaacagactt

SEQ ID NO: 44167 - DNA, 15 bp, Homo sapiens
aaaaattaacagact

SEQ ID NO: 44168 - DNA, 15 bp, Homo sapiens
taaaaattaacagac

SEQ ID NO: 44169 - DNA, 15 bp, Homo sapiens
ataaaaattaacaga

SEQ ID NO: 44170 - DNA, 15 bp, Homo sapiens
gataaaaattaacag

SEQ ID NO: 44171 - DNA, 15 bp, Homo sapiens
tgataaaaattaaca

SEQ ID NO: 44172 - DNA, 15 bp, Homo sapiens
ctgataaaaattaac

SEQ ID NO: 44173 - DNA, 15 bp, Homo sapiens
cctgataaaaattaa

SEQ ID NO: 44174 - DNA, 15 bp, Homo sapiens
ccctgataaaaatta

SEQ ID NO: 44175 - DNA, 15 bp, Homo sapiens
tccctgataaaaatt

SEQ ID NO: 44176 - DNA, 15 bp, Homo sapiens
ttccctgataaaaat

SEQ ID NO: 44177 - DNA, 15 bp, Homo sapiens
tttccctgataaaaa

SEQ ID NO: 44178 - DNA, 15 bp, Homo sapiens
atttccctgataaaa

SEQ ID NO: 44179 - DNA, 15 bp, Homo sapiens
tatttccctgataaa

SEQ ID NO: 44180 - DNA, 15 bp, Homo sapiens
ttatttccctgataa

SEQ ID NO: 44181 - DNA, 15 bp, Homo sapiens
attatttccctgata

SEQ ID NO: 44182 - DNA, 15 bp, Homo sapiens
tattatttccctgat

SEQ ID NO: 44183 - DNA, 15 bp, Homo sapiens
ctattatttccctga

SEQ ID NO: 44184 - DNA, 15 bp, Homo sapiens
actattatttccctg

SEQ ID NO: 44185 - DNA, 15 bp, Homo sapiens
aactattatttccct

SEQ ID NO: 44186 - DNA, 15 bp, Homo sapiens
gaactattatttccc

SEQ ID NO: 44187 - DNA, 15 bp, Homo sapiens
agaactattatttcc

SEQ ID NO: 44188 - DNA, 15 bp, Homo sapiens
gagaactattatttc

SEQ ID NO: 44189 - DNA, 15 bp, Homo sapiens
ggagaactattattt

SEQ ID NO: 44190 - DNA, 15 bp, Homo sapiens
aggagaactattatt

SEQ ID NO: 44191 - DNA, 15 bp, Homo sapiens
caggagaactattat

SEQ ID NO: 44192 - DNA, 15 bp, Homo sapiens
ccaggagaactatta

SEQ ID NO: 44193 - DNA, 15 bp, Homo sapiens
cccaggagaactatt

SEQ ID NO: 44194 - DNA, 15 bp, Homo sapiens
acccaggagaactat

SEQ ID NO: 44195 - DNA, 15 bp, Homo sapiens
gacccaggagaacta

SEQ ID NO: 44196 - DNA, 15 bp, Homo sapiens
agacccaggagaact

SEQ ID NO: 44197 - DNA, 15 bp, Homo sapiens
aagacccaggagaac

SEQ ID NO: 44198 - DNA, 15 bp, Homo sapiens
gaagacccaggagaa

SEQ ID NO: 44199 - DNA, 15 bp, Homo sapiens
ggaagacccaggaga

SEQ ID NO: 44200 - DNA, 15 bp, Homo sapiens
tggaagacccaggag

SEQ ID NO: 44201 - DNA, 15 bp, Homo sapiens
gtggaagacccagga

SEQ ID NO: 44202 - DNA, 15 bp, Homo sapiens
ggtggaagacccagg

SEQ ID NO: 44203 - DNA, 15 bp, Homo sapiens
gggtggaagacccag

SEQ ID NO: 44204 - DNA, 15 bp, Homo sapiens
tgggtggaagaccca

SEQ ID NO: 44205 - DNA, 15 bp, Homo sapiens
ttgggtggaagaccc

SEQ ID NO: 44206 - DNA, 15 bp, Homo sapiens
attgggtggaagacc

SEQ ID NO: 44207 - DNA, 15 bp, Homo sapiens
tattgggtggaagac

SEQ ID NO: 44208 - DNA, 15 bp, Homo sapiens
atattgggtggaaga

SEQ ID NO: 44209 - DNA, 15 bp, Homo sapiens
tatattgggtggaag

SEQ ID NO: 44210 - DNA, 15 bp, Homo sapiens
gtatattgggtggaa

SEQ ID NO: 44211 - DNA, 15 bp, Homo sapiens
agtatattgggtgga

SEQ ID NO: 44212 - DNA, 15 bp, Homo sapiens
aagtatattgggtgg

SEQ ID NO: 44213 - DNA, 15 bp, Homo sapiens
gaagtatattgggtg

SEQ ID NO: 44214 - DNA, 15 bp, Homo sapiens
agaagtatattgggt

SEQ ID NO: 44215 - DNA, 15 bp, Homo sapiens
gagaagtatattggg

SEQ ID NO: 44216 - DNA, 15 bp, Homo sapiens
ggagaagtatattgg

SEQ ID NO: 44217 - DNA, 15 bp, Homo sapiens
gggagaagtatattg

SEQ ID NO: 44218 - DNA, 15 bp, Homo sapiens
ggggagaagtatatt

SEQ ID NO: 44219 - DNA, 15 bp, Homo sapiens
aggggagaagtatat

SEQ ID NO: 44220 - DNA, 15 bp, Homo sapiens
gaggggagaagtata

SEQ ID NO: 44221 - DNA, 15 bp, Homo sapiens
ggaggggagaagtat

SEQ ID NO: 44222 - DNA, 15 bp, Homo sapiens
aggaggggagaagta

SEQ ID NO: 44223 - DNA, 15 bp, Homo sapiens
gaggaggggagaagt

SEQ ID NO: 44224 - DNA, 15 bp, Homo sapiens
agaggaggggagaag

SEQ ID NO: 44225 - DNA, 15 bp, Homo sapiens
cagaggaggggagaa

SEQ ID NO: 44226 - DNA, 15 bp, Homo sapiens
ccagaggaggggaga

SEQ ID NO: 44227 - DNA, 15 bp, Homo sapiens
cccagaggaggggag

SEQ ID NO: 44228 - DNA, 15 bp, Homo sapiens
gcccagaggagggga

SEQ ID NO: 44229 - DNA, 15 bp, Homo sapiens
cgcccagaggagggg

SEQ ID NO: 44230 - DNA, 15 bp, Homo sapiens
ccgcccagaggaggg

SEQ ID NO: 44231 - DNA, 15 bp, Homo sapiens
tccgcccagaggagg

SEQ ID NO: 44232 - DNA, 15 bp, Homo sapiens
ttccgcccagaggag

SEQ ID NO: 44233 - DNA, 15 bp, Homo sapiens
attccgcccagagga

SEQ ID NO: 44234 - DNA, 15 bp, Homo sapiens
aattccgcccagagg

SEQ ID NO: 44235 - DNA, 15 bp, Homo sapiens
caattccgcccagag

SEQ ID NO: 44236 - DNA, 15 bp, Homo sapiens
tcaattccgcccaga

SEQ ID NO: 44237 - DNA, 15 bp, Homo sapiens
ctcaattccgcccag

SEQ ID NO: 44238 - DNA, 15 bp, Homo sapiens
gctcaattccgccca

SEQ ID NO: 44239 - DNA, 15 bp, Homo sapiens
ggctcaattccgccc

SEQ ID NO: 44240 - DNA, 15 bp, Homo sapiens
tggctcaattccgcc

SEQ ID NO: 44241 - DNA, 15 bp, Homo sapiens
ttggctcaattccgc

SEQ ID NO: 44242 - DNA, 15 bp, Homo sapiens
tttggctcaattccg

SEQ ID NO: 44243 - DNA, 15 bp, Homo sapiens
atttggctcaattcc

SEQ ID NO: 44244 - DNA, 15 bp, Homo sapiens
catttggctcaattc

SEQ ID NO: 44245 - DNA, 15 bp, Homo sapiens
ccatttggctcaatt

SEQ ID NO: 44246 - DNA, 15 bp, Homo sapiens
accatttggctcaat

SEQ ID NO: 44247 - DNA, 15 bp, Homo sapiens
aaccatttggctcaa

SEQ ID NO: 44248 - DNA, 15 bp, Homo sapiens
taaccatttggctca

SEQ ID NO: 44249 - DNA, 15 bp, Homo sapiens
ataaccatttggctc

SEQ ID NO: 44250 - DNA, 15 bp, Homo sapiens
gataaccatttggct

SEQ ID NO: 44251 - DNA, 15 bp, Homo sapiens
agataaccatttggc

SEQ ID NO: 44252 - DNA, 15 bp, Homo sapiens
gagataaccatttgg

SEQ ID NO: 44253 - DNA, 15 bp, Homo sapiens
agagataaccatttg

SEQ ID NO: 44254 - DNA, 15 bp, Homo sapiens
tagagataaccattt

SEQ ID NO: 44255 - DNA, 15 bp, Homo sapiens
ctagagataaccatt

SEQ ID NO: 44256 - DNA, 15 bp, Homo sapiens
actagagataaccat

SEQ ID NO: 44257 - DNA, 15 bp, Homo sapiens
aactagagataacca

SEQ ID NO: 44258 - DNA, 15 bp, Homo sapiens
caactagagataacc

SEQ ID NO: 44259 - DNA, 15 bp, Homo sapiens
gcaactagagataac

SEQ ID NO: 44260 - DNA, 15 bp, Homo sapiens
tgcaactagagataa

SEQ ID NO: 44261 - DNA, 15 bp, Homo sapiens
ttgcaactagagata

SEQ ID NO: 44262 - DNA, 15 bp, Homo sapiens
cttgcaactagagat

SEQ ID NO: 44263 - DNA, 15 bp, Homo sapiens
ccttgcaactagaga

SEQ ID NO: 44264 - DNA, 15 bp, Homo sapiens
gccttgcaactagag

SEQ ID NO: 44265 - DNA, 15 bp, Homo sapiens
tgccttgcaactaga

SEQ ID NO: 44266 - DNA, 15 bp, Homo sapiens
ttgccttgcaactag

SEQ ID NO: 44267 - DNA, 15 bp, Homo sapiens
cttgccttgcaacta

SEQ ID NO: 44268 - DNA, 15 bp, Homo sapiens
ccttgccttgcaact

SEQ ID NO: 44269 - DNA, 15 bp, Homo sapiens
accttgccttgcaac

SEQ ID NO: 44270 - DNA, 15 bp, Homo sapiens
caccttgccttgcaa

SEQ ID NO: 44271 - DNA, 15 bp, Homo sapiens
tcaccttgccttgca

SEQ ID NO: 44272 - DNA, 15 bp, Homo sapiens
ttcaccttgccttgc

SEQ ID NO: 44273 - DNA, 15 bp, Homo sapiens
attcaccttgccttg

SEQ ID NO: 44274 - DNA, 15 bp, Homo sapiens
tattcaccttgcctt

SEQ ID NO: 44275 - DNA, 15 bp, Homo sapiens
atattcaccttgcct

SEQ ID NO: 44276 - DNA, 15 bp, Homo sapiens
aatattcaccttgcc

SEQ ID NO: 44277 - DNA, 15 bp, Homo sapiens
aaatattcaccttgc

SEQ ID NO: 44278 - DNA, 15 bp, Homo sapiens
aaaatattcaccttg

SEQ ID NO: 44279 - DNA, 15 bp, Homo sapiens
taaaatattcacctt

SEQ ID NO: 44280 - DNA, 15 bp, Homo sapiens
ttaaaatattcacct

SEQ ID NO: 44281 - DNA, 15 bp, Homo sapiens
gttaaaatattcacc

SEQ ID NO: 44282 - DNA, 15 bp, Homo sapiens
agttaaaatattcac

SEQ ID NO: 44283 - DNA, 15 bp, Homo sapiens
cagttaaaatattca

SEQ ID NO: 44284 - DNA, 15 bp, Homo sapiens
ccagttaaaatattc

SEQ ID NO: 44285 - DNA, 15 bp, Homo sapiens
gccagttaaaatatt

SEQ ID NO: 44286 - DNA, 15 bp, Homo sapiens
ggccagttaaaatat

SEQ ID NO: 44287 - DNA, 15 bp, Homo sapiens
tggccagttaaaata

SEQ ID NO: 44288 - DNA, 15 bp, Homo sapiens
gtggccagttaaaat

SEQ ID NO: 44289 - DNA, 15 bp, Homo sapiens
ggtggccagttaaaa

SEQ ID NO: 44290 - DNA, 15 bp, Homo sapiens
aggtggccagttaaa

SEQ ID NO: 44291 - DNA, 15 bp, Homo sapiens
aaggtggccagttaa

SEQ ID NO: 44292 - DNA, 15 bp, Homo sapiens
caaggtggccagtta

SEQ ID NO: 44293 - DNA, 15 bp, Homo sapiens
gcaaggtggccagtt

SEQ ID NO: 44294 - DNA, 15 bp, Homo sapiens
agcaaggtggccagt

SEQ ID NO: 44295 - DNA, 15 bp, Homo sapiens
tagcaaggtggccag

SEQ ID NO: 44296 - DNA, 15 bp, Homo sapiens
gtagcaaggtggcca

SEQ ID NO: 44297 - DNA, 15 bp, Homo sapiens
tgtagcaaggtggcc

SEQ ID NO: 44298 - DNA, 15 bp, Homo sapiens
ctgtagcaaggtggc

SEQ ID NO: 44299 - DNA, 15 bp, Homo sapiens
cctgtagcaaggtgg

SEQ ID NO: 44300 - DNA, 15 bp, Homo sapiens
ccctgtagcaaggtg

SEQ ID NO: 44301 - DNA, 15 bp, Homo sapiens
tccctgtagcaaggt

SEQ ID NO: 44302 - DNA, 15 bp, Homo sapiens
ttccctgtagcaagg

SEQ ID NO: 44303 - DNA, 15 bp, Homo sapiens
tttccctgtagcaag

SEQ ID NO: 44304 - DNA, 15 bp, Homo sapiens
ttttccctgtagcaa

SEQ ID NO: 44305 - DNA, 15 bp, Homo sapiens
tttttccctgtagca

SEQ ID NO: 44306 - DNA, 15 bp, Homo sapiens
ttttttccctgtagc

SEQ ID NO: 44307 - DNA, 15 bp, Homo sapiens
tttttttccctgtag

SEQ ID NO: 44308 - DNA, 15 bp, Homo sapiens
ttttttttccctgta

SEQ ID NO: 44309 - DNA, 15 bp, Homo sapiens
attttttttccctgt

SEQ ID NO: 44310 - DNA, 15 bp, Homo sapiens
cattttttttccctg

SEQ ID NO: 44311 - DNA, 15 bp, Homo sapiens
ccattttttttccct

SEQ ID NO: 44312 - DNA, 15 bp, Homo sapiens
cccattttttttccc

SEQ ID NO: 44313 - DNA, 15 bp, Homo sapiens
tcccattttttttcc

SEQ ID NO: 44314 - DNA, 15 bp, Homo sapiens
atcccattttttttc

SEQ ID NO: 44315 - DNA, 15 bp, Homo sapiens
aatcccatttttttt

SEQ ID NO: 44316 - DNA, 15 bp, Homo sapiens
taatcccattttttt

SEQ ID NO: 44317 - DNA, 15 bp, Homo sapiens
ttaatcccatttttt

SEQ ID NO: 44318 - DNA, 15 bp, Homo sapiens
attaatcccattttt

SEQ ID NO: 44319 - DNA, 15 bp, Homo sapiens
gattaatcccatttt

SEQ ID NO: 44320 - DNA, 15 bp, Homo sapiens
agattaatcccattt

SEQ ID NO: 44321 - DNA, 15 bp, Homo sapiens
aagattaatcccatt

SEQ ID NO: 44322 - DNA, 15 bp, Homo sapiens
caagattaatcccat

SEQ ID NO: 44323 - DNA, 15 bp, Homo sapiens
acaagattaatccca

SEQ ID NO: 44324 - DNA, 15 bp, Homo sapiens
tacaagattaatccc

SEQ ID NO: 44325 - DNA, 15 bp, Homo sapiens
ttacaagattaatcc

SEQ ID NO: 44326 - DNA, 15 bp, Homo sapiens
cttacaagattaatc

SEQ ID NO: 44327 - DNA, 15 bp, Homo sapiens
acttacaagattaat

SEQ ID NO: 44328 - DNA, 15 bp, Homo sapiens
cacttacaagattaa

SEQ ID NO: 44329 - DNA, 15 bp, Homo sapiens
tcacttacaagatta

SEQ ID NO: 44330 - DNA, 15 bp, Homo sapiens
ctcacttacaagatt

SEQ ID NO: 44331 - DNA, 15 bp, Homo sapiens
tctcacttacaagat

SEQ ID NO: 44332 - DNA, 15 bp, Homo sapiens
ttctcacttacaaga

SEQ ID NO: 44333 - DNA, 15 bp, Homo sapiens
cttctcacttacaag

SEQ ID NO: 44334 - DNA, 15 bp, Homo sapiens
ccttctcacttacaa

SEQ ID NO: 44335 - DNA, 15 bp, Homo sapiens
tccttctcacttaca

SEQ ID NO: 44336 - DNA, 15 bp, Homo sapiens
ctccttctcacttac

SEQ ID NO: 44337 - DNA, 15 bp, Homo sapiens
tctccttctcactta

SEQ ID NO: 44338 - DNA, 15 bp, Homo sapiens
ctctccttctcactt

SEQ ID NO: 44339 - DNA, 15 bp, Homo sapiens
tctctccttctcact

SEQ ID NO: 44340 - DNA, 15 bp, Homo sapiens
ttctctccttctcac

SEQ ID NO: 44341 - DNA, 15 bp, Homo sapiens
tttctctccttctca

SEQ ID NO: 44342 - DNA, 15 bp, Homo sapiens
ctttctctccttctc

SEQ ID NO: 44343 - DNA, 15 bp, Homo sapiens
cctttctctccttct

SEQ ID NO: 44344 - DNA, 15 bp, Homo sapiens
tcctttctctccttc

SEQ ID NO: 44345 - DNA, 15 bp, Homo sapiens
atcctttctctcctt

SEQ ID NO: 44346 - DNA, 15 bp, Homo sapiens
catcctttctctcct

SEQ ID NO: 44347 - DNA, 15 bp, Homo sapiens
gcatcctttctctcc

SEQ ID NO: 44348 - DNA, 15 bp, Homo sapiens
agcatcctttctctc

SEQ ID NO: 44349 - DNA, 15 bp, Homo sapiens
aagcatcctttctct

SEQ ID NO: 44350 - DNA, 15 bp, Homo sapiens
caagcatcctttctc

SEQ ID NO: 44351 - DNA, 15 bp, Homo sapiens
tcaagcatcctttct

SEQ ID NO: 44352 - DNA, 15 bp, Homo sapiens
ctcaagcatcctttc

SEQ ID NO: 44353 - DNA, 15 bp, Homo sapiens
actcaagcatccttt

SEQ ID NO: 44354 - DNA, 15 bp, Homo sapiens
tactcaagcatcctt

SEQ ID NO: 44355 - DNA, 15 bp, Homo sapiens
ctactcaagcatcct

SEQ ID NO: 44356 - DNA, 15 bp, Homo sapiens
cctactcaagcatcc

SEQ ID NO: 44357 - DNA, 15 bp, Homo sapiens
gcctactcaagcatc

SEQ ID NO: 44358 - DNA, 15 bp, Homo sapiens
tgcctactcaagcat

SEQ ID NO: 44359 - DNA, 15 bp, Homo sapiens
ttgcctactcaagca

SEQ ID NO: 44360 - DNA, 15 bp, Homo sapiens
gttgcctactcaagc

SEQ ID NO: 44361 - DNA, 15 bp, Homo sapiens
agttgcctactcaag

SEQ ID NO: 44362 - DNA, 15 bp, Homo sapiens
tagttgcctactcaa

SEQ ID NO: 44363 - DNA, 15 bp, Homo sapiens
ctagttgcctactca

SEQ ID NO: 44364 - DNA, 15 bp, Homo sapiens
gctagttgcctactc

SEQ ID NO: 44365 - DNA, 15 bp, Homo sapiens
tgctagttgcctact

SEQ ID NO: 44366 - DNA, 15 bp, Homo sapiens
ctgctagttgcctac

SEQ ID NO: 44367 - DNA, 15 bp, Homo sapiens
actgctagttgccta

SEQ ID NO: 44368 - DNA, 15 bp, Homo sapiens
cactgctagttgcct

SEQ ID NO: 44369 - DNA, 15 bp, Homo sapiens
acactgctagttgcc

SEQ ID NO: 44370 - DNA, 15 bp, Homo sapiens
cacactgctagttgc

SEQ ID NO: 44371 - DNA, 15 bp, Homo sapiens
acacactgctagttg

SEQ ID NO: 44372 - DNA, 15 bp, Homo sapiens
tacacactgctagtt

SEQ ID NO: 44373 - DNA, 15 bp, Homo sapiens
gtacacactgctagt

SEQ ID NO: 44374 - DNA, 15 bp, Homo sapiens
ggtacacactgctag

SEQ ID NO: 44375 - DNA, 15 bp, Homo sapiens
tggtacacactgcta

SEQ ID NO: 44376 - DNA, 15 bp, Homo sapiens
atggtacacactgct

SEQ ID NO: 44377 - DNA, 15 bp, Homo sapiens
tatggtacacactgc

SEQ ID NO: 44378 - DNA, 15 bp, Homo sapiens
ctatggtacacactg

SEQ ID NO: 44379 - DNA, 15 bp, Homo sapiens
actatggtacacact

SEQ ID NO: 44380 - DNA, 15 bp, Homo sapiens
cactatggtacacac

SEQ ID NO: 44381 - DNA, 15 bp, Homo sapiens
tcactatggtacaca

SEQ ID NO: 44382 - DNA, 15 bp, Homo sapiens
ctcactatggtacac

SEQ ID NO: 44383 - DNA, 15 bp, Homo sapiens
actcactatggtaca

SEQ ID NO: 44384 - DNA, 15 bp, Homo sapiens
aactcactatggtac

SEQ ID NO: 44385 - DNA, 15 bp, Homo sapiens
gaactcactatggta

SEQ ID NO: 44386 - DNA, 15 bp, Homo sapiens
ggaactcactatggt

SEQ ID NO: 44387 - DNA, 15 bp, Homo sapiens
tggaactcactatgg

SEQ ID NO: 44388 - DNA, 15 bp, Homo sapiens
ctggaactcactatg

SEQ ID NO: 44389 - DNA, 15 bp, Homo sapiens
gctggaactcactat

SEQ ID NO: 44390 - DNA, 15 bp, Homo sapiens
tgctggaactcacta

SEQ ID NO: 44391 - DNA, 15 bp, Homo sapiens
ttgctggaactcact

SEQ ID NO: 44392 - DNA, 15 bp, Homo sapiens
tttgctggaactcac

SEQ ID NO: 44393 - DNA, 15 bp, Homo sapiens
atttgctggaactca

SEQ ID NO: 44394 - DNA, 15 bp, Homo sapiens
tatttgctggaactc

SEQ ID NO: 44395 - DNA, 15 bp, Homo sapiens
ctatttgctggaact

SEQ ID NO: 44396 - DNA, 15 bp, Homo sapiens
actatttgctggaac

SEQ ID NO: 44397 - DNA, 15 bp, Homo sapiens
aactatttgctggaa

SEQ ID NO: 44398 - DNA, 15 bp, Homo sapiens
gaactatttgctgga

SEQ ID NO: 44399 - DNA, 15 bp, Homo sapiens
agaactatttgctgg

SEQ ID NO: 44400 - DNA, 15 bp, Homo sapiens
tagaactatttgctg

SEQ ID NO: 44401 - DNA, 15 bp, Homo sapiens
atagaactatttgct

SEQ ID NO: 44402 - DNA, 15 bp, Homo sapiens
gatagaactatttgc

SEQ ID NO: 44403 - DNA, 15 bp, Homo sapiens
agatagaactatttg

SEQ ID NO: 44404 - DNA, 15 bp, Homo sapiens
aagatagaactattt

SEQ ID NO: 44405 - DNA, 15 bp, Homo sapiens
taagatagaactatt

SEQ ID NO: 44406 - DNA, 15 bp, Homo sapiens
ttaagatagaactat

SEQ ID NO: 44407 - DNA, 15 bp, Homo sapiens
tttaagatagaacta

SEQ ID NO: 44408 - DNA, 15 bp, Homo sapiens
atttaagatagaact

SEQ ID NO: 44409 - DNA, 15 bp, Homo sapiens
tatttaagatagaac

SEQ ID NO: 44410 - DNA, 15 bp, Homo sapiens
gtatttaagatagaa

SEQ ID NO: 44411 - DNA, 15 bp, Homo sapiens
ggtatttaagataga

SEQ ID NO: 44412 - DNA, 15 bp, Homo sapiens
tggtatttaagatag

SEQ ID NO: 44413 - DNA, 15 bp, Homo sapiens
atggtatttaagata

SEQ ID NO: 44414 - DNA, 15 bp, Homo sapiens
catggtatttaagat

SEQ ID NO: 44415 - DNA, 15 bp, Homo sapiens
acatggtatttaaga

SEQ ID NO: 44416 - DNA, 15 bp, Homo sapiens
gacatggtatttaag

SEQ ID NO: 44417 - DNA, 15 bp, Homo sapiens
agacatggtatttaa

SEQ ID NO: 44418 - DNA, 15 bp, Homo sapiens
tagacatggtattta

SEQ ID NO: 44419 - DNA, 15 bp, Homo sapiens
ctagacatggtattt

SEQ ID NO: 44420 - DNA, 15 bp, Homo sapiens
tctagacatggtatt

SEQ ID NO: 44421 - DNA, 15 bp, Homo sapiens
ctctagacatggtat

SEQ ID NO: 44422 - DNA, 15 bp, Homo sapiens
cctctagacatggta

SEQ ID NO: 44423 - DNA, 15 bp, Homo sapiens
gcctctagacatggt

SEQ ID NO: 44424 - DNA, 15 bp, Homo sapiens
tgcctctagacatgg

SEQ ID NO: 44425 - DNA, 15 bp, Homo sapiens
atgcctctagacatg

SEQ ID NO: 44426 - DNA, 15 bp, Homo sapiens
catgcctctagacat

SEQ ID NO: 44427 - DNA, 15 bp, Homo sapiens
tcatgcctctagaca

SEQ ID NO: 44428 - DNA, 15 bp, Homo sapiens
atcatgcctctagac

SEQ ID NO: 44429 - DNA, 15 bp, Homo sapiens
gatcatgcctctaga

SEQ ID NO: 44430 - DNA, 15 bp, Homo sapiens
tgatcatgcctctag

SEQ ID NO: 44431 - DNA, 15 bp, Homo sapiens
ctgatcatgcctcta

SEQ ID NO: 44432 - DNA, 15 bp, Homo sapiens
tctgatcatgcctct

SEQ ID NO: 44433 - DNA, 15 bp, Homo sapiens
ctctgatcatgcctc

SEQ ID NO: 44434 - DNA, 15 bp, Homo sapiens
actctgatcatgcct

SEQ ID NO: 44435 - DNA, 15 bp, Homo sapiens
cactctgatcatgcc

SEQ ID NO: 44436 - DNA, 15 bp, Homo sapiens
tcactctgatcatgc

SEQ ID NO: 44437 - DNA, 15 bp, Homo sapiens
ttcactctgatcatg

SEQ ID NO: 44438 - DNA, 15 bp, Homo sapiens
tttcactctgatcat

SEQ ID NO: 44439 - DNA, 15 bp, Homo sapiens
ttttcactctgatca

SEQ ID NO: 44440 - DNA, 15 bp, Homo sapiens
gttttcactctgatc

SEQ ID NO: 44441 - DNA, 15 bp, Homo sapiens
tgttttcactctgat

SEQ ID NO: 44442 - DNA, 15 bp, Homo sapiens
ttgttttcactctga

SEQ ID NO: 44443 - DNA, 15 bp, Homo sapiens
attgttttcactctg

SEQ ID NO: 44444 - DNA, 15 bp, Homo sapiens
aattgttttcactct

SEQ ID NO: 44445 - DNA, 15 bp, Homo sapiens
gaattgttttcactc

SEQ ID NO: 44446 - DNA, 15 bp, Homo sapiens
agaattgttttcact

SEQ ID NO: 44447 - DNA, 15 bp, Homo sapiens
cagaattgttttcac

SEQ ID NO: 44448 - DNA, 15 bp, Homo sapiens
tcagaattgttttca

SEQ ID NO: 44449 - DNA, 15 bp, Homo sapiens
atcagaattgttttc

SEQ ID NO: 44450 - DNA, 15 bp, Homo sapiens
aatcagaattgtttt

SEQ ID NO: 44451 - DNA, 15 bp, Homo sapiens
gaatcagaattgttt

SEQ ID NO: 44452 - DNA, 15 bp, Homo sapiens
agaatcagaattgtt

SEQ ID NO: 44453 - DNA, 15 bp, Homo sapiens
tagaatcagaattgt

SEQ ID NO: 44454 - DNA, 15 bp, Homo sapiens
ctagaatcagaattg

SEQ ID NO: 44455 - DNA, 15 bp, Homo sapiens
tctagaatcagaatt

SEQ ID NO: 44456 - DNA, 15 bp, Homo sapiens
ttctagaatcagaat

SEQ ID NO: 44457 - DNA, 15 bp, Homo sapiens
attctagaatcagaa

SEQ ID NO: 44458 - DNA, 15 bp, Homo sapiens
aattctagaatcaga

SEQ ID NO: 44459 - DNA, 15 bp, Homo sapiens
gaattctagaatcag

SEQ ID NO: 44460 - DNA, 15 bp, Homo sapiens
tgaattctagaatca

SEQ ID NO: 44461 - DNA, 15 bp, Homo sapiens
ctgaattctagaatc

SEQ ID NO: 44462 - DNA, 15 bp, Homo sapiens
cctgaattctagaat

SEQ ID NO: 44463 - DNA, 15 bp, Homo sapiens
acctgaattctagaa

SEQ ID NO: 44464 - DNA, 15 bp, Homo sapiens
aacctgaattctaga

SEQ ID NO: 44465 - DNA, 15 bp, Homo sapiens
taacctgaattctag

SEQ ID NO: 44466 - DNA, 15 bp, Homo sapiens
gtaacctgaattcta

SEQ ID NO: 44467 - DNA, 15 bp, Homo sapiens
ggtaacctgaattct

SEQ ID NO: 44468 - DNA, 15 bp, Homo sapiens
aggtaacctgaattc

SEQ ID NO: 44469 - DNA, 15 bp, Homo sapiens
caggtaacctgaatt

SEQ ID NO: 44470 - DNA, 15 bp, Homo sapiens
acaggtaacctgaat

SEQ ID NO: 44471 - DNA, 15 bp, Homo sapiens
tacaggtaacctgaa

SEQ ID NO: 44472 - DNA, 15 bp, Homo sapiens
ttacaggtaacctga

SEQ ID NO: 44473 - DNA, 15 bp, Homo sapiens
attacaggtaacctg

SEQ ID NO: 44474 - DNA, 15 bp, Homo sapiens
aattacaggtaacct

SEQ ID NO: 44475 - DNA, 15 bp, Homo sapiens
taattacaggtaacc

SEQ ID NO: 44476 - DNA, 15 bp, Homo sapiens
ataattacaggtaac

SEQ ID NO: 44477 - DNA, 15 bp, Homo sapiens
tataattacaggtaa

SEQ ID NO: 44478 - DNA, 15 bp, Homo sapiens
atataattacaggta

SEQ ID NO: 44479 - DNA, 15 bp, Homo sapiens
aatataattacaggt

SEQ ID NO: 44480 - DNA, 15 bp, Homo sapiens
gaatataattacagg

SEQ ID NO: 44481 - DNA, 15 bp, Homo sapiens
agaatataattacag

SEQ ID NO: 44482 - DNA, 15 bp, Homo sapiens
cagaatataattaca

SEQ ID NO: 44483 - DNA, 15 bp, Homo sapiens
tcagaatataattac

SEQ ID NO: 44484 - DNA, 15 bp, Homo sapiens
ttcagaatataatta

SEQ ID NO: 44485 - DNA, 15 bp, Homo sapiens
tttcagaatataatt

SEQ ID NO: 44486 - DNA, 15 bp, Homo sapiens
ctttcagaatataat

SEQ ID NO: 44487 - DNA, 15 bp, Homo sapiens
tctttcagaatataa

SEQ ID NO: 44488 - DNA, 15 bp, Homo sapiens
ttctttcagaatata

SEQ ID NO: 44489 - DNA, 15 bp, Homo sapiens
attctttcagaatat

SEQ ID NO: 44490 - DNA, 15 bp, Homo sapiens
cattctttcagaata

SEQ ID NO: 44491 - DNA, 15 bp, Homo sapiens
tcattctttcagaat

SEQ ID NO: 44492 - DNA, 15 bp, Homo sapiens
atcattctttcagaa

SEQ ID NO: 44493 - DNA, 15 bp, Homo sapiens
tatcattctttcaga

SEQ ID NO: 44494 - DNA, 15 bp, Homo sapiens
ctatcattctttcag

SEQ ID NO: 44495 - DNA, 15 bp, Homo sapiens
cctatcattctttca

SEQ ID NO: 44496 - DNA, 15 bp, Homo sapiens
acctatcattctttc

SEQ ID NO: 44497 - DNA, 15 bp, Homo sapiens
aacctatcattcttt

SEQ ID NO: 44498 - DNA, 15 bp, Homo sapiens
caacctatcattctt

SEQ ID NO: 44499 - DNA, 15 bp, Homo sapiens
tcaacctatcattct

SEQ ID NO: 44500 - DNA, 15 bp, Homo sapiens
ttcaacctatcattc

SEQ ID NO: 44501 - DNA, 15 bp, Homo sapiens
tttcaacctatcatt

SEQ ID NO: 44502 - DNA, 15 bp, Homo sapiens
ttttcaacctatcat

SEQ ID NO: 44503 - DNA, 15 bp, Homo sapiens
attttcaacctatca

SEQ ID NO: 44504 - DNA, 15 bp, Homo sapiens
tattttcaacctatc

SEQ ID NO: 44505 - DNA, 15 bp, Homo sapiens
atattttcaacctat

SEQ ID NO: 44506 - DNA, 15 bp, Homo sapiens
catattttcaaccta

SEQ ID NO: 44507 - DNA, 15 bp, Homo sapiens
tcatattttcaacct

SEQ ID NO: 44508 - DNA, 15 bp, Homo sapiens
ctcatattttcaacc

SEQ ID NO: 44509 - DNA, 15 bp, Homo sapiens
actcatattttcaac

SEQ ID NO: 44510 - DNA, 15 bp, Homo sapiens
tactcatattttcaa

SEQ ID NO: 44511 - DNA, 15 bp, Homo sapiens
atactcatattttca

SEQ ID NO: 44512 - DNA, 15 bp, Homo sapiens
aatactcatattttc

SEQ ID NO: 44513 - DNA, 15 bp, Homo sapiens
taatactcatatttt

SEQ ID NO: 44514 - DNA, 15 bp, Homo sapiens
ttaatactcatattt

SEQ ID NO: 44515 - DNA, 15 bp, Homo sapiens
tttaatactcatatt

SEQ ID NO: 44516 - DNA, 15 bp, Homo sapiens
ttttaatactcatat

SEQ ID NO: 44517 - DNA, 15 bp, Homo sapiens
cttttaatactcata

SEQ ID NO: 44518 - DNA, 15 bp, Homo sapiens
tcttttaatactcat

SEQ ID NO: 44519 - DNA, 15 bp, Homo sapiens
gtcttttaatactca

SEQ ID NO: 44520 - DNA, 15 bp, Homo sapiens
tgtcttttaatactc

SEQ ID NO: 44521 - DNA, 15 bp, Homo sapiens
ttgtcttttaatact

SEQ ID NO: 44522 - DNA, 15 bp, Homo sapiens
tttgtcttttaatac

SEQ ID NO: 44523 - DNA, 15 bp, Homo sapiens
ttttgtcttttaata

SEQ ID NO: 44524 - DNA, 15 bp, Homo sapiens
attttgtcttttaat

SEQ ID NO: 44525 - DNA, 15 bp, Homo sapiens
aattttgtcttttaa

SEQ ID NO: 44526 - DNA, 15 bp, Homo sapiens
caattttgtctttta

SEQ ID NO: 44527 - DNA, 15 bp, Homo sapiens
ccaattttgtctttt

SEQ ID NO: 44528 - DNA, 15 bp, Homo sapiens
tccaattttgtcttt

SEQ ID NO: 44529 - DNA, 15 bp, Homo sapiens
ttccaattttgtctt

SEQ ID NO: 44530 - DNA, 15 bp, Homo sapiens
gttccaattttgtct

SEQ ID NO: 44531 - DNA, 15 bp, Homo sapiens
ggttccaattttgtc

SEQ ID NO: 44532 - DNA, 15 bp, Homo sapiens
tggttccaattttgt

SEQ ID NO: 44533 - DNA, 15 bp, Homo sapiens
ttggttccaattttg

SEQ ID NO: 44534 - DNA, 15 bp, Homo sapiens
cttggttccaatttt

SEQ ID NO: 44535 - DNA, 15 bp, Homo sapiens
acttggttccaattt

SEQ ID NO: 44536 - DNA, 15 bp, Homo sapiens
tacttggttccaatt

SEQ ID NO: 44537 - DNA, 15 bp, Homo sapiens
gtacttggttccaat

SEQ ID NO: 44538 - DNA, 15 bp, Homo sapiens
tgtacttggttccaa

SEQ ID NO: 44539 - DNA, 15 bp, Homo sapiens
ttgtacttggttcca

SEQ ID NO: 44540 - DNA, 15 bp, Homo sapiens
attgtacttggttcc

SEQ ID NO: 44541 - DNA, 15 bp, Homo sapiens
aattgtacttggttc

SEQ ID NO: 44542 - DNA, 15 bp, Homo sapiens
aaattgtacttggtt

SEQ ID NO: 44543 - DNA, 15 bp, Homo sapiens
gaaattgtacttggt

SEQ ID NO: 44544 - DNA, 15 bp, Homo sapiens
agaaattgtacttgg

SEQ ID NO: 44545 - DNA, 15 bp, Homo sapiens
gagaaattgtacttg

SEQ ID NO: 44546 - DNA, 15 bp, Homo sapiens
ggagaaattgtactt

SEQ ID NO: 44547 - DNA, 15 bp, Homo sapiens
tggagaaattgtact

SEQ ID NO: 44548 - DNA, 15 bp, Homo sapiens
atggagaaattgtac

SEQ ID NO: 44549 - DNA, 15 bp, Homo sapiens
aatggagaaattgta

SEQ ID NO: 44550 - DNA, 15 bp, Homo sapiens
aaatggagaaattgt

SEQ ID NO: 44551 - DNA, 15 bp, Homo sapiens
caaatggagaaattg

SEQ ID NO: 44552 - DNA, 15 bp, Homo sapiens
acaaatggagaaatt

SEQ ID NO: 44553 - DNA, 15 bp, Homo sapiens
gacaaatggagaaat

SEQ ID NO: 44554 - DNA, 15 bp, Homo sapiens
agacaaatggagaaa

SEQ ID NO: 44555 - DNA, 15 bp, Homo sapiens
aagacaaatggagaa

SEQ ID NO: 44556 - DNA, 15 bp, Homo sapiens
taagacaaatggaga

SEQ ID NO: 44557 - DNA, 15 bp, Homo sapiens
ataagacaaatggag

SEQ ID NO: 44558 - DNA, 15 bp, Homo sapiens
tataagacaaatgga

SEQ ID NO: 44559 - DNA, 15 bp, Homo sapiens
ctataagacaaatgg

SEQ ID NO: 44560 - DNA, 15 bp, Homo sapiens
cctataagacaaatg

SEQ ID NO: 44561 - DNA, 15 bp, Homo sapiens
ccctataagacaaat

SEQ ID NO: 44562 - DNA, 15 bp, Homo sapiens
cccctataagacaaa

SEQ ID NO: 44563 - DNA, 15 bp, Homo sapiens
tcccctataagacaa

SEQ ID NO: 44564 - DNA, 15 bp, Homo sapiens
ttcccctataagaca

SEQ ID NO: 44565 - DNA, 15 bp, Homo sapiens
attcccctataagac

SEQ ID NO: 44566 - DNA, 15 bp, Homo sapiens
tattcccctataaga

SEQ ID NO: 44567 - DNA, 15 bp, Homo sapiens
atattcccctataag

SEQ ID NO: 44568 - DNA, 15 bp, Homo sapiens
tatattcccctataa

SEQ ID NO: 44569 - DNA, 15 bp, Homo sapiens
atatattcccctata

SEQ ID NO: 44570 - DNA, 15 bp, Homo sapiens
catatattcccctat

SEQ ID NO: 44571 - DNA, 15 bp, Homo sapiens
tcatatattccccta

SEQ ID NO: 44572 - DNA, 15 bp, Homo sapiens
ttcatatattcccct

SEQ ID NO: 44573 - DNA, 15 bp, Homo sapiens
tttcatatattcccc

SEQ ID NO: 44574 - DNA, 15 bp, Homo sapiens
ttttcatatattccc

SEQ ID NO: 44575 - DNA, 15 bp, Homo sapiens
cttttcatatattcc

SEQ ID NO: 44576 - DNA, 15 bp, Homo sapiens
acttttcatatattc

SEQ ID NO: 44577 - DNA, 15 bp, Homo sapiens
aacttttcatatatt

SEQ ID NO: 44578 - DNA, 15 bp, Homo sapiens
caacttttcatatat

SEQ ID NO: 44579 - DNA, 15 bp, Homo sapiens
tcaacttttcatata

SEQ ID NO: 44580 - DNA, 15 bp, Homo sapiens
ctcaacttttcatat

SEQ ID NO: 44581 - DNA, 15 bp, Homo sapiens
tctcaacttttcata

SEQ ID NO: 44582 - DNA, 15 bp, Homo sapiens
atctcaacttttcat

SEQ ID NO: 44583 - DNA, 15 bp, Homo sapiens
tatctcaacttttca

SEQ ID NO: 44584 - DNA, 15 bp, Homo sapiens
ttatctcaacttttc

SEQ ID NO: 44585 - DNA, 15 bp, Homo sapiens
tttatctcaactttt

SEQ ID NO: 44586 - DNA, 15 bp, Homo sapiens
atttatctcaacttt

SEQ ID NO: 44587 - DNA, 15 bp, Homo sapiens
aatttatctcaactt

SEQ ID NO: 44588 - DNA, 15 bp, Homo sapiens
taatttatctcaact

SEQ ID NO: 44589 - DNA, 15 bp, Homo sapiens
ttaatttatctcaac

SEQ ID NO: 44590 - DNA, 15 bp, Homo sapiens
attaatttatctcaa

SEQ ID NO: 44591 - DNA, 15 bp, Homo sapiens
gattaatttatctca

SEQ ID NO: 44592 - DNA, 15 bp, Homo sapiens
agattaatttatctc

SEQ ID NO: 44593 - DNA, 15 bp, Homo sapiens
gagattaatttatct

SEQ ID NO: 44594 - DNA, 15 bp, Homo sapiens
agagattaatttatc

SEQ ID NO: 44595 - DNA, 15 bp, Homo sapiens
aagagattaatttat

SEQ ID NO: 44596 - DNA, 15 bp, Homo sapiens
aaagagattaattta

SEQ ID NO: 44597 - DNA, 15 bp, Homo sapiens
aaaagagattaattt

SEQ ID NO: 44598 - DNA, 15 bp, Homo sapiens
gaaaagagattaatt

SEQ ID NO: 44599 - DNA, 15 bp, Homo sapiens
agaaaagagattaat

SEQ ID NO: 44600 - DNA, 15 bp, Homo sapiens
aagaaaagagattaa

SEQ ID NO: 44601 - DNA, 15 bp, Homo sapiens
gaagaaaagagatta

SEQ ID NO: 44602 - DNA, 15 bp, Homo sapiens
tgaagaaaagagatt

SEQ ID NO: 44603 - DNA, 15 bp, Homo sapiens
ttgaagaaaagagat

SEQ ID NO: 44604 - DNA, 15 bp, Homo sapiens
tttgaagaaaagaga

SEQ ID NO: 44605 - DNA, 15 bp, Homo sapiens
ttttgaagaaaagag

SEQ ID NO: 44606 - DNA, 15 bp, Homo sapiens
tttttgaagaaaaga

SEQ ID NO: 44607 - DNA, 15 bp, Homo sapiens
ttttttgaagaaaag

SEQ ID NO: 44608 - DNA, 15 bp, Homo sapiens
tttttttgaagaaaa

SEQ ID NO: 44609 - DNA, 15 bp, Homo sapiens
atttttttgaagaaa

SEQ ID NO: 44610 - DNA, 15 bp, Homo sapiens
tatttttttgaagaa

SEQ ID NO: 44611 - DNA, 15 bp, Homo sapiens
ttatttttttgaaga

SEQ ID NO: 44612 - DNA, 15 bp, Homo sapiens
gttatttttttgaag

SEQ ID NO: 44613 - DNA, 15 bp, Homo sapiens
tgttatttttttgaa

SEQ ID NO: 44614 - DNA, 15 bp, Homo sapiens
gtgttatttttttga

SEQ ID NO: 44615 - DNA, 15 bp, Homo sapiens
agtgttatttttttg

SEQ ID NO: 44616 - DNA, 15 bp, Homo sapiens
cagtgttattttttt

SEQ ID NO: 44617 - DNA, 15 bp, Homo sapiens
acagtgttatttttt

SEQ ID NO: 44618 - DNA, 15 bp, Homo sapiens
cacagtgttattttt

SEQ ID NO: 44619 - DNA, 15 bp, Homo sapiens
tcacagtgttatttt

SEQ ID NO: 44620 - DNA, 15 bp, Homo sapiens
ttcacagtgttattt

SEQ ID NO: 44621 - DNA, 15 bp, Homo sapiens
tttcacagtgttatt

SEQ ID NO: 44622 - DNA, 15 bp, Homo sapiens
atttcacagtgttat

SEQ ID NO: 44623 - DNA, 15 bp, Homo sapiens
catttcacagtgtta

SEQ ID NO: 44624 - DNA, 15 bp, Homo sapiens
tcatttcacagtgtt

SEQ ID NO: 44625 - DNA, 15 bp, Homo sapiens
ttcatttcacagtgt

SEQ ID NO: 44626 - DNA, 15 bp, Homo sapiens
gttcatttcacagtg

SEQ ID NO: 44627 - DNA, 15 bp, Homo sapiens
tgttcatttcacagt

SEQ ID NO: 44628 - DNA, 15 bp, Homo sapiens
atgttcatttcacag

SEQ ID NO: 44629 - DNA, 15 bp, Homo sapiens
catgttcatttcaca

SEQ ID NO: 44630 - DNA, 15 bp, Homo sapiens
tcatgttcatttcac

SEQ ID NO: 44631 - DNA, 15 bp, Homo sapiens
ttcatgttcatttca

SEQ ID NO: 44632 - DNA, 15 bp, Homo sapiens
tttcatgttcatttc

SEQ ID NO: 44633 - DNA, 15 bp, Homo sapiens
ttttcatgttcattt

SEQ ID NO: 44634 - DNA, 15 bp, Homo sapiens
tttttcatgttcatt

SEQ ID NO: 44635 - DNA, 15 bp, Homo sapiens
atttttcatgttcat

SEQ ID NO: 44636 - DNA, 15 bp, Homo sapiens
catttttcatgttca

SEQ ID NO: 44637 - DNA, 15 bp, Homo sapiens
acatttttcatgttc

SEQ ID NO: 44638 - DNA, 15 bp, Homo sapiens
aacatttttcatgtt

SEQ ID NO: 44639 - DNA, 15 bp, Homo sapiens
aaacatttttcatgt

SEQ ID NO: 44640 - DNA, 15 bp, Homo sapiens
taaacatttttcatg

SEQ ID NO: 44641 - DNA, 15 bp, Homo sapiens
ataaacatttttcat

SEQ ID NO: 44642 - DNA, 15 bp, Homo sapiens
aataaacatttttca

SEQ ID NO: 44643 - DNA, 15 bp, Homo sapiens
caataaacatttttc

SEQ ID NO: 44644 - DNA, 15 bp, Homo sapiens
gcaataaacattttt

SEQ ID NO: 44645 - DNA, 15 bp, Homo sapiens
tgcaataaacatttt

SEQ ID NO: 44646 - DNA, 15 bp, Homo sapiens
atgcaataaacattt

SEQ ID NO: 44647 - DNA, 15 bp, Homo sapiens
gatgcaataaacatt

SEQ ID NO: 44648 - DNA, 15 bp, Homo sapiens
agatgcaataaacat

SEQ ID NO: 44649 - DNA, 15 bp, Homo sapiens
cagatgcaataaaca

SEQ ID NO: 44650 - DNA, 15 bp, Homo sapiens
ccagatgcaataaac

SEQ ID NO: 44651 - DNA, 15 bp, Homo sapiens
accagatgcaataaa

SEQ ID NO: 44652 - DNA, 15 bp, Homo sapiens
aaccagatgcaataa

SEQ ID NO: 44653 - DNA, 15 bp, Homo sapiens
aaaccagatgcaata

SEQ ID NO: 44654 - DNA, 15 bp, Homo sapiens
aaaaccagatgcaat

SEQ ID NO: 44655 - DNA, 15 bp, Homo sapiens
aaaaaccagatgcaa

SEQ ID NO: 44656 - DNA, 15 bp, Homo sapiens
aaaaaaccagatgca

SEQ ID NO: 44657 - DNA, 15 bp, Homo sapiens
aaaaaaaccagatgc

SEQ ID NO: 44658 - DNA, 15 bp, Homo sapiens
gaaaaaaaccagatg

SEQ ID NO: 44659 - DNA, 15 bp, Homo sapiens
ggaaaaaaaccagat

SEQ ID NO: 44660 - DNA, 15 bp, Homo sapiens
aggaaaaaaaccaga

SEQ ID NO: 44661 - DNA, 15 bp, Homo sapiens
gaggaaaaaaaccag

SEQ ID NO: 44662 - DNA, 15 bp, Homo sapiens
agaggaaaaaaacca

SEQ ID NO: 44663 - DNA, 15 bp, Homo sapiens
tagaggaaaaaaacc

SEQ ID NO: 44664 - DNA, 15 bp, Homo sapiens
atagaggaaaaaaac

SEQ ID NO: 44665 - DNA, 15 bp, Homo sapiens
catagaggaaaaaaa

SEQ ID NO: 44666 - DNA, 15 bp, Homo sapiens
acatagaggaaaaaa

SEQ ID NO: 44667 - DNA, 15 bp, Homo sapiens
aacatagaggaaaaa

SEQ ID NO: 44668 - DNA, 15 bp, Homo sapiens
aaacatagaggaaaa

SEQ ID NO: 44669 - DNA, 15 bp, Homo sapiens
aaaacatagaggaaa

SEQ ID NO: 44670 - DNA, 15 bp, Homo sapiens
taaaacatagaggaa

SEQ ID NO: 44671 - DNA, 15 bp, Homo sapiens
ataaaacatagagga

SEQ ID NO: 44672 - DNA, 15 bp, Homo sapiens
aataaaacatagagg

SEQ ID NO: 44673 - DNA, 15 bp, Homo sapiens
aaataaaacatagag

SEQ ID NO: 44674 - DNA, 15 bp, Homo sapiens
gaaataaaacataga

SEQ ID NO: 44675 - DNA, 15 bp, Homo sapiens
tgaaataaaacatag

SEQ ID NO: 44676 - DNA, 15 bp, Homo sapiens
ctgaaataaaacata

SEQ ID NO: 44677 - DNA, 15 bp, Homo sapiens
actgaaataaaacat

SEQ ID NO: 44678 - DNA, 15 bp, Homo sapiens
tactgaaataaaaca

SEQ ID NO: 44679 - DNA, 15 bp, Homo sapiens
ttactgaaataaaac

SEQ ID NO: 44680 - DNA, 15 bp, Homo sapiens
tttactgaaataaaa

SEQ ID NO: 44681 - DNA, 15 bp, Homo sapiens
ttttactgaaataaa

SEQ ID NO: 44682 - DNA, 15 bp, Homo sapiens
attttactgaaataa

SEQ ID NO: 44683 - DNA, 15 bp, Homo sapiens
tattttactgaaata

SEQ ID NO: 44684 - DNA, 15 bp, Homo sapiens
gtattttactgaaat

SEQ ID NO: 44685 - DNA, 15 bp, Homo sapiens
tgtattttactgaaa

SEQ ID NO: 44686 - DNA, 15 bp, Homo sapiens
ctgtattttactgaa

SEQ ID NO: 44687 - DNA, 15 bp, Homo sapiens
tctgtattttactga

SEQ ID NO: 44688 - DNA, 15 bp, Homo sapiens
atctgtattttactg

SEQ ID NO: 44689 - DNA, 15 bp, Homo sapiens
tatctgtattttact

SEQ ID NO: 44690 - DNA, 15 bp, Homo sapiens
ttatctgtattttac

SEQ ID NO: 44691 - DNA, 15 bp, Homo sapiens
gttatctgtatttta

SEQ ID NO: 44692 - DNA, 15 bp, Homo sapiens
tgttatctgtatttt

SEQ ID NO: 44693 - DNA, 15 bp, Homo sapiens
atgttatctgtattt

SEQ ID NO: 44694 - DNA, 15 bp, Homo sapiens
tatgttatctgtatt

SEQ ID NO: 44695 - DNA, 15 bp, Homo sapiens
ttatgttatctgtat

SEQ ID NO: 44696 - DNA, 15 bp, Homo sapiens
tttatgttatctgta

SEQ ID NO: 44697 - DNA, 15 bp, Homo sapiens
ttttatgttatctgt

SEQ ID NO: 44698 - DNA, 15 bp, Homo sapiens
attttatgttatctg

SEQ ID NO: 44699 - DNA, 15 bp, Homo sapiens
aattttatgttatct

SEQ ID NO: 44700 - DNA, 15 bp, Homo sapiens
aaattttatgttatc

SEQ ID NO: 44701 - DNA, 15 bp, Homo sapiens
taaattttatgttat

SEQ ID NO: 44702 - DNA, 15 bp, Homo sapiens
ataaattttatgtta

SEQ ID NO: 44703 - DNA, 15 bp, Homo sapiens
aataaattttatgtt

SEQ ID NO: 44704 - DNA, 15 bp, Homo sapiens
taataaattttatgt

SEQ ID NO: 44705 - DNA, 15 bp, Homo sapiens
ataataaattttatg

SEQ ID NO: 44706 - DNA, 15 bp, Homo sapiens
aataataaattttat

SEQ ID NO: 44707 - DNA, 15 bp, Homo sapiens
aaataataaatttta

SEQ ID NO: 44708 - DNA, 15 bp, Homo sapiens
aaaataataaatttt

SEQ ID NO: 44709 - DNA, 15 bp, Homo sapiens
taaaataataaattt

SEQ ID NO: 44710 - DNA, 15 bp, Homo sapiens
ctaaaataataaatt

SEQ ID NO: 44711 - DNA, 15 bp, Homo sapiens
gctaaaataataaat

SEQ ID NO: 44712 - DNA, 15 bp, Homo sapiens
ggctaaaataataaa

SEQ ID NO: 44713 - DNA, 15 bp, Homo sapiens
tggctaaaataataa

SEQ ID NO: 44714 - DNA, 15 bp, Homo sapiens
atggctaaaataata

SEQ ID NO: 44715 - DNA, 15 bp, Homo sapiens
aatggctaaaataat

SEQ ID NO: 44716 - DNA, 15 bp, Homo sapiens
aaatggctaaaataa

SEQ ID NO: 44717 - DNA, 15 bp, Homo sapiens
caaatggctaaaata

SEQ ID NO: 44718 - DNA, 15 bp, Homo sapiens
tcaaatggctaaaat

SEQ ID NO: 44719 - DNA, 15 bp, Homo sapiens
ttcaaatggctaaaa

SEQ ID NO: 44720 - DNA, 15 bp, Homo sapiens
tttcaaatggctaaa

SEQ ID NO: 44721 - DNA, 15 bp, Homo sapiens
atttcaaatggctaa

SEQ ID NO: 44722 - DNA, 15 bp, Homo sapiens
catttcaaatggcta

SEQ ID NO: 44723 - DNA, 15 bp, Homo sapiens
acatttcaaatggct

SEQ ID NO: 44724 - DNA, 15 bp, Homo sapiens
tacatttcaaatggc

SEQ ID NO: 44725 - DNA, 15 bp, Homo sapiens
gtacatttcaaatgg

SEQ ID NO: 44726 - DNA, 15 bp, Homo sapiens
tgtacatttcaaatg

SEQ ID NO: 44727 - DNA, 15 bp, Homo sapiens
atgtacatttcaaat

SEQ ID NO: 44728 - DNA, 15 bp, Homo sapiens
tatgtacatttcaaa

SEQ ID NO: 44729 - DNA, 15 bp, Homo sapiens
gtatgtacatttcaa

SEQ ID NO: 44730 - DNA, 15 bp, Homo sapiens
tgtatgtacatttca

SEQ ID NO: 44731 - DNA, 15 bp, Homo sapiens
atgtatgtacatttc

SEQ ID NO: 44732 - DNA, 15 bp, Homo sapiens
gatgtatgtacattt

SEQ ID NO: 44733 - DNA, 15 bp, Homo sapiens
agatgtatgtacatt

SEQ ID NO: 44734 - DNA, 15 bp, Homo sapiens
aagatgtatgtacat

SEQ ID NO: 44735 - DNA, 15 bp, Homo sapiens
caagatgtatgtaca

SEQ ID NO: 44736 - DNA, 15 bp, Homo sapiens
acaagatgtatgtac

SEQ ID NO: 44737 - DNA, 15 bp, Homo sapiens
aacaagatgtatgta

SEQ ID NO: 44738 - DNA, 15 bp, Homo sapiens
taacaagatgtatgt

SEQ ID NO: 44739 - DNA, 15 bp, Homo sapiens
ataacaagatgtatg

SEQ ID NO: 44740 - DNA, 15 bp, Homo sapiens
tataacaagatgtat

SEQ ID NO: 44741 - DNA, 15 bp, Homo sapiens
atataacaagatgta

SEQ ID NO: 44742 - DNA, 15 bp, Homo sapiens
tatataacaagatgt

SEQ ID NO: 44743 - DNA, 15 bp, Homo sapiens
ttatataacaagatg

SEQ ID NO: 44744 - DNA, 15 bp, Homo sapiens
gttatataacaagat

SEQ ID NO: 44745 - DNA, 15 bp, Homo sapiens
ggttatataacaaga

SEQ ID NO: 44746 - DNA, 15 bp, Homo sapiens
tggttatataacaag

SEQ ID NO: 44747 - DNA, 15 bp, Homo sapiens
atggttatataacaa

SEQ ID NO: 44748 - DNA, 15 bp, Homo sapiens
gatggttatataaca

SEQ ID NO: 44749 - DNA, 15 bp, Homo sapiens
tgatggttatataac

SEQ ID NO: 44750 - DNA, 15 bp, Homo sapiens
gtgatggttatataa

SEQ ID NO: 44751 - DNA, 15 bp, Homo sapiens
agtgatggttatata

SEQ ID NO: 44752 - DNA, 15 bp, Homo sapiens
tagtgatggttatat

SEQ ID NO: 44753 - DNA, 15 bp, Homo sapiens
gtagtgatggttata

SEQ ID NO: 44754 - DNA, 15 bp, Homo sapiens
ggtagtgatggttat

SEQ ID NO: 44755 - DNA, 15 bp, Homo sapiens
tggtagtgatggtta

SEQ ID NO: 44756 - DNA, 15 bp, Homo sapiens
atggtagtgatggtt

SEQ ID NO: 44757 - DNA, 15 bp, Homo sapiens
gatggtagtgatggt

SEQ ID NO: 44758 - DNA, 15 bp, Homo sapiens
cgatggtagtgatgg

SEQ ID NO: 44759 - DNA, 15 bp, Homo sapiens
acgatggtagtgatg

SEQ ID NO: 44760 - DNA, 15 bp, Homo sapiens
aacgatggtagtgat

SEQ ID NO: 44761 - DNA, 15 bp, Homo sapiens
gaacgatggtagtga

SEQ ID NO: 44762 - DNA, 15 bp, Homo sapiens
agaacgatggtagtg

SEQ ID NO: 44763 - DNA, 15 bp, Homo sapiens
gagaacgatggtagt

SEQ ID NO: 44764 - DNA, 15 bp, Homo sapiens
ggagaacgatggtag

SEQ ID NO: 44765 - DNA, 15 bp, Homo sapiens
aggagaacgatggta

SEQ ID NO: 44766 - DNA, 15 bp, Homo sapiens
caggagaacgatggt

SEQ ID NO: 44767 - DNA, 15 bp, Homo sapiens
tcaggagaacgatgg

SEQ ID NO: 44768 - DNA, 15 bp, Homo sapiens
ttcaggagaacgatg

SEQ ID NO: 44769 - DNA, 15 bp, Homo sapiens
attcaggagaacgat

SEQ ID NO: 44770 - DNA, 15 bp, Homo sapiens
aattcaggagaacga

SEQ ID NO: 44771 - DNA, 15 bp, Homo sapiens
gaattcaggagaacg

SEQ ID NO: 44772 - DNA, 15 bp, Homo sapiens
agaattcaggagaac

SEQ ID NO: 44773 - DNA, 15 bp, Homo sapiens
aagaattcaggagaa

SEQ ID NO: 44774 - DNA, 15 bp, Homo sapiens
aaagaattcaggaga

SEQ ID NO: 44775 - DNA, 15 bp, Homo sapiens
aaaagaattcaggag

SEQ ID NO: 44776 - DNA, 15 bp, Homo sapiens
gaaaagaattcagga

SEQ ID NO: 44777 - DNA, 15 bp, Homo sapiens
agaaaagaattcagg

SEQ ID NO: 44778 - DNA, 15 bp, Homo sapiens
aagaaaagaattcag

SEQ ID NO: 44779 - DNA, 15 bp, Homo sapiens
caagaaaagaattca

SEQ ID NO: 44780 - DNA, 15 bp, Homo sapiens
acaagaaaagaattc

SEQ ID NO: 44781 - DNA, 15 bp, Homo sapiens
aacaagaaaagaatt

SEQ ID NO: 44782 - DNA, 15 bp, Homo sapiens
caacaagaaaagaat

SEQ ID NO: 44783 - DNA, 15 bp, Homo sapiens
tcaacaagaaaagaa

SEQ ID NO: 44784 - DNA, 15 bp, Homo sapiens
ttcaacaagaaaaga

SEQ ID NO: 44785 - DNA, 15 bp, Homo sapiens
tttcaacaagaaaag

SEQ ID NO: 44786 - DNA, 15 bp, Homo sapiens
ttttcaacaagaaaa

SEQ ID NO: 44787 - DNA, 15 bp, Homo sapiens
tttttcaacaagaaa

SEQ ID NO: 44788 - DNA, 15 bp, Homo sapiens
gtttttcaacaagaa

SEQ ID NO: 44789 - DNA, 15 bp, Homo sapiens
agtttttcaacaaga

SEQ ID NO: 44790 - DNA, 15 bp, Homo sapiens
cagtttttcaacaag

SEQ ID NO: 44791 - DNA, 15 bp, Homo sapiens
tcagtttttcaacaa

SEQ ID NO: 44792 - DNA, 15 bp, Homo sapiens
ttcagtttttcaaca

SEQ ID NO: 44793 - DNA, 15 bp, Homo sapiens
tttcagtttttcaac

SEQ ID NO: 44794 - DNA, 15 bp, Homo sapiens
ttttcagtttttcaa

SEQ ID NO: 44795 - DNA, 15 bp, Homo sapiens
attttcagtttttca

SEQ ID NO: 44796 - DNA, 15 bp, Homo sapiens
tattttcagtttttc

SEQ ID NO: 44797 - DNA, 15 bp, Homo sapiens
atattttcagttttt

SEQ ID NO: 44798 - DNA, 15 bp, Homo sapiens
tatattttcagtttt

SEQ ID NO: 44799 - DNA, 15 bp, Homo sapiens
atatattttcagttt

SEQ ID NO: 44800 - DNA, 15 bp, Homo sapiens
tatatattttcagtt

SEQ ID NO: 44801 - DNA, 15 bp, Homo sapiens
gtatatattttcagt

SEQ ID NO: 44802 - DNA, 15 bp, Homo sapiens
ggtatatattttcag

SEQ ID NO: 44803 - DNA, 15 bp, Homo sapiens
gggtatatattttca

SEQ ID NO: 44804 - DNA, 15 bp, Homo sapiens
tgggtatatattttc

SEQ ID NO: 44805 - DNA, 15 bp, Homo sapiens
atgggtatatatttt

SEQ ID NO: 44806 - DNA, 15 bp, Homo sapiens
aatgggtatatattt

SEQ ID NO: 44807 - DNA, 15 bp, Homo sapiens
taatgggtatatatt

SEQ ID NO: 44808 - DNA, 15 bp, Homo sapiens
ttaatgggtatatat

SEQ ID NO: 44809 - DNA, 15 bp, Homo sapiens
tttaatgggtatata

SEQ ID NO: 44810 - DNA, 15 bp, Homo sapiens
gtttaatgggtatat

SEQ ID NO: 44811 - DNA, 15 bp, Homo sapiens
ggtttaatgggtata

SEQ ID NO: 44812 - DNA, 15 bp, Homo sapiens
tggtttaatgggtat

SEQ ID NO: 44813 - DNA, 15 bp, Homo sapiens
ctggtttaatgggta

SEQ ID NO: 44814 - DNA, 15 bp, Homo sapiens
cctggtttaatgggt

SEQ ID NO: 44815 - DNA, 15 bp, Homo sapiens
ccctggtttaatggg

SEQ ID NO: 44816 - DNA, 15 bp, Homo sapiens
cccctggtttaatgg

SEQ ID NO: 44817 - DNA, 15 bp, Homo sapiens
acccctggtttaatg

SEQ ID NO: 44818 - DNA, 15 bp, Homo sapiens
gacccctggtttaat

SEQ ID NO: 44819 - DNA, 15 bp, Homo sapiens
ggacccctggtttaa

SEQ ID NO: 44820 - DNA, 15 bp, Homo sapiens
gggacccctggttta

SEQ ID NO: 44821 - DNA, 15 bp, Homo sapiens
ggggacccctggttt

SEQ ID NO: 44822 - DNA, 15 bp, Homo sapiens
tggggacccctggtt

SEQ ID NO: 44823 - DNA, 15 bp, Homo sapiens
ttggggacccctggt

SEQ ID NO: 44824 - DNA, 15 bp, Homo sapiens
cttggggacccctgg

SEQ ID NO: 44825 - DNA, 15 bp, Homo sapiens
gcttggggacccctg

SEQ ID NO: 44826 - DNA, 15 bp, Homo sapiens
ggcttggggacccct

SEQ ID NO: 44827 - DNA, 15 bp, Homo sapiens
gggcttggggacccc

SEQ ID NO: 44828 - DNA, 15 bp, Homo sapiens
agggcttggggaccc

SEQ ID NO: 44829 - DNA, 15 bp, Homo sapiens
cagggcttggggacc

SEQ ID NO: 44830 - DNA, 15 bp, Homo sapiens
ccagggcttggggac

SEQ ID NO: 44831 - DNA, 15 bp, Homo sapiens
cccagggcttgggga

SEQ ID NO: 44832 - DNA, 15 bp, Homo sapiens
gcccagggcttgggg

SEQ ID NO: 44833 - DNA, 15 bp, Homo sapiens
ggcccagggcttggg

SEQ ID NO: 44834 - DNA, 15 bp, Homo sapiens
tggcccagggcttgg

SEQ ID NO: 44835 - DNA, 15 bp, Homo sapiens
gtggcccagggcttg

SEQ ID NO: 44836 - DNA, 15 bp, Homo sapiens
tgtggcccagggctt

SEQ ID NO: 44837 - DNA, 15 bp, Homo sapiens
ctgtggcccagggct

SEQ ID NO: 44838 - DNA, 15 bp, Homo sapiens
cctgtggcccagggc

SEQ ID NO: 44839 - DNA, 15 bp, Homo sapiens
acctgtggcccaggg

SEQ ID NO: 44840 - DNA, 15 bp, Homo sapiens
gacctgtggcccagg

SEQ ID NO: 44841 - DNA, 15 bp, Homo sapiens
cgacctgtggcccag

SEQ ID NO: 44842 - DNA, 15 bp, Homo sapiens
gcgacctgtggccca

SEQ ID NO: 44843 - DNA, 15 bp, Homo sapiens
agcgacctgtggccc

SEQ ID NO: 44844 - DNA, 15 bp, Homo sapiens
tagcgacctgtggcc

SEQ ID NO: 44845 - DNA, 15 bp, Homo sapiens
gtagcgacctgtggc

SEQ ID NO: 44846 - DNA, 15 bp, Homo sapiens
agtagcgacctgtgg

SEQ ID NO: 44847 - DNA, 15 bp, Homo sapiens
tagtagcgacctgtg

SEQ ID NO: 44848 - DNA, 15 bp, Homo sapiens
ctagtagcgacctgt

SEQ ID NO: 44849 - DNA, 15 bp, Homo sapiens
actagtagcgacctg

SEQ ID NO: 44850 - DNA, 15 bp, Homo sapiens
gactagtagcgacct

SEQ ID NO: 44851 - DNA, 15 bp, Homo sapiens
agactagtagcgacc

SEQ ID NO: 44852 - DNA, 15 bp, Homo sapiens
cagactagtagcgac

SEQ ID NO: 44853 - DNA, 15 bp, Homo sapiens
acagactagtagcga

SEQ ID NO: 44854 - DNA, 15 bp, Homo sapiens
aacagactagtagcg

SEQ ID NO: 44855 - DNA, 15 bp, Homo sapiens
caacagactagtagc

SEQ ID NO: 44856 - DNA, 15 bp, Homo sapiens
gcaacagactagtag

SEQ ID NO: 44857 - DNA, 15 bp, Homo sapiens
ggcaacagactagta

SEQ ID NO: 44858 - DNA, 15 bp, Homo sapiens
aggcaacagactagt

SEQ ID NO: 44859 - DNA, 15 bp, Homo sapiens
caggcaacagactag

SEQ ID NO: 44860 - DNA, 15 bp, Homo sapiens
acaggcaacagacta

SEQ ID NO: 44861 - DNA, 15 bp, Homo sapiens
aacaggcaacagact

SEQ ID NO: 44862 - DNA, 15 bp, Homo sapiens
taacaggcaacagac

SEQ ID NO: 44863 - DNA, 15 bp, Homo sapiens
ctaacaggcaacaga

SEQ ID NO: 44864 - DNA, 15 bp, Homo sapiens
cctaacaggcaacag

SEQ ID NO: 44865 - DNA, 15 bp, Homo sapiens
tcctaacaggcaaca

SEQ ID NO: 44866 - DNA, 15 bp, Homo sapiens
ctcctaacaggcaac

SEQ ID NO: 44867 - DNA, 15 bp, Homo sapiens
cctcctaacaggcaa

SEQ ID NO: 44868 - DNA, 15 bp, Homo sapiens
gcctcctaacaggca

SEQ ID NO: 44869 - DNA, 15 bp, Homo sapiens
cgcctcctaacaggc

SEQ ID NO: 44870 - DNA, 15 bp, Homo sapiens
tcgcctcctaacagg

SEQ ID NO: 44871 - DNA, 15 bp, Homo sapiens
ctcgcctcctaacag

SEQ ID NO: 44872 - DNA, 15 bp, Homo sapiens
actcgcctcctaaca

SEQ ID NO: 44873 - DNA, 15 bp, Homo sapiens
gactcgcctcctaac

SEQ ID NO: 44874 - DNA, 15 bp, Homo sapiens
tgactcgcctcctaa

SEQ ID NO: 44875 - DNA, 15 bp, Homo sapiens
gtgactcgcctccta

SEQ ID NO: 44876 - DNA, 15 bp, Homo sapiens
tgtgactcgcctcct

SEQ ID NO: 44877 - DNA, 15 bp, Homo sapiens
gtgtgactcgcctcc

SEQ ID NO: 44878 - DNA, 15 bp, Homo sapiens
tgtgtgactcgcctc

SEQ ID NO: 44879 - DNA, 15 bp, Homo sapiens
ctgtgtgactcgcct

SEQ ID NO: 44880 - DNA, 15 bp, Homo sapiens
gctgtgtgactcgcc

SEQ ID NO: 44881 - DNA, 15 bp, Homo sapiens
tgctgtgtgactcgc

SEQ ID NO: 44882 - DNA, 15 bp, Homo sapiens
ctgctgtgtgactcg

SEQ ID NO: 44883 - DNA, 15 bp, Homo sapiens
cctgctgtgtgactc

SEQ ID NO: 44884 - DNA, 15 bp, Homo sapiens
ccctgctgtgtgact

SEQ ID NO: 44885 - DNA, 15 bp, Homo sapiens
cccctgctgtgtgac

SEQ ID NO: 44886 - DNA, 15 bp, Homo sapiens
ccccctgctgtgtga

SEQ ID NO: 44887 - DNA, 15 bp, Homo sapiens
accccctgctgtgtg

SEQ ID NO: 44888 - DNA, 15 bp, Homo sapiens
caccccctgctgtgt

SEQ ID NO: 44889 - DNA, 15 bp, Homo sapiens
tcaccccctgctgtg

SEQ ID NO: 44890 - DNA, 15 bp, Homo sapiens
ctcaccccctgctgt

SEQ ID NO: 44891 - DNA, 15 bp, Homo sapiens
gctcaccccctgctg

SEQ ID NO: 44892 - DNA, 15 bp, Homo sapiens
cgctcaccccctgct

SEQ ID NO: 44893 - DNA, 15 bp, Homo sapiens
ccgctcaccccctgc

SEQ ID NO: 44894 - DNA, 15 bp, Homo sapiens
accgctcaccccctg

SEQ ID NO: 44895 - DNA, 15 bp, Homo sapiens
caccgctcaccccct

SEQ ID NO: 44896 - DNA, 15 bp, Homo sapiens
ccaccgctcaccccc

SEQ ID NO: 44897 - DNA, 15 bp, Homo sapiens
cccaccgctcacccc

SEQ ID NO: 44898 - DNA, 15 bp, Homo sapiens
acccaccgctcaccc

SEQ ID NO: 44899 - DNA, 15 bp, Homo sapiens
tacccaccgctcacc

SEQ ID NO: 44900 - DNA, 15 bp, Homo sapiens
ttacccaccgctcac

SEQ ID NO: 44901 - DNA, 15 bp, Homo sapiens
attacccaccgctca

SEQ ID NO: 44902 - DNA, 15 bp, Homo sapiens
gattacccaccgctc

SEQ ID NO: 44903 - DNA, 15 bp, Homo sapiens
cgattacccaccgct

SEQ ID NO: 44904 - DNA, 15 bp, Homo sapiens
tcgattacccaccgc

SEQ ID NO: 44905 - DNA, 15 bp, Homo sapiens
ctcgattacccaccg

SEQ ID NO: 44906 - DNA, 15 bp, Homo sapiens
gctcgattacccacc

SEQ ID NO: 44907 - DNA, 15 bp, Homo sapiens
tgctcgattacccac

SEQ ID NO: 44908 - DNA, 15 bp, Homo sapiens
atgctcgattaccca

SEQ ID NO: 44909 - DNA, 15 bp, Homo sapiens
aatgctcgattaccc

SEQ ID NO: 44910 - DNA, 15 bp, Homo sapiens
taatgctcgattacc

SEQ ID NO: 44911 - DNA, 15 bp, Homo sapiens
gtaatgctcgattac

SEQ ID NO: 44912 - DNA, 15 bp, Homo sapiens
ggtaatgctcgatta

SEQ ID NO: 44913 - DNA, 15 bp, Homo sapiens
aggtaatgctcgatt

SEQ ID NO: 44914 - DNA, 15 bp, Homo sapiens
gaggtaatgctcgat

SEQ ID NO: 44915 - DNA, 15 bp, Homo sapiens
ggaggtaatgctcga

SEQ ID NO: 44916 - DNA, 15 bp, Homo sapiens
aggaggtaatgctcg

SEQ ID NO: 44917 - DNA, 15 bp, Homo sapiens
caggaggtaatgctc

SEQ ID NO: 44918 - DNA, 15 bp, Homo sapiens
tcaggaggtaatgct

SEQ ID NO: 44919 - DNA, 15 bp, Homo sapiens
ctcaggaggtaatgc

SEQ ID NO: 44920 - DNA, 15 bp, Homo sapiens
gctcaggaggtaatg

SEQ ID NO: 44921 - DNA, 15 bp, Homo sapiens
agctcaggaggtaat

SEQ ID NO: 44922 - DNA, 15 bp, Homo sapiens
gagctcaggaggtaa

SEQ ID NO: 44923 - DNA, 15 bp, Homo sapiens
agagctcaggaggta

SEQ ID NO: 44924 - DNA, 15 bp, Homo sapiens
cagagctcaggaggt

SEQ ID NO: 44925 - DNA, 15 bp, Homo sapiens
gcagagctcaggagg

SEQ ID NO: 44926 - DNA, 15 bp, Homo sapiens
ggcagagctcaggag

SEQ ID NO: 44927 - DNA, 15 bp, Homo sapiens
aggcagagctcagga

SEQ ID NO: 44928 - DNA, 15 bp, Homo sapiens
tgctgatctgacagg

SEQ ID NO: 44929 - DNA, 15 bp, Homo sapiens
ctgctgatctgacag

SEQ ID NO: 44930 - DNA, 15 bp, Homo sapiens
gctgctgatctgaca

SEQ ID NO: 44931 - DNA, 15 bp, Homo sapiens
cgctgctgatctgac

SEQ ID NO: 44932 - DNA, 15 bp, Homo sapiens
ccgctgctgatctga

SEQ ID NO: 44933 - DNA, 15 bp, Homo sapiens
gccgctgctgatctg

SEQ ID NO: 44934 - DNA, 15 bp, Homo sapiens
tgccgctgctgatct

SEQ ID NO: 44935 - DNA, 15 bp, Homo sapiens
atgccgctgctgatc

SEQ ID NO: 44936 - DNA, 15 bp, Homo sapiens
aatgccgctgctgat

SEQ ID NO: 44937 - DNA, 15 bp, Homo sapiens
gaatgccgctgctga

SEQ ID NO: 44938 - DNA, 15 bp, Homo sapiens
cgaatgccgctgctg

SEQ ID NO: 44939 - DNA, 15 bp, Homo sapiens
tcgaatgccgctgct

SEQ ID NO: 44940 - DNA, 15 bp, Homo sapiens
atcgaatgccgctgc

SEQ ID NO: 44941 - DNA, 15 bp, Homo sapiens
aatcgaatgccgctg

SEQ ID NO: 44942 - DNA, 15 bp, Homo sapiens
gaatcgaatgccgct

SEQ ID NO: 44943 - DNA, 15 bp, Homo sapiens
agaatcgaatgccgc

SEQ ID NO: 44944 - DNA, 15 bp, Homo sapiens
gagaatcgaatgccg

SEQ ID NO: 44945 - DNA, 15 bp, Homo sapiens
tgagaatcgaatgcc

SEQ ID NO: 44946 - DNA, 15 bp, Homo sapiens
atgagaatcgaatgc

SEQ ID NO: 44947 - DNA, 15 bp, Homo sapiens
tatgagaatcgaatg

SEQ ID NO: 44948 - DNA, 15 bp, Homo sapiens
ctatgagaatcgaat

SEQ ID NO: 44949 - DNA, 15 bp, Homo sapiens
cctatgagaatcgaa

SEQ ID NO: 44950 - DNA, 15 bp, Homo sapiens
tcctatgagaatcga

SEQ ID NO: 44951 - DNA, 15 bp, Homo sapiens
ctcctatgagaatcg

SEQ ID NO: 44952 - DNA, 15 bp, Homo sapiens
gctcctatgagaatc

SEQ ID NO: 44953 - DNA, 15 bp, Homo sapiens
tgctcctatgagaat

SEQ ID NO: 44954 - DNA, 15 bp, Homo sapiens
gtgctcctatgagaa

SEQ ID NO: 44955 - DNA, 15 bp, Homo sapiens
cgtgctcctatgaga

SEQ ID NO: 44956 - DNA, 15 bp, Homo sapiens
tcgtgctcctatgag

SEQ ID NO: 44957 - DNA, 15 bp, Homo sapiens
ttcgtgctcctatga

SEQ ID NO: 44958 - DNA, 15 bp, Homo sapiens
gttcgtgctcctatg

SEQ ID NO: 44959 - DNA, 15 bp, Homo sapiens
ggttcgtgctcctat

SEQ ID NO: 44960 - DNA, 15 bp, Homo sapiens
gggttcgtgctccta

SEQ ID NO: 44961 - DNA, 15 bp, Homo sapiens
agggttcgtgctcct

SEQ ID NO: 44962 - DNA, 15 bp, Homo sapiens
tagggttcgtgctcc

SEQ ID NO: 44963 - DNA, 15 bp, Homo sapiens
atagggttcgtgctc

SEQ ID NO: 44964 - DNA, 15 bp, Homo sapiens
aatagggttcgtgct

SEQ ID NO: 44965 - DNA, 15 bp, Homo sapiens
caatagggttcgtgc

SEQ ID NO: 44966 - DNA, 15 bp, Homo sapiens
acaatagggttcgtg

SEQ ID NO: 44967 - DNA, 15 bp, Homo sapiens
cacaatagggttcgt

SEQ ID NO: 44968 - DNA, 15 bp, Homo sapiens
ccacaatagggttcg

SEQ ID NO: 44969 - DNA, 15 bp, Homo sapiens
tccacaatagggttc

SEQ ID NO: 44970 - DNA, 15 bp, Homo sapiens
gtccacaatagggtt

SEQ ID NO: 44971 - DNA, 15 bp, Homo sapiens
agtccacaatagggt

SEQ ID NO: 44972 - DNA, 15 bp, Homo sapiens
cagtccacaataggg

SEQ ID NO: 44973 - DNA, 15 bp, Homo sapiens
acagtccacaatagg

SEQ ID NO: 44974 - DNA, 15 bp, Homo sapiens
cacagtccacaatag

SEQ ID NO: 44975 - DNA, 15 bp, Homo sapiens
gcacagtccacaata

SEQ ID NO: 44976 - DNA, 15 bp, Homo sapiens
tgcacagtccacaat

SEQ ID NO: 44977 - DNA, 15 bp, Homo sapiens
atgcacagtccacaa

SEQ ID NO: 44978 - DNA, 15 bp, Homo sapiens
catgcacagtccaca

SEQ ID NO: 44979 - DNA, 15 bp, Homo sapiens
acatgcacagtccac

SEQ ID NO: 44980 - DNA, 15 bp, Homo sapiens
cacatgcacagtcca

SEQ ID NO: 44981 - DNA, 15 bp, Homo sapiens
tcacatgcacagtcc

SEQ ID NO: 44982 - DNA, 15 bp, Homo sapiens
ctcacatgcacagtc

SEQ ID NO: 44983 - DNA, 15 bp, Homo sapiens
cctcacatgcacagt

SEQ ID NO: 44984 - DNA, 15 bp, Homo sapiens
ccctcacatgcacag

SEQ ID NO: 44985 - DNA, 15 bp, Homo sapiens
tccctcacatgcaca

SEQ ID NO: 44986 - DNA, 15 bp, Homo sapiens
atccctcacatgcac

SEQ ID NO: 44987 - DNA, 15 bp, Homo sapiens
catccctcacatgca

SEQ ID NO: 44988 - DNA, 15 bp, Homo sapiens
acatccctcacatgc

SEQ ID NO: 44989 - DNA, 15 bp, Homo sapiens
tacatccctcacatg

SEQ ID NO: 44990 - DNA, 15 bp, Homo sapiens
ctacatccctcacat

SEQ ID NO: 44991 - DNA, 15 bp, Homo sapiens
cctacatccctcaca

SEQ ID NO: 44992 - DNA, 15 bp, Homo sapiens
acctacatccctcac

SEQ ID NO: 44993 - DNA, 15 bp, Homo sapiens
gacctacatccctca

SEQ ID NO: 44994 - DNA, 15 bp, Homo sapiens
cgacctacatccctc

SEQ ID NO: 44995 - DNA, 15 bp, Homo sapiens
acgacctacatccct

SEQ ID NO: 44996 - DNA, 15 bp, Homo sapiens
tacgacctacatccc

SEQ ID NO: 44997 - DNA, 15 bp, Homo sapiens
gtacgacctacatcc

SEQ ID NO: 44998 - DNA, 15 bp, Homo sapiens
tgtacgacctacatc

SEQ ID NO: 44999 - DNA, 15 bp, Homo sapiens
gtgtacgacctacat

SEQ ID NO: 45000 - DNA, 15 bp, Homo sapiens
agtgtacgacctaca

SEQ ID NO: 45001 - DNA, 15 bp, Homo sapiens
gagtgtacgacctac

SEQ ID NO: 45002 - DNA, 15 bp, Homo sapiens
ggagtgtacgaccta

SEQ ID NO: 45003 - DNA, 15 bp, Homo sapiens
aggagtgtacgacct

SEQ ID NO: 45004 - DNA, 15 bp, Homo sapiens
aaggagtgtacgacc

SEQ ID NO: 45005 - DNA, 15 bp, Homo sapiens
taaggagtgtacgac

SEQ ID NO: 45006 - DNA, 15 bp, Homo sapiens
ataaggagtgtacga

SEQ ID NO: 45007 - DNA, 15 bp, Homo sapiens
aataaggagtgtacg

SEQ ID NO: 45008 - DNA, 15 bp, Homo sapiens
taataaggagtgtac

SEQ ID NO: 45009 - DNA, 15 bp, Homo sapiens
ctaataaggagtgta

SEQ ID NO: 45010 - DNA, 15 bp, Homo sapiens
tctaataaggagtgt

SEQ ID NO: 45011 - DNA, 15 bp, Homo sapiens
ttctaataaggagtg

SEQ ID NO: 45012 - DNA, 15 bp, Homo sapiens
attctaataaggagt

SEQ ID NO: 45013 - DNA, 15 bp, Homo sapiens
gattctaataaggag

SEQ ID NO: 45014 - DNA, 15 bp, Homo sapiens
agattctaataagga

SEQ ID NO: 45015 - DNA, 15 bp, Homo sapiens
tagattctaataagg

SEQ ID NO: 45016 - DNA, 15 bp, Homo sapiens
ttagattctaataag

SEQ ID NO: 45017 - DNA, 15 bp, Homo sapiens
gttagattctaataa

SEQ ID NO: 45018 - DNA, 15 bp, Homo sapiens
agttagattctaata

SEQ ID NO: 45019 - DNA, 15 bp, Homo sapiens
tagttagattctaat

SEQ ID NO: 45020 - DNA, 15 bp, Homo sapiens
ttagttagattctaa

SEQ ID NO: 45021 - DNA, 15 bp, Homo sapiens
attagttagattcta

SEQ ID NO: 45022 - DNA, 15 bp, Homo sapiens
cattagttagattct

SEQ ID NO: 45023 - DNA, 15 bp, Homo sapiens
gcattagttagattc

SEQ ID NO: 45024 - DNA, 15 bp, Homo sapiens
ggcattagttagatt

SEQ ID NO: 45025 - DNA, 15 bp, Homo sapiens
aggcattagttagat

SEQ ID NO: 45026 - DNA, 15 bp, Homo sapiens
caggcattagttaga

SEQ ID NO: 45027 - DNA, 15 bp, Homo sapiens
tcaggcattagttag

SEQ ID NO: 45028 - DNA, 15 bp, Homo sapiens
atcaggcattagtta

SEQ ID NO: 45029 - DNA, 15 bp, Homo sapiens
catcaggcattagtt

SEQ ID NO: 45030 - DNA, 15 bp, Homo sapiens
tcatcaggcattagt

SEQ ID NO: 45031 - DNA, 15 bp, Homo sapiens
acagatcatcaggca

SEQ ID NO: 45032 - DNA, 15 bp, Homo sapiens
cacagatcatcaggc

SEQ ID NO: 45033 - DNA, 15 bp, Homo sapiens
ccacagatcatcagg

SEQ ID NO: 45034 - DNA, 15 bp, Homo sapiens
accacagatcatcag

SEQ ID NO: 45035 - DNA, 15 bp, Homo sapiens
caccacagatcatca

SEQ ID NO: 45036 - DNA, 15 bp, Homo sapiens
tcaccacagatcatc

SEQ ID NO: 45037 - DNA, 15 bp, Homo sapiens
ttcaccacagatcat

SEQ ID NO: 45038 - DNA, 15 bp, Homo sapiens
tttcaccacagatca

SEQ ID NO: 45039 - DNA, 15 bp, Homo sapiens
gtttcaccacagatc

SEQ ID NO: 45040 - DNA, 15 bp, Homo sapiens
tgtttcaccacagat

SEQ ID NO: 45041 - DNA, 15 bp, Homo sapiens
ctgtttcaccacaga

SEQ ID NO: 45042 - DNA, 15 bp, Homo sapiens
actgtttcaccacag

SEQ ID NO: 45043 - DNA, 15 bp, Homo sapiens
aactgtttcaccaca

SEQ ID NO: 45044 - DNA, 15 bp, Homo sapiens
aaactgtttcaccac

SEQ ID NO: 45045 - DNA, 15 bp, Homo sapiens
gaaactgtttcacca

SEQ ID NO: 45046 - DNA, 15 bp, Homo sapiens
tgaaactgtttcacc

SEQ ID NO: 45047 - DNA, 15 bp, Homo sapiens
atgaaactgtttcac

SEQ ID NO: 45048 - DNA, 15 bp, Homo sapiens
gatgaaactgtttca

SEQ ID NO: 45049 - DNA, 15 bp, Homo sapiens
ggatgaaactgtttc

SEQ ID NO: 45050 - DNA, 15 bp, Homo sapiens
gggatgaaactgttt

SEQ ID NO: 45051 - DNA, 15 bp, Homo sapiens
cgggatgaaactgtt

SEQ ID NO: 45052 - DNA, 15 bp, Homo sapiens
tcgggatgaaactgt

SEQ ID NO: 45053 - DNA, 15 bp, Homo sapiens
ttcgggatgaaactg

SEQ ID NO: 45054 - DNA, 15 bp, Homo sapiens
tttcgggatgaaact

SEQ ID NO: 45055 - DNA, 15 bp, Homo sapiens
gtttcgggatgaaac

SEQ ID NO: 45056 - DNA, 15 bp, Homo sapiens
ggtttcgggatgaaa

SEQ ID NO: 45057 - DNA, 15 bp, Homo sapiens
tggtttcgggatgaa

SEQ ID NO: 45058 - DNA, 15 bp, Homo sapiens
gtggtttcgggatga

SEQ ID NO: 45059 - DNA, 15 bp, Homo sapiens
agtggtttcgggatg

SEQ ID NO: 45060 - DNA, 15 bp, Homo sapiens
gagtggtttcgggat

SEQ ID NO: 45061 - DNA, 15 bp, Homo sapiens
ggagtggtttcggga

SEQ ID NO: 45062 - DNA, 15 bp, Homo sapiens
gggagtggtttcggg

SEQ ID NO: 45063 - DNA, 15 bp, Homo sapiens
ggggagtggtttcgg

SEQ ID NO: 45064 - DNA, 15 bp, Homo sapiens
gggggagtggtttcg

SEQ ID NO: 45065 - DNA, 15 bp, Homo sapiens
tgggggagtggtttc

SEQ ID NO: 45066 - DNA, 15 bp, Homo sapiens
gtgggggagtggttt

SEQ ID NO: 45067 - DNA, 15 bp, Homo sapiens
agtgggggagtggtt

SEQ ID NO: 45068 - DNA, 15 bp, Homo sapiens
cagtgggggagtggt

SEQ ID NO: 45069 - DNA, 15 bp, Homo sapiens
gcagtgggggagtgg

SEQ ID NO: 45070 - DNA, 15 bp, Homo sapiens
ggcagtgggggagtg

SEQ ID NO: 45071 - DNA, 15 bp, Homo sapiens
aggcagtgggggagt

SEQ ID NO: 45072 - DNA, 15 bp, Homo sapiens
gaggcagtgggggag

SEQ ID NO: 45073 - DNA, 15 bp, Homo sapiens
ggaggcagtggggga

SEQ ID NO: 45074 - DNA, 15 bp, Homo sapiens
gggaggcagtggggg

SEQ ID NO: 45075 - DNA, 15 bp, Homo sapiens
ggggaggcagtgggg

SEQ ID NO: 45076 - DNA, 15 bp, Homo sapiens
gggggaggcagtggg

SEQ ID NO: 45077 - DNA, 15 bp, Homo sapiens
tgggggaggcagtgg

SEQ ID NO: 45078 - DNA, 15 bp, Homo sapiens
gtgggggaggcagtg

SEQ ID NO: 45079 - DNA, 15 bp, Homo sapiens
agtgggggaggcagt

SEQ ID NO: 45080 - DNA, 15 bp, Homo sapiens
cagtgggggaggcag

SEQ ID NO: 45081 - DNA, 15 bp, Homo sapiens
gcagtgggggaggca

SEQ ID NO: 45082 - DNA, 15 bp, Homo sapiens
ggcagtgggggaggc

SEQ ID NO: 45083 - DNA, 15 bp, Homo sapiens
gggcagtgggggagg

SEQ ID NO: 45084 - DNA, 15 bp, Homo sapiens
ggggcagtgggggag

SEQ ID NO: 45085 - DNA, 15 bp, Homo sapiens
cggggcagtggggga

SEQ ID NO: 45086 - DNA, 15 bp, Homo sapiens
gcggggcagtggggg

SEQ ID NO: 45087 - DNA, 15 bp, Homo sapiens
ggcggggcagtgggg

SEQ ID NO: 45088 - DNA, 15 bp, Homo sapiens
gggcggggcagtggg

SEQ ID NO: 45089 - DNA, 15 bp, Homo sapiens
tgggcggggcagtgg

SEQ ID NO: 45090 - DNA, 15 bp, Homo sapiens
atgggcggggcagtg

SEQ ID NO: 45091 - DNA, 15 bp, Homo sapiens
catgggcggggcagt

SEQ ID NO: 45092 - DNA, 15 bp, Homo sapiens
ccatgggcggggcag

SEQ ID NO: 45093 - DNA, 15 bp, Homo sapiens
tccatgggcggggca

SEQ ID NO: 45094 - DNA, 15 bp, Homo sapiens
ttccatgggcggggc

SEQ ID NO: 45095 - DNA, 15 bp, Homo sapiens
tttccatgggcgggg

SEQ ID NO: 45096 - DNA, 15 bp, Homo sapiens
ttttccatgggcggg

SEQ ID NO: 45097 - DNA, 15 bp, Homo sapiens
tttttccatgggcgg

SEQ ID NO: 45098 - DNA, 15 bp, Homo sapiens
atttttccatgggcg

SEQ ID NO: 45099 - DNA, 15 bp, Homo sapiens
aatttttccatgggc

SEQ ID NO: 45100 - DNA, 15 bp, Homo sapiens
caatttttccatggg

SEQ ID NO: 45101 - DNA, 15 bp, Homo sapiens
acaatttttccatgg

SEQ ID NO: 45102 - DNA, 15 bp, Homo sapiens
gacaatttttccatg

SEQ ID NO: 45103 - DNA, 15 bp, Homo sapiens
agacaatttttccat

SEQ ID NO: 45104 - DNA, 15 bp, Homo sapiens
aagacaatttttcca

SEQ ID NO: 45105 - DNA, 15 bp, Homo sapiens
aaagacaatttttcc

SEQ ID NO: 45106 - DNA, 15 bp, Homo sapiens
gaaagacaatttttc

SEQ ID NO: 45107 - DNA, 15 bp, Homo sapiens
tgaaagacaattttt

SEQ ID NO: 45108 - DNA, 15 bp, Homo sapiens
gtgaaagacaatttt

SEQ ID NO: 45109 - DNA, 15 bp, Homo sapiens
tgtgaaagacaattt

SEQ ID NO: 45110 - DNA, 15 bp, Homo sapiens
ttgtgaaagacaatt

SEQ ID NO: 45111 - DNA, 15 bp, Homo sapiens
tttgtgaaagacaat

SEQ ID NO: 45112 - DNA, 15 bp, Homo sapiens
ttttgtgaaagacaa

SEQ ID NO: 45113 - DNA, 15 bp, Homo sapiens
gttttgtgaaagaca

SEQ ID NO: 45114 - DNA, 15 bp, Homo sapiens
ggttttgtgaaagac

SEQ ID NO: 45115 - DNA, 15 bp, Homo sapiens
cggttttgtgaaaga

SEQ ID NO: 45116 - DNA, 15 bp, Homo sapiens
ccggttttgtgaaag

SEQ ID NO: 45117 - DNA, 15 bp, Homo sapiens
accggttttgtgaaa

SEQ ID NO: 45118 - DNA, 15 bp, Homo sapiens
aaccggttttgtgaa

SEQ ID NO: 45119 - DNA, 15 bp, Homo sapiens
gaaccggttttgtga

SEQ ID NO: 45120 - DNA, 15 bp, Homo sapiens
ggaaccggttttgtg

SEQ ID NO: 45121 - DNA, 15 bp, Homo sapiens
aggaaccggttttgt

SEQ ID NO: 45122 - DNA, 15 bp, Homo sapiens
aaggaaccggttttg

SEQ ID NO: 45123 - DNA, 15 bp, Homo sapiens
aaaggaaccggtttt

SEQ ID NO: 45124 - DNA, 15 bp, Homo sapiens
aaaaggaaccggttt

SEQ ID NO: 45125 - DNA, 15 bp, Homo sapiens
aaaaaggaaccggtt

SEQ ID NO: 45126 - DNA, 15 bp, Homo sapiens
caaaaaggaaccggt

SEQ ID NO: 45127 - DNA, 15 bp, Homo sapiens
ccaaaaaggaaccgg

SEQ ID NO: 45128 - DNA, 15 bp, Homo sapiens
accaaaaaggaaccg

SEQ ID NO: 45129 - DNA, 15 bp, Homo sapiens
caccaaaaaggaacc

SEQ ID NO: 45130 - DNA, 15 bp, Homo sapiens
gcaccaaaaaggaac

SEQ ID NO: 45131 - DNA, 15 bp, Homo sapiens
ggcaccaaaaaggaa

SEQ ID NO: 45132 - DNA, 15 bp, Homo sapiens
tggcaccaaaaagga

SEQ ID NO: 45133 - DNA, 15 bp, Homo sapiens
ttggcaccaaaaagg

SEQ ID NO: 45134 - DNA, 15 bp, Homo sapiens
tttggcaccaaaaag

SEQ ID NO: 45135 - DNA, 15 bp, Homo sapiens
ttttggcaccaaaaa

SEQ ID NO: 45136 - DNA, 15 bp, Homo sapiens
tttttggcaccaaaa

SEQ ID NO: 45137 - DNA, 15 bp, Homo sapiens
ctttttggcaccaaa

SEQ ID NO: 45138 - DNA, 15 bp, Homo sapiens
cctttttggcaccaa

SEQ ID NO: 45139 - DNA, 15 bp, Homo sapiens
acctttttggcacca

SEQ ID NO: 45140 - DNA, 15 bp, Homo sapiens
aacctttttggcacc

SEQ ID NO: 45141 - DNA, 15 bp, Homo sapiens
taacctttttggcac

SEQ ID NO: 45142 - DNA, 15 bp, Homo sapiens
ctaacctttttggca

SEQ ID NO: 45143 - DNA, 15 bp, Homo sapiens
cctaacctttttggc

SEQ ID NO: 45144 - DNA, 15 bp, Homo sapiens
ccctaacctttttgg

SEQ ID NO: 45145 - DNA, 15 bp, Homo sapiens
tccctaacctttttg

SEQ ID NO: 45146 - DNA, 15 bp, Homo sapiens
gtccctaaccttttt

SEQ ID NO: 45147 - DNA, 15 bp, Homo sapiens
ggtccctaacctttt

SEQ ID NO: 45148 - DNA, 15 bp, Homo sapiens
cggtccctaaccttt

SEQ ID NO: 45149 - DNA, 15 bp, Homo sapiens
gcggtccctaacctt

SEQ ID NO: 45150 - DNA, 15 bp, Homo sapiens
ggcggtccctaacct

SEQ ID NO: 45151 - DNA, 15 bp, Homo sapiens
tggcggtccctaacc

SEQ ID NO: 45152 - DNA, 15 bp, Homo sapiens
gtggcggtccctaac

SEQ ID NO: 45153 - DNA, 15 bp, Homo sapiens
tgtggcggtccctaa

SEQ ID NO: 45154 - DNA, 15 bp, Homo sapiens
atgtggcggtcccta

SEQ ID NO: 45155 - DNA, 15 bp, Homo sapiens
aatgtggcggtccct

SEQ ID NO: 45156 - DNA, 15 bp, Homo sapiens
taatgtggcggtccc

SEQ ID NO: 45157 - DNA, 15 bp, Homo sapiens
ttaatgtggcggtcc

SEQ ID NO: 45158 - DNA, 15 bp, Homo sapiens
tttaatgtggcggtc

SEQ ID NO: 45159 - DNA, 15 bp, Homo sapiens
gtttaatgtggcggt

SEQ ID NO: 45160 - DNA, 15 bp, Homo sapiens
tgtttaatgtggcgg

SEQ ID NO: 45161 - DNA, 15 bp, Homo sapiens
ttgtttaatgtggcg

SEQ ID NO: 45162 - DNA, 15 bp, Homo sapiens
gttgtttaatgtggc

SEQ ID NO: 45163 - DNA, 15 bp, Homo sapiens
tgttgtttaatgtgg

SEQ ID NO: 45164 - DNA, 15 bp, Homo sapiens
ttgttgtttaatgtg

SEQ ID NO: 45165 - DNA, 15 bp, Homo sapiens
gttgttgtttaatgt

SEQ ID NO: 45166 - DNA, 15 bp, Homo sapiens
agttgttgtttaatg

SEQ ID NO: 45167 - DNA, 15 bp, Homo sapiens
gagttgttgtttaat

SEQ ID NO: 45168 - DNA, 15 bp, Homo sapiens
ggagttgttgtttaa

SEQ ID NO: 45169 - DNA, 15 bp, Homo sapiens
aggagttgttgttta

SEQ ID NO: 45170 - DNA, 15 bp, Homo sapiens
gaggagttgttgttt

SEQ ID NO: 45171 - DNA, 15 bp, Homo sapiens
tgaggagttgttgtt

SEQ ID NO: 45172 - DNA, 15 bp, Homo sapiens
gtgaggagttgttgt

SEQ ID NO: 45173 - DNA, 15 bp, Homo sapiens
agtgaggagttgttg

SEQ ID NO: 45174 - DNA, 15 bp, Homo sapiens
gagtgaggagttgtt

SEQ ID NO: 45175 - DNA, 15 bp, Homo sapiens
ggagtgaggagttgt

SEQ ID NO: 45176 - DNA, 15 bp, Homo sapiens
aggagtgaggagttg

SEQ ID NO: 45177 - DNA, 15 bp, Homo sapiens
gaggagtgaggagtt

SEQ ID NO: 45178 - DNA, 15 bp, Homo sapiens
agaggagtgaggagt

SEQ ID NO: 45179 - DNA, 15 bp, Homo sapiens
gagaggagtgaggag

SEQ ID NO: 45180 - DNA, 15 bp, Homo sapiens
agagaggagtgagga

SEQ ID NO: 45181 - DNA, 15 bp, Homo sapiens
gagagaggagtgagg

SEQ ID NO: 45182 - DNA, 15 bp, Homo sapiens
ggagagaggagtgag

SEQ ID NO: 45183 - DNA, 15 bp, Homo sapiens
aggagagaggagtga

SEQ ID NO: 45184 - DNA, 15 bp, Homo sapiens
gaggagagaggagtg

SEQ ID NO: 45185 - DNA, 15 bp, Homo sapiens
ggaggagagaggagt

SEQ ID NO: 45186 - DNA, 15 bp, Homo sapiens
aggaggagagaggag

SEQ ID NO: 45187 - DNA, 15 bp, Homo sapiens
taggaggagagagga

SEQ ID NO: 45188 - DNA, 15 bp, Homo sapiens
ctaggaggagagagg

SEQ ID NO: 45189 - DNA, 15 bp, Homo sapiens
gctaggaggagagag

SEQ ID NO: 45190 - DNA, 15 bp, Homo sapiens
ggctaggaggagaga

SEQ ID NO: 45191 - DNA, 15 bp, Homo sapiens
gggctaggaggagag

SEQ ID NO: 45192 - DNA, 15 bp, Homo sapiens
agggctaggaggaga

SEQ ID NO: 45193 - DNA, 15 bp, Homo sapiens
aagggctaggaggag

SEQ ID NO: 45194 - DNA, 15 bp, Homo sapiens
caagggctaggagga

SEQ ID NO: 45195 - DNA, 15 bp, Homo sapiens
ccaagggctaggagg

SEQ ID NO: 45196 - DNA, 15 bp, Homo sapiens
gccaagggctaggag

SEQ ID NO: 45197 - DNA, 15 bp, Homo sapiens
tgccaagggctagga

SEQ ID NO: 45198 - DNA, 15 bp, Homo sapiens
ttgccaagggctagg

SEQ ID NO: 45199 - DNA, 15 bp, Homo sapiens
gttgccaagggctag

SEQ ID NO: 45200 - DNA, 15 bp, Homo sapiens
ggttgccaagggcta

SEQ ID NO: 45201 - DNA, 15 bp, Homo sapiens
tggttgccaagggct

SEQ ID NO: 45202 - DNA, 15 bp, Homo sapiens
gtggttgccaagggc

SEQ ID NO: 45203 - DNA, 15 bp, Homo sapiens
ggtggttgccaaggg

SEQ ID NO: 45204 - DNA, 15 bp, Homo sapiens
tggtggttgccaagg

SEQ ID NO: 45205 - DNA, 15 bp, Homo sapiens
atggtggttgccaag

SEQ ID NO: 45206 - DNA, 15 bp, Homo sapiens
aatggtggttgccaa

SEQ ID NO: 45207 - DNA, 15 bp, Homo sapiens
aaatggtggttgcca

SEQ ID NO: 45208 - DNA, 15 bp, Homo sapiens
aaaatggtggttgcc

SEQ ID NO: 45209 - DNA, 15 bp, Homo sapiens
taaaatggtggttgc

SEQ ID NO: 45210 - DNA, 15 bp, Homo sapiens
gtaaaatggtggttg

SEQ ID NO: 45211 - DNA, 15 bp, Homo sapiens
agtaaaatggtggtt

SEQ ID NO: 45212 - DNA, 15 bp, Homo sapiens
aagtaaaatggtggt

SEQ ID NO: 45213 - DNA, 15 bp, Homo sapiens
aaagtaaaatggtgg

SEQ ID NO: 45214 - DNA, 15 bp, Homo sapiens
gaaagtaaaatggtg

SEQ ID NO: 45215 - DNA, 15 bp, Homo sapiens
tgaaagtaaaatggt

SEQ ID NO: 45216 - DNA, 15 bp, Homo sapiens
gtgaaagtaaaatgg

SEQ ID NO: 45217 - DNA, 15 bp, Homo sapiens
agtgaaagtaaaatg

SEQ ID NO: 45218 - DNA, 15 bp, Homo sapiens
tagtgaaagtaaaat

SEQ ID NO: 45219 - DNA, 15 bp, Homo sapiens
atagtgaaagtaaaa

SEQ ID NO: 45220 - DNA, 15 bp, Homo sapiens
aatagtgaaagtaaa

SEQ ID NO: 45221 - DNA, 15 bp, Homo sapiens
gaatagtgaaagtaa

SEQ ID NO: 45222 - DNA, 15 bp, Homo sapiens
agaatagtgaaagta

SEQ ID NO: 45223 - DNA, 15 bp, Homo sapiens
tagaatagtgaaagt

SEQ ID NO: 45224 - DNA, 15 bp, Homo sapiens
ctagaatagtgaaag

SEQ ID NO: 45225 - DNA, 15 bp, Homo sapiens
cctagaatagtgaaa

SEQ ID NO: 45226 - DNA, 15 bp, Homo sapiens
acctagaatagtgaa

SEQ ID NO: 45227 - DNA, 15 bp, Homo sapiens
tacctagaatagtga

SEQ ID NO: 45228 - DNA, 15 bp, Homo sapiens
gtacctagaatagtg

SEQ ID NO: 45229 - DNA, 15 bp, Homo sapiens
ggtacctagaatagt

SEQ ID NO: 45230 - DNA, 15 bp, Homo sapiens
aggtacctagaatag

SEQ ID NO: 45231 - DNA, 15 bp, Homo sapiens
gaggtacctagaata

SEQ ID NO: 45232 - DNA, 15 bp, Homo sapiens
tgaggtacctagaat

SEQ ID NO: 45233 - DNA, 15 bp, Homo sapiens
atgaggtacctagaa

SEQ ID NO: 45234 - DNA, 15 bp, Homo sapiens
catgaggtacctaga

SEQ ID NO: 45235 - DNA, 15 bp, Homo sapiens
acatgaggtacctag

SEQ ID NO: 45236 - DNA, 15 bp, Homo sapiens
tacatgaggtaccta

SEQ ID NO: 45237 - DNA, 15 bp, Homo sapiens
ttacatgaggtacct

SEQ ID NO: 45238 - DNA, 15 bp, Homo sapiens
cttacatgaggtacc

SEQ ID NO: 45239 - DNA, 15 bp, Homo sapiens
acttacatgaggtac

SEQ ID NO: 45240 - DNA, 15 bp, Homo sapiens
cacttacatgaggta

SEQ ID NO: 45241 - DNA, 15 bp, Homo sapiens
ccacttacatgaggt

SEQ ID NO: 45242 - DNA, 15 bp, Homo sapiens
tccacttacatgagg

SEQ ID NO: 45243 - DNA, 15 bp, Homo sapiens
ttccacttacatgag

SEQ ID NO: 45244 - DNA, 15 bp, Homo sapiens
attccacttacatga

SEQ ID NO: 45245 - DNA, 15 bp, Homo sapiens
gattccacttacatg

SEQ ID NO: 45246 - DNA, 15 bp, Homo sapiens
tgattccacttacat

SEQ ID NO: 45247 - DNA, 15 bp, Homo sapiens
atgattccacttaca

SEQ ID NO: 45248 - DNA, 15 bp, Homo sapiens
tatgattccacttac

SEQ ID NO: 45249 - DNA, 15 bp, Homo sapiens
gtatgattccactta

SEQ ID NO: 45250 - DNA, 15 bp, Homo sapiens
ggtatgattccactt

SEQ ID NO: 45251 - DNA, 15 bp, Homo sapiens
tggtatgattccact

SEQ ID NO: 45252 - DNA, 15 bp, Homo sapiens
atggtatgattccac

SEQ ID NO: 45253 - DNA, 15 bp, Homo sapiens
tatggtatgattcca

SEQ ID NO: 45254 - DNA, 15 bp, Homo sapiens
ctatggtatgattcc

SEQ ID NO: 45255 - DNA, 15 bp, Homo sapiens
actatggtatgattc

SEQ ID NO: 45256 - DNA, 15 bp, Homo sapiens
aactatggtatgatt

SEQ ID NO: 45257 - DNA, 15 bp, Homo sapiens
aaactatggtatgat

SEQ ID NO: 45258 - DNA, 15 bp, Homo sapiens
aaaactatggtatga

SEQ ID NO: 45259 - DNA, 15 bp, Homo sapiens
gaaaactatggtatg

SEQ ID NO: 45260 - DNA, 15 bp, Homo sapiens
agaaaactatggtat

SEQ ID NO: 45261 - DNA, 15 bp, Homo sapiens
aagaaaactatggta

SEQ ID NO: 45262 - DNA, 15 bp, Homo sapiens
aaagaaaactatggt

SEQ ID NO: 45263 - DNA, 15 bp, Homo sapiens
taaagaaaactatgg

SEQ ID NO: 45264 - DNA, 15 bp, Homo sapiens
ataaagaaaactatg

SEQ ID NO: 45265 - DNA, 15 bp, Homo sapiens
cataaagaaaactat

SEQ ID NO: 45266 - DNA, 15 bp, Homo sapiens
acataaagaaaacta

SEQ ID NO: 45267 - DNA, 15 bp, Homo sapiens
cacataaagaaaact

SEQ ID NO: 45268 - DNA, 15 bp, Homo sapiens
tcacataaagaaaac

SEQ ID NO: 45269 - DNA, 15 bp, Homo sapiens
gtcacataaagaaaa

SEQ ID NO: 45270 - DNA, 15 bp, Homo sapiens
agtcacataaagaaa

SEQ ID NO: 45271 - DNA, 15 bp, Homo sapiens
cagtcacataaagaa

SEQ ID NO: 45272 - DNA, 15 bp, Homo sapiens
ccagtcacataaaga

SEQ ID NO: 45273 - DNA, 15 bp, Homo sapiens
gccagtcacataaag

SEQ ID NO: 45274 - DNA, 15 bp, Homo sapiens
agccagtcacataaa

SEQ ID NO: 45275 - DNA, 15 bp, Homo sapiens
cagccagtcacataa

SEQ ID NO: 45276 - DNA, 15 bp, Homo sapiens
acagccagtcacata

SEQ ID NO: 45277 - DNA, 15 bp, Homo sapiens
cacagccagtcacat

SEQ ID NO: 45278 - DNA, 15 bp, Homo sapiens
acacagccagtcaca

SEQ ID NO: 45279 - DNA, 15 bp, Homo sapiens
gacacagccagtcac

SEQ ID NO: 45280 - DNA, 15 bp, Homo sapiens
tgacacagccagtca

SEQ ID NO: 45281 - DNA, 15 bp, Homo sapiens
gtgacacagccagtc

SEQ ID NO: 45282 - DNA, 15 bp, Homo sapiens
agtgacacagccagt

SEQ ID NO: 45283 - DNA, 15 bp, Homo sapiens
aagtgacacagccag

SEQ ID NO: 45284 - DNA, 15 bp, Homo sapiens
taagtgacacagcca

SEQ ID NO: 45285 - DNA, 15 bp, Homo sapiens
ctaagtgacacagcc

SEQ ID NO: 45286 - DNA, 15 bp, Homo sapiens
gctaagtgacacagc

SEQ ID NO: 45287 - DNA, 15 bp, Homo sapiens
tgctaagtgacacag

SEQ ID NO: 45288 - DNA, 15 bp, Homo sapiens
gtgctaagtgacaca

SEQ ID NO: 45289 - DNA, 15 bp, Homo sapiens
tgtgctaagtgacac

SEQ ID NO: 45290 - DNA, 15 bp, Homo sapiens
gtgtgctaagtgaca

SEQ ID NO: 45291 - DNA, 15 bp, Homo sapiens
agtgtgctaagtgac

SEQ ID NO: 45292 - DNA, 15 bp, Homo sapiens
cagtgtgctaagtga

SEQ ID NO: 45293 - DNA, 15 bp, Homo sapiens
acagtgtgctaagtg

SEQ ID NO: 45294 - DNA, 15 bp, Homo sapiens
gacagtgtgctaagt

SEQ ID NO: 45295 - DNA, 15 bp, Homo sapiens
ggacagtgtgctaag

SEQ ID NO: 45296 - DNA, 15 bp, Homo sapiens
aggacagtgtgctaa

SEQ ID NO: 45297 - DNA, 15 bp, Homo sapiens
gaggacagtgtgcta

SEQ ID NO: 45298 - DNA, 15 bp, Homo sapiens
ggaggacagtgtgct

SEQ ID NO: 45299 - DNA, 15 bp, Homo sapiens
tggaggacagtgtgc

SEQ ID NO: 45300 - DNA, 15 bp, Homo sapiens
atggaggacagtgtg

SEQ ID NO: 45301 - DNA, 15 bp, Homo sapiens
catggaggacagtgt

SEQ ID NO: 45302 - DNA, 15 bp, Homo sapiens
acatggaggacagtg

SEQ ID NO: 45303 - DNA, 15 bp, Homo sapiens
aacatggaggacagt

SEQ ID NO: 45304 - DNA, 15 bp, Homo sapiens
gaacatggaggacag

SEQ ID NO: 45305 - DNA, 15 bp, Homo sapiens
tgaacatggaggaca

SEQ ID NO: 45306 - DNA, 15 bp, Homo sapiens
atgaacatggaggac

SEQ ID NO: 45307 - DNA, 15 bp, Homo sapiens
gatgaacatggagga

SEQ ID NO: 45308 - DNA, 15 bp, Homo sapiens
ggatgaacatggagg

SEQ ID NO: 45309 - DNA, 15 bp, Homo sapiens
tggatgaacatggag

SEQ ID NO: 45310 - DNA, 15 bp, Homo sapiens
atggatgaacatgga

SEQ ID NO: 45311 - DNA, 15 bp, Homo sapiens
catggatgaacatgg

SEQ ID NO: 45312 - DNA, 15 bp, Homo sapiens
acatggatgaacatg

SEQ ID NO: 45313 - DNA, 15 bp, Homo sapiens
aacatggatgaacat

SEQ ID NO: 45314 - DNA, 15 bp, Homo sapiens
caacatggatgaaca

SEQ ID NO: 45315 - DNA, 15 bp, Homo sapiens
acaacatggatgaac

SEQ ID NO: 45316 - DNA, 15 bp, Homo sapiens
tacaacatggatgaa

SEQ ID NO: 45317 - DNA, 15 bp, Homo sapiens
ctacaacatggatga

SEQ ID NO: 45318 - DNA, 15 bp, Homo sapiens
gctacaacatggatg

SEQ ID NO: 45319 - DNA, 15 bp, Homo sapiens
tgctacaacatggat

SEQ ID NO: 45320 - DNA, 15 bp, Homo sapiens
atgctacaacatgga

SEQ ID NO: 45321 - DNA, 15 bp, Homo sapiens
catgctacaacatgg

SEQ ID NO: 45322 - DNA, 15 bp, Homo sapiens
acatgctacaacatg

SEQ ID NO: 45323 - DNA, 15 bp, Homo sapiens
agacacatgctacaa

SEQ ID NO: 45324 - DNA, 15 bp, Homo sapiens
cagacacatgctaca

SEQ ID NO: 45325 - DNA, 15 bp, Homo sapiens
tcagacacatgctac

SEQ ID NO: 45326 - DNA, 15 bp, Homo sapiens
ttcagacacatgcta

SEQ ID NO: 45327 - DNA, 15 bp, Homo sapiens
attcagacacatgct

SEQ ID NO: 45328 - DNA, 15 bp, Homo sapiens
aattcagacacatgc

SEQ ID NO: 45329 - DNA, 15 bp, Homo sapiens
aaattcagacacatg

SEQ ID NO: 45330 - DNA, 15 bp, Homo sapiens
gaaattcagacacat

SEQ ID NO: 45331 - DNA, 15 bp, Homo sapiens
ggaaattcagacaca

SEQ ID NO: 45332 - DNA, 15 bp, Homo sapiens
aggaaattcagacac

SEQ ID NO: 45333 - DNA, 15 bp, Homo sapiens
aaggaaattcagaca

SEQ ID NO: 45334 - DNA, 15 bp, Homo sapiens
aaaggaaattcagac

SEQ ID NO: 45335 - DNA, 15 bp, Homo sapiens
gaaaggaaattcaga

SEQ ID NO: 45336 - DNA, 15 bp, Homo sapiens
agaaaggaaattcag

SEQ ID NO: 45337 - DNA, 15 bp, Homo sapiens
gagaaaggaaattca

SEQ ID NO: 45338 - DNA, 15 bp, Homo sapiens
agagaaaggaaattc

SEQ ID NO: 45339 - DNA, 15 bp, Homo sapiens
aagagaaaggaaatt

SEQ ID NO: 45340 - DNA, 15 bp, Homo sapiens
gaagagaaaggaaat

SEQ ID NO: 45341 - DNA, 15 bp, Homo sapiens
tgaagagaaaggaaa

SEQ ID NO: 45342 - DNA, 15 bp, Homo sapiens
ttgaagagaaaggaa

SEQ ID NO: 45343 - DNA, 15 bp, Homo sapiens
cttgaagagaaagga

SEQ ID NO: 45344 - DNA, 15 bp, Homo sapiens
ccttgaagagaaagg

SEQ ID NO: 45345 - DNA, 15 bp, Homo sapiens
gccttgaagagaaag

SEQ ID NO: 45346 - DNA, 15 bp, Homo sapiens
agccttgaagagaaa

SEQ ID NO: 45347 - DNA, 15 bp, Homo sapiens
cagccttgaagagaa

SEQ ID NO: 45348 - DNA, 15 bp, Homo sapiens
ccagccttgaagaga

SEQ ID NO: 45349 - DNA, 15 bp, Homo sapiens
accagccttgaagag

SEQ ID NO: 45350 - DNA, 15 bp, Homo sapiens
aaccagccttgaaga

SEQ ID NO: 45351 - DNA, 15 bp, Homo sapiens
taaccagccttgaag

SEQ ID NO: 45352 - DNA, 15 bp, Homo sapiens
ataaccagccttgaa

SEQ ID NO: 45353 - DNA, 15 bp, Homo sapiens
aataaccagccttga

SEQ ID NO: 45354 - DNA, 15 bp, Homo sapiens
taataaccagccttg

SEQ ID NO: 45355 - DNA, 15 bp, Homo sapiens
ataataaccagcctt

SEQ ID NO: 45356 - DNA, 15 bp, Homo sapiens
aataataaccagcct

SEQ ID NO: 45357 - DNA, 15 bp, Homo sapiens
gaataataaccagcc

SEQ ID NO: 45358 - DNA, 15 bp, Homo sapiens
ggaataataaccagc

SEQ ID NO: 45359 - DNA, 15 bp, Homo sapiens
tggaataataaccag

SEQ ID NO: 45360 - DNA, 15 bp, Homo sapiens
atggaataataacca

SEQ ID NO: 45361 - DNA, 15 bp, Homo sapiens
aatggaataataacc

SEQ ID NO: 45362 - DNA, 15 bp, Homo sapiens
aaatggaataataac

SEQ ID NO: 45363 - DNA, 15 bp, Homo sapiens
aaaatggaataataa

SEQ ID NO: 45364 - DNA, 15 bp, Homo sapiens
taaaatggaataata

SEQ ID NO: 45365 - DNA, 15 bp, Homo sapiens
ataaaatggaataat

SEQ ID NO: 45366 - DNA, 15 bp, Homo sapiens
cataaaatggaataa

SEQ ID NO: 45367 - DNA, 15 bp, Homo sapiens
acataaaatggaata

SEQ ID NO: 45368 - DNA, 15 bp, Homo sapiens
tacataaaatggaat

SEQ ID NO: 45369 - DNA, 15 bp, Homo sapiens
ttacataaaatggaa

SEQ ID NO: 45370 - DNA, 15 bp, Homo sapiens
tttacataaaatgga

SEQ ID NO: 45371 - DNA, 15 bp, Homo sapiens
atttacataaaatgg

SEQ ID NO: 45372 - DNA, 15 bp, Homo sapiens
tatttacataaaatg

SEQ ID NO: 45373 - DNA, 15 bp, Homo sapiens
atatttacataaaat

SEQ ID NO: 45374 - DNA, 15 bp, Homo sapiens
gatatttacataaaa

SEQ ID NO: 45375 - DNA, 15 bp, Homo sapiens
tgatatttacataaa

SEQ ID NO: 45376 - DNA, 15 bp, Homo sapiens
gtgatatttacataa

SEQ ID NO: 45377 - DNA, 15 bp, Homo sapiens
tgtgatatttacata

SEQ ID NO: 45378 - DNA, 15 bp, Homo sapiens
atgtgatatttacat

SEQ ID NO: 45379 - DNA, 15 bp, Homo sapiens
aatgtgatatttaca

SEQ ID NO: 45380 - DNA, 15 bp, Homo sapiens
aaatgtgatatttac

SEQ ID NO: 45381 - DNA, 15 bp, Homo sapiens
aaaatgtgatattta

SEQ ID NO: 45382 - DNA, 15 bp, Homo sapiens
caaaatgtgatattt

SEQ ID NO: 45383 - DNA, 15 bp, Homo sapiens
gcaaaatgtgatatt

SEQ ID NO: 45384 - DNA, 15 bp, Homo sapiens
agcaaaatgtgatat

SEQ ID NO: 45385 - DNA, 15 bp, Homo sapiens
tagcaaaatgtgata

SEQ ID NO: 45386 - DNA, 15 bp, Homo sapiens
ttagcaaaatgtgat

SEQ ID NO: 45387 - DNA, 15 bp, Homo sapiens
attagcaaaatgtga

SEQ ID NO: 45388 - DNA, 15 bp, Homo sapiens
aattagcaaaatgtg

SEQ ID NO: 45389 - DNA, 15 bp, Homo sapiens
taattagcaaaatgt

SEQ ID NO: 45390 - DNA, 15 bp, Homo sapiens
ttaattagcaaaatg

SEQ ID NO: 45391 - DNA, 15 bp, Homo sapiens
attaattagcaaaat

SEQ ID NO: 45392 - DNA, 15 bp, Homo sapiens
aattaattagcaaaa

SEQ ID NO: 45393 - DNA, 15 bp, Homo sapiens
caattaattagcaaa

SEQ ID NO: 45394 - DNA, 15 bp, Homo sapiens
tcaattaattagcaa

SEQ ID NO: 45395 - DNA, 15 bp, Homo sapiens
atcaattaattagca

SEQ ID NO: 45396 - DNA, 15 bp, Homo sapiens
gatcaattaattagc

SEQ ID NO: 45397 - DNA, 15 bp, Homo sapiens
agatcaattaattag

SEQ ID NO: 45398 - DNA, 15 bp, Homo sapiens
cagatcaattaatta

SEQ ID NO: 45399 - DNA, 15 bp, Homo sapiens
acagatcaattaatt

SEQ ID NO: 45400 - DNA, 15 bp, Homo sapiens
aacagatcaattaat

SEQ ID NO: 45401 - DNA, 15 bp, Homo sapiens
aaacagatcaattaa

SEQ ID NO: 45402 - DNA, 15 bp, Homo sapiens
caaacagatcaatta

SEQ ID NO: 45403 - DNA, 15 bp, Homo sapiens
acaaacagatcaatt

SEQ ID NO: 45404 - DNA, 15 bp, Homo sapiens
cacaaacagatcaat

SEQ ID NO: 45405 - DNA, 15 bp, Homo sapiens
ccacaaacagatcaa

SEQ ID NO: 45406 - DNA, 15 bp, Homo sapiens
tccacaaacagatca

SEQ ID NO: 45407 - DNA, 15 bp, Homo sapiens
gtccacaaacagatc

SEQ ID NO: 45408 - DNA, 15 bp, Homo sapiens
tgtccacaaacagat

SEQ ID NO: 45409 - DNA, 15 bp, Homo sapiens
gtgtccacaaacaga

SEQ ID NO: 45410 - DNA, 15 bp, Homo sapiens
agtgtccacaaacag

SEQ ID NO: 45411 - DNA, 15 bp, Homo sapiens
aagtgtccacaaaca

SEQ ID NO: 45412 - DNA, 15 bp, Homo sapiens
caagtgtccacaaac

SEQ ID NO: 45413 - DNA, 15 bp, Homo sapiens
ccaagtgtccacaaa

SEQ ID NO: 45414 - DNA, 15 bp, Homo sapiens
cccaagtgtccacaa

SEQ ID NO: 45415 - DNA, 15 bp, Homo sapiens
acccaagtgtccaca

SEQ ID NO: 45416 - DNA, 15 bp, Homo sapiens
aacccaagtgtccac

SEQ ID NO: 45417 - DNA, 15 bp, Homo sapiens
caacccaagtgtcca

SEQ ID NO: 45418 - DNA, 15 bp, Homo sapiens
gcaacccaagtgtcc

SEQ ID NO: 45419 - DNA, 15 bp, Homo sapiens
agcaacccaagtgtc

SEQ ID NO: 45420 - DNA, 15 bp, Homo sapiens
aagcaacccaagtgt

SEQ ID NO: 45421 - DNA, 15 bp, Homo sapiens
gaagcaacccaagtg

SEQ ID NO: 45422 - DNA, 15 bp, Homo sapiens
ggaagcaacccaagt

SEQ ID NO: 45423 - DNA, 15 bp, Homo sapiens
tggaagcaacccaag

SEQ ID NO: 45424 - DNA, 15 bp, Homo sapiens
atggaagcaacccaa

SEQ ID NO: 45425 - DNA, 15 bp, Homo sapiens
gatggaagcaaccca

SEQ ID NO: 45426 - DNA, 15 bp, Homo sapiens
agatggaagcaaccc

SEQ ID NO: 45427 - DNA, 15 bp, Homo sapiens
aagatggaagcaacc

SEQ ID NO: 45428 - DNA, 15 bp, Homo sapiens
aaagatggaagcaac

SEQ ID NO: 45429 - DNA, 15 bp, Homo sapiens
aaaagatggaagcaa

SEQ ID NO: 45430 - DNA, 15 bp, Homo sapiens
taaaagatggaagca

SEQ ID NO: 45431 - DNA, 15 bp, Homo sapiens
ctaaaagatggaagc

SEQ ID NO: 45432 - DNA, 15 bp, Homo sapiens
gctaaaagatggaag

SEQ ID NO: 45433 - DNA, 15 bp, Homo sapiens
agctaaaagatggaa

SEQ ID NO: 45434 - DNA, 15 bp, Homo sapiens
aagctaaaagatgga

SEQ ID NO: 45435 - DNA, 15 bp, Homo sapiens
aaagctaaaagatgg

SEQ ID NO: 45436 - DNA, 15 bp, Homo sapiens
aaaagctaaaagatg

SEQ ID NO: 45437 - DNA, 15 bp, Homo sapiens
caaaagctaaaagat

SEQ ID NO: 45438 - DNA, 15 bp, Homo sapiens
acaaaagctaaaaga

SEQ ID NO: 45439 - DNA, 15 bp, Homo sapiens
cacaaaagctaaaag

SEQ ID NO: 45440 - DNA, 15 bp, Homo sapiens
tcacaaaagctaaaa

SEQ ID NO: 45441 - DNA, 15 bp, Homo sapiens
ttcacaaaagctaaa

SEQ ID NO: 45442 - DNA, 15 bp, Homo sapiens
attcacaaaagctaa

SEQ ID NO: 45443 - DNA, 15 bp, Homo sapiens
tattcacaaaagcta

SEQ ID NO: 45444 - DNA, 15 bp, Homo sapiens
ctattcacaaaagct

SEQ ID NO: 45445 - DNA, 15 bp, Homo sapiens
gctattcacaaaagc

SEQ ID NO: 45446 - DNA, 15 bp, Homo sapiens
cgctattcacaaaag

SEQ ID NO: 45447 - DNA, 15 bp, Homo sapiens
acgctattcacaaaa

SEQ ID NO: 45448 - DNA, 15 bp, Homo sapiens
aacgctattcacaaa

SEQ ID NO: 45449 - DNA, 15 bp, Homo sapiens
gaacgctattcacaa

SEQ ID NO: 45450 - DNA, 15 bp, Homo sapiens
ggaacgctattcaca

SEQ ID NO: 45451 - DNA, 15 bp, Homo sapiens
aggaacgctattcac

SEQ ID NO: 45452 - DNA, 15 bp, Homo sapiens
taggaacgctattca

SEQ ID NO: 45453 - DNA, 15 bp, Homo sapiens
ataggaacgctattc

SEQ ID NO: 45454 - DNA, 15 bp, Homo sapiens
aataggaacgctatt

SEQ ID NO: 45455 - DNA, 15 bp, Homo sapiens
taataggaacgctat

SEQ ID NO: 45456 - DNA, 15 bp, Homo sapiens
ttaataggaacgcta

SEQ ID NO: 45457 - DNA, 15 bp, Homo sapiens
gttaataggaacgct

SEQ ID NO: 45458 - DNA, 15 bp, Homo sapiens
tgttaataggaacgc

SEQ ID NO: 45459 - DNA, 15 bp, Homo sapiens
atgttaataggaacg

SEQ ID NO: 45460 - DNA, 15 bp, Homo sapiens
catgttaataggaac

SEQ ID NO: 45461 - DNA, 15 bp, Homo sapiens
ccatgttaataggaa

SEQ ID NO: 45462 - DNA, 15 bp, Homo sapiens
tccatgttaatagga

SEQ ID NO: 45463 - DNA, 15 bp, Homo sapiens
atccatgttaatagg

SEQ ID NO: 45464 - DNA, 15 bp, Homo sapiens
catccatgttaatag

SEQ ID NO: 45465 - DNA, 15 bp, Homo sapiens
acatccatgttaata

SEQ ID NO: 45466 - DNA, 15 bp, Homo sapiens
tacatccatgttaat

SEQ ID NO: 45467 - DNA, 15 bp, Homo sapiens
gtacatccatgttaa

SEQ ID NO: 45468 - DNA, 15 bp, Homo sapiens
tgtacatccatgtta

SEQ ID NO: 45469 - DNA, 15 bp, Homo sapiens
ttgtacatccatgtt

SEQ ID NO: 45470 - DNA, 15 bp, Homo sapiens
tttgtacatccatgt

SEQ ID NO: 45471 - DNA, 15 bp, Homo sapiens
atttgtacatccatg

SEQ ID NO: 45472 - DNA, 15 bp, Homo sapiens
tatttgtacatccat

SEQ ID NO: 45473 - DNA, 15 bp, Homo sapiens
atatttgtacatcca

SEQ ID NO: 45474 - DNA, 15 bp, Homo sapiens
gatatttgtacatcc

SEQ ID NO: 45475 - DNA, 15 bp, Homo sapiens
agatatttgtacatc

SEQ ID NO: 45476 - DNA, 15 bp, Homo sapiens
gagatatttgtacat

SEQ ID NO: 45477 - DNA, 15 bp, Homo sapiens
agagatatttgtaca

SEQ ID NO: 45478 - DNA, 15 bp, Homo sapiens
cagagatatttgtac

SEQ ID NO: 45479 - DNA, 15 bp, Homo sapiens
tcagagatatttgta

SEQ ID NO: 45480 - DNA, 15 bp, Homo sapiens
ctcagagatatttgt

SEQ ID NO: 45481 - DNA, 15 bp, Homo sapiens
tctcagagatatttg

SEQ ID NO: 45482 - DNA, 15 bp, Homo sapiens
atctcagagatattt

SEQ ID NO: 45483 - DNA, 15 bp, Homo sapiens
aatctcagagatatt

SEQ ID NO: 45484 - DNA, 15 bp, Homo sapiens
gaatctcagagatat

SEQ ID NO: 45485 - DNA, 15 bp, Homo sapiens
agaatctcagagata

SEQ ID NO: 45486 - DNA, 15 bp, Homo sapiens
cagaatctcagagat

SEQ ID NO: 45487 - DNA, 15 bp, Homo sapiens
gcagaatctcagaga

SEQ ID NO: 45488 - DNA, 15 bp, Homo sapiens
agcagaatctcagag

SEQ ID NO: 45489 - DNA, 15 bp, Homo sapiens
aagcagaatctcaga

SEQ ID NO: 45490 - DNA, 15 bp, Homo sapiens
aaagcagaatctcag

SEQ ID NO: 45491 - DNA, 15 bp, Homo sapiens
gaaagcagaatctca

SEQ ID NO: 45492 - DNA, 15 bp, Homo sapiens
tgaaagcagaatctc

SEQ ID NO: 45493 - DNA, 15 bp, Homo sapiens
ctgaaagcagaatct

SEQ ID NO: 45494 - DNA, 15 bp, Homo sapiens
actgaaagcagaatc

SEQ ID NO: 45495 - DNA, 15 bp, Homo sapiens
aactgaaagcagaat

SEQ ID NO: 45496 - DNA, 15 bp, Homo sapiens
gaactgaaagcagaa

SEQ ID NO: 45497 - DNA, 15 bp, Homo sapiens
agaactgaaagcaga

SEQ ID NO: 45498 - DNA, 15 bp, Homo sapiens
aagaactgaaagcag

SEQ ID NO: 45499 - DNA, 15 bp, Homo sapiens
gaagaactgaaagca

SEQ ID NO: 45500 - DNA, 15 bp, Homo sapiens
agaagaactgaaagc

SEQ ID NO: 45501 - DNA, 15 bp, Homo sapiens
cagaagaactgaaag

SEQ ID NO: 45502 - DNA, 15 bp, Homo sapiens
ccagaagaactgaaa

SEQ ID NO: 45503 - DNA, 15 bp, Homo sapiens
accagaagaactgaa

SEQ ID NO: 45504 - DNA, 15 bp, Homo sapiens
aaccagaagaactga

SEQ ID NO: 45505 - DNA, 15 bp, Homo sapiens
taaccagaagaactg

SEQ ID NO: 45506 - DNA, 15 bp, Homo sapiens
ataaccagaagaact

SEQ ID NO: 45507 - DNA, 15 bp, Homo sapiens
tataaccagaagaac

SEQ ID NO: 45508 - DNA, 15 bp, Homo sapiens
atataaccagaagaa

SEQ ID NO: 45509 - DNA, 15 bp, Homo sapiens
gatataaccagaaga

SEQ ID NO: 45510 - DNA, 15 bp, Homo sapiens
tgatataaccagaag

SEQ ID NO: 45511 - DNA, 15 bp, Homo sapiens
atgatataaccagaa

SEQ ID NO: 45512 - DNA, 15 bp, Homo sapiens
aatgatataaccaga

SEQ ID NO: 45513 - DNA, 15 bp, Homo sapiens
caatgatataaccag

SEQ ID NO: 45514 - DNA, 15 bp, Homo sapiens
gcaatgatataacca

SEQ ID NO: 45515 - DNA, 15 bp, Homo sapiens
tgcaatgatataacc

SEQ ID NO: 45516 - DNA, 15 bp, Homo sapiens
atgcaatgatataac

SEQ ID NO: 45517 - DNA, 15 bp, Homo sapiens
tatgcaatgatataa

SEQ ID NO: 45518 - DNA, 15 bp, Homo sapiens
atatgcaatgatata

SEQ ID NO: 45519 - DNA, 15 bp, Homo sapiens
catatgcaatgatat

SEQ ID NO: 45520 - DNA, 15 bp, Homo sapiens
gcatatgcaatgata

SEQ ID NO: 45521 - DNA, 15 bp, Homo sapiens
agcatatgcaatgat

SEQ ID NO: 45522 - DNA, 15 bp, Homo sapiens
aagcatatgcaatga

SEQ ID NO: 45523 - DNA, 15 bp, Homo sapiens
aaagcatatgcaatg

SEQ ID NO: 45524 - DNA, 15 bp, Homo sapiens
aaaagcatatgcaat

SEQ ID NO: 45525 - DNA, 15 bp, Homo sapiens
aaaaagcatatgcaa

SEQ ID NO: 45526 - DNA, 15 bp, Homo sapiens
taaaaagcatatgca

SEQ ID NO: 45527 - DNA, 15 bp, Homo sapiens
gtaaaaagcatatgc

SEQ ID NO: 45528 - DNA, 15 bp, Homo sapiens
agtaaaaagcatatg

SEQ ID NO: 45529 - DNA, 15 bp, Homo sapiens
gagtaaaaagcatat

SEQ ID NO: 45530 - DNA, 15 bp, Homo sapiens
tgagtaaaaagcata

SEQ ID NO: 45531 - DNA, 15 bp, Homo sapiens
ctgagtaaaaagcat

SEQ ID NO: 45532 - DNA, 15 bp, Homo sapiens
tctgagtaaaaagca

SEQ ID NO: 45533 - DNA, 15 bp, Homo sapiens
atctgagtaaaaagc

SEQ ID NO: 45534 - DNA, 15 bp, Homo sapiens
gatctgagtaaaaag

SEQ ID NO: 45535 - DNA, 15 bp, Homo sapiens
ggatctgagtaaaaa

SEQ ID NO: 45536 - DNA, 15 bp, Homo sapiens
gggatctgagtaaaa

SEQ ID NO: 45537 - DNA, 15 bp, Homo sapiens
cgggatctgagtaaa

SEQ ID NO: 45538 - DNA, 15 bp, Homo sapiens
acgggatctgagtaa

SEQ ID NO: 45539 - DNA, 15 bp, Homo sapiens
aacgggatctgagta

SEQ ID NO: 45540 - DNA, 15 bp, Homo sapiens
aaacgggatctgagt

SEQ ID NO: 45541 - DNA, 15 bp, Homo sapiens
gaaacgggatctgag

SEQ ID NO: 45542 - DNA, 15 bp, Homo sapiens
agaaacgggatctga

SEQ ID NO: 45543 - DNA, 15 bp, Homo sapiens
gagaaacgggatctg

SEQ ID NO: 45544 - DNA, 15 bp, Homo sapiens
ggagaaacgggatct

SEQ ID NO: 45545 - DNA, 15 bp, Homo sapiens
aggagaaacgggatc

SEQ ID NO: 45546 - DNA, 15 bp, Homo sapiens
aaggagaaacgggat

SEQ ID NO: 45547 - DNA, 15 bp, Homo sapiens
caaggagaaacggga

SEQ ID NO: 45548 - DNA, 15 bp, Homo sapiens
tcaaggagaaacggg

SEQ ID NO: 45549 - DNA, 15 bp, Homo sapiens
gtcaaggagaaacgg

SEQ ID NO: 45550 - DNA, 15 bp, Homo sapiens
tgtcaaggagaaacg

SEQ ID NO: 45551 - DNA, 15 bp, Homo sapiens
atgtcaaggagaaac

SEQ ID NO: 45552 - DNA, 15 bp, Homo sapiens
tatgtcaaggagaaa

SEQ ID NO: 45553 - DNA, 15 bp, Homo sapiens
ttatgtcaaggagaa

SEQ ID NO: 45554 - DNA, 15 bp, Homo sapiens
gttatgtcaaggaga

SEQ ID NO: 45555 - DNA, 15 bp, Homo sapiens
ggttatgtcaaggag

SEQ ID NO: 45556 - DNA, 15 bp, Homo sapiens
gggttatgtcaagga

SEQ ID NO: 45557 - DNA, 15 bp, Homo sapiens
agggttatgtcaagg

SEQ ID NO: 45558 - DNA, 15 bp, Homo sapiens
tagggttatgtcaag

SEQ ID NO: 45559 - DNA, 15 bp, Homo sapiens
ctagggttatgtcaa

SEQ ID NO: 45560 - DNA, 15 bp, Homo sapiens
cctagggttatgtca

SEQ ID NO: 45561 - DNA, 15 bp, Homo sapiens
acctagggttatgtc

SEQ ID NO: 45562 - DNA, 15 bp, Homo sapiens
tacctagggttatgt

SEQ ID NO: 45563 - DNA, 15 bp, Homo sapiens
ttacctagggttatg

SEQ ID NO: 45564 - DNA, 15 bp, Homo sapiens
attacctagggttat

SEQ ID NO: 45565 - DNA, 15 bp, Homo sapiens
cattacctagggtta

SEQ ID NO: 45566 - DNA, 15 bp, Homo sapiens
ccattacctagggtt

SEQ ID NO: 45567 - DNA, 15 bp, Homo sapiens
accattacctagggt

SEQ ID NO: 45568 - DNA, 15 bp, Homo sapiens
taccattacctaggg

SEQ ID NO: 45569 - DNA, 15 bp, Homo sapiens
ctaccattacctagg

SEQ ID NO: 45570 - DNA, 15 bp, Homo sapiens
actaccattacctag

SEQ ID NO: 45571 - DNA, 15 bp, Homo sapiens
aactaccattaccta

SEQ ID NO: 45572 - DNA, 15 bp, Homo sapiens
taactaccattacct

SEQ ID NO: 45573 - DNA, 15 bp, Homo sapiens
ctaactaccattacc

SEQ ID NO: 45574 - DNA, 15 bp, Homo sapiens
gctaactaccattac

SEQ ID NO: 45575 - DNA, 15 bp, Homo sapiens
agctaactaccatta

SEQ ID NO: 45576 - DNA, 15 bp, Homo sapiens
aagctaactaccatt

SEQ ID NO: 45577 - DNA, 15 bp, Homo sapiens
taagctaactaccat

SEQ ID NO: 45578 - DNA, 15 bp, Homo sapiens
gtaagctaactacca

SEQ ID NO: 45579 - DNA, 15 bp, Homo sapiens
agtaagctaactacc

SEQ ID NO: 45580 - DNA, 15 bp, Homo sapiens
gagtaagctaactac

SEQ ID NO: 45581 - DNA, 15 bp, Homo sapiens
agagtaagctaacta

SEQ ID NO: 45582 - DNA, 15 bp, Homo sapiens
aagagtaagctaact

SEQ ID NO: 45583 - DNA, 15 bp, Homo sapiens
taagagtaagctaac

SEQ ID NO: 45584 - DNA, 15 bp, Homo sapiens
ataagagtaagctaa

SEQ ID NO: 45585 - DNA, 15 bp, Homo sapiens
gataagagtaagcta

SEQ ID NO: 45586 - DNA, 15 bp, Homo sapiens
agataagagtaagct

SEQ ID NO: 45587 - DNA, 15 bp, Homo sapiens
aagataagagtaagc

SEQ ID NO: 45588 - DNA, 15 bp, Homo sapiens
caagataagagtaag

SEQ ID NO: 45589 - DNA, 15 bp, Homo sapiens
tcaagataagagtaa

SEQ ID NO: 45590 - DNA, 15 bp, Homo sapiens
ctcaagataagagta

SEQ ID NO: 45591 - DNA, 15 bp, Homo sapiens
cctcaagataagagt

SEQ ID NO: 45592 - DNA, 15 bp, Homo sapiens
ccctcaagataagag

SEQ ID NO: 45593 - DNA, 15 bp, Homo sapiens
tccctcaagataaga

SEQ ID NO: 45594 - DNA, 15 bp, Homo sapiens
ttccctcaagataag

SEQ ID NO: 45595 - DNA, 15 bp, Homo sapiens
tttccctcaagataa

SEQ ID NO: 45596 - DNA, 15 bp, Homo sapiens
atttccctcaagata

SEQ ID NO: 45597 - DNA, 15 bp, Homo sapiens
catttccctcaagat

SEQ ID NO: 45598 - DNA, 15 bp, Homo sapiens
gcatttccctcaaga

SEQ ID NO: 45599 - DNA, 15 bp, Homo sapiens
agcatttccctcaag

SEQ ID NO: 45600 - DNA, 15 bp, Homo sapiens
tagcatttccctcaa

SEQ ID NO: 45601 - DNA, 15 bp, Homo sapiens
ttagcatttccctca

SEQ ID NO: 45602 - DNA, 15 bp, Homo sapiens
tttagcatttccctc

SEQ ID NO: 45603 - DNA, 15 bp, Homo sapiens
ctttagcatttccct

SEQ ID NO: 45604 - DNA, 15 bp, Homo sapiens
actttagcatttccc

SEQ ID NO: 45605 - DNA, 15 bp, Homo sapiens
aactttagcatttcc

SEQ ID NO: 45606 - DNA, 15 bp, Homo sapiens
aaactttagcatttc

SEQ ID NO: 45607 - DNA, 15 bp, Homo sapiens
aaaactttagcattt

SEQ ID NO: 45608 - DNA, 15 bp, Homo sapiens
caaaactttagcatt

SEQ ID NO: 45609 - DNA, 15 bp, Homo sapiens
tcaaaactttagcat

SEQ ID NO: 45610 - DNA, 15 bp, Homo sapiens
ctcaaaactttagca

SEQ ID NO: 45611 - DNA, 15 bp, Homo sapiens
cctcaaaactttagc

SEQ ID NO: 45612 - DNA, 15 bp, Homo sapiens
tcctcaaaactttag

SEQ ID NO: 45613 - DNA, 15 bp, Homo sapiens
ttcctcaaaacttta

SEQ ID NO: 45614 - DNA, 15 bp, Homo sapiens
tttcctcaaaacttt

SEQ ID NO: 45615 - DNA, 15 bp, Homo sapiens
ctttcctcaaaactt

SEQ ID NO: 45616 - DNA, 15 bp, Homo sapiens
tctttcctcaaaact

SEQ ID NO: 45617 - DNA, 15 bp, Homo sapiens
atctttcctcaaaac

SEQ ID NO: 45618 - DNA, 15 bp, Homo sapiens
gatctttcctcaaaa

SEQ ID NO: 45619 - DNA, 15 bp, Homo sapiens
tgatctttcctcaaa

SEQ ID NO: 45620 - DNA, 15 bp, Homo sapiens
atgatctttcctcaa

SEQ ID NO: 45621 - DNA, 15 bp, Homo sapiens
aatgatctttcctca

SEQ ID NO: 45622 - DNA, 15 bp, Homo sapiens
gaatgatctttcctc

SEQ ID NO: 45623 - DNA, 15 bp, Homo sapiens
tgaatgatctttcct

SEQ ID NO: 45624 - DNA, 15 bp, Homo sapiens
atgaatgatctttcc

SEQ ID NO: 45625 - DNA, 15 bp, Homo sapiens
gatgaatgatctttc

SEQ ID NO: 45626 - DNA, 15 bp, Homo sapiens
ggatgaatgatcttt

SEQ ID NO: 45627 - DNA, 15 bp, Homo sapiens
tggatgaatgatctt

SEQ ID NO: 45628 - DNA, 15 bp, Homo sapiens
ttggatgaatgatct

SEQ ID NO: 45629 - DNA, 15 bp, Homo sapiens
tttggatgaatgatc

SEQ ID NO: 45630 - DNA, 15 bp, Homo sapiens
atttggatgaatgat

SEQ ID NO: 45631 - DNA, 15 bp, Homo sapiens
gatttggatgaatga

SEQ ID NO: 45632 - DNA, 15 bp, Homo sapiens
agatttggatgaatg

SEQ ID NO: 45633 - DNA, 15 bp, Homo sapiens
aagatttggatgaat

SEQ ID NO: 45634 - DNA, 15 bp, Homo sapiens
aaagatttggatgaa

SEQ ID NO: 45635 - DNA, 15 bp, Homo sapiens
aaaagatttggatga

SEQ ID NO: 45636 - DNA, 15 bp, Homo sapiens
aaaaagatttggatg

SEQ ID NO: 45637 - DNA, 15 bp, Homo sapiens
caaaaagatttggat

SEQ ID NO: 45638 - DNA, 15 bp, Homo sapiens
acaaaaagatttgga

SEQ ID NO: 45639 - DNA, 15 bp, Homo sapiens
aacaaaaagatttgg

SEQ ID NO: 45640 - DNA, 15 bp, Homo sapiens
aaacaaaaagatttg

SEQ ID NO: 45641 - DNA, 15 bp, Homo sapiens
caaacaaaaagattt

SEQ ID NO: 45642 - DNA, 15 bp, Homo sapiens
tcaaacaaaaagatt

SEQ ID NO: 45643 - DNA, 15 bp, Homo sapiens
atcaaacaaaaagat

SEQ ID NO: 45644 - DNA, 15 bp, Homo sapiens
aatcaaacaaaaaga

SEQ ID NO: 45645 - DNA, 15 bp, Homo sapiens
caatcaaacaaaaag

SEQ ID NO: 45646 - DNA, 15 bp, Homo sapiens
tcaatcaaacaaaaa

SEQ ID NO: 45647 - DNA, 15 bp, Homo sapiens
gtcaatcaaacaaaa

SEQ ID NO: 45648 - DNA, 15 bp, Homo sapiens
agtcaatcaaacaaa

SEQ ID NO: 45649 - DNA, 15 bp, Homo sapiens
gagtcaatcaaacaa

SEQ ID NO: 45650 - DNA, 15 bp, Homo sapiens
agagtcaatcaaaca

SEQ ID NO: 45651 - DNA, 15 bp, Homo sapiens
aagagtcaatcaaac

SEQ ID NO: 45652 - DNA, 15 bp, Homo sapiens
caagagtcaatcaaa

SEQ ID NO: 45653 - DNA, 15 bp, Homo sapiens
gcaagagtcaatcaa

SEQ ID NO: 45654 - DNA, 15 bp, Homo sapiens
agcaagagtcaatca

SEQ ID NO: 45655 - DNA, 15 bp, Homo sapiens
tagcaagagtcaatc

SEQ ID NO: 45656 - DNA, 15 bp, Homo sapiens
ttagcaagagtcaat

SEQ ID NO: 45657 - DNA, 15 bp, Homo sapiens
gttagcaagagtcaa

SEQ ID NO: 45658 - DNA, 15 bp, Homo sapiens
ggttagcaagagtca

SEQ ID NO: 45659 - DNA, 15 bp, Homo sapiens
aggttagcaagagtc

SEQ ID NO: 45660 - DNA, 15 bp, Homo sapiens
gaggttagcaagagt

SEQ ID NO: 45661 - DNA, 15 bp, Homo sapiens
ggaggttagcaagag

SEQ ID NO: 45662 - DNA, 15 bp, Homo sapiens
tggaggttagcaaga

SEQ ID NO: 45663 - DNA, 15 bp, Homo sapiens
ttggaggttagcaag

SEQ ID NO: 45664 - DNA, 15 bp, Homo sapiens
cttggaggttagcaa

SEQ ID NO: 45665 - DNA, 15 bp, Homo sapiens
tcttggaggttagca

SEQ ID NO: 45666 - DNA, 15 bp, Homo sapiens
ttcttggaggttagc

SEQ ID NO: 45667 - DNA, 15 bp, Homo sapiens
tttcttggaggttag

SEQ ID NO: 45668 - DNA, 15 bp, Homo sapiens
ttttcttggaggtta

SEQ ID NO: 45669 - DNA, 15 bp, Homo sapiens
tttttcttggaggtt

SEQ ID NO: 45670 - DNA, 15 bp, Homo sapiens
atttttcttggaggt

SEQ ID NO: 45671 - DNA, 15 bp, Homo sapiens
aatttttcttggagg

SEQ ID NO: 45672 - DNA, 15 bp, Homo sapiens
aaatttttcttggag

SEQ ID NO: 45673 - DNA, 15 bp, Homo sapiens
caaatttttcttgga

SEQ ID NO: 45674 - DNA, 15 bp, Homo sapiens
acaaatttttcttgg

SEQ ID NO: 45675 - DNA, 15 bp, Homo sapiens
cacaaatttttcttg

SEQ ID NO: 45676 - DNA, 15 bp, Homo sapiens
tcacaaatttttctt

SEQ ID NO: 45677 - DNA, 15 bp, Homo sapiens
atcacaaatttttct

SEQ ID NO: 45678 - DNA, 15 bp, Homo sapiens
gatcacaaatttttc

SEQ ID NO: 45679 - DNA, 15 bp, Homo sapiens
tgatcacaaattttt

SEQ ID NO: 45680 - DNA, 15 bp, Homo sapiens
gtgatcacaaatttt

SEQ ID NO: 45681 - DNA, 15 bp, Homo sapiens
cgtgatcacaaattt

SEQ ID NO: 45682 - DNA, 15 bp, Homo sapiens
tcgtgatcacaaatt

SEQ ID NO: 45683 - DNA, 15 bp, Homo sapiens
ctcgtgatcacaaat

SEQ ID NO: 45684 - DNA, 15 bp, Homo sapiens
actcgtgatcacaaa

SEQ ID NO: 45685 - DNA, 15 bp, Homo sapiens
aactcgtgatcacaa

SEQ ID NO: 45686 - DNA, 15 bp, Homo sapiens
taactcgtgatcaca

SEQ ID NO: 45687 - DNA, 15 bp, Homo sapiens
ataactcgtgatcac

SEQ ID NO: 45688 - DNA, 15 bp, Homo sapiens
tataactcgtgatca

SEQ ID NO: 45689 - DNA, 15 bp, Homo sapiens
atataactcgtgatc

SEQ ID NO: 45690 - DNA, 15 bp, Homo sapiens
aatataactcgtgat

SEQ ID NO: 45691 - DNA, 15 bp, Homo sapiens
aaatataactcgtga

SEQ ID NO: 45692 - DNA, 15 bp, Homo sapiens
aaaatataactcgtg

SEQ ID NO: 45693 - DNA, 15 bp, Homo sapiens
taaaatataactcgt

SEQ ID NO: 45694 - DNA, 15 bp, Homo sapiens
ataaaatataactcg

SEQ ID NO: 45695 - DNA, 15 bp, Homo sapiens
tataaaatataactc

SEQ ID NO: 45696 - DNA, 15 bp, Homo sapiens
gtataaaatataact

SEQ ID NO: 45697 - DNA, 15 bp, Homo sapiens
tgtataaaatataac

SEQ ID NO: 45698 - DNA, 15 bp, Homo sapiens
ctgtataaaatataa

SEQ ID NO: 45699 - DNA, 15 bp, Homo sapiens
actgtataaaatata

SEQ ID NO: 45700 - DNA, 15 bp, Homo sapiens
gactgtataaaatat

SEQ ID NO: 45701 - DNA, 15 bp, Homo sapiens
ggactgtataaaata

SEQ ID NO: 45702 - DNA, 15 bp, Homo sapiens
tggactgtataaaat

SEQ ID NO: 45703 - DNA, 15 bp, Homo sapiens
atggactgtataaaa

SEQ ID NO: 45704 - DNA, 15 bp, Homo sapiens
tatggactgtataaa

SEQ ID NO: 45705 - DNA, 15 bp, Homo sapiens
ctatggactgtataa

SEQ ID NO: 45706 - DNA, 15 bp, Homo sapiens
cctatggactgtata

SEQ ID NO: 45707 - DNA, 15 bp, Homo sapiens
acctatggactgtat

SEQ ID NO: 45708 - DNA, 15 bp, Homo sapiens
aacctatggactgta

SEQ ID NO: 45709 - DNA, 15 bp, Homo sapiens
gaacctatggactgt

SEQ ID NO: 45710 - DNA, 15 bp, Homo sapiens
tgaacctatggactg

SEQ ID NO: 45711 - DNA, 15 bp, Homo sapiens
ctgaacctatggact

SEQ ID NO: 45712 - DNA, 15 bp, Homo sapiens
cctgaacctatggac

SEQ ID NO: 45713 - DNA, 15 bp, Homo sapiens
ccctgaacctatgga

SEQ ID NO: 45714 - DNA, 15 bp, Homo sapiens
tccctgaacctatgg

SEQ ID NO: 45715 - DNA, 15 bp, Homo sapiens
ttccctgaacctatg

SEQ ID NO: 45716 - DNA, 15 bp, Homo sapiens
cttccctgaacctat

SEQ ID NO: 45717 - DNA, 15 bp, Homo sapiens
ccttccctgaaccta

SEQ ID NO: 45718 - DNA, 15 bp, Homo sapiens
cccttccctgaacct

SEQ ID NO: 45719 - DNA, 15 bp, Homo sapiens
tcccttccctgaacc

SEQ ID NO: 45720 - DNA, 15 bp, Homo sapiens
ctcccttccctgaac

SEQ ID NO: 45721 - DNA, 15 bp, Homo sapiens
actcccttccctgaa

SEQ ID NO: 45722 - DNA, 15 bp, Homo sapiens
tactcccttccctga

SEQ ID NO: 45723 - DNA, 15 bp, Homo sapiens
ttactcccttccctg

SEQ ID NO: 45724 - DNA, 15 bp, Homo sapiens
attactcccttccct

SEQ ID NO: 45725 - DNA, 15 bp, Homo sapiens
aattactcccttccc

SEQ ID NO: 45726 - DNA, 15 bp, Homo sapiens
gaattactcccttcc

SEQ ID NO: 45727 - DNA, 15 bp, Homo sapiens
agaattactcccttc

SEQ ID NO: 45728 - DNA, 15 bp, Homo sapiens
tagaattactccctt

SEQ ID NO: 45729 - DNA, 15 bp, Homo sapiens
ctagaattactccct

SEQ ID NO: 45730 - DNA, 15 bp, Homo sapiens
actagaattactccc

SEQ ID NO: 45731 - DNA, 15 bp, Homo sapiens
cactagaattactcc

SEQ ID NO: 45732 - DNA, 15 bp, Homo sapiens
acactagaattactc

SEQ ID NO: 45733 - DNA, 15 bp, Homo sapiens
aacactagaattact

SEQ ID NO: 45734 - DNA, 15 bp, Homo sapiens
gaacactagaattac

SEQ ID NO: 45735 - DNA, 15 bp, Homo sapiens
ggaacactagaatta

SEQ ID NO: 45736 - DNA, 15 bp, Homo sapiens
aggaacactagaatt

SEQ ID NO: 45737 - DNA, 15 bp, Homo sapiens
taggaacactagaat

SEQ ID NO: 45738 - DNA, 15 bp, Homo sapiens
ttaggaacactagaa

SEQ ID NO: 45739 - DNA, 15 bp, Homo sapiens
tttaggaacactaga

SEQ ID NO: 45740 - DNA, 15 bp, Homo sapiens
ttttaggaacactag

SEQ ID NO: 45741 - DNA, 15 bp, Homo sapiens
cttttaggaacacta

SEQ ID NO: 45742 - DNA, 15 bp, Homo sapiens
tcttttaggaacact

SEQ ID NO: 45743 - DNA, 15 bp, Homo sapiens
atcttttaggaacac

SEQ ID NO: 45744 - DNA, 15 bp, Homo sapiens
catcttttaggaaca

SEQ ID NO: 45745 - DNA, 15 bp, Homo sapiens
gcatcttttaggaac

SEQ ID NO: 45746 - DNA, 15 bp, Homo sapiens
ggcatcttttaggaa

SEQ ID NO: 45747 - DNA, 15 bp, Homo sapiens
tggcatcttttagga

SEQ ID NO: 45748 - DNA, 15 bp, Homo sapiens
atggcatcttttagg

SEQ ID NO: 45749 - DNA, 15 bp, Homo sapiens
aatggcatcttttag

SEQ ID NO: 45750 - DNA, 15 bp, Homo sapiens
caatggcatctttta

SEQ ID NO: 45751 - DNA, 15 bp, Homo sapiens
gcaatggcatctttt

SEQ ID NO: 45752 - DNA, 15 bp, Homo sapiens
tgcaatggcatcttt

SEQ ID NO: 45753 - DNA, 15 bp, Homo sapiens
ctgcaatggcatctt

SEQ ID NO: 45754 - DNA, 15 bp, Homo sapiens
actgcaatggcatct

SEQ ID NO: 45755 - DNA, 15 bp, Homo sapiens
cactgcaatggcatc

SEQ ID NO: 45756 - DNA, 15 bp, Homo sapiens
gcactgcaatggcat

SEQ ID NO: 45757 - DNA, 15 bp, Homo sapiens
agcactgcaatggca

SEQ ID NO: 45758 - DNA, 15 bp, Homo sapiens
cagcactgcaatggc

SEQ ID NO: 45759 - DNA, 15 bp, Homo sapiens
acagcactgcaatgg

SEQ ID NO: 45760 - DNA, 15 bp, Homo sapiens
tacagcactgcaatg

SEQ ID NO: 45761 - DNA, 15 bp, Homo sapiens
ttacagcactgcaat

SEQ ID NO: 45762 - DNA, 15 bp, Homo sapiens
attacagcactgcaa

SEQ ID NO: 45763 - DNA, 15 bp, Homo sapiens
cattacagcactgca

SEQ ID NO: 45764 - DNA, 15 bp, Homo sapiens
gcattacagcactgc

SEQ ID NO: 45765 - DNA, 15 bp, Homo sapiens
tgcattacagcactg

SEQ ID NO: 45766 - DNA, 15 bp, Homo sapiens
ctgcattacagcact

SEQ ID NO: 45767 - DNA, 15 bp, Homo sapiens
tctgcattacagcac

SEQ ID NO: 45768 - DNA, 15 bp, Homo sapiens
ttctgcattacagca

SEQ ID NO: 45769 - DNA, 15 bp, Homo sapiens
tttctgcattacagc

SEQ ID NO: 45770 - DNA, 15 bp, Homo sapiens
ttttctgcattacag

SEQ ID NO: 45771 - DNA, 15 bp, Homo sapiens
tttttctgcattaca

SEQ ID NO: 45772 - DNA, 15 bp, Homo sapiens
gtttttctgcattac

SEQ ID NO: 45773 - DNA, 15 bp, Homo sapiens
cgtttttctgcatta

SEQ ID NO: 45774 - DNA, 15 bp, Homo sapiens
gcgtttttctgcatt

SEQ ID NO: 45775 - DNA, 15 bp, Homo sapiens
agcgtttttctgcat

SEQ ID NO: 45776 - DNA, 15 bp, Homo sapiens
tagcgtttttctgca

SEQ ID NO: 45777 - DNA, 15 bp, Homo sapiens
ctagcgtttttctgc

SEQ ID NO: 45778 - DNA, 15 bp, Homo sapiens
cctagcgtttttctg

SEQ ID NO: 45779 - DNA, 15 bp, Homo sapiens
acctagcgtttttct

SEQ ID NO: 45780 - DNA, 15 bp, Homo sapiens
aacctagcgtttttc

SEQ ID NO: 45781 - DNA, 15 bp, Homo sapiens
aaacctagcgttttt

SEQ ID NO: 45782 - DNA, 15 bp, Homo sapiens
aaaacctagcgtttt

SEQ ID NO: 45783 - DNA, 15 bp, Homo sapiens
caaaacctagcgttt

SEQ ID NO: 45784 - DNA, 15 bp, Homo sapiens
ccaaaacctagcgtt

SEQ ID NO: 45785 - DNA, 15 bp, Homo sapiens
cccaaaacctagcgt

SEQ ID NO: 45786 - DNA, 15 bp, Homo sapiens
ccccaaaacctagcg

SEQ ID NO: 45787 - DNA, 15 bp, Homo sapiens
accccaaaacctagc

SEQ ID NO: 45788 - DNA, 15 bp, Homo sapiens
caccccaaaacctag

SEQ ID NO: 45789 - DNA, 15 bp, Homo sapiens
acaccccaaaaccta

SEQ ID NO: 45790 - DNA, 15 bp, Homo sapiens
gacaccccaaaacct

SEQ ID NO: 45791 - DNA, 15 bp, Homo sapiens
ggacaccccaaaacc

SEQ ID NO: 45792 - DNA, 15 bp, Homo sapiens
aggacaccccaaaac

SEQ ID NO: 45793 - DNA, 15 bp, Homo sapiens
aaggacaccccaaaa

SEQ ID NO: 45794 - DNA, 15 bp, Homo sapiens
taaggacaccccaaa

SEQ ID NO: 45795 - DNA, 15 bp, Homo sapiens
ctaaggacaccccaa

SEQ ID NO: 45796 - DNA, 15 bp, Homo sapiens
cctaaggacacccca

SEQ ID NO: 45797 - DNA, 15 bp, Homo sapiens
tcctaaggacacccc

SEQ ID NO: 45798 - DNA, 15 bp, Homo sapiens
ttcctaaggacaccc

SEQ ID NO: 45799 - DNA, 15 bp, Homo sapiens
cttcctaaggacacc

SEQ ID NO: 45800 - DNA, 15 bp, Homo sapiens
ccttcctaaggacac

SEQ ID NO: 45801 - DNA, 15 bp, Homo sapiens
tccttcctaaggaca

SEQ ID NO: 45802 - DNA, 15 bp, Homo sapiens
ctccttcctaaggac

SEQ ID NO: 45803 - DNA, 15 bp, Homo sapiens
tctccttcctaagga

SEQ ID NO: 45804 - DNA, 15 bp, Homo sapiens
gtctccttcctaagg

SEQ ID NO: 45805 - DNA, 15 bp, Homo sapiens
tgtctccttcctaag

SEQ ID NO: 45806 - DNA, 15 bp, Homo sapiens
ttgtctccttcctaa

SEQ ID NO: 45807 - DNA, 15 bp, Homo sapiens
cttgtctccttccta

SEQ ID NO: 45808 - DNA, 15 bp, Homo sapiens
tcttgtctccttcct

SEQ ID NO: 45809 - DNA, 15 bp, Homo sapiens
ttcttgtctccttcc

SEQ ID NO: 45810 - DNA, 15 bp, Homo sapiens
tttcttgtctccttc

SEQ ID NO: 45811 - DNA, 15 bp, Homo sapiens
ctttcttgtctcctt

SEQ ID NO: 45812 - DNA, 15 bp, Homo sapiens
tctttcttgtctcct

SEQ ID NO: 45813 - DNA, 15 bp, Homo sapiens
ttctttcttgtctcc

SEQ ID NO: 45814 - DNA, 15 bp, Homo sapiens
tttctttcttgtctc

SEQ ID NO: 45815 - DNA, 15 bp, Homo sapiens
ttttctttcttgtct

SEQ ID NO: 45816 - DNA, 15 bp, Homo sapiens
gttttctttcttgtc

SEQ ID NO: 45817 - DNA, 15 bp, Homo sapiens
tgttttctttcttgt

SEQ ID NO: 45818 - DNA, 15 bp, Homo sapiens
ctgttttctttcttg

SEQ ID NO: 45819 - DNA, 15 bp, Homo sapiens
tctgttttctttctt

SEQ ID NO: 45820 - DNA, 15 bp, Homo sapiens
ctctgttttctttct

SEQ ID NO: 45821 - DNA, 15 bp, Homo sapiens
tctctgttttctttc

SEQ ID NO: 45822 - DNA, 15 bp, Homo sapiens
ttctctgttttcttt

SEQ ID NO: 45823 - DNA, 15 bp, Homo sapiens
gttctctgttttctt

SEQ ID NO: 45824 - DNA, 15 bp, Homo sapiens
cgttctctgttttct

SEQ ID NO: 45825 - DNA, 15 bp, Homo sapiens
acgttctctgttttc

SEQ ID NO: 45826 - DNA, 15 bp, Homo sapiens
aacgttctctgtttt

SEQ ID NO: 45827 - DNA, 15 bp, Homo sapiens
taacgttctctgttt

SEQ ID NO: 45828 - DNA, 15 bp, Homo sapiens
ataacgttctctgtt

SEQ ID NO: 45829 - DNA, 15 bp, Homo sapiens
gataacgttctctgt

SEQ ID NO: 45830 - DNA, 15 bp, Homo sapiens
ggataacgttctctg

SEQ ID NO: 45831 - DNA, 15 bp, Homo sapiens
aggataacgttctct

SEQ ID NO: 45832 - DNA, 15 bp, Homo sapiens
aaggataacgttctc

SEQ ID NO: 45833 - DNA, 15 bp, Homo sapiens
gaaggataacgttct

SEQ ID NO: 45834 - DNA, 15 bp, Homo sapiens
ggaaggataacgttc

SEQ ID NO: 45835 - DNA, 15 bp, Homo sapiens
aggaaggataacgtt

SEQ ID NO: 45836 - DNA, 15 bp, Homo sapiens
aaggaaggataacgt

SEQ ID NO: 45837 - DNA, 15 bp, Homo sapiens
aaaggaaggataacg

SEQ ID NO: 45838 - DNA, 15 bp, Homo sapiens
caaaggaaggataac

SEQ ID NO: 45839 - DNA, 15 bp, Homo sapiens
gcaaaggaaggataa

SEQ ID NO: 45840 - DNA, 15 bp, Homo sapiens
tgcaaaggaaggata

SEQ ID NO: 45841 - DNA, 15 bp, Homo sapiens
ttgcaaaggaaggat

SEQ ID NO: 45842 - DNA, 15 bp, Homo sapiens
tttgcaaaggaagga

SEQ ID NO: 45843 - DNA, 15 bp, Homo sapiens
ctttgcaaaggaagg

SEQ ID NO: 45844 - DNA, 15 bp, Homo sapiens
gctttgcaaaggaag

SEQ ID NO: 45845 - DNA, 15 bp, Homo sapiens
ggctttgcaaaggaa

SEQ ID NO: 45846 - DNA, 15 bp, Homo sapiens
tggctttgcaaagga

SEQ ID NO: 45847 - DNA, 15 bp, Homo sapiens
atggctttgcaaagg

SEQ ID NO: 45848 - DNA, 15 bp, Homo sapiens
catggctttgcaaag

SEQ ID NO: 45849 - DNA, 15 bp, Homo sapiens
acatggctttgcaaa

SEQ ID NO: 45850 - DNA, 15 bp, Homo sapiens
aacatggctttgcaa

SEQ ID NO: 45851 - DNA, 15 bp, Homo sapiens
caacatggctttgca

SEQ ID NO: 45852 - DNA, 15 bp, Homo sapiens
tcaacatggctttgc

SEQ ID NO: 45853 - DNA, 15 bp, Homo sapiens
gtcaacatggctttg

SEQ ID NO: 45854 - DNA, 15 bp, Homo sapiens
agtcaacatggcttt

SEQ ID NO: 45855 - DNA, 15 bp, Homo sapiens
cagtcaacatggctt

SEQ ID NO: 45856 - DNA, 15 bp, Homo sapiens
acagtcaacatggct

SEQ ID NO: 45857 - DNA, 15 bp, Homo sapiens
cacagtcaacatggc

SEQ ID NO: 45858 - DNA, 15 bp, Homo sapiens
gcacagtcaacatgg

SEQ ID NO: 45859 - DNA, 15 bp, Homo sapiens
tgcacagtcaacatg

SEQ ID NO: 45860 - DNA, 15 bp, Homo sapiens
gtgcacagtcaacat

SEQ ID NO: 45861 - DNA, 15 bp, Homo sapiens
tgtgcacagtcaaca

SEQ ID NO: 45862 - DNA, 15 bp, Homo sapiens
atgtgcacagtcaac

SEQ ID NO: 45863 - DNA, 15 bp, Homo sapiens
catgtgcacagtcaa

SEQ ID NO: 45864 - DNA, 15 bp, Homo sapiens
ccatgtgcacagtca

SEQ ID NO: 45865 - DNA, 15 bp, Homo sapiens
tccatgtgcacagtc

SEQ ID NO: 45866 - DNA, 15 bp, Homo sapiens
atccatgtgcacagt

SEQ ID NO: 45867 - DNA, 15 bp, Homo sapiens
aatccatgtgcacag

SEQ ID NO: 45868 - DNA, 15 bp, Homo sapiens
taatccatgtgcaca

SEQ ID NO: 45869 - DNA, 15 bp, Homo sapiens
gtaatccatgtgcac

SEQ ID NO: 45870 - DNA, 15 bp, Homo sapiens
cgtaatccatgtgca

SEQ ID NO: 45871 - DNA, 15 bp, Homo sapiens
tcgtaatccatgtgc

SEQ ID NO: 45872 - DNA, 15 bp, Homo sapiens
atcgtaatccatgtg

SEQ ID NO: 45873 - DNA, 15 bp, Homo sapiens
gatcgtaatccatgt

SEQ ID NO: 45874 - DNA, 15 bp, Homo sapiens
agatcgtaatccatg

SEQ ID NO: 45875 - DNA, 15 bp, Homo sapiens
cagatcgtaatccat

SEQ ID NO: 45876 - DNA, 15 bp, Homo sapiens
tcagatcgtaatcca

SEQ ID NO: 45877 - DNA, 15 bp, Homo sapiens
ctcagatcgtaatcc

SEQ ID NO: 45878 - DNA, 15 bp, Homo sapiens
tctcagatcgtaatc

SEQ ID NO: 45879 - DNA, 15 bp, Homo sapiens
atctcagatcgtaat

SEQ ID NO: 45880 - DNA, 15 bp, Homo sapiens
aatctcagatcgtaa

SEQ ID NO: 45881 - DNA, 15 bp, Homo sapiens
gaatctcagatcgta

SEQ ID NO: 45882 - DNA, 15 bp, Homo sapiens
agaatctcagatcgt

SEQ ID NO: 45883 - DNA, 15 bp, Homo sapiens
cagaatctcagatcg

SEQ ID NO: 45884 - DNA, 15 bp, Homo sapiens
ccagaatctcagatc

SEQ ID NO: 45885 - DNA, 15 bp, Homo sapiens
accagaatctcagat

SEQ ID NO: 45886 - DNA, 15 bp, Homo sapiens
gaccagaatctcaga

SEQ ID NO: 45887 - DNA, 15 bp, Homo sapiens
agaccagaatctcag

SEQ ID NO: 45888 - DNA, 15 bp, Homo sapiens
gagaccagaatctca

SEQ ID NO: 45889 - DNA, 15 bp, Homo sapiens
ggagaccagaatctc

SEQ ID NO: 45890 - DNA, 15 bp, Homo sapiens
aggagaccagaatct

SEQ ID NO: 45891 - DNA, 15 bp, Homo sapiens
taggagaccagaatc

SEQ ID NO: 45892 - DNA, 15 bp, Homo sapiens
gtaggagaccagaat

SEQ ID NO: 45893 - DNA, 15 bp, Homo sapiens
agtaggagaccagaa

SEQ ID NO: 45894 - DNA, 15 bp, Homo sapiens
aagtaggagaccaga

SEQ ID NO: 45895 - DNA, 15 bp, Homo sapiens
taagtaggagaccag

SEQ ID NO: 45896 - DNA, 15 bp, Homo sapiens
ttaagtaggagacca

SEQ ID NO: 45897 - DNA, 15 bp, Homo sapiens
tttaagtaggagacc

SEQ ID NO: 45898 - DNA, 15 bp, Homo sapiens
atttaagtaggagac

SEQ ID NO: 45899 - DNA, 15 bp, Homo sapiens
catttaagtaggaga

SEQ ID NO: 45900 - DNA, 15 bp, Homo sapiens
tcatttaagtaggag

SEQ ID NO: 45901 - DNA, 15 bp, Homo sapiens
atcatttaagtagga

SEQ ID NO: 45902 - DNA, 15 bp, Homo sapiens
aatcatttaagtagg

SEQ ID NO: 45903 - DNA, 15 bp, Homo sapiens
aaatcatttaagtag

SEQ ID NO: 45904 - DNA, 15 bp, Homo sapiens
taaatcatttaagta

SEQ ID NO: 45905 - DNA, 15 bp, Homo sapiens
ttaaatcatttaagt

SEQ ID NO: 45906 - DNA, 15 bp, Homo sapiens
gttaaatcatttaag

SEQ ID NO: 45907 - DNA, 15 bp, Homo sapiens
tgttaaatcatttaa

SEQ ID NO: 45908 - DNA, 15 bp, Homo sapiens
ctgttaaatcattta

SEQ ID NO: 45909 - DNA, 15 bp, Homo sapiens
actgttaaatcattt

SEQ ID NO: 45910 - DNA, 15 bp, Homo sapiens
cactgttaaatcatt

SEQ ID NO: 45911 - DNA, 15 bp, Homo sapiens
ccactgttaaatcat

SEQ ID NO: 45912 - DNA, 15 bp, Homo sapiens
tccactgttaaatca

SEQ ID NO: 45913 - DNA, 15 bp, Homo sapiens
ttccactgttaaatc

SEQ ID NO: 45914 - DNA, 15 bp, Homo sapiens
cttccactgttaaat

SEQ ID NO: 45915 - DNA, 15 bp, Homo sapiens
ccttccactgttaaa

SEQ ID NO: 45916 - DNA, 15 bp, Homo sapiens
accttccactgttaa

SEQ ID NO: 45917 - DNA, 15 bp, Homo sapiens
taccttccactgtta

SEQ ID NO: 45918 - DNA, 15 bp, Homo sapiens
ataccttccactgtt

SEQ ID NO: 45919 - DNA, 15 bp, Homo sapiens
aataccttccactgt

SEQ ID NO: 45920 - DNA, 15 bp, Homo sapiens
gaataccttccactg

SEQ ID NO: 45921 - DNA, 15 bp, Homo sapiens
agaataccttccact

SEQ ID NO: 45922 - DNA, 15 bp, Homo sapiens
tagaataccttccac

SEQ ID NO: 45923 - DNA, 15 bp, Homo sapiens
ctagaataccttcca

SEQ ID NO: 45924 - DNA, 15 bp, Homo sapiens
actagaataccttcc

SEQ ID NO: 45925 - DNA, 15 bp, Homo sapiens
cactagaataccttc

SEQ ID NO: 45926 - DNA, 15 bp, Homo sapiens
tcactagaatacctt

SEQ ID NO: 45927 - DNA, 15 bp, Homo sapiens
ttcactagaatacct

SEQ ID NO: 45928 - DNA, 15 bp, Homo sapiens
cttcactagaatacc

SEQ ID NO: 45929 - DNA, 15 bp, Homo sapiens
ccttcactagaatac

SEQ ID NO: 45930 - DNA, 15 bp, Homo sapiens
tccttcactagaata

SEQ ID NO: 45931 - DNA, 15 bp, Homo sapiens
ttccttcactagaat

SEQ ID NO: 45932 - DNA, 15 bp, Homo sapiens
tttccttcactagaa

SEQ ID NO: 45933 - DNA, 15 bp, Homo sapiens
gtttccttcactaga

SEQ ID NO: 45934 - DNA, 15 bp, Homo sapiens
ggtttccttcactag

SEQ ID NO: 45935 - DNA, 15 bp, Homo sapiens
gggtttccttcacta

SEQ ID NO: 45936 - DNA, 15 bp, Homo sapiens
tgggtttccttcact

SEQ ID NO: 45937 - DNA, 15 bp, Homo sapiens
ttgggtttccttcac

SEQ ID NO: 45938 - DNA, 15 bp, Homo sapiens
cttgggtttccttca

SEQ ID NO: 45939 - DNA, 15 bp, Homo sapiens
acttgggtttccttc

SEQ ID NO: 45940 - DNA, 15 bp, Homo sapiens
gacttgggtttcctt

SEQ ID NO: 45941 - DNA, 15 bp, Homo sapiens
ggacttgggtttcct

SEQ ID NO: 45942 - DNA, 15 bp, Homo sapiens
gggacttgggtttcc

SEQ ID NO: 45943 - DNA, 15 bp, Homo sapiens
cgggacttgggtttc

SEQ ID NO: 45944 - DNA, 15 bp, Homo sapiens
ccgggacttgggttt

SEQ ID NO: 45945 - DNA, 15 bp, Homo sapiens
tccgggacttgggtt

SEQ ID NO: 45946 - DNA, 15 bp, Homo sapiens
ctccgggacttgggt

SEQ ID NO: 45947 - DNA, 15 bp, Homo sapiens
gctccgggacttggg

SEQ ID NO: 45948 - DNA, 15 bp, Homo sapiens
cgctccgggacttgg

SEQ ID NO: 45949 - DNA, 15 bp, Homo sapiens
tcgctccgggacttg

SEQ ID NO: 45950 - DNA, 15 bp, Homo sapiens
ttcgctccgggactt

SEQ ID NO: 45951 - DNA, 15 bp, Homo sapiens
attcgctccgggact

SEQ ID NO: 45952 - DNA, 15 bp, Homo sapiens
cattcgctccgggac

SEQ ID NO: 45953 - DNA, 15 bp, Homo sapiens
gcattcgctccggga

SEQ ID NO: 45954 - DNA, 15 bp, Homo sapiens
tgcattcgctccggg

SEQ ID NO: 45955 - DNA, 15 bp, Homo sapiens
atgcattcgctccgg

SEQ ID NO: 45956 - DNA, 15 bp, Homo sapiens
aatgcattcgctccg

SEQ ID NO: 45957 - DNA, 15 bp, Homo sapiens
aaatgcattcgctcc

SEQ ID NO: 45958 - DNA, 15 bp, Homo sapiens
caaatgcattcgctc

SEQ ID NO: 45959 - DNA, 15 bp, Homo sapiens
acaaatgcattcgct

SEQ ID NO: 45960 - DNA, 15 bp, Homo sapiens
aacaaatgcattcgc

SEQ ID NO: 45961 - DNA, 15 bp, Homo sapiens
taacaaatgcattcg

SEQ ID NO: 45962 - DNA, 15 bp, Homo sapiens
gtaacaaatgcattc

SEQ ID NO: 45963 - DNA, 15 bp, Homo sapiens
agtaacaaatgcatt

SEQ ID NO: 45964 - DNA, 15 bp, Homo sapiens
aagtaacaaatgcat

SEQ ID NO: 45965 - DNA, 15 bp, Homo sapiens
aaagtaacaaatgca

SEQ ID NO: 45966 - DNA, 15 bp, Homo sapiens
aaaagtaacaaatgc

SEQ ID NO: 45967 - DNA, 15 bp, Homo sapiens
caaaagtaacaaatg

SEQ ID NO: 45968 - DNA, 15 bp, Homo sapiens
acaaaagtaacaaat

SEQ ID NO: 45969 - DNA, 15 bp, Homo sapiens
tacaaaagtaacaaa

SEQ ID NO: 45970 - DNA, 15 bp, Homo sapiens
ttacaaaagtaacaa

SEQ ID NO: 45971 - DNA, 15 bp, Homo sapiens
tttacaaaagtaaca

SEQ ID NO: 45972 - DNA, 15 bp, Homo sapiens
ttttacaaaagtaac

SEQ ID NO: 45973 - DNA, 15 bp, Homo sapiens
gttttacaaaagtaa

SEQ ID NO: 45974 - DNA, 15 bp, Homo sapiens
agttttacaaaagta

SEQ ID NO: 45975 - DNA, 15 bp, Homo sapiens
cagttttacaaaagt

SEQ ID NO: 45976 - DNA, 15 bp, Homo sapiens
tcagttttacaaaag

SEQ ID NO: 45977 - DNA, 15 bp, Homo sapiens
gtcagttttacaaaa

SEQ ID NO: 45978 - DNA, 15 bp, Homo sapiens
agtcagttttacaaa

SEQ ID NO: 45979 - DNA, 15 bp, Homo sapiens
tagtcagttttacaa

SEQ ID NO: 45980 - DNA, 15 bp, Homo sapiens
ttagtcagttttaca

SEQ ID NO: 45981 - DNA, 15 bp, Homo sapiens
cttagtcagttttac

SEQ ID NO: 45982 - DNA, 15 bp, Homo sapiens
ccttagtcagtttta

SEQ ID NO: 45983 - DNA, 15 bp, Homo sapiens
accttagtcagtttt

SEQ ID NO: 45984 - DNA, 15 bp, Homo sapiens
caccttagtcagttt

SEQ ID NO: 45985 - DNA, 15 bp, Homo sapiens
tcaccttagtcagtt

SEQ ID NO: 45986 - DNA, 15 bp, Homo sapiens
atcaccttagtcagt

SEQ ID NO: 45987 - DNA, 15 bp, Homo sapiens
gatcaccttagtcag

SEQ ID NO: 45988 - DNA, 15 bp, Homo sapiens
tgatcaccttagtca

SEQ ID NO: 45989 - DNA, 15 bp, Homo sapiens
ctgatcaccttagtc

SEQ ID NO: 45990 - DNA, 15 bp, Homo sapiens
actgatcaccttagt

SEQ ID NO: 45991 - DNA, 15 bp, Homo sapiens
tactgatcaccttag

SEQ ID NO: 45992 - DNA, 15 bp, Homo sapiens
gtactgatcacctta

SEQ ID NO: 45993 - DNA, 15 bp, Homo sapiens
agtactgatcacctt

SEQ ID NO: 45994 - DNA, 15 bp, Homo sapiens
gagtactgatcacct

SEQ ID NO: 45995 - DNA, 15 bp, Homo sapiens
agagtactgatcacc

SEQ ID NO: 45996 - DNA, 15 bp, Homo sapiens
aagagtactgatcac

SEQ ID NO: 45997 - DNA, 15 bp, Homo sapiens
gaagagtactgatca

SEQ ID NO: 45998 - DNA, 15 bp, Homo sapiens
tgaagagtactgatc

SEQ ID NO: 45999 - DNA, 15 bp, Homo sapiens
ctgaagagtactgat

SEQ ID NO: 46000 - DNA, 15 bp, Homo sapiens
actgaagagtactga

SEQ ID NO: 46001 - DNA, 15 bp, Homo sapiens
gactgaagagtactg

SEQ ID NO: 46002 - DNA, 15 bp, Homo sapiens
agactgaagagtact

SEQ ID NO: 46003 - DNA, 15 bp, Homo sapiens
tagactgaagagtac

SEQ ID NO: 46004 - DNA, 15 bp, Homo sapiens
ttagactgaagagta

SEQ ID NO: 46005 - DNA, 15 bp, Homo sapiens
tttagactgaagagt

SEQ ID NO: 46006 - DNA, 15 bp, Homo sapiens
ttttagactgaagag

SEQ ID NO: 46007 - DNA, 15 bp, Homo sapiens
tttttagactgaaga

SEQ ID NO: 46008 - DNA, 15 bp, Homo sapiens
atttttagactgaag

SEQ ID NO: 46009 - DNA, 15 bp, Homo sapiens
tatttttagactgaa

SEQ ID NO: 46010 - DNA, 15 bp, Homo sapiens
atatttttagactga

SEQ ID NO: 46011 - DNA, 15 bp, Homo sapiens
catatttttagactg

SEQ ID NO: 46012 - DNA, 15 bp, Homo sapiens
tcatatttttagact

SEQ ID NO: 46013 - DNA, 15 bp, Homo sapiens
ttcatatttttagac

SEQ ID NO: 46014 - DNA, 15 bp, Homo sapiens
tttcatatttttaga

SEQ ID NO: 46015 - DNA, 15 bp, Homo sapiens
ctttcatatttttag

SEQ ID NO: 46016 - DNA, 15 bp, Homo sapiens
actttcatattttta

SEQ ID NO: 46017 - DNA, 15 bp, Homo sapiens
cactttcatattttt

SEQ ID NO: 46018 - DNA, 15 bp, Homo sapiens
ccactttcatatttt

SEQ ID NO: 46019 - DNA, 15 bp, Homo sapiens
tccactttcatattt

SEQ ID NO: 46020 - DNA, 15 bp, Homo sapiens
ttccactttcatatt

SEQ ID NO: 46021 - DNA, 15 bp, Homo sapiens
tttccactttcatat

SEQ ID NO: 46022 - DNA, 15 bp, Homo sapiens
ctttccactttcata

SEQ ID NO: 46023 - DNA, 15 bp, Homo sapiens
tctttccactttcat

SEQ ID NO: 46024 - DNA, 15 bp, Homo sapiens
ttctttccactttca

SEQ ID NO: 46025 - DNA, 15 bp, Homo sapiens
cttctttccactttc

SEQ ID NO: 46026 - DNA, 15 bp, Homo sapiens
tcttctttccacttt

SEQ ID NO: 46027 - DNA, 15 bp, Homo sapiens
gtcttctttccactt

SEQ ID NO: 46028 - DNA, 15 bp, Homo sapiens
tgtcttctttccact

SEQ ID NO: 46029 - DNA, 15 bp, Homo sapiens
atgtcttctttccac

SEQ ID NO: 46030 - DNA, 15 bp, Homo sapiens
tatgtcttctttcca

SEQ ID NO: 46031 - DNA, 15 bp, Homo sapiens
gtatgtcttctttcc

SEQ ID NO: 46032 - DNA, 15 bp, Homo sapiens
agtatgtcttctttc

SEQ ID NO: 46033 - DNA, 15 bp, Homo sapiens
aagtatgtcttcttt

SEQ ID NO: 46034 - DNA, 15 bp, Homo sapiens
taagtatgtcttctt

SEQ ID NO: 46035 - DNA, 15 bp, Homo sapiens
gtaagtatgtcttct

SEQ ID NO: 46036 - DNA, 15 bp, Homo sapiens
ggtaagtatgtcttc

SEQ ID NO: 46037 - DNA, 15 bp, Homo sapiens
tggtaagtatgtctt

SEQ ID NO: 46038 - DNA, 15 bp, Homo sapiens
ctggtaagtatgtct

SEQ ID NO: 46039 - DNA, 15 bp, Homo sapiens
gctggtaagtatgtc

SEQ ID NO: 46040 - DNA, 15 bp, Homo sapiens
agctggtaagtatgt

SEQ ID NO: 46041 - DNA, 15 bp, Homo sapiens
tagctggtaagtatg

SEQ ID NO: 46042 - DNA, 15 bp, Homo sapiens
atagctggtaagtat

SEQ ID NO: 46043 - DNA, 15 bp, Homo sapiens
tatagctggtaagta

SEQ ID NO: 46044 - DNA, 15 bp, Homo sapiens
ttatagctggtaagt

SEQ ID NO: 46045 - DNA, 15 bp, Homo sapiens
cttatagctggtaag

SEQ ID NO: 46046 - DNA, 15 bp, Homo sapiens
gcttatagctggtaa

SEQ ID NO: 46047 - DNA, 15 bp, Homo sapiens
agcttatagctggta

SEQ ID NO: 46048 - DNA, 15 bp, Homo sapiens
aagcttatagctggt

SEQ ID NO: 46049 - DNA, 15 bp, Homo sapiens
taagcttatagctgg

SEQ ID NO: 46050 - DNA, 15 bp, Homo sapiens
ataagcttatagctg

SEQ ID NO: 46051 - DNA, 15 bp, Homo sapiens
aataagcttatagct

SEQ ID NO: 46052 - DNA, 15 bp, Homo sapiens
aaataagcttatagc

SEQ ID NO: 46053 - DNA, 15 bp, Homo sapiens
gaaataagcttatag

SEQ ID NO: 46054 - DNA, 15 bp, Homo sapiens
tgaaataagcttata

SEQ ID NO: 46055 - DNA, 15 bp, Homo sapiens
ctgaaataagcttat

SEQ ID NO: 46056 - DNA, 15 bp, Homo sapiens
tctgaaataagctta

SEQ ID NO: 46057 - DNA, 15 bp, Homo sapiens
ttctgaaataagctt

SEQ ID NO: 46058 - DNA, 15 bp, Homo sapiens
tttctgaaataagct

SEQ ID NO: 46059 - DNA, 15 bp, Homo sapiens
ttttctgaaataagc

SEQ ID NO: 46060 - DNA, 15 bp, Homo sapiens
cttttctgaaataag

SEQ ID NO: 46061 - DNA, 15 bp, Homo sapiens
gcttttctgaaataa

SEQ ID NO: 46062 - DNA, 15 bp, Homo sapiens
tgcttttctgaaata

SEQ ID NO: 46063 - DNA, 15 bp, Homo sapiens
ttgcttttctgaaat

SEQ ID NO: 46064 - DNA, 15 bp, Homo sapiens
tttgcttttctgaaa

SEQ ID NO: 46065 - DNA, 15 bp, Homo sapiens
gtttgcttttctgaa

SEQ ID NO: 46066 - DNA, 15 bp, Homo sapiens
tgtttgcttttctga

SEQ ID NO: 46067 - DNA, 15 bp, Homo sapiens
atgtttgcttttctg

SEQ ID NO: 46068 - DNA, 15 bp, Homo sapiens
tatgtttgcttttct

SEQ ID NO: 46069 - DNA, 15 bp, Homo sapiens
ttatgtttgcttttc

SEQ ID NO: 46070 - DNA, 15 bp, Homo sapiens
tttatgtttgctttt

SEQ ID NO: 46071 - DNA, 15 bp, Homo sapiens
gtttatgtttgcttt

SEQ ID NO: 46072 - DNA, 15 bp, Homo sapiens
agtttatgtttgctt

SEQ ID NO: 46073 - DNA, 15 bp, Homo sapiens
aagtttatgtttgct

SEQ ID NO: 46074 - DNA, 15 bp, Homo sapiens
taagtttatgtttgc

SEQ ID NO: 46075 - DNA, 15 bp, Homo sapiens
ataagtttatgtttg

SEQ ID NO: 46076 - DNA, 15 bp, Homo sapiens
aataagtttatgttt

SEQ ID NO: 46077 - DNA, 15 bp, Homo sapiens
gaataagtttatgtt

SEQ ID NO: 46078 - DNA, 15 bp, Homo sapiens
agaataagtttatgt

SEQ ID NO: 46079 - DNA, 15 bp, Homo sapiens
aagaataagtttatg

SEQ ID NO: 46080 - DNA, 15 bp, Homo sapiens
gaagaataagtttat

SEQ ID NO: 46081 - DNA, 15 bp, Homo sapiens
agaagaataagttta

SEQ ID NO: 46082 - DNA, 15 bp, Homo sapiens
tagaagaataagttt

SEQ ID NO: 46083 - DNA, 15 bp, Homo sapiens
ttagaagaataagtt

SEQ ID NO: 46084 - DNA, 15 bp, Homo sapiens
gttagaagaataagt

SEQ ID NO: 46085 - DNA, 15 bp, Homo sapiens
ggttagaagaataag

SEQ ID NO: 46086 - DNA, 15 bp, Homo sapiens
aggttagaagaataa

SEQ ID NO: 46087 - DNA, 15 bp, Homo sapiens
aaggttagaagaata

SEQ ID NO: 46088 - DNA, 15 bp, Homo sapiens
gaaggttagaagaat

SEQ ID NO: 46089 - DNA, 15 bp, Homo sapiens
tgaaggttagaagaa

SEQ ID NO: 46090 - DNA, 15 bp, Homo sapiens
ttgaaggttagaaga

SEQ ID NO: 46091 - DNA, 15 bp, Homo sapiens
gttgaaggttagaag

SEQ ID NO: 46092 - DNA, 15 bp, Homo sapiens
tgttgaaggttagaa

SEQ ID NO: 46093 - DNA, 15 bp, Homo sapiens
ctgttgaaggttaga

SEQ ID NO: 46094 - DNA, 15 bp, Homo sapiens
actgttgaaggttag

SEQ ID NO: 46095 - DNA, 15 bp, Homo sapiens
aactgttgaaggtta

SEQ ID NO: 46096 - DNA, 15 bp, Homo sapiens
taactgttgaaggtt

SEQ ID NO: 46097 - DNA, 15 bp, Homo sapiens
ataactgttgaaggt

SEQ ID NO: 46098 - DNA, 15 bp, Homo sapiens
gataactgttgaagg

SEQ ID NO: 46099 - DNA, 15 bp, Homo sapiens
agataactgttgaag

SEQ ID NO: 46100 - DNA, 15 bp, Homo sapiens
cagataactgttgaa

SEQ ID NO: 46101 - DNA, 15 bp, Homo sapiens
ccagataactgttga

SEQ ID NO: 46102 - DNA, 15 bp, Homo sapiens
tccagataactgttg

SEQ ID NO: 46103 - DNA, 15 bp, Homo sapiens
gtccagataactgtt

SEQ ID NO: 46104 - DNA, 15 bp, Homo sapiens
agtccagataactgt

SEQ ID NO: 46105 - DNA, 15 bp, Homo sapiens
aagtccagataactg

SEQ ID NO: 46106 - DNA, 15 bp, Homo sapiens
aaagtccagataact

SEQ ID NO: 46107 - DNA, 15 bp, Homo sapiens
aaaagtccagataac

SEQ ID NO: 46108 - DNA, 15 bp, Homo sapiens
aaaaagtccagataa

SEQ ID NO: 46109 - DNA, 15 bp, Homo sapiens
caaaaagtccagata

SEQ ID NO: 46110 - DNA, 15 bp, Homo sapiens
tcaaaaagtccagat

SEQ ID NO: 46111 - DNA, 15 bp, Homo sapiens
atcaaaaagtccaga

SEQ ID NO: 46112 - DNA, 15 bp, Homo sapiens
catcaaaaagtccag

SEQ ID NO: 46113 - DNA, 15 bp, Homo sapiens
gcatcaaaaagtcca

SEQ ID NO: 46114 - DNA, 15 bp, Homo sapiens
agcatcaaaaagtcc

SEQ ID NO: 46115 - DNA, 15 bp, Homo sapiens
aagcatcaaaaagtc

SEQ ID NO: 46116 - DNA, 15 bp, Homo sapiens
taagcatcaaaaagt

SEQ ID NO: 46117 - DNA, 15 bp, Homo sapiens
ttaagcatcaaaaag

SEQ ID NO: 46118 - DNA, 15 bp, Homo sapiens
tttaagcatcaaaaa

SEQ ID NO: 46119 - DNA, 15 bp, Homo sapiens
ttttaagcatcaaaa

SEQ ID NO: 46120 - DNA, 15 bp, Homo sapiens
cttttaagcatcaaa

SEQ ID NO: 46121 - DNA, 15 bp, Homo sapiens
tcttttaagcatcaa

SEQ ID NO: 46122 - DNA, 15 bp, Homo sapiens
gtcttttaagcatca

SEQ ID NO: 46123 - DNA, 15 bp, Homo sapiens
ggtcttttaagcatc

SEQ ID NO: 46124 - DNA, 15 bp, Homo sapiens
tggtcttttaagcat

SEQ ID NO: 46125 - DNA, 15 bp, Homo sapiens
ctggtcttttaagca

SEQ ID NO: 46126 - DNA, 15 bp, Homo sapiens
gctggtcttttaagc

SEQ ID NO: 46127 - DNA, 15 bp, Homo sapiens
tgctggtcttttaag

SEQ ID NO: 46128 - DNA, 15 bp, Homo sapiens
ttgctggtcttttaa

SEQ ID NO: 46129 - DNA, 15 bp, Homo sapiens
tttgctggtctttta

SEQ ID NO: 46130 - DNA, 15 bp, Homo sapiens
atttgctggtctttt

SEQ ID NO: 46131 - DNA, 15 bp, Homo sapiens
catttgctggtcttt

SEQ ID NO: 46132 - DNA, 15 bp, Homo sapiens
acatttgctggtctt

SEQ ID NO: 46133 - DNA, 15 bp, Homo sapiens
aacatttgctggtct

SEQ ID NO: 46134 - DNA, 15 bp, Homo sapiens
gaacatttgctggtc

SEQ ID NO: 46135 - DNA, 15 bp, Homo sapiens
tgaacatttgctggt

SEQ ID NO: 46136 - DNA, 15 bp, Homo sapiens
ttgaacatttgctgg

SEQ ID NO: 46137 - DNA, 15 bp, Homo sapiens
cttgaacatttgctg

SEQ ID NO: 46138 - DNA, 15 bp, Homo sapiens
tcttgaacatttgct

SEQ ID NO: 46139 - DNA, 15 bp, Homo sapiens
gtcttgaacatttgc

SEQ ID NO: 46140 - DNA, 15 bp, Homo sapiens
tgtcttgaacatttg

SEQ ID NO: 46141 - DNA, 15 bp, Homo sapiens
ttgtcttgaacattt

SEQ ID NO: 46142 - DNA, 15 bp, Homo sapiens
tttgtcttgaacatt

SEQ ID NO: 46143 - DNA, 15 bp, Homo sapiens
atttgtcttgaacat

SEQ ID NO: 46144 - DNA, 15 bp, Homo sapiens
catttgtcttgaaca

SEQ ID NO: 46145 - DNA, 15 bp, Homo sapiens
tcatttgtcttgaac

SEQ ID NO: 46146 - DNA, 15 bp, Homo sapiens
ctcatttgtcttgaa

SEQ ID NO: 46147 - DNA, 15 bp, Homo sapiens
tctcatttgtcttga

SEQ ID NO: 46148 - DNA, 15 bp, Homo sapiens
ctctcatttgtcttg

SEQ ID NO: 46149 - DNA, 15 bp, Homo sapiens
cctctcatttgtctt

SEQ ID NO: 46150 - DNA, 15 bp, Homo sapiens
tcctctcatttgtct

SEQ ID NO: 46151 - DNA, 15 bp, Homo sapiens
ttcctctcatttgtc

SEQ ID NO: 46152 - DNA, 15 bp, Homo sapiens
cttcctctcatttgt

SEQ ID NO: 46153 - DNA, 15 bp, Homo sapiens
tcttcctctcatttg

SEQ ID NO: 46154 - DNA, 15 bp, Homo sapiens
ctcttcctctcattt

SEQ ID NO: 46155 - DNA, 15 bp, Homo sapiens
gctcttcctctcatt

SEQ ID NO: 46156 - DNA, 15 bp, Homo sapiens
agctcttcctctcat

SEQ ID NO: 46157 - DNA, 15 bp, Homo sapiens
tagctcttcctctca

SEQ ID NO: 46158 - DNA, 15 bp, Homo sapiens
atagctcttcctctc

SEQ ID NO: 46159 - DNA, 15 bp, Homo sapiens
aatagctcttcctct

SEQ ID NO: 46160 - DNA, 15 bp, Homo sapiens
aaatagctcttcctc

SEQ ID NO: 46161 - DNA, 15 bp, Homo sapiens
aaaatagctcttcct

SEQ ID NO: 46162 - DNA, 15 bp, Homo sapiens
taaaatagctcttcc

SEQ ID NO: 46163 - DNA, 15 bp, Homo sapiens
gtaaaatagctcttc

SEQ ID NO: 46164 - DNA, 15 bp, Homo sapiens
tgtaaaatagctctt

SEQ ID NO: 46165 - DNA, 15 bp, Homo sapiens
gtgtaaaatagctct

SEQ ID NO: 46166 - DNA, 15 bp, Homo sapiens
agtgtaaaatagctc

SEQ ID NO: 46167 - DNA, 15 bp, Homo sapiens
cagtgtaaaatagct

SEQ ID NO: 46168 - DNA, 15 bp, Homo sapiens
tcagtgtaaaatagc

SEQ ID NO: 46169 - DNA, 15 bp, Homo sapiens
ttcagtgtaaaatag

SEQ ID NO: 46170 - DNA, 15 bp, Homo sapiens
cttcagtgtaaaata

SEQ ID NO: 46171 - DNA, 15 bp, Homo sapiens
tcttcagtgtaaaat

SEQ ID NO: 46172 - DNA, 15 bp, Homo sapiens
atcttcagtgtaaaa

SEQ ID NO: 46173 - DNA, 15 bp, Homo sapiens
tatcttcagtgtaaa

SEQ ID NO: 46174 - DNA, 15 bp, Homo sapiens
atatcttcagtgtaa

SEQ ID NO: 46175 - DNA, 15 bp, Homo sapiens
tatatcttcagtgta

SEQ ID NO: 46176 - DNA, 15 bp, Homo sapiens
ttatatcttcagtgt

SEQ ID NO: 46177 - DNA, 15 bp, Homo sapiens
attatatcttcagtg

SEQ ID NO: 46178 - DNA, 15 bp, Homo sapiens
aattatatcttcagt

SEQ ID NO: 46179 - DNA, 15 bp, Homo sapiens
taattatatcttcag

SEQ ID NO: 46180 - DNA, 15 bp, Homo sapiens
ctaattatatcttca

SEQ ID NO: 46181 - DNA, 15 bp, Homo sapiens
gctaattatatcttc

SEQ ID NO: 46182 - DNA, 15 bp, Homo sapiens
tgctaattatatctt

SEQ ID NO: 46183 - DNA, 15 bp, Homo sapiens
ttgctaattatatct

SEQ ID NO: 46184 - DNA, 15 bp, Homo sapiens
cttgctaattatatc

SEQ ID NO: 46185 - DNA, 15 bp, Homo sapiens
acttgctaattatat

SEQ ID NO: 46186 - DNA, 15 bp, Homo sapiens
aacttgctaattata

SEQ ID NO: 46187 - DNA, 15 bp, Homo sapiens
aaacttgctaattat

SEQ ID NO: 46188 - DNA, 15 bp, Homo sapiens
caaacttgctaatta

SEQ ID NO: 46189 - DNA, 15 bp, Homo sapiens
gcaaacttgctaatt

SEQ ID NO: 46190 - DNA, 15 bp, Homo sapiens
tgcaaacttgctaat

SEQ ID NO: 46191 - DNA, 15 bp, Homo sapiens
ctgcaaacttgctaa

SEQ ID NO: 46192 - DNA, 15 bp, Homo sapiens
actgcaaacttgcta

SEQ ID NO: 46193 - DNA, 15 bp, Homo sapiens
tactgcaaacttgct

SEQ ID NO: 46194 - DNA, 15 bp, Homo sapiens
gtactgcaaacttgc

SEQ ID NO: 46195 - DNA, 15 bp, Homo sapiens
ggtactgcaaacttg

SEQ ID NO: 46196 - DNA, 15 bp, Homo sapiens
gggtactgcaaactt

SEQ ID NO: 46197 - DNA, 15 bp, Homo sapiens
tgggtactgcaaact

SEQ ID NO: 46198 - DNA, 15 bp, Homo sapiens
ctgggtactgcaaac

SEQ ID NO: 46199 - DNA, 15 bp, Homo sapiens
actgggtactgcaaa

SEQ ID NO: 46200 - DNA, 15 bp, Homo sapiens
cactgggtactgcaa

SEQ ID NO: 46201 - DNA, 15 bp, Homo sapiens
tcactgggtactgca

SEQ ID NO: 46202 - DNA, 15 bp, Homo sapiens
atcactgggtactgc

SEQ ID NO: 46203 - DNA, 15 bp, Homo sapiens
tatcactgggtactg

SEQ ID NO: 46204 - DNA, 15 bp, Homo sapiens
ctatcactgggtact

SEQ ID NO: 46205 - DNA, 15 bp, Homo sapiens
actatcactgggtac

SEQ ID NO: 46206 - DNA, 15 bp, Homo sapiens
tactatcactgggta

SEQ ID NO: 46207 - DNA, 15 bp, Homo sapiens
atactatcactgggt

SEQ ID NO: 46208 - DNA, 15 bp, Homo sapiens
tatactatcactggg

SEQ ID NO: 46209 - DNA, 15 bp, Homo sapiens
ctatactatcactgg

SEQ ID NO: 46210 - DNA, 15 bp, Homo sapiens
tctatactatcactg

SEQ ID NO: 46211 - DNA, 15 bp, Homo sapiens
gtctatactatcact

SEQ ID NO: 46212 - DNA, 15 bp, Homo sapiens
agtctatactatcac

SEQ ID NO: 46213 - DNA, 15 bp, Homo sapiens
cagtctatactatca

SEQ ID NO: 46214 - DNA, 15 bp, Homo sapiens
tcagtctatactatc

SEQ ID NO: 46215 - DNA, 15 bp, Homo sapiens
ttcagtctatactat

SEQ ID NO: 46216 - DNA, 15 bp, Homo sapiens
attcagtctatacta

SEQ ID NO: 46217 - DNA, 15 bp, Homo sapiens
aattcagtctatact

SEQ ID NO: 46218 - DNA, 15 bp, Homo sapiens
aaattcagtctatac

SEQ ID NO: 46219 - DNA, 15 bp, Homo sapiens
taaattcagtctata

SEQ ID NO: 46220 - DNA, 15 bp, Homo sapiens
gtaaattcagtctat

SEQ ID NO: 46221 - DNA, 15 bp, Homo sapiens
tgtaaattcagtcta

SEQ ID NO: 46222 - DNA, 15 bp, Homo sapiens
ttgtaaattcagtct

SEQ ID NO: 46223 - DNA, 15 bp, Homo sapiens
tttgtaaattcagtc

SEQ ID NO: 46224 - DNA, 15 bp, Homo sapiens
atttgtaaattcagt

SEQ ID NO: 46225 - DNA, 15 bp, Homo sapiens
aatttgtaaattcag

SEQ ID NO: 46226 - DNA, 15 bp, Homo sapiens
aaatttgtaaattca

SEQ ID NO: 46227 - DNA, 15 bp, Homo sapiens
aaaatttgtaaattc

SEQ ID NO: 46228 - DNA, 15 bp, Homo sapiens
aaaaatttgtaaatt

SEQ ID NO: 46229 - DNA, 15 bp, Homo sapiens
aaaaaatttgtaaat

SEQ ID NO: 46230 - DNA, 15 bp, Homo sapiens
gaaaaaatttgtaaa

SEQ ID NO: 46231 - DNA, 15 bp, Homo sapiens
agaaaaaatttgtaa

SEQ ID NO: 46232 - DNA, 15 bp, Homo sapiens
aagaaaaaatttgta

SEQ ID NO: 46233 - DNA, 15 bp, Homo sapiens
aaagaaaaaatttgt

SEQ ID NO: 46234 - DNA, 15 bp, Homo sapiens
aaaagaaaaaatttg

SEQ ID NO: 46235 - DNA, 15 bp, Homo sapiens
taaaagaaaaaattt

SEQ ID NO: 46236 - DNA, 15 bp, Homo sapiens
ttaaaagaaaaaatt

SEQ ID NO: 46237 - DNA, 15 bp, Homo sapiens
tttaaaagaaaaaat

SEQ ID NO: 46238 - DNA, 15 bp, Homo sapiens
ctttaaaagaaaaaa

SEQ ID NO: 46239 - DNA, 15 bp, Homo sapiens
cctttaaaagaaaaa

SEQ ID NO: 46240 - DNA, 15 bp, Homo sapiens
gcctttaaaagaaaa

SEQ ID NO: 46241 - DNA, 15 bp, Homo sapiens
tgcctttaaaagaaa

SEQ ID NO: 46242 - DNA, 15 bp, Homo sapiens
ttgcctttaaaagaa

SEQ ID NO: 46243 - DNA, 15 bp, Homo sapiens
attgcctttaaaaga

SEQ ID NO: 46244 - DNA, 15 bp, Homo sapiens
tattgcctttaaaag

SEQ ID NO: 46245 - DNA, 15 bp, Homo sapiens
ttattgcctttaaaa

SEQ ID NO: 46246 - DNA, 15 bp, Homo sapiens
tttattgcctttaaa

SEQ ID NO: 46247 - DNA, 15 bp, Homo sapiens
atttattgcctttaa

SEQ ID NO: 46248 - DNA, 15 bp, Homo sapiens
catttattgccttta

SEQ ID NO: 46249 - DNA, 15 bp, Homo sapiens
acatttattgccttt

SEQ ID NO: 46250 - DNA, 15 bp, Homo sapiens
gacatttattgcctt

SEQ ID NO: 46251 - DNA, 15 bp, Homo sapiens
tgacatttattgcct

SEQ ID NO: 46252 - DNA, 15 bp, Homo sapiens
ctgacatttattgcc

SEQ ID NO: 46253 - DNA, 15 bp, Homo sapiens
tctgacatttattgc

SEQ ID NO: 46254 - DNA, 15 bp, Homo sapiens
gtctgacatttattg

SEQ ID NO: 46255 - DNA, 15 bp, Homo sapiens
agtctgacatttatt

SEQ ID NO: 46256 - DNA, 15 bp, Homo sapiens
gagtctgacatttat

SEQ ID NO: 46257 - DNA, 15 bp, Homo sapiens
tgagtctgacattta

SEQ ID NO: 46258 - DNA, 15 bp, Homo sapiens
gtgagtctgacattt

SEQ ID NO: 46259 - DNA, 15 bp, Homo sapiens
tgtgagtctgacatt

SEQ ID NO: 46260 - DNA, 15 bp, Homo sapiens
ctgtgagtctgacat

SEQ ID NO: 46261 - DNA, 15 bp, Homo sapiens
actgtgagtctgaca

SEQ ID NO: 46262 - DNA, 15 bp, Homo sapiens
tactgtgagtctgac

SEQ ID NO: 46263 - DNA, 15 bp, Homo sapiens
ctactgtgagtctga

SEQ ID NO: 46264 - DNA, 15 bp, Homo sapiens
tctactgtgagtctg

SEQ ID NO: 46265 - DNA, 15 bp, Homo sapiens
gtctactgtgagtct

SEQ ID NO: 46266 - DNA, 15 bp, Homo sapiens
agtctactgtgagtc

SEQ ID NO: 46267 - DNA, 15 bp, Homo sapiens
tagtctactgtgagt

SEQ ID NO: 46268 - DNA, 15 bp, Homo sapiens
atagtctactgtgag

SEQ ID NO: 46269 - DNA, 15 bp, Homo sapiens
aatagtctactgtga

SEQ ID NO: 46270 - DNA, 15 bp, Homo sapiens
taatagtctactgtg

SEQ ID NO: 46271 - DNA, 15 bp, Homo sapiens
ttaatagtctactgt

SEQ ID NO: 46272 - DNA, 15 bp, Homo sapiens
tttaatagtctactg

SEQ ID NO: 46273 - DNA, 15 bp, Homo sapiens
atttaatagtctact

SEQ ID NO: 46274 - DNA, 15 bp, Homo sapiens
tatttaatagtctac

SEQ ID NO: 46275 - DNA, 15 bp, Homo sapiens
ttatttaatagtcta

SEQ ID NO: 46276 - DNA, 15 bp, Homo sapiens
tttatttaatagtct

SEQ ID NO: 46277 - DNA, 15 bp, Homo sapiens
ctttatttaatagtc

SEQ ID NO: 46278 - DNA, 15 bp, Homo sapiens
tctttatttaatagt

SEQ ID NO: 46279 - DNA, 15 bp, Homo sapiens
gtctttatttaatag

SEQ ID NO: 46280 - DNA, 15 bp, Homo sapiens
tgtctttatttaata

SEQ ID NO: 46281 - DNA, 15 bp, Homo sapiens
ctgtctttatttaat

SEQ ID NO: 46282 - DNA, 15 bp, Homo sapiens
actgtctttatttaa

SEQ ID NO: 46283 - DNA, 15 bp, Homo sapiens
cactgtctttattta

SEQ ID NO: 46284 - DNA, 15 bp, Homo sapiens
gcactgtctttattt

SEQ ID NO: 46285 - DNA, 15 bp, Homo sapiens
agcactgtctttatt

SEQ ID NO: 46286 - DNA, 15 bp, Homo sapiens
cagcactgtctttat

SEQ ID NO: 46287 - DNA, 15 bp, Homo sapiens
gcagcactgtcttta

SEQ ID NO: 46288 - DNA, 15 bp, Homo sapiens
ggcagcactgtcttt

SEQ ID NO: 46289 - DNA, 15 bp, Homo sapiens
tggcagcactgtctt

SEQ ID NO: 46290 - DNA, 15 bp, Homo sapiens
ctggcagcactgtct

SEQ ID NO: 46291 - DNA, 15 bp, Homo sapiens
tctggcagcactgtc

SEQ ID NO: 46292 - DNA, 15 bp, Homo sapiens
ttctggcagcactgt

SEQ ID NO: 46293 - DNA, 15 bp, Homo sapiens
gttctggcagcactg

SEQ ID NO: 46294 - DNA, 15 bp, Homo sapiens
agttctggcagcact

SEQ ID NO: 46295 - DNA, 15 bp, Homo sapiens
gagttctggcagcac

SEQ ID NO: 46296 - DNA, 15 bp, Homo sapiens
agagttctggcagca

SEQ ID NO: 46297 - DNA, 15 bp, Homo sapiens
tagagttctggcagc

SEQ ID NO: 46298 - DNA, 15 bp, Homo sapiens
atagagttctggcag

SEQ ID NO: 46299 - DNA, 15 bp, Homo sapiens
aatagagttctggca

SEQ ID NO: 46300 - DNA, 15 bp, Homo sapiens
aaatagagttctggc

SEQ ID NO: 46301 - DNA, 15 bp, Homo sapiens
aaaatagagttctgg

SEQ ID NO: 46302 - DNA, 15 bp, Homo sapiens
aaaaatagagttctg

SEQ ID NO: 46303 - DNA, 15 bp, Homo sapiens
aaaaaatagagttct

SEQ ID NO: 46304 - DNA, 15 bp, Homo sapiens
aaaaaaatagagttc

SEQ ID NO: 46305 - DNA, 15 bp, Homo sapiens
aaaaaaaatagagtt

SEQ ID NO: 46306 - DNA, 15 bp, Homo sapiens
aaaaaaaaatagagt

SEQ ID NO: 46307 - DNA, 15 bp, Homo sapiens
aaaaaaaaaatagag

SEQ ID NO: 46308 - DNA, 15 bp, Homo sapiens
aaaaaaaaaaataga

SEQ ID NO: 46309 - DNA, 15 bp, Homo sapiens
aaaaaaaaaaaatag

SEQ ID NO: 46310 - DNA, 15 bp, Homo sapiens
aaaaaaaaaaaaata

SEQ ID NO: 46311 - DNA, 15 bp, Homo sapiens
ctcaaaagaaaaaaa

SEQ ID NO: 46312 - DNA, 15 bp, Homo sapiens
tctcaaaagaaaaaa

SEQ ID NO: 46313 - DNA, 15 bp, Homo sapiens
gtctcaaaagaaaaa

SEQ ID NO: 46314 - DNA, 15 bp, Homo sapiens
cgtctcaaaagaaaa

SEQ ID NO: 46315 - DNA, 15 bp, Homo sapiens
ccgtctcaaaagaaa

SEQ ID NO: 46316 - DNA, 15 bp, Homo sapiens
tccgtctcaaaagaa

SEQ ID NO: 46317 - DNA, 15 bp, Homo sapiens
ctccgtctcaaaaga

SEQ ID NO: 46318 - DNA, 15 bp, Homo sapiens
actccgtctcaaaag

SEQ ID NO: 46319 - DNA, 15 bp, Homo sapiens
gcaagactccgtctc

SEQ ID NO: 46320 - DNA, 15 bp, Homo sapiens
agcaagactccgtct

SEQ ID NO: 46321 - DNA, 15 bp, Homo sapiens
gagcaagactccgtc

SEQ ID NO: 46322 - DNA, 15 bp, Homo sapiens
agagcaagactccgt

SEQ ID NO: 46323 - DNA, 15 bp, Homo sapiens
aagagcaagactccg

SEQ ID NO: 46324 - DNA, 15 bp, Homo sapiens
gaaagagcaagactc

SEQ ID NO: 46325 - DNA, 15 bp, Homo sapiens
cgaaagagcaagact

SEQ ID NO: 46326 - DNA, 15 bp, Homo sapiens
gcgaaagagcaagac

SEQ ID NO: 46327 - DNA, 15 bp, Homo sapiens
agcgaaagagcaaga

SEQ ID NO: 46328 - DNA, 15 bp, Homo sapiens
gagcgaaagagcaag

SEQ ID NO: 46329 - DNA, 15 bp, Homo sapiens
tgagcgaaagagcaa

SEQ ID NO: 46330 - DNA, 15 bp, Homo sapiens
ctgagcgaaagagca

SEQ ID NO: 46331 - DNA, 15 bp, Homo sapiens
cctgagcgaaagagc

SEQ ID NO: 46332 - DNA, 15 bp, Homo sapiens
gcctgagcgaaagag

SEQ ID NO: 46333 - DNA, 15 bp, Homo sapiens
agcctgagcgaaaga

SEQ ID NO: 46334 - DNA, 15 bp, Homo sapiens
aagcctgagcgaaag

SEQ ID NO: 46335 - DNA, 15 bp, Homo sapiens
caagcctgagcgaaa

SEQ ID NO: 46336 - DNA, 15 bp, Homo sapiens
tcaagcctgagcgaa

SEQ ID NO: 46337 - DNA, 15 bp, Homo sapiens
ctcaagcctgagcga

SEQ ID NO: 46338 - DNA, 15 bp, Homo sapiens
actcaagcctgagcg

SEQ ID NO: 46339 - DNA, 15 bp, Homo sapiens
cactcaagcctgagc

SEQ ID NO: 46340 - DNA, 15 bp, Homo sapiens
gcactcaagcctgag

SEQ ID NO: 46341 - DNA, 15 bp, Homo sapiens
tgcactcaagcctga

SEQ ID NO: 46342 - DNA, 15 bp, Homo sapiens
ctgcactcaagcctg

SEQ ID NO: 46343 - DNA, 15 bp, Homo sapiens
tctgcactcaagcct

SEQ ID NO: 46344 - DNA, 15 bp, Homo sapiens
ctctgcactcaagcc

SEQ ID NO: 46345 - DNA, 15 bp, Homo sapiens
cctctgcactcaagc

SEQ ID NO: 46346 - DNA, 15 bp, Homo sapiens
acctctgcactcaag

SEQ ID NO: 46347 - DNA, 15 bp, Homo sapiens
cacctctgcactcaa

SEQ ID NO: 46348 - DNA, 15 bp, Homo sapiens
gcacctctgcactca

SEQ ID NO: 46349 - DNA, 15 bp, Homo sapiens
cgcacctctgcactc

SEQ ID NO: 46350 - DNA, 15 bp, Homo sapiens
tcgcacctctgcact

SEQ ID NO: 46351 - DNA, 15 bp, Homo sapiens
atcgcacctctgcac

SEQ ID NO: 46352 - DNA, 15 bp, Homo sapiens
gatcgcacctctgca

SEQ ID NO: 46353 - DNA, 15 bp, Homo sapiens
agatcgcacctctgc

SEQ ID NO: 46354 - DNA, 15 bp, Homo sapiens
gagatcgcacctctg

SEQ ID NO: 46355 - DNA, 15 bp, Homo sapiens
cgagatcgcacctct

SEQ ID NO: 46356 - DNA, 15 bp, Homo sapiens
ccgagatcgcacctc

SEQ ID NO: 46357 - DNA, 15 bp, Homo sapiens
gccgagatcgcacct

SEQ ID NO: 46358 - DNA, 15 bp, Homo sapiens
ctgagccgagatcgc

SEQ ID NO: 46359 - DNA, 15 bp, Homo sapiens
actgagccgagatcg

SEQ ID NO: 46360 - DNA, 15 bp, Homo sapiens
cactgagccgagatc

SEQ ID NO: 46361 - DNA, 15 bp, Homo sapiens
gcactgagccgagat

SEQ ID NO: 46362 - DNA, 15 bp, Homo sapiens
tgcactgagccgaga

SEQ ID NO: 46363 - DNA, 15 bp, Homo sapiens
ttgcactgagccgag

SEQ ID NO: 46364 - DNA, 15 bp, Homo sapiens
gttgcactgagccga

SEQ ID NO: 46365 - DNA, 15 bp, Homo sapiens
ggttgcactgagccg

SEQ ID NO: 46366 - DNA, 15 bp, Homo sapiens
aggttgcactgagcc

SEQ ID NO: 46367 - DNA, 15 bp, Homo sapiens
gaggttgcactgagc

SEQ ID NO: 46368 - DNA, 15 bp, Homo sapiens
ggaggttgcactgag

SEQ ID NO: 46369 - DNA, 15 bp, Homo sapiens
cggaggttgcactga

SEQ ID NO: 46370 - DNA, 15 bp, Homo sapiens
gcggaggttgcactg

SEQ ID NO: 46371 - DNA, 15 bp, Homo sapiens
ggcggaggttgcact

SEQ ID NO: 46372 - DNA, 15 bp, Homo sapiens
aggcggaggttgcac

SEQ ID NO: 46373 - DNA, 15 bp, Homo sapiens
agaggcggaggttgc

SEQ ID NO: 46374 - DNA, 15 bp, Homo sapiens
aagaggcggaggttg

SEQ ID NO: 46375 - DNA, 15 bp, Homo sapiens
taagaggcggaggtt

SEQ ID NO: 46376 - DNA, 15 bp, Homo sapiens
ttaagaggcggaggt

SEQ ID NO: 46377 - DNA, 15 bp, Homo sapiens
cttaagaggcggagg

SEQ ID NO: 46378 - DNA, 15 bp, Homo sapiens
acttaagaggcggag

SEQ ID NO: 46379 - DNA, 15 bp, Homo sapiens
aacttaagaggcgga

SEQ ID NO: 46380 - DNA, 15 bp, Homo sapiens
gaacttaagaggcgg

SEQ ID NO: 46381 - DNA, 15 bp, Homo sapiens
tgaacttaagaggcg

SEQ ID NO: 46382 - DNA, 15 bp, Homo sapiens
ttgaacttaagaggc

SEQ ID NO: 46383 - DNA, 15 bp, Homo sapiens
cttgaacttaagagg

SEQ ID NO: 46384 - DNA, 15 bp, Homo sapiens
acttgaacttaagag

SEQ ID NO: 46385 - DNA, 15 bp, Homo sapiens
cacttgaacttaaga

SEQ ID NO: 46386 - DNA, 15 bp, Homo sapiens
tcacttgaacttaag

SEQ ID NO: 46387 - DNA, 15 bp, Homo sapiens
atcacttgaacttaa

SEQ ID NO: 46388 - DNA, 15 bp, Homo sapiens
aatcacttgaactta

SEQ ID NO: 46389 - DNA, 15 bp, Homo sapiens
gaatcacttgaactt

SEQ ID NO: 46390 - DNA, 15 bp, Homo sapiens
agaatcacttgaact

SEQ ID NO: 46391 - DNA, 15 bp, Homo sapiens
ttgaggcaggagaat

SEQ ID NO: 46392 - DNA, 15 bp, Homo sapiens
gttgaggcaggagaa

SEQ ID NO: 46393 - DNA, 15 bp, Homo sapiens
ggttgaggcaggaga

SEQ ID NO: 46394 - DNA, 15 bp, Homo sapiens
aggttgaggcaggag

SEQ ID NO: 46395 - DNA, 15 bp, Homo sapiens
gaggttgaggcagga

SEQ ID NO: 46396 - DNA, 15 bp, Homo sapiens
ggaggttgaggcagg

SEQ ID NO: 46397 - DNA, 15 bp, Homo sapiens
tcaggaggttgaggc

SEQ ID NO: 46398 - DNA, 15 bp, Homo sapiens
ctcaggaggttgagg

SEQ ID NO: 46399 - DNA, 15 bp, Homo sapiens
actcaggaggttgag

SEQ ID NO: 46400 - DNA, 15 bp, Homo sapiens
tactcaggaggttga

SEQ ID NO: 46401 - DNA, 15 bp, Homo sapiens
ctactcaggaggttg

SEQ ID NO: 46402 - DNA, 15 bp, Homo sapiens
gctactcaggaggtt

SEQ ID NO: 46403 - DNA, 15 bp, Homo sapiens
agctactcaggaggt

SEQ ID NO: 46404 - DNA, 15 bp, Homo sapiens
ttgtaatcccagcta

SEQ ID NO: 46405 - DNA, 15 bp, Homo sapiens
cttgtaatcccagct

SEQ ID NO: 46406 - DNA, 15 bp, Homo sapiens
gcttgtaatcccagc

SEQ ID NO: 46407 - DNA, 15 bp, Homo sapiens
gcgcttgtaatccca

SEQ ID NO: 46408 - DNA, 15 bp, Homo sapiens
tgcgcttgtaatccc

SEQ ID NO: 46409 - DNA, 15 bp, Homo sapiens
gtgcgcttgtaatcc

SEQ ID NO: 46410 - DNA, 15 bp, Homo sapiens
tgtgcgcttgtaatc

SEQ ID NO: 46411 - DNA, 15 bp, Homo sapiens
gtgtgcgcttgtaat

SEQ ID NO: 46412 - DNA, 15 bp, Homo sapiens
ggtgtgcgcttgtaa

SEQ ID NO: 46413 - DNA, 15 bp, Homo sapiens
tggtgtgcgcttgta

SEQ ID NO: 46414 - DNA, 15 bp, Homo sapiens
gtggtgtgcgcttgt

SEQ ID NO: 46415 - DNA, 15 bp, Homo sapiens
ggtggtgtgcgcttg

SEQ ID NO: 46416 - DNA, 15 bp, Homo sapiens
tggtggtgtgcgctt

SEQ ID NO: 46417 - DNA, 15 bp, Homo sapiens
gtggtggtgtgcgct

SEQ ID NO: 46418 - DNA, 15 bp, Homo sapiens
tgtggtggtgtgcgc

SEQ ID NO: 46419 - DNA, 15 bp, Homo sapiens
gtgtggtggtgtgcg

SEQ ID NO: 46420 - DNA, 15 bp, Homo sapiens
ggtgtggtggtgtgc

SEQ ID NO: 46421 - DNA, 15 bp, Homo sapiens
aggtgtggtggtgtg

SEQ ID NO: 46422 - DNA, 15 bp, Homo sapiens
caggtgtggtggtgt

SEQ ID NO: 46423 - DNA, 15 bp, Homo sapiens
ttgtctctactaaaa

SEQ ID NO: 46424 - DNA, 15 bp, Homo sapiens
cttgtctctactaaa

SEQ ID NO: 46425 - DNA, 15 bp, Homo sapiens
ccttgtctctactaa

SEQ ID NO: 46426 - DNA, 15 bp, Homo sapiens
accttgtctctacta

SEQ ID NO: 46427 - DNA, 15 bp, Homo sapiens
aaccttgtctctact

SEQ ID NO: 46428 - DNA, 15 bp, Homo sapiens
aaaccttgtctctac

SEQ ID NO: 46429 - DNA, 15 bp, Homo sapiens
gaaaccttgtctcta

SEQ ID NO: 46430 - DNA, 15 bp, Homo sapiens
tgaaaccttgtctct

SEQ ID NO: 46431 - DNA, 15 bp, Homo sapiens
atgaaaccttgtctc

SEQ ID NO: 46432 - DNA, 15 bp, Homo sapiens
gatgaaaccttgtct

SEQ ID NO: 46433 - DNA, 15 bp, Homo sapiens
tgatgaaaccttgtc

SEQ ID NO: 46434 - DNA, 15 bp, Homo sapiens
atgatgaaaccttgt

SEQ ID NO: 46435 - DNA, 15 bp, Homo sapiens
catgatgaaaccttg

SEQ ID NO: 46436 - DNA, 15 bp, Homo sapiens
acatgatgaaacctt

SEQ ID NO: 46437 - DNA, 15 bp, Homo sapiens
aacatgatgaaacct

SEQ ID NO: 46438 - DNA, 15 bp, Homo sapiens
tcaacatgatgaaac

SEQ ID NO: 46439 - DNA, 15 bp, Homo sapiens
gtcaacatgatgaaa

SEQ ID NO: 46440 - DNA, 15 bp, Homo sapiens
ggtcaacatgatgaa

SEQ ID NO: 46441 - DNA, 15 bp, Homo sapiens
tggtcaacatgatga

SEQ ID NO: 46442 - DNA, 15 bp, Homo sapiens
ctggtcaacatgatg

SEQ ID NO: 46443 - DNA, 15 bp, Homo sapiens
cctggtcaacatgat

SEQ ID NO: 46444 - DNA, 15 bp, Homo sapiens
gcctggtcaacatga

SEQ ID NO: 46445 - DNA, 15 bp, Homo sapiens
agcctggtcaacatg

SEQ ID NO: 46446 - DNA, 15 bp, Homo sapiens
cagcctggtcaacat

SEQ ID NO: 46447 - DNA, 15 bp, Homo sapiens
ccagcctggtcaaca

SEQ ID NO: 46448 - DNA, 15 bp, Homo sapiens
accagcctggtcaac

SEQ ID NO: 46449 - DNA, 15 bp, Homo sapiens
gaccagcctggtcaa

SEQ ID NO: 46450 - DNA, 15 bp, Homo sapiens
agaccagcctggtca

SEQ ID NO: 46451 - DNA, 15 bp, Homo sapiens
aagaccagcctggtc

SEQ ID NO: 46452 - DNA, 15 bp, Homo sapiens
caagaccagcctggt

SEQ ID NO: 46453 - DNA, 15 bp, Homo sapiens
aaagttcaagaccag

SEQ ID NO: 46454 - DNA, 15 bp, Homo sapiens
aaaagttcaagacca

SEQ ID NO: 46455 - DNA, 15 bp, Homo sapiens
caaaagttcaagacc

SEQ ID NO: 46456 - DNA, 15 bp, Homo sapiens
tcaaaagttcaagac

SEQ ID NO: 46457 - DNA, 15 bp, Homo sapiens
gtcaaaagttcaaga

SEQ ID NO: 46458 - DNA, 15 bp, Homo sapiens
agtcaaaagttcaag

SEQ ID NO: 46459 - DNA, 15 bp, Homo sapiens
aagtcaaaagttcaa

SEQ ID NO: 46460 - DNA, 15 bp, Homo sapiens
gaagtcaaaagttca

SEQ ID NO: 46461 - DNA, 15 bp, Homo sapiens
tgaagtcaaaagttc

SEQ ID NO: 46462 - DNA, 15 bp, Homo sapiens
ctgaagtcaaaagtt

SEQ ID NO: 46463 - DNA, 15 bp, Homo sapiens
tctgaagtcaaaagt

SEQ ID NO: 46464 - DNA, 15 bp, Homo sapiens
atctgaagtcaaaag

SEQ ID NO: 46465 - DNA, 15 bp, Homo sapiens
catctgaagtcaaaa

SEQ ID NO: 46466 - DNA, 15 bp, Homo sapiens
tcatctgaagtcaaa

SEQ ID NO: 46467 - DNA, 15 bp, Homo sapiens
atcatctgaagtcaa

SEQ ID NO: 46468 - DNA, 15 bp, Homo sapiens
gatcatctgaagtca

SEQ ID NO: 46469 - DNA, 15 bp, Homo sapiens
ggatcatctgaagtc

SEQ ID NO: 46470 - DNA, 15 bp, Homo sapiens
tggatcatctgaagt

SEQ ID NO: 46471 - DNA, 15 bp, Homo sapiens
gtggatcatctgaag

SEQ ID NO: 46472 - DNA, 15 bp, Homo sapiens
ggtggatcatctgaa

SEQ ID NO: 46473 - DNA, 15 bp, Homo sapiens
gcaggtggatcatct

SEQ ID NO: 46474 - DNA, 15 bp, Homo sapiens
ggcaggtggatcatc

SEQ ID NO: 46475 - DNA, 15 bp, Homo sapiens
gtggctcatgcctat

SEQ ID NO: 46476 - DNA, 15 bp, Homo sapiens
agtggctcatgccta

SEQ ID NO: 46477 - DNA, 15 bp, Homo sapiens
acagtggctcatgcc

SEQ ID NO: 46478 - DNA, 15 bp, Homo sapiens
gacagtggctcatgc

SEQ ID NO: 46479 - DNA, 15 bp, Homo sapiens
ggacagtggctcatg

SEQ ID NO: 46480 - DNA, 15 bp, Homo sapiens
gggacagtggctcat

SEQ ID NO: 46481 - DNA, 15 bp, Homo sapiens
ggggacagtggctca

SEQ ID NO: 46482 - DNA, 15 bp, Homo sapiens
cggggacagtggctc

SEQ ID NO: 46483 - DNA, 15 bp, Homo sapiens
ccggggacagtggct

SEQ ID NO: 46484 - DNA, 15 bp, Homo sapiens
gccggggacagtggc

SEQ ID NO: 46485 - DNA, 15 bp, Homo sapiens
ggccggggacagtgg

SEQ ID NO: 46486 - DNA, 15 bp, Homo sapiens
gggccggggacagtg

SEQ ID NO: 46487 - DNA, 15 bp, Homo sapiens
tgggccggggacagt

SEQ ID NO: 46488 - DNA, 15 bp, Homo sapiens
ctgggccggggacag

SEQ ID NO: 46489 - DNA, 15 bp, Homo sapiens
tctgggccggggaca

SEQ ID NO: 46490 - DNA, 15 bp, Homo sapiens
ttctgggccggggac

SEQ ID NO: 46491 - DNA, 15 bp, Homo sapiens
gttctgggccgggga

SEQ ID NO: 46492 - DNA, 15 bp, Homo sapiens
ggttctgggccgggg

SEQ ID NO: 46493 - DNA, 15 bp, Homo sapiens
gggttctgggccggg

SEQ ID NO: 46494 - DNA, 15 bp, Homo sapiens
agggttctgggccgg

SEQ ID NO: 46495 - DNA, 15 bp, Homo sapiens
tagggttctgggccg

SEQ ID NO: 46496 - DNA, 15 bp, Homo sapiens
ttagggttctgggcc

SEQ ID NO: 46497 - DNA, 15 bp, Homo sapiens
attagggttctgggc

SEQ ID NO: 46498 - DNA, 15 bp, Homo sapiens
aattagggttctggg

SEQ ID NO: 46499 - DNA, 15 bp, Homo sapiens
aaattagggttctgg

SEQ ID NO: 46500 - DNA, 15 bp, Homo sapiens
aaaattagggttctg

SEQ ID NO: 46501 - DNA, 15 bp, Homo sapiens
aaaaattagggttct

SEQ ID NO: 46502 - DNA, 15 bp, Homo sapiens
taaaaattagggttc

SEQ ID NO: 46503 - DNA, 15 bp, Homo sapiens
ttaaaaattagggtt

SEQ ID NO: 46504 - DNA, 15 bp, Homo sapiens
gttaaaaattagggt

SEQ ID NO: 46505 - DNA, 15 bp, Homo sapiens
tgttaaaaattaggg

SEQ ID NO: 46506 - DNA, 15 bp, Homo sapiens
ctgttaaaaattagg

SEQ ID NO: 46507 - DNA, 15 bp, Homo sapiens
actgttaaaaattag

SEQ ID NO: 46508 - DNA, 15 bp, Homo sapiens
cactgttaaaaatta

SEQ ID NO: 46509 - DNA, 15 bp, Homo sapiens
tcactgttaaaaatt

SEQ ID NO: 46510 - DNA, 15 bp, Homo sapiens
gtcactgttaaaaat

SEQ ID NO: 46511 - DNA, 15 bp, Homo sapiens
tgtcactgttaaaaa

SEQ ID NO: 46512 - DNA, 15 bp, Homo sapiens
ttgtcactgttaaaa

SEQ ID NO: 46513 - DNA, 15 bp, Homo sapiens
cttgtcactgttaaa

SEQ ID NO: 46514 - DNA, 15 bp, Homo sapiens
tcttgtcactgttaa

SEQ ID NO: 46515 - DNA, 15 bp, Homo sapiens
ttcttgtcactgtta

SEQ ID NO: 46516 - DNA, 15 bp, Homo sapiens
cttcttgtcactgtt

SEQ ID NO: 46517 - DNA, 15 bp, Homo sapiens
acttcttgtcactgt

SEQ ID NO: 46518 - DNA, 15 bp, Homo sapiens
aacttcttgtcactg

SEQ ID NO: 46519 - DNA, 15 bp, Homo sapiens
taacttcttgtcact

SEQ ID NO: 46520 - DNA, 15 bp, Homo sapiens
ttaacttcttgtcac

SEQ ID NO: 46521 - DNA, 15 bp, Homo sapiens
gttaacttcttgtca

SEQ ID NO: 46522 - DNA, 15 bp, Homo sapiens
tgttaacttcttgtc

SEQ ID NO: 46523 - DNA, 15 bp, Homo sapiens
atgttaacttcttgt

SEQ ID NO: 46524 - DNA, 15 bp, Homo sapiens
catgttaacttcttg

SEQ ID NO: 46525 - DNA, 15 bp, Homo sapiens
tcatgttaacttctt

SEQ ID NO: 46526 - DNA, 15 bp, Homo sapiens
ttcatgttaacttct

SEQ ID NO: 46527 - DNA, 15 bp, Homo sapiens
cttcatgttaacttc

SEQ ID NO: 46528 - DNA, 15 bp, Homo sapiens
ccttcatgttaactt

SEQ ID NO: 46529 - DNA, 15 bp, Homo sapiens
tccttcatgttaact

SEQ ID NO: 46530 - DNA, 15 bp, Homo sapiens
ttccttcatgttaac

SEQ ID NO: 46531 - DNA, 15 bp, Homo sapiens
cttccttcatgttaa

SEQ ID NO: 46532 - DNA, 15 bp, Homo sapiens
acttccttcatgtta

SEQ ID NO: 46533 - DNA, 15 bp, Homo sapiens
gacttccttcatgtt

SEQ ID NO: 46534 - DNA, 15 bp, Homo sapiens
tgacttccttcatgt

SEQ ID NO: 46535 - DNA, 15 bp, Homo sapiens
atgacttccttcatg

SEQ ID NO: 46536 - DNA, 15 bp, Homo sapiens
aatgacttccttcat

SEQ ID NO: 46537 - DNA, 15 bp, Homo sapiens
taatgacttccttca

SEQ ID NO: 46538 - DNA, 15 bp, Homo sapiens
ctaatgacttccttc

SEQ ID NO: 46539 - DNA, 15 bp, Homo sapiens
cctaatgacttcctt

SEQ ID NO: 46540 - DNA, 15 bp, Homo sapiens
tcctaatgacttcct

SEQ ID NO: 46541 - DNA, 15 bp, Homo sapiens
ttcctaatgacttcc

SEQ ID NO: 46542 - DNA, 15 bp, Homo sapiens
tttcctaatgacttc

SEQ ID NO: 46543 - DNA, 15 bp, Homo sapiens
ctttcctaatgactt

SEQ ID NO: 46544 - DNA, 15 bp, Homo sapiens
actttcctaatgact

SEQ ID NO: 46545 - DNA, 15 bp, Homo sapiens
cactttcctaatgac

SEQ ID NO: 46546 - DNA, 15 bp, Homo sapiens
tcactttcctaatga

SEQ ID NO: 46547 - DNA, 15 bp, Homo sapiens
ctcactttcctaatg

SEQ ID NO: 46548 - DNA, 15 bp, Homo sapiens
actcactttcctaat

SEQ ID NO: 46549 - DNA, 15 bp, Homo sapiens
cactcactttcctaa

SEQ ID NO: 46550 - DNA, 15 bp, Homo sapiens
ccactcactttccta

SEQ ID NO: 46551 - DNA, 15 bp, Homo sapiens
gccactcactttcct

SEQ ID NO: 46552 - DNA, 15 bp, Homo sapiens
ggccactcactttcc

SEQ ID NO: 46553 - DNA, 15 bp, Homo sapiens
aggccactcactttc

SEQ ID NO: 46554 - DNA, 15 bp, Homo sapiens
caggccactcacttt

SEQ ID NO: 46555 - DNA, 15 bp, Homo sapiens
acaggccactcactt

SEQ ID NO: 46556 - DNA, 15 bp, Homo sapiens
tacaggccactcact

SEQ ID NO: 46557 - DNA, 15 bp, Homo sapiens
ttacaggccactcac

SEQ ID NO: 46558 - DNA, 15 bp, Homo sapiens
tttacaggccactca

SEQ ID NO: 46559 - DNA, 15 bp, Homo sapiens
atttacaggccactc

SEQ ID NO: 46560 - DNA, 15 bp, Homo sapiens
catttacaggccact

SEQ ID NO: 46561 - DNA, 15 bp, Homo sapiens
tcatttacaggccac

SEQ ID NO: 46562 - DNA, 15 bp, Homo sapiens
ttcatttacaggcca

SEQ ID NO: 46563 - DNA, 15 bp, Homo sapiens
cttcatttacaggcc

SEQ ID NO: 46564 - DNA, 15 bp, Homo sapiens
acttcatttacaggc

SEQ ID NO: 46565 - DNA, 15 bp, Homo sapiens
aacttcatttacagg

SEQ ID NO: 46566 - DNA, 15 bp, Homo sapiens
aaacttcatttacag

SEQ ID NO: 46567 - DNA, 15 bp, Homo sapiens
gaaacttcatttaca

SEQ ID NO: 46568 - DNA, 15 bp, Homo sapiens
agaaacttcatttac

SEQ ID NO: 46569 - DNA, 15 bp, Homo sapiens
aagaaacttcattta

SEQ ID NO: 46570 - DNA, 15 bp, Homo sapiens
caagaaacttcattt

SEQ ID NO: 46571 - DNA, 15 bp, Homo sapiens
gcaagaaacttcatt

SEQ ID NO: 46572 - DNA, 15 bp, Homo sapiens
cgcaagaaacttcat

SEQ ID NO: 46573 - DNA, 15 bp, Homo sapiens
gcgcaagaaacttca

SEQ ID NO: 46574 - DNA, 15 bp, Homo sapiens
agcgcaagaaacttc

SEQ ID NO: 46575 - DNA, 15 bp, Homo sapiens
aagcgcaagaaactt

SEQ ID NO: 46576 - DNA, 15 bp, Homo sapiens
aaagcgcaagaaact

SEQ ID NO: 46577 - DNA, 15 bp, Homo sapiens
aaaagcgcaagaaac

SEQ ID NO: 46578 - DNA, 15 bp, Homo sapiens
caaaagcgcaagaaa

SEQ ID NO: 46579 - DNA, 15 bp, Homo sapiens
gcaaaagcgcaagaa

SEQ ID NO: 46580 - DNA, 15 bp, Homo sapiens
agcaaaagcgcaaga

SEQ ID NO: 46581 - DNA, 15 bp, Homo sapiens
gagcaaaagcgcaag

SEQ ID NO: 46582 - DNA, 15 bp, Homo sapiens
tgagcaaaagcgcaa

SEQ ID NO: 46583 - DNA, 15 bp, Homo sapiens
ctgagcaaaagcgca

SEQ ID NO: 46584 - DNA, 15 bp, Homo sapiens
cctgagcaaaagcgc

SEQ ID NO: 46585 - DNA, 15 bp, Homo sapiens
gcctgagcaaaagcg

SEQ ID NO: 46586 - DNA, 15 bp, Homo sapiens
tgcctgagcaaaagc

SEQ ID NO: 46587 - DNA, 15 bp, Homo sapiens
ttgcctgagcaaaag

SEQ ID NO: 46588 - DNA, 15 bp, Homo sapiens
attgcctgagcaaaa

SEQ ID NO: 46589 - DNA, 15 bp, Homo sapiens
cattgcctgagcaaa

SEQ ID NO: 46590 - DNA, 15 bp, Homo sapiens
ccattgcctgagcaa

SEQ ID NO: 46591 - DNA, 15 bp, Homo sapiens
tccattgcctgagca

SEQ ID NO: 46592 - DNA, 15 bp, Homo sapiens
atccattgcctgagc

SEQ ID NO: 46593 - DNA, 15 bp, Homo sapiens
aatccattgcctgag

SEQ ID NO: 46594 - DNA, 15 bp, Homo sapiens
aaatccattgcctga

SEQ ID NO: 46595 - DNA, 15 bp, Homo sapiens
aaaatccattgcctg

SEQ ID NO: 46596 - DNA, 15 bp, Homo sapiens
taaaatccattgcct

SEQ ID NO: 46597 - DNA, 15 bp, Homo sapiens
ataaaatccattgcc

SEQ ID NO: 46598 - DNA, 15 bp, Homo sapiens
gataaaatccattgc

SEQ ID NO: 46599 - DNA, 15 bp, Homo sapiens
agataaaatccattg

SEQ ID NO: 46600 - DNA, 15 bp, Homo sapiens
cagataaaatccatt

SEQ ID NO: 46601 - DNA, 15 bp, Homo sapiens
acagataaaatccat

SEQ ID NO: 46602 - DNA, 15 bp, Homo sapiens
gacagataaaatcca

SEQ ID NO: 46603 - DNA, 15 bp, Homo sapiens
ggacagataaaatcc

SEQ ID NO: 46604 - DNA, 15 bp, Homo sapiens
gggacagataaaatc

SEQ ID NO: 46605 - DNA, 15 bp, Homo sapiens
ggggacagataaaat

SEQ ID NO: 46606 - DNA, 15 bp, Homo sapiens
gggggacagataaaa

SEQ ID NO: 46607 - DNA, 15 bp, Homo sapiens
agggggacagataaa

SEQ ID NO: 46608 - DNA, 15 bp, Homo sapiens
gagggggacagataa

SEQ ID NO: 46609 - DNA, 15 bp, Homo sapiens
tgagggggacagata

SEQ ID NO: 46610 - DNA, 15 bp, Homo sapiens
atgagggggacagat

SEQ ID NO: 46611 - DNA, 15 bp, Homo sapiens
gatgagggggacaga

SEQ ID NO: 46612 - DNA, 15 bp, Homo sapiens
ggatgagggggacag

SEQ ID NO: 46613 - DNA, 15 bp, Homo sapiens
tggatgagggggaca

SEQ ID NO: 46614 - DNA, 15 bp, Homo sapiens
ttggatgagggggac

SEQ ID NO: 46615 - DNA, 15 bp, Homo sapiens
gttggatgaggggga

SEQ ID NO: 46616 - DNA, 15 bp, Homo sapiens
ggttggatgaggggg

SEQ ID NO: 46617 - DNA, 15 bp, Homo sapiens
gggttggatgagggg

SEQ ID NO: 46618 - DNA, 15 bp, Homo sapiens
agggttggatgaggg

SEQ ID NO: 46619 - DNA, 15 bp, Homo sapiens
tagggttggatgagg

SEQ ID NO: 46620 - DNA, 15 bp, Homo sapiens
gtagggttggatgag

SEQ ID NO: 46621 - DNA, 15 bp, Homo sapiens
ggtagggttggatga

SEQ ID NO: 46622 - DNA, 15 bp, Homo sapiens
aggtagggttggatg

SEQ ID NO: 46623 - DNA, 15 bp, Homo sapiens
caggtagggttggat

SEQ ID NO: 46624 - DNA, 15 bp, Homo sapiens
tcaggtagggttgga

SEQ ID NO: 46625 - DNA, 15 bp, Homo sapiens
ttcaggtagggttgg

SEQ ID NO: 46626 - DNA, 15 bp, Homo sapiens
attcaggtagggttg

SEQ ID NO: 46627 - DNA, 15 bp, Homo sapiens
cattcaggtagggtt

SEQ ID NO: 46628 - DNA, 15 bp, Homo sapiens
tcattcaggtagggt

SEQ ID NO: 46629 - DNA, 15 bp, Homo sapiens
ctcattcaggtaggg

SEQ ID NO: 46630 - DNA, 15 bp, Homo sapiens
gctcattcaggtagg

SEQ ID NO: 46631 - DNA, 15 bp, Homo sapiens
agctcattcaggtag

SEQ ID NO: 46632 - DNA, 15 bp, Homo sapiens
aagctcattcaggta

SEQ ID NO: 46633 - DNA, 15 bp, Homo sapiens
aaagctcattcaggt

SEQ ID NO: 46634 - DNA, 15 bp, Homo sapiens
aaaagctcattcagg

SEQ ID NO: 46635 - DNA, 15 bp, Homo sapiens
aaaaagctcattcag

SEQ ID NO: 46636 - DNA, 15 bp, Homo sapiens
taaaaagctcattca

SEQ ID NO: 46637 - DNA, 15 bp, Homo sapiens
ttaaaaagctcattc

SEQ ID NO: 46638 - DNA, 15 bp, Homo sapiens
attaaaaagctcatt

SEQ ID NO: 46639 - DNA, 15 bp, Homo sapiens
aattaaaaagctcat

SEQ ID NO: 46640 - DNA, 15 bp, Homo sapiens
taattaaaaagctca

SEQ ID NO: 46641 - DNA, 15 bp, Homo sapiens
ttaattaaaaagctc

SEQ ID NO: 46642 - DNA, 15 bp, Homo sapiens
tttaattaaaaagct

SEQ ID NO: 46643 - DNA, 15 bp, Homo sapiens
ttttaattaaaaagc

SEQ ID NO: 46644 - DNA, 15 bp, Homo sapiens
tttttaattaaaaag

SEQ ID NO: 46645 - DNA, 15 bp, Homo sapiens
ttttttaattaaaaa

SEQ ID NO: 46646 - DNA, 15 bp, Homo sapiens
attttttaattaaaa

SEQ ID NO: 46647 - DNA, 15 bp, Homo sapiens
aattttttaattaaa

SEQ ID NO: 46648 - DNA, 15 bp, Homo sapiens
gaattttttaattaa

SEQ ID NO: 46649 - DNA, 15 bp, Homo sapiens
tgaattttttaatta

SEQ ID NO: 46650 - DNA, 15 bp, Homo sapiens
atgaattttttaatt

SEQ ID NO: 46651 - DNA, 15 bp, Homo sapiens
aatgaattttttaat

SEQ ID NO: 46652 - DNA, 15 bp, Homo sapiens
taatgaattttttaa

SEQ ID NO: 46653 - DNA, 15 bp, Homo sapiens
ctaatgaatttttta

SEQ ID NO: 46654 - DNA, 15 bp, Homo sapiens
actaatgaatttttt

SEQ ID NO: 46655 - DNA, 15 bp, Homo sapiens
tactaatgaattttt

SEQ ID NO: 46656 - DNA, 15 bp, Homo sapiens
ttactaatgaatttt

SEQ ID NO: 46657 - DNA, 15 bp, Homo sapiens
cttactaatgaattt

SEQ ID NO: 46658 - DNA, 15 bp, Homo sapiens
ccttactaatgaatt

SEQ ID NO: 46659 - DNA, 15 bp, Homo sapiens
gccttactaatgaat

SEQ ID NO: 46660 - DNA, 15 bp, Homo sapiens
agccttactaatgaa

SEQ ID NO: 46661 - DNA, 15 bp, Homo sapiens
cagccttactaatga

SEQ ID NO: 46662 - DNA, 15 bp, Homo sapiens
ccagccttactaatg

SEQ ID NO: 46663 - DNA, 15 bp, Homo sapiens
cccagccttactaat

SEQ ID NO: 46664 - DNA, 15 bp, Homo sapiens
tcccagccttactaa

SEQ ID NO: 46665 - DNA, 15 bp, Homo sapiens
ctcccagccttacta

SEQ ID NO: 46666 - DNA, 15 bp, Homo sapiens
gctcccagccttact

SEQ ID NO: 46667 - DNA, 15 bp, Homo sapiens
tgctcccagccttac

SEQ ID NO: 46668 - DNA, 15 bp, Homo sapiens
ctgctcccagcctta

SEQ ID NO: 46669 - DNA, 15 bp, Homo sapiens
actgctcccagcctt

SEQ ID NO: 46670 - DNA, 15 bp, Homo sapiens
cactgctcccagcct

SEQ ID NO: 46671 - DNA, 15 bp, Homo sapiens
ccactgctcccagcc

SEQ ID NO: 46672 - DNA, 15 bp, Homo sapiens
accactgctcccagc

SEQ ID NO: 46673 - DNA, 15 bp, Homo sapiens
aaccactgctcccag

SEQ ID NO: 46674 - DNA, 15 bp, Homo sapiens
gaaccactgctccca

SEQ ID NO: 46675 - DNA, 15 bp, Homo sapiens
tgaaccactgctccc

SEQ ID NO: 46676 - DNA, 15 bp, Homo sapiens
atgaaccactgctcc

SEQ ID NO: 46677 - DNA, 15 bp, Homo sapiens
catgaaccactgctc

SEQ ID NO: 46678 - DNA, 15 bp, Homo sapiens
gcatgaaccactgct

SEQ ID NO: 46679 - DNA, 15 bp, Homo sapiens
agcatgaaccactgc

SEQ ID NO: 46680 - DNA, 15 bp, Homo sapiens
aagcatgaaccactg

SEQ ID NO: 46681 - DNA, 15 bp, Homo sapiens
caagcatgaaccact

SEQ ID NO: 46682 - DNA, 15 bp, Homo sapiens
acaagcatgaaccac

SEQ ID NO: 46683 - DNA, 15 bp, Homo sapiens
aacaagcatgaacca

SEQ ID NO: 46684 - DNA, 15 bp, Homo sapiens
taacaagcatgaacc

SEQ ID NO: 46685 - DNA, 15 bp, Homo sapiens
ataacaagcatgaac

SEQ ID NO: 46686 - DNA, 15 bp, Homo sapiens
gataacaagcatgaa

SEQ ID NO: 46687 - DNA, 15 bp, Homo sapiens
ggataacaagcatga

SEQ ID NO: 46688 - DNA, 15 bp, Homo sapiens
gggataacaagcatg

SEQ ID NO: 46689 - DNA, 15 bp, Homo sapiens
tgggataacaagcat

SEQ ID NO: 46690 - DNA, 15 bp, Homo sapiens
ctgggataacaagca

SEQ ID NO: 46691 - DNA, 15 bp, Homo sapiens
gctgggataacaagc

SEQ ID NO: 46692 - DNA, 15 bp, Homo sapiens
tgctgggataacaag

SEQ ID NO: 46693 - DNA, 15 bp, Homo sapiens
gtgctgggataacaa

SEQ ID NO: 46694 - DNA, 15 bp, Homo sapiens
agtgctgggataaca

SEQ ID NO: 46695 - DNA, 15 bp, Homo sapiens
aagtgctgggataac

SEQ ID NO: 46696 - DNA, 15 bp, Homo sapiens
aaagtgctgggataa

SEQ ID NO: 46697 - DNA, 15 bp, Homo sapiens
caaagtgctgggata

SEQ ID NO: 46698 - DNA, 15 bp, Homo sapiens
acaaagtgctgggat

SEQ ID NO: 46699 - DNA, 15 bp, Homo sapiens
cacaaagtgctggga

SEQ ID NO: 46700 - DNA, 15 bp, Homo sapiens
acacaaagtgctggg

SEQ ID NO: 46701 - DNA, 15 bp, Homo sapiens
cacacaaagtgctgg

SEQ ID NO: 46702 - DNA, 15 bp, Homo sapiens
ccacacaaagtgctg

SEQ ID NO: 46703 - DNA, 15 bp, Homo sapiens
accacacaaagtgct

SEQ ID NO: 46704 - DNA, 15 bp, Homo sapiens
caccacacaaagtgc

SEQ ID NO: 46705 - DNA, 15 bp, Homo sapiens
acaccacacaaagtg

SEQ ID NO: 46706 - DNA, 15 bp, Homo sapiens
tacaccacacaaagt

SEQ ID NO: 46707 - DNA, 15 bp, Homo sapiens
ctacaccacacaaag

SEQ ID NO: 46708 - DNA, 15 bp, Homo sapiens
cctacaccacacaaa

SEQ ID NO: 46709 - DNA, 15 bp, Homo sapiens
gcctacaccacacaa

SEQ ID NO: 46710 - DNA, 15 bp, Homo sapiens
cgcctacaccacaca

SEQ ID NO: 46711 - DNA, 15 bp, Homo sapiens
ccgcctacaccacac

SEQ ID NO: 46712 - DNA, 15 bp, Homo sapiens
cccgcctacaccaca

SEQ ID NO: 46713 - DNA, 15 bp, Homo sapiens
gcccgcctacaccac

SEQ ID NO: 46714 - DNA, 15 bp, Homo sapiens
cgcccgcctacacca

SEQ ID NO: 46715 - DNA, 15 bp, Homo sapiens
ccgcccgcctacacc

SEQ ID NO: 46716 - DNA, 15 bp, Homo sapiens
tccgcccgcctacac

SEQ ID NO: 46717 - DNA, 15 bp, Homo sapiens
gtccgcccgcctaca

SEQ ID NO: 46718 - DNA, 15 bp, Homo sapiens
agtccgcccgcctac

SEQ ID NO: 46719 - DNA, 15 bp, Homo sapiens
cagtccgcccgccta

SEQ ID NO: 46720 - DNA, 15 bp, Homo sapiens
gcagtccgcccgcct

SEQ ID NO: 46721 - DNA, 15 bp, Homo sapiens
agcagtccgcccgcc

SEQ ID NO: 46722 - DNA, 15 bp, Homo sapiens
aagcagtccgcccgc

SEQ ID NO: 46723 - DNA, 15 bp, Homo sapiens
caagcagtccgcccg

SEQ ID NO: 46724 - DNA, 15 bp, Homo sapiens
tcaagcagtccgccc

SEQ ID NO: 46725 - DNA, 15 bp, Homo sapiens
ctcaagcagtccgcc

SEQ ID NO: 46726 - DNA, 15 bp, Homo sapiens
gctcaagcagtccgc

SEQ ID NO: 46727 - DNA, 15 bp, Homo sapiens
ggctcaagcagtccg

SEQ ID NO: 46728 - DNA, 15 bp, Homo sapiens
ggggctcaagcagtc

SEQ ID NO: 46729 - DNA, 15 bp, Homo sapiens
cggggctcaagcagt

SEQ ID NO: 46730 - DNA, 15 bp, Homo sapiens
ccggggctcaagcag

SEQ ID NO: 46731 - DNA, 15 bp, Homo sapiens
tccggggctcaagca

SEQ ID NO: 46732 - DNA, 15 bp, Homo sapiens
ctccggggctcaagc

SEQ ID NO: 46733 - DNA, 15 bp, Homo sapiens
actccggggctcaag

SEQ ID NO: 46734 - DNA, 15 bp, Homo sapiens
aactccggggctcaa

SEQ ID NO: 46735 - DNA, 15 bp, Homo sapiens
gaactccggggctca

SEQ ID NO: 46736 - DNA, 15 bp, Homo sapiens
cgaactccggggctc

SEQ ID NO: 46737 - DNA, 15 bp, Homo sapiens
tcgaactccggggct

SEQ ID NO: 46738 - DNA, 15 bp, Homo sapiens
ctcgaactccggggc

SEQ ID NO: 46739 - DNA, 15 bp, Homo sapiens
tctcgaactccgggg

SEQ ID NO: 46740 - DNA, 15 bp, Homo sapiens
gtctcgaactccggg

SEQ ID NO: 46741 - DNA, 15 bp, Homo sapiens
ggtctcgaactccgg

SEQ ID NO: 46742 - DNA, 15 bp, Homo sapiens
tggtctcgaactccg

SEQ ID NO: 46743 - DNA, 15 bp, Homo sapiens
tggctggtctcgaac

SEQ ID NO: 46744 - DNA, 15 bp, Homo sapiens
ctggctggtctcgaa

SEQ ID NO: 46745 - DNA, 15 bp, Homo sapiens
cctggctggtctcga

SEQ ID NO: 46746 - DNA, 15 bp, Homo sapiens
ccctggctggtctcg

SEQ ID NO: 46747 - DNA, 15 bp, Homo sapiens
gccctggctggtctc

SEQ ID NO: 46748 - DNA, 15 bp, Homo sapiens
tgccctggctggtct

SEQ ID NO: 46749 - DNA, 15 bp, Homo sapiens
ttgccctggctggtc

SEQ ID NO: 46750 - DNA, 15 bp, Homo sapiens
gttgccctggctggt

SEQ ID NO: 46751 - DNA, 15 bp, Homo sapiens
tgttgccctggctgg

SEQ ID NO: 46752 - DNA, 15 bp, Homo sapiens
atgttgccctggctg

SEQ ID NO: 46753 - DNA, 15 bp, Homo sapiens
catgttgccctggct

SEQ ID NO: 46754 - DNA, 15 bp, Homo sapiens
ccatgttgccctggc

SEQ ID NO: 46755 - DNA, 15 bp, Homo sapiens
gccatgttgccctgg

SEQ ID NO: 46756 - DNA, 15 bp, Homo sapiens
cgccatgttgccctg

SEQ ID NO: 46757 - DNA, 15 bp, Homo sapiens
tcgccatgttgccct

SEQ ID NO: 46758 - DNA, 15 bp, Homo sapiens
ttcgccatgttgccc

SEQ ID NO: 46759 - DNA, 15 bp, Homo sapiens
tttcgccatgttgcc

SEQ ID NO: 46760 - DNA, 15 bp, Homo sapiens
gtttcgccatgttgc

SEQ ID NO: 46761 - DNA, 15 bp, Homo sapiens
ggtttcgccatgttg

SEQ ID NO: 46762 - DNA, 15 bp, Homo sapiens
aggtttcgccatgtt

SEQ ID NO: 46763 - DNA, 15 bp, Homo sapiens
gaggtttcgccatgt

SEQ ID NO: 46764 - DNA, 15 bp, Homo sapiens
cgaggtttcgccatg

SEQ ID NO: 46765 - DNA, 15 bp, Homo sapiens
acgaggtttcgccat

SEQ ID NO: 46766 - DNA, 15 bp, Homo sapiens
cacgaggtttcgcca

SEQ ID NO: 46767 - DNA, 15 bp, Homo sapiens
acacgaggtttcgcc

SEQ ID NO: 46768 - DNA, 15 bp, Homo sapiens
gacacgaggtttcgc

SEQ ID NO: 46769 - DNA, 15 bp, Homo sapiens
agacacgaggtttcg

SEQ ID NO: 46770 - DNA, 15 bp, Homo sapiens
tagacacgaggtttc

SEQ ID NO: 46771 - DNA, 15 bp, Homo sapiens
gtagacacgaggttt

SEQ ID NO: 46772 - DNA, 15 bp, Homo sapiens
tgtagacacgaggtt

SEQ ID NO: 46773 - DNA, 15 bp, Homo sapiens
ctgtagacacgaggt

SEQ ID NO: 46774 - DNA, 15 bp, Homo sapiens
tctgtagacacgagg

SEQ ID NO: 46775 - DNA, 15 bp, Homo sapiens
ttctgtagacacgag

SEQ ID NO: 46776 - DNA, 15 bp, Homo sapiens
tttctgtagacacga

SEQ ID NO: 46777 - DNA, 15 bp, Homo sapiens
ttttctgtagacacg

SEQ ID NO: 46778 - DNA, 15 bp, Homo sapiens
tttttctgtagacac

SEQ ID NO: 46779 - DNA, 15 bp, Homo sapiens
atttttctgtagaca

SEQ ID NO: 46780 - DNA, 15 bp, Homo sapiens
tatttttctgtagac

SEQ ID NO: 46781 - DNA, 15 bp, Homo sapiens
gtatttttctgtaga

SEQ ID NO: 46782 - DNA, 15 bp, Homo sapiens
tgtatttttctgtag

SEQ ID NO: 46783 - DNA, 15 bp, Homo sapiens
ttgtatttttctgta

SEQ ID NO: 46784 - DNA, 15 bp, Homo sapiens
tttgtatttttctgt

SEQ ID NO: 46785 - DNA, 15 bp, Homo sapiens
ttttgtatttttctg

SEQ ID NO: 46786 - DNA, 15 bp, Homo sapiens
tttttgtatttttct

SEQ ID NO: 46787 - DNA, 15 bp, Homo sapiens
atttttgtatttttc

SEQ ID NO: 46788 - DNA, 15 bp, Homo sapiens
ggctaatttttgtat

SEQ ID NO: 46789 - DNA, 15 bp, Homo sapiens
tggctaatttttgta

SEQ ID NO: 46790 - DNA, 15 bp, Homo sapiens
ctggctaatttttgt

SEQ ID NO: 46791 - DNA, 15 bp, Homo sapiens
cctggctaatttttg

SEQ ID NO: 46792 - DNA, 15 bp, Homo sapiens
acatgcctggctaat

SEQ ID NO: 46793 - DNA, 15 bp, Homo sapiens
aacatgcctggctaa

SEQ ID NO: 46794 - DNA, 15 bp, Homo sapiens
caacatgcctggcta

SEQ ID NO: 46795 - DNA, 15 bp, Homo sapiens
ccaacatgcctggct

SEQ ID NO: 46796 - DNA, 15 bp, Homo sapiens
gccaacatgcctggc

SEQ ID NO: 46797 - DNA, 15 bp, Homo sapiens
tgccaacatgcctgg

SEQ ID NO: 46798 - DNA, 15 bp, Homo sapiens
gtgccaacatgcctg

SEQ ID NO: 46799 - DNA, 15 bp, Homo sapiens
tgtgccaacatgcct

SEQ ID NO: 46800 - DNA, 15 bp, Homo sapiens
atgtgccaacatgcc

SEQ ID NO: 46801 - DNA, 15 bp, Homo sapiens
catgtgccaacatgc

SEQ ID NO: 46802 - DNA, 15 bp, Homo sapiens
gcatgtgccaacatg

SEQ ID NO: 46803 - DNA, 15 bp, Homo sapiens
ggcatgtgccaacat

SEQ ID NO: 46804 - DNA, 15 bp, Homo sapiens
gggcatgtgccaaca

SEQ ID NO: 46805 - DNA, 15 bp, Homo sapiens
agggcatgtgccaac

SEQ ID NO: 46806 - DNA, 15 bp, Homo sapiens
gagggcatgtgccaa

SEQ ID NO: 46807 - DNA, 15 bp, Homo sapiens
ggagggcatgtgcca

SEQ ID NO: 46808 - DNA, 15 bp, Homo sapiens
tggagggcatgtgcc

SEQ ID NO: 46809 - DNA, 15 bp, Homo sapiens
ctggagggcatgtgc

SEQ ID NO: 46810 - DNA, 15 bp, Homo sapiens
cctggagggcatgtg

SEQ ID NO: 46811 - DNA, 15 bp, Homo sapiens
acctggagggcatgt

SEQ ID NO: 46812 - DNA, 15 bp, Homo sapiens
tacctggagggcatg

SEQ ID NO: 46813 - DNA, 15 bp, Homo sapiens
gtacctggagggcat

SEQ ID NO: 46814 - DNA, 15 bp, Homo sapiens
ggtacctggagggca

SEQ ID NO: 46815 - DNA, 15 bp, Homo sapiens
aggtacctggagggc

SEQ ID NO: 46816 - DNA, 15 bp, Homo sapiens
caggtacctggaggg

SEQ ID NO: 46817 - DNA, 15 bp, Homo sapiens
ccaggtacctggagg

SEQ ID NO: 46818 - DNA, 15 bp, Homo sapiens
cccaggtacctggag

SEQ ID NO: 46819 - DNA, 15 bp, Homo sapiens
tcccaggtacctgga

SEQ ID NO: 46820 - DNA, 15 bp, Homo sapiens
ctcccaggtacctgg

SEQ ID NO: 46821 - DNA, 15 bp, Homo sapiens
cctcccaggtacctg

SEQ ID NO: 46822 - DNA, 15 bp, Homo sapiens
gcctcccaggtacct

SEQ ID NO: 46823 - DNA, 15 bp, Homo sapiens
tgcctcccaggtacc

SEQ ID NO: 46824 - DNA, 15 bp, Homo sapiens
ctgcctcccaggtac

SEQ ID NO: 46825 - DNA, 15 bp, Homo sapiens
tctgcctcccaggta

SEQ ID NO: 46826 - DNA, 15 bp, Homo sapiens
cacctctgcctccca

SEQ ID NO: 46827 - DNA, 15 bp, Homo sapiens
ccacctctgcctccc

SEQ ID NO: 46828 - DNA, 15 bp, Homo sapiens
cccacctctgcctcc

SEQ ID NO: 46829 - DNA, 15 bp, Homo sapiens
tcccacctctgcctc

SEQ ID NO: 46830 - DNA, 15 bp, Homo sapiens
tctcccacctctgcc

SEQ ID NO: 46831 - DNA, 15 bp, Homo sapiens
ttctcccacctctgc

SEQ ID NO: 46832 - DNA, 15 bp, Homo sapiens
attctcccacctctg

SEQ ID NO: 46833 - DNA, 15 bp, Homo sapiens
gattctcccacctct

SEQ ID NO: 46834 - DNA, 15 bp, Homo sapiens
cgattctcccacctc

SEQ ID NO: 46835 - DNA, 15 bp, Homo sapiens
gcgattctcccacct

SEQ ID NO: 46836 - DNA, 15 bp, Homo sapiens
agcgattctcccacc

SEQ ID NO: 46837 - DNA, 15 bp, Homo sapiens
aagcgattctcccac

SEQ ID NO: 46838 - DNA, 15 bp, Homo sapiens
caagcgattctccca

SEQ ID NO: 46839 - DNA, 15 bp, Homo sapiens
tcaagcgattctccc

SEQ ID NO: 46840 - DNA, 15 bp, Homo sapiens
ctcaagcgattctcc

SEQ ID NO: 46841 - DNA, 15 bp, Homo sapiens
gctcaagcgattctc

SEQ ID NO: 46842 - DNA, 15 bp, Homo sapiens
ggctcaagcgattct

SEQ ID NO: 46843 - DNA, 15 bp, Homo sapiens
aggctcaagcgattc

SEQ ID NO: 46844 - DNA, 15 bp, Homo sapiens
gaggctcaagcgatt

SEQ ID NO: 46845 - DNA, 15 bp, Homo sapiens
cgaggctcaagcgat

SEQ ID NO: 46846 - DNA, 15 bp, Homo sapiens
ccgaggctcaagcga

SEQ ID NO: 46847 - DNA, 15 bp, Homo sapiens
tccgaggctcaagcg

SEQ ID NO: 46848 - DNA, 15 bp, Homo sapiens
ttccgaggctcaagc

SEQ ID NO: 46849 - DNA, 15 bp, Homo sapiens
cttccgaggctcaag

SEQ ID NO: 46850 - DNA, 15 bp, Homo sapiens
acttccgaggctcaa

SEQ ID NO: 46851 - DNA, 15 bp, Homo sapiens
aacttccgaggctca

SEQ ID NO: 46852 - DNA, 15 bp, Homo sapiens
caacttccgaggctc

SEQ ID NO: 46853 - DNA, 15 bp, Homo sapiens
tcaacttccgaggct

SEQ ID NO: 46854 - DNA, 15 bp, Homo sapiens
ttcaacttccgaggc

SEQ ID NO: 46855 - DNA, 15 bp, Homo sapiens
cttcaacttccgagg

SEQ ID NO: 46856 - DNA, 15 bp, Homo sapiens
ccttcaacttccgag

SEQ ID NO: 46857 - DNA, 15 bp, Homo sapiens
gccttcaacttccga

SEQ ID NO: 46858 - DNA, 15 bp, Homo sapiens
agccttcaacttccg

SEQ ID NO: 46859 - DNA, 15 bp, Homo sapiens
cagccttcaacttcc

SEQ ID NO: 46860 - DNA, 15 bp, Homo sapiens
gcagccttcaacttc

SEQ ID NO: 46861 - DNA, 15 bp, Homo sapiens
tgcagccttcaactt

SEQ ID NO: 46862 - DNA, 15 bp, Homo sapiens
ctgcagccttcaact

SEQ ID NO: 46863 - DNA, 15 bp, Homo sapiens
actgcagccttcaac

SEQ ID NO: 46864 - DNA, 15 bp, Homo sapiens
cactgcagccttcaa

SEQ ID NO: 46865 - DNA, 15 bp, Homo sapiens
tcactgcagccttca

SEQ ID NO: 46866 - DNA, 15 bp, Homo sapiens
ctcactgcagccttc

SEQ ID NO: 46867 - DNA, 15 bp, Homo sapiens
ggctcactgcagcct

SEQ ID NO: 46868 - DNA, 15 bp, Homo sapiens
cggctcactgcagcc

SEQ ID NO: 46869 - DNA, 15 bp, Homo sapiens
acggctcactgcagc

SEQ ID NO: 46870 - DNA, 15 bp, Homo sapiens
cacggctcactgcag

SEQ ID NO: 46871 - DNA, 15 bp, Homo sapiens
tcacggctcactgca

SEQ ID NO: 46872 - DNA, 15 bp, Homo sapiens
atcacggctcactgc

SEQ ID NO: 46873 - DNA, 15 bp, Homo sapiens
gatcacggctcactg

SEQ ID NO: 46874 - DNA, 15 bp, Homo sapiens
tgatcacggctcact

SEQ ID NO: 46875 - DNA, 15 bp, Homo sapiens
atgatcacggctcac

SEQ ID NO: 46876 - DNA, 15 bp, Homo sapiens
tatgatcacggctca

SEQ ID NO: 46877 - DNA, 15 bp, Homo sapiens
gtatgatcacggctc

SEQ ID NO: 46878 - DNA, 15 bp, Homo sapiens
agtatgatcacggct

SEQ ID NO: 46879 - DNA, 15 bp, Homo sapiens
tagtatgatcacggc

SEQ ID NO: 46880 - DNA, 15 bp, Homo sapiens
gtagtatgatcacgg

SEQ ID NO: 46881 - DNA, 15 bp, Homo sapiens
agtagtatgatcacg

SEQ ID NO: 46882 - DNA, 15 bp, Homo sapiens
cagtagtatgatcac

SEQ ID NO: 46883 - DNA, 15 bp, Homo sapiens
gcagtagtatgatca

SEQ ID NO: 46884 - DNA, 15 bp, Homo sapiens
tgcagtagtatgatc

SEQ ID NO: 46885 - DNA, 15 bp, Homo sapiens
gtgcagtagtatgat

SEQ ID NO: 46886 - DNA, 15 bp, Homo sapiens
agtgcagtagtatga

SEQ ID NO: 46887 - DNA, 15 bp, Homo sapiens
gagtgcagtagtatg

SEQ ID NO: 46888 - DNA, 15 bp, Homo sapiens
tgagtgcagtagtat

SEQ ID NO: 46889 - DNA, 15 bp, Homo sapiens
ttgagtgcagtagta

SEQ ID NO: 46890 - DNA, 15 bp, Homo sapiens
cttgagtgcagtagt

SEQ ID NO: 46891 - DNA, 15 bp, Homo sapiens
gcttgagtgcagtag

SEQ ID NO: 46892 - DNA, 15 bp, Homo sapiens
ggcttgagtgcagta

SEQ ID NO: 46893 - DNA, 15 bp, Homo sapiens
aggcttgagtgcagt

SEQ ID NO: 46894 - DNA, 15 bp, Homo sapiens
taggcttgagtgcag

SEQ ID NO: 46895 - DNA, 15 bp, Homo sapiens
ctaggcttgagtgca

SEQ ID NO: 46896 - DNA, 15 bp, Homo sapiens
cctaggcttgagtgc

SEQ ID NO: 46897 - DNA, 15 bp, Homo sapiens
acctaggcttgagtg

SEQ ID NO: 46898 - DNA, 15 bp, Homo sapiens
cacctaggcttgagt

SEQ ID NO: 46899 - DNA, 15 bp, Homo sapiens
tcacctaggcttgag

SEQ ID NO: 46900 - DNA, 15 bp, Homo sapiens
gtcacctaggcttga

SEQ ID NO: 46901 - DNA, 15 bp, Homo sapiens
tgtcacctaggcttg

SEQ ID NO: 46902 - DNA, 15 bp, Homo sapiens
ctgtcacctaggctt

SEQ ID NO: 46903 - DNA, 15 bp, Homo sapiens
tctgtcacctaggct

SEQ ID NO: 46904 - DNA, 15 bp, Homo sapiens
ctctgtcacctaggc

SEQ ID NO: 46905 - DNA, 15 bp, Homo sapiens
actctgtcacctagg

SEQ ID NO: 46906 - DNA, 15 bp, Homo sapiens
cactctgtcacctag

SEQ ID NO: 46907 - DNA, 15 bp, Homo sapiens
tcactctgtcaccta

SEQ ID NO: 46908 - DNA, 15 bp, Homo sapiens
ctcactctgtcacct

SEQ ID NO: 46909 - DNA, 15 bp, Homo sapiens
gtttgtttgagacag

SEQ ID NO: 46910 - DNA, 15 bp, Homo sapiens
tgtttgtttgagaca

SEQ ID NO: 46911 - DNA, 15 bp, Homo sapiens
ttgtttgtttgagac

SEQ ID NO: 46912 - DNA, 15 bp, Homo sapiens
tttgtttgtttgaga

SEQ ID NO: 46913 - DNA, 15 bp, Homo sapiens
gtttgtttgtttgag

SEQ ID NO: 46914 - DNA, 15 bp, Homo sapiens
tgtttgtttgtttga

SEQ ID NO: 46915 - DNA, 15 bp, Homo sapiens
ctttttgtttgtttg

SEQ ID NO: 46916 - DNA, 15 bp, Homo sapiens
actttttgtttgttt

SEQ ID NO: 46917 - DNA, 15 bp, Homo sapiens
tactttttgtttgtt

SEQ ID NO: 46918 - DNA, 15 bp, Homo sapiens
atactttttgtttgt

SEQ ID NO: 46919 - DNA, 15 bp, Homo sapiens
aatactttttgtttg

SEQ ID NO: 46920 - DNA, 15 bp, Homo sapiens
taatactttttgttt

SEQ ID NO: 46921 - DNA, 15 bp, Homo sapiens
ctaatactttttgtt

SEQ ID NO: 46922 - DNA, 15 bp, Homo sapiens
actaatactttttgt

SEQ ID NO: 46923 - DNA, 15 bp, Homo sapiens
tactaatactttttg

SEQ ID NO: 46924 - DNA, 15 bp, Homo sapiens
ctactaatacttttt

SEQ ID NO: 46925 - DNA, 15 bp, Homo sapiens
actactaatactttt

SEQ ID NO: 46926 - DNA, 15 bp, Homo sapiens
aactactaatacttt

SEQ ID NO: 46927 - DNA, 15 bp, Homo sapiens
aaactactaatactt

SEQ ID NO: 46928 - DNA, 15 bp, Homo sapiens
taaactactaatact

SEQ ID NO: 46929 - DNA, 15 bp, Homo sapiens
ataaactactaatac

SEQ ID NO: 46930 - DNA, 15 bp, Homo sapiens
cataaactactaata

SEQ ID NO: 46931 - DNA, 15 bp, Homo sapiens
acataaactactaat

SEQ ID NO: 46932 - DNA, 15 bp, Homo sapiens
cacataaactactaa

SEQ ID NO: 46933 - DNA, 15 bp, Homo sapiens
tcacataaactacta

SEQ ID NO: 46934 - DNA, 15 bp, Homo sapiens
ttcacataaactact

SEQ ID NO: 46935 - DNA, 15 bp, Homo sapiens
gttcacataaactac

SEQ ID NO: 46936 - DNA, 15 bp, Homo sapiens
ggttcacataaacta

SEQ ID NO: 46937 - DNA, 15 bp, Homo sapiens
aggttcacataaact

SEQ ID NO: 46938 - DNA, 15 bp, Homo sapiens
aaggttcacataaac

SEQ ID NO: 46939 - DNA, 15 bp, Homo sapiens
aaaggttcacataaa

SEQ ID NO: 46940 - DNA, 15 bp, Homo sapiens
aaaaggttcacataa

SEQ ID NO: 46941 - DNA, 15 bp, Homo sapiens
gaaaaggttcacata

SEQ ID NO: 46942 - DNA, 15 bp, Homo sapiens
tgaaaaggttcacat

SEQ ID NO: 46943 - DNA, 15 bp, Homo sapiens
atgaaaaggttcaca

SEQ ID NO: 46944 - DNA, 15 bp, Homo sapiens
tatgaaaaggttcac

SEQ ID NO: 46945 - DNA, 15 bp, Homo sapiens
ctatgaaaaggttca

SEQ ID NO: 46946 - DNA, 15 bp, Homo sapiens
actatgaaaaggttc

SEQ ID NO: 46947 - DNA, 15 bp, Homo sapiens
aactatgaaaaggtt

SEQ ID NO: 46948 - DNA, 15 bp, Homo sapiens
taactatgaaaaggt

SEQ ID NO: 46949 - DNA, 15 bp, Homo sapiens
ataactatgaaaagg

SEQ ID NO: 46950 - DNA, 15 bp, Homo sapiens
cataactatgaaaag

SEQ ID NO: 46951 - DNA, 15 bp, Homo sapiens
tcataactatgaaaa

SEQ ID NO: 46952 - DNA, 15 bp, Homo sapiens
ttcataactatgaaa

SEQ ID NO: 46953 - DNA, 15 bp, Homo sapiens
tttcataactatgaa

SEQ ID NO: 46954 - DNA, 15 bp, Homo sapiens
ttttcataactatga

SEQ ID NO: 46955 - DNA, 15 bp, Homo sapiens
attttcataactatg

SEQ ID NO: 46956 - DNA, 15 bp, Homo sapiens
aattttcataactat

SEQ ID NO: 46957 - DNA, 15 bp, Homo sapiens
taattttcataacta

SEQ ID NO: 46958 - DNA, 15 bp, Homo sapiens
ttaattttcataact

SEQ ID NO: 46959 - DNA, 15 bp, Homo sapiens
tttaattttcataac

SEQ ID NO: 46960 - DNA, 15 bp, Homo sapiens
ttttaattttcataa

SEQ ID NO: 46961 - DNA, 15 bp, Homo sapiens
atttttaattttcat

SEQ ID NO: 46962 - DNA, 15 bp, Homo sapiens
tatttttaattttca

SEQ ID NO: 46963 - DNA, 15 bp, Homo sapiens
ttatttttaattttc

SEQ ID NO: 46964 - DNA, 15 bp, Homo sapiens
cttatttttaatttt

SEQ ID NO: 46965 - DNA, 15 bp, Homo sapiens
tcttatttttaattt

SEQ ID NO: 46966 - DNA, 15 bp, Homo sapiens
ttcttatttttaatt

SEQ ID NO: 46967 - DNA, 15 bp, Homo sapiens
attcttatttttaat

SEQ ID NO: 46968 - DNA, 15 bp, Homo sapiens
tattcttatttttaa

SEQ ID NO: 46969 - DNA, 15 bp, Homo sapiens
atattcttattttta

SEQ ID NO: 46970 - DNA, 15 bp, Homo sapiens
catattcttattttt

SEQ ID NO: 46971 - DNA, 15 bp, Homo sapiens
acatattcttatttt

SEQ ID NO: 46972 - DNA, 15 bp, Homo sapiens
tacatattcttattt

SEQ ID NO: 46973 - DNA, 15 bp, Homo sapiens
atacatattcttatt

SEQ ID NO: 46974 - DNA, 15 bp, Homo sapiens
aatacatattcttat

SEQ ID NO: 46975 - DNA, 15 bp, Homo sapiens
aaatacatattctta

SEQ ID NO: 46976 - DNA, 15 bp, Homo sapiens
aaaatacatattctt

SEQ ID NO: 46977 - DNA, 15 bp, Homo sapiens
aaaaatacatattct

SEQ ID NO: 46978 - DNA, 15 bp, Homo sapiens
gaaaaatacatattc

SEQ ID NO: 46979 - DNA, 15 bp, Homo sapiens
tgaaaaatacatatt

SEQ ID NO: 46980 - DNA, 15 bp, Homo sapiens
ttgaaaaatacatat

SEQ ID NO: 46981 - DNA, 15 bp, Homo sapiens
attgaaaaatacata

SEQ ID NO: 46982 - DNA, 15 bp, Homo sapiens
tattgaaaaatacat

SEQ ID NO: 46983 - DNA, 15 bp, Homo sapiens
atattgaaaaataca

SEQ ID NO: 46984 - DNA, 15 bp, Homo sapiens
catattgaaaaatac

SEQ ID NO: 46985 - DNA, 15 bp, Homo sapiens
tcatattgaaaaata

SEQ ID NO: 46986 - DNA, 15 bp, Homo sapiens
ctcatattgaaaaat

SEQ ID NO: 46987 - DNA, 15 bp, Homo sapiens
tctcatattgaaaaa

SEQ ID NO: 46988 - DNA, 15 bp, Homo sapiens
gtctcatattgaaaa

SEQ ID NO: 46989 - DNA, 15 bp, Homo sapiens
agtctcatattgaaa

SEQ ID NO: 46990 - DNA, 15 bp, Homo sapiens
tagtctcatattgaa

SEQ ID NO: 46991 - DNA, 15 bp, Homo sapiens
ttagtctcatattga

SEQ ID NO: 46992 - DNA, 15 bp, Homo sapiens
tttagtctcatattg

SEQ ID NO: 46993 - DNA, 15 bp, Homo sapiens
gtttagtctcatatt

SEQ ID NO: 46994 - DNA, 15 bp, Homo sapiens
ggtttagtctcatat

SEQ ID NO: 46995 - DNA, 15 bp, Homo sapiens
aggtttagtctcata

SEQ ID NO: 46996 - DNA, 15 bp, Homo sapiens
aaggtttagtctcat

SEQ ID NO: 46997 - DNA, 15 bp, Homo sapiens
aaaggtttagtctca

SEQ ID NO: 46998 - DNA, 15 bp, Homo sapiens
gaaaggtttagtctc

SEQ ID NO: 46999 - DNA, 15 bp, Homo sapiens
tgaaaggtttagtct

SEQ ID NO: 47000 - DNA, 15 bp, Homo sapiens
ttgaaaggtttagtc

SEQ ID NO: 47001 - DNA, 15 bp, Homo sapiens
attgaaaggtttagt

SEQ ID NO: 47002 - DNA, 15 bp, Homo sapiens
aattgaaaggtttag

SEQ ID NO: 47003 - DNA, 15 bp, Homo sapiens
taattgaaaggttta

SEQ ID NO: 47004 - DNA, 15 bp, Homo sapiens
ataattgaaaggttt

SEQ ID NO: 47005 - DNA, 15 bp, Homo sapiens
aataattgaaaggtt

SEQ ID NO: 47006 - DNA, 15 bp, Homo sapiens
aaataattgaaaggt

SEQ ID NO: 47007 - DNA, 15 bp, Homo sapiens
aaaataattgaaagg

SEQ ID NO: 47008 - DNA, 15 bp, Homo sapiens
taaaataattgaaag

SEQ ID NO: 47009 - DNA, 15 bp, Homo sapiens
ataaaataattgaaa

SEQ ID NO: 47010 - DNA, 15 bp, Homo sapiens
aataaaataattgaa

SEQ ID NO: 47011 - DNA, 15 bp, Homo sapiens
aaataaaataattga

SEQ ID NO: 47012 - DNA, 15 bp, Homo sapiens
taaataaaataattg

SEQ ID NO: 47013 - DNA, 15 bp, Homo sapiens
ataaataaaataatt

SEQ ID NO: 47014 - DNA, 15 bp, Homo sapiens
aataaataaaataat

SEQ ID NO: 47015 - DNA, 15 bp, Homo sapiens
taataaataaaataa

SEQ ID NO: 47016 - DNA, 15 bp, Homo sapiens
ttaataaataaaata

SEQ ID NO: 47017 - DNA, 15 bp, Homo sapiens
gttaataaataaaat

SEQ ID NO: 47018 - DNA, 15 bp, Homo sapiens
agttaataaataaaa

SEQ ID NO: 47019 - DNA, 15 bp, Homo sapiens
aagttaataaataaa

SEQ ID NO: 47020 - DNA, 15 bp, Homo sapiens
gaagttaataaataa

SEQ ID NO: 47021 - DNA, 15 bp, Homo sapiens
ggaagttaataaata

SEQ ID NO: 47022 - DNA, 15 bp, Homo sapiens
tggaagttaataaat

SEQ ID NO: 47023 - DNA, 15 bp, Homo sapiens
ttggaagttaataaa

SEQ ID NO: 47024 - DNA, 15 bp, Homo sapiens
attggaagttaataa

SEQ ID NO: 47025 - DNA, 15 bp, Homo sapiens
aattggaagttaata

SEQ ID NO: 47026 - DNA, 15 bp, Homo sapiens
aaattggaagttaat

SEQ ID NO: 47027 - DNA, 15 bp, Homo sapiens
taaattggaagttaa

SEQ ID NO: 47028 - DNA, 15 bp, Homo sapiens
ataaattggaagtta

SEQ ID NO: 47029 - DNA, 15 bp, Homo sapiens
tataaattggaagtt

SEQ ID NO: 47030 - DNA, 15 bp, Homo sapiens
gtataaattggaagt

SEQ ID NO: 47031 - DNA, 15 bp, Homo sapiens
ggtataaattggaag

SEQ ID NO: 47032 - DNA, 15 bp, Homo sapiens
gggtataaattggaa

SEQ ID NO: 47033 - DNA, 15 bp, Homo sapiens
agggtataaattgga

SEQ ID NO: 47034 - DNA, 15 bp, Homo sapiens
aagggtataaattgg

SEQ ID NO: 47035 - DNA, 15 bp, Homo sapiens
aaagggtataaattg

SEQ ID NO: 47036 - DNA, 15 bp, Homo sapiens
aaaagggtataaatt

SEQ ID NO: 47037 - DNA, 15 bp, Homo sapiens
taaaagggtataaat

SEQ ID NO: 47038 - DNA, 15 bp, Homo sapiens
ctaaaagggtataaa

SEQ ID NO: 47039 - DNA, 15 bp, Homo sapiens
cctaaaagggtataa

SEQ ID NO: 47040 - DNA, 15 bp, Homo sapiens
gcctaaaagggtata

SEQ ID NO: 47041 - DNA, 15 bp, Homo sapiens
tgcctaaaagggtat

SEQ ID NO: 47042 - DNA, 15 bp, Homo sapiens
ttgcctaaaagggta

SEQ ID NO: 47043 - DNA, 15 bp, Homo sapiens
tttgcctaaaagggt

SEQ ID NO: 47044 - DNA, 15 bp, Homo sapiens
ctttgcctaaaaggg

SEQ ID NO: 47045 - DNA, 15 bp, Homo sapiens
tctttgcctaaaagg

SEQ ID NO: 47046 - DNA, 15 bp, Homo sapiens
ctctttgcctaaaag

SEQ ID NO: 47047 - DNA, 15 bp, Homo sapiens
actctttgcctaaaa

SEQ ID NO: 47048 - DNA, 15 bp, Homo sapiens
aactctttgcctaaa

SEQ ID NO: 47049 - DNA, 15 bp, Homo sapiens
gaactctttgcctaa

SEQ ID NO: 47050 - DNA, 15 bp, Homo sapiens
agaactctttgccta

SEQ ID NO: 47051 - DNA, 15 bp, Homo sapiens
cagaactctttgcct

SEQ ID NO: 47052 - DNA, 15 bp, Homo sapiens
acagaactctttgcc

SEQ ID NO: 47053 - DNA, 15 bp, Homo sapiens
cacagaactctttgc

SEQ ID NO: 47054 - DNA, 15 bp, Homo sapiens
tcacagaactctttg

SEQ ID NO: 47055 - DNA, 15 bp, Homo sapiens
atcacagaactcttt

SEQ ID NO: 47056 - DNA, 15 bp, Homo sapiens
aatcacagaactctt

SEQ ID NO: 47057 - DNA, 15 bp, Homo sapiens
aaatcacagaactct

SEQ ID NO: 47058 - DNA, 15 bp, Homo sapiens
taaatcacagaactc

SEQ ID NO: 47059 - DNA, 15 bp, Homo sapiens
ataaatcacagaact

SEQ ID NO: 47060 - DNA, 15 bp, Homo sapiens
cataaatcacagaac

SEQ ID NO: 47061 - DNA, 15 bp, Homo sapiens
ccataaatcacagaa

SEQ ID NO: 47062 - DNA, 15 bp, Homo sapiens
cccataaatcacaga

SEQ ID NO: 47063 - DNA, 15 bp, Homo sapiens
gcccataaatcacag

SEQ ID NO: 47064 - DNA, 15 bp, Homo sapiens
ggcccataaatcaca

SEQ ID NO: 47065 - DNA, 15 bp, Homo sapiens
tggcccataaatcac

SEQ ID NO: 47066 - DNA, 15 bp, Homo sapiens
ttggcccataaatca

SEQ ID NO: 47067 - DNA, 15 bp, Homo sapiens
attggcccataaatc

SEQ ID NO: 47068 - DNA, 15 bp, Homo sapiens
aattggcccataaat

SEQ ID NO: 47069 - DNA, 15 bp, Homo sapiens
aaattggcccataaa

SEQ ID NO: 47070 - DNA, 15 bp, Homo sapiens
aaaattggcccataa

SEQ ID NO: 47071 - DNA, 15 bp, Homo sapiens
aaaaattggcccata

SEQ ID NO: 47072 - DNA, 15 bp, Homo sapiens
taaaaattggcccat

SEQ ID NO: 47073 - DNA, 15 bp, Homo sapiens
ttaaaaattggccca

SEQ ID NO: 47074 - DNA, 15 bp, Homo sapiens
tttaaaaattggccc

SEQ ID NO: 47075 - DNA, 15 bp, Homo sapiens
gtttaaaaattggcc

SEQ ID NO: 47076 - DNA, 15 bp, Homo sapiens
agtttaaaaattggc

SEQ ID NO: 47077 - DNA, 15 bp, Homo sapiens
cagtttaaaaattgg

SEQ ID NO: 47078 - DNA, 15 bp, Homo sapiens
acagtttaaaaattg

SEQ ID NO: 47079 - DNA, 15 bp, Homo sapiens
cacagtttaaaaatt

SEQ ID NO: 47080 - DNA, 15 bp, Homo sapiens
tcacagtttaaaaat

SEQ ID NO: 47081 - DNA, 15 bp, Homo sapiens
atcacagtttaaaaa

SEQ ID NO: 47082 - DNA, 15 bp, Homo sapiens
catcacagtttaaaa

SEQ ID NO: 47083 - DNA, 15 bp, Homo sapiens
acatcacagtttaaa

SEQ ID NO: 47084 - DNA, 15 bp, Homo sapiens
gacatcacagtttaa

SEQ ID NO: 47085 - DNA, 15 bp, Homo sapiens
ggacatcacagttta

SEQ ID NO: 47086 - DNA, 15 bp, Homo sapiens
tggacatcacagttt

SEQ ID NO: 47087 - DNA, 15 bp, Homo sapiens
atggacatcacagtt

SEQ ID NO: 47088 - DNA, 15 bp, Homo sapiens
catggacatcacagt

SEQ ID NO: 47089 - DNA, 15 bp, Homo sapiens
ccatggacatcacag

SEQ ID NO: 47090 - DNA, 15 bp, Homo sapiens
cccatggacatcaca

SEQ ID NO: 47091 - DNA, 15 bp, Homo sapiens
tcccatggacatcac

SEQ ID NO: 47092 - DNA, 15 bp, Homo sapiens
ttcccatggacatca

SEQ ID NO: 47093 - DNA, 15 bp, Homo sapiens
cttcccatggacatc

SEQ ID NO: 47094 - DNA, 15 bp, Homo sapiens
tcttcccatggacat

SEQ ID NO: 47095 - DNA, 15 bp, Homo sapiens
ttcttcccatggaca

SEQ ID NO: 47096 - DNA, 15 bp, Homo sapiens
tttcttcccatggac

SEQ ID NO: 47097 - DNA, 15 bp, Homo sapiens
atttcttcccatgga

SEQ ID NO: 47098 - DNA, 15 bp, Homo sapiens
aatttcttcccatgg

SEQ ID NO: 47099 - DNA, 15 bp, Homo sapiens
aaatttcttcccatg

SEQ ID NO: 47100 - DNA, 15 bp, Homo sapiens
aaaatttcttcccat

SEQ ID NO: 47101 - DNA, 15 bp, Homo sapiens
aaaaatttcttccca

SEQ ID NO: 47102 - DNA, 15 bp, Homo sapiens
taaaaatttcttccc

SEQ ID NO: 47103 - DNA, 15 bp, Homo sapiens
ctaaaaatttcttcc

SEQ ID NO: 47104 - DNA, 15 bp, Homo sapiens
gctaaaaatttcttc

SEQ ID NO: 47105 - DNA, 15 bp, Homo sapiens
ggctaaaaatttctt

SEQ ID NO: 47106 - DNA, 15 bp, Homo sapiens
gggctaaaaatttct

SEQ ID NO: 47107 - DNA, 15 bp, Homo sapiens
agggctaaaaatttc

SEQ ID NO: 47108 - DNA, 15 bp, Homo sapiens
cagggctaaaaattt

SEQ ID NO: 47109 - DNA, 15 bp, Homo sapiens
tcagggctaaaaatt

SEQ ID NO: 47110 - DNA, 15 bp, Homo sapiens
ctcagggctaaaaat

SEQ ID NO: 47111 - DNA, 15 bp, Homo sapiens
actcagggctaaaaa

SEQ ID NO: 47112 - DNA, 15 bp, Homo sapiens
aactcagggctaaaa

SEQ ID NO: 47113 - DNA, 15 bp, Homo sapiens
aaactcagggctaaa

SEQ ID NO: 47114 - DNA, 15 bp, Homo sapiens
aaaactcagggctaa

SEQ ID NO: 47115 - DNA, 15 bp, Homo sapiens
caaaactcagggcta

SEQ ID NO: 47116 - DNA, 15 bp, Homo sapiens
tcaaaactcagggct

SEQ ID NO: 47117 - DNA, 15 bp, Homo sapiens
ttcaaaactcagggc

SEQ ID NO: 47118 - DNA, 15 bp, Homo sapiens
cttcaaaactcaggg

SEQ ID NO: 47119 - DNA, 15 bp, Homo sapiens
ccttcaaaactcagg

SEQ ID NO: 47120 - DNA, 15 bp, Homo sapiens
cccttcaaaactcag

SEQ ID NO: 47121 - DNA, 15 bp, Homo sapiens
ccccttcaaaactca

SEQ ID NO: 47122 - DNA, 15 bp, Homo sapiens
tccccttcaaaactc

SEQ ID NO: 47123 - DNA, 15 bp, Homo sapiens
ttccccttcaaaact

SEQ ID NO: 47124 - DNA, 15 bp, Homo sapiens
attccccttcaaaac

SEQ ID NO: 47125 - DNA, 15 bp, Homo sapiens
cattccccttcaaaa

SEQ ID NO: 47126 - DNA, 15 bp, Homo sapiens
gcattccccttcaaa

SEQ ID NO: 47127 - DNA, 15 bp, Homo sapiens
tgcattccccttcaa

SEQ ID NO: 47128 - DNA, 15 bp, Homo sapiens
ctgcattccccttca

SEQ ID NO: 47129 - DNA, 15 bp, Homo sapiens
actgcattccccttc

SEQ ID NO: 47130 - DNA, 15 bp, Homo sapiens
cactgcattcccctt

SEQ ID NO: 47131 - DNA, 15 bp, Homo sapiens
acactgcattcccct

SEQ ID NO: 47132 - DNA, 15 bp, Homo sapiens
aacactgcattcccc

SEQ ID NO: 47133 - DNA, 15 bp, Homo sapiens
gaacactgcattccc

SEQ ID NO: 47134 - DNA, 15 bp, Homo sapiens
ggaacactgcattcc

SEQ ID NO: 47135 - DNA, 15 bp, Homo sapiens
aggaacactgcattc

SEQ ID NO: 47136 - DNA, 15 bp, Homo sapiens
aaggaacactgcatt

SEQ ID NO: 47137 - DNA, 15 bp, Homo sapiens
aaaggaacactgcat

SEQ ID NO: 47138 - DNA, 15 bp, Homo sapiens
gaaaggaacactgca

SEQ ID NO: 47139 - DNA, 15 bp, Homo sapiens
agaaaggaacactgc

SEQ ID NO: 47140 - DNA, 15 bp, Homo sapiens
cagaaaggaacactg

SEQ ID NO: 47141 - DNA, 15 bp, Homo sapiens
tcagaaaggaacact

SEQ ID NO: 47142 - DNA, 15 bp, Homo sapiens
gtcagaaaggaacac

SEQ ID NO: 47143 - DNA, 15 bp, Homo sapiens
agtcagaaaggaaca

SEQ ID NO: 47144 - DNA, 15 bp, Homo sapiens
aagtcagaaaggaac

SEQ ID NO: 47145 - DNA, 15 bp, Homo sapiens
caagtcagaaaggaa

SEQ ID NO: 47146 - DNA, 15 bp, Homo sapiens
acaagtcagaaagga

SEQ ID NO: 47147 - DNA, 15 bp, Homo sapiens
aacaagtcagaaagg

SEQ ID NO: 47148 - DNA, 15 bp, Homo sapiens
aaacaagtcagaaag

SEQ ID NO: 47149 - DNA, 15 bp, Homo sapiens
aaaacaagtcagaaa

SEQ ID NO: 47150 - DNA, 15 bp, Homo sapiens
aaaaacaagtcagaa

SEQ ID NO: 47151 - DNA, 15 bp, Homo sapiens
gaaaaacaagtcaga

SEQ ID NO: 47152 - DNA, 15 bp, Homo sapiens
ggaaaaacaagtcag

SEQ ID NO: 47153 - DNA, 15 bp, Homo sapiens
aggaaaaacaagtca

SEQ ID NO: 47154 - DNA, 15 bp, Homo sapiens
caggaaaaacaagtc

SEQ ID NO: 47155 - DNA, 15 bp, Homo sapiens
gcaggaaaaacaagt

SEQ ID NO: 47156 - DNA, 15 bp, Homo sapiens
agcaggaaaaacaag

SEQ ID NO: 47157 - DNA, 15 bp, Homo sapiens
aagcaggaaaaacaa

SEQ ID NO: 47158 - DNA, 15 bp, Homo sapiens
taagcaggaaaaaca

SEQ ID NO: 47159 - DNA, 15 bp, Homo sapiens
ataagcaggaaaaac

SEQ ID NO: 47160 - DNA, 15 bp, Homo sapiens
aataagcaggaaaaa

SEQ ID NO: 47161 - DNA, 15 bp, Homo sapiens
taataagcaggaaaa

SEQ ID NO: 47162 - DNA, 15 bp, Homo sapiens
ataataagcaggaaa

SEQ ID NO: 47163 - DNA, 15 bp, Homo sapiens
tataataagcaggaa

SEQ ID NO: 47164 - DNA, 15 bp, Homo sapiens
ttataataagcagga

SEQ ID NO: 47165 - DNA, 15 bp, Homo sapiens
tttataataagcagg

SEQ ID NO: 47166 - DNA, 15 bp, Homo sapiens
atttataataagcag

SEQ ID NO: 47167 - DNA, 15 bp, Homo sapiens
tatttataataagca

SEQ ID NO: 47168 - DNA, 15 bp, Homo sapiens
atatttataataagc

SEQ ID NO: 47169 - DNA, 15 bp, Homo sapiens
aatatttataataag

SEQ ID NO: 47170 - DNA, 15 bp, Homo sapiens
aaatatttataataa

SEQ ID NO: 47171 - DNA, 15 bp, Homo sapiens
taaatatttataata

SEQ ID NO: 47172 - DNA, 15 bp, Homo sapiens
ataaatatttataat

SEQ ID NO: 47173 - DNA, 15 bp, Homo sapiens
gataaatatttataa

SEQ ID NO: 47174 - DNA, 15 bp, Homo sapiens
agataaatatttata

SEQ ID NO: 47175 - DNA, 15 bp, Homo sapiens
aagataaatatttat

SEQ ID NO: 47176 - DNA, 15 bp, Homo sapiens
caagataaatattta

SEQ ID NO: 47177 - DNA, 15 bp, Homo sapiens
ccaagataaatattt

SEQ ID NO: 47178 - DNA, 15 bp, Homo sapiens
tccaagataaatatt

SEQ ID NO: 47179 - DNA, 15 bp, Homo sapiens
gtccaagataaatat

SEQ ID NO: 47180 - DNA, 15 bp, Homo sapiens
tgtccaagataaata

SEQ ID NO: 47181 - DNA, 15 bp, Homo sapiens
ttgtccaagataaat

SEQ ID NO: 47182 - DNA, 15 bp, Homo sapiens
tttgtccaagataaa

SEQ ID NO: 47183 - DNA, 15 bp, Homo sapiens
ctttgtccaagataa

SEQ ID NO: 47184 - DNA, 15 bp, Homo sapiens
cctttgtccaagata

SEQ ID NO: 47185 - DNA, 15 bp, Homo sapiens
tcctttgtccaagat

SEQ ID NO: 47186 - DNA, 15 bp, Homo sapiens
atcctttgtccaaga

SEQ ID NO: 47187 - DNA, 15 bp, Homo sapiens
aatcctttgtccaag

SEQ ID NO: 47188 - DNA, 15 bp, Homo sapiens
caatcctttgtccaa

SEQ ID NO: 47189 - DNA, 15 bp, Homo sapiens
gcaatcctttgtcca

SEQ ID NO: 47190 - DNA, 15 bp, Homo sapiens
tgcaatcctttgtcc

SEQ ID NO: 47191 - DNA, 15 bp, Homo sapiens
atgcaatcctttgtc

SEQ ID NO: 47192 - DNA, 15 bp, Homo sapiens
aatgcaatcctttgt

SEQ ID NO: 47193 - DNA, 15 bp, Homo sapiens
aaatgcaatcctttg

SEQ ID NO: 47194 - DNA, 15 bp, Homo sapiens
aaaatgcaatccttt

SEQ ID NO: 47195 - DNA, 15 bp, Homo sapiens
taaaatgcaatcctt

SEQ ID NO: 47196 - DNA, 15 bp, Homo sapiens
ctaaaatgcaatcct

SEQ ID NO: 47197 - DNA, 15 bp, Homo sapiens
gctaaaatgcaatcc

SEQ ID NO: 47198 - DNA, 15 bp, Homo sapiens
cgctaaaatgcaatc

SEQ ID NO: 47199 - DNA, 15 bp, Homo sapiens
ccgctaaaatgcaat

SEQ ID NO: 47200 - DNA, 15 bp, Homo sapiens
tccgctaaaatgcaa

SEQ ID NO: 47201 - DNA, 15 bp, Homo sapiens
atccgctaaaatgca

SEQ ID NO: 47202 - DNA, 15 bp, Homo sapiens
catccgctaaaatgc

SEQ ID NO: 47203 - DNA, 15 bp, Homo sapiens
acatccgctaaaatg

SEQ ID NO: 47204 - DNA, 15 bp, Homo sapiens
cacatccgctaaaat

SEQ ID NO: 47205 - DNA, 15 bp, Homo sapiens
gcacatccgctaaaa

SEQ ID NO: 47206 - DNA, 15 bp, Homo sapiens
tgcacatccgctaaa

SEQ ID NO: 47207 - DNA, 15 bp, Homo sapiens
ttgcacatccgctaa

SEQ ID NO: 47208 - DNA, 15 bp, Homo sapiens
attgcacatccgcta

SEQ ID NO: 47209 - DNA, 15 bp, Homo sapiens
aattgcacatccgct

SEQ ID NO: 47210 - DNA, 15 bp, Homo sapiens
aaattgcacatccgc

SEQ ID NO: 47211 - DNA, 15 bp, Homo sapiens
aaaattgcacatccg

SEQ ID NO: 47212 - DNA, 15 bp, Homo sapiens
taaaattgcacatcc

SEQ ID NO: 47213 - DNA, 15 bp, Homo sapiens
gtaaaattgcacatc

SEQ ID NO: 47214 - DNA, 15 bp, Homo sapiens
tgtaaaattgcacat

SEQ ID NO: 47215 - DNA, 15 bp, Homo sapiens
ttgtaaaattgcaca

SEQ ID NO: 47216 - DNA, 15 bp, Homo sapiens
tttgtaaaattgcac

SEQ ID NO: 47217 - DNA, 15 bp, Homo sapiens
atttgtaaaattgca

SEQ ID NO: 47218 - DNA, 15 bp, Homo sapiens
aatttgtaaaattgc

SEQ ID NO: 47219 - DNA, 15 bp, Homo sapiens
aaatttgtaaaattg

SEQ ID NO: 47220 - DNA, 15 bp, Homo sapiens
taaatttgtaaaatt

SEQ ID NO: 47221 - DNA, 15 bp, Homo sapiens
ttaaatttgtaaaat

SEQ ID NO: 47222 - DNA, 15 bp, Homo sapiens
attaaatttgtaaaa

SEQ ID NO: 47223 - DNA, 15 bp, Homo sapiens
aattaaatttgtaaa

SEQ ID NO: 47224 - DNA, 15 bp, Homo sapiens
taattaaatttgtaa

SEQ ID NO: 47225 - DNA, 15 bp, Homo sapiens
ataattaaatttgta

SEQ ID NO: 47226 - DNA, 15 bp, Homo sapiens
aataattaaatttgt

SEQ ID NO: 47227 - DNA, 15 bp, Homo sapiens
taataattaaatttg

SEQ ID NO: 47228 - DNA, 15 bp, Homo sapiens
ttaataattaaattt

SEQ ID NO: 47229 - DNA, 15 bp, Homo sapiens
tttaataattaaatt

SEQ ID NO: 47230 - DNA, 15 bp, Homo sapiens
ttttaataattaaat

SEQ ID NO: 47231 - DNA, 15 bp, Homo sapiens
attttaataattaaa

SEQ ID NO: 47232 - DNA, 15 bp, Homo sapiens
cattttaataattaa

SEQ ID NO: 47233 - DNA, 15 bp, Homo sapiens
tcattttaataatta

SEQ ID NO: 47234 - DNA, 15 bp, Homo sapiens
gtcattttaataatt

SEQ ID NO: 47235 - DNA, 15 bp, Homo sapiens
agtcattttaataat

SEQ ID NO: 47236 - DNA, 15 bp, Homo sapiens
gagtcattttaataa

SEQ ID NO: 47237 - DNA, 15 bp, Homo sapiens
agagtcattttaata

SEQ ID NO: 47238 - DNA, 15 bp, Homo sapiens
aagagtcattttaat

SEQ ID NO: 47239 - DNA, 15 bp, Homo sapiens
gaagagtcattttaa

SEQ ID NO: 47240 - DNA, 15 bp, Homo sapiens
agaagagtcatttta

SEQ ID NO: 47241 - DNA, 15 bp, Homo sapiens
aagaagagtcatttt

SEQ ID NO: 47242 - DNA, 15 bp, Homo sapiens
gaagaagagtcattt

SEQ ID NO: 47243 - DNA, 15 bp, Homo sapiens
ggaagaagagtcatt

SEQ ID NO: 47244 - DNA, 15 bp, Homo sapiens
aggaagaagagtcat

SEQ ID NO: 47245 - DNA, 15 bp, Homo sapiens
aaggaagaagagtca

SEQ ID NO: 47246 - DNA, 15 bp, Homo sapiens
aaaggaagaagagtc

SEQ ID NO: 47247 - DNA, 15 bp, Homo sapiens
aaaaggaagaagagt

SEQ ID NO: 47248 - DNA, 15 bp, Homo sapiens
aaaaaggaagaagag

SEQ ID NO: 47249 - DNA, 15 bp, Homo sapiens
aaaaaaggaagaaga

SEQ ID NO: 47250 - DNA, 15 bp, Homo sapiens
aaaaaaaggaagaag

SEQ ID NO: 47251 - DNA, 15 bp, Homo sapiens
taaaaaaaggaagaa

SEQ ID NO: 47252 - DNA, 15 bp, Homo sapiens
ataaaaaaaggaaga

SEQ ID NO: 47253 - DNA, 15 bp, Homo sapiens
cataaaaaaaggaag

SEQ ID NO: 47254 - DNA, 15 bp, Homo sapiens
tcataaaaaaaggaa

SEQ ID NO: 47255 - DNA, 15 bp, Homo sapiens
atcataaaaaaagga

SEQ ID NO: 47256 - DNA, 15 bp, Homo sapiens
gatcataaaaaaagg

SEQ ID NO: 47257 - DNA, 15 bp, Homo sapiens
agatcataaaaaaag

SEQ ID NO: 47258 - DNA, 15 bp, Homo sapiens
aagatcataaaaaaa

SEQ ID NO: 47259 - DNA, 15 bp, Homo sapiens
taagatcataaaaaa

SEQ ID NO: 47260 - DNA, 15 bp, Homo sapiens
gtaagatcataaaaa

SEQ ID NO: 47261 - DNA, 15 bp, Homo sapiens
tgtaagatcataaaa

SEQ ID NO: 47262 - DNA, 15 bp, Homo sapiens
atgtaagatcataaa

SEQ ID NO: 47263 - DNA, 15 bp, Homo sapiens
aatgtaagatcataa

SEQ ID NO: 47264 - DNA, 15 bp, Homo sapiens
aaatgtaagatcata

SEQ ID NO: 47265 - DNA, 15 bp, Homo sapiens
aaaatgtaagatcat

SEQ ID NO: 47266 - DNA, 15 bp, Homo sapiens
caaaatgtaagatca

SEQ ID NO: 47267 - DNA, 15 bp, Homo sapiens
acaaaatgtaagatc

SEQ ID NO: 47268 - DNA, 15 bp, Homo sapiens
aacaaaatgtaagat

SEQ ID NO: 47269 - DNA, 15 bp, Homo sapiens
aaacaaaatgtaaga

SEQ ID NO: 47270 - DNA, 15 bp, Homo sapiens
aaaacaaaatgtaag

SEQ ID NO: 47271 - DNA, 15 bp, Homo sapiens
aaaaacaaaatgtaa

SEQ ID NO: 47272 - DNA, 15 bp, Homo sapiens
taaaaacaaaatgta

SEQ ID NO: 47273 - DNA, 15 bp, Homo sapiens
ttaaaaacaaaatgt

SEQ ID NO: 47274 - DNA, 15 bp, Homo sapiens
gttaaaaacaaaatg

SEQ ID NO: 47275 - DNA, 15 bp, Homo sapiens
agttaaaaacaaaat

SEQ ID NO: 47276 - DNA, 15 bp, Homo sapiens
aagttaaaaacaaaa

SEQ ID NO: 47277 - DNA, 15 bp, Homo sapiens
caagttaaaaacaaa

SEQ ID NO: 47278 - DNA, 15 bp, Homo sapiens
acaagttaaaaacaa

SEQ ID NO: 47279 - DNA, 15 bp, Homo sapiens
gacaagttaaaaaca

SEQ ID NO: 47280 - DNA, 15 bp, Homo sapiens
tgacaagttaaaaac

SEQ ID NO: 47281 - DNA, 15 bp, Homo sapiens
atgacaagttaaaaa

SEQ ID NO: 47282 - DNA, 15 bp, Homo sapiens
catgacaagttaaaa

SEQ ID NO: 47283 - DNA, 15 bp, Homo sapiens
ccatgacaagttaaa

SEQ ID NO: 47284 - DNA, 15 bp, Homo sapiens
gccatgacaagttaa

SEQ ID NO: 47285 - DNA, 15 bp, Homo sapiens
cgccatgacaagtta

SEQ ID NO: 47286 - DNA, 15 bp, Homo sapiens
ccgccatgacaagtt

SEQ ID NO: 47287 - DNA, 15 bp, Homo sapiens
tccgccatgacaagt

SEQ ID NO: 47288 - DNA, 15 bp, Homo sapiens
atccgccatgacaag

SEQ ID NO: 47289 - DNA, 15 bp, Homo sapiens
tatccgccatgacaa

SEQ ID NO: 47290 - DNA, 15 bp, Homo sapiens
atatccgccatgaca

SEQ ID NO: 47291 - DNA, 15 bp, Homo sapiens
aatatccgccatgac

SEQ ID NO: 47292 - DNA, 15 bp, Homo sapiens
taatatccgccatga

SEQ ID NO: 47293 - DNA, 15 bp, Homo sapiens
ttaatatccgccatg

SEQ ID NO: 47294 - DNA, 15 bp, Homo sapiens
tttaatatccgccat

SEQ ID NO: 47295 - DNA, 15 bp, Homo sapiens
ttttaatatccgcca

SEQ ID NO: 47296 - DNA, 15 bp, Homo sapiens
gttttaatatccgcc

SEQ ID NO: 47297 - DNA, 15 bp, Homo sapiens
tgttttaatatccgc

SEQ ID NO: 47298 - DNA, 15 bp, Homo sapiens
gtgttttaatatccg

SEQ ID NO: 47299 - DNA, 15 bp, Homo sapiens
agtgttttaatatcc

SEQ ID NO: 47300 - DNA, 15 bp, Homo sapiens
gagtgttttaatatc

SEQ ID NO: 47301 - DNA, 15 bp, Homo sapiens
ggagtgttttaatat

SEQ ID NO: 47302 - DNA, 15 bp, Homo sapiens
tggagtgttttaata

SEQ ID NO: 47303 - DNA, 15 bp, Homo sapiens
ttggagtgttttaat

SEQ ID NO: 47304 - DNA, 15 bp, Homo sapiens
tttggagtgttttaa

SEQ ID NO: 47305 - DNA, 15 bp, Homo sapiens
atttggagtgtttta

SEQ ID NO: 47306 - DNA, 15 bp, Homo sapiens
tatttggagtgtttt

SEQ ID NO: 47307 - DNA, 15 bp, Homo sapiens
ttatttggagtgttt

SEQ ID NO: 47308 - DNA, 15 bp, Homo sapiens
tttatttggagtgtt

SEQ ID NO: 47309 - DNA, 15 bp, Homo sapiens
ctttatttggagtgt

SEQ ID NO: 47310 - DNA, 15 bp, Homo sapiens
tctttatttggagtg

SEQ ID NO: 47311 - DNA, 15 bp, Homo sapiens
gtctttatttggagt

SEQ ID NO: 47312 - DNA, 15 bp, Homo sapiens
tgtctttatttggag

SEQ ID NO: 47313 - DNA, 15 bp, Homo sapiens
ttgtctttatttgga

SEQ ID NO: 47314 - DNA, 15 bp, Homo sapiens
tttgtctttatttgg

SEQ ID NO: 47315 - DNA, 15 bp, Homo sapiens
ttttgtctttatttg

SEQ ID NO: 47316 - DNA, 15 bp, Homo sapiens
tttttgtctttattt

SEQ ID NO: 47317 - DNA, 15 bp, Homo sapiens
ttttttgtctttatt

SEQ ID NO: 47318 - DNA, 15 bp, Homo sapiens
tttttttgtctttat

SEQ ID NO: 47319 - DNA, 15 bp, Homo sapiens
gtttttttgtcttta

SEQ ID NO: 47320 - DNA, 15 bp, Homo sapiens
agtttttttgtcttt

SEQ ID NO: 47321 - DNA, 15 bp, Homo sapiens
gagtttttttgtctt

SEQ ID NO: 47322 - DNA, 15 bp, Homo sapiens
tgagtttttttgtct

SEQ ID NO: 47323 - DNA, 15 bp, Homo sapiens
ttgagtttttttgtc

SEQ ID NO: 47324 - DNA, 15 bp, Homo sapiens
attgagtttttttgt

SEQ ID NO: 47325 - DNA, 15 bp, Homo sapiens
tattgagtttttttg

SEQ ID NO: 47326 - DNA, 15 bp, Homo sapiens
atattgagttttttt

SEQ ID NO: 47327 - DNA, 15 bp, Homo sapiens
tatattgagtttttt

SEQ ID NO: 47328 - DNA, 15 bp, Homo sapiens
ttatattgagttttt

SEQ ID NO: 47329 - DNA, 15 bp, Homo sapiens
tttatattgagtttt

SEQ ID NO: 47330 - DNA, 15 bp, Homo sapiens
ttttatattgagttt

SEQ ID NO: 47331 - DNA, 15 bp, Homo sapiens
tttttatattgagtt

SEQ ID NO: 47332 - DNA, 15 bp, Homo sapiens
ttttttatattgagt

SEQ ID NO: 47333 - DNA, 15 bp, Homo sapiens
tttttttatattgag

SEQ ID NO: 47334 - DNA, 15 bp, Homo sapiens
ttttttttatattga

SEQ ID NO: 47335 - DNA, 15 bp, Homo sapiens
tttttttttatattg

SEQ ID NO: 47336 - DNA, 15 bp, Homo sapiens
gtttttttttatatt

SEQ ID NO: 47337 - DNA, 15 bp, Homo sapiens
ggtttttttttatat

SEQ ID NO: 47338 - DNA, 15 bp, Homo sapiens
tggtttttttttata

SEQ ID NO: 47339 - DNA, 15 bp, Homo sapiens
ttggtttttttttat

SEQ ID NO: 47340 - DNA, 15 bp, Homo sapiens
tttggttttttttta

SEQ ID NO: 47341 - DNA, 15 bp, Homo sapiens
ttttggttttttttt

SEQ ID NO: 47342 - DNA, 15 bp, Homo sapiens
tttttggtttttttt

SEQ ID NO: 47343 - DNA, 15 bp, Homo sapiens
gtttttggttttttt

SEQ ID NO: 47344 - DNA, 15 bp, Homo sapiens
ggtttttggtttttt

SEQ ID NO: 47345 - DNA, 15 bp, Homo sapiens
tggtttttggttttt

SEQ ID NO: 47346 - DNA, 15 bp, Homo sapiens
gtggtttttggtttt

SEQ ID NO: 47347 - DNA, 15 bp, Homo sapiens
agtggtttttggttt

SEQ ID NO: 47348 - DNA, 15 bp, Homo sapiens
aagtggtttttggtt

SEQ ID NO: 47349 - DNA, 15 bp, Homo sapiens
gaagtggtttttggt

SEQ ID NO: 47350 - DNA, 15 bp, Homo sapiens
ggaagtggtttttgg

SEQ ID NO: 47351 - DNA, 15 bp, Homo sapiens
cggaagtggtttttg

SEQ ID NO: 47352 - DNA, 15 bp, Homo sapiens
tcggaagtggttttt

SEQ ID NO: 47353 - DNA, 15 bp, Homo sapiens
ttcggaagtggtttt

SEQ ID NO: 47354 - DNA, 15 bp, Homo sapiens
tttcggaagtggttt

SEQ ID NO: 47355 - DNA, 15 bp, Homo sapiens
atttcggaagtggtt

SEQ ID NO: 47356 - DNA, 15 bp, Homo sapiens
tatttcggaagtggt

SEQ ID NO: 47357 - DNA, 15 bp, Homo sapiens
gtatttcggaagtgg

SEQ ID NO: 47358 - DNA, 15 bp, Homo sapiens
agtatttcggaagtg

SEQ ID NO: 47359 - DNA, 15 bp, Homo sapiens
gagtatttcggaagt

SEQ ID NO: 47360 - DNA, 15 bp, Homo sapiens
ggagtatttcggaag

SEQ ID NO: 47361 - DNA, 15 bp, Homo sapiens
tggagtatttcggaa

SEQ ID NO: 47362 - DNA, 15 bp, Homo sapiens
atggagtatttcgga

SEQ ID NO: 47363 - DNA, 15 bp, Homo sapiens
aatggagtatttcgg

SEQ ID NO: 47364 - DNA, 15 bp, Homo sapiens
aaatggagtatttcg

SEQ ID NO: 47365 - DNA, 15 bp, Homo sapiens
aaaatggagtatttc

SEQ ID NO: 47366 - DNA, 15 bp, Homo sapiens
aaaaatggagtattt

SEQ ID NO: 47367 - DNA, 15 bp, Homo sapiens
aaaaaatggagtatt

SEQ ID NO: 47368 - DNA, 15 bp, Homo sapiens
gaaaaaatggagtat

SEQ ID NO: 47369 - DNA, 15 bp, Homo sapiens
agaaaaaatggagta

SEQ ID NO: 47370 - DNA, 15 bp, Homo sapiens
aagaaaaaatggagt

SEQ ID NO: 47371 - DNA, 15 bp, Homo sapiens
taagaaaaaatggag

SEQ ID NO: 47372 - DNA, 15 bp, Homo sapiens
ataagaaaaaatgga

SEQ ID NO: 47373 - DNA, 15 bp, Homo sapiens
aaataagaaaaaatg

SEQ ID NO: 47374 - DNA, 15 bp, Homo sapiens
taaataagaaaaaat

SEQ ID NO: 47375 - DNA, 15 bp, Homo sapiens
ttaaataagaaaaaa

SEQ ID NO: 47376 - DNA, 15 bp, Homo sapiens
tttaaataagaaaaa

SEQ ID NO: 47377 - DNA, 15 bp, Homo sapiens
ttttaaataagaaaa

SEQ ID NO: 47378 - DNA, 15 bp, Homo sapiens
tttttaaataagaaa

SEQ ID NO: 47379 - DNA, 15 bp, Homo sapiens
ttttttaaataagaa

SEQ ID NO: 47380 - DNA, 15 bp, Homo sapiens
tttttttaaataaga

SEQ ID NO: 47381 - DNA, 15 bp, Homo sapiens
atttttttaaataag

SEQ ID NO: 47382 - DNA, 15 bp, Homo sapiens
catttttttaaataa

SEQ ID NO: 47383 - DNA, 15 bp, Homo sapiens
gcatttttttaaata

SEQ ID NO: 47384 - DNA, 15 bp, Homo sapiens
agcatttttttaaat

SEQ ID NO: 47385 - DNA, 15 bp, Homo sapiens
tagcatttttttaaa

SEQ ID NO: 47386 - DNA, 15 bp, Homo sapiens
atagcatttttttaa

SEQ ID NO: 47387 - DNA, 15 bp, Homo sapiens
aatagcattttttta

SEQ ID NO: 47388 - DNA, 15 bp, Homo sapiens
aaatagcattttttt

SEQ ID NO: 47389 - DNA, 15 bp, Homo sapiens
taaatagcatttttt

SEQ ID NO: 47390 - DNA, 15 bp, Homo sapiens
ataaatagcattttt

SEQ ID NO: 47391 - DNA, 15 bp, Homo sapiens
tataaatagcatttt

SEQ ID NO: 47392 - DNA, 15 bp, Homo sapiens
ctataaatagcattt

SEQ ID NO: 47393 - DNA, 15 bp, Homo sapiens
actataaatagcatt

SEQ ID NO: 47394 - DNA, 15 bp, Homo sapiens
tactataaatagcat

SEQ ID NO: 47395 - DNA, 15 bp, Homo sapiens
ctactataaatagca

SEQ ID NO: 47396 - DNA, 15 bp, Homo sapiens
actactataaatagc

SEQ ID NO: 47397 - DNA, 15 bp, Homo sapiens
tactactataaatag

SEQ ID NO: 47398 - DNA, 15 bp, Homo sapiens
ctactactataaata

SEQ ID NO: 47399 - DNA, 15 bp, Homo sapiens
actactactataaat

SEQ ID NO: 47400 - DNA, 15 bp, Homo sapiens
aactactactataaa

SEQ ID NO: 47401 - DNA, 15 bp, Homo sapiens
caactactactataa

SEQ ID NO: 47402 - DNA, 15 bp, Homo sapiens
ccaactactactata

SEQ ID NO: 47403 - DNA, 15 bp, Homo sapiens
gccaactactactat

SEQ ID NO: 47404 - DNA, 15 bp, Homo sapiens
tgccaactactacta

SEQ ID NO: 47405 - DNA, 15 bp, Homo sapiens
atgccaactactact

SEQ ID NO: 47406 - DNA, 15 bp, Homo sapiens
aatgccaactactac

SEQ ID NO: 47407 - DNA, 15 bp, Homo sapiens
aaatgccaactacta

SEQ ID NO: 47408 - DNA, 15 bp, Homo sapiens
gaaatgccaactact

SEQ ID NO: 47409 - DNA, 15 bp, Homo sapiens
tgaaatgccaactac

SEQ ID NO: 47410 - DNA, 15 bp, Homo sapiens
atgaaatgccaacta

SEQ ID NO: 47411 - DNA, 15 bp, Homo sapiens
gatgaaatgccaact

SEQ ID NO: 47412 - DNA, 15 bp, Homo sapiens
tgatgaaatgccaac

SEQ ID NO: 47413 - DNA, 15 bp, Homo sapiens
ttgatgaaatgccaa

SEQ ID NO: 47414 - DNA, 15 bp, Homo sapiens
tttgatgaaatgcca

SEQ ID NO: 47415 - DNA, 15 bp, Homo sapiens
ctttgatgaaatgcc

SEQ ID NO: 47416 - DNA, 15 bp, Homo sapiens
actttgatgaaatgc

SEQ ID NO: 47417 - DNA, 15 bp, Homo sapiens
tactttgatgaaatg

SEQ ID NO: 47418 - DNA, 15 bp, Homo sapiens
gtactttgatgaaat

SEQ ID NO: 47419 - DNA, 15 bp, Homo sapiens
tgtactttgatgaaa

SEQ ID NO: 47420 - DNA, 15 bp, Homo sapiens
atgtactttgatgaa

SEQ ID NO: 47421 - DNA, 15 bp, Homo sapiens
tatgtactttgatga

SEQ ID NO: 47422 - DNA, 15 bp, Homo sapiens
ttatgtactttgatg

SEQ ID NO: 47423 - DNA, 15 bp, Homo sapiens
cttatgtactttgat

SEQ ID NO: 47424 - DNA, 15 bp, Homo sapiens
gcttatgtactttga

SEQ ID NO: 47425 - DNA, 15 bp, Homo sapiens
tgcttatgtactttg

SEQ ID NO: 47426 - DNA, 15 bp, Homo sapiens
ttgcttatgtacttt

SEQ ID NO: 47427 - DNA, 15 bp, Homo sapiens
tttgcttatgtactt

SEQ ID NO: 47428 - DNA, 15 bp, Homo sapiens
ctttgcttatgtact

SEQ ID NO: 47429 - DNA, 15 bp, Homo sapiens
cctttgcttatgtac

SEQ ID NO: 47430 - DNA, 15 bp, Homo sapiens
tcctttgcttatgta

SEQ ID NO: 47431 - DNA, 15 bp, Homo sapiens
gtcctttgcttatgt

SEQ ID NO: 47432 - DNA, 15 bp, Homo sapiens
tgtcctttgcttatg

SEQ ID NO: 47433 - DNA, 15 bp, Homo sapiens
ctgtcctttgcttat

SEQ ID NO: 47434 - DNA, 15 bp, Homo sapiens
tctgtcctttgctta

SEQ ID NO: 47435 - DNA, 15 bp, Homo sapiens
atctgtcctttgctt

SEQ ID NO: 47436 - DNA, 15 bp, Homo sapiens
tatctgtcctttgct

SEQ ID NO: 47437 - DNA, 15 bp, Homo sapiens
gtatctgtcctttgc

SEQ ID NO: 47438 - DNA, 15 bp, Homo sapiens
agtatctgtcctttg

SEQ ID NO: 47439 - DNA, 15 bp, Homo sapiens
gagtatctgtccttt

SEQ ID NO: 47440 - DNA, 15 bp, Homo sapiens
ggagtatctgtcctt

SEQ ID NO: 47441 - DNA, 15 bp, Homo sapiens
aggagtatctgtcct

SEQ ID NO: 47442 - DNA, 15 bp, Homo sapiens
gaggagtatctgtcc

SEQ ID NO: 47443 - DNA, 15 bp, Homo sapiens
tgaggagtatctgtc

SEQ ID NO: 47444 - DNA, 15 bp, Homo sapiens
atgaggagtatctgt

SEQ ID NO: 47445 - DNA, 15 bp, Homo sapiens
aatgaggagtatctg

SEQ ID NO: 47446 - DNA, 15 bp, Homo sapiens
aaatgaggagtatct

SEQ ID NO: 47447 - DNA, 15 bp, Homo sapiens
aaaatgaggagtatc

SEQ ID NO: 47448 - DNA, 15 bp, Homo sapiens
aaaaatgaggagtat

SEQ ID NO: 47449 - DNA, 15 bp, Homo sapiens
aaaaaatgaggagta

SEQ ID NO: 47450 - DNA, 15 bp, Homo sapiens
gaaaaaatgaggagt

SEQ ID NO: 47451 - DNA, 15 bp, Homo sapiens
ggaaaaaatgaggag

SEQ ID NO: 47452 - DNA, 15 bp, Homo sapiens
gggaaaaaatgagga

SEQ ID NO: 47453 - DNA, 15 bp, Homo sapiens
tgggaaaaaatgagg

SEQ ID NO: 47454 - DNA, 15 bp, Homo sapiens
ctgggaaaaaatgag

SEQ ID NO: 47455 - DNA, 15 bp, Homo sapiens
cctgggaaaaaatga

SEQ ID NO: 47456 - DNA, 15 bp, Homo sapiens
acctgggaaaaaatg

SEQ ID NO: 47457 - DNA, 15 bp, Homo sapiens
aacctgggaaaaaat

SEQ ID NO: 47458 - DNA, 15 bp, Homo sapiens
aaacctgggaaaaaa

SEQ ID NO: 47459 - DNA, 15 bp, Homo sapiens
gaaacctgggaaaaa

SEQ ID NO: 47460 - DNA, 15 bp, Homo sapiens
agaaacctgggaaaa

SEQ ID NO: 47461 - DNA, 15 bp, Homo sapiens
tagaaacctgggaaa

SEQ ID NO: 47462 - DNA, 15 bp, Homo sapiens
atagaaacctgggaa

SEQ ID NO: 47463 - DNA, 15 bp, Homo sapiens
aatagaaacctggga

SEQ ID NO: 47464 - DNA, 15 bp, Homo sapiens
gaatagaaacctggg

SEQ ID NO: 47465 - DNA, 15 bp, Homo sapiens
agaatagaaacctgg

SEQ ID NO: 47466 - DNA, 15 bp, Homo sapiens
aagaatagaaacctg

SEQ ID NO: 47467 - DNA, 15 bp, Homo sapiens
aaagaatagaaacct

SEQ ID NO: 47468 - DNA, 15 bp, Homo sapiens
aaaagaatagaaacc

SEQ ID NO: 47469 - DNA, 15 bp, Homo sapiens
aaaaagaatagaaac

SEQ ID NO: 47470 - DNA, 15 bp, Homo sapiens
gaaaaagaatagaaa

SEQ ID NO: 47471 - DNA, 15 bp, Homo sapiens
agaaaaagaatagaa

SEQ ID NO: 47472 - DNA, 15 bp, Homo sapiens
cagaaaaagaataga

SEQ ID NO: 47473 - DNA, 15 bp, Homo sapiens
tcagaaaaagaatag

SEQ ID NO: 47474 - DNA, 15 bp, Homo sapiens
ttcagaaaaagaata

SEQ ID NO: 47475 - DNA, 15 bp, Homo sapiens
tttcagaaaaagaat

SEQ ID NO: 47476 - DNA, 15 bp, Homo sapiens
ctttcagaaaaagaa

SEQ ID NO: 47477 - DNA, 15 bp, Homo sapiens
actttcagaaaaaga

SEQ ID NO: 47478 - DNA, 15 bp, Homo sapiens
cactttcagaaaaag

SEQ ID NO: 47479 - DNA, 15 bp, Homo sapiens
tcactttcagaaaaa

SEQ ID NO: 47480 - DNA, 15 bp, Homo sapiens
ctcactttcagaaaa

SEQ ID NO: 47481 - DNA, 15 bp, Homo sapiens
actcactttcagaaa

SEQ ID NO: 47482 - DNA, 15 bp, Homo sapiens
tactcactttcagaa

SEQ ID NO: 47483 - DNA, 15 bp, Homo sapiens
ttactcactttcaga

SEQ ID NO: 47484 - DNA, 15 bp, Homo sapiens
tttactcactttcag

SEQ ID NO: 47485 - DNA, 15 bp, Homo sapiens
ttttactcactttca

SEQ ID NO: 47486 - DNA, 15 bp, Homo sapiens
attttactcactttc

SEQ ID NO: 47487 - DNA, 15 bp, Homo sapiens
tattttactcacttt

SEQ ID NO: 47488 - DNA, 15 bp, Homo sapiens
atattttactcactt

SEQ ID NO: 47489 - DNA, 15 bp, Homo sapiens
aatattttactcact

SEQ ID NO: 47490 - DNA, 15 bp, Homo sapiens
taatattttactcac

SEQ ID NO: 47491 - DNA, 15 bp, Homo sapiens
ctaatattttactca

SEQ ID NO: 47492 - DNA, 15 bp, Homo sapiens
cctaatattttactc

SEQ ID NO: 47493 - DNA, 15 bp, Homo sapiens
gcctaatattttact

SEQ ID NO: 47494 - DNA, 15 bp, Homo sapiens
agcctaatattttac

SEQ ID NO: 47495 - DNA, 15 bp, Homo sapiens
aagcctaatatttta

SEQ ID NO: 47496 - DNA, 15 bp, Homo sapiens
aaagcctaatatttt

SEQ ID NO: 47497 - DNA, 15 bp, Homo sapiens
caaagcctaatattt

SEQ ID NO: 47498 - DNA, 15 bp, Homo sapiens
ccaaagcctaatatt

SEQ ID NO: 47499 - DNA, 15 bp, Homo sapiens
tccaaagcctaatat

SEQ ID NO: 47500 - DNA, 15 bp, Homo sapiens
ctccaaagcctaata

SEQ ID NO: 47501 - DNA, 15 bp, Homo sapiens
tctccaaagcctaat

SEQ ID NO: 47502 - DNA, 15 bp, Homo sapiens
ttctccaaagcctaa

SEQ ID NO: 47503 - DNA, 15 bp, Homo sapiens
tttctccaaagccta

SEQ ID NO: 47504 - DNA, 15 bp, Homo sapiens
ctttctccaaagcct

SEQ ID NO: 47505 - DNA, 15 bp, Homo sapiens
actttctccaaagcc

SEQ ID NO: 47506 - DNA, 15 bp, Homo sapiens
gactttctccaaagc

SEQ ID NO: 47507 - DNA, 15 bp, Homo sapiens
agactttctccaaag

SEQ ID NO: 47508 - DNA, 15 bp, Homo sapiens
tagactttctccaaa

SEQ ID NO: 47509 - DNA, 15 bp, Homo sapiens
ctagactttctccaa

SEQ ID NO: 47510 - DNA, 15 bp, Homo sapiens
cctagactttctcca

SEQ ID NO: 47511 - DNA, 15 bp, Homo sapiens
acctagactttctcc

SEQ ID NO: 47512 - DNA, 15 bp, Homo sapiens
tacctagactttctc

SEQ ID NO: 47513 - DNA, 15 bp, Homo sapiens
ctacctagactttct

SEQ ID NO: 47514 - DNA, 15 bp, Homo sapiens
actacctagactttc

SEQ ID NO: 47515 - DNA, 15 bp, Homo sapiens
aactacctagacttt

SEQ ID NO: 47516 - DNA, 15 bp, Homo sapiens
aaactacctagactt

SEQ ID NO: 47517 - DNA, 15 bp, Homo sapiens
caaactacctagact

SEQ ID NO: 47518 - DNA, 15 bp, Homo sapiens
ccaaactacctagac

SEQ ID NO: 47519 - DNA, 15 bp, Homo sapiens
accaaactacctaga

SEQ ID NO: 47520 - DNA, 15 bp, Homo sapiens
caccaaactacctag

SEQ ID NO: 47521 - DNA, 15 bp, Homo sapiens
acaccaaactaccta

SEQ ID NO: 47522 - DNA, 15 bp, Homo sapiens
cacaccaaactacct

SEQ ID NO: 47523 - DNA, 15 bp, Homo sapiens
tcacaccaaactacc

SEQ ID NO: 47524 - DNA, 15 bp, Homo sapiens
atcacaccaaactac

SEQ ID NO: 47525 - DNA, 15 bp, Homo sapiens
gatcacaccaaacta

SEQ ID NO: 47526 - DNA, 15 bp, Homo sapiens
agatcacaccaaact

SEQ ID NO: 47527 - DNA, 15 bp, Homo sapiens
cagatcacaccaaac

SEQ ID NO: 47528 - DNA, 15 bp, Homo sapiens
acagatcacaccaaa

SEQ ID NO: 47529 - DNA, 15 bp, Homo sapiens
aacagatcacaccaa

SEQ ID NO: 47530 - DNA, 15 bp, Homo sapiens
caacagatcacacca

SEQ ID NO: 47531 - DNA, 15 bp, Homo sapiens
ccaacagatcacacc

SEQ ID NO: 47532 - DNA, 15 bp, Homo sapiens
accaacagatcacac

SEQ ID NO: 47533 - DNA, 15 bp, Homo sapiens
taccaacagatcaca

SEQ ID NO: 47534 - DNA, 15 bp, Homo sapiens
ctaccaacagatcac

SEQ ID NO: 47535 - DNA, 15 bp, Homo sapiens
gctaccaacagatca

SEQ ID NO: 47536 - DNA, 15 bp, Homo sapiens
tgctaccaacagatc

SEQ ID NO: 47537 - DNA, 15 bp, Homo sapiens
atgctaccaacagat

SEQ ID NO: 47538 - DNA, 15 bp, Homo sapiens
aatgctaccaacaga

SEQ ID NO: 47539 - DNA, 15 bp, Homo sapiens
aaatgctaccaacag

SEQ ID NO: 47540 - DNA, 15 bp, Homo sapiens
aaaatgctaccaaca

SEQ ID NO: 47541 - DNA, 15 bp, Homo sapiens
caaaatgctaccaac

SEQ ID NO: 47542 - DNA, 15 bp, Homo sapiens
acaaaatgctaccaa

SEQ ID NO: 47543 - DNA, 15 bp, Homo sapiens
aacaaaatgctacca

SEQ ID NO: 47544 - DNA, 15 bp, Homo sapiens
aaacaaaatgctacc

SEQ ID NO: 47545 - DNA, 15 bp, Homo sapiens
aaaacaaaatgctac

SEQ ID NO: 47546 - DNA, 15 bp, Homo sapiens
caaaacaaaatgcta

SEQ ID NO: 47547 - DNA, 15 bp, Homo sapiens
gcaaaacaaaatgct

SEQ ID NO: 47548 - DNA, 15 bp, Homo sapiens
ggcaaaacaaaatgc

SEQ ID NO: 47549 - DNA, 15 bp, Homo sapiens
aggcaaaacaaaatg

SEQ ID NO: 47550 - DNA, 15 bp, Homo sapiens
aaggcaaaacaaaat

SEQ ID NO: 47551 - DNA, 15 bp, Homo sapiens
taaggcaaaacaaaa

SEQ ID NO: 47552 - DNA, 15 bp, Homo sapiens
ttaaggcaaaacaaa

SEQ ID NO: 47553 - DNA, 15 bp, Homo sapiens
attaaggcaaaacaa

SEQ ID NO: 47554 - DNA, 15 bp, Homo sapiens
gattaaggcaaaaca

SEQ ID NO: 47555 - DNA, 15 bp, Homo sapiens
agattaaggcaaaac

SEQ ID NO: 47556 - DNA, 15 bp, Homo sapiens
aagattaaggcaaaa

SEQ ID NO: 47557 - DNA, 15 bp, Homo sapiens
gaagattaaggcaaa

SEQ ID NO: 47558 - DNA, 15 bp, Homo sapiens
agaagattaaggcaa

SEQ ID NO: 47559 - DNA, 15 bp, Homo sapiens
tagaagattaaggca

SEQ ID NO: 47560 - DNA, 15 bp, Homo sapiens
atagaagattaaggc

SEQ ID NO: 47561 - DNA, 15 bp, Homo sapiens
aatagaagattaagg

SEQ ID NO: 47562 - DNA, 15 bp, Homo sapiens
aaatagaagattaag

SEQ ID NO: 47563 - DNA, 15 bp, Homo sapiens
aaaatagaagattaa

SEQ ID NO: 47564 - DNA, 15 bp, Homo sapiens
aaaaatagaagatta

SEQ ID NO: 47565 - DNA, 15 bp, Homo sapiens
aaaaaatagaagatt

SEQ ID NO: 47566 - DNA, 15 bp, Homo sapiens
aaaaaaatagaagat

SEQ ID NO: 47567 - DNA, 15 bp, Homo sapiens
gaaaaaaatagaaga

SEQ ID NO: 47568 - DNA, 15 bp, Homo sapiens
agaaaaaaatagaag

SEQ ID NO: 47569 - DNA, 15 bp, Homo sapiens
aagaaaaaaatagaa

SEQ ID NO: 47570 - DNA, 15 bp, Homo sapiens
gaagaaaaaaataga

SEQ ID NO: 47571 - DNA, 15 bp, Homo sapiens
ggaagaaaaaaatag

SEQ ID NO: 47572 - DNA, 15 bp, Homo sapiens
gggaagaaaaaaata

SEQ ID NO: 47573 - DNA, 15 bp, Homo sapiens
tgggaagaaaaaaat

SEQ ID NO: 47574 - DNA, 15 bp, Homo sapiens
atgggaagaaaaaaa

SEQ ID NO: 47575 - DNA, 15 bp, Homo sapiens
aatgggaagaaaaaa

SEQ ID NO: 47576 - DNA, 15 bp, Homo sapiens
aaatgggaagaaaaa

SEQ ID NO: 47577 - DNA, 15 bp, Homo sapiens
aaaatgggaagaaaa

SEQ ID NO: 47578 - DNA, 15 bp, Homo sapiens
taaaatgggaagaaa

SEQ ID NO: 47579 - DNA, 15 bp, Homo sapiens
ataaaatgggaagaa

SEQ ID NO: 47580 - DNA, 15 bp, Homo sapiens
aataaaatgggaaga

SEQ ID NO: 47581 - DNA, 15 bp, Homo sapiens
aaataaaatgggaag

SEQ ID NO: 47582 - DNA, 15 bp, Homo sapiens
taaataaaatgggaa

SEQ ID NO: 47583 - DNA, 15 bp, Homo sapiens
ataaataaaatggga

SEQ ID NO: 47584 - DNA, 15 bp, Homo sapiens
aataaataaaatggg

SEQ ID NO: 47585 - DNA, 15 bp, Homo sapiens
aaataaataaaatgg

SEQ ID NO: 47586 - DNA, 15 bp, Homo sapiens
taaataaataaaatg

SEQ ID NO: 47587 - DNA, 15 bp, Homo sapiens
ataaataaataaaat

SEQ ID NO: 47588 - DNA, 15 bp, Homo sapiens
caaaaaaataaataa

SEQ ID NO: 47589 - DNA, 15 bp, Homo sapiens
tcaaaaaaataaata

SEQ ID NO: 47590 - DNA, 15 bp, Homo sapiens
ctcaaaaaaataaat

SEQ ID NO: 47591 - DNA, 15 bp, Homo sapiens
atctcaaaaaaataa

SEQ ID NO: 47592 - DNA, 15 bp, Homo sapiens
catctcaaaaaaata

SEQ ID NO: 47593 - DNA, 15 bp, Homo sapiens
ccatctcaaaaaaat

SEQ ID NO: 47594 - DNA, 15 bp, Homo sapiens
cctccatctcaaaaa

SEQ ID NO: 47595 - DNA, 15 bp, Homo sapiens
gcctccatctcaaaa

SEQ ID NO: 47596 - DNA, 15 bp, Homo sapiens
agcctccatctcaaa

SEQ ID NO: 47597 - DNA, 15 bp, Homo sapiens
gagcctccatctcaa

SEQ ID NO: 47598 - DNA, 15 bp, Homo sapiens
tgagcctccatctca

SEQ ID NO: 47599 - DNA, 15 bp, Homo sapiens
atgagcctccatctc

SEQ ID NO: 47600 - DNA, 15 bp, Homo sapiens
aatgagcctccatct

SEQ ID NO: 47601 - DNA, 15 bp, Homo sapiens
gaatgagcctccatc

SEQ ID NO: 47602 - DNA, 15 bp, Homo sapiens
tgaatgagcctccat

SEQ ID NO: 47603 - DNA, 15 bp, Homo sapiens
gtgaatgagcctcca

SEQ ID NO: 47604 - DNA, 15 bp, Homo sapiens
agtgaatgagcctcc

SEQ ID NO: 47605 - DNA, 15 bp, Homo sapiens
aagtgaatgagcctc

SEQ ID NO: 47606 - DNA, 15 bp, Homo sapiens
aaagtgaatgagcct

SEQ ID NO: 47607 - DNA, 15 bp, Homo sapiens
caaagtgaatgagcc

SEQ ID NO: 47608 - DNA, 15 bp, Homo sapiens
acaaagtgaatgagc

SEQ ID NO: 47609 - DNA, 15 bp, Homo sapiens
gacaaagtgaatgag

SEQ ID NO: 47610 - DNA, 15 bp, Homo sapiens
cgacaaagtgaatga

SEQ ID NO: 47611 - DNA, 15 bp, Homo sapiens
gcgacaaagtgaatg

SEQ ID NO: 47612 - DNA, 15 bp, Homo sapiens
ggcgacaaagtgaat

SEQ ID NO: 47613 - DNA, 15 bp, Homo sapiens
gggcgacaaagtgaa

SEQ ID NO: 47614 - DNA, 15 bp, Homo sapiens
tgggcgacaaagtga

SEQ ID NO: 47615 - DNA, 15 bp, Homo sapiens
ctgggcgacaaagtg

SEQ ID NO: 47616 - DNA, 15 bp, Homo sapiens
cctgggcgacaaagt

SEQ ID NO: 47617 - DNA, 15 bp, Homo sapiens
gcctgggcgacaaag

SEQ ID NO: 47618 - DNA, 15 bp, Homo sapiens
agcctgggcgacaaa

SEQ ID NO: 47619 - DNA, 15 bp, Homo sapiens
cagcctgggcgacaa

SEQ ID NO: 47620 - DNA, 15 bp, Homo sapiens
gctgcactccagcct

SEQ ID NO: 47621 - DNA, 15 bp, Homo sapiens
cgctgcactccagcc

SEQ ID NO: 47622 - DNA, 15 bp, Homo sapiens
ccgctgcactccagc

SEQ ID NO: 47623 - DNA, 15 bp, Homo sapiens
gccgctgcactccag

SEQ ID NO: 47624 - DNA, 15 bp, Homo sapiens
cgccgctgcactcca

SEQ ID NO: 47625 - DNA, 15 bp, Homo sapiens
gcgccgctgcactcc

SEQ ID NO: 47626 - DNA, 15 bp, Homo sapiens
cgcgccgctgcactc

SEQ ID NO: 47627 - DNA, 15 bp, Homo sapiens
tcgcgccgctgcact

SEQ ID NO: 47628 - DNA, 15 bp, Homo sapiens
atcgcgccgctgcac

SEQ ID NO: 47629 - DNA, 15 bp, Homo sapiens
gatcgcgccgctgca

SEQ ID NO: 47630 - DNA, 15 bp, Homo sapiens
agatcgcgccgctgc

SEQ ID NO: 47631 - DNA, 15 bp, Homo sapiens
aagatcgcgccgctg

SEQ ID NO: 47632 - DNA, 15 bp, Homo sapiens
caagatcgcgccgct

SEQ ID NO: 47633 - DNA, 15 bp, Homo sapiens
ccaagatcgcgccgc

SEQ ID NO: 47634 - DNA, 15 bp, Homo sapiens
gccaagatcgcgccg

SEQ ID NO: 47635 - DNA, 15 bp, Homo sapiens
agccaagatcgcgcc

SEQ ID NO: 47636 - DNA, 15 bp, Homo sapiens
gagccaagatcgcgc

SEQ ID NO: 47637 - DNA, 15 bp, Homo sapiens
tgagccaagatcgcg

SEQ ID NO: 47638 - DNA, 15 bp, Homo sapiens
tcttgaacccaggag

SEQ ID NO: 47639 - DNA, 15 bp, Homo sapiens
ctcttgaacccagga

SEQ ID NO: 47640 - DNA, 15 bp, Homo sapiens
tctcttgaacccagg

SEQ ID NO: 47641 - DNA, 15 bp, Homo sapiens
atctcttgaacccag

SEQ ID NO: 47642 - DNA, 15 bp, Homo sapiens
aatctcttgaaccca

SEQ ID NO: 47643 - DNA, 15 bp, Homo sapiens
gaatctcttgaaccc

SEQ ID NO: 47644 - DNA, 15 bp, Homo sapiens
agaatctcttgaacc

SEQ ID NO: 47645 - DNA, 15 bp, Homo sapiens
gagaatctcttgaac

SEQ ID NO: 47646 - DNA, 15 bp, Homo sapiens
tgagaatctcttgaa

SEQ ID NO: 47647 - DNA, 15 bp, Homo sapiens
atgagaatctcttga

SEQ ID NO: 47648 - DNA, 15 bp, Homo sapiens
catgagaatctcttg

SEQ ID NO: 47649 - DNA, 15 bp, Homo sapiens
acatgagaatctctt

SEQ ID NO: 47650 - DNA, 15 bp, Homo sapiens
gacatgagaatctct

SEQ ID NO: 47651 - DNA, 15 bp, Homo sapiens
agacatgagaatctc

SEQ ID NO: 47652 - DNA, 15 bp, Homo sapiens
gagacatgagaatct

SEQ ID NO: 47653 - DNA, 15 bp, Homo sapiens
tgagacatgagaatc

SEQ ID NO: 47654 - DNA, 15 bp, Homo sapiens
ctgagacatgagaat

SEQ ID NO: 47655 - DNA, 15 bp, Homo sapiens
gctgagacatgagaa

SEQ ID NO: 47656 - DNA, 15 bp, Homo sapiens
ggctgagacatgaga

SEQ ID NO: 47657 - DNA, 15 bp, Homo sapiens
aggctgagacatgag

SEQ ID NO: 47658 - DNA, 15 bp, Homo sapiens
gaggctgagacatga

SEQ ID NO: 47659 - DNA, 15 bp, Homo sapiens
ggaggctgagacatg

SEQ ID NO: 47660 - DNA, 15 bp, Homo sapiens
aggaggctgagacat

SEQ ID NO: 47661 - DNA, 15 bp, Homo sapiens
caggaggctgagaca

SEQ ID NO: 47662 - DNA, 15 bp, Homo sapiens
tcaggaggctgagac

SEQ ID NO: 47663 - DNA, 15 bp, Homo sapiens
ctcaggaggctgaga

SEQ ID NO: 47664 - DNA, 15 bp, Homo sapiens
actactcaggaggct

SEQ ID NO: 47665 - DNA, 15 bp, Homo sapiens
cactactcaggaggc

SEQ ID NO: 47666 - DNA, 15 bp, Homo sapiens
ccactactcaggagg

SEQ ID NO: 47667 - DNA, 15 bp, Homo sapiens
tccactactcaggag

SEQ ID NO: 47668 - DNA, 15 bp, Homo sapiens
ttccactactcagga

SEQ ID NO: 47669 - DNA, 15 bp, Homo sapiens
tttccactactcagg

SEQ ID NO: 47670 - DNA, 15 bp, Homo sapiens
atttccactactcag

SEQ ID NO: 47671 - DNA, 15 bp, Homo sapiens
aatttccactactca

SEQ ID NO: 47672 - DNA, 15 bp, Homo sapiens
taatttccactactc

SEQ ID NO: 47673 - DNA, 15 bp, Homo sapiens
gtaatttccactact

SEQ ID NO: 47674 - DNA, 15 bp, Homo sapiens
tgtaatttccactac

SEQ ID NO: 47675 - DNA, 15 bp, Homo sapiens
ctgtaatttccacta

SEQ ID NO: 47676 - DNA, 15 bp, Homo sapiens
cctgtaatttccact

SEQ ID NO: 47677 - DNA, 15 bp, Homo sapiens
acctgtaatttccac

SEQ ID NO: 47678 - DNA, 15 bp, Homo sapiens
tacctgtaatttcca

SEQ ID NO: 47679 - DNA, 15 bp, Homo sapiens
gtacctgtaatttcc

SEQ ID NO: 47680 - DNA, 15 bp, Homo sapiens
cgtacctgtaatttc

SEQ ID NO: 47681 - DNA, 15 bp, Homo sapiens
acgtacctgtaattt

SEQ ID NO: 47682 - DNA, 15 bp, Homo sapiens
cacgtacctgtaatt

SEQ ID NO: 47683 - DNA, 15 bp, Homo sapiens
gcacgtacctgtaat

SEQ ID NO: 47684 - DNA, 15 bp, Homo sapiens
ggcacgtacctgtaa

SEQ ID NO: 47685 - DNA, 15 bp, Homo sapiens
tggcacgtacctgta

SEQ ID NO: 47686 - DNA, 15 bp, Homo sapiens
gtggcacgtacctgt

SEQ ID NO: 47687 - DNA, 15 bp, Homo sapiens
ggtggcacgtacctg

SEQ ID NO: 47688 - DNA, 15 bp, Homo sapiens
tggtggcacgtacct

SEQ ID NO: 47689 - DNA, 15 bp, Homo sapiens
atggtggcacgtacc

SEQ ID NO: 47690 - DNA, 15 bp, Homo sapiens
catggtggcacgtac

SEQ ID NO: 47691 - DNA, 15 bp, Homo sapiens
gcatggtggcacgta

SEQ ID NO: 47692 - DNA, 15 bp, Homo sapiens
ggcatggtggcacgt

SEQ ID NO: 47693 - DNA, 15 bp, Homo sapiens
aggcatggtggcacg

SEQ ID NO: 47694 - DNA, 15 bp, Homo sapiens
accatctctactaaa

SEQ ID NO: 47695 - DNA, 15 bp, Homo sapiens
caccatctctactaa

SEQ ID NO: 47696 - DNA, 15 bp, Homo sapiens
acaccatctctacta

SEQ ID NO: 47697 - DNA, 15 bp, Homo sapiens
aacaccatctctact

SEQ ID NO: 47698 - DNA, 15 bp, Homo sapiens
aaacaccatctctac

SEQ ID NO: 47699 - DNA, 15 bp, Homo sapiens
gaaacaccatctcta

SEQ ID NO: 47700 - DNA, 15 bp, Homo sapiens
tgaaacaccatctct

SEQ ID NO: 47701 - DNA, 15 bp, Homo sapiens
ggtgaaacaccatct

SEQ ID NO: 47702 - DNA, 15 bp, Homo sapiens
tggtgaaacaccatc

SEQ ID NO: 47703 - DNA, 15 bp, Homo sapiens
atggtgaaacaccat

SEQ ID NO: 47704 - DNA, 15 bp, Homo sapiens
tatggtgaaacacca

SEQ ID NO: 47705 - DNA, 15 bp, Homo sapiens
atatggtgaaacacc

SEQ ID NO: 47706 - DNA, 15 bp, Homo sapiens
aatatggtgaaacac

SEQ ID NO: 47707 - DNA, 15 bp, Homo sapiens
caatatggtgaaaca

SEQ ID NO: 47708 - DNA, 15 bp, Homo sapiens
acaatatggtgaaac

SEQ ID NO: 47709 - DNA, 15 bp, Homo sapiens
gacaatatggtgaaa

SEQ ID NO: 47710 - DNA, 15 bp, Homo sapiens
ggacaatatggtgaa

SEQ ID NO: 47711 - DNA, 15 bp, Homo sapiens
tggacaatatggtga

SEQ ID NO: 47712 - DNA, 15 bp, Homo sapiens
gtggacaatatggtg

SEQ ID NO: 47713 - DNA, 15 bp, Homo sapiens
agtggacaatatggt

SEQ ID NO: 47714 - DNA, 15 bp, Homo sapiens
aagtggacaatatgg

SEQ ID NO: 47715 - DNA, 15 bp, Homo sapiens
gaagtggacaatatg

SEQ ID NO: 47716 - DNA, 15 bp, Homo sapiens
agaagtggacaatat

SEQ ID NO: 47717 - DNA, 15 bp, Homo sapiens
aagaagtggacaata

SEQ ID NO: 47718 - DNA, 15 bp, Homo sapiens
caagaagtggacaat

SEQ ID NO: 47719 - DNA, 15 bp, Homo sapiens
tcaagaagtggacaa

SEQ ID NO: 47720 - DNA, 15 bp, Homo sapiens
ttcaagaagtggaca

SEQ ID NO: 47721 - DNA, 15 bp, Homo sapiens
gttcaagaagtggac

SEQ ID NO: 47722 - DNA, 15 bp, Homo sapiens
agttcaagaagtgga

SEQ ID NO: 47723 - DNA, 15 bp, Homo sapiens
gagttcaagaagtgg

SEQ ID NO: 47724 - DNA, 15 bp, Homo sapiens
ggagttcaagaagtg

SEQ ID NO: 47725 - DNA, 15 bp, Homo sapiens
aggagttcaagaagt

SEQ ID NO: 47726 - DNA, 15 bp, Homo sapiens
caggagttcaagaag

SEQ ID NO: 47727 - DNA, 15 bp, Homo sapiens
tcaggagttcaagaa

SEQ ID NO: 47728 - DNA, 15 bp, Homo sapiens
aaggtcaggagttca

SEQ ID NO: 47729 - DNA, 15 bp, Homo sapiens
taaggtcaggagttc

SEQ ID NO: 47730 - DNA, 15 bp, Homo sapiens
ttaaggtcaggagtt

SEQ ID NO: 47731 - DNA, 15 bp, Homo sapiens
cttaaggtcaggagt

SEQ ID NO: 47732 - DNA, 15 bp, Homo sapiens
acttaaggtcaggag

SEQ ID NO: 47733 - DNA, 15 bp, Homo sapiens
cacttaaggtcagga

SEQ ID NO: 47734 - DNA, 15 bp, Homo sapiens
tcacttaaggtcagg

SEQ ID NO: 47735 - DNA, 15 bp, Homo sapiens
atcacttaaggtcag

SEQ ID NO: 47736 - DNA, 15 bp, Homo sapiens
gatcacttaaggtca

SEQ ID NO: 47737 - DNA, 15 bp, Homo sapiens
ggatcacttaaggtc

SEQ ID NO: 47738 - DNA, 15 bp, Homo sapiens
aggatcacttaaggt

SEQ ID NO: 47739 - DNA, 15 bp, Homo sapiens
gaggatcacttaagg

SEQ ID NO: 47740 - DNA, 15 bp, Homo sapiens
caggaggatcactta

SEQ ID NO: 47741 - DNA, 15 bp, Homo sapiens
gcaggaggatcactt

SEQ ID NO: 47742 - DNA, 15 bp, Homo sapiens
ggcaggaggatcact

SEQ ID NO: 47743 - DNA, 15 bp, Homo sapiens
aggcaggaggatcac

SEQ ID NO: 47744 - DNA, 15 bp, Homo sapiens
aaggcaggaggatca

SEQ ID NO: 47745 - DNA, 15 bp, Homo sapiens
caaggcaggaggatc

SEQ ID NO: 47746 - DNA, 15 bp, Homo sapiens
ccaaggcaggaggat

SEQ ID NO: 47747 - DNA, 15 bp, Homo sapiens
gccaaggcaggagga

SEQ ID NO: 47748 - DNA, 15 bp, Homo sapiens
ggccaaggcaggagg

SEQ ID NO: 47749 - DNA, 15 bp, Homo sapiens
aggccaaggcaggag

SEQ ID NO: 47750 - DNA, 15 bp, Homo sapiens
gaggccaaggcagga

SEQ ID NO: 47751 - DNA, 15 bp, Homo sapiens
tcagcactttgggag

SEQ ID NO: 47752 - DNA, 15 bp, Homo sapiens
ctcagcactttggga

SEQ ID NO: 47753 - DNA, 15 bp, Homo sapiens
tctcagcactttggg

SEQ ID NO: 47754 - DNA, 15 bp, Homo sapiens
atctcagcactttgg

SEQ ID NO: 47755 - DNA, 15 bp, Homo sapiens
aatctcagcactttg

SEQ ID NO: 47756 - DNA, 15 bp, Homo sapiens
cctgtaatctcagca

SEQ ID NO: 47757 - DNA, 15 bp, Homo sapiens
catgcctgtaatctc

SEQ ID NO: 47758 - DNA, 15 bp, Homo sapiens
ggcatggtggctcat

SEQ ID NO: 47759 - DNA, 15 bp, Homo sapiens
ggccgggcatggtgg

SEQ ID NO: 47760 - DNA, 15 bp, Homo sapiens
aggccgggcatggtg

SEQ ID NO: 47761 - DNA, 15 bp, Homo sapiens
aaggccgggcatggt

SEQ ID NO: 47762 - DNA, 15 bp, Homo sapiens
gaaggccgggcatgg

SEQ ID NO: 47763 - DNA, 15 bp, Homo sapiens
agaaggccgggcatg

SEQ ID NO: 47764 - DNA, 15 bp, Homo sapiens
aagaaggccgggcat

SEQ ID NO: 47765 - DNA, 15 bp, Homo sapiens
gaagaaggccgggca

SEQ ID NO: 47766 - DNA, 15 bp, Homo sapiens
ggaagaaggccgggc

SEQ ID NO: 47767 - DNA, 15 bp, Homo sapiens
gggaagaaggccggg

SEQ ID NO: 47768 - DNA, 15 bp, Homo sapiens
tgggaagaaggccgg

SEQ ID NO: 47769 - DNA, 15 bp, Homo sapiens
atgggaagaaggccg

SEQ ID NO: 47770 - DNA, 15 bp, Homo sapiens
aatgggaagaaggcc

SEQ ID NO: 47771 - DNA, 15 bp, Homo sapiens
aaatgggaagaaggc

SEQ ID NO: 47772 - DNA, 15 bp, Homo sapiens
aaaatgggaagaagg

SEQ ID NO: 47773 - DNA, 15 bp, Homo sapiens
taaaatgggaagaag

SEQ ID NO: 47774 - DNA, 15 bp, Homo sapiens
ttaaaatgggaagaa

SEQ ID NO: 47775 - DNA, 15 bp, Homo sapiens
attaaaatgggaaga

SEQ ID NO: 47776 - DNA, 15 bp, Homo sapiens
tattaaaatgggaag

SEQ ID NO: 47777 - DNA, 15 bp, Homo sapiens
ttattaaaatgggaa

SEQ ID NO: 47778 - DNA, 15 bp, Homo sapiens
gttattaaaatggga

SEQ ID NO: 47779 - DNA, 15 bp, Homo sapiens
agttattaaaatggg

SEQ ID NO: 47780 - DNA, 15 bp, Homo sapiens
tagttattaaaatgg

SEQ ID NO: 47781 - DNA, 15 bp, Homo sapiens
ttagttattaaaatg

SEQ ID NO: 47782 - DNA, 15 bp, Homo sapiens
attagttattaaaat

SEQ ID NO: 47783 - DNA, 15 bp, Homo sapiens
cattagttattaaaa

SEQ ID NO: 47784 - DNA, 15 bp, Homo sapiens
tcattagttattaaa

SEQ ID NO: 47785 - DNA, 15 bp, Homo sapiens
atcattagttattaa

SEQ ID NO: 47786 - DNA, 15 bp, Homo sapiens
aatcattagttatta

SEQ ID NO: 47787 - DNA, 15 bp, Homo sapiens
aaatcattagttatt

SEQ ID NO: 47788 - DNA, 15 bp, Homo sapiens
aaaatcattagttat

SEQ ID NO: 47789 - DNA, 15 bp, Homo sapiens
caaaatcattagtta

SEQ ID NO: 47790 - DNA, 15 bp, Homo sapiens
gcaaaatcattagtt

SEQ ID NO: 47791 - DNA, 15 bp, Homo sapiens
ggcaaaatcattagt

SEQ ID NO: 47792 - DNA, 15 bp, Homo sapiens
aggcaaaatcattag

SEQ ID NO: 47793 - DNA, 15 bp, Homo sapiens
aaggcaaaatcatta

SEQ ID NO: 47794 - DNA, 15 bp, Homo sapiens
taaggcaaaatcatt

SEQ ID NO: 47795 - DNA, 15 bp, Homo sapiens
ttaaggcaaaatcat

SEQ ID NO: 47796 - DNA, 15 bp, Homo sapiens
tttaaggcaaaatca

SEQ ID NO: 47797 - DNA, 15 bp, Homo sapiens
ttttaaggcaaaatc

SEQ ID NO: 47798 - DNA, 15 bp, Homo sapiens
attttaaggcaaaat

SEQ ID NO: 47799 - DNA, 15 bp, Homo sapiens
tattttaaggcaaaa

SEQ ID NO: 47800 - DNA, 15 bp, Homo sapiens
gtattttaaggcaaa

SEQ ID NO: 47801 - DNA, 15 bp, Homo sapiens
agtattttaaggcaa

SEQ ID NO: 47802 - DNA, 15 bp, Homo sapiens
aagtattttaaggca

SEQ ID NO: 47803 - DNA, 15 bp, Homo sapiens
caagtattttaaggc

SEQ ID NO: 47804 - DNA, 15 bp, Homo sapiens
tcaagtattttaagg

SEQ ID NO: 47805 - DNA, 15 bp, Homo sapiens
ttcaagtattttaag

SEQ ID NO: 47806 - DNA, 15 bp, Homo sapiens
attcaagtattttaa

SEQ ID NO: 47807 - DNA, 15 bp, Homo sapiens
aattcaagtatttta

SEQ ID NO: 47808 - DNA, 15 bp, Homo sapiens
aaattcaagtatttt

SEQ ID NO: 47809 - DNA, 15 bp, Homo sapiens
taaattcaagtattt

SEQ ID NO: 47810 - DNA, 15 bp, Homo sapiens
ataaattcaagtatt

SEQ ID NO: 47811 - DNA, 15 bp, Homo sapiens
aataaattcaagtat

SEQ ID NO: 47812 - DNA, 15 bp, Homo sapiens
caataaattcaagta

SEQ ID NO: 47813 - DNA, 15 bp, Homo sapiens
gcaataaattcaagt

SEQ ID NO: 47814 - DNA, 15 bp, Homo sapiens
tgcaataaattcaag

SEQ ID NO: 47815 - DNA, 15 bp, Homo sapiens
ttgcaataaattcaa

SEQ ID NO: 47816 - DNA, 15 bp, Homo sapiens
tttgcaataaattca

SEQ ID NO: 47817 - DNA, 15 bp, Homo sapiens
ttttgcaataaattc

SEQ ID NO: 47818 - DNA, 15 bp, Homo sapiens
cttttgcaataaatt

SEQ ID NO: 47819 - DNA, 15 bp, Homo sapiens
ccttttgcaataaat

SEQ ID NO: 47820 - DNA, 15 bp, Homo sapiens
accttttgcaataaa

SEQ ID NO: 47821 - DNA, 15 bp, Homo sapiens
caccttttgcaataa

SEQ ID NO: 47822 - DNA, 15 bp, Homo sapiens
acaccttttgcaata

SEQ ID NO: 47823 - DNA, 15 bp, Homo sapiens
tacaccttttgcaat

SEQ ID NO: 47824 - DNA, 15 bp, Homo sapiens
atacaccttttgcaa

SEQ ID NO: 47825 - DNA, 15 bp, Homo sapiens
aatacaccttttgca

SEQ ID NO: 47826 - DNA, 15 bp, Homo sapiens
aaatacaccttttgc

SEQ ID NO: 47827 - DNA, 15 bp, Homo sapiens
aaaatacaccttttg

SEQ ID NO: 47828 - DNA, 15 bp, Homo sapiens
taaaatacacctttt

SEQ ID NO: 47829 - DNA, 15 bp, Homo sapiens
ttaaaatacaccttt

SEQ ID NO: 47830 - DNA, 15 bp, Homo sapiens
tttaaaatacacctt

SEQ ID NO: 47831 - DNA, 15 bp, Homo sapiens
atttaaaatacacct

SEQ ID NO: 47832 - DNA, 15 bp, Homo sapiens
catttaaaatacacc

SEQ ID NO: 47833 - DNA, 15 bp, Homo sapiens
tcatttaaaatacac

SEQ ID NO: 47834 - DNA, 15 bp, Homo sapiens
atcatttaaaataca

SEQ ID NO: 47835 - DNA, 15 bp, Homo sapiens
aatcatttaaaatac

SEQ ID NO: 47836 - DNA, 15 bp, Homo sapiens
gaatcatttaaaata

SEQ ID NO: 47837 - DNA, 15 bp, Homo sapiens
tgaatcatttaaaat

SEQ ID NO: 47838 - DNA, 15 bp, Homo sapiens
ctgaatcatttaaaa

SEQ ID NO: 47839 - DNA, 15 bp, Homo sapiens
gctgaatcatttaaa

SEQ ID NO: 47840 - DNA, 15 bp, Homo sapiens
agctgaatcatttaa

SEQ ID NO: 47841 - DNA, 15 bp, Homo sapiens
gagctgaatcattta

SEQ ID NO: 47842 - DNA, 15 bp, Homo sapiens
ggagctgaatcattt

SEQ ID NO: 47843 - DNA, 15 bp, Homo sapiens
gggagctgaatcatt

SEQ ID NO: 47844 - DNA, 15 bp, Homo sapiens
agggagctgaatcat

SEQ ID NO: 47845 - DNA, 15 bp, Homo sapiens
gagggagctgaatca

SEQ ID NO: 47846 - DNA, 15 bp, Homo sapiens
agagggagctgaatc

SEQ ID NO: 47847 - DNA, 15 bp, Homo sapiens
aagagggagctgaat

SEQ ID NO: 47848 - DNA, 15 bp, Homo sapiens
gaagagggagctgaa

SEQ ID NO: 47849 - DNA, 15 bp, Homo sapiens
ggaagagggagctga

SEQ ID NO: 47850 - DNA, 15 bp, Homo sapiens
tggaagagggagctg

SEQ ID NO: 47851 - DNA, 15 bp, Homo sapiens
gtggaagagggagct

SEQ ID NO: 47852 - DNA, 15 bp, Homo sapiens
cgtggaagagggagc

SEQ ID NO: 47853 - DNA, 15 bp, Homo sapiens
ccgtggaagagggag

SEQ ID NO: 47854 - DNA, 15 bp, Homo sapiens
accgtggaagaggga

SEQ ID NO: 47855 - DNA, 15 bp, Homo sapiens
caccgtggaagaggg

SEQ ID NO: 47856 - DNA, 15 bp, Homo sapiens
acaccgtggaagagg

SEQ ID NO: 47857 - DNA, 15 bp, Homo sapiens
aacaccgtggaagag

SEQ ID NO: 47858 - DNA, 15 bp, Homo sapiens
aaacaccgtggaaga

SEQ ID NO: 47859 - DNA, 15 bp, Homo sapiens
gaaacaccgtggaag

SEQ ID NO: 47860 - DNA, 15 bp, Homo sapiens
agaaacaccgtggaa

SEQ ID NO: 47861 - DNA, 15 bp, Homo sapiens
cagaaacaccgtgga

SEQ ID NO: 47862 - DNA, 15 bp, Homo sapiens
acagaaacaccgtgg

SEQ ID NO: 47863 - DNA, 15 bp, Homo sapiens
tacagaaacaccgtg

SEQ ID NO: 47864 - DNA, 15 bp, Homo sapiens
ctacagaaacaccgt

SEQ ID NO: 47865 - DNA, 15 bp, Homo sapiens
actacagaaacaccg

SEQ ID NO: 47866 - DNA, 15 bp, Homo sapiens
cactacagaaacacc

SEQ ID NO: 47867 - DNA, 15 bp, Homo sapiens
tcactacagaaacac

SEQ ID NO: 47868 - DNA, 15 bp, Homo sapiens
ttcactacagaaaca

SEQ ID NO: 47869 - DNA, 15 bp, Homo sapiens
attcactacagaaac

SEQ ID NO: 47870 - DNA, 15 bp, Homo sapiens
tattcactacagaaa

SEQ ID NO: 47871 - DNA, 15 bp, Homo sapiens
ctattcactacagaa

SEQ ID NO: 47872 - DNA, 15 bp, Homo sapiens
tctattcactacaga

SEQ ID NO: 47873 - DNA, 15 bp, Homo sapiens
gtctattcactacag

SEQ ID NO: 47874 - DNA, 15 bp, Homo sapiens
agtctattcactaca

SEQ ID NO: 47875 - DNA, 15 bp, Homo sapiens
cagtctattcactac

SEQ ID NO: 47876 - DNA, 15 bp, Homo sapiens
ccagtctattcacta

SEQ ID NO: 47877 - DNA, 15 bp, Homo sapiens
tccagtctattcact

SEQ ID NO: 47878 - DNA, 15 bp, Homo sapiens
ttccagtctattcac

SEQ ID NO: 47879 - DNA, 15 bp, Homo sapiens
cttccagtctattca

SEQ ID NO: 47880 - DNA, 15 bp, Homo sapiens
gcttccagtctattc

SEQ ID NO: 47881 - DNA, 15 bp, Homo sapiens
agcttccagtctatt

SEQ ID NO: 47882 - DNA, 15 bp, Homo sapiens
cagcttccagtctat

SEQ ID NO: 47883 - DNA, 15 bp, Homo sapiens
ccagcttccagtcta

SEQ ID NO: 47884 - DNA, 15 bp, Homo sapiens
cccagcttccagtct

SEQ ID NO: 47885 - DNA, 15 bp, Homo sapiens
tcccagcttccagtc

SEQ ID NO: 47886 - DNA, 15 bp, Homo sapiens
ttcccagcttccagt

SEQ ID NO: 47887 - DNA, 15 bp, Homo sapiens
cttcccagcttccag

SEQ ID NO: 47888 - DNA, 15 bp, Homo sapiens
tcttcccagcttcca

SEQ ID NO: 47889 - DNA, 15 bp, Homo sapiens
ttcttcccagcttcc

SEQ ID NO: 47890 - DNA, 15 bp, Homo sapiens
tttcttcccagcttc

SEQ ID NO: 47891 - DNA, 15 bp, Homo sapiens
ctttcttcccagctt

SEQ ID NO: 47892 - DNA, 15 bp, Homo sapiens
actttcttcccagct

SEQ ID NO: 47893 - DNA, 15 bp, Homo sapiens
cactttcttcccagc

SEQ ID NO: 47894 - DNA, 15 bp, Homo sapiens
tcactttcttcccag

SEQ ID NO: 47895 - DNA, 15 bp, Homo sapiens
gtcactttcttccca

SEQ ID NO: 47896 - DNA, 15 bp, Homo sapiens
ggtcactttcttccc

SEQ ID NO: 47897 - DNA, 15 bp, Homo sapiens
aggtcactttcttcc

SEQ ID NO: 47898 - DNA, 15 bp, Homo sapiens
gaggtcactttcttc

SEQ ID NO: 47899 - DNA, 15 bp, Homo sapiens
ggaggtcactttctt

SEQ ID NO: 47900 - DNA, 15 bp, Homo sapiens
tggaggtcactttct

SEQ ID NO: 47901 - DNA, 15 bp, Homo sapiens
atggaggtcactttc

SEQ ID NO: 47902 - DNA, 15 bp, Homo sapiens
tatggaggtcacttt

SEQ ID NO: 47903 - DNA, 15 bp, Homo sapiens
ttatggaggtcactt

SEQ ID NO: 47904 - DNA, 15 bp, Homo sapiens
agataatgatcctga

SEQ ID NO: 47905 - DNA, 15 bp, Homo sapiens
aagataatgatcctg

SEQ ID NO: 47906 - DNA, 15 bp, Homo sapiens
aaagataatgatcct

SEQ ID NO: 47907 - DNA, 15 bp, Homo sapiens
taaagataatgatcc

SEQ ID NO: 47908 - DNA, 15 bp, Homo sapiens
ataaagataatgatc

SEQ ID NO: 47909 - DNA, 15 bp, Homo sapiens
cataaagataatgat

SEQ ID NO: 47910 - DNA, 15 bp, Homo sapiens
ccataaagataatga

SEQ ID NO: 47911 - DNA, 15 bp, Homo sapiens
gccataaagataatg

SEQ ID NO: 47912 - DNA, 15 bp, Homo sapiens
tgccataaagataat

SEQ ID NO: 47913 - DNA, 15 bp, Homo sapiens
ctgccataaagataa

SEQ ID NO: 47914 - DNA, 15 bp, Homo sapiens
cctgccataaagata

SEQ ID NO: 47915 - DNA, 15 bp, Homo sapiens
gcctgccataaagat

SEQ ID NO: 47916 - DNA, 15 bp, Homo sapiens
ggcctgccataaaga

SEQ ID NO: 47917 - DNA, 15 bp, Homo sapiens
tggcctgccataaag

SEQ ID NO: 47918 - DNA, 15 bp, Homo sapiens
ctggcctgccataaa

SEQ ID NO: 47919 - DNA, 15 bp, Homo sapiens
cctggcctgccataa

SEQ ID NO: 47920 - DNA, 15 bp, Homo sapiens
acctggcctgccata

SEQ ID NO: 47921 - DNA, 15 bp, Homo sapiens
aacctggcctgccat

SEQ ID NO: 47922 - DNA, 15 bp, Homo sapiens
taacctggcctgcca

SEQ ID NO: 47923 - DNA, 15 bp, Homo sapiens
ataacctggcctgcc

SEQ ID NO: 47924 - DNA, 15 bp, Homo sapiens
aataacctggcctgc

SEQ ID NO: 47925 - DNA, 15 bp, Homo sapiens
taataacctggcctg

SEQ ID NO: 47926 - DNA, 15 bp, Homo sapiens
ataataacctggcct

SEQ ID NO: 47927 - DNA, 15 bp, Homo sapiens
cataataacctggcc

SEQ ID NO: 47928 - DNA, 15 bp, Homo sapiens
tcataataacctggc

SEQ ID NO: 47929 - DNA, 15 bp, Homo sapiens
ttcataataacctgg

SEQ ID NO: 47930 - DNA, 15 bp, Homo sapiens
cttcataataacctg

SEQ ID NO: 47931 - DNA, 15 bp, Homo sapiens
tcttcataataacct

SEQ ID NO: 47932 - DNA, 15 bp, Homo sapiens
ttcttcataataacc

SEQ ID NO: 47933 - DNA, 15 bp, Homo sapiens
cttcttcataataac

SEQ ID NO: 47934 - DNA, 15 bp, Homo sapiens
gcttcttcataataa

SEQ ID NO: 47935 - DNA, 15 bp, Homo sapiens
tgcttcttcataata

SEQ ID NO: 47936 - DNA, 15 bp, Homo sapiens
gtgcttcttcataat

SEQ ID NO: 47937 - DNA, 15 bp, Homo sapiens
ggtgcttcttcataa

SEQ ID NO: 47938 - DNA, 15 bp, Homo sapiens
gggtgcttcttcata

SEQ ID NO: 47939 - DNA, 15 bp, Homo sapiens
tgggtgcttcttcat

SEQ ID NO: 47940 - DNA, 15 bp, Homo sapiens
ctgggtgcttcttca

SEQ ID NO: 47941 - DNA, 15 bp, Homo sapiens
cctgggtgcttcttc

SEQ ID NO: 47942 - DNA, 15 bp, Homo sapiens
tcctgggtgcttctt

SEQ ID NO: 47943 - DNA, 15 bp, Homo sapiens
ctcctgggtgcttct

SEQ ID NO: 47944 - DNA, 15 bp, Homo sapiens
gctcctgggtgcttc

SEQ ID NO: 47945 - DNA, 15 bp, Homo sapiens
agctcctgggtgctt

SEQ ID NO: 47946 - DNA, 15 bp, Homo sapiens
tagctcctgggtgct

SEQ ID NO: 47947 - DNA, 15 bp, Homo sapiens
atagctcctgggtgc

SEQ ID NO: 47948 - DNA, 15 bp, Homo sapiens
catagctcctgggtg

SEQ ID NO: 47949 - DNA, 15 bp, Homo sapiens
tcatagctcctgggt

SEQ ID NO: 47950 - DNA, 15 bp, Homo sapiens
atcatagctcctggg

SEQ ID NO: 47951 - DNA, 15 bp, Homo sapiens
tatcatagctcctgg

SEQ ID NO: 47952 - DNA, 15 bp, Homo sapiens
gtatcatagctcctg

SEQ ID NO: 47953 - DNA, 15 bp, Homo sapiens
tgtatcatagctcct

SEQ ID NO: 47954 - DNA, 15 bp, Homo sapiens
atgtatcatagctcc

SEQ ID NO: 47955 - DNA, 15 bp, Homo sapiens
tatgtatcatagctc

SEQ ID NO: 47956 - DNA, 15 bp, Homo sapiens
gtatgtatcatagct

SEQ ID NO: 47957 - DNA, 15 bp, Homo sapiens
tgtatgtatcatagc

SEQ ID NO: 47958 - DNA, 15 bp, Homo sapiens
gtgtatgtatcatag

SEQ ID NO: 47959 - DNA, 15 bp, Homo sapiens
tgtgtatgtatcata

SEQ ID NO: 47960 - DNA, 15 bp, Homo sapiens
ctgtgtatgtatcat

SEQ ID NO: 47961 - DNA, 15 bp, Homo sapiens
gctgtgtatgtatca

SEQ ID NO: 47962 - DNA, 15 bp, Homo sapiens
tgctgtgtatgtatc

SEQ ID NO: 47963 - DNA, 15 bp, Homo sapiens
ctgctgtgtatgtat

SEQ ID NO: 47964 - DNA, 15 bp, Homo sapiens
actgctgtgtatgta

SEQ ID NO: 47965 - DNA, 15 bp, Homo sapiens
tactgctgtgtatgt

SEQ ID NO: 47966 - DNA, 15 bp, Homo sapiens
gtactgctgtgtatg

SEQ ID NO: 47967 - DNA, 15 bp, Homo sapiens
cgtactgctgtgtat

SEQ ID NO: 47968 - DNA, 15 bp, Homo sapiens
ccgtactgctgtgta

SEQ ID NO: 47969 - DNA, 15 bp, Homo sapiens
tccgtactgctgtgt

SEQ ID NO: 47970 - DNA, 15 bp, Homo sapiens
ctccgtactgctgtg

SEQ ID NO: 47971 - DNA, 15 bp, Homo sapiens
tctccgtactgctgt

SEQ ID NO: 47972 - DNA, 15 bp, Homo sapiens
ctctccgtactgctg

SEQ ID NO: 47973 - DNA, 15 bp, Homo sapiens
tctctccgtactgct

SEQ ID NO: 47974 - DNA, 15 bp, Homo sapiens
ttctctccgtactgc

SEQ ID NO: 47975 - DNA, 15 bp, Homo sapiens
tttctctccgtactg

SEQ ID NO: 47976 - DNA, 15 bp, Homo sapiens
ttttctctccgtact

SEQ ID NO: 47977 - DNA, 15 bp, Homo sapiens
tttttctctccgtac

SEQ ID NO: 47978 - DNA, 15 bp, Homo sapiens
ctttttctctccgta

SEQ ID NO: 47979 - DNA, 15 bp, Homo sapiens
tctttttctctccgt

SEQ ID NO: 47980 - DNA, 15 bp, Homo sapiens
ttctttttctctccg

SEQ ID NO: 47981 - DNA, 15 bp, Homo sapiens
ctgttctttttctct

SEQ ID NO: 47982 - DNA, 15 bp, Homo sapiens
gctgttctttttctc

SEQ ID NO: 47983 - DNA, 15 bp, Homo sapiens
agctgttctttttct

SEQ ID NO: 47984 - DNA, 15 bp, Homo sapiens
aagctgttctttttc

SEQ ID NO: 47985 - DNA, 15 bp, Homo sapiens
caagctgttcttttt

SEQ ID NO: 47986 - DNA, 15 bp, Homo sapiens
acaagctgttctttt

SEQ ID NO: 47987 - DNA, 15 bp, Homo sapiens
cacaagctgttcttt

SEQ ID NO: 47988 - DNA, 15 bp, Homo sapiens
tcacaagctgttctt

SEQ ID NO: 47989 - DNA, 15 bp, Homo sapiens
ctcacaagctgttct

SEQ ID NO: 47990 - DNA, 15 bp, Homo sapiens
tctcacaagctgttc

SEQ ID NO: 47991 - DNA, 15 bp, Homo sapiens
ctctcacaagctgtt

SEQ ID NO: 47992 - DNA, 15 bp, Homo sapiens
gctctcacaagctgt

SEQ ID NO: 47993 - DNA, 15 bp, Homo sapiens
tgctctcacaagctg

SEQ ID NO: 47994 - DNA, 15 bp, Homo sapiens
atgctctcacaagct

SEQ ID NO: 47995 - DNA, 15 bp, Homo sapiens
catgctctcacaagc

SEQ ID NO: 47996 - DNA, 15 bp, Homo sapiens
tcatgctctcacaag

SEQ ID NO: 47997 - DNA, 15 bp, Homo sapiens
ttcatgctctcacaa

SEQ ID NO: 47998 - DNA, 15 bp, Homo sapiens
cttcatgctctcaca

SEQ ID NO: 47999 - DNA, 15 bp, Homo sapiens
tcttcatgctctcac

SEQ ID NO: 48000 - DNA, 15 bp, Homo sapiens
ctcttcatgctctca

SEQ ID NO: 48001 - DNA, 15 bp, Homo sapiens
gctcttcatgctctc

SEQ ID NO: 48002 - DNA, 15 bp, Homo sapiens
ggctcttcatgctct

SEQ ID NO: 48003 - DNA, 15 bp, Homo sapiens
tggctcttcatgctc

SEQ ID NO: 48004 - DNA, 15 bp, Homo sapiens
ctggctcttcatgct

SEQ ID NO: 48005 - DNA, 15 bp, Homo sapiens
gctggctcttcatgc

SEQ ID NO: 48006 - DNA, 15 bp, Homo sapiens
ggctggctcttcatg

SEQ ID NO: 48007 - DNA, 15 bp, Homo sapiens
gggctggctcttcat

SEQ ID NO: 48008 - DNA, 15 bp, Homo sapiens
ggggctggctcttca

SEQ ID NO: 48009 - DNA, 15 bp, Homo sapiens
aggggctggctcttc

SEQ ID NO: 48010 - DNA, 15 bp, Homo sapiens
caggggctggctctt

SEQ ID NO: 48011 - DNA, 15 bp, Homo sapiens
ccaggggctggctct

SEQ ID NO: 48012 - DNA, 15 bp, Homo sapiens
cccaggggctggctc

SEQ ID NO: 48013 - DNA, 15 bp, Homo sapiens
tcccaggggctggct

SEQ ID NO: 48014 - DNA, 15 bp, Homo sapiens
atcccaggggctggc

SEQ ID NO: 48015 - DNA, 15 bp, Homo sapiens
gatcccaggggctgg

SEQ ID NO: 48016 - DNA, 15 bp, Homo sapiens
tgatcccaggggctg

SEQ ID NO: 48017 - DNA, 15 bp, Homo sapiens
ttgatcccaggggct

SEQ ID NO: 48018 - DNA, 15 bp, Homo sapiens
cttgatcccaggggc

SEQ ID NO: 48019 - DNA, 15 bp, Homo sapiens
tcttgatcccagggg

SEQ ID NO: 48020 - DNA, 15 bp, Homo sapiens
ttcttgatcccaggg

SEQ ID NO: 48021 - DNA, 15 bp, Homo sapiens
tttcttgatcccagg

SEQ ID NO: 48022 - DNA, 15 bp, Homo sapiens
ttttcttgatcccag

SEQ ID NO: 48023 - DNA, 15 bp, Homo sapiens
attttcttgatccca

SEQ ID NO: 48024 - DNA, 15 bp, Homo sapiens
tattttcttgatccc

SEQ ID NO: 48025 - DNA, 15 bp, Homo sapiens
gtattttcttgatcc

SEQ ID NO: 48026 - DNA, 15 bp, Homo sapiens
ggtattttcttgatc

SEQ ID NO: 48027 - DNA, 15 bp, Homo sapiens
tggtattttcttgat

SEQ ID NO: 48028 - DNA, 15 bp, Homo sapiens
ctggtattttcttga

SEQ ID NO: 48029 - DNA, 15 bp, Homo sapiens
cctggtattttcttg

SEQ ID NO: 48030 - DNA, 15 bp, Homo sapiens
tcctggtattttctt

SEQ ID NO: 48031 - DNA, 15 bp, Homo sapiens
ttcctggtattttct

SEQ ID NO: 48032 - DNA, 15 bp, Homo sapiens
attcctggtattttc

SEQ ID NO: 48033 - DNA, 15 bp, Homo sapiens
tattcctggtatttt

SEQ ID NO: 48034 - DNA, 15 bp, Homo sapiens
ctattcctggtattt

SEQ ID NO: 48035 - DNA, 15 bp, Homo sapiens
gctattcctggtatt

SEQ ID NO: 48036 - DNA, 15 bp, Homo sapiens
agctattcctggtat

SEQ ID NO: 48037 - DNA, 15 bp, Homo sapiens
gagctattcctggta

SEQ ID NO: 48038 - DNA, 15 bp, Homo sapiens
tgagctattcctggt

SEQ ID NO: 48039 - DNA, 15 bp, Homo sapiens
gtgagctattcctgg

SEQ ID NO: 48040 - DNA, 15 bp, Homo sapiens
agtgagctattcctg

SEQ ID NO: 48041 - DNA, 15 bp, Homo sapiens
cagtgagctattcct

SEQ ID NO: 48042 - DNA, 15 bp, Homo sapiens
gcagtgagctattcc

SEQ ID NO: 48043 - DNA, 15 bp, Homo sapiens
ggcagtgagctattc

SEQ ID NO: 48044 - DNA, 15 bp, Homo sapiens
gggcagtgagctatt

SEQ ID NO: 48045 - DNA, 15 bp, Homo sapiens
agggcagtgagctat

SEQ ID NO: 48046 - DNA, 15 bp, Homo sapiens
cagggcagtgagcta

SEQ ID NO: 48047 - DNA, 15 bp, Homo sapiens
gcagggcagtgagct

SEQ ID NO: 48048 - DNA, 15 bp, Homo sapiens
cgcagggcagtgagc

SEQ ID NO: 48049 - DNA, 15 bp, Homo sapiens
ccgcagggcagtgag

SEQ ID NO: 48050 - DNA, 15 bp, Homo sapiens
cccgcagggcagtga

SEQ ID NO: 48051 - DNA, 15 bp, Homo sapiens
gcccgcagggcagtg

SEQ ID NO: 48052 - DNA, 15 bp, Homo sapiens
agcccgcagggcagt

SEQ ID NO: 48053 - DNA, 15 bp, Homo sapiens
aagcccgcagggcag

SEQ ID NO: 48054 - DNA, 15 bp, Homo sapiens
gaagcccgcagggca

SEQ ID NO: 48055 - DNA, 15 bp, Homo sapiens
agaagcccgcagggc

SEQ ID NO: 48056 - DNA, 15 bp, Homo sapiens
aagaagcccgcaggg

SEQ ID NO: 48057 - DNA, 15 bp, Homo sapiens
gaagaagcccgcagg

SEQ ID NO: 48058 - DNA, 15 bp, Homo sapiens
agaagaagcccgcag

SEQ ID NO: 48059 - DNA, 15 bp, Homo sapiens
gagaagaagcccgca

SEQ ID NO: 48060 - DNA, 15 bp, Homo sapiens
agagaagaagcccgc

SEQ ID NO: 48061 - DNA, 15 bp, Homo sapiens
gagagaagaagcccg

SEQ ID NO: 48062 - DNA, 15 bp, Homo sapiens
tgagagaagaagccc

SEQ ID NO: 48063 - DNA, 15 bp, Homo sapiens
ctgagagaagaagcc

SEQ ID NO: 48064 - DNA, 15 bp, Homo sapiens
tctgagagaagaagc

SEQ ID NO: 48065 - DNA, 15 bp, Homo sapiens
ttctgagagaagaag

SEQ ID NO: 48066 - DNA, 15 bp, Homo sapiens
cttctgagagaagaa

SEQ ID NO: 48067 - DNA, 15 bp, Homo sapiens
tcttctgagagaaga

SEQ ID NO: 48068 - DNA, 15 bp, Homo sapiens
ttcttctgagagaag

SEQ ID NO: 48069 - DNA, 15 bp, Homo sapiens
tttcttctgagagaa

SEQ ID NO: 48070 - DNA, 15 bp, Homo sapiens
atttcttctgagaga

SEQ ID NO: 48071 - DNA, 15 bp, Homo sapiens
catttcttctgagag

SEQ ID NO: 48072 - DNA, 15 bp, Homo sapiens
tcatttcttctgaga

SEQ ID NO: 48073 - DNA, 15 bp, Homo sapiens
ctcatttcttctgag

SEQ ID NO: 48074 - DNA, 15 bp, Homo sapiens
tctcatttcttctga

SEQ ID NO: 48075 - DNA, 15 bp, Homo sapiens
gtctcatttcttctg

SEQ ID NO: 48076 - DNA, 15 bp, Homo sapiens
agtctcatttcttct

SEQ ID NO: 48077 - DNA, 15 bp, Homo sapiens
tagtctcatttcttc

SEQ ID NO: 48078 - DNA, 15 bp, Homo sapiens
atagtctcatttctt

SEQ ID NO: 48079 - DNA, 15 bp, Homo sapiens
tatagtctcatttct

SEQ ID NO: 48080 - DNA, 15 bp, Homo sapiens
ttatagtctcatttc

SEQ ID NO: 48081 - DNA, 15 bp, Homo sapiens
attatagtctcattt

SEQ ID NO: 48082 - DNA, 15 bp, Homo sapiens
cattatagtctcatt

SEQ ID NO: 48083 - DNA, 15 bp, Homo sapiens
ccattatagtctcat

SEQ ID NO: 48084 - DNA, 15 bp, Homo sapiens
gccattatagtctca

SEQ ID NO: 48085 - DNA, 15 bp, Homo sapiens
agccattatagtctc

SEQ ID NO: 48086 - DNA, 15 bp, Homo sapiens
aagccattatagtct

SEQ ID NO: 48087 - DNA, 15 bp, Homo sapiens
gaagccattatagtc

SEQ ID NO: 48088 - DNA, 15 bp, Homo sapiens
tgaagccattatagt

SEQ ID NO: 48089 - DNA, 15 bp, Homo sapiens
gtgaagccattatag

SEQ ID NO: 48090 - DNA, 15 bp, Homo sapiens
tgtgaagccattata

SEQ ID NO: 48091 - DNA, 15 bp, Homo sapiens
ctgtgaagccattat

SEQ ID NO: 48092 - DNA, 15 bp, Homo sapiens
cctgtgaagccatta

SEQ ID NO: 48093 - DNA, 15 bp, Homo sapiens
acctgtgaagccatt

SEQ ID NO: 48094 - DNA, 15 bp, Homo sapiens
aacctgtgaagccat

SEQ ID NO: 48095 - DNA, 15 bp, Homo sapiens
aaacctgtgaagcca

SEQ ID NO: 48096 - DNA, 15 bp, Homo sapiens
caaacctgtgaagcc

SEQ ID NO: 48097 - DNA, 15 bp, Homo sapiens
tcaaacctgtgaagc

SEQ ID NO: 48098 - DNA, 15 bp, Homo sapiens
atcaaacctgtgaag

SEQ ID NO: 48099 - DNA, 15 bp, Homo sapiens
tatcaaacctgtgaa

SEQ ID NO: 48100 - DNA, 15 bp, Homo sapiens
ctatcaaacctgtga

SEQ ID NO: 48101 - DNA, 15 bp, Homo sapiens
gctatcaaacctgtg

SEQ ID NO: 48102 - DNA, 15 bp, Homo sapiens
ggctatcaaacctgt

SEQ ID NO: 48103 - DNA, 15 bp, Homo sapiens
tggctatcaaacctg

SEQ ID NO: 48104 - DNA, 15 bp, Homo sapiens
ctggctatcaaacct

SEQ ID NO: 48105 - DNA, 15 bp, Homo sapiens
actggctatcaaacc

SEQ ID NO: 48106 - DNA, 15 bp, Homo sapiens
cactggctatcaaac

SEQ ID NO: 48107 - DNA, 15 bp, Homo sapiens
tcactggctatcaaa

SEQ ID NO: 48108 - DNA, 15 bp, Homo sapiens
ctcactggctatcaa

SEQ ID NO: 48109 - DNA, 15 bp, Homo sapiens
cctcactggctatca

SEQ ID NO: 48110 - DNA, 15 bp, Homo sapiens
acctcactggctatc

SEQ ID NO: 48111 - DNA, 15 bp, Homo sapiens
cacctcactggctat

SEQ ID NO: 48112 - DNA, 15 bp, Homo sapiens
tcacctcactggcta

SEQ ID NO: 48113 - DNA, 15 bp, Homo sapiens
gtcacctcactggct

SEQ ID NO: 48114 - DNA, 15 bp, Homo sapiens
tgtcacctcactggc

SEQ ID NO: 48115 - DNA, 15 bp, Homo sapiens
gtgtcacctcactgg

SEQ ID NO: 48116 - DNA, 15 bp, Homo sapiens
tgtgtcacctcactg

SEQ ID NO: 48117 - DNA, 15 bp, Homo sapiens
ctgtgtcacctcact

SEQ ID NO: 48118 - DNA, 15 bp, Homo sapiens
gctgtgtcacctcac

SEQ ID NO: 48119 - DNA, 15 bp, Homo sapiens
tgctgtgtcacctca

SEQ ID NO: 48120 - DNA, 15 bp, Homo sapiens
atgctgtgtcacctc

SEQ ID NO: 48121 - DNA, 15 bp, Homo sapiens
gatgctgtgtcacct

SEQ ID NO: 48122 - DNA, 15 bp, Homo sapiens
agatgctgtgtcacc

SEQ ID NO: 48123 - DNA, 15 bp, Homo sapiens
aagatgctgtgtcac

SEQ ID NO: 48124 - DNA, 15 bp, Homo sapiens
caagatgctgtgtca

SEQ ID NO: 48125 - DNA, 15 bp, Homo sapiens
ccaagatgctgtgtc

SEQ ID NO: 48126 - DNA, 15 bp, Homo sapiens
cccaagatgctgtgt

SEQ ID NO: 48127 - DNA, 15 bp, Homo sapiens
tcccaagatgctgtg

SEQ ID NO: 48128 - DNA, 15 bp, Homo sapiens
ttcccaagatgctgt

SEQ ID NO: 48129 - DNA, 15 bp, Homo sapiens
cttcccaagatgctg

SEQ ID NO: 48130 - DNA, 15 bp, Homo sapiens
tcttcccaagatgct

SEQ ID NO: 48131 - DNA, 15 bp, Homo sapiens
gtcttcccaagatgc

SEQ ID NO: 48132 - DNA, 15 bp, Homo sapiens
tgtcttcccaagatg

SEQ ID NO: 48133 - DNA, 15 bp, Homo sapiens
atgtcttcccaagat

SEQ ID NO: 48134 - DNA, 15 bp, Homo sapiens
catgtcttcccaaga

SEQ ID NO: 48135 - DNA, 15 bp, Homo sapiens
ccatgtcttcccaag

SEQ ID NO: 48136 - DNA, 15 bp, Homo sapiens
accatgtcttcccaa

SEQ ID NO: 48137 - DNA, 15 bp, Homo sapiens
gaccatgtcttccca

SEQ ID NO: 48138 - DNA, 15 bp, Homo sapiens
ggaccatgtcttccc

SEQ ID NO: 48139 - DNA, 15 bp, Homo sapiens
tggaccatgtcttcc

SEQ ID NO: 48140 - DNA, 15 bp, Homo sapiens
gtggaccatgtcttc

SEQ ID NO: 48141 - DNA, 15 bp, Homo sapiens
agtggaccatgtctt

SEQ ID NO: 48142 - DNA, 15 bp, Homo sapiens
aagtggaccatgtct

SEQ ID NO: 48143 - DNA, 15 bp, Homo sapiens
caagtggaccatgtc

SEQ ID NO: 48144 - DNA, 15 bp, Homo sapiens
acaagtggaccatgt

SEQ ID NO: 48145 - DNA, 15 bp, Homo sapiens
cacaagtggaccatg

SEQ ID NO: 48146 - DNA, 15 bp, Homo sapiens
acacaagtggaccat

SEQ ID NO: 48147 - DNA, 15 bp, Homo sapiens
aacacaagtggacca

SEQ ID NO: 48148 - DNA, 15 bp, Homo sapiens
taacacaagtggacc

SEQ ID NO: 48149 - DNA, 15 bp, Homo sapiens
ataacacaagtggac

SEQ ID NO: 48150 - DNA, 15 bp, Homo sapiens
aataacacaagtgga

SEQ ID NO: 48151 - DNA, 15 bp, Homo sapiens
taataacacaagtgg

SEQ ID NO: 48152 - DNA, 15 bp, Homo sapiens
ataataacacaagtg

SEQ ID NO: 48153 - DNA, 15 bp, Homo sapiens
aataataacacaagt

SEQ ID NO: 48154 - DNA, 15 bp, Homo sapiens
caataataacacaag

SEQ ID NO: 48155 - DNA, 15 bp, Homo sapiens
gcaataataacacaa

SEQ ID NO: 48156 - DNA, 15 bp, Homo sapiens
ggcaataataacaca

SEQ ID NO: 48157 - DNA, 15 bp, Homo sapiens
gggcaataataacac

SEQ ID NO: 48158 - DNA, 15 bp, Homo sapiens
tgggcaataataaca

SEQ ID NO: 48159 - DNA, 15 bp, Homo sapiens
atgggcaataataac

SEQ ID NO: 48160 - DNA, 15 bp, Homo sapiens
gatgggcaataataa

SEQ ID NO: 48161 - DNA, 15 bp, Homo sapiens
cgatgggcaataata

SEQ ID NO: 48162 - DNA, 15 bp, Homo sapiens
ccgatgggcaataat

SEQ ID NO: 48163 - DNA, 15 bp, Homo sapiens
tccgatgggcaataa

SEQ ID NO: 48164 - DNA, 15 bp, Homo sapiens
atccgatgggcaata

SEQ ID NO: 48165 - DNA, 15 bp, Homo sapiens
aatccgatgggcaat

SEQ ID NO: 48166 - DNA, 15 bp, Homo sapiens
gaatccgatgggcaa

SEQ ID NO: 48167 - DNA, 15 bp, Homo sapiens
tgaatccgatgggca

SEQ ID NO: 48168 - DNA, 15 bp, Homo sapiens
atgaatccgatgggc

SEQ ID NO: 48169 - DNA, 15 bp, Homo sapiens
aatgaatccgatggg

SEQ ID NO: 48170 - DNA, 15 bp, Homo sapiens
gaatgaatccgatgg

SEQ ID NO: 48171 - DNA, 15 bp, Homo sapiens
ggaatgaatccgatg

SEQ ID NO: 48172 - DNA, 15 bp, Homo sapiens
gggaatgaatccgat

SEQ ID NO: 48173 - DNA, 15 bp, Homo sapiens
ggggaatgaatccga

SEQ ID NO: 48174 - DNA, 15 bp, Homo sapiens
tggggaatgaatccg

SEQ ID NO: 48175 - DNA, 15 bp, Homo sapiens
ttggggaatgaatcc

SEQ ID NO: 48176 - DNA, 15 bp, Homo sapiens
cttggggaatgaatc

SEQ ID NO: 48177 - DNA, 15 bp, Homo sapiens
gcttggggaatgaat

SEQ ID NO: 48178 - DNA, 15 bp, Homo sapiens
tgcttggggaatgaa

SEQ ID NO: 48179 - DNA, 15 bp, Homo sapiens
ttgcttggggaatga

SEQ ID NO: 48180 - DNA, 15 bp, Homo sapiens
gttgcttggggaatg

SEQ ID NO: 48181 - DNA, 15 bp, Homo sapiens
agttgcttggggaat

SEQ ID NO: 48182 - DNA, 15 bp, Homo sapiens
tagttgcttggggaa

SEQ ID NO: 48183 - DNA, 15 bp, Homo sapiens
ctagttgcttgggga

SEQ ID NO: 48184 - DNA, 15 bp, Homo sapiens
actagttgcttgggg

SEQ ID NO: 48185 - DNA, 15 bp, Homo sapiens
aactagttgcttggg

SEQ ID NO: 48186 - DNA, 15 bp, Homo sapiens
gaactagttgcttgg

SEQ ID NO: 48187 - DNA, 15 bp, Homo sapiens
tgaactagttgcttg

SEQ ID NO: 48188 - DNA, 15 bp, Homo sapiens
atgaactagttgctt

SEQ ID NO: 48189 - DNA, 15 bp, Homo sapiens
aatgaactagttgct

SEQ ID NO: 48190 - DNA, 15 bp, Homo sapiens
caatgaactagttgc

SEQ ID NO: 48191 - DNA, 15 bp, Homo sapiens
acaatgaactagttg

SEQ ID NO: 48192 - DNA, 15 bp, Homo sapiens
tacaatgaactagtt

SEQ ID NO: 48193 - DNA, 15 bp, Homo sapiens
ttacaatgaactagt

SEQ ID NO: 48194 - DNA, 15 bp, Homo sapiens
tttacaatgaactag

SEQ ID NO: 48195 - DNA, 15 bp, Homo sapiens
gtttacaatgaacta

SEQ ID NO: 48196 - DNA, 15 bp, Homo sapiens
agtttacaatgaact

SEQ ID NO: 48197 - DNA, 15 bp, Homo sapiens
tagtttacaatgaac

SEQ ID NO: 48198 - DNA, 15 bp, Homo sapiens
ttagtttacaatgaa

SEQ ID NO: 48199 - DNA, 15 bp, Homo sapiens
tttagtttacaatga

SEQ ID NO: 48200 - DNA, 15 bp, Homo sapiens
ctttagtttacaatg

SEQ ID NO: 48201 - DNA, 15 bp, Homo sapiens
gctttagtttacaat

SEQ ID NO: 48202 - DNA, 15 bp, Homo sapiens
tgctttagtttacaa

SEQ ID NO: 48203 - DNA, 15 bp, Homo sapiens
ttgctttagtttaca

SEQ ID NO: 48204 - DNA, 15 bp, Homo sapiens
tttgctttagtttac

SEQ ID NO: 48205 - DNA, 15 bp, Homo sapiens
ttttgctttagttta

SEQ ID NO: 48206 - DNA, 15 bp, Homo sapiens
gttttgctttagttt

SEQ ID NO: 48207 - DNA, 15 bp, Homo sapiens
tgttttgctttagtt

SEQ ID NO: 48208 - DNA, 15 bp, Homo sapiens
atgttttgctttagt

SEQ ID NO: 48209 - DNA, 15 bp, Homo sapiens
tatgttttgctttag

SEQ ID NO: 48210 - DNA, 15 bp, Homo sapiens
atatgttttgcttta

SEQ ID NO: 48211 - DNA, 15 bp, Homo sapiens
gatatgttttgcttt

SEQ ID NO: 48212 - DNA, 15 bp, Homo sapiens
cgatatgttttgctt

SEQ ID NO: 48213 - DNA, 15 bp, Homo sapiens
acgatatgttttgct

SEQ ID NO: 48214 - DNA, 15 bp, Homo sapiens
aacgatatgttttgc

SEQ ID NO: 48215 - DNA, 15 bp, Homo sapiens
taacgatatgttttg

SEQ ID NO: 48216 - DNA, 15 bp, Homo sapiens
ttaacgatatgtttt

SEQ ID NO: 48217 - DNA, 15 bp, Homo sapiens
tttaacgatatgttt

SEQ ID NO: 48218 - DNA, 15 bp, Homo sapiens
ttttaacgatatgtt

SEQ ID NO: 48219 - DNA, 15 bp, Homo sapiens
tttttaacgatatgt

SEQ ID NO: 48220 - DNA, 15 bp, Homo sapiens
ttttttaacgatatg

SEQ ID NO: 48221 - DNA, 15 bp, Homo sapiens
tttttttaacgatat

SEQ ID NO: 48222 - DNA, 15 bp, Homo sapiens
ttttttttaacgata

SEQ ID NO: 48223 - DNA, 15 bp, Homo sapiens
tttttttttaacgat

SEQ ID NO: 48224 - DNA, 15 bp, Homo sapiens
ttttttttttaacga

SEQ ID NO: 48225 - DNA, 15 bp, Homo sapiens
tttttttttttaacg

SEQ ID NO: 48226 - DNA, 15 bp, Homo sapiens
gatttttttttttta

SEQ ID NO: 48227 - DNA, 15 bp, Homo sapiens
gttgatttttttttt

SEQ ID NO: 48228 - DNA, 15 bp, Homo sapiens
agttgattttttttt

SEQ ID NO: 48229 - DNA, 15 bp, Homo sapiens
aagttgatttttttt

SEQ ID NO: 48230 - DNA, 15 bp, Homo sapiens
caagttgattttttt

SEQ ID NO: 48231 - DNA, 15 bp, Homo sapiens
acaagttgatttttt

SEQ ID NO: 48232 - DNA, 15 bp, Homo sapiens
tacaagttgattttt

SEQ ID NO: 48233 - DNA, 15 bp, Homo sapiens
atacaagttgatttt

SEQ ID NO: 48234 - DNA, 15 bp, Homo sapiens
aatacaagttgattt

SEQ ID NO: 48235 - DNA, 15 bp, Homo sapiens
aaatacaagttgatt

SEQ ID NO: 48236 - DNA, 15 bp, Homo sapiens
taaatacaagttgat

SEQ ID NO: 48237 - DNA, 15 bp, Homo sapiens
ctaaatacaagttga

SEQ ID NO: 48238 - DNA, 15 bp, Homo sapiens
gctaaatacaagttg

SEQ ID NO: 48239 - DNA, 15 bp, Homo sapiens
agctaaatacaagtt

SEQ ID NO: 48240 - DNA, 15 bp, Homo sapiens
aagctaaatacaagt

SEQ ID NO: 48241 - DNA, 15 bp, Homo sapiens
aaagctaaatacaag

SEQ ID NO: 48242 - DNA, 15 bp, Homo sapiens
aaaagctaaatacaa

SEQ ID NO: 48243 - DNA, 15 bp, Homo sapiens
aaaaagctaaataca

SEQ ID NO: 48244 - DNA, 15 bp, Homo sapiens
taaaaagctaaatac

SEQ ID NO: 48245 - DNA, 15 bp, Homo sapiens
gtaaaaagctaaata

SEQ ID NO: 48246 - DNA, 15 bp, Homo sapiens
tgtaaaaagctaaat

SEQ ID NO: 48247 - DNA, 15 bp, Homo sapiens
ctgtaaaaagctaaa

SEQ ID NO: 48248 - DNA, 15 bp, Homo sapiens
tctgtaaaaagctaa

SEQ ID NO: 48249 - DNA, 15 bp, Homo sapiens
ctctgtaaaaagcta

SEQ ID NO: 48250 - DNA, 15 bp, Homo sapiens
actctgtaaaaagct

SEQ ID NO: 48251 - DNA, 15 bp, Homo sapiens
cactctgtaaaaagc

SEQ ID NO: 48252 - DNA, 15 bp, Homo sapiens
tcactctgtaaaaag

SEQ ID NO: 48253 - DNA, 15 bp, Homo sapiens
ttcactctgtaaaaa

SEQ ID NO: 48254 - DNA, 15 bp, Homo sapiens
cttcactctgtaaaa

SEQ ID NO: 48255 - DNA, 15 bp, Homo sapiens
acttcactctgtaaa

SEQ ID NO: 48256 - DNA, 15 bp, Homo sapiens
cacttcactctgtaa

SEQ ID NO: 48257 - DNA, 15 bp, Homo sapiens
tcacttcactctgta

SEQ ID NO: 48258 - DNA, 15 bp, Homo sapiens
ttcacttcactctgt

SEQ ID NO: 48259 - DNA, 15 bp, Homo sapiens
tttcacttcactctg

SEQ ID NO: 48260 - DNA, 15 bp, Homo sapiens
gtttcacttcactct

SEQ ID NO: 48261 - DNA, 15 bp, Homo sapiens
agtttcacttcactc

SEQ ID NO: 48262 - DNA, 15 bp, Homo sapiens
gagtttcacttcact

SEQ ID NO: 48263 - DNA, 15 bp, Homo sapiens
agagtttcacttcac

SEQ ID NO: 48264 - DNA, 15 bp, Homo sapiens
cagagtttcacttca

SEQ ID NO: 48265 - DNA, 15 bp, Homo sapiens
acagagtttcacttc

SEQ ID NO: 48266 - DNA, 15 bp, Homo sapiens
aacagagtttcactt

SEQ ID NO: 48267 - DNA, 15 bp, Homo sapiens
aaacagagtttcact

SEQ ID NO: 48268 - DNA, 15 bp, Homo sapiens
aaaacagagtttcac

SEQ ID NO: 48269 - DNA, 15 bp, Homo sapiens
taaaacagagtttca

SEQ ID NO: 48270 - DNA, 15 bp, Homo sapiens
ttaaaacagagtttc

SEQ ID NO: 48271 - DNA, 15 bp, Homo sapiens
tttaaaacagagttt

SEQ ID NO: 48272 - DNA, 15 bp, Homo sapiens
atttaaaacagagtt

SEQ ID NO: 48273 - DNA, 15 bp, Homo sapiens
catttaaaacagagt

SEQ ID NO: 48274 - DNA, 15 bp, Homo sapiens
gcatttaaaacagag

SEQ ID NO: 48275 - DNA, 15 bp, Homo sapiens
cgcatttaaaacaga

SEQ ID NO: 48276 - DNA, 15 bp, Homo sapiens
ccgcatttaaaacag

SEQ ID NO: 48277 - DNA, 15 bp, Homo sapiens
accgcatttaaaaca

SEQ ID NO: 48278 - DNA, 15 bp, Homo sapiens
aaccgcatttaaaac

SEQ ID NO: 48279 - DNA, 15 bp, Homo sapiens
aaaccgcatttaaaa

SEQ ID NO: 48280 - DNA, 15 bp, Homo sapiens
aaaaccgcatttaaa

SEQ ID NO: 48281 - DNA, 15 bp, Homo sapiens
aaaaaccgcatttaa

SEQ ID NO: 48282 - DNA, 15 bp, Homo sapiens
taaaaaccgcattta

SEQ ID NO: 48283 - DNA, 15 bp, Homo sapiens
ctaaaaaccgcattt

SEQ ID NO: 48284 - DNA, 15 bp, Homo sapiens
gctaaaaaccgcatt

SEQ ID NO: 48285 - DNA, 15 bp, Homo sapiens
agctaaaaaccgcat

SEQ ID NO: 48286 - DNA, 15 bp, Homo sapiens
aagctaaaaaccgca

SEQ ID NO: 48287 - DNA, 15 bp, Homo sapiens
aaagctaaaaaccgc

SEQ ID NO: 48288 - DNA, 15 bp, Homo sapiens
taaagctaaaaaccg

SEQ ID NO: 48289 - DNA, 15 bp, Homo sapiens
ttaaagctaaaaacc

SEQ ID NO: 48290 - DNA, 15 bp, Homo sapiens
attaaagctaaaaac

SEQ ID NO: 48291 - DNA, 15 bp, Homo sapiens
tattaaagctaaaaa

SEQ ID NO: 48292 - DNA, 15 bp, Homo sapiens
ttattaaagctaaaa

SEQ ID NO: 48293 - DNA, 15 bp, Homo sapiens
gttattaaagctaaa

SEQ ID NO: 48294 - DNA, 15 bp, Homo sapiens
cgttattaaagctaa

SEQ ID NO: 48295 - DNA, 15 bp, Homo sapiens
acgttattaaagcta

SEQ ID NO: 48296 - DNA, 15 bp, Homo sapiens
gacgttattaaagct

SEQ ID NO: 48297 - DNA, 15 bp, Homo sapiens
tgacgttattaaagc

SEQ ID NO: 48298 - DNA, 15 bp, Homo sapiens
ttgacgttattaaag

SEQ ID NO: 48299 - DNA, 15 bp, Homo sapiens
cttgacgttattaaa

SEQ ID NO: 48300 - DNA, 15 bp, Homo sapiens
ccttgacgttattaa

SEQ ID NO: 48301 - DNA, 15 bp, Homo sapiens
accttgacgttatta

SEQ ID NO: 48302 - DNA, 15 bp, Homo sapiens
aaccttgacgttatt

SEQ ID NO: 48303 - DNA, 15 bp, Homo sapiens
aaaccttgacgttat

SEQ ID NO: 48304 - DNA, 15 bp, Homo sapiens
taaaccttgacgtta

SEQ ID NO: 48305 - DNA, 15 bp, Homo sapiens
ttaaaccttgacgtt

SEQ ID NO: 48306 - DNA, 15 bp, Homo sapiens
tttaaaccttgacgt

SEQ ID NO: 48307 - DNA, 15 bp, Homo sapiens
atttaaaccttgacg

SEQ ID NO: 48308 - DNA, 15 bp, Homo sapiens
catttaaaccttgac

SEQ ID NO: 48309 - DNA, 15 bp, Homo sapiens
acatttaaaccttga

SEQ ID NO: 48310 - DNA, 15 bp, Homo sapiens
cacatttaaaccttg

SEQ ID NO: 48311 - DNA, 15 bp, Homo sapiens
ccacatttaaacctt

SEQ ID NO: 48312 - DNA, 15 bp, Homo sapiens
gccacatttaaacct

SEQ ID NO: 48313 - DNA, 15 bp, Homo sapiens
tgccacatttaaacc

SEQ ID NO: 48314 - DNA, 15 bp, Homo sapiens
ttgccacatttaaac

SEQ ID NO: 48315 - DNA, 15 bp, Homo sapiens
tttgccacatttaaa

SEQ ID NO: 48316 - DNA, 15 bp, Homo sapiens
gtttgccacatttaa

SEQ ID NO: 48317 - DNA, 15 bp, Homo sapiens
agtttgccacattta

SEQ ID NO: 48318 - DNA, 15 bp, Homo sapiens
gagtttgccacattt

SEQ ID NO: 48319 - DNA, 15 bp, Homo sapiens
tgagtttgccacatt

SEQ ID NO: 48320 - DNA, 15 bp, Homo sapiens
gtgagtttgccacat

SEQ ID NO: 48321 - DNA, 15 bp, Homo sapiens
tgtgagtttgccaca

SEQ ID NO: 48322 - DNA, 15 bp, Homo sapiens
ttgtgagtttgccac

SEQ ID NO: 48323 - DNA, 15 bp, Homo sapiens
tttgtgagtttgcca

SEQ ID NO: 48324 - DNA, 15 bp, Homo sapiens
ttttgtgagtttgcc

SEQ ID NO: 48325 - DNA, 15 bp, Homo sapiens
tttttgtgagtttgc

SEQ ID NO: 48326 - DNA, 15 bp, Homo sapiens
atttttgtgagtttg

SEQ ID NO: 48327 - DNA, 15 bp, Homo sapiens
tatttttgtgagttt

SEQ ID NO: 48328 - DNA, 15 bp, Homo sapiens
atatttttgtgagtt

SEQ ID NO: 48329 - DNA, 15 bp, Homo sapiens
gatatttttgtgagt

SEQ ID NO: 48330 - DNA, 15 bp, Homo sapiens
tgatatttttgtgag

SEQ ID NO: 48331 - DNA, 15 bp, Homo sapiens
atgatatttttgtga

SEQ ID NO: 48332 - DNA, 15 bp, Homo sapiens
aatgatatttttgtg

SEQ ID NO: 48333 - DNA, 15 bp, Homo sapiens
aaatgatatttttgt

SEQ ID NO: 48334 - DNA, 15 bp, Homo sapiens
caaatgatatttttg

SEQ ID NO: 48335 - DNA, 15 bp, Homo sapiens
tcaaatgatattttt

SEQ ID NO: 48336 - DNA, 15 bp, Homo sapiens
ttcaaatgatatttt

SEQ ID NO: 48337 - DNA, 15 bp, Homo sapiens
tttcaaatgatattt

SEQ ID NO: 48338 - DNA, 15 bp, Homo sapiens
atttcaaatgatatt

SEQ ID NO: 48339 - DNA, 15 bp, Homo sapiens
catttcaaatgatat

SEQ ID NO: 48340 - DNA, 15 bp, Homo sapiens
acatttcaaatgata

SEQ ID NO: 48341 - DNA, 15 bp, Homo sapiens
aacatttcaaatgat

SEQ ID NO: 48342 - DNA, 15 bp, Homo sapiens
taacatttcaaatga

SEQ ID NO: 48343 - DNA, 15 bp, Homo sapiens
ttaacatttcaaatg

SEQ ID NO: 48344 - DNA, 15 bp, Homo sapiens
attaacatttcaaat

SEQ ID NO: 48345 - DNA, 15 bp, Homo sapiens
aattaacatttcaaa

SEQ ID NO: 48346 - DNA, 15 bp, Homo sapiens
taattaacatttcaa

SEQ ID NO: 48347 - DNA, 15 bp, Homo sapiens
ataattaacatttca

SEQ ID NO: 48348 - DNA, 15 bp, Homo sapiens
gataattaacatttc

SEQ ID NO: 48349 - DNA, 15 bp, Homo sapiens
agataattaacattt

SEQ ID NO: 48350 - DNA, 15 bp, Homo sapiens
tagataattaacatt

SEQ ID NO: 48351 - DNA, 15 bp, Homo sapiens
ttagataattaacat

SEQ ID NO: 48352 - DNA, 15 bp, Homo sapiens
tttagataattaaca

SEQ ID NO: 48353 - DNA, 15 bp, Homo sapiens
gtttagataattaac

SEQ ID NO: 48354 - DNA, 15 bp, Homo sapiens
agtttagataattaa

SEQ ID NO: 48355 - DNA, 15 bp, Homo sapiens
aagtttagataatta

SEQ ID NO: 48356 - DNA, 15 bp, Homo sapiens
gaagtttagataatt

SEQ ID NO: 48357 - DNA, 15 bp, Homo sapiens
agaagtttagataat

SEQ ID NO: 48358 - DNA, 15 bp, Homo sapiens
aagaagtttagataa

SEQ ID NO: 48359 - DNA, 15 bp, Homo sapiens
caagaagtttagata

SEQ ID NO: 48360 - DNA, 15 bp, Homo sapiens
acaagaagtttagat

SEQ ID NO: 48361 - DNA, 15 bp, Homo sapiens
tacaagaagtttaga

SEQ ID NO: 48362 - DNA, 15 bp, Homo sapiens
gtacaagaagtttag

SEQ ID NO: 48363 - DNA, 15 bp, Homo sapiens
tgtacaagaagttta

SEQ ID NO: 48364 - DNA, 15 bp, Homo sapiens
gtgtacaagaagttt

SEQ ID NO: 48365 - DNA, 15 bp, Homo sapiens
agtgtacaagaagtt

SEQ ID NO: 48366 - DNA, 15 bp, Homo sapiens
aagtgtacaagaagt

SEQ ID NO: 48367 - DNA, 15 bp, Homo sapiens
taagtgtacaagaag

SEQ ID NO: 48368 - DNA, 15 bp, Homo sapiens
ctaagtgtacaagaa

SEQ ID NO: 48369 - DNA, 15 bp, Homo sapiens
cctaagtgtacaaga

SEQ ID NO: 48370 - DNA, 15 bp, Homo sapiens
acctaagtgtacaag

SEQ ID NO: 48371 - DNA, 15 bp, Homo sapiens
tacctaagtgtacaa

SEQ ID NO: 48372 - DNA, 15 bp, Homo sapiens
ctacctaagtgtaca

SEQ ID NO: 48373 - DNA, 15 bp, Homo sapiens
actacctaagtgtac

SEQ ID NO: 48374 - DNA, 15 bp, Homo sapiens
aactacctaagtgta

SEQ ID NO: 48375 - DNA, 15 bp, Homo sapiens
aaactacctaagtgt

SEQ ID NO: 48376 - DNA, 15 bp, Homo sapiens
aaaactacctaagtg

SEQ ID NO: 48377 - DNA, 15 bp, Homo sapiens
caaaactacctaagt

SEQ ID NO: 48378 - DNA, 15 bp, Homo sapiens
tcaaaactacctaag

SEQ ID NO: 48379 - DNA, 15 bp, Homo sapiens
gtcaaaactacctaa

SEQ ID NO: 48380 - DNA, 15 bp, Homo sapiens
tgtcaaaactaccta

SEQ ID NO: 48381 - DNA, 15 bp, Homo sapiens
ttgtcaaaactacct

SEQ ID NO: 48382 - DNA, 15 bp, Homo sapiens
attgtcaaaactacc

SEQ ID NO: 48383 - DNA, 15 bp, Homo sapiens
aattgtcaaaactac

SEQ ID NO: 48384 - DNA, 15 bp, Homo sapiens
gaattgtcaaaacta

SEQ ID NO: 48385 - DNA, 15 bp, Homo sapiens
agaattgtcaaaact

SEQ ID NO: 48386 - DNA, 15 bp, Homo sapiens
cagaattgtcaaaac

SEQ ID NO: 48387 - DNA, 15 bp, Homo sapiens
tcagaattgtcaaaa

SEQ ID NO: 48388 - DNA, 15 bp, Homo sapiens
ttcagaattgtcaaa

SEQ ID NO: 48389 - DNA, 15 bp, Homo sapiens
tttcagaattgtcaa

SEQ ID NO: 48390 - DNA, 15 bp, Homo sapiens
ttttcagaattgtca

SEQ ID NO: 48391 - DNA, 15 bp, Homo sapiens
gttttcagaattgtc

SEQ ID NO: 48392 - DNA, 15 bp, Homo sapiens
agttttcagaattgt

SEQ ID NO: 48393 - DNA, 15 bp, Homo sapiens
tagttttcagaattg

SEQ ID NO: 48394 - DNA, 15 bp, Homo sapiens
gtagttttcagaatt

SEQ ID NO: 48395 - DNA, 15 bp, Homo sapiens
tgtagttttcagaat

SEQ ID NO: 48396 - DNA, 15 bp, Homo sapiens
atgtagttttcagaa

SEQ ID NO: 48397 - DNA, 15 bp, Homo sapiens
aatgtagttttcaga

SEQ ID NO: 48398 - DNA, 15 bp, Homo sapiens
aaatgtagttttcag

SEQ ID NO: 48399 - DNA, 15 bp, Homo sapiens
aaaatgtagttttca

SEQ ID NO: 48400 - DNA, 15 bp, Homo sapiens
aaaaatgtagttttc

SEQ ID NO: 48401 - DNA, 15 bp, Homo sapiens
taaaaatgtagtttt

SEQ ID NO: 48402 - DNA, 15 bp, Homo sapiens
ttaaaaatgtagttt

SEQ ID NO: 48403 - DNA, 15 bp, Homo sapiens
aattaaaaatgtagt

SEQ ID NO: 48404 - DNA, 15 bp, Homo sapiens
aaattaaaaatgtag

SEQ ID NO: 48405 - DNA, 15 bp, Homo sapiens
aaaattaaaaatgta

SEQ ID NO: 48406 - DNA, 15 bp, Homo sapiens
caaaattaaaaatgt

SEQ ID NO: 48407 - DNA, 15 bp, Homo sapiens
ccaaaattaaaaatg

SEQ ID NO: 48408 - DNA, 15 bp, Homo sapiens
gccaaaattaaaaat

SEQ ID NO: 48409 - DNA, 15 bp, Homo sapiens
agccaaaattaaaaa

SEQ ID NO: 48410 - DNA, 15 bp, Homo sapiens
aagccaaaattaaaa

SEQ ID NO: 48411 - DNA, 15 bp, Homo sapiens
aaagccaaaattaaa

SEQ ID NO: 48412 - DNA, 15 bp, Homo sapiens
aaaagccaaaattaa

SEQ ID NO: 48413 - DNA, 15 bp, Homo sapiens
aaaaagccaaaatta

SEQ ID NO: 48414 - DNA, 15 bp, Homo sapiens
aaaaaagccaaaatt

SEQ ID NO: 48415 - DNA, 15 bp, Homo sapiens
taaaaaagccaaaat

SEQ ID NO: 48416 - DNA, 15 bp, Homo sapiens
ttaaaaaagccaaaa

SEQ ID NO: 48417 - DNA, 15 bp, Homo sapiens
cttaaaaaagccaaa

SEQ ID NO: 48418 - DNA, 15 bp, Homo sapiens
ccttaaaaaagccaa

SEQ ID NO: 48419 - DNA, 15 bp, Homo sapiens
accttaaaaaagcca

SEQ ID NO: 48420 - DNA, 15 bp, Homo sapiens
gaccttaaaaaagcc

SEQ ID NO: 48421 - DNA, 15 bp, Homo sapiens
ggaccttaaaaaagc

SEQ ID NO: 48422 - DNA, 15 bp, Homo sapiens
aggaccttaaaaaag

SEQ ID NO: 48423 - DNA, 15 bp, Homo sapiens
gaggaccttaaaaaa

SEQ ID NO: 48424 - DNA, 15 bp, Homo sapiens
agaggaccttaaaaa

SEQ ID NO: 48425 - DNA, 15 bp, Homo sapiens
cagaggaccttaaaa

SEQ ID NO: 48426 - DNA, 15 bp, Homo sapiens
tcagaggaccttaaa

SEQ ID NO: 48427 - DNA, 15 bp, Homo sapiens
ctcagaggaccttaa

SEQ ID NO: 48428 - DNA, 15 bp, Homo sapiens
cctcagaggacctta

SEQ ID NO: 48429 - DNA, 15 bp, Homo sapiens
tcctcagaggacctt

SEQ ID NO: 48430 - DNA, 15 bp, Homo sapiens
atcctcagaggacct

SEQ ID NO: 48431 - DNA, 15 bp, Homo sapiens
catcctcagaggacc

SEQ ID NO: 48432 - DNA, 15 bp, Homo sapiens
acatcctcagaggac

SEQ ID NO: 48433 - DNA, 15 bp, Homo sapiens
gacatcctcagagga

SEQ ID NO: 48434 - DNA, 15 bp, Homo sapiens
cgacatcctcagagg

SEQ ID NO: 48435 - DNA, 15 bp, Homo sapiens
ccgacatcctcagag

SEQ ID NO: 48436 - DNA, 15 bp, Homo sapiens
tccgacatcctcaga

SEQ ID NO: 48437 - DNA, 15 bp, Homo sapiens
atccgacatcctcag

SEQ ID NO: 48438 - DNA, 15 bp, Homo sapiens
aatccgacatcctca

SEQ ID NO: 48439 - DNA, 15 bp, Homo sapiens
aaatccgacatcctc

SEQ ID NO: 48440 - DNA, 15 bp, Homo sapiens
aaaatccgacatcct

SEQ ID NO: 48441 - DNA, 15 bp, Homo sapiens
caaaatccgacatcc

SEQ ID NO: 48442 - DNA, 15 bp, Homo sapiens
tcaaaatccgacatc

SEQ ID NO: 48443 - DNA, 15 bp, Homo sapiens
ttcaaaatccgacat

SEQ ID NO: 48444 - DNA, 15 bp, Homo sapiens
tttcaaaatccgaca

SEQ ID NO: 48445 - DNA, 15 bp, Homo sapiens
ctttcaaaatccgac

SEQ ID NO: 48446 - DNA, 15 bp, Homo sapiens
tctttcaaaatccga

SEQ ID NO: 48447 - DNA, 15 bp, Homo sapiens
ttctttcaaaatccg

SEQ ID NO: 48448 - DNA, 15 bp, Homo sapiens
tttctttcaaaatcc

SEQ ID NO: 48449 - DNA, 15 bp, Homo sapiens
gtttctttcaaaatc

SEQ ID NO: 48450 - DNA, 15 bp, Homo sapiens
agtttctttcaaaat

SEQ ID NO: 48451 - DNA, 15 bp, Homo sapiens
gagtttctttcaaaa

SEQ ID NO: 48452 - DNA, 15 bp, Homo sapiens
tgagtttctttcaaa

SEQ ID NO: 48453 - DNA, 15 bp, Homo sapiens
ctgagtttctttcaa

SEQ ID NO: 48454 - DNA, 15 bp, Homo sapiens
cctgagtttctttca

SEQ ID NO: 48455 - DNA, 15 bp, Homo sapiens
ccctgagtttctttc

SEQ ID NO: 48456 - DNA, 15 bp, Homo sapiens
tccctgagtttcttt

SEQ ID NO: 48457 - DNA, 15 bp, Homo sapiens
ctccctgagtttctt

SEQ ID NO: 48458 - DNA, 15 bp, Homo sapiens
cctccctgagtttct

SEQ ID NO: 48459 - DNA, 15 bp, Homo sapiens
acctccctgagtttc

SEQ ID NO: 48460 - DNA, 15 bp, Homo sapiens
aacctccctgagttt

SEQ ID NO: 48461 - DNA, 15 bp, Homo sapiens
taacctccctgagtt

SEQ ID NO: 48462 - DNA, 15 bp, Homo sapiens
ttaacctccctgagt

SEQ ID NO: 48463 - DNA, 15 bp, Homo sapiens
tttaacctccctgag

SEQ ID NO: 48464 - DNA, 15 bp, Homo sapiens
gtttaacctccctga

SEQ ID NO: 48465 - DNA, 15 bp, Homo sapiens
tgtttaacctccctg

SEQ ID NO: 48466 - DNA, 15 bp, Homo sapiens
atgtttaacctccct

SEQ ID NO: 48467 - DNA, 15 bp, Homo sapiens
aatgtttaacctccc

SEQ ID NO: 48468 - DNA, 15 bp, Homo sapiens
aaatgtttaacctcc

SEQ ID NO: 48469 - DNA, 15 bp, Homo sapiens
gaaatgtttaacctc

SEQ ID NO: 48470 - DNA, 15 bp, Homo sapiens
agaaatgtttaacct

SEQ ID NO: 48471 - DNA, 15 bp, Homo sapiens
cagaaatgtttaacc

SEQ ID NO: 48472 - DNA, 15 bp, Homo sapiens
acagaaatgtttaac

SEQ ID NO: 48473 - DNA, 15 bp, Homo sapiens
aacagaaatgtttaa

SEQ ID NO: 48474 - DNA, 15 bp, Homo sapiens
aaacagaaatgttta

SEQ ID NO: 48475 - DNA, 15 bp, Homo sapiens
caaacagaaatgttt

SEQ ID NO: 48476 - DNA, 15 bp, Homo sapiens
tcaaacagaaatgtt

SEQ ID NO: 48477 - DNA, 15 bp, Homo sapiens
ctcaaacagaaatgt

SEQ ID NO: 48478 - DNA, 15 bp, Homo sapiens
tctcaaacagaaatg

SEQ ID NO: 48479 - DNA, 15 bp, Homo sapiens
ctctcaaacagaaat

SEQ ID NO: 48480 - DNA, 15 bp, Homo sapiens
gctctcaaacagaaa

SEQ ID NO: 48481 - DNA, 15 bp, Homo sapiens
tgctctcaaacagaa

SEQ ID NO: 48482 - DNA, 15 bp, Homo sapiens
ctgctctcaaacaga

SEQ ID NO: 48483 - DNA, 15 bp, Homo sapiens
actgctctcaaacag

SEQ ID NO: 48484 - DNA, 15 bp, Homo sapiens
gactgctctcaaaca

SEQ ID NO: 48485 - DNA, 15 bp, Homo sapiens
agactgctctcaaac

SEQ ID NO: 48486 - DNA, 15 bp, Homo sapiens
cagactgctctcaaa

SEQ ID NO: 48487 - DNA, 15 bp, Homo sapiens
acagactgctctcaa

SEQ ID NO: 48488 - DNA, 15 bp, Homo sapiens
tacagactgctctca

SEQ ID NO: 48489 - DNA, 15 bp, Homo sapiens
atacagactgctctc

SEQ ID NO: 48490 - DNA, 15 bp, Homo sapiens
gatacagactgctct

SEQ ID NO: 48491 - DNA, 15 bp, Homo sapiens
ggatacagactgctc

SEQ ID NO: 48492 - DNA, 15 bp, Homo sapiens
aggatacagactgct

SEQ ID NO: 48493 - DNA, 15 bp, Homo sapiens
caggatacagactgc

SEQ ID NO: 48494 - DNA, 15 bp, Homo sapiens
acaggatacagactg

SEQ ID NO: 48495 - DNA, 15 bp, Homo sapiens
aacaggatacagact

SEQ ID NO: 48496 - DNA, 15 bp, Homo sapiens
caacaggatacagac

SEQ ID NO: 48497 - DNA, 15 bp, Homo sapiens
ccaacaggatacaga

SEQ ID NO: 48498 - DNA, 15 bp, Homo sapiens
gccaacaggatacag

SEQ ID NO: 48499 - DNA, 15 bp, Homo sapiens
agccaacaggataca

SEQ ID NO: 48500 - DNA, 15 bp, Homo sapiens
aagccaacaggatac

SEQ ID NO: 48501 - DNA, 15 bp, Homo sapiens
aaagccaacaggata

SEQ ID NO: 48502 - DNA, 15 bp, Homo sapiens
caaagccaacaggat

SEQ ID NO: 48503 - DNA, 15 bp, Homo sapiens
acaaagccaacagga

SEQ ID NO: 48504 - DNA, 15 bp, Homo sapiens
aacaaagccaacagg

SEQ ID NO: 48505 - DNA, 15 bp, Homo sapiens
aaacaaagccaacag

SEQ ID NO: 48506 - DNA, 15 bp, Homo sapiens
gaaacaaagccaaca

SEQ ID NO: 48507 - DNA, 15 bp, Homo sapiens
agaaacaaagccaac

SEQ ID NO: 48508 - DNA, 15 bp, Homo sapiens
aagaaacaaagccaa

SEQ ID NO: 48509 - DNA, 15 bp, Homo sapiens
aaagaaacaaagcca

SEQ ID NO: 48510 - DNA, 15 bp, Homo sapiens
caaagaaacaaagcc

SEQ ID NO: 48511 - DNA, 15 bp, Homo sapiens
acaaagaaacaaagc

SEQ ID NO: 48512 - DNA, 15 bp, Homo sapiens
gacaaagaaacaaag

SEQ ID NO: 48513 - DNA, 15 bp, Homo sapiens
agacaaagaaacaaa

SEQ ID NO: 48514 - DNA, 15 bp, Homo sapiens
tagacaaagaaacaa

SEQ ID NO: 48515 - DNA, 15 bp, Homo sapiens
gtagacaaagaaaca

SEQ ID NO: 48516 - DNA, 15 bp, Homo sapiens
tgtagacaaagaaac

SEQ ID NO: 48517 - DNA, 15 bp, Homo sapiens
atgtagacaaagaaa

SEQ ID NO: 48518 - DNA, 15 bp, Homo sapiens
tatgtagacaaagaa

SEQ ID NO: 48519 - DNA, 15 bp, Homo sapiens
gtatgtagacaaaga

SEQ ID NO: 48520 - DNA, 15 bp, Homo sapiens
tgtatgtagacaaag

SEQ ID NO: 48521 - DNA, 15 bp, Homo sapiens
atgtatgtagacaaa

SEQ ID NO: 48522 - DNA, 15 bp, Homo sapiens
tatgtatgtagacaa

SEQ ID NO: 48523 - DNA, 15 bp, Homo sapiens
atatgtatgtagaca

SEQ ID NO: 48524 - DNA, 15 bp, Homo sapiens
aatatgtatgtagac

SEQ ID NO: 48525 - DNA, 15 bp, Homo sapiens
aaatatgtatgtaga

SEQ ID NO: 48526 - DNA, 15 bp, Homo sapiens
taaatatgtatgtag

SEQ ID NO: 48527 - DNA, 15 bp, Homo sapiens
ataaatatgtatgta

SEQ ID NO: 48528 - DNA, 15 bp, Homo sapiens
tataaatatgtatgt

SEQ ID NO: 48529 - DNA, 15 bp, Homo sapiens
ttataaatatgtatg

SEQ ID NO: 48530 - DNA, 15 bp, Homo sapiens
attataaatatgtat

SEQ ID NO: 48531 - DNA, 15 bp, Homo sapiens
tattataaatatgta

SEQ ID NO: 48532 - DNA, 15 bp, Homo sapiens
atattataaatatgt

SEQ ID NO: 48533 - DNA, 15 bp, Homo sapiens
aatattataaatatg

SEQ ID NO: 48534 - DNA, 15 bp, Homo sapiens
aaatattataaatat

SEQ ID NO: 48535 - DNA, 15 bp, Homo sapiens
aaaatattataaata

SEQ ID NO: 48536 - DNA, 15 bp, Homo sapiens
taaaatattataaat

SEQ ID NO: 48537 - DNA, 15 bp, Homo sapiens
gtaaaatattataaa

SEQ ID NO: 48538 - DNA, 15 bp, Homo sapiens
tgtaaaatattataa

SEQ ID NO: 48539 - DNA, 15 bp, Homo sapiens
ctgtaaaatattata

SEQ ID NO: 48540 - DNA, 15 bp, Homo sapiens
tctgtaaaatattat

SEQ ID NO: 48541 - DNA, 15 bp, Homo sapiens
atctgtaaaatatta

SEQ ID NO: 48542 - DNA, 15 bp, Homo sapiens
aatctgtaaaatatt

SEQ ID NO: 48543 - DNA, 15 bp, Homo sapiens
taatctgtaaaatat

SEQ ID NO: 48544 - DNA, 15 bp, Homo sapiens
ataatctgtaaaata

SEQ ID NO: 48545 - DNA, 15 bp, Homo sapiens
aataatctgtaaaat

SEQ ID NO: 48546 - DNA, 15 bp, Homo sapiens
taataatctgtaaaa

SEQ ID NO: 48547 - DNA, 15 bp, Homo sapiens
ataataatctgtaaa

SEQ ID NO: 48548 - DNA, 15 bp, Homo sapiens
tataataatctgtaa

SEQ ID NO: 48549 - DNA, 15 bp, Homo sapiens
atataataatctgta

SEQ ID NO: 48550 - DNA, 15 bp, Homo sapiens
tatataataatctgt

SEQ ID NO: 48551 - DNA, 15 bp, Homo sapiens
ttatataataatctg

SEQ ID NO: 48552 - DNA, 15 bp, Homo sapiens
attatataataatct

SEQ ID NO: 48553 - DNA, 15 bp, Homo sapiens
tattatataataatc

SEQ ID NO: 48554 - DNA, 15 bp, Homo sapiens
atattatataataat

SEQ ID NO: 48555 - DNA, 15 bp, Homo sapiens
aatattatataataa

SEQ ID NO: 48556 - DNA, 15 bp, Homo sapiens
aaatattatataata

SEQ ID NO: 48557 - DNA, 15 bp, Homo sapiens
taaatattatataat

SEQ ID NO: 48558 - DNA, 15 bp, Homo sapiens
ataaatattatataa

SEQ ID NO: 48559 - DNA, 15 bp, Homo sapiens
aataaatattatata

SEQ ID NO: 48560 - DNA, 15 bp, Homo sapiens
taataaatattatat

SEQ ID NO: 48561 - DNA, 15 bp, Homo sapiens
ataataaatattata

SEQ ID NO: 48562 - DNA, 15 bp, Homo sapiens
aataataaatattat

SEQ ID NO: 48563 - DNA, 15 bp, Homo sapiens
gaataataaatatta

SEQ ID NO: 48564 - DNA, 15 bp, Homo sapiens
ggaataataaatatt

SEQ ID NO: 48565 - DNA, 15 bp, Homo sapiens
gggaataataaatat

SEQ ID NO: 48566 - DNA, 15 bp, Homo sapiens
tgggaataataaata

SEQ ID NO: 48567 - DNA, 15 bp, Homo sapiens
atgggaataataaat

SEQ ID NO: 48568 - DNA, 15 bp, Homo sapiens
aatgggaataataaa

SEQ ID NO: 48569 - DNA, 15 bp, Homo sapiens
aaatgggaataataa

SEQ ID NO: 48570 - DNA, 15 bp, Homo sapiens
caaatgggaataata

SEQ ID NO: 48571 - DNA, 15 bp, Homo sapiens
tcaaatgggaataat

SEQ ID NO: 48572 - DNA, 15 bp, Homo sapiens
gtcaaatgggaataa

SEQ ID NO: 48573 - DNA, 15 bp, Homo sapiens
tgtcaaatgggaata

SEQ ID NO: 48574 - DNA, 15 bp, Homo sapiens
atgtcaaatgggaat

SEQ ID NO: 48575 - DNA, 15 bp, Homo sapiens
aatgtcaaatgggaa

SEQ ID NO: 48576 - DNA, 15 bp, Homo sapiens
aaatgtcaaatggga

SEQ ID NO: 48577 - DNA, 15 bp, Homo sapiens
aaaatgtcaaatggg

SEQ ID NO: 48578 - DNA, 15 bp, Homo sapiens
taaaatgtcaaatgg

SEQ ID NO: 48579 - DNA, 15 bp, Homo sapiens
ttaaaatgtcaaatg

SEQ ID NO: 48580 - DNA, 15 bp, Homo sapiens
attaaaatgtcaaat

SEQ ID NO: 48581 - DNA, 15 bp, Homo sapiens
tattaaaatgtcaaa

SEQ ID NO: 48582 - DNA, 15 bp, Homo sapiens
ttattaaaatgtcaa

SEQ ID NO: 48583 - DNA, 15 bp, Homo sapiens
tttattaaaatgtca

SEQ ID NO: 48584 - DNA, 15 bp, Homo sapiens
atttattaaaatgtc

SEQ ID NO: 48585 - DNA, 15 bp, Homo sapiens
tatttattaaaatgt

SEQ ID NO: 48586 - DNA, 15 bp, Homo sapiens
atatttattaaaatg

SEQ ID NO: 48587 - DNA, 15 bp, Homo sapiens
aatatttattaaaat

SEQ ID NO: 48588 - DNA, 15 bp, Homo sapiens
caatatttattaaaa

SEQ ID NO: 48589 - DNA, 15 bp, Homo sapiens
acaatatttattaaa

SEQ ID NO: 48590 - DNA, 15 bp, Homo sapiens
aacaatatttattaa

SEQ ID NO: 48591 - DNA, 15 bp, Homo sapiens
aaacaatatttatta

SEQ ID NO: 48592 - DNA, 15 bp, Homo sapiens
caaacaatatttatt

SEQ ID NO: 48593 - DNA, 15 bp, Homo sapiens
tcaaacaatatttat

SEQ ID NO: 48594 - DNA, 15 bp, Homo sapiens
ttcaaacaatattta

SEQ ID NO: 48595 - DNA, 15 bp, Homo sapiens
attcaaacaatattt

SEQ ID NO: 48596 - DNA, 15 bp, Homo sapiens
tattcaaacaatatt

SEQ ID NO: 48597 - DNA, 15 bp, Homo sapiens
ttattcaaacaatat

SEQ ID NO: 48598 - DNA, 15 bp, Homo sapiens
tttattcaaacaata

SEQ ID NO: 48599 - DNA, 15 bp, Homo sapiens
atttattcaaacaat

SEQ ID NO: 48600 - DNA, 15 bp, Homo sapiens
catttattcaaacaa

SEQ ID NO: 48601 - DNA, 15 bp, Homo sapiens
tcatttattcaaaca

SEQ ID NO: 48602 - DNA, 15 bp, Homo sapiens
ttcatttattcaaac

SEQ ID NO: 48603 - DNA, 15 bp, Homo sapiens
attcatttattcaaa

SEQ ID NO: 48604 - DNA, 15 bp, Homo sapiens
aattcatttattcaa

SEQ ID NO: 48605 - DNA, 15 bp, Homo sapiens
taattcatttattca

SEQ ID NO: 48606 - DNA, 15 bp, Homo sapiens
ctaattcatttattc

SEQ ID NO: 48607 - DNA, 15 bp, Homo sapiens
actaattcatttatt

SEQ ID NO: 48608 - DNA, 15 bp, Homo sapiens
cactaattcatttat

SEQ ID NO: 48609 - DNA, 15 bp, Homo sapiens
acactaattcattta

SEQ ID NO: 48610 - DNA, 15 bp, Homo sapiens
aacactaattcattt

SEQ ID NO: 48611 - DNA, 15 bp, Homo sapiens
aaacactaattcatt

SEQ ID NO: 48612 - DNA, 15 bp, Homo sapiens
caaacactaattcat

SEQ ID NO: 48613 - DNA, 15 bp, Homo sapiens
ccaaacactaattca

SEQ ID NO: 48614 - DNA, 15 bp, Homo sapiens
cccaaacactaattc

SEQ ID NO: 48615 - DNA, 15 bp, Homo sapiens
acccaaacactaatt

SEQ ID NO: 48616 - DNA, 15 bp, Homo sapiens
cacccaaacactaat

SEQ ID NO: 48617 - DNA, 15 bp, Homo sapiens
acacccaaacactaa

SEQ ID NO: 48618 - DNA, 15 bp, Homo sapiens
cacacccaaacacta

SEQ ID NO: 48619 - DNA, 15 bp, Homo sapiens
tcacacccaaacact

SEQ ID NO: 48620 - DNA, 15 bp, Homo sapiens
atcacacccaaacac

SEQ ID NO: 48621 - DNA, 15 bp, Homo sapiens
aatcacacccaaaca

SEQ ID NO: 48622 - DNA, 15 bp, Homo sapiens
caatcacacccaaac

SEQ ID NO: 48623 - DNA, 15 bp, Homo sapiens
ccaatcacacccaaa

SEQ ID NO: 48624 - DNA, 15 bp, Homo sapiens
cccaatcacacccaa

SEQ ID NO: 48625 - DNA, 15 bp, Homo sapiens
acccaatcacaccca

SEQ ID NO: 48626 - DNA, 15 bp, Homo sapiens
cacccaatcacaccc

SEQ ID NO: 48627 - DNA, 15 bp, Homo sapiens
acacccaatcacacc

SEQ ID NO: 48628 - DNA, 15 bp, Homo sapiens
cacacccaatcacac

SEQ ID NO: 48629 - DNA, 15 bp, Homo sapiens
tcacacccaatcaca

SEQ ID NO: 48630 - DNA, 15 bp, Homo sapiens
atcacacccaatcac

SEQ ID NO: 48631 - DNA, 15 bp, Homo sapiens
catcacacccaatca

SEQ ID NO: 48632 - DNA, 15 bp, Homo sapiens
tcatcacacccaatc

SEQ ID NO: 48633 - DNA, 15 bp, Homo sapiens
ttcatcacacccaat

SEQ ID NO: 48634 - DNA, 15 bp, Homo sapiens
tttcatcacacccaa

SEQ ID NO: 48635 - DNA, 15 bp, Homo sapiens
gtttcatcacaccca

SEQ ID NO: 48636 - DNA, 15 bp, Homo sapiens
tgtttcatcacaccc

SEQ ID NO: 48637 - DNA, 15 bp, Homo sapiens
ttgtttcatcacacc

SEQ ID NO: 48638 - DNA, 15 bp, Homo sapiens
cttgtttcatcacac

SEQ ID NO: 48639 - DNA, 15 bp, Homo sapiens
tcttgtttcatcaca

SEQ ID NO: 48640 - DNA, 15 bp, Homo sapiens
ctcttgtttcatcac

SEQ ID NO: 48641 - DNA, 15 bp, Homo sapiens
atgctctcttgtttc

SEQ ID NO: 48642 - DNA, 15 bp, Homo sapiens
tatgctctcttgttt

SEQ ID NO: 48643 - DNA, 15 bp, Homo sapiens
ttatgctctcttgtt

SEQ ID NO: 48644 - DNA, 15 bp, Homo sapiens
attatgctctcttgt

SEQ ID NO: 48645 - DNA, 15 bp, Homo sapiens
cattatgctctcttg

SEQ ID NO: 48646 - DNA, 15 bp, Homo sapiens
ccattatgctctctt

SEQ ID NO: 48647 - DNA, 15 bp, Homo sapiens
gccattatgctctct

SEQ ID NO: 48648 - DNA, 15 bp, Homo sapiens
tgccattatgctctc

SEQ ID NO: 48649 - DNA, 15 bp, Homo sapiens
atgccattatgctct

SEQ ID NO: 48650 - DNA, 15 bp, Homo sapiens
tatgccattatgctc

SEQ ID NO: 48651 - DNA, 15 bp, Homo sapiens
ttatgccattatgct

SEQ ID NO: 48652 - DNA, 15 bp, Homo sapiens
gttatgccattatgc

SEQ ID NO: 48653 - DNA, 15 bp, Homo sapiens
agttatgccattatg

SEQ ID NO: 48654 - DNA, 15 bp, Homo sapiens
tagttatgccattat

SEQ ID NO: 48655 - DNA, 15 bp, Homo sapiens
ttagttatgccatta

SEQ ID NO: 48656 - DNA, 15 bp, Homo sapiens
cttagttatgccatt

SEQ ID NO: 48657 - DNA, 15 bp, Homo sapiens
acttagttatgccat

SEQ ID NO: 48658 - DNA, 15 bp, Homo sapiens
cacttagttatgcca

SEQ ID NO: 48659 - DNA, 15 bp, Homo sapiens
acacttagttatgcc

SEQ ID NO: 48660 - DNA, 15 bp, Homo sapiens
cacacttagttatgc

SEQ ID NO: 48661 - DNA, 15 bp, Homo sapiens
tcacacttagttatg

SEQ ID NO: 48662 - DNA, 15 bp, Homo sapiens
ctcacacttagttat

SEQ ID NO: 48663 - DNA, 15 bp, Homo sapiens
actcacacttagtta

SEQ ID NO: 48664 - DNA, 15 bp, Homo sapiens
cactcacacttagtt

SEQ ID NO: 48665 - DNA, 15 bp, Homo sapiens
ccactcacacttagt

SEQ ID NO: 48666 - DNA, 15 bp, Homo sapiens
gccactcacacttag

SEQ ID NO: 48667 - DNA, 15 bp, Homo sapiens
tgccactcacactta

SEQ ID NO: 48668 - DNA, 15 bp, Homo sapiens
ctgccactcacactt

SEQ ID NO: 48669 - DNA, 15 bp, Homo sapiens
tctgccactcacact

SEQ ID NO: 48670 - DNA, 15 bp, Homo sapiens
ttctgccactcacac

SEQ ID NO: 48671 - DNA, 15 bp, Homo sapiens
attctgccactcaca

SEQ ID NO: 48672 - DNA, 15 bp, Homo sapiens
aattctgccactcac

SEQ ID NO: 48673 - DNA, 15 bp, Homo sapiens
taattctgccactca

SEQ ID NO: 48674 - DNA, 15 bp, Homo sapiens
ataattctgccactc

SEQ ID NO: 48675 - DNA, 15 bp, Homo sapiens
tataattctgccact

SEQ ID NO: 48676 - DNA, 15 bp, Homo sapiens
atataattctgccac

SEQ ID NO: 48677 - DNA, 15 bp, Homo sapiens
aatataattctgcca

SEQ ID NO: 48678 - DNA, 15 bp, Homo sapiens
caatataattctgcc

SEQ ID NO: 48679 - DNA, 15 bp, Homo sapiens
ccaatataattctgc

SEQ ID NO: 48680 - DNA, 15 bp, Homo sapiens
cccaatataattctg

SEQ ID NO: 48681 - DNA, 15 bp, Homo sapiens
tcccaatataattct

SEQ ID NO: 48682 - DNA, 15 bp, Homo sapiens
ctcccaatataattc

SEQ ID NO: 48683 - DNA, 15 bp, Homo sapiens
actcccaatataatt

SEQ ID NO: 48684 - DNA, 15 bp, Homo sapiens
cactcccaatataat

SEQ ID NO: 48685 - DNA, 15 bp, Homo sapiens
tcactcccaatataa

SEQ ID NO: 48686 - DNA, 15 bp, Homo sapiens
atcactcccaatata

SEQ ID NO: 48687 - DNA, 15 bp, Homo sapiens
aatcactcccaatat

SEQ ID NO: 48688 - DNA, 15 bp, Homo sapiens
gaatcactcccaata

SEQ ID NO: 48689 - DNA, 15 bp, Homo sapiens
tgaatcactcccaat

SEQ ID NO: 48690 - DNA, 15 bp, Homo sapiens
gtgaatcactcccaa

SEQ ID NO: 48691 - DNA, 15 bp, Homo sapiens
tgtgaatcactccca

SEQ ID NO: 48692 - DNA, 15 bp, Homo sapiens
atgtgaatcactccc

SEQ ID NO: 48693 - DNA, 15 bp, Homo sapiens
catgtgaatcactcc

SEQ ID NO: 48694 - DNA, 15 bp, Homo sapiens
acatgtgaatcactc

SEQ ID NO: 48695 - DNA, 15 bp, Homo sapiens
tacatgtgaatcact

SEQ ID NO: 48696 - DNA, 15 bp, Homo sapiens
ctacatgtgaatcac

SEQ ID NO: 48697 - DNA, 15 bp, Homo sapiens
cctacatgtgaatca

SEQ ID NO: 48698 - DNA, 15 bp, Homo sapiens
ccctacatgtgaatc

SEQ ID NO: 48699 - DNA, 15 bp, Homo sapiens
gccctacatgtgaat

SEQ ID NO: 48700 - DNA, 15 bp, Homo sapiens
ggccctacatgtgaa

SEQ ID NO: 48701 - DNA, 15 bp, Homo sapiens
gggccctacatgtga

SEQ ID NO: 48702 - DNA, 15 bp, Homo sapiens
tgggccctacatgtg

SEQ ID NO: 48703 - DNA, 15 bp, Homo sapiens
gtgggccctacatgt

SEQ ID NO: 48704 - DNA, 15 bp, Homo sapiens
tgtgggccctacatg

SEQ ID NO: 48705 - DNA, 15 bp, Homo sapiens
ttgtgggccctacat

SEQ ID NO: 48706 - DNA, 15 bp, Homo sapiens
tttgtgggccctaca

SEQ ID NO: 48707 - DNA, 15 bp, Homo sapiens
ttttgtgggccctac

SEQ ID NO: 48708 - DNA, 15 bp, Homo sapiens
tttttgtgggcccta

SEQ ID NO: 48709 - DNA, 15 bp, Homo sapiens
ctttttgtgggccct

SEQ ID NO: 48710 - DNA, 15 bp, Homo sapiens
tctttttgtgggccc

SEQ ID NO: 48711 - DNA, 15 bp, Homo sapiens
ttctttttgtgggcc

SEQ ID NO: 48712 - DNA, 15 bp, Homo sapiens
cttctttttgtgggc

SEQ ID NO: 48713 - DNA, 15 bp, Homo sapiens
tcttctttttgtggg

SEQ ID NO: 48714 - DNA, 15 bp, Homo sapiens
ttcttctttttgtgg

SEQ ID NO: 48715 - DNA, 15 bp, Homo sapiens
tttcttctttttgtg

SEQ ID NO: 48716 - DNA, 15 bp, Homo sapiens
atttcttctttttgt

SEQ ID NO: 48717 - DNA, 15 bp, Homo sapiens
catttcttctttttg

SEQ ID NO: 48718 - DNA, 15 bp, Homo sapiens
tcatttcttcttttt

SEQ ID NO: 48719 - DNA, 15 bp, Homo sapiens
ctcatttcttctttt

SEQ ID NO: 48720 - DNA, 15 bp, Homo sapiens
tctcatttcttcttt

SEQ ID NO: 48721 - DNA, 15 bp, Homo sapiens
ttctcatttcttctt

SEQ ID NO: 48722 - DNA, 15 bp, Homo sapiens
attctcatttcttct

SEQ ID NO: 48723 - DNA, 15 bp, Homo sapiens
tattctcatttcttc

SEQ ID NO: 48724 - DNA, 15 bp, Homo sapiens
atattctcatttctt

SEQ ID NO: 48725 - DNA, 15 bp, Homo sapiens
catattctcatttct

SEQ ID NO: 48726 - DNA, 15 bp, Homo sapiens
tcatattctcatttc

SEQ ID NO: 48727 - DNA, 15 bp, Homo sapiens
atcatattctcattt

SEQ ID NO: 48728 - DNA, 15 bp, Homo sapiens
gatcatattctcatt

SEQ ID NO: 48729 - DNA, 15 bp, Homo sapiens
agatcatattctcat

SEQ ID NO: 48730 - DNA, 15 bp, Homo sapiens
cagatcatattctca

SEQ ID NO: 48731 - DNA, 15 bp, Homo sapiens
tcagatcatattctc

SEQ ID NO: 48732 - DNA, 15 bp, Homo sapiens
ttcagatcatattct

SEQ ID NO: 48733 - DNA, 15 bp, Homo sapiens
tttcagatcatattc

SEQ ID NO: 48734 - DNA, 15 bp, Homo sapiens
atttcagatcatatt

SEQ ID NO: 48735 - DNA, 15 bp, Homo sapiens
catttcagatcatat

SEQ ID NO: 48736 - DNA, 15 bp, Homo sapiens
gcatttcagatcata

SEQ ID NO: 48737 - DNA, 15 bp, Homo sapiens
agcatttcagatcat

SEQ ID NO: 48738 - DNA, 15 bp, Homo sapiens
aagcatttcagatca

SEQ ID NO: 48739 - DNA, 15 bp, Homo sapiens
aaagcatttcagatc

SEQ ID NO: 48740 - DNA, 15 bp, Homo sapiens
aaaagcatttcagat

SEQ ID NO: 48741 - DNA, 15 bp, Homo sapiens
caaaagcatttcaga

SEQ ID NO: 48742 - DNA, 15 bp, Homo sapiens
acaaaagcatttcag

SEQ ID NO: 48743 - DNA, 15 bp, Homo sapiens
aacaaaagcatttca

SEQ ID NO: 48744 - DNA, 15 bp, Homo sapiens
taacaaaagcatttc

SEQ ID NO: 48745 - DNA, 15 bp, Homo sapiens
gtaacaaaagcattt

SEQ ID NO: 48746 - DNA, 15 bp, Homo sapiens
agtaacaaaagcatt

SEQ ID NO: 48747 - DNA, 15 bp, Homo sapiens
aagtaacaaaagcat

SEQ ID NO: 48748 - DNA, 15 bp, Homo sapiens
gaagtaacaaaagca

SEQ ID NO: 48749 - DNA, 15 bp, Homo sapiens
ggaagtaacaaaagc

SEQ ID NO: 48750 - DNA, 15 bp, Homo sapiens
tggaagtaacaaaag

SEQ ID NO: 48751 - DNA, 15 bp, Homo sapiens
ttggaagtaacaaaa

SEQ ID NO: 48752 - DNA, 15 bp, Homo sapiens
tttggaagtaacaaa

SEQ ID NO: 48753 - DNA, 15 bp, Homo sapiens
ttttggaagtaacaa

SEQ ID NO: 48754 - DNA, 15 bp, Homo sapiens
attttggaagtaaca

SEQ ID NO: 48755 - DNA, 15 bp, Homo sapiens
tattttggaagtaac

SEQ ID NO: 48756 - DNA, 15 bp, Homo sapiens
ttattttggaagtaa

SEQ ID NO: 48757 - DNA, 15 bp, Homo sapiens
attattttggaagta

SEQ ID NO: 48758 - DNA, 15 bp, Homo sapiens
tattattttggaagt

SEQ ID NO: 48759 - DNA, 15 bp, Homo sapiens
ttattattttggaag

SEQ ID NO: 48760 - DNA, 15 bp, Homo sapiens
attattattttggaa

SEQ ID NO: 48761 - DNA, 15 bp, Homo sapiens
gattattattttgga

SEQ ID NO: 48762 - DNA, 15 bp, Homo sapiens
agattattattttgg

SEQ ID NO: 48763 - DNA, 15 bp, Homo sapiens
aagattattattttg

SEQ ID NO: 48764 - DNA, 15 bp, Homo sapiens
aaagattattatttt

SEQ ID NO: 48765 - DNA, 15 bp, Homo sapiens
caaagattattattt

SEQ ID NO: 48766 - DNA, 15 bp, Homo sapiens
gcaaagattattatt

SEQ ID NO: 48767 - DNA, 15 bp, Homo sapiens
agcaaagattattat

SEQ ID NO: 48768 - DNA, 15 bp, Homo sapiens
tagcaaagattatta

SEQ ID NO: 48769 - DNA, 15 bp, Homo sapiens
ttagcaaagattatt

SEQ ID NO: 48770 - DNA, 15 bp, Homo sapiens
gttagcaaagattat

SEQ ID NO: 48771 - DNA, 15 bp, Homo sapiens
cgttagcaaagatta

SEQ ID NO: 48772 - DNA, 15 bp, Homo sapiens
tcgttagcaaagatt

SEQ ID NO: 48773 - DNA, 15 bp, Homo sapiens
ctcgttagcaaagat

SEQ ID NO: 48774 - DNA, 15 bp, Homo sapiens
tctcgttagcaaaga

SEQ ID NO: 48775 - DNA, 15 bp, Homo sapiens
ctctcgttagcaaag

SEQ ID NO: 48776 - DNA, 15 bp, Homo sapiens
tctctcgttagcaaa

SEQ ID NO: 48777 - DNA, 15 bp, Homo sapiens
atctctcgttagcaa

SEQ ID NO: 48778 - DNA, 15 bp, Homo sapiens
aatctctcgttagca

SEQ ID NO: 48779 - DNA, 15 bp, Homo sapiens
caatctctcgttagc

SEQ ID NO: 48780 - DNA, 15 bp, Homo sapiens
ccaatctctcgttag

SEQ ID NO: 48781 - DNA, 15 bp, Homo sapiens
gccaatctctcgtta

SEQ ID NO: 48782 - DNA, 15 bp, Homo sapiens
agccaatctctcgtt

SEQ ID NO: 48783 - DNA, 15 bp, Homo sapiens
aagccaatctctcgt

SEQ ID NO: 48784 - DNA, 15 bp, Homo sapiens
aaagccaatctctcg

SEQ ID NO: 48785 - DNA, 15 bp, Homo sapiens
gaaagccaatctctc

SEQ ID NO: 48786 - DNA, 15 bp, Homo sapiens
agaaagccaatctct

SEQ ID NO: 48787 - DNA, 15 bp, Homo sapiens
tagaaagccaatctc

SEQ ID NO: 48788 - DNA, 15 bp, Homo sapiens
ctagaaagccaatct

SEQ ID NO: 48789 - DNA, 15 bp, Homo sapiens
cctagaaagccaatc

SEQ ID NO: 48790 - DNA, 15 bp, Homo sapiens
ccctagaaagccaat

SEQ ID NO: 48791 - DNA, 15 bp, Homo sapiens
accctagaaagccaa

SEQ ID NO: 48792 - DNA, 15 bp, Homo sapiens
caccctagaaagcca

SEQ ID NO: 48793 - DNA, 15 bp, Homo sapiens
acaccctagaaagcc

SEQ ID NO: 48794 - DNA, 15 bp, Homo sapiens
cacaccctagaaagc

SEQ ID NO: 48795 - DNA, 15 bp, Homo sapiens
acacaccctagaaag

SEQ ID NO: 48796 - DNA, 15 bp, Homo sapiens
aacacaccctagaaa

SEQ ID NO: 48797 - DNA, 15 bp, Homo sapiens
taacacaccctagaa

SEQ ID NO: 48798 - DNA, 15 bp, Homo sapiens
ttaacacaccctaga

SEQ ID NO: 48799 - DNA, 15 bp, Homo sapiens
cttaacacaccctag

SEQ ID NO: 48800 - DNA, 15 bp, Homo sapiens
acttaacacacccta

SEQ ID NO: 48801 - DNA, 15 bp, Homo sapiens
aacttaacacaccct

SEQ ID NO: 48802 - DNA, 15 bp, Homo sapiens
aaacttaacacaccc

SEQ ID NO: 48803 - DNA, 15 bp, Homo sapiens
aaaacttaacacacc

SEQ ID NO: 48804 - DNA, 15 bp, Homo sapiens
caaaacttaacacac

SEQ ID NO: 48805 - DNA, 15 bp, Homo sapiens
gcaaaacttaacaca

SEQ ID NO: 48806 - DNA, 15 bp, Homo sapiens
tgcaaaacttaacac

SEQ ID NO: 48807 - DNA, 15 bp, Homo sapiens
atgcaaaacttaaca

SEQ ID NO: 48808 - DNA, 15 bp, Homo sapiens
aatgcaaaacttaac

SEQ ID NO: 48809 - DNA, 15 bp, Homo sapiens
aaatgcaaaacttaa

SEQ ID NO: 48810 - DNA, 15 bp, Homo sapiens
caaatgcaaaactta

SEQ ID NO: 48811 - DNA, 15 bp, Homo sapiens
acaaatgcaaaactt

SEQ ID NO: 48812 - DNA, 15 bp, Homo sapiens
cacaaatgcaaaact

SEQ ID NO: 48813 - DNA, 15 bp, Homo sapiens
tcacaaatgcaaaac

SEQ ID NO: 48814 - DNA, 15 bp, Homo sapiens
ttcacaaatgcaaaa

SEQ ID NO: 48815 - DNA, 15 bp, Homo sapiens
tttcacaaatgcaaa

SEQ ID NO: 48816 - DNA, 15 bp, Homo sapiens
ctttcacaaatgcaa

SEQ ID NO: 48817 - DNA, 15 bp, Homo sapiens
tctttcacaaatgca

SEQ ID NO: 48818 - DNA, 15 bp, Homo sapiens
ctctttcacaaatgc

SEQ ID NO: 48819 - DNA, 15 bp, Homo sapiens
cctctttcacaaatg

SEQ ID NO: 48820 - DNA, 15 bp, Homo sapiens
gcctctttcacaaat

SEQ ID NO: 48821 - DNA, 15 bp, Homo sapiens
ggcctctttcacaaa

SEQ ID NO: 48822 - DNA, 15 bp, Homo sapiens
aggcctctttcacaa

SEQ ID NO: 48823 - DNA, 15 bp, Homo sapiens
aaggcctctttcaca

SEQ ID NO: 48824 - DNA, 15 bp, Homo sapiens
taaggcctctttcac

SEQ ID NO: 48825 - DNA, 15 bp, Homo sapiens
ttaaggcctctttca

SEQ ID NO: 48826 - DNA, 15 bp, Homo sapiens
attaaggcctctttc

SEQ ID NO: 48827 - DNA, 15 bp, Homo sapiens
tattaaggcctcttt

SEQ ID NO: 48828 - DNA, 15 bp, Homo sapiens
ttattaaggcctctt

SEQ ID NO: 48829 - DNA, 15 bp, Homo sapiens
tttattaaggcctct

SEQ ID NO: 48830 - DNA, 15 bp, Homo sapiens
ttttattaaggcctc

SEQ ID NO: 48831 - DNA, 15 bp, Homo sapiens
attttattaaggcct

SEQ ID NO: 48832 - DNA, 15 bp, Homo sapiens
gattttattaaggcc

SEQ ID NO: 48833 - DNA, 15 bp, Homo sapiens
tgattttattaaggc

SEQ ID NO: 48834 - DNA, 15 bp, Homo sapiens
ttgattttattaagg

SEQ ID NO: 48835 - DNA, 15 bp, Homo sapiens
attgattttattaag

SEQ ID NO: 48836 - DNA, 15 bp, Homo sapiens
gattgattttattaa

SEQ ID NO: 48837 - DNA, 15 bp, Homo sapiens
ggattgattttatta

SEQ ID NO: 48838 - DNA, 15 bp, Homo sapiens
tggattgattttatt

SEQ ID NO: 48839 - DNA, 15 bp, Homo sapiens
ttggattgattttat

SEQ ID NO: 48840 - DNA, 15 bp, Homo sapiens
cttggattgatttta

SEQ ID NO: 48841 - DNA, 15 bp, Homo sapiens
acttggattgatttt

SEQ ID NO: 48842 - DNA, 15 bp, Homo sapiens
aacttggattgattt

SEQ ID NO: 48843 - DNA, 15 bp, Homo sapiens
aaacttggattgatt

SEQ ID NO: 48844 - DNA, 15 bp, Homo sapiens
taaacttggattgat

SEQ ID NO: 48845 - DNA, 15 bp, Homo sapiens
ttaaacttggattga

SEQ ID NO: 48846 - DNA, 15 bp, Homo sapiens
tttaaacttggattg

SEQ ID NO: 48847 - DNA, 15 bp, Homo sapiens
ttttaaacttggatt

SEQ ID NO: 48848 - DNA, 15 bp, Homo sapiens
attttaaacttggat

SEQ ID NO: 48849 - DNA, 15 bp, Homo sapiens
gattttaaacttgga

SEQ ID NO: 48850 - DNA, 15 bp, Homo sapiens
tgattttaaacttgg

SEQ ID NO: 48851 - DNA, 15 bp, Homo sapiens
atgattttaaacttg

SEQ ID NO: 48852 - DNA, 15 bp, Homo sapiens
gatgattttaaactt

SEQ ID NO: 48853 - DNA, 15 bp, Homo sapiens
ggatgattttaaact

SEQ ID NO: 48854 - DNA, 15 bp, Homo sapiens
tggatgattttaaac

SEQ ID NO: 48855 - DNA, 15 bp, Homo sapiens
ttggatgattttaaa

SEQ ID NO: 48856 - DNA, 15 bp, Homo sapiens
attggatgattttaa

SEQ ID NO: 48857 - DNA, 15 bp, Homo sapiens
tattggatgatttta

SEQ ID NO: 48858 - DNA, 15 bp, Homo sapiens
ttattggatgatttt

SEQ ID NO: 48859 - DNA, 15 bp, Homo sapiens
cttattggatgattt

SEQ ID NO: 48860 - DNA, 15 bp, Homo sapiens
tcttattggatgatt

SEQ ID NO: 48861 - DNA, 15 bp, Homo sapiens
ctcttattggatgat

SEQ ID NO: 48862 - DNA, 15 bp, Homo sapiens
tctcttattggatga

SEQ ID NO: 48863 - DNA, 15 bp, Homo sapiens
atctcttattggatg

SEQ ID NO: 48864 - DNA, 15 bp, Homo sapiens
aatctcttattggat

SEQ ID NO: 48865 - DNA, 15 bp, Homo sapiens
aaatctcttattgga

SEQ ID NO: 48866 - DNA, 15 bp, Homo sapiens
gaaatctcttattgg

SEQ ID NO: 48867 - DNA, 15 bp, Homo sapiens
agaaatctcttattg

SEQ ID NO: 48868 - DNA, 15 bp, Homo sapiens
aagaaatctcttatt

SEQ ID NO: 48869 - DNA, 15 bp, Homo sapiens
aaagaaatctcttat

SEQ ID NO: 48870 - DNA, 15 bp, Homo sapiens
gaaagaaatctctta

SEQ ID NO: 48871 - DNA, 15 bp, Homo sapiens
agaaagaaatctctt

SEQ ID NO: 48872 - DNA, 15 bp, Homo sapiens
aagaaagaaatctct

SEQ ID NO: 48873 - DNA, 15 bp, Homo sapiens
caagaaagaaatctc

SEQ ID NO: 48874 - DNA, 15 bp, Homo sapiens
ccaagaaagaaatct

SEQ ID NO: 48875 - DNA, 15 bp, Homo sapiens
gccaagaaagaaatc

SEQ ID NO: 48876 - DNA, 15 bp, Homo sapiens
agccaagaaagaaat

SEQ ID NO: 48877 - DNA, 15 bp, Homo sapiens
tagccaagaaagaaa

SEQ ID NO: 48878 - DNA, 15 bp, Homo sapiens
ttagccaagaaagaa

SEQ ID NO: 48879 - DNA, 15 bp, Homo sapiens
tttagccaagaaaga

SEQ ID NO: 48880 - DNA, 15 bp, Homo sapiens
ctttagccaagaaag

SEQ ID NO: 48881 - DNA, 15 bp, Homo sapiens
cctttagccaagaaa

SEQ ID NO: 48882 - DNA, 15 bp, Homo sapiens
acctttagccaagaa

SEQ ID NO: 48883 - DNA, 15 bp, Homo sapiens
gacctttagccaaga

SEQ ID NO: 48884 - DNA, 15 bp, Homo sapiens
agacctttagccaag

SEQ ID NO: 48885 - DNA, 15 bp, Homo sapiens
tagacctttagccaa

SEQ ID NO: 48886 - DNA, 15 bp, Homo sapiens
ctagacctttagcca

SEQ ID NO: 48887 - DNA, 15 bp, Homo sapiens
cctagacctttagcc

SEQ ID NO: 48888 - DNA, 15 bp, Homo sapiens
acctagacctttagc

SEQ ID NO: 48889 - DNA, 15 bp, Homo sapiens
cacctagacctttag

SEQ ID NO: 48890 - DNA, 15 bp, Homo sapiens
gcacctagaccttta

SEQ ID NO: 48891 - DNA, 15 bp, Homo sapiens
agcacctagaccttt

SEQ ID NO: 48892 - DNA, 15 bp, Homo sapiens
tagcacctagacctt

SEQ ID NO: 48893 - DNA, 15 bp, Homo sapiens
gtagcacctagacct

SEQ ID NO: 48894 - DNA, 15 bp, Homo sapiens
agtagcacctagacc

SEQ ID NO: 48895 - DNA, 15 bp, Homo sapiens
aagtagcacctagac

SEQ ID NO: 48896 - DNA, 15 bp, Homo sapiens
aaagtagcacctaga

SEQ ID NO: 48897 - DNA, 15 bp, Homo sapiens
gaaagtagcacctag

SEQ ID NO: 48898 - DNA, 15 bp, Homo sapiens
ggaaagtagcaccta

SEQ ID NO: 48899 - DNA, 15 bp, Homo sapiens
aggaaagtagcacct

SEQ ID NO: 48900 - DNA, 15 bp, Homo sapiens
caggaaagtagcacc

SEQ ID NO: 48901 - DNA, 15 bp, Homo sapiens
tcaggaaagtagcac

SEQ ID NO: 48902 - DNA, 15 bp, Homo sapiens
ttcaggaaagtagca

SEQ ID NO: 48903 - DNA, 15 bp, Homo sapiens
attcaggaaagtagc

SEQ ID NO: 48904 - DNA, 15 bp, Homo sapiens
tattcaggaaagtag

SEQ ID NO: 48905 - DNA, 15 bp, Homo sapiens
ttattcaggaaagta

SEQ ID NO: 48906 - DNA, 15 bp, Homo sapiens
attattcaggaaagt

SEQ ID NO: 48907 - DNA, 15 bp, Homo sapiens
tattattcaggaaag

SEQ ID NO: 48908 - DNA, 15 bp, Homo sapiens
ttattattcaggaaa

SEQ ID NO: 48909 - DNA, 15 bp, Homo sapiens
cttattattcaggaa

SEQ ID NO: 48910 - DNA, 15 bp, Homo sapiens
gcttattattcagga

SEQ ID NO: 48911 - DNA, 15 bp, Homo sapiens
agcttattattcagg

SEQ ID NO: 48912 - DNA, 15 bp, Homo sapiens
cagcttattattcag

SEQ ID NO: 48913 - DNA, 15 bp, Homo sapiens
gcagcttattattca

SEQ ID NO: 48914 - DNA, 15 bp, Homo sapiens
tgcagcttattattc

SEQ ID NO: 48915 - DNA, 15 bp, Homo sapiens
gtgcagcttattatt

SEQ ID NO: 48916 - DNA, 15 bp, Homo sapiens
agtgcagcttattat

SEQ ID NO: 48917 - DNA, 15 bp, Homo sapiens
aagtgcagcttatta

SEQ ID NO: 48918 - DNA, 15 bp, Homo sapiens
aaagtgcagcttatt

SEQ ID NO: 48919 - DNA, 15 bp, Homo sapiens
taaagtgcagcttat

SEQ ID NO: 48920 - DNA, 15 bp, Homo sapiens
ctaaagtgcagctta

SEQ ID NO: 48921 - DNA, 15 bp, Homo sapiens
cctaaagtgcagctt

SEQ ID NO: 48922 - DNA, 15 bp, Homo sapiens
ccctaaagtgcagct

SEQ ID NO: 48923 - DNA, 15 bp, Homo sapiens
tccctaaagtgcagc

SEQ ID NO: 48924 - DNA, 15 bp, Homo sapiens
ttccctaaagtgcag

SEQ ID NO: 48925 - DNA, 15 bp, Homo sapiens
gttccctaaagtgca

SEQ ID NO: 48926 - DNA, 15 bp, Homo sapiens
agttccctaaagtgc

SEQ ID NO: 48927 - DNA, 15 bp, Homo sapiens
gagttccctaaagtg

SEQ ID NO: 48928 - DNA, 15 bp, Homo sapiens
tgagttccctaaagt

SEQ ID NO: 48929 - DNA, 15 bp, Homo sapiens
atgagttccctaaag

SEQ ID NO: 48930 - DNA, 15 bp, Homo sapiens
catgagttccctaaa

SEQ ID NO: 48931 - DNA, 15 bp, Homo sapiens
acatgagttccctaa

SEQ ID NO: 48932 - DNA, 15 bp, Homo sapiens
aacatgagttcccta

SEQ ID NO: 48933 - DNA, 15 bp, Homo sapiens
taacatgagttccct

SEQ ID NO: 48934 - DNA, 15 bp, Homo sapiens
ataacatgagttccc

SEQ ID NO: 48935 - DNA, 15 bp, Homo sapiens
cataacatgagttcc

SEQ ID NO: 48936 - DNA, 15 bp, Homo sapiens
acataacatgagttc

SEQ ID NO: 48937 - DNA, 15 bp, Homo sapiens
aacataacatgagtt

SEQ ID NO: 48938 - DNA, 15 bp, Homo sapiens
taacataacatgagt

SEQ ID NO: 48939 - DNA, 15 bp, Homo sapiens
ctaacataacatgag

SEQ ID NO: 48940 - DNA, 15 bp, Homo sapiens
actaacataacatga

SEQ ID NO: 48941 - DNA, 15 bp, Homo sapiens
cactaacataacatg

SEQ ID NO: 48942 - DNA, 15 bp, Homo sapiens
acactaacataacat

SEQ ID NO: 48943 - DNA, 15 bp, Homo sapiens
gacactaacataaca

SEQ ID NO: 48944 - DNA, 15 bp, Homo sapiens
tgacactaacataac

SEQ ID NO: 48945 - DNA, 15 bp, Homo sapiens
ctgacactaacataa

SEQ ID NO: 48946 - DNA, 15 bp, Homo sapiens
gctgacactaacata

SEQ ID NO: 48947 - DNA, 15 bp, Homo sapiens
ggctgacactaacat

SEQ ID NO: 48948 - DNA, 15 bp, Homo sapiens
tggctgacactaaca

SEQ ID NO: 48949 - DNA, 15 bp, Homo sapiens
ttggctgacactaac

SEQ ID NO: 48950 - DNA, 15 bp, Homo sapiens
gttggctgacactaa

SEQ ID NO: 48951 - DNA, 15 bp, Homo sapiens
agttggctgacacta

SEQ ID NO: 48952 - DNA, 15 bp, Homo sapiens
cagttggctgacact

SEQ ID NO: 48953 - DNA, 15 bp, Homo sapiens
ccagttggctgacac

SEQ ID NO: 48954 - DNA, 15 bp, Homo sapiens
tccagttggctgaca

SEQ ID NO: 48955 - DNA, 15 bp, Homo sapiens
gtccagttggctgac

SEQ ID NO: 48956 - DNA, 15 bp, Homo sapiens
tgtccagttggctga

SEQ ID NO: 48957 - DNA, 15 bp, Homo sapiens
gtgtccagttggctg

SEQ ID NO: 48958 - DNA, 15 bp, Homo sapiens
agtgtccagttggct

SEQ ID NO: 48959 - DNA, 15 bp, Homo sapiens
gagtgtccagttggc

SEQ ID NO: 48960 - DNA, 15 bp, Homo sapiens
agagtgtccagttgg

SEQ ID NO: 48961 - DNA, 15 bp, Homo sapiens
aagagtgtccagttg

SEQ ID NO: 48962 - DNA, 15 bp, Homo sapiens
taagagtgtccagtt

SEQ ID NO: 48963 - DNA, 15 bp, Homo sapiens
ttaagagtgtccagt

SEQ ID NO: 48964 - DNA, 15 bp, Homo sapiens
tttaagagtgtccag

SEQ ID NO: 48965 - DNA, 15 bp, Homo sapiens
atttaagagtgtcca

SEQ ID NO: 48966 - DNA, 15 bp, Homo sapiens
aatttaagagtgtcc

SEQ ID NO: 48967 - DNA, 15 bp, Homo sapiens
caatttaagagtgtc

SEQ ID NO: 48968 - DNA, 15 bp, Homo sapiens
gcaatttaagagtgt

SEQ ID NO: 48969 - DNA, 15 bp, Homo sapiens
agcaatttaagagtg

SEQ ID NO: 48970 - DNA, 15 bp, Homo sapiens
aagcaatttaagagt

SEQ ID NO: 48971 - DNA, 15 bp, Homo sapiens
gaagcaatttaagag

SEQ ID NO: 48972 - DNA, 15 bp, Homo sapiens
tgaagcaatttaaga

SEQ ID NO: 48973 - DNA, 15 bp, Homo sapiens
ttgaagcaatttaag

SEQ ID NO: 48974 - DNA, 15 bp, Homo sapiens
tttgaagcaatttaa

SEQ ID NO: 48975 - DNA, 15 bp, Homo sapiens
atttgaagcaattta

SEQ ID NO: 48976 - DNA, 15 bp, Homo sapiens
catttgaagcaattt

SEQ ID NO: 48977 - DNA, 15 bp, Homo sapiens
ccatttgaagcaatt

SEQ ID NO: 48978 - DNA, 15 bp, Homo sapiens
accatttgaagcaat

SEQ ID NO: 48979 - DNA, 15 bp, Homo sapiens
caccatttgaagcaa

SEQ ID NO: 48980 - DNA, 15 bp, Homo sapiens
acaccatttgaagca

SEQ ID NO: 48981 - DNA, 15 bp, Homo sapiens
tacaccatttgaagc

SEQ ID NO: 48982 - DNA, 15 bp, Homo sapiens
gtacaccatttgaag

SEQ ID NO: 48983 - DNA, 15 bp, Homo sapiens
agtacaccatttgaa

SEQ ID NO: 48984 - DNA, 15 bp, Homo sapiens
tagtacaccatttga

SEQ ID NO: 48985 - DNA, 15 bp, Homo sapiens
ctagtacaccatttg

SEQ ID NO: 48986 - DNA, 15 bp, Homo sapiens
tctagtacaccattt

SEQ ID NO: 48987 - DNA, 15 bp, Homo sapiens
ctctagtacaccatt

SEQ ID NO: 48988 - DNA, 15 bp, Homo sapiens
cctctagtacaccat

SEQ ID NO: 48989 - DNA, 15 bp, Homo sapiens
tcctctagtacacca

SEQ ID NO: 48990 - DNA, 15 bp, Homo sapiens
atcctctagtacacc

SEQ ID NO: 48991 - DNA, 15 bp, Homo sapiens
tatcctctagtacac

SEQ ID NO: 48992 - DNA, 15 bp, Homo sapiens
ttatcctctagtaca

SEQ ID NO: 48993 - DNA, 15 bp, Homo sapiens
attatcctctagtac

SEQ ID NO: 48994 - DNA, 15 bp, Homo sapiens
cattatcctctagta

SEQ ID NO: 48995 - DNA, 15 bp, Homo sapiens
gcattatcctctagt

SEQ ID NO: 48996 - DNA, 15 bp, Homo sapiens
agcattatcctctag

SEQ ID NO: 48997 - DNA, 15 bp, Homo sapiens
aagcattatcctcta

SEQ ID NO: 48998 - DNA, 15 bp, Homo sapiens
aaagcattatcctct

SEQ ID NO: 48999 - DNA, 15 bp, Homo sapiens
gaaagcattatcctc

SEQ ID NO: 49000 - DNA, 15 bp, Homo sapiens
agaaagcattatcct

SEQ ID NO: 49001 - DNA, 15 bp, Homo sapiens
gagaaagcattatcc

SEQ ID NO: 49002 - DNA, 15 bp, Homo sapiens
agagaaagcattatc

SEQ ID NO: 49003 - DNA, 15 bp, Homo sapiens
gagagaaagcattat

SEQ ID NO: 49004 - DNA, 15 bp, Homo sapiens
agagagaaagcatta

SEQ ID NO: 49005 - DNA, 15 bp, Homo sapiens
tagagagaaagcatt

SEQ ID NO: 49006 - DNA, 15 bp, Homo sapiens
ttagagagaaagcat

SEQ ID NO: 49007 - DNA, 15 bp, Homo sapiens
attagagagaaagca

SEQ ID NO: 49008 - DNA, 15 bp, Homo sapiens
tattagagagaaagc

SEQ ID NO: 49009 - DNA, 15 bp, Homo sapiens
ttattagagagaaag

SEQ ID NO: 49010 - DNA, 15 bp, Homo sapiens
gttattagagagaaa

SEQ ID NO: 49011 - DNA, 15 bp, Homo sapiens
tgttattagagagaa

SEQ ID NO: 49012 - DNA, 15 bp, Homo sapiens
ctgttattagagaga

SEQ ID NO: 49013 - DNA, 15 bp, Homo sapiens
actgttattagagag

SEQ ID NO: 49014 - DNA, 15 bp, Homo sapiens
tactgttattagaga

SEQ ID NO: 49015 - DNA, 15 bp, Homo sapiens
ctactgttattagag

SEQ ID NO: 49016 - DNA, 15 bp, Homo sapiens
tctactgttattaga

SEQ ID NO: 49017 - DNA, 15 bp, Homo sapiens
ctctactgttattag

SEQ ID NO: 49018 - DNA, 15 bp, Homo sapiens
actctactgttatta

SEQ ID NO: 49019 - DNA, 15 bp, Homo sapiens
aactctactgttatt

SEQ ID NO: 49020 - DNA, 15 bp, Homo sapiens
aaactctactgttat

SEQ ID NO: 49021 - DNA, 15 bp, Homo sapiens
aaaactctactgtta

SEQ ID NO: 49022 - DNA, 15 bp, Homo sapiens
taaaactctactgtt

SEQ ID NO: 49023 - DNA, 15 bp, Homo sapiens
ctaaaactctactgt

SEQ ID NO: 49024 - DNA, 15 bp, Homo sapiens
tctaaaactctactg

SEQ ID NO: 49025 - DNA, 15 bp, Homo sapiens
ctctaaaactctact

SEQ ID NO: 49026 - DNA, 15 bp, Homo sapiens
cctctaaaactctac

SEQ ID NO: 49027 - DNA, 15 bp, Homo sapiens
acctctaaaactcta

SEQ ID NO: 49028 - DNA, 15 bp, Homo sapiens
cacctctaaaactct

SEQ ID NO: 49029 - DNA, 15 bp, Homo sapiens
tcacctctaaaactc

SEQ ID NO: 49030 - DNA, 15 bp, Homo sapiens
atcacctctaaaact

SEQ ID NO: 49031 - DNA, 15 bp, Homo sapiens
aatcacctctaaaac

SEQ ID NO: 49032 - DNA, 15 bp, Homo sapiens
aaatcacctctaaaa

SEQ ID NO: 49033 - DNA, 15 bp, Homo sapiens
caaatcacctctaaa

SEQ ID NO: 49034 - DNA, 15 bp, Homo sapiens
acaaatcacctctaa

SEQ ID NO: 49035 - DNA, 15 bp, Homo sapiens
cacaaatcacctcta

SEQ ID NO: 49036 - DNA, 15 bp, Homo sapiens
acacaaatcacctct

SEQ ID NO: 49037 - DNA, 15 bp, Homo sapiens
cacacaaatcacctc

SEQ ID NO: 49038 - DNA, 15 bp, Homo sapiens
gcacacaaatcacct

SEQ ID NO: 49039 - DNA, 15 bp, Homo sapiens
agcacacaaatcacc

SEQ ID NO: 49040 - DNA, 15 bp, Homo sapiens
aagcacacaaatcac

SEQ ID NO: 49041 - DNA, 15 bp, Homo sapiens
aaagcacacaaatca

SEQ ID NO: 49042 - DNA, 15 bp, Homo sapiens
gaaagcacacaaatc

SEQ ID NO: 49043 - DNA, 15 bp, Homo sapiens
tgaaagcacacaaat

SEQ ID NO: 49044 - DNA, 15 bp, Homo sapiens
atgaaagcacacaaa

SEQ ID NO: 49045 - DNA, 15 bp, Homo sapiens
tatgaaagcacacaa

SEQ ID NO: 49046 - DNA, 15 bp, Homo sapiens
ctatgaaagcacaca

SEQ ID NO: 49047 - DNA, 15 bp, Homo sapiens
cctatgaaagcacac

SEQ ID NO: 49048 - DNA, 15 bp, Homo sapiens
ccctatgaaagcaca

SEQ ID NO: 49049 - DNA, 15 bp, Homo sapiens
cccctatgaaagcac

SEQ ID NO: 49050 - DNA, 15 bp, Homo sapiens
tcccctatgaaagca

SEQ ID NO: 49051 - DNA, 15 bp, Homo sapiens
ttcccctatgaaagc

SEQ ID NO: 49052 - DNA, 15 bp, Homo sapiens
tttcccctatgaaag

SEQ ID NO: 49053 - DNA, 15 bp, Homo sapiens
gtttcccctatgaaa

SEQ ID NO: 49054 - DNA, 15 bp, Homo sapiens
tgtttcccctatgaa

SEQ ID NO: 49055 - DNA, 15 bp, Homo sapiens
ttgtttcccctatga

SEQ ID NO: 49056 - DNA, 15 bp, Homo sapiens
gttgtttcccctatg

SEQ ID NO: 49057 - DNA, 15 bp, Homo sapiens
agttgtttcccctat

SEQ ID NO: 49058 - DNA, 15 bp, Homo sapiens
gagttgtttccccta

SEQ ID NO: 49059 - DNA, 15 bp, Homo sapiens
ggagttgtttcccct

SEQ ID NO: 49060 - DNA, 15 bp, Homo sapiens
aggagttgtttcccc

SEQ ID NO: 49061 - DNA, 15 bp, Homo sapiens
taggagttgtttccc

SEQ ID NO: 49062 - DNA, 15 bp, Homo sapiens
ttaggagttgtttcc

SEQ ID NO: 49063 - DNA, 15 bp, Homo sapiens
attaggagttgtttc

SEQ ID NO: 49064 - DNA, 15 bp, Homo sapiens
aattaggagttgttt

SEQ ID NO: 49065 - DNA, 15 bp, Homo sapiens
aaattaggagttgtt

SEQ ID NO: 49066 - DNA, 15 bp, Homo sapiens
gaaattaggagttgt

SEQ ID NO: 49067 - DNA, 15 bp, Homo sapiens
agaaattaggagttg

SEQ ID NO: 49068 - DNA, 15 bp, Homo sapiens
gagaaattaggagtt

SEQ ID NO: 49069 - DNA, 15 bp, Homo sapiens
agagaaattaggagt

SEQ ID NO: 49070 - DNA, 15 bp, Homo sapiens
cagagaaattaggag

SEQ ID NO: 49071 - DNA, 15 bp, Homo sapiens
gcagagaaattagga

SEQ ID NO: 49072 - DNA, 15 bp, Homo sapiens
ggcagagaaattagg

SEQ ID NO: 49073 - DNA, 15 bp, Homo sapiens
tggcagagaaattag

SEQ ID NO: 49074 - DNA, 15 bp, Homo sapiens
gtggcagagaaatta

SEQ ID NO: 49075 - DNA, 15 bp, Homo sapiens
tgtggcagagaaatt

SEQ ID NO: 49076 - DNA, 15 bp, Homo sapiens
atgtggcagagaaat

SEQ ID NO: 49077 - DNA, 15 bp, Homo sapiens
aatgtggcagagaaa

SEQ ID NO: 49078 - DNA, 15 bp, Homo sapiens
aaatgtggcagagaa

SEQ ID NO: 49079 - DNA, 15 bp, Homo sapiens
gaaatgtggcagaga

SEQ ID NO: 49080 - DNA, 15 bp, Homo sapiens
ggaaatgtggcagag

SEQ ID NO: 49081 - DNA, 15 bp, Homo sapiens
tggaaatgtggcaga

SEQ ID NO: 49082 - DNA, 15 bp, Homo sapiens
ctggaaatgtggcag

SEQ ID NO: 49083 - DNA, 15 bp, Homo sapiens
actggaaatgtggca

SEQ ID NO: 49084 - DNA, 15 bp, Homo sapiens
aactggaaatgtggc

SEQ ID NO: 49085 - DNA, 15 bp, Homo sapiens
aaactggaaatgtgg

SEQ ID NO: 49086 - DNA, 15 bp, Homo sapiens
taaactggaaatgtg

SEQ ID NO: 49087 - DNA, 15 bp, Homo sapiens
ctaaactggaaatgt

SEQ ID NO: 49088 - DNA, 15 bp, Homo sapiens
cctaaactggaaatg

SEQ ID NO: 49089 - DNA, 15 bp, Homo sapiens
tcctaaactggaaat

SEQ ID NO: 49090 - DNA, 15 bp, Homo sapiens
atcctaaactggaaa

SEQ ID NO: 49091 - DNA, 15 bp, Homo sapiens
aatcctaaactggaa

SEQ ID NO: 49092 - DNA, 15 bp, Homo sapiens
aaatcctaaactgga

SEQ ID NO: 49093 - DNA, 15 bp, Homo sapiens
taaatcctaaactgg

SEQ ID NO: 49094 - DNA, 15 bp, Homo sapiens
ttaaatcctaaactg

SEQ ID NO: 49095 - DNA, 15 bp, Homo sapiens
tttaaatcctaaact

SEQ ID NO: 49096 - DNA, 15 bp, Homo sapiens
atttaaatcctaaac

SEQ ID NO: 49097 - DNA, 15 bp, Homo sapiens
aatttaaatcctaaa

SEQ ID NO: 49098 - DNA, 15 bp, Homo sapiens
caatttaaatcctaa

SEQ ID NO: 49099 - DNA, 15 bp, Homo sapiens
tcaatttaaatccta

SEQ ID NO: 49100 - DNA, 15 bp, Homo sapiens
atcaatttaaatcct

SEQ ID NO: 49101 - DNA, 15 bp, Homo sapiens
tatcaatttaaatcc

SEQ ID NO: 49102 - DNA, 15 bp, Homo sapiens
atatcaatttaaatc

SEQ ID NO: 49103 - DNA, 15 bp, Homo sapiens
tatatcaatttaaat

SEQ ID NO: 49104 - DNA, 15 bp, Homo sapiens
atatatcaatttaaa

SEQ ID NO: 49105 - DNA, 15 bp, Homo sapiens
catatatcaatttaa

SEQ ID NO: 49106 - DNA, 15 bp, Homo sapiens
acatatatcaattta

SEQ ID NO: 49107 - DNA, 15 bp, Homo sapiens
aacatatatcaattt

SEQ ID NO: 49108 - DNA, 15 bp, Homo sapiens
caacatatatcaatt

SEQ ID NO: 49109 - DNA, 15 bp, Homo sapiens
gcaacatatatcaat

SEQ ID NO: 49110 - DNA, 15 bp, Homo sapiens
agcaacatatatcaa

SEQ ID NO: 49111 - DNA, 15 bp, Homo sapiens
tagcaacatatatca

SEQ ID NO: 49112 - DNA, 15 bp, Homo sapiens
gtagcaacatatatc

SEQ ID NO: 49113 - DNA, 15 bp, Homo sapiens
cgtagcaacatatat

SEQ ID NO: 49114 - DNA, 15 bp, Homo sapiens
acgtagcaacatata

SEQ ID NO: 49115 - DNA, 15 bp, Homo sapiens
aacgtagcaacatat

SEQ ID NO: 49116 - DNA, 15 bp, Homo sapiens
gaacgtagcaacata

SEQ ID NO: 49117 - DNA, 15 bp, Homo sapiens
agaacgtagcaacat

SEQ ID NO: 49118 - DNA, 15 bp, Homo sapiens
cagaacgtagcaaca

SEQ ID NO: 49119 - DNA, 15 bp, Homo sapiens
gcagaacgtagcaac

SEQ ID NO: 49120 - DNA, 15 bp, Homo sapiens
agcagaacgtagcaa

SEQ ID NO: 49121 - DNA, 15 bp, Homo sapiens
tagcagaacgtagca

SEQ ID NO: 49122 - DNA, 15 bp, Homo sapiens
ttagcagaacgtagc

SEQ ID NO: 49123 - DNA, 15 bp, Homo sapiens
tttagcagaacgtag

SEQ ID NO: 49124 - DNA, 15 bp, Homo sapiens
ttttagcagaacgta

SEQ ID NO: 49125 - DNA, 15 bp, Homo sapiens
gttttagcagaacgt

SEQ ID NO: 49126 - DNA, 15 bp, Homo sapiens
tgttttagcagaacg

SEQ ID NO: 49127 - DNA, 15 bp, Homo sapiens
ttgttttagcagaac

SEQ ID NO: 49128 - DNA, 15 bp, Homo sapiens
attgttttagcagaa

SEQ ID NO: 49129 - DNA, 15 bp, Homo sapiens
aattgttttagcaga

SEQ ID NO: 49130 - DNA, 15 bp, Homo sapiens
aaattgttttagcag

SEQ ID NO: 49131 - DNA, 15 bp, Homo sapiens
aaaattgttttagca

SEQ ID NO: 49132 - DNA, 15 bp, Homo sapiens
gaaaattgttttagc

SEQ ID NO: 49133 - DNA, 15 bp, Homo sapiens
ggaaaattgttttag

SEQ ID NO: 49134 - DNA, 15 bp, Homo sapiens
tggaaaattgtttta

SEQ ID NO: 49135 - DNA, 15 bp, Homo sapiens
atggaaaattgtttt

SEQ ID NO: 49136 - DNA, 15 bp, Homo sapiens
tatggaaaattgttt

SEQ ID NO: 49137 - DNA, 15 bp, Homo sapiens
gtatggaaaattgtt

SEQ ID NO: 49138 - DNA, 15 bp, Homo sapiens
ggtatggaaaattgt

SEQ ID NO: 49139 - DNA, 15 bp, Homo sapiens
gggtatggaaaattg

SEQ ID NO: 49140 - DNA, 15 bp, Homo sapiens
tgggtatggaaaatt

SEQ ID NO: 49141 - DNA, 15 bp, Homo sapiens
atgggtatggaaaat

SEQ ID NO: 49142 - DNA, 15 bp, Homo sapiens
aatgggtatggaaaa

SEQ ID NO: 49143 - DNA, 15 bp, Homo sapiens
aaatgggtatggaaa

SEQ ID NO: 49144 - DNA, 15 bp, Homo sapiens
caaatgggtatggaa

SEQ ID NO: 49145 - DNA, 15 bp, Homo sapiens
tcaaatgggtatgga

SEQ ID NO: 49146 - DNA, 15 bp, Homo sapiens
ctcaaatgggtatgg

SEQ ID NO: 49147 - DNA, 15 bp, Homo sapiens
gctcaaatgggtatg

SEQ ID NO: 49148 - DNA, 15 bp, Homo sapiens
agctcaaatgggtat

SEQ ID NO: 49149 - DNA, 15 bp, Homo sapiens
cagctcaaatgggta

SEQ ID NO: 49150 - DNA, 15 bp, Homo sapiens
ccagctcaaatgggt

SEQ ID NO: 49151 - DNA, 15 bp, Homo sapiens
accagctcaaatggg

SEQ ID NO: 49152 - DNA, 15 bp, Homo sapiens
caccagctcaaatgg

SEQ ID NO: 49153 - DNA, 15 bp, Homo sapiens
tcaccagctcaaatg

SEQ ID NO: 49154 - DNA, 15 bp, Homo sapiens
ttcaccagctcaaat

SEQ ID NO: 49155 - DNA, 15 bp, Homo sapiens
cttcaccagctcaaa

SEQ ID NO: 49156 - DNA, 15 bp, Homo sapiens
acttcaccagctcaa

SEQ ID NO: 49157 - DNA, 15 bp, Homo sapiens
cacttcaccagctca

SEQ ID NO: 49158 - DNA, 15 bp, Homo sapiens
tcacttcaccagctc

SEQ ID NO: 49159 - DNA, 15 bp, Homo sapiens
ttcacttcaccagct

SEQ ID NO: 49160 - DNA, 15 bp, Homo sapiens
tttcacttcaccagc

SEQ ID NO: 49161 - DNA, 15 bp, Homo sapiens
ttttcacttcaccag

SEQ ID NO: 49162 - DNA, 15 bp, Homo sapiens
gttttcacttcacca

SEQ ID NO: 49163 - DNA, 15 bp, Homo sapiens
tgttttcacttcacc

SEQ ID NO: 49164 - DNA, 15 bp, Homo sapiens
atgttttcacttcac

SEQ ID NO: 49165 - DNA, 15 bp, Homo sapiens
aatgttttcacttca

SEQ ID NO: 49166 - DNA, 15 bp, Homo sapiens
aaatgttttcacttc

SEQ ID NO: 49167 - DNA, 15 bp, Homo sapiens
aaaatgttttcactt

SEQ ID NO: 49168 - DNA, 15 bp, Homo sapiens
caaaatgttttcact

SEQ ID NO: 49169 - DNA, 15 bp, Homo sapiens
tcaaaatgttttcac

SEQ ID NO: 49170 - DNA, 15 bp, Homo sapiens
ttcaaaatgttttca

SEQ ID NO: 49171 - DNA, 15 bp, Homo sapiens
tttcaaaatgttttc

SEQ ID NO: 49172 - DNA, 15 bp, Homo sapiens
gtttcaaaatgtttt

SEQ ID NO: 49173 - DNA, 15 bp, Homo sapiens
ggtttcaaaatgttt

SEQ ID NO: 49174 - DNA, 15 bp, Homo sapiens
tggtttcaaaatgtt

SEQ ID NO: 49175 - DNA, 15 bp, Homo sapiens
ctggtttcaaaatgt

SEQ ID NO: 49176 - DNA, 15 bp, Homo sapiens
actggtttcaaaatg

SEQ ID NO: 49177 - DNA, 15 bp, Homo sapiens
aactggtttcaaaat

SEQ ID NO: 49178 - DNA, 15 bp, Homo sapiens
aaactggtttcaaaa

SEQ ID NO: 49179 - DNA, 15 bp, Homo sapiens
gaaactggtttcaaa

SEQ ID NO: 49180 - DNA, 15 bp, Homo sapiens
ggaaactggtttcaa

SEQ ID NO: 49181 - DNA, 15 bp, Homo sapiens
aggaaactggtttca

SEQ ID NO: 49182 - DNA, 15 bp, Homo sapiens
aaggaaactggtttc

SEQ ID NO: 49183 - DNA, 15 bp, Homo sapiens
caaggaaactggttt

SEQ ID NO: 49184 - DNA, 15 bp, Homo sapiens
tcaaggaaactggtt

SEQ ID NO: 49185 - DNA, 15 bp, Homo sapiens
ttcaaggaaactggt

SEQ ID NO: 49186 - DNA, 15 bp, Homo sapiens
cttcaaggaaactgg

SEQ ID NO: 49187 - DNA, 15 bp, Homo sapiens
tcttcaaggaaactg

SEQ ID NO: 49188 - DNA, 15 bp, Homo sapiens
atcttcaaggaaact

SEQ ID NO: 49189 - DNA, 15 bp, Homo sapiens
aatcttcaaggaaac

SEQ ID NO: 49190 - DNA, 15 bp, Homo sapiens
aaatcttcaaggaaa

SEQ ID NO: 49191 - DNA, 15 bp, Homo sapiens
taaatcttcaaggaa

SEQ ID NO: 49192 - DNA, 15 bp, Homo sapiens
ataaatcttcaagga

SEQ ID NO: 49193 - DNA, 15 bp, Homo sapiens
gataaatcttcaagg

SEQ ID NO: 49194 - DNA, 15 bp, Homo sapiens
tgataaatcttcaag

SEQ ID NO: 49195 - DNA, 15 bp, Homo sapiens
ttgataaatcttcaa

SEQ ID NO: 49196 - DNA, 15 bp, Homo sapiens
cttgataaatcttca

SEQ ID NO: 49197 - DNA, 15 bp, Homo sapiens
gcttgataaatcttc

SEQ ID NO: 49198 - DNA, 15 bp, Homo sapiens
tgcttgataaatctt

SEQ ID NO: 49199 - DNA, 15 bp, Homo sapiens
ctgcttgataaatct

SEQ ID NO: 49200 - DNA, 15 bp, Homo sapiens
actgcttgataaatc

SEQ ID NO: 49201 - DNA, 15 bp, Homo sapiens
aactgcttgataaat

SEQ ID NO: 49202 - DNA, 15 bp, Homo sapiens
aaactgcttgataaa

SEQ ID NO: 49203 - DNA, 15 bp, Homo sapiens
aaaactgcttgataa

SEQ ID NO: 49204 - DNA, 15 bp, Homo sapiens
caaaactgcttgata

SEQ ID NO: 49205 - DNA, 15 bp, Homo sapiens
acaaaactgcttgat

SEQ ID NO: 49206 - DNA, 15 bp, Homo sapiens
aacaaaactgcttga

SEQ ID NO: 49207 - DNA, 15 bp, Homo sapiens
caacaaaactgcttg

SEQ ID NO: 49208 - DNA, 15 bp, Homo sapiens
tcaacaaaactgctt

SEQ ID NO: 49209 - DNA, 15 bp, Homo sapiens
atcaacaaaactgct

SEQ ID NO: 49210 - DNA, 15 bp, Homo sapiens
catcaacaaaactgc

SEQ ID NO: 49211 - DNA, 15 bp, Homo sapiens
acatcaacaaaactg

SEQ ID NO: 49212 - DNA, 15 bp, Homo sapiens
cacatcaacaaaact

SEQ ID NO: 49213 - DNA, 15 bp, Homo sapiens
acacatcaacaaaac

SEQ ID NO: 49214 - DNA, 15 bp, Homo sapiens
gacacatcaacaaaa

SEQ ID NO: 49215 - DNA, 15 bp, Homo sapiens
agacacatcaacaaa

SEQ ID NO: 49216 - DNA, 15 bp, Homo sapiens
aagacacatcaacaa

SEQ ID NO: 49217 - DNA, 15 bp, Homo sapiens
caagacacatcaaca

SEQ ID NO: 49218 - DNA, 15 bp, Homo sapiens
gcaagacacatcaac

SEQ ID NO: 49219 - DNA, 15 bp, Homo sapiens
agcaagacacatcaa

SEQ ID NO: 49220 - DNA, 15 bp, Homo sapiens
tagcaagacacatca

SEQ ID NO: 49221 - DNA, 15 bp, Homo sapiens
atagcaagacacatc

SEQ ID NO: 49222 - DNA, 15 bp, Homo sapiens
tatagcaagacacat

SEQ ID NO: 49223 - DNA, 15 bp, Homo sapiens
gtatagcaagacaca

SEQ ID NO: 49224 - DNA, 15 bp, Homo sapiens
agtatagcaagacac

SEQ ID NO: 49225 - DNA, 15 bp, Homo sapiens
aagtatagcaagaca

SEQ ID NO: 49226 - DNA, 15 bp, Homo sapiens
gaagtatagcaagac

SEQ ID NO: 49227 - DNA, 15 bp, Homo sapiens
agaagtatagcaaga

SEQ ID NO: 49228 - DNA, 15 bp, Homo sapiens
aagaagtatagcaag

SEQ ID NO: 49229 - DNA, 15 bp, Homo sapiens
aaagaagtatagcaa

SEQ ID NO: 49230 - DNA, 15 bp, Homo sapiens
aaaagaagtatagca

SEQ ID NO: 49231 - DNA, 15 bp, Homo sapiens
taaaagaagtatagc

SEQ ID NO: 49232 - DNA, 15 bp, Homo sapiens
gtaaaagaagtatag

SEQ ID NO: 49233 - DNA, 15 bp, Homo sapiens
ggtaaaagaagtata

SEQ ID NO: 49234 - DNA, 15 bp, Homo sapiens
aggtaaaagaagtat

SEQ ID NO: 49235 - DNA, 15 bp, Homo sapiens
taggtaaaagaagta

SEQ ID NO: 49236 - DNA, 15 bp, Homo sapiens
ataggtaaaagaagt

SEQ ID NO: 49237 - DNA, 15 bp, Homo sapiens
gataggtaaaagaag

SEQ ID NO: 49238 - DNA, 15 bp, Homo sapiens
tgataggtaaaagaa

SEQ ID NO: 49239 - DNA, 15 bp, Homo sapiens
gtgataggtaaaaga

SEQ ID NO: 49240 - DNA, 15 bp, Homo sapiens
tgtgataggtaaaag

SEQ ID NO: 49241 - DNA, 15 bp, Homo sapiens
ctgtgataggtaaaa

SEQ ID NO: 49242 - DNA, 15 bp, Homo sapiens
tctgtgataggtaaa

SEQ ID NO: 49243 - DNA, 15 bp, Homo sapiens
ttctgtgataggtaa

SEQ ID NO: 49244 - DNA, 15 bp, Homo sapiens
tttctgtgataggta

SEQ ID NO: 49245 - DNA, 15 bp, Homo sapiens
atttctgtgataggt

SEQ ID NO: 49246 - DNA, 15 bp, Homo sapiens
tatttctgtgatagg

SEQ ID NO: 49247 - DNA, 15 bp, Homo sapiens
ttatttctgtgatag

SEQ ID NO: 49248 - DNA, 15 bp, Homo sapiens
tttatttctgtgata

SEQ ID NO: 49249 - DNA, 15 bp, Homo sapiens
ttttatttctgtgat

SEQ ID NO: 49250 - DNA, 15 bp, Homo sapiens
attttatttctgtga

SEQ ID NO: 49251 - DNA, 15 bp, Homo sapiens
gattttatttctgtg

SEQ ID NO: 49252 - DNA, 15 bp, Homo sapiens
ggattttatttctgt

SEQ ID NO: 49253 - DNA, 15 bp, Homo sapiens
gggattttatttctg

SEQ ID NO: 49254 - DNA, 15 bp, Homo sapiens
tgggattttatttct

SEQ ID NO: 49255 - DNA, 15 bp, Homo sapiens
ctgggattttatttc

SEQ ID NO: 49256 - DNA, 15 bp, Homo sapiens
cctgggattttattt

SEQ ID NO: 49257 - DNA, 15 bp, Homo sapiens
gcctgggattttatt

SEQ ID NO: 49258 - DNA, 15 bp, Homo sapiens
agcctgggattttat

SEQ ID NO: 49259 - DNA, 15 bp, Homo sapiens
tagcctgggatttta

SEQ ID NO: 49260 - DNA, 15 bp, Homo sapiens
ctagcctgggatttt

SEQ ID NO: 49261 - DNA, 15 bp, Homo sapiens
cctagcctgggattt

SEQ ID NO: 49262 - DNA, 15 bp, Homo sapiens
gcctagcctgggatt

SEQ ID NO: 49263 - DNA, 15 bp, Homo sapiens
tgcctagcctgggat

SEQ ID NO: 49264 - DNA, 15 bp, Homo sapiens
ctgcctagcctggga

SEQ ID NO: 49265 - DNA, 15 bp, Homo sapiens
gctgcctagcctggg

SEQ ID NO: 49266 - DNA, 15 bp, Homo sapiens
tgctgcctagcctgg

SEQ ID NO: 49267 - DNA, 15 bp, Homo sapiens
ctgctgcctagcctg

SEQ ID NO: 49268 - DNA, 15 bp, Homo sapiens
actgctgcctagcct

SEQ ID NO: 49269 - DNA, 15 bp, Homo sapiens
cactgctgcctagcc

SEQ ID NO: 49270 - DNA, 15 bp, Homo sapiens
tcactgctgcctagc

SEQ ID NO: 49271 - DNA, 15 bp, Homo sapiens
ttcactgctgcctag

SEQ ID NO: 49272 - DNA, 15 bp, Homo sapiens
cttcactgctgccta

SEQ ID NO: 49273 - DNA, 15 bp, Homo sapiens
ccttcactgctgcct

SEQ ID NO: 49274 - DNA, 15 bp, Homo sapiens
gccttcactgctgcc

SEQ ID NO: 49275 - DNA, 15 bp, Homo sapiens
ggccttcactgctgc

SEQ ID NO: 49276 - DNA, 15 bp, Homo sapiens
aggccttcactgctg

SEQ ID NO: 49277 - DNA, 15 bp, Homo sapiens
aaggccttcactgct

SEQ ID NO: 49278 - DNA, 15 bp, Homo sapiens
aaaggccttcactgc

SEQ ID NO: 49279 - DNA, 15 bp, Homo sapiens
caaaggccttcactg

SEQ ID NO: 49280 - DNA, 15 bp, Homo sapiens
ccaaaggccttcact

SEQ ID NO: 49281 - DNA, 15 bp, Homo sapiens
tccaaaggccttcac

SEQ ID NO: 49282 - DNA, 15 bp, Homo sapiens
atccaaaggccttca

SEQ ID NO: 49283 - DNA, 15 bp, Homo sapiens
gatccaaaggccttc

SEQ ID NO: 49284 - DNA, 15 bp, Homo sapiens
agatccaaaggcctt

SEQ ID NO: 49285 - DNA, 15 bp, Homo sapiens
cagatccaaaggcct

SEQ ID NO: 49286 - DNA, 15 bp, Homo sapiens
acagatccaaaggcc

SEQ ID NO: 49287 - DNA, 15 bp, Homo sapiens
cacagatccaaaggc

SEQ ID NO: 49288 - DNA, 15 bp, Homo sapiens
acacagatccaaagg

SEQ ID NO: 49289 - DNA, 15 bp, Homo sapiens
cacacagatccaaag

SEQ ID NO: 49290 - DNA, 15 bp, Homo sapiens
tcacacagatccaaa

SEQ ID NO: 49291 - DNA, 15 bp, Homo sapiens
ctcacacagatccaa

SEQ ID NO: 49292 - DNA, 15 bp, Homo sapiens
gctcacacagatcca

SEQ ID NO: 49293 - DNA, 15 bp, Homo sapiens
tgctcacacagatcc

SEQ ID NO: 49294 - DNA, 15 bp, Homo sapiens
atgctcacacagatc

SEQ ID NO: 49295 - DNA, 15 bp, Homo sapiens
catgctcacacagat

SEQ ID NO: 49296 - DNA, 15 bp, Homo sapiens
acatgctcacacaga

SEQ ID NO: 49297 - DNA, 15 bp, Homo sapiens
gacatgctcacacag

SEQ ID NO: 49298 - DNA, 15 bp, Homo sapiens
tgacatgctcacaca

SEQ ID NO: 49299 - DNA, 15 bp, Homo sapiens
ttgacatgctcacac

SEQ ID NO: 49300 - DNA, 15 bp, Homo sapiens
tttgacatgctcaca

SEQ ID NO: 49301 - DNA, 15 bp, Homo sapiens
ttttgacatgctcac

SEQ ID NO: 49302 - DNA, 15 bp, Homo sapiens
cttttgacatgctca

SEQ ID NO: 49303 - DNA, 15 bp, Homo sapiens
gcttttgacatgctc

SEQ ID NO: 49304 - DNA, 15 bp, Homo sapiens
tgcttttgacatgct

SEQ ID NO: 49305 - DNA, 15 bp, Homo sapiens
atgcttttgacatgc

SEQ ID NO: 49306 - DNA, 15 bp, Homo sapiens
aatgcttttgacatg

SEQ ID NO: 49307 - DNA, 15 bp, Homo sapiens
aaatgcttttgacat

SEQ ID NO: 49308 - DNA, 15 bp, Homo sapiens
aaaatgcttttgaca

SEQ ID NO: 49309 - DNA, 15 bp, Homo sapiens
taaaatgcttttgac

SEQ ID NO: 49310 - DNA, 15 bp, Homo sapiens
ttaaaatgcttttga

SEQ ID NO: 49311 - DNA, 15 bp, Homo sapiens
cttaaaatgcttttg

SEQ ID NO: 49312 - DNA, 15 bp, Homo sapiens
tcttaaaatgctttt

SEQ ID NO: 49313 - DNA, 15 bp, Homo sapiens
ttcttaaaatgcttt

SEQ ID NO: 49314 - DNA, 15 bp, Homo sapiens
cttcttaaaatgctt

SEQ ID NO: 49315 - DNA, 15 bp, Homo sapiens
tcttcttaaaatgct

SEQ ID NO: 49316 - DNA, 15 bp, Homo sapiens
ctcttcttaaaatgc

SEQ ID NO: 49317 - DNA, 15 bp, Homo sapiens
gctcttcttaaaatg

SEQ ID NO: 49318 - DNA, 15 bp, Homo sapiens
tgctcttcttaaaat

SEQ ID NO: 49319 - DNA, 15 bp, Homo sapiens
ttgctcttcttaaaa

SEQ ID NO: 49320 - DNA, 15 bp, Homo sapiens
tttgctcttcttaaa

SEQ ID NO: 49321 - DNA, 15 bp, Homo sapiens
ttttgctcttcttaa

SEQ ID NO: 49322 - DNA, 15 bp, Homo sapiens
attttgctcttctta

SEQ ID NO: 49323 - DNA, 15 bp, Homo sapiens
tattttgctcttctt

SEQ ID NO: 49324 - DNA, 15 bp, Homo sapiens
atattttgctcttct

SEQ ID NO: 49325 - DNA, 15 bp, Homo sapiens
aatattttgctcttc

SEQ ID NO: 49326 - DNA, 15 bp, Homo sapiens
aaatattttgctctt

SEQ ID NO: 49327 - DNA, 15 bp, Homo sapiens
taaatattttgctct

SEQ ID NO: 49328 - DNA, 15 bp, Homo sapiens
ctaaatattttgctc

SEQ ID NO: 49329 - DNA, 15 bp, Homo sapiens
tctaaatattttgct

SEQ ID NO: 49330 - DNA, 15 bp, Homo sapiens
ctctaaatattttgc

SEQ ID NO: 49331 - DNA, 15 bp, Homo sapiens
cctctaaatattttg

SEQ ID NO: 49332 - DNA, 15 bp, Homo sapiens
tcctctaaatatttt

SEQ ID NO: 49333 - DNA, 15 bp, Homo sapiens
ttcctctaaatattt

SEQ ID NO: 49334 - DNA, 15 bp, Homo sapiens
cttcctctaaatatt

SEQ ID NO: 49335 - DNA, 15 bp, Homo sapiens
tcttcctctaaatat

SEQ ID NO: 49336 - DNA, 15 bp, Homo sapiens
ttcttcctctaaata

SEQ ID NO: 49337 - DNA, 15 bp, Homo sapiens
attcttcctctaaat

SEQ ID NO: 49338 - DNA, 15 bp, Homo sapiens
aattcttcctctaaa

SEQ ID NO: 49339 - DNA, 15 bp, Homo sapiens
aaattcttcctctaa

SEQ ID NO: 49340 - DNA, 15 bp, Homo sapiens
caaattcttcctcta

SEQ ID NO: 49341 - DNA, 15 bp, Homo sapiens
ccaaattcttcctct

SEQ ID NO: 49342 - DNA, 15 bp, Homo sapiens
cccaaattcttcctc

SEQ ID NO: 49343 - DNA, 15 bp, Homo sapiens
tcccaaattcttcct

SEQ ID NO: 49344 - DNA, 15 bp, Homo sapiens
ttcccaaattcttcc

SEQ ID NO: 49345 - DNA, 15 bp, Homo sapiens
tttcccaaattcttc

SEQ ID NO: 49346 - DNA, 15 bp, Homo sapiens
ctttcccaaattctt

SEQ ID NO: 49347 - DNA, 15 bp, Homo sapiens
gctttcccaaattct

SEQ ID NO: 49348 - DNA, 15 bp, Homo sapiens
tgctttcccaaattc

SEQ ID NO: 49349 - DNA, 15 bp, Homo sapiens
ctgctttcccaaatt

SEQ ID NO: 49350 - DNA, 15 bp, Homo sapiens
gctgctttcccaaat

SEQ ID NO: 49351 - DNA, 15 bp, Homo sapiens
ggctgctttcccaaa

SEQ ID NO: 49352 - DNA, 15 bp, Homo sapiens
aggctgctttcccaa

SEQ ID NO: 49353 - DNA, 15 bp, Homo sapiens
aaggctgctttccca

SEQ ID NO: 49354 - DNA, 15 bp, Homo sapiens
taaggctgctttccc

SEQ ID NO: 49355 - DNA, 15 bp, Homo sapiens
ttaaggctgctttcc

SEQ ID NO: 49356 - DNA, 15 bp, Homo sapiens
cttaaggctgctttc

SEQ ID NO: 49357 - DNA, 15 bp, Homo sapiens
ccttaaggctgcttt

SEQ ID NO: 49358 - DNA, 15 bp, Homo sapiens
cccttaaggctgctt

SEQ ID NO: 49359 - DNA, 15 bp, Homo sapiens
tcccttaaggctgct

SEQ ID NO: 49360 - DNA, 15 bp, Homo sapiens
atcccttaaggctgc

SEQ ID NO: 49361 - DNA, 15 bp, Homo sapiens
aatcccttaaggctg

SEQ ID NO: 49362 - DNA, 15 bp, Homo sapiens
aaatcccttaaggct

SEQ ID NO: 49363 - DNA, 15 bp, Homo sapiens
taaatcccttaaggc

SEQ ID NO: 49364 - DNA, 15 bp, Homo sapiens
ttaaatcccttaagg

SEQ ID NO: 49365 - DNA, 15 bp, Homo sapiens
gttaaatcccttaag

SEQ ID NO: 49366 - DNA, 15 bp, Homo sapiens
tgttaaatcccttaa

SEQ ID NO: 49367 - DNA, 15 bp, Homo sapiens
gtgttaaatccctta

SEQ ID NO: 49368 - DNA, 15 bp, Homo sapiens
tgtgttaaatccctt

SEQ ID NO: 49369 - DNA, 15 bp, Homo sapiens
atgtgttaaatccct

SEQ ID NO: 49370 - DNA, 15 bp, Homo sapiens
aatgtgttaaatccc

SEQ ID NO: 49371 - DNA, 15 bp, Homo sapiens
aaatgtgttaaatcc

SEQ ID NO: 49372 - DNA, 15 bp, Homo sapiens
aaaatgtgttaaatc

SEQ ID NO: 49373 - DNA, 15 bp, Homo sapiens
aaaaatgtgttaaat

SEQ ID NO: 49374 - DNA, 15 bp, Homo sapiens
gaaaaatgtgttaaa

SEQ ID NO: 49375 - DNA, 15 bp, Homo sapiens
agaaaaatgtgttaa

SEQ ID NO: 49376 - DNA, 15 bp, Homo sapiens
aagaaaaatgtgtta

SEQ ID NO: 49377 - DNA, 15 bp, Homo sapiens
gaagaaaaatgtgtt

SEQ ID NO: 49378 - DNA, 15 bp, Homo sapiens
agaagaaaaatgtgt

SEQ ID NO: 49379 - DNA, 15 bp, Homo sapiens
aagaagaaaaatgtg

SEQ ID NO: 49380 - DNA, 15 bp, Homo sapiens
gaagaagaaaaatgt

SEQ ID NO: 49381 - DNA, 15 bp, Homo sapiens
agaagaagaaaaatg

SEQ ID NO: 49382 - DNA, 15 bp, Homo sapiens
tagaagaagaaaaat

SEQ ID NO: 49383 - DNA, 15 bp, Homo sapiens
ttagaagaagaaaaa

SEQ ID NO: 49384 - DNA, 15 bp, Homo sapiens
attagaagaagaaaa

SEQ ID NO: 49385 - DNA, 15 bp, Homo sapiens
aattagaagaagaaa

SEQ ID NO: 49386 - DNA, 15 bp, Homo sapiens
gaattagaagaagaa

SEQ ID NO: 49387 - DNA, 15 bp, Homo sapiens
tgaattagaagaaga

SEQ ID NO: 49388 - DNA, 15 bp, Homo sapiens
ctgaattagaagaag

SEQ ID NO: 49389 - DNA, 15 bp, Homo sapiens
actgaattagaagaa

SEQ ID NO: 49390 - DNA, 15 bp, Homo sapiens
gactgaattagaaga

SEQ ID NO: 49391 - DNA, 15 bp, Homo sapiens
agactgaattagaag

SEQ ID NO: 49392 - DNA, 15 bp, Homo sapiens
gagactgaattagaa

SEQ ID NO: 49393 - DNA, 15 bp, Homo sapiens
cgagactgaattaga

SEQ ID NO: 49394 - DNA, 15 bp, Homo sapiens
acgagactgaattag

SEQ ID NO: 49395 - DNA, 15 bp, Homo sapiens
cacgagactgaatta

SEQ ID NO: 49396 - DNA, 15 bp, Homo sapiens
acacgagactgaatt

SEQ ID NO: 49397 - DNA, 15 bp, Homo sapiens
aacacgagactgaat

SEQ ID NO: 49398 - DNA, 15 bp, Homo sapiens
gaacacgagactgaa

SEQ ID NO: 49399 - DNA, 15 bp, Homo sapiens
tgaacacgagactga

SEQ ID NO: 49400 - DNA, 15 bp, Homo sapiens
atgaacacgagactg

SEQ ID NO: 49401 - DNA, 15 bp, Homo sapiens
gatgaacacgagact

SEQ ID NO: 49402 - DNA, 15 bp, Homo sapiens
ggatgaacacgagac

SEQ ID NO: 49403 - DNA, 15 bp, Homo sapiens
gggatgaacacgaga

SEQ ID NO: 49404 - DNA, 15 bp, Homo sapiens
agggatgaacacgag

SEQ ID NO: 49405 - DNA, 15 bp, Homo sapiens
gagggatgaacacga

SEQ ID NO: 49406 - DNA, 15 bp, Homo sapiens
agagggatgaacacg

SEQ ID NO: 49407 - DNA, 15 bp, Homo sapiens
tagagggatgaacac

SEQ ID NO: 49408 - DNA, 15 bp, Homo sapiens
ttagagggatgaaca

SEQ ID NO: 49409 - DNA, 15 bp, Homo sapiens
attagagggatgaac

SEQ ID NO: 49410 - DNA, 15 bp, Homo sapiens
cattagagggatgaa

SEQ ID NO: 49411 - DNA, 15 bp, Homo sapiens
ccattagagggatga

SEQ ID NO: 49412 - DNA, 15 bp, Homo sapiens
tccattagagggatg

SEQ ID NO: 49413 - DNA, 15 bp, Homo sapiens
ctccattagagggat

SEQ ID NO: 49414 - DNA, 15 bp, Homo sapiens
tctccattagaggga

SEQ ID NO: 49415 - DNA, 15 bp, Homo sapiens
ttctccattagaggg

SEQ ID NO: 49416 - DNA, 15 bp, Homo sapiens
tttctccattagagg

SEQ ID NO: 49417 - DNA, 15 bp, Homo sapiens
ctttctccattagag

SEQ ID NO: 49418 - DNA, 15 bp, Homo sapiens
cctttctccattaga

SEQ ID NO: 49419 - DNA, 15 bp, Homo sapiens
acctttctccattag

SEQ ID NO: 49420 - DNA, 15 bp, Homo sapiens
gacctttctccatta

SEQ ID NO: 49421 - DNA, 15 bp, Homo sapiens
tgacctttctccatt

SEQ ID NO: 49422 - DNA, 15 bp, Homo sapiens
atgacctttctccat

SEQ ID NO: 49423 - DNA, 15 bp, Homo sapiens
aatgacctttctcca

SEQ ID NO: 49424 - DNA, 15 bp, Homo sapiens
taatgacctttctcc

SEQ ID NO: 49425 - DNA, 15 bp, Homo sapiens
ttaatgacctttctc

SEQ ID NO: 49426 - DNA, 15 bp, Homo sapiens
attaatgacctttct

SEQ ID NO: 49427 - DNA, 15 bp, Homo sapiens
cattaatgacctttc

SEQ ID NO: 49428 - DNA, 15 bp, Homo sapiens
ccattaatgaccttt

SEQ ID NO: 49429 - DNA, 15 bp, Homo sapiens
tccattaatgacctt

SEQ ID NO: 49430 - DNA, 15 bp, Homo sapiens
atccattaatgacct

SEQ ID NO: 49431 - DNA, 15 bp, Homo sapiens
tatccattaatgacc

SEQ ID NO: 49432 - DNA, 15 bp, Homo sapiens
ttatccattaatgac

SEQ ID NO: 49433 - DNA, 15 bp, Homo sapiens
cttatccattaatga

SEQ ID NO: 49434 - DNA, 15 bp, Homo sapiens
tcttatccattaatg

SEQ ID NO: 49435 - DNA, 15 bp, Homo sapiens
atcttatccattaat

SEQ ID NO: 49436 - DNA, 15 bp, Homo sapiens
aatcttatccattaa

SEQ ID NO: 49437 - DNA, 15 bp, Homo sapiens
aaatcttatccatta

SEQ ID NO: 49438 - DNA, 15 bp, Homo sapiens
caaatcttatccatt

SEQ ID NO: 49439 - DNA, 15 bp, Homo sapiens
gcaaatcttatccat

SEQ ID NO: 49440 - DNA, 15 bp, Homo sapiens
agcaaatcttatcca

SEQ ID NO: 49441 - DNA, 15 bp, Homo sapiens
tagcaaatcttatcc

SEQ ID NO: 49442 - DNA, 15 bp, Homo sapiens
ttagcaaatcttatc

SEQ ID NO: 49443 - DNA, 15 bp, Homo sapiens
cttagcaaatcttat

SEQ ID NO: 49444 - DNA, 15 bp, Homo sapiens
gcttagcaaatctta

SEQ ID NO: 49445 - DNA, 15 bp, Homo sapiens
ggcttagcaaatctt

SEQ ID NO: 49446 - DNA, 15 bp, Homo sapiens
tggcttagcaaatct

SEQ ID NO: 49447 - DNA, 15 bp, Homo sapiens
ctggcttagcaaatc

SEQ ID NO: 49448 - DNA, 15 bp, Homo sapiens
gctggcttagcaaat

SEQ ID NO: 49449 - DNA, 15 bp, Homo sapiens
tgctggcttagcaaa

SEQ ID NO: 49450 - DNA, 15 bp, Homo sapiens
ttgctggcttagcaa

SEQ ID NO: 49451 - DNA, 15 bp, Homo sapiens
tttgctggcttagca

SEQ ID NO: 49452 - DNA, 15 bp, Homo sapiens
ctttgctggcttagc

SEQ ID NO: 49453 - DNA, 15 bp, Homo sapiens
cctttgctggcttag

SEQ ID NO: 49454 - DNA, 15 bp, Homo sapiens
gcctttgctggctta

SEQ ID NO: 49455 - DNA, 15 bp, Homo sapiens
agcctttgctggctt

SEQ ID NO: 49456 - DNA, 15 bp, Homo sapiens
aagcctttgctggct

SEQ ID NO: 49457 - DNA, 15 bp, Homo sapiens
aaagcctttgctggc

SEQ ID NO: 49458 - DNA, 15 bp, Homo sapiens
aaaagcctttgctgg

SEQ ID NO: 49459 - DNA, 15 bp, Homo sapiens
taaaagcctttgctg

SEQ ID NO: 49460 - DNA, 15 bp, Homo sapiens
ctaaaagcctttgct

SEQ ID NO: 49461 - DNA, 15 bp, Homo sapiens
tctaaaagcctttgc

SEQ ID NO: 49462 - DNA, 15 bp, Homo sapiens
ttctaaaagcctttg

SEQ ID NO: 49463 - DNA, 15 bp, Homo sapiens
tttctaaaagccttt

SEQ ID NO: 49464 - DNA, 15 bp, Homo sapiens
gtttctaaaagcctt

SEQ ID NO: 49465 - DNA, 15 bp, Homo sapiens
tgtttctaaaagcct

SEQ ID NO: 49466 - DNA, 15 bp, Homo sapiens
ttgtttctaaaagcc

SEQ ID NO: 49467 - DNA, 15 bp, Homo sapiens
tttgtttctaaaagc

SEQ ID NO: 49468 - DNA, 15 bp, Homo sapiens
ttttgtttctaaaag

SEQ ID NO: 49469 - DNA, 15 bp, Homo sapiens
attttgtttctaaaa

SEQ ID NO: 49470 - DNA, 15 bp, Homo sapiens
cattttgtttctaaa

SEQ ID NO: 49471 - DNA, 15 bp, Homo sapiens
ccattttgtttctaa

SEQ ID NO: 49472 - DNA, 15 bp, Homo sapiens
accattttgtttcta

SEQ ID NO: 49473 - DNA, 15 bp, Homo sapiens
aaccattttgtttct

SEQ ID NO: 49474 - DNA, 15 bp, Homo sapiens
aaaccattttgtttc

SEQ ID NO: 49475 - DNA, 15 bp, Homo sapiens
aaaaccattttgttt

SEQ ID NO: 49476 - DNA, 15 bp, Homo sapiens
gaaaaccattttgtt

SEQ ID NO: 49477 - DNA, 15 bp, Homo sapiens
tgaaaaccattttgt

SEQ ID NO: 49478 - DNA, 15 bp, Homo sapiens
ttgaaaaccattttg

SEQ ID NO: 49479 - DNA, 15 bp, Homo sapiens
tttgaaaaccatttt

SEQ ID NO: 49480 - DNA, 15 bp, Homo sapiens
ttttgaaaaccattt

SEQ ID NO: 49481 - DNA, 15 bp, Homo sapiens
tttttgaaaaccatt

SEQ ID NO: 49482 - DNA, 15 bp, Homo sapiens
atttttgaaaaccat

SEQ ID NO: 49483 - DNA, 15 bp, Homo sapiens
gatttttgaaaacca

SEQ ID NO: 49484 - DNA, 15 bp, Homo sapiens
ggatttttgaaaacc

SEQ ID NO: 49485 - DNA, 15 bp, Homo sapiens
tggatttttgaaaac

SEQ ID NO: 49486 - DNA, 15 bp, Homo sapiens
ttggatttttgaaaa

SEQ ID NO: 49487 - DNA, 15 bp, Homo sapiens
cttggatttttgaaa

SEQ ID NO: 49488 - DNA, 15 bp, Homo sapiens
gcttggatttttgaa

SEQ ID NO: 49489 - DNA, 15 bp, Homo sapiens
ggcttggatttttga

SEQ ID NO: 49490 - DNA, 15 bp, Homo sapiens
aggcttggatttttg

SEQ ID NO: 49491 - DNA, 15 bp, Homo sapiens
taggcttggattttt

SEQ ID NO: 49492 - DNA, 15 bp, Homo sapiens
ttaggcttggatttt

SEQ ID NO: 49493 - DNA, 15 bp, Homo sapiens
cttaggcttggattt

SEQ ID NO: 49494 - DNA, 15 bp, Homo sapiens
ccttaggcttggatt

SEQ ID NO: 49495 - DNA, 15 bp, Homo sapiens
tccttaggcttggat

SEQ ID NO: 49496 - DNA, 15 bp, Homo sapiens
ttccttaggcttgga

SEQ ID NO: 49497 - DNA, 15 bp, Homo sapiens
tttccttaggcttgg

SEQ ID NO: 49498 - DNA, 15 bp, Homo sapiens
ttttccttaggcttg

SEQ ID NO: 49499 - DNA, 15 bp, Homo sapiens
gttttccttaggctt

SEQ ID NO: 49500 - DNA, 15 bp, Homo sapiens
tgttttccttaggct

SEQ ID NO: 49501 - DNA, 15 bp, Homo sapiens
ctgttttccttaggc

SEQ ID NO: 49502 - DNA, 15 bp, Homo sapiens
cctgttttccttagg

SEQ ID NO: 49503 - DNA, 15 bp, Homo sapiens
ccctgttttccttag

SEQ ID NO: 49504 - DNA, 15 bp, Homo sapiens
accctgttttcctta

SEQ ID NO: 49505 - DNA, 15 bp, Homo sapiens
aaccctgttttcctt

SEQ ID NO: 49506 - DNA, 15 bp, Homo sapiens
aaaccctgttttcct

SEQ ID NO: 49507 - DNA, 15 bp, Homo sapiens
caaaccctgttttcc

SEQ ID NO: 49508 - DNA, 15 bp, Homo sapiens
tcaaaccctgttttc

SEQ ID NO: 49509 - DNA, 15 bp, Homo sapiens
ttcaaaccctgtttt

SEQ ID NO: 49510 - DNA, 15 bp, Homo sapiens
attcaaaccctgttt

SEQ ID NO: 49511 - DNA, 15 bp, Homo sapiens
aattcaaaccctgtt

SEQ ID NO: 49512 - DNA, 15 bp, Homo sapiens
aaattcaaaccctgt

SEQ ID NO: 49513 - DNA, 15 bp, Homo sapiens
caaattcaaaccctg

SEQ ID NO: 49514 - DNA, 15 bp, Homo sapiens
ccaaattcaaaccct

SEQ ID NO: 49515 - DNA, 15 bp, Homo sapiens
cccaaattcaaaccc

SEQ ID NO: 49516 - DNA, 15 bp, Homo sapiens
tcccaaattcaaacc

SEQ ID NO: 49517 - DNA, 15 bp, Homo sapiens
ctcccaaattcaaac

SEQ ID NO: 49518 - DNA, 15 bp, Homo sapiens
gctcccaaattcaaa

SEQ ID NO: 49519 - DNA, 15 bp, Homo sapiens
agctcccaaattcaa

SEQ ID NO: 49520 - DNA, 15 bp, Homo sapiens
aagctcccaaattca

SEQ ID NO: 49521 - DNA, 15 bp, Homo sapiens
caagctcccaaattc

SEQ ID NO: 49522 - DNA, 15 bp, Homo sapiens
tcaagctcccaaatt

SEQ ID NO: 49523 - DNA, 15 bp, Homo sapiens
ttcaagctcccaaat

SEQ ID NO: 49524 - DNA, 15 bp, Homo sapiens
tttcaagctcccaaa

SEQ ID NO: 49525 - DNA, 15 bp, Homo sapiens
ctttcaagctcccaa

SEQ ID NO: 49526 - DNA, 15 bp, Homo sapiens
tctttcaagctccca

SEQ ID NO: 49527 - DNA, 15 bp, Homo sapiens
ttctttcaagctccc

SEQ ID NO: 49528 - DNA, 15 bp, Homo sapiens
attctttcaagctcc

SEQ ID NO: 49529 - DNA, 15 bp, Homo sapiens
tattctttcaagctc

SEQ ID NO: 49530 - DNA, 15 bp, Homo sapiens
gtattctttcaagct

SEQ ID NO: 49531 - DNA, 15 bp, Homo sapiens
tgtattctttcaagc

SEQ ID NO: 49532 - DNA, 15 bp, Homo sapiens
atgtattctttcaag

SEQ ID NO: 49533 - DNA, 15 bp, Homo sapiens
aatgtattctttcaa

SEQ ID NO: 49534 - DNA, 15 bp, Homo sapiens
aaatgtattctttca

SEQ ID NO: 49535 - DNA, 15 bp, Homo sapiens
taaatgtattctttc

SEQ ID NO: 49536 - DNA, 15 bp, Homo sapiens
ctaaatgtattcttt

SEQ ID NO: 49537 - DNA, 15 bp, Homo sapiens
tctaaatgtattctt

SEQ ID NO: 49538 - DNA, 15 bp, Homo sapiens
ctctaaatgtattct

SEQ ID NO: 49539 - DNA, 15 bp, Homo sapiens
tctctaaatgtattc

SEQ ID NO: 49540 - DNA, 15 bp, Homo sapiens
ttctctaaatgtatt

SEQ ID NO: 49541 - DNA, 15 bp, Homo sapiens
cttctctaaatgtat

SEQ ID NO: 49542 - DNA, 15 bp, Homo sapiens
ccttctctaaatgta

SEQ ID NO: 49543 - DNA, 15 bp, Homo sapiens
accttctctaaatgt

SEQ ID NO: 49544 - DNA, 15 bp, Homo sapiens
caccttctctaaatg

SEQ ID NO: 49545 - DNA, 15 bp, Homo sapiens
acaccttctctaaat

SEQ ID NO: 49546 - DNA, 15 bp, Homo sapiens
tacaccttctctaaa

SEQ ID NO: 49547 - DNA, 15 bp, Homo sapiens
atacaccttctctaa

SEQ ID NO: 49548 - DNA, 15 bp, Homo sapiens
tatacaccttctcta

SEQ ID NO: 49549 - DNA, 15 bp, Homo sapiens
atatacaccttctct

SEQ ID NO: 49550 - DNA, 15 bp, Homo sapiens
catatacaccttctc

SEQ ID NO: 49551 - DNA, 15 bp, Homo sapiens
gcatatacaccttct

SEQ ID NO: 49552 - DNA, 15 bp, Homo sapiens
tgcatatacaccttc

SEQ ID NO: 49553 - DNA, 15 bp, Homo sapiens
ctgcatatacacctt

SEQ ID NO: 49554 - DNA, 15 bp, Homo sapiens
actgcatatacacct

SEQ ID NO: 49555 - DNA, 15 bp, Homo sapiens
cactgcatatacacc

SEQ ID NO: 49556 - DNA, 15 bp, Homo sapiens
acactgcatatacac

SEQ ID NO: 49557 - DNA, 15 bp, Homo sapiens
tacactgcatataca

SEQ ID NO: 49558 - DNA, 15 bp, Homo sapiens
ttacactgcatatac

SEQ ID NO: 49559 - DNA, 15 bp, Homo sapiens
tttacactgcatata

SEQ ID NO: 49560 - DNA, 15 bp, Homo sapiens
atttacactgcatat

SEQ ID NO: 49561 - DNA, 15 bp, Homo sapiens
aatttacactgcata

SEQ ID NO: 49562 - DNA, 15 bp, Homo sapiens
taatttacactgcat

SEQ ID NO: 49563 - DNA, 15 bp, Homo sapiens
ataatttacactgca

SEQ ID NO: 49564 - DNA, 15 bp, Homo sapiens
tataatttacactgc

SEQ ID NO: 49565 - DNA, 15 bp, Homo sapiens
atataatttacactg

SEQ ID NO: 49566 - DNA, 15 bp, Homo sapiens
aatataatttacact

SEQ ID NO: 49567 - DNA, 15 bp, Homo sapiens
gaatataatttacac

SEQ ID NO: 49568 - DNA, 15 bp, Homo sapiens
tgaatataatttaca

SEQ ID NO: 49569 - DNA, 15 bp, Homo sapiens
atgaatataatttac

SEQ ID NO: 49570 - DNA, 15 bp, Homo sapiens
aatgaatataattta

SEQ ID NO: 49571 - DNA, 15 bp, Homo sapiens
gaatgaatataattt

SEQ ID NO: 49572 - DNA, 15 bp, Homo sapiens
tgaatgaatataatt

SEQ ID NO: 49573 - DNA, 15 bp, Homo sapiens
gtgaatgaatataat

SEQ ID NO: 49574 - DNA, 15 bp, Homo sapiens
agtgaatgaatataa

SEQ ID NO: 49575 - DNA, 15 bp, Homo sapiens
aagtgaatgaatata

SEQ ID NO: 49576 - DNA, 15 bp, Homo sapiens
taagtgaatgaatat

SEQ ID NO: 49577 - DNA, 15 bp, Homo sapiens
ttaagtgaatgaata

SEQ ID NO: 49578 - DNA, 15 bp, Homo sapiens
attaagtgaatgaat

SEQ ID NO: 49579 - DNA, 15 bp, Homo sapiens
tattaagtgaatgaa

SEQ ID NO: 49580 - DNA, 15 bp, Homo sapiens
atattaagtgaatga

SEQ ID NO: 49581 - DNA, 15 bp, Homo sapiens
aatattaagtgaatg

SEQ ID NO: 49582 - DNA, 15 bp, Homo sapiens
taatattaagtgaat

SEQ ID NO: 49583 - DNA, 15 bp, Homo sapiens
ataatattaagtgaa

SEQ ID NO: 49584 - DNA, 15 bp, Homo sapiens
tataatattaagtga

SEQ ID NO: 49585 - DNA, 15 bp, Homo sapiens
gtataatattaagtg

SEQ ID NO: 49586 - DNA, 15 bp, Homo sapiens
tgtataatattaagt

SEQ ID NO: 49587 - DNA, 15 bp, Homo sapiens
atgtataatattaag

SEQ ID NO: 49588 - DNA, 15 bp, Homo sapiens
tatgtataatattaa

SEQ ID NO: 49589 - DNA, 15 bp, Homo sapiens
atatgtataatatta

SEQ ID NO: 49590 - DNA, 15 bp, Homo sapiens
tatatgtataatatt

SEQ ID NO: 49591 - DNA, 15 bp, Homo sapiens
atatatgtataatat

SEQ ID NO: 49592 - DNA, 15 bp, Homo sapiens
tatatatgtataata

SEQ ID NO: 49593 - DNA, 15 bp, Homo sapiens
atatatatgtataat

SEQ ID NO: 49594 - DNA, 15 bp, Homo sapiens
aatatatatgtataa

SEQ ID NO: 49595 - DNA, 15 bp, Homo sapiens
aaatatatatgtata

SEQ ID NO: 49596 - DNA, 15 bp, Homo sapiens
taaatatatatgtat

SEQ ID NO: 49597 - DNA, 15 bp, Homo sapiens
ataaatatatatgta

SEQ ID NO: 49598 - DNA, 15 bp, Homo sapiens
tataaatatatatgt

SEQ ID NO: 49599 - DNA, 15 bp, Homo sapiens
ttataaatatatatg

SEQ ID NO: 49600 - DNA, 15 bp, Homo sapiens
attataaatatatat

SEQ ID NO: 49601 - DNA, 15 bp, Homo sapiens
gattataaatatata

SEQ ID NO: 49602 - DNA, 15 bp, Homo sapiens
tgattataaatatat

SEQ ID NO: 49603 - DNA, 15 bp, Homo sapiens
ttgattataaatata

SEQ ID NO: 49604 - DNA, 15 bp, Homo sapiens
cttgattataaatat

SEQ ID NO: 49605 - DNA, 15 bp, Homo sapiens
acttgattataaata

SEQ ID NO: 49606 - DNA, 15 bp, Homo sapiens
aacttgattataaat

SEQ ID NO: 49607 - DNA, 15 bp, Homo sapiens
taacttgattataaa

SEQ ID NO: 49608 - DNA, 15 bp, Homo sapiens
ataacttgattataa

SEQ ID NO: 49609 - DNA, 15 bp, Homo sapiens
tataacttgattata

SEQ ID NO: 49610 - DNA, 15 bp, Homo sapiens
ctataacttgattat

SEQ ID NO: 49611 - DNA, 15 bp, Homo sapiens
actataacttgatta

SEQ ID NO: 49612 - DNA, 15 bp, Homo sapiens
tactataacttgatt

SEQ ID NO: 49613 - DNA, 15 bp, Homo sapiens
atactataacttgat

SEQ ID NO: 49614 - DNA, 15 bp, Homo sapiens
catactataacttga

SEQ ID NO: 49615 - DNA, 15 bp, Homo sapiens
acatactataacttg

SEQ ID NO: 49616 - DNA, 15 bp, Homo sapiens
aacatactataactt

SEQ ID NO: 49617 - DNA, 15 bp, Homo sapiens
aaacatactataact

SEQ ID NO: 49618 - DNA, 15 bp, Homo sapiens
caaacatactataac

SEQ ID NO: 49619 - DNA, 15 bp, Homo sapiens
acaaacatactataa

SEQ ID NO: 49620 - DNA, 15 bp, Homo sapiens
aacaaacatactata

SEQ ID NO: 49621 - DNA, 15 bp, Homo sapiens
caacaaacatactat

SEQ ID NO: 49622 - DNA, 15 bp, Homo sapiens
gcaacaaacatacta

SEQ ID NO: 49623 - DNA, 15 bp, Homo sapiens
tgcaacaaacatact

SEQ ID NO: 49624 - DNA, 15 bp, Homo sapiens
atgcaacaaacatac

SEQ ID NO: 49625 - DNA, 15 bp, Homo sapiens
aatgcaacaaacata

SEQ ID NO: 49626 - DNA, 15 bp, Homo sapiens
gaatgcaacaaacat

SEQ ID NO: 49627 - DNA, 15 bp, Homo sapiens
agaatgcaacaaaca

SEQ ID NO: 49628 - DNA, 15 bp, Homo sapiens
aagaatgcaacaaac

SEQ ID NO: 49629 - DNA, 15 bp, Homo sapiens
taagaatgcaacaaa

SEQ ID NO: 49630 - DNA, 15 bp, Homo sapiens
gtaagaatgcaacaa

SEQ ID NO: 49631 - DNA, 15 bp, Homo sapiens
tgtaagaatgcaaca

SEQ ID NO: 49632 - DNA, 15 bp, Homo sapiens
gtgtaagaatgcaac

SEQ ID NO: 49633 - DNA, 15 bp, Homo sapiens
tgtgtaagaatgcaa

SEQ ID NO: 49634 - DNA, 15 bp, Homo sapiens
atgtgtaagaatgca

SEQ ID NO: 49635 - DNA, 15 bp, Homo sapiens
aatgtgtaagaatgc

SEQ ID NO: 49636 - DNA, 15 bp, Homo sapiens
aaatgtgtaagaatg

SEQ ID NO: 49637 - DNA, 15 bp, Homo sapiens
aaaatgtgtaagaat

SEQ ID NO: 49638 - DNA, 15 bp, Homo sapiens
aaaaatgtgtaagaa

SEQ ID NO: 49639 - DNA, 15 bp, Homo sapiens
caaaaatgtgtaaga

SEQ ID NO: 49640 - DNA, 15 bp, Homo sapiens
acaaaaatgtgtaag

SEQ ID NO: 49641 - DNA, 15 bp, Homo sapiens
aacaaaaatgtgtaa

SEQ ID NO: 49642 - DNA, 15 bp, Homo sapiens
aaacaaaaatgtgta

SEQ ID NO: 49643 - DNA, 15 bp, Homo sapiens
aaaacaaaaatgtgt

SEQ ID NO: 49644 - DNA, 15 bp, Homo sapiens
caaaacaaaaatgtg

SEQ ID NO: 49645 - DNA, 15 bp, Homo sapiens
ccaaaacaaaaatgt

SEQ ID NO: 49646 - DNA, 15 bp, Homo sapiens
tccaaaacaaaaatg

SEQ ID NO: 49647 - DNA, 15 bp, Homo sapiens
ctccaaaacaaaaat

SEQ ID NO: 49648 - DNA, 15 bp, Homo sapiens
tctccaaaacaaaaa

SEQ ID NO: 49649 - DNA, 15 bp, Homo sapiens
ttctccaaaacaaaa

SEQ ID NO: 49650 - DNA, 15 bp, Homo sapiens
cttctccaaaacaaa

SEQ ID NO: 49651 - DNA, 15 bp, Homo sapiens
acttctccaaaacaa

SEQ ID NO: 49652 - DNA, 15 bp, Homo sapiens
aacttctccaaaaca

SEQ ID NO: 49653 - DNA, 15 bp, Homo sapiens
taacttctccaaaac

SEQ ID NO: 49654 - DNA, 15 bp, Homo sapiens
ttaacttctccaaaa

SEQ ID NO: 49655 - DNA, 15 bp, Homo sapiens
tttaacttctccaaa

SEQ ID NO: 49656 - DNA, 15 bp, Homo sapiens
ttttaacttctccaa

SEQ ID NO: 49657 - DNA, 15 bp, Homo sapiens
attttaacttctcca

SEQ ID NO: 49658 - DNA, 15 bp, Homo sapiens
tattttaacttctcc

SEQ ID NO: 49659 - DNA, 15 bp, Homo sapiens
ttattttaacttctc

SEQ ID NO: 49660 - DNA, 15 bp, Homo sapiens
gttattttaacttct

SEQ ID NO: 49661 - DNA, 15 bp, Homo sapiens
cgttattttaacttc

SEQ ID NO: 49662 - DNA, 15 bp, Homo sapiens
tcgttattttaactt

SEQ ID NO: 49663 - DNA, 15 bp, Homo sapiens
ttcgttattttaact

SEQ ID NO: 49664 - DNA, 15 bp, Homo sapiens
attcgttattttaac

SEQ ID NO: 49665 - DNA, 15 bp, Homo sapiens
aattcgttattttaa

SEQ ID NO: 49666 - DNA, 15 bp, Homo sapiens
caattcgttatttta

SEQ ID NO: 49667 - DNA, 15 bp, Homo sapiens
ccaattcgttatttt

SEQ ID NO: 49668 - DNA, 15 bp, Homo sapiens
gccaattcgttattt

SEQ ID NO: 49669 - DNA, 15 bp, Homo sapiens
agccaattcgttatt

SEQ ID NO: 49670 - DNA, 15 bp, Homo sapiens
aagccaattcgttat

SEQ ID NO: 49671 - DNA, 15 bp, Homo sapiens
caagccaattcgtta

SEQ ID NO: 49672 - DNA, 15 bp, Homo sapiens
tcaagccaattcgtt

SEQ ID NO: 49673 - DNA, 15 bp, Homo sapiens
atcaagccaattcgt

SEQ ID NO: 49674 - DNA, 15 bp, Homo sapiens
tatcaagccaattcg

SEQ ID NO: 49675 - DNA, 15 bp, Homo sapiens
ttatcaagccaattc

SEQ ID NO: 49676 - DNA, 15 bp, Homo sapiens
attatcaagccaatt

SEQ ID NO: 49677 - DNA, 15 bp, Homo sapiens
cattatcaagccaat

SEQ ID NO: 49678 - DNA, 15 bp, Homo sapiens
tcattatcaagccaa

SEQ ID NO: 49679 - DNA, 15 bp, Homo sapiens
ttcattatcaagcca

SEQ ID NO: 49680 - DNA, 15 bp, Homo sapiens
cttcattatcaagcc

SEQ ID NO: 49681 - DNA, 15 bp, Homo sapiens
tcttcattatcaagc

SEQ ID NO: 49682 - DNA, 15 bp, Homo sapiens
atcttcattatcaag

SEQ ID NO: 49683 - DNA, 15 bp, Homo sapiens
aatcttcattatcaa

SEQ ID NO: 49684 - DNA, 15 bp, Homo sapiens
caatcttcattatca

SEQ ID NO: 49685 - DNA, 15 bp, Homo sapiens
tcaatcttcattatc

SEQ ID NO: 49686 - DNA, 15 bp, Homo sapiens
ttcaatcttcattat

SEQ ID NO: 49687 - DNA, 15 bp, Homo sapiens
tttcaatcttcatta

SEQ ID NO: 49688 - DNA, 15 bp, Homo sapiens
atttcaatcttcatt

SEQ ID NO: 49689 - DNA, 15 bp, Homo sapiens
tatttcaatcttcat

SEQ ID NO: 49690 - DNA, 15 bp, Homo sapiens
ttatttcaatcttca

SEQ ID NO: 49691 - DNA, 15 bp, Homo sapiens
attatttcaatcttc

SEQ ID NO: 49692 - DNA, 15 bp, Homo sapiens
aattatttcaatctt

SEQ ID NO: 49693 - DNA, 15 bp, Homo sapiens
aaattatttcaatct

SEQ ID NO: 49694 - DNA, 15 bp, Homo sapiens
gaaattatttcaatc

SEQ ID NO: 49695 - DNA, 15 bp, Homo sapiens
tgaaattatttcaat

SEQ ID NO: 49696 - DNA, 15 bp, Homo sapiens
ctgaaattatttcaa

SEQ ID NO: 49697 - DNA, 15 bp, Homo sapiens
tctgaaattatttca

SEQ ID NO: 49698 - DNA, 15 bp, Homo sapiens
gtctgaaattatttc

SEQ ID NO: 49699 - DNA, 15 bp, Homo sapiens
agtctgaaattattt

SEQ ID NO: 49700 - DNA, 15 bp, Homo sapiens
cagtctgaaattatt

SEQ ID NO: 49701 - DNA, 15 bp, Homo sapiens
acagtctgaaattat

SEQ ID NO: 49702 - DNA, 15 bp, Homo sapiens
cacagtctgaaatta

SEQ ID NO: 49703 - DNA, 15 bp, Homo sapiens
ccacagtctgaaatt

SEQ ID NO: 49704 - DNA, 15 bp, Homo sapiens
tccacagtctgaaat

SEQ ID NO: 49705 - DNA, 15 bp, Homo sapiens
ttccacagtctgaaa

SEQ ID NO: 49706 - DNA, 15 bp, Homo sapiens
cttccacagtctgaa

SEQ ID NO: 49707 - DNA, 15 bp, Homo sapiens
acttccacagtctga

SEQ ID NO: 49708 - DNA, 15 bp, Homo sapiens
aacttccacagtctg

SEQ ID NO: 49709 - DNA, 15 bp, Homo sapiens
gaacttccacagtct

SEQ ID NO: 49710 - DNA, 15 bp, Homo sapiens
agaacttccacagtc

SEQ ID NO: 49711 - DNA, 15 bp, Homo sapiens
cagaacttccacagt

SEQ ID NO: 49712 - DNA, 15 bp, Homo sapiens
acagaacttccacag

SEQ ID NO: 49713 - DNA, 15 bp, Homo sapiens
tacagaacttccaca

SEQ ID NO: 49714 - DNA, 15 bp, Homo sapiens
atacagaacttccac

SEQ ID NO: 49715 - DNA, 15 bp, Homo sapiens
tatacagaacttcca

SEQ ID NO: 49716 - DNA, 15 bp, Homo sapiens
ttatacagaacttcc

SEQ ID NO: 49717 - DNA, 15 bp, Homo sapiens
tttatacagaacttc

SEQ ID NO: 49718 - DNA, 15 bp, Homo sapiens
atttatacagaactt

SEQ ID NO: 49719 - DNA, 15 bp, Homo sapiens
aatttatacagaact

SEQ ID NO: 49720 - DNA, 15 bp, Homo sapiens
aaatttatacagaac

SEQ ID NO: 49721 - DNA, 15 bp, Homo sapiens
gaaatttatacagaa

SEQ ID NO: 49722 - DNA, 15 bp, Homo sapiens
agaaatttatacaga

SEQ ID NO: 49723 - DNA, 15 bp, Homo sapiens
tagaaatttatacag

SEQ ID NO: 49724 - DNA, 15 bp, Homo sapiens
ctagaaatttataca

SEQ ID NO: 49725 - DNA, 15 bp, Homo sapiens
cctagaaatttatac

SEQ ID NO: 49726 - DNA, 15 bp, Homo sapiens
gcctagaaatttata

SEQ ID NO: 49727 - DNA, 15 bp, Homo sapiens
tgcctagaaatttat

SEQ ID NO: 49728 - DNA, 15 bp, Homo sapiens
ctgcctagaaattta

SEQ ID NO: 49729 - DNA, 15 bp, Homo sapiens
tctgcctagaaattt

SEQ ID NO: 49730 - DNA, 15 bp, Homo sapiens
gtctgcctagaaatt

SEQ ID NO: 49731 - DNA, 15 bp, Homo sapiens
tgtctgcctagaaat

SEQ ID NO: 49732 - DNA, 15 bp, Homo sapiens
ttgtctgcctagaaa

SEQ ID NO: 49733 - DNA, 15 bp, Homo sapiens
tttgtctgcctagaa

SEQ ID NO: 49734 - DNA, 15 bp, Homo sapiens
ttttgtctgcctaga

SEQ ID NO: 49735 - DNA, 15 bp, Homo sapiens
attttgtctgcctag

SEQ ID NO: 49736 - DNA, 15 bp, Homo sapiens
cattttgtctgccta

SEQ ID NO: 49737 - DNA, 15 bp, Homo sapiens
ccattttgtctgcct

SEQ ID NO: 49738 - DNA, 15 bp, Homo sapiens
gccattttgtctgcc

SEQ ID NO: 49739 - DNA, 15 bp, Homo sapiens
agccattttgtctgc

SEQ ID NO: 49740 - DNA, 15 bp, Homo sapiens
cagccattttgtctg

SEQ ID NO: 49741 - DNA, 15 bp, Homo sapiens
tcagccattttgtct

SEQ ID NO: 49742 - DNA, 15 bp, Homo sapiens
atcagccattttgtc

SEQ ID NO: 49743 - DNA, 15 bp, Homo sapiens
gatcagccattttgt

SEQ ID NO: 49744 - DNA, 15 bp, Homo sapiens
tgatcagccattttg

SEQ ID NO: 49745 - DNA, 15 bp, Homo sapiens
ctgatcagccatttt

SEQ ID NO: 49746 - DNA, 15 bp, Homo sapiens
tctgatcagccattt

SEQ ID NO: 49747 - DNA, 15 bp, Homo sapiens
ttctgatcagccatt

SEQ ID NO: 49748 - DNA, 15 bp, Homo sapiens
attctgatcagccat

SEQ ID NO: 49749 - DNA, 15 bp, Homo sapiens
tattctgatcagcca

SEQ ID NO: 49750 - DNA, 15 bp, Homo sapiens
ctattctgatcagcc

SEQ ID NO: 49751 - DNA, 15 bp, Homo sapiens
gctattctgatcagc

SEQ ID NO: 49752 - DNA, 15 bp, Homo sapiens
tgctattctgatcag

SEQ ID NO: 49753 - DNA, 15 bp, Homo sapiens
atgctattctgatca

SEQ ID NO: 49754 - DNA, 15 bp, Homo sapiens
catgctattctgatc

SEQ ID NO: 49755 - DNA, 15 bp, Homo sapiens
tcatgctattctgat

SEQ ID NO: 49756 - DNA, 15 bp, Homo sapiens
gtcatgctattctga

SEQ ID NO: 49757 - DNA, 15 bp, Homo sapiens
cgtcatgctattctg

SEQ ID NO: 49758 - DNA, 15 bp, Homo sapiens
ccgtcatgctattct

SEQ ID NO: 49759 - DNA, 15 bp, Homo sapiens
tccgtcatgctattc

SEQ ID NO: 49760 - DNA, 15 bp, Homo sapiens
ctccgtcatgctatt

SEQ ID NO: 49761 - DNA, 15 bp, Homo sapiens
actccgtcatgctat

SEQ ID NO: 49762 - DNA, 15 bp, Homo sapiens
aactccgtcatgcta

SEQ ID NO: 49763 - DNA, 15 bp, Homo sapiens
aaactccgtcatgct

SEQ ID NO: 49764 - DNA, 15 bp, Homo sapiens
aaaactccgtcatgc

SEQ ID NO: 49765 - DNA, 15 bp, Homo sapiens
taaaactccgtcatg

SEQ ID NO: 49766 - DNA, 15 bp, Homo sapiens
ctaaaactccgtcat

SEQ ID NO: 49767 - DNA, 15 bp, Homo sapiens
actaaaactccgtca

SEQ ID NO: 49768 - DNA, 15 bp, Homo sapiens
aactaaaactccgtc

SEQ ID NO: 49769 - DNA, 15 bp, Homo sapiens
caactaaaactccgt

SEQ ID NO: 49770 - DNA, 15 bp, Homo sapiens
acaactaaaactccg

SEQ ID NO: 49771 - DNA, 15 bp, Homo sapiens
gacaactaaaactcc

SEQ ID NO: 49772 - DNA, 15 bp, Homo sapiens
ggacaactaaaactc

SEQ ID NO: 49773 - DNA, 15 bp, Homo sapiens
aggacaactaaaact

SEQ ID NO: 49774 - DNA, 15 bp, Homo sapiens
caggacaactaaaac

SEQ ID NO: 49775 - DNA, 15 bp, Homo sapiens
acaggacaactaaaa

SEQ ID NO: 49776 - DNA, 15 bp, Homo sapiens
aacaggacaactaaa

SEQ ID NO: 49777 - DNA, 15 bp, Homo sapiens
taacaggacaactaa

SEQ ID NO: 49778 - DNA, 15 bp, Homo sapiens
gtaacaggacaacta

SEQ ID NO: 49779 - DNA, 15 bp, Homo sapiens
agtaacaggacaact

SEQ ID NO: 49780 - DNA, 15 bp, Homo sapiens
gagtaacaggacaac

SEQ ID NO: 49781 - DNA, 15 bp, Homo sapiens
cgagtaacaggacaa

SEQ ID NO: 49782 - DNA, 15 bp, Homo sapiens
acgagtaacaggaca

SEQ ID NO: 49783 - DNA, 15 bp, Homo sapiens
gacgagtaacaggac

SEQ ID NO: 49784 - DNA, 15 bp, Homo sapiens
agacgagtaacagga

SEQ ID NO: 49785 - DNA, 15 bp, Homo sapiens
cagacgagtaacagg

SEQ ID NO: 49786 - DNA, 15 bp, Homo sapiens
gcagacgagtaacag

SEQ ID NO: 49787 - DNA, 15 bp, Homo sapiens
agcagacgagtaaca

SEQ ID NO: 49788 - DNA, 15 bp, Homo sapiens
tagcagacgagtaac

SEQ ID NO: 49789 - DNA, 15 bp, Homo sapiens
atagcagacgagtaa

SEQ ID NO: 49790 - DNA, 15 bp, Homo sapiens
aatagcagacgagta

SEQ ID NO: 49791 - DNA, 15 bp, Homo sapiens
aaatagcagacgagt

SEQ ID NO: 49792 - DNA, 15 bp, Homo sapiens
aaaatagcagacgag

SEQ ID NO: 49793 - DNA, 15 bp, Homo sapiens
aaaaatagcagacga

SEQ ID NO: 49794 - DNA, 15 bp, Homo sapiens
taaaaatagcagacg

SEQ ID NO: 49795 - DNA, 15 bp, Homo sapiens
gtaaaaatagcagac

SEQ ID NO: 49796 - DNA, 15 bp, Homo sapiens
cgtaaaaatagcaga

SEQ ID NO: 49797 - DNA, 15 bp, Homo sapiens
acgtaaaaatagcag

SEQ ID NO: 49798 - DNA, 15 bp, Homo sapiens
cacgtaaaaatagca

SEQ ID NO: 49799 - DNA, 15 bp, Homo sapiens
gcacgtaaaaatagc

SEQ ID NO: 49800 - DNA, 15 bp, Homo sapiens
ggcacgtaaaaatag

SEQ ID NO: 49801 - DNA, 15 bp, Homo sapiens
gggcacgtaaaaata

SEQ ID NO: 49802 - DNA, 15 bp, Homo sapiens
cgggcacgtaaaaat

SEQ ID NO: 49803 - DNA, 15 bp, Homo sapiens
tcgggcacgtaaaaa

SEQ ID NO: 49804 - DNA, 15 bp, Homo sapiens
ctcgggcacgtaaaa

SEQ ID NO: 49805 - DNA, 15 bp, Homo sapiens
tctcgggcacgtaaa

SEQ ID NO: 49806 - DNA, 15 bp, Homo sapiens
atctcgggcacgtaa

SEQ ID NO: 49807 - DNA, 15 bp, Homo sapiens
gatctcgggcacgta

SEQ ID NO: 49808 - DNA, 15 bp, Homo sapiens
agatctcgggcacgt

SEQ ID NO: 49809 - DNA, 15 bp, Homo sapiens
cagatctcgggcacg

SEQ ID NO: 49810 - DNA, 15 bp, Homo sapiens
ccagatctcgggcac

SEQ ID NO: 49811 - DNA, 15 bp, Homo sapiens
cccagatctcgggca

SEQ ID NO: 49812 - DNA, 15 bp, Homo sapiens
gcccagatctcgggc

SEQ ID NO: 49813 - DNA, 15 bp, Homo sapiens
ggcccagatctcggg

SEQ ID NO: 49814 - DNA, 15 bp, Homo sapiens
tggcccagatctcgg

SEQ ID NO: 49815 - DNA, 15 bp, Homo sapiens
ttggcccagatctcg

SEQ ID NO: 49816 - DNA, 15 bp, Homo sapiens
cttggcccagatctc

SEQ ID NO: 49817 - DNA, 15 bp, Homo sapiens
tcttggcccagatct

SEQ ID NO: 49818 - DNA, 15 bp, Homo sapiens
atcttggcccagatc

SEQ ID NO: 49819 - DNA, 15 bp, Homo sapiens
aatcttggcccagat

SEQ ID NO: 49820 - DNA, 15 bp, Homo sapiens
caatcttggcccaga

SEQ ID NO: 49821 - DNA, 15 bp, Homo sapiens
acaatcttggcccag

SEQ ID NO: 49822 - DNA, 15 bp, Homo sapiens
aacaatcttggccca

SEQ ID NO: 49823 - DNA, 15 bp, Homo sapiens
aaacaatcttggccc

SEQ ID NO: 49824 - DNA, 15 bp, Homo sapiens
taaacaatcttggcc

SEQ ID NO: 49825 - DNA, 15 bp, Homo sapiens
gtaaacaatcttggc

SEQ ID NO: 49826 - DNA, 15 bp, Homo sapiens
ggtaaacaatcttgg

SEQ ID NO: 49827 - DNA, 15 bp, Homo sapiens
aggtaaacaatcttg

SEQ ID NO: 49828 - DNA, 15 bp, Homo sapiens
aaggtaaacaatctt

SEQ ID NO: 49829 - DNA, 15 bp, Homo sapiens
taaggtaaacaatct

SEQ ID NO: 49830 - DNA, 15 bp, Homo sapiens
ttaaggtaaacaatc

SEQ ID NO: 49831 - DNA, 15 bp, Homo sapiens
attaaggtaaacaat

SEQ ID NO: 49832 - DNA, 15 bp, Homo sapiens
aattaaggtaaacaa

SEQ ID NO: 49833 - DNA, 15 bp, Homo sapiens
caattaaggtaaaca

SEQ ID NO: 49834 - DNA, 15 bp, Homo sapiens
acaattaaggtaaac

SEQ ID NO: 49835 - DNA, 15 bp, Homo sapiens
aacaattaaggtaaa

SEQ ID NO: 49836 - DNA, 15 bp, Homo sapiens
caacaattaaggtaa

SEQ ID NO: 49837 - DNA, 15 bp, Homo sapiens
acaacaattaaggta

SEQ ID NO: 49838 - DNA, 15 bp, Homo sapiens
cacaacaattaaggt

SEQ ID NO: 49839 - DNA, 15 bp, Homo sapiens
tcacaacaattaagg

SEQ ID NO: 49840 - DNA, 15 bp, Homo sapiens
atcacaacaattaag

SEQ ID NO: 49841 - DNA, 15 bp, Homo sapiens
catcacaacaattaa

SEQ ID NO: 49842 - DNA, 15 bp, Homo sapiens
acatcacaacaatta

SEQ ID NO: 49843 - DNA, 15 bp, Homo sapiens
cacatcacaacaatt

SEQ ID NO: 49844 - DNA, 15 bp, Homo sapiens
ccacatcacaacaat

SEQ ID NO: 49845 - DNA, 15 bp, Homo sapiens
tccacatcacaacaa

SEQ ID NO: 49846 - DNA, 15 bp, Homo sapiens
ctccacatcacaaca

SEQ ID NO: 49847 - DNA, 15 bp, Homo sapiens
cctccacatcacaac

SEQ ID NO: 49848 - DNA, 15 bp, Homo sapiens
acctccacatcacaa

SEQ ID NO: 49849 - DNA, 15 bp, Homo sapiens
aacctccacatcaca

SEQ ID NO: 49850 - DNA, 15 bp, Homo sapiens
taacctccacatcac

SEQ ID NO: 49851 - DNA, 15 bp, Homo sapiens
ctaacctccacatca

SEQ ID NO: 49852 - DNA, 15 bp, Homo sapiens
actaacctccacatc

SEQ ID NO: 49853 - DNA, 15 bp, Homo sapiens
tactaacctccacat

SEQ ID NO: 49854 - DNA, 15 bp, Homo sapiens
ttactaacctccaca

SEQ ID NO: 49855 - DNA, 15 bp, Homo sapiens
cttactaacctccac

SEQ ID NO: 49856 - DNA, 15 bp, Homo sapiens
acttactaacctcca

SEQ ID NO: 49857 - DNA, 15 bp, Homo sapiens
cacttactaacctcc

SEQ ID NO: 49858 - DNA, 15 bp, Homo sapiens
acacttactaacctc

SEQ ID NO: 49859 - DNA, 15 bp, Homo sapiens
cacacttactaacct

SEQ ID NO: 49860 - DNA, 15 bp, Homo sapiens
acacacttactaacc

SEQ ID NO: 49861 - DNA, 15 bp, Homo sapiens
cacacacttactaac

SEQ ID NO: 49862 - DNA, 15 bp, Homo sapiens
tcacacacttactaa

SEQ ID NO: 49863 - DNA, 15 bp, Homo sapiens
ttcacacacttacta

SEQ ID NO: 49864 - DNA, 15 bp, Homo sapiens
tttcacacacttact

SEQ ID NO: 49865 - DNA, 15 bp, Homo sapiens
atttcacacacttac

SEQ ID NO: 49866 - DNA, 15 bp, Homo sapiens
aatttcacacactta

SEQ ID NO: 49867 - DNA, 15 bp, Homo sapiens
aaatttcacacactt

SEQ ID NO: 49868 - DNA, 15 bp, Homo sapiens
caaatttcacacact

SEQ ID NO: 49869 - DNA, 15 bp, Homo sapiens
acaaatttcacacac

SEQ ID NO: 49870 - DNA, 15 bp, Homo sapiens
aacaaatttcacaca

SEQ ID NO: 49871 - DNA, 15 bp, Homo sapiens
taacaaatttcacac

SEQ ID NO: 49872 - DNA, 15 bp, Homo sapiens
gtaacaaatttcaca

SEQ ID NO: 49873 - DNA, 15 bp, Homo sapiens
tgtaacaaatttcac

SEQ ID NO: 49874 - DNA, 15 bp, Homo sapiens
atgtaacaaatttca

SEQ ID NO: 49875 - DNA, 15 bp, Homo sapiens
aatgtaacaaatttc

SEQ ID NO: 49876 - DNA, 15 bp, Homo sapiens
aaatgtaacaaattt

SEQ ID NO: 49877 - DNA, 15 bp, Homo sapiens
gaaatgtaacaaatt

SEQ ID NO: 49878 - DNA, 15 bp, Homo sapiens
tgaaatgtaacaaat

SEQ ID NO: 49879 - DNA, 15 bp, Homo sapiens
ttgaaatgtaacaaa

SEQ ID NO: 49880 - DNA, 15 bp, Homo sapiens
attgaaatgtaacaa

SEQ ID NO: 49881 - DNA, 15 bp, Homo sapiens
gattgaaatgtaaca

SEQ ID NO: 49882 - DNA, 15 bp, Homo sapiens
agattgaaatgtaac

SEQ ID NO: 49883 - DNA, 15 bp, Homo sapiens
gagattgaaatgtaa

SEQ ID NO: 49884 - DNA, 15 bp, Homo sapiens
tgagattgaaatgta

SEQ ID NO: 49885 - DNA, 15 bp, Homo sapiens
atgagattgaaatgt

SEQ ID NO: 49886 - DNA, 15 bp, Homo sapiens
tatgagattgaaatg

SEQ ID NO: 49887 - DNA, 15 bp, Homo sapiens
ttatgagattgaaat

SEQ ID NO: 49888 - DNA, 15 bp, Homo sapiens
attatgagattgaaa

SEQ ID NO: 49889 - DNA, 15 bp, Homo sapiens
aattatgagattgaa

SEQ ID NO: 49890 - DNA, 15 bp, Homo sapiens
caattatgagattga

SEQ ID NO: 49891 - DNA, 15 bp, Homo sapiens
tcaattatgagattg

SEQ ID NO: 49892 - DNA, 15 bp, Homo sapiens
ttcaattatgagatt

SEQ ID NO: 49893 - DNA, 15 bp, Homo sapiens
tttcaattatgagat

SEQ ID NO: 49894 - DNA, 15 bp, Homo sapiens
ttttcaattatgaga

SEQ ID NO: 49895 - DNA, 15 bp, Homo sapiens
cttttcaattatgag

SEQ ID NO: 49896 - DNA, 15 bp, Homo sapiens
gcttttcaattatga

SEQ ID NO: 49897 - DNA, 15 bp, Homo sapiens
ggcttttcaattatg

SEQ ID NO: 49898 - DNA, 15 bp, Homo sapiens
tggcttttcaattat

SEQ ID NO: 49899 - DNA, 15 bp, Homo sapiens
gtggcttttcaatta

SEQ ID NO: 49900 - DNA, 15 bp, Homo sapiens
tgtggcttttcaatt

SEQ ID NO: 49901 - DNA, 15 bp, Homo sapiens
ctgtggcttttcaat

SEQ ID NO: 49902 - DNA, 15 bp, Homo sapiens
cctgtggcttttcaa

SEQ ID NO: 49903 - DNA, 15 bp, Homo sapiens
gcctgtggcttttca

SEQ ID NO: 49904 - DNA, 15 bp, Homo sapiens
tgcctgtggcttttc

SEQ ID NO: 49905 - DNA, 15 bp, Homo sapiens
ttgcctgtggctttt

SEQ ID NO: 49906 - DNA, 15 bp, Homo sapiens
tttgcctgtggcttt

SEQ ID NO: 49907 - DNA, 15 bp, Homo sapiens
atttgcctgtggctt

SEQ ID NO: 49908 - DNA, 15 bp, Homo sapiens
aatttgcctgtggct

SEQ ID NO: 49909 - DNA, 15 bp, Homo sapiens
gaatttgcctgtggc

SEQ ID NO: 49910 - DNA, 15 bp, Homo sapiens
agaatttgcctgtgg

SEQ ID NO: 49911 - DNA, 15 bp, Homo sapiens
aagaatttgcctgtg

SEQ ID NO: 49912 - DNA, 15 bp, Homo sapiens
caagaatttgcctgt

SEQ ID NO: 49913 - DNA, 15 bp, Homo sapiens
acaagaatttgcctg

SEQ ID NO: 49914 - DNA, 15 bp, Homo sapiens
aacaagaatttgcct

SEQ ID NO: 49915 - DNA, 15 bp, Homo sapiens
gaacaagaatttgcc

SEQ ID NO: 49916 - DNA, 15 bp, Homo sapiens
agaacaagaatttgc

SEQ ID NO: 49917 - DNA, 15 bp, Homo sapiens
aagaacaagaatttg

SEQ ID NO: 49918 - DNA, 15 bp, Homo sapiens
aaagaacaagaattt

SEQ ID NO: 49919 - DNA, 15 bp, Homo sapiens
aaaagaacaagaatt

SEQ ID NO: 49920 - DNA, 15 bp, Homo sapiens
taaaagaacaagaat

SEQ ID NO: 49921 - DNA, 15 bp, Homo sapiens
gtaaaagaacaagaa

SEQ ID NO: 49922 - DNA, 15 bp, Homo sapiens
agtaaaagaacaaga

SEQ ID NO: 49923 - DNA, 15 bp, Homo sapiens
cagtaaaagaacaag

SEQ ID NO: 49924 - DNA, 15 bp, Homo sapiens
tcagtaaaagaacaa

SEQ ID NO: 49925 - DNA, 15 bp, Homo sapiens
ttcagtaaaagaaca

SEQ ID NO: 49926 - DNA, 15 bp, Homo sapiens
attcagtaaaagaac

SEQ ID NO: 49927 - DNA, 15 bp, Homo sapiens
aattcagtaaaagaa

SEQ ID NO: 49928 - DNA, 15 bp, Homo sapiens
gaattcagtaaaaga

SEQ ID NO: 49929 - DNA, 15 bp, Homo sapiens
ggaattcagtaaaag

SEQ ID NO: 49930 - DNA, 15 bp, Homo sapiens
aggaattcagtaaaa

SEQ ID NO: 49931 - DNA, 15 bp, Homo sapiens
caggaattcagtaaa

SEQ ID NO: 49932 - DNA, 15 bp, Homo sapiens
acaggaattcagtaa

SEQ ID NO: 49933 - DNA, 15 bp, Homo sapiens
gacaggaattcagta

SEQ ID NO: 49934 - DNA, 15 bp, Homo sapiens
agacaggaattcagt

SEQ ID NO: 49935 - DNA, 15 bp, Homo sapiens
tagacaggaattcag

SEQ ID NO: 49936 - DNA, 15 bp, Homo sapiens
ctagacaggaattca

SEQ ID NO: 49937 - DNA, 15 bp, Homo sapiens
actagacaggaattc

SEQ ID NO: 49938 - DNA, 15 bp, Homo sapiens
tactagacaggaatt

SEQ ID NO: 49939 - DNA, 15 bp, Homo sapiens
ctactagacaggaat

SEQ ID NO: 49940 - DNA, 15 bp, Homo sapiens
tctactagacaggaa

SEQ ID NO: 49941 - DNA, 15 bp, Homo sapiens
ttctactagacagga

SEQ ID NO: 49942 - DNA, 15 bp, Homo sapiens
tttctactagacagg

SEQ ID NO: 49943 - DNA, 15 bp, Homo sapiens
ttttctactagacag

SEQ ID NO: 49944 - DNA, 15 bp, Homo sapiens
attttctactagaca

SEQ ID NO: 49945 - DNA, 15 bp, Homo sapiens
tattttctactagac

SEQ ID NO: 49946 - DNA, 15 bp, Homo sapiens
ttattttctactaga

SEQ ID NO: 49947 - DNA, 15 bp, Homo sapiens
cttattttctactag

SEQ ID NO: 49948 - DNA, 15 bp, Homo sapiens
tcttattttctacta

SEQ ID NO: 49949 - DNA, 15 bp, Homo sapiens
ttcttattttctact

SEQ ID NO: 49950 - DNA, 15 bp, Homo sapiens
cttcttattttctac

SEQ ID NO: 49951 - DNA, 15 bp, Homo sapiens
acttcttattttcta

SEQ ID NO: 49952 - DNA, 15 bp, Homo sapiens
tacttcttattttct

SEQ ID NO: 49953 - DNA, 15 bp, Homo sapiens
atacttcttattttc

SEQ ID NO: 49954 - DNA, 15 bp, Homo sapiens
catacttcttatttt

SEQ ID NO: 49955 - DNA, 15 bp, Homo sapiens
acatacttcttattt

SEQ ID NO: 49956 - DNA, 15 bp, Homo sapiens
cacatacttcttatt

SEQ ID NO: 49957 - DNA, 15 bp, Homo sapiens
acacatacttcttat

SEQ ID NO: 49958 - DNA, 15 bp, Homo sapiens
cacacatacttctta

SEQ ID NO: 49959 - DNA, 15 bp, Homo sapiens
acacacatacttctt

SEQ ID NO: 49960 - DNA, 15 bp, Homo sapiens
aacacacatacttct

SEQ ID NO: 49961 - DNA, 15 bp, Homo sapiens
aaacacacatacttc

SEQ ID NO: 49962 - DNA, 15 bp, Homo sapiens
caaacacacatactt

SEQ ID NO: 49963 - DNA, 15 bp, Homo sapiens
acaaacacacatact

SEQ ID NO: 49964 - DNA, 15 bp, Homo sapiens
tacaaacacacatac

SEQ ID NO: 49965 - DNA, 15 bp, Homo sapiens
atacaaacacacata

SEQ ID NO: 49966 - DNA, 15 bp, Homo sapiens
catacaaacacacat

SEQ ID NO: 49967 - DNA, 15 bp, Homo sapiens
acatacaaacacaca

SEQ ID NO: 49968 - DNA, 15 bp, Homo sapiens
cacatacaaacacac

SEQ ID NO: 49969 - DNA, 15 bp, Homo sapiens
acacatacaaacaca

SEQ ID NO: 49970 - DNA, 15 bp, Homo sapiens
cacacatacaaacac

SEQ ID NO: 49971 - DNA, 15 bp, Homo sapiens
acacacatacaaaca

SEQ ID NO: 49972 - DNA, 15 bp, Homo sapiens
cacacacatacaaac

SEQ ID NO: 49973 - DNA, 15 bp, Homo sapiens
acacacacacataca

SEQ ID NO: 49974 - DNA, 15 bp, Homo sapiens
cacacacacacatac

SEQ ID NO: 49975 - DNA, 15 bp, Homo sapiens
gacacacacacacat

SEQ ID NO: 49976 - DNA, 15 bp, Homo sapiens
tcagacacacacaca

SEQ ID NO: 49977 - DNA, 15 bp, Homo sapiens
ttcagacacacacac

SEQ ID NO: 49978 - DNA, 15 bp, Homo sapiens
tttcagacacacaca

SEQ ID NO: 49979 - DNA, 15 bp, Homo sapiens
ttttcagacacacac

SEQ ID NO: 49980 - DNA, 15 bp, Homo sapiens
tttttcagacacaca

SEQ ID NO: 49981 - DNA, 15 bp, Homo sapiens
ttttttcagacacac

SEQ ID NO: 49982 - DNA, 15 bp, Homo sapiens
cttttttcagacaca

SEQ ID NO: 49983 - DNA, 15 bp, Homo sapiens
ccttttttcagacac

SEQ ID NO: 49984 - DNA, 15 bp, Homo sapiens
tccttttttcagaca

SEQ ID NO: 49985 - DNA, 15 bp, Homo sapiens
ttccttttttcagac

SEQ ID NO: 49986 - DNA, 15 bp, Homo sapiens
tttccttttttcaga

SEQ ID NO: 49987 - DNA, 15 bp, Homo sapiens
ttttccttttttcag

SEQ ID NO: 49988 - DNA, 15 bp, Homo sapiens
attttccttttttca

SEQ ID NO: 49989 - DNA, 15 bp, Homo sapiens
cattttccttttttc

SEQ ID NO: 49990 - DNA, 15 bp, Homo sapiens
gcattttcctttttt

SEQ ID NO: 49991 - DNA, 15 bp, Homo sapiens
tgcattttccttttt

SEQ ID NO: 49992 - DNA, 15 bp, Homo sapiens
ttgcattttcctttt

SEQ ID NO: 49993 - DNA, 15 bp, Homo sapiens
tttgcattttccttt

SEQ ID NO: 49994 - DNA, 15 bp, Homo sapiens
gtttgcattttcctt

SEQ ID NO: 49995 - DNA, 15 bp, Homo sapiens
agtttgcattttcct

SEQ ID NO: 49996 - DNA, 15 bp, Homo sapiens
tagtttgcattttcc

SEQ ID NO: 49997 - DNA, 15 bp, Homo sapiens
ctagtttgcattttc

SEQ ID NO: 49998 - DNA, 15 bp, Homo sapiens
actagtttgcatttt

SEQ ID NO: 49999 - DNA, 15 bp, Homo sapiens
gactagtttgcattt

SEQ ID NO: 50000 - DNA, 15 bp, Homo sapiens
agactagtttgcatt

SEQ ID NO: 50001 - DNA, 15 bp, Homo sapiens
aagactagtttgcat

SEQ ID NO: 50002 - DNA, 15 bp, Homo sapiens
aaagactagtttgca

SEQ ID NO: 50003 - DNA, 15 bp, Homo sapiens
caaagactagtttgc

SEQ ID NO: 50004 - DNA, 15 bp, Homo sapiens
tcaaagactagtttg

SEQ ID NO: 50005 - DNA, 15 bp, Homo sapiens
ttcaaagactagttt

SEQ ID NO: 50006 - DNA, 15 bp, Homo sapiens
tttcaaagactagtt

SEQ ID NO: 50007 - DNA, 15 bp, Homo sapiens
atttcaaagactagt

SEQ ID NO: 50008 - DNA, 15 bp, Homo sapiens
tatttcaaagactag

SEQ ID NO: 50009 - DNA, 15 bp, Homo sapiens
atatttcaaagacta

SEQ ID NO: 50010 - DNA, 15 bp, Homo sapiens
catatttcaaagact

SEQ ID NO: 50011 - DNA, 15 bp, Homo sapiens
acatatttcaaagac

SEQ ID NO: 50012 - DNA, 15 bp, Homo sapiens
tacatatttcaaaga

SEQ ID NO: 50013 - DNA, 15 bp, Homo sapiens
gtacatatttcaaag

SEQ ID NO: 50014 - DNA, 15 bp, Homo sapiens
agtacatatttcaaa

SEQ ID NO: 50015 - DNA, 15 bp, Homo sapiens
gagtacatatttcaa

SEQ ID NO: 50016 - DNA, 15 bp, Homo sapiens
ggagtacatatttca

SEQ ID NO: 50017 - DNA, 15 bp, Homo sapiens
gggagtacatatttc

SEQ ID NO: 50018 - DNA, 15 bp, Homo sapiens
agggagtacatattt

SEQ ID NO: 50019 - DNA, 15 bp, Homo sapiens
aagggagtacatatt

SEQ ID NO: 50020 - DNA, 15 bp, Homo sapiens
aaagggagtacatat

SEQ ID NO: 50021 - DNA, 15 bp, Homo sapiens
aaaagggagtacata

SEQ ID NO: 50022 - DNA, 15 bp, Homo sapiens
gaaaagggagtacat

SEQ ID NO: 50023 - DNA, 15 bp, Homo sapiens
ggaaaagggagtaca

SEQ ID NO: 50024 - DNA, 15 bp, Homo sapiens
gggaaaagggagtac

SEQ ID NO: 50025 - DNA, 15 bp, Homo sapiens
ggggaaaagggagta

SEQ ID NO: 50026 - DNA, 15 bp, Homo sapiens
tggggaaaagggagt

SEQ ID NO: 50027 - DNA, 15 bp, Homo sapiens
atggggaaaagggag

SEQ ID NO: 50028 - DNA, 15 bp, Homo sapiens
aatggggaaaaggga

SEQ ID NO: 50029 - DNA, 15 bp, Homo sapiens
aaatggggaaaaggg

SEQ ID NO: 50030 - DNA, 15 bp, Homo sapiens
aaaatggggaaaagg

SEQ ID NO: 50031 - DNA, 15 bp, Homo sapiens
aaaaatggggaaaag

SEQ ID NO: 50032 - DNA, 15 bp, Homo sapiens
taaaaatggggaaaa

SEQ ID NO: 50033 - DNA, 15 bp, Homo sapiens
ttaaaaatggggaaa

SEQ ID NO: 50034 - DNA, 15 bp, Homo sapiens
gttaaaaatggggaa

SEQ ID NO: 50035 - DNA, 15 bp, Homo sapiens
agttaaaaatgggga

SEQ ID NO: 50036 - DNA, 15 bp, Homo sapiens
cagttaaaaatgggg

SEQ ID NO: 50037 - DNA, 15 bp, Homo sapiens
acagttaaaaatggg

SEQ ID NO: 50038 - DNA, 15 bp, Homo sapiens
tacagttaaaaatgg

SEQ ID NO: 50039 - DNA, 15 bp, Homo sapiens
atacagttaaaaatg

SEQ ID NO: 50040 - DNA, 15 bp, Homo sapiens
gatacagttaaaaat

SEQ ID NO: 50041 - DNA, 15 bp, Homo sapiens
tgatacagttaaaaa

SEQ ID NO: 50042 - DNA, 15 bp, Homo sapiens
ttgatacagttaaaa

SEQ ID NO: 50043 - DNA, 15 bp, Homo sapiens
cttgatacagttaaa

SEQ ID NO: 50044 - DNA, 15 bp, Homo sapiens
tcttgatacagttaa

SEQ ID NO: 50045 - DNA, 15 bp, Homo sapiens
ctcttgatacagtta

SEQ ID NO: 50046 - DNA, 15 bp, Homo sapiens
tctcttgatacagtt

SEQ ID NO: 50047 - DNA, 15 bp, Homo sapiens
ttctcttgatacagt

SEQ ID NO: 50048 - DNA, 15 bp, Homo sapiens
attctcttgatacag

SEQ ID NO: 50049 - DNA, 15 bp, Homo sapiens
cattctcttgataca

SEQ ID NO: 50050 - DNA, 15 bp, Homo sapiens
tcattctcttgatac

SEQ ID NO: 50051 - DNA, 15 bp, Homo sapiens
ttcattctcttgata

SEQ ID NO: 50052 - DNA, 15 bp, Homo sapiens
attcattctcttgat

SEQ ID NO: 50053 - DNA, 15 bp, Homo sapiens
cattcattctcttga

SEQ ID NO: 50054 - DNA, 15 bp, Homo sapiens
gcattcattctcttg

SEQ ID NO: 50055 - DNA, 15 bp, Homo sapiens
cgcattcattctctt

SEQ ID NO: 50056 - DNA, 15 bp, Homo sapiens
ccgcattcattctct

SEQ ID NO: 50057 - DNA, 15 bp, Homo sapiens
tccgcattcattctc

SEQ ID NO: 50058 - DNA, 15 bp, Homo sapiens
ttccgcattcattct

SEQ ID NO: 50059 - DNA, 15 bp, Homo sapiens
cttccgcattcattc

SEQ ID NO: 50060 - DNA, 15 bp, Homo sapiens
acttccgcattcatt

SEQ ID NO: 50061 - DNA, 15 bp, Homo sapiens
cacttccgcattcat

SEQ ID NO: 50062 - DNA, 15 bp, Homo sapiens
acacttccgcattca

SEQ ID NO: 50063 - DNA, 15 bp, Homo sapiens
cacacttccgcattc

SEQ ID NO: 50064 - DNA, 15 bp, Homo sapiens
acacacttccgcatt

SEQ ID NO: 50065 - DNA, 15 bp, Homo sapiens
aacacacttccgcat

SEQ ID NO: 50066 - DNA, 15 bp, Homo sapiens
aaacacacttccgca

SEQ ID NO: 50067 - DNA, 15 bp, Homo sapiens
taaacacacttccgc

SEQ ID NO: 50068 - DNA, 15 bp, Homo sapiens
ataaacacacttccg

SEQ ID NO: 50069 - DNA, 15 bp, Homo sapiens
tataaacacacttcc

SEQ ID NO: 50070 - DNA, 15 bp, Homo sapiens
ttataaacacacttc

SEQ ID NO: 50071 - DNA, 15 bp, Homo sapiens
tttataaacacactt

SEQ ID NO: 50072 - DNA, 15 bp, Homo sapiens
gtttataaacacact

SEQ ID NO: 50073 - DNA, 15 bp, Homo sapiens
agtttataaacacac

SEQ ID NO: 50074 - DNA, 15 bp, Homo sapiens
aagtttataaacaca

SEQ ID NO: 50075 - DNA, 15 bp, Homo sapiens
aaagtttataaacac

SEQ ID NO: 50076 - DNA, 15 bp, Homo sapiens
caaagtttataaaca

SEQ ID NO: 50077 - DNA, 15 bp, Homo sapiens
tcaaagtttataaac

SEQ ID NO: 50078 - DNA, 15 bp, Homo sapiens
ttcaaagtttataaa

SEQ ID NO: 50079 - DNA, 15 bp, Homo sapiens
cttcaaagtttataa

SEQ ID NO: 50080 - DNA, 15 bp, Homo sapiens
acttcaaagtttata

SEQ ID NO: 50081 - DNA, 15 bp, Homo sapiens
tacttcaaagtttat

SEQ ID NO: 50082 - DNA, 15 bp, Homo sapiens
atacttcaaagttta

SEQ ID NO: 50083 - DNA, 15 bp, Homo sapiens
aatacttcaaagttt

SEQ ID NO: 50084 - DNA, 15 bp, Homo sapiens
aaatacttcaaagtt

SEQ ID NO: 50085 - DNA, 15 bp, Homo sapiens
aaaatacttcaaagt

SEQ ID NO: 50086 - DNA, 15 bp, Homo sapiens
aaaaatacttcaaag

SEQ ID NO: 50087 - DNA, 15 bp, Homo sapiens
caaaaatacttcaaa

SEQ ID NO: 50088 - DNA, 15 bp, Homo sapiens
tcaaaaatacttcaa

SEQ ID NO: 50089 - DNA, 15 bp, Homo sapiens
ttcaaaaatacttca

SEQ ID NO: 50090 - DNA, 15 bp, Homo sapiens
tttcaaaaatacttc

SEQ ID NO: 50091 - DNA, 15 bp, Homo sapiens
gtttcaaaaatactt

SEQ ID NO: 50092 - DNA, 15 bp, Homo sapiens
tgtttcaaaaatact

SEQ ID NO: 50093 - DNA, 15 bp, Homo sapiens
atgtttcaaaaatac

SEQ ID NO: 50094 - DNA, 15 bp, Homo sapiens
aatgtttcaaaaata

SEQ ID NO: 50095 - DNA, 15 bp, Homo sapiens
aaatgtttcaaaaat

SEQ ID NO: 50096 - DNA, 15 bp, Homo sapiens
caaatgtttcaaaaa

SEQ ID NO: 50097 - DNA, 15 bp, Homo sapiens
ccaaatgtttcaaaa

SEQ ID NO: 50098 - DNA, 15 bp, Homo sapiens
tccaaatgtttcaaa

SEQ ID NO: 50099 - DNA, 15 bp, Homo sapiens
atccaaatgtttcaa

SEQ ID NO: 50100 - DNA, 15 bp, Homo sapiens
catccaaatgtttca

SEQ ID NO: 50101 - DNA, 15 bp, Homo sapiens
acatccaaatgtttc

SEQ ID NO: 50102 - DNA, 15 bp, Homo sapiens
aacatccaaatgttt

SEQ ID NO: 50103 - DNA, 15 bp, Homo sapiens
taacatccaaatgtt

SEQ ID NO: 50104 - DNA, 15 bp, Homo sapiens
ctaacatccaaatgt

SEQ ID NO: 50105 - DNA, 15 bp, Homo sapiens
tctaacatccaaatg

SEQ ID NO: 50106 - DNA, 15 bp, Homo sapiens
ttctaacatccaaat

SEQ ID NO: 50107 - DNA, 15 bp, Homo sapiens
tttctaacatccaaa

SEQ ID NO: 50108 - DNA, 15 bp, Homo sapiens
ttttctaacatccaa

SEQ ID NO: 50109 - DNA, 15 bp, Homo sapiens
attttctaacatcca

SEQ ID NO: 50110 - DNA, 15 bp, Homo sapiens
cattttctaacatcc

SEQ ID NO: 50111 - DNA, 15 bp, Homo sapiens
acattttctaacatc

SEQ ID NO: 50112 - DNA, 15 bp, Homo sapiens
tacattttctaacat

SEQ ID NO: 50113 - DNA, 15 bp, Homo sapiens
atacattttctaaca

SEQ ID NO: 50114 - DNA, 15 bp, Homo sapiens
gatacattttctaac

SEQ ID NO: 50115 - DNA, 15 bp, Homo sapiens
cgatacattttctaa

SEQ ID NO: 50116 - DNA, 15 bp, Homo sapiens
acgatacattttcta

SEQ ID NO: 50117 - DNA, 15 bp, Homo sapiens
aacgatacattttct

SEQ ID NO: 50118 - DNA, 15 bp, Homo sapiens
aaacgatacattttc

SEQ ID NO: 50119 - DNA, 15 bp, Homo sapiens
taaacgatacatttt

SEQ ID NO: 50120 - DNA, 15 bp, Homo sapiens
gtaaacgatacattt

SEQ ID NO: 50121 - DNA, 15 bp, Homo sapiens
tgtaaacgatacatt

SEQ ID NO: 50122 - DNA, 15 bp, Homo sapiens
ctgtaaacgatacat

SEQ ID NO: 50123 - DNA, 15 bp, Homo sapiens
cctgtaaacgataca

SEQ ID NO: 50124 - DNA, 15 bp, Homo sapiens
gcctgtaaacgatac

SEQ ID NO: 50125 - DNA, 15 bp, Homo sapiens
tgcctgtaaacgata

SEQ ID NO: 50126 - DNA, 15 bp, Homo sapiens
ttgcctgtaaacgat

SEQ ID NO: 50127 - DNA, 15 bp, Homo sapiens
tttgcctgtaaacga

SEQ ID NO: 50128 - DNA, 15 bp, Homo sapiens
atttgcctgtaaacg

SEQ ID NO: 50129 - DNA, 15 bp, Homo sapiens
tatttgcctgtaaac

SEQ ID NO: 50130 - DNA, 15 bp, Homo sapiens
ttatttgcctgtaaa

SEQ ID NO: 50131 - DNA, 15 bp, Homo sapiens
attatttgcctgtaa

SEQ ID NO: 50132 - DNA, 15 bp, Homo sapiens
aattatttgcctgta

SEQ ID NO: 50133 - DNA, 15 bp, Homo sapiens
aaattatttgcctgt

SEQ ID NO: 50134 - DNA, 15 bp, Homo sapiens
caaattatttgcctg

SEQ ID NO: 50135 - DNA, 15 bp, Homo sapiens
acaaattatttgcct

SEQ ID NO: 50136 - DNA, 15 bp, Homo sapiens
gacaaattatttgcc

SEQ ID NO: 50137 - DNA, 15 bp, Homo sapiens
agacaaattatttgc

SEQ ID NO: 50138 - DNA, 15 bp, Homo sapiens
cagacaaattatttg

SEQ ID NO: 50139 - DNA, 15 bp, Homo sapiens
acagacaaattattt

SEQ ID NO: 50140 - DNA, 15 bp, Homo sapiens
aacagacaaattatt

SEQ ID NO: 50141 - DNA, 15 bp, Homo sapiens
taacagacaaattat

SEQ ID NO: 50142 - DNA, 15 bp, Homo sapiens
gtaacagacaaatta

SEQ ID NO: 50143 - DNA, 15 bp, Homo sapiens
agtaacagacaaatt

SEQ ID NO: 50144 - DNA, 15 bp, Homo sapiens
aagtaacagacaaat

SEQ ID NO: 50145 - DNA, 15 bp, Homo sapiens
taagtaacagacaaa

SEQ ID NO: 50146 - DNA, 15 bp, Homo sapiens
ctaagtaacagacaa

SEQ ID NO: 50147 - DNA, 15 bp, Homo sapiens
tctaagtaacagaca

SEQ ID NO: 50148 - DNA, 15 bp, Homo sapiens
gtctaagtaacagac

SEQ ID NO: 50149 - DNA, 15 bp, Homo sapiens
agtctaagtaacaga

SEQ ID NO: 50150 - DNA, 15 bp, Homo sapiens
aagtctaagtaacag

SEQ ID NO: 50151 - DNA, 15 bp, Homo sapiens
taagtctaagtaaca

SEQ ID NO: 50152 - DNA, 15 bp, Homo sapiens
ataagtctaagtaac

SEQ ID NO: 50153 - DNA, 15 bp, Homo sapiens
tataagtctaagtaa

SEQ ID NO: 50154 - DNA, 15 bp, Homo sapiens
atataagtctaagta

SEQ ID NO: 50155 - DNA, 15 bp, Homo sapiens
aatataagtctaagt

SEQ ID NO: 50156 - DNA, 15 bp, Homo sapiens
gaatataagtctaag

SEQ ID NO: 50157 - DNA, 15 bp, Homo sapiens
agaatataagtctaa

SEQ ID NO: 50158 - DNA, 15 bp, Homo sapiens
cagaatataagtcta

SEQ ID NO: 50159 - DNA, 15 bp, Homo sapiens
tcagaatataagtct

SEQ ID NO: 50160 - DNA, 15 bp, Homo sapiens
gtcagaatataagtc

SEQ ID NO: 50161 - DNA, 15 bp, Homo sapiens
tgtcagaatataagt

SEQ ID NO: 50162 - DNA, 15 bp, Homo sapiens
atgtcagaatataag

SEQ ID NO: 50163 - DNA, 15 bp, Homo sapiens
aatgtcagaatataa

SEQ ID NO: 50164 - DNA, 15 bp, Homo sapiens
caatgtcagaatata

SEQ ID NO: 50165 - DNA, 15 bp, Homo sapiens
tcaatgtcagaatat

SEQ ID NO: 50166 - DNA, 15 bp, Homo sapiens
gtcaatgtcagaata

SEQ ID NO: 50167 - DNA, 15 bp, Homo sapiens
agtcaatgtcagaat

SEQ ID NO: 50168 - DNA, 15 bp, Homo sapiens
aagtcaatgtcagaa

SEQ ID NO: 50169 - DNA, 15 bp, Homo sapiens
caagtcaatgtcaga

SEQ ID NO: 50170 - DNA, 15 bp, Homo sapiens
tcaagtcaatgtcag

SEQ ID NO: 50171 - DNA, 15 bp, Homo sapiens
gtcaagtcaatgtca

SEQ ID NO: 50172 - DNA, 15 bp, Homo sapiens
ggtcaagtcaatgtc

SEQ ID NO: 50173 - DNA, 15 bp, Homo sapiens
gggtcaagtcaatgt

SEQ ID NO: 50174 - DNA, 15 bp, Homo sapiens
tgggtcaagtcaatg

SEQ ID NO: 50175 - DNA, 15 bp, Homo sapiens
atgggtcaagtcaat

SEQ ID NO: 50176 - DNA, 15 bp, Homo sapiens
tatgggtcaagtcaa

SEQ ID NO: 50177 - DNA, 15 bp, Homo sapiens
ttatgggtcaagtca

SEQ ID NO: 50178 - DNA, 15 bp, Homo sapiens
tttatgggtcaagtc

SEQ ID NO: 50179 - DNA, 15 bp, Homo sapiens
ttttatgggtcaagt

SEQ ID NO: 50180 - DNA, 15 bp, Homo sapiens
attttatgggtcaag

SEQ ID NO: 50181 - DNA, 15 bp, Homo sapiens
tattttatgggtcaa

SEQ ID NO: 50182 - DNA, 15 bp, Homo sapiens
ttattttatgggtca

SEQ ID NO: 50183 - DNA, 15 bp, Homo sapiens
tttattttatgggtc

SEQ ID NO: 50184 - DNA, 15 bp, Homo sapiens
ctttattttatgggt

SEQ ID NO: 50185 - DNA, 15 bp, Homo sapiens
tctttattttatggg

SEQ ID NO: 50186 - DNA, 15 bp, Homo sapiens
gtctttattttatgg

SEQ ID NO: 50187 - DNA, 15 bp, Homo sapiens
agtctttattttatg

SEQ ID NO: 50188 - DNA, 15 bp, Homo sapiens
tagtctttattttat

SEQ ID NO: 50189 - DNA, 15 bp, Homo sapiens
atagtctttatttta

SEQ ID NO: 50190 - DNA, 15 bp, Homo sapiens
aatagtctttatttt

SEQ ID NO: 50191 - DNA, 15 bp, Homo sapiens
caatagtctttattt

SEQ ID NO: 50192 - DNA, 15 bp, Homo sapiens
acaatagtctttatt

SEQ ID NO: 50193 - DNA, 15 bp, Homo sapiens
aacaatagtctttat

SEQ ID NO: 50194 - DNA, 15 bp, Homo sapiens
caacaatagtcttta

SEQ ID NO: 50195 - DNA, 15 bp, Homo sapiens
tcaacaatagtcttt

SEQ ID NO: 50196 - DNA, 15 bp, Homo sapiens
ttcaacaatagtctt

SEQ ID NO: 50197 - DNA, 15 bp, Homo sapiens
tttcaacaatagtct

SEQ ID NO: 50198 - DNA, 15 bp, Homo sapiens
atttcaacaatagtc

SEQ ID NO: 50199 - DNA, 15 bp, Homo sapiens
tatttcaacaatagt

SEQ ID NO: 50200 - DNA, 15 bp, Homo sapiens
atatttcaacaatag

SEQ ID NO: 50201 - DNA, 15 bp, Homo sapiens
aatatttcaacaata

SEQ ID NO: 50202 - DNA, 15 bp, Homo sapiens
taatatttcaacaat

SEQ ID NO: 50203 - DNA, 15 bp, Homo sapiens
ataatatttcaacaa

SEQ ID NO: 50204 - DNA, 15 bp, Homo sapiens
gataatatttcaaca

SEQ ID NO: 50205 - DNA, 15 bp, Homo sapiens
agataatatttcaac

SEQ ID NO: 50206 - DNA, 15 bp, Homo sapiens
aagataatatttcaa

SEQ ID NO: 50207 - DNA, 15 bp, Homo sapiens
taagataatatttca

SEQ ID NO: 50208 - DNA, 15 bp, Homo sapiens
gtaagataatatttc

SEQ ID NO: 50209 - DNA, 15 bp, Homo sapiens
agtaagataatattt

SEQ ID NO: 50210 - DNA, 15 bp, Homo sapiens
gagtaagataatatt

SEQ ID NO: 50211 - DNA, 15 bp, Homo sapiens
tgagtaagataatat

SEQ ID NO: 50212 - DNA, 15 bp, Homo sapiens
atgagtaagataata

SEQ ID NO: 50213 - DNA, 15 bp, Homo sapiens
aatgagtaagataat

SEQ ID NO: 50214 - DNA, 15 bp, Homo sapiens
aaatgagtaagataa

SEQ ID NO: 50215 - DNA, 15 bp, Homo sapiens
aaaatgagtaagata

SEQ ID NO: 50216 - DNA, 15 bp, Homo sapiens
aaaaatgagtaagat

SEQ ID NO: 50217 - DNA, 15 bp, Homo sapiens
taaaaatgagtaaga

SEQ ID NO: 50218 - DNA, 15 bp, Homo sapiens
gtaaaaatgagtaag

SEQ ID NO: 50219 - DNA, 15 bp, Homo sapiens
tgtaaaaatgagtaa

SEQ ID NO: 50220 - DNA, 15 bp, Homo sapiens
ttgtaaaaatgagta

SEQ ID NO: 50221 - DNA, 15 bp, Homo sapiens
tttgtaaaaatgagt

SEQ ID NO: 50222 - DNA, 15 bp, Homo sapiens
gtttgtaaaaatgag

SEQ ID NO: 50223 - DNA, 15 bp, Homo sapiens
tgtttgtaaaaatga

SEQ ID NO: 50224 - DNA, 15 bp, Homo sapiens
atgtttgtaaaaatg

SEQ ID NO: 50225 - DNA, 15 bp, Homo sapiens
tatgtttgtaaaaat

SEQ ID NO: 50226 - DNA, 15 bp, Homo sapiens
ttatgtttgtaaaaa

SEQ ID NO: 50227 - DNA, 15 bp, Homo sapiens
cttatgtttgtaaaa

SEQ ID NO: 50228 - DNA, 15 bp, Homo sapiens
tcttatgtttgtaaa

SEQ ID NO: 50229 - DNA, 15 bp, Homo sapiens
ttcttatgtttgtaa

SEQ ID NO: 50230 - DNA, 15 bp, Homo sapiens
attcttatgtttgta

SEQ ID NO: 50231 - DNA, 15 bp, Homo sapiens
cattcttatgtttgt

SEQ ID NO: 50232 - DNA, 15 bp, Homo sapiens
ccattcttatgtttg

SEQ ID NO: 50233 - DNA, 15 bp, Homo sapiens
cccattcttatgttt

SEQ ID NO: 50234 - DNA, 15 bp, Homo sapiens
tcccattcttatgtt

SEQ ID NO: 50235 - DNA, 15 bp, Homo sapiens
ttcccattcttatgt

SEQ ID NO: 50236 - DNA, 15 bp, Homo sapiens
attcccattcttatg

SEQ ID NO: 50237 - DNA, 15 bp, Homo sapiens
gattcccattcttat

SEQ ID NO: 50238 - DNA, 15 bp, Homo sapiens
ggattcccattctta

SEQ ID NO: 50239 - DNA, 15 bp, Homo sapiens
tggattcccattctt

SEQ ID NO: 50240 - DNA, 15 bp, Homo sapiens
atggattcccattct

SEQ ID NO: 50241 - DNA, 15 bp, Homo sapiens
tatggattcccattc

SEQ ID NO: 50242 - DNA, 15 bp, Homo sapiens
ttatggattcccatt

SEQ ID NO: 50243 - DNA, 15 bp, Homo sapiens
tttatggattcccat

SEQ ID NO: 50244 - DNA, 15 bp, Homo sapiens
atttatggattccca

SEQ ID NO: 50245 - DNA, 15 bp, Homo sapiens
aatttatggattccc

SEQ ID NO: 50246 - DNA, 15 bp, Homo sapiens
aaatttatggattcc

SEQ ID NO: 50247 - DNA, 15 bp, Homo sapiens
aaaatttatggattc

SEQ ID NO: 50248 - DNA, 15 bp, Homo sapiens
taaaatttatggatt

SEQ ID NO: 50249 - DNA, 15 bp, Homo sapiens
ataaaatttatggat

SEQ ID NO: 50250 - DNA, 15 bp, Homo sapiens
aataaaatttatgga

SEQ ID NO: 50251 - DNA, 15 bp, Homo sapiens
aaataaaatttatgg

SEQ ID NO: 50252 - DNA, 15 bp, Homo sapiens
gaaataaaatttatg

SEQ ID NO: 50253 - DNA, 15 bp, Homo sapiens
tgaaataaaatttat

SEQ ID NO: 50254 - DNA, 15 bp, Homo sapiens
atgaaataaaattta

SEQ ID NO: 50255 - DNA, 15 bp, Homo sapiens
aatgaaataaaattt

SEQ ID NO: 50256 - DNA, 15 bp, Homo sapiens
aaatgaaataaaatt

SEQ ID NO: 50257 - DNA, 15 bp, Homo sapiens
gaaatgaaataaaat

SEQ ID NO: 50258 - DNA, 15 bp, Homo sapiens
tgaaatgaaataaaa

SEQ ID NO: 50259 - DNA, 15 bp, Homo sapiens
atgaaatgaaataaa

SEQ ID NO: 50260 - DNA, 15 bp, Homo sapiens
tatgaaatgaaataa

SEQ ID NO: 50261 - DNA, 15 bp, Homo sapiens
atatgaaatgaaata

SEQ ID NO: 50262 - DNA, 15 bp, Homo sapiens
catatgaaatgaaat

SEQ ID NO: 50263 - DNA, 15 bp, Homo sapiens
acatatgaaatgaaa

SEQ ID NO: 50264 - DNA, 15 bp, Homo sapiens
cacatatgaaatgaa

SEQ ID NO: 50265 - DNA, 15 bp, Homo sapiens
tcacatatgaaatga

SEQ ID NO: 50266 - DNA, 15 bp, Homo sapiens
atcacatatgaaatg

SEQ ID NO: 50267 - DNA, 15 bp, Homo sapiens
tatcacatatgaaat

SEQ ID NO: 50268 - DNA, 15 bp, Homo sapiens
ttatcacatatgaaa

SEQ ID NO: 50269 - DNA, 15 bp, Homo sapiens
tttatcacatatgaa

SEQ ID NO: 50270 - DNA, 15 bp, Homo sapiens
ttttatcacatatga

SEQ ID NO: 50271 - DNA, 15 bp, Homo sapiens
attttatcacatatg

SEQ ID NO: 50272 - DNA, 15 bp, Homo sapiens
cattttatcacatat

SEQ ID NO: 50273 - DNA, 15 bp, Homo sapiens
ccattttatcacata

SEQ ID NO: 50274 - DNA, 15 bp, Homo sapiens
tccattttatcacat

SEQ ID NO: 50275 - DNA, 15 bp, Homo sapiens
ttccattttatcaca

SEQ ID NO: 50276 - DNA, 15 bp, Homo sapiens
tttccattttatcac

SEQ ID NO: 50277 - DNA, 15 bp, Homo sapiens
ctttccattttatca

SEQ ID NO: 50278 - DNA, 15 bp, Homo sapiens
tctttccattttatc

SEQ ID NO: 50279 - DNA, 15 bp, Homo sapiens
atctttccattttat

SEQ ID NO: 50280 - DNA, 15 bp, Homo sapiens
aatctttccatttta

SEQ ID NO: 50281 - DNA, 15 bp, Homo sapiens
taatctttccatttt

SEQ ID NO: 50282 - DNA, 15 bp, Homo sapiens
ataatctttccattt

SEQ ID NO: 50283 - DNA, 15 bp, Homo sapiens
aataatctttccatt

SEQ ID NO: 50284 - DNA, 15 bp, Homo sapiens
taataatctttccat

SEQ ID NO: 50285 - DNA, 15 bp, Homo sapiens
ataataatctttcca

SEQ ID NO: 50286 - DNA, 15 bp, Homo sapiens
gataataatctttcc

SEQ ID NO: 50287 - DNA, 15 bp, Homo sapiens
tgataataatctttc

SEQ ID NO: 50288 - DNA, 15 bp, Homo sapiens
atgataataatcttt

SEQ ID NO: 50289 - DNA, 15 bp, Homo sapiens
aatgataataatctt

SEQ ID NO: 50290 - DNA, 15 bp, Homo sapiens
caatgataataatct

SEQ ID NO: 50291 - DNA, 15 bp, Homo sapiens
tcaatgataataatc

SEQ ID NO: 50292 - DNA, 15 bp, Homo sapiens
atcaatgataataat

SEQ ID NO: 50293 - DNA, 15 bp, Homo sapiens
tatcaatgataataa

SEQ ID NO: 50294 - DNA, 15 bp, Homo sapiens
ctatcaatgataata

SEQ ID NO: 50295 - DNA, 15 bp, Homo sapiens
cctatcaatgataat

SEQ ID NO: 50296 - DNA, 15 bp, Homo sapiens
ccctatcaatgataa

SEQ ID NO: 50297 - DNA, 15 bp, Homo sapiens
accctatcaatgata

SEQ ID NO: 50298 - DNA, 15 bp, Homo sapiens
taccctatcaatgat

SEQ ID NO: 50299 - DNA, 15 bp, Homo sapiens
ttaccctatcaatga

SEQ ID NO: 50300 - DNA, 15 bp, Homo sapiens
attaccctatcaatg

SEQ ID NO: 50301 - DNA, 15 bp, Homo sapiens
tattaccctatcaat

SEQ ID NO: 50302 - DNA, 15 bp, Homo sapiens
ctattaccctatcaa

SEQ ID NO: 50303 - DNA, 15 bp, Homo sapiens
actattaccctatca

SEQ ID NO: 50304 - DNA, 15 bp, Homo sapiens
cactattaccctatc

SEQ ID NO: 50305 - DNA, 15 bp, Homo sapiens
gcactattaccctat

SEQ ID NO: 50306 - DNA, 15 bp, Homo sapiens
agcactattacccta

SEQ ID NO: 50307 - DNA, 15 bp, Homo sapiens
gagcactattaccct

SEQ ID NO: 50308 - DNA, 15 bp, Homo sapiens
tgagcactattaccc

SEQ ID NO: 50309 - DNA, 15 bp, Homo sapiens
atgagcactattacc

SEQ ID NO: 50310 - DNA, 15 bp, Homo sapiens
aatgagcactattac

SEQ ID NO: 50311 - DNA, 15 bp, Homo sapiens
aaatgagcactatta

SEQ ID NO: 50312 - DNA, 15 bp, Homo sapiens
gaaatgagcactatt

SEQ ID NO: 50313 - DNA, 15 bp, Homo sapiens
agaaatgagcactat

SEQ ID NO: 50314 - DNA, 15 bp, Homo sapiens
aagaaatgagcacta

SEQ ID NO: 50315 - DNA, 15 bp, Homo sapiens
aaagaaatgagcact

SEQ ID NO: 50316 - DNA, 15 bp, Homo sapiens
caaagaaatgagcac

SEQ ID NO: 50317 - DNA, 15 bp, Homo sapiens
gcaaagaaatgagca

SEQ ID NO: 50318 - DNA, 15 bp, Homo sapiens
ggcaaagaaatgagc

SEQ ID NO: 50319 - DNA, 15 bp, Homo sapiens
tgggcaaagaaatga

SEQ ID NO: 50320 - DNA, 15 bp, Homo sapiens
gtgggcaaagaaatg

SEQ ID NO: 50321 - DNA, 15 bp, Homo sapiens
agtgggcaaagaaat

SEQ ID NO: 50322 - DNA, 15 bp, Homo sapiens
aagtgggcaaagaaa

SEQ ID NO: 50323 - DNA, 15 bp, Homo sapiens
aaagtgggcaaagaa

SEQ ID NO: 50324 - DNA, 15 bp, Homo sapiens
taaagtgggcaaaga

SEQ ID NO: 50325 - DNA, 15 bp, Homo sapiens
ataaagtgggcaaag

SEQ ID NO: 50326 - DNA, 15 bp, Homo sapiens
tataaagtgggcaaa

SEQ ID NO: 50327 - DNA, 15 bp, Homo sapiens
atataaagtgggcaa

SEQ ID NO: 50328 - DNA, 15 bp, Homo sapiens
gatataaagtgggca

SEQ ID NO: 50329 - DNA, 15 bp, Homo sapiens
agatataaagtgggc

SEQ ID NO: 50330 - DNA, 15 bp, Homo sapiens
cagatataaagtggg

SEQ ID NO: 50331 - DNA, 15 bp, Homo sapiens
ccagatataaagtgg

SEQ ID NO: 50332 - DNA, 15 bp, Homo sapiens
cccagatataaagtg

SEQ ID NO: 50333 - DNA, 15 bp, Homo sapiens
ccccagatataaagt

SEQ ID NO: 50334 - DNA, 15 bp, Homo sapiens
tccccagatataaag

SEQ ID NO: 50335 - DNA, 15 bp, Homo sapiens
ctccccagatataaa

SEQ ID NO: 50336 - DNA, 15 bp, Homo sapiens
tctccccagatataa

SEQ ID NO: 50337 - DNA, 15 bp, Homo sapiens
ttctccccagatata

SEQ ID NO: 50338 - DNA, 15 bp, Homo sapiens
tttctccccagatat

SEQ ID NO: 50339 - DNA, 15 bp, Homo sapiens
gtttctccccagata

SEQ ID NO: 50340 - DNA, 15 bp, Homo sapiens
ggtttctccccagat

SEQ ID NO: 50341 - DNA, 15 bp, Homo sapiens
aggtttctccccaga

SEQ ID NO: 50342 - DNA, 15 bp, Homo sapiens
taggtttctccccag

SEQ ID NO: 50343 - DNA, 15 bp, Homo sapiens
gtaggtttctcccca

SEQ ID NO: 50344 - DNA, 15 bp, Homo sapiens
tgtaggtttctcccc

SEQ ID NO: 50345 - DNA, 15 bp, Homo sapiens
atgtaggtttctccc

SEQ ID NO: 50346 - DNA, 15 bp, Homo sapiens
tatgtaggtttctcc

SEQ ID NO: 50347 - DNA, 15 bp, Homo sapiens
ctatgtaggtttctc

SEQ ID NO: 50348 - DNA, 15 bp, Homo sapiens
actatgtaggtttct

SEQ ID NO: 50349 - DNA, 15 bp, Homo sapiens
tactatgtaggtttc

SEQ ID NO: 50350 - DNA, 15 bp, Homo sapiens
atactatgtaggttt

SEQ ID NO: 50351 - DNA, 15 bp, Homo sapiens
aatactatgtaggtt

SEQ ID NO: 50352 - DNA, 15 bp, Homo sapiens
taatactatgtaggt

SEQ ID NO: 50353 - DNA, 15 bp, Homo sapiens
ctaatactatgtagg

SEQ ID NO: 50354 - DNA, 15 bp, Homo sapiens
tctaatactatgtag

SEQ ID NO: 50355 - DNA, 15 bp, Homo sapiens
atctaatactatgta

SEQ ID NO: 50356 - DNA, 15 bp, Homo sapiens
tatctaatactatgt

SEQ ID NO: 50357 - DNA, 15 bp, Homo sapiens
atatctaatactatg

SEQ ID NO: 50358 - DNA, 15 bp, Homo sapiens
aatatctaatactat

SEQ ID NO: 50359 - DNA, 15 bp, Homo sapiens
aaatatctaatacta

SEQ ID NO: 50360 - DNA, 15 bp, Homo sapiens
aaaatatctaatact

SEQ ID NO: 50361 - DNA, 15 bp, Homo sapiens
taaaatatctaatac

SEQ ID NO: 50362 - DNA, 15 bp, Homo sapiens
ttaaaatatctaata

SEQ ID NO: 50363 - DNA, 15 bp, Homo sapiens
attaaaatatctaat

SEQ ID NO: 50364 - DNA, 15 bp, Homo sapiens
tattaaaatatctaa

SEQ ID NO: 50365 - DNA, 15 bp, Homo sapiens
atattaaaatatcta

SEQ ID NO: 50366 - DNA, 15 bp, Homo sapiens
catattaaaatatct

SEQ ID NO: 50367 - DNA, 15 bp, Homo sapiens
acatattaaaatatc

SEQ ID NO: 50368 - DNA, 15 bp, Homo sapiens
aacatattaaaatat

SEQ ID NO: 50369 - DNA, 15 bp, Homo sapiens
aaacatattaaaata

SEQ ID NO: 50370 - DNA, 15 bp, Homo sapiens
aaaacatattaaaat

SEQ ID NO: 50371 - DNA, 15 bp, Homo sapiens
aaaaacatattaaaa

SEQ ID NO: 50372 - DNA, 15 bp, Homo sapiens
caaaaacatattaaa

SEQ ID NO: 50373 - DNA, 15 bp, Homo sapiens
tcaaaaacatattaa

SEQ ID NO: 50374 - DNA, 15 bp, Homo sapiens
ttcaaaaacatatta

SEQ ID NO: 50375 - DNA, 15 bp, Homo sapiens
tttcaaaaacatatt

SEQ ID NO: 50376 - DNA, 15 bp, Homo sapiens
atttcaaaaacatat

SEQ ID NO: 50377 - DNA, 15 bp, Homo sapiens
tatttcaaaaacata

SEQ ID NO: 50378 - DNA, 15 bp, Homo sapiens
ttatttcaaaaacat

SEQ ID NO: 50379 - DNA, 15 bp, Homo sapiens
cttatttcaaaaaca

SEQ ID NO: 50380 - DNA, 15 bp, Homo sapiens
tcttatttcaaaaac

SEQ ID NO: 50381 - DNA, 15 bp, Homo sapiens
ttcttatttcaaaaa

SEQ ID NO: 50382 - DNA, 15 bp, Homo sapiens
tttcttatttcaaaa

SEQ ID NO: 50383 - DNA, 15 bp, Homo sapiens
ctttcttatttcaaa

SEQ ID NO: 50384 - DNA, 15 bp, Homo sapiens
actttcttatttcaa

SEQ ID NO: 50385 - DNA, 15 bp, Homo sapiens
aactttcttatttca

SEQ ID NO: 50386 - DNA, 15 bp, Homo sapiens
taactttcttatttc

SEQ ID NO: 50387 - DNA, 15 bp, Homo sapiens
ttaactttcttattt

SEQ ID NO: 50388 - DNA, 15 bp, Homo sapiens
tttaactttcttatt

SEQ ID NO: 50389 - DNA, 15 bp, Homo sapiens
atttaactttcttat

SEQ ID NO: 50390 - DNA, 15 bp, Homo sapiens
catttaactttctta

SEQ ID NO: 50391 - DNA, 15 bp, Homo sapiens
gcatttaactttctt

SEQ ID NO: 50392 - DNA, 15 bp, Homo sapiens
agcatttaactttct

SEQ ID NO: 50393 - DNA, 15 bp, Homo sapiens
gagcatttaactttc

SEQ ID NO: 50394 - DNA, 15 bp, Homo sapiens
ggagcatttaacttt

SEQ ID NO: 50395 - DNA, 15 bp, Homo sapiens
cggagcatttaactt

SEQ ID NO: 50396 - DNA, 15 bp, Homo sapiens
ccggagcatttaact

SEQ ID NO: 50397 - DNA, 15 bp, Homo sapiens
tccggagcatttaac

SEQ ID NO: 50398 - DNA, 15 bp, Homo sapiens
ttccggagcatttaa

SEQ ID NO: 50399 - DNA, 15 bp, Homo sapiens
tttccggagcattta

SEQ ID NO: 50400 - DNA, 15 bp, Homo sapiens
gtttccggagcattt

SEQ ID NO: 50401 - DNA, 15 bp, Homo sapiens
tgtttccggagcatt

SEQ ID NO: 50402 - DNA, 15 bp, Homo sapiens
ctgtttccggagcat

SEQ ID NO: 50403 - DNA, 15 bp, Homo sapiens
cctgtttccggagca

SEQ ID NO: 50404 - DNA, 15 bp, Homo sapiens
acctgtttccggagc

SEQ ID NO: 50405 - DNA, 15 bp, Homo sapiens
aacctgtttccggag

SEQ ID NO: 50406 - DNA, 15 bp, Homo sapiens
taacctgtttccgga

SEQ ID NO: 50407 - DNA, 15 bp, Homo sapiens
ttaacctgtttccgg

SEQ ID NO: 50408 - DNA, 15 bp, Homo sapiens
cttaacctgtttccg

SEQ ID NO: 50409 - DNA, 15 bp, Homo sapiens
tcttaacctgtttcc

SEQ ID NO: 50410 - DNA, 15 bp, Homo sapiens
ttcttaacctgtttc

SEQ ID NO: 50411 - DNA, 15 bp, Homo sapiens
tttcttaacctgttt

SEQ ID NO: 50412 - DNA, 15 bp, Homo sapiens
ttttcttaacctgtt

SEQ ID NO: 50413 - DNA, 15 bp, Homo sapiens
attttcttaacctgt

SEQ ID NO: 50414 - DNA, 15 bp, Homo sapiens
cattttcttaacctg

SEQ ID NO: 50415 - DNA, 15 bp, Homo sapiens
acattttcttaacct

SEQ ID NO: 50416 - DNA, 15 bp, Homo sapiens
tacattttcttaacc

SEQ ID NO: 50417 - DNA, 15 bp, Homo sapiens
ttacattttcttaac

SEQ ID NO: 50418 - DNA, 15 bp, Homo sapiens
tttacattttcttaa

SEQ ID NO: 50419 - DNA, 15 bp, Homo sapiens
ttttacattttctta

SEQ ID NO: 50420 - DNA, 15 bp, Homo sapiens
attttacattttctt

SEQ ID NO: 50421 - DNA, 15 bp, Homo sapiens
cattttacattttct

SEQ ID NO: 50422 - DNA, 15 bp, Homo sapiens
acattttacattttc

SEQ ID NO: 50423 - DNA, 15 bp, Homo sapiens
tacattttacatttt

SEQ ID NO: 50424 - DNA, 15 bp, Homo sapiens
ctacattttacattt

SEQ ID NO: 50425 - DNA, 15 bp, Homo sapiens
actacattttacatt

SEQ ID NO: 50426 - DNA, 15 bp, Homo sapiens
tactacattttacat

SEQ ID NO: 50427 - DNA, 15 bp, Homo sapiens
ttactacattttaca

SEQ ID NO: 50428 - DNA, 15 bp, Homo sapiens
cttactacattttac

SEQ ID NO: 50429 - DNA, 15 bp, Homo sapiens
tcttactacatttta

SEQ ID NO: 50430 - DNA, 15 bp, Homo sapiens
atcttactacatttt

SEQ ID NO: 50431 - DNA, 15 bp, Homo sapiens
aatcttactacattt

SEQ ID NO: 50432 - DNA, 15 bp, Homo sapiens
aaatcttactacatt

SEQ ID NO: 50433 - DNA, 15 bp, Homo sapiens
gaaatcttactacat

SEQ ID NO: 50434 - DNA, 15 bp, Homo sapiens
agaaatcttactaca

SEQ ID NO: 50435 - DNA, 15 bp, Homo sapiens
gagaaatcttactac

SEQ ID NO: 50436 - DNA, 15 bp, Homo sapiens
agagaaatcttacta

SEQ ID NO: 50437 - DNA, 15 bp, Homo sapiens
gagagaaatcttact

SEQ ID NO: 50438 - DNA, 15 bp, Homo sapiens
agagagaaatcttac

SEQ ID NO: 50439 - DNA, 15 bp, Homo sapiens
aagagagaaatctta

SEQ ID NO: 50440 - DNA, 15 bp, Homo sapiens
taagagagaaatctt

SEQ ID NO: 50441 - DNA, 15 bp, Homo sapiens
ctaagagagaaatct

SEQ ID NO: 50442 - DNA, 15 bp, Homo sapiens
tctaagagagaaatc

SEQ ID NO: 50443 - DNA, 15 bp, Homo sapiens
ttctaagagagaaat

SEQ ID NO: 50444 - DNA, 15 bp, Homo sapiens
attctaagagagaaa

SEQ ID NO: 50445 - DNA, 15 bp, Homo sapiens
aattctaagagagaa

SEQ ID NO: 50446 - DNA, 15 bp, Homo sapiens
aaattctaagagaga

SEQ ID NO: 50447 - DNA, 15 bp, Homo sapiens
aaaattctaagagag

SEQ ID NO: 50448 - DNA, 15 bp, Homo sapiens
aaaaattctaagaga

SEQ ID NO: 50449 - DNA, 15 bp, Homo sapiens
aaaaaattctaagag

SEQ ID NO: 50450 - DNA, 15 bp, Homo sapiens
gaaaaaattctaaga

SEQ ID NO: 50451 - DNA, 15 bp, Homo sapiens
ggaaaaaattctaag

SEQ ID NO: 50452 - DNA, 15 bp, Homo sapiens
tggaaaaaattctaa

SEQ ID NO: 50453 - DNA, 15 bp, Homo sapiens
atggaaaaaattcta

SEQ ID NO: 50454 - DNA, 15 bp, Homo sapiens
aatggaaaaaattct

SEQ ID NO: 50455 - DNA, 15 bp, Homo sapiens
aaatggaaaaaattc

SEQ ID NO: 50456 - DNA, 15 bp, Homo sapiens
aaaatggaaaaaatt

SEQ ID NO: 50457 - DNA, 15 bp, Homo sapiens
aaaaatggaaaaaat

SEQ ID NO: 50458 - DNA, 15 bp, Homo sapiens
taaaaatggaaaaaa

SEQ ID NO: 50459 - DNA, 15 bp, Homo sapiens
ataaaaatggaaaaa

SEQ ID NO: 50460 - DNA, 15 bp, Homo sapiens
cataaaaatggaaaa

SEQ ID NO: 50461 - DNA, 15 bp, Homo sapiens
ccataaaaatggaaa

SEQ ID NO: 50462 - DNA, 15 bp, Homo sapiens
gccataaaaatggaa

SEQ ID NO: 50463 - DNA, 15 bp, Homo sapiens
ggccataaaaatgga

SEQ ID NO: 50464 - DNA, 15 bp, Homo sapiens
gggccataaaaatgg

SEQ ID NO: 50465 - DNA, 15 bp, Homo sapiens
ggggccataaaaatg

SEQ ID NO: 50466 - DNA, 15 bp, Homo sapiens
tggggccataaaaat

SEQ ID NO: 50467 - DNA, 15 bp, Homo sapiens
ttggggccataaaaa

SEQ ID NO: 50468 - DNA, 15 bp, Homo sapiens
tttggggccataaaa

SEQ ID NO: 50469 - DNA, 15 bp, Homo sapiens
atttggggccataaa

SEQ ID NO: 50470 - DNA, 15 bp, Homo sapiens
aatttggggccataa

SEQ ID NO: 50471 - DNA, 15 bp, Homo sapiens
gaatttggggccata

SEQ ID NO: 50472 - DNA, 15 bp, Homo sapiens
agaatttggggccat

SEQ ID NO: 50473 - DNA, 15 bp, Homo sapiens
aagaatttggggcca

SEQ ID NO: 50474 - DNA, 15 bp, Homo sapiens
taagaatttggggcc

SEQ ID NO: 50475 - DNA, 15 bp, Homo sapiens
ttaagaatttggggc

SEQ ID NO: 50476 - DNA, 15 bp, Homo sapiens
cttaagaatttgggg

SEQ ID NO: 50477 - DNA, 15 bp, Homo sapiens
acttaagaatttggg

SEQ ID NO: 50478 - DNA, 15 bp, Homo sapiens
aacttaagaatttgg

SEQ ID NO: 50479 - DNA, 15 bp, Homo sapiens
caacttaagaatttg

SEQ ID NO: 50480 - DNA, 15 bp, Homo sapiens
acaacttaagaattt

SEQ ID NO: 50481 - DNA, 15 bp, Homo sapiens
cacaacttaagaatt

SEQ ID NO: 50482 - DNA, 15 bp, Homo sapiens
acacaacttaagaat

SEQ ID NO: 50483 - DNA, 15 bp, Homo sapiens
cacacaacttaagaa

SEQ ID NO: 50484 - DNA, 15 bp, Homo sapiens
tcacacaacttaaga

SEQ ID NO: 50485 - DNA, 15 bp, Homo sapiens
ttcacacaacttaag

SEQ ID NO: 50486 - DNA, 15 bp, Homo sapiens
attcacacaacttaa

SEQ ID NO: 50487 - DNA, 15 bp, Homo sapiens
cattcacacaactta

SEQ ID NO: 50488 - DNA, 15 bp, Homo sapiens
acattcacacaactt

SEQ ID NO: 50489 - DNA, 15 bp, Homo sapiens
aacattcacacaact

SEQ ID NO: 50490 - DNA, 15 bp, Homo sapiens
taacattcacacaac

SEQ ID NO: 50491 - DNA, 15 bp, Homo sapiens
ataacattcacacaa

SEQ ID NO: 50492 - DNA, 15 bp, Homo sapiens
gataacattcacaca

SEQ ID NO: 50493 - DNA, 15 bp, Homo sapiens
tgataacattcacac

SEQ ID NO: 50494 - DNA, 15 bp, Homo sapiens
ttgataacattcaca

SEQ ID NO: 50495 - DNA, 15 bp, Homo sapiens
tttgataacattcac

SEQ ID NO: 50496 - DNA, 15 bp, Homo sapiens
atttgataacattca

SEQ ID NO: 50497 - DNA, 15 bp, Homo sapiens
aatttgataacattc

SEQ ID NO: 50498 - DNA, 15 bp, Homo sapiens
taatttgataacatt

SEQ ID NO: 50499 - DNA, 15 bp, Homo sapiens
ttaatttgataacat

SEQ ID NO: 50500 - DNA, 15 bp, Homo sapiens
cttaatttgataaca

SEQ ID NO: 50501 - DNA, 15 bp, Homo sapiens
tcttaatttgataac

SEQ ID NO: 50502 - DNA, 15 bp, Homo sapiens
atcttaatttgataa

SEQ ID NO: 50503 - DNA, 15 bp, Homo sapiens
tatcttaatttgata

SEQ ID NO: 50504 - DNA, 15 bp, Homo sapiens
attatcttaatttga

SEQ ID NO: 50505 - DNA, 15 bp, Homo sapiens
aattatcttaatttg

SEQ ID NO: 50506 - DNA, 15 bp, Homo sapiens
aaattatcttaattt

SEQ ID NO: 50507 - DNA, 15 bp, Homo sapiens
taaattatcttaatt

SEQ ID NO: 50508 - DNA, 15 bp, Homo sapiens
ttaaattatcttaat

SEQ ID NO: 50509 - DNA, 15 bp, Homo sapiens
attaaattatcttaa

SEQ ID NO: 50510 - DNA, 15 bp, Homo sapiens
tattaaattatctta

SEQ ID NO: 50511 - DNA, 15 bp, Homo sapiens
gtattaaattatctt

SEQ ID NO: 50512 - DNA, 15 bp, Homo sapiens
agtattaaattatct

SEQ ID NO: 50513 - DNA, 15 bp, Homo sapiens
aagtattaaattatc

SEQ ID NO: 50514 - DNA, 15 bp, Homo sapiens
taagtattaaattat

SEQ ID NO: 50515 - DNA, 15 bp, Homo sapiens
ataagtattaaatta

SEQ ID NO: 50516 - DNA, 15 bp, Homo sapiens
aataagtattaaatt

SEQ ID NO: 50517 - DNA, 15 bp, Homo sapiens
aaataagtattaaat

SEQ ID NO: 50518 - DNA, 15 bp, Homo sapiens
taaataagtattaaa

SEQ ID NO: 50519 - DNA, 15 bp, Homo sapiens
ataaataagtattaa

SEQ ID NO: 50520 - DNA, 15 bp, Homo sapiens
cataaataagtatta

SEQ ID NO: 50521 - DNA, 15 bp, Homo sapiens
tcataaataagtatt

SEQ ID NO: 50522 - DNA, 15 bp, Homo sapiens
gtcataaataagtat

SEQ ID NO: 50523 - DNA, 15 bp, Homo sapiens
ggtcataaataagta

SEQ ID NO: 50524 - DNA, 15 bp, Homo sapiens
aggtcataaataagt

SEQ ID NO: 50525 - DNA, 15 bp, Homo sapiens
aaggtcataaataag

SEQ ID NO: 50526 - DNA, 15 bp, Homo sapiens
aaaggtcataaataa

SEQ ID NO: 50527 - DNA, 15 bp, Homo sapiens
gaaaggtcataaata

SEQ ID NO: 50528 - DNA, 15 bp, Homo sapiens
agaaaggtcataaat

SEQ ID NO: 50529 - DNA, 15 bp, Homo sapiens
tagaaaggtcataaa

SEQ ID NO: 50530 - DNA, 15 bp, Homo sapiens
atagaaaggtcataa

SEQ ID NO: 50531 - DNA, 15 bp, Homo sapiens
tatagaaaggtcata

SEQ ID NO: 50532 - DNA, 15 bp, Homo sapiens
atatagaaaggtcat

SEQ ID NO: 50533 - DNA, 15 bp, Homo sapiens
aatatagaaaggtca

SEQ ID NO: 50534 - DNA, 15 bp, Homo sapiens
aaatatagaaaggtc

SEQ ID NO: 50535 - DNA, 15 bp, Homo sapiens
aaaatatagaaaggt

SEQ ID NO: 50536 - DNA, 15 bp, Homo sapiens
aaaaatatagaaagg

SEQ ID NO: 50537 - DNA, 15 bp, Homo sapiens
aaaaaatatagaaag

SEQ ID NO: 50538 - DNA, 15 bp, Homo sapiens
aaaaaaatatagaaa

SEQ ID NO: 50539 - DNA, 15 bp, Homo sapiens
taaaaaaatatagaa

SEQ ID NO: 50540 - DNA, 15 bp, Homo sapiens
ataaaaaaatataga

SEQ ID NO: 50541 - DNA, 15 bp, Homo sapiens
aataaaaaaatatag

SEQ ID NO: 50542 - DNA, 15 bp, Homo sapiens
gaataaaaaaatata

SEQ ID NO: 50543 - DNA, 15 bp, Homo sapiens
tgaataaaaaaatat

SEQ ID NO: 50544 - DNA, 15 bp, Homo sapiens
atgaataaaaaaata

SEQ ID NO: 50545 - DNA, 15 bp, Homo sapiens
catgaataaaaaaat

SEQ ID NO: 50546 - DNA, 15 bp, Homo sapiens
ccatgaataaaaaaa

SEQ ID NO: 50547 - DNA, 15 bp, Homo sapiens
cccatgaataaaaaa

SEQ ID NO: 50548 - DNA, 15 bp, Homo sapiens
tcccatgaataaaaa

SEQ ID NO: 50549 - DNA, 15 bp, Homo sapiens
atcccatgaataaaa

SEQ ID NO: 50550 - DNA, 15 bp, Homo sapiens
aatcccatgaataaa

SEQ ID NO: 50551 - DNA, 15 bp, Homo sapiens
taatcccatgaataa

SEQ ID NO: 50552 - DNA, 15 bp, Homo sapiens
ttaatcccatgaata

SEQ ID NO: 50553 - DNA, 15 bp, Homo sapiens
tttaatcccatgaat

SEQ ID NO: 50554 - DNA, 15 bp, Homo sapiens
atttaatcccatgaa

SEQ ID NO: 50555 - DNA, 15 bp, Homo sapiens
catttaatcccatga

SEQ ID NO: 50556 - DNA, 15 bp, Homo sapiens
tcatttaatcccatg

SEQ ID NO: 50557 - DNA, 15 bp, Homo sapiens
ttcatttaatcccat

SEQ ID NO: 50558 - DNA, 15 bp, Homo sapiens
tttcatttaatccca

SEQ ID NO: 50559 - DNA, 15 bp, Homo sapiens
gtttcatttaatccc

SEQ ID NO: 50560 - DNA, 15 bp, Homo sapiens
agtttcatttaatcc

SEQ ID NO: 50561 - DNA, 15 bp, Homo sapiens
cagtttcatttaatc

SEQ ID NO: 50562 - DNA, 15 bp, Homo sapiens
gcagtttcatttaat

SEQ ID NO: 50563 - DNA, 15 bp, Homo sapiens
tgcagtttcatttaa

SEQ ID NO: 50564 - DNA, 15 bp, Homo sapiens
atgcagtttcattta

SEQ ID NO: 50565 - DNA, 15 bp, Homo sapiens
tatgcagtttcattt

SEQ ID NO: 50566 - DNA, 15 bp, Homo sapiens
atatgcagtttcatt

SEQ ID NO: 50567 - DNA, 15 bp, Homo sapiens
tatatgcagtttcat

SEQ ID NO: 50568 - DNA, 15 bp, Homo sapiens
ttatatgcagtttca

SEQ ID NO: 50569 - DNA, 15 bp, Homo sapiens
gttatatgcagtttc

SEQ ID NO: 50570 - DNA, 15 bp, Homo sapiens
tgttatatgcagttt

SEQ ID NO: 50571 - DNA, 15 bp, Homo sapiens
ttgttatatgcagtt

SEQ ID NO: 50572 - DNA, 15 bp, Homo sapiens
cttgttatatgcagt

SEQ ID NO: 50573 - DNA, 15 bp, Homo sapiens
tcttgttatatgcag

SEQ ID NO: 50574 - DNA, 15 bp, Homo sapiens
atcttgttatatgca

SEQ ID NO: 50575 - DNA, 15 bp, Homo sapiens
aatcttgttatatgc

SEQ ID NO: 50576 - DNA, 15 bp, Homo sapiens
aaatcttgttatatg

SEQ ID NO: 50577 - DNA, 15 bp, Homo sapiens
taaatcttgttatat

SEQ ID NO: 50578 - DNA, 15 bp, Homo sapiens
ataaatcttgttata

SEQ ID NO: 50579 - DNA, 15 bp, Homo sapiens
cataaatcttgttat

SEQ ID NO: 50580 - DNA, 15 bp, Homo sapiens
tcataaatcttgtta

SEQ ID NO: 50581 - DNA, 15 bp, Homo sapiens
ttcataaatcttgtt

SEQ ID NO: 50582 - DNA, 15 bp, Homo sapiens
tttcataaatcttgt

SEQ ID NO: 50583 - DNA, 15 bp, Homo sapiens
ttttcataaatcttg

SEQ ID NO: 50584 - DNA, 15 bp, Homo sapiens
attttcataaatctt

SEQ ID NO: 50585 - DNA, 15 bp, Homo sapiens
tattttcataaatct

SEQ ID NO: 50586 - DNA, 15 bp, Homo sapiens
ttattttcataaatc

SEQ ID NO: 50587 - DNA, 15 bp, Homo sapiens
tttattttcataaat

SEQ ID NO: 50588 - DNA, 15 bp, Homo sapiens
atttattttcataaa

SEQ ID NO: 50589 - DNA, 15 bp, Homo sapiens
gatttattttcataa

SEQ ID NO: 50590 - DNA, 15 bp, Homo sapiens
ggatttattttcata

SEQ ID NO: 50591 - DNA, 15 bp, Homo sapiens
aggatttattttcat

SEQ ID NO: 50592 - DNA, 15 bp, Homo sapiens
aaggatttattttca

SEQ ID NO: 50593 - DNA, 15 bp, Homo sapiens
aaaggatttattttc

SEQ ID NO: 50594 - DNA, 15 bp, Homo sapiens
aaaaggatttatttt

SEQ ID NO: 50595 - DNA, 15 bp, Homo sapiens
aaaaaggatttattt

SEQ ID NO: 50596 - DNA, 15 bp, Homo sapiens
taaaaaggatttatt

SEQ ID NO: 50597 - DNA, 15 bp, Homo sapiens
ttaaaaaggatttat

SEQ ID NO: 50598 - DNA, 15 bp, Homo sapiens
cttaaaaaggattta

SEQ ID NO: 50599 - DNA, 15 bp, Homo sapiens
ccttaaaaaggattt

SEQ ID NO: 50600 - DNA, 15 bp, Homo sapiens
accttaaaaaggatt

SEQ ID NO: 50601 - DNA, 15 bp, Homo sapiens
taccttaaaaaggat

SEQ ID NO: 50602 - DNA, 15 bp, Homo sapiens
ctaccttaaaaagga

SEQ ID NO: 50603 - DNA, 15 bp, Homo sapiens
actaccttaaaaagg

SEQ ID NO: 50604 - DNA, 15 bp, Homo sapiens
cactaccttaaaaag

SEQ ID NO: 50605 - DNA, 15 bp, Homo sapiens
ccactaccttaaaaa

SEQ ID NO: 50606 - DNA, 15 bp, Homo sapiens
cccactaccttaaaa

SEQ ID NO: 50607 - DNA, 15 bp, Homo sapiens
tcccactaccttaaa

SEQ ID NO: 50608 - DNA, 15 bp, Homo sapiens
gtcccactaccttaa

SEQ ID NO: 50609 - DNA, 15 bp, Homo sapiens
tgtcccactacctta

SEQ ID NO: 50610 - DNA, 15 bp, Homo sapiens
ttgtcccactacctt

SEQ ID NO: 50611 - DNA, 15 bp, Homo sapiens
tttgtcccactacct

SEQ ID NO: 50612 - DNA, 15 bp, Homo sapiens
atttgtcccactacc

SEQ ID NO: 50613 - DNA, 15 bp, Homo sapiens
tatttgtcccactac

SEQ ID NO: 50614 - DNA, 15 bp, Homo sapiens
ttatttgtcccacta

SEQ ID NO: 50615 - DNA, 15 bp, Homo sapiens
attatttgtcccact

SEQ ID NO: 50616 - DNA, 15 bp, Homo sapiens
aattatttgtcccac

SEQ ID NO: 50617 - DNA, 15 bp, Homo sapiens
caattatttgtccca

SEQ ID NO: 50618 - DNA, 15 bp, Homo sapiens
ccaattatttgtccc

SEQ ID NO: 50619 - DNA, 15 bp, Homo sapiens
tccaattatttgtcc

SEQ ID NO: 50620 - DNA, 15 bp, Homo sapiens
atccaattatttgtc

SEQ ID NO: 50621 - DNA, 15 bp, Homo sapiens
aatccaattatttgt

SEQ ID NO: 50622 - DNA, 15 bp, Homo sapiens
aaatccaattatttg

SEQ ID NO: 50623 - DNA, 15 bp, Homo sapiens
aaaatccaattattt

SEQ ID NO: 50624 - DNA, 15 bp, Homo sapiens
gaaaatccaattatt

SEQ ID NO: 50625 - DNA, 15 bp, Homo sapiens
ggaaaatccaattat

SEQ ID NO: 50626 - DNA, 15 bp, Homo sapiens
tggaaaatccaatta

SEQ ID NO: 50627 - DNA, 15 bp, Homo sapiens
ttggaaaatccaatt

SEQ ID NO: 50628 - DNA, 15 bp, Homo sapiens
tttggaaaatccaat

SEQ ID NO: 50629 - DNA, 15 bp, Homo sapiens
atttggaaaatccaa

SEQ ID NO: 50630 - DNA, 15 bp, Homo sapiens
catttggaaaatcca

SEQ ID NO: 50631 - DNA, 15 bp, Homo sapiens
gcatttggaaaatcc

SEQ ID NO: 50632 - DNA, 15 bp, Homo sapiens
ggcatttggaaaatc

SEQ ID NO: 50633 - DNA, 15 bp, Homo sapiens
gggcatttggaaaat

SEQ ID NO: 50634 - DNA, 15 bp, Homo sapiens
agggcatttggaaaa

SEQ ID NO: 50635 - DNA, 15 bp, Homo sapiens
tagggcatttggaaa

SEQ ID NO: 50636 - DNA, 15 bp, Homo sapiens
ttagggcatttggaa

SEQ ID NO: 50637 - DNA, 15 bp, Homo sapiens
tttagggcatttgga

SEQ ID NO: 50638 - DNA, 15 bp, Homo sapiens
gtttagggcatttgg

SEQ ID NO: 50639 - DNA, 15 bp, Homo sapiens
tgtttagggcatttg

SEQ ID NO: 50640 - DNA, 15 bp, Homo sapiens
gtgtttagggcattt

SEQ ID NO: 50641 - DNA, 15 bp, Homo sapiens
agtgtttagggcatt

SEQ ID NO: 50642 - DNA, 15 bp, Homo sapiens
cagtgtttagggcat

SEQ ID NO: 50643 - DNA, 15 bp, Homo sapiens
tcagtgtttagggca

SEQ ID NO: 50644 - DNA, 15 bp, Homo sapiens
atcagtgtttagggc

SEQ ID NO: 50645 - DNA, 15 bp, Homo sapiens
aatcagtgtttaggg

SEQ ID NO: 50646 - DNA, 15 bp, Homo sapiens
aaatcagtgtttagg

SEQ ID NO: 50647 - DNA, 15 bp, Homo sapiens
aaaatcagtgtttag

SEQ ID NO: 50648 - DNA, 15 bp, Homo sapiens
aaaaatcagtgttta

SEQ ID NO: 50649 - DNA, 15 bp, Homo sapiens
taaaaatcagtgttt

SEQ ID NO: 50650 - DNA, 15 bp, Homo sapiens
ttaaaaatcagtgtt

SEQ ID NO: 50651 - DNA, 15 bp, Homo sapiens
attaaaaatcagtgt

SEQ ID NO: 50652 - DNA, 15 bp, Homo sapiens
tattaaaaatcagtg

SEQ ID NO: 50653 - DNA, 15 bp, Homo sapiens
atattaaaaatcagt

SEQ ID NO: 50654 - DNA, 15 bp, Homo sapiens
aatattaaaaatcag

SEQ ID NO: 50655 - DNA, 15 bp, Homo sapiens
taatattaaaaatca

SEQ ID NO: 50656 - DNA, 15 bp, Homo sapiens
ttaatattaaaaatc

SEQ ID NO: 50657 - DNA, 15 bp, Homo sapiens
tttaatattaaaaat

SEQ ID NO: 50658 - DNA, 15 bp, Homo sapiens
atttaatattaaaaa

SEQ ID NO: 50659 - DNA, 15 bp, Homo sapiens
aatttaatattaaaa

SEQ ID NO: 50660 - DNA, 15 bp, Homo sapiens
gaatttaatattaaa

SEQ ID NO: 50661 - DNA, 15 bp, Homo sapiens
tgaatttaatattaa

SEQ ID NO: 50662 - DNA, 15 bp, Homo sapiens
atgaatttaatatta

SEQ ID NO: 50663 - DNA, 15 bp, Homo sapiens
aatgaatttaatatt

SEQ ID NO: 50664 - DNA, 15 bp, Homo sapiens
aaatgaatttaatat

SEQ ID NO: 50665 - DNA, 15 bp, Homo sapiens
aaaatgaatttaata

SEQ ID NO: 50666 - DNA, 15 bp, Homo sapiens
caaaatgaatttaat

SEQ ID NO: 50667 - DNA, 15 bp, Homo sapiens
ccaaaatgaatttaa

SEQ ID NO: 50668 - DNA, 15 bp, Homo sapiens
accaaaatgaattta

SEQ ID NO: 50669 - DNA, 15 bp, Homo sapiens
caccaaaatgaattt

SEQ ID NO: 50670 - DNA, 15 bp, Homo sapiens
tcaccaaaatgaatt

SEQ ID NO: 50671 - DNA, 15 bp, Homo sapiens
ctcaccaaaatgaat

SEQ ID NO: 50672 - DNA, 15 bp, Homo sapiens
cctcaccaaaatgaa

SEQ ID NO: 50673 - DNA, 15 bp, Homo sapiens
gcctcaccaaaatga

SEQ ID NO: 50674 - DNA, 15 bp, Homo sapiens
agcctcaccaaaatg

SEQ ID NO: 50675 - DNA, 15 bp, Homo sapiens
cagcctcaccaaaat

SEQ ID NO: 50676 - DNA, 15 bp, Homo sapiens
ccagcctcaccaaaa

SEQ ID NO: 50677 - DNA, 15 bp, Homo sapiens
accagcctcaccaaa

SEQ ID NO: 50678 - DNA, 15 bp, Homo sapiens
taccagcctcaccaa

SEQ ID NO: 50679 - DNA, 15 bp, Homo sapiens
ataccagcctcacca

SEQ ID NO: 50680 - DNA, 15 bp, Homo sapiens
tataccagcctcacc

SEQ ID NO: 50681 - DNA, 15 bp, Homo sapiens
atataccagcctcac

SEQ ID NO: 50682 - DNA, 15 bp, Homo sapiens
gatataccagcctca

SEQ ID NO: 50683 - DNA, 15 bp, Homo sapiens
ggatataccagcctc

SEQ ID NO: 50684 - DNA, 15 bp, Homo sapiens
gggatataccagcct

SEQ ID NO: 50685 - DNA, 15 bp, Homo sapiens
ggggatataccagcc

SEQ ID NO: 50686 - DNA, 15 bp, Homo sapiens
gggggatataccagc

SEQ ID NO: 50687 - DNA, 15 bp, Homo sapiens
ggggggatataccag

SEQ ID NO: 50688 - DNA, 15 bp, Homo sapiens
aggggggatatacca

SEQ ID NO: 50689 - DNA, 15 bp, Homo sapiens
aaggggggatatacc

SEQ ID NO: 50690 - DNA, 15 bp, Homo sapiens
gaaggggggatatac

SEQ ID NO: 50691 - DNA, 15 bp, Homo sapiens
tgaaggggggatata

SEQ ID NO: 50692 - DNA, 15 bp, Homo sapiens
ctgaaggggggatat

SEQ ID NO: 50693 - DNA, 15 bp, Homo sapiens
cctgaaggggggata

SEQ ID NO: 50694 - DNA, 15 bp, Homo sapiens
acctgaaggggggat

SEQ ID NO: 50695 - DNA, 15 bp, Homo sapiens
aacctgaagggggga

SEQ ID NO: 50696 - DNA, 15 bp, Homo sapiens
caacctgaagggggg

SEQ ID NO: 50697 - DNA, 15 bp, Homo sapiens
tcaacctgaaggggg

SEQ ID NO: 50698 - DNA, 15 bp, Homo sapiens
atcaacctgaagggg

SEQ ID NO: 50699 - DNA, 15 bp, Homo sapiens
catcaacctgaaggg

SEQ ID NO: 50700 - DNA, 15 bp, Homo sapiens
acatcaacctgaagg

SEQ ID NO: 50701 - DNA, 15 bp, Homo sapiens
cacatcaacctgaag

SEQ ID NO: 50702 - DNA, 15 bp, Homo sapiens
acacatcaacctgaa

SEQ ID NO: 50703 - DNA, 15 bp, Homo sapiens
cacacatcaacctga

SEQ ID NO: 50704 - DNA, 15 bp, Homo sapiens
ccacacatcaacctg

SEQ ID NO: 50705 - DNA, 15 bp, Homo sapiens
accacacatcaacct

SEQ ID NO: 50706 - DNA, 15 bp, Homo sapiens
caccacacatcaacc

SEQ ID NO: 50707 - DNA, 15 bp, Homo sapiens
ccaccacacatcaac

SEQ ID NO: 50708 - DNA, 15 bp, Homo sapiens
accaccacacatcaa

SEQ ID NO: 50709 - DNA, 15 bp, Homo sapiens
taccaccacacatca

SEQ ID NO: 50710 - DNA, 15 bp, Homo sapiens
ctaccaccacacatc

SEQ ID NO: 50711 - DNA, 15 bp, Homo sapiens
gctaccaccacacat

SEQ ID NO: 50712 - DNA, 15 bp, Homo sapiens
ggctaccaccacaca

SEQ ID NO: 50713 - DNA, 15 bp, Homo sapiens
aggctaccaccacac

SEQ ID NO: 50714 - DNA, 15 bp, Homo sapiens
aaggctaccaccaca

SEQ ID NO: 50715 - DNA, 15 bp, Homo sapiens
taaggctaccaccac

SEQ ID NO: 50716 - DNA, 15 bp, Homo sapiens
ataaggctaccacca

SEQ ID NO: 50717 - DNA, 15 bp, Homo sapiens
tataaggctaccacc

SEQ ID NO: 50718 - DNA, 15 bp, Homo sapiens
atataaggctaccac

SEQ ID NO: 50719 - DNA, 15 bp, Homo sapiens
aatataaggctacca

SEQ ID NO: 50720 - DNA, 15 bp, Homo sapiens
gaatataaggctacc

SEQ ID NO: 50721 - DNA, 15 bp, Homo sapiens
agaatataaggctac

SEQ ID NO: 50722 - DNA, 15 bp, Homo sapiens
cagaatataaggcta

SEQ ID NO: 50723 - DNA, 15 bp, Homo sapiens
tcagaatataaggct

SEQ ID NO: 50724 - DNA, 15 bp, Homo sapiens
ctcagaatataaggc

SEQ ID NO: 50725 - DNA, 15 bp, Homo sapiens
actcagaatataagg

SEQ ID NO: 50726 - DNA, 15 bp, Homo sapiens
tactcagaatataag

SEQ ID NO: 50727 - DNA, 15 bp, Homo sapiens
atactcagaatataa

SEQ ID NO: 50728 - DNA, 15 bp, Homo sapiens
tatactcagaatata

SEQ ID NO: 50729 - DNA, 15 bp, Homo sapiens
ttatactcagaatat

SEQ ID NO: 50730 - DNA, 15 bp, Homo sapiens
attatactcagaata

SEQ ID NO: 50731 - DNA, 15 bp, Homo sapiens
gattatactcagaat

SEQ ID NO: 50732 - DNA, 15 bp, Homo sapiens
agattatactcagaa

SEQ ID NO: 50733 - DNA, 15 bp, Homo sapiens
gagattatactcaga

SEQ ID NO: 50734 - DNA, 15 bp, Homo sapiens
agagattatactcag

SEQ ID NO: 50735 - DNA, 15 bp, Homo sapiens
tagagattatactca

SEQ ID NO: 50736 - DNA, 15 bp, Homo sapiens
gtagagattatactc

SEQ ID NO: 50737 - DNA, 15 bp, Homo sapiens
agtagagattatact

SEQ ID NO: 50738 - DNA, 15 bp, Homo sapiens
cagtagagattatac

SEQ ID NO: 50739 - DNA, 15 bp, Homo sapiens
acagtagagattata

SEQ ID NO: 50740 - DNA, 15 bp, Homo sapiens
cacagtagagattat

SEQ ID NO: 50741 - DNA, 15 bp, Homo sapiens
acacagtagagatta

SEQ ID NO: 50742 - DNA, 15 bp, Homo sapiens
gacacagtagagatt

SEQ ID NO: 50743 - DNA, 15 bp, Homo sapiens
ggacacagtagagat

SEQ ID NO: 50744 - DNA, 15 bp, Homo sapiens
gggacacagtagaga

SEQ ID NO: 50745 - DNA, 15 bp, Homo sapiens
agggacacagtagag

SEQ ID NO: 50746 - DNA, 15 bp, Homo sapiens
gagggacacagtaga

SEQ ID NO: 50747 - DNA, 15 bp, Homo sapiens
agagggacacagtag

SEQ ID NO: 50748 - DNA, 15 bp, Homo sapiens
aagagggacacagta

SEQ ID NO: 50749 - DNA, 15 bp, Homo sapiens
aaagagggacacagt

SEQ ID NO: 50750 - DNA, 15 bp, Homo sapiens
caaagagggacacag

SEQ ID NO: 50751 - DNA, 15 bp, Homo sapiens
tcaaagagggacaca

SEQ ID NO: 50752 - DNA, 15 bp, Homo sapiens
atcaaagagggacac

SEQ ID NO: 50753 - DNA, 15 bp, Homo sapiens
tatcaaagagggaca

SEQ ID NO: 50754 - DNA, 15 bp, Homo sapiens
atatcaaagagggac

SEQ ID NO: 50755 - DNA, 15 bp, Homo sapiens
catatcaaagaggga

SEQ ID NO: 50756 - DNA, 15 bp, Homo sapiens
tcatatcaaagaggg

SEQ ID NO: 50757 - DNA, 15 bp, Homo sapiens
ttcatatcaaagagg

SEQ ID NO: 50758 - DNA, 15 bp, Homo sapiens
cttcatatcaaagag

SEQ ID NO: 50759 - DNA, 15 bp, Homo sapiens
tcttcatatcaaaga

SEQ ID NO: 50760 - DNA, 15 bp, Homo sapiens
atcttcatatcaaag

SEQ ID NO: 50761 - DNA, 15 bp, Homo sapiens
catcttcatatcaaa

SEQ ID NO: 50762 - DNA, 15 bp, Homo sapiens
ccatcttcatatcaa

SEQ ID NO: 50763 - DNA, 15 bp, Homo sapiens
accatcttcatatca

SEQ ID NO: 50764 - DNA, 15 bp, Homo sapiens
taccatcttcatatc

SEQ ID NO: 50765 - DNA, 15 bp, Homo sapiens
ttaccatcttcatat

SEQ ID NO: 50766 - DNA, 15 bp, Homo sapiens
tttaccatcttcata

SEQ ID NO: 50767 - DNA, 15 bp, Homo sapiens
ctttaccatcttcat

SEQ ID NO: 50768 - DNA, 15 bp, Homo sapiens
cctttaccatcttca

SEQ ID NO: 50769 - DNA, 15 bp, Homo sapiens
ccctttaccatcttc

SEQ ID NO: 50770 - DNA, 15 bp, Homo sapiens
accctttaccatctt

SEQ ID NO: 50771 - DNA, 15 bp, Homo sapiens
gaccctttaccatct

SEQ ID NO: 50772 - DNA, 15 bp, Homo sapiens
tgaccctttaccatc

SEQ ID NO: 50773 - DNA, 15 bp, Homo sapiens
atgaccctttaccat

SEQ ID NO: 50774 - DNA, 15 bp, Homo sapiens
aatgaccctttacca

SEQ ID NO: 50775 - DNA, 15 bp, Homo sapiens
gaatgaccctttacc

SEQ ID NO: 50776 - DNA, 15 bp, Homo sapiens
tgaatgaccctttac

SEQ ID NO: 50777 - DNA, 15 bp, Homo sapiens
gtgaatgacccttta

SEQ ID NO: 50778 - DNA, 15 bp, Homo sapiens
agtgaatgacccttt

SEQ ID NO: 50779 - DNA, 15 bp, Homo sapiens
cagtgaatgaccctt

SEQ ID NO: 50780 - DNA, 15 bp, Homo sapiens
acagtgaatgaccct

SEQ ID NO: 50781 - DNA, 15 bp, Homo sapiens
cacagtgaatgaccc

SEQ ID NO: 50782 - DNA, 15 bp, Homo sapiens
acacagtgaatgacc

SEQ ID NO: 50783 - DNA, 15 bp, Homo sapiens
tacacagtgaatgac

SEQ ID NO: 50784 - DNA, 15 bp, Homo sapiens
ttacacagtgaatga

SEQ ID NO: 50785 - DNA, 15 bp, Homo sapiens
cttacacagtgaatg

SEQ ID NO: 50786 - DNA, 15 bp, Homo sapiens
gcttacacagtgaat

SEQ ID NO: 50787 - DNA, 15 bp, Homo sapiens
tgcttacacagtgaa

SEQ ID NO: 50788 - DNA, 15 bp, Homo sapiens
ttgcttacacagtga

SEQ ID NO: 50789 - DNA, 15 bp, Homo sapiens
cttgcttacacagtg

SEQ ID NO: 50790 - DNA, 15 bp, Homo sapiens
acttgcttacacagt

SEQ ID NO: 50791 - DNA, 15 bp, Homo sapiens
aacttgcttacacag

SEQ ID NO: 50792 - DNA, 15 bp, Homo sapiens
gaacttgcttacaca

SEQ ID NO: 50793 - DNA, 15 bp, Homo sapiens
agaacttgcttacac

SEQ ID NO: 50794 - DNA, 15 bp, Homo sapiens
gagaacttgcttaca

SEQ ID NO: 50795 - DNA, 15 bp, Homo sapiens
agagaacttgcttac

SEQ ID NO: 50796 - DNA, 15 bp, Homo sapiens
aagagaacttgctta

SEQ ID NO: 50797 - DNA, 15 bp, Homo sapiens
caagagaacttgctt

SEQ ID NO: 50798 - DNA, 15 bp, Homo sapiens
ccaagagaacttgct

SEQ ID NO: 50799 - DNA, 15 bp, Homo sapiens
accaagagaacttgc

SEQ ID NO: 50800 - DNA, 15 bp, Homo sapiens
aaccaagagaacttg

SEQ ID NO: 50801 - DNA, 15 bp, Homo sapiens
taaccaagagaactt

SEQ ID NO: 50802 - DNA, 15 bp, Homo sapiens
ttaaccaagagaact

SEQ ID NO: 50803 - DNA, 15 bp, Homo sapiens
attaaccaagagaac

SEQ ID NO: 50804 - DNA, 15 bp, Homo sapiens
tattaaccaagagaa

SEQ ID NO: 50805 - DNA, 15 bp, Homo sapiens
ttattaaccaagaga

SEQ ID NO: 50806 - DNA, 15 bp, Homo sapiens
tttattaaccaagag

SEQ ID NO: 50807 - DNA, 15 bp, Homo sapiens
atttattaaccaaga

SEQ ID NO: 50808 - DNA, 15 bp, Homo sapiens
catttattaaccaag

SEQ ID NO: 50809 - DNA, 15 bp, Homo sapiens
ccatttattaaccaa

SEQ ID NO: 50810 - DNA, 15 bp, Homo sapiens
gccatttattaacca

SEQ ID NO: 50811 - DNA, 15 bp, Homo sapiens
agccatttattaacc

SEQ ID NO: 50812 - DNA, 15 bp, Homo sapiens
aagccatttattaac

SEQ ID NO: 50813 - DNA, 15 bp, Homo sapiens
taagccatttattaa

SEQ ID NO: 50814 - DNA, 15 bp, Homo sapiens
ataagccatttatta

SEQ ID NO: 50815 - DNA, 15 bp, Homo sapiens
cataagccatttatt

SEQ ID NO: 50816 - DNA, 15 bp, Homo sapiens
acataagccatttat

SEQ ID NO: 50817 - DNA, 15 bp, Homo sapiens
cacataagccattta

SEQ ID NO: 50818 - DNA, 15 bp, Homo sapiens
ccacataagccattt

SEQ ID NO: 50819 - DNA, 15 bp, Homo sapiens
gccacataagccatt

SEQ ID NO: 50820 - DNA, 15 bp, Homo sapiens
ggccacataagccat

SEQ ID NO: 50821 - DNA, 15 bp, Homo sapiens
aggccacataagcca

SEQ ID NO: 50822 - DNA, 15 bp, Homo sapiens
aaggccacataagcc

SEQ ID NO: 50823 - DNA, 15 bp, Homo sapiens
caaggccacataagc

SEQ ID NO: 50824 - DNA, 15 bp, Homo sapiens
tcaaggccacataag

SEQ ID NO: 50825 - DNA, 15 bp, Homo sapiens
atcaaggccacataa

SEQ ID NO: 50826 - DNA, 15 bp, Homo sapiens
gatcaaggccacata

SEQ ID NO: 50827 - DNA, 15 bp, Homo sapiens
tgatcaaggccacat

SEQ ID NO: 50828 - DNA, 15 bp, Homo sapiens
ctgatcaaggccaca

SEQ ID NO: 50829 - DNA, 15 bp, Homo sapiens
tctgatcaaggccac

SEQ ID NO: 50830 - DNA, 15 bp, Homo sapiens
atctgatcaaggcca

SEQ ID NO: 50831 - DNA, 15 bp, Homo sapiens
tatctgatcaaggcc

SEQ ID NO: 50832 - DNA, 15 bp, Homo sapiens
ttatctgatcaaggc

SEQ ID NO: 50833 - DNA, 15 bp, Homo sapiens
attatctgatcaagg

SEQ ID NO: 50834 - DNA, 15 bp, Homo sapiens
tattatctgatcaag

SEQ ID NO: 50835 - DNA, 15 bp, Homo sapiens
atattatctgatcaa

SEQ ID NO: 50836 - DNA, 15 bp, Homo sapiens
tatattatctgatca

SEQ ID NO: 50837 - DNA, 15 bp, Homo sapiens
ttatattatctgatc

SEQ ID NO: 50838 - DNA, 15 bp, Homo sapiens
tttatattatctgat

SEQ ID NO: 50839 - DNA, 15 bp, Homo sapiens
ctttatattatctga

SEQ ID NO: 50840 - DNA, 15 bp, Homo sapiens
gctttatattatctg

SEQ ID NO: 50841 - DNA, 15 bp, Homo sapiens
agctttatattatct

SEQ ID NO: 50842 - DNA, 15 bp, Homo sapiens
aagctttatattatc

SEQ ID NO: 50843 - DNA, 15 bp, Homo sapiens
caagctttatattat

SEQ ID NO: 50844 - DNA, 15 bp, Homo sapiens
tcaagctttatatta

SEQ ID NO: 50845 - DNA, 15 bp, Homo sapiens
ttcaagctttatatt

SEQ ID NO: 50846 - DNA, 15 bp, Homo sapiens
tttcaagctttatat

SEQ ID NO: 50847 - DNA, 15 bp, Homo sapiens
atttcaagctttata

SEQ ID NO: 50848 - DNA, 15 bp, Homo sapiens
tatttcaagctttat

SEQ ID NO: 50849 - DNA, 15 bp, Homo sapiens
ctatttcaagcttta

SEQ ID NO: 50850 - DNA, 15 bp, Homo sapiens
cctatttcaagcttt

SEQ ID NO: 50851 - DNA, 15 bp, Homo sapiens
ccctatttcaagctt

SEQ ID NO: 50852 - DNA, 15 bp, Homo sapiens
tccctatttcaagct

SEQ ID NO: 50853 - DNA, 15 bp, Homo sapiens
atccctatttcaagc

SEQ ID NO: 50854 - DNA, 15 bp, Homo sapiens
gatccctatttcaag

SEQ ID NO: 50855 - DNA, 15 bp, Homo sapiens
cgatccctatttcaa

SEQ ID NO: 50856 - DNA, 15 bp, Homo sapiens
acgatccctatttca

SEQ ID NO: 50857 - DNA, 15 bp, Homo sapiens
aacgatccctatttc

SEQ ID NO: 50858 - DNA, 15 bp, Homo sapiens
caacgatccctattt

SEQ ID NO: 50859 - DNA, 15 bp, Homo sapiens
gcaacgatccctatt

SEQ ID NO: 50860 - DNA, 15 bp, Homo sapiens
agcaacgatccctat

SEQ ID NO: 50861 - DNA, 15 bp, Homo sapiens
cagcaacgatcccta

SEQ ID NO: 50862 - DNA, 15 bp, Homo sapiens
acagcaacgatccct

SEQ ID NO: 50863 - DNA, 15 bp, Homo sapiens
gacagcaacgatccc

SEQ ID NO: 50864 - DNA, 15 bp, Homo sapiens
agacagcaacgatcc

SEQ ID NO: 50865 - DNA, 15 bp, Homo sapiens
aagacagcaacgatc

SEQ ID NO: 50866 - DNA, 15 bp, Homo sapiens
aaagacagcaacgat

SEQ ID NO: 50867 - DNA, 15 bp, Homo sapiens
caaagacagcaacga

SEQ ID NO: 50868 - DNA, 15 bp, Homo sapiens
gcaaagacagcaacg

SEQ ID NO: 50869 - DNA, 15 bp, Homo sapiens
agcaaagacagcaac

SEQ ID NO: 50870 - DNA, 15 bp, Homo sapiens
cagcaaagacagcaa

SEQ ID NO: 50871 - DNA, 15 bp, Homo sapiens
acagcaaagacagca

SEQ ID NO: 50872 - DNA, 15 bp, Homo sapiens
gacagcaaagacagc

SEQ ID NO: 50873 - DNA, 15 bp, Homo sapiens
ggacagcaaagacag

SEQ ID NO: 50874 - DNA, 15 bp, Homo sapiens
aggacagcaaagaca

SEQ ID NO: 50875 - DNA, 15 bp, Homo sapiens
aaggacagcaaagac

SEQ ID NO: 50876 - DNA, 15 bp, Homo sapiens
aaaggacagcaaaga

SEQ ID NO: 50877 - DNA, 15 bp, Homo sapiens
gaaaggacagcaaag

SEQ ID NO: 50878 - DNA, 15 bp, Homo sapiens
agaaaggacagcaaa

SEQ ID NO: 50879 - DNA, 15 bp, Homo sapiens
aagaaaggacagcaa

SEQ ID NO: 50880 - DNA, 15 bp, Homo sapiens
caagaaaggacagca

SEQ ID NO: 50881 - DNA, 15 bp, Homo sapiens
tcaagaaaggacagc

SEQ ID NO: 50882 - DNA, 15 bp, Homo sapiens
ttcaagaaaggacag

SEQ ID NO: 50883 - DNA, 15 bp, Homo sapiens
cttcaagaaaggaca

SEQ ID NO: 50884 - DNA, 15 bp, Homo sapiens
ccttcaagaaaggac

SEQ ID NO: 50885 - DNA, 15 bp, Homo sapiens
tccttcaagaaagga

SEQ ID NO: 50886 - DNA, 15 bp, Homo sapiens
ttccttcaagaaagg

SEQ ID NO: 50887 - DNA, 15 bp, Homo sapiens
cttccttcaagaaag

SEQ ID NO: 50888 - DNA, 15 bp, Homo sapiens
ccttccttcaagaaa

SEQ ID NO: 50889 - DNA, 15 bp, Homo sapiens
accttccttcaagaa

SEQ ID NO: 50890 - DNA, 15 bp, Homo sapiens
gaccttccttcaaga

SEQ ID NO: 50891 - DNA, 15 bp, Homo sapiens
tgaccttccttcaag

SEQ ID NO: 50892 - DNA, 15 bp, Homo sapiens
gtgaccttccttcaa

SEQ ID NO: 50893 - DNA, 15 bp, Homo sapiens
ggtgaccttccttca

SEQ ID NO: 50894 - DNA, 15 bp, Homo sapiens
aggtgaccttccttc

SEQ ID NO: 50895 - DNA, 15 bp, Homo sapiens
gaggtgaccttcctt

SEQ ID NO: 50896 - DNA, 15 bp, Homo sapiens
agaggtgaccttcct

SEQ ID NO: 50897 - DNA, 15 bp, Homo sapiens
cagaggtgaccttcc

SEQ ID NO: 50898 - DNA, 15 bp, Homo sapiens
tcagaggtgaccttc

SEQ ID NO: 50899 - DNA, 15 bp, Homo sapiens
ctcagaggtgacctt

SEQ ID NO: 50900 - DNA, 15 bp, Homo sapiens
gctcagaggtgacct

SEQ ID NO: 50901 - DNA, 15 bp, Homo sapiens
tgctcagaggtgacc

SEQ ID NO: 50902 - DNA, 15 bp, Homo sapiens
gtgctcagaggtgac

SEQ ID NO: 50903 - DNA, 15 bp, Homo sapiens
ggtgctcagaggtga

SEQ ID NO: 50904 - DNA, 15 bp, Homo sapiens
tggtgctcagaggtg

SEQ ID NO: 50905 - DNA, 15 bp, Homo sapiens
atggtgctcagaggt

SEQ ID NO: 50906 - DNA, 15 bp, Homo sapiens
aatggtgctcagagg

SEQ ID NO: 50907 - DNA, 15 bp, Homo sapiens
taatggtgctcagag

SEQ ID NO: 50908 - DNA, 15 bp, Homo sapiens
ttaatggtgctcaga

SEQ ID NO: 50909 - DNA, 15 bp, Homo sapiens
attaatggtgctcag

SEQ ID NO: 50910 - DNA, 15 bp, Homo sapiens
tattaatggtgctca

SEQ ID NO: 50911 - DNA, 15 bp, Homo sapiens
atattaatggtgctc

SEQ ID NO: 50912 - DNA, 15 bp, Homo sapiens
gatattaatggtgct

SEQ ID NO: 50913 - DNA, 15 bp, Homo sapiens
tgatattaatggtgc

SEQ ID NO: 50914 - DNA, 15 bp, Homo sapiens
ttgatattaatggtg

SEQ ID NO: 50915 - DNA, 15 bp, Homo sapiens
cttgatattaatggt

SEQ ID NO: 50916 - DNA, 15 bp, Homo sapiens
ccttgatattaatgg

SEQ ID NO: 50917 - DNA, 15 bp, Homo sapiens
tccttgatattaatg

SEQ ID NO: 50918 - DNA, 15 bp, Homo sapiens
ctccttgatattaat

SEQ ID NO: 50919 - DNA, 15 bp, Homo sapiens
actccttgatattaa

SEQ ID NO: 50920 - DNA, 15 bp, Homo sapiens
aactccttgatatta

SEQ ID NO: 50921 - DNA, 15 bp, Homo sapiens
aaactccttgatatt

SEQ ID NO: 50922 - DNA, 15 bp, Homo sapiens
gaaactccttgatat

SEQ ID NO: 50923 - DNA, 15 bp, Homo sapiens
agaaactccttgata

SEQ ID NO: 50924 - DNA, 15 bp, Homo sapiens
aagaaactccttgat

SEQ ID NO: 50925 - DNA, 15 bp, Homo sapiens
taagaaactccttga

SEQ ID NO: 50926 - DNA, 15 bp, Homo sapiens
ttaagaaactccttg

SEQ ID NO: 50927 - DNA, 15 bp, Homo sapiens
tttaagaaactcctt

SEQ ID NO: 50928 - DNA, 15 bp, Homo sapiens
gtttaagaaactcct

SEQ ID NO: 50929 - DNA, 15 bp, Homo sapiens
tgtttaagaaactcc

SEQ ID NO: 50930 - DNA, 15 bp, Homo sapiens
ctgtttaagaaactc

SEQ ID NO: 50931 - DNA, 15 bp, Homo sapiens
gctgtttaagaaact

SEQ ID NO: 50932 - DNA, 15 bp, Homo sapiens
tgctgtttaagaaac

SEQ ID NO: 50933 - DNA, 15 bp, Homo sapiens
ctgctgtttaagaaa

SEQ ID NO: 50934 - DNA, 15 bp, Homo sapiens
actgctgtttaagaa

SEQ ID NO: 50935 - DNA, 15 bp, Homo sapiens
aactgctgtttaaga

SEQ ID NO: 50936 - DNA, 15 bp, Homo sapiens
aaactgctgtttaag

SEQ ID NO: 50937 - DNA, 15 bp, Homo sapiens
aaaactgctgtttaa

SEQ ID NO: 50938 - DNA, 15 bp, Homo sapiens
caaaactgctgttta

SEQ ID NO: 50939 - DNA, 15 bp, Homo sapiens
acaaaactgctgttt

SEQ ID NO: 50940 - DNA, 15 bp, Homo sapiens
aacaaaactgctgtt

SEQ ID NO: 50941 - DNA, 15 bp, Homo sapiens
aaacaaaactgctgt

SEQ ID NO: 50942 - DNA, 15 bp, Homo sapiens
aaaacaaaactgctg

SEQ ID NO: 50943 - DNA, 15 bp, Homo sapiens
gaaaacaaaactgct

SEQ ID NO: 50944 - DNA, 15 bp, Homo sapiens
agaaaacaaaactgc

SEQ ID NO: 50945 - DNA, 15 bp, Homo sapiens
tagaaaacaaaactg

SEQ ID NO: 50946 - DNA, 15 bp, Homo sapiens
atagaaaacaaaact

SEQ ID NO: 50947 - DNA, 15 bp, Homo sapiens
tatagaaaacaaaac

SEQ ID NO: 50948 - DNA, 15 bp, Homo sapiens
gtatagaaaacaaaa

SEQ ID NO: 50949 - DNA, 15 bp, Homo sapiens
ggtatagaaaacaaa

SEQ ID NO: 50950 - DNA, 15 bp, Homo sapiens
tggtatagaaaacaa

SEQ ID NO: 50951 - DNA, 15 bp, Homo sapiens
gtggtatagaaaaca

SEQ ID NO: 50952 - DNA, 15 bp, Homo sapiens
agtggtatagaaaac

SEQ ID NO: 50953 - DNA, 15 bp, Homo sapiens
aagtggtatagaaaa

SEQ ID NO: 50954 - DNA, 15 bp, Homo sapiens
caagtggtatagaaa

SEQ ID NO: 50955 - DNA, 15 bp, Homo sapiens
gcaagtggtatagaa

SEQ ID NO: 50956 - DNA, 15 bp, Homo sapiens
agcaagtggtataga

SEQ ID NO: 50957 - DNA, 15 bp, Homo sapiens
gagcaagtggtatag

SEQ ID NO: 50958 - DNA, 15 bp, Homo sapiens
ggagcaagtggtata

SEQ ID NO: 50959 - DNA, 15 bp, Homo sapiens
gggagcaagtggtat

SEQ ID NO: 50960 - DNA, 15 bp, Homo sapiens
agggagcaagtggta

SEQ ID NO: 50961 - DNA, 15 bp, Homo sapiens
aagggagcaagtggt

SEQ ID NO: 50962 - DNA, 15 bp, Homo sapiens
taagggagcaagtgg

SEQ ID NO: 50963 - DNA, 15 bp, Homo sapiens
ctaagggagcaagtg

SEQ ID NO: 50964 - DNA, 15 bp, Homo sapiens
actaagggagcaagt

SEQ ID NO: 50965 - DNA, 15 bp, Homo sapiens
cactaagggagcaag

SEQ ID NO: 50966 - DNA, 15 bp, Homo sapiens
acactaagggagcaa

SEQ ID NO: 50967 - DNA, 15 bp, Homo sapiens
gacactaagggagca

SEQ ID NO: 50968 - DNA, 15 bp, Homo sapiens
agacactaagggagc

SEQ ID NO: 50969 - DNA, 15 bp, Homo sapiens
aagacactaagggag

SEQ ID NO: 50970 - DNA, 15 bp, Homo sapiens
caagacactaaggga

SEQ ID NO: 50971 - DNA, 15 bp, Homo sapiens
ccaagacactaaggg

SEQ ID NO: 50972 - DNA, 15 bp, Homo sapiens
tccaagacactaagg

SEQ ID NO: 50973 - DNA, 15 bp, Homo sapiens
ctccaagacactaag

SEQ ID NO: 50974 - DNA, 15 bp, Homo sapiens
actccaagacactaa

SEQ ID NO: 50975 - DNA, 15 bp, Homo sapiens
aactccaagacacta

SEQ ID NO: 50976 - DNA, 15 bp, Homo sapiens
caactccaagacact

SEQ ID NO: 50977 - DNA, 15 bp, Homo sapiens
ccaactccaagacac

SEQ ID NO: 50978 - DNA, 15 bp, Homo sapiens
accaactccaagaca

SEQ ID NO: 50979 - DNA, 15 bp, Homo sapiens
gaccaactccaagac

SEQ ID NO: 50980 - DNA, 15 bp, Homo sapiens
agaccaactccaaga

SEQ ID NO: 50981 - DNA, 15 bp, Homo sapiens
gagaccaactccaag

SEQ ID NO: 50982 - DNA, 15 bp, Homo sapiens
ggagaccaactccaa

SEQ ID NO: 50983 - DNA, 15 bp, Homo sapiens
tggagaccaactcca

SEQ ID NO: 50984 - DNA, 15 bp, Homo sapiens
ttggagaccaactcc

SEQ ID NO: 50985 - DNA, 15 bp, Homo sapiens
attggagaccaactc

SEQ ID NO: 50986 - DNA, 15 bp, Homo sapiens
aattggagaccaact

SEQ ID NO: 50987 - DNA, 15 bp, Homo sapiens
taattggagaccaac

SEQ ID NO: 50988 - DNA, 15 bp, Homo sapiens
gtaattggagaccaa

SEQ ID NO: 50989 - DNA, 15 bp, Homo sapiens
ggtaattggagacca

SEQ ID NO: 50990 - DNA, 15 bp, Homo sapiens
aggtaattggagacc

SEQ ID NO: 50991 - DNA, 15 bp, Homo sapiens
aaggtaattggagac

SEQ ID NO: 50992 - DNA, 15 bp, Homo sapiens
aaaggtaattggaga

SEQ ID NO: 50993 - DNA, 15 bp, Homo sapiens
taaaggtaattggag

SEQ ID NO: 50994 - DNA, 15 bp, Homo sapiens
ataaaggtaattgga

SEQ ID NO: 50995 - DNA, 15 bp, Homo sapiens
cataaaggtaattgg

SEQ ID NO: 50996 - DNA, 15 bp, Homo sapiens
ccataaaggtaattg

SEQ ID NO: 50997 - DNA, 15 bp, Homo sapiens
tccataaaggtaatt

SEQ ID NO: 50998 - DNA, 15 bp, Homo sapiens
atccataaaggtaat

SEQ ID NO: 50999 - DNA, 15 bp, Homo sapiens
aatccataaaggtaa

SEQ ID NO: 51000 - DNA, 15 bp, Homo sapiens
aaatccataaaggta

SEQ ID NO: 51001 - DNA, 15 bp, Homo sapiens
caaatccataaaggt

SEQ ID NO: 51002 - DNA, 15 bp, Homo sapiens
acaaatccataaagg

SEQ ID NO: 51003 - DNA, 15 bp, Homo sapiens
tacaaatccataaag

SEQ ID NO: 51004 - DNA, 15 bp, Homo sapiens
ttacaaatccataaa

SEQ ID NO: 51005 - DNA, 15 bp, Homo sapiens
tttacaaatccataa

SEQ ID NO: 51006 - DNA, 15 bp, Homo sapiens
ttttacaaatccata

SEQ ID NO: 51007 - DNA, 15 bp, Homo sapiens
cttttacaaatccat

SEQ ID NO: 51008 - DNA, 15 bp, Homo sapiens
acttttacaaatcca

SEQ ID NO: 51009 - DNA, 15 bp, Homo sapiens
cacttttacaaatcc

SEQ ID NO: 51010 - DNA, 15 bp, Homo sapiens
gcacttttacaaatc

SEQ ID NO: 51011 - DNA, 15 bp, Homo sapiens
tgcacttttacaaat

SEQ ID NO: 51012 - DNA, 15 bp, Homo sapiens
atgcacttttacaaa

SEQ ID NO: 51013 - DNA, 15 bp, Homo sapiens
aatgcacttttacaa

SEQ ID NO: 51014 - DNA, 15 bp, Homo sapiens
aaatgcacttttaca

SEQ ID NO: 51015 - DNA, 15 bp, Homo sapiens
aaaatgcacttttac

SEQ ID NO: 51016 - DNA, 15 bp, Homo sapiens
aaaaatgcactttta

SEQ ID NO: 51017 - DNA, 15 bp, Homo sapiens
aaaaaatgcactttt

SEQ ID NO: 51018 - DNA, 15 bp, Homo sapiens
aaaaaaatgcacttt

SEQ ID NO: 51019 - DNA, 15 bp, Homo sapiens
aaaaaaaatgcactt

SEQ ID NO: 51020 - DNA, 15 bp, Homo sapiens
aaaaaaaaatgcact

SEQ ID NO: 51021 - DNA, 15 bp, Homo sapiens
aaaaaaaaaatgcac

SEQ ID NO: 51022 - DNA, 15 bp, Homo sapiens
aaaaaaaaaaatgca

SEQ ID NO: 51023 - DNA, 15 bp, Homo sapiens
gaaaaaaaaaaatgc

SEQ ID NO: 51024 - DNA, 15 bp, Homo sapiens
agaaaaaaaaaaatg

SEQ ID NO: 51025 - DNA, 15 bp, Homo sapiens
cagaaaaaaaaaaat

SEQ ID NO: 51026 - DNA, 15 bp, Homo sapiens
tcagaaaaaaaaaaa

SEQ ID NO: 51027 - DNA, 15 bp, Homo sapiens
ttcagaaaaaaaaaa

SEQ ID NO: 51028 - DNA, 15 bp, Homo sapiens
cttcagaaaaaaaaa

SEQ ID NO: 51029 - DNA, 15 bp, Homo sapiens
gcttcagaaaaaaaa

SEQ ID NO: 51030 - DNA, 15 bp, Homo sapiens
agcttcagaaaaaaa

SEQ ID NO: 51031 - DNA, 15 bp, Homo sapiens
cagcttcagaaaaaa

SEQ ID NO: 51032 - DNA, 15 bp, Homo sapiens
gcagcttcagaaaaa

SEQ ID NO: 51033 - DNA, 15 bp, Homo sapiens
agcagcttcagaaaa

SEQ ID NO: 51034 - DNA, 15 bp, Homo sapiens
cagcagcttcagaaa

SEQ ID NO: 51035 - DNA, 15 bp, Homo sapiens
gcagcagcttcagaa

SEQ ID NO: 51036 - DNA, 15 bp, Homo sapiens
agcagcagcttcaga

SEQ ID NO: 51037 - DNA, 15 bp, Homo sapiens
tagcagcagcttcag

SEQ ID NO: 51038 - DNA, 15 bp, Homo sapiens
atagcagcagcttca

SEQ ID NO: 51039 - DNA, 15 bp, Homo sapiens
tatagcagcagcttc

SEQ ID NO: 51040 - DNA, 15 bp, Homo sapiens
atatagcagcagctt

SEQ ID NO: 51041 - DNA, 15 bp, Homo sapiens
aatatagcagcagct

SEQ ID NO: 51042 - DNA, 15 bp, Homo sapiens
aaatatagcagcagc

SEQ ID NO: 51043 - DNA, 15 bp, Homo sapiens
taaatatagcagcag

SEQ ID NO: 51044 - DNA, 15 bp, Homo sapiens
ataaatatagcagca

SEQ ID NO: 51045 - DNA, 15 bp, Homo sapiens
aataaatatagcagc

SEQ ID NO: 51046 - DNA, 15 bp, Homo sapiens
gaataaatatagcag

SEQ ID NO: 51047 - DNA, 15 bp, Homo sapiens
agaataaatatagca

SEQ ID NO: 51048 - DNA, 15 bp, Homo sapiens
cagaataaatatagc

SEQ ID NO: 51049 - DNA, 15 bp, Homo sapiens
ccagaataaatatag

SEQ ID NO: 51050 - DNA, 15 bp, Homo sapiens
cccagaataaatata

SEQ ID NO: 51051 - DNA, 15 bp, Homo sapiens
tcccagaataaatat

SEQ ID NO: 51052 - DNA, 15 bp, Homo sapiens
ttcccagaataaata

SEQ ID NO: 51053 - DNA, 15 bp, Homo sapiens
attcccagaataaat

SEQ ID NO: 51054 - DNA, 15 bp, Homo sapiens
cattcccagaataaa

SEQ ID NO: 51055 - DNA, 15 bp, Homo sapiens
tcattcccagaataa

SEQ ID NO: 51056 - DNA, 15 bp, Homo sapiens
gtcattcccagaata

SEQ ID NO: 51057 - DNA, 15 bp, Homo sapiens
ggtcattcccagaat

SEQ ID NO: 51058 - DNA, 15 bp, Homo sapiens
aggtcattcccagaa

SEQ ID NO: 51059 - DNA, 15 bp, Homo sapiens
aaggtcattcccaga

SEQ ID NO: 51060 - DNA, 15 bp, Homo sapiens
aaaggtcattcccag

SEQ ID NO: 51061 - DNA, 15 bp, Homo sapiens
aaaaggtcattccca

SEQ ID NO: 51062 - DNA, 15 bp, Homo sapiens
taaaaggtcattccc

SEQ ID NO: 51063 - DNA, 15 bp, Homo sapiens
ttaaaaggtcattcc

SEQ ID NO: 51064 - DNA, 15 bp, Homo sapiens
attaaaaggtcattc

SEQ ID NO: 51065 - DNA, 15 bp, Homo sapiens
aattaaaaggtcatt

SEQ ID NO: 51066 - DNA, 15 bp, Homo sapiens
taattaaaaggtcat

SEQ ID NO: 51067 - DNA, 15 bp, Homo sapiens
gtaattaaaaggtca

SEQ ID NO: 51068 - DNA, 15 bp, Homo sapiens
tgtaattaaaaggtc

SEQ ID NO: 51069 - DNA, 15 bp, Homo sapiens
ttgtaattaaaaggt

SEQ ID NO: 51070 - DNA, 15 bp, Homo sapiens
tttgtaattaaaagg

SEQ ID NO: 51071 - DNA, 15 bp, Homo sapiens
gtttgtaattaaaag

SEQ ID NO: 51072 - DNA, 15 bp, Homo sapiens
agtttgtaattaaaa

SEQ ID NO: 51073 - DNA, 15 bp, Homo sapiens
gagtttgtaattaaa

SEQ ID NO: 51074 - DNA, 15 bp, Homo sapiens
agagtttgtaattaa

SEQ ID NO: 51075 - DNA, 15 bp, Homo sapiens
gagagtttgtaatta

SEQ ID NO: 51076 - DNA, 15 bp, Homo sapiens
ggagagtttgtaatt

SEQ ID NO: 51077 - DNA, 15 bp, Homo sapiens
aggagagtttgtaat

SEQ ID NO: 51078 - DNA, 15 bp, Homo sapiens
aaggagagtttgtaa

SEQ ID NO: 51079 - DNA, 15 bp, Homo sapiens
gaaggagagtttgta

SEQ ID NO: 51080 - DNA, 15 bp, Homo sapiens
ggaaggagagtttgt

SEQ ID NO: 51081 - DNA, 15 bp, Homo sapiens
tggaaggagagtttg

SEQ ID NO: 51082 - DNA, 15 bp, Homo sapiens
gtggaaggagagttt

SEQ ID NO: 51083 - DNA, 15 bp, Homo sapiens
tgtggaaggagagtt

SEQ ID NO: 51084 - DNA, 15 bp, Homo sapiens
ttgtggaaggagagt

SEQ ID NO: 51085 - DNA, 15 bp, Homo sapiens
cttgtggaaggagag

SEQ ID NO: 51086 - DNA, 15 bp, Homo sapiens
ccttgtggaaggaga

SEQ ID NO: 51087 - DNA, 15 bp, Homo sapiens
cccttgtggaaggag

SEQ ID NO: 51088 - DNA, 15 bp, Homo sapiens
ccccttgtggaagga

SEQ ID NO: 51089 - DNA, 15 bp, Homo sapiens
cccccttgtggaagg

SEQ ID NO: 51090 - DNA, 15 bp, Homo sapiens
acccccttgtggaag

SEQ ID NO: 51091 - DNA, 15 bp, Homo sapiens
tacccccttgtggaa

SEQ ID NO: 51092 - DNA, 15 bp, Homo sapiens
ttacccccttgtgga

SEQ ID NO: 51093 - DNA, 15 bp, Homo sapiens
cttacccccttgtgg

SEQ ID NO: 51094 - DNA, 15 bp, Homo sapiens
ccttacccccttgtg

SEQ ID NO: 51095 - DNA, 15 bp, Homo sapiens
tccttacccccttgt

SEQ ID NO: 51096 - DNA, 15 bp, Homo sapiens
gtccttacccccttg

SEQ ID NO: 51097 - DNA, 15 bp, Homo sapiens
ggtccttaccccctt

SEQ ID NO: 51098 - DNA, 15 bp, Homo sapiens
cggtccttaccccct

SEQ ID NO: 51099 - DNA, 15 bp, Homo sapiens
tcggtccttaccccc

SEQ ID NO: 51100 - DNA, 15 bp, Homo sapiens
ttcggtccttacccc

SEQ ID NO: 51101 - DNA, 15 bp, Homo sapiens
cttcggtccttaccc

SEQ ID NO: 51102 - DNA, 15 bp, Homo sapiens
tcttcggtccttacc

SEQ ID NO: 51103 - DNA, 15 bp, Homo sapiens
gtcttcggtccttac

SEQ ID NO: 51104 - DNA, 15 bp, Homo sapiens
ggtcttcggtcctta

SEQ ID NO: 51105 - DNA, 15 bp, Homo sapiens
tggtcttcggtcctt

SEQ ID NO: 51106 - DNA, 15 bp, Homo sapiens
gtggtcttcggtcct

SEQ ID NO: 51107 - DNA, 15 bp, Homo sapiens
tgtggtcttcggtcc

SEQ ID NO: 51108 - DNA, 15 bp, Homo sapiens
ttgtggtcttcggtc

SEQ ID NO: 51109 - DNA, 15 bp, Homo sapiens
tttgtggtcttcggt

SEQ ID NO: 51110 - DNA, 15 bp, Homo sapiens
gtttgtggtcttcgg

SEQ ID NO: 51111 - DNA, 15 bp, Homo sapiens
agtttgtggtcttcg

SEQ ID NO: 51112 - DNA, 15 bp, Homo sapiens
cagtttgtggtcttc

SEQ ID NO: 51113 - DNA, 15 bp, Homo sapiens
ccagtttgtggtctt

SEQ ID NO: 51114 - DNA, 15 bp, Homo sapiens
cccagtttgtggtct

SEQ ID NO: 51115 - DNA, 15 bp, Homo sapiens
acccagtttgtggtc

SEQ ID NO: 51116 - DNA, 15 bp, Homo sapiens
cacccagtttgtggt

SEQ ID NO: 51117 - DNA, 15 bp, Homo sapiens
tcacccagtttgtgg

SEQ ID NO: 51118 - DNA, 15 bp, Homo sapiens
ttcacccagtttgtg

SEQ ID NO: 51119 - DNA, 15 bp, Homo sapiens
cttcacccagtttgt

SEQ ID NO: 51120 - DNA, 15 bp, Homo sapiens
acttcacccagtttg

SEQ ID NO: 51121 - DNA, 15 bp, Homo sapiens
cacttcacccagttt

SEQ ID NO: 51122 - DNA, 15 bp, Homo sapiens
ccacttcacccagtt

SEQ ID NO: 51123 - DNA, 15 bp, Homo sapiens
accacttcacccagt

SEQ ID NO: 51124 - DNA, 15 bp, Homo sapiens
taccacttcacccag

SEQ ID NO: 51125 - DNA, 15 bp, Homo sapiens
ctaccacttcaccca

SEQ ID NO: 51126 - DNA, 15 bp, Homo sapiens
cctaccacttcaccc

SEQ ID NO: 51127 - DNA, 15 bp, Homo sapiens
gcctaccacttcacc

SEQ ID NO: 51128 - DNA, 15 bp, Homo sapiens
cgcctaccacttcac

SEQ ID NO: 51129 - DNA, 15 bp, Homo sapiens
tcgcctaccacttca

SEQ ID NO: 51130 - DNA, 15 bp, Homo sapiens
ttcgcctaccacttc

SEQ ID NO: 51131 - DNA, 15 bp, Homo sapiens
gttcgcctaccactt

SEQ ID NO: 51132 - DNA, 15 bp, Homo sapiens
ggttcgcctaccact

SEQ ID NO: 51133 - DNA, 15 bp, Homo sapiens
aggttcgcctaccac

SEQ ID NO: 51134 - DNA, 15 bp, Homo sapiens
gaggttcgcctacca

SEQ ID NO: 51135 - DNA, 15 bp, Homo sapiens
agaggttcgcctacc

SEQ ID NO: 51136 - DNA, 15 bp, Homo sapiens
tagaggttcgcctac

SEQ ID NO: 51137 - DNA, 15 bp, Homo sapiens
ttagaggttcgccta

SEQ ID NO: 51138 - DNA, 15 bp, Homo sapiens
attagaggttcgcct

SEQ ID NO: 51139 - DNA, 15 bp, Homo sapiens
cattagaggttcgcc

SEQ ID NO: 51140 - DNA, 15 bp, Homo sapiens
tcattagaggttcgc

SEQ ID NO: 51141 - DNA, 15 bp, Homo sapiens
atcattagaggttcg

SEQ ID NO: 51142 - DNA, 15 bp, Homo sapiens
gatcattagaggttc

SEQ ID NO: 51143 - DNA, 15 bp, Homo sapiens
ggatcattagaggtt

SEQ ID NO: 51144 - DNA, 15 bp, Homo sapiens
aggatcattagaggt

SEQ ID NO: 51145 - DNA, 15 bp, Homo sapiens
taggatcattagagg

SEQ ID NO: 51146 - DNA, 15 bp, Homo sapiens
ctaggatcattagag

SEQ ID NO: 51147 - DNA, 15 bp, Homo sapiens
gctaggatcattaga

SEQ ID NO: 51148 - DNA, 15 bp, Homo sapiens
tgctaggatcattag

SEQ ID NO: 51149 - DNA, 15 bp, Homo sapiens
ctgctaggatcatta

SEQ ID NO: 51150 - DNA, 15 bp, Homo sapiens
tctgctaggatcatt

SEQ ID NO: 51151 - DNA, 15 bp, Homo sapiens
ctctgctaggatcat

SEQ ID NO: 51152 - DNA, 15 bp, Homo sapiens
cctctgctaggatca

SEQ ID NO: 51153 - DNA, 15 bp, Homo sapiens
acctctgctaggatc

SEQ ID NO: 51154 - DNA, 15 bp, Homo sapiens
aacctctgctaggat

SEQ ID NO: 51155 - DNA, 15 bp, Homo sapiens
gaacctctgctagga

SEQ ID NO: 51156 - DNA, 15 bp, Homo sapiens
cgaacctctgctagg

SEQ ID NO: 51157 - DNA, 15 bp, Homo sapiens
acgaacctctgctag

SEQ ID NO: 51158 - DNA, 15 bp, Homo sapiens
cacgaacctctgcta

SEQ ID NO: 51159 - DNA, 15 bp, Homo sapiens
tcacgaacctctgct

SEQ ID NO: 51160 - DNA, 15 bp, Homo sapiens
ctcacgaacctctgc

SEQ ID NO: 51161 - DNA, 15 bp, Homo sapiens
gctcacgaacctctg

SEQ ID NO: 51162 - DNA, 15 bp, Homo sapiens
tgctcacgaacctct

SEQ ID NO: 51163 - DNA, 15 bp, Homo sapiens
ctgctcacgaacctc

SEQ ID NO: 51164 - DNA, 15 bp, Homo sapiens
cctgctcacgaacct

SEQ ID NO: 51165 - DNA, 15 bp, Homo sapiens
acctgctcacgaacc

SEQ ID NO: 51166 - DNA, 15 bp, Homo sapiens
gacctgctcacgaac

SEQ ID NO: 51167 - DNA, 15 bp, Homo sapiens
agacctgctcacgaa

SEQ ID NO: 51168 - DNA, 15 bp, Homo sapiens
cagacctgctcacga

SEQ ID NO: 51169 - DNA, 15 bp, Homo sapiens
acagacctgctcacg

SEQ ID NO: 51170 - DNA, 15 bp, Homo sapiens
tacagacctgctcac

SEQ ID NO: 51171 - DNA, 15 bp, Homo sapiens
atacagacctgctca

SEQ ID NO: 51172 - DNA, 15 bp, Homo sapiens
aatacagacctgctc

SEQ ID NO: 51173 - DNA, 15 bp, Homo sapiens
aaatacagacctgct

SEQ ID NO: 51174 - DNA, 15 bp, Homo sapiens
taaatacagacctgc

SEQ ID NO: 51175 - DNA, 15 bp, Homo sapiens
ttaaatacagacctg

SEQ ID NO: 51176 - DNA, 15 bp, Homo sapiens
attaaatacagacct

SEQ ID NO: 51177 - DNA, 15 bp, Homo sapiens
cattaaatacagacc

SEQ ID NO: 51178 - DNA, 15 bp, Homo sapiens
acattaaatacagac

SEQ ID NO: 51179 - DNA, 15 bp, Homo sapiens
cacattaaatacaga

SEQ ID NO: 51180 - DNA, 15 bp, Homo sapiens
ccacattaaatacag

SEQ ID NO: 51181 - DNA, 15 bp, Homo sapiens
tccacattaaataca

SEQ ID NO: 51182 - DNA, 15 bp, Homo sapiens
ttccacattaaatac

SEQ ID NO: 51183 - DNA, 15 bp, Homo sapiens
gttccacattaaata

SEQ ID NO: 51184 - DNA, 15 bp, Homo sapiens
agttccacattaaat

SEQ ID NO: 51185 - DNA, 15 bp, Homo sapiens
cagttccacattaaa

SEQ ID NO: 51186 - DNA, 15 bp, Homo sapiens
tcagttccacattaa

SEQ ID NO: 51187 - DNA, 15 bp, Homo sapiens
gtcagttccacatta

SEQ ID NO: 51188 - DNA, 15 bp, Homo sapiens
tgtcagttccacatt

SEQ ID NO: 51189 - DNA, 15 bp, Homo sapiens
gtgtcagttccacat

SEQ ID NO: 51190 - DNA, 15 bp, Homo sapiens
agtgtcagttccaca

SEQ ID NO: 51191 - DNA, 15 bp, Homo sapiens
cagtgtcagttccac

SEQ ID NO: 51192 - DNA, 15 bp, Homo sapiens
ccagtgtcagttcca

SEQ ID NO: 51193 - DNA, 15 bp, Homo sapiens
tccagtgtcagttcc

SEQ ID NO: 51194 - DNA, 15 bp, Homo sapiens
ctccagtgtcagttc

SEQ ID NO: 51195 - DNA, 15 bp, Homo sapiens
cctccagtgtcagtt

SEQ ID NO: 51196 - DNA, 15 bp, Homo sapiens
ccctccagtgtcagt

SEQ ID NO: 51197 - DNA, 15 bp, Homo sapiens
gccctccagtgtcag

SEQ ID NO: 51198 - DNA, 15 bp, Homo sapiens
ggccctccagtgtca

SEQ ID NO: 51199 - DNA, 15 bp, Homo sapiens
tggccctccagtgtc

SEQ ID NO: 51200 - DNA, 15 bp, Homo sapiens
ttggccctccagtgt

SEQ ID NO: 51201 - DNA, 15 bp, Homo sapiens
cttggccctccagtg

SEQ ID NO: 51202 - DNA, 15 bp, Homo sapiens
gcttggccctccagt

SEQ ID NO: 51203 - DNA, 15 bp, Homo sapiens
tgcttggccctccag

SEQ ID NO: 51204 - DNA, 15 bp, Homo sapiens
gtgcttggccctcca

SEQ ID NO: 51205 - DNA, 15 bp, Homo sapiens
tgtgcttggccctcc

SEQ ID NO: 51206 - DNA, 15 bp, Homo sapiens
gtgtgcttggccctc

SEQ ID NO: 51207 - DNA, 15 bp, Homo sapiens
ggtgtgcttggccct

SEQ ID NO: 51208 - DNA, 15 bp, Homo sapiens
aggtgtgcttggccc

SEQ ID NO: 51209 - DNA, 15 bp, Homo sapiens
caggtgtgcttggcc

SEQ ID NO: 51210 - DNA, 15 bp, Homo sapiens
ccaggtgtgcttggc

SEQ ID NO: 51211 - DNA, 15 bp, Homo sapiens
cccaggtgtgcttgg

SEQ ID NO: 51212 - DNA, 15 bp, Homo sapiens
gcccaggtgtgcttg

SEQ ID NO: 51213 - DNA, 15 bp, Homo sapiens
agcccaggtgtgctt

SEQ ID NO: 51214 - DNA, 15 bp, Homo sapiens
aagcccaggtgtgct

SEQ ID NO: 51215 - DNA, 15 bp, Homo sapiens
gaagcccaggtgtgc

SEQ ID NO: 51216 - DNA, 15 bp, Homo sapiens
ggaagcccaggtgtg

SEQ ID NO: 51217 - DNA, 15 bp, Homo sapiens
aggaagcccaggtgt

SEQ ID NO: 51218 - DNA, 15 bp, Homo sapiens
gaggaagcccaggtg

SEQ ID NO: 51219 - DNA, 15 bp, Homo sapiens
ggaggaagcccaggt

SEQ ID NO: 51220 - DNA, 15 bp, Homo sapiens
tggaggaagcccagg

SEQ ID NO: 51221 - DNA, 15 bp, Homo sapiens
atggaggaagcccag

SEQ ID NO: 51222 - DNA, 15 bp, Homo sapiens
aatggaggaagccca

SEQ ID NO: 51223 - DNA, 15 bp, Homo sapiens
taatggaggaagccc

SEQ ID NO: 51224 - DNA, 15 bp, Homo sapiens
ataatggaggaagcc

SEQ ID NO: 51225 - DNA, 15 bp, Homo sapiens
aataatggaggaagc

SEQ ID NO: 51226 - DNA, 15 bp, Homo sapiens
taataatggaggaag

SEQ ID NO: 51227 - DNA, 15 bp, Homo sapiens
ataataatggaggaa

SEQ ID NO: 51228 - DNA, 15 bp, Homo sapiens
aataataatggagga

SEQ ID NO: 51229 - DNA, 15 bp, Homo sapiens
aaataataatggagg

SEQ ID NO: 51230 - DNA, 15 bp, Homo sapiens
aaaataataatggag

SEQ ID NO: 51231 - DNA, 15 bp, Homo sapiens
caaaataataatgga

SEQ ID NO: 51232 - DNA, 15 bp, Homo sapiens
gcaaaataataatgg

SEQ ID NO: 51233 - DNA, 15 bp, Homo sapiens
agcaaaataataatg

SEQ ID NO: 51234 - DNA, 15 bp, Homo sapiens
cagcaaaataataat

SEQ ID NO: 51235 - DNA, 15 bp, Homo sapiens
gcagcaaaataataa

SEQ ID NO: 51236 - DNA, 15 bp, Homo sapiens
agcagcaaaataata

SEQ ID NO: 51237 - DNA, 15 bp, Homo sapiens
gagcagcaaaataat

SEQ ID NO: 51238 - DNA, 15 bp, Homo sapiens
agagcagcaaaataa

SEQ ID NO: 51239 - DNA, 15 bp, Homo sapiens
cagagcagcaaaata

SEQ ID NO: 51240 - DNA, 15 bp, Homo sapiens
tcagagcagcaaaat

SEQ ID NO: 51241 - DNA, 15 bp, Homo sapiens
atcagagcagcaaaa

SEQ ID NO: 51242 - DNA, 15 bp, Homo sapiens
catcagagcagcaaa

SEQ ID NO: 51243 - DNA, 15 bp, Homo sapiens
acatcagagcagcaa

SEQ ID NO: 51244 - DNA, 15 bp, Homo sapiens
cacatcagagcagca

SEQ ID NO: 51245 - DNA, 15 bp, Homo sapiens
ccacatcagagcagc

SEQ ID NO: 51246 - DNA, 15 bp, Homo sapiens
cccacatcagagcag

SEQ ID NO: 51247 - DNA, 15 bp, Homo sapiens
tcccacatcagagca

SEQ ID NO: 51248 - DNA, 15 bp, Homo sapiens
ctcccacatcagagc

SEQ ID NO: 51249 - DNA, 15 bp, Homo sapiens
cctcccacatcagag

SEQ ID NO: 51250 - DNA, 15 bp, Homo sapiens
gcctcccacatcaga

SEQ ID NO: 51251 - DNA, 15 bp, Homo sapiens
tgcctcccacatcag

SEQ ID NO: 51252 - DNA, 15 bp, Homo sapiens
ctgcctcccacatca

SEQ ID NO: 51253 - DNA, 15 bp, Homo sapiens
gctgcctcccacatc

SEQ ID NO: 51254 - DNA, 15 bp, Homo sapiens
ggctgcctcccacat

SEQ ID NO: 51255 - DNA, 15 bp, Homo sapiens
gggctgcctcccaca

SEQ ID NO: 51256 - DNA, 15 bp, Homo sapiens
tgggctgcctcccac

SEQ ID NO: 51257 - DNA, 15 bp, Homo sapiens
ctgggctgcctccca

SEQ ID NO: 51258 - DNA, 15 bp, Homo sapiens
gctgggctgcctccc

SEQ ID NO: 51259 - DNA, 15 bp, Homo sapiens
tgctgggctgcctcc

SEQ ID NO: 51260 - DNA, 15 bp, Homo sapiens
ctgctgggctgcctc

SEQ ID NO: 51261 - DNA, 15 bp, Homo sapiens
actgctgggctgcct

SEQ ID NO: 51262 - DNA, 15 bp, Homo sapiens
tactgctgggctgcc

SEQ ID NO: 51263 - DNA, 15 bp, Homo sapiens
atactgctgggctgc

SEQ ID NO: 51264 - DNA, 15 bp, Homo sapiens
tatactgctgggctg

SEQ ID NO: 51265 - DNA, 15 bp, Homo sapiens
ttatactgctgggct

SEQ ID NO: 51266 - DNA, 15 bp, Homo sapiens
tttatactgctgggc

SEQ ID NO: 51267 - DNA, 15 bp, Homo sapiens
ttttatactgctggg

SEQ ID NO: 51268 - DNA, 15 bp, Homo sapiens
cttttatactgctgg

SEQ ID NO: 51269 - DNA, 15 bp, Homo sapiens
ccttttatactgctg

SEQ ID NO: 51270 - DNA, 15 bp, Homo sapiens
accttttatactgct

SEQ ID NO: 51271 - DNA, 15 bp, Homo sapiens
caccttttatactgc

SEQ ID NO: 51272 - DNA, 15 bp, Homo sapiens
ccaccttttatactg

SEQ ID NO: 51273 - DNA, 15 bp, Homo sapiens
gccaccttttatact

SEQ ID NO: 51274 - DNA, 15 bp, Homo sapiens
tgccaccttttatac

SEQ ID NO: 51275 - DNA, 15 bp, Homo sapiens
ttgccaccttttata

SEQ ID NO: 51276 - DNA, 15 bp, Homo sapiens
tttgccaccttttat

SEQ ID NO: 51277 - DNA, 15 bp, Homo sapiens
ctttgccacctttta

SEQ ID NO: 51278 - DNA, 15 bp, Homo sapiens
cctttgccacctttt

SEQ ID NO: 51279 - DNA, 15 bp, Homo sapiens
tcctttgccaccttt

SEQ ID NO: 51280 - DNA, 15 bp, Homo sapiens
ctcctttgccacctt

SEQ ID NO: 51281 - DNA, 15 bp, Homo sapiens
cctcctttgccacct

SEQ ID NO: 51282 - DNA, 15 bp, Homo sapiens
gcctcctttgccacc

SEQ ID NO: 51283 - DNA, 15 bp, Homo sapiens
tgcctcctttgccac

SEQ ID NO: 51284 - DNA, 15 bp, Homo sapiens
ctgcctcctttgcca

SEQ ID NO: 51285 - DNA, 15 bp, Homo sapiens
cctgcctcctttgcc

SEQ ID NO: 51286 - DNA, 15 bp, Homo sapiens
tcctgcctcctttgc

SEQ ID NO: 51287 - DNA, 15 bp, Homo sapiens
gtcctgcctcctttg

SEQ ID NO: 51288 - DNA, 15 bp, Homo sapiens
tgtcctgcctccttt

SEQ ID NO: 51289 - DNA, 15 bp, Homo sapiens
gtgtcctgcctcctt

SEQ ID NO: 51290 - DNA, 15 bp, Homo sapiens
tgtgtcctgcctcct

SEQ ID NO: 51291 - DNA, 15 bp, Homo sapiens
gtgtgtcctgcctcc

SEQ ID NO: 51292 - DNA, 15 bp, Homo sapiens
tgtgtgtcctgcctc

SEQ ID NO: 51293 - DNA, 15 bp, Homo sapiens
atgtgtgtcctgcct

SEQ ID NO: 51294 - DNA, 15 bp, Homo sapiens
tatgtgtgtcctgcc

SEQ ID NO: 51295 - DNA, 15 bp, Homo sapiens
atatgtgtgtcctgc

SEQ ID NO: 51296 - DNA, 15 bp, Homo sapiens
catatgtgtgtcctg

SEQ ID NO: 51297 - DNA, 15 bp, Homo sapiens
ccatatgtgtgtcct

SEQ ID NO: 51298 - DNA, 15 bp, Homo sapiens
tccatatgtgtgtcc

SEQ ID NO: 51299 - DNA, 15 bp, Homo sapiens
atccatatgtgtgtc

SEQ ID NO: 51300 - DNA, 15 bp, Homo sapiens
catccatatgtgtgt

SEQ ID NO: 51301 - DNA, 15 bp, Homo sapiens
ccatccatatgtgtg

SEQ ID NO: 51302 - DNA, 15 bp, Homo sapiens
tccatccatatgtgt

SEQ ID NO: 51303 - DNA, 15 bp, Homo sapiens
ctccatccatatgtg

SEQ ID NO: 51304 - DNA, 15 bp, Homo sapiens
gctccatccatatgt

SEQ ID NO: 51305 - DNA, 15 bp, Homo sapiens
ggctccatccatatg

SEQ ID NO: 51306 - DNA, 15 bp, Homo sapiens
tggctccatccatat

SEQ ID NO: 51307 - DNA, 15 bp, Homo sapiens
gtggctccatccata

SEQ ID NO: 51308 - DNA, 15 bp, Homo sapiens
tgtggctccatccat

SEQ ID NO: 51309 - DNA, 15 bp, Homo sapiens
gtgtggctccatcca

SEQ ID NO: 51310 - DNA, 15 bp, Homo sapiens
ggtgtggctccatcc

SEQ ID NO: 51311 - DNA, 15 bp, Homo sapiens
aggtgtggctccatc

SEQ ID NO: 51312 - DNA, 15 bp, Homo sapiens
aaggtgtggctccat

SEQ ID NO: 51313 - DNA, 15 bp, Homo sapiens
aaaggtgtggctcca

SEQ ID NO: 51314 - DNA, 15 bp, Homo sapiens
gaaaggtgtggctcc

SEQ ID NO: 51315 - DNA, 15 bp, Homo sapiens
agaaaggtgtggctc

SEQ ID NO: 51316 - DNA, 15 bp, Homo sapiens
cagaaaggtgtggct

SEQ ID NO: 51317 - DNA, 15 bp, Homo sapiens
gcagaaaggtgtggc

SEQ ID NO: 51318 - DNA, 15 bp, Homo sapiens
tgcagaaaggtgtgg

SEQ ID NO: 51319 - DNA, 15 bp, Homo sapiens
gtgcagaaaggtgtg

SEQ ID NO: 51320 - DNA, 15 bp, Homo sapiens
agtgcagaaaggtgt

SEQ ID NO: 51321 - DNA, 15 bp, Homo sapiens
cagtgcagaaaggtg

SEQ ID NO: 51322 - DNA, 15 bp, Homo sapiens
acagtgcagaaaggt

SEQ ID NO: 51323 - DNA, 15 bp, Homo sapiens
gacagtgcagaaagg

SEQ ID NO: 51324 - DNA, 15 bp, Homo sapiens
cgacagtgcagaaag

SEQ ID NO: 51325 - DNA, 15 bp, Homo sapiens
gcgacagtgcagaaa

SEQ ID NO: 51326 - DNA, 15 bp, Homo sapiens
tgcgacagtgcagaa

SEQ ID NO: 51327 - DNA, 15 bp, Homo sapiens
ctgcgacagtgcaga

SEQ ID NO: 51328 - DNA, 15 bp, Homo sapiens
tctgcgacagtgcag

SEQ ID NO: 51329 - DNA, 15 bp, Homo sapiens
atctgcgacagtgca

SEQ ID NO: 51330 - DNA, 15 bp, Homo sapiens
tatctgcgacagtgc

SEQ ID NO: 51331 - DNA, 15 bp, Homo sapiens
gtatctgcgacagtg

SEQ ID NO: 51332 - DNA, 15 bp, Homo sapiens
cgtatctgcgacagt

SEQ ID NO: 51333 - DNA, 15 bp, Homo sapiens
gcgtatctgcgacag

SEQ ID NO: 51334 - DNA, 15 bp, Homo sapiens
ggcgtatctgcgaca

SEQ ID NO: 51335 - DNA, 15 bp, Homo sapiens
aggcgtatctgcgac

SEQ ID NO: 51336 - DNA, 15 bp, Homo sapiens
aaggcgtatctgcga

SEQ ID NO: 51337 - DNA, 15 bp, Homo sapiens
caaggcgtatctgcg

SEQ ID NO: 51338 - DNA, 15 bp, Homo sapiens
ccaaggcgtatctgc

SEQ ID NO: 51339 - DNA, 15 bp, Homo sapiens
tccaaggcgtatctg

SEQ ID NO: 51340 - DNA, 15 bp, Homo sapiens
gtccaaggcgtatct

SEQ ID NO: 51341 - DNA, 15 bp, Homo sapiens
tgtccaaggcgtatc

SEQ ID NO: 51342 - DNA, 15 bp, Homo sapiens
ctgtccaaggcgtat

SEQ ID NO: 51343 - DNA, 15 bp, Homo sapiens
gctgtccaaggcgta

SEQ ID NO: 51344 - DNA, 15 bp, Homo sapiens
agctgtccaaggcgt

SEQ ID NO: 51345 - DNA, 15 bp, Homo sapiens
aagctgtccaaggcg

SEQ ID NO: 51346 - DNA, 15 bp, Homo sapiens
aaagctgtccaaggc

SEQ ID NO: 51347 - DNA, 15 bp, Homo sapiens
gaaagctgtccaagg

SEQ ID NO: 51348 - DNA, 15 bp, Homo sapiens
agaaagctgtccaag

SEQ ID NO: 51349 - DNA, 15 bp, Homo sapiens
cagaaagctgtccaa

SEQ ID NO: 51350 - DNA, 15 bp, Homo sapiens
tcagaaagctgtcca

SEQ ID NO: 51351 - DNA, 15 bp, Homo sapiens
ttcagaaagctgtcc

SEQ ID NO: 51352 - DNA, 15 bp, Homo sapiens
gttcagaaagctgtc

SEQ ID NO: 51353 - DNA, 15 bp, Homo sapiens
tgttcagaaagctgt

SEQ ID NO: 51354 - DNA, 15 bp, Homo sapiens
ttgttcagaaagctg

SEQ ID NO: 51355 - DNA, 15 bp, Homo sapiens
gttgttcagaaagct

SEQ ID NO: 51356 - DNA, 15 bp, Homo sapiens
agttgttcagaaagc

SEQ ID NO: 51357 - DNA, 15 bp, Homo sapiens
cagttgttcagaaag

SEQ ID NO: 51358 - DNA, 15 bp, Homo sapiens
tcagttgttcagaaa

SEQ ID NO: 51359 - DNA, 15 bp, Homo sapiens
atcagttgttcagaa

SEQ ID NO: 51360 - DNA, 15 bp, Homo sapiens
tatcagttgttcaga

SEQ ID NO: 51361 - DNA, 15 bp, Homo sapiens
ctatcagttgttcag

SEQ ID NO: 51362 - DNA, 15 bp, Homo sapiens
tctatcagttgttca

SEQ ID NO: 51363 - DNA, 15 bp, Homo sapiens
ctctatcagttgttc

SEQ ID NO: 51364 - DNA, 15 bp, Homo sapiens
tctctatcagttgtt

SEQ ID NO: 51365 - DNA, 15 bp, Homo sapiens
atctctatcagttgt

SEQ ID NO: 51366 - DNA, 15 bp, Homo sapiens
aatctctatcagttg

SEQ ID NO: 51367 - DNA, 15 bp, Homo sapiens
caatctctatcagtt

SEQ ID NO: 51368 - DNA, 15 bp, Homo sapiens
acaatctctatcagt

SEQ ID NO: 51369 - DNA, 15 bp, Homo sapiens
cacaatctctatcag

SEQ ID NO: 51370 - DNA, 15 bp, Homo sapiens
tcacaatctctatca

SEQ ID NO: 51371 - DNA, 15 bp, Homo sapiens
ttcacaatctctatc

SEQ ID NO: 51372 - DNA, 15 bp, Homo sapiens
tttcacaatctctat

SEQ ID NO: 51373 - DNA, 15 bp, Homo sapiens
ttttcacaatctcta

SEQ ID NO: 51374 - DNA, 15 bp, Homo sapiens
attttcacaatctct

SEQ ID NO: 51375 - DNA, 15 bp, Homo sapiens
cattttcacaatctc

SEQ ID NO: 51376 - DNA, 15 bp, Homo sapiens
gcattttcacaatct

SEQ ID NO: 51377 - DNA, 15 bp, Homo sapiens
agcattttcacaatc

SEQ ID NO: 51378 - DNA, 15 bp, Homo sapiens
cagcattttcacaat

SEQ ID NO: 51379 - DNA, 15 bp, Homo sapiens
acagcattttcacaa

SEQ ID NO: 51380 - DNA, 15 bp, Homo sapiens
aacagcattttcaca

SEQ ID NO: 51381 - DNA, 15 bp, Homo sapiens
aaacagcattttcac

SEQ ID NO: 51382 - DNA, 15 bp, Homo sapiens
aaaacagcattttca

SEQ ID NO: 51383 - DNA, 15 bp, Homo sapiens
caaaacagcattttc

SEQ ID NO: 51384 - DNA, 15 bp, Homo sapiens
acaaaacagcatttt

SEQ ID NO: 51385 - DNA, 15 bp, Homo sapiens
tacaaaacagcattt

SEQ ID NO: 51386 - DNA, 15 bp, Homo sapiens
ctacaaaacagcatt

SEQ ID NO: 51387 - DNA, 15 bp, Homo sapiens
cctacaaaacagcat

SEQ ID NO: 51388 - DNA, 15 bp, Homo sapiens
tcctacaaaacagca

SEQ ID NO: 51389 - DNA, 15 bp, Homo sapiens
atcctacaaaacagc

SEQ ID NO: 51390 - DNA, 15 bp, Homo sapiens
aatcctacaaaacag

SEQ ID NO: 51391 - DNA, 15 bp, Homo sapiens
aaatcctacaaaaca

SEQ ID NO: 51392 - DNA, 15 bp, Homo sapiens
taaatcctacaaaac

SEQ ID NO: 51393 - DNA, 15 bp, Homo sapiens
ttaaatcctacaaaa

SEQ ID NO: 51394 - DNA, 15 bp, Homo sapiens
cttaaatcctacaaa

SEQ ID NO: 51395 - DNA, 15 bp, Homo sapiens
gcttaaatcctacaa

SEQ ID NO: 51396 - DNA, 15 bp, Homo sapiens
ggcttaaatcctaca

SEQ ID NO: 51397 - DNA, 15 bp, Homo sapiens
tggcttaaatcctac

SEQ ID NO: 51398 - DNA, 15 bp, Homo sapiens
ttggcttaaatccta

SEQ ID NO: 51399 - DNA, 15 bp, Homo sapiens
gttggcttaaatcct

SEQ ID NO: 51400 - DNA, 15 bp, Homo sapiens
tgttggcttaaatcc

SEQ ID NO: 51401 - DNA, 15 bp, Homo sapiens
ttgttggcttaaatc

SEQ ID NO: 51402 - DNA, 15 bp, Homo sapiens
attgttggcttaaat

SEQ ID NO: 51403 - DNA, 15 bp, Homo sapiens
cattgttggcttaaa

SEQ ID NO: 51404 - DNA, 15 bp, Homo sapiens
tcattgttggcttaa

SEQ ID NO: 51405 - DNA, 15 bp, Homo sapiens
gtcattgttggctta

SEQ ID NO: 51406 - DNA, 15 bp, Homo sapiens
agtcattgttggctt

SEQ ID NO: 51407 - DNA, 15 bp, Homo sapiens
gagtcattgttggct

SEQ ID NO: 51408 - DNA, 15 bp, Homo sapiens
agagtcattgttggc

SEQ ID NO: 51409 - DNA, 15 bp, Homo sapiens
aagagtcattgttgg

SEQ ID NO: 51410 - DNA, 15 bp, Homo sapiens
aaagagtcattgttg

SEQ ID NO: 51411 - DNA, 15 bp, Homo sapiens
aaaagagtcattgtt

SEQ ID NO: 51412 - DNA, 15 bp, Homo sapiens
taaaagagtcattgt

SEQ ID NO: 51413 - DNA, 15 bp, Homo sapiens
gtaaaagagtcattg

SEQ ID NO: 51414 - DNA, 15 bp, Homo sapiens
agtaaaagagtcatt

SEQ ID NO: 51415 - DNA, 15 bp, Homo sapiens
cagtaaaagagtcat

SEQ ID NO: 51416 - DNA, 15 bp, Homo sapiens
ccagtaaaagagtca

SEQ ID NO: 51417 - DNA, 15 bp, Homo sapiens
gccagtaaaagagtc

SEQ ID NO: 51418 - DNA, 15 bp, Homo sapiens
agccagtaaaagagt

SEQ ID NO: 51419 - DNA, 15 bp, Homo sapiens
aagccagtaaaagag

SEQ ID NO: 51420 - DNA, 15 bp, Homo sapiens
aaagccagtaaaaga

SEQ ID NO: 51421 - DNA, 15 bp, Homo sapiens
taaagccagtaaaag

SEQ ID NO: 51422 - DNA, 15 bp, Homo sapiens
ttaaagccagtaaaa

SEQ ID NO: 51423 - DNA, 15 bp, Homo sapiens
attaaagccagtaaa

SEQ ID NO: 51424 - DNA, 15 bp, Homo sapiens
tattaaagccagtaa

SEQ ID NO: 51425 - DNA, 15 bp, Homo sapiens
ctattaaagccagta

SEQ ID NO: 51426 - DNA, 15 bp, Homo sapiens
tctattaaagccagt

SEQ ID NO: 51427 - DNA, 15 bp, Homo sapiens
ttctattaaagccag

SEQ ID NO: 51428 - DNA, 15 bp, Homo sapiens
tttctattaaagcca

SEQ ID NO: 51429 - DNA, 15 bp, Homo sapiens
ttttctattaaagcc

SEQ ID NO: 51430 - DNA, 15 bp, Homo sapiens
attttctattaaagc

SEQ ID NO: 51431 - DNA, 15 bp, Homo sapiens
gattttctattaaag

SEQ ID NO: 51432 - DNA, 15 bp, Homo sapiens
cgattttctattaaa

SEQ ID NO: 51433 - DNA, 15 bp, Homo sapiens
acgattttctattaa

SEQ ID NO: 51434 - DNA, 15 bp, Homo sapiens
cacgattttctatta

SEQ ID NO: 51435 - DNA, 15 bp, Homo sapiens
ccacgattttctatt

SEQ ID NO: 51436 - DNA, 15 bp, Homo sapiens
tccacgattttctat

SEQ ID NO: 51437 - DNA, 15 bp, Homo sapiens
ctccacgattttcta

SEQ ID NO: 51438 - DNA, 15 bp, Homo sapiens
actccacgattttct

SEQ ID NO: 51439 - DNA, 15 bp, Homo sapiens
cactccacgattttc

SEQ ID NO: 51440 - DNA, 15 bp, Homo sapiens
tcactccacgatttt

SEQ ID NO: 51441 - DNA, 15 bp, Homo sapiens
atcactccacgattt

SEQ ID NO: 51442 - DNA, 15 bp, Homo sapiens
catcactccacgatt

SEQ ID NO: 51443 - DNA, 15 bp, Homo sapiens
ccatcactccacgat

SEQ ID NO: 51444 - DNA, 15 bp, Homo sapiens
tccatcactccacga

SEQ ID NO: 51445 - DNA, 15 bp, Homo sapiens
ttccatcactccacg

SEQ ID NO: 51446 - DNA, 15 bp, Homo sapiens
cttccatcactccac

SEQ ID NO: 51447 - DNA, 15 bp, Homo sapiens
tcttccatcactcca

SEQ ID NO: 51448 - DNA, 15 bp, Homo sapiens
ctcttccatcactcc

SEQ ID NO: 51449 - DNA, 15 bp, Homo sapiens
actcttccatcactc

SEQ ID NO: 51450 - DNA, 15 bp, Homo sapiens
tactcttccatcact

SEQ ID NO: 51451 - DNA, 15 bp, Homo sapiens
atactcttccatcac

SEQ ID NO: 51452 - DNA, 15 bp, Homo sapiens
catactcttccatca

SEQ ID NO: 51453 - DNA, 15 bp, Homo sapiens
tcatactcttccatc

SEQ ID NO: 51454 - DNA, 15 bp, Homo sapiens
atcatactcttccat

SEQ ID NO: 51455 - DNA, 15 bp, Homo sapiens
aatcatactcttcca

SEQ ID NO: 51456 - DNA, 15 bp, Homo sapiens
aaatcatactcttcc

SEQ ID NO: 51457 - DNA, 15 bp, Homo sapiens
caaatcatactcttc

SEQ ID NO: 51458 - DNA, 15 bp, Homo sapiens
tcaaatcatactctt

SEQ ID NO: 51459 - DNA, 15 bp, Homo sapiens
ttcaaatcatactct

SEQ ID NO: 51460 - DNA, 15 bp, Homo sapiens
cttcaaatcatactc

SEQ ID NO: 51461 - DNA, 15 bp, Homo sapiens
tcttcaaatcatact

SEQ ID NO: 51462 - DNA, 15 bp, Homo sapiens
ctcttcaaatcatac

SEQ ID NO: 51463 - DNA, 15 bp, Homo sapiens
cctcttcaaatcata

SEQ ID NO: 51464 - DNA, 15 bp, Homo sapiens
acctcttcaaatcat

SEQ ID NO: 51465 - DNA, 15 bp, Homo sapiens
gacctcttcaaatca

SEQ ID NO: 51466 - DNA, 15 bp, Homo sapiens
ggacctcttcaaatc

SEQ ID NO: 51467 - DNA, 15 bp, Homo sapiens
tggacctcttcaaat

SEQ ID NO: 51468 - DNA, 15 bp, Homo sapiens
ttggacctcttcaaa

SEQ ID NO: 51469 - DNA, 15 bp, Homo sapiens
attggacctcttcaa

SEQ ID NO: 51470 - DNA, 15 bp, Homo sapiens
cattggacctcttca

SEQ ID NO: 51471 - DNA, 15 bp, Homo sapiens
tcattggacctcttc

SEQ ID NO: 51472 - DNA, 15 bp, Homo sapiens
ttcattggacctctt

SEQ ID NO: 51473 - DNA, 15 bp, Homo sapiens
attcattggacctct

SEQ ID NO: 51474 - DNA, 15 bp, Homo sapiens
tattcattggacctc

SEQ ID NO: 51475 - DNA, 15 bp, Homo sapiens
atattcattggacct

SEQ ID NO: 51476 - DNA, 15 bp, Homo sapiens
aatattcattggacc

SEQ ID NO: 51477 - DNA, 15 bp, Homo sapiens
aaatattcattggac

SEQ ID NO: 51478 - DNA, 15 bp, Homo sapiens
taaatattcattgga

SEQ ID NO: 51479 - DNA, 15 bp, Homo sapiens
ataaatattcattgg

SEQ ID NO: 51480 - DNA, 15 bp, Homo sapiens
aataaatattcattg

SEQ ID NO: 51481 - DNA, 15 bp, Homo sapiens
aaataaatattcatt

SEQ ID NO: 51482 - DNA, 15 bp, Homo sapiens
taaataaatattcat

SEQ ID NO: 51483 - DNA, 15 bp, Homo sapiens
ataaataaatattca

SEQ ID NO: 51484 - DNA, 15 bp, Homo sapiens
gataaataaatattc

SEQ ID NO: 51485 - DNA, 15 bp, Homo sapiens
agataaataaatatt

SEQ ID NO: 51486 - DNA, 15 bp, Homo sapiens
tagataaataaatat

SEQ ID NO: 51487 - DNA, 15 bp, Homo sapiens
gtagataaataaata

SEQ ID NO: 51488 - DNA, 15 bp, Homo sapiens
ggtagataaataaat

SEQ ID NO: 51489 - DNA, 15 bp, Homo sapiens
aggtagataaataaa

SEQ ID NO: 51490 - DNA, 15 bp, Homo sapiens
aaggtagataaataa

SEQ ID NO: 51491 - DNA, 15 bp, Homo sapiens
caaggtagataaata

SEQ ID NO: 51492 - DNA, 15 bp, Homo sapiens
gcaaggtagataaat

SEQ ID NO: 51493 - DNA, 15 bp, Homo sapiens
agcaaggtagataaa

SEQ ID NO: 51494 - DNA, 15 bp, Homo sapiens
aagcaaggtagataa

SEQ ID NO: 51495 - DNA, 15 bp, Homo sapiens
taagcaaggtagata

SEQ ID NO: 51496 - DNA, 15 bp, Homo sapiens
gtaagcaaggtagat

SEQ ID NO: 51497 - DNA, 15 bp, Homo sapiens
tgtaagcaaggtaga

SEQ ID NO: 51498 - DNA, 15 bp, Homo sapiens
gtgtaagcaaggtag

SEQ ID NO: 51499 - DNA, 15 bp, Homo sapiens
agtgtaagcaaggta

SEQ ID NO: 51500 - DNA, 15 bp, Homo sapiens
aagtgtaagcaaggt

SEQ ID NO: 51501 - DNA, 15 bp, Homo sapiens
aaagtgtaagcaagg

SEQ ID NO: 51502 - DNA, 15 bp, Homo sapiens
aaaagtgtaagcaag

SEQ ID NO: 51503 - DNA, 15 bp, Homo sapiens
taaaagtgtaagcaa

SEQ ID NO: 51504 - DNA, 15 bp, Homo sapiens
gtaaaagtgtaagca

SEQ ID NO: 51505 - DNA, 15 bp, Homo sapiens
agtaaaagtgtaagc

SEQ ID NO: 51506 - DNA, 15 bp, Homo sapiens
cagtaaaagtgtaag

SEQ ID NO: 51507 - DNA, 15 bp, Homo sapiens
acagtaaaagtgtaa

SEQ ID NO: 51508 - DNA, 15 bp, Homo sapiens
tacagtaaaagtgta

SEQ ID NO: 51509 - DNA, 15 bp, Homo sapiens
ttacagtaaaagtgt

SEQ ID NO: 51510 - DNA, 15 bp, Homo sapiens
attacagtaaaagtg

SEQ ID NO: 51511 - DNA, 15 bp, Homo sapiens
gattacagtaaaagt

SEQ ID NO: 51512 - DNA, 15 bp, Homo sapiens
tgattacagtaaaag

SEQ ID NO: 51513 - DNA, 15 bp, Homo sapiens
atgattacagtaaaa

SEQ ID NO: 51514 - DNA, 15 bp, Homo sapiens
aatgattacagtaaa

SEQ ID NO: 51515 - DNA, 15 bp, Homo sapiens
taatgattacagtaa

SEQ ID NO: 51516 - DNA, 15 bp, Homo sapiens
ataatgattacagta

SEQ ID NO: 51517 - DNA, 15 bp, Homo sapiens
tataatgattacagt

SEQ ID NO: 51518 - DNA, 15 bp, Homo sapiens
ttataatgattacag

SEQ ID NO: 51519 - DNA, 15 bp, Homo sapiens
gttataatgattaca

SEQ ID NO: 51520 - DNA, 15 bp, Homo sapiens
tgttataatgattac

SEQ ID NO: 51521 - DNA, 15 bp, Homo sapiens
ttgttataatgatta

SEQ ID NO: 51522 - DNA, 15 bp, Homo sapiens
gttgttataatgatt

SEQ ID NO: 51523 - DNA, 15 bp, Homo sapiens
cgttgttataatgat

SEQ ID NO: 51524 - DNA, 15 bp, Homo sapiens
tcgttgttataatga

SEQ ID NO: 51525 - DNA, 15 bp, Homo sapiens
ctcgttgttataatg

SEQ ID NO: 51526 - DNA, 15 bp, Homo sapiens
gctcgttgttataat

SEQ ID NO: 51527 - DNA, 15 bp, Homo sapiens
agctcgttgttataa

SEQ ID NO: 51528 - DNA, 15 bp, Homo sapiens
cagctcgttgttata

SEQ ID NO: 51529 - DNA, 15 bp, Homo sapiens
tcagctcgttgttat

SEQ ID NO: 51530 - DNA, 15 bp, Homo sapiens
ttcagctcgttgtta

SEQ ID NO: 51531 - DNA, 15 bp, Homo sapiens
gttcagctcgttgtt

SEQ ID NO: 51532 - DNA, 15 bp, Homo sapiens
tgttcagctcgttgt

SEQ ID NO: 51533 - DNA, 15 bp, Homo sapiens
gtgttcagctcgttg

SEQ ID NO: 51534 - DNA, 15 bp, Homo sapiens
ggtgttcagctcgtt

SEQ ID NO: 51535 - DNA, 15 bp, Homo sapiens
tggtgttcagctcgt

SEQ ID NO: 51536 - DNA, 15 bp, Homo sapiens
ctggtgttcagctcg

SEQ ID NO: 51537 - DNA, 15 bp, Homo sapiens
gctggtgttcagctc

SEQ ID NO: 51538 - DNA, 15 bp, Homo sapiens
agctggtgttcagct

SEQ ID NO: 51539 - DNA, 15 bp, Homo sapiens
gagctggtgttcagc

SEQ ID NO: 51540 - DNA, 15 bp, Homo sapiens
agagctggtgttcag

SEQ ID NO: 51541 - DNA, 15 bp, Homo sapiens
aagagctggtgttca

SEQ ID NO: 51542 - DNA, 15 bp, Homo sapiens
gaagagctggtgttc

SEQ ID NO: 51543 - DNA, 15 bp, Homo sapiens
cgaagagctggtgtt

SEQ ID NO: 51544 - DNA, 15 bp, Homo sapiens
acgaagagctggtgt

SEQ ID NO: 51545 - DNA, 15 bp, Homo sapiens
gacgaagagctggtg

SEQ ID NO: 51546 - DNA, 15 bp, Homo sapiens
tgacgaagagctggt

SEQ ID NO: 51547 - DNA, 15 bp, Homo sapiens
ttgacgaagagctgg

SEQ ID NO: 51548 - DNA, 15 bp, Homo sapiens
cttgacgaagagctg

SEQ ID NO: 51549 - DNA, 15 bp, Homo sapiens
acttgacgaagagct

SEQ ID NO: 51550 - DNA, 15 bp, Homo sapiens
cacttgacgaagagc

SEQ ID NO: 51551 - DNA, 15 bp, Homo sapiens
gcacttgacgaagag

SEQ ID NO: 51552 - DNA, 15 bp, Homo sapiens
agcacttgacgaaga

SEQ ID NO: 51553 - DNA, 15 bp, Homo sapiens
aagcacttgacgaag

SEQ ID NO: 51554 - DNA, 15 bp, Homo sapiens
aaagcacttgacgaa

SEQ ID NO: 51555 - DNA, 15 bp, Homo sapiens
aaaagcacttgacga

SEQ ID NO: 51556 - DNA, 15 bp, Homo sapiens
gaaaagcacttgacg

SEQ ID NO: 51557 - DNA, 15 bp, Homo sapiens
tgaaaagcacttgac

SEQ ID NO: 51558 - DNA, 15 bp, Homo sapiens
atgaaaagcacttga

SEQ ID NO: 51559 - DNA, 15 bp, Homo sapiens
aatgaaaagcacttg

SEQ ID NO: 51560 - DNA, 15 bp, Homo sapiens
aaatgaaaagcactt

SEQ ID NO: 51561 - DNA, 15 bp, Homo sapiens
taaatgaaaagcact

SEQ ID NO: 51562 - DNA, 15 bp, Homo sapiens
ataaatgaaaagcac

SEQ ID NO: 51563 - DNA, 15 bp, Homo sapiens
tataaatgaaaagca

SEQ ID NO: 51564 - DNA, 15 bp, Homo sapiens
atataaatgaaaagc

SEQ ID NO: 51565 - DNA, 15 bp, Homo sapiens
aatataaatgaaaag

SEQ ID NO: 51566 - DNA, 15 bp, Homo sapiens
gaatataaatgaaaa

SEQ ID NO: 51567 - DNA, 15 bp, Homo sapiens
tgaatataaatgaaa

SEQ ID NO: 51568 - DNA, 15 bp, Homo sapiens
gtgaatataaatgaa

SEQ ID NO: 51569 - DNA, 15 bp, Homo sapiens
agtgaatataaatga

SEQ ID NO: 51570 - DNA, 15 bp, Homo sapiens
tagtgaatataaatg

SEQ ID NO: 51571 - DNA, 15 bp, Homo sapiens
ttagtgaatataaat

SEQ ID NO: 51572 - DNA, 15 bp, Homo sapiens
gttagtgaatataaa

SEQ ID NO: 51573 - DNA, 15 bp, Homo sapiens
ggttagtgaatataa

SEQ ID NO: 51574 - DNA, 15 bp, Homo sapiens
aggttagtgaatata

SEQ ID NO: 51575 - DNA, 15 bp, Homo sapiens
aaggttagtgaatat

SEQ ID NO: 51576 - DNA, 15 bp, Homo sapiens
aaaggttagtgaata

SEQ ID NO: 51577 - DNA, 15 bp, Homo sapiens
taaaggttagtgaat

SEQ ID NO: 51578 - DNA, 15 bp, Homo sapiens
gtaaaggttagtgaa

SEQ ID NO: 51579 - DNA, 15 bp, Homo sapiens
tgtaaaggttagtga

SEQ ID NO: 51580 - DNA, 15 bp, Homo sapiens
ttgtaaaggttagtg

SEQ ID NO: 51581 - DNA, 15 bp, Homo sapiens
attgtaaaggttagt

SEQ ID NO: 51582 - DNA, 15 bp, Homo sapiens
tattgtaaaggttag

SEQ ID NO: 51583 - DNA, 15 bp, Homo sapiens
gtattgtaaaggtta

SEQ ID NO: 51584 - DNA, 15 bp, Homo sapiens
agtattgtaaaggtt

SEQ ID NO: 51585 - DNA, 15 bp, Homo sapiens
gagtattgtaaaggt

SEQ ID NO: 51586 - DNA, 15 bp, Homo sapiens
agagtattgtaaagg

SEQ ID NO: 51587 - DNA, 15 bp, Homo sapiens
aagagtattgtaaag

SEQ ID NO: 51588 - DNA, 15 bp, Homo sapiens
caagagtattgtaaa

SEQ ID NO: 51589 - DNA, 15 bp, Homo sapiens
gcaagagtattgtaa

SEQ ID NO: 51590 - DNA, 15 bp, Homo sapiens
tgcaagagtattgta

SEQ ID NO: 51591 - DNA, 15 bp, Homo sapiens
ttgcaagagtattgt

SEQ ID NO: 51592 - DNA, 15 bp, Homo sapiens
cttgcaagagtattg

SEQ ID NO: 51593 - DNA, 15 bp, Homo sapiens
gcttgcaagagtatt

SEQ ID NO: 51594 - DNA, 15 bp, Homo sapiens
agcttgcaagagtat

SEQ ID NO: 51595 - DNA, 15 bp, Homo sapiens
tagcttgcaagagta

SEQ ID NO: 51596 - DNA, 15 bp, Homo sapiens
ctagcttgcaagagt

SEQ ID NO: 51597 - DNA, 15 bp, Homo sapiens
cctagcttgcaagag

SEQ ID NO: 51598 - DNA, 15 bp, Homo sapiens
acctagcttgcaaga

SEQ ID NO: 51599 - DNA, 15 bp, Homo sapiens
tacctagcttgcaag

SEQ ID NO: 51600 - DNA, 15 bp, Homo sapiens
atacctagcttgcaa

SEQ ID NO: 51601 - DNA, 15 bp, Homo sapiens
aatacctagcttgca

SEQ ID NO: 51602 - DNA, 15 bp, Homo sapiens
taatacctagcttgc

SEQ ID NO: 51603 - DNA, 15 bp, Homo sapiens
ataatacctagcttg

SEQ ID NO: 51604 - DNA, 15 bp, Homo sapiens
aataatacctagctt

SEQ ID NO: 51605 - DNA, 15 bp, Homo sapiens
aaataatacctagct

SEQ ID NO: 51606 - DNA, 15 bp, Homo sapiens
taaataatacctagc

SEQ ID NO: 51607 - DNA, 15 bp, Homo sapiens
ataaataatacctag

SEQ ID NO: 51608 - DNA, 15 bp, Homo sapiens
gataaataataccta

SEQ ID NO: 51609 - DNA, 15 bp, Homo sapiens
ggataaataatacct

SEQ ID NO: 51610 - DNA, 15 bp, Homo sapiens
gggataaataatacc

SEQ ID NO: 51611 - DNA, 15 bp, Homo sapiens
ggggataaataatac

SEQ ID NO: 51612 - DNA, 15 bp, Homo sapiens
tggggataaataata

SEQ ID NO: 51613 - DNA, 15 bp, Homo sapiens
atggggataaataat

SEQ ID NO: 51614 - DNA, 15 bp, Homo sapiens
aatggggataaataa

SEQ ID NO: 51615 - DNA, 15 bp, Homo sapiens
aaatggggataaata

SEQ ID NO: 51616 - DNA, 15 bp, Homo sapiens
aaaatggggataaat

SEQ ID NO: 51617 - DNA, 15 bp, Homo sapiens
taaaatggggataaa

SEQ ID NO: 51618 - DNA, 15 bp, Homo sapiens
gtaaaatggggataa

SEQ ID NO: 51619 - DNA, 15 bp, Homo sapiens
tgtaaaatggggata

SEQ ID NO: 51620 - DNA, 15 bp, Homo sapiens
ctgtaaaatggggat

SEQ ID NO: 51621 - DNA, 15 bp, Homo sapiens
tctgtaaaatgggga

SEQ ID NO: 51622 - DNA, 15 bp, Homo sapiens
atctgtaaaatgggg

SEQ ID NO: 51623 - DNA, 15 bp, Homo sapiens
catctgtaaaatggg

SEQ ID NO: 51624 - DNA, 15 bp, Homo sapiens
tcatctgtaaaatgg

SEQ ID NO: 51625 - DNA, 15 bp, Homo sapiens
ctcatctgtaaaatg

SEQ ID NO: 51626 - DNA, 15 bp, Homo sapiens
tctcatctgtaaaat

SEQ ID NO: 51627 - DNA, 15 bp, Homo sapiens
ttctcatctgtaaaa

SEQ ID NO: 51628 - DNA, 15 bp, Homo sapiens
gttctcatctgtaaa

SEQ ID NO: 51629 - DNA, 15 bp, Homo sapiens
agttctcatctgtaa

SEQ ID NO: 51630 - DNA, 15 bp, Homo sapiens
cagttctcatctgta

SEQ ID NO: 51631 - DNA, 15 bp, Homo sapiens
acagttctcatctgt

SEQ ID NO: 51632 - DNA, 15 bp, Homo sapiens
cacagttctcatctg

SEQ ID NO: 51633 - DNA, 15 bp, Homo sapiens
tcacagttctcatct

SEQ ID NO: 51634 - DNA, 15 bp, Homo sapiens
ctcacagttctcatc

SEQ ID NO: 51635 - DNA, 15 bp, Homo sapiens
cctcacagttctcat

SEQ ID NO: 51636 - DNA, 15 bp, Homo sapiens
tcctcacagttctca

SEQ ID NO: 51637 - DNA, 15 bp, Homo sapiens
ttcctcacagttctc

SEQ ID NO: 51638 - DNA, 15 bp, Homo sapiens
tttcctcacagttct

SEQ ID NO: 51639 - DNA, 15 bp, Homo sapiens
ttttcctcacagttc

SEQ ID NO: 51640 - DNA, 15 bp, Homo sapiens
cttttcctcacagtt

SEQ ID NO: 51641 - DNA, 15 bp, Homo sapiens
gcttttcctcacagt

SEQ ID NO: 51642 - DNA, 15 bp, Homo sapiens
cgcttttcctcacag

SEQ ID NO: 51643 - DNA, 15 bp, Homo sapiens
tcgcttttcctcaca

SEQ ID NO: 51644 - DNA, 15 bp, Homo sapiens
atcgcttttcctcac

SEQ ID NO: 51645 - DNA, 15 bp, Homo sapiens
catcgcttttcctca

SEQ ID NO: 51646 - DNA, 15 bp, Homo sapiens
acatcgcttttcctc

SEQ ID NO: 51647 - DNA, 15 bp, Homo sapiens
aacatcgcttttcct

SEQ ID NO: 51648 - DNA, 15 bp, Homo sapiens
taacatcgcttttcc

SEQ ID NO: 51649 - DNA, 15 bp, Homo sapiens
ataacatcgcttttc

SEQ ID NO: 51650 - DNA, 15 bp, Homo sapiens
tataacatcgctttt

SEQ ID NO: 51651 - DNA, 15 bp, Homo sapiens
ttataacatcgcttt

SEQ ID NO: 51652 - DNA, 15 bp, Homo sapiens
attataacatcgctt

SEQ ID NO: 51653 - DNA, 15 bp, Homo sapiens
cattataacatcgct

SEQ ID NO: 51654 - DNA, 15 bp, Homo sapiens
tcattataacatcgc

SEQ ID NO: 51655 - DNA, 15 bp, Homo sapiens
gtcattataacatcg

SEQ ID NO: 51656 - DNA, 15 bp, Homo sapiens
ggtcattataacatc

SEQ ID NO: 51657 - DNA, 15 bp, Homo sapiens
gggtcattataacat

SEQ ID NO: 51658 - DNA, 15 bp, Homo sapiens
tgggtcattataaca

SEQ ID NO: 51659 - DNA, 15 bp, Homo sapiens
ttgggtcattataac

SEQ ID NO: 51660 - DNA, 15 bp, Homo sapiens
cttgggtcattataa

SEQ ID NO: 51661 - DNA, 15 bp, Homo sapiens
ccttgggtcattata

SEQ ID NO: 51662 - DNA, 15 bp, Homo sapiens
accttgggtcattat

SEQ ID NO: 51663 - DNA, 15 bp, Homo sapiens
gaccttgggtcatta

SEQ ID NO: 51664 - DNA, 15 bp, Homo sapiens
tgaccttgggtcatt

SEQ ID NO: 51665 - DNA, 15 bp, Homo sapiens
gtgaccttgggtcat

SEQ ID NO: 51666 - DNA, 15 bp, Homo sapiens
tgtgaccttgggtca

SEQ ID NO: 51667 - DNA, 15 bp, Homo sapiens
gtgtgaccttgggtc

SEQ ID NO: 51668 - DNA, 15 bp, Homo sapiens
tgtgtgaccttgggt

SEQ ID NO: 51669 - DNA, 15 bp, Homo sapiens
ttgtgtgaccttggg

SEQ ID NO: 51670 - DNA, 15 bp, Homo sapiens
attgtgtgaccttgg

SEQ ID NO: 51671 - DNA, 15 bp, Homo sapiens
tattgtgtgaccttg

SEQ ID NO: 51672 - DNA, 15 bp, Homo sapiens
ttattgtgtgacctt

SEQ ID NO: 51673 - DNA, 15 bp, Homo sapiens
tttattgtgtgacct

SEQ ID NO: 51674 - DNA, 15 bp, Homo sapiens
atttattgtgtgacc

SEQ ID NO: 51675 - DNA, 15 bp, Homo sapiens
catttattgtgtgac

SEQ ID NO: 51676 - DNA, 15 bp, Homo sapiens
ccatttattgtgtga

SEQ ID NO: 51677 - DNA, 15 bp, Homo sapiens
tccatttattgtgtg

SEQ ID NO: 51678 - DNA, 15 bp, Homo sapiens
atccatttattgtgt

SEQ ID NO: 51679 - DNA, 15 bp, Homo sapiens
aatccatttattgtg

SEQ ID NO: 51680 - DNA, 15 bp, Homo sapiens
caatccatttattgt

SEQ ID NO: 51681 - DNA, 15 bp, Homo sapiens
ccaatccatttattg

SEQ ID NO: 51682 - DNA, 15 bp, Homo sapiens
cccaatccatttatt

SEQ ID NO: 51683 - DNA, 15 bp, Homo sapiens
tcccaatccatttat

SEQ ID NO: 51684 - DNA, 15 bp, Homo sapiens
gtcccaatccattta

SEQ ID NO: 51685 - DNA, 15 bp, Homo sapiens
tgtcccaatccattt

SEQ ID NO: 51686 - DNA, 15 bp, Homo sapiens
gtgtcccaatccatt

SEQ ID NO: 51687 - DNA, 15 bp, Homo sapiens
ggtgtcccaatccat

SEQ ID NO: 51688 - DNA, 15 bp, Homo sapiens
cggtgtcccaatcca

SEQ ID NO: 51689 - DNA, 15 bp, Homo sapiens
acggtgtcccaatcc

SEQ ID NO: 51690 - DNA, 15 bp, Homo sapiens
gacggtgtcccaatc

SEQ ID NO: 51691 - DNA, 15 bp, Homo sapiens
agacggtgtcccaat

SEQ ID NO: 51692 - DNA, 15 bp, Homo sapiens
tagacggtgtcccaa

SEQ ID NO: 51693 - DNA, 15 bp, Homo sapiens
atagacggtgtccca

SEQ ID NO: 51694 - DNA, 15 bp, Homo sapiens
aatagacggtgtccc

SEQ ID NO: 51695 - DNA, 15 bp, Homo sapiens
aaatagacggtgtcc

SEQ ID NO: 51696 - DNA, 15 bp, Homo sapiens
caaatagacggtgtc

SEQ ID NO: 51697 - DNA, 15 bp, Homo sapiens
ccaaatagacggtgt

SEQ ID NO: 51698 - DNA, 15 bp, Homo sapiens
accaaatagacggtg

SEQ ID NO: 51699 - DNA, 15 bp, Homo sapiens
aaccaaatagacggt

SEQ ID NO: 51700 - DNA, 15 bp, Homo sapiens
gaaccaaatagacgg

SEQ ID NO: 51701 - DNA, 15 bp, Homo sapiens
agaaccaaatagacg

SEQ ID NO: 51702 - DNA, 15 bp, Homo sapiens
tagaaccaaatagac

SEQ ID NO: 51703 - DNA, 15 bp, Homo sapiens
ttagaaccaaataga

SEQ ID NO: 51704 - DNA, 15 bp, Homo sapiens
tttagaaccaaatag

SEQ ID NO: 51705 - DNA, 15 bp, Homo sapiens
ctttagaaccaaata

SEQ ID NO: 51706 - DNA, 15 bp, Homo sapiens
tctttagaaccaaat

SEQ ID NO: 51707 - DNA, 15 bp, Homo sapiens
ctctttagaaccaaa

SEQ ID NO: 51708 - DNA, 15 bp, Homo sapiens
tctctttagaaccaa

SEQ ID NO: 51709 - DNA, 15 bp, Homo sapiens
ttctctttagaacca

SEQ ID NO: 51710 - DNA, 15 bp, Homo sapiens
tttctctttagaacc

SEQ ID NO: 51711 - DNA, 15 bp, Homo sapiens
ctttctctttagaac

SEQ ID NO: 51712 - DNA, 15 bp, Homo sapiens
actttctctttagaa

SEQ ID NO: 51713 - DNA, 15 bp, Homo sapiens
gactttctctttaga

SEQ ID NO: 51714 - DNA, 15 bp, Homo sapiens
ggactttctctttag

SEQ ID NO: 51715 - DNA, 15 bp, Homo sapiens
aggactttctcttta

SEQ ID NO: 51716 - DNA, 15 bp, Homo sapiens
aaggactttctcttt

SEQ ID NO: 51717 - DNA, 15 bp, Homo sapiens
aaaggactttctctt

SEQ ID NO: 51718 - DNA, 15 bp, Homo sapiens
aaaaggactttctct

SEQ ID NO: 51719 - DNA, 15 bp, Homo sapiens
gaaaaggactttctc

SEQ ID NO: 51720 - DNA, 15 bp, Homo sapiens
agaaaaggactttct

SEQ ID NO: 51721 - DNA, 15 bp, Homo sapiens
gagaaaaggactttc

SEQ ID NO: 51722 - DNA, 15 bp, Homo sapiens
agagaaaaggacttt

SEQ ID NO: 51723 - DNA, 15 bp, Homo sapiens
aagagaaaaggactt

SEQ ID NO: 51724 - DNA, 15 bp, Homo sapiens
aaagagaaaaggact

SEQ ID NO: 51725 - DNA, 15 bp, Homo sapiens
aaaagagaaaaggac

SEQ ID NO: 51726 - DNA, 15 bp, Homo sapiens
aaaaagagaaaagga

SEQ ID NO: 51727 - DNA, 15 bp, Homo sapiens
caaaaagagaaaagg

SEQ ID NO: 51728 - DNA, 15 bp, Homo sapiens
acaaaaagagaaaag

SEQ ID NO: 51729 - DNA, 15 bp, Homo sapiens
aacaaaaagagaaaa

SEQ ID NO: 51730 - DNA, 15 bp, Homo sapiens
taacaaaaagagaaa

SEQ ID NO: 51731 - DNA, 15 bp, Homo sapiens
ctaacaaaaagagaa

SEQ ID NO: 51732 - DNA, 15 bp, Homo sapiens
gctaacaaaaagaga

SEQ ID NO: 51733 - DNA, 15 bp, Homo sapiens
ggctaacaaaaagag

SEQ ID NO: 51734 - DNA, 15 bp, Homo sapiens
tggctaacaaaaaga

SEQ ID NO: 51735 - DNA, 15 bp, Homo sapiens
gtggctaacaaaaag

SEQ ID NO: 51736 - DNA, 15 bp, Homo sapiens
tgtggctaacaaaaa

SEQ ID NO: 51737 - DNA, 15 bp, Homo sapiens
atgtggctaacaaaa

SEQ ID NO: 51738 - DNA, 15 bp, Homo sapiens
catgtggctaacaaa

SEQ ID NO: 51739 - DNA, 15 bp, Homo sapiens
ccatgtggctaacaa

SEQ ID NO: 51740 - DNA, 15 bp, Homo sapiens
tccatgtggctaaca

SEQ ID NO: 51741 - DNA, 15 bp, Homo sapiens
gtccatgtggctaac

SEQ ID NO: 51742 - DNA, 15 bp, Homo sapiens
agtccatgtggctaa

SEQ ID NO: 51743 - DNA, 15 bp, Homo sapiens
gagtccatgtggcta

SEQ ID NO: 51744 - DNA, 15 bp, Homo sapiens
ggagtccatgtggct

SEQ ID NO: 51745 - DNA, 15 bp, Homo sapiens
aggagtccatgtggc

SEQ ID NO: 51746 - DNA, 15 bp, Homo sapiens
aaggagtccatgtgg

SEQ ID NO: 51747 - DNA, 15 bp, Homo sapiens
caaggagtccatgtg

SEQ ID NO: 51748 - DNA, 15 bp, Homo sapiens
acaaggagtccatgt

SEQ ID NO: 51749 - DNA, 15 bp, Homo sapiens
tacaaggagtccatg

SEQ ID NO: 51750 - DNA, 15 bp, Homo sapiens
atacaaggagtccat

SEQ ID NO: 51751 - DNA, 15 bp, Homo sapiens
catacaaggagtcca

SEQ ID NO: 51752 - DNA, 15 bp, Homo sapiens
acatacaaggagtcc

SEQ ID NO: 51753 - DNA, 15 bp, Homo sapiens
tacatacaaggagtc

SEQ ID NO: 51754 - DNA, 15 bp, Homo sapiens
ttacatacaaggagt

SEQ ID NO: 51755 - DNA, 15 bp, Homo sapiens
gttacatacaaggag

SEQ ID NO: 51756 - DNA, 15 bp, Homo sapiens
ggttacatacaagga

SEQ ID NO: 51757 - DNA, 15 bp, Homo sapiens
tggttacatacaagg

SEQ ID NO: 51758 - DNA, 15 bp, Homo sapiens
ttggttacatacaag

SEQ ID NO: 51759 - DNA, 15 bp, Homo sapiens
tttggttacatacaa

SEQ ID NO: 51760 - DNA, 15 bp, Homo sapiens
atttggttacataca

SEQ ID NO: 51761 - DNA, 15 bp, Homo sapiens
gatttggttacatac

SEQ ID NO: 51762 - DNA, 15 bp, Homo sapiens
ggatttggttacata

SEQ ID NO: 51763 - DNA, 15 bp, Homo sapiens
aggatttggttacat

SEQ ID NO: 51764 - DNA, 15 bp, Homo sapiens
aaggatttggttaca

SEQ ID NO: 51765 - DNA, 15 bp, Homo sapiens
gaaggatttggttac

SEQ ID NO: 51766 - DNA, 15 bp, Homo sapiens
agaaggatttggtta

SEQ ID NO: 51767 - DNA, 15 bp, Homo sapiens
tagaaggatttggtt

SEQ ID NO: 51768 - DNA, 15 bp, Homo sapiens
gtagaaggatttggt

SEQ ID NO: 51769 - DNA, 15 bp, Homo sapiens
ggtagaaggatttgg

SEQ ID NO: 51770 - DNA, 15 bp, Homo sapiens
gggtagaaggatttg

SEQ ID NO: 51771 - DNA, 15 bp, Homo sapiens
tgggtagaaggattt

SEQ ID NO: 51772 - DNA, 15 bp, Homo sapiens
atgggtagaaggatt

SEQ ID NO: 51773 - DNA, 15 bp, Homo sapiens
tatgggtagaaggat

SEQ ID NO: 51774 - DNA, 15 bp, Homo sapiens
atatgggtagaagga

SEQ ID NO: 51775 - DNA, 15 bp, Homo sapiens
aatatgggtagaagg

SEQ ID NO: 51776 - DNA, 15 bp, Homo sapiens
aaatatgggtagaag

SEQ ID NO: 51777 - DNA, 15 bp, Homo sapiens
gaaatatgggtagaa

SEQ ID NO: 51778 - DNA, 15 bp, Homo sapiens
tgaaatatgggtaga

SEQ ID NO: 51779 - DNA, 15 bp, Homo sapiens
ttgaaatatgggtag

SEQ ID NO: 51780 - DNA, 15 bp, Homo sapiens
tttgaaatatgggta

SEQ ID NO: 51781 - DNA, 15 bp, Homo sapiens
ttttgaaatatgggt

SEQ ID NO: 51782 - DNA, 15 bp, Homo sapiens
cttttgaaatatggg

SEQ ID NO: 51783 - DNA, 15 bp, Homo sapiens
acttttgaaatatgg

SEQ ID NO: 51784 - DNA, 15 bp, Homo sapiens
aacttttgaaatatg

SEQ ID NO: 51785 - DNA, 15 bp, Homo sapiens
gaacttttgaaatat

SEQ ID NO: 51786 - DNA, 15 bp, Homo sapiens
tgaacttttgaaata

SEQ ID NO: 51787 - DNA, 15 bp, Homo sapiens
ctgaacttttgaaat

SEQ ID NO: 51788 - DNA, 15 bp, Homo sapiens
cctgaacttttgaaa

SEQ ID NO: 51789 - DNA, 15 bp, Homo sapiens
ccctgaacttttgaa

SEQ ID NO: 51790 - DNA, 15 bp, Homo sapiens
accctgaacttttga

SEQ ID NO: 51791 - DNA, 15 bp, Homo sapiens
caccctgaacttttg

SEQ ID NO: 51792 - DNA, 15 bp, Homo sapiens
ccaccctgaactttt

SEQ ID NO: 51793 - DNA, 15 bp, Homo sapiens
accaccctgaacttt

SEQ ID NO: 51794 - DNA, 15 bp, Homo sapiens
gaccaccctgaactt

SEQ ID NO: 51795 - DNA, 15 bp, Homo sapiens
tgaccaccctgaact

SEQ ID NO: 51796 - DNA, 15 bp, Homo sapiens
ctgaccaccctgaac

SEQ ID NO: 51797 - DNA, 15 bp, Homo sapiens
actgaccaccctgaa

SEQ ID NO: 51798 - DNA, 15 bp, Homo sapiens
gactgaccaccctga

SEQ ID NO: 51799 - DNA, 15 bp, Homo sapiens
agactgaccaccctg

SEQ ID NO: 51800 - DNA, 15 bp, Homo sapiens
aagactgaccaccct

SEQ ID NO: 51801 - DNA, 15 bp, Homo sapiens
aaagactgaccaccc

SEQ ID NO: 51802 - DNA, 15 bp, Homo sapiens
aaaagactgaccacc

SEQ ID NO: 51803 - DNA, 15 bp, Homo sapiens
taaaagactgaccac

SEQ ID NO: 51804 - DNA, 15 bp, Homo sapiens
ttaaaagactgacca

SEQ ID NO: 51805 - DNA, 15 bp, Homo sapiens
tttaaaagactgacc

SEQ ID NO: 51806 - DNA, 15 bp, Homo sapiens
ctttaaaagactgac

SEQ ID NO: 51807 - DNA, 15 bp, Homo sapiens
actttaaaagactga

SEQ ID NO: 51808 - DNA, 15 bp, Homo sapiens
tactttaaaagactg

SEQ ID NO: 51809 - DNA, 15 bp, Homo sapiens
ttactttaaaagact

SEQ ID NO: 51810 - DNA, 15 bp, Homo sapiens
gttactttaaaagac

SEQ ID NO: 51811 - DNA, 15 bp, Homo sapiens
agttactttaaaaga

SEQ ID NO: 51812 - DNA, 15 bp, Homo sapiens
aagttactttaaaag

SEQ ID NO: 51813 - DNA, 15 bp, Homo sapiens
aaagttactttaaaa

SEQ ID NO: 51814 - DNA, 15 bp, Homo sapiens
aaaagttactttaaa

SEQ ID NO: 51815 - DNA, 15 bp, Homo sapiens
gaaaagttactttaa

SEQ ID NO: 51816 - DNA, 15 bp, Homo sapiens
agaaaagttacttta

SEQ ID NO: 51817 - DNA, 15 bp, Homo sapiens
aagaaaagttacttt

SEQ ID NO: 51818 - DNA, 15 bp, Homo sapiens
aaagaaaagttactt

SEQ ID NO: 51819 - DNA, 15 bp, Homo sapiens
aaaagaaaagttact

SEQ ID NO: 51820 - DNA, 15 bp, Homo sapiens
aaaaagaaaagttac

SEQ ID NO: 51821 - DNA, 15 bp, Homo sapiens
aaaaaagaaaagtta

SEQ ID NO: 51822 - DNA, 15 bp, Homo sapiens
aaaaaaagaaaagtt

SEQ ID NO: 51823 - DNA, 15 bp, Homo sapiens
aaaaaaaagaaaagt

SEQ ID NO: 51824 - DNA, 15 bp, Homo sapiens
ataaaaaaaagaaaa

SEQ ID NO: 51825 - DNA, 15 bp, Homo sapiens
cataaaaaaaagaaa

SEQ ID NO: 51826 - DNA, 15 bp, Homo sapiens
ccataaaaaaaagaa

SEQ ID NO: 51827 - DNA, 15 bp, Homo sapiens
gccataaaaaaaaga

SEQ ID NO: 51828 - DNA, 15 bp, Homo sapiens
agccataaaaaaaag

SEQ ID NO: 51829 - DNA, 15 bp, Homo sapiens
gagccataaaaaaaa

SEQ ID NO: 51830 - DNA, 15 bp, Homo sapiens
tgagccataaaaaaa

SEQ ID NO: 51831 - DNA, 15 bp, Homo sapiens
ctgagccataaaaaa

SEQ ID NO: 51832 - DNA, 15 bp, Homo sapiens
tctgagccataaaaa

SEQ ID NO: 51833 - DNA, 15 bp, Homo sapiens
ttctgagccataaaa

SEQ ID NO: 51834 - DNA, 15 bp, Homo sapiens
tttctgagccataaa

SEQ ID NO: 51835 - DNA, 15 bp, Homo sapiens
ttttctgagccataa

SEQ ID NO: 51836 - DNA, 15 bp, Homo sapiens
attttctgagccata

SEQ ID NO: 51837 - DNA, 15 bp, Homo sapiens
cattttctgagccat

SEQ ID NO: 51838 - DNA, 15 bp, Homo sapiens
tcattttctgagcca

SEQ ID NO: 51839 - DNA, 15 bp, Homo sapiens
ttcattttctgagcc

SEQ ID NO: 51840 - DNA, 15 bp, Homo sapiens
attcattttctgagc

SEQ ID NO: 51841 - DNA, 15 bp, Homo sapiens
aattcattttctgag

SEQ ID NO: 51842 - DNA, 15 bp, Homo sapiens
aaattcattttctga

SEQ ID NO: 51843 - DNA, 15 bp, Homo sapiens
caaattcattttctg

SEQ ID NO: 51844 - DNA, 15 bp, Homo sapiens
acaaattcattttct

SEQ ID NO: 51845 - DNA, 15 bp, Homo sapiens
tacaaattcattttc

SEQ ID NO: 51846 - DNA, 15 bp, Homo sapiens
ttacaaattcatttt

SEQ ID NO: 51847 - DNA, 15 bp, Homo sapiens
attacaaattcattt

SEQ ID NO: 51848 - DNA, 15 bp, Homo sapiens
gattacaaattcatt

SEQ ID NO: 51849 - DNA, 15 bp, Homo sapiens
tgattacaaattcat

SEQ ID NO: 51850 - DNA, 15 bp, Homo sapiens
ttgattacaaattca

SEQ ID NO: 51851 - DNA, 15 bp, Homo sapiens
tttgattacaaattc

SEQ ID NO: 51852 - DNA, 15 bp, Homo sapiens
ttttgattacaaatt

SEQ ID NO: 51853 - DNA, 15 bp, Homo sapiens
gttttgattacaaat

SEQ ID NO: 51854 - DNA, 15 bp, Homo sapiens
ggttttgattacaaa

SEQ ID NO: 51855 - DNA, 15 bp, Homo sapiens
tggttttgattacaa

SEQ ID NO: 51856 - DNA, 15 bp, Homo sapiens
ttggttttgattaca

SEQ ID NO: 51857 - DNA, 15 bp, Homo sapiens
tttggttttgattac

SEQ ID NO: 51858 - DNA, 15 bp, Homo sapiens
ttttggttttgatta

SEQ ID NO: 51859 - DNA, 15 bp, Homo sapiens
gttttggttttgatt

SEQ ID NO: 51860 - DNA, 15 bp, Homo sapiens
cgttttggttttgat

SEQ ID NO: 51861 - DNA, 15 bp, Homo sapiens
ccgttttggttttga

SEQ ID NO: 51862 - DNA, 15 bp, Homo sapiens
tccgttttggttttg

SEQ ID NO: 51863 - DNA, 15 bp, Homo sapiens
atccgttttggtttt

SEQ ID NO: 51864 - DNA, 15 bp, Homo sapiens
tatccgttttggttt

SEQ ID NO: 51865 - DNA, 15 bp, Homo sapiens
ttatccgttttggtt

SEQ ID NO: 51866 - DNA, 15 bp, Homo sapiens
attatccgttttggt

SEQ ID NO: 51867 - DNA, 15 bp, Homo sapiens
cattatccgttttgg

SEQ ID NO: 51868 - DNA, 15 bp, Homo sapiens
ccattatccgttttg

SEQ ID NO: 51869 - DNA, 15 bp, Homo sapiens
accattatccgtttt

SEQ ID NO: 51870 - DNA, 15 bp, Homo sapiens
aaccattatccgttt

SEQ ID NO: 51871 - DNA, 15 bp, Homo sapiens
aaaccattatccgtt

SEQ ID NO: 51872 - DNA, 15 bp, Homo sapiens
aaaaccattatccgt

SEQ ID NO: 51873 - DNA, 15 bp, Homo sapiens
taaaaccattatccg

SEQ ID NO: 51874 - DNA, 15 bp, Homo sapiens
ttaaaaccattatcc

SEQ ID NO: 51875 - DNA, 15 bp, Homo sapiens
tttaaaaccattatc

SEQ ID NO: 51876 - DNA, 15 bp, Homo sapiens
atttaaaaccattat

SEQ ID NO: 51877 - DNA, 15 bp, Homo sapiens
aatttaaaaccatta

SEQ ID NO: 51878 - DNA, 15 bp, Homo sapiens
gaatttaaaaccatt

SEQ ID NO: 51879 - DNA, 15 bp, Homo sapiens
agaatttaaaaccat

SEQ ID NO: 51880 - DNA, 15 bp, Homo sapiens
aagaatttaaaacca

SEQ ID NO: 51881 - DNA, 15 bp, Homo sapiens
gaagaatttaaaacc

SEQ ID NO: 51882 - DNA, 15 bp, Homo sapiens
agaagaatttaaaac

SEQ ID NO: 51883 - DNA, 15 bp, Homo sapiens
cagaagaatttaaaa

SEQ ID NO: 51884 - DNA, 15 bp, Homo sapiens
tcagaagaatttaaa

SEQ ID NO: 51885 - DNA, 15 bp, Homo sapiens
atcagaagaatttaa

SEQ ID NO: 51886 - DNA, 15 bp, Homo sapiens
aatcagaagaattta

SEQ ID NO: 51887 - DNA, 15 bp, Homo sapiens
aaatcagaagaattt

SEQ ID NO: 51888 - DNA, 15 bp, Homo sapiens
aaaatcagaagaatt

SEQ ID NO: 51889 - DNA, 15 bp, Homo sapiens
aaaaatcagaagaat

SEQ ID NO: 51890 - DNA, 15 bp, Homo sapiens
gaaaaatcagaagaa

SEQ ID NO: 51891 - DNA, 15 bp, Homo sapiens
agaaaaatcagaaga

SEQ ID NO: 51892 - DNA, 15 bp, Homo sapiens
tagaaaaatcagaag

SEQ ID NO: 51893 - DNA, 15 bp, Homo sapiens
gtagaaaaatcagaa

SEQ ID NO: 51894 - DNA, 15 bp, Homo sapiens
ggtagaaaaatcaga

SEQ ID NO: 51895 - DNA, 15 bp, Homo sapiens
aggtagaaaaatcag

SEQ ID NO: 51896 - DNA, 15 bp, Homo sapiens
caggtagaaaaatca

SEQ ID NO: 51897 - DNA, 15 bp, Homo sapiens
acaggtagaaaaatc

SEQ ID NO: 51898 - DNA, 15 bp, Homo sapiens
tacaggtagaaaaat

SEQ ID NO: 51899 - DNA, 15 bp, Homo sapiens
ttacaggtagaaaaa

SEQ ID NO: 51900 - DNA, 15 bp, Homo sapiens
tttacaggtagaaaa

SEQ ID NO: 51901 - DNA, 15 bp, Homo sapiens
ttttacaggtagaaa

SEQ ID NO: 51902 - DNA, 15 bp, Homo sapiens
cttttacaggtagaa

SEQ ID NO: 51903 - DNA, 15 bp, Homo sapiens
acttttacaggtaga

SEQ ID NO: 51904 - DNA, 15 bp, Homo sapiens
aacttttacaggtag

SEQ ID NO: 51905 - DNA, 15 bp, Homo sapiens
gaacttttacaggta

SEQ ID NO: 51906 - DNA, 15 bp, Homo sapiens
cgaacttttacaggt

SEQ ID NO: 51907 - DNA, 15 bp, Homo sapiens
acgaacttttacagg

SEQ ID NO: 51908 - DNA, 15 bp, Homo sapiens
tacgaacttttacag

SEQ ID NO: 51909 - DNA, 15 bp, Homo sapiens
atacgaacttttaca

SEQ ID NO: 51910 - DNA, 15 bp, Homo sapiens
tatacgaacttttac

SEQ ID NO: 51911 - DNA, 15 bp, Homo sapiens
ctatacgaactttta

SEQ ID NO: 51912 - DNA, 15 bp, Homo sapiens
tctatacgaactttt

SEQ ID NO: 51913 - DNA, 15 bp, Homo sapiens
atctatacgaacttt

SEQ ID NO: 51914 - DNA, 15 bp, Homo sapiens
gatctatacgaactt

SEQ ID NO: 51915 - DNA, 15 bp, Homo sapiens
tgatctatacgaact

SEQ ID NO: 51916 - DNA, 15 bp, Homo sapiens
ttgatctatacgaac

SEQ ID NO: 51917 - DNA, 15 bp, Homo sapiens
cttgatctatacgaa

SEQ ID NO: 51918 - DNA, 15 bp, Homo sapiens
tcttgatctatacga

SEQ ID NO: 51919 - DNA, 15 bp, Homo sapiens
atcttgatctatacg

SEQ ID NO: 51920 - DNA, 15 bp, Homo sapiens
gatcttgatctatac

SEQ ID NO: 51921 - DNA, 15 bp, Homo sapiens
tgatcttgatctata

SEQ ID NO: 51922 - DNA, 15 bp, Homo sapiens
atgatcttgatctat

SEQ ID NO: 51923 - DNA, 15 bp, Homo sapiens
aatgatcttgatcta

SEQ ID NO: 51924 - DNA, 15 bp, Homo sapiens
taatgatcttgatct

SEQ ID NO: 51925 - DNA, 15 bp, Homo sapiens
ttaatgatcttgatc

SEQ ID NO: 51926 - DNA, 15 bp, Homo sapiens
tttaatgatcttgat

SEQ ID NO: 51927 - DNA, 15 bp, Homo sapiens
ttttaatgatcttga

SEQ ID NO: 51928 - DNA, 15 bp, Homo sapiens
gttttaatgatcttg

SEQ ID NO: 51929 - DNA, 15 bp, Homo sapiens
ggttttaatgatctt

SEQ ID NO: 51930 - DNA, 15 bp, Homo sapiens
aggttttaatgatct

SEQ ID NO: 51931 - DNA, 15 bp, Homo sapiens
gaggttttaatgatc

SEQ ID NO: 51932 - DNA, 15 bp, Homo sapiens
tgaggttttaatgat

SEQ ID NO: 51933 - DNA, 15 bp, Homo sapiens
atgaggttttaatga

SEQ ID NO: 51934 - DNA, 15 bp, Homo sapiens
catgaggttttaatg

SEQ ID NO: 51935 - DNA, 15 bp, Homo sapiens
gcatgaggttttaat

SEQ ID NO: 51936 - DNA, 15 bp, Homo sapiens
ggcatgaggttttaa

SEQ ID NO: 51937 - DNA, 15 bp, Homo sapiens
tggcatgaggtttta

SEQ ID NO: 51938 - DNA, 15 bp, Homo sapiens
ttggcatgaggtttt

SEQ ID NO: 51939 - DNA, 15 bp, Homo sapiens
attggcatgaggttt

SEQ ID NO: 51940 - DNA, 15 bp, Homo sapiens
gattggcatgaggtt

SEQ ID NO: 51941 - DNA, 15 bp, Homo sapiens
agattggcatgaggt

SEQ ID NO: 51942 - DNA, 15 bp, Homo sapiens
aagattggcatgagg

SEQ ID NO: 51943 - DNA, 15 bp, Homo sapiens
taagattggcatgag

SEQ ID NO: 51944 - DNA, 15 bp, Homo sapiens
gtaagattggcatga

SEQ ID NO: 51945 - DNA, 15 bp, Homo sapiens
agtaagattggcatg

SEQ ID NO: 51946 - DNA, 15 bp, Homo sapiens
tagtaagattggcat

SEQ ID NO: 51947 - DNA, 15 bp, Homo sapiens
gtagtaagattggca

SEQ ID NO: 51948 - DNA, 15 bp, Homo sapiens
tgtagtaagattggc

SEQ ID NO: 51949 - DNA, 15 bp, Homo sapiens
ctgtagtaagattgg

SEQ ID NO: 51950 - DNA, 15 bp, Homo sapiens
cctgtagtaagattg

SEQ ID NO: 51951 - DNA, 15 bp, Homo sapiens
tcctgtagtaagatt

SEQ ID NO: 51952 - DNA, 15 bp, Homo sapiens
ttcctgtagtaagat

SEQ ID NO: 51953 - DNA, 15 bp, Homo sapiens
tttcctgtagtaaga

SEQ ID NO: 51954 - DNA, 15 bp, Homo sapiens
ttttcctgtagtaag

SEQ ID NO: 51955 - DNA, 15 bp, Homo sapiens
attttcctgtagtaa

SEQ ID NO: 51956 - DNA, 15 bp, Homo sapiens
cattttcctgtagta

SEQ ID NO: 51957 - DNA, 15 bp, Homo sapiens
ccattttcctgtagt

SEQ ID NO: 51958 - DNA, 15 bp, Homo sapiens
cccattttcctgtag

SEQ ID NO: 51959 - DNA, 15 bp, Homo sapiens
acccattttcctgta

SEQ ID NO: 51960 - DNA, 15 bp, Homo sapiens
aacccattttcctgt

SEQ ID NO: 51961 - DNA, 15 bp, Homo sapiens
taacccattttcctg

SEQ ID NO: 51962 - DNA, 15 bp, Homo sapiens
gtaacccattttcct

SEQ ID NO: 51963 - DNA, 15 bp, Homo sapiens
tgtaacccattttcc

SEQ ID NO: 51964 - DNA, 15 bp, Homo sapiens
ttgtaacccattttc

SEQ ID NO: 51965 - DNA, 15 bp, Homo sapiens
cttgtaacccatttt

SEQ ID NO: 51966 - DNA, 15 bp, Homo sapiens
tcttgtaacccattt

SEQ ID NO: 51967 - DNA, 15 bp, Homo sapiens
atcttgtaacccatt

SEQ ID NO: 51968 - DNA, 15 bp, Homo sapiens
aatcttgtaacccat

SEQ ID NO: 51969 - DNA, 15 bp, Homo sapiens
caatcttgtaaccca

SEQ ID NO: 51970 - DNA, 15 bp, Homo sapiens
tcaatcttgtaaccc

SEQ ID NO: 51971 - DNA, 15 bp, Homo sapiens
gtcaatcttgtaacc

SEQ ID NO: 51972 - DNA, 15 bp, Homo sapiens
ggtcaatcttgtaac

SEQ ID NO: 51973 - DNA, 15 bp, Homo sapiens
tggtcaatcttgtaa

SEQ ID NO: 51974 - DNA, 15 bp, Homo sapiens
atggtcaatcttgta

SEQ ID NO: 51975 - DNA, 15 bp, Homo sapiens
tatggtcaatcttgt

SEQ ID NO: 51976 - DNA, 15 bp, Homo sapiens
ttatggtcaatcttg

SEQ ID NO: 51977 - DNA, 15 bp, Homo sapiens
tttatggtcaatctt

SEQ ID NO: 51978 - DNA, 15 bp, Homo sapiens
gtttatggtcaatct

SEQ ID NO: 51979 - DNA, 15 bp, Homo sapiens
ggtttatggtcaatc

SEQ ID NO: 51980 - DNA, 15 bp, Homo sapiens
aggtttatggtcaat

SEQ ID NO: 51981 - DNA, 15 bp, Homo sapiens
aaggtttatggtcaa

SEQ ID NO: 51982 - DNA, 15 bp, Homo sapiens
taaggtttatggtca

SEQ ID NO: 51983 - DNA, 15 bp, Homo sapiens
ataaggtttatggtc

SEQ ID NO: 51984 - DNA, 15 bp, Homo sapiens
tataaggtttatggt

SEQ ID NO: 51985 - DNA, 15 bp, Homo sapiens
gtataaggtttatgg

SEQ ID NO: 51986 - DNA, 15 bp, Homo sapiens
agtataaggtttatg

SEQ ID NO: 51987 - DNA, 15 bp, Homo sapiens
cagtataaggtttat

SEQ ID NO: 51988 - DNA, 15 bp, Homo sapiens
acagtataaggttta

SEQ ID NO: 51989 - DNA, 15 bp, Homo sapiens
gacagtataaggttt

SEQ ID NO: 51990 - DNA, 15 bp, Homo sapiens
tgacagtataaggtt

SEQ ID NO: 51991 - DNA, 15 bp, Homo sapiens
atgacagtataaggt

SEQ ID NO: 51992 - DNA, 15 bp, Homo sapiens
aatgacagtataagg

SEQ ID NO: 51993 - DNA, 15 bp, Homo sapiens
gaatgacagtataag

SEQ ID NO: 51994 - DNA, 15 bp, Homo sapiens
agaatgacagtataa

SEQ ID NO: 51995 - DNA, 15 bp, Homo sapiens
tagaatgacagtata

SEQ ID NO: 51996 - DNA, 15 bp, Homo sapiens
ctagaatgacagtat

SEQ ID NO: 51997 - DNA, 15 bp, Homo sapiens
tctagaatgacagta

SEQ ID NO: 51998 - DNA, 15 bp, Homo sapiens
ctctagaatgacagt

SEQ ID NO: 51999 - DNA, 15 bp, Homo sapiens
cctctagaatgacag

SEQ ID NO: 52000 - DNA, 15 bp, Homo sapiens
ccctctagaatgaca

SEQ ID NO: 52001 - DNA, 15 bp, Homo sapiens
accctctagaatgac

SEQ ID NO: 52002 - DNA, 15 bp, Homo sapiens
caccctctagaatga

SEQ ID NO: 52003 - DNA, 15 bp, Homo sapiens
acaccctctagaatg

SEQ ID NO: 52004 - DNA, 15 bp, Homo sapiens
tacaccctctagaat

SEQ ID NO: 52005 - DNA, 15 bp, Homo sapiens
ctacaccctctagaa

SEQ ID NO: 52006 - DNA, 15 bp, Homo sapiens
cctacaccctctaga

SEQ ID NO: 52007 - DNA, 15 bp, Homo sapiens
tcctacaccctctag

SEQ ID NO: 52008 - DNA, 15 bp, Homo sapiens
gtcctacaccctcta

SEQ ID NO: 52009 - DNA, 15 bp, Homo sapiens
ggtcctacaccctct

SEQ ID NO: 52010 - DNA, 15 bp, Homo sapiens
tggtcctacaccctc

SEQ ID NO: 52011 - DNA, 15 bp, Homo sapiens
ctggtcctacaccct

SEQ ID NO: 52012 - DNA, 15 bp, Homo sapiens
actggtcctacaccc

SEQ ID NO: 52013 - DNA, 15 bp, Homo sapiens
tactggtcctacacc

SEQ ID NO: 52014 - DNA, 15 bp, Homo sapiens
atactggtcctacac

SEQ ID NO: 52015 - DNA, 15 bp, Homo sapiens
catactggtcctaca

SEQ ID NO: 52016 - DNA, 15 bp, Homo sapiens
tcatactggtcctac

SEQ ID NO: 52017 - DNA, 15 bp, Homo sapiens
ttcatactggtccta

SEQ ID NO: 52018 - DNA, 15 bp, Homo sapiens
cttcatactggtcct

SEQ ID NO: 52019 - DNA, 15 bp, Homo sapiens
tcttcatactggtcc

SEQ ID NO: 52020 - DNA, 15 bp, Homo sapiens
ctcttcatactggtc

SEQ ID NO: 52021 - DNA, 15 bp, Homo sapiens
cctcttcatactggt

SEQ ID NO: 52022 - DNA, 15 bp, Homo sapiens
ccctcttcatactgg

SEQ ID NO: 52023 - DNA, 15 bp, Homo sapiens
tccctcttcatactg

SEQ ID NO: 52024 - DNA, 15 bp, Homo sapiens
ctccctcttcatact

SEQ ID NO: 52025 - DNA, 15 bp, Homo sapiens
cctccctcttcatac

SEQ ID NO: 52026 - DNA, 15 bp, Homo sapiens
tcctccctcttcata

SEQ ID NO: 52027 - DNA, 15 bp, Homo sapiens
ttcctccctcttcat

SEQ ID NO: 52028 - DNA, 15 bp, Homo sapiens
cttcctccctcttca

SEQ ID NO: 52029 - DNA, 15 bp, Homo sapiens
acttcctccctcttc

SEQ ID NO: 52030 - DNA, 15 bp, Homo sapiens
gacttcctccctctt

SEQ ID NO: 52031 - DNA, 15 bp, Homo sapiens
tgacttcctccctct

SEQ ID NO: 52032 - DNA, 15 bp, Homo sapiens
gtgacttcctccctc

SEQ ID NO: 52033 - DNA, 15 bp, Homo sapiens
cgtgacttcctccct

SEQ ID NO: 52034 - DNA, 15 bp, Homo sapiens
tcgtgacttcctccc

SEQ ID NO: 52035 - DNA, 15 bp, Homo sapiens
ttcgtgacttcctcc

SEQ ID NO: 52036 - DNA, 15 bp, Homo sapiens
attcgtgacttcctc

SEQ ID NO: 52037 - DNA, 15 bp, Homo sapiens
aattcgtgacttcct

SEQ ID NO: 52038 - DNA, 15 bp, Homo sapiens
gaattcgtgacttcc

SEQ ID NO: 52039 - DNA, 15 bp, Homo sapiens
ggaattcgtgacttc

SEQ ID NO: 52040 - DNA, 15 bp, Homo sapiens
aggaattcgtgactt

SEQ ID NO: 52041 - DNA, 15 bp, Homo sapiens
caggaattcgtgact

SEQ ID NO: 52042 - DNA, 15 bp, Homo sapiens
tcaggaattcgtgac

SEQ ID NO: 52043 - DNA, 15 bp, Homo sapiens
ctcaggaattcgtga

SEQ ID NO: 52044 - DNA, 15 bp, Homo sapiens
actcaggaattcgtg

SEQ ID NO: 52045 - DNA, 15 bp, Homo sapiens
aactcaggaattcgt

SEQ ID NO: 52046 - DNA, 15 bp, Homo sapiens
aaactcaggaattcg

SEQ ID NO: 52047 - DNA, 15 bp, Homo sapiens
aaaactcaggaattc

SEQ ID NO: 52048 - DNA, 15 bp, Homo sapiens
aaaaactcaggaatt

SEQ ID NO: 52049 - DNA, 15 bp, Homo sapiens
taaaaactcaggaat

SEQ ID NO: 52050 - DNA, 15 bp, Homo sapiens
ataaaaactcaggaa

SEQ ID NO: 52051 - DNA, 15 bp, Homo sapiens
aataaaaactcagga

SEQ ID NO: 52052 - DNA, 15 bp, Homo sapiens
caataaaaactcagg

SEQ ID NO: 52053 - DNA, 15 bp, Homo sapiens
ccaataaaaactcag

SEQ ID NO: 52054 - DNA, 15 bp, Homo sapiens
tccaataaaaactca

SEQ ID NO: 52055 - DNA, 15 bp, Homo sapiens
atccaataaaaactc

SEQ ID NO: 52056 - DNA, 15 bp, Homo sapiens
tatccaataaaaact

SEQ ID NO: 52057 - DNA, 15 bp, Homo sapiens
ttatccaataaaaac

SEQ ID NO: 52058 - DNA, 15 bp, Homo sapiens
gttatccaataaaaa

SEQ ID NO: 52059 - DNA, 15 bp, Homo sapiens
agttatccaataaaa

SEQ ID NO: 52060 - DNA, 15 bp, Homo sapiens
aagttatccaataaa

SEQ ID NO: 52061 - DNA, 15 bp, Homo sapiens
aaagttatccaataa

SEQ ID NO: 52062 - DNA, 15 bp, Homo sapiens
taaagttatccaata

SEQ ID NO: 52063 - DNA, 15 bp, Homo sapiens
ttaaagttatccaat

SEQ ID NO: 52064 - DNA, 15 bp, Homo sapiens
attaaagttatccaa

SEQ ID NO: 52065 - DNA, 15 bp, Homo sapiens
aattaaagttatcca

SEQ ID NO: 52066 - DNA, 15 bp, Homo sapiens
aaattaaagttatcc

SEQ ID NO: 52067 - DNA, 15 bp, Homo sapiens
aaaattaaagttatc

SEQ ID NO: 52068 - DNA, 15 bp, Homo sapiens
aaaaattaaagttat

SEQ ID NO: 52069 - DNA, 15 bp, Homo sapiens
caaaaattaaagtta

SEQ ID NO: 52070 - DNA, 15 bp, Homo sapiens
acaaaaattaaagtt

SEQ ID NO: 52071 - DNA, 15 bp, Homo sapiens
aacaaaaattaaagt

SEQ ID NO: 52072 - DNA, 15 bp, Homo sapiens
aaacaaaaattaaag

SEQ ID NO: 52073 - DNA, 15 bp, Homo sapiens
aaaacaaaaattaaa

SEQ ID NO: 52074 - DNA, 15 bp, Homo sapiens
aaaaacaaaaattaa

SEQ ID NO: 52075 - DNA, 15 bp, Homo sapiens
taaaaacaaaaatta

SEQ ID NO: 52076 - DNA, 15 bp, Homo sapiens
ctaaaaacaaaaatt

SEQ ID NO: 52077 - DNA, 15 bp, Homo sapiens
gctaaaaacaaaaat

SEQ ID NO: 52078 - DNA, 15 bp, Homo sapiens
tgctaaaaacaaaaa

SEQ ID NO: 52079 - DNA, 15 bp, Homo sapiens
atgctaaaaacaaaa

SEQ ID NO: 52080 - DNA, 15 bp, Homo sapiens
catgctaaaaacaaa

SEQ ID NO: 52081 - DNA, 15 bp, Homo sapiens
gcatgctaaaaacaa

SEQ ID NO: 52082 - DNA, 15 bp, Homo sapiens
agcatgctaaaaaca

SEQ ID NO: 52083 - DNA, 15 bp, Homo sapiens
cagcatgctaaaaac

SEQ ID NO: 52084 - DNA, 15 bp, Homo sapiens
tcagcatgctaaaaa

SEQ ID NO: 52085 - DNA, 15 bp, Homo sapiens
gtcagcatgctaaaa

SEQ ID NO: 52086 - DNA, 15 bp, Homo sapiens
tgtcagcatgctaaa

SEQ ID NO: 52087 - DNA, 15 bp, Homo sapiens
atgtcagcatgctaa

SEQ ID NO: 52088 - DNA, 15 bp, Homo sapiens
aatgtcagcatgcta

SEQ ID NO: 52089 - DNA, 15 bp, Homo sapiens
aaatgtcagcatgct

SEQ ID NO: 52090 - DNA, 15 bp, Homo sapiens
aaaatgtcagcatgc

SEQ ID NO: 52091 - DNA, 15 bp, Homo sapiens
caaaatgtcagcatg

SEQ ID NO: 52092 - DNA, 15 bp, Homo sapiens
tcaaaatgtcagcat

SEQ ID NO: 52093 - DNA, 15 bp, Homo sapiens
atcaaaatgtcagca

SEQ ID NO: 52094 - DNA, 15 bp, Homo sapiens
aatcaaaatgtcagc

SEQ ID NO: 52095 - DNA, 15 bp, Homo sapiens
taatcaaaatgtcag

SEQ ID NO: 52096 - DNA, 15 bp, Homo sapiens
ataatcaaaatgtca

SEQ ID NO: 52097 - DNA, 15 bp, Homo sapiens
cataatcaaaatgtc

SEQ ID NO: 52098 - DNA, 15 bp, Homo sapiens
gcataatcaaaatgt

SEQ ID NO: 52099 - DNA, 15 bp, Homo sapiens
agcataatcaaaatg

SEQ ID NO: 52100 - DNA, 15 bp, Homo sapiens
cagcataatcaaaat

SEQ ID NO: 52101 - DNA, 15 bp, Homo sapiens
tcagcataatcaaaa

SEQ ID NO: 52102 - DNA, 15 bp, Homo sapiens
ttcagcataatcaaa

SEQ ID NO: 52103 - DNA, 15 bp, Homo sapiens
tttcagcataatcaa

SEQ ID NO: 52104 - DNA, 15 bp, Homo sapiens
atttcagcataatca

SEQ ID NO: 52105 - DNA, 15 bp, Homo sapiens
aatttcagcataatc

SEQ ID NO: 52106 - DNA, 15 bp, Homo sapiens
aaatttcagcataat

SEQ ID NO: 52107 - DNA, 15 bp, Homo sapiens
aaaatttcagcataa

SEQ ID NO: 52108 - DNA, 15 bp, Homo sapiens
taaaatttcagcata

SEQ ID NO: 52109 - DNA, 15 bp, Homo sapiens
gtaaaatttcagcat

SEQ ID NO: 52110 - DNA, 15 bp, Homo sapiens
agtaaaatttcagca

SEQ ID NO: 52111 - DNA, 15 bp, Homo sapiens
aagtaaaatttcagc

SEQ ID NO: 52112 - DNA, 15 bp, Homo sapiens
caagtaaaatttcag

SEQ ID NO: 52113 - DNA, 15 bp, Homo sapiens
gcaagtaaaatttca

SEQ ID NO: 52114 - DNA, 15 bp, Homo sapiens
tgcaagtaaaatttc

SEQ ID NO: 52115 - DNA, 15 bp, Homo sapiens
gtgcaagtaaaattt

SEQ ID NO: 52116 - DNA, 15 bp, Homo sapiens
tgtgcaagtaaaatt

SEQ ID NO: 52117 - DNA, 15 bp, Homo sapiens
ttgtgcaagtaaaat

SEQ ID NO: 52118 - DNA, 15 bp, Homo sapiens
tttgtgcaagtaaaa

SEQ ID NO: 52119 - DNA, 15 bp, Homo sapiens
ttttgtgcaagtaaa

SEQ ID NO: 52120 - DNA, 15 bp, Homo sapiens
attttgtgcaagtaa

SEQ ID NO: 52121 - DNA, 15 bp, Homo sapiens
cattttgtgcaagta

SEQ ID NO: 52122 - DNA, 15 bp, Homo sapiens
acattttgtgcaagt

SEQ ID NO: 52123 - DNA, 15 bp, Homo sapiens
tacattttgtgcaag

SEQ ID NO: 52124 - DNA, 15 bp, Homo sapiens
ctacattttgtgcaa

SEQ ID NO: 52125 - DNA, 15 bp, Homo sapiens
gctacattttgtgca

SEQ ID NO: 52126 - DNA, 15 bp, Homo sapiens
tgctacattttgtgc

SEQ ID NO: 52127 - DNA, 15 bp, Homo sapiens
ctgctacattttgtg

SEQ ID NO: 52128 - DNA, 15 bp, Homo sapiens
tctgctacattttgt

SEQ ID NO: 52129 - DNA, 15 bp, Homo sapiens
ttctgctacattttg

SEQ ID NO: 52130 - DNA, 15 bp, Homo sapiens
tttctgctacatttt

SEQ ID NO: 52131 - DNA, 15 bp, Homo sapiens
ctttctgctacattt

SEQ ID NO: 52132 - DNA, 15 bp, Homo sapiens
actttctgctacatt

SEQ ID NO: 52133 - DNA, 15 bp, Homo sapiens
cactttctgctacat

SEQ ID NO: 52134 - DNA, 15 bp, Homo sapiens
gcactttctgctaca

SEQ ID NO: 52135 - DNA, 15 bp, Homo sapiens
agcactttctgctac

SEQ ID NO: 52136 - DNA, 15 bp, Homo sapiens
tagcactttctgcta

SEQ ID NO: 52137 - DNA, 15 bp, Homo sapiens
gtagcactttctgct

SEQ ID NO: 52138 - DNA, 15 bp, Homo sapiens
cgtagcactttctgc

SEQ ID NO: 52139 - DNA, 15 bp, Homo sapiens
ccgtagcactttctg

SEQ ID NO: 52140 - DNA, 15 bp, Homo sapiens
cccgtagcactttct

SEQ ID NO: 52141 - DNA, 15 bp, Homo sapiens
acccgtagcactttc

SEQ ID NO: 52142 - DNA, 15 bp, Homo sapiens
tacccgtagcacttt

SEQ ID NO: 52143 - DNA, 15 bp, Homo sapiens
gtacccgtagcactt

SEQ ID NO: 52144 - DNA, 15 bp, Homo sapiens
agtacccgtagcact

SEQ ID NO: 52145 - DNA, 15 bp, Homo sapiens
tagtacccgtagcac

SEQ ID NO: 52146 - DNA, 15 bp, Homo sapiens
ctagtacccgtagca

SEQ ID NO: 52147 - DNA, 15 bp, Homo sapiens
gctagtacccgtagc

SEQ ID NO: 52148 - DNA, 15 bp, Homo sapiens
agctagtacccgtag

SEQ ID NO: 52149 - DNA, 15 bp, Homo sapiens
cagctagtacccgta

SEQ ID NO: 52150 - DNA, 15 bp, Homo sapiens
ccagctagtacccgt

SEQ ID NO: 52151 - DNA, 15 bp, Homo sapiens
tccagctagtacccg

SEQ ID NO: 52152 - DNA, 15 bp, Homo sapiens
ttccagctagtaccc

SEQ ID NO: 52153 - DNA, 15 bp, Homo sapiens
tttccagctagtacc

SEQ ID NO: 52154 - DNA, 15 bp, Homo sapiens
ctttccagctagtac

SEQ ID NO: 52155 - DNA, 15 bp, Homo sapiens
actttccagctagta

SEQ ID NO: 52156 - DNA, 15 bp, Homo sapiens
tactttccagctagt

SEQ ID NO: 52157 - DNA, 15 bp, Homo sapiens
ctactttccagctag

SEQ ID NO: 52158 - DNA, 15 bp, Homo sapiens
cctactttccagcta

SEQ ID NO: 52159 - DNA, 15 bp, Homo sapiens
ccctactttccagct

SEQ ID NO: 52160 - DNA, 15 bp, Homo sapiens
gccctactttccagc

SEQ ID NO: 52161 - DNA, 15 bp, Homo sapiens
agccctactttccag

SEQ ID NO: 52162 - DNA, 15 bp, Homo sapiens
gagccctactttcca

SEQ ID NO: 52163 - DNA, 15 bp, Homo sapiens
agagccctactttcc

SEQ ID NO: 52164 - DNA, 15 bp, Homo sapiens
cagagccctactttc

SEQ ID NO: 52165 - DNA, 15 bp, Homo sapiens
tcagagccctacttt

SEQ ID NO: 52166 - DNA, 15 bp, Homo sapiens
atcagagccctactt

SEQ ID NO: 52167 - DNA, 15 bp, Homo sapiens
aatcagagccctact

SEQ ID NO: 52168 - DNA, 15 bp, Homo sapiens
aaatcagagccctac

SEQ ID NO: 52169 - DNA, 15 bp, Homo sapiens
caaatcagagcccta

SEQ ID NO: 52170 - DNA, 15 bp, Homo sapiens
tcaaatcagagccct

SEQ ID NO: 52171 - DNA, 15 bp, Homo sapiens
atcaaatcagagccc

SEQ ID NO: 52172 - DNA, 15 bp, Homo sapiens
gatcaaatcagagcc

SEQ ID NO: 52173 - DNA, 15 bp, Homo sapiens
ggatcaaatcagagc

SEQ ID NO: 52174 - DNA, 15 bp, Homo sapiens
cggatcaaatcagag

SEQ ID NO: 52175 - DNA, 15 bp, Homo sapiens
tcggatcaaatcaga

SEQ ID NO: 52176 - DNA, 15 bp, Homo sapiens
atcggatcaaatcag

SEQ ID NO: 52177 - DNA, 15 bp, Homo sapiens
tatcggatcaaatca

SEQ ID NO: 52178 - DNA, 15 bp, Homo sapiens
ttatcggatcaaatc

SEQ ID NO: 52179 - DNA, 15 bp, Homo sapiens
tttatcggatcaaat

SEQ ID NO: 52180 - DNA, 15 bp, Homo sapiens
gtttatcggatcaaa

SEQ ID NO: 52181 - DNA, 15 bp, Homo sapiens
ggtttatcggatcaa

SEQ ID NO: 52182 - DNA, 15 bp, Homo sapiens
aggtttatcggatca

SEQ ID NO: 52183 - DNA, 15 bp, Homo sapiens
caggtttatcggatc

SEQ ID NO: 52184 - DNA, 15 bp, Homo sapiens
ccaggtttatcggat

SEQ ID NO: 52185 - DNA, 15 bp, Homo sapiens
tccaggtttatcgga

SEQ ID NO: 52186 - DNA, 15 bp, Homo sapiens
atccaggtttatcgg

SEQ ID NO: 52187 - DNA, 15 bp, Homo sapiens
aatccaggtttatcg

SEQ ID NO: 52188 - DNA, 15 bp, Homo sapiens
aaatccaggtttatc

SEQ ID NO: 52189 - DNA, 15 bp, Homo sapiens
caaatccaggtttat

SEQ ID NO: 52190 - DNA, 15 bp, Homo sapiens
ccaaatccaggttta

SEQ ID NO: 52191 - DNA, 15 bp, Homo sapiens
accaaatccaggttt

SEQ ID NO: 52192 - DNA, 15 bp, Homo sapiens
gaccaaatccaggtt

SEQ ID NO: 52193 - DNA, 15 bp, Homo sapiens
tgaccaaatccaggt

SEQ ID NO: 52194 - DNA, 15 bp, Homo sapiens
gtgaccaaatccagg

SEQ ID NO: 52195 - DNA, 15 bp, Homo sapiens
agtgaccaaatccag

SEQ ID NO: 52196 - DNA, 15 bp, Homo sapiens
cagtgaccaaatcca

SEQ ID NO: 52197 - DNA, 15 bp, Homo sapiens
tcagtgaccaaatcc

SEQ ID NO: 52198 - DNA, 15 bp, Homo sapiens
atcagtgaccaaatc

SEQ ID NO: 52199 - DNA, 15 bp, Homo sapiens
catcagtgaccaaat

SEQ ID NO: 52200 - DNA, 15 bp, Homo sapiens
ccatcagtgaccaaa

SEQ ID NO: 52201 - DNA, 15 bp, Homo sapiens
gccatcagtgaccaa

SEQ ID NO: 52202 - DNA, 15 bp, Homo sapiens
tgccatcagtgacca

SEQ ID NO: 52203 - DNA, 15 bp, Homo sapiens
ctgccatcagtgacc

SEQ ID NO: 52204 - DNA, 15 bp, Homo sapiens
cctgccatcagtgac

SEQ ID NO: 52205 - DNA, 15 bp, Homo sapiens
tcctgccatcagtga

SEQ ID NO: 52206 - DNA, 15 bp, Homo sapiens
gtcctgccatcagtg

SEQ ID NO: 52207 - DNA, 15 bp, Homo sapiens
agtcctgccatcagt

SEQ ID NO: 52208 - DNA, 15 bp, Homo sapiens
gagtcctgccatcag

SEQ ID NO: 52209 - DNA, 15 bp, Homo sapiens
ggagtcctgccatca

SEQ ID NO: 52210 - DNA, 15 bp, Homo sapiens
cggagtcctgccatc

SEQ ID NO: 52211 - DNA, 15 bp, Homo sapiens
ccggagtcctgccat

SEQ ID NO: 52212 - DNA, 15 bp, Homo sapiens
cccggagtcctgcca

SEQ ID NO: 52213 - DNA, 15 bp, Homo sapiens
ccccggagtcctgcc

SEQ ID NO: 52214 - DNA, 15 bp, Homo sapiens
accccggagtcctgc

SEQ ID NO: 52215 - DNA, 15 bp, Homo sapiens
aaccccggagtcctg

SEQ ID NO: 52216 - DNA, 15 bp, Homo sapiens
aaaccccggagtcct

SEQ ID NO: 52217 - DNA, 15 bp, Homo sapiens
taaaccccggagtcc

SEQ ID NO: 52218 - DNA, 15 bp, Homo sapiens
ctaaaccccggagtc

SEQ ID NO: 52219 - DNA, 15 bp, Homo sapiens
cctaaaccccggagt

SEQ ID NO: 52220 - DNA, 15 bp, Homo sapiens
ccctaaaccccggag

SEQ ID NO: 52221 - DNA, 15 bp, Homo sapiens
accctaaaccccgga

SEQ ID NO: 52222 - DNA, 15 bp, Homo sapiens
caccctaaaccccgg

SEQ ID NO: 52223 - DNA, 15 bp, Homo sapiens
tcaccctaaaccccg

SEQ ID NO: 52224 - DNA, 15 bp, Homo sapiens
ctcaccctaaacccc

SEQ ID NO: 52225 - DNA, 15 bp, Homo sapiens
tctcaccctaaaccc

SEQ ID NO: 52226 - DNA, 15 bp, Homo sapiens
gtctcaccctaaacc

SEQ ID NO: 52227 - DNA, 15 bp, Homo sapiens
tgtctcaccctaaac

SEQ ID NO: 52228 - DNA, 15 bp, Homo sapiens
ttgtctcaccctaaa

SEQ ID NO: 52229 - DNA, 15 bp, Homo sapiens
gttgtctcaccctaa

SEQ ID NO: 52230 - DNA, 15 bp, Homo sapiens
ggttgtctcacccta

SEQ ID NO: 52231 - DNA, 15 bp, Homo sapiens
aggttgtctcaccct

SEQ ID NO: 52232 - DNA, 15 bp, Homo sapiens
caggttgtctcaccc

SEQ ID NO: 52233 - DNA, 15 bp, Homo sapiens
ccaggttgtctcacc

SEQ ID NO: 52234 - DNA, 15 bp, Homo sapiens
accaggttgtctcac

SEQ ID NO: 52235 - DNA, 15 bp, Homo sapiens
gaccaggttgtctca

SEQ ID NO: 52236 - DNA, 15 bp, Homo sapiens
ggaccaggttgtctc

SEQ ID NO: 52237 - DNA, 15 bp, Homo sapiens
gggaccaggttgtct

SEQ ID NO: 52238 - DNA, 15 bp, Homo sapiens
agggaccaggttgtc

SEQ ID NO: 52239 - DNA, 15 bp, Homo sapiens
aagggaccaggttgt

SEQ ID NO: 52240 - DNA, 15 bp, Homo sapiens
caagggaccaggttg

SEQ ID NO: 52241 - DNA, 15 bp, Homo sapiens
ccaagggaccaggtt

SEQ ID NO: 52242 - DNA, 15 bp, Homo sapiens
cccaagggaccaggt

SEQ ID NO: 52243 - DNA, 15 bp, Homo sapiens
tcccaagggaccagg

SEQ ID NO: 52244 - DNA, 15 bp, Homo sapiens
ttcccaagggaccag

SEQ ID NO: 52245 - DNA, 15 bp, Homo sapiens
tttcccaagggacca

SEQ ID NO: 52246 - DNA, 15 bp, Homo sapiens
ctttcccaagggacc

SEQ ID NO: 52247 - DNA, 15 bp, Homo sapiens
cctttcccaagggac

SEQ ID NO: 52248 - DNA, 15 bp, Homo sapiens
acctttcccaaggga

SEQ ID NO: 52249 - DNA, 15 bp, Homo sapiens
cacctttcccaaggg

SEQ ID NO: 52250 - DNA, 15 bp, Homo sapiens
gcacctttcccaagg

SEQ ID NO: 52251 - DNA, 15 bp, Homo sapiens
ggcacctttcccaag

SEQ ID NO: 52252 - DNA, 15 bp, Homo sapiens
gggcacctttcccaa

SEQ ID NO: 52253 - DNA, 15 bp, Homo sapiens
cgggcacctttccca

SEQ ID NO: 52254 - DNA, 15 bp, Homo sapiens
tcgggcacctttccc

SEQ ID NO: 52255 - DNA, 15 bp, Homo sapiens
ctcgggcacctttcc

SEQ ID NO: 52256 - DNA, 15 bp, Homo sapiens
gctcgggcacctttc

SEQ ID NO: 52257 - DNA, 15 bp, Homo sapiens
ggctcgggcaccttt

SEQ ID NO: 52258 - DNA, 15 bp, Homo sapiens
aggctcgggcacctt

SEQ ID NO: 52259 - DNA, 15 bp, Homo sapiens
gaggctcgggcacct

SEQ ID NO: 52260 - DNA, 15 bp, Homo sapiens
ggaggctcgggcacc

SEQ ID NO: 52261 - DNA, 15 bp, Homo sapiens
gggaggctcgggcac

SEQ ID NO: 52262 - DNA, 15 bp, Homo sapiens
agggaggctcgggca

SEQ ID NO: 52263 - DNA, 15 bp, Homo sapiens
gagggaggctcgggc

SEQ ID NO: 52264 - DNA, 15 bp, Homo sapiens
agagggaggctcggg

SEQ ID NO: 52265 - DNA, 15 bp, Homo sapiens
cagagggaggctcgg

SEQ ID NO: 52266 - DNA, 15 bp, Homo sapiens
acagagggaggctcg

SEQ ID NO: 52267 - DNA, 15 bp, Homo sapiens
aacagagggaggctc

SEQ ID NO: 52268 - DNA, 15 bp, Homo sapiens
caacagagggaggct

SEQ ID NO: 52269 - DNA, 15 bp, Homo sapiens
acaacagagggaggc

SEQ ID NO: 52270 - DNA, 15 bp, Homo sapiens
tacaacagagggagg

SEQ ID NO: 52271 - DNA, 15 bp, Homo sapiens
ctacaacagagggag

SEQ ID NO: 52272 - DNA, 15 bp, Homo sapiens
cctacaacagaggga

SEQ ID NO: 52273 - DNA, 15 bp, Homo sapiens
gcctacaacagaggg

SEQ ID NO: 52274 - DNA, 15 bp, Homo sapiens
tgcctacaacagagg

SEQ ID NO: 52275 - DNA, 15 bp, Homo sapiens
ctgcctacaacagag

SEQ ID NO: 52276 - DNA, 15 bp, Homo sapiens
actgcctacaacaga

SEQ ID NO: 52277 - DNA, 15 bp, Homo sapiens
cactgcctacaacag

SEQ ID NO: 52278 - DNA, 15 bp, Homo sapiens
acactgcctacaaca

SEQ ID NO: 52279 - DNA, 15 bp, Homo sapiens
aacactgcctacaac

SEQ ID NO: 52280 - DNA, 15 bp, Homo sapiens
caacactgcctacaa

SEQ ID NO: 52281 - DNA, 15 bp, Homo sapiens
ccaacactgcctaca

SEQ ID NO: 52282 - DNA, 15 bp, Homo sapiens
cccaacactgcctac

SEQ ID NO: 52283 - DNA, 15 bp, Homo sapiens
gcccaacactgccta

SEQ ID NO: 52284 - DNA, 15 bp, Homo sapiens
agcccaacactgcct

SEQ ID NO: 52285 - DNA, 15 bp, Homo sapiens
gagcccaacactgcc

SEQ ID NO: 52286 - DNA, 15 bp, Homo sapiens
ggagcccaacactgc

SEQ ID NO: 52287 - DNA, 15 bp, Homo sapiens
tggagcccaacactg

SEQ ID NO: 52288 - DNA, 15 bp, Homo sapiens
atggagcccaacact

SEQ ID NO: 52289 - DNA, 15 bp, Homo sapiens
tatggagcccaacac

SEQ ID NO: 52290 - DNA, 15 bp, Homo sapiens
ttatggagcccaaca

SEQ ID NO: 52291 - DNA, 15 bp, Homo sapiens
cttatggagcccaac

SEQ ID NO: 52292 - DNA, 15 bp, Homo sapiens
acttatggagcccaa

SEQ ID NO: 52293 - DNA, 15 bp, Homo sapiens
cacttatggagccca

SEQ ID NO: 52294 - DNA, 15 bp, Homo sapiens
acacttatggagccc

SEQ ID NO: 52295 - DNA, 15 bp, Homo sapiens
tacacttatggagcc

SEQ ID NO: 52296 - DNA, 15 bp, Homo sapiens
gtacacttatggagc

SEQ ID NO: 52297 - DNA, 15 bp, Homo sapiens
ggtacacttatggag

SEQ ID NO: 52298 - DNA, 15 bp, Homo sapiens
cggtacacttatgga

SEQ ID NO: 52299 - DNA, 15 bp, Homo sapiens
ccggtacacttatgg

SEQ ID NO: 52300 - DNA, 15 bp, Homo sapiens
cccggtacacttatg

SEQ ID NO: 52301 - DNA, 15 bp, Homo sapiens
gcccggtacacttat

SEQ ID NO: 52302 - DNA, 15 bp, Homo sapiens
tgcccggtacactta

SEQ ID NO: 52303 - DNA, 15 bp, Homo sapiens
ctgcccggtacactt

SEQ ID NO: 52304 - DNA, 15 bp, Homo sapiens
actgcccggtacact

SEQ ID NO: 52305 - DNA, 15 bp, Homo sapiens
gactgcccggtacac

SEQ ID NO: 52306 - DNA, 15 bp, Homo sapiens
tgactgcccggtaca

SEQ ID NO: 52307 - DNA, 15 bp, Homo sapiens
atgactgcccggtac

SEQ ID NO: 52308 - DNA, 15 bp, Homo sapiens
gatgactgcccggta

SEQ ID NO: 52309 - DNA, 15 bp, Homo sapiens
tgatgactgcccggt

SEQ ID NO: 52310 - DNA, 15 bp, Homo sapiens
gtgatgactgcccgg

SEQ ID NO: 52311 - DNA, 15 bp, Homo sapiens
tgtgatgactgcccg

SEQ ID NO: 52312 - DNA, 15 bp, Homo sapiens
atgtgatgactgccc

SEQ ID NO: 52313 - DNA, 15 bp, Homo sapiens
aatgtgatgactgcc

SEQ ID NO: 52314 - DNA, 15 bp, Homo sapiens
gaatgtgatgactgc

SEQ ID NO: 52315 - DNA, 15 bp, Homo sapiens
agaatgtgatgactg

SEQ ID NO: 52316 - DNA, 15 bp, Homo sapiens
cagaatgtgatgact

SEQ ID NO: 52317 - DNA, 15 bp, Homo sapiens
gcagaatgtgatgac

SEQ ID NO: 52318 - DNA, 15 bp, Homo sapiens
tgcagaatgtgatga

SEQ ID NO: 52319 - DNA, 15 bp, Homo sapiens
atgcagaatgtgatg

SEQ ID NO: 52320 - DNA, 15 bp, Homo sapiens
aatgcagaatgtgat

SEQ ID NO: 52321 - DNA, 15 bp, Homo sapiens
taatgcagaatgtga

SEQ ID NO: 52322 - DNA, 15 bp, Homo sapiens
ctaatgcagaatgtg

SEQ ID NO: 52323 - DNA, 15 bp, Homo sapiens
gctaatgcagaatgt

SEQ ID NO: 52324 - DNA, 15 bp, Homo sapiens
agctaatgcagaatg

SEQ ID NO: 52325 - DNA, 15 bp, Homo sapiens
gagctaatgcagaat

SEQ ID NO: 52326 - DNA, 15 bp, Homo sapiens
ggagctaatgcagaa

SEQ ID NO: 52327 - DNA, 15 bp, Homo sapiens
cggagctaatgcaga

SEQ ID NO: 52328 - DNA, 15 bp, Homo sapiens
gcggagctaatgcag

SEQ ID NO: 52329 - DNA, 15 bp, Homo sapiens
ggcggagctaatgca

SEQ ID NO: 52330 - DNA, 15 bp, Homo sapiens
aggcggagctaatgc

SEQ ID NO: 52331 - DNA, 15 bp, Homo sapiens
gaggcggagctaatg

SEQ ID NO: 52332 - DNA, 15 bp, Homo sapiens
tgaggcggagctaat

SEQ ID NO: 52333 - DNA, 15 bp, Homo sapiens
atgaggcggagctaa

SEQ ID NO: 52334 - DNA, 15 bp, Homo sapiens
aatgaggcggagcta

SEQ ID NO: 52335 - DNA, 15 bp, Homo sapiens
caatgaggcggagct

SEQ ID NO: 52336 - DNA, 15 bp, Homo sapiens
acaatgaggcggagc

SEQ ID NO: 52337 - DNA, 15 bp, Homo sapiens
cacaatgaggcggag

SEQ ID NO: 52338 - DNA, 15 bp, Homo sapiens
gcacaatgaggcgga

SEQ ID NO: 52339 - DNA, 15 bp, Homo sapiens
agcacaatgaggcgg

SEQ ID NO: 52340 - DNA, 15 bp, Homo sapiens
gagcacaatgaggcg

SEQ ID NO: 52341 - DNA, 15 bp, Homo sapiens
tgagcacaatgaggc

SEQ ID NO: 52342 - DNA, 15 bp, Homo sapiens
ttgagcacaatgagg

SEQ ID NO: 52343 - DNA, 15 bp, Homo sapiens
cttgagcacaatgag

SEQ ID NO: 52344 - DNA, 15 bp, Homo sapiens
ccttgagcacaatga

SEQ ID NO: 52345 - DNA, 15 bp, Homo sapiens
tccttgagcacaatg

SEQ ID NO: 52346 - DNA, 15 bp, Homo sapiens
ctccttgagcacaat

SEQ ID NO: 52347 - DNA, 15 bp, Homo sapiens
gctccttgagcacaa

SEQ ID NO: 52348 - DNA, 15 bp, Homo sapiens
agctccttgagcaca

SEQ ID NO: 52349 - DNA, 15 bp, Homo sapiens
gagctccttgagcac

SEQ ID NO: 52350 - DNA, 15 bp, Homo sapiens
cgagctccttgagca

SEQ ID NO: 52351 - DNA, 15 bp, Homo sapiens
tcgagctccttgagc

SEQ ID NO: 52352 - DNA, 15 bp, Homo sapiens
gtcgagctccttgag

SEQ ID NO: 52353 - DNA, 15 bp, Homo sapiens
agtcgagctccttga

SEQ ID NO: 52354 - DNA, 15 bp, Homo sapiens
tagtcgagctccttg

SEQ ID NO: 52355 - DNA, 15 bp, Homo sapiens
ttagtcgagctcctt

SEQ ID NO: 52356 - DNA, 15 bp, Homo sapiens
attagtcgagctcct

SEQ ID NO: 52357 - DNA, 15 bp, Homo sapiens
tattagtcgagctcc

SEQ ID NO: 52358 - DNA, 15 bp, Homo sapiens
ctattagtcgagctc

SEQ ID NO: 52359 - DNA, 15 bp, Homo sapiens
cctattagtcgagct

SEQ ID NO: 52360 - DNA, 15 bp, Homo sapiens
tcctattagtcgagc

SEQ ID NO: 52361 - DNA, 15 bp, Homo sapiens
gtcctattagtcgag

SEQ ID NO: 52362 - DNA, 15 bp, Homo sapiens
agtcctattagtcga

SEQ ID NO: 52363 - DNA, 15 bp, Homo sapiens
tagtcctattagtcg

SEQ ID NO: 52364 - DNA, 15 bp, Homo sapiens
atagtcctattagtc

SEQ ID NO: 52365 - DNA, 15 bp, Homo sapiens
aatagtcctattagt

SEQ ID NO: 52366 - DNA, 15 bp, Homo sapiens
aaatagtcctattag

SEQ ID NO: 52367 - DNA, 15 bp, Homo sapiens
aaaatagtcctatta

SEQ ID NO: 52368 - DNA, 15 bp, Homo sapiens
taaaatagtcctatt

SEQ ID NO: 52369 - DNA, 15 bp, Homo sapiens
ttaaaatagtcctat

SEQ ID NO: 52370 - DNA, 15 bp, Homo sapiens
tttaaaatagtccta

SEQ ID NO: 52371 - DNA, 15 bp, Homo sapiens
gtttaaaatagtcct

SEQ ID NO: 52372 - DNA, 15 bp, Homo sapiens
agtttaaaatagtcc

SEQ ID NO: 52373 - DNA, 15 bp, Homo sapiens
gagtttaaaatagtc

SEQ ID NO: 52374 - DNA, 15 bp, Homo sapiens
agagtttaaaatagt

SEQ ID NO: 52375 - DNA, 15 bp, Homo sapiens
gagagtttaaaatag

SEQ ID NO: 52376 - DNA, 15 bp, Homo sapiens
ggagagtttaaaata

SEQ ID NO: 52377 - DNA, 15 bp, Homo sapiens
tggagagtttaaaat

SEQ ID NO: 52378 - DNA, 15 bp, Homo sapiens
ctggagagtttaaaa

SEQ ID NO: 52379 - DNA, 15 bp, Homo sapiens
cctggagagtttaaa

SEQ ID NO: 52380 - DNA, 15 bp, Homo sapiens
tcctggagagtttaa

SEQ ID NO: 52381 - DNA, 15 bp, Homo sapiens
atcctggagagttta

SEQ ID NO: 52382 - DNA, 15 bp, Homo sapiens
tatcctggagagttt

SEQ ID NO: 52383 - DNA, 15 bp, Homo sapiens
ctatcctggagagtt

SEQ ID NO: 52384 - DNA, 15 bp, Homo sapiens
tctatcctggagagt

SEQ ID NO: 52385 - DNA, 15 bp, Homo sapiens
ctctatcctggagag

SEQ ID NO: 52386 - DNA, 15 bp, Homo sapiens
tctctatcctggaga

SEQ ID NO: 52387 - DNA, 15 bp, Homo sapiens
atctctatcctggag

SEQ ID NO: 52388 - DNA, 15 bp, Homo sapiens
tatctctatcctgga

SEQ ID NO: 52389 - DNA, 15 bp, Homo sapiens
ttatctctatcctgg

SEQ ID NO: 52390 - DNA, 15 bp, Homo sapiens
gttatctctatcctg

SEQ ID NO: 52391 - DNA, 15 bp, Homo sapiens
ggttatctctatcct

SEQ ID NO: 52392 - DNA, 15 bp, Homo sapiens
aggttatctctatcc

SEQ ID NO: 52393 - DNA, 15 bp, Homo sapiens
aaggttatctctatc

SEQ ID NO: 52394 - DNA, 15 bp, Homo sapiens
taaggttatctctat

SEQ ID NO: 52395 - DNA, 15 bp, Homo sapiens
ataaggttatctcta

SEQ ID NO: 52396 - DNA, 15 bp, Homo sapiens
aataaggttatctct

SEQ ID NO: 52397 - DNA, 15 bp, Homo sapiens
aaataaggttatctc

SEQ ID NO: 52398 - DNA, 15 bp, Homo sapiens
caaataaggttatct

SEQ ID NO: 52399 - DNA, 15 bp, Homo sapiens
ccaaataaggttatc

SEQ ID NO: 52400 - DNA, 15 bp, Homo sapiens
accaaataaggttat

SEQ ID NO: 52401 - DNA, 15 bp, Homo sapiens
caccaaataaggtta

SEQ ID NO: 52402 - DNA, 15 bp, Homo sapiens
gcaccaaataaggtt

SEQ ID NO: 52403 - DNA, 15 bp, Homo sapiens
agcaccaaataaggt

SEQ ID NO: 52404 - DNA, 15 bp, Homo sapiens
aagcaccaaataagg

SEQ ID NO: 52405 - DNA, 15 bp, Homo sapiens
aaagcaccaaataag

SEQ ID NO: 52406 - DNA, 15 bp, Homo sapiens
taaagcaccaaataa

SEQ ID NO: 52407 - DNA, 15 bp, Homo sapiens
gtaaagcaccaaata

SEQ ID NO: 52408 - DNA, 15 bp, Homo sapiens
agtaaagcaccaaat

SEQ ID NO: 52409 - DNA, 15 bp, Homo sapiens
tagtaaagcaccaaa

SEQ ID NO: 52410 - DNA, 15 bp, Homo sapiens
ttagtaaagcaccaa

SEQ ID NO: 52411 - DNA, 15 bp, Homo sapiens
tttagtaaagcacca

SEQ ID NO: 52412 - DNA, 15 bp, Homo sapiens
ctttagtaaagcacc

SEQ ID NO: 52413 - DNA, 15 bp, Homo sapiens
cctttagtaaagcac

SEQ ID NO: 52414 - DNA, 15 bp, Homo sapiens
acctttagtaaagca

SEQ ID NO: 52415 - DNA, 15 bp, Homo sapiens
tacctttagtaaagc

SEQ ID NO: 52416 - DNA, 15 bp, Homo sapiens
gtacctttagtaaag

SEQ ID NO: 52417 - DNA, 15 bp, Homo sapiens
tgtacctttagtaaa

SEQ ID NO: 52418 - DNA, 15 bp, Homo sapiens
ctgtacctttagtaa

SEQ ID NO: 52419 - DNA, 15 bp, Homo sapiens
tctgtacctttagta

SEQ ID NO: 52420 - DNA, 15 bp, Homo sapiens
gtctgtacctttagt

SEQ ID NO: 52421 - DNA, 15 bp, Homo sapiens
agtctgtacctttag

SEQ ID NO: 52422 - DNA, 15 bp, Homo sapiens
gagtctgtaccttta

SEQ ID NO: 52423 - DNA, 15 bp, Homo sapiens
agagtctgtaccttt

SEQ ID NO: 52424 - DNA, 15 bp, Homo sapiens
gagagtctgtacctt

SEQ ID NO: 52425 - DNA, 15 bp, Homo sapiens
tgagagtctgtacct

SEQ ID NO: 52426 - DNA, 15 bp, Homo sapiens
atgagagtctgtacc

SEQ ID NO: 52427 - DNA, 15 bp, Homo sapiens
tatgagagtctgtac

SEQ ID NO: 52428 - DNA, 15 bp, Homo sapiens
gtatgagagtctgta

SEQ ID NO: 52429 - DNA, 15 bp, Homo sapiens
agtatgagagtctgt

SEQ ID NO: 52430 - DNA, 15 bp, Homo sapiens
aagtatgagagtctg

SEQ ID NO: 52431 - DNA, 15 bp, Homo sapiens
aaagtatgagagtct

SEQ ID NO: 52432 - DNA, 15 bp, Homo sapiens
aaaagtatgagagtc

SEQ ID NO: 52433 - DNA, 15 bp, Homo sapiens
aaaaagtatgagagt

SEQ ID NO: 52434 - DNA, 15 bp, Homo sapiens
gaaaaagtatgagag

SEQ ID NO: 52435 - DNA, 15 bp, Homo sapiens
ggaaaaagtatgaga

SEQ ID NO: 52436 - DNA, 15 bp, Homo sapiens
aggaaaaagtatgag

SEQ ID NO: 52437 - DNA, 15 bp, Homo sapiens
aaggaaaaagtatga

SEQ ID NO: 52438 - DNA, 15 bp, Homo sapiens
gaaggaaaaagtatg

SEQ ID NO: 52439 - DNA, 15 bp, Homo sapiens
agaaggaaaaagtat

SEQ ID NO: 52440 - DNA, 15 bp, Homo sapiens
gagaaggaaaaagta

SEQ ID NO: 52441 - DNA, 15 bp, Homo sapiens
agagaaggaaaaagt

SEQ ID NO: 52442 - DNA, 15 bp, Homo sapiens
aagagaaggaaaaag

SEQ ID NO: 52443 - DNA, 15 bp, Homo sapiens
aaagagaaggaaaaa

SEQ ID NO: 52444 - DNA, 15 bp, Homo sapiens
gaaagagaaggaaaa

SEQ ID NO: 52445 - DNA, 15 bp, Homo sapiens
agaaagagaaggaaa

SEQ ID NO: 52446 - DNA, 15 bp, Homo sapiens
aagaaagagaaggaa

SEQ ID NO: 52447 - DNA, 15 bp, Homo sapiens
aaagaaagagaagga

SEQ ID NO: 52448 - DNA, 15 bp, Homo sapiens
aaaagaaagagaagg

SEQ ID NO: 52449 - DNA, 15 bp, Homo sapiens
aaaaagaaagagaag

SEQ ID NO: 52450 - DNA, 15 bp, Homo sapiens
gaaaaagaaagagaa

SEQ ID NO: 52451 - DNA, 15 bp, Homo sapiens
ggaaaaagaaagaga

SEQ ID NO: 52452 - DNA, 15 bp, Homo sapiens
tggaaaaagaaagag

SEQ ID NO: 52453 - DNA, 15 bp, Homo sapiens
atggaaaaagaaaga

SEQ ID NO: 52454 - DNA, 15 bp, Homo sapiens
aatggaaaaagaaag

SEQ ID NO: 52455 - DNA, 15 bp, Homo sapiens
gaatggaaaaagaaa

SEQ ID NO: 52456 - DNA, 15 bp, Homo sapiens
ggaatggaaaaagaa

SEQ ID NO: 52457 - DNA, 15 bp, Homo sapiens
tggaatggaaaaaga

SEQ ID NO: 52458 - DNA, 15 bp, Homo sapiens
gtggaatggaaaaag

SEQ ID NO: 52459 - DNA, 15 bp, Homo sapiens
tgtggaatggaaaaa

SEQ ID NO: 52460 - DNA, 15 bp, Homo sapiens
ctgtggaatggaaaa

SEQ ID NO: 52461 - DNA, 15 bp, Homo sapiens
tctgtggaatggaaa

SEQ ID NO: 52462 - DNA, 15 bp, Homo sapiens
atctgtggaatggaa

SEQ ID NO: 52463 - DNA, 15 bp, Homo sapiens
catctgtggaatgga

SEQ ID NO: 52464 - DNA, 15 bp, Homo sapiens
tcatctgtggaatgg

SEQ ID NO: 52465 - DNA, 15 bp, Homo sapiens
ttcatctgtggaatg

SEQ ID NO: 52466 - DNA, 15 bp, Homo sapiens
gttcatctgtggaat

SEQ ID NO: 52467 - DNA, 15 bp, Homo sapiens
tgttcatctgtggaa

SEQ ID NO: 52468 - DNA, 15 bp, Homo sapiens
gtgttcatctgtgga

SEQ ID NO: 52469 - DNA, 15 bp, Homo sapiens
tgtgttcatctgtgg

SEQ ID NO: 52470 - DNA, 15 bp, Homo sapiens
ttgtgttcatctgtg

SEQ ID NO: 52471 - DNA, 15 bp, Homo sapiens
attgtgttcatctgt

SEQ ID NO: 52472 - DNA, 15 bp, Homo sapiens
cattgtgttcatctg

SEQ ID NO: 52473 - DNA, 15 bp, Homo sapiens
tcattgtgttcatct

SEQ ID NO: 52474 - DNA, 15 bp, Homo sapiens
gtcattgtgttcatc

SEQ ID NO: 52475 - DNA, 15 bp, Homo sapiens
cgtcattgtgttcat

SEQ ID NO: 52476 - DNA, 15 bp, Homo sapiens
acgtcattgtgttca

SEQ ID NO: 52477 - DNA, 15 bp, Homo sapiens
tacgtcattgtgttc

SEQ ID NO: 52478 - DNA, 15 bp, Homo sapiens
gtacgtcattgtgtt

SEQ ID NO: 52479 - DNA, 15 bp, Homo sapiens
tgtacgtcattgtgt

SEQ ID NO: 52480 - DNA, 15 bp, Homo sapiens
ctgtacgtcattgtg

SEQ ID NO: 52481 - DNA, 15 bp, Homo sapiens
tctgtacgtcattgt

SEQ ID NO: 52482 - DNA, 15 bp, Homo sapiens
ttctgtacgtcattg

SEQ ID NO: 52483 - DNA, 15 bp, Homo sapiens
cttctgtacgtcatt

SEQ ID NO: 52484 - DNA, 15 bp, Homo sapiens
tcttctgtacgtcat

SEQ ID NO: 52485 - DNA, 15 bp, Homo sapiens
ttcttctgtacgtca

SEQ ID NO: 52486 - DNA, 15 bp, Homo sapiens
tttcttctgtacgtc

SEQ ID NO: 52487 - DNA, 15 bp, Homo sapiens
ttttcttctgtacgt

SEQ ID NO: 52488 - DNA, 15 bp, Homo sapiens
gttttcttctgtacg

SEQ ID NO: 52489 - DNA, 15 bp, Homo sapiens
ggttttcttctgtac

SEQ ID NO: 52490 - DNA, 15 bp, Homo sapiens
aggttttcttctgta

SEQ ID NO: 52491 - DNA, 15 bp, Homo sapiens
aaggttttcttctgt

SEQ ID NO: 52492 - DNA, 15 bp, Homo sapiens
aaaggttttcttctg

SEQ ID NO: 52493 - DNA, 15 bp, Homo sapiens
taaaggttttcttct

SEQ ID NO: 52494 - DNA, 15 bp, Homo sapiens
gtaaaggttttcttc

SEQ ID NO: 52495 - DNA, 15 bp, Homo sapiens
ggtaaaggttttctt

SEQ ID NO: 52496 - DNA, 15 bp, Homo sapiens
tggtaaaggttttct

SEQ ID NO: 52497 - DNA, 15 bp, Homo sapiens
ttggtaaaggttttc

SEQ ID NO: 52498 - DNA, 15 bp, Homo sapiens
tttggtaaaggtttt

SEQ ID NO: 52499 - DNA, 15 bp, Homo sapiens
atttggtaaaggttt

SEQ ID NO: 52500 - DNA, 15 bp, Homo sapiens
catttggtaaaggtt

SEQ ID NO: 52501 - DNA, 15 bp, Homo sapiens
ccatttggtaaaggt

SEQ ID NO: 52502 - DNA, 15 bp, Homo sapiens
tccatttggtaaagg

SEQ ID NO: 52503 - DNA, 15 bp, Homo sapiens
atccatttggtaaag

SEQ ID NO: 52504 - DNA, 15 bp, Homo sapiens
tatccatttggtaaa

SEQ ID NO: 52505 - DNA, 15 bp, Homo sapiens
ttatccatttggtaa

SEQ ID NO: 52506 - DNA, 15 bp, Homo sapiens
tttatccatttggta

SEQ ID NO: 52507 - DNA, 15 bp, Homo sapiens
atttatccatttggt

SEQ ID NO: 52508 - DNA, 15 bp, Homo sapiens
catttatccatttgg

SEQ ID NO: 52509 - DNA, 15 bp, Homo sapiens
gcatttatccatttg

SEQ ID NO: 52510 - DNA, 15 bp, Homo sapiens
agcatttatccattt

SEQ ID NO: 52511 - DNA, 15 bp, Homo sapiens
gagcatttatccatt

SEQ ID NO: 52512 - DNA, 15 bp, Homo sapiens
cgagcatttatccat

SEQ ID NO: 52513 - DNA, 15 bp, Homo sapiens
tcgagcatttatcca

SEQ ID NO: 52514 - DNA, 15 bp, Homo sapiens
atcgagcatttatcc

SEQ ID NO: 52515 - DNA, 15 bp, Homo sapiens
aatcgagcatttatc

SEQ ID NO: 52516 - DNA, 15 bp, Homo sapiens
aaatcgagcatttat

SEQ ID NO: 52517 - DNA, 15 bp, Homo sapiens
aaaatcgagcattta

SEQ ID NO: 52518 - DNA, 15 bp, Homo sapiens
gaaaatcgagcattt

SEQ ID NO: 52519 - DNA, 15 bp, Homo sapiens
tgaaaatcgagcatt

SEQ ID NO: 52520 - DNA, 15 bp, Homo sapiens
ttgaaaatcgagcat

SEQ ID NO: 52521 - DNA, 15 bp, Homo sapiens
tttgaaaatcgagca

SEQ ID NO: 52522 - DNA, 15 bp, Homo sapiens
ctttgaaaatcgagc

SEQ ID NO: 52523 - DNA, 15 bp, Homo sapiens
cctttgaaaatcgag

SEQ ID NO: 52524 - DNA, 15 bp, Homo sapiens
acctttgaaaatcga

SEQ ID NO: 52525 - DNA, 15 bp, Homo sapiens
tacctttgaaaatcg

SEQ ID NO: 52526 - DNA, 15 bp, Homo sapiens
ttacctttgaaaatc

SEQ ID NO: 52527 - DNA, 15 bp, Homo sapiens
gttacctttgaaaat

SEQ ID NO: 52528 - DNA, 15 bp, Homo sapiens
agttacctttgaaaa

SEQ ID NO: 52529 - DNA, 15 bp, Homo sapiens
cagttacctttgaaa

SEQ ID NO: 52530 - DNA, 15 bp, Homo sapiens
tcagttacctttgaa

SEQ ID NO: 52531 - DNA, 15 bp, Homo sapiens
ctcagttacctttga

SEQ ID NO: 52532 - DNA, 15 bp, Homo sapiens
tctcagttacctttg

SEQ ID NO: 52533 - DNA, 15 bp, Homo sapiens
gtctcagttaccttt

SEQ ID NO: 52534 - DNA, 15 bp, Homo sapiens
agtctcagttacctt

SEQ ID NO: 52535 - DNA, 15 bp, Homo sapiens
aagtctcagttacct

SEQ ID NO: 52536 - DNA, 15 bp, Homo sapiens
aaagtctcagttacc

SEQ ID NO: 52537 - DNA, 15 bp, Homo sapiens
gaaagtctcagttac

SEQ ID NO: 52538 - DNA, 15 bp, Homo sapiens
tgaaagtctcagtta

SEQ ID NO: 52539 - DNA, 15 bp, Homo sapiens
ttgaaagtctcagtt

SEQ ID NO: 52540 - DNA, 15 bp, Homo sapiens
tttgaaagtctcagt

SEQ ID NO: 52541 - DNA, 15 bp, Homo sapiens
ttttgaaagtctcag

SEQ ID NO: 52542 - DNA, 15 bp, Homo sapiens
tttttgaaagtctca

SEQ ID NO: 52543 - DNA, 15 bp, Homo sapiens
gtttttgaaagtctc

SEQ ID NO: 52544 - DNA, 15 bp, Homo sapiens
agtttttgaaagtct

SEQ ID NO: 52545 - DNA, 15 bp, Homo sapiens
aagtttttgaaagtc

SEQ ID NO: 52546 - DNA, 15 bp, Homo sapiens
gaagtttttgaaagt

SEQ ID NO: 52547 - DNA, 15 bp, Homo sapiens
cgaagtttttgaaag

SEQ ID NO: 52548 - DNA, 15 bp, Homo sapiens
tcgaagtttttgaaa

SEQ ID NO: 52549 - DNA, 15 bp, Homo sapiens
atcgaagtttttgaa

SEQ ID NO: 52550 - DNA, 15 bp, Homo sapiens
catcgaagtttttga

SEQ ID NO: 52551 - DNA, 15 bp, Homo sapiens
ccatcgaagtttttg

SEQ ID NO: 52552 - DNA, 15 bp, Homo sapiens
accatcgaagttttt

SEQ ID NO: 52553 - DNA, 15 bp, Homo sapiens
aaccatcgaagtttt

SEQ ID NO: 52554 - DNA, 15 bp, Homo sapiens
gaaccatcgaagttt

SEQ ID NO: 52555 - DNA, 15 bp, Homo sapiens
tgaaccatcgaagtt

SEQ ID NO: 52556 - DNA, 15 bp, Homo sapiens
ctgaaccatcgaagt

SEQ ID NO: 52557 - DNA, 15 bp, Homo sapiens
tctgaaccatcgaag

SEQ ID NO: 52558 - DNA, 15 bp, Homo sapiens
atctgaaccatcgaa

SEQ ID NO: 52559 - DNA, 15 bp, Homo sapiens
catctgaaccatcga

SEQ ID NO: 52560 - DNA, 15 bp, Homo sapiens
gcatctgaaccatcg

SEQ ID NO: 52561 - DNA, 15 bp, Homo sapiens
ggcatctgaaccatc

SEQ ID NO: 52562 - DNA, 15 bp, Homo sapiens
cggcatctgaaccat

SEQ ID NO: 52563 - DNA, 15 bp, Homo sapiens
gcggcatctgaacca

SEQ ID NO: 52564 - DNA, 15 bp, Homo sapiens
tgcggcatctgaacc

SEQ ID NO: 52565 - DNA, 15 bp, Homo sapiens
atgcggcatctgaac

SEQ ID NO: 52566 - DNA, 15 bp, Homo sapiens
aatgcggcatctgaa

SEQ ID NO: 52567 - DNA, 15 bp, Homo sapiens
gaatgcggcatctga

SEQ ID NO: 52568 - DNA, 15 bp, Homo sapiens
agaatgcggcatctg

SEQ ID NO: 52569 - DNA, 15 bp, Homo sapiens
cagaatgcggcatct

SEQ ID NO: 52570 - DNA, 15 bp, Homo sapiens
tcagaatgcggcatc

SEQ ID NO: 52571 - DNA, 15 bp, Homo sapiens
atcagaatgcggcat

SEQ ID NO: 52572 - DNA, 15 bp, Homo sapiens
aatcagaatgcggca

SEQ ID NO: 52573 - DNA, 15 bp, Homo sapiens
caatcagaatgcggc

SEQ ID NO: 52574 - DNA, 15 bp, Homo sapiens
tcaatcagaatgcgg

SEQ ID NO: 52575 - DNA, 15 bp, Homo sapiens
ttcaatcagaatgcg

SEQ ID NO: 52576 - DNA, 15 bp, Homo sapiens
cttcaatcagaatgc

SEQ ID NO: 52577 - DNA, 15 bp, Homo sapiens
ccttcaatcagaatg

SEQ ID NO: 52578 - DNA, 15 bp, Homo sapiens
tccttcaatcagaat

SEQ ID NO: 52579 - DNA, 15 bp, Homo sapiens
ctccttcaatcagaa

SEQ ID NO: 52580 - DNA, 15 bp, Homo sapiens
actccttcaatcaga

SEQ ID NO: 52581 - DNA, 15 bp, Homo sapiens
aactccttcaatcag

SEQ ID NO: 52582 - DNA, 15 bp, Homo sapiens
aaactccttcaatca

SEQ ID NO: 52583 - DNA, 15 bp, Homo sapiens
caaactccttcaatc

SEQ ID NO: 52584 - DNA, 15 bp, Homo sapiens
ccaaactccttcaat

SEQ ID NO: 52585 - DNA, 15 bp, Homo sapiens
accaaactccttcaa

SEQ ID NO: 52586 - DNA, 15 bp, Homo sapiens
aaccaaactccttca

SEQ ID NO: 52587 - DNA, 15 bp, Homo sapiens
caaccaaactccttc

SEQ ID NO: 52588 - DNA, 15 bp, Homo sapiens
ccaaccaaactcctt

SEQ ID NO: 52589 - DNA, 15 bp, Homo sapiens
tccaaccaaactcct

SEQ ID NO: 52590 - DNA, 15 bp, Homo sapiens
ttccaaccaaactcc

SEQ ID NO: 52591 - DNA, 15 bp, Homo sapiens
cttccaaccaaactc

SEQ ID NO: 52592 - DNA, 15 bp, Homo sapiens
acttccaaccaaact

SEQ ID NO: 52593 - DNA, 15 bp, Homo sapiens
cacttccaaccaaac

SEQ ID NO: 52594 - DNA, 15 bp, Homo sapiens
gcacttccaaccaaa

SEQ ID NO: 52595 - DNA, 15 bp, Homo sapiens
tgcacttccaaccaa

SEQ ID NO: 52596 - DNA, 15 bp, Homo sapiens
ctgcacttccaacca

SEQ ID NO: 52597 - DNA, 15 bp, Homo sapiens
actgcacttccaacc

SEQ ID NO: 52598 - DNA, 15 bp, Homo sapiens
cactgcacttccaac

SEQ ID NO: 52599 - DNA, 15 bp, Homo sapiens
tcactgcacttccaa

SEQ ID NO: 52600 - DNA, 15 bp, Homo sapiens
ttcactgcacttcca

SEQ ID NO: 52601 - DNA, 15 bp, Homo sapiens
attcactgcacttcc

SEQ ID NO: 52602 - DNA, 15 bp, Homo sapiens
aattcactgcacttc

SEQ ID NO: 52603 - DNA, 15 bp, Homo sapiens
aaattcactgcactt

SEQ ID NO: 52604 - DNA, 15 bp, Homo sapiens
aaaattcactgcact

SEQ ID NO: 52605 - DNA, 15 bp, Homo sapiens
gaaaattcactgcac

SEQ ID NO: 52606 - DNA, 15 bp, Homo sapiens
ggaaaattcactgca

SEQ ID NO: 52607 - DNA, 15 bp, Homo sapiens
gggaaaattcactgc

SEQ ID NO: 52608 - DNA, 15 bp, Homo sapiens
ggggaaaattcactg

SEQ ID NO: 52609 - DNA, 15 bp, Homo sapiens
tggggaaaattcact

SEQ ID NO: 52610 - DNA, 15 bp, Homo sapiens
ctggggaaaattcac

SEQ ID NO: 52611 - DNA, 15 bp, Homo sapiens
cctggggaaaattca

SEQ ID NO: 52612 - DNA, 15 bp, Homo sapiens
tcctggggaaaattc

SEQ ID NO: 52613 - DNA, 15 bp, Homo sapiens
ttcctggggaaaatt

SEQ ID NO: 52614 - DNA, 15 bp, Homo sapiens
tttcctggggaaaat

SEQ ID NO: 52615 - DNA, 15 bp, Homo sapiens
atttcctggggaaaa

SEQ ID NO: 52616 - DNA, 15 bp, Homo sapiens
catttcctggggaaa

SEQ ID NO: 52617 - DNA, 15 bp, Homo sapiens
acatttcctggggaa

SEQ ID NO: 52618 - DNA, 15 bp, Homo sapiens
gacatttcctgggga

SEQ ID NO: 52619 - DNA, 15 bp, Homo sapiens
tgacatttcctgggg

SEQ ID NO: 52620 - DNA, 15 bp, Homo sapiens
gtgacatttcctggg

SEQ ID NO: 52621 - DNA, 15 bp, Homo sapiens
ggtgacatttcctgg

SEQ ID NO: 52622 - DNA, 15 bp, Homo sapiens
aggtgacatttcctg

SEQ ID NO: 52623 - DNA, 15 bp, Homo sapiens
taggtgacatttcct

SEQ ID NO: 52624 - DNA, 15 bp, Homo sapiens
ctaggtgacatttcc

SEQ ID NO: 52625 - DNA, 15 bp, Homo sapiens
gctaggtgacatttc

SEQ ID NO: 52626 - DNA, 15 bp, Homo sapiens
ggctaggtgacattt

SEQ ID NO: 52627 - DNA, 15 bp, Homo sapiens
cggctaggtgacatt

SEQ ID NO: 52628 - DNA, 15 bp, Homo sapiens
tcggctaggtgacat

SEQ ID NO: 52629 - DNA, 15 bp, Homo sapiens
ttcggctaggtgaca

SEQ ID NO: 52630 - DNA, 15 bp, Homo sapiens
cttcggctaggtgac

SEQ ID NO: 52631 - DNA, 15 bp, Homo sapiens
acttcggctaggtga

SEQ ID NO: 52632 - DNA, 15 bp, Homo sapiens
gacttcggctaggtg

SEQ ID NO: 52633 - DNA, 15 bp, Homo sapiens
agacttcggctaggt

SEQ ID NO: 52634 - DNA, 15 bp, Homo sapiens
aagacttcggctagg

SEQ ID NO: 52635 - DNA, 15 bp, Homo sapiens
gaagacttcggctag

SEQ ID NO: 52636 - DNA, 15 bp, Homo sapiens
agaagacttcggcta

SEQ ID NO: 52637 - DNA, 15 bp, Homo sapiens
cagaagacttcggct

SEQ ID NO: 52638 - DNA, 15 bp, Homo sapiens
tcagaagacttcggc

SEQ ID NO: 52639 - DNA, 15 bp, Homo sapiens
ctcagaagacttcgg

SEQ ID NO: 52640 - DNA, 15 bp, Homo sapiens
actcagaagacttcg

SEQ ID NO: 52641 - DNA, 15 bp, Homo sapiens
tactcagaagacttc

SEQ ID NO: 52642 - DNA, 15 bp, Homo sapiens
atactcagaagactt

SEQ ID NO: 52643 - DNA, 15 bp, Homo sapiens
catactcagaagact

SEQ ID NO: 52644 - DNA, 15 bp, Homo sapiens
gcatactcagaagac

SEQ ID NO: 52645 - DNA, 15 bp, Homo sapiens
tgcatactcagaaga

SEQ ID NO: 52646 - DNA, 15 bp, Homo sapiens
ctgcatactcagaag

SEQ ID NO: 52647 - DNA, 15 bp, Homo sapiens
tctgcatactcagaa

SEQ ID NO: 52648 - DNA, 15 bp, Homo sapiens
atctgcatactcaga

SEQ ID NO: 52649 - DNA, 15 bp, Homo sapiens
tatctgcatactcag

SEQ ID NO: 52650 - DNA, 15 bp, Homo sapiens
gtatctgcatactca

SEQ ID NO: 52651 - DNA, 15 bp, Homo sapiens
tgtatctgcatactc

SEQ ID NO: 52652 - DNA, 15 bp, Homo sapiens
atgtatctgcatact

SEQ ID NO: 52653 - DNA, 15 bp, Homo sapiens
aatgtatctgcatac

SEQ ID NO: 52654 - DNA, 15 bp, Homo sapiens
aaatgtatctgcata

SEQ ID NO: 52655 - DNA, 15 bp, Homo sapiens
caaatgtatctgcat

SEQ ID NO: 52656 - DNA, 15 bp, Homo sapiens
acaaatgtatctgca

SEQ ID NO: 52657 - DNA, 15 bp, Homo sapiens
aacaaatgtatctgc

SEQ ID NO: 52658 - DNA, 15 bp, Homo sapiens
caacaaatgtatctg

SEQ ID NO: 52659 - DNA, 15 bp, Homo sapiens
acaacaaatgtatct

SEQ ID NO: 52660 - DNA, 15 bp, Homo sapiens
aacaacaaatgtatc

SEQ ID NO: 52661 - DNA, 15 bp, Homo sapiens
gaacaacaaatgtat

SEQ ID NO: 52662 - DNA, 15 bp, Homo sapiens
ggaacaacaaatgta

SEQ ID NO: 52663 - DNA, 15 bp, Homo sapiens
aggaacaacaaatgt

SEQ ID NO: 52664 - DNA, 15 bp, Homo sapiens
aaggaacaacaaatg

SEQ ID NO: 52665 - DNA, 15 bp, Homo sapiens
aaaggaacaacaaat

SEQ ID NO: 52666 - DNA, 15 bp, Homo sapiens
taaaggaacaacaaa

SEQ ID NO: 52667 - DNA, 15 bp, Homo sapiens
ataaaggaacaacaa

SEQ ID NO: 52668 - DNA, 15 bp, Homo sapiens
aataaaggaacaaca

SEQ ID NO: 52669 - DNA, 15 bp, Homo sapiens
gaataaaggaacaac

SEQ ID NO: 52670 - DNA, 15 bp, Homo sapiens
agaataaaggaacaa

SEQ ID NO: 52671 - DNA, 15 bp, Homo sapiens
cagaataaaggaaca

SEQ ID NO: 52672 - DNA, 15 bp, Homo sapiens
acagaataaaggaac

SEQ ID NO: 52673 - DNA, 15 bp, Homo sapiens
gacagaataaaggaa

SEQ ID NO: 52674 - DNA, 15 bp, Homo sapiens
ggacagaataaagga

SEQ ID NO: 52675 - DNA, 15 bp, Homo sapiens
aggacagaataaagg

SEQ ID NO: 52676 - DNA, 15 bp, Homo sapiens
taggacagaataaag

SEQ ID NO: 52677 - DNA, 15 bp, Homo sapiens
ttaggacagaataaa

SEQ ID NO: 52678 - DNA, 15 bp, Homo sapiens
tttaggacagaataa

SEQ ID NO: 52679 - DNA, 15 bp, Homo sapiens
ttttaggacagaata

SEQ ID NO: 52680 - DNA, 15 bp, Homo sapiens
attttaggacagaat

SEQ ID NO: 52681 - DNA, 15 bp, Homo sapiens
tattttaggacagaa

SEQ ID NO: 52682 - DNA, 15 bp, Homo sapiens
atattttaggacaga

SEQ ID NO: 52683 - DNA, 15 bp, Homo sapiens
catattttaggacag

SEQ ID NO: 52684 - DNA, 15 bp, Homo sapiens
acatattttaggaca

SEQ ID NO: 52685 - DNA, 15 bp, Homo sapiens
aacatattttaggac

SEQ ID NO: 52686 - DNA, 15 bp, Homo sapiens
aaacatattttagga

SEQ ID NO: 52687 - DNA, 15 bp, Homo sapiens
taaacatattttagg

SEQ ID NO: 52688 - DNA, 15 bp, Homo sapiens
ttaaacatattttag

SEQ ID NO: 52689 - DNA, 15 bp, Homo sapiens
tttaaacatatttta

SEQ ID NO: 52690 - DNA, 15 bp, Homo sapiens
gtttaaacatatttt

SEQ ID NO: 52691 - DNA, 15 bp, Homo sapiens
cgtttaaacatattt

SEQ ID NO: 52692 - DNA, 15 bp, Homo sapiens
ccgtttaaacatatt

SEQ ID NO: 52693 - DNA, 15 bp, Homo sapiens
tccgtttaaacatat

SEQ ID NO: 52694 - DNA, 15 bp, Homo sapiens
ttccgtttaaacata

SEQ ID NO: 52695 - DNA, 15 bp, Homo sapiens
tttccgtttaaacat

SEQ ID NO: 52696 - DNA, 15 bp, Homo sapiens
atttccgtttaaaca

SEQ ID NO: 52697 - DNA, 15 bp, Homo sapiens
aatttccgtttaaac

SEQ ID NO: 52698 - DNA, 15 bp, Homo sapiens
gaatttccgtttaaa

SEQ ID NO: 52699 - DNA, 15 bp, Homo sapiens
agaatttccgtttaa

SEQ ID NO: 52700 - DNA, 15 bp, Homo sapiens
gagaatttccgttta

SEQ ID NO: 52701 - DNA, 15 bp, Homo sapiens
tgagaatttccgttt

SEQ ID NO: 52702 - DNA, 15 bp, Homo sapiens
atgagaatttccgtt

SEQ ID NO: 52703 - DNA, 15 bp, Homo sapiens
catgagaatttccgt

SEQ ID NO: 52704 - DNA, 15 bp, Homo sapiens
gcatgagaatttccg

SEQ ID NO: 52705 - DNA, 15 bp, Homo sapiens
tgcatgagaatttcc

SEQ ID NO: 52706 - DNA, 15 bp, Homo sapiens
gtgcatgagaatttc

SEQ ID NO: 52707 - DNA, 15 bp, Homo sapiens
tgtgcatgagaattt

SEQ ID NO: 52708 - DNA, 15 bp, Homo sapiens
atgtgcatgagaatt

SEQ ID NO: 52709 - DNA, 15 bp, Homo sapiens
tatgtgcatgagaat

SEQ ID NO: 52710 - DNA, 15 bp, Homo sapiens
ctatgtgcatgagaa

SEQ ID NO: 52711 - DNA, 15 bp, Homo sapiens
actatgtgcatgaga

SEQ ID NO: 52712 - DNA, 15 bp, Homo sapiens
aactatgtgcatgag

SEQ ID NO: 52713 - DNA, 15 bp, Homo sapiens
aaactatgtgcatga

SEQ ID NO: 52714 - DNA, 15 bp, Homo sapiens
taaactatgtgcatg

SEQ ID NO: 52715 - DNA, 15 bp, Homo sapiens
ataaactatgtgcat

SEQ ID NO: 52716 - DNA, 15 bp, Homo sapiens
cataaactatgtgca

SEQ ID NO: 52717 - DNA, 15 bp, Homo sapiens
ccataaactatgtgc

SEQ ID NO: 52718 - DNA, 15 bp, Homo sapiens
cccataaactatgtg

SEQ ID NO: 52719 - DNA, 15 bp, Homo sapiens
tcccataaactatgt

SEQ ID NO: 52720 - DNA, 15 bp, Homo sapiens
gtcccataaactatg

SEQ ID NO: 52721 - DNA, 15 bp, Homo sapiens
cgtcccataaactat

SEQ ID NO: 52722 - DNA, 15 bp, Homo sapiens
gcgtcccataaacta

SEQ ID NO: 52723 - DNA, 15 bp, Homo sapiens
agcgtcccataaact

SEQ ID NO: 52724 - DNA, 15 bp, Homo sapiens
tagcgtcccataaac

SEQ ID NO: 52725 - DNA, 15 bp, Homo sapiens
atagcgtcccataaa

SEQ ID NO: 52726 - DNA, 15 bp, Homo sapiens
aatagcgtcccataa

SEQ ID NO: 52727 - DNA, 15 bp, Homo sapiens
caatagcgtcccata

SEQ ID NO: 52728 - DNA, 15 bp, Homo sapiens
tcaatagcgtcccat

SEQ ID NO: 52729 - DNA, 15 bp, Homo sapiens
gtcaatagcgtccca

SEQ ID NO: 52730 - DNA, 15 bp, Homo sapiens
agtcaatagcgtccc

SEQ ID NO: 52731 - DNA, 15 bp, Homo sapiens
aagtcaatagcgtcc

SEQ ID NO: 52732 - DNA, 15 bp, Homo sapiens
aaagtcaatagcgtc

SEQ ID NO: 52733 - DNA, 15 bp, Homo sapiens
aaaagtcaatagcgt

SEQ ID NO: 52734 - DNA, 15 bp, Homo sapiens
taaaagtcaatagcg

SEQ ID NO: 52735 - DNA, 15 bp, Homo sapiens
gtaaaagtcaatagc

SEQ ID NO: 52736 - DNA, 15 bp, Homo sapiens
ggtaaaagtcaatag

SEQ ID NO: 52737 - DNA, 15 bp, Homo sapiens
aggtaaaagtcaata

SEQ ID NO: 52738 - DNA, 15 bp, Homo sapiens
caggtaaaagtcaat

SEQ ID NO: 52739 - DNA, 15 bp, Homo sapiens
ccaggtaaaagtcaa

SEQ ID NO: 52740 - DNA, 15 bp, Homo sapiens
gccaggtaaaagtca

SEQ ID NO: 52741 - DNA, 15 bp, Homo sapiens
ggccaggtaaaagtc

SEQ ID NO: 52742 - DNA, 15 bp, Homo sapiens
aggccaggtaaaagt

SEQ ID NO: 52743 - DNA, 15 bp, Homo sapiens
aaggccaggtaaaag

SEQ ID NO: 52744 - DNA, 15 bp, Homo sapiens
gaaggccaggtaaaa

SEQ ID NO: 52745 - DNA, 15 bp, Homo sapiens
agaaggccaggtaaa

SEQ ID NO: 52746 - DNA, 15 bp, Homo sapiens
gagaaggccaggtaa

SEQ ID NO: 52747 - DNA, 15 bp, Homo sapiens
ggagaaggccaggta

SEQ ID NO: 52748 - DNA, 15 bp, Homo sapiens
tggagaaggccaggt

SEQ ID NO: 52749 - DNA, 15 bp, Homo sapiens
ctggagaaggccagg

SEQ ID NO: 52750 - DNA, 15 bp, Homo sapiens
tctggagaaggccag

SEQ ID NO: 52751 - DNA, 15 bp, Homo sapiens
atctggagaaggcca

SEQ ID NO: 52752 - DNA, 15 bp, Homo sapiens
tatctggagaaggcc

SEQ ID NO: 52753 - DNA, 15 bp, Homo sapiens
atatctggagaaggc

SEQ ID NO: 52754 - DNA, 15 bp, Homo sapiens
gatatctggagaagg

SEQ ID NO: 52755 - DNA, 15 bp, Homo sapiens
agatatctggagaag

SEQ ID NO: 52756 - DNA, 15 bp, Homo sapiens
tagatatctggagaa

SEQ ID NO: 52757 - DNA, 15 bp, Homo sapiens
ttagatatctggaga

SEQ ID NO: 52758 - DNA, 15 bp, Homo sapiens
cttagatatctggag

SEQ ID NO: 52759 - DNA, 15 bp, Homo sapiens
ccttagatatctgga

SEQ ID NO: 52760 - DNA, 15 bp, Homo sapiens
gccttagatatctgg

SEQ ID NO: 52761 - DNA, 15 bp, Homo sapiens
tgccttagatatctg

SEQ ID NO: 52762 - DNA, 15 bp, Homo sapiens
ctgccttagatatct

SEQ ID NO: 52763 - DNA, 15 bp, Homo sapiens
gctgccttagatatc

SEQ ID NO: 52764 - DNA, 15 bp, Homo sapiens
tgctgccttagatat

SEQ ID NO: 52765 - DNA, 15 bp, Homo sapiens
ctgctgccttagata

SEQ ID NO: 52766 - DNA, 15 bp, Homo sapiens
actgctgccttagat

SEQ ID NO: 52767 - DNA, 15 bp, Homo sapiens
aactgctgccttaga

SEQ ID NO: 52768 - DNA, 15 bp, Homo sapiens
taactgctgccttag

SEQ ID NO: 52769 - DNA, 15 bp, Homo sapiens
ctaactgctgcctta

SEQ ID NO: 52770 - DNA, 15 bp, Homo sapiens
gctaactgctgcctt

SEQ ID NO: 52771 - DNA, 15 bp, Homo sapiens
agctaactgctgcct

SEQ ID NO: 52772 - DNA, 15 bp, Homo sapiens
cagctaactgctgcc

SEQ ID NO: 52773 - DNA, 15 bp, Homo sapiens
gcagctaactgctgc

SEQ ID NO: 52774 - DNA, 15 bp, Homo sapiens
agcagctaactgctg

SEQ ID NO: 52775 - DNA, 15 bp, Homo sapiens
aagcagctaactgct

SEQ ID NO: 52776 - DNA, 15 bp, Homo sapiens
aaagcagctaactgc

SEQ ID NO: 52777 - DNA, 15 bp, Homo sapiens
gaaagcagctaactg

SEQ ID NO: 52778 - DNA, 15 bp, Homo sapiens
cgaaagcagctaact

SEQ ID NO: 52779 - DNA, 15 bp, Homo sapiens
tcgaaagcagctaac

SEQ ID NO: 52780 - DNA, 15 bp, Homo sapiens
atcgaaagcagctaa

SEQ ID NO: 52781 - DNA, 15 bp, Homo sapiens
aatcgaaagcagcta

SEQ ID NO: 52782 - DNA, 15 bp, Homo sapiens
gaatcgaaagcagct

SEQ ID NO: 52783 - DNA, 15 bp, Homo sapiens
agaatcgaaagcagc

SEQ ID NO: 52784 - DNA, 15 bp, Homo sapiens
cagaatcgaaagcag

SEQ ID NO: 52785 - DNA, 15 bp, Homo sapiens
acagaatcgaaagca

SEQ ID NO: 52786 - DNA, 15 bp, Homo sapiens
cacagaatcgaaagc

SEQ ID NO: 52787 - DNA, 15 bp, Homo sapiens
tcacagaatcgaaag

SEQ ID NO: 52788 - DNA, 15 bp, Homo sapiens
ttcacagaatcgaaa

SEQ ID NO: 52789 - DNA, 15 bp, Homo sapiens
attcacagaatcgaa

SEQ ID NO: 52790 - DNA, 15 bp, Homo sapiens
gattcacagaatcga

SEQ ID NO: 52791 - DNA, 15 bp, Homo sapiens
ggattcacagaatcg

SEQ ID NO: 52792 - DNA, 15 bp, Homo sapiens
aggattcacagaatc

SEQ ID NO: 52793 - DNA, 15 bp, Homo sapiens
caggattcacagaat

SEQ ID NO: 52794 - DNA, 15 bp, Homo sapiens
ccaggattcacagaa

SEQ ID NO: 52795 - DNA, 15 bp, Homo sapiens
cccaggattcacaga

SEQ ID NO: 52796 - DNA, 15 bp, Homo sapiens
acccaggattcacag

SEQ ID NO: 52797 - DNA, 15 bp, Homo sapiens
tacccaggattcaca

SEQ ID NO: 52798 - DNA, 15 bp, Homo sapiens
gtacccaggattcac

SEQ ID NO: 52799 - DNA, 15 bp, Homo sapiens
tgtacccaggattca

SEQ ID NO: 52800 - DNA, 15 bp, Homo sapiens
atgtacccaggattc

SEQ ID NO: 52801 - DNA, 15 bp, Homo sapiens
gatgtacccaggatt

SEQ ID NO: 52802 - DNA, 15 bp, Homo sapiens
agatgtacccaggat

SEQ ID NO: 52803 - DNA, 15 bp, Homo sapiens
aagatgtacccagga

SEQ ID NO: 52804 - DNA, 15 bp, Homo sapiens
caagatgtacccagg

SEQ ID NO: 52805 - DNA, 15 bp, Homo sapiens
ccaagatgtacccag

SEQ ID NO: 52806 - DNA, 15 bp, Homo sapiens
tccaagatgtaccca

SEQ ID NO: 52807 - DNA, 15 bp, Homo sapiens
ttccaagatgtaccc

SEQ ID NO: 52808 - DNA, 15 bp, Homo sapiens
tttccaagatgtacc

SEQ ID NO: 52809 - DNA, 15 bp, Homo sapiens
ttttccaagatgtac

SEQ ID NO: 52810 - DNA, 15 bp, Homo sapiens
cttttccaagatgta

SEQ ID NO: 52811 - DNA, 15 bp, Homo sapiens
tcttttccaagatgt

SEQ ID NO: 52812 - DNA, 15 bp, Homo sapiens
ttcttttccaagatg

SEQ ID NO: 52813 - DNA, 15 bp, Homo sapiens
attcttttccaagat

SEQ ID NO: 52814 - DNA, 15 bp, Homo sapiens
tattcttttccaaga

SEQ ID NO: 52815 - DNA, 15 bp, Homo sapiens
atattcttttccaag

SEQ ID NO: 52816 - DNA, 15 bp, Homo sapiens
tatattcttttccaa

SEQ ID NO: 52817 - DNA, 15 bp, Homo sapiens
atatattcttttcca

SEQ ID NO: 52818 - DNA, 15 bp, Homo sapiens
gatatattcttttcc

SEQ ID NO: 52819 - DNA, 15 bp, Homo sapiens
tgatatattcttttc

SEQ ID NO: 52820 - DNA, 15 bp, Homo sapiens
atgatatattctttt

SEQ ID NO: 52821 - DNA, 15 bp, Homo sapiens
aatgatatattcttt

SEQ ID NO: 52822 - DNA, 15 bp, Homo sapiens
caatgatatattctt

SEQ ID NO: 52823 - DNA, 15 bp, Homo sapiens
ccaatgatatattct

SEQ ID NO: 52824 - DNA, 15 bp, Homo sapiens
cccaatgatatattc

SEQ ID NO: 52825 - DNA, 15 bp, Homo sapiens
tcccaatgatatatt

SEQ ID NO: 52826 - DNA, 15 bp, Homo sapiens
ttcccaatgatatat

SEQ ID NO: 52827 - DNA, 15 bp, Homo sapiens
tttcccaatgatata

SEQ ID NO: 52828 - DNA, 15 bp, Homo sapiens
ttttcccaatgatat

SEQ ID NO: 52829 - DNA, 15 bp, Homo sapiens
attttcccaatgata

SEQ ID NO: 52830 - DNA, 15 bp, Homo sapiens
aattttcccaatgat

SEQ ID NO: 52831 - DNA, 15 bp, Homo sapiens
aaattttcccaatga

SEQ ID NO: 52832 - DNA, 15 bp, Homo sapiens
aaaattttcccaatg

SEQ ID NO: 52833 - DNA, 15 bp, Homo sapiens
aaaaattttcccaat

SEQ ID NO: 52834 - DNA, 15 bp, Homo sapiens
caaaaattttcccaa

SEQ ID NO: 52835 - DNA, 15 bp, Homo sapiens
tcaaaaattttccca

SEQ ID NO: 52836 - DNA, 15 bp, Homo sapiens
ctcaaaaattttccc

SEQ ID NO: 52837 - DNA, 15 bp, Homo sapiens
actcaaaaattttcc

SEQ ID NO: 52838 - DNA, 15 bp, Homo sapiens
aactcaaaaattttc

SEQ ID NO: 52839 - DNA, 15 bp, Homo sapiens
gaactcaaaaatttt

SEQ ID NO: 52840 - DNA, 15 bp, Homo sapiens
agaactcaaaaattt

SEQ ID NO: 52841 - DNA, 15 bp, Homo sapiens
gagaactcaaaaatt

SEQ ID NO: 52842 - DNA, 15 bp, Homo sapiens
agagaactcaaaaat

SEQ ID NO: 52843 - DNA, 15 bp, Homo sapiens
aagagaactcaaaaa

SEQ ID NO: 52844 - DNA, 15 bp, Homo sapiens
caagagaactcaaaa

SEQ ID NO: 52845 - DNA, 15 bp, Homo sapiens
ccaagagaactcaaa

SEQ ID NO: 52846 - DNA, 15 bp, Homo sapiens
accaagagaactcaa

SEQ ID NO: 52847 - DNA, 15 bp, Homo sapiens
aaccaagagaactca

SEQ ID NO: 52848 - DNA, 15 bp, Homo sapiens
taaccaagagaactc

SEQ ID NO: 52849 - DNA, 15 bp, Homo sapiens
cttaaccaagagaac

SEQ ID NO: 52850 - DNA, 15 bp, Homo sapiens
tcttaaccaagagaa

SEQ ID NO: 52851 - DNA, 15 bp, Homo sapiens
ctcttaaccaagaga

SEQ ID NO: 52852 - DNA, 15 bp, Homo sapiens
cctcttaaccaagag

SEQ ID NO: 52853 - DNA, 15 bp, Homo sapiens
tcctcttaaccaaga

SEQ ID NO: 52854 - DNA, 15 bp, Homo sapiens
atcctcttaaccaag

SEQ ID NO: 52855 - DNA, 15 bp, Homo sapiens
catcctcttaaccaa

SEQ ID NO: 52856 - DNA, 15 bp, Homo sapiens
tcatcctcttaacca

SEQ ID NO: 52857 - DNA, 15 bp, Homo sapiens
atcatcctcttaacc

SEQ ID NO: 52858 - DNA, 15 bp, Homo sapiens
catcatcctcttaac

SEQ ID NO: 52859 - DNA, 15 bp, Homo sapiens
tcatcatcctcttaa

SEQ ID NO: 52860 - DNA, 15 bp, Homo sapiens
atcatcatcctctta

SEQ ID NO: 52861 - DNA, 15 bp, Homo sapiens
aatcatcatcctctt

SEQ ID NO: 52862 - DNA, 15 bp, Homo sapiens
aaatcatcatcctct

SEQ ID NO: 52863 - DNA, 15 bp, Homo sapiens
gaaatcatcatcctc

SEQ ID NO: 52864 - DNA, 15 bp, Homo sapiens
tgaaatcatcatcct

SEQ ID NO: 52865 - DNA, 15 bp, Homo sapiens
atgaaatcatcatcc

SEQ ID NO: 52866 - DNA, 15 bp, Homo sapiens
aatgaaatcatcatc

SEQ ID NO: 52867 - DNA, 15 bp, Homo sapiens
aaatgaaatcatcat

SEQ ID NO: 52868 - DNA, 15 bp, Homo sapiens
aaaatgaaatcatca

SEQ ID NO: 52869 - DNA, 15 bp, Homo sapiens
caaaatgaaatcatc

SEQ ID NO: 52870 - DNA, 15 bp, Homo sapiens
gcaaaatgaaatcat

SEQ ID NO: 52871 - DNA, 15 bp, Homo sapiens
ggcaaaatgaaatca

SEQ ID NO: 52872 - DNA, 15 bp, Homo sapiens
aggcaaaatgaaatc

SEQ ID NO: 52873 - DNA, 15 bp, Homo sapiens
caggcaaaatgaaat

SEQ ID NO: 52874 - DNA, 15 bp, Homo sapiens
ccaggcaaaatgaaa

SEQ ID NO: 52875 - DNA, 15 bp, Homo sapiens
accaggcaaaatgaa

SEQ ID NO: 52876 - DNA, 15 bp, Homo sapiens
aaccaggcaaaatga

SEQ ID NO: 52877 - DNA, 15 bp, Homo sapiens
taaccaggcaaaatg

SEQ ID NO: 52878 - DNA, 15 bp, Homo sapiens
ttaaccaggcaaaat

SEQ ID NO: 52879 - DNA, 15 bp, Homo sapiens
tttaaccaggcaaaa

SEQ ID NO: 52880 - DNA, 15 bp, Homo sapiens
ttttaaccaggcaaa

SEQ ID NO: 52881 - DNA, 15 bp, Homo sapiens
gttttaaccaggcaa

SEQ ID NO: 52882 - DNA, 15 bp, Homo sapiens
ggttttaaccaggca

SEQ ID NO: 52883 - DNA, 15 bp, Homo sapiens
tggttttaaccaggc

SEQ ID NO: 52884 - DNA, 15 bp, Homo sapiens
ttggttttaaccagg

SEQ ID NO: 52885 - DNA, 15 bp, Homo sapiens
tttggttttaaccag

SEQ ID NO: 52886 - DNA, 15 bp, Homo sapiens
atttggttttaacca

SEQ ID NO: 52887 - DNA, 15 bp, Homo sapiens
catttggttttaacc

SEQ ID NO: 52888 - DNA, 15 bp, Homo sapiens
acatttggttttaac

SEQ ID NO: 52889 - DNA, 15 bp, Homo sapiens
aacatttggttttaa

SEQ ID NO: 52890 - DNA, 15 bp, Homo sapiens
taacatttggtttta

SEQ ID NO: 52891 - DNA, 15 bp, Homo sapiens
ataacatttggtttt

SEQ ID NO: 52892 - DNA, 15 bp, Homo sapiens
tataacatttggttt

SEQ ID NO: 52893 - DNA, 15 bp, Homo sapiens
ttataacatttggtt

SEQ ID NO: 52894 - DNA, 15 bp, Homo sapiens
attataacatttggt

SEQ ID NO: 52895 - DNA, 15 bp, Homo sapiens
aattataacatttgg

SEQ ID NO: 52896 - DNA, 15 bp, Homo sapiens
gaattataacatttg

SEQ ID NO: 52897 - DNA, 15 bp, Homo sapiens
tgaattataacattt

SEQ ID NO: 52898 - DNA, 15 bp, Homo sapiens
ctgaattataacatt

SEQ ID NO: 52899 - DNA, 15 bp, Homo sapiens
cctgaattataacat

SEQ ID NO: 52900 - DNA, 15 bp, Homo sapiens
gcctgaattataaca

SEQ ID NO: 52901 - DNA, 15 bp, Homo sapiens
tgcctgaattataac

SEQ ID NO: 52902 - DNA, 15 bp, Homo sapiens
ctgcctgaattataa

SEQ ID NO: 52903 - DNA, 15 bp, Homo sapiens
actgcctgaattata

SEQ ID NO: 52904 - DNA, 15 bp, Homo sapiens
gactgcctgaattat

SEQ ID NO: 52905 - DNA, 15 bp, Homo sapiens
agactgcctgaatta

SEQ ID NO: 52906 - DNA, 15 bp, Homo sapiens
aagactgcctgaatt

SEQ ID NO: 52907 - DNA, 15 bp, Homo sapiens
aaagactgcctgaat

SEQ ID NO: 52908 - DNA, 15 bp, Homo sapiens
gaaagactgcctgaa

SEQ ID NO: 52909 - DNA, 15 bp, Homo sapiens
agaaagactgcctga

SEQ ID NO: 52910 - DNA, 15 bp, Homo sapiens
tagaaagactgcctg

SEQ ID NO: 52911 - DNA, 15 bp, Homo sapiens
gtagaaagactgcct

SEQ ID NO: 52912 - DNA, 15 bp, Homo sapiens
ggtagaaagactgcc

SEQ ID NO: 52913 - DNA, 15 bp, Homo sapiens
gggtagaaagactgc

SEQ ID NO: 52914 - DNA, 15 bp, Homo sapiens
agggtagaaagactg

SEQ ID NO: 52915 - DNA, 15 bp, Homo sapiens
cagggtagaaagact

SEQ ID NO: 52916 - DNA, 15 bp, Homo sapiens
acagggtagaaagac

SEQ ID NO: 52917 - DNA, 15 bp, Homo sapiens
gacagggtagaaaga

SEQ ID NO: 52918 - DNA, 15 bp, Homo sapiens
tgacagggtagaaag

SEQ ID NO: 52919 - DNA, 15 bp, Homo sapiens
ctgacagggtagaaa

SEQ ID NO: 52920 - DNA, 15 bp, Homo sapiens
tctgacagggtagaa

SEQ ID NO: 52921 - DNA, 15 bp, Homo sapiens
ttctgacagggtaga

SEQ ID NO: 52922 - DNA, 15 bp, Homo sapiens
tttctgacagggtag

SEQ ID NO: 52923 - DNA, 15 bp, Homo sapiens
atttctgacagggta

SEQ ID NO: 52924 - DNA, 15 bp, Homo sapiens
tatttctgacagggt

SEQ ID NO: 52925 - DNA, 15 bp, Homo sapiens
atatttctgacaggg

SEQ ID NO: 52926 - DNA, 15 bp, Homo sapiens
aatatttctgacagg

SEQ ID NO: 52927 - DNA, 15 bp, Homo sapiens
aaatatttctgacag

SEQ ID NO: 52928 - DNA, 15 bp, Homo sapiens
taaatatttctgaca

SEQ ID NO: 52929 - DNA, 15 bp, Homo sapiens
ataaatatttctgac

SEQ ID NO: 52930 - DNA, 15 bp, Homo sapiens
cataaatatttctga

SEQ ID NO: 52931 - DNA, 15 bp, Homo sapiens
ccataaatatttctg

SEQ ID NO: 52932 - DNA, 15 bp, Homo sapiens
tccataaatatttct

SEQ ID NO: 52933 - DNA, 15 bp, Homo sapiens
atccataaatatttc

SEQ ID NO: 52934 - DNA, 15 bp, Homo sapiens
aatccataaatattt

SEQ ID NO: 52935 - DNA, 15 bp, Homo sapiens
aaatccataaatatt

SEQ ID NO: 52936 - DNA, 15 bp, Homo sapiens
aaaatccataaatat

SEQ ID NO: 52937 - DNA, 15 bp, Homo sapiens
aaaaatccataaata

SEQ ID NO: 52938 - DNA, 15 bp, Homo sapiens
taaaaatccataaat

SEQ ID NO: 52939 - DNA, 15 bp, Homo sapiens
ataaaaatccataaa

SEQ ID NO: 52940 - DNA, 15 bp, Homo sapiens
aataaaaatccataa

SEQ ID NO: 52941 - DNA, 15 bp, Homo sapiens
gaataaaaatccata

SEQ ID NO: 52942 - DNA, 15 bp, Homo sapiens
agaataaaaatccat

SEQ ID NO: 52943 - DNA, 15 bp, Homo sapiens
aagaataaaaatcca

SEQ ID NO: 52944 - DNA, 15 bp, Homo sapiens
caagaataaaaatcc

SEQ ID NO: 52945 - DNA, 15 bp, Homo sapiens
acaagaataaaaatc

SEQ ID NO: 52946 - DNA, 15 bp, Homo sapiens
cacaagaataaaaat

SEQ ID NO: 52947 - DNA, 15 bp, Homo sapiens
ccacaagaataaaaa

SEQ ID NO: 52948 - DNA, 15 bp, Homo sapiens
tccacaagaataaaa

SEQ ID NO: 52949 - DNA, 15 bp, Homo sapiens
atccacaagaataaa

SEQ ID NO: 52950 - DNA, 15 bp, Homo sapiens
catccacaagaataa

SEQ ID NO: 52951 - DNA, 15 bp, Homo sapiens
acatccacaagaata

SEQ ID NO: 52952 - DNA, 15 bp, Homo sapiens
cacatccacaagaat

SEQ ID NO: 52953 - DNA, 15 bp, Homo sapiens
ccacatccacaagaa

SEQ ID NO: 52954 - DNA, 15 bp, Homo sapiens
gccacatccacaaga

SEQ ID NO: 52955 - DNA, 15 bp, Homo sapiens
agccacatccacaag

SEQ ID NO: 52956 - DNA, 15 bp, Homo sapiens
tagccacatccacaa

SEQ ID NO: 52957 - DNA, 15 bp, Homo sapiens
ttagccacatccaca

SEQ ID NO: 52958 - DNA, 15 bp, Homo sapiens
attagccacatccac

SEQ ID NO: 52959 - DNA, 15 bp, Homo sapiens
tattagccacatcca

SEQ ID NO: 52960 - DNA, 15 bp, Homo sapiens
ttattagccacatcc

SEQ ID NO: 52961 - DNA, 15 bp, Homo sapiens
attattagccacatc

SEQ ID NO: 52962 - DNA, 15 bp, Homo sapiens
tattattagccacat

SEQ ID NO: 52963 - DNA, 15 bp, Homo sapiens
atattattagccaca

SEQ ID NO: 52964 - DNA, 15 bp, Homo sapiens
aatattattagccac

SEQ ID NO: 52965 - DNA, 15 bp, Homo sapiens
aaatattattagcca

SEQ ID NO: 52966 - DNA, 15 bp, Homo sapiens
taaatattattagcc

SEQ ID NO: 52967 - DNA, 15 bp, Homo sapiens
ataaatattattagc

SEQ ID NO: 52968 - DNA, 15 bp, Homo sapiens
gataaatattattag

SEQ ID NO: 52969 - DNA, 15 bp, Homo sapiens
agataaatattatta

SEQ ID NO: 52970 - DNA, 15 bp, Homo sapiens
cagataaatattatt

SEQ ID NO: 52971 - DNA, 15 bp, Homo sapiens
gcagataaatattat

SEQ ID NO: 52972 - DNA, 15 bp, Homo sapiens
ggcagataaatatta

SEQ ID NO: 52973 - DNA, 15 bp, Homo sapiens
aggcagataaatatt

SEQ ID NO: 52974 - DNA, 15 bp, Homo sapiens
aaggcagataaatat

SEQ ID NO: 52975 - DNA, 15 bp, Homo sapiens
caaggcagataaata

SEQ ID NO: 52976 - DNA, 15 bp, Homo sapiens
acaaggcagataaat

SEQ ID NO: 52977 - DNA, 15 bp, Homo sapiens
cacaaggcagataaa

SEQ ID NO: 52978 - DNA, 15 bp, Homo sapiens
ccacaaggcagataa

SEQ ID NO: 52979 - DNA, 15 bp, Homo sapiens
cccacaaggcagata

SEQ ID NO: 52980 - DNA, 15 bp, Homo sapiens
acccacaaggcagat

SEQ ID NO: 52981 - DNA, 15 bp, Homo sapiens
aacccacaaggcaga

SEQ ID NO: 52982 - DNA, 15 bp, Homo sapiens
caacccacaaggcag

SEQ ID NO: 52983 - DNA, 15 bp, Homo sapiens
acaacccacaaggca

SEQ ID NO: 52984 - DNA, 15 bp, Homo sapiens
aacaacccacaaggc

SEQ ID NO: 52985 - DNA, 15 bp, Homo sapiens
aaacaacccacaagg

SEQ ID NO: 52986 - DNA, 15 bp, Homo sapiens
aaaacaacccacaag

SEQ ID NO: 52987 - DNA, 15 bp, Homo sapiens
aaaaacaacccacaa

SEQ ID NO: 52988 - DNA, 15 bp, Homo sapiens
aaaaaacaacccaca

SEQ ID NO: 52989 - DNA, 15 bp, Homo sapiens
gaaaaaacaacccac

SEQ ID NO: 52990 - DNA, 15 bp, Homo sapiens
agaaaaaacaaccca

SEQ ID NO: 52991 - DNA, 15 bp, Homo sapiens
aagaaaaaacaaccc

SEQ ID NO: 52992 - DNA, 15 bp, Homo sapiens
caagaaaaaacaacc

SEQ ID NO: 52993 - DNA, 15 bp, Homo sapiens
acaagaaaaaacaac

SEQ ID NO: 52994 - DNA, 15 bp, Homo sapiens
cacaagaaaaaacaa

SEQ ID NO: 52995 - DNA, 15 bp, Homo sapiens
acacaagaaaaaaca

SEQ ID NO: 52996 - DNA, 15 bp, Homo sapiens
tacacaagaaaaaac

SEQ ID NO: 52997 - DNA, 15 bp, Homo sapiens
gtacacaagaaaaaa

SEQ ID NO: 52998 - DNA, 15 bp, Homo sapiens
agtacacaagaaaaa

SEQ ID NO: 52999 - DNA, 15 bp, Homo sapiens
aagtacacaagaaaa

SEQ ID NO: 53000 - DNA, 15 bp, Homo sapiens
gaagtacacaagaaa

SEQ ID NO: 53001 - DNA, 15 bp, Homo sapiens
ggaagtacacaagaa

SEQ ID NO: 53002 - DNA, 15 bp, Homo sapiens
aggaagtacacaaga

SEQ ID NO: 53003 - DNA, 15 bp, Homo sapiens
aaggaagtacacaag

SEQ ID NO: 53004 - DNA, 15 bp, Homo sapiens
taaggaagtacacaa

SEQ ID NO: 53005 - DNA, 15 bp, Homo sapiens
ttaaggaagtacaca

SEQ ID NO: 53006 - DNA, 15 bp, Homo sapiens
attaaggaagtacac

SEQ ID NO: 53007 - DNA, 15 bp, Homo sapiens
aattaaggaagtaca

SEQ ID NO: 53008 - DNA, 15 bp, Homo sapiens
gaattaaggaagtac

SEQ ID NO: 53009 - DNA, 15 bp, Homo sapiens
ggaattaaggaagta

SEQ ID NO: 53010 - DNA, 15 bp, Homo sapiens
aggaattaaggaagt

SEQ ID NO: 53011 - DNA, 15 bp, Homo sapiens
gaggaattaaggaag

SEQ ID NO: 53012 - DNA, 15 bp, Homo sapiens
ggaggaattaaggaa

SEQ ID NO: 53013 - DNA, 15 bp, Homo sapiens
gggaggaattaagga

SEQ ID NO: 53014 - DNA, 15 bp, Homo sapiens
ggggaggaattaagg

SEQ ID NO: 53015 - DNA, 15 bp, Homo sapiens
gggggaggaattaag

SEQ ID NO: 53016 - DNA, 15 bp, Homo sapiens
tgggggaggaattaa

SEQ ID NO: 53017 - DNA, 15 bp, Homo sapiens
gtgggggaggaatta

SEQ ID NO: 53018 - DNA, 15 bp, Homo sapiens
ggtgggggaggaatt

SEQ ID NO: 53019 - DNA, 15 bp, Homo sapiens
gggtgggggaggaat

SEQ ID NO: 53020 - DNA, 15 bp, Homo sapiens
ggggtgggggaggaa

SEQ ID NO: 53021 - DNA, 15 bp, Homo sapiens
tggggtgggggagga

SEQ ID NO: 53022 - DNA, 15 bp, Homo sapiens
ttggggtgggggagg

SEQ ID NO: 53023 - DNA, 15 bp, Homo sapiens
tttggggtgggggag

SEQ ID NO: 53024 - DNA, 15 bp, Homo sapiens
ctttggggtggggga

SEQ ID NO: 53025 - DNA, 15 bp, Homo sapiens
tctttggggtggggg

SEQ ID NO: 53026 - DNA, 15 bp, Homo sapiens
atctttggggtgggg

SEQ ID NO: 53027 - DNA, 15 bp, Homo sapiens
gatctttggggtggg

SEQ ID NO: 53028 - DNA, 15 bp, Homo sapiens
agatctttggggtgg

SEQ ID NO: 53029 - DNA, 15 bp, Homo sapiens
tagatctttggggtg

SEQ ID NO: 53030 - DNA, 15 bp, Homo sapiens
gtagatctttggggt

SEQ ID NO: 53031 - DNA, 15 bp, Homo sapiens
agtagatctttgggg

SEQ ID NO: 53032 - DNA, 15 bp, Homo sapiens
gagtagatctttggg

SEQ ID NO: 53033 - DNA, 15 bp, Homo sapiens
agagtagatctttgg

SEQ ID NO: 53034 - DNA, 15 bp, Homo sapiens
aagagtagatctttg

SEQ ID NO: 53035 - DNA, 15 bp, Homo sapiens
taagagtagatcttt

SEQ ID NO: 53036 - DNA, 15 bp, Homo sapiens
ctaagagtagatctt

SEQ ID NO: 53037 - DNA, 15 bp, Homo sapiens
gctaagagtagatct

SEQ ID NO: 53038 - DNA, 15 bp, Homo sapiens
tgctaagagtagatc

SEQ ID NO: 53039 - DNA, 15 bp, Homo sapiens
atgctaagagtagat

SEQ ID NO: 53040 - DNA, 15 bp, Homo sapiens
aatgctaagagtaga

SEQ ID NO: 53041 - DNA, 15 bp, Homo sapiens
aaatgctaagagtag

SEQ ID NO: 53042 - DNA, 15 bp, Homo sapiens
gaaatgctaagagta

SEQ ID NO: 53043 - DNA, 15 bp, Homo sapiens
agaaatgctaagagt

SEQ ID NO: 53044 - DNA, 15 bp, Homo sapiens
tagaaatgctaagag

SEQ ID NO: 53045 - DNA, 15 bp, Homo sapiens
ttagaaatgctaaga

SEQ ID NO: 53046 - DNA, 15 bp, Homo sapiens
gttagaaatgctaag

SEQ ID NO: 53047 - DNA, 15 bp, Homo sapiens
ggttagaaatgctaa

SEQ ID NO: 53048 - DNA, 15 bp, Homo sapiens
tggttagaaatgcta

SEQ ID NO: 53049 - DNA, 15 bp, Homo sapiens
atggttagaaatgct

SEQ ID NO: 53050 - DNA, 15 bp, Homo sapiens
aatggttagaaatgc

SEQ ID NO: 53051 - DNA, 15 bp, Homo sapiens
aaatggttagaaatg

SEQ ID NO: 53052 - DNA, 15 bp, Homo sapiens
taaatggttagaaat

SEQ ID NO: 53053 - DNA, 15 bp, Homo sapiens
ctaaatggttagaaa

SEQ ID NO: 53054 - DNA, 15 bp, Homo sapiens
tctaaatggttagaa

SEQ ID NO: 53055 - DNA, 15 bp, Homo sapiens
ttctaaatggttaga

SEQ ID NO: 53056 - DNA, 15 bp, Homo sapiens
gttctaaatggttag

SEQ ID NO: 53057 - DNA, 15 bp, Homo sapiens
tgttctaaatggtta

SEQ ID NO: 53058 - DNA, 15 bp, Homo sapiens
atgttctaaatggtt

SEQ ID NO: 53059 - DNA, 15 bp, Homo sapiens
tatgttctaaatggt

SEQ ID NO: 53060 - DNA, 15 bp, Homo sapiens
ttatgttctaaatgg

SEQ ID NO: 53061 - DNA, 15 bp, Homo sapiens
attatgttctaaatg

SEQ ID NO: 53062 - DNA, 15 bp, Homo sapiens
gattatgttctaaat

SEQ ID NO: 53063 - DNA, 15 bp, Homo sapiens
tgattatgttctaaa

SEQ ID NO: 53064 - DNA, 15 bp, Homo sapiens
ttgattatgttctaa

SEQ ID NO: 53065 - DNA, 15 bp, Homo sapiens
attgattatgttcta

SEQ ID NO: 53066 - DNA, 15 bp, Homo sapiens
cattgattatgttct

SEQ ID NO: 53067 - DNA, 15 bp, Homo sapiens
gcattgattatgttc

SEQ ID NO: 53068 - DNA, 15 bp, Homo sapiens
agcattgattatgtt

SEQ ID NO: 53069 - DNA, 15 bp, Homo sapiens
aagcattgattatgt

SEQ ID NO: 53070 - DNA, 15 bp, Homo sapiens
aaagcattgattatg

SEQ ID NO: 53071 - DNA, 15 bp, Homo sapiens
caaagcattgattat

SEQ ID NO: 53072 - DNA, 15 bp, Homo sapiens
tcaaagcattgatta

SEQ ID NO: 53073 - DNA, 15 bp, Homo sapiens
ctcaaagcattgatt

SEQ ID NO: 53074 - DNA, 15 bp, Homo sapiens
gctcaaagcattgat

SEQ ID NO: 53075 - DNA, 15 bp, Homo sapiens
tgctcaaagcattga

SEQ ID NO: 53076 - DNA, 15 bp, Homo sapiens
ttgctcaaagcattg

SEQ ID NO: 53077 - DNA, 15 bp, Homo sapiens
attgctcaaagcatt

SEQ ID NO: 53078 - DNA, 15 bp, Homo sapiens
tattgctcaaagcat

SEQ ID NO: 53079 - DNA, 15 bp, Homo sapiens
atattgctcaaagca

SEQ ID NO: 53080 - DNA, 15 bp, Homo sapiens
aatattgctcaaagc

SEQ ID NO: 53081 - DNA, 15 bp, Homo sapiens
aaatattgctcaaag

SEQ ID NO: 53082 - DNA, 15 bp, Homo sapiens
aaaatattgctcaaa

SEQ ID NO: 53083 - DNA, 15 bp, Homo sapiens
aaaaatattgctcaa

SEQ ID NO: 53084 - DNA, 15 bp, Homo sapiens
aaaaaatattgctca

SEQ ID NO: 53085 - DNA, 15 bp, Homo sapiens
gaaaaaatattgctc

SEQ ID NO: 53086 - DNA, 15 bp, Homo sapiens
tgaaaaaatattgct

SEQ ID NO: 53087 - DNA, 15 bp, Homo sapiens
atgaaaaaatattgc

SEQ ID NO: 53088 - DNA, 15 bp, Homo sapiens
tatgaaaaaatattg

SEQ ID NO: 53089 - DNA, 15 bp, Homo sapiens
ctatgaaaaaatatt

SEQ ID NO: 53090 - DNA, 15 bp, Homo sapiens
cctatgaaaaaatat

SEQ ID NO: 53091 - DNA, 15 bp, Homo sapiens
ccctatgaaaaaata

SEQ ID NO: 53092 - DNA, 15 bp, Homo sapiens
cccctatgaaaaaat

SEQ ID NO: 53093 - DNA, 15 bp, Homo sapiens
gcccctatgaaaaaa

SEQ ID NO: 53094 - DNA, 15 bp, Homo sapiens
tgcccctatgaaaaa

SEQ ID NO: 53095 - DNA, 15 bp, Homo sapiens
ctgcccctatgaaaa

SEQ ID NO: 53096 - DNA, 15 bp, Homo sapiens
tctgcccctatgaaa

SEQ ID NO: 53097 - DNA, 15 bp, Homo sapiens
ctctgcccctatgaa

SEQ ID NO: 53098 - DNA, 15 bp, Homo sapiens
gctctgcccctatga

SEQ ID NO: 53099 - DNA, 15 bp, Homo sapiens
tgctctgcccctatg

SEQ ID NO: 53100 - DNA, 15 bp, Homo sapiens
atgctctgcccctat

SEQ ID NO: 53101 - DNA, 15 bp, Homo sapiens
catgctctgccccta

SEQ ID NO: 53102 - DNA, 15 bp, Homo sapiens
gcatgctctgcccct

SEQ ID NO: 53103 - DNA, 15 bp, Homo sapiens
agcatgctctgcccc

SEQ ID NO: 53104 - DNA, 15 bp, Homo sapiens
cagcatgctctgccc

SEQ ID NO: 53105 - DNA, 15 bp, Homo sapiens
tcagcatgctctgcc

SEQ ID NO: 53106 - DNA, 15 bp, Homo sapiens
ttcagcatgctctgc

SEQ ID NO: 53107 - DNA, 15 bp, Homo sapiens
cttcagcatgctctg

SEQ ID NO: 53108 - DNA, 15 bp, Homo sapiens
tcttcagcatgctct

SEQ ID NO: 53109 - DNA, 15 bp, Homo sapiens
ctcttcagcatgctc

SEQ ID NO: 53110 - DNA, 15 bp, Homo sapiens
tctcttcagcatgct

SEQ ID NO: 53111 - DNA, 15 bp, Homo sapiens
ctctcttcagcatgc

SEQ ID NO: 53112 - DNA, 15 bp, Homo sapiens
cctctcttcagcatg

SEQ ID NO: 53113 - DNA, 15 bp, Homo sapiens
tcctctcttcagcat

SEQ ID NO: 53114 - DNA, 15 bp, Homo sapiens
ttcctctcttcagca

SEQ ID NO: 53115 - DNA, 15 bp, Homo sapiens
attcctctcttcagc

SEQ ID NO: 53116 - DNA, 15 bp, Homo sapiens
aattcctctcttcag

SEQ ID NO: 53117 - DNA, 15 bp, Homo sapiens
caattcctctcttca

SEQ ID NO: 53118 - DNA, 15 bp, Homo sapiens
acaattcctctcttc

SEQ ID NO: 53119 - DNA, 15 bp, Homo sapiens
gacaattcctctctt

SEQ ID NO: 53120 - DNA, 15 bp, Homo sapiens
tgacaattcctctct

SEQ ID NO: 53121 - DNA, 15 bp, Homo sapiens
ctgacaattcctctc

SEQ ID NO: 53122 - DNA, 15 bp, Homo sapiens
actgacaattcctct

SEQ ID NO: 53123 - DNA, 15 bp, Homo sapiens
cactgacaattcctc

SEQ ID NO: 53124 - DNA, 15 bp, Homo sapiens
gcactgacaattcct

SEQ ID NO: 53125 - DNA, 15 bp, Homo sapiens
agcactgacaattcc

SEQ ID NO: 53126 - DNA, 15 bp, Homo sapiens
tagcactgacaattc

SEQ ID NO: 53127 - DNA, 15 bp, Homo sapiens
atagcactgacaatt

SEQ ID NO: 53128 - DNA, 15 bp, Homo sapiens
aatagcactgacaat

SEQ ID NO: 53129 - DNA, 15 bp, Homo sapiens
aaatagcactgacaa

SEQ ID NO: 53130 - DNA, 15 bp, Homo sapiens
aaaatagcactgaca

SEQ ID NO: 53131 - DNA, 15 bp, Homo sapiens
gaaaatagcactgac

SEQ ID NO: 53132 - DNA, 15 bp, Homo sapiens
tgaaaatagcactga

SEQ ID NO: 53133 - DNA, 15 bp, Homo sapiens
ttgaaaatagcactg

SEQ ID NO: 53134 - DNA, 15 bp, Homo sapiens
tttgaaaatagcact

SEQ ID NO: 53135 - DNA, 15 bp, Homo sapiens
atttgaaaatagcac

SEQ ID NO: 53136 - DNA, 15 bp, Homo sapiens
gatttgaaaatagca

SEQ ID NO: 53137 - DNA, 15 bp, Homo sapiens
agatttgaaaatagc

SEQ ID NO: 53138 - DNA, 15 bp, Homo sapiens
cagatttgaaaatag

SEQ ID NO: 53139 - DNA, 15 bp, Homo sapiens
acagatttgaaaata

SEQ ID NO: 53140 - DNA, 15 bp, Homo sapiens
aacagatttgaaaat

SEQ ID NO: 53141 - DNA, 15 bp, Homo sapiens
gaacagatttgaaaa

SEQ ID NO: 53142 - DNA, 15 bp, Homo sapiens
agaacagatttgaaa

SEQ ID NO: 53143 - DNA, 15 bp, Homo sapiens
tagaacagatttgaa

SEQ ID NO: 53144 - DNA, 15 bp, Homo sapiens
ttagaacagatttga

SEQ ID NO: 53145 - DNA, 15 bp, Homo sapiens
attagaacagatttg

SEQ ID NO: 53146 - DNA, 15 bp, Homo sapiens
tattagaacagattt

SEQ ID NO: 53147 - DNA, 15 bp, Homo sapiens
atattagaacagatt

SEQ ID NO: 53148 - DNA, 15 bp, Homo sapiens
catattagaacagat

SEQ ID NO: 53149 - DNA, 15 bp, Homo sapiens
tcatattagaacaga

SEQ ID NO: 53150 - DNA, 15 bp, Homo sapiens
atcatattagaacag

SEQ ID NO: 53151 - DNA, 15 bp, Homo sapiens
aatcatattagaaca

SEQ ID NO: 53152 - DNA, 15 bp, Homo sapiens
taatcatattagaac

SEQ ID NO: 53153 - DNA, 15 bp, Homo sapiens
ataatcatattagaa

SEQ ID NO: 53154 - DNA, 15 bp, Homo sapiens
gataatcatattaga

SEQ ID NO: 53155 - DNA, 15 bp, Homo sapiens
agataatcatattag

SEQ ID NO: 53156 - DNA, 15 bp, Homo sapiens
tagataatcatatta

SEQ ID NO: 53157 - DNA, 15 bp, Homo sapiens
atagataatcatatt

SEQ ID NO: 53158 - DNA, 15 bp, Homo sapiens
aatagataatcatat

SEQ ID NO: 53159 - DNA, 15 bp, Homo sapiens
taatagataatcata

SEQ ID NO: 53160 - DNA, 15 bp, Homo sapiens
ctaatagataatcat

SEQ ID NO: 53161 - DNA, 15 bp, Homo sapiens
actaatagataatca

SEQ ID NO: 53162 - DNA, 15 bp, Homo sapiens
aactaatagataatc

SEQ ID NO: 53163 - DNA, 15 bp, Homo sapiens
taactaatagataat

SEQ ID NO: 53164 - DNA, 15 bp, Homo sapiens
ataactaatagataa

SEQ ID NO: 53165 - DNA, 15 bp, Homo sapiens
aataactaatagata

SEQ ID NO: 53166 - DNA, 15 bp, Homo sapiens
caataactaatagat

SEQ ID NO: 53167 - DNA, 15 bp, Homo sapiens
ccaataactaataga

SEQ ID NO: 53168 - DNA, 15 bp, Homo sapiens
accaataactaatag

SEQ ID NO: 53169 - DNA, 15 bp, Homo sapiens
caccaataactaata

SEQ ID NO: 53170 - DNA, 15 bp, Homo sapiens
acaccaataactaat

SEQ ID NO: 53171 - DNA, 15 bp, Homo sapiens
aacaccaataactaa

SEQ ID NO: 53172 - DNA, 15 bp, Homo sapiens
caacaccaataacta

SEQ ID NO: 53173 - DNA, 15 bp, Homo sapiens
ccaacaccaataact

SEQ ID NO: 53174 - DNA, 15 bp, Homo sapiens
tccaacaccaataac

SEQ ID NO: 53175 - DNA, 15 bp, Homo sapiens
ttccaacaccaataa

SEQ ID NO: 53176 - DNA, 15 bp, Homo sapiens
attccaacaccaata

SEQ ID NO: 53177 - DNA, 15 bp, Homo sapiens
aattccaacaccaat

SEQ ID NO: 53178 - DNA, 15 bp, Homo sapiens
aaattccaacaccaa

SEQ ID NO: 53179 - DNA, 15 bp, Homo sapiens
aaaattccaacacca

SEQ ID NO: 53180 - DNA, 15 bp, Homo sapiens
caaaattccaacacc

SEQ ID NO: 53181 - DNA, 15 bp, Homo sapiens
acaaaattccaacac

SEQ ID NO: 53182 - DNA, 15 bp, Homo sapiens
cacaaaattccaaca

SEQ ID NO: 53183 - DNA, 15 bp, Homo sapiens
gcacaaaattccaac

SEQ ID NO: 53184 - DNA, 15 bp, Homo sapiens
tgcacaaaattccaa

SEQ ID NO: 53185 - DNA, 15 bp, Homo sapiens
gtgcacaaaattcca

SEQ ID NO: 53186 - DNA, 15 bp, Homo sapiens
agtgcacaaaattcc

SEQ ID NO: 53187 - DNA, 15 bp, Homo sapiens
tagtgcacaaaattc

SEQ ID NO: 53188 - DNA, 15 bp, Homo sapiens
ttagtgcacaaaatt

SEQ ID NO: 53189 - DNA, 15 bp, Homo sapiens
cttagtgcacaaaat

SEQ ID NO: 53190 - DNA, 15 bp, Homo sapiens
gcttagtgcacaaaa

SEQ ID NO: 53191 - DNA, 15 bp, Homo sapiens
ggcttagtgcacaaa

SEQ ID NO: 53192 - DNA, 15 bp, Homo sapiens
aggcttagtgcacaa

SEQ ID NO: 53193 - DNA, 15 bp, Homo sapiens
caggcttagtgcaca

SEQ ID NO: 53194 - DNA, 15 bp, Homo sapiens
tcaggcttagtgcac

SEQ ID NO: 53195 - DNA, 15 bp, Homo sapiens
ctcaggcttagtgca

SEQ ID NO: 53196 - DNA, 15 bp, Homo sapiens
cctcaggcttagtgc

SEQ ID NO: 53197 - DNA, 15 bp, Homo sapiens
acctcaggcttagtg

SEQ ID NO: 53198 - DNA, 15 bp, Homo sapiens
tacctcaggcttagt

SEQ ID NO: 53199 - DNA, 15 bp, Homo sapiens
ctacctcaggcttag

SEQ ID NO: 53200 - DNA, 15 bp, Homo sapiens
cctacctcaggctta

SEQ ID NO: 53201 - DNA, 15 bp, Homo sapiens
tcctacctcaggctt

SEQ ID NO: 53202 - DNA, 15 bp, Homo sapiens
ctcctacctcaggct

SEQ ID NO: 53203 - DNA, 15 bp, Homo sapiens
cctcctacctcaggc

SEQ ID NO: 53204 - DNA, 15 bp, Homo sapiens
tcctcctacctcagg

SEQ ID NO: 53205 - DNA, 15 bp, Homo sapiens
ctcctcctacctcag

SEQ ID NO: 53206 - DNA, 15 bp, Homo sapiens
tctcctcctacctca

SEQ ID NO: 53207 - DNA, 15 bp, Homo sapiens
ctctcctcctacctc

SEQ ID NO: 53208 - DNA, 15 bp, Homo sapiens
actctcctcctacct

SEQ ID NO: 53209 - DNA, 15 bp, Homo sapiens
aactctcctcctacc

SEQ ID NO: 53210 - DNA, 15 bp, Homo sapiens
aaactctcctcctac

SEQ ID NO: 53211 - DNA, 15 bp, Homo sapiens
aaaactctcctccta

SEQ ID NO: 53212 - DNA, 15 bp, Homo sapiens
gaaaactctcctcct

SEQ ID NO: 53213 - DNA, 15 bp, Homo sapiens
tgaaaactctcctcc

SEQ ID NO: 53214 - DNA, 15 bp, Homo sapiens
ctgaaaactctcctc

SEQ ID NO: 53215 - DNA, 15 bp, Homo sapiens
cctgaaaactctcct

SEQ ID NO: 53216 - DNA, 15 bp, Homo sapiens
tcctgaaaactctcc

SEQ ID NO: 53217 - DNA, 15 bp, Homo sapiens
atcctgaaaactctc

SEQ ID NO: 53218 - DNA, 15 bp, Homo sapiens
tatcctgaaaactct

SEQ ID NO: 53219 - DNA, 15 bp, Homo sapiens
ttatcctgaaaactc

SEQ ID NO: 53220 - DNA, 15 bp, Homo sapiens
gttatcctgaaaact

SEQ ID NO: 53221 - DNA, 15 bp, Homo sapiens
tgttatcctgaaaac

SEQ ID NO: 53222 - DNA, 15 bp, Homo sapiens
ctgttatcctgaaaa

SEQ ID NO: 53223 - DNA, 15 bp, Homo sapiens
tctgttatcctgaaa

SEQ ID NO: 53224 - DNA, 15 bp, Homo sapiens
atctgttatcctgaa

SEQ ID NO: 53225 - DNA, 15 bp, Homo sapiens
aatctgttatcctga

SEQ ID NO: 53226 - DNA, 15 bp, Homo sapiens
caatctgttatcctg

SEQ ID NO: 53227 - DNA, 15 bp, Homo sapiens
acaatctgttatcct

SEQ ID NO: 53228 - DNA, 15 bp, Homo sapiens
aacaatctgttatcc

SEQ ID NO: 53229 - DNA, 15 bp, Homo sapiens
aaacaatctgttatc

SEQ ID NO: 53230 - DNA, 15 bp, Homo sapiens
taaacaatctgttat

SEQ ID NO: 53231 - DNA, 15 bp, Homo sapiens
ctaaacaatctgtta

SEQ ID NO: 53232 - DNA, 15 bp, Homo sapiens
cctaaacaatctgtt

SEQ ID NO: 53233 - DNA, 15 bp, Homo sapiens
tcctaaacaatctgt

SEQ ID NO: 53234 - DNA, 15 bp, Homo sapiens
gtcctaaacaatctg

SEQ ID NO: 53235 - DNA, 15 bp, Homo sapiens
agtcctaaacaatct

SEQ ID NO: 53236 - DNA, 15 bp, Homo sapiens
gagtcctaaacaatc

SEQ ID NO: 53237 - DNA, 15 bp, Homo sapiens
agagtcctaaacaat

SEQ ID NO: 53238 - DNA, 15 bp, Homo sapiens
aagagtcctaaacaa

SEQ ID NO: 53239 - DNA, 15 bp, Homo sapiens
gaagagtcctaaaca

SEQ ID NO: 53240 - DNA, 15 bp, Homo sapiens
agaagagtcctaaac

SEQ ID NO: 53241 - DNA, 15 bp, Homo sapiens
tagaagagtcctaaa

SEQ ID NO: 53242 - DNA, 15 bp, Homo sapiens
gtagaagagtcctaa

SEQ ID NO: 53243 - DNA, 15 bp, Homo sapiens
tgtagaagagtccta

SEQ ID NO: 53244 - DNA, 15 bp, Homo sapiens
ttgtagaagagtcct

SEQ ID NO: 53245 - DNA, 15 bp, Homo sapiens
gttgtagaagagtcc

SEQ ID NO: 53246 - DNA, 15 bp, Homo sapiens
tgttgtagaagagtc

SEQ ID NO: 53247 - DNA, 15 bp, Homo sapiens
ttgttgtagaagagt

SEQ ID NO: 53248 - DNA, 15 bp, Homo sapiens
cttgttgtagaagag

SEQ ID NO: 53249 - DNA, 15 bp, Homo sapiens
tcttgttgtagaaga

SEQ ID NO: 53250 - DNA, 15 bp, Homo sapiens
atcttgttgtagaag

SEQ ID NO: 53251 - DNA, 15 bp, Homo sapiens
catcttgttgtagaa

SEQ ID NO: 53252 - DNA, 15 bp, Homo sapiens
tcatcttgttgtaga

SEQ ID NO: 53253 - DNA, 15 bp, Homo sapiens
ttcatcttgttgtag

SEQ ID NO: 53254 - DNA, 15 bp, Homo sapiens
tttcatcttgttgta

SEQ ID NO: 53255 - DNA, 15 bp, Homo sapiens
ttttcatcttgttgt

SEQ ID NO: 53256 - DNA, 15 bp, Homo sapiens
tttttcatcttgttg

SEQ ID NO: 53257 - DNA, 15 bp, Homo sapiens
atttttcatcttgtt

SEQ ID NO: 53258 - DNA, 15 bp, Homo sapiens
tatttttcatcttgt

SEQ ID NO: 53259 - DNA, 15 bp, Homo sapiens
ctatttttcatcttg

SEQ ID NO: 53260 - DNA, 15 bp, Homo sapiens
tctatttttcatctt

SEQ ID NO: 53261 - DNA, 15 bp, Homo sapiens
ttctatttttcatct

SEQ ID NO: 53262 - DNA, 15 bp, Homo sapiens
cttctatttttcatc

SEQ ID NO: 53263 - DNA, 15 bp, Homo sapiens
acttctatttttcat

SEQ ID NO: 53264 - DNA, 15 bp, Homo sapiens
aacttctatttttca

SEQ ID NO: 53265 - DNA, 15 bp, Homo sapiens
aaacttctatttttc

SEQ ID NO: 53266 - DNA, 15 bp, Homo sapiens
gaaacttctattttt

SEQ ID NO: 53267 - DNA, 15 bp, Homo sapiens
agaaacttctatttt

SEQ ID NO: 53268 - DNA, 15 bp, Homo sapiens
gagaaacttctattt

SEQ ID NO: 53269 - DNA, 15 bp, Homo sapiens
tgagaaacttctatt

SEQ ID NO: 53270 - DNA, 15 bp, Homo sapiens
ctgagaaacttctat

SEQ ID NO: 53271 - DNA, 15 bp, Homo sapiens
tctgagaaacttcta

SEQ ID NO: 53272 - DNA, 15 bp, Homo sapiens
ctctgagaaacttct

SEQ ID NO: 53273 - DNA, 15 bp, Homo sapiens
tctctgagaaacttc

SEQ ID NO: 53274 - DNA, 15 bp, Homo sapiens
ttctctgagaaactt

SEQ ID NO: 53275 - DNA, 15 bp, Homo sapiens
tttctctgagaaact

SEQ ID NO: 53276 - DNA, 15 bp, Homo sapiens
gtttctctgagaaac

SEQ ID NO: 53277 - DNA, 15 bp, Homo sapiens
tgtttctctgagaaa

SEQ ID NO: 53278 - DNA, 15 bp, Homo sapiens
gtgtttctctgagaa

SEQ ID NO: 53279 - DNA, 15 bp, Homo sapiens
agtgtttctctgaga

SEQ ID NO: 53280 - DNA, 15 bp, Homo sapiens
cagtgtttctctgag

SEQ ID NO: 53281 - DNA, 15 bp, Homo sapiens
acagtgtttctctga

SEQ ID NO: 53282 - DNA, 15 bp, Homo sapiens
aacagtgtttctctg

SEQ ID NO: 53283 - DNA, 15 bp, Homo sapiens
caacagtgtttctct

SEQ ID NO: 53284 - DNA, 15 bp, Homo sapiens
acaacagtgtttctc

SEQ ID NO: 53285 - DNA, 15 bp, Homo sapiens
cacaacagtgtttct

SEQ ID NO: 53286 - DNA, 15 bp, Homo sapiens
ccacaacagtgtttc

SEQ ID NO: 53287 - DNA, 15 bp, Homo sapiens
accacaacagtgttt

SEQ ID NO: 53288 - DNA, 15 bp, Homo sapiens
gaccacaacagtgtt

SEQ ID NO: 53289 - DNA, 15 bp, Homo sapiens
agaccacaacagtgt

SEQ ID NO: 53290 - DNA, 15 bp, Homo sapiens
aagaccacaacagtg

SEQ ID NO: 53291 - DNA, 15 bp, Homo sapiens
aaagaccacaacagt

SEQ ID NO: 53292 - DNA, 15 bp, Homo sapiens
aaaagaccacaacag

SEQ ID NO: 53293 - DNA, 15 bp, Homo sapiens
taaaagaccacaaca

SEQ ID NO: 53294 - DNA, 15 bp, Homo sapiens
ttaaaagaccacaac

SEQ ID NO: 53295 - DNA, 15 bp, Homo sapiens
tttaaaagaccacaa

SEQ ID NO: 53296 - DNA, 15 bp, Homo sapiens
atttaaaagaccaca

SEQ ID NO: 53297 - DNA, 15 bp, Homo sapiens
tatttaaaagaccac

SEQ ID NO: 53298 - DNA, 15 bp, Homo sapiens
ctatttaaaagacca

SEQ ID NO: 53299 - DNA, 15 bp, Homo sapiens
actatttaaaagacc

SEQ ID NO: 53300 - DNA, 15 bp, Homo sapiens
tactatttaaaagac

SEQ ID NO: 53301 - DNA, 15 bp, Homo sapiens
atactatttaaaaga

SEQ ID NO: 53302 - DNA, 15 bp, Homo sapiens
tatactatttaaaag

SEQ ID NO: 53303 - DNA, 15 bp, Homo sapiens
ttatactatttaaaa

SEQ ID NO: 53304 - DNA, 15 bp, Homo sapiens
tttatactatttaaa

SEQ ID NO: 53305 - DNA, 15 bp, Homo sapiens
ttttatactatttaa

SEQ ID NO: 53306 - DNA, 15 bp, Homo sapiens
cttttatactattta

SEQ ID NO: 53307 - DNA, 15 bp, Homo sapiens
gcttttatactattt

SEQ ID NO: 53308 - DNA, 15 bp, Homo sapiens
agcttttatactatt

SEQ ID NO: 53309 - DNA, 15 bp, Homo sapiens
tagcttttatactat

SEQ ID NO: 53310 - DNA, 15 bp, Homo sapiens
atagcttttatacta

SEQ ID NO: 53311 - DNA, 15 bp, Homo sapiens
aaatagcttttatac

SEQ ID NO: 53312 - DNA, 15 bp, Homo sapiens
aaaatagcttttata

SEQ ID NO: 53313 - DNA, 15 bp, Homo sapiens
taaaatagcttttat

SEQ ID NO: 53314 - DNA, 15 bp, Homo sapiens
ttaaaatagctttta

SEQ ID NO: 53315 - DNA, 15 bp, Homo sapiens
attaaaatagctttt

SEQ ID NO: 53316 - DNA, 15 bp, Homo sapiens
cattaaaatagcttt

SEQ ID NO: 53317 - DNA, 15 bp, Homo sapiens
tcattaaaatagctt

SEQ ID NO: 53318 - DNA, 15 bp, Homo sapiens
ttcattaaaatagct

SEQ ID NO: 53319 - DNA, 15 bp, Homo sapiens
cttcattaaaatagc

SEQ ID NO: 53320 - DNA, 15 bp, Homo sapiens
tcttcattaaaatag

SEQ ID NO: 53321 - DNA, 15 bp, Homo sapiens
ctcttcattaaaata

SEQ ID NO: 53322 - DNA, 15 bp, Homo sapiens
actcttcattaaaat

SEQ ID NO: 53323 - DNA, 15 bp, Homo sapiens
aactcttcattaaaa

SEQ ID NO: 53324 - DNA, 15 bp, Homo sapiens
caactcttcattaaa

SEQ ID NO: 53325 - DNA, 15 bp, Homo sapiens
gcaactcttcattaa

SEQ ID NO: 53326 - DNA, 15 bp, Homo sapiens
agcaactcttcatta

SEQ ID NO: 53327 - DNA, 15 bp, Homo sapiens
aagcaactcttcatt

SEQ ID NO: 53328 - DNA, 15 bp, Homo sapiens
aaagcaactcttcat

SEQ ID NO: 53329 - DNA, 15 bp, Homo sapiens
aaaagcaactcttca

SEQ ID NO: 53330 - DNA, 15 bp, Homo sapiens
gaaaagcaactcttc

SEQ ID NO: 53331 - DNA, 15 bp, Homo sapiens
tgaaaagcaactctt

SEQ ID NO: 53332 - DNA, 15 bp, Homo sapiens
ttgaaaagcaactct

SEQ ID NO: 53333 - DNA, 15 bp, Homo sapiens
tttgaaaagcaactc

SEQ ID NO: 53334 - DNA, 15 bp, Homo sapiens
ttttgaaaagcaact

SEQ ID NO: 53335 - DNA, 15 bp, Homo sapiens
attttgaaaagcaac

SEQ ID NO: 53336 - DNA, 15 bp, Homo sapiens
aattttgaaaagcaa

SEQ ID NO: 53337 - DNA, 15 bp, Homo sapiens
aaattttgaaaagca

SEQ ID NO: 53338 - DNA, 15 bp, Homo sapiens
aaaattttgaaaagc

SEQ ID NO: 53339 - DNA, 15 bp, Homo sapiens
aaaaattttgaaaag

SEQ ID NO: 53340 - DNA, 15 bp, Homo sapiens
ccaaaaattttgaaa

SEQ ID NO: 53341 - DNA, 15 bp, Homo sapiens
accaaaaattttgaa

SEQ ID NO: 53342 - DNA, 15 bp, Homo sapiens
aaccaaaaattttga

SEQ ID NO: 53343 - DNA, 15 bp, Homo sapiens
caaccaaaaattttg

SEQ ID NO: 53344 - DNA, 15 bp, Homo sapiens
gcaaccaaaaatttt

SEQ ID NO: 53345 - DNA, 15 bp, Homo sapiens
agcaaccaaaaattt

SEQ ID NO: 53346 - DNA, 15 bp, Homo sapiens
aagcaaccaaaaatt

SEQ ID NO: 53347 - DNA, 15 bp, Homo sapiens
aaagcaaccaaaaat

SEQ ID NO: 53348 - DNA, 15 bp, Homo sapiens
aaaagcaaccaaaaa

SEQ ID NO: 53349 - DNA, 15 bp, Homo sapiens
gaaaagcaaccaaaa

SEQ ID NO: 53350 - DNA, 15 bp, Homo sapiens
tgaaaagcaaccaaa

SEQ ID NO: 53351 - DNA, 15 bp, Homo sapiens
ttgaaaagcaaccaa

SEQ ID NO: 53352 - DNA, 15 bp, Homo sapiens
tttgaaaagcaacca

SEQ ID NO: 53353 - DNA, 15 bp, Homo sapiens
ttttgaaaagcaacc

SEQ ID NO: 53354 - DNA, 15 bp, Homo sapiens
cttttgaaaagcaac

SEQ ID NO: 53355 - DNA, 15 bp, Homo sapiens
acttttgaaaagcaa

SEQ ID NO: 53356 - DNA, 15 bp, Homo sapiens
aacttttgaaaagca

SEQ ID NO: 53357 - DNA, 15 bp, Homo sapiens
caacttttgaaaagc

SEQ ID NO: 53358 - DNA, 15 bp, Homo sapiens
acaacttttgaaaag

SEQ ID NO: 53359 - DNA, 15 bp, Homo sapiens
tacaacttttgaaaa

SEQ ID NO: 53360 - DNA, 15 bp, Homo sapiens
ttacaacttttgaaa

SEQ ID NO: 53361 - DNA, 15 bp, Homo sapiens
tttacaacttttgaa

SEQ ID NO: 53362 - DNA, 15 bp, Homo sapiens
ctttacaacttttga

SEQ ID NO: 53363 - DNA, 15 bp, Homo sapiens
cctttacaacttttg

SEQ ID NO: 53364 - DNA, 15 bp, Homo sapiens
acctttacaactttt

SEQ ID NO: 53365 - DNA, 15 bp, Homo sapiens
gacctttacaacttt

SEQ ID NO: 53366 - DNA, 15 bp, Homo sapiens
tgacctttacaactt

SEQ ID NO: 53367 - DNA, 15 bp, Homo sapiens
ctgacctttacaact

SEQ ID NO: 53368 - DNA, 15 bp, Homo sapiens
tctgacctttacaac

SEQ ID NO: 53369 - DNA, 15 bp, Homo sapiens
ctctgacctttacaa

SEQ ID NO: 53370 - DNA, 15 bp, Homo sapiens
tctctgacctttaca

SEQ ID NO: 53371 - DNA, 15 bp, Homo sapiens
ctctctgacctttac

SEQ ID NO: 53372 - DNA, 15 bp, Homo sapiens
tctctctgaccttta

SEQ ID NO: 53373 - DNA, 15 bp, Homo sapiens
gtctctctgaccttt

SEQ ID NO: 53374 - DNA, 15 bp, Homo sapiens
tgtctctctgacctt

SEQ ID NO: 53375 - DNA, 15 bp, Homo sapiens
ttgtctctctgacct

SEQ ID NO: 53376 - DNA, 15 bp, Homo sapiens
tttgtctctctgacc

SEQ ID NO: 53377 - DNA, 15 bp, Homo sapiens
gtttgtctctctgac

SEQ ID NO: 53378 - DNA, 15 bp, Homo sapiens
tgtttgtctctctga

SEQ ID NO: 53379 - DNA, 15 bp, Homo sapiens
atgtttgtctctctg

SEQ ID NO: 53380 - DNA, 15 bp, Homo sapiens
aatgtttgtctctct

SEQ ID NO: 53381 - DNA, 15 bp, Homo sapiens
caatgtttgtctctc

SEQ ID NO: 53382 - DNA, 15 bp, Homo sapiens
ccaatgtttgtctct

SEQ ID NO: 53383 - DNA, 15 bp, Homo sapiens
accaatgtttgtctc

SEQ ID NO: 53384 - DNA, 15 bp, Homo sapiens
taccaatgtttgtct

SEQ ID NO: 53385 - DNA, 15 bp, Homo sapiens
ataccaatgtttgtc

SEQ ID NO: 53386 - DNA, 15 bp, Homo sapiens
aataccaatgtttgt

SEQ ID NO: 53387 - DNA, 15 bp, Homo sapiens
aaataccaatgtttg

SEQ ID NO: 53388 - DNA, 15 bp, Homo sapiens
gaaataccaatgttt

SEQ ID NO: 53389 - DNA, 15 bp, Homo sapiens
agaaataccaatgtt

SEQ ID NO: 53390 - DNA, 15 bp, Homo sapiens
aagaaataccaatgt

SEQ ID NO: 53391 - DNA, 15 bp, Homo sapiens
caagaaataccaatg

SEQ ID NO: 53392 - DNA, 15 bp, Homo sapiens
tcaagaaataccaat

SEQ ID NO: 53393 - DNA, 15 bp, Homo sapiens
ctcaagaaataccaa

SEQ ID NO: 53394 - DNA, 15 bp, Homo sapiens
cctcaagaaatacca

SEQ ID NO: 53395 - DNA, 15 bp, Homo sapiens
tcctcaagaaatacc

SEQ ID NO: 53396 - DNA, 15 bp, Homo sapiens
ttcctcaagaaatac

SEQ ID NO: 53397 - DNA, 15 bp, Homo sapiens
tttcctcaagaaata

SEQ ID NO: 53398 - DNA, 15 bp, Homo sapiens
ttttcctcaagaaat

SEQ ID NO: 53399 - DNA, 15 bp, Homo sapiens
tttttcctcaagaaa

SEQ ID NO: 53400 - DNA, 15 bp, Homo sapiens
atttttcctcaagaa

SEQ ID NO: 53401 - DNA, 15 bp, Homo sapiens
catttttcctcaaga

SEQ ID NO: 53402 - DNA, 15 bp, Homo sapiens
tcatttttcctcaag

SEQ ID NO: 53403 - DNA, 15 bp, Homo sapiens
ctcatttttcctcaa

SEQ ID NO: 53404 - DNA, 15 bp, Homo sapiens
cctcatttttcctca

SEQ ID NO: 53405 - DNA, 15 bp, Homo sapiens
tcctcatttttcctc

SEQ ID NO: 53406 - DNA, 15 bp, Homo sapiens
atcctcatttttcct

SEQ ID NO: 53407 - DNA, 15 bp, Homo sapiens
tatcctcatttttcc

SEQ ID NO: 53408 - DNA, 15 bp, Homo sapiens
atatcctcatttttc

SEQ ID NO: 53409 - DNA, 15 bp, Homo sapiens
gatatcctcattttt

SEQ ID NO: 53410 - DNA, 15 bp, Homo sapiens
agatatcctcatttt

SEQ ID NO: 53411 - DNA, 15 bp, Homo sapiens
aagatatcctcattt

SEQ ID NO: 53412 - DNA, 15 bp, Homo sapiens
taagatatcctcatt

SEQ ID NO: 53413 - DNA, 15 bp, Homo sapiens
ttaagatatcctcat

SEQ ID NO: 53414 - DNA, 15 bp, Homo sapiens
cttaagatatcctca

SEQ ID NO: 53415 - DNA, 15 bp, Homo sapiens
ccttaagatatcctc

SEQ ID NO: 53416 - DNA, 15 bp, Homo sapiens
accttaagatatcct

SEQ ID NO: 53417 - DNA, 15 bp, Homo sapiens
aaccttaagatatcc

SEQ ID NO: 53418 - DNA, 15 bp, Homo sapiens
taaccttaagatatc

SEQ ID NO: 53419 - DNA, 15 bp, Homo sapiens
gtaaccttaagatat

SEQ ID NO: 53420 - DNA, 15 bp, Homo sapiens
agtaaccttaagata

SEQ ID NO: 53421 - DNA, 15 bp, Homo sapiens
aagtaaccttaagat

SEQ ID NO: 53422 - DNA, 15 bp, Homo sapiens
aaagtaaccttaaga

SEQ ID NO: 53423 - DNA, 15 bp, Homo sapiens
caaagtaaccttaag

SEQ ID NO: 53424 - DNA, 15 bp, Homo sapiens
tcaaagtaaccttaa

SEQ ID NO: 53425 - DNA, 15 bp, Homo sapiens
ctcaaagtaacctta

SEQ ID NO: 53426 - DNA, 15 bp, Homo sapiens
actcaaagtaacctt

SEQ ID NO: 53427 - DNA, 15 bp, Homo sapiens
tactcaaagtaacct

SEQ ID NO: 53428 - DNA, 15 bp, Homo sapiens
ctactcaaagtaacc

SEQ ID NO: 53429 - DNA, 15 bp, Homo sapiens
gctactcaaagtaac

SEQ ID NO: 53430 - DNA, 15 bp, Homo sapiens
tgctactcaaagtaa

SEQ ID NO: 53431 - DNA, 15 bp, Homo sapiens
ctgctactcaaagta

SEQ ID NO: 53432 - DNA, 15 bp, Homo sapiens
gctgctactcaaagt

SEQ ID NO: 53433 - DNA, 15 bp, Homo sapiens
tgctgctactcaaag

SEQ ID NO: 53434 - DNA, 15 bp, Homo sapiens
atgctgctactcaaa

SEQ ID NO: 53435 - DNA, 15 bp, Homo sapiens
tatgctgctactcaa

SEQ ID NO: 53436 - DNA, 15 bp, Homo sapiens
ctatgctgctactca

SEQ ID NO: 53437 - DNA, 15 bp, Homo sapiens
actatgctgctactc

SEQ ID NO: 53438 - DNA, 15 bp, Homo sapiens
aactatgctgctact

SEQ ID NO: 53439 - DNA, 15 bp, Homo sapiens
aaactatgctgctac

SEQ ID NO: 53440 - DNA, 15 bp, Homo sapiens
taaactatgctgcta

SEQ ID NO: 53441 - DNA, 15 bp, Homo sapiens
ttaaactatgctgct

SEQ ID NO: 53442 - DNA, 15 bp, Homo sapiens
tttaaactatgctgc

SEQ ID NO: 53443 - DNA, 15 bp, Homo sapiens
ttttaaactatgctg

SEQ ID NO: 53444 - DNA, 15 bp, Homo sapiens
tttttaaactatgct

SEQ ID NO: 53445 - DNA, 15 bp, Homo sapiens
ttttttaaactatgc

SEQ ID NO: 53446 - DNA, 15 bp, Homo sapiens
attttttaaactatg

SEQ ID NO: 53447 - DNA, 15 bp, Homo sapiens
cattttttaaactat

SEQ ID NO: 53448 - DNA, 15 bp, Homo sapiens
gcattttttaaacta

SEQ ID NO: 53449 - DNA, 15 bp, Homo sapiens
agcattttttaaact

SEQ ID NO: 53450 - DNA, 15 bp, Homo sapiens
gagcattttttaaac

SEQ ID NO: 53451 - DNA, 15 bp, Homo sapiens
ggagcattttttaaa

SEQ ID NO: 53452 - DNA, 15 bp, Homo sapiens
tggagcattttttaa

SEQ ID NO: 53453 - DNA, 15 bp, Homo sapiens
gtggagcatttttta

SEQ ID NO: 53454 - DNA, 15 bp, Homo sapiens
cgtggagcatttttt

SEQ ID NO: 53455 - DNA, 15 bp, Homo sapiens
acgtggagcattttt

SEQ ID NO: 53456 - DNA, 15 bp, Homo sapiens
gacgtggagcatttt

SEQ ID NO: 53457 - DNA, 15 bp, Homo sapiens
ggacgtggagcattt

SEQ ID NO: 53458 - DNA, 15 bp, Homo sapiens
gggacgtggagcatt

SEQ ID NO: 53459 - DNA, 15 bp, Homo sapiens
tgggacgtggagcat

SEQ ID NO: 53460 - DNA, 15 bp, Homo sapiens
ttgggacgtggagca

SEQ ID NO: 53461 - DNA, 15 bp, Homo sapiens
attgggacgtggagc

SEQ ID NO: 53462 - DNA, 15 bp, Homo sapiens
tattgggacgtggag

SEQ ID NO: 53463 - DNA, 15 bp, Homo sapiens
atattgggacgtgga

SEQ ID NO: 53464 - DNA, 15 bp, Homo sapiens
aatattgggacgtgg

SEQ ID NO: 53465 - DNA, 15 bp, Homo sapiens
aaatattgggacgtg

SEQ ID NO: 53466 - DNA, 15 bp, Homo sapiens
taaatattgggacgt

SEQ ID NO: 53467 - DNA, 15 bp, Homo sapiens
ataaatattgggacg

SEQ ID NO: 53468 - DNA, 15 bp, Homo sapiens
tataaatattgggac

SEQ ID NO: 53469 - DNA, 15 bp, Homo sapiens
ctataaatattggga

SEQ ID NO: 53470 - DNA, 15 bp, Homo sapiens
actataaatattggg

SEQ ID NO: 53471 - DNA, 15 bp, Homo sapiens
aactataaatattgg

SEQ ID NO: 53472 - DNA, 15 bp, Homo sapiens
caactataaatattg

SEQ ID NO: 53473 - DNA, 15 bp, Homo sapiens
ccaactataaatatt

SEQ ID NO: 53474 - DNA, 15 bp, Homo sapiens
accaactataaatat

SEQ ID NO: 53475 - DNA, 15 bp, Homo sapiens
aaccaactataaata

SEQ ID NO: 53476 - DNA, 15 bp, Homo sapiens
taaccaactataaat

SEQ ID NO: 53477 - DNA, 15 bp, Homo sapiens
ataaccaactataaa

SEQ ID NO: 53478 - DNA, 15 bp, Homo sapiens
aataaccaactataa

SEQ ID NO: 53479 - DNA, 15 bp, Homo sapiens
aaataaccaactata

SEQ ID NO: 53480 - DNA, 15 bp, Homo sapiens
caaataaccaactat

SEQ ID NO: 53481 - DNA, 15 bp, Homo sapiens
tcaaataaccaacta

SEQ ID NO: 53482 - DNA, 15 bp, Homo sapiens
atcaaataaccaact

SEQ ID NO: 53483 - DNA, 15 bp, Homo sapiens
aatcaaataaccaac

SEQ ID NO: 53484 - DNA, 15 bp, Homo sapiens
aaatcaaataaccaa

SEQ ID NO: 53485 - DNA, 15 bp, Homo sapiens
gaaatcaaataacca

SEQ ID NO: 53486 - DNA, 15 bp, Homo sapiens
tgaaatcaaataacc

SEQ ID NO: 53487 - DNA, 15 bp, Homo sapiens
gtgaaatcaaataac

SEQ ID NO: 53488 - DNA, 15 bp, Homo sapiens
agtgaaatcaaataa

SEQ ID NO: 53489 - DNA, 15 bp, Homo sapiens
cagtgaaatcaaata

SEQ ID NO: 53490 - DNA, 15 bp, Homo sapiens
gcagtgaaatcaaat

SEQ ID NO: 53491 - DNA, 15 bp, Homo sapiens
agcagtgaaatcaaa

SEQ ID NO: 53492 - DNA, 15 bp, Homo sapiens
aagcagtgaaatcaa

SEQ ID NO: 53493 - DNA, 15 bp, Homo sapiens
aaagcagtgaaatca

SEQ ID NO: 53494 - DNA, 15 bp, Homo sapiens
aaaagcagtgaaatc

SEQ ID NO: 53495 - DNA, 15 bp, Homo sapiens
aaaaagcagtgaaat

SEQ ID NO: 53496 - DNA, 15 bp, Homo sapiens
caaaaagcagtgaaa

SEQ ID NO: 53497 - DNA, 15 bp, Homo sapiens
ccaaaaagcagtgaa

SEQ ID NO: 53498 - DNA, 15 bp, Homo sapiens
cccaaaaagcagtga

SEQ ID NO: 53499 - DNA, 15 bp, Homo sapiens
gcccaaaaagcagtg

SEQ ID NO: 53500 - DNA, 15 bp, Homo sapiens
agcccaaaaagcagt

SEQ ID NO: 53501 - DNA, 15 bp, Homo sapiens
aagcccaaaaagcag

SEQ ID NO: 53502 - DNA, 15 bp, Homo sapiens
aaagcccaaaaagca

SEQ ID NO: 53503 - DNA, 15 bp, Homo sapiens
caaagcccaaaaagc

SEQ ID NO: 53504 - DNA, 15 bp, Homo sapiens
gcaaagcccaaaaag

SEQ ID NO: 53505 - DNA, 15 bp, Homo sapiens
cgcaaagcccaaaaa

SEQ ID NO: 53506 - DNA, 15 bp, Homo sapiens
tcgcaaagcccaaaa

SEQ ID NO: 53507 - DNA, 15 bp, Homo sapiens
ctcgcaaagcccaaa

SEQ ID NO: 53508 - DNA, 15 bp, Homo sapiens
actcgcaaagcccaa

SEQ ID NO: 53509 - DNA, 15 bp, Homo sapiens
aactcgcaaagccca

SEQ ID NO: 53510 - DNA, 15 bp, Homo sapiens
aaactcgcaaagccc

SEQ ID NO: 53511 - DNA, 15 bp, Homo sapiens
taaactcgcaaagcc

SEQ ID NO: 53512 - DNA, 15 bp, Homo sapiens
ataaactcgcaaagc

SEQ ID NO: 53513 - DNA, 15 bp, Homo sapiens
gataaactcgcaaag

SEQ ID NO: 53514 - DNA, 15 bp, Homo sapiens
agataaactcgcaaa

SEQ ID NO: 53515 - DNA, 15 bp, Homo sapiens
aagataaactcgcaa

SEQ ID NO: 53516 - DNA, 15 bp, Homo sapiens
caagataaactcgca

SEQ ID NO: 53517 - DNA, 15 bp, Homo sapiens
tcaagataaactcgc

SEQ ID NO: 53518 - DNA, 15 bp, Homo sapiens
ctcaagataaactcg

SEQ ID NO: 53519 - DNA, 15 bp, Homo sapiens
cctcaagataaactc

SEQ ID NO: 53520 - DNA, 15 bp, Homo sapiens
ccctcaagataaact

SEQ ID NO: 53521 - DNA, 15 bp, Homo sapiens
cccctcaagataaac

SEQ ID NO: 53522 - DNA, 15 bp, Homo sapiens
acccctcaagataaa

SEQ ID NO: 53523 - DNA, 15 bp, Homo sapiens
tacccctcaagataa

SEQ ID NO: 53524 - DNA, 15 bp, Homo sapiens
atacccctcaagata

SEQ ID NO: 53525 - DNA, 15 bp, Homo sapiens
aatacccctcaagat

SEQ ID NO: 53526 - DNA, 15 bp, Homo sapiens
aaatacccctcaaga

SEQ ID NO: 53527 - DNA, 15 bp, Homo sapiens
aaaatacccctcaag

SEQ ID NO: 53528 - DNA, 15 bp, Homo sapiens
taaaatacccctcaa

SEQ ID NO: 53529 - DNA, 15 bp, Homo sapiens
ataaaatacccctca

SEQ ID NO: 53530 - DNA, 15 bp, Homo sapiens
gataaaatacccctc

SEQ ID NO: 53531 - DNA, 15 bp, Homo sapiens
agataaaatacccct

SEQ ID NO: 53532 - DNA, 15 bp, Homo sapiens
aagataaaatacccc

SEQ ID NO: 53533 - DNA, 15 bp, Homo sapiens
caagataaaataccc

SEQ ID NO: 53534 - DNA, 15 bp, Homo sapiens
gcaagataaaatacc

SEQ ID NO: 53535 - DNA, 15 bp, Homo sapiens
ggcaagataaaatac

SEQ ID NO: 53536 - DNA, 15 bp, Homo sapiens
aggcaagataaaata

SEQ ID NO: 53537 - DNA, 15 bp, Homo sapiens
caggcaagataaaat

SEQ ID NO: 53538 - DNA, 15 bp, Homo sapiens
acaggcaagataaaa

SEQ ID NO: 53539 - DNA, 15 bp, Homo sapiens
cacaggcaagataaa

SEQ ID NO: 53540 - DNA, 15 bp, Homo sapiens
tcacaggcaagataa

SEQ ID NO: 53541 - DNA, 15 bp, Homo sapiens
ctcacaggcaagata

SEQ ID NO: 53542 - DNA, 15 bp, Homo sapiens
actcacaggcaagat

SEQ ID NO: 53543 - DNA, 15 bp, Homo sapiens
tactcacaggcaaga

SEQ ID NO: 53544 - DNA, 15 bp, Homo sapiens
atactcacaggcaag

SEQ ID NO: 53545 - DNA, 15 bp, Homo sapiens
catactcacaggcaa

SEQ ID NO: 53546 - DNA, 15 bp, Homo sapiens
acatactcacaggca

SEQ ID NO: 53547 - DNA, 15 bp, Homo sapiens
tacatactcacaggc

SEQ ID NO: 53548 - DNA, 15 bp, Homo sapiens
ttacatactcacagg

SEQ ID NO: 53549 - DNA, 15 bp, Homo sapiens
cttacatactcacag

SEQ ID NO: 53550 - DNA, 15 bp, Homo sapiens
ccttacatactcaca

SEQ ID NO: 53551 - DNA, 15 bp, Homo sapiens
tccttacatactcac

SEQ ID NO: 53552 - DNA, 15 bp, Homo sapiens
ttccttacatactca

SEQ ID NO: 53553 - DNA, 15 bp, Homo sapiens
gttccttacatactc

SEQ ID NO: 53554 - DNA, 15 bp, Homo sapiens
tgttccttacatact

SEQ ID NO: 53555 - DNA, 15 bp, Homo sapiens
atgttccttacatac

SEQ ID NO: 53556 - DNA, 15 bp, Homo sapiens
catgttccttacata

SEQ ID NO: 53557 - DNA, 15 bp, Homo sapiens
tcatgttccttacat

SEQ ID NO: 53558 - DNA, 15 bp, Homo sapiens
ttcatgttccttaca

SEQ ID NO: 53559 - DNA, 15 bp, Homo sapiens
tttcatgttccttac

SEQ ID NO: 53560 - DNA, 15 bp, Homo sapiens
ttttcatgttcctta

SEQ ID NO: 53561 - DNA, 15 bp, Homo sapiens
gttttcatgttcctt

SEQ ID NO: 53562 - DNA, 15 bp, Homo sapiens
ggttttcatgttcct

SEQ ID NO: 53563 - DNA, 15 bp, Homo sapiens
tggttttcatgttcc

SEQ ID NO: 53564 - DNA, 15 bp, Homo sapiens
ttggttttcatgttc

SEQ ID NO: 53565 - DNA, 15 bp, Homo sapiens
gttggttttcatgtt

SEQ ID NO: 53566 - DNA, 15 bp, Homo sapiens
agttggttttcatgt

SEQ ID NO: 53567 - DNA, 15 bp, Homo sapiens
aagttggttttcatg

SEQ ID NO: 53568 - DNA, 15 bp, Homo sapiens
aaagttggttttcat

SEQ ID NO: 53569 - DNA, 15 bp, Homo sapiens
caaagttggttttca

SEQ ID NO: 53570 - DNA, 15 bp, Homo sapiens
tcaaagttggttttc

SEQ ID NO: 53571 - DNA, 15 bp, Homo sapiens
gtcaaagttggtttt

SEQ ID NO: 53572 - DNA, 15 bp, Homo sapiens
tgtcaaagttggttt

SEQ ID NO: 53573 - DNA, 15 bp, Homo sapiens
ctgtcaaagttggtt

SEQ ID NO: 53574 - DNA, 15 bp, Homo sapiens
tctgtcaaagttggt

SEQ ID NO: 53575 - DNA, 15 bp, Homo sapiens
ctctgtcaaagttgg

SEQ ID NO: 53576 - DNA, 15 bp, Homo sapiens
cctctgtcaaagttg

SEQ ID NO: 53577 - DNA, 15 bp, Homo sapiens
ccctctgtcaaagtt

SEQ ID NO: 53578 - DNA, 15 bp, Homo sapiens
accctctgtcaaagt

SEQ ID NO: 53579 - DNA, 15 bp, Homo sapiens
aaccctctgtcaaag

SEQ ID NO: 53580 - DNA, 15 bp, Homo sapiens
taaccctctgtcaaa

SEQ ID NO: 53581 - DNA, 15 bp, Homo sapiens
ttaaccctctgtcaa

SEQ ID NO: 53582 - DNA, 15 bp, Homo sapiens
tttaaccctctgtca

SEQ ID NO: 53583 - DNA, 15 bp, Homo sapiens
ttttaaccctctgtc

SEQ ID NO: 53584 - DNA, 15 bp, Homo sapiens
tttttaaccctctgt

SEQ ID NO: 53585 - DNA, 15 bp, Homo sapiens
atttttaaccctctg

SEQ ID NO: 53586 - DNA, 15 bp, Homo sapiens
tatttttaaccctct

SEQ ID NO: 53587 - DNA, 15 bp, Homo sapiens
gtatttttaaccctc

SEQ ID NO: 53588 - DNA, 15 bp, Homo sapiens
tgtatttttaaccct

SEQ ID NO: 53589 - DNA, 15 bp, Homo sapiens
ctgtatttttaaccc

SEQ ID NO: 53590 - DNA, 15 bp, Homo sapiens
tctgtatttttaacc

SEQ ID NO: 53591 - DNA, 15 bp, Homo sapiens
ctctgtatttttaac

SEQ ID NO: 53592 - DNA, 15 bp, Homo sapiens
tctctgtatttttaa

SEQ ID NO: 53593 - DNA, 15 bp, Homo sapiens
ttctctgtattttta

SEQ ID NO: 53594 - DNA, 15 bp, Homo sapiens
attctctgtattttt

SEQ ID NO: 53595 - DNA, 15 bp, Homo sapiens
aattctctgtatttt

SEQ ID NO: 53596 - DNA, 15 bp, Homo sapiens
taattctctgtattt

SEQ ID NO: 53597 - DNA, 15 bp, Homo sapiens
ctaattctctgtatt

SEQ ID NO: 53598 - DNA, 15 bp, Homo sapiens
tctaattctctgtat

SEQ ID NO: 53599 - DNA, 15 bp, Homo sapiens
ttctaattctctgta

SEQ ID NO: 53600 - DNA, 15 bp, Homo sapiens
gttctaattctctgt

SEQ ID NO: 53601 - DNA, 15 bp, Homo sapiens
tgttctaattctctg

SEQ ID NO: 53602 - DNA, 15 bp, Homo sapiens
atgttctaattctct

SEQ ID NO: 53603 - DNA, 15 bp, Homo sapiens
tatgttctaattctc

SEQ ID NO: 53604 - DNA, 15 bp, Homo sapiens
ttatgttctaattct

SEQ ID NO: 53605 - DNA, 15 bp, Homo sapiens
tttatgttctaattc

SEQ ID NO: 53606 - DNA, 15 bp, Homo sapiens
ctttatgttctaatt

SEQ ID NO: 53607 - DNA, 15 bp, Homo sapiens
cctttatgttctaat

SEQ ID NO: 53608 - DNA, 15 bp, Homo sapiens
acctttatgttctaa

SEQ ID NO: 53609 - DNA, 15 bp, Homo sapiens
cacctttatgttcta

SEQ ID NO: 53610 - DNA, 15 bp, Homo sapiens
gcacctttatgttct

SEQ ID NO: 53611 - DNA, 15 bp, Homo sapiens
agcacctttatgttc

SEQ ID NO: 53612 - DNA, 15 bp, Homo sapiens
aagcacctttatgtt

SEQ ID NO: 53613 - DNA, 15 bp, Homo sapiens
caagcacctttatgt

SEQ ID NO: 53614 - DNA, 15 bp, Homo sapiens
gcaagcacctttatg

SEQ ID NO: 53615 - DNA, 15 bp, Homo sapiens
tgcaagcacctttat

SEQ ID NO: 53616 - DNA, 15 bp, Homo sapiens
atgcaagcaccttta

SEQ ID NO: 53617 - DNA, 15 bp, Homo sapiens
tatgcaagcaccttt

SEQ ID NO: 53618 - DNA, 15 bp, Homo sapiens
ttatgcaagcacctt

SEQ ID NO: 53619 - DNA, 15 bp, Homo sapiens
attatgcaagcacct

SEQ ID NO: 53620 - DNA, 15 bp, Homo sapiens
aattatgcaagcacc

SEQ ID NO: 53621 - DNA, 15 bp, Homo sapiens
caattatgcaagcac

SEQ ID NO: 53622 - DNA, 15 bp, Homo sapiens
ccaattatgcaagca

SEQ ID NO: 53623 - DNA, 15 bp, Homo sapiens
gccaattatgcaagc

SEQ ID NO: 53624 - DNA, 15 bp, Homo sapiens
tgccaattatgcaag

SEQ ID NO: 53625 - DNA, 15 bp, Homo sapiens
ctgccaattatgcaa

SEQ ID NO: 53626 - DNA, 15 bp, Homo sapiens
actgccaattatgca

SEQ ID NO: 53627 - DNA, 15 bp, Homo sapiens
aactgccaattatgc

SEQ ID NO: 53628 - DNA, 15 bp, Homo sapiens
taactgccaattatg

SEQ ID NO: 53629 - DNA, 15 bp, Homo sapiens
ataactgccaattat

SEQ ID NO: 53630 - DNA, 15 bp, Homo sapiens
tataactgccaatta

SEQ ID NO: 53631 - DNA, 15 bp, Homo sapiens
atataactgccaatt

SEQ ID NO: 53632 - DNA, 15 bp, Homo sapiens
catataactgccaat

SEQ ID NO: 53633 - DNA, 15 bp, Homo sapiens
acatataactgccaa

SEQ ID NO: 53634 - DNA, 15 bp, Homo sapiens
cacatataactgcca

SEQ ID NO: 53635 - DNA, 15 bp, Homo sapiens
acacatataactgcc

SEQ ID NO: 53636 - DNA, 15 bp, Homo sapiens
tacacatataactgc

SEQ ID NO: 53637 - DNA, 15 bp, Homo sapiens
ctacacatataactg

SEQ ID NO: 53638 - DNA, 15 bp, Homo sapiens
cctacacatataact

SEQ ID NO: 53639 - DNA, 15 bp, Homo sapiens
tcctacacatataac

SEQ ID NO: 53640 - DNA, 15 bp, Homo sapiens
atcctacacatataa

SEQ ID NO: 53641 - DNA, 15 bp, Homo sapiens
aatcctacacatata

SEQ ID NO: 53642 - DNA, 15 bp, Homo sapiens
taatcctacacatat

SEQ ID NO: 53643 - DNA, 15 bp, Homo sapiens
ataatcctacacata

SEQ ID NO: 53644 - DNA, 15 bp, Homo sapiens
aataatcctacacat

SEQ ID NO: 53645 - DNA, 15 bp, Homo sapiens
gaataatcctacaca

SEQ ID NO: 53646 - DNA, 15 bp, Homo sapiens
ggaataatcctacac

SEQ ID NO: 53647 - DNA, 15 bp, Homo sapiens
tggaataatcctaca

SEQ ID NO: 53648 - DNA, 15 bp, Homo sapiens
ttggaataatcctac

SEQ ID NO: 53649 - DNA, 15 bp, Homo sapiens
tttggaataatccta

SEQ ID NO: 53650 - DNA, 15 bp, Homo sapiens
atttggaataatcct

SEQ ID NO: 53651 - DNA, 15 bp, Homo sapiens
gatttggaataatcc

SEQ ID NO: 53652 - DNA, 15 bp, Homo sapiens
tgatttggaataatc

SEQ ID NO: 53653 - DNA, 15 bp, Homo sapiens
gtgatttggaataat

SEQ ID NO: 53654 - DNA, 15 bp, Homo sapiens
tgtgatttggaataa

SEQ ID NO: 53655 - DNA, 15 bp, Homo sapiens
atgtgatttggaata

SEQ ID NO: 53656 - DNA, 15 bp, Homo sapiens
catgtgatttggaat

SEQ ID NO: 53657 - DNA, 15 bp, Homo sapiens
gcatgtgatttggaa

SEQ ID NO: 53658 - DNA, 15 bp, Homo sapiens
tgcatgtgatttgga

SEQ ID NO: 53659 - DNA, 15 bp, Homo sapiens
ctgcatgtgatttgg

SEQ ID NO: 53660 - DNA, 15 bp, Homo sapiens
cctgcatgtgatttg

SEQ ID NO: 53661 - DNA, 15 bp, Homo sapiens
acctgcatgtgattt

SEQ ID NO: 53662 - DNA, 15 bp, Homo sapiens
cacctgcatgtgatt

SEQ ID NO: 53663 - DNA, 15 bp, Homo sapiens
acacctgcatgtgat

SEQ ID NO: 53664 - DNA, 15 bp, Homo sapiens
cacacctgcatgtga

SEQ ID NO: 53665 - DNA, 15 bp, Homo sapiens
acacacctgcatgtg

SEQ ID NO: 53666 - DNA, 15 bp, Homo sapiens
aacacacctgcatgt

SEQ ID NO: 53667 - DNA, 15 bp, Homo sapiens
aaacacacctgcatg

SEQ ID NO: 53668 - DNA, 15 bp, Homo sapiens
aaaacacacctgcat

SEQ ID NO: 53669 - DNA, 15 bp, Homo sapiens
caaaacacacctgca

SEQ ID NO: 53670 - DNA, 15 bp, Homo sapiens
ccaaaacacacctgc

SEQ ID NO: 53671 - DNA, 15 bp, Homo sapiens
accaaaacacacctg

SEQ ID NO: 53672 - DNA, 15 bp, Homo sapiens
taccaaaacacacct

SEQ ID NO: 53673 - DNA, 15 bp, Homo sapiens
ttaccaaaacacacc

SEQ ID NO: 53674 - DNA, 15 bp, Homo sapiens
tttaccaaaacacac

SEQ ID NO: 53675 - DNA, 15 bp, Homo sapiens
atttaccaaaacaca

SEQ ID NO: 53676 - DNA, 15 bp, Homo sapiens
aatttaccaaaacac

SEQ ID NO: 53677 - DNA, 15 bp, Homo sapiens
aaatttaccaaaaca

SEQ ID NO: 53678 - DNA, 15 bp, Homo sapiens
aaaatttaccaaaac

SEQ ID NO: 53679 - DNA, 15 bp, Homo sapiens
taaaatttaccaaaa

SEQ ID NO: 53680 - DNA, 15 bp, Homo sapiens
ctaaaatttaccaaa

SEQ ID NO: 53681 - DNA, 15 bp, Homo sapiens
actaaaatttaccaa

SEQ ID NO: 53682 - DNA, 15 bp, Homo sapiens
aactaaaatttacca

SEQ ID NO: 53683 - DNA, 15 bp, Homo sapiens
aaactaaaatttacc

SEQ ID NO: 53684 - DNA, 15 bp, Homo sapiens
caaactaaaatttac

SEQ ID NO: 53685 - DNA, 15 bp, Homo sapiens
acaaactaaaattta

SEQ ID NO: 53686 - DNA, 15 bp, Homo sapiens
aacaaactaaaattt

SEQ ID NO: 53687 - DNA, 15 bp, Homo sapiens
aaacaaactaaaatt

SEQ ID NO: 53688 - DNA, 15 bp, Homo sapiens
aaaacaaactaaaat

SEQ ID NO: 53689 - DNA, 15 bp, Homo sapiens
taaaacaaactaaaa

SEQ ID NO: 53690 - DNA, 15 bp, Homo sapiens
ataaaacaaactaaa

SEQ ID NO: 53691 - DNA, 15 bp, Homo sapiens
aataaaacaaactaa

SEQ ID NO: 53692 - DNA, 15 bp, Homo sapiens
gaataaaacaaacta

SEQ ID NO: 53693 - DNA, 15 bp, Homo sapiens
ggaataaaacaaact

SEQ ID NO: 53694 - DNA, 15 bp, Homo sapiens
tggaataaaacaaac

SEQ ID NO: 53695 - DNA, 15 bp, Homo sapiens
ctggaataaaacaaa

SEQ ID NO: 53696 - DNA, 15 bp, Homo sapiens
tctggaataaaacaa

SEQ ID NO: 53697 - DNA, 15 bp, Homo sapiens
ctctggaataaaaca

SEQ ID NO: 53698 - DNA, 15 bp, Homo sapiens
tctctggaataaaac

SEQ ID NO: 53699 - DNA, 15 bp, Homo sapiens
gtctctggaataaaa

SEQ ID NO: 53700 - DNA, 15 bp, Homo sapiens
tgtctctggaataaa

SEQ ID NO: 53701 - DNA, 15 bp, Homo sapiens
gtgtctctggaataa

SEQ ID NO: 53702 - DNA, 15 bp, Homo sapiens
tgtgtctctggaata

SEQ ID NO: 53703 - DNA, 15 bp, Homo sapiens
ctgtgtctctggaat

SEQ ID NO: 53704 - DNA, 15 bp, Homo sapiens
cctgtgtctctggaa

SEQ ID NO: 53705 - DNA, 15 bp, Homo sapiens
acctgtgtctctgga

SEQ ID NO: 53706 - DNA, 15 bp, Homo sapiens
tacctgtgtctctgg

SEQ ID NO: 53707 - DNA, 15 bp, Homo sapiens
ttacctgtgtctctg

SEQ ID NO: 53708 - DNA, 15 bp, Homo sapiens
gttacctgtgtctct

SEQ ID NO: 53709 - DNA, 15 bp, Homo sapiens
tgttacctgtgtctc

SEQ ID NO: 53710 - DNA, 15 bp, Homo sapiens
atgttacctgtgtct

SEQ ID NO: 53711 - DNA, 15 bp, Homo sapiens
tatgttacctgtgtc

SEQ ID NO: 53712 - DNA, 15 bp, Homo sapiens
atatgttacctgtgt

SEQ ID NO: 53713 - DNA, 15 bp, Homo sapiens
catatgttacctgtg

SEQ ID NO: 53714 - DNA, 15 bp, Homo sapiens
acatatgttacctgt

SEQ ID NO: 53715 - DNA, 15 bp, Homo sapiens
cacatatgttacctg

SEQ ID NO: 53716 - DNA, 15 bp, Homo sapiens
gcacatatgttacct

SEQ ID NO: 53717 - DNA, 15 bp, Homo sapiens
tgcacatatgttacc

SEQ ID NO: 53718 - DNA, 15 bp, Homo sapiens
atgcacatatgttac

SEQ ID NO: 53719 - DNA, 15 bp, Homo sapiens
gatgcacatatgtta

SEQ ID NO: 53720 - DNA, 15 bp, Homo sapiens
agatgcacatatgtt

SEQ ID NO: 53721 - DNA, 15 bp, Homo sapiens
gagatgcacatatgt

SEQ ID NO: 53722 - DNA, 15 bp, Homo sapiens
cgagatgcacatatg

SEQ ID NO: 53723 - DNA, 15 bp, Homo sapiens
ccgagatgcacatat

SEQ ID NO: 53724 - DNA, 15 bp, Homo sapiens
cccgagatgcacata

SEQ ID NO: 53725 - DNA, 15 bp, Homo sapiens
gcccgagatgcacat

SEQ ID NO: 53726 - DNA, 15 bp, Homo sapiens
agcccgagatgcaca

SEQ ID NO: 53727 - DNA, 15 bp, Homo sapiens
aagcccgagatgcac

SEQ ID NO: 53728 - DNA, 15 bp, Homo sapiens
caagcccgagatgca

SEQ ID NO: 53729 - DNA, 15 bp, Homo sapiens
tcaagcccgagatgc

SEQ ID NO: 53730 - DNA, 15 bp, Homo sapiens
gtcaagcccgagatg

SEQ ID NO: 53731 - DNA, 15 bp, Homo sapiens
tgtcaagcccgagat

SEQ ID NO: 53732 - DNA, 15 bp, Homo sapiens
atgtcaagcccgaga

SEQ ID NO: 53733 - DNA, 15 bp, Homo sapiens
catgtcaagcccgag

SEQ ID NO: 53734 - DNA, 15 bp, Homo sapiens
tcatgtcaagcccga

SEQ ID NO: 53735 - DNA, 15 bp, Homo sapiens
ttcatgtcaagcccg

SEQ ID NO: 53736 - DNA, 15 bp, Homo sapiens
attcatgtcaagccc

SEQ ID NO: 53737 - DNA, 15 bp, Homo sapiens
tattcatgtcaagcc

SEQ ID NO: 53738 - DNA, 15 bp, Homo sapiens
ttattcatgtcaagc

SEQ ID NO: 53739 - DNA, 15 bp, Homo sapiens
tttattcatgtcaag

SEQ ID NO: 53740 - DNA, 15 bp, Homo sapiens
ttttattcatgtcaa

SEQ ID NO: 53741 - DNA, 15 bp, Homo sapiens
tttttattcatgtca

SEQ ID NO: 53742 - DNA, 15 bp, Homo sapiens
gtttttattcatgtc

SEQ ID NO: 53743 - DNA, 15 bp, Homo sapiens
agtttttattcatgt

SEQ ID NO: 53744 - DNA, 15 bp, Homo sapiens
aagtttttattcatg

SEQ ID NO: 53745 - DNA, 15 bp, Homo sapiens
aaagtttttattcat

SEQ ID NO: 53746 - DNA, 15 bp, Homo sapiens
aaaagtttttattca

SEQ ID NO: 53747 - DNA, 15 bp, Homo sapiens
caaaagtttttattc

SEQ ID NO: 53748 - DNA, 15 bp, Homo sapiens
tcaaaagtttttatt

SEQ ID NO: 53749 - DNA, 15 bp, Homo sapiens
ttcaaaagtttttat

SEQ ID NO: 53750 - DNA, 15 bp, Homo sapiens
gttcaaaagttttta

SEQ ID NO: 53751 - DNA, 15 bp, Homo sapiens
agttcaaaagttttt

SEQ ID NO: 53752 - DNA, 15 bp, Homo sapiens
tagttcaaaagtttt

SEQ ID NO: 53753 - DNA, 15 bp, Homo sapiens
atagttcaaaagttt

SEQ ID NO: 53754 - DNA, 15 bp, Homo sapiens
aatagttcaaaagtt

SEQ ID NO: 53755 - DNA, 15 bp, Homo sapiens
gaatagttcaaaagt

SEQ ID NO: 53756 - DNA, 15 bp, Homo sapiens
tgaatagttcaaaag

SEQ ID NO: 53757 - DNA, 15 bp, Homo sapiens
atgaatagttcaaaa

SEQ ID NO: 53758 - DNA, 15 bp, Homo sapiens
gatgaatagttcaaa

SEQ ID NO: 53759 - DNA, 15 bp, Homo sapiens
agatgaatagttcaa

SEQ ID NO: 53760 - DNA, 15 bp, Homo sapiens
cagatgaatagttca

SEQ ID NO: 53761 - DNA, 15 bp, Homo sapiens
gcagatgaatagttc

SEQ ID NO: 53762 - DNA, 15 bp, Homo sapiens
tgcagatgaatagtt

SEQ ID NO: 53763 - DNA, 15 bp, Homo sapiens
atgcagatgaatagt

SEQ ID NO: 53764 - DNA, 15 bp, Homo sapiens
catgcagatgaatag

SEQ ID NO: 53765 - DNA, 15 bp, Homo sapiens
acatgcagatgaata

SEQ ID NO: 53766 - DNA, 15 bp, Homo sapiens
cacatgcagatgaat

SEQ ID NO: 53767 - DNA, 15 bp, Homo sapiens
tcacatgcagatgaa

SEQ ID NO: 53768 - DNA, 15 bp, Homo sapiens
gtcacatgcagatga

SEQ ID NO: 53769 - DNA, 15 bp, Homo sapiens
ggtcacatgcagatg

SEQ ID NO: 53770 - DNA, 15 bp, Homo sapiens
tggtcacatgcagat

SEQ ID NO: 53771 - DNA, 15 bp, Homo sapiens
atggtcacatgcaga

SEQ ID NO: 53772 - DNA, 15 bp, Homo sapiens
aatggtcacatgcag

SEQ ID NO: 53773 - DNA, 15 bp, Homo sapiens
aaatggtcacatgca

SEQ ID NO: 53774 - DNA, 15 bp, Homo sapiens
aaaatggtcacatgc

SEQ ID NO: 53775 - DNA, 15 bp, Homo sapiens
gaaaatggtcacatg

SEQ ID NO: 53776 - DNA, 15 bp, Homo sapiens
ggaaaatggtcacat

SEQ ID NO: 53777 - DNA, 15 bp, Homo sapiens
tggaaaatggtcaca

SEQ ID NO: 53778 - DNA, 15 bp, Homo sapiens
ctggaaaatggtcac

SEQ ID NO: 53779 - DNA, 15 bp, Homo sapiens
tctggaaaatggtca

SEQ ID NO: 53780 - DNA, 15 bp, Homo sapiens
ctctggaaaatggtc

SEQ ID NO: 53781 - DNA, 15 bp, Homo sapiens
tctctggaaaatggt

SEQ ID NO: 53782 - DNA, 15 bp, Homo sapiens
ttctctggaaaatgg

SEQ ID NO: 53783 - DNA, 15 bp, Homo sapiens
attctctggaaaatg

SEQ ID NO: 53784 - DNA, 15 bp, Homo sapiens
cattctctggaaaat

SEQ ID NO: 53785 - DNA, 15 bp, Homo sapiens
acattctctggaaaa

SEQ ID NO: 53786 - DNA, 15 bp, Homo sapiens
tacattctctggaaa

SEQ ID NO: 53787 - DNA, 15 bp, Homo sapiens
ctacattctctggaa

SEQ ID NO: 53788 - DNA, 15 bp, Homo sapiens
actacattctctgga

SEQ ID NO: 53789 - DNA, 15 bp, Homo sapiens
aactacattctctgg

SEQ ID NO: 53790 - DNA, 15 bp, Homo sapiens
aaactacattctctg

SEQ ID NO: 53791 - DNA, 15 bp, Homo sapiens
aaaactacattctct

SEQ ID NO: 53792 - DNA, 15 bp, Homo sapiens
taaaactacattctc

SEQ ID NO: 53793 - DNA, 15 bp, Homo sapiens
ctaaaactacattct

SEQ ID NO: 53794 - DNA, 15 bp, Homo sapiens
gctaaaactacattc

SEQ ID NO: 53795 - DNA, 15 bp, Homo sapiens
tgctaaaactacatt

SEQ ID NO: 53796 - DNA, 15 bp, Homo sapiens
ttgctaaaactacat

SEQ ID NO: 53797 - DNA, 15 bp, Homo sapiens
gttgctaaaactaca

SEQ ID NO: 53798 - DNA, 15 bp, Homo sapiens
agttgctaaaactac

SEQ ID NO: 53799 - DNA, 15 bp, Homo sapiens
cagttgctaaaacta

SEQ ID NO: 53800 - DNA, 15 bp, Homo sapiens
ccagttgctaaaact

SEQ ID NO: 53801 - DNA, 15 bp, Homo sapiens
cccagttgctaaaac

SEQ ID NO: 53802 - DNA, 15 bp, Homo sapiens
tcccagttgctaaaa

SEQ ID NO: 53803 - DNA, 15 bp, Homo sapiens
ctcccagttgctaaa

SEQ ID NO: 53804 - DNA, 15 bp, Homo sapiens
actcccagttgctaa

SEQ ID NO: 53805 - DNA, 15 bp, Homo sapiens
gactcccagttgcta

SEQ ID NO: 53806 - DNA, 15 bp, Homo sapiens
agactcccagttgct

SEQ ID NO: 53807 - DNA, 15 bp, Homo sapiens
cagactcccagttgc

SEQ ID NO: 53808 - DNA, 15 bp, Homo sapiens
ccagactcccagttg

SEQ ID NO: 53809 - DNA, 15 bp, Homo sapiens
tccagactcccagtt

SEQ ID NO: 53810 - DNA, 15 bp, Homo sapiens
atccagactcccagt

SEQ ID NO: 53811 - DNA, 15 bp, Homo sapiens
tatccagactcccag

SEQ ID NO: 53812 - DNA, 15 bp, Homo sapiens
atatccagactccca

SEQ ID NO: 53813 - DNA, 15 bp, Homo sapiens
catatccagactccc

SEQ ID NO: 53814 - DNA, 15 bp, Homo sapiens
tcatatccagactcc

SEQ ID NO: 53815 - DNA, 15 bp, Homo sapiens
ctcatatccagactc

SEQ ID NO: 53816 - DNA, 15 bp, Homo sapiens
cctcatatccagact

SEQ ID NO: 53817 - DNA, 15 bp, Homo sapiens
acctcatatccagac

SEQ ID NO: 53818 - DNA, 15 bp, Homo sapiens
cacctcatatccaga

SEQ ID NO: 53819 - DNA, 15 bp, Homo sapiens
acacctcatatccag

SEQ ID NO: 53820 - DNA, 15 bp, Homo sapiens
aacacctcatatcca

SEQ ID NO: 53821 - DNA, 15 bp, Homo sapiens
aaacacctcatatcc

SEQ ID NO: 53822 - DNA, 15 bp, Homo sapiens
aaaacacctcatatc

SEQ ID NO: 53823 - DNA, 15 bp, Homo sapiens
taaaacacctcatat

SEQ ID NO: 53824 - DNA, 15 bp, Homo sapiens
ataaaacacctcata

SEQ ID NO: 53825 - DNA, 15 bp, Homo sapiens
aataaaacacctcat

SEQ ID NO: 53826 - DNA, 15 bp, Homo sapiens
gaataaaacacctca

SEQ ID NO: 53827 - DNA, 15 bp, Homo sapiens
ggaataaaacacctc

SEQ ID NO: 53828 - DNA, 15 bp, Homo sapiens
tggaataaaacacct

SEQ ID NO: 53829 - DNA, 15 bp, Homo sapiens
ctggaataaaacacc

SEQ ID NO: 53830 - DNA, 15 bp, Homo sapiens
actggaataaaacac

SEQ ID NO: 53831 - DNA, 15 bp, Homo sapiens
cactggaataaaaca

SEQ ID NO: 53832 - DNA, 15 bp, Homo sapiens
ccactggaataaaac

SEQ ID NO: 53833 - DNA, 15 bp, Homo sapiens
accactggaataaaa

SEQ ID NO: 53834 - DNA, 15 bp, Homo sapiens
gaccactggaataaa

SEQ ID NO: 53835 - DNA, 15 bp, Homo sapiens
agaccactggaataa

SEQ ID NO: 53836 - DNA, 15 bp, Homo sapiens
aagaccactggaata

SEQ ID NO: 53837 - DNA, 15 bp, Homo sapiens
taagaccactggaat

SEQ ID NO: 53838 - DNA, 15 bp, Homo sapiens
ataagaccactggaa

SEQ ID NO: 53839 - DNA, 15 bp, Homo sapiens
cataagaccactgga

SEQ ID NO: 53840 - DNA, 15 bp, Homo sapiens
tcataagaccactgg

SEQ ID NO: 53841 - DNA, 15 bp, Homo sapiens
atcataagaccactg

SEQ ID NO: 53842 - DNA, 15 bp, Homo sapiens
aatcataagaccact

SEQ ID NO: 53843 - DNA, 15 bp, Homo sapiens
caatcataagaccac

SEQ ID NO: 53844 - DNA, 15 bp, Homo sapiens
gcaatcataagacca

SEQ ID NO: 53845 - DNA, 15 bp, Homo sapiens
agcaatcataagacc

SEQ ID NO: 53846 - DNA, 15 bp, Homo sapiens
gagcaatcataagac

SEQ ID NO: 53847 - DNA, 15 bp, Homo sapiens
tgagcaatcataaga

SEQ ID NO: 53848 - DNA, 15 bp, Homo sapiens
atgagcaatcataag

SEQ ID NO: 53849 - DNA, 15 bp, Homo sapiens
tatgagcaatcataa

SEQ ID NO: 53850 - DNA, 15 bp, Homo sapiens
ttatgagcaatcata

SEQ ID NO: 53851 - DNA, 15 bp, Homo sapiens
tttatgagcaatcat

SEQ ID NO: 53852 - DNA, 15 bp, Homo sapiens
ttttatgagcaatca

SEQ ID NO: 53853 - DNA, 15 bp, Homo sapiens
cttttatgagcaatc

SEQ ID NO: 53854 - DNA, 15 bp, Homo sapiens
acttttatgagcaat

SEQ ID NO: 53855 - DNA, 15 bp, Homo sapiens
tacttttatgagcaa

SEQ ID NO: 53856 - DNA, 15 bp, Homo sapiens
ttacttttatgagca

SEQ ID NO: 53857 - DNA, 15 bp, Homo sapiens
cttacttttatgagc

SEQ ID NO: 53858 - DNA, 15 bp, Homo sapiens
tcttacttttatgag

SEQ ID NO: 53859 - DNA, 15 bp, Homo sapiens
atcttacttttatga

SEQ ID NO: 53860 - DNA, 15 bp, Homo sapiens
aatcttacttttatg

SEQ ID NO: 53861 - DNA, 15 bp, Homo sapiens
taatcttacttttat

SEQ ID NO: 53862 - DNA, 15 bp, Homo sapiens
ataatcttactttta

SEQ ID NO: 53863 - DNA, 15 bp, Homo sapiens
aataatcttactttt

SEQ ID NO: 53864 - DNA, 15 bp, Homo sapiens
aaataatcttacttt

SEQ ID NO: 53865 - DNA, 15 bp, Homo sapiens
aaaataatcttactt

SEQ ID NO: 53866 - DNA, 15 bp, Homo sapiens
aaaaataatcttact

SEQ ID NO: 53867 - DNA, 15 bp, Homo sapiens
gaaaaataatcttac

SEQ ID NO: 53868 - DNA, 15 bp, Homo sapiens
ggaaaaataatctta

SEQ ID NO: 53869 - DNA, 15 bp, Homo sapiens
aggaaaaataatctt

SEQ ID NO: 53870 - DNA, 15 bp, Homo sapiens
caggaaaaataatct

SEQ ID NO: 53871 - DNA, 15 bp, Homo sapiens
ccaggaaaaataatc

SEQ ID NO: 53872 - DNA, 15 bp, Homo sapiens
accaggaaaaataat

SEQ ID NO: 53873 - DNA, 15 bp, Homo sapiens
aaccaggaaaaataa

SEQ ID NO: 53874 - DNA, 15 bp, Homo sapiens
taaccaggaaaaata

SEQ ID NO: 53875 - DNA, 15 bp, Homo sapiens
ataaccaggaaaaat

SEQ ID NO: 53876 - DNA, 15 bp, Homo sapiens
aataaccaggaaaaa

SEQ ID NO: 53877 - DNA, 15 bp, Homo sapiens
gaataaccaggaaaa

SEQ ID NO: 53878 - DNA, 15 bp, Homo sapiens
tgaataaccaggaaa

SEQ ID NO: 53879 - DNA, 15 bp, Homo sapiens
gtgaataaccaggaa

SEQ ID NO: 53880 - DNA, 15 bp, Homo sapiens
cgtgaataaccagga

SEQ ID NO: 53881 - DNA, 15 bp, Homo sapiens
tcgtgaataaccagg

SEQ ID NO: 53882 - DNA, 15 bp, Homo sapiens
ctcgtgaataaccag

SEQ ID NO: 53883 - DNA, 15 bp, Homo sapiens
cctcgtgaataacca

SEQ ID NO: 53884 - DNA, 15 bp, Homo sapiens
tcctcgtgaataacc

SEQ ID NO: 53885 - DNA, 15 bp, Homo sapiens
atcctcgtgaataac

SEQ ID NO: 53886 - DNA, 15 bp, Homo sapiens
tatcctcgtgaataa

SEQ ID NO: 53887 - DNA, 15 bp, Homo sapiens
ttatcctcgtgaata

SEQ ID NO: 53888 - DNA, 15 bp, Homo sapiens
gttatcctcgtgaat

SEQ ID NO: 53889 - DNA, 15 bp, Homo sapiens
tgttatcctcgtgaa

SEQ ID NO: 53890 - DNA, 15 bp, Homo sapiens
gtgttatcctcgtga

SEQ ID NO: 53891 - DNA, 15 bp, Homo sapiens
tgtgttatcctcgtg

SEQ ID NO: 53892 - DNA, 15 bp, Homo sapiens
ctgtgttatcctcgt

SEQ ID NO: 53893 - DNA, 15 bp, Homo sapiens
actgtgttatcctcg

SEQ ID NO: 53894 - DNA, 15 bp, Homo sapiens
tactgtgttatcctc

SEQ ID NO: 53895 - DNA, 15 bp, Homo sapiens
ttactgtgttatcct

SEQ ID NO: 53896 - DNA, 15 bp, Homo sapiens
attactgtgttatcc

SEQ ID NO: 53897 - DNA, 15 bp, Homo sapiens
aattactgtgttatc

SEQ ID NO: 53898 - DNA, 15 bp, Homo sapiens
caattactgtgttat

SEQ ID NO: 53899 - DNA, 15 bp, Homo sapiens
acaattactgtgtta

SEQ ID NO: 53900 - DNA, 15 bp, Homo sapiens
aacaattactgtgtt

SEQ ID NO: 53901 - DNA, 15 bp, Homo sapiens
aaacaattactgtgt

SEQ ID NO: 53902 - DNA, 15 bp, Homo sapiens
taaacaattactgtg

SEQ ID NO: 53903 - DNA, 15 bp, Homo sapiens
ctaaacaattactgt

SEQ ID NO: 53904 - DNA, 15 bp, Homo sapiens
tctaaacaattactg

SEQ ID NO: 53905 - DNA, 15 bp, Homo sapiens
atctaaacaattact

SEQ ID NO: 53906 - DNA, 15 bp, Homo sapiens
tatctaaacaattac

SEQ ID NO: 53907 - DNA, 15 bp, Homo sapiens
ctatctaaacaatta

SEQ ID NO: 53908 - DNA, 15 bp, Homo sapiens
tctatctaaacaatt

SEQ ID NO: 53909 - DNA, 15 bp, Homo sapiens
ttctatctaaacaat

SEQ ID NO: 53910 - DNA, 15 bp, Homo sapiens
gttctatctaaacaa

SEQ ID NO: 53911 - DNA, 15 bp, Homo sapiens
tgttctatctaaaca

SEQ ID NO: 53912 - DNA, 15 bp, Homo sapiens
ttgttctatctaaac

SEQ ID NO: 53913 - DNA, 15 bp, Homo sapiens
cttgttctatctaaa

SEQ ID NO: 53914 - DNA, 15 bp, Homo sapiens
acttgttctatctaa

SEQ ID NO: 53915 - DNA, 15 bp, Homo sapiens
cacttgttctatcta

SEQ ID NO: 53916 - DNA, 15 bp, Homo sapiens
tcacttgttctatct

SEQ ID NO: 53917 - DNA, 15 bp, Homo sapiens
ttcacttgttctatc

SEQ ID NO: 53918 - DNA, 15 bp, Homo sapiens
cttcacttgttctat

SEQ ID NO: 53919 - DNA, 15 bp, Homo sapiens
gcttcacttgttcta

SEQ ID NO: 53920 - DNA, 15 bp, Homo sapiens
tgcttcacttgttct

SEQ ID NO: 53921 - DNA, 15 bp, Homo sapiens
ctgcttcacttgttc

SEQ ID NO: 53922 - DNA, 15 bp, Homo sapiens
actgcttcacttgtt

SEQ ID NO: 53923 - DNA, 15 bp, Homo sapiens
aactgcttcacttgt

SEQ ID NO: 53924 - DNA, 15 bp, Homo sapiens
aaactgcttcacttg

SEQ ID NO: 53925 - DNA, 15 bp, Homo sapiens
aaaactgcttcactt

SEQ ID NO: 53926 - DNA, 15 bp, Homo sapiens
aaaaactgcttcact

SEQ ID NO: 53927 - DNA, 15 bp, Homo sapiens
taaaaactgcttcac

SEQ ID NO: 53928 - DNA, 15 bp, Homo sapiens
ctaaaaactgcttca

SEQ ID NO: 53929 - DNA, 15 bp, Homo sapiens
gctaaaaactgcttc

SEQ ID NO: 53930 - DNA, 15 bp, Homo sapiens
tgctaaaaactgctt

SEQ ID NO: 53931 - DNA, 15 bp, Homo sapiens
ctgctaaaaactgct

SEQ ID NO: 53932 - DNA, 15 bp, Homo sapiens
gctgctaaaaactgc

SEQ ID NO: 53933 - DNA, 15 bp, Homo sapiens
agctgctaaaaactg

SEQ ID NO: 53934 - DNA, 15 bp, Homo sapiens
aagctgctaaaaact

SEQ ID NO: 53935 - DNA, 15 bp, Homo sapiens
taagctgctaaaaac

SEQ ID NO: 53936 - DNA, 15 bp, Homo sapiens
ttaagctgctaaaaa

SEQ ID NO: 53937 - DNA, 15 bp, Homo sapiens
attaagctgctaaaa

SEQ ID NO: 53938 - DNA, 15 bp, Homo sapiens
aattaagctgctaaa

SEQ ID NO: 53939 - DNA, 15 bp, Homo sapiens
aaattaagctgctaa

SEQ ID NO: 53940 - DNA, 15 bp, Homo sapiens
taaattaagctgcta

SEQ ID NO: 53941 - DNA, 15 bp, Homo sapiens
ctaaattaagctgct

SEQ ID NO: 53942 - DNA, 15 bp, Homo sapiens
actaaattaagctgc

SEQ ID NO: 53943 - DNA, 15 bp, Homo sapiens
gactaaattaagctg

SEQ ID NO: 53944 - DNA, 15 bp, Homo sapiens
agactaaattaagct

SEQ ID NO: 53945 - DNA, 15 bp, Homo sapiens
aagactaaattaagc

SEQ ID NO: 53946 - DNA, 15 bp, Homo sapiens
aaagactaaattaag

SEQ ID NO: 53947 - DNA, 15 bp, Homo sapiens
caaagactaaattaa

SEQ ID NO: 53948 - DNA, 15 bp, Homo sapiens
ccaaagactaaatta

SEQ ID NO: 53949 - DNA, 15 bp, Homo sapiens
cccaaagactaaatt

SEQ ID NO: 53950 - DNA, 15 bp, Homo sapiens
ccccaaagactaaat

SEQ ID NO: 53951 - DNA, 15 bp, Homo sapiens
tccccaaagactaaa

SEQ ID NO: 53952 - DNA, 15 bp, Homo sapiens
ttccccaaagactaa

SEQ ID NO: 53953 - DNA, 15 bp, Homo sapiens
cttccccaaagacta

SEQ ID NO: 53954 - DNA, 15 bp, Homo sapiens
tcttccccaaagact

SEQ ID NO: 53955 - DNA, 15 bp, Homo sapiens
ttcttccccaaagac

SEQ ID NO: 53956 - DNA, 15 bp, Homo sapiens
attcttccccaaaga

SEQ ID NO: 53957 - DNA, 15 bp, Homo sapiens
aattcttccccaaag

SEQ ID NO: 53958 - DNA, 15 bp, Homo sapiens
caattcttccccaaa

SEQ ID NO: 53959 - DNA, 15 bp, Homo sapiens
gcaattcttccccaa

SEQ ID NO: 53960 - DNA, 15 bp, Homo sapiens
ggcaattcttcccca

SEQ ID NO: 53961 - DNA, 15 bp, Homo sapiens
aggcaattcttcccc

SEQ ID NO: 53962 - DNA, 15 bp, Homo sapiens
aaggcaattcttccc

SEQ ID NO: 53963 - DNA, 15 bp, Homo sapiens
taaggcaattcttcc

SEQ ID NO: 53964 - DNA, 15 bp, Homo sapiens
ctaaggcaattcttc

SEQ ID NO: 53965 - DNA, 15 bp, Homo sapiens
tctaaggcaattctt

SEQ ID NO: 53966 - DNA, 15 bp, Homo sapiens
ttctaaggcaattct

SEQ ID NO: 53967 - DNA, 15 bp, Homo sapiens
gttctaaggcaattc

SEQ ID NO: 53968 - DNA, 15 bp, Homo sapiens
agttctaaggcaatt

SEQ ID NO: 53969 - DNA, 15 bp, Homo sapiens
tagttctaaggcaat

SEQ ID NO: 53970 - DNA, 15 bp, Homo sapiens
ttagttctaaggcaa

SEQ ID NO: 53971 - DNA, 15 bp, Homo sapiens
attagttctaaggca

SEQ ID NO: 53972 - DNA, 15 bp, Homo sapiens
aattagttctaaggc

SEQ ID NO: 53973 - DNA, 15 bp, Homo sapiens
aaattagttctaagg

SEQ ID NO: 53974 - DNA, 15 bp, Homo sapiens
aaaattagttctaag

SEQ ID NO: 53975 - DNA, 15 bp, Homo sapiens
caaaattagttctaa

SEQ ID NO: 53976 - DNA, 15 bp, Homo sapiens
tcaaaattagttcta

SEQ ID NO: 53977 - DNA, 15 bp, Homo sapiens
ttcaaaattagttct

SEQ ID NO: 53978 - DNA, 15 bp, Homo sapiens
cttcaaaattagttc

SEQ ID NO: 53979 - DNA, 15 bp, Homo sapiens
tcttcaaaattagtt

SEQ ID NO: 53980 - DNA, 15 bp, Homo sapiens
atcttcaaaattagt

SEQ ID NO: 53981 - DNA, 15 bp, Homo sapiens
aatcttcaaaattag

SEQ ID NO: 53982 - DNA, 15 bp, Homo sapiens
caatcttcaaaatta

SEQ ID NO: 53983 - DNA, 15 bp, Homo sapiens
acaatcttcaaaatt

SEQ ID NO: 53984 - DNA, 15 bp, Homo sapiens
aacaatcttcaaaat

SEQ ID NO: 53985 - DNA, 15 bp, Homo sapiens
aaacaatcttcaaaa

SEQ ID NO: 53986 - DNA, 15 bp, Homo sapiens
aaaacaatcttcaaa

SEQ ID NO: 53987 - DNA, 15 bp, Homo sapiens
caaaacaatcttcaa

SEQ ID NO: 53988 - DNA, 15 bp, Homo sapiens
tcaaaacaatcttca

SEQ ID NO: 53989 - DNA, 15 bp, Homo sapiens
ttcaaaacaatcttc

SEQ ID NO: 53990 - DNA, 15 bp, Homo sapiens
tttcaaaacaatctt

SEQ ID NO: 53991 - DNA, 15 bp, Homo sapiens
ctttcaaaacaatct

SEQ ID NO: 53992 - DNA, 15 bp, Homo sapiens
gctttcaaaacaatc

SEQ ID NO: 53993 - DNA, 15 bp, Homo sapiens
tgctttcaaaacaat

SEQ ID NO: 53994 - DNA, 15 bp, Homo sapiens
atgctttcaaaacaa

SEQ ID NO: 53995 - DNA, 15 bp, Homo sapiens
aatgctttcaaaaca

SEQ ID NO: 53996 - DNA, 15 bp, Homo sapiens
taatgctttcaaaac

SEQ ID NO: 53997 - DNA, 15 bp, Homo sapiens
ttaatgctttcaaaa

SEQ ID NO: 53998 - DNA, 15 bp, Homo sapiens
tttaatgctttcaaa

SEQ ID NO: 53999 - DNA, 15 bp, Homo sapiens
gtttaatgctttcaa

SEQ ID NO: 54000 - DNA, 15 bp, Homo sapiens
agtttaatgctttca

SEQ ID NO: 54001 - DNA, 15 bp, Homo sapiens
aagtttaatgctttc

SEQ ID NO: 54002 - DNA, 15 bp, Homo sapiens
caagtttaatgcttt

SEQ ID NO: 54003 - DNA, 15 bp, Homo sapiens
ccaagtttaatgctt

SEQ ID NO: 54004 - DNA, 15 bp, Homo sapiens
accaagtttaatgct

SEQ ID NO: 54005 - DNA, 15 bp, Homo sapiens
taccaagtttaatgc

SEQ ID NO: 54006 - DNA, 15 bp, Homo sapiens
ctaccaagtttaatg

SEQ ID NO: 54007 - DNA, 15 bp, Homo sapiens
tctaccaagtttaat

SEQ ID NO: 54008 - DNA, 15 bp, Homo sapiens
gtctaccaagtttaa

SEQ ID NO: 54009 - DNA, 15 bp, Homo sapiens
ggtctaccaagttta

SEQ ID NO: 54010 - DNA, 15 bp, Homo sapiens
aggtctaccaagttt

SEQ ID NO: 54011 - DNA, 15 bp, Homo sapiens
taggtctaccaagtt

SEQ ID NO: 54012 - DNA, 15 bp, Homo sapiens
ttaggtctaccaagt

SEQ ID NO: 54013 - DNA, 15 bp, Homo sapiens
cttaggtctaccaag

SEQ ID NO: 54014 - DNA, 15 bp, Homo sapiens
acttaggtctaccaa

SEQ ID NO: 54015 - DNA, 15 bp, Homo sapiens
aacttaggtctacca

SEQ ID NO: 54016 - DNA, 15 bp, Homo sapiens
aaacttaggtctacc

SEQ ID NO: 54017 - DNA, 15 bp, Homo sapiens
taaacttaggtctac

SEQ ID NO: 54018 - DNA, 15 bp, Homo sapiens
ctaaacttaggtcta

SEQ ID NO: 54019 - DNA, 15 bp, Homo sapiens
tctaaacttaggtct

SEQ ID NO: 54020 - DNA, 15 bp, Homo sapiens
ctctaaacttaggtc

SEQ ID NO: 54021 - DNA, 15 bp, Homo sapiens
tctctaaacttaggt

SEQ ID NO: 54022 - DNA, 15 bp, Homo sapiens
ctctctaaacttagg

SEQ ID NO: 54023 - DNA, 15 bp, Homo sapiens
gctctctaaacttag

SEQ ID NO: 54024 - DNA, 15 bp, Homo sapiens
tgctctctaaactta

SEQ ID NO: 54025 - DNA, 15 bp, Homo sapiens
atgctctctaaactt

SEQ ID NO: 54026 - DNA, 15 bp, Homo sapiens
aatgctctctaaact

SEQ ID NO: 54027 - DNA, 15 bp, Homo sapiens
aaatgctctctaaac

SEQ ID NO: 54028 - DNA, 15 bp, Homo sapiens
caaatgctctctaaa

SEQ ID NO: 54029 - DNA, 15 bp, Homo sapiens
tcaaatgctctctaa

SEQ ID NO: 54030 - DNA, 15 bp, Homo sapiens
ttcaaatgctctcta

SEQ ID NO: 54031 - DNA, 15 bp, Homo sapiens
tttcaaatgctctct

SEQ ID NO: 54032 - DNA, 15 bp, Homo sapiens
gtttcaaatgctctc

SEQ ID NO: 54033 - DNA, 15 bp, Homo sapiens
agtttcaaatgctct

SEQ ID NO: 54034 - DNA, 15 bp, Homo sapiens
cagtttcaaatgctc

SEQ ID NO: 54035 - DNA, 15 bp, Homo sapiens
ccagtttcaaatgct

SEQ ID NO: 54036 - DNA, 15 bp, Homo sapiens
cccagtttcaaatgc

SEQ ID NO: 54037 - DNA, 15 bp, Homo sapiens
acccagtttcaaatg

SEQ ID NO: 54038 - DNA, 15 bp, Homo sapiens
tacccagtttcaaat

SEQ ID NO: 54039 - DNA, 15 bp, Homo sapiens
ttacccagtttcaaa

SEQ ID NO: 54040 - DNA, 15 bp, Homo sapiens
tttacccagtttcaa

SEQ ID NO: 54041 - DNA, 15 bp, Homo sapiens
atttacccagtttca

SEQ ID NO: 54042 - DNA, 15 bp, Homo sapiens
aatttacccagtttc

SEQ ID NO: 54043 - DNA, 15 bp, Homo sapiens
taatttacccagttt

SEQ ID NO: 54044 - DNA, 15 bp, Homo sapiens
gtaatttacccagtt

SEQ ID NO: 54045 - DNA, 15 bp, Homo sapiens
agtaatttacccagt

SEQ ID NO: 54046 - DNA, 15 bp, Homo sapiens
aagtaatttacccag

SEQ ID NO: 54047 - DNA, 15 bp, Homo sapiens
aaagtaatttaccca

SEQ ID NO: 54048 - DNA, 15 bp, Homo sapiens
aaaagtaatttaccc

SEQ ID NO: 54049 - DNA, 15 bp, Homo sapiens
aaaaagtaatttacc

SEQ ID NO: 54050 - DNA, 15 bp, Homo sapiens
taaaaagtaatttac

SEQ ID NO: 54051 - DNA, 15 bp, Homo sapiens
gtaaaaagtaattta

SEQ ID NO: 54052 - DNA, 15 bp, Homo sapiens
ggtaaaaagtaattt

SEQ ID NO: 54053 - DNA, 15 bp, Homo sapiens
aggtaaaaagtaatt

SEQ ID NO: 54054 - DNA, 15 bp, Homo sapiens
taggtaaaaagtaat

SEQ ID NO: 54055 - DNA, 15 bp, Homo sapiens
ataggtaaaaagtaa

SEQ ID NO: 54056 - DNA, 15 bp, Homo sapiens
aataggtaaaaagta

SEQ ID NO: 54057 - DNA, 15 bp, Homo sapiens
aaataggtaaaaagt

SEQ ID NO: 54058 - DNA, 15 bp, Homo sapiens
taaataggtaaaaag

SEQ ID NO: 54059 - DNA, 15 bp, Homo sapiens
ataaataggtaaaaa

SEQ ID NO: 54060 - DNA, 15 bp, Homo sapiens
cataaataggtaaaa

SEQ ID NO: 54061 - DNA, 15 bp, Homo sapiens
tcataaataggtaaa

SEQ ID NO: 54062 - DNA, 15 bp, Homo sapiens
ttcataaataggtaa

SEQ ID NO: 54063 - DNA, 15 bp, Homo sapiens
tttcataaataggta

SEQ ID NO: 54064 - DNA, 15 bp, Homo sapiens
ttttcataaataggt

SEQ ID NO: 54065 - DNA, 15 bp, Homo sapiens
attttcataaatagg

SEQ ID NO: 54066 - DNA, 15 bp, Homo sapiens
cattttcataaatag

SEQ ID NO: 54067 - DNA, 15 bp, Homo sapiens
ccattttcataaata

SEQ ID NO: 54068 - DNA, 15 bp, Homo sapiens
tccattttcataaat

SEQ ID NO: 54069 - DNA, 15 bp, Homo sapiens
ctccattttcataaa

SEQ ID NO: 54070 - DNA, 15 bp, Homo sapiens
tctccattttcataa

SEQ ID NO: 54071 - DNA, 15 bp, Homo sapiens
ctctccattttcata

SEQ ID NO: 54072 - DNA, 15 bp, Homo sapiens
tctctccattttcat

SEQ ID NO: 54073 - DNA, 15 bp, Homo sapiens
ttctctccattttca

SEQ ID NO: 54074 - DNA, 15 bp, Homo sapiens
tttctctccattttc

SEQ ID NO: 54075 - DNA, 15 bp, Homo sapiens
atttctctccatttt

SEQ ID NO: 54076 - DNA, 15 bp, Homo sapiens
tatttctctccattt

SEQ ID NO: 54077 - DNA, 15 bp, Homo sapiens
ctatttctctccatt

SEQ ID NO: 54078 - DNA, 15 bp, Homo sapiens
cctatttctctccat

SEQ ID NO: 54079 - DNA, 15 bp, Homo sapiens
acctatttctctcca

SEQ ID NO: 54080 - DNA, 15 bp, Homo sapiens
tacctatttctctcc

SEQ ID NO: 54081 - DNA, 15 bp, Homo sapiens
ctacctatttctctc

SEQ ID NO: 54082 - DNA, 15 bp, Homo sapiens
actacctatttctct

SEQ ID NO: 54083 - DNA, 15 bp, Homo sapiens
tactacctatttctc

SEQ ID NO: 54084 - DNA, 15 bp, Homo sapiens
ttactacctatttct

SEQ ID NO: 54085 - DNA, 15 bp, Homo sapiens
tttactacctatttc

SEQ ID NO: 54086 - DNA, 15 bp, Homo sapiens
ttttactacctattt

SEQ ID NO: 54087 - DNA, 15 bp, Homo sapiens
attttactacctatt

SEQ ID NO: 54088 - DNA, 15 bp, Homo sapiens
tattttactacctat

SEQ ID NO: 54089 - DNA, 15 bp, Homo sapiens
ctattttactaccta

SEQ ID NO: 54090 - DNA, 15 bp, Homo sapiens
cctattttactacct

SEQ ID NO: 54091 - DNA, 15 bp, Homo sapiens
tcctattttactacc

SEQ ID NO: 54092 - DNA, 15 bp, Homo sapiens
gtcctattttactac

SEQ ID NO: 54093 - DNA, 15 bp, Homo sapiens
tgtcctattttacta

SEQ ID NO: 54094 - DNA, 15 bp, Homo sapiens
atgtcctattttact

SEQ ID NO: 54095 - DNA, 15 bp, Homo sapiens
catgtcctattttac

SEQ ID NO: 54096 - DNA, 15 bp, Homo sapiens
ccatgtcctatttta

SEQ ID NO: 54097 - DNA, 15 bp, Homo sapiens
tccatgtcctatttt

SEQ ID NO: 54098 - DNA, 15 bp, Homo sapiens
ttccatgtcctattt

SEQ ID NO: 54099 - DNA, 15 bp, Homo sapiens
tttccatgtcctatt

SEQ ID NO: 54100 - DNA, 15 bp, Homo sapiens
ctttccatgtcctat

SEQ ID NO: 54101 - DNA, 15 bp, Homo sapiens
cctttccatgtccta

SEQ ID NO: 54102 - DNA, 15 bp, Homo sapiens
ccctttccatgtcct

SEQ ID NO: 54103 - DNA, 15 bp, Homo sapiens
accctttccatgtcc

SEQ ID NO: 54104 - DNA, 15 bp, Homo sapiens
aaccctttccatgtc

SEQ ID NO: 54105 - DNA, 15 bp, Homo sapiens
aaaccctttccatgt

SEQ ID NO: 54106 - DNA, 15 bp, Homo sapiens
caaaccctttccatg

SEQ ID NO: 54107 - DNA, 15 bp, Homo sapiens
acaaaccctttccat

SEQ ID NO: 54108 - DNA, 15 bp, Homo sapiens
tacaaaccctttcca

SEQ ID NO: 54109 - DNA, 15 bp, Homo sapiens
ctacaaaccctttcc

SEQ ID NO: 54110 - DNA, 15 bp, Homo sapiens
tctacaaaccctttc

SEQ ID NO: 54111 - DNA, 15 bp, Homo sapiens
ctctacaaacccttt

SEQ ID NO: 54112 - DNA, 15 bp, Homo sapiens
cctctacaaaccctt

SEQ ID NO: 54113 - DNA, 15 bp, Homo sapiens
tcctctacaaaccct

SEQ ID NO: 54114 - DNA, 15 bp, Homo sapiens
ttcctctacaaaccc

SEQ ID NO: 54115 - DNA, 15 bp, Homo sapiens
cttcctctacaaacc

SEQ ID NO: 54116 - DNA, 15 bp, Homo sapiens
tcttcctctacaaac

SEQ ID NO: 54117 - DNA, 15 bp, Homo sapiens
ctcttcctctacaaa

SEQ ID NO: 54118 - DNA, 15 bp, Homo sapiens
tctcttcctctacaa

SEQ ID NO: 54119 - DNA, 15 bp, Homo sapiens
ctctcttcctctaca

SEQ ID NO: 54120 - DNA, 15 bp, Homo sapiens
tctctcttcctctac

SEQ ID NO: 54121 - DNA, 15 bp, Homo sapiens
atctctcttcctcta

SEQ ID NO: 54122 - DNA, 15 bp, Homo sapiens
catctctcttcctct

SEQ ID NO: 54123 - DNA, 15 bp, Homo sapiens
tcatctctcttcctc

SEQ ID NO: 54124 - DNA, 15 bp, Homo sapiens
gtcatctctcttcct

SEQ ID NO: 54125 - DNA, 15 bp, Homo sapiens
tgtcatctctcttcc

SEQ ID NO: 54126 - DNA, 15 bp, Homo sapiens
ttgtcatctctcttc

SEQ ID NO: 54127 - DNA, 15 bp, Homo sapiens
gttgtcatctctctt

SEQ ID NO: 54128 - DNA, 15 bp, Homo sapiens
agttgtcatctctct

SEQ ID NO: 54129 - DNA, 15 bp, Homo sapiens
cagttgtcatctctc

SEQ ID NO: 54130 - DNA, 15 bp, Homo sapiens
tcagttgtcatctct

SEQ ID NO: 54131 - DNA, 15 bp, Homo sapiens
ctcagttgtcatctc

SEQ ID NO: 54132 - DNA, 15 bp, Homo sapiens
tctcagttgtcatct

SEQ ID NO: 54133 - DNA, 15 bp, Homo sapiens
gtctcagttgtcatc

SEQ ID NO: 54134 - DNA, 15 bp, Homo sapiens
tgtctcagttgtcat

SEQ ID NO: 54135 - DNA, 15 bp, Homo sapiens
ctgtctcagttgtca

SEQ ID NO: 54136 - DNA, 15 bp, Homo sapiens
tctgtctcagttgtc

SEQ ID NO: 54137 - DNA, 15 bp, Homo sapiens
ttctgtctcagttgt

SEQ ID NO: 54138 - DNA, 15 bp, Homo sapiens
attctgtctcagttg

SEQ ID NO: 54139 - DNA, 15 bp, Homo sapiens
tattctgtctcagtt

SEQ ID NO: 54140 - DNA, 15 bp, Homo sapiens
ttattctgtctcagt

SEQ ID NO: 54141 - DNA, 15 bp, Homo sapiens
attattctgtctcag

SEQ ID NO: 54142 - DNA, 15 bp, Homo sapiens
aattattctgtctca

SEQ ID NO: 54143 - DNA, 15 bp, Homo sapiens
caattattctgtctc

SEQ ID NO: 54144 - DNA, 15 bp, Homo sapiens
tcaattattctgtct

SEQ ID NO: 54145 - DNA, 15 bp, Homo sapiens
ttcaattattctgtc

SEQ ID NO: 54146 - DNA, 15 bp, Homo sapiens
cttttcaattattct

SEQ ID NO: 54147 - DNA, 15 bp, Homo sapiens
tcttttcaattattc

SEQ ID NO: 54148 - DNA, 15 bp, Homo sapiens
ttcttttcaattatt

SEQ ID NO: 54149 - DNA, 15 bp, Homo sapiens
tttcttttcaattat

SEQ ID NO: 54150 - DNA, 15 bp, Homo sapiens
atttcttttcaatta

SEQ ID NO: 54151 - DNA, 15 bp, Homo sapiens
aatttcttttcaatt

SEQ ID NO: 54152 - DNA, 15 bp, Homo sapiens
aaatttcttttcaat

SEQ ID NO: 54153 - DNA, 15 bp, Homo sapiens
gaaatttcttttcaa

SEQ ID NO: 54154 - DNA, 15 bp, Homo sapiens
agaaatttcttttca

SEQ ID NO: 54155 - DNA, 15 bp, Homo sapiens
gagaaatttcttttc

SEQ ID NO: 54156 - DNA, 15 bp, Homo sapiens
tgagaaatttctttt

SEQ ID NO: 54157 - DNA, 15 bp, Homo sapiens
ttgagaaatttcttt

SEQ ID NO: 54158 - DNA, 15 bp, Homo sapiens
attgagaaatttctt

SEQ ID NO: 54159 - DNA, 15 bp, Homo sapiens
tattgagaaatttct

SEQ ID NO: 54160 - DNA, 15 bp, Homo sapiens
atattgagaaatttc

SEQ ID NO: 54161 - DNA, 15 bp, Homo sapiens
aatattgagaaattt

SEQ ID NO: 54162 - DNA, 15 bp, Homo sapiens
aaatattgagaaatt

SEQ ID NO: 54163 - DNA, 15 bp, Homo sapiens
taaatattgagaaat

SEQ ID NO: 54164 - DNA, 15 bp, Homo sapiens
ataaatattgagaaa

SEQ ID NO: 54165 - DNA, 15 bp, Homo sapiens
cataaatattgagaa

SEQ ID NO: 54166 - DNA, 15 bp, Homo sapiens
ccataaatattgaga

SEQ ID NO: 54167 - DNA, 15 bp, Homo sapiens
accataaatattgag

SEQ ID NO: 54168 - DNA, 15 bp, Homo sapiens
caccataaatattga

SEQ ID NO: 54169 - DNA, 15 bp, Homo sapiens
ccaccataaatattg

SEQ ID NO: 54170 - DNA, 15 bp, Homo sapiens
cccaccataaatatt

SEQ ID NO: 54171 - DNA, 15 bp, Homo sapiens
acccaccataaatat

SEQ ID NO: 54172 - DNA, 15 bp, Homo sapiens
gacccaccataaata

SEQ ID NO: 54173 - DNA, 15 bp, Homo sapiens
tgacccaccataaat

SEQ ID NO: 54174 - DNA, 15 bp, Homo sapiens
atgacccaccataaa

SEQ ID NO: 54175 - DNA, 15 bp, Homo sapiens
aatgacccaccataa

SEQ ID NO: 54176 - DNA, 15 bp, Homo sapiens
caatgacccaccata

SEQ ID NO: 54177 - DNA, 15 bp, Homo sapiens
tcaatgacccaccat

SEQ ID NO: 54178 - DNA, 15 bp, Homo sapiens
gtcaatgacccacca

SEQ ID NO: 54179 - DNA, 15 bp, Homo sapiens
tgtcaatgacccacc

SEQ ID NO: 54180 - DNA, 15 bp, Homo sapiens
gtgtcaatgacccac

SEQ ID NO: 54181 - DNA, 15 bp, Homo sapiens
ggtgtcaatgaccca

SEQ ID NO: 54182 - DNA, 15 bp, Homo sapiens
aggtgtcaatgaccc

SEQ ID NO: 54183 - DNA, 15 bp, Homo sapiens
aaggtgtcaatgacc

SEQ ID NO: 54184 - DNA, 15 bp, Homo sapiens
aaaggtgtcaatgac

SEQ ID NO: 54185 - DNA, 15 bp, Homo sapiens
taaaggtgtcaatga

SEQ ID NO: 54186 - DNA, 15 bp, Homo sapiens
ttaaaggtgtcaatg

SEQ ID NO: 54187 - DNA, 15 bp, Homo sapiens
tttaaaggtgtcaat

SEQ ID NO: 54188 - DNA, 15 bp, Homo sapiens
ttttaaaggtgtcaa

SEQ ID NO: 54189 - DNA, 15 bp, Homo sapiens
tttttaaaggtgtca

SEQ ID NO: 54190 - DNA, 15 bp, Homo sapiens
ctttttaaaggtgtc

SEQ ID NO: 54191 - DNA, 15 bp, Homo sapiens
tctttttaaaggtgt

SEQ ID NO: 54192 - DNA, 15 bp, Homo sapiens
gtctttttaaaggtg

SEQ ID NO: 54193 - DNA, 15 bp, Homo sapiens
ggtctttttaaaggt

SEQ ID NO: 54194 - DNA, 15 bp, Homo sapiens
aggtctttttaaagg

SEQ ID NO: 54195 - DNA, 15 bp, Homo sapiens
gaggtctttttaaag

SEQ ID NO: 54196 - DNA, 15 bp, Homo sapiens
tgaggtctttttaaa

SEQ ID NO: 54197 - DNA, 15 bp, Homo sapiens
ttgaggtctttttaa

SEQ ID NO: 54198 - DNA, 15 bp, Homo sapiens
tttgaggtcttttta

SEQ ID NO: 54199 - DNA, 15 bp, Homo sapiens
ctttgaggtcttttt

SEQ ID NO: 54200 - DNA, 15 bp, Homo sapiens
tctttgaggtctttt

SEQ ID NO: 54201 - DNA, 15 bp, Homo sapiens
ttctttgaggtcttt

SEQ ID NO: 54202 - DNA, 15 bp, Homo sapiens
tttctttgaggtctt

SEQ ID NO: 54203 - DNA, 15 bp, Homo sapiens
ttttctttgaggtct

SEQ ID NO: 54204 - DNA, 15 bp, Homo sapiens
gttttctttgaggtc

SEQ ID NO: 54205 - DNA, 15 bp, Homo sapiens
tgttttctttgaggt

SEQ ID NO: 54206 - DNA, 15 bp, Homo sapiens
ttgttttctttgagg

SEQ ID NO: 54207 - DNA, 15 bp, Homo sapiens
tttgttttctttgag

SEQ ID NO: 54208 - DNA, 15 bp, Homo sapiens
ttttgttttctttga

SEQ ID NO: 54209 - DNA, 15 bp, Homo sapiens
attttgttttctttg

SEQ ID NO: 54210 - DNA, 15 bp, Homo sapiens
gattttgttttcttt

SEQ ID NO: 54211 - DNA, 15 bp, Homo sapiens
agattttgttttctt

SEQ ID NO: 54212 - DNA, 15 bp, Homo sapiens
cagattttgttttct

SEQ ID NO: 54213 - DNA, 15 bp, Homo sapiens
ccagattttgttttc

SEQ ID NO: 54214 - DNA, 15 bp, Homo sapiens
accagattttgtttt

SEQ ID NO: 54215 - DNA, 15 bp, Homo sapiens
taccagattttgttt

SEQ ID NO: 54216 - DNA, 15 bp, Homo sapiens
ctaccagattttgtt

SEQ ID NO: 54217 - DNA, 15 bp, Homo sapiens
actaccagattttgt

SEQ ID NO: 54218 - DNA, 15 bp, Homo sapiens
tactaccagattttg

SEQ ID NO: 54219 - DNA, 15 bp, Homo sapiens
gtactaccagatttt

SEQ ID NO: 54220 - DNA, 15 bp, Homo sapiens
ggtactaccagattt

SEQ ID NO: 54221 - DNA, 15 bp, Homo sapiens
tggtactaccagatt

SEQ ID NO: 54222 - DNA, 15 bp, Homo sapiens
ctggtactaccagat

SEQ ID NO: 54223 - DNA, 15 bp, Homo sapiens
tctggtactaccaga

SEQ ID NO: 54224 - DNA, 15 bp, Homo sapiens
gtctggtactaccag

SEQ ID NO: 54225 - DNA, 15 bp, Homo sapiens
agtctggtactacca

SEQ ID NO: 54226 - DNA, 15 bp, Homo sapiens
tagtctggtactacc

SEQ ID NO: 54227 - DNA, 15 bp, Homo sapiens
ctagtctggtactac

SEQ ID NO: 54228 - DNA, 15 bp, Homo sapiens
actagtctggtacta

SEQ ID NO: 54229 - DNA, 15 bp, Homo sapiens
aactagtctggtact

SEQ ID NO: 54230 - DNA, 15 bp, Homo sapiens
aaactagtctggtac

SEQ ID NO: 54231 - DNA, 15 bp, Homo sapiens
taaactagtctggta

SEQ ID NO: 54232 - DNA, 15 bp, Homo sapiens
ataaactagtctggt

SEQ ID NO: 54233 - DNA, 15 bp, Homo sapiens
aataaactagtctgg

SEQ ID NO: 54234 - DNA, 15 bp, Homo sapiens
taataaactagtctg

SEQ ID NO: 54235 - DNA, 15 bp, Homo sapiens
ttaataaactagtct

SEQ ID NO: 54236 - DNA, 15 bp, Homo sapiens
tttaataaactagtc

SEQ ID NO: 54237 - DNA, 15 bp, Homo sapiens
atttaataaactagt

SEQ ID NO: 54238 - DNA, 15 bp, Homo sapiens
catttaataaactag

SEQ ID NO: 54239 - DNA, 15 bp, Homo sapiens
tcatttaataaacta

SEQ ID NO: 54240 - DNA, 15 bp, Homo sapiens
ttcatttaataaact

SEQ ID NO: 54241 - DNA, 15 bp, Homo sapiens
gttcatttaataaac

SEQ ID NO: 54242 - DNA, 15 bp, Homo sapiens
agttcatttaataaa

SEQ ID NO: 54243 - DNA, 15 bp, Homo sapiens
aagttcatttaataa

SEQ ID NO: 54244 - DNA, 15 bp, Homo sapiens
caagttcatttaata

SEQ ID NO: 54245 - DNA, 15 bp, Homo sapiens
tcaagttcatttaat

SEQ ID NO: 54246 - DNA, 15 bp, Homo sapiens
atcaagttcatttaa

SEQ ID NO: 54247 - DNA, 15 bp, Homo sapiens
tatcaagttcattta

SEQ ID NO: 54248 - DNA, 15 bp, Homo sapiens
atatcaagttcattt

SEQ ID NO: 54249 - DNA, 15 bp, Homo sapiens
aatatcaagttcatt

SEQ ID NO: 54250 - DNA, 15 bp, Homo sapiens
aaatatcaagttcat

SEQ ID NO: 54251 - DNA, 15 bp, Homo sapiens
taaatatcaagttca

SEQ ID NO: 54252 - DNA, 15 bp, Homo sapiens
ttaaatatcaagttc

SEQ ID NO: 54253 - DNA, 15 bp, Homo sapiens
tttaaatatcaagtt

SEQ ID NO: 54254 - DNA, 15 bp, Homo sapiens
atttaaatatcaagt

SEQ ID NO: 54255 - DNA, 15 bp, Homo sapiens
aatttaaatatcaag

SEQ ID NO: 54256 - DNA, 15 bp, Homo sapiens
aaatttaaatatcaa

SEQ ID NO: 54257 - DNA, 15 bp, Homo sapiens
caaatttaaatatca

SEQ ID NO: 54258 - DNA, 15 bp, Homo sapiens
acaaatttaaatatc

SEQ ID NO: 54259 - DNA, 15 bp, Homo sapiens
cacaaatttaaatat

SEQ ID NO: 54260 - DNA, 15 bp, Homo sapiens
gcacaaatttaaata

SEQ ID NO: 54261 - DNA, 15 bp, Homo sapiens
tgcacaaatttaaat

SEQ ID NO: 54262 - DNA, 15 bp, Homo sapiens
atgcacaaatttaaa

SEQ ID NO: 54263 - DNA, 15 bp, Homo sapiens
aatgcacaaatttaa

SEQ ID NO: 54264 - DNA, 15 bp, Homo sapiens
aaatgcacaaattta

SEQ ID NO: 54265 - DNA, 15 bp, Homo sapiens
taaatgcacaaattt

SEQ ID NO: 54266 - DNA, 15 bp, Homo sapiens
ataaatgcacaaatt

SEQ ID NO: 54267 - DNA, 15 bp, Homo sapiens
tataaatgcacaaat

SEQ ID NO: 54268 - DNA, 15 bp, Homo sapiens
ttataaatgcacaaa

SEQ ID NO: 54269 - DNA, 15 bp, Homo sapiens
attataaatgcacaa

SEQ ID NO: 54270 - DNA, 15 bp, Homo sapiens
cattataaatgcaca

SEQ ID NO: 54271 - DNA, 15 bp, Homo sapiens
acattataaatgcac

SEQ ID NO: 54272 - DNA, 15 bp, Homo sapiens
gacattataaatgca

SEQ ID NO: 54273 - DNA, 15 bp, Homo sapiens
agacattataaatgc

SEQ ID NO: 54274 - DNA, 15 bp, Homo sapiens
tagacattataaatg

SEQ ID NO: 54275 - DNA, 15 bp, Homo sapiens
atagacattataaat

SEQ ID NO: 54276 - DNA, 15 bp, Homo sapiens
aatagacattataaa

SEQ ID NO: 54277 - DNA, 15 bp, Homo sapiens
taatagacattataa

SEQ ID NO: 54278 - DNA, 15 bp, Homo sapiens
ataatagacattata

SEQ ID NO: 54279 - DNA, 15 bp, Homo sapiens
aataatagacattat

SEQ ID NO: 54280 - DNA, 15 bp, Homo sapiens
aaataatagacatta

SEQ ID NO: 54281 - DNA, 15 bp, Homo sapiens
aaaataatagacatt

SEQ ID NO: 54282 - DNA, 15 bp, Homo sapiens
caaaataatagacat

SEQ ID NO: 54283 - DNA, 15 bp, Homo sapiens
gcaaaataatagaca

SEQ ID NO: 54284 - DNA, 15 bp, Homo sapiens
tgcaaaataatagac

SEQ ID NO: 54285 - DNA, 15 bp, Homo sapiens
ttgcaaaataataga

SEQ ID NO: 54286 - DNA, 15 bp, Homo sapiens
attgcaaaataatag

SEQ ID NO: 54287 - DNA, 15 bp, Homo sapiens
aattgcaaaataata

SEQ ID NO: 54288 - DNA, 15 bp, Homo sapiens
taattgcaaaataat

SEQ ID NO: 54289 - DNA, 15 bp, Homo sapiens
ttaattgcaaaataa

SEQ ID NO: 54290 - DNA, 15 bp, Homo sapiens
tttaattgcaaaata

SEQ ID NO: 54291 - DNA, 15 bp, Homo sapiens
atttaattgcaaaat

SEQ ID NO: 54292 - DNA, 15 bp, Homo sapiens
catttaattgcaaaa

SEQ ID NO: 54293 - DNA, 15 bp, Homo sapiens
ccatttaattgcaaa

SEQ ID NO: 54294 - DNA, 15 bp, Homo sapiens
cccatttaattgcaa

SEQ ID NO: 54295 - DNA, 15 bp, Homo sapiens
ccccatttaattgca

SEQ ID NO: 54296 - DNA, 15 bp, Homo sapiens
gccccatttaattgc

SEQ ID NO: 54297 - DNA, 15 bp, Homo sapiens
agccccatttaattg

SEQ ID NO: 54298 - DNA, 15 bp, Homo sapiens
aagccccatttaatt

SEQ ID NO: 54299 - DNA, 15 bp, Homo sapiens
aaagccccatttaat

SEQ ID NO: 54300 - DNA, 15 bp, Homo sapiens
taaagccccatttaa

SEQ ID NO: 54301 - DNA, 15 bp, Homo sapiens
ttaaagccccattta

SEQ ID NO: 54302 - DNA, 15 bp, Homo sapiens
cttaaagccccattt

SEQ ID NO: 54303 - DNA, 15 bp, Homo sapiens
acttaaagccccatt

SEQ ID NO: 54304 - DNA, 15 bp, Homo sapiens
gacttaaagccccat

SEQ ID NO: 54305 - DNA, 15 bp, Homo sapiens
ggacttaaagcccca

SEQ ID NO: 54306 - DNA, 15 bp, Homo sapiens
gggacttaaagcccc

SEQ ID NO: 54307 - DNA, 15 bp, Homo sapiens
tgggacttaaagccc

SEQ ID NO: 54308 - DNA, 15 bp, Homo sapiens
atgggacttaaagcc

SEQ ID NO: 54309 - DNA, 15 bp, Homo sapiens
catgggacttaaagc

SEQ ID NO: 54310 - DNA, 15 bp, Homo sapiens
acatgggacttaaag

SEQ ID NO: 54311 - DNA, 15 bp, Homo sapiens
tacatgggacttaaa

SEQ ID NO: 54312 - DNA, 15 bp, Homo sapiens
ttacatgggacttaa

SEQ ID NO: 54313 - DNA, 15 bp, Homo sapiens
tttacatgggactta

SEQ ID NO: 54314 - DNA, 15 bp, Homo sapiens
atttacatgggactt

SEQ ID NO: 54315 - DNA, 15 bp, Homo sapiens
aatttacatgggact

SEQ ID NO: 54316 - DNA, 15 bp, Homo sapiens
caatttacatgggac

SEQ ID NO: 54317 - DNA, 15 bp, Homo sapiens
acaatttacatggga

SEQ ID NO: 54318 - DNA, 15 bp, Homo sapiens
aacaatttacatggg

SEQ ID NO: 54319 - DNA, 15 bp, Homo sapiens
aaacaatttacatgg

SEQ ID NO: 54320 - DNA, 15 bp, Homo sapiens
caaacaatttacatg

SEQ ID NO: 54321 - DNA, 15 bp, Homo sapiens
gcaaacaatttacat

SEQ ID NO: 54322 - DNA, 15 bp, Homo sapiens
ggcaaacaatttaca

SEQ ID NO: 54323 - DNA, 15 bp, Homo sapiens
gggcaaacaatttac

SEQ ID NO: 54324 - DNA, 15 bp, Homo sapiens
agggcaaacaattta

SEQ ID NO: 54325 - DNA, 15 bp, Homo sapiens
cagggcaaacaattt

SEQ ID NO: 54326 - DNA, 15 bp, Homo sapiens
ccagggcaaacaatt

SEQ ID NO: 54327 - DNA, 15 bp, Homo sapiens
tccagggcaaacaat

SEQ ID NO: 54328 - DNA, 15 bp, Homo sapiens
ttccagggcaaacaa

SEQ ID NO: 54329 - DNA, 15 bp, Homo sapiens
attccagggcaaaca

SEQ ID NO: 54330 - DNA, 15 bp, Homo sapiens
tattccagggcaaac

SEQ ID NO: 54331 - DNA, 15 bp, Homo sapiens
atattccagggcaaa

SEQ ID NO: 54332 - DNA, 15 bp, Homo sapiens
aatattccagggcaa

SEQ ID NO: 54333 - DNA, 15 bp, Homo sapiens
aaatattccagggca

SEQ ID NO: 54334 - DNA, 15 bp, Homo sapiens
caaatattccagggc

SEQ ID NO: 54335 - DNA, 15 bp, Homo sapiens
acaaatattccaggg

SEQ ID NO: 54336 - DNA, 15 bp, Homo sapiens
tacaaatattccagg

SEQ ID NO: 54337 - DNA, 15 bp, Homo sapiens
atacaaatattccag

SEQ ID NO: 54338 - DNA, 15 bp, Homo sapiens
aatacaaatattcca

SEQ ID NO: 54339 - DNA, 15 bp, Homo sapiens
aaatacaaatattcc

SEQ ID NO: 54340 - DNA, 15 bp, Homo sapiens
gaaatacaaatattc

SEQ ID NO: 54341 - DNA, 15 bp, Homo sapiens
agaaatacaaatatt

SEQ ID NO: 54342 - DNA, 15 bp, Homo sapiens
aagaaatacaaatat

SEQ ID NO: 54343 - DNA, 15 bp, Homo sapiens
taagaaatacaaata

SEQ ID NO: 54344 - DNA, 15 bp, Homo sapiens
gtaagaaatacaaat

SEQ ID NO: 54345 - DNA, 15 bp, Homo sapiens
ggtaagaaatacaaa

SEQ ID NO: 54346 - DNA, 15 bp, Homo sapiens
tggtaagaaatacaa

SEQ ID NO: 54347 - DNA, 15 bp, Homo sapiens
ttggtaagaaataca

SEQ ID NO: 54348 - DNA, 15 bp, Homo sapiens
cttggtaagaaatac

SEQ ID NO: 54349 - DNA, 15 bp, Homo sapiens
tcttggtaagaaata

SEQ ID NO: 54350 - DNA, 15 bp, Homo sapiens
atcttggtaagaaat

SEQ ID NO: 54351 - DNA, 15 bp, Homo sapiens
tatcttggtaagaaa

SEQ ID NO: 54352 - DNA, 15 bp, Homo sapiens
gtatcttggtaagaa

SEQ ID NO: 54353 - DNA, 15 bp, Homo sapiens
agtatcttggtaaga

SEQ ID NO: 54354 - DNA, 15 bp, Homo sapiens
cagtatcttggtaag

SEQ ID NO: 54355 - DNA, 15 bp, Homo sapiens
ccagtatcttggtaa

SEQ ID NO: 54356 - DNA, 15 bp, Homo sapiens
tccagtatcttggta

SEQ ID NO: 54357 - DNA, 15 bp, Homo sapiens
ttccagtatcttggt

SEQ ID NO: 54358 - DNA, 15 bp, Homo sapiens
tttccagtatcttgg

SEQ ID NO: 54359 - DNA, 15 bp, Homo sapiens
ttttccagtatcttg

SEQ ID NO: 54360 - DNA, 15 bp, Homo sapiens
cttttccagtatctt

SEQ ID NO: 54361 - DNA, 15 bp, Homo sapiens
tcttttccagtatct

SEQ ID NO: 54362 - DNA, 15 bp, Homo sapiens
gtcttttccagtatc

SEQ ID NO: 54363 - DNA, 15 bp, Homo sapiens
agtcttttccagtat

SEQ ID NO: 54364 - DNA, 15 bp, Homo sapiens
aagtcttttccagta

SEQ ID NO: 54365 - DNA, 15 bp, Homo sapiens
caagtcttttccagt

SEQ ID NO: 54366 - DNA, 15 bp, Homo sapiens
ccaagtcttttccag

SEQ ID NO: 54367 - DNA, 15 bp, Homo sapiens
accaagtcttttcca

SEQ ID NO: 54368 - DNA, 15 bp, Homo sapiens
taccaagtcttttcc

SEQ ID NO: 54369 - DNA, 15 bp, Homo sapiens
ttaccaagtcttttc

SEQ ID NO: 54370 - DNA, 15 bp, Homo sapiens
attaccaagtctttt

SEQ ID NO: 54371 - DNA, 15 bp, Homo sapiens
aattaccaagtcttt

SEQ ID NO: 54372 - DNA, 15 bp, Homo sapiens
aaattaccaagtctt

SEQ ID NO: 54373 - DNA, 15 bp, Homo sapiens
aaaattaccaagtct

SEQ ID NO: 54374 - DNA, 15 bp, Homo sapiens
aaaaattaccaagtc

SEQ ID NO: 54375 - DNA, 15 bp, Homo sapiens
taaaaattaccaagt

SEQ ID NO: 54376 - DNA, 15 bp, Homo sapiens
ataaaaattaccaag

SEQ ID NO: 54377 - DNA, 15 bp, Homo sapiens
gataaaaattaccaa

SEQ ID NO: 54378 - DNA, 15 bp, Homo sapiens
tgataaaaattacca

SEQ ID NO: 54379 - DNA, 15 bp, Homo sapiens
atgataaaaattacc

SEQ ID NO: 54380 - DNA, 15 bp, Homo sapiens
aatgataaaaattac

SEQ ID NO: 54381 - DNA, 15 bp, Homo sapiens
aaatgataaaaatta

SEQ ID NO: 54382 - DNA, 15 bp, Homo sapiens
aaaatgataaaaatt

SEQ ID NO: 54383 - DNA, 15 bp, Homo sapiens
aaaaatgataaaaat

SEQ ID NO: 54384 - DNA, 15 bp, Homo sapiens
taaaaatgataaaaa

SEQ ID NO: 54385 - DNA, 15 bp, Homo sapiens
ctaaaaatgataaaa

SEQ ID NO: 54386 - DNA, 15 bp, Homo sapiens
actaaaaatgataaa

SEQ ID NO: 54387 - DNA, 15 bp, Homo sapiens
tactaaaaatgataa

SEQ ID NO: 54388 - DNA, 15 bp, Homo sapiens
ttactaaaaatgata

SEQ ID NO: 54389 - DNA, 15 bp, Homo sapiens
tttactaaaaatgat

SEQ ID NO: 54390 - DNA, 15 bp, Homo sapiens
ttttactaaaaatga

SEQ ID NO: 54391 - DNA, 15 bp, Homo sapiens
cttttactaaaaatg

SEQ ID NO: 54392 - DNA, 15 bp, Homo sapiens
acttttactaaaaat

SEQ ID NO: 54393 - DNA, 15 bp, Homo sapiens
aacttttactaaaaa

SEQ ID NO: 54394 - DNA, 15 bp, Homo sapiens
taacttttactaaaa

SEQ ID NO: 54395 - DNA, 15 bp, Homo sapiens
ataacttttactaaa

SEQ ID NO: 54396 - DNA, 15 bp, Homo sapiens
tataacttttactaa

SEQ ID NO: 54397 - DNA, 15 bp, Homo sapiens
ctataacttttacta

SEQ ID NO: 54398 - DNA, 15 bp, Homo sapiens
actataacttttact

SEQ ID NO: 54399 - DNA, 15 bp, Homo sapiens
aactataacttttac

SEQ ID NO: 54400 - DNA, 15 bp, Homo sapiens
taactataactttta

SEQ ID NO: 54401 - DNA, 15 bp, Homo sapiens
ctaactataactttt

SEQ ID NO: 54402 - DNA, 15 bp, Homo sapiens
actaactataacttt

SEQ ID NO: 54403 - DNA, 15 bp, Homo sapiens
aactaactataactt

SEQ ID NO: 54404 - DNA, 15 bp, Homo sapiens
aaactaactataact

SEQ ID NO: 54405 - DNA, 15 bp, Homo sapiens
aaaactaactataac

SEQ ID NO: 54406 - DNA, 15 bp, Homo sapiens
taaaactaactataa

SEQ ID NO: 54407 - DNA, 15 bp, Homo sapiens
ctaaaactaactata

SEQ ID NO: 54408 - DNA, 15 bp, Homo sapiens
gctaaaactaactat

SEQ ID NO: 54409 - DNA, 15 bp, Homo sapiens
agctaaaactaacta

SEQ ID NO: 54410 - DNA, 15 bp, Homo sapiens
tagctaaaactaact

SEQ ID NO: 54411 - DNA, 15 bp, Homo sapiens
ttagctaaaactaac

SEQ ID NO: 54412 - DNA, 15 bp, Homo sapiens
tttagctaaaactaa

SEQ ID NO: 54413 - DNA, 15 bp, Homo sapiens
ttttagctaaaacta

SEQ ID NO: 54414 - DNA, 15 bp, Homo sapiens
cttttagctaaaact

SEQ ID NO: 54415 - DNA, 15 bp, Homo sapiens
gcttttagctaaaac

SEQ ID NO: 54416 - DNA, 15 bp, Homo sapiens
agcttttagctaaaa

SEQ ID NO: 54417 - DNA, 15 bp, Homo sapiens
aagcttttagctaaa

SEQ ID NO: 54418 - DNA, 15 bp, Homo sapiens
gaagcttttagctaa

SEQ ID NO: 54419 - DNA, 15 bp, Homo sapiens
agaagcttttagcta

SEQ ID NO: 54420 - DNA, 15 bp, Homo sapiens
gagaagcttttagct

SEQ ID NO: 54421 - DNA, 15 bp, Homo sapiens
agagaagcttttagc

SEQ ID NO: 54422 - DNA, 15 bp, Homo sapiens
tagagaagcttttag

SEQ ID NO: 54423 - DNA, 15 bp, Homo sapiens
atagagaagctttta

SEQ ID NO: 54424 - DNA, 15 bp, Homo sapiens
aatagagaagctttt

SEQ ID NO: 54425 - DNA, 15 bp, Homo sapiens
taatagagaagcttt

SEQ ID NO: 54426 - DNA, 15 bp, Homo sapiens
ctaatagagaagctt

SEQ ID NO: 54427 - DNA, 15 bp, Homo sapiens
actaatagagaagct

SEQ ID NO: 54428 - DNA, 15 bp, Homo sapiens
cactaatagagaagc

SEQ ID NO: 54429 - DNA, 15 bp, Homo sapiens
acactaatagagaag

SEQ ID NO: 54430 - DNA, 15 bp, Homo sapiens
aacactaatagagaa

SEQ ID NO: 54431 - DNA, 15 bp, Homo sapiens
aaacactaatagaga

SEQ ID NO: 54432 - DNA, 15 bp, Homo sapiens
caaacactaatagag

SEQ ID NO: 54433 - DNA, 15 bp, Homo sapiens
ccaaacactaataga

SEQ ID NO: 54434 - DNA, 15 bp, Homo sapiens
tccaaacactaatag

SEQ ID NO: 54435 - DNA, 15 bp, Homo sapiens
ctccaaacactaata

SEQ ID NO: 54436 - DNA, 15 bp, Homo sapiens
tctccaaacactaat

SEQ ID NO: 54437 - DNA, 15 bp, Homo sapiens
atctccaaacactaa

SEQ ID NO: 54438 - DNA, 15 bp, Homo sapiens
catctccaaacacta

SEQ ID NO: 54439 - DNA, 15 bp, Homo sapiens
ccatctccaaacact

SEQ ID NO: 54440 - DNA, 15 bp, Homo sapiens
accatctccaaacac

SEQ ID NO: 54441 - DNA, 15 bp, Homo sapiens
taccatctccaaaca

SEQ ID NO: 54442 - DNA, 15 bp, Homo sapiens
ctaccatctccaaac

SEQ ID NO: 54443 - DNA, 15 bp, Homo sapiens
actaccatctccaaa

SEQ ID NO: 54444 - DNA, 15 bp, Homo sapiens
aactaccatctccaa

SEQ ID NO: 54445 - DNA, 15 bp, Homo sapiens
aaactaccatctcca

SEQ ID NO: 54446 - DNA, 15 bp, Homo sapiens
gaaactaccatctcc

SEQ ID NO: 54447 - DNA, 15 bp, Homo sapiens
agaaactaccatctc

SEQ ID NO: 54448 - DNA, 15 bp, Homo sapiens
tagaaactaccatct

SEQ ID NO: 54449 - DNA, 15 bp, Homo sapiens
ttagaaactaccatc

SEQ ID NO: 54450 - DNA, 15 bp, Homo sapiens
cttagaaactaccat

SEQ ID NO: 54451 - DNA, 15 bp, Homo sapiens
gcttagaaactacca

SEQ ID NO: 54452 - DNA, 15 bp, Homo sapiens
agcttagaaactacc

SEQ ID NO: 54453 - DNA, 15 bp, Homo sapiens
gagcttagaaactac

SEQ ID NO: 54454 - DNA, 15 bp, Homo sapiens
tgagcttagaaacta

SEQ ID NO: 54455 - DNA, 15 bp, Homo sapiens
ctgagcttagaaact

SEQ ID NO: 54456 - DNA, 15 bp, Homo sapiens
gctgagcttagaaac

SEQ ID NO: 54457 - DNA, 15 bp, Homo sapiens
agctgagcttagaaa

SEQ ID NO: 54458 - DNA, 15 bp, Homo sapiens
aagctgagcttagaa

SEQ ID NO: 54459 - DNA, 15 bp, Homo sapiens
gaagctgagcttaga

SEQ ID NO: 54460 - DNA, 15 bp, Homo sapiens
agaagctgagcttag

SEQ ID NO: 54461 - DNA, 15 bp, Homo sapiens
cagaagctgagctta

SEQ ID NO: 54462 - DNA, 15 bp, Homo sapiens
acagaagctgagctt

SEQ ID NO: 54463 - DNA, 15 bp, Homo sapiens
cacagaagctgagct

SEQ ID NO: 54464 - DNA, 15 bp, Homo sapiens
acacagaagctgagc

SEQ ID NO: 54465 - DNA, 15 bp, Homo sapiens
aacacagaagctgag

SEQ ID NO: 54466 - DNA, 15 bp, Homo sapiens
taacacagaagctga

SEQ ID NO: 54467 - DNA, 15 bp, Homo sapiens
ctaacacagaagctg

SEQ ID NO: 54468 - DNA, 15 bp, Homo sapiens
actaacacagaagct

SEQ ID NO: 54469 - DNA, 15 bp, Homo sapiens
cactaacacagaagc

SEQ ID NO: 54470 - DNA, 15 bp, Homo sapiens
acactaacacagaag

SEQ ID NO: 54471 - DNA, 15 bp, Homo sapiens
aacactaacacagaa

SEQ ID NO: 54472 - DNA, 15 bp, Homo sapiens
aaacactaacacaga

SEQ ID NO: 54473 - DNA, 15 bp, Homo sapiens
caaacactaacacag

SEQ ID NO: 54474 - DNA, 15 bp, Homo sapiens
ccaaacactaacaca

SEQ ID NO: 54475 - DNA, 15 bp, Homo sapiens
tccaaacactaacac

SEQ ID NO: 54476 - DNA, 15 bp, Homo sapiens
ctccaaacactaaca

SEQ ID NO: 54477 - DNA, 15 bp, Homo sapiens
tctccaaacactaac

SEQ ID NO: 54478 - DNA, 15 bp, Homo sapiens
caccatctccaaaca

SEQ ID NO: 54479 - DNA, 15 bp, Homo sapiens
acaccatctccaaac

SEQ ID NO: 54480 - DNA, 15 bp, Homo sapiens
aacaccatctccaaa

SEQ ID NO: 54481 - DNA, 15 bp, Homo sapiens
aaacaccatctccaa

SEQ ID NO: 54482 - DNA, 15 bp, Homo sapiens
caaacaccatctcca

SEQ ID NO: 54483 - DNA, 15 bp, Homo sapiens
ccaaacaccatctcc

SEQ ID NO: 54484 - DNA, 15 bp, Homo sapiens
tccaaacaccatctc

SEQ ID NO: 54485 - DNA, 15 bp, Homo sapiens
ctccaaacaccatct

SEQ ID NO: 54486 - DNA, 15 bp, Homo sapiens
tctccaaacaccatc

SEQ ID NO: 54487 - DNA, 15 bp, Homo sapiens
ttctccaaacaccat

SEQ ID NO: 54488 - DNA, 15 bp, Homo sapiens
tttctccaaacacca

SEQ ID NO: 54489 - DNA, 15 bp, Homo sapiens
ttttctccaaacacc

SEQ ID NO: 54490 - DNA, 15 bp, Homo sapiens
tttttctccaaacac

SEQ ID NO: 54491 - DNA, 15 bp, Homo sapiens
gtttttctccaaaca

SEQ ID NO: 54492 - DNA, 15 bp, Homo sapiens
agtttttctccaaac

SEQ ID NO: 54493 - DNA, 15 bp, Homo sapiens
tagtttttctccaaa

SEQ ID NO: 54494 - DNA, 15 bp, Homo sapiens
gtagtttttctccaa

SEQ ID NO: 54495 - DNA, 15 bp, Homo sapiens
ggtagtttttctcca

SEQ ID NO: 54496 - DNA, 15 bp, Homo sapiens
tggtagtttttctcc

SEQ ID NO: 54497 - DNA, 15 bp, Homo sapiens
ttggtagtttttctc

SEQ ID NO: 54498 - DNA, 15 bp, Homo sapiens
tttggtagtttttct

SEQ ID NO: 54499 - DNA, 15 bp, Homo sapiens
gtttggtagtttttc

SEQ ID NO: 54500 - DNA, 15 bp, Homo sapiens
cgtttggtagttttt

SEQ ID NO: 54501 - DNA, 15 bp, Homo sapiens
acgtttggtagtttt

SEQ ID NO: 54502 - DNA, 15 bp, Homo sapiens
cacgtttggtagttt

SEQ ID NO: 54503 - DNA, 15 bp, Homo sapiens
ccacgtttggtagtt

SEQ ID NO: 54504 - DNA, 15 bp, Homo sapiens
cccacgtttggtagt

SEQ ID NO: 54505 - DNA, 15 bp, Homo sapiens
tcccacgtttggtag

SEQ ID NO: 54506 - DNA, 15 bp, Homo sapiens
atcccacgtttggta

SEQ ID NO: 54507 - DNA, 15 bp, Homo sapiens
catcccacgtttggt

SEQ ID NO: 54508 - DNA, 15 bp, Homo sapiens
tcatcccacgtttgg

SEQ ID NO: 54509 - DNA, 15 bp, Homo sapiens
gtcatcccacgtttg

SEQ ID NO: 54510 - DNA, 15 bp, Homo sapiens
agtcatcccacgttt

SEQ ID NO: 54511 - DNA, 15 bp, Homo sapiens
gagtcatcccacgtt

SEQ ID NO: 54512 - DNA, 15 bp, Homo sapiens
agagtcatcccacgt

SEQ ID NO: 54513 - DNA, 15 bp, Homo sapiens
cagagtcatcccacg

SEQ ID NO: 54514 - DNA, 15 bp, Homo sapiens
tcagagtcatcccac

SEQ ID NO: 54515 - DNA, 15 bp, Homo sapiens
ttcagagtcatccca

SEQ ID NO: 54516 - DNA, 15 bp, Homo sapiens
tttcagagtcatccc

SEQ ID NO: 54517 - DNA, 15 bp, Homo sapiens
ttttcagagtcatcc

SEQ ID NO: 54518 - DNA, 15 bp, Homo sapiens
gttttcagagtcatc

SEQ ID NO: 54519 - DNA, 15 bp, Homo sapiens
agttttcagagtcat

SEQ ID NO: 54520 - DNA, 15 bp, Homo sapiens
aagttttcagagtca

SEQ ID NO: 54521 - DNA, 15 bp, Homo sapiens
aaagttttcagagtc

SEQ ID NO: 54522 - DNA, 15 bp, Homo sapiens
aaaagttttcagagt

SEQ ID NO: 54523 - DNA, 15 bp, Homo sapiens
taaaagttttcagag

SEQ ID NO: 54524 - DNA, 15 bp, Homo sapiens
ataaaagttttcaga

SEQ ID NO: 54525 - DNA, 15 bp, Homo sapiens
aataaaagttttcag

SEQ ID NO: 54526 - DNA, 15 bp, Homo sapiens
aaataaaagttttca

SEQ ID NO: 54527 - DNA, 15 bp, Homo sapiens
aaaataaaagttttc

SEQ ID NO: 54528 - DNA, 15 bp, Homo sapiens
gaaaataaaagtttt

SEQ ID NO: 54529 - DNA, 15 bp, Homo sapiens
tgaaaataaaagttt

SEQ ID NO: 54530 - DNA, 15 bp, Homo sapiens
atgaaaataaaagtt

SEQ ID NO: 54531 - DNA, 15 bp, Homo sapiens
gatgaaaataaaagt

SEQ ID NO: 54532 - DNA, 15 bp, Homo sapiens
agatgaaaataaaag

SEQ ID NO: 54533 - DNA, 15 bp, Homo sapiens
tagatgaaaataaaa

SEQ ID NO: 54534 - DNA, 15 bp, Homo sapiens
ctagatgaaaataaa

SEQ ID NO: 54535 - DNA, 15 bp, Homo sapiens
gctagatgaaaataa

SEQ ID NO: 54536 - DNA, 15 bp, Homo sapiens
tgctagatgaaaata

SEQ ID NO: 54537 - DNA, 15 bp, Homo sapiens
ttgctagatgaaaat

SEQ ID NO: 54538 - DNA, 15 bp, Homo sapiens
cttgctagatgaaaa

SEQ ID NO: 54539 - DNA, 15 bp, Homo sapiens
tcttgctagatgaaa

SEQ ID NO: 54540 - DNA, 15 bp, Homo sapiens
ttcttgctagatgaa

SEQ ID NO: 54541 - DNA, 15 bp, Homo sapiens
tttcttgctagatga

SEQ ID NO: 54542 - DNA, 15 bp, Homo sapiens
atttcttgctagatg

SEQ ID NO: 54543 - DNA, 15 bp, Homo sapiens
gatttcttgctagat

SEQ ID NO: 54544 - DNA, 15 bp, Homo sapiens
tgatttcttgctaga

SEQ ID NO: 54545 - DNA, 15 bp, Homo sapiens
ttgatttcttgctag

SEQ ID NO: 54546 - DNA, 15 bp, Homo sapiens
tttgatttcttgcta

SEQ ID NO: 54547 - DNA, 15 bp, Homo sapiens
ttttgatttcttgct

SEQ ID NO: 54548 - DNA, 15 bp, Homo sapiens
gttttgatttcttgc

SEQ ID NO: 54549 - DNA, 15 bp, Homo sapiens
ggttttgatttcttg

SEQ ID NO: 54550 - DNA, 15 bp, Homo sapiens
aggttttgatttctt

SEQ ID NO: 54551 - DNA, 15 bp, Homo sapiens
taggttttgatttct

SEQ ID NO: 54552 - DNA, 15 bp, Homo sapiens
ctaggttttgatttc

SEQ ID NO: 54553 - DNA, 15 bp, Homo sapiens
tctaggttttgattt

SEQ ID NO: 54554 - DNA, 15 bp, Homo sapiens
ttctaggttttgatt

SEQ ID NO: 54555 - DNA, 15 bp, Homo sapiens
cttctaggttttgat

SEQ ID NO: 54556 - DNA, 15 bp, Homo sapiens
ccttctaggttttga

SEQ ID NO: 54557 - DNA, 15 bp, Homo sapiens
tccttctaggttttg

SEQ ID NO: 54558 - DNA, 15 bp, Homo sapiens
ttccttctaggtttt

SEQ ID NO: 54559 - DNA, 15 bp, Homo sapiens
attccttctaggttt

SEQ ID NO: 54560 - DNA, 15 bp, Homo sapiens
aattccttctaggtt

SEQ ID NO: 54561 - DNA, 15 bp, Homo sapiens
aaattccttctaggt

SEQ ID NO: 54562 - DNA, 15 bp, Homo sapiens
taaattccttctagg

SEQ ID NO: 54563 - DNA, 15 bp, Homo sapiens
ataaattccttctag

SEQ ID NO: 54564 - DNA, 15 bp, Homo sapiens
gataaattccttcta

SEQ ID NO: 54565 - DNA, 15 bp, Homo sapiens
agataaattccttct

SEQ ID NO: 54566 - DNA, 15 bp, Homo sapiens
cagataaattccttc

SEQ ID NO: 54567 - DNA, 15 bp, Homo sapiens
tcagataaattcctt

SEQ ID NO: 54568 - DNA, 15 bp, Homo sapiens
ctcagataaattcct

SEQ ID NO: 54569 - DNA, 15 bp, Homo sapiens
tctcagataaattcc

SEQ ID NO: 54570 - DNA, 15 bp, Homo sapiens
ttctcagataaattc

SEQ ID NO: 54571 - DNA, 15 bp, Homo sapiens
tttctcagataaatt

SEQ ID NO: 54572 - DNA, 15 bp, Homo sapiens
atttctcagataaat

SEQ ID NO: 54573 - DNA, 15 bp, Homo sapiens
aatttctcagataaa

SEQ ID NO: 54574 - DNA, 15 bp, Homo sapiens
taatttctcagataa

SEQ ID NO: 54575 - DNA, 15 bp, Homo sapiens
ataatttctcagata

SEQ ID NO: 54576 - DNA, 15 bp, Homo sapiens
cataatttctcagat

SEQ ID NO: 54577 - DNA, 15 bp, Homo sapiens
tcataatttctcaga

SEQ ID NO: 54578 - DNA, 15 bp, Homo sapiens
ttcataatttctcag

SEQ ID NO: 54579 - DNA, 15 bp, Homo sapiens
attcataatttctca

SEQ ID NO: 54580 - DNA, 15 bp, Homo sapiens
tattcataatttctc

SEQ ID NO: 54581 - DNA, 15 bp, Homo sapiens
atattcataatttct

SEQ ID NO: 54582 - DNA, 15 bp, Homo sapiens
aatattcataatttc

SEQ ID NO: 54583 - DNA, 15 bp, Homo sapiens
aaatattcataattt

SEQ ID NO: 54584 - DNA, 15 bp, Homo sapiens
caaatattcataatt

SEQ ID NO: 54585 - DNA, 15 bp, Homo sapiens
ccaaatattcataat

SEQ ID NO: 54586 - DNA, 15 bp, Homo sapiens
tccaaatattcataa

SEQ ID NO: 54587 - DNA, 15 bp, Homo sapiens
ctccaaatattcata

SEQ ID NO: 54588 - DNA, 15 bp, Homo sapiens
tctccaaatattcat

SEQ ID NO: 54589 - DNA, 15 bp, Homo sapiens
atctccaaatattca

SEQ ID NO: 54590 - DNA, 15 bp, Homo sapiens
catctccaaatattc

SEQ ID NO: 54591 - DNA, 15 bp, Homo sapiens
ccatctccaaatatt

SEQ ID NO: 54592 - DNA, 15 bp, Homo sapiens
cccatctccaaatat

SEQ ID NO: 54593 - DNA, 15 bp, Homo sapiens
tcccatctccaaata

SEQ ID NO: 54594 - DNA, 15 bp, Homo sapiens
ttcccatctccaaat

SEQ ID NO: 54595 - DNA, 15 bp, Homo sapiens
cttcccatctccaaa

SEQ ID NO: 54596 - DNA, 15 bp, Homo sapiens
gcttcccatctccaa

SEQ ID NO: 54597 - DNA, 15 bp, Homo sapiens
agcttcccatctcca

SEQ ID NO: 54598 - DNA, 15 bp, Homo sapiens
gagcttcccatctcc

SEQ ID NO: 54599 - DNA, 15 bp, Homo sapiens
tgagcttcccatctc

SEQ ID NO: 54600 - DNA, 15 bp, Homo sapiens
atgagcttcccatct

SEQ ID NO: 54601 - DNA, 15 bp, Homo sapiens
catgagcttcccatc

SEQ ID NO: 54602 - DNA, 15 bp, Homo sapiens
ccatgagcttcccat

SEQ ID NO: 54603 - DNA, 15 bp, Homo sapiens
gccatgagcttccca

SEQ ID NO: 54604 - DNA, 15 bp, Homo sapiens
tgccatgagcttccc

SEQ ID NO: 54605 - DNA, 15 bp, Homo sapiens
ctgccatgagcttcc

SEQ ID NO: 54606 - DNA, 15 bp, Homo sapiens
actgccatgagcttc

SEQ ID NO: 54607 - DNA, 15 bp, Homo sapiens
cactgccatgagctt

SEQ ID NO: 54608 - DNA, 15 bp, Homo sapiens
tcactgccatgagct

SEQ ID NO: 54609 - DNA, 15 bp, Homo sapiens
gtcactgccatgagc

SEQ ID NO: 54610 - DNA, 15 bp, Homo sapiens
tgtcactgccatgag

SEQ ID NO: 54611 - DNA, 15 bp, Homo sapiens
gtgtcactgccatga

SEQ ID NO: 54612 - DNA, 15 bp, Homo sapiens
agtgtcactgccatg

SEQ ID NO: 54613 - DNA, 15 bp, Homo sapiens
tagtgtcactgccat

SEQ ID NO: 54614 - DNA, 15 bp, Homo sapiens
ttagtgtcactgcca

SEQ ID NO: 54615 - DNA, 15 bp, Homo sapiens
tttagtgtcactgcc

SEQ ID NO: 54616 - DNA, 15 bp, Homo sapiens
gtttagtgtcactgc

SEQ ID NO: 54617 - DNA, 15 bp, Homo sapiens
tgtttagtgtcactg

SEQ ID NO: 54618 - DNA, 15 bp, Homo sapiens
atgtttagtgtcact

SEQ ID NO: 54619 - DNA, 15 bp, Homo sapiens
gatgtttagtgtcac

SEQ ID NO: 54620 - DNA, 15 bp, Homo sapiens
ggatgtttagtgtca

SEQ ID NO: 54621 - DNA, 15 bp, Homo sapiens
tggatgtttagtgtc

SEQ ID NO: 54622 - DNA, 15 bp, Homo sapiens
gtggatgtttagtgt

SEQ ID NO: 54623 - DNA, 15 bp, Homo sapiens
tgtggatgtttagtg

SEQ ID NO: 54624 - DNA, 15 bp, Homo sapiens
atgtggatgtttagt

SEQ ID NO: 54625 - DNA, 15 bp, Homo sapiens
aatgtggatgtttag

SEQ ID NO: 54626 - DNA, 15 bp, Homo sapiens
taatgtggatgttta

SEQ ID NO: 54627 - DNA, 15 bp, Homo sapiens
ataatgtggatgttt

SEQ ID NO: 54628 - DNA, 15 bp, Homo sapiens
aataatgtggatgtt

SEQ ID NO: 54629 - DNA, 15 bp, Homo sapiens
aaataatgtggatgt

SEQ ID NO: 54630 - DNA, 15 bp, Homo sapiens
aaaataatgtggatg

SEQ ID NO: 54631 - DNA, 15 bp, Homo sapiens
aaaaataatgtggat

SEQ ID NO: 54632 - DNA, 15 bp, Homo sapiens
aaaaaataatgtgga

SEQ ID NO: 54633 - DNA, 15 bp, Homo sapiens
gaaaaaataatgtgg

SEQ ID NO: 54634 - DNA, 15 bp, Homo sapiens
agaaaaaataatgtg

SEQ ID NO: 54635 - DNA, 15 bp, Homo sapiens
aagaaaaaataatgt

SEQ ID NO: 54636 - DNA, 15 bp, Homo sapiens
aaagaaaaaataatg

SEQ ID NO: 54637 - DNA, 15 bp, Homo sapiens
gaaagaaaaaataat

SEQ ID NO: 54638 - DNA, 15 bp, Homo sapiens
agaaagaaaaaataa

SEQ ID NO: 54639 - DNA, 15 bp, Homo sapiens
aagaaagaaaaaata

SEQ ID NO: 54640 - DNA, 15 bp, Homo sapiens
gaagaaagaaaaaat

SEQ ID NO: 54641 - DNA, 15 bp, Homo sapiens
agaagaaagaaaaaa

SEQ ID NO: 54642 - DNA, 15 bp, Homo sapiens
cagaagaaagaaaaa

SEQ ID NO: 54643 - DNA, 15 bp, Homo sapiens
ccagaagaaagaaaa

SEQ ID NO: 54644 - DNA, 15 bp, Homo sapiens
gccagaagaaagaaa

SEQ ID NO: 54645 - DNA, 15 bp, Homo sapiens
agccagaagaaagaa

SEQ ID NO: 54646 - DNA, 15 bp, Homo sapiens
cagccagaagaaaga

SEQ ID NO: 54647 - DNA, 15 bp, Homo sapiens
acagccagaagaaag

SEQ ID NO: 54648 - DNA, 15 bp, Homo sapiens
gacagccagaagaaa

SEQ ID NO: 54649 - DNA, 15 bp, Homo sapiens
agacagccagaagaa

SEQ ID NO: 54650 - DNA, 15 bp, Homo sapiens
aagacagccagaaga

SEQ ID NO: 54651 - DNA, 15 bp, Homo sapiens
taagacagccagaag

SEQ ID NO: 54652 - DNA, 15 bp, Homo sapiens
ttaagacagccagaa

SEQ ID NO: 54653 - DNA, 15 bp, Homo sapiens
cttaagacagccaga

SEQ ID NO: 54654 - DNA, 15 bp, Homo sapiens
tcttaagacagccag

SEQ ID NO: 54655 - DNA, 15 bp, Homo sapiens
gtcttaagacagcca

SEQ ID NO: 54656 - DNA, 15 bp, Homo sapiens
ggtcttaagacagcc

SEQ ID NO: 54657 - DNA, 15 bp, Homo sapiens
tggtcttaagacagc

SEQ ID NO: 54658 - DNA, 15 bp, Homo sapiens
atggtcttaagacag

SEQ ID NO: 54659 - DNA, 15 bp, Homo sapiens
tatggtcttaagaca

SEQ ID NO: 54660 - DNA, 15 bp, Homo sapiens
ttatggtcttaagac

SEQ ID NO: 54661 - DNA, 15 bp, Homo sapiens
cttatggtcttaaga

SEQ ID NO: 54662 - DNA, 15 bp, Homo sapiens
acttatggtcttaag

SEQ ID NO: 54663 - DNA, 15 bp, Homo sapiens
aacttatggtcttaa

SEQ ID NO: 54664 - DNA, 15 bp, Homo sapiens
caacttatggtctta

SEQ ID NO: 54665 - DNA, 15 bp, Homo sapiens
ccaacttatggtctt

SEQ ID NO: 54666 - DNA, 15 bp, Homo sapiens
tccaacttatggtct

SEQ ID NO: 54667 - DNA, 15 bp, Homo sapiens
atccaacttatggtc

SEQ ID NO: 54668 - DNA, 15 bp, Homo sapiens
aatccaacttatggt

SEQ ID NO: 54669 - DNA, 15 bp, Homo sapiens
caatccaacttatgg

SEQ ID NO: 54670 - DNA, 15 bp, Homo sapiens
gcaatccaacttatg

SEQ ID NO: 54671 - DNA, 15 bp, Homo sapiens
agcaatccaacttat

SEQ ID NO: 54672 - DNA, 15 bp, Homo sapiens
aagcaatccaactta

SEQ ID NO: 54673 - DNA, 15 bp, Homo sapiens
gaagcaatccaactt

SEQ ID NO: 54674 - DNA, 15 bp, Homo sapiens
ggaagcaatccaact

SEQ ID NO: 54675 - DNA, 15 bp, Homo sapiens
tggaagcaatccaac

SEQ ID NO: 54676 - DNA, 15 bp, Homo sapiens
ttggaagcaatccaa

SEQ ID NO: 54677 - DNA, 15 bp, Homo sapiens
attggaagcaatcca

SEQ ID NO: 54678 - DNA, 15 bp, Homo sapiens
aattggaagcaatcc

SEQ ID NO: 54679 - DNA, 15 bp, Homo sapiens
caattggaagcaatc

SEQ ID NO: 54680 - DNA, 15 bp, Homo sapiens
ccaattggaagcaat

SEQ ID NO: 54681 - DNA, 15 bp, Homo sapiens
cccaattggaagcaa

SEQ ID NO: 54682 - DNA, 15 bp, Homo sapiens
ccccaattggaagca

SEQ ID NO: 54683 - DNA, 15 bp, Homo sapiens
tccccaattggaagc

SEQ ID NO: 54684 - DNA, 15 bp, Homo sapiens
atccccaattggaag

SEQ ID NO: 54685 - DNA, 15 bp, Homo sapiens
tatccccaattggaa

SEQ ID NO: 54686 - DNA, 15 bp, Homo sapiens
ctatccccaattgga

SEQ ID NO: 54687 - DNA, 15 bp, Homo sapiens
actatccccaattgg

SEQ ID NO: 54688 - DNA, 15 bp, Homo sapiens
cactatccccaattg

SEQ ID NO: 54689 - DNA, 15 bp, Homo sapiens
tcactatccccaatt

SEQ ID NO: 54690 - DNA, 15 bp, Homo sapiens
ttcactatccccaat

SEQ ID NO: 54691 - DNA, 15 bp, Homo sapiens
tttcactatccccaa

SEQ ID NO: 54692 - DNA, 15 bp, Homo sapiens
ctttcactatcccca

SEQ ID NO: 54693 - DNA, 15 bp, Homo sapiens
tctttcactatcccc

SEQ ID NO: 54694 - DNA, 15 bp, Homo sapiens
ctctttcactatccc

SEQ ID NO: 54695 - DNA, 15 bp, Homo sapiens
cctctttcactatcc

SEQ ID NO: 54696 - DNA, 15 bp, Homo sapiens
ccctctttcactatc

SEQ ID NO: 54697 - DNA, 15 bp, Homo sapiens
tccctctttcactat

SEQ ID NO: 54698 - DNA, 15 bp, Homo sapiens
ctccctctttcacta

SEQ ID NO: 54699 - DNA, 15 bp, Homo sapiens
actccctctttcact

SEQ ID NO: 54700 - DNA, 15 bp, Homo sapiens
tactccctctttcac

SEQ ID NO: 54701 - DNA, 15 bp, Homo sapiens
ttactccctctttca

SEQ ID NO: 54702 - DNA, 15 bp, Homo sapiens
gttactccctctttc

SEQ ID NO: 54703 - DNA, 15 bp, Homo sapiens
tgttactccctcttt

SEQ ID NO: 54704 - DNA, 15 bp, Homo sapiens
gtgttactccctctt

SEQ ID NO: 54705 - DNA, 15 bp, Homo sapiens
tgtgttactccctct

SEQ ID NO: 54706 - DNA, 15 bp, Homo sapiens
atgtgttactccctc

SEQ ID NO: 54707 - DNA, 15 bp, Homo sapiens
aatgtgttactccct

SEQ ID NO: 54708 - DNA, 15 bp, Homo sapiens
aaatgtgttactccc

SEQ ID NO: 54709 - DNA, 15 bp, Homo sapiens
gaaatgtgttactcc

SEQ ID NO: 54710 - DNA, 15 bp, Homo sapiens
agaaatgtgttactc

SEQ ID NO: 54711 - DNA, 15 bp, Homo sapiens
tagaaatgtgttact

SEQ ID NO: 54712 - DNA, 15 bp, Homo sapiens
ctagaaatgtgttac

SEQ ID NO: 54713 - DNA, 15 bp, Homo sapiens
tctagaaatgtgtta

SEQ ID NO: 54714 - DNA, 15 bp, Homo sapiens
gtctagaaatgtgtt

SEQ ID NO: 54715 - DNA, 15 bp, Homo sapiens
agtctagaaatgtgt

SEQ ID NO: 54716 - DNA, 15 bp, Homo sapiens
cagtctagaaatgtg

SEQ ID NO: 54717 - DNA, 15 bp, Homo sapiens
ccagtctagaaatgt

SEQ ID NO: 54718 - DNA, 15 bp, Homo sapiens
cccagtctagaaatg

SEQ ID NO: 54719 - DNA, 15 bp, Homo sapiens
tcccagtctagaaat

SEQ ID NO: 54720 - DNA, 15 bp, Homo sapiens
ctcccagtctagaaa

SEQ ID NO: 54721 - DNA, 15 bp, Homo sapiens
tctcccagtctagaa

SEQ ID NO: 54722 - DNA, 15 bp, Homo sapiens
atctcccagtctaga

SEQ ID NO: 54723 - DNA, 15 bp, Homo sapiens
aatctcccagtctag

SEQ ID NO: 54724 - DNA, 15 bp, Homo sapiens
aaatctcccagtcta

SEQ ID NO: 54725 - DNA, 15 bp, Homo sapiens
gaaatctcccagtct

SEQ ID NO: 54726 - DNA, 15 bp, Homo sapiens
ggaaatctcccagtc

SEQ ID NO: 54727 - DNA, 15 bp, Homo sapiens
tggaaatctcccagt

SEQ ID NO: 54728 - DNA, 15 bp, Homo sapiens
atggaaatctcccag

SEQ ID NO: 54729 - DNA, 15 bp, Homo sapiens
tatggaaatctccca

SEQ ID NO: 54730 - DNA, 15 bp, Homo sapiens
ctatggaaatctccc

SEQ ID NO: 54731 - DNA, 15 bp, Homo sapiens
tctatggaaatctcc

SEQ ID NO: 54732 - DNA, 15 bp, Homo sapiens
gtctatggaaatctc

SEQ ID NO: 54733 - DNA, 15 bp, Homo sapiens
agtctatggaaatct

SEQ ID NO: 54734 - DNA, 15 bp, Homo sapiens
gagtctatggaaatc

SEQ ID NO: 54735 - DNA, 15 bp, Homo sapiens
ggagtctatggaaat

SEQ ID NO: 54736 - DNA, 15 bp, Homo sapiens
gggagtctatggaaa

SEQ ID NO: 54737 - DNA, 15 bp, Homo sapiens
tgggagtctatggaa

SEQ ID NO: 54738 - DNA, 15 bp, Homo sapiens
atgggagtctatgga

SEQ ID NO: 54739 - DNA, 15 bp, Homo sapiens
catgggagtctatgg

SEQ ID NO: 54740 - DNA, 15 bp, Homo sapiens
acatgggagtctatg

SEQ ID NO: 54741 - DNA, 15 bp, Homo sapiens
cacatgggagtctat

SEQ ID NO: 54742 - DNA, 15 bp, Homo sapiens
ccacatgggagtcta

SEQ ID NO: 54743 - DNA, 15 bp, Homo sapiens
gccacatgggagtct

SEQ ID NO: 54744 - DNA, 15 bp, Homo sapiens
agccacatgggagtc

SEQ ID NO: 54745 - DNA, 15 bp, Homo sapiens
aagccacatgggagt

SEQ ID NO: 54746 - DNA, 15 bp, Homo sapiens
taagccacatgggag

SEQ ID NO: 54747 - DNA, 15 bp, Homo sapiens
ttaagccacatggga

SEQ ID NO: 54748 - DNA, 15 bp, Homo sapiens
gttaagccacatggg

SEQ ID NO: 54749 - DNA, 15 bp, Homo sapiens
agttaagccacatgg

SEQ ID NO: 54750 - DNA, 15 bp, Homo sapiens
gagttaagccacatg

SEQ ID NO: 54751 - DNA, 15 bp, Homo sapiens
agagttaagccacat

SEQ ID NO: 54752 - DNA, 15 bp, Homo sapiens
aagagttaagccaca

SEQ ID NO: 54753 - DNA, 15 bp, Homo sapiens
caagagttaagccac

SEQ ID NO: 54754 - DNA, 15 bp, Homo sapiens
gcaagagttaagcca

SEQ ID NO: 54755 - DNA, 15 bp, Homo sapiens
agcaagagttaagcc

SEQ ID NO: 54756 - DNA, 15 bp, Homo sapiens
cagcaagagttaagc

SEQ ID NO: 54757 - DNA, 15 bp, Homo sapiens
tcagcaagagttaag

SEQ ID NO: 54758 - DNA, 15 bp, Homo sapiens
ctcagcaagagttaa

SEQ ID NO: 54759 - DNA, 15 bp, Homo sapiens
gctcagcaagagtta

SEQ ID NO: 54760 - DNA, 15 bp, Homo sapiens
agctcagcaagagtt

SEQ ID NO: 54761 - DNA, 15 bp, Homo sapiens
cagctcagcaagagt

SEQ ID NO: 54762 - DNA, 15 bp, Homo sapiens
ccagctcagcaagag

SEQ ID NO: 54763 - DNA, 15 bp, Homo sapiens
cccagctcagcaaga

SEQ ID NO: 54764 - DNA, 15 bp, Homo sapiens
ccccagctcagcaag

SEQ ID NO: 54765 - DNA, 15 bp, Homo sapiens
tccccagctcagcaa

SEQ ID NO: 54766 - DNA, 15 bp, Homo sapiens
ttccccagctcagca

SEQ ID NO: 54767 - DNA, 15 bp, Homo sapiens
tttccccagctcagc

SEQ ID NO: 54768 - DNA, 15 bp, Homo sapiens
ctttccccagctcag

SEQ ID NO: 54769 - DNA, 15 bp, Homo sapiens
tctttccccagctca

SEQ ID NO: 54770 - DNA, 15 bp, Homo sapiens
gtctttccccagctc

SEQ ID NO: 54771 - DNA, 15 bp, Homo sapiens
ggtctttccccagct

SEQ ID NO: 54772 - DNA, 15 bp, Homo sapiens
cggtctttccccagc

SEQ ID NO: 54773 - DNA, 15 bp, Homo sapiens
acggtctttccccag

SEQ ID NO: 54774 - DNA, 15 bp, Homo sapiens
tacggtctttcccca

SEQ ID NO: 54775 - DNA, 15 bp, Homo sapiens
atacggtctttcccc

SEQ ID NO: 54776 - DNA, 15 bp, Homo sapiens
aatacggtctttccc

SEQ ID NO: 54777 - DNA, 15 bp, Homo sapiens
gaatacggtctttcc

SEQ ID NO: 54778 - DNA, 15 bp, Homo sapiens
tgaatacggtctttc

SEQ ID NO: 54779 - DNA, 15 bp, Homo sapiens
atgaatacggtcttt

SEQ ID NO: 54780 - DNA, 15 bp, Homo sapiens
catgaatacggtctt

SEQ ID NO: 54781 - DNA, 15 bp, Homo sapiens
gcatgaatacggtct

SEQ ID NO: 54782 - DNA, 15 bp, Homo sapiens
ggcatgaatacggtc

SEQ ID NO: 54783 - DNA, 15 bp, Homo sapiens
aggcatgaatacggt

SEQ ID NO: 54784 - DNA, 15 bp, Homo sapiens
caggcatgaatacgg

SEQ ID NO: 54785 - DNA, 15 bp, Homo sapiens
ccaggcatgaatacg

SEQ ID NO: 54786 - DNA, 15 bp, Homo sapiens
accaggcatgaatac

SEQ ID NO: 54787 - DNA, 15 bp, Homo sapiens
taccaggcatgaata

SEQ ID NO: 54788 - DNA, 15 bp, Homo sapiens
ataccaggcatgaat

SEQ ID NO: 54789 - DNA, 15 bp, Homo sapiens
aataccaggcatgaa

SEQ ID NO: 54790 - DNA, 15 bp, Homo sapiens
taataccaggcatga

SEQ ID NO: 54791 - DNA, 15 bp, Homo sapiens
gtaataccaggcatg

SEQ ID NO: 54792 - DNA, 15 bp, Homo sapiens
agtaataccaggcat

SEQ ID NO: 54793 - DNA, 15 bp, Homo sapiens
tagtaataccaggca

SEQ ID NO: 54794 - DNA, 15 bp, Homo sapiens
ctagtaataccaggc

SEQ ID NO: 54795 - DNA, 15 bp, Homo sapiens
cctagtaataccagg

SEQ ID NO: 54796 - DNA, 15 bp, Homo sapiens
acctagtaataccag

SEQ ID NO: 54797 - DNA, 15 bp, Homo sapiens
tacctagtaatacca

SEQ ID NO: 54798 - DNA, 15 bp, Homo sapiens
ttacctagtaatacc

SEQ ID NO: 54799 - DNA, 15 bp, Homo sapiens
attacctagtaatac

SEQ ID NO: 54800 - DNA, 15 bp, Homo sapiens
cattacctagtaata

SEQ ID NO: 54801 - DNA, 15 bp, Homo sapiens
gcattacctagtaat

SEQ ID NO: 54802 - DNA, 15 bp, Homo sapiens
cgcattacctagtaa

SEQ ID NO: 54803 - DNA, 15 bp, Homo sapiens
tcgcattacctagta

SEQ ID NO: 54804 - DNA, 15 bp, Homo sapiens
ctcgcattacctagt

SEQ ID NO: 54805 - DNA, 15 bp, Homo sapiens
cctcgcattacctag

SEQ ID NO: 54806 - DNA, 15 bp, Homo sapiens
tcctcgcattaccta

SEQ ID NO: 54807 - DNA, 15 bp, Homo sapiens
atcctcgcattacct

SEQ ID NO: 54808 - DNA, 15 bp, Homo sapiens
tatcctcgcattacc

SEQ ID NO: 54809 - DNA, 15 bp, Homo sapiens
ctatcctcgcattac

SEQ ID NO: 54810 - DNA, 15 bp, Homo sapiens
tctatcctcgcatta

SEQ ID NO: 54811 - DNA, 15 bp, Homo sapiens
ttctatcctcgcatt

SEQ ID NO: 54812 - DNA, 15 bp, Homo sapiens
gttctatcctcgcat

SEQ ID NO: 54813 - DNA, 15 bp, Homo sapiens
tgttctatcctcgca

SEQ ID NO: 54814 - DNA, 15 bp, Homo sapiens
ttgttctatcctcgc

SEQ ID NO: 54815 - DNA, 15 bp, Homo sapiens
cttgttctatcctcg

SEQ ID NO: 54816 - DNA, 15 bp, Homo sapiens
tcttgttctatcctc

SEQ ID NO: 54817 - DNA, 15 bp, Homo sapiens
ttcttgttctatcct

SEQ ID NO: 54818 - DNA, 15 bp, Homo sapiens
tttcttgttctatcc

SEQ ID NO: 54819 - DNA, 15 bp, Homo sapiens
ttttcttgttctatc

SEQ ID NO: 54820 - DNA, 15 bp, Homo sapiens
tttttcttgttctat

SEQ ID NO: 54821 - DNA, 15 bp, Homo sapiens
ttttttcttgttcta

SEQ ID NO: 54822 - DNA, 15 bp, Homo sapiens
tttttttcttgttct

SEQ ID NO: 54823 - DNA, 15 bp, Homo sapiens
ttttttttcttgttc

SEQ ID NO: 54824 - DNA, 15 bp, Homo sapiens
tttttttttcttgtt

SEQ ID NO: 54825 - DNA, 15 bp, Homo sapiens
atttttttttcttgt

SEQ ID NO: 54826 - DNA, 15 bp, Homo sapiens
tatttttttttcttg

SEQ ID NO: 54827 - DNA, 15 bp, Homo sapiens
ttatttttttttctt

SEQ ID NO: 54828 - DNA, 15 bp, Homo sapiens
tttatttttttttct

SEQ ID NO: 54829 - DNA, 15 bp, Homo sapiens
atttatttttttttc

SEQ ID NO: 54830 - DNA, 15 bp, Homo sapiens
gatttattttttttt

SEQ ID NO: 54831 - DNA, 15 bp, Homo sapiens
ggatttatttttttt

SEQ ID NO: 54832 - DNA, 15 bp, Homo sapiens
gggatttattttttt

SEQ ID NO: 54833 - DNA, 15 bp, Homo sapiens
cgggatttatttttt

SEQ ID NO: 54834 - DNA, 15 bp, Homo sapiens
acgggatttattttt

SEQ ID NO: 54835 - DNA, 15 bp, Homo sapiens
aacgggatttatttt

SEQ ID NO: 54836 - DNA, 15 bp, Homo sapiens
caacgggatttattt

SEQ ID NO: 54837 - DNA, 15 bp, Homo sapiens
tcaacgggatttatt

SEQ ID NO: 54838 - DNA, 15 bp, Homo sapiens
ttcaacgggatttat

SEQ ID NO: 54839 - DNA, 15 bp, Homo sapiens
cttcaacgggattta

SEQ ID NO: 54840 - DNA, 15 bp, Homo sapiens
ccttcaacgggattt

SEQ ID NO: 54841 - DNA, 15 bp, Homo sapiens
cccttcaacgggatt

SEQ ID NO: 54842 - DNA, 15 bp, Homo sapiens
tcccttcaacgggat

SEQ ID NO: 54843 - DNA, 15 bp, Homo sapiens
ttcccttcaacggga

SEQ ID NO: 54844 - DNA, 15 bp, Homo sapiens
gttcccttcaacggg

SEQ ID NO: 54845 - DNA, 15 bp, Homo sapiens
cgttcccttcaacgg

SEQ ID NO: 54846 - DNA, 15 bp, Homo sapiens
tcgttcccttcaacg

SEQ ID NO: 54847 - DNA, 15 bp, Homo sapiens
ttcgttcccttcaac

SEQ ID NO: 54848 - DNA, 15 bp, Homo sapiens
attcgttcccttcaa

SEQ ID NO: 54849 - DNA, 15 bp, Homo sapiens
aattcgttcccttca

SEQ ID NO: 54850 - DNA, 15 bp, Homo sapiens
aaattcgttcccttc

SEQ ID NO: 54851 - DNA, 15 bp, Homo sapiens
aaaattcgttccctt

SEQ ID NO: 54852 - DNA, 15 bp, Homo sapiens
aaaaattcgttccct

SEQ ID NO: 54853 - DNA, 15 bp, Homo sapiens
aaaaaattcgttccc

SEQ ID NO: 54854 - DNA, 15 bp, Homo sapiens
aaaaaaattcgttcc

SEQ ID NO: 54855 - DNA, 15 bp, Homo sapiens
aaaaaaaattcgttc

SEQ ID NO: 54856 - DNA, 15 bp, Homo sapiens
aaaaaaaaattcgtt

SEQ ID NO: 54857 - DNA, 15 bp, Homo sapiens
aaaaaaaaaattcgt

SEQ ID NO: 54858 - DNA, 15 bp, Homo sapiens
gaaaaaaaaaattcg

SEQ ID NO: 54859 - DNA, 15 bp, Homo sapiens
tgaaaaaaaaaattc

SEQ ID NO: 54860 - DNA, 15 bp, Homo sapiens
atgaaaaaaaaaatt

SEQ ID NO: 54861 - DNA, 15 bp, Homo sapiens
aatgaaaaaaaaaat

SEQ ID NO: 54862 - DNA, 15 bp, Homo sapiens
aaaatgaaaaaaaaa

SEQ ID NO: 54863 - DNA, 15 bp, Homo sapiens
aaaaatgaaaaaaaa

SEQ ID NO: 54864 - DNA, 15 bp, Homo sapiens
taaaaatgaaaaaaa

SEQ ID NO: 54865 - DNA, 15 bp, Homo sapiens
ttaaaaatgaaaaaa

SEQ ID NO: 54866 - DNA, 15 bp, Homo sapiens
tttaaaaatgaaaaa

SEQ ID NO: 54867 - DNA, 15 bp, Homo sapiens
ttttaaaaatgaaaa

SEQ ID NO: 54868 - DNA, 15 bp, Homo sapiens
tttttaaaaatgaaa

SEQ ID NO: 54869 - DNA, 15 bp, Homo sapiens
atttttaaaaatgaa

SEQ ID NO: 54870 - DNA, 15 bp, Homo sapiens
ggatttttaaaaatg

SEQ ID NO: 54871 - DNA, 15 bp, Homo sapiens
tggatttttaaaaat

SEQ ID NO: 54872 - DNA, 15 bp, Homo sapiens
atggatttttaaaaa

SEQ ID NO: 54873 - DNA, 15 bp, Homo sapiens
catggatttttaaaa

SEQ ID NO: 54874 - DNA, 15 bp, Homo sapiens
acatggatttttaaa

SEQ ID NO: 54875 - DNA, 15 bp, Homo sapiens
gacatggatttttaa

SEQ ID NO: 54876 - DNA, 15 bp, Homo sapiens
ggacatggattttta

SEQ ID NO: 54877 - DNA, 15 bp, Homo sapiens
aggacatggattttt

SEQ ID NO: 54878 - DNA, 15 bp, Homo sapiens
aaggacatggatttt

SEQ ID NO: 54879 - DNA, 15 bp, Homo sapiens
aaaggacatggattt

SEQ ID NO: 54880 - DNA, 15 bp, Homo sapiens
caaaggacatggatt

SEQ ID NO: 54881 - DNA, 15 bp, Homo sapiens
ccaaaggacatggat

SEQ ID NO: 54882 - DNA, 15 bp, Homo sapiens
accaaaggacatgga

SEQ ID NO: 54883 - DNA, 15 bp, Homo sapiens
taccaaaggacatgg

SEQ ID NO: 54884 - DNA, 15 bp, Homo sapiens
gtaccaaaggacatg

SEQ ID NO: 54885 - DNA, 15 bp, Homo sapiens
tgtaccaaaggacat

SEQ ID NO: 54886 - DNA, 15 bp, Homo sapiens
atgtaccaaaggaca

SEQ ID NO: 54887 - DNA, 15 bp, Homo sapiens
aatgtaccaaaggac

SEQ ID NO: 54888 - DNA, 15 bp, Homo sapiens
caatgtaccaaagga

SEQ ID NO: 54889 - DNA, 15 bp, Homo sapiens
acaatgtaccaaagg

SEQ ID NO: 54890 - DNA, 15 bp, Homo sapiens
cacaatgtaccaaag

SEQ ID NO: 54891 - DNA, 15 bp, Homo sapiens
ccacaatgtaccaaa

SEQ ID NO: 54892 - DNA, 15 bp, Homo sapiens
accacaatgtaccaa

SEQ ID NO: 54893 - DNA, 15 bp, Homo sapiens
caccacaatgtacca

SEQ ID NO: 54894 - DNA, 15 bp, Homo sapiens
ccaccacaatgtacc

SEQ ID NO: 54895 - DNA, 15 bp, Homo sapiens
cccaccacaatgtac

SEQ ID NO: 54896 - DNA, 15 bp, Homo sapiens
acccaccacaatgta

SEQ ID NO: 54897 - DNA, 15 bp, Homo sapiens
aacccaccacaatgt

SEQ ID NO: 54898 - DNA, 15 bp, Homo sapiens
aaacccaccacaatg

SEQ ID NO: 54899 - DNA, 15 bp, Homo sapiens
aaaacccaccacaat

SEQ ID NO: 54900 - DNA, 15 bp, Homo sapiens
taaaacccaccacaa

SEQ ID NO: 54901 - DNA, 15 bp, Homo sapiens
gtaaaacccaccaca

SEQ ID NO: 54902 - DNA, 15 bp, Homo sapiens
tgtaaaacccaccac

SEQ ID NO: 54903 - DNA, 15 bp, Homo sapiens
ttgtaaaacccacca

SEQ ID NO: 54904 - DNA, 15 bp, Homo sapiens
attgtaaaacccacc

SEQ ID NO: 54905 - DNA, 15 bp, Homo sapiens
tattgtaaaacccac

SEQ ID NO: 54906 - DNA, 15 bp, Homo sapiens
atattgtaaaaccca

SEQ ID NO: 54907 - DNA, 15 bp, Homo sapiens
tatattgtaaaaccc

SEQ ID NO: 54908 - DNA, 15 bp, Homo sapiens
ttatattgtaaaacc

SEQ ID NO: 54909 - DNA, 15 bp, Homo sapiens
attatattgtaaaac

SEQ ID NO: 54910 - DNA, 15 bp, Homo sapiens
aattatattgtaaaa

SEQ ID NO: 54911 - DNA, 15 bp, Homo sapiens
aaattatattgtaaa

SEQ ID NO: 54912 - DNA, 15 bp, Homo sapiens
aaaattatattgtaa

SEQ ID NO: 54913 - DNA, 15 bp, Homo sapiens
aaaaattatattgta

SEQ ID NO: 54914 - DNA, 15 bp, Homo sapiens
gaaaaattatattgt

SEQ ID NO: 54915 - DNA, 15 bp, Homo sapiens
tgaaaaattatattg

SEQ ID NO: 54916 - DNA, 15 bp, Homo sapiens
ctgaaaaattatatt

SEQ ID NO: 54917 - DNA, 15 bp, Homo sapiens
actgaaaaattatat

SEQ ID NO: 54918 - DNA, 15 bp, Homo sapiens
cactgaaaaattata

SEQ ID NO: 54919 - DNA, 15 bp, Homo sapiens
ccactgaaaaattat

SEQ ID NO: 54920 - DNA, 15 bp, Homo sapiens
cccactgaaaaatta

SEQ ID NO: 54921 - DNA, 15 bp, Homo sapiens
acccactgaaaaatt

SEQ ID NO: 54922 - DNA, 15 bp, Homo sapiens
gacccactgaaaaat

SEQ ID NO: 54923 - DNA, 15 bp, Homo sapiens
ggacccactgaaaaa

SEQ ID NO: 54924 - DNA, 15 bp, Homo sapiens
tggacccactgaaaa

SEQ ID NO: 54925 - DNA, 15 bp, Homo sapiens
gtggacccactgaaa

SEQ ID NO: 54926 - DNA, 15 bp, Homo sapiens
agtggacccactgaa

SEQ ID NO: 54927 - DNA, 15 bp, Homo sapiens
tagtggacccactga

SEQ ID NO: 54928 - DNA, 15 bp, Homo sapiens
gtagtggacccactg

SEQ ID NO: 54929 - DNA, 15 bp, Homo sapiens
agtagtggacccact

SEQ ID NO: 54930 - DNA, 15 bp, Homo sapiens
aagtagtggacccac

SEQ ID NO: 54931 - DNA, 15 bp, Homo sapiens
gaagtagtggaccca

SEQ ID NO: 54932 - DNA, 15 bp, Homo sapiens
ggaagtagtggaccc

SEQ ID NO: 54933 - DNA, 15 bp, Homo sapiens
gggaagtagtggacc

SEQ ID NO: 54934 - DNA, 15 bp, Homo sapiens
agggaagtagtggac

SEQ ID NO: 54935 - DNA, 15 bp, Homo sapiens
tagggaagtagtgga

SEQ ID NO: 54936 - DNA, 15 bp, Homo sapiens
gtagggaagtagtgg

SEQ ID NO: 54937 - DNA, 15 bp, Homo sapiens
tgtagggaagtagtg

SEQ ID NO: 54938 - DNA, 15 bp, Homo sapiens
ctgtagggaagtagt

SEQ ID NO: 54939 - DNA, 15 bp, Homo sapiens
actgtagggaagtag

SEQ ID NO: 54940 - DNA, 15 bp, Homo sapiens
cactgtagggaagta

SEQ ID NO: 54941 - DNA, 15 bp, Homo sapiens
acactgtagggaagt

SEQ ID NO: 54942 - DNA, 15 bp, Homo sapiens
cacactgtagggaag

SEQ ID NO: 54943 - DNA, 15 bp, Homo sapiens
ccacactgtagggaa

SEQ ID NO: 54944 - DNA, 15 bp, Homo sapiens
cccacactgtaggga

SEQ ID NO: 54945 - DNA, 15 bp, Homo sapiens
acccacactgtaggg

SEQ ID NO: 54946 - DNA, 15 bp, Homo sapiens
aacccacactgtagg

SEQ ID NO: 54947 - DNA, 15 bp, Homo sapiens
gaacccacactgtag

SEQ ID NO: 54948 - DNA, 15 bp, Homo sapiens
ggaacccacactgta

SEQ ID NO: 54949 - DNA, 15 bp, Homo sapiens
aggaacccacactgt

SEQ ID NO: 54950 - DNA, 15 bp, Homo sapiens
taggaacccacactg

SEQ ID NO: 54951 - DNA, 15 bp, Homo sapiens
ttaggaacccacact

SEQ ID NO: 54952 - DNA, 15 bp, Homo sapiens
tttaggaacccacac

SEQ ID NO: 54953 - DNA, 15 bp, Homo sapiens
gtttaggaacccaca

SEQ ID NO: 54954 - DNA, 15 bp, Homo sapiens
tgtttaggaacccac

SEQ ID NO: 54955 - DNA, 15 bp, Homo sapiens
ctgtttaggaaccca

SEQ ID NO: 54956 - DNA, 15 bp, Homo sapiens
tctgtttaggaaccc

SEQ ID NO: 54957 - DNA, 15 bp, Homo sapiens
ctctgtttaggaacc

SEQ ID NO: 54958 - DNA, 15 bp, Homo sapiens
gctctgtttaggaac

SEQ ID NO: 54959 - DNA, 15 bp, Homo sapiens
tgctctgtttaggaa

SEQ ID NO: 54960 - DNA, 15 bp, Homo sapiens
ttgctctgtttagga

SEQ ID NO: 54961 - DNA, 15 bp, Homo sapiens
gttgctctgtttagg

SEQ ID NO: 54962 - DNA, 15 bp, Homo sapiens
tgttgctctgtttag

SEQ ID NO: 54963 - DNA, 15 bp, Homo sapiens
ctgttgctctgttta

SEQ ID NO: 54964 - DNA, 15 bp, Homo sapiens
cctgttgctctgttt

SEQ ID NO: 54965 - DNA, 15 bp, Homo sapiens
tcctgttgctctgtt

SEQ ID NO: 54966 - DNA, 15 bp, Homo sapiens
gtcctgttgctctgt

SEQ ID NO: 54967 - DNA, 15 bp, Homo sapiens
ggtcctgttgctctg

SEQ ID NO: 54968 - DNA, 15 bp, Homo sapiens
aggtcctgttgctct

SEQ ID NO: 54969 - DNA, 15 bp, Homo sapiens
gaggtcctgttgctc

SEQ ID NO: 54970 - DNA, 15 bp, Homo sapiens
agaggtcctgttgct

SEQ ID NO: 54971 - DNA, 15 bp, Homo sapiens
cagaggtcctgttgc

SEQ ID NO: 54972 - DNA, 15 bp, Homo sapiens
acagaggtcctgttg

SEQ ID NO: 54973 - DNA, 15 bp, Homo sapiens
cacagaggtcctgtt

SEQ ID NO: 54974 - DNA, 15 bp, Homo sapiens
gcacagaggtcctgt

SEQ ID NO: 54975 - DNA, 15 bp, Homo sapiens
cagcacagaggtcct

SEQ ID NO: 54976 - DNA, 15 bp, Homo sapiens
tcagcacagaggtcc

SEQ ID NO: 54977 - DNA, 15 bp, Homo sapiens
ctcagcacagaggtc

SEQ ID NO: 54978 - DNA, 15 bp, Homo sapiens
tctcagcacagaggt

SEQ ID NO: 54979 - DNA, 15 bp, Homo sapiens
ttctcagcacagagg

SEQ ID NO: 54980 - DNA, 15 bp, Homo sapiens
tttctcagcacagag

SEQ ID NO: 54981 - DNA, 15 bp, Homo sapiens
atttctcagcacaga

SEQ ID NO: 54982 - DNA, 15 bp, Homo sapiens
gatttctcagcacag

SEQ ID NO: 54983 - DNA, 15 bp, Homo sapiens
ggatttctcagcaca

SEQ ID NO: 54984 - DNA, 15 bp, Homo sapiens
tggatttctcagcac

SEQ ID NO: 54985 - DNA, 15 bp, Homo sapiens
ttggatttctcagca

SEQ ID NO: 54986 - DNA, 15 bp, Homo sapiens
tttggatttctcagc

SEQ ID NO: 54987 - DNA, 15 bp, Homo sapiens
gtttggatttctcag

SEQ ID NO: 54988 - DNA, 15 bp, Homo sapiens
tgtttggatttctca

SEQ ID NO: 54989 - DNA, 15 bp, Homo sapiens
ctgtttggatttctc

SEQ ID NO: 54990 - DNA, 15 bp, Homo sapiens
tctgtttggatttct

SEQ ID NO: 54991 - DNA, 15 bp, Homo sapiens
gtctgtttggatttc

SEQ ID NO: 54992 - DNA, 15 bp, Homo sapiens
tgtctgtttggattt

SEQ ID NO: 54993 - DNA, 15 bp, Homo sapiens
gtgtctgtttggatt

SEQ ID NO: 54994 - DNA, 15 bp, Homo sapiens
agtgtctgtttggat

SEQ ID NO: 54995 - DNA, 15 bp, Homo sapiens
cagtgtctgtttgga

SEQ ID NO: 54996 - DNA, 15 bp, Homo sapiens
tcagtgtctgtttgg

SEQ ID NO: 54997 - DNA, 15 bp, Homo sapiens
atcagtgtctgtttg

SEQ ID NO: 54998 - DNA, 15 bp, Homo sapiens
catcagtgtctgttt

SEQ ID NO: 54999 - DNA, 15 bp, Homo sapiens
ccatcagtgtctgtt

SEQ ID NO: 55000 - DNA, 15 bp, Homo sapiens
gccatcagtgtctgt

SEQ ID NO: 55001 - DNA, 15 bp, Homo sapiens
tgccatcagtgtctg

SEQ ID NO: 55002 - DNA, 15 bp, Homo sapiens
gtgccatcagtgtct

SEQ ID NO: 55003 - DNA, 15 bp, Homo sapiens
ggtgccatcagtgtc

SEQ ID NO: 55004 - DNA, 15 bp, Homo sapiens
aggtgccatcagtgt

SEQ ID NO: 55005 - DNA, 15 bp, Homo sapiens
aaggtgccatcagtg

SEQ ID NO: 55006 - DNA, 15 bp, Homo sapiens
gaaggtgccatcagt

SEQ ID NO: 55007 - DNA, 15 bp, Homo sapiens
agaaggtgccatcag

SEQ ID NO: 55008 - DNA, 15 bp, Homo sapiens
cagaaggtgccatca

SEQ ID NO: 55009 - DNA, 15 bp, Homo sapiens
gcagaaggtgccatc

SEQ ID NO: 55010 - DNA, 15 bp, Homo sapiens
ggcagaaggtgccat

SEQ ID NO: 55011 - DNA, 15 bp, Homo sapiens
tggcagaaggtgcca

SEQ ID NO: 55012 - DNA, 15 bp, Homo sapiens
atggcagaaggtgcc

SEQ ID NO: 55013 - DNA, 15 bp, Homo sapiens
aatggcagaaggtgc

SEQ ID NO: 55014 - DNA, 15 bp, Homo sapiens
aaatggcagaaggtg

SEQ ID NO: 55015 - DNA, 15 bp, Homo sapiens
taaatggcagaaggt

SEQ ID NO: 55016 - DNA, 15 bp, Homo sapiens
ctaaatggcagaagg

SEQ ID NO: 55017 - DNA, 15 bp, Homo sapiens
cctaaatggcagaag

SEQ ID NO: 55018 - DNA, 15 bp, Homo sapiens
tcctaaatggcagaa

SEQ ID NO: 55019 - DNA, 15 bp, Homo sapiens
ttcctaaatggcaga

SEQ ID NO: 55020 - DNA, 15 bp, Homo sapiens
attcctaaatggcag

SEQ ID NO: 55021 - DNA, 15 bp, Homo sapiens
aattcctaaatggca

SEQ ID NO: 55022 - DNA, 15 bp, Homo sapiens
aaattcctaaatggc

SEQ ID NO: 55023 - DNA, 15 bp, Homo sapiens
caaattcctaaatgg

SEQ ID NO: 55024 - DNA, 15 bp, Homo sapiens
acaaattcctaaatg

SEQ ID NO: 55025 - DNA, 15 bp, Homo sapiens
aacaaattcctaaat

SEQ ID NO: 55026 - DNA, 15 bp, Homo sapiens
aaacaaattcctaaa

SEQ ID NO: 55027 - DNA, 15 bp, Homo sapiens
aaaacaaattcctaa

SEQ ID NO: 55028 - DNA, 15 bp, Homo sapiens
taaaacaaattccta

SEQ ID NO: 55029 - DNA, 15 bp, Homo sapiens
ttaaaacaaattcct

SEQ ID NO: 55030 - DNA, 15 bp, Homo sapiens
tttaaaacaaattcc

SEQ ID NO: 55031 - DNA, 15 bp, Homo sapiens
ttttaaaacaaattc

SEQ ID NO: 55032 - DNA, 15 bp, Homo sapiens
gttttaaaacaaatt

SEQ ID NO: 55033 - DNA, 15 bp, Homo sapiens
tgttttaaaacaaat

SEQ ID NO: 55034 - DNA, 15 bp, Homo sapiens
ctgttttaaaacaaa

SEQ ID NO: 55035 - DNA, 15 bp, Homo sapiens
tctgttttaaaacaa

SEQ ID NO: 55036 - DNA, 15 bp, Homo sapiens
gtctgttttaaaaca

SEQ ID NO: 55037 - DNA, 15 bp, Homo sapiens
tgtctgttttaaaac

SEQ ID NO: 55038 - DNA, 15 bp, Homo sapiens
atgtctgttttaaaa

SEQ ID NO: 55039 - DNA, 15 bp, Homo sapiens
aatgtctgttttaaa

SEQ ID NO: 55040 - DNA, 15 bp, Homo sapiens
aaatgtctgttttaa

SEQ ID NO: 55041 - DNA, 15 bp, Homo sapiens
caaatgtctgtttta

SEQ ID NO: 55042 - DNA, 15 bp, Homo sapiens
acaaatgtctgtttt

SEQ ID NO: 55043 - DNA, 15 bp, Homo sapiens
gacaaatgtctgttt

SEQ ID NO: 55044 - DNA, 15 bp, Homo sapiens
agacaaatgtctgtt

SEQ ID NO: 55045 - DNA, 15 bp, Homo sapiens
tagacaaatgtctgt

SEQ ID NO: 55046 - DNA, 15 bp, Homo sapiens
ctagacaaatgtctg

SEQ ID NO: 55047 - DNA, 15 bp, Homo sapiens
tctagacaaatgtct

SEQ ID NO: 55048 - DNA, 15 bp, Homo sapiens
atctagacaaatgtc

SEQ ID NO: 55049 - DNA, 15 bp, Homo sapiens
tatctagacaaatgt

SEQ ID NO: 55050 - DNA, 15 bp, Homo sapiens
atatctagacaaatg

SEQ ID NO: 55051 - DNA, 15 bp, Homo sapiens
aatatctagacaaat

SEQ ID NO: 55052 - DNA, 15 bp, Homo sapiens
aaatatctagacaaa

SEQ ID NO: 55053 - DNA, 15 bp, Homo sapiens
gaaatatctagacaa

SEQ ID NO: 55054 - DNA, 15 bp, Homo sapiens
ggaaatatctagaca

SEQ ID NO: 55055 - DNA, 15 bp, Homo sapiens
aggaaatatctagac

SEQ ID NO: 55056 - DNA, 15 bp, Homo sapiens
aaggaaatatctaga

SEQ ID NO: 55057 - DNA, 15 bp, Homo sapiens
aaaggaaatatctag

SEQ ID NO: 55058 - DNA, 15 bp, Homo sapiens
caaaggaaatatcta

SEQ ID NO: 55059 - DNA, 15 bp, Homo sapiens
acaaaggaaatatct

SEQ ID NO: 55060 - DNA, 15 bp, Homo sapiens
cacaaaggaaatatc

SEQ ID NO: 55061 - DNA, 15 bp, Homo sapiens
ccacaaaggaaatat

SEQ ID NO: 55062 - DNA, 15 bp, Homo sapiens
gccacaaaggaaata

SEQ ID NO: 55063 - DNA, 15 bp, Homo sapiens
ggccacaaaggaaat

SEQ ID NO: 55064 - DNA, 15 bp, Homo sapiens
aggccacaaaggaaa

SEQ ID NO: 55065 - DNA, 15 bp, Homo sapiens
gaggccacaaaggaa

SEQ ID NO: 55066 - DNA, 15 bp, Homo sapiens
ggaggccacaaagga

SEQ ID NO: 55067 - DNA, 15 bp, Homo sapiens
aggaggccacaaagg

SEQ ID NO: 55068 - DNA, 15 bp, Homo sapiens
gaggaggccacaaag

SEQ ID NO: 55069 - DNA, 15 bp, Homo sapiens
ggaggaggccacaaa

SEQ ID NO: 55070 - DNA, 15 bp, Homo sapiens
gggaggaggccacaa

SEQ ID NO: 55071 - DNA, 15 bp, Homo sapiens
ggggaggaggccaca

SEQ ID NO: 55072 - DNA, 15 bp, Homo sapiens
tggggaggaggccac

SEQ ID NO: 55073 - DNA, 15 bp, Homo sapiens
atggggaggaggcca

SEQ ID NO: 55074 - DNA, 15 bp, Homo sapiens
gatggggaggaggcc

SEQ ID NO: 55075 - DNA, 15 bp, Homo sapiens
tgatggggaggaggc

SEQ ID NO: 55076 - DNA, 15 bp, Homo sapiens
ttgatggggaggagg

SEQ ID NO: 55077 - DNA, 15 bp, Homo sapiens
tttgatggggaggag

SEQ ID NO: 55078 - DNA, 15 bp, Homo sapiens
ttttgatggggagga

SEQ ID NO: 55079 - DNA, 15 bp, Homo sapiens
cttttgatggggagg

SEQ ID NO: 55080 - DNA, 15 bp, Homo sapiens
acttttgatggggag

SEQ ID NO: 55081 - DNA, 15 bp, Homo sapiens
gacttttgatgggga

SEQ ID NO: 55082 - DNA, 15 bp, Homo sapiens
tgacttttgatgggg

SEQ ID NO: 55083 - DNA, 15 bp, Homo sapiens
ttgacttttgatggg

SEQ ID NO: 55084 - DNA, 15 bp, Homo sapiens
attgacttttgatgg

SEQ ID NO: 55085 - DNA, 15 bp, Homo sapiens
gattgacttttgatg

SEQ ID NO: 55086 - DNA, 15 bp, Homo sapiens
tgattgacttttgat

SEQ ID NO: 55087 - DNA, 15 bp, Homo sapiens
ttgattgacttttga

SEQ ID NO: 55088 - DNA, 15 bp, Homo sapiens
tttgattgacttttg

SEQ ID NO: 55089 - DNA, 15 bp, Homo sapiens
gtttgattgactttt

SEQ ID NO: 55090 - DNA, 15 bp, Homo sapiens
tgtttgattgacttt

SEQ ID NO: 55091 - DNA, 15 bp, Homo sapiens
atgtttgattgactt

SEQ ID NO: 55092 - DNA, 15 bp, Homo sapiens
gatgtttgattgact

SEQ ID NO: 55093 - DNA, 15 bp, Homo sapiens
cgatgtttgattgac

SEQ ID NO: 55094 - DNA, 15 bp, Homo sapiens
tcgatgtttgattga

SEQ ID NO: 55095 - DNA, 15 bp, Homo sapiens
ctcgatgtttgattg

SEQ ID NO: 55096 - DNA, 15 bp, Homo sapiens
gctcgatgtttgatt

SEQ ID NO: 55097 - DNA, 15 bp, Homo sapiens
ggctcgatgtttgat

SEQ ID NO: 55098 - DNA, 15 bp, Homo sapiens
aggctcgatgtttga

SEQ ID NO: 55099 - DNA, 15 bp, Homo sapiens
aaggctcgatgtttg

SEQ ID NO: 55100 - DNA, 15 bp, Homo sapiens
caaggctcgatgttt

SEQ ID NO: 55101 - DNA, 15 bp, Homo sapiens
acaaggctcgatgtt

SEQ ID NO: 55102 - DNA, 15 bp, Homo sapiens
aacaaggctcgatgt

SEQ ID NO: 55103 - DNA, 15 bp, Homo sapiens
taacaaggctcgatg

SEQ ID NO: 55104 - DNA, 15 bp, Homo sapiens
ttaacaaggctcgat

SEQ ID NO: 55105 - DNA, 15 bp, Homo sapiens
attaacaaggctcga

SEQ ID NO: 55106 - DNA, 15 bp, Homo sapiens
aattaacaaggctcg

SEQ ID NO: 55107 - DNA, 15 bp, Homo sapiens
gaattaacaaggctc

SEQ ID NO: 55108 - DNA, 15 bp, Homo sapiens
ggaattaacaaggct

SEQ ID NO: 55109 - DNA, 15 bp, Homo sapiens
tggaattaacaaggc

SEQ ID NO: 55110 - DNA, 15 bp, Homo sapiens
ttggaattaacaagg

SEQ ID NO: 55111 - DNA, 15 bp, Homo sapiens
attggaattaacaag

SEQ ID NO: 55112 - DNA, 15 bp, Homo sapiens
tattggaattaacaa

SEQ ID NO: 55113 - DNA, 15 bp, Homo sapiens
gtattggaattaaca

SEQ ID NO: 55114 - DNA, 15 bp, Homo sapiens
ggtattggaattaac

SEQ ID NO: 55115 - DNA, 15 bp, Homo sapiens
aggtattggaattaa

SEQ ID NO: 55116 - DNA, 15 bp, Homo sapiens
taggtattggaatta

SEQ ID NO: 55117 - DNA, 15 bp, Homo sapiens
gtaggtattggaatt

SEQ ID NO: 55118 - DNA, 15 bp, Homo sapiens
tgtaggtattggaat

SEQ ID NO: 55119 - DNA, 15 bp, Homo sapiens
atgtaggtattggaa

SEQ ID NO: 55120 - DNA, 15 bp, Homo sapiens
tatgtaggtattgga

SEQ ID NO: 55121 - DNA, 15 bp, Homo sapiens
atatgtaggtattgg

SEQ ID NO: 55122 - DNA, 15 bp, Homo sapiens
tatatgtaggtattg

SEQ ID NO: 55123 - DNA, 15 bp, Homo sapiens
atatatgtaggtatt

SEQ ID NO: 55124 - DNA, 15 bp, Homo sapiens
aatatatgtaggtat

SEQ ID NO: 55125 - DNA, 15 bp, Homo sapiens
gaatatatgtaggta

SEQ ID NO: 55126 - DNA, 15 bp, Homo sapiens
tgaatatatgtaggt

SEQ ID NO: 55127 - DNA, 15 bp, Homo sapiens
ttgaatatatgtagg

SEQ ID NO: 55128 - DNA, 15 bp, Homo sapiens
tttgaatatatgtag

SEQ ID NO: 55129 - DNA, 15 bp, Homo sapiens
ttttgaatatatgta

SEQ ID NO: 55130 - DNA, 15 bp, Homo sapiens
attttgaatatatgt

SEQ ID NO: 55131 - DNA, 15 bp, Homo sapiens
aattttgaatatatg

SEQ ID NO: 55132 - DNA, 15 bp, Homo sapiens
caattttgaatatat

SEQ ID NO: 55133 - DNA, 15 bp, Homo sapiens
acaattttgaatata

SEQ ID NO: 55134 - DNA, 15 bp, Homo sapiens
gacaattttgaatat

SEQ ID NO: 55135 - DNA, 15 bp, Homo sapiens
ggacaattttgaata

SEQ ID NO: 55136 - DNA, 15 bp, Homo sapiens
tggacaattttgaat

SEQ ID NO: 55137 - DNA, 15 bp, Homo sapiens
gtggacaattttgaa

SEQ ID NO: 55138 - DNA, 15 bp, Homo sapiens
agtggacaattttga

SEQ ID NO: 55139 - DNA, 15 bp, Homo sapiens
aagtggacaattttg

SEQ ID NO: 55140 - DNA, 15 bp, Homo sapiens
taagtggacaatttt

SEQ ID NO: 55141 - DNA, 15 bp, Homo sapiens
gtaagtggacaattt

SEQ ID NO: 55142 - DNA, 15 bp, Homo sapiens
agtaagtggacaatt

SEQ ID NO: 55143 - DNA, 15 bp, Homo sapiens
gagtaagtggacaat

SEQ ID NO: 55144 - DNA, 15 bp, Homo sapiens
agagtaagtggacaa

SEQ ID NO: 55145 - DNA, 15 bp, Homo sapiens
tagagtaagtggaca

SEQ ID NO: 55146 - DNA, 15 bp, Homo sapiens
atagagtaagtggac

SEQ ID NO: 55147 - DNA, 15 bp, Homo sapiens
catagagtaagtgga

SEQ ID NO: 55148 - DNA, 15 bp, Homo sapiens
acatagagtaagtgg

SEQ ID NO: 55149 - DNA, 15 bp, Homo sapiens
tacatagagtaagtg

SEQ ID NO: 55150 - DNA, 15 bp, Homo sapiens
ctacatagagtaagt

SEQ ID NO: 55151 - DNA, 15 bp, Homo sapiens
tctacatagagtaag

SEQ ID NO: 55152 - DNA, 15 bp, Homo sapiens
ctctacatagagtaa

SEQ ID NO: 55153 - DNA, 15 bp, Homo sapiens
actctacatagagta

SEQ ID NO: 55154 - DNA, 15 bp, Homo sapiens
cactctacatagagt

SEQ ID NO: 55155 - DNA, 15 bp, Homo sapiens
tcactctacatagag

SEQ ID NO: 55156 - DNA, 15 bp, Homo sapiens
gtcactctacataga

SEQ ID NO: 55157 - DNA, 15 bp, Homo sapiens
tgtcactctacatag

SEQ ID NO: 55158 - DNA, 15 bp, Homo sapiens
gtgtcactctacata

SEQ ID NO: 55159 - DNA, 15 bp, Homo sapiens
cgtgtcactctacat

SEQ ID NO: 55160 - DNA, 15 bp, Homo sapiens
acgtgtcactctaca

SEQ ID NO: 55161 - DNA, 15 bp, Homo sapiens
gacgtgtcactctac

SEQ ID NO: 55162 - DNA, 15 bp, Homo sapiens
agacgtgtcactcta

SEQ ID NO: 55163 - DNA, 15 bp, Homo sapiens
gagacgtgtcactct

SEQ ID NO: 55164 - DNA, 15 bp, Homo sapiens
agagacgtgtcactc

SEQ ID NO: 55165 - DNA, 15 bp, Homo sapiens
aagagacgtgtcact

SEQ ID NO: 55166 - DNA, 15 bp, Homo sapiens
aaagagacgtgtcac

SEQ ID NO: 55167 - DNA, 15 bp, Homo sapiens
aaaagagacgtgtca

SEQ ID NO: 55168 - DNA, 15 bp, Homo sapiens
gaaaagagacgtgtc

SEQ ID NO: 55169 - DNA, 15 bp, Homo sapiens
ggaaaagagacgtgt

SEQ ID NO: 55170 - DNA, 15 bp, Homo sapiens
tggaaaagagacgtg

SEQ ID NO: 55171 - DNA, 15 bp, Homo sapiens
ttggaaaagagacgt

SEQ ID NO: 55172 - DNA, 15 bp, Homo sapiens
cttggaaaagagacg

SEQ ID NO: 55173 - DNA, 15 bp, Homo sapiens
ccttggaaaagagac

SEQ ID NO: 55174 - DNA, 15 bp, Homo sapiens
gccttggaaaagaga

SEQ ID NO: 55175 - DNA, 15 bp, Homo sapiens
tgccttggaaaagag

SEQ ID NO: 55176 - DNA, 15 bp, Homo sapiens
atgccttggaaaaga

SEQ ID NO: 55177 - DNA, 15 bp, Homo sapiens
aatgccttggaaaag

SEQ ID NO: 55178 - DNA, 15 bp, Homo sapiens
caatgccttggaaaa

SEQ ID NO: 55179 - DNA, 15 bp, Homo sapiens
acaatgccttggaaa

SEQ ID NO: 55180 - DNA, 15 bp, Homo sapiens
aacaatgccttggaa

SEQ ID NO: 55181 - DNA, 15 bp, Homo sapiens
taacaatgccttgga

SEQ ID NO: 55182 - DNA, 15 bp, Homo sapiens
ataacaatgccttgg

SEQ ID NO: 55183 - DNA, 15 bp, Homo sapiens
aataacaatgccttg

SEQ ID NO: 55184 - DNA, 15 bp, Homo sapiens
aaataacaatgcctt

SEQ ID NO: 55185 - DNA, 15 bp, Homo sapiens
caaataacaatgcct

SEQ ID NO: 55186 - DNA, 15 bp, Homo sapiens
acaaataacaatgcc

SEQ ID NO: 55187 - DNA, 15 bp, Homo sapiens
tacaaataacaatgc

SEQ ID NO: 55188 - DNA, 15 bp, Homo sapiens
atacaaataacaatg

SEQ ID NO: 55189 - DNA, 15 bp, Homo sapiens
aatacaaataacaat

SEQ ID NO: 55190 - DNA, 15 bp, Homo sapiens
taatacaaataacaa

SEQ ID NO: 55191 - DNA, 15 bp, Homo sapiens
ctaatacaaataaca

SEQ ID NO: 55192 - DNA, 15 bp, Homo sapiens
tctaatacaaataac

SEQ ID NO: 55193 - DNA, 15 bp, Homo sapiens
ttctaatacaaataa

SEQ ID NO: 55194 - DNA, 15 bp, Homo sapiens
tttctaatacaaata

SEQ ID NO: 55195 - DNA, 15 bp, Homo sapiens
ttttctaatacaaat

SEQ ID NO: 55196 - DNA, 15 bp, Homo sapiens
tttttctaatacaaa

SEQ ID NO: 55197 - DNA, 15 bp, Homo sapiens
ttttttctaatacaa

SEQ ID NO: 55198 - DNA, 15 bp, Homo sapiens
attttttctaataca

SEQ ID NO: 55199 - DNA, 15 bp, Homo sapiens
cattttttctaatac

SEQ ID NO: 55200 - DNA, 15 bp, Homo sapiens
ccattttttctaata

SEQ ID NO: 55201 - DNA, 15 bp, Homo sapiens
accattttttctaat

SEQ ID NO: 55202 - DNA, 15 bp, Homo sapiens
caccattttttctaa

SEQ ID NO: 55203 - DNA, 15 bp, Homo sapiens
tcaccattttttcta

SEQ ID NO: 55204 - DNA, 15 bp, Homo sapiens
ctcaccattttttct

SEQ ID NO: 55205 - DNA, 15 bp, Homo sapiens
tctcaccattttttc

SEQ ID NO: 55206 - DNA, 15 bp, Homo sapiens
ctctcaccatttttt

SEQ ID NO: 55207 - DNA, 15 bp, Homo sapiens
tctctcaccattttt

SEQ ID NO: 55208 - DNA, 15 bp, Homo sapiens
gtctctcaccatttt

SEQ ID NO: 55209 - DNA, 15 bp, Homo sapiens
agtctctcaccattt

SEQ ID NO: 55210 - DNA, 15 bp, Homo sapiens
aagtctctcaccatt

SEQ ID NO: 55211 - DNA, 15 bp, Homo sapiens
aaagtctctcaccat

SEQ ID NO: 55212 - DNA, 15 bp, Homo sapiens
taaagtctctcacca

SEQ ID NO: 55213 - DNA, 15 bp, Homo sapiens
gtaaagtctctcacc

SEQ ID NO: 55214 - DNA, 15 bp, Homo sapiens
tgtaaagtctctcac

SEQ ID NO: 55215 - DNA, 15 bp, Homo sapiens
ttgtaaagtctctca

SEQ ID NO: 55216 - DNA, 15 bp, Homo sapiens
attgtaaagtctctc

SEQ ID NO: 55217 - DNA, 15 bp, Homo sapiens
cattgtaaagtctct

SEQ ID NO: 55218 - DNA, 15 bp, Homo sapiens
ccattgtaaagtctc

SEQ ID NO: 55219 - DNA, 15 bp, Homo sapiens
cccattgtaaagtct

SEQ ID NO: 55220 - DNA, 15 bp, Homo sapiens
gcccattgtaaagtc

SEQ ID NO: 55221 - DNA, 15 bp, Homo sapiens
tgcccattgtaaagt

SEQ ID NO: 55222 - DNA, 15 bp, Homo sapiens
ttgcccattgtaaag

SEQ ID NO: 55223 - DNA, 15 bp, Homo sapiens
tttgcccattgtaaa

SEQ ID NO: 55224 - DNA, 15 bp, Homo sapiens
ttttgcccattgtaa

SEQ ID NO: 55225 - DNA, 15 bp, Homo sapiens
tttttgcccattgta

SEQ ID NO: 55226 - DNA, 15 bp, Homo sapiens
ttttttgcccattgt

SEQ ID NO: 55227 - DNA, 15 bp, Homo sapiens
gttttttgcccattg

SEQ ID NO: 55228 - DNA, 15 bp, Homo sapiens
agttttttgcccatt

SEQ ID NO: 55229 - DNA, 15 bp, Homo sapiens
tagttttttgcccat

SEQ ID NO: 55230 - DNA, 15 bp, Homo sapiens
ctagttttttgccca

SEQ ID NO: 55231 - DNA, 15 bp, Homo sapiens
actagttttttgccc

SEQ ID NO: 55232 - DNA, 15 bp, Homo sapiens
cactagttttttgcc

SEQ ID NO: 55233 - DNA, 15 bp, Homo sapiens
ccactagttttttgc

SEQ ID NO: 55234 - DNA, 15 bp, Homo sapiens
cccactagttttttg

SEQ ID NO: 55235 - DNA, 15 bp, Homo sapiens
acccactagtttttt

SEQ ID NO: 55236 - DNA, 15 bp, Homo sapiens
cacccactagttttt

SEQ ID NO: 55237 - DNA, 15 bp, Homo sapiens
acacccactagtttt

SEQ ID NO: 55238 - DNA, 15 bp, Homo sapiens
gacacccactagttt

SEQ ID NO: 55239 - DNA, 15 bp, Homo sapiens
ggacacccactagtt

SEQ ID NO: 55240 - DNA, 15 bp, Homo sapiens
aggacacccactagt

SEQ ID NO: 55241 - DNA, 15 bp, Homo sapiens
caggacacccactag

SEQ ID NO: 55242 - DNA, 15 bp, Homo sapiens
acaggacacccacta

SEQ ID NO: 55243 - DNA, 15 bp, Homo sapiens
aacaggacacccact

SEQ ID NO: 55244 - DNA, 15 bp, Homo sapiens
taacaggacacccac

SEQ ID NO: 55245 - DNA, 15 bp, Homo sapiens
ctaacaggacaccca

SEQ ID NO: 55246 - DNA, 15 bp, Homo sapiens
gctaacaggacaccc

SEQ ID NO: 55247 - DNA, 15 bp, Homo sapiens
agctaacaggacacc

SEQ ID NO: 55248 - DNA, 15 bp, Homo sapiens
gagctaacaggacac

SEQ ID NO: 55249 - DNA, 15 bp, Homo sapiens
tgagctaacaggaca

SEQ ID NO: 55250 - DNA, 15 bp, Homo sapiens
ctgagctaacaggac

SEQ ID NO: 55251 - DNA, 15 bp, Homo sapiens
cctgagctaacagga

SEQ ID NO: 55252 - DNA, 15 bp, Homo sapiens
gcctgagctaacagg

SEQ ID NO: 55253 - DNA, 15 bp, Homo sapiens
tgcctgagctaacag

SEQ ID NO: 55254 - DNA, 15 bp, Homo sapiens
atgcctgagctaaca

SEQ ID NO: 55255 - DNA, 15 bp, Homo sapiens
gatgcctgagctaac

SEQ ID NO: 55256 - DNA, 15 bp, Homo sapiens
agatgcctgagctaa

SEQ ID NO: 55257 - DNA, 15 bp, Homo sapiens
cagatgcctgagcta

SEQ ID NO: 55258 - DNA, 15 bp, Homo sapiens
tcagatgcctgagct

SEQ ID NO: 55259 - DNA, 15 bp, Homo sapiens
ttcagatgcctgagc

SEQ ID NO: 55260 - DNA, 15 bp, Homo sapiens
attcagatgcctgag

SEQ ID NO: 55261 - DNA, 15 bp, Homo sapiens
aattcagatgcctga

SEQ ID NO: 55262 - DNA, 15 bp, Homo sapiens
taattcagatgcctg

SEQ ID NO: 55263 - DNA, 15 bp, Homo sapiens
ataattcagatgcct

SEQ ID NO: 55264 - DNA, 15 bp, Homo sapiens
gataattcagatgcc

SEQ ID NO: 55265 - DNA, 15 bp, Homo sapiens
agataattcagatgc

SEQ ID NO: 55266 - DNA, 15 bp, Homo sapiens
gagataattcagatg

SEQ ID NO: 55267 - DNA, 15 bp, Homo sapiens
agagataattcagat

SEQ ID NO: 55268 - DNA, 15 bp, Homo sapiens
cagagataattcaga

SEQ ID NO: 55269 - DNA, 15 bp, Homo sapiens
gcagagataattcag

SEQ ID NO: 55270 - DNA, 15 bp, Homo sapiens
ggcagagataattca

SEQ ID NO: 55271 - DNA, 15 bp, Homo sapiens
aggcagagataattc

SEQ ID NO: 55272 - DNA, 15 bp, Homo sapiens
aaggcagagataatt

SEQ ID NO: 55273 - DNA, 15 bp, Homo sapiens
aaaggcagagataat

SEQ ID NO: 55274 - DNA, 15 bp, Homo sapiens
taaaggcagagataa

SEQ ID NO: 55275 - DNA, 15 bp, Homo sapiens
ttaaaggcagagata

SEQ ID NO: 55276 - DNA, 15 bp, Homo sapiens
attaaaggcagagat

SEQ ID NO: 55277 - DNA, 15 bp, Homo sapiens
aattaaaggcagaga

SEQ ID NO: 55278 - DNA, 15 bp, Homo sapiens
taattaaaggcagag

SEQ ID NO: 55279 - DNA, 15 bp, Homo sapiens
gtaattaaaggcaga

SEQ ID NO: 55280 - DNA, 15 bp, Homo sapiens
agtaattaaaggcag

SEQ ID NO: 55281 - DNA, 15 bp, Homo sapiens
aagtaattaaaggca

SEQ ID NO: 55282 - DNA, 15 bp, Homo sapiens
aaagtaattaaaggc

SEQ ID NO: 55283 - DNA, 15 bp, Homo sapiens
aaaagtaattaaagg

SEQ ID NO: 55284 - DNA, 15 bp, Homo sapiens
caaaagtaattaaag

SEQ ID NO: 55285 - DNA, 15 bp, Homo sapiens
tcaaaagtaattaaa

SEQ ID NO: 55286 - DNA, 15 bp, Homo sapiens
ctcaaaagtaattaa

SEQ ID NO: 55287 - DNA, 15 bp, Homo sapiens
gctcaaaagtaatta

SEQ ID NO: 55288 - DNA, 15 bp, Homo sapiens
agctcaaaagtaatt

SEQ ID NO: 55289 - DNA, 15 bp, Homo sapiens
tagctcaaaagtaat

SEQ ID NO: 55290 - DNA, 15 bp, Homo sapiens
gtagctcaaaagtaa

SEQ ID NO: 55291 - DNA, 15 bp, Homo sapiens
agtagctcaaaagta

SEQ ID NO: 55292 - DNA, 15 bp, Homo sapiens
aagtagctcaaaagt

SEQ ID NO: 55293 - DNA, 15 bp, Homo sapiens
aaagtagctcaaaag

SEQ ID NO: 55294 - DNA, 15 bp, Homo sapiens
taaagtagctcaaaa

SEQ ID NO: 55295 - DNA, 15 bp, Homo sapiens
gtaaagtagctcaaa

SEQ ID NO: 55296 - DNA, 15 bp, Homo sapiens
cgtaaagtagctcaa

SEQ ID NO: 55297 - DNA, 15 bp, Homo sapiens
tcgtaaagtagctca

SEQ ID NO: 55298 - DNA, 15 bp, Homo sapiens
gtcgtaaagtagctc

SEQ ID NO: 55299 - DNA, 15 bp, Homo sapiens
agtcgtaaagtagct

SEQ ID NO: 55300 - DNA, 15 bp, Homo sapiens
tagtcgtaaagtagc

SEQ ID NO: 55301 - DNA, 15 bp, Homo sapiens
ctagtcgtaaagtag

SEQ ID NO: 55302 - DNA, 15 bp, Homo sapiens
cctagtcgtaaagta

SEQ ID NO: 55303 - DNA, 15 bp, Homo sapiens
acctagtcgtaaagt

SEQ ID NO: 55304 - DNA, 15 bp, Homo sapiens
tacctagtcgtaaag

SEQ ID NO: 55305 - DNA, 15 bp, Homo sapiens
ttacctagtcgtaaa

SEQ ID NO: 55306 - DNA, 15 bp, Homo sapiens
cttacctagtcgtaa

SEQ ID NO: 55307 - DNA, 15 bp, Homo sapiens
acttacctagtcgta

SEQ ID NO: 55308 - DNA, 15 bp, Homo sapiens
aacttacctagtcgt

SEQ ID NO: 55309 - DNA, 15 bp, Homo sapiens
caacttacctagtcg

SEQ ID NO: 55310 - DNA, 15 bp, Homo sapiens
acaacttacctagtc

SEQ ID NO: 55311 - DNA, 15 bp, Homo sapiens
cacaacttacctagt

SEQ ID NO: 55312 - DNA, 15 bp, Homo sapiens
ccacaacttacctag

SEQ ID NO: 55313 - DNA, 15 bp, Homo sapiens
tccacaacttaccta

SEQ ID NO: 55314 - DNA, 15 bp, Homo sapiens
ttccacaacttacct

SEQ ID NO: 55315 - DNA, 15 bp, Homo sapiens
tttccacaacttacc

SEQ ID NO: 55316 - DNA, 15 bp, Homo sapiens
ttttccacaacttac

SEQ ID NO: 55317 - DNA, 15 bp, Homo sapiens
attttccacaactta

SEQ ID NO: 55318 - DNA, 15 bp, Homo sapiens
tattttccacaactt

SEQ ID NO: 55319 - DNA, 15 bp, Homo sapiens
ctattttccacaact

SEQ ID NO: 55320 - DNA, 15 bp, Homo sapiens
cctattttccacaac

SEQ ID NO: 55321 - DNA, 15 bp, Homo sapiens
acctattttccacaa

SEQ ID NO: 55322 - DNA, 15 bp, Homo sapiens
tacctattttccaca

SEQ ID NO: 55323 - DNA, 15 bp, Homo sapiens
atacctattttccac

SEQ ID NO: 55324 - DNA, 15 bp, Homo sapiens
catacctattttcca

SEQ ID NO: 55325 - DNA, 15 bp, Homo sapiens
gcatacctattttcc

SEQ ID NO: 55326 - DNA, 15 bp, Homo sapiens
tgcatacctattttc

SEQ ID NO: 55327 - DNA, 15 bp, Homo sapiens
ttgcatacctatttt

SEQ ID NO: 55328 - DNA, 15 bp, Homo sapiens
tttgcatacctattt

SEQ ID NO: 55329 - DNA, 15 bp, Homo sapiens
atttgcatacctatt

SEQ ID NO: 55330 - DNA, 15 bp, Homo sapiens
catttgcatacctat

SEQ ID NO: 55331 - DNA, 15 bp, Homo sapiens
tcatttgcataccta

SEQ ID NO: 55332 - DNA, 15 bp, Homo sapiens
atcatttgcatacct

SEQ ID NO: 55333 - DNA, 15 bp, Homo sapiens
aatcatttgcatacc

SEQ ID NO: 55334 - DNA, 15 bp, Homo sapiens
gaatcatttgcatac

SEQ ID NO: 55335 - DNA, 15 bp, Homo sapiens
agaatcatttgcata

SEQ ID NO: 55336 - DNA, 15 bp, Homo sapiens
aagaatcatttgcat

SEQ ID NO: 55337 - DNA, 15 bp, Homo sapiens
taagaatcatttgca

SEQ ID NO: 55338 - DNA, 15 bp, Homo sapiens
ataagaatcatttgc

SEQ ID NO: 55339 - DNA, 15 bp, Homo sapiens
gataagaatcatttg

SEQ ID NO: 55340 - DNA, 15 bp, Homo sapiens
ggataagaatcattt

SEQ ID NO: 55341 - DNA, 15 bp, Homo sapiens
tggataagaatcatt

SEQ ID NO: 55342 - DNA, 15 bp, Homo sapiens
atggataagaatcat

SEQ ID NO: 55343 - DNA, 15 bp, Homo sapiens
tatggataagaatca

SEQ ID NO: 55344 - DNA, 15 bp, Homo sapiens
ttatggataagaatc

SEQ ID NO: 55345 - DNA, 15 bp, Homo sapiens
tttatggataagaat

SEQ ID NO: 55346 - DNA, 15 bp, Homo sapiens
ttttatggataagaa

SEQ ID NO: 55347 - DNA, 15 bp, Homo sapiens
tttttatggataaga

SEQ ID NO: 55348 - DNA, 15 bp, Homo sapiens
atttttatggataag

SEQ ID NO: 55349 - DNA, 15 bp, Homo sapiens
catttttatggataa

SEQ ID NO: 55350 - DNA, 15 bp, Homo sapiens
tcatttttatggata

SEQ ID NO: 55351 - DNA, 15 bp, Homo sapiens
ttcatttttatggat

SEQ ID NO: 55352 - DNA, 15 bp, Homo sapiens
tttcatttttatgga

SEQ ID NO: 55353 - DNA, 15 bp, Homo sapiens
ttttcatttttatgg

SEQ ID NO: 55354 - DNA, 15 bp, Homo sapiens
attttcatttttatg

SEQ ID NO: 55355 - DNA, 15 bp, Homo sapiens
aattttcatttttat

SEQ ID NO: 55356 - DNA, 15 bp, Homo sapiens
taattttcattttta

SEQ ID NO: 55357 - DNA, 15 bp, Homo sapiens
ataattttcattttt

SEQ ID NO: 55358 - DNA, 15 bp, Homo sapiens
aataattttcatttt

SEQ ID NO: 55359 - DNA, 15 bp, Homo sapiens
aaataattttcattt

SEQ ID NO: 55360 - DNA, 15 bp, Homo sapiens
caaataattttcatt

SEQ ID NO: 55361 - DNA, 15 bp, Homo sapiens
acaaataattttcat

SEQ ID NO: 55362 - DNA, 15 bp, Homo sapiens
tacaaataattttca

SEQ ID NO: 55363 - DNA, 15 bp, Homo sapiens
ttacaaataattttc

SEQ ID NO: 55364 - DNA, 15 bp, Homo sapiens
tttacaaataatttt

SEQ ID NO: 55365 - DNA, 15 bp, Homo sapiens
ctttacaaataattt

SEQ ID NO: 55366 - DNA, 15 bp, Homo sapiens
gctttacaaataatt

SEQ ID NO: 55367 - DNA, 15 bp, Homo sapiens
tgctttacaaataat

SEQ ID NO: 55368 - DNA, 15 bp, Homo sapiens
ctgctttacaaataa

SEQ ID NO: 55369 - DNA, 15 bp, Homo sapiens
actgctttacaaata

SEQ ID NO: 55370 - DNA, 15 bp, Homo sapiens
aactgctttacaaat

SEQ ID NO: 55371 - DNA, 15 bp, Homo sapiens
taactgctttacaaa

SEQ ID NO: 55372 - DNA, 15 bp, Homo sapiens
ttaactgctttacaa

SEQ ID NO: 55373 - DNA, 15 bp, Homo sapiens
attaactgctttaca

SEQ ID NO: 55374 - DNA, 15 bp, Homo sapiens
aattaactgctttac

SEQ ID NO: 55375 - DNA, 15 bp, Homo sapiens
taattaactgcttta

SEQ ID NO: 55376 - DNA, 15 bp, Homo sapiens
ataattaactgcttt

SEQ ID NO: 55377 - DNA, 15 bp, Homo sapiens
aataattaactgctt

SEQ ID NO: 55378 - DNA, 15 bp, Homo sapiens
taataattaactgct

SEQ ID NO: 55379 - DNA, 15 bp, Homo sapiens
gtaataattaactgc

SEQ ID NO: 55380 - DNA, 15 bp, Homo sapiens
agtaataattaactg

SEQ ID NO: 55381 - DNA, 15 bp, Homo sapiens
gagtaataattaact

SEQ ID NO: 55382 - DNA, 15 bp, Homo sapiens
ggagtaataattaac

SEQ ID NO: 55383 - DNA, 15 bp, Homo sapiens
aggagtaataattaa

SEQ ID NO: 55384 - DNA, 15 bp, Homo sapiens
aaggagtaataatta

SEQ ID NO: 55385 - DNA, 15 bp, Homo sapiens
caaggagtaataatt

SEQ ID NO: 55386 - DNA, 15 bp, Homo sapiens
ccaaggagtaataat

SEQ ID NO: 55387 - DNA, 15 bp, Homo sapiens
tccaaggagtaataa

SEQ ID NO: 55388 - DNA, 15 bp, Homo sapiens
atccaaggagtaata

SEQ ID NO: 55389 - DNA, 15 bp, Homo sapiens
tatccaaggagtaat

SEQ ID NO: 55390 - DNA, 15 bp, Homo sapiens
ctatccaaggagtaa

SEQ ID NO: 55391 - DNA, 15 bp, Homo sapiens
tctatccaaggagta

SEQ ID NO: 55392 - DNA, 15 bp, Homo sapiens
gtctatccaaggagt

SEQ ID NO: 55393 - DNA, 15 bp, Homo sapiens
ggtctatccaaggag

SEQ ID NO: 55394 - DNA, 15 bp, Homo sapiens
tggtctatccaagga

SEQ ID NO: 55395 - DNA, 15 bp, Homo sapiens
ctggtctatccaagg

SEQ ID NO: 55396 - DNA, 15 bp, Homo sapiens
actggtctatccaag

SEQ ID NO: 55397 - DNA, 15 bp, Homo sapiens
aactggtctatccaa

SEQ ID NO: 55398 - DNA, 15 bp, Homo sapiens
aaactggtctatcca

SEQ ID NO: 55399 - DNA, 15 bp, Homo sapiens
aaaactggtctatcc

SEQ ID NO: 55400 - DNA, 15 bp, Homo sapiens
aaaaactggtctatc

SEQ ID NO: 55401 - DNA, 15 bp, Homo sapiens
caaaaactggtctat

SEQ ID NO: 55402 - DNA, 15 bp, Homo sapiens
gcaaaaactggtcta

SEQ ID NO: 55403 - DNA, 15 bp, Homo sapiens
tgcaaaaactggtct

SEQ ID NO: 55404 - DNA, 15 bp, Homo sapiens
atgcaaaaactggtc

SEQ ID NO: 55405 - DNA, 15 bp, Homo sapiens
gatgcaaaaactggt

SEQ ID NO: 55406 - DNA, 15 bp, Homo sapiens
agatgcaaaaactgg

SEQ ID NO: 55407 - DNA, 15 bp, Homo sapiens
tagatgcaaaaactg

SEQ ID NO: 55408 - DNA, 15 bp, Homo sapiens
atagatgcaaaaact

SEQ ID NO: 55409 - DNA, 15 bp, Homo sapiens
aatagatgcaaaaac

SEQ ID NO: 55410 - DNA, 15 bp, Homo sapiens
caatagatgcaaaaa

SEQ ID NO: 55411 - DNA, 15 bp, Homo sapiens
gcaatagatgcaaaa

SEQ ID NO: 55412 - DNA, 15 bp, Homo sapiens
tgcaatagatgcaaa

SEQ ID NO: 55413 - DNA, 15 bp, Homo sapiens
ttgcaatagatgcaa

SEQ ID NO: 55414 - DNA, 15 bp, Homo sapiens
tttgcaatagatgca

SEQ ID NO: 55415 - DNA, 15 bp, Homo sapiens
atttgcaatagatgc

SEQ ID NO: 55416 - DNA, 15 bp, Homo sapiens
gatttgcaatagatg

SEQ ID NO: 55417 - DNA, 15 bp, Homo sapiens
agatttgcaatagat

SEQ ID NO: 55418 - DNA, 15 bp, Homo sapiens
tagatttgcaataga

SEQ ID NO: 55419 - DNA, 15 bp, Homo sapiens
atagatttgcaatag

SEQ ID NO: 55420 - DNA, 15 bp, Homo sapiens
aatagatttgcaata

SEQ ID NO: 55421 - DNA, 15 bp, Homo sapiens
aaatagatttgcaat

SEQ ID NO: 55422 - DNA, 15 bp, Homo sapiens
gaaatagatttgcaa

SEQ ID NO: 55423 - DNA, 15 bp, Homo sapiens
tgaaatagatttgca

SEQ ID NO: 55424 - DNA, 15 bp, Homo sapiens
ctgaaatagatttgc

SEQ ID NO: 55425 - DNA, 15 bp, Homo sapiens
actgaaatagatttg

SEQ ID NO: 55426 - DNA, 15 bp, Homo sapiens
aactgaaatagattt

SEQ ID NO: 55427 - DNA, 15 bp, Homo sapiens
aaactgaaatagatt

SEQ ID NO: 55428 - DNA, 15 bp, Homo sapiens
aaaactgaaatagat

SEQ ID NO: 55429 - DNA, 15 bp, Homo sapiens
gaaaactgaaataga

SEQ ID NO: 55430 - DNA, 15 bp, Homo sapiens
tgaaaactgaaatag

SEQ ID NO: 55431 - DNA, 15 bp, Homo sapiens
atgaaaactgaaata

SEQ ID NO: 55432 - DNA, 15 bp, Homo sapiens
aatgaaaactgaaat

SEQ ID NO: 55433 - DNA, 15 bp, Homo sapiens
aaatgaaaactgaaa

SEQ ID NO: 55434 - DNA, 15 bp, Homo sapiens
aaaatgaaaactgaa

SEQ ID NO: 55435 - DNA, 15 bp, Homo sapiens
aaaaatgaaaactga

SEQ ID NO: 55436 - DNA, 15 bp, Homo sapiens
gaaaaatgaaaactg

SEQ ID NO: 55437 - DNA, 15 bp, Homo sapiens
agaaaaatgaaaact

SEQ ID NO: 55438 - DNA, 15 bp, Homo sapiens
aagaaaaatgaaaac

SEQ ID NO: 55439 - DNA, 15 bp, Homo sapiens
caagaaaaatgaaaa

SEQ ID NO: 55440 - DNA, 15 bp, Homo sapiens
acaagaaaaatgaaa

SEQ ID NO: 55441 - DNA, 15 bp, Homo sapiens
cacaagaaaaatgaa

SEQ ID NO: 55442 - DNA, 15 bp, Homo sapiens
acacaagaaaaatga

SEQ ID NO: 55443 - DNA, 15 bp, Homo sapiens
tacacaagaaaaatg

SEQ ID NO: 55444 - DNA, 15 bp, Homo sapiens
ttacacaagaaaaat

SEQ ID NO: 55445 - DNA, 15 bp, Homo sapiens
tttacacaagaaaaa

SEQ ID NO: 55446 - DNA, 15 bp, Homo sapiens
ttttacacaagaaaa

SEQ ID NO: 55447 - DNA, 15 bp, Homo sapiens
gttttacacaagaaa

SEQ ID NO: 55448 - DNA, 15 bp, Homo sapiens
tgttttacacaagaa

SEQ ID NO: 55449 - DNA, 15 bp, Homo sapiens
atgttttacacaaga

SEQ ID NO: 55450 - DNA, 15 bp, Homo sapiens
catgttttacacaag

SEQ ID NO: 55451 - DNA, 15 bp, Homo sapiens
acatgttttacacaa

SEQ ID NO: 55452 - DNA, 15 bp, Homo sapiens
cacatgttttacaca

SEQ ID NO: 55453 - DNA, 15 bp, Homo sapiens
acacatgttttacac

SEQ ID NO: 55454 - DNA, 15 bp, Homo sapiens
aacacatgttttaca

SEQ ID NO: 55455 - DNA, 15 bp, Homo sapiens
aaacacatgttttac

SEQ ID NO: 55456 - DNA, 15 bp, Homo sapiens
aaaacacatgtttta

SEQ ID NO: 55457 - DNA, 15 bp, Homo sapiens
aaaaacacatgtttt

SEQ ID NO: 55458 - DNA, 15 bp, Homo sapiens
taaaaacacatgttt

SEQ ID NO: 55459 - DNA, 15 bp, Homo sapiens
ttaaaaacacatgtt

SEQ ID NO: 55460 - DNA, 15 bp, Homo sapiens
tttaaaaacacatgt

SEQ ID NO: 55461 - DNA, 15 bp, Homo sapiens
ttttaaaaacacatg

SEQ ID NO: 55462 - DNA, 15 bp, Homo sapiens
tttttaaaaacacat

SEQ ID NO: 55463 - DNA, 15 bp, Homo sapiens
atttttaaaaacaca

SEQ ID NO: 55464 - DNA, 15 bp, Homo sapiens
aatttttaaaaacac

SEQ ID NO: 55465 - DNA, 15 bp, Homo sapiens
aaatttttaaaaaca

SEQ ID NO: 55466 - DNA, 15 bp, Homo sapiens
aaaatttttaaaaac

SEQ ID NO: 55467 - DNA, 15 bp, Homo sapiens
gaaaatttttaaaaa

SEQ ID NO: 55468 - DNA, 15 bp, Homo sapiens
ggaaaatttttaaaa

SEQ ID NO: 55469 - DNA, 15 bp, Homo sapiens
gggaaaatttttaaa

SEQ ID NO: 55470 - DNA, 15 bp, Homo sapiens
ggggaaaatttttaa

SEQ ID NO: 55471 - DNA, 15 bp, Homo sapiens
aggggaaaattttta

SEQ ID NO: 55472 - DNA, 15 bp, Homo sapiens
caggggaaaattttt

SEQ ID NO: 55473 - DNA, 15 bp, Homo sapiens
tcaggggaaaatttt

SEQ ID NO: 55474 - DNA, 15 bp, Homo sapiens
ttcaggggaaaattt

SEQ ID NO: 55475 - DNA, 15 bp, Homo sapiens
gttcaggggaaaatt

SEQ ID NO: 55476 - DNA, 15 bp, Homo sapiens
agttcaggggaaaat

SEQ ID NO: 55477 - DNA, 15 bp, Homo sapiens
cagttcaggggaaaa

SEQ ID NO: 55478 - DNA, 15 bp, Homo sapiens
ccagttcaggggaaa

SEQ ID NO: 55479 - DNA, 15 bp, Homo sapiens
accagttcaggggaa

SEQ ID NO: 55480 - DNA, 15 bp, Homo sapiens
aaccagttcagggga

SEQ ID NO: 55481 - DNA, 15 bp, Homo sapiens
caaccagttcagggg

SEQ ID NO: 55482 - DNA, 15 bp, Homo sapiens
acaaccagttcaggg

SEQ ID NO: 55483 - DNA, 15 bp, Homo sapiens
tacaaccagttcagg

SEQ ID NO: 55484 - DNA, 15 bp, Homo sapiens
ttacaaccagttcag

SEQ ID NO: 55485 - DNA, 15 bp, Homo sapiens
gttacaaccagttca

SEQ ID NO: 55486 - DNA, 15 bp, Homo sapiens
tgttacaaccagttc

SEQ ID NO: 55487 - DNA, 15 bp, Homo sapiens
ctgttacaaccagtt

SEQ ID NO: 55488 - DNA, 15 bp, Homo sapiens
gctgttacaaccagt

SEQ ID NO: 55489 - DNA, 15 bp, Homo sapiens
agctgttacaaccag

SEQ ID NO: 55490 - DNA, 15 bp, Homo sapiens
aagctgttacaacca

SEQ ID NO: 55491 - DNA, 15 bp, Homo sapiens
taagctgttacaacc

SEQ ID NO: 55492 - DNA, 15 bp, Homo sapiens
gtaagctgttacaac

SEQ ID NO: 55493 - DNA, 15 bp, Homo sapiens
agtaagctgttacaa

SEQ ID NO: 55494 - DNA, 15 bp, Homo sapiens
cagtaagctgttaca

SEQ ID NO: 55495 - DNA, 15 bp, Homo sapiens
ccagtaagctgttac

SEQ ID NO: 55496 - DNA, 15 bp, Homo sapiens
cccagtaagctgtta

SEQ ID NO: 55497 - DNA, 15 bp, Homo sapiens
acccagtaagctgtt

SEQ ID NO: 55498 - DNA, 15 bp, Homo sapiens
gacccagtaagctgt

SEQ ID NO: 55499 - DNA, 15 bp, Homo sapiens
ggacccagtaagctg

SEQ ID NO: 55500 - DNA, 15 bp, Homo sapiens
gggacccagtaagct

SEQ ID NO: 55501 - DNA, 15 bp, Homo sapiens
agggacccagtaagc

SEQ ID NO: 55502 - DNA, 15 bp, Homo sapiens
gagggacccagtaag

SEQ ID NO: 55503 - DNA, 15 bp, Homo sapiens
tgagggacccagtaa

SEQ ID NO: 55504 - DNA, 15 bp, Homo sapiens
atgagggacccagta

SEQ ID NO: 55505 - DNA, 15 bp, Homo sapiens
aatgagggacccagt

SEQ ID NO: 55506 - DNA, 15 bp, Homo sapiens
taatgagggacccag

SEQ ID NO: 55507 - DNA, 15 bp, Homo sapiens
ttaatgagggaccca

SEQ ID NO: 55508 - DNA, 15 bp, Homo sapiens
attaatgagggaccc

SEQ ID NO: 55509 - DNA, 15 bp, Homo sapiens
aattaatgagggacc

SEQ ID NO: 55510 - DNA, 15 bp, Homo sapiens
taattaatgagggac

SEQ ID NO: 55511 - DNA, 15 bp, Homo sapiens
ttaattaatgaggga

SEQ ID NO: 55512 - DNA, 15 bp, Homo sapiens
attaattaatgaggg

SEQ ID NO: 55513 - DNA, 15 bp, Homo sapiens
cattaattaatgagg

SEQ ID NO: 55514 - DNA, 15 bp, Homo sapiens
tcattaattaatgag

SEQ ID NO: 55515 - DNA, 15 bp, Homo sapiens
ctcattaattaatga

SEQ ID NO: 55516 - DNA, 15 bp, Homo sapiens
actcattaattaatg

SEQ ID NO: 55517 - DNA, 15 bp, Homo sapiens
aactcattaattaat

SEQ ID NO: 55518 - DNA, 15 bp, Homo sapiens
taactcattaattaa

SEQ ID NO: 55519 - DNA, 15 bp, Homo sapiens
ttaactcattaatta

SEQ ID NO: 55520 - DNA, 15 bp, Homo sapiens
tttaactcattaatt

SEQ ID NO: 55521 - DNA, 15 bp, Homo sapiens
atttaactcattaat

SEQ ID NO: 55522 - DNA, 15 bp, Homo sapiens
tatttaactcattaa

SEQ ID NO: 55523 - DNA, 15 bp, Homo sapiens
ttatttaactcatta

SEQ ID NO: 55524 - DNA, 15 bp, Homo sapiens
tttatttaactcatt

SEQ ID NO: 55525 - DNA, 15 bp, Homo sapiens
atttatttaactcat

SEQ ID NO: 55526 - DNA, 15 bp, Homo sapiens
gatttatttaactca

SEQ ID NO: 55527 - DNA, 15 bp, Homo sapiens
agatttatttaactc

SEQ ID NO: 55528 - DNA, 15 bp, Homo sapiens
aagatttatttaact

SEQ ID NO: 55529 - DNA, 15 bp, Homo sapiens
aaagatttatttaac

SEQ ID NO: 55530 - DNA, 15 bp, Homo sapiens
caaagatttatttaa

SEQ ID NO: 55531 - DNA, 15 bp, Homo sapiens
tcaaagatttattta

SEQ ID NO: 55532 - DNA, 15 bp, Homo sapiens
gtcaaagatttattt

SEQ ID NO: 55533 - DNA, 15 bp, Homo sapiens
tgtcaaagatttatt

SEQ ID NO: 55534 - DNA, 15 bp, Homo sapiens
ctgtcaaagatttat

SEQ ID NO: 55535 - DNA, 15 bp, Homo sapiens
tctgtcaaagattta

SEQ ID NO: 55536 - DNA, 15 bp, Homo sapiens
gtctgtcaaagattt

SEQ ID NO: 55537 - DNA, 15 bp, Homo sapiens
tgtctgtcaaagatt

SEQ ID NO: 55538 - DNA, 15 bp, Homo sapiens
atgtctgtcaaagat

SEQ ID NO: 55539 - DNA, 15 bp, Homo sapiens
aatgtctgtcaaaga

SEQ ID NO: 55540 - DNA, 15 bp, Homo sapiens
taatgtctgtcaaag

SEQ ID NO: 55541 - DNA, 15 bp, Homo sapiens
ataatgtctgtcaaa

SEQ ID NO: 55542 - DNA, 15 bp, Homo sapiens
aataatgtctgtcaa

SEQ ID NO: 55543 - DNA, 15 bp, Homo sapiens
taataatgtctgtca

SEQ ID NO: 55544 - DNA, 15 bp, Homo sapiens
ataataatgtctgtc

SEQ ID NO: 55545 - DNA, 15 bp, Homo sapiens
gataataatgtctgt

SEQ ID NO: 55546 - DNA, 15 bp, Homo sapiens
tgataataatgtctg

SEQ ID NO: 55547 - DNA, 15 bp, Homo sapiens
gtgataataatgtct

SEQ ID NO: 55548 - DNA, 15 bp, Homo sapiens
tgtgataataatgtc

SEQ ID NO: 55549 - DNA, 15 bp, Homo sapiens
atgtgataataatgt

SEQ ID NO: 55550 - DNA, 15 bp, Homo sapiens
aatgtgataataatg

SEQ ID NO: 55551 - DNA, 15 bp, Homo sapiens
caatgtgataataat

SEQ ID NO: 55552 - DNA, 15 bp, Homo sapiens
ccaatgtgataataa

SEQ ID NO: 55553 - DNA, 15 bp, Homo sapiens
accaatgtgataata

SEQ ID NO: 55554 - DNA, 15 bp, Homo sapiens
aaccaatgtgataat

SEQ ID NO: 55555 - DNA, 15 bp, Homo sapiens
aaaccaatgtgataa

SEQ ID NO: 55556 - DNA, 15 bp, Homo sapiens
caaaccaatgtgata

SEQ ID NO: 55557 - DNA, 15 bp, Homo sapiens
tcaaaccaatgtgat

SEQ ID NO: 55558 - DNA, 15 bp, Homo sapiens
ctcaaaccaatgtga

SEQ ID NO: 55559 - DNA, 15 bp, Homo sapiens
tctcaaaccaatgtg

SEQ ID NO: 55560 - DNA, 15 bp, Homo sapiens
ctctcaaaccaatgt

SEQ ID NO: 55561 - DNA, 15 bp, Homo sapiens
actctcaaaccaatg

SEQ ID NO: 55562 - DNA, 15 bp, Homo sapiens
aactctcaaaccaat

SEQ ID NO: 55563 - DNA, 15 bp, Homo sapiens
taactctcaaaccaa

SEQ ID NO: 55564 - DNA, 15 bp, Homo sapiens
ataactctcaaacca

SEQ ID NO: 55565 - DNA, 15 bp, Homo sapiens
cataactctcaaacc

SEQ ID NO: 55566 - DNA, 15 bp, Homo sapiens
tcataactctcaaac

SEQ ID NO: 55567 - DNA, 15 bp, Homo sapiens
gtcataactctcaaa

SEQ ID NO: 55568 - DNA, 15 bp, Homo sapiens
agtcataactctcaa

SEQ ID NO: 55569 - DNA, 15 bp, Homo sapiens
aagtcataactctca

SEQ ID NO: 55570 - DNA, 15 bp, Homo sapiens
aaagtcataactctc

SEQ ID NO: 55571 - DNA, 15 bp, Homo sapiens
taaagtcataactct

SEQ ID NO: 55572 - DNA, 15 bp, Homo sapiens
gtaaagtcataactc

SEQ ID NO: 55573 - DNA, 15 bp, Homo sapiens
ggtaaagtcataact

SEQ ID NO: 55574 - DNA, 15 bp, Homo sapiens
aggtaaagtcataac

SEQ ID NO: 55575 - DNA, 15 bp, Homo sapiens
aaggtaaagtcataa

SEQ ID NO: 55576 - DNA, 15 bp, Homo sapiens
caaggtaaagtcata

SEQ ID NO: 55577 - DNA, 15 bp, Homo sapiens
acaaggtaaagtcat

SEQ ID NO: 55578 - DNA, 15 bp, Homo sapiens
aacaaggtaaagtca

SEQ ID NO: 55579 - DNA, 15 bp, Homo sapiens
caacaaggtaaagtc

SEQ ID NO: 55580 - DNA, 15 bp, Homo sapiens
ccaacaaggtaaagt

SEQ ID NO: 55581 - DNA, 15 bp, Homo sapiens
tccaacaaggtaaag

SEQ ID NO: 55582 - DNA, 15 bp, Homo sapiens
ttccaacaaggtaaa

SEQ ID NO: 55583 - DNA, 15 bp, Homo sapiens
tttccaacaaggtaa

SEQ ID NO: 55584 - DNA, 15 bp, Homo sapiens
ttttccaacaaggta

SEQ ID NO: 55585 - DNA, 15 bp, Homo sapiens
attttccaacaaggt

SEQ ID NO: 55586 - DNA, 15 bp, Homo sapiens
aattttccaacaagg

SEQ ID NO: 55587 - DNA, 15 bp, Homo sapiens
taattttccaacaag

SEQ ID NO: 55588 - DNA, 15 bp, Homo sapiens
ataattttccaacaa

SEQ ID NO: 55589 - DNA, 15 bp, Homo sapiens
gataattttccaaca

SEQ ID NO: 55590 - DNA, 15 bp, Homo sapiens
ggataattttccaac

SEQ ID NO: 55591 - DNA, 15 bp, Homo sapiens
aggataattttccaa

SEQ ID NO: 55592 - DNA, 15 bp, Homo sapiens
aaggataattttcca

SEQ ID NO: 55593 - DNA, 15 bp, Homo sapiens
caaggataattttcc

SEQ ID NO: 55594 - DNA, 15 bp, Homo sapiens
tcaaggataattttc

SEQ ID NO: 55595 - DNA, 15 bp, Homo sapiens
ttcaaggataatttt

SEQ ID NO: 55596 - DNA, 15 bp, Homo sapiens
attcaaggataattt

SEQ ID NO: 55597 - DNA, 15 bp, Homo sapiens
tattcaaggataatt

SEQ ID NO: 55598 - DNA, 15 bp, Homo sapiens
gtattcaaggataat

SEQ ID NO: 55599 - DNA, 15 bp, Homo sapiens
tgtattcaaggataa

SEQ ID NO: 55600 - DNA, 15 bp, Homo sapiens
atgtattcaaggata

SEQ ID NO: 55601 - DNA, 15 bp, Homo sapiens
catgtattcaaggat

SEQ ID NO: 55602 - DNA, 15 bp, Homo sapiens
ccatgtattcaagga

SEQ ID NO: 55603 - DNA, 15 bp, Homo sapiens
tccatgtattcaagg

SEQ ID NO: 55604 - DNA, 15 bp, Homo sapiens
gtccatgtattcaag

SEQ ID NO: 55605 - DNA, 15 bp, Homo sapiens
ggtccatgtattcaa

SEQ ID NO: 55606 - DNA, 15 bp, Homo sapiens
tggtccatgtattca

SEQ ID NO: 55607 - DNA, 15 bp, Homo sapiens
gtggtccatgtattc

SEQ ID NO: 55608 - DNA, 15 bp, Homo sapiens
agtggtccatgtatt

SEQ ID NO: 55609 - DNA, 15 bp, Homo sapiens
cagtggtccatgtat

SEQ ID NO: 55610 - DNA, 15 bp, Homo sapiens
acagtggtccatgta

SEQ ID NO: 55611 - DNA, 15 bp, Homo sapiens
cacagtggtccatgt

SEQ ID NO: 55612 - DNA, 15 bp, Homo sapiens
tcacagtggtccatg

SEQ ID NO: 55613 - DNA, 15 bp, Homo sapiens
atcacagtggtccat

SEQ ID NO: 55614 - DNA, 15 bp, Homo sapiens
tatcacagtggtcca

SEQ ID NO: 55615 - DNA, 15 bp, Homo sapiens
ttatcacagtggtcc

SEQ ID NO: 55616 - DNA, 15 bp, Homo sapiens
attatcacagtggtc

SEQ ID NO: 55617 - DNA, 15 bp, Homo sapiens
gattatcacagtggt

SEQ ID NO: 55618 - DNA, 15 bp, Homo sapiens
agattatcacagtgg

SEQ ID NO: 55619 - DNA, 15 bp, Homo sapiens
cagattatcacagtg

SEQ ID NO: 55620 - DNA, 15 bp, Homo sapiens
gcagattatcacagt

SEQ ID NO: 55621 - DNA, 15 bp, Homo sapiens
agcagattatcacag

SEQ ID NO: 55622 - DNA, 15 bp, Homo sapiens
tagcagattatcaca

SEQ ID NO: 55623 - DNA, 15 bp, Homo sapiens
ttagcagattatcac

SEQ ID NO: 55624 - DNA, 15 bp, Homo sapiens
attagcagattatca

SEQ ID NO: 55625 - DNA, 15 bp, Homo sapiens
aattagcagattatc

SEQ ID NO: 55626 - DNA, 15 bp, Homo sapiens
caattagcagattat

SEQ ID NO: 55627 - DNA, 15 bp, Homo sapiens
ccaattagcagatta

SEQ ID NO: 55628 - DNA, 15 bp, Homo sapiens
accaattagcagatt

SEQ ID NO: 55629 - DNA, 15 bp, Homo sapiens
aaccaattagcagat

SEQ ID NO: 55630 - DNA, 15 bp, Homo sapiens
gaaccaattagcaga

SEQ ID NO: 55631 - DNA, 15 bp, Homo sapiens
agaaccaattagcag

SEQ ID NO: 55632 - DNA, 15 bp, Homo sapiens
aagaaccaattagca

SEQ ID NO: 55633 - DNA, 15 bp, Homo sapiens
gaagaaccaattagc

SEQ ID NO: 55634 - DNA, 15 bp, Homo sapiens
ggaagaaccaattag

SEQ ID NO: 55635 - DNA, 15 bp, Homo sapiens
tggaagaaccaatta

SEQ ID NO: 55636 - DNA, 15 bp, Homo sapiens
atggaagaaccaatt

SEQ ID NO: 55637 - DNA, 15 bp, Homo sapiens
aatggaagaaccaat

SEQ ID NO: 55638 - DNA, 15 bp, Homo sapiens
gaatggaagaaccaa

SEQ ID NO: 55639 - DNA, 15 bp, Homo sapiens
ggaatggaagaacca

SEQ ID NO: 55640 - DNA, 15 bp, Homo sapiens
tggaatggaagaacc

SEQ ID NO: 55641 - DNA, 15 bp, Homo sapiens
atggaatggaagaac

SEQ ID NO: 55642 - DNA, 15 bp, Homo sapiens
catggaatggaagaa

SEQ ID NO: 55643 - DNA, 15 bp, Homo sapiens
gcatggaatggaaga

SEQ ID NO: 55644 - DNA, 15 bp, Homo sapiens
agcatggaatggaag

SEQ ID NO: 55645 - DNA, 15 bp, Homo sapiens
gagcatggaatggaa

SEQ ID NO: 55646 - DNA, 15 bp, Homo sapiens
ggagcatggaatgga

SEQ ID NO: 55647 - DNA, 15 bp, Homo sapiens
tggagcatggaatgg

SEQ ID NO: 55648 - DNA, 15 bp, Homo sapiens
gtggagcatggaatg

SEQ ID NO: 55649 - DNA, 15 bp, Homo sapiens
ggtggagcatggaat

SEQ ID NO: 55650 - DNA, 15 bp, Homo sapiens
aggtggagcatggaa

SEQ ID NO: 55651 - DNA, 15 bp, Homo sapiens
aaggtggagcatgga

SEQ ID NO: 55652 - DNA, 15 bp, Homo sapiens
gaaggtggagcatgg

SEQ ID NO: 55653 - DNA, 15 bp, Homo sapiens
agaaggtggagcatg

SEQ ID NO: 55654 - DNA, 15 bp, Homo sapiens
gagaaggtggagcat

SEQ ID NO: 55655 - DNA, 15 bp, Homo sapiens
ggagaaggtggagca

SEQ ID NO: 55656 - DNA, 15 bp, Homo sapiens
tggagaaggtggagc

SEQ ID NO: 55657 - DNA, 15 bp, Homo sapiens
atggagaaggtggag

SEQ ID NO: 55658 - DNA, 15 bp, Homo sapiens
gatggagaaggtgga

SEQ ID NO: 55659 - DNA, 15 bp, Homo sapiens
agatggagaaggtgg

SEQ ID NO: 55660 - DNA, 15 bp, Homo sapiens
gagatggagaaggtg

SEQ ID NO: 55661 - DNA, 15 bp, Homo sapiens
ggagatggagaaggt

SEQ ID NO: 55662 - DNA, 15 bp, Homo sapiens
gggagatggagaagg

SEQ ID NO: 55663 - DNA, 15 bp, Homo sapiens
agggagatggagaag

SEQ ID NO: 55664 - DNA, 15 bp, Homo sapiens
aagggagatggagaa

SEQ ID NO: 55665 - DNA, 15 bp, Homo sapiens
aaagggagatggaga

SEQ ID NO: 55666 - DNA, 15 bp, Homo sapiens
gaaagggagatggag

SEQ ID NO: 55667 - DNA, 15 bp, Homo sapiens
ggaaagggagatgga

SEQ ID NO: 55668 - DNA, 15 bp, Homo sapiens
aggaaagggagatgg

SEQ ID NO: 55669 - DNA, 15 bp, Homo sapiens
aaggaaagggagatg

SEQ ID NO: 55670 - DNA, 15 bp, Homo sapiens
aaaggaaagggagat

SEQ ID NO: 55671 - DNA, 15 bp, Homo sapiens
aaaaggaaagggaga

SEQ ID NO: 55672 - DNA, 15 bp, Homo sapiens
aaaaaggaaagggag

SEQ ID NO: 55673 - DNA, 15 bp, Homo sapiens
aaaaaaggaaaggga

SEQ ID NO: 55674 - DNA, 15 bp, Homo sapiens
aaaaaaaggaaaggg

SEQ ID NO: 55675 - DNA, 15 bp, Homo sapiens
aaaaaaaaggaaagg

SEQ ID NO: 55676 - DNA, 15 bp, Homo sapiens
gaaaaaaaaaggaaa

SEQ ID NO: 55677 - DNA, 15 bp, Homo sapiens
agaaaaaaaaaggaa

SEQ ID NO: 55678 - DNA, 15 bp, Homo sapiens
aagaaaaaaaaagga

SEQ ID NO: 55679 - DNA, 15 bp, Homo sapiens
aaagaaaaaaaaagg

SEQ ID NO: 55680 - DNA, 15 bp, Homo sapiens
aaaagaaaaaaaaag

SEQ ID NO: 55681 - DNA, 15 bp, Homo sapiens
gaaaagaaaaaaaaa

SEQ ID NO: 55682 - DNA, 15 bp, Homo sapiens
agaaaagaaaaaaaa

SEQ ID NO: 55683 - DNA, 15 bp, Homo sapiens
aagaaaagaaaaaaa

SEQ ID NO: 55684 - DNA, 15 bp, Homo sapiens
gtgtctcaaaaaaaa

SEQ ID NO: 55685 - DNA, 15 bp, Homo sapiens
tgtgtctcaaaaaaa

SEQ ID NO: 55686 - DNA, 15 bp, Homo sapiens
ctgtgtctcaaaaaa

SEQ ID NO: 55687 - DNA, 15 bp, Homo sapiens
actgtgtctcaaaaa

SEQ ID NO: 55688 - DNA, 15 bp, Homo sapiens
gactgtgtctcaaaa

SEQ ID NO: 55689 - DNA, 15 bp, Homo sapiens
agactgtgtctcaaa

SEQ ID NO: 55690 - DNA, 15 bp, Homo sapiens
tagactgtgtctcaa

SEQ ID NO: 55691 - DNA, 15 bp, Homo sapiens
ctagactgtgtctca

SEQ ID NO: 55692 - DNA, 15 bp, Homo sapiens
gctagactgtgtctc

SEQ ID NO: 55693 - DNA, 15 bp, Homo sapiens
agctagactgtgtct

SEQ ID NO: 55694 - DNA, 15 bp, Homo sapiens
gagctagactgtgtc

SEQ ID NO: 55695 - DNA, 15 bp, Homo sapiens
agagctagactgtgt

SEQ ID NO: 55696 - DNA, 15 bp, Homo sapiens
cagagctagactgtg

SEQ ID NO: 55697 - DNA, 15 bp, Homo sapiens
acagagctagactgt

SEQ ID NO: 55698 - DNA, 15 bp, Homo sapiens
aacagagctagactg

SEQ ID NO: 55699 - DNA, 15 bp, Homo sapiens
caacagagctagact

SEQ ID NO: 55700 - DNA, 15 bp, Homo sapiens
gcaacagagctagac

SEQ ID NO: 55701 - DNA, 15 bp, Homo sapiens
ggcaacagagctaga

SEQ ID NO: 55702 - DNA, 15 bp, Homo sapiens
gggcaacagagctag

SEQ ID NO: 55703 - DNA, 15 bp, Homo sapiens
tgggcaacagagcta

SEQ ID NO: 55704 - DNA, 15 bp, Homo sapiens
ctgggcaacagagct

SEQ ID NO: 55705 - DNA, 15 bp, Homo sapiens
actgggcaacagagc

SEQ ID NO: 55706 - DNA, 15 bp, Homo sapiens
gactgggcaacagag

SEQ ID NO: 55707 - DNA, 15 bp, Homo sapiens
agactgggcaacaga

SEQ ID NO: 55708 - DNA, 15 bp, Homo sapiens
cagactgggcaacag

SEQ ID NO: 55709 - DNA, 15 bp, Homo sapiens
ccagactgggcaaca

SEQ ID NO: 55710 - DNA, 15 bp, Homo sapiens
tccagactgggcaac

SEQ ID NO: 55711 - DNA, 15 bp, Homo sapiens
ctccagactgggcaa

SEQ ID NO: 55712 - DNA, 15 bp, Homo sapiens
actccagactgggca

SEQ ID NO: 55713 - DNA, 15 bp, Homo sapiens
cactccagactgggc

SEQ ID NO: 55714 - DNA, 15 bp, Homo sapiens
gcactccagactggg

SEQ ID NO: 55715 - DNA, 15 bp, Homo sapiens
tgcactccagactgg

SEQ ID NO: 55716 - DNA, 15 bp, Homo sapiens
ctgcactccagactg

SEQ ID NO: 55717 - DNA, 15 bp, Homo sapiens
actgcactccagact

SEQ ID NO: 55718 - DNA, 15 bp, Homo sapiens
cactgcactccagac

SEQ ID NO: 55719 - DNA, 15 bp, Homo sapiens
ccactgcactccaga

SEQ ID NO: 55720 - DNA, 15 bp, Homo sapiens
aagattgcaccactg

SEQ ID NO: 55721 - DNA, 15 bp, Homo sapiens
caagattgcaccact

SEQ ID NO: 55722 - DNA, 15 bp, Homo sapiens
ccaagattgcaccac

SEQ ID NO: 55723 - DNA, 15 bp, Homo sapiens
gccaagattgcacca

SEQ ID NO: 55724 - DNA, 15 bp, Homo sapiens
agccaagattgcacc

SEQ ID NO: 55725 - DNA, 15 bp, Homo sapiens
gagccaagattgcac

SEQ ID NO: 55726 - DNA, 15 bp, Homo sapiens
tgagccaagattgca

SEQ ID NO: 55727 - DNA, 15 bp, Homo sapiens
atgagccaagattgc

SEQ ID NO: 55728 - DNA, 15 bp, Homo sapiens
aatgagccaagattg

SEQ ID NO: 55729 - DNA, 15 bp, Homo sapiens
caatgagccaagatt

SEQ ID NO: 55730 - DNA, 15 bp, Homo sapiens
gcaatgagccaagat

SEQ ID NO: 55731 - DNA, 15 bp, Homo sapiens
tgcaatgagccaaga

SEQ ID NO: 55732 - DNA, 15 bp, Homo sapiens
ctgcaatgagccaag

SEQ ID NO: 55733 - DNA, 15 bp, Homo sapiens
gctgcaatgagccaa

SEQ ID NO: 55734 - DNA, 15 bp, Homo sapiens
ggctgcaatgagcca

SEQ ID NO: 55735 - DNA, 15 bp, Homo sapiens
aggctgcaatgagcc

SEQ ID NO: 55736 - DNA, 15 bp, Homo sapiens
caggctgcaatgagc

SEQ ID NO: 55737 - DNA, 15 bp, Homo sapiens
gcaggctgcaatgag

SEQ ID NO: 55738 - DNA, 15 bp, Homo sapiens
tgcaggctgcaatga

SEQ ID NO: 55739 - DNA, 15 bp, Homo sapiens
ctgcaggctgcaatg

SEQ ID NO: 55740 - DNA, 15 bp, Homo sapiens
gctgcaggctgcaat

SEQ ID NO: 55741 - DNA, 15 bp, Homo sapiens
ggctgcaggctgcaa

SEQ ID NO: 55742 - DNA, 15 bp, Homo sapiens
aggctgcaggctgca

SEQ ID NO: 55743 - DNA, 15 bp, Homo sapiens
gaggctgcaggctgc

SEQ ID NO: 55744 - DNA, 15 bp, Homo sapiens
agaggctgcaggctg

SEQ ID NO: 55745 - DNA, 15 bp, Homo sapiens
cagaggctgcaggct

SEQ ID NO: 55746 - DNA, 15 bp, Homo sapiens
gcagaggctgcaggc

SEQ ID NO: 55747 - DNA, 15 bp, Homo sapiens
ggcagaggctgcagg

SEQ ID NO: 55748 - DNA, 15 bp, Homo sapiens
aggcagaggctgcag

SEQ ID NO: 55749 - DNA, 15 bp, Homo sapiens
gaggcagaggctgca

SEQ ID NO: 55750 - DNA, 15 bp, Homo sapiens
ggaggcagaggctgc

SEQ ID NO: 55751 - DNA, 15 bp, Homo sapiens
gggaggcagaggctg

SEQ ID NO: 55752 - DNA, 15 bp, Homo sapiens
tgggaggcagaggct

SEQ ID NO: 55753 - DNA, 15 bp, Homo sapiens
ctgggaggcagaggc

SEQ ID NO: 55754 - DNA, 15 bp, Homo sapiens
caacctgggaggcag

SEQ ID NO: 55755 - DNA, 15 bp, Homo sapiens
gcaacctgggaggca

SEQ ID NO: 55756 - DNA, 15 bp, Homo sapiens
tgcaacctgggaggc

SEQ ID NO: 55757 - DNA, 15 bp, Homo sapiens
ctgcaacctgggagg

SEQ ID NO: 55758 - DNA, 15 bp, Homo sapiens
gctgcaacctgggag

SEQ ID NO: 55759 - DNA, 15 bp, Homo sapiens
cgctgcaacctggga

SEQ ID NO: 55760 - DNA, 15 bp, Homo sapiens
tcgctgcaacctggg

SEQ ID NO: 55761 - DNA, 15 bp, Homo sapiens
atcgctgcaacctgg

SEQ ID NO: 55762 - DNA, 15 bp, Homo sapiens
aatcgctgcaacctg

SEQ ID NO: 55763 - DNA, 15 bp, Homo sapiens
gaatcgctgcaacct

SEQ ID NO: 55764 - DNA, 15 bp, Homo sapiens
agaatcgctgcaacc

SEQ ID NO: 55765 - DNA, 15 bp, Homo sapiens
gagaatcgctgcaac

SEQ ID NO: 55766 - DNA, 15 bp, Homo sapiens
ggagaatcgctgcaa

SEQ ID NO: 55767 - DNA, 15 bp, Homo sapiens
aggagaatcgctgca

SEQ ID NO: 55768 - DNA, 15 bp, Homo sapiens
caggagaatcgctgc

SEQ ID NO: 55769 - DNA, 15 bp, Homo sapiens
gcaggagaatcgctg

SEQ ID NO: 55770 - DNA, 15 bp, Homo sapiens
agggaggctgaggca

SEQ ID NO: 55771 - DNA, 15 bp, Homo sapiens
tagggaggctgaggc

SEQ ID NO: 55772 - DNA, 15 bp, Homo sapiens
ctagggaggctgagg

SEQ ID NO: 55773 - DNA, 15 bp, Homo sapiens
actagggaggctgag

SEQ ID NO: 55774 - DNA, 15 bp, Homo sapiens
tactagggaggctga

SEQ ID NO: 55775 - DNA, 15 bp, Homo sapiens
ctactagggaggctg

SEQ ID NO: 55776 - DNA, 15 bp, Homo sapiens
gctactagggaggct

SEQ ID NO: 55777 - DNA, 15 bp, Homo sapiens
agctactagggaggc

SEQ ID NO: 55778 - DNA, 15 bp, Homo sapiens
cagctactagggagg

SEQ ID NO: 55779 - DNA, 15 bp, Homo sapiens
ccagctactagggag

SEQ ID NO: 55780 - DNA, 15 bp, Homo sapiens
cccagctactaggga

SEQ ID NO: 55781 - DNA, 15 bp, Homo sapiens
tcccagctactaggg

SEQ ID NO: 55782 - DNA, 15 bp, Homo sapiens
atcccagctactagg

SEQ ID NO: 55783 - DNA, 15 bp, Homo sapiens
aatcccagctactag

SEQ ID NO: 55784 - DNA, 15 bp, Homo sapiens
taatcccagctacta

SEQ ID NO: 55785 - DNA, 15 bp, Homo sapiens
cataatcccagctac

SEQ ID NO: 55786 - DNA, 15 bp, Homo sapiens
ccataatcccagcta

SEQ ID NO: 55787 - DNA, 15 bp, Homo sapiens
cccataatcccagct

SEQ ID NO: 55788 - DNA, 15 bp, Homo sapiens
gcccataatcccagc

SEQ ID NO: 55789 - DNA, 15 bp, Homo sapiens
cgcccataatcccag

SEQ ID NO: 55790 - DNA, 15 bp, Homo sapiens
gcgcccataatccca

SEQ ID NO: 55791 - DNA, 15 bp, Homo sapiens
tgcgcccataatccc

SEQ ID NO: 55792 - DNA, 15 bp, Homo sapiens
atgcgcccataatcc

SEQ ID NO: 55793 - DNA, 15 bp, Homo sapiens
catgcgcccataatc

SEQ ID NO: 55794 - DNA, 15 bp, Homo sapiens
acatgcgcccataat

SEQ ID NO: 55795 - DNA, 15 bp, Homo sapiens
gacatgcgcccataa

SEQ ID NO: 55796 - DNA, 15 bp, Homo sapiens
tgacatgcgcccata

SEQ ID NO: 55797 - DNA, 15 bp, Homo sapiens
gtgacatgcgcccat

SEQ ID NO: 55798 - DNA, 15 bp, Homo sapiens
ggtgacatgcgccca

SEQ ID NO: 55799 - DNA, 15 bp, Homo sapiens
tggtgacatgcgccc

SEQ ID NO: 55800 - DNA, 15 bp, Homo sapiens
atggtgacatgcgcc

SEQ ID NO: 55801 - DNA, 15 bp, Homo sapiens
catggtgacatgcgc

SEQ ID NO: 55802 - DNA, 15 bp, Homo sapiens
gcatggtgacatgcg

SEQ ID NO: 55803 - DNA, 15 bp, Homo sapiens
ggcatggtgacatgc

SEQ ID NO: 55804 - DNA, 15 bp, Homo sapiens
gggcatggtgacatg

SEQ ID NO: 55805 - DNA, 15 bp, Homo sapiens
tgggcatggtgacat

SEQ ID NO: 55806 - DNA, 15 bp, Homo sapiens
ctgggcatggtgaca

SEQ ID NO: 55807 - DNA, 15 bp, Homo sapiens
gctgggcatggtgac

SEQ ID NO: 55808 - DNA, 15 bp, Homo sapiens
agctgggcatggtga

SEQ ID NO: 55809 - DNA, 15 bp, Homo sapiens
agccaacatggtgaa

SEQ ID NO: 55810 - DNA, 15 bp, Homo sapiens
tagccaacatggtga

SEQ ID NO: 55811 - DNA, 15 bp, Homo sapiens
ctagccaacatggtg

SEQ ID NO: 55812 - DNA, 15 bp, Homo sapiens
cctagccaacatggt

SEQ ID NO: 55813 - DNA, 15 bp, Homo sapiens
gcctagccaacatgg

SEQ ID NO: 55814 - DNA, 15 bp, Homo sapiens
agcctagccaacatg

SEQ ID NO: 55815 - DNA, 15 bp, Homo sapiens
cagcctagccaacat

SEQ ID NO: 55816 - DNA, 15 bp, Homo sapiens
ccagcctagccaaca

SEQ ID NO: 55817 - DNA, 15 bp, Homo sapiens
accagcctagccaac

SEQ ID NO: 55818 - DNA, 15 bp, Homo sapiens
aaccagcctagccaa

SEQ ID NO: 55819 - DNA, 15 bp, Homo sapiens
aaaccagcctagcca

SEQ ID NO: 55820 - DNA, 15 bp, Homo sapiens
gaaaccagcctagcc

SEQ ID NO: 55821 - DNA, 15 bp, Homo sapiens
tgaaaccagcctagc

SEQ ID NO: 55822 - DNA, 15 bp, Homo sapiens
ttgaaaccagcctag

SEQ ID NO: 55823 - DNA, 15 bp, Homo sapiens
tttgaaaccagccta

SEQ ID NO: 55824 - DNA, 15 bp, Homo sapiens
gtttgaaaccagcct

SEQ ID NO: 55825 - DNA, 15 bp, Homo sapiens
agtttgaaaccagcc

SEQ ID NO: 55826 - DNA, 15 bp, Homo sapiens
gagtttgaaaccagc

SEQ ID NO: 55827 - DNA, 15 bp, Homo sapiens
ggagtttgaaaccag

SEQ ID NO: 55828 - DNA, 15 bp, Homo sapiens
aggagtttgaaacca

SEQ ID NO: 55829 - DNA, 15 bp, Homo sapiens
caggagtttgaaacc

SEQ ID NO: 55830 - DNA, 15 bp, Homo sapiens
tcaggagtttgaaac

SEQ ID NO: 55831 - DNA, 15 bp, Homo sapiens
gtcaggagtttgaaa

SEQ ID NO: 55832 - DNA, 15 bp, Homo sapiens
ggtcaggagtttgaa

SEQ ID NO: 55833 - DNA, 15 bp, Homo sapiens
cggatcacttgaggt

SEQ ID NO: 55834 - DNA, 15 bp, Homo sapiens
gcggatcacttgagg

SEQ ID NO: 55835 - DNA, 15 bp, Homo sapiens
ggcggatcacttgag

SEQ ID NO: 55836 - DNA, 15 bp, Homo sapiens
aggcggatcacttga

SEQ ID NO: 55837 - DNA, 15 bp, Homo sapiens
caggcggatcacttg

SEQ ID NO: 55838 - DNA, 15 bp, Homo sapiens
gcaggcggatcactt

SEQ ID NO: 55839 - DNA, 15 bp, Homo sapiens
ggcaggcggatcact

SEQ ID NO: 55840 - DNA, 15 bp, Homo sapiens
tcgaggcaggcggat

SEQ ID NO: 55841 - DNA, 15 bp, Homo sapiens
gtcgaggcaggcgga

SEQ ID NO: 55842 - DNA, 15 bp, Homo sapiens
ggtcgaggcaggcgg

SEQ ID NO: 55843 - DNA, 15 bp, Homo sapiens
aggtcgaggcaggcg

SEQ ID NO: 55844 - DNA, 15 bp, Homo sapiens
gaggtcgaggcaggc

SEQ ID NO: 55845 - DNA, 15 bp, Homo sapiens
ggaggtcgaggcagg

SEQ ID NO: 55846 - DNA, 15 bp, Homo sapiens
gggaggtcgaggcag

SEQ ID NO: 55847 - DNA, 15 bp, Homo sapiens
tgggaggtcgaggca

SEQ ID NO: 55848 - DNA, 15 bp, Homo sapiens
ttgggaggtcgaggc

SEQ ID NO: 55849 - DNA, 15 bp, Homo sapiens
tttgggaggtcgagg

SEQ ID NO: 55850 - DNA, 15 bp, Homo sapiens
tggtggctcacgcct

SEQ ID NO: 55851 - DNA, 15 bp, Homo sapiens
gtggtggctcacgcc

SEQ ID NO: 55852 - DNA, 15 bp, Homo sapiens
cgtggtggctcacgc

SEQ ID NO: 55853 - DNA, 15 bp, Homo sapiens
gcgtggtggctcacg

SEQ ID NO: 55854 - DNA, 15 bp, Homo sapiens
ggcgtggtggctcac

SEQ ID NO: 55855 - DNA, 15 bp, Homo sapiens
gggcgtggtggctca

SEQ ID NO: 55856 - DNA, 15 bp, Homo sapiens
cgggcgtggtggctc

SEQ ID NO: 55857 - DNA, 15 bp, Homo sapiens
ccgggcgtggtggct

SEQ ID NO: 55858 - DNA, 15 bp, Homo sapiens
ggccgggcgtggtgg

SEQ ID NO: 55859 - DNA, 15 bp, Homo sapiens
aggccgggcgtggtg

SEQ ID NO: 55860 - DNA, 15 bp, Homo sapiens
gaggccgggcgtggt

SEQ ID NO: 55861 - DNA, 15 bp, Homo sapiens
ggaggccgggcgtgg

SEQ ID NO: 55862 - DNA, 15 bp, Homo sapiens
gggaggccgggcgtg

SEQ ID NO: 55863 - DNA, 15 bp, Homo sapiens
ggggaggccgggcgt

SEQ ID NO: 55864 - DNA, 15 bp, Homo sapiens
aggggaggccgggcg

SEQ ID NO: 55865 - DNA, 15 bp, Homo sapiens
aaggggaggccgggc

SEQ ID NO: 55866 - DNA, 15 bp, Homo sapiens
gaaggggaggccggg

SEQ ID NO: 55867 - DNA, 15 bp, Homo sapiens
ggaaggggaggccgg

SEQ ID NO: 55868 - DNA, 15 bp, Homo sapiens
tggaaggggaggccg

SEQ ID NO: 55869 - DNA, 15 bp, Homo sapiens
atggaaggggaggcc

SEQ ID NO: 55870 - DNA, 15 bp, Homo sapiens
aatggaaggggaggc

SEQ ID NO: 55871 - DNA, 15 bp, Homo sapiens
aaatggaaggggagg

SEQ ID NO: 55872 - DNA, 15 bp, Homo sapiens
aaaatggaaggggag

SEQ ID NO: 55873 - DNA, 15 bp, Homo sapiens
gaaaatggaagggga

SEQ ID NO: 55874 - DNA, 15 bp, Homo sapiens
tgaaaatggaagggg

SEQ ID NO: 55875 - DNA, 15 bp, Homo sapiens
ttgaaaatggaaggg

SEQ ID NO: 55876 - DNA, 15 bp, Homo sapiens
cttgaaaatggaagg

SEQ ID NO: 55877 - DNA, 15 bp, Homo sapiens
tcttgaaaatggaag

SEQ ID NO: 55878 - DNA, 15 bp, Homo sapiens
ctcttgaaaatggaa

SEQ ID NO: 55879 - DNA, 15 bp, Homo sapiens
tctcttgaaaatgga

SEQ ID NO: 55880 - DNA, 15 bp, Homo sapiens
ctctcttgaaaatgg

SEQ ID NO: 55881 - DNA, 15 bp, Homo sapiens
actctcttgaaaatg

SEQ ID NO: 55882 - DNA, 15 bp, Homo sapiens
tactctcttgaaaat

SEQ ID NO: 55883 - DNA, 15 bp, Homo sapiens
atactctcttgaaaa

SEQ ID NO: 55884 - DNA, 15 bp, Homo sapiens
gatactctcttgaaa

SEQ ID NO: 55885 - DNA, 15 bp, Homo sapiens
agatactctcttgaa

SEQ ID NO: 55886 - DNA, 15 bp, Homo sapiens
tagatactctcttga

SEQ ID NO: 55887 - DNA, 15 bp, Homo sapiens
gtagatactctcttg

SEQ ID NO: 55888 - DNA, 15 bp, Homo sapiens
cgtagatactctctt

SEQ ID NO: 55889 - DNA, 15 bp, Homo sapiens
ccgtagatactctct

SEQ ID NO: 55890 - DNA, 15 bp, Homo sapiens
accgtagatactctc

SEQ ID NO: 55891 - DNA, 15 bp, Homo sapiens
caccgtagatactct

SEQ ID NO: 55892 - DNA, 15 bp, Homo sapiens
gcaccgtagatactc

SEQ ID NO: 55893 - DNA, 15 bp, Homo sapiens
agcaccgtagatact

SEQ ID NO: 55894 - DNA, 15 bp, Homo sapiens
aagcaccgtagatac

SEQ ID NO: 55895 - DNA, 15 bp, Homo sapiens
gaagcaccgtagata

SEQ ID NO: 55896 - DNA, 15 bp, Homo sapiens
agaagcaccgtagat

SEQ ID NO: 55897 - DNA, 15 bp, Homo sapiens
tagaagcaccgtaga

SEQ ID NO: 55898 - DNA, 15 bp, Homo sapiens
ttagaagcaccgtag

SEQ ID NO: 55899 - DNA, 15 bp, Homo sapiens
tttagaagcaccgta

SEQ ID NO: 55900 - DNA, 15 bp, Homo sapiens
ctttagaagcaccgt

SEQ ID NO: 55901 - DNA, 15 bp, Homo sapiens
cctttagaagcaccg

SEQ ID NO: 55902 - DNA, 15 bp, Homo sapiens
ccctttagaagcacc

SEQ ID NO: 55903 - DNA, 15 bp, Homo sapiens
accctttagaagcac

SEQ ID NO: 55904 - DNA, 15 bp, Homo sapiens
taccctttagaagca

SEQ ID NO: 55905 - DNA, 15 bp, Homo sapiens
ttaccctttagaagc

SEQ ID NO: 55906 - DNA, 15 bp, Homo sapiens
tttaccctttagaag

SEQ ID NO: 55907 - DNA, 15 bp, Homo sapiens
gtttaccctttagaa

SEQ ID NO: 55908 - DNA, 15 bp, Homo sapiens
ggtttaccctttaga

SEQ ID NO: 55909 - DNA, 15 bp, Homo sapiens
aggtttaccctttag

SEQ ID NO: 55910 - DNA, 15 bp, Homo sapiens
caggtttacccttta

SEQ ID NO: 55911 - DNA, 15 bp, Homo sapiens
tcaggtttacccttt

SEQ ID NO: 55912 - DNA, 15 bp, Homo sapiens
ttcaggtttaccctt

SEQ ID NO: 55913 - DNA, 15 bp, Homo sapiens
attcaggtttaccct

SEQ ID NO: 55914 - DNA, 15 bp, Homo sapiens
tattcaggtttaccc

SEQ ID NO: 55915 - DNA, 15 bp, Homo sapiens
gtattcaggtttacc

SEQ ID NO: 55916 - DNA, 15 bp, Homo sapiens
ggtattcaggtttac

SEQ ID NO: 55917 - DNA, 15 bp, Homo sapiens
aggtattcaggttta

SEQ ID NO: 55918 - DNA, 15 bp, Homo sapiens
aaggtattcaggttt

SEQ ID NO: 55919 - DNA, 15 bp, Homo sapiens
aaaggtattcaggtt

SEQ ID NO: 55920 - DNA, 15 bp, Homo sapiens
aaaaggtattcaggt

SEQ ID NO: 55921 - DNA, 15 bp, Homo sapiens
aaaaaggtattcagg

SEQ ID NO: 55922 - DNA, 15 bp, Homo sapiens
gaaaaaggtattcag

SEQ ID NO: 55923 - DNA, 15 bp, Homo sapiens
agaaaaaggtattca

SEQ ID NO: 55924 - DNA, 15 bp, Homo sapiens
gagaaaaaggtattc

SEQ ID NO: 55925 - DNA, 15 bp, Homo sapiens
agagaaaaaggtatt

SEQ ID NO: 55926 - DNA, 15 bp, Homo sapiens
aagagaaaaaggtat

SEQ ID NO: 55927 - DNA, 15 bp, Homo sapiens
gaagagaaaaaggta

SEQ ID NO: 55928 - DNA, 15 bp, Homo sapiens
agaagagaaaaaggt

SEQ ID NO: 55929 - DNA, 15 bp, Homo sapiens
cagaagagaaaaagg

SEQ ID NO: 55930 - DNA, 15 bp, Homo sapiens
acagaagagaaaaag

SEQ ID NO: 55931 - DNA, 15 bp, Homo sapiens
tacagaagagaaaaa

SEQ ID NO: 55932 - DNA, 15 bp, Homo sapiens
ttacagaagagaaaa

SEQ ID NO: 55933 - DNA, 15 bp, Homo sapiens
cttacagaagagaaa

SEQ ID NO: 55934 - DNA, 15 bp, Homo sapiens
gcttacagaagagaa

SEQ ID NO: 55935 - DNA, 15 bp, Homo sapiens
agcttacagaagaga

SEQ ID NO: 55936 - DNA, 15 bp, Homo sapiens
gagcttacagaagag

SEQ ID NO: 55937 - DNA, 15 bp, Homo sapiens
agagcttacagaaga

SEQ ID NO: 55938 - DNA, 15 bp, Homo sapiens
aagagcttacagaag

SEQ ID NO: 55939 - DNA, 15 bp, Homo sapiens
aaagagcttacagaa

SEQ ID NO: 55940 - DNA, 15 bp, Homo sapiens
gaaagagcttacaga

SEQ ID NO: 55941 - DNA, 15 bp, Homo sapiens
cgaaagagcttacag

SEQ ID NO: 55942 - DNA, 15 bp, Homo sapiens
acgaaagagcttaca

SEQ ID NO: 55943 - DNA, 15 bp, Homo sapiens
aacgaaagagcttac

SEQ ID NO: 55944 - DNA, 15 bp, Homo sapiens
caacgaaagagctta

SEQ ID NO: 55945 - DNA, 15 bp, Homo sapiens
ccaacgaaagagctt

SEQ ID NO: 55946 - DNA, 15 bp, Homo sapiens
cccaacgaaagagct

SEQ ID NO: 55947 - DNA, 15 bp, Homo sapiens
acccaacgaaagagc

SEQ ID NO: 55948 - DNA, 15 bp, Homo sapiens
cacccaacgaaagag

SEQ ID NO: 55949 - DNA, 15 bp, Homo sapiens
gcacccaacgaaaga

SEQ ID NO: 55950 - DNA, 15 bp, Homo sapiens
ggcacccaacgaaag

SEQ ID NO: 55951 - DNA, 15 bp, Homo sapiens
gggcacccaacgaaa

SEQ ID NO: 55952 - DNA, 15 bp, Homo sapiens
tgggcacccaacgaa

SEQ ID NO: 55953 - DNA, 15 bp, Homo sapiens
atgggcacccaacga

SEQ ID NO: 55954 - DNA, 15 bp, Homo sapiens
aatgggcacccaacg

SEQ ID NO: 55955 - DNA, 15 bp, Homo sapiens
aaatgggcacccaac

SEQ ID NO: 55956 - DNA, 15 bp, Homo sapiens
aaaatgggcacccaa

SEQ ID NO: 55957 - DNA, 15 bp, Homo sapiens
gaaaatgggcaccca

SEQ ID NO: 55958 - DNA, 15 bp, Homo sapiens
ggaaaatgggcaccc

SEQ ID NO: 55959 - DNA, 15 bp, Homo sapiens
aggaaaatgggcacc

SEQ ID NO: 55960 - DNA, 15 bp, Homo sapiens
aaggaaaatgggcac

SEQ ID NO: 55961 - DNA, 15 bp, Homo sapiens
aaaggaaaatgggca

SEQ ID NO: 55962 - DNA, 15 bp, Homo sapiens
aaaaggaaaatgggc

SEQ ID NO: 55963 - DNA, 15 bp, Homo sapiens
aaaaaggaaaatggg

SEQ ID NO: 55964 - DNA, 15 bp, Homo sapiens
aaaaaaggaaaatgg

SEQ ID NO: 55965 - DNA, 15 bp, Homo sapiens
aaaaaaaggaaaatg

SEQ ID NO: 55966 - DNA, 15 bp, Homo sapiens
taaaaaaaggaaaat

SEQ ID NO: 55967 - DNA, 15 bp, Homo sapiens
ttaaaaaaaggaaaa

SEQ ID NO: 55968 - DNA, 15 bp, Homo sapiens
tttaaaaaaaggaaa

SEQ ID NO: 55969 - DNA, 15 bp, Homo sapiens
ttttaaaaaaaggaa

SEQ ID NO: 55970 - DNA, 15 bp, Homo sapiens
tttttaaaaaaagga

SEQ ID NO: 55971 - DNA, 15 bp, Homo sapiens
ttttttaaaaaaagg

SEQ ID NO: 55972 - DNA, 15 bp, Homo sapiens
tgttttttaaaaaaa

SEQ ID NO: 55973 - DNA, 15 bp, Homo sapiens
gtgttttttaaaaaa

SEQ ID NO: 55974 - DNA, 15 bp, Homo sapiens
tgtgttttttaaaaa

SEQ ID NO: 55975 - DNA, 15 bp, Homo sapiens
ttgtgttttttaaaa

SEQ ID NO: 55976 - DNA, 15 bp, Homo sapiens
attgtgttttttaaa

SEQ ID NO: 55977 - DNA, 15 bp, Homo sapiens
aattgtgttttttaa

SEQ ID NO: 55978 - DNA, 15 bp, Homo sapiens
taattgtgtttttta

SEQ ID NO: 55979 - DNA, 15 bp, Homo sapiens
ttaattgtgtttttt

SEQ ID NO: 55980 - DNA, 15 bp, Homo sapiens
tttaattgtgttttt

SEQ ID NO: 55981 - DNA, 15 bp, Homo sapiens
ttttaattgtgtttt

SEQ ID NO: 55982 - DNA, 15 bp, Homo sapiens
tttttaattgtgttt

SEQ ID NO: 55983 - DNA, 15 bp, Homo sapiens
atttttaattgtgtt

SEQ ID NO: 55984 - DNA, 15 bp, Homo sapiens
aatttttaattgtgt

SEQ ID NO: 55985 - DNA, 15 bp, Homo sapiens
caatttttaattgtg

SEQ ID NO: 55986 - DNA, 15 bp, Homo sapiens
tcaatttttaattgt

SEQ ID NO: 55987 - DNA, 15 bp, Homo sapiens
ttcaatttttaattg

SEQ ID NO: 55988 - DNA, 15 bp, Homo sapiens
tttcaatttttaatt

SEQ ID NO: 55989 - DNA, 15 bp, Homo sapiens
atttcaatttttaat

SEQ ID NO: 55990 - DNA, 15 bp, Homo sapiens
aatttcaatttttaa

SEQ ID NO: 55991 - DNA, 15 bp, Homo sapiens
caatttcaattttta

SEQ ID NO: 55992 - DNA, 15 bp, Homo sapiens
acaatttcaattttt

SEQ ID NO: 55993 - DNA, 15 bp, Homo sapiens
tacaatttcaatttt

SEQ ID NO: 55994 - DNA, 15 bp, Homo sapiens
atacaatttcaattt

SEQ ID NO: 55995 - DNA, 15 bp, Homo sapiens
tatacaatttcaatt

SEQ ID NO: 55996 - DNA, 15 bp, Homo sapiens
ttatacaatttcaat

SEQ ID NO: 55997 - DNA, 15 bp, Homo sapiens
attatacaatttcaa

SEQ ID NO: 55998 - DNA, 15 bp, Homo sapiens
aattatacaatttca

SEQ ID NO: 55999 - DNA, 15 bp, Homo sapiens
aaattatacaatttc

SEQ ID NO: 56000 - DNA, 15 bp, Homo sapiens
aaaattatacaattt

SEQ ID NO: 56001 - DNA, 15 bp, Homo sapiens
aaaaattatacaatt

SEQ ID NO: 56002 - DNA, 15 bp, Homo sapiens
caaaaattatacaat

SEQ ID NO: 56003 - DNA, 15 bp, Homo sapiens
ccaaaaattatacaa

SEQ ID NO: 56004 - DNA, 15 bp, Homo sapiens
accaaaaattataca

SEQ ID NO: 56005 - DNA, 15 bp, Homo sapiens
taccaaaaattatac

SEQ ID NO: 56006 - DNA, 15 bp, Homo sapiens
ataccaaaaattata

SEQ ID NO: 56007 - DNA, 15 bp, Homo sapiens
tataccaaaaattat

SEQ ID NO: 56008 - DNA, 15 bp, Homo sapiens
atataccaaaaatta

SEQ ID NO: 56009 - DNA, 15 bp, Homo sapiens
tatataccaaaaatt

SEQ ID NO: 56010 - DNA, 15 bp, Homo sapiens
ctatataccaaaaat

SEQ ID NO: 56011 - DNA, 15 bp, Homo sapiens
actatataccaaaaa

SEQ ID NO: 56012 - DNA, 15 bp, Homo sapiens
cactatataccaaaa

SEQ ID NO: 56013 - DNA, 15 bp, Homo sapiens
acactatataccaaa

SEQ ID NO: 56014 - DNA, 15 bp, Homo sapiens
cacactatataccaa

SEQ ID NO: 56015 - DNA, 15 bp, Homo sapiens
tcacactatatacca

SEQ ID NO: 56016 - DNA, 15 bp, Homo sapiens
atcacactatatacc

SEQ ID NO: 56017 - DNA, 15 bp, Homo sapiens
catcacactatatac

SEQ ID NO: 56018 - DNA, 15 bp, Homo sapiens
acatcacactatata

SEQ ID NO: 56019 - DNA, 15 bp, Homo sapiens
aacatcacactatat

SEQ ID NO: 56020 - DNA, 15 bp, Homo sapiens
aaacatcacactata

SEQ ID NO: 56021 - DNA, 15 bp, Homo sapiens
aaaacatcacactat

SEQ ID NO: 56022 - DNA, 15 bp, Homo sapiens
caaaacatcacacta

SEQ ID NO: 56023 - DNA, 15 bp, Homo sapiens
ccaaaacatcacact

SEQ ID NO: 56024 - DNA, 15 bp, Homo sapiens
accaaaacatcacac

SEQ ID NO: 56025 - DNA, 15 bp, Homo sapiens
gaccaaaacatcaca

SEQ ID NO: 56026 - DNA, 15 bp, Homo sapiens
agaccaaaacatcac

SEQ ID NO: 56027 - DNA, 15 bp, Homo sapiens
aagaccaaaacatca

SEQ ID NO: 56028 - DNA, 15 bp, Homo sapiens
taagaccaaaacatc

SEQ ID NO: 56029 - DNA, 15 bp, Homo sapiens
gtaagaccaaaacat

SEQ ID NO: 56030 - DNA, 15 bp, Homo sapiens
agtaagaccaaaaca

SEQ ID NO: 56031 - DNA, 15 bp, Homo sapiens
aagtaagaccaaaac

SEQ ID NO: 56032 - DNA, 15 bp, Homo sapiens
caagtaagaccaaaa

SEQ ID NO: 56033 - DNA, 15 bp, Homo sapiens
ccaagtaagaccaaa

SEQ ID NO: 56034 - DNA, 15 bp, Homo sapiens
accaagtaagaccaa

SEQ ID NO: 56035 - DNA, 15 bp, Homo sapiens
aaccaagtaagacca

SEQ ID NO: 56036 - DNA, 15 bp, Homo sapiens
gaaccaagtaagacc

SEQ ID NO: 56037 - DNA, 15 bp, Homo sapiens
agaaccaagtaagac

SEQ ID NO: 56038 - DNA, 15 bp, Homo sapiens
aagaaccaagtaaga

SEQ ID NO: 56039 - DNA, 15 bp, Homo sapiens
taagaaccaagtaag

SEQ ID NO: 56040 - DNA, 15 bp, Homo sapiens
ttaagaaccaagtaa

SEQ ID NO: 56041 - DNA, 15 bp, Homo sapiens
tttaagaaccaagta

SEQ ID NO: 56042 - DNA, 15 bp, Homo sapiens
ctttaagaaccaagt

SEQ ID NO: 56043 - DNA, 15 bp, Homo sapiens
gctttaagaaccaag

SEQ ID NO: 56044 - DNA, 15 bp, Homo sapiens
agctttaagaaccaa

SEQ ID NO: 56045 - DNA, 15 bp, Homo sapiens
gagctttaagaacca

SEQ ID NO: 56046 - DNA, 15 bp, Homo sapiens
agagctttaagaacc

SEQ ID NO: 56047 - DNA, 15 bp, Homo sapiens
tagagctttaagaac

SEQ ID NO: 56048 - DNA, 15 bp, Homo sapiens
ttagagctttaagaa

SEQ ID NO: 56049 - DNA, 15 bp, Homo sapiens
tttagagctttaaga

SEQ ID NO: 56050 - DNA, 15 bp, Homo sapiens
atttagagctttaag

SEQ ID NO: 56051 - DNA, 15 bp, Homo sapiens
tatttagagctttaa

SEQ ID NO: 56052 - DNA, 15 bp, Homo sapiens
ctatttagagcttta

SEQ ID NO: 56053 - DNA, 15 bp, Homo sapiens
gctatttagagcttt

SEQ ID NO: 56054 - DNA, 15 bp, Homo sapiens
agctatttagagctt

SEQ ID NO: 56055 - DNA, 15 bp, Homo sapiens
cagctatttagagct

SEQ ID NO: 56056 - DNA, 15 bp, Homo sapiens
gcagctatttagagc

SEQ ID NO: 56057 - DNA, 15 bp, Homo sapiens
ggcagctatttagag

SEQ ID NO: 56058 - DNA, 15 bp, Homo sapiens
aggcagctatttaga

SEQ ID NO: 56059 - DNA, 15 bp, Homo sapiens
gaggcagctatttag

SEQ ID NO: 56060 - DNA, 15 bp, Homo sapiens
ggaggcagctattta

SEQ ID NO: 56061 - DNA, 15 bp, Homo sapiens
gggaggcagctattt

SEQ ID NO: 56062 - DNA, 15 bp, Homo sapiens
tgggaggcagctatt

SEQ ID NO: 56063 - DNA, 15 bp, Homo sapiens
ttgggaggcagctat

SEQ ID NO: 56064 - DNA, 15 bp, Homo sapiens
attgggaggcagcta

SEQ ID NO: 56065 - DNA, 15 bp, Homo sapiens
aattgggaggcagct

SEQ ID NO: 56066 - DNA, 15 bp, Homo sapiens
aaattgggaggcagc

SEQ ID NO: 56067 - DNA, 15 bp, Homo sapiens
taaattgggaggcag

SEQ ID NO: 56068 - DNA, 15 bp, Homo sapiens
gtaaattgggaggca

SEQ ID NO: 56069 - DNA, 15 bp, Homo sapiens
agtaaattgggaggc

SEQ ID NO: 56070 - DNA, 15 bp, Homo sapiens
gagtaaattgggagg

SEQ ID NO: 56071 - DNA, 15 bp, Homo sapiens
ggagtaaattgggag

SEQ ID NO: 56072 - DNA, 15 bp, Homo sapiens
aggagtaaattggga

SEQ ID NO: 56073 - DNA, 15 bp, Homo sapiens
taggagtaaattggg

SEQ ID NO: 56074 - DNA, 15 bp, Homo sapiens
ttaggagtaaattgg

SEQ ID NO: 56075 - DNA, 15 bp, Homo sapiens
attaggagtaaattg

SEQ ID NO: 56076 - DNA, 15 bp, Homo sapiens
aattaggagtaaatt

SEQ ID NO: 56077 - DNA, 15 bp, Homo sapiens
aaattaggagtaaat

SEQ ID NO: 56078 - DNA, 15 bp, Homo sapiens
aaaattaggagtaaa

SEQ ID NO: 56079 - DNA, 15 bp, Homo sapiens
taaaattaggagtaa

SEQ ID NO: 56080 - DNA, 15 bp, Homo sapiens
ataaaattaggagta

SEQ ID NO: 56081 - DNA, 15 bp, Homo sapiens
aataaaattaggagt

SEQ ID NO: 56082 - DNA, 15 bp, Homo sapiens
aaataaaattaggag

SEQ ID NO: 56083 - DNA, 15 bp, Homo sapiens
aaaataaaattagga

SEQ ID NO: 56084 - DNA, 15 bp, Homo sapiens
taaaataaaattagg

SEQ ID NO: 56085 - DNA, 15 bp, Homo sapiens
gtaaaataaaattag

SEQ ID NO: 56086 - DNA, 15 bp, Homo sapiens
agtaaaataaaatta

SEQ ID NO: 56087 - DNA, 15 bp, Homo sapiens
aagtaaaataaaatt

SEQ ID NO: 56088 - DNA, 15 bp, Homo sapiens
aaagtaaaataaaat

SEQ ID NO: 56089 - DNA, 15 bp, Homo sapiens
gaaagtaaaataaaa

SEQ ID NO: 56090 - DNA, 15 bp, Homo sapiens
ggaaagtaaaataaa

SEQ ID NO: 56091 - DNA, 15 bp, Homo sapiens
aggaaagtaaaataa

SEQ ID NO: 56092 - DNA, 15 bp, Homo sapiens
gaggaaagtaaaata

SEQ ID NO: 56093 - DNA, 15 bp, Homo sapiens
agaggaaagtaaaat

SEQ ID NO: 56094 - DNA, 15 bp, Homo sapiens
gagaggaaagtaaaa

SEQ ID NO: 56095 - DNA, 15 bp, Homo sapiens
cgagaggaaagtaaa

SEQ ID NO: 56096 - DNA, 15 bp, Homo sapiens
gcgagaggaaagtaa

SEQ ID NO: 56097 - DNA, 15 bp, Homo sapiens
agcgagaggaaagta

SEQ ID NO: 56098 - DNA, 15 bp, Homo sapiens
gagcgagaggaaagt

SEQ ID NO: 56099 - DNA, 15 bp, Homo sapiens
ggagcgagaggaaag

SEQ ID NO: 56100 - DNA, 15 bp, Homo sapiens
gggagcgagaggaaa

SEQ ID NO: 56101 - DNA, 15 bp, Homo sapiens
agggagcgagaggaa

SEQ ID NO: 56102 - DNA, 15 bp, Homo sapiens
gagggagcgagagga

SEQ ID NO: 56103 - DNA, 15 bp, Homo sapiens
tgagggagcgagagg

SEQ ID NO: 56104 - DNA, 15 bp, Homo sapiens
atgagggagcgagag

SEQ ID NO: 56105 - DNA, 15 bp, Homo sapiens
aatgagggagcgaga

SEQ ID NO: 56106 - DNA, 15 bp, Homo sapiens
aaatgagggagcgag

SEQ ID NO: 56107 - DNA, 15 bp, Homo sapiens
aaaatgagggagcga

SEQ ID NO: 56108 - DNA, 15 bp, Homo sapiens
caaaatgagggagcg

SEQ ID NO: 56109 - DNA, 15 bp, Homo sapiens
gcaaaatgagggagc

SEQ ID NO: 56110 - DNA, 15 bp, Homo sapiens
agcaaaatgagggag

SEQ ID NO: 56111 - DNA, 15 bp, Homo sapiens
gagcaaaatgaggga

SEQ ID NO: 56112 - DNA, 15 bp, Homo sapiens
ggagcaaaatgaggg

SEQ ID NO: 56113 - DNA, 15 bp, Homo sapiens
tggagcaaaatgagg

SEQ ID NO: 56114 - DNA, 15 bp, Homo sapiens
ctggagcaaaatgag

SEQ ID NO: 56115 - DNA, 15 bp, Homo sapiens
gctggagcaaaatga

SEQ ID NO: 56116 - DNA, 15 bp, Homo sapiens
ggctggagcaaaatg

SEQ ID NO: 56117 - DNA, 15 bp, Homo sapiens
tggctggagcaaaat

SEQ ID NO: 56118 - DNA, 15 bp, Homo sapiens
gtggctggagcaaaa

SEQ ID NO: 56119 - DNA, 15 bp, Homo sapiens
tgtggctggagcaaa

SEQ ID NO: 56120 - DNA, 15 bp, Homo sapiens
gtgtggctggagcaa

SEQ ID NO: 56121 - DNA, 15 bp, Homo sapiens
cgtgtggctggagca

SEQ ID NO: 56122 - DNA, 15 bp, Homo sapiens
ccgtgtggctggagc

SEQ ID NO: 56123 - DNA, 15 bp, Homo sapiens
gccgtgtggctggag

SEQ ID NO: 56124 - DNA, 15 bp, Homo sapiens
ggccgtgtggctgga

SEQ ID NO: 56125 - DNA, 15 bp, Homo sapiens
aggccgtgtggctgg

SEQ ID NO: 56126 - DNA, 15 bp, Homo sapiens
aaggccgtgtggctg

SEQ ID NO: 56127 - DNA, 15 bp, Homo sapiens
aaaggccgtgtggct

SEQ ID NO: 56128 - DNA, 15 bp, Homo sapiens
caaaggccgtgtggc

SEQ ID NO: 56129 - DNA, 15 bp, Homo sapiens
gcaaaggccgtgtgg

SEQ ID NO: 56130 - DNA, 15 bp, Homo sapiens
agcaaaggccgtgtg

SEQ ID NO: 56131 - DNA, 15 bp, Homo sapiens
aagcaaaggccgtgt

SEQ ID NO: 56132 - DNA, 15 bp, Homo sapiens
taagcaaaggccgtg

SEQ ID NO: 56133 - DNA, 15 bp, Homo sapiens
gtaagcaaaggccgt

SEQ ID NO: 56134 - DNA, 15 bp, Homo sapiens
ggtaagcaaaggccg

SEQ ID NO: 56135 - DNA, 15 bp, Homo sapiens
tggtaagcaaaggcc

SEQ ID NO: 56136 - DNA, 15 bp, Homo sapiens
atggtaagcaaaggc

SEQ ID NO: 56137 - DNA, 15 bp, Homo sapiens
gatggtaagcaaagg

SEQ ID NO: 56138 - DNA, 15 bp, Homo sapiens
ggatggtaagcaaag

SEQ ID NO: 56139 - DNA, 15 bp, Homo sapiens
gggatggtaagcaaa

SEQ ID NO: 56140 - DNA, 15 bp, Homo sapiens
cgggatggtaagcaa

SEQ ID NO: 56141 - DNA, 15 bp, Homo sapiens
ccgggatggtaagca

SEQ ID NO: 56142 - DNA, 15 bp, Homo sapiens
accgggatggtaagc

SEQ ID NO: 56143 - DNA, 15 bp, Homo sapiens
caccgggatggtaag

SEQ ID NO: 56144 - DNA, 15 bp, Homo sapiens
ccaccgggatggtaa

SEQ ID NO: 56145 - DNA, 15 bp, Homo sapiens
cccaccgggatggta

SEQ ID NO: 56146 - DNA, 15 bp, Homo sapiens
gcccaccgggatggt

SEQ ID NO: 56147 - DNA, 15 bp, Homo sapiens
ggcccaccgggatgg

SEQ ID NO: 56148 - DNA, 15 bp, Homo sapiens
gggcccaccgggatg

SEQ ID NO: 56149 - DNA, 15 bp, Homo sapiens
agggcccaccgggat

SEQ ID NO: 56150 - DNA, 15 bp, Homo sapiens
gagggcccaccggga

SEQ ID NO: 56151 - DNA, 15 bp, Homo sapiens
ggagggcccaccggg

SEQ ID NO: 56152 - DNA, 15 bp, Homo sapiens
gggagggcccaccgg

SEQ ID NO: 56153 - DNA, 15 bp, Homo sapiens
agggagggcccaccg

SEQ ID NO: 56154 - DNA, 15 bp, Homo sapiens
cagggagggcccacc

SEQ ID NO: 56155 - DNA, 15 bp, Homo sapiens
ccagggagggcccac

SEQ ID NO: 56156 - DNA, 15 bp, Homo sapiens
gccagggagggccca

SEQ ID NO: 56157 - DNA, 15 bp, Homo sapiens
ggccagggagggccc

SEQ ID NO: 56158 - DNA, 15 bp, Homo sapiens
aggccagggagggcc

SEQ ID NO: 56159 - DNA, 15 bp, Homo sapiens
aaggccagggagggc

SEQ ID NO: 56160 - DNA, 15 bp, Homo sapiens
aaaggccagggaggg

SEQ ID NO: 56161 - DNA, 15 bp, Homo sapiens
caaaggccagggagg

SEQ ID NO: 56162 - DNA, 15 bp, Homo sapiens
gcaaaggccagggag

SEQ ID NO: 56163 - DNA, 15 bp, Homo sapiens
tgcaaaggccaggga

SEQ ID NO: 56164 - DNA, 15 bp, Homo sapiens
gtgcaaaggccaggg

SEQ ID NO: 56165 - DNA, 15 bp, Homo sapiens
tgtgcaaaggccagg

SEQ ID NO: 56166 - DNA, 15 bp, Homo sapiens
gtgtgcaaaggccag

SEQ ID NO: 56167 - DNA, 15 bp, Homo sapiens
tgtgtgcaaaggcca

SEQ ID NO: 56168 - DNA, 15 bp, Homo sapiens
ctgtgtgcaaaggcc

SEQ ID NO: 56169 - DNA, 15 bp, Homo sapiens
actgtgtgcaaaggc

SEQ ID NO: 56170 - DNA, 15 bp, Homo sapiens
gactgtgtgcaaagg

SEQ ID NO: 56171 - DNA, 15 bp, Homo sapiens
ggactgtgtgcaaag

SEQ ID NO: 56172 - DNA, 15 bp, Homo sapiens
aggactgtgtgcaaa

SEQ ID NO: 56173 - DNA, 15 bp, Homo sapiens
aaggactgtgtgcaa

SEQ ID NO: 56174 - DNA, 15 bp, Homo sapiens
aaaggactgtgtgca

SEQ ID NO: 56175 - DNA, 15 bp, Homo sapiens
gaaaggactgtgtgc

SEQ ID NO: 56176 - DNA, 15 bp, Homo sapiens
agaaaggactgtgtg

SEQ ID NO: 56177 - DNA, 15 bp, Homo sapiens
gagaaaggactgtgt

SEQ ID NO: 56178 - DNA, 15 bp, Homo sapiens
agagaaaggactgtg

SEQ ID NO: 56179 - DNA, 15 bp, Homo sapiens
tagagaaaggactgt

SEQ ID NO: 56180 - DNA, 15 bp, Homo sapiens
atagagaaaggactg

SEQ ID NO: 56181 - DNA, 15 bp, Homo sapiens
gatagagaaaggact

SEQ ID NO: 56182 - DNA, 15 bp, Homo sapiens
agatagagaaaggac

SEQ ID NO: 56183 - DNA, 15 bp, Homo sapiens
gagatagagaaagga

SEQ ID NO: 56184 - DNA, 15 bp, Homo sapiens
agagatagagaaagg

SEQ ID NO: 56185 - DNA, 15 bp, Homo sapiens
aagagatagagaaag

SEQ ID NO: 56186 - DNA, 15 bp, Homo sapiens
ggaagagatagagaa

SEQ ID NO: 56187 - DNA, 15 bp, Homo sapiens
aggaagagatagaga

SEQ ID NO: 56188 - DNA, 15 bp, Homo sapiens
caggaagagatagag

SEQ ID NO: 56189 - DNA, 15 bp, Homo sapiens
ccaggaagagataga

SEQ ID NO: 56190 - DNA, 15 bp, Homo sapiens
gccaggaagagatag

SEQ ID NO: 56191 - DNA, 15 bp, Homo sapiens
ggccaggaagagata

SEQ ID NO: 56192 - DNA, 15 bp, Homo sapiens
tggccaggaagagat

SEQ ID NO: 56193 - DNA, 15 bp, Homo sapiens
ctggccaggaagaga

SEQ ID NO: 56194 - DNA, 15 bp, Homo sapiens
gctggccaggaagag

SEQ ID NO: 56195 - DNA, 15 bp, Homo sapiens
agctggccaggaaga

SEQ ID NO: 56196 - DNA, 15 bp, Homo sapiens
gagctggccaggaag

SEQ ID NO: 56197 - DNA, 15 bp, Homo sapiens
ggagctggccaggaa

SEQ ID NO: 56198 - DNA, 15 bp, Homo sapiens
aggagctggccagga

SEQ ID NO: 56199 - DNA, 15 bp, Homo sapiens
taggagctggccagg

SEQ ID NO: 56200 - DNA, 15 bp, Homo sapiens
gtaggagctggccag

SEQ ID NO: 56201 - DNA, 15 bp, Homo sapiens
ggtaggagctggcca

SEQ ID NO: 56202 - DNA, 15 bp, Homo sapiens
gggtaggagctggcc

SEQ ID NO: 56203 - DNA, 15 bp, Homo sapiens
ggggtaggagctggc

SEQ ID NO: 56204 - DNA, 15 bp, Homo sapiens
aggggtaggagctgg

SEQ ID NO: 56205 - DNA, 15 bp, Homo sapiens
aaggggtaggagctg

SEQ ID NO: 56206 - DNA, 15 bp, Homo sapiens
gaaggggtaggagct

SEQ ID NO: 56207 - DNA, 15 bp, Homo sapiens
ggaaggggtaggagc

SEQ ID NO: 56208 - DNA, 15 bp, Homo sapiens
aggaaggggtaggag

SEQ ID NO: 56209 - DNA, 15 bp, Homo sapiens
caggaaggggtagga

SEQ ID NO: 56210 - DNA, 15 bp, Homo sapiens
gcaggaaggggtagg

SEQ ID NO: 56211 - DNA, 15 bp, Homo sapiens
agcaggaaggggtag

SEQ ID NO: 56212 - DNA, 15 bp, Homo sapiens
aagcaggaaggggta

SEQ ID NO: 56213 - DNA, 15 bp, Homo sapiens
caagcaggaaggggt

SEQ ID NO: 56214 - DNA, 15 bp, Homo sapiens
acaagcaggaagggg

SEQ ID NO: 56215 - DNA, 15 bp, Homo sapiens
gacaagcaggaaggg

SEQ ID NO: 56216 - DNA, 15 bp, Homo sapiens
agacaagcaggaagg

SEQ ID NO: 56217 - DNA, 15 bp, Homo sapiens
cagacaagcaggaag

SEQ ID NO: 56218 - DNA, 15 bp, Homo sapiens
tcagacaagcaggaa

SEQ ID NO: 56219 - DNA, 15 bp, Homo sapiens
ctcagacaagcagga

SEQ ID NO: 56220 - DNA, 15 bp, Homo sapiens
gctcagacaagcagg

SEQ ID NO: 56221 - DNA, 15 bp, Homo sapiens
agctcagacaagcag

SEQ ID NO: 56222 - DNA, 15 bp, Homo sapiens
aagctcagacaagca

SEQ ID NO: 56223 - DNA, 15 bp, Homo sapiens
taagctcagacaagc

SEQ ID NO: 56224 - DNA, 15 bp, Homo sapiens
ttaagctcagacaag

SEQ ID NO: 56225 - DNA, 15 bp, Homo sapiens
tttaagctcagacaa

SEQ ID NO: 56226 - DNA, 15 bp, Homo sapiens
atttaagctcagaca

SEQ ID NO: 56227 - DNA, 15 bp, Homo sapiens
catttaagctcagac

SEQ ID NO: 56228 - DNA, 15 bp, Homo sapiens
acatttaagctcaga

SEQ ID NO: 56229 - DNA, 15 bp, Homo sapiens
aacatttaagctcag

SEQ ID NO: 56230 - DNA, 15 bp, Homo sapiens
caacatttaagctca

SEQ ID NO: 56231 - DNA, 15 bp, Homo sapiens
gcaacatttaagctc

SEQ ID NO: 56232 - DNA, 15 bp, Homo sapiens
agcaacatttaagct

SEQ ID NO: 56233 - DNA, 15 bp, Homo sapiens
aagcaacatttaagc

SEQ ID NO: 56234 - DNA, 15 bp, Homo sapiens
gaagcaacatttaag

SEQ ID NO: 56235 - DNA, 15 bp, Homo sapiens
ggaagcaacatttaa

SEQ ID NO: 56236 - DNA, 15 bp, Homo sapiens
aggaagcaacattta

SEQ ID NO: 56237 - DNA, 15 bp, Homo sapiens
caggaagcaacattt

SEQ ID NO: 56238 - DNA, 15 bp, Homo sapiens
tcaggaagcaacatt

SEQ ID NO: 56239 - DNA, 15 bp, Homo sapiens
ttcaggaagcaacat

SEQ ID NO: 56240 - DNA, 15 bp, Homo sapiens
cttcaggaagcaaca

SEQ ID NO: 56241 - DNA, 15 bp, Homo sapiens
ccttcaggaagcaac

SEQ ID NO: 56242 - DNA, 15 bp, Homo sapiens
tccttcaggaagcaa

SEQ ID NO: 56243 - DNA, 15 bp, Homo sapiens
atccttcaggaagca

SEQ ID NO: 56244 - DNA, 15 bp, Homo sapiens
gatccttcaggaagc

SEQ ID NO: 56245 - DNA, 15 bp, Homo sapiens
agatccttcaggaag

SEQ ID NO: 56246 - DNA, 15 bp, Homo sapiens
gagatccttcaggaa

SEQ ID NO: 56247 - DNA, 15 bp, Homo sapiens
agagatccttcagga

SEQ ID NO: 56248 - DNA, 15 bp, Homo sapiens
aagagatccttcagg

SEQ ID NO: 56249 - DNA, 15 bp, Homo sapiens
aaagagatccttcag

SEQ ID NO: 56250 - DNA, 15 bp, Homo sapiens
aaaagagatccttca

SEQ ID NO: 56251 - DNA, 15 bp, Homo sapiens
gaaaagagatccttc

SEQ ID NO: 56252 - DNA, 15 bp, Homo sapiens
agaaaagagatcctt

SEQ ID NO: 56253 - DNA, 15 bp, Homo sapiens
cagaaaagagatcct

SEQ ID NO: 56254 - DNA, 15 bp, Homo sapiens
tcagaaaagagatcc

SEQ ID NO: 56255 - DNA, 15 bp, Homo sapiens
ctcagaaaagagatc

SEQ ID NO: 56256 - DNA, 15 bp, Homo sapiens
gctcagaaaagagat

SEQ ID NO: 56257 - DNA, 15 bp, Homo sapiens
agctcagaaaagaga

SEQ ID NO: 56258 - DNA, 15 bp, Homo sapiens
gagctcagaaaagag

SEQ ID NO: 56259 - DNA, 15 bp, Homo sapiens
ggagctcagaaaaga

SEQ ID NO: 56260 - DNA, 15 bp, Homo sapiens
gggagctcagaaaag

SEQ ID NO: 56261 - DNA, 15 bp, Homo sapiens
tgggagctcagaaaa

SEQ ID NO: 56262 - DNA, 15 bp, Homo sapiens
ctgggagctcagaaa

SEQ ID NO: 56263 - DNA, 15 bp, Homo sapiens
tctgggagctcagaa

SEQ ID NO: 56264 - DNA, 15 bp, Homo sapiens
gtctgggagctcaga

SEQ ID NO: 56265 - DNA, 15 bp, Homo sapiens
agtctgggagctcag

SEQ ID NO: 56266 - DNA, 15 bp, Homo sapiens
tagtctgggagctca

SEQ ID NO: 56267 - DNA, 15 bp, Homo sapiens
ctagtctgggagctc

SEQ ID NO: 56268 - DNA, 15 bp, Homo sapiens
cctagtctgggagct

SEQ ID NO: 56269 - DNA, 15 bp, Homo sapiens
ccctagtctgggagc

SEQ ID NO: 56270 - DNA, 15 bp, Homo sapiens
accctagtctgggag

SEQ ID NO: 56271 - DNA, 15 bp, Homo sapiens
taccctagtctggga

SEQ ID NO: 56272 - DNA, 15 bp, Homo sapiens
ctaccctagtctggg

SEQ ID NO: 56273 - DNA, 15 bp, Homo sapiens
tctaccctagtctgg

SEQ ID NO: 56274 - DNA, 15 bp, Homo sapiens
atctaccctagtctg

SEQ ID NO: 56275 - DNA, 15 bp, Homo sapiens
tatctaccctagtct

SEQ ID NO: 56276 - DNA, 15 bp, Homo sapiens
ttatctaccctagtc

SEQ ID NO: 56277 - DNA, 15 bp, Homo sapiens
cttatctaccctagt

SEQ ID NO: 56278 - DNA, 15 bp, Homo sapiens
gcttatctaccctag

SEQ ID NO: 56279 - DNA, 15 bp, Homo sapiens
agcttatctacccta

SEQ ID NO: 56280 - DNA, 15 bp, Homo sapiens
cagcttatctaccct

SEQ ID NO: 56281 - DNA, 15 bp, Homo sapiens
acagcttatctaccc

SEQ ID NO: 56282 - DNA, 15 bp, Homo sapiens
tacagcttatctacc

SEQ ID NO: 56283 - DNA, 15 bp, Homo sapiens
atacagcttatctac

SEQ ID NO: 56284 - DNA, 15 bp, Homo sapiens
tatacagcttatcta

SEQ ID NO: 56285 - DNA, 15 bp, Homo sapiens
gtatacagcttatct

SEQ ID NO: 56286 - DNA, 15 bp, Homo sapiens
agtatacagcttatc

SEQ ID NO: 56287 - DNA, 15 bp, Homo sapiens
gagtatacagcttat

SEQ ID NO: 56288 - DNA, 15 bp, Homo sapiens
agagtatacagctta

SEQ ID NO: 56289 - DNA, 15 bp, Homo sapiens
gagagtatacagctt

SEQ ID NO: 56290 - DNA, 15 bp, Homo sapiens
tgagagtatacagct

SEQ ID NO: 56291 - DNA, 15 bp, Homo sapiens
ttgagagtatacagc

SEQ ID NO: 56292 - DNA, 15 bp, Homo sapiens
tttgagagtatacag

SEQ ID NO: 56293 - DNA, 15 bp, Homo sapiens
ctttgagagtataca

SEQ ID NO: 56294 - DNA, 15 bp, Homo sapiens
actttgagagtatac

SEQ ID NO: 56295 - DNA, 15 bp, Homo sapiens
cactttgagagtata

SEQ ID NO: 56296 - DNA, 15 bp, Homo sapiens
acactttgagagtat

SEQ ID NO: 56297 - DNA, 15 bp, Homo sapiens
aacactttgagagta

SEQ ID NO: 56298 - DNA, 15 bp, Homo sapiens
taacactttgagagt

SEQ ID NO: 56299 - DNA, 15 bp, Homo sapiens
ataacactttgagag

SEQ ID NO: 56300 - DNA, 15 bp, Homo sapiens
cataacactttgaga

SEQ ID NO: 56301 - DNA, 15 bp, Homo sapiens
tcataacactttgag

SEQ ID NO: 56302 - DNA, 15 bp, Homo sapiens
atcataacactttga

SEQ ID NO: 56303 - DNA, 15 bp, Homo sapiens
aatcataacactttg

SEQ ID NO: 56304 - DNA, 15 bp, Homo sapiens
aaatcataacacttt

SEQ ID NO: 56305 - DNA, 15 bp, Homo sapiens
caaatcataacactt

SEQ ID NO: 56306 - DNA, 15 bp, Homo sapiens
tcaaatcataacact

SEQ ID NO: 56307 - DNA, 15 bp, Homo sapiens
ttcaaatcataacac

SEQ ID NO: 56308 - DNA, 15 bp, Homo sapiens
cttcaaatcataaca

SEQ ID NO: 56309 - DNA, 15 bp, Homo sapiens
gcttcaaatcataac

SEQ ID NO: 56310 - DNA, 15 bp, Homo sapiens
tgcttcaaatcataa

SEQ ID NO: 56311 - DNA, 15 bp, Homo sapiens
gtgcttcaaatcata

SEQ ID NO: 56312 - DNA, 15 bp, Homo sapiens
agtgcttcaaatcat

SEQ ID NO: 56313 - DNA, 15 bp, Homo sapiens
aagtgcttcaaatca

SEQ ID NO: 56314 - DNA, 15 bp, Homo sapiens
taagtgcttcaaatc

SEQ ID NO: 56315 - DNA, 15 bp, Homo sapiens
gtaagtgcttcaaat

SEQ ID NO: 56316 - DNA, 15 bp, Homo sapiens
ggtaagtgcttcaaa

SEQ ID NO: 56317 - DNA, 15 bp, Homo sapiens
tggtaagtgcttcaa

SEQ ID NO: 56318 - DNA, 15 bp, Homo sapiens
atggtaagtgcttca

SEQ ID NO: 56319 - DNA, 15 bp, Homo sapiens
tatggtaagtgcttc

SEQ ID NO: 56320 - DNA, 15 bp, Homo sapiens
gtatggtaagtgctt

SEQ ID NO: 56321 - DNA, 15 bp, Homo sapiens
agtatggtaagtgct

SEQ ID NO: 56322 - DNA, 15 bp, Homo sapiens
cagtatggtaagtgc

SEQ ID NO: 56323 - DNA, 15 bp, Homo sapiens
acagtatggtaagtg

SEQ ID NO: 56324 - DNA, 15 bp, Homo sapiens
tacagtatggtaagt

SEQ ID NO: 56325 - DNA, 15 bp, Homo sapiens
ttacagtatggtaag

SEQ ID NO: 56326 - DNA, 15 bp, Homo sapiens
attacagtatggtaa

SEQ ID NO: 56327 - DNA, 15 bp, Homo sapiens
aattacagtatggta

SEQ ID NO: 56328 - DNA, 15 bp, Homo sapiens
aaattacagtatggt

SEQ ID NO: 56329 - DNA, 15 bp, Homo sapiens
taaattacagtatgg

SEQ ID NO: 56330 - DNA, 15 bp, Homo sapiens
ttaaattacagtatg

SEQ ID NO: 56331 - DNA, 15 bp, Homo sapiens
tttaaattacagtat

SEQ ID NO: 56332 - DNA, 15 bp, Homo sapiens
atttaaattacagta

SEQ ID NO: 56333 - DNA, 15 bp, Homo sapiens
tatttaaattacagt

SEQ ID NO: 56334 - DNA, 15 bp, Homo sapiens
ctatttaaattacag

SEQ ID NO: 56335 - DNA, 15 bp, Homo sapiens
actatttaaattaca

SEQ ID NO: 56336 - DNA, 15 bp, Homo sapiens
aactatttaaattac

SEQ ID NO: 56337 - DNA, 15 bp, Homo sapiens
caactatttaaatta

SEQ ID NO: 56338 - DNA, 15 bp, Homo sapiens
gcaactatttaaatt

SEQ ID NO: 56339 - DNA, 15 bp, Homo sapiens
ggcaactatttaaat

SEQ ID NO: 56340 - DNA, 15 bp, Homo sapiens
tggcaactatttaaa

SEQ ID NO: 56341 - DNA, 15 bp, Homo sapiens
ctggcaactatttaa

SEQ ID NO: 56342 - DNA, 15 bp, Homo sapiens
gctggcaactattta

SEQ ID NO: 56343 - DNA, 15 bp, Homo sapiens
ggctggcaactattt

SEQ ID NO: 56344 - DNA, 15 bp, Homo sapiens
aggctggcaactatt

SEQ ID NO: 56345 - DNA, 15 bp, Homo sapiens
aaggctggcaactat

SEQ ID NO: 56346 - DNA, 15 bp, Homo sapiens
aaaggctggcaacta

SEQ ID NO: 56347 - DNA, 15 bp, Homo sapiens
aaaaggctggcaact

SEQ ID NO: 56348 - DNA, 15 bp, Homo sapiens
aaaaaggctggcaac

SEQ ID NO: 56349 - DNA, 15 bp, Homo sapiens
aaaaaaggctggcaa

SEQ ID NO: 56350 - DNA, 15 bp, Homo sapiens
gaaaaaaggctggca

SEQ ID NO: 56351 - DNA, 15 bp, Homo sapiens
ggaaaaaaggctggc

SEQ ID NO: 56352 - DNA, 15 bp, Homo sapiens
aggaaaaaaggctgg

SEQ ID NO: 56353 - DNA, 15 bp, Homo sapiens
taggaaaaaaggctg

SEQ ID NO: 56354 - DNA, 15 bp, Homo sapiens
ctaggaaaaaaggct

SEQ ID NO: 56355 - DNA, 15 bp, Homo sapiens
cctaggaaaaaaggc

SEQ ID NO: 56356 - DNA, 15 bp, Homo sapiens
acctaggaaaaaagg

SEQ ID NO: 56357 - DNA, 15 bp, Homo sapiens
aacctaggaaaaaag

SEQ ID NO: 56358 - DNA, 15 bp, Homo sapiens
taacctaggaaaaaa

SEQ ID NO: 56359 - DNA, 15 bp, Homo sapiens
ctaacctaggaaaaa

SEQ ID NO: 56360 - DNA, 15 bp, Homo sapiens
tctaacctaggaaaa

SEQ ID NO: 56361 - DNA, 15 bp, Homo sapiens
gtctaacctaggaaa

SEQ ID NO: 56362 - DNA, 15 bp, Homo sapiens
tgtctaacctaggaa

SEQ ID NO: 56363 - DNA, 15 bp, Homo sapiens
atgtctaacctagga

SEQ ID NO: 56364 - DNA, 15 bp, Homo sapiens
tatgtctaacctagg

SEQ ID NO: 56365 - DNA, 15 bp, Homo sapiens
ttatgtctaacctag

SEQ ID NO: 56366 - DNA, 15 bp, Homo sapiens
tttatgtctaaccta

SEQ ID NO: 56367 - DNA, 15 bp, Homo sapiens
gtttatgtctaacct

SEQ ID NO: 56368 - DNA, 15 bp, Homo sapiens
agtttatgtctaacc

SEQ ID NO: 56369 - DNA, 15 bp, Homo sapiens
gagtttatgtctaac

SEQ ID NO: 56370 - DNA, 15 bp, Homo sapiens
agagtttatgtctaa

SEQ ID NO: 56371 - DNA, 15 bp, Homo sapiens
cagagtttatgtcta

SEQ ID NO: 56372 - DNA, 15 bp, Homo sapiens
acagagtttatgtct

SEQ ID NO: 56373 - DNA, 15 bp, Homo sapiens
cacagagtttatgtc

SEQ ID NO: 56374 - DNA, 15 bp, Homo sapiens
ccacagagtttatgt

SEQ ID NO: 56375 - DNA, 15 bp, Homo sapiens
cccacagagtttatg

SEQ ID NO: 56376 - DNA, 15 bp, Homo sapiens
acccacagagtttat

SEQ ID NO: 56377 - DNA, 15 bp, Homo sapiens
cacccacagagttta

SEQ ID NO: 56378 - DNA, 15 bp, Homo sapiens
gcacccacagagttt

SEQ ID NO: 56379 - DNA, 15 bp, Homo sapiens
tgcacccacagagtt

SEQ ID NO: 56380 - DNA, 15 bp, Homo sapiens
ctgcacccacagagt

SEQ ID NO: 56381 - DNA, 15 bp, Homo sapiens
cctgcacccacagag

SEQ ID NO: 56382 - DNA, 15 bp, Homo sapiens
ccctgcacccacaga

SEQ ID NO: 56383 - DNA, 15 bp, Homo sapiens
tccctgcacccacag

SEQ ID NO: 56384 - DNA, 15 bp, Homo sapiens
gtccctgcacccaca

SEQ ID NO: 56385 - DNA, 15 bp, Homo sapiens
agtccctgcacccac

SEQ ID NO: 56386 - DNA, 15 bp, Homo sapiens
aagtccctgcaccca

SEQ ID NO: 56387 - DNA, 15 bp, Homo sapiens
aaagtccctgcaccc

SEQ ID NO: 56388 - DNA, 15 bp, Homo sapiens
gaaagtccctgcacc

SEQ ID NO: 56389 - DNA, 15 bp, Homo sapiens
agaaagtccctgcac

SEQ ID NO: 56390 - DNA, 15 bp, Homo sapiens
tagaaagtccctgca

SEQ ID NO: 56391 - DNA, 15 bp, Homo sapiens
atagaaagtccctgc

SEQ ID NO: 56392 - DNA, 15 bp, Homo sapiens
aatagaaagtccctg

SEQ ID NO: 56393 - DNA, 15 bp, Homo sapiens
aaatagaaagtccct

SEQ ID NO: 56394 - DNA, 15 bp, Homo sapiens
caaatagaaagtccc

SEQ ID NO: 56395 - DNA, 15 bp, Homo sapiens
gcaaatagaaagtcc

SEQ ID NO: 56396 - DNA, 15 bp, Homo sapiens
agcaaatagaaagtc

SEQ ID NO: 56397 - DNA, 15 bp, Homo sapiens
aagcaaatagaaagt

SEQ ID NO: 56398 - DNA, 15 bp, Homo sapiens
taagcaaatagaaag

SEQ ID NO: 56399 - DNA, 15 bp, Homo sapiens
ataagcaaatagaaa

SEQ ID NO: 56400 - DNA, 15 bp, Homo sapiens
aataagcaaatagaa

SEQ ID NO: 56401 - DNA, 15 bp, Homo sapiens
caataagcaaataga

SEQ ID NO: 56402 - DNA, 15 bp, Homo sapiens
ccaataagcaaatag

SEQ ID NO: 56403 - DNA, 15 bp, Homo sapiens
gccaataagcaaata

SEQ ID NO: 56404 - DNA, 15 bp, Homo sapiens
tgccaataagcaaat

SEQ ID NO: 56405 - DNA, 15 bp, Homo sapiens
atgccaataagcaaa

SEQ ID NO: 56406 - DNA, 15 bp, Homo sapiens
tatgccaataagcaa

SEQ ID NO: 56407 - DNA, 15 bp, Homo sapiens
atatgccaataagca

SEQ ID NO: 56408 - DNA, 15 bp, Homo sapiens
gatatgccaataagc

SEQ ID NO: 56409 - DNA, 15 bp, Homo sapiens
agatatgccaataag

SEQ ID NO: 56410 - DNA, 15 bp, Homo sapiens
aagatatgccaataa

SEQ ID NO: 56411 - DNA, 15 bp, Homo sapiens
aaagatatgccaata

SEQ ID NO: 56412 - DNA, 15 bp, Homo sapiens
aaaagatatgccaat

SEQ ID NO: 56413 - DNA, 15 bp, Homo sapiens
caaaagatatgccaa

SEQ ID NO: 56414 - DNA, 15 bp, Homo sapiens
ccaaaagatatgcca

SEQ ID NO: 56415 - DNA, 15 bp, Homo sapiens
gccaaaagatatgcc

SEQ ID NO: 56416 - DNA, 15 bp, Homo sapiens
tgccaaaagatatgc

SEQ ID NO: 56417 - DNA, 15 bp, Homo sapiens
atgccaaaagatatg

SEQ ID NO: 56418 - DNA, 15 bp, Homo sapiens
aatgccaaaagatat

SEQ ID NO: 56419 - DNA, 15 bp, Homo sapiens
aaatgccaaaagata

SEQ ID NO: 56420 - DNA, 15 bp, Homo sapiens
taaatgccaaaagat

SEQ ID NO: 56421 - DNA, 15 bp, Homo sapiens
ctaaatgccaaaaga

SEQ ID NO: 56422 - DNA, 15 bp, Homo sapiens
actaaatgccaaaag

SEQ ID NO: 56423 - DNA, 15 bp, Homo sapiens
tactaaatgccaaaa

SEQ ID NO: 56424 - DNA, 15 bp, Homo sapiens
ctactaaatgccaaa

SEQ ID NO: 56425 - DNA, 15 bp, Homo sapiens
cctactaaatgccaa

SEQ ID NO: 56426 - DNA, 15 bp, Homo sapiens
acctactaaatgcca

SEQ ID NO: 56427 - DNA, 15 bp, Homo sapiens
tacctactaaatgcc

SEQ ID NO: 56428 - DNA, 15 bp, Homo sapiens
atacctactaaatgc

SEQ ID NO: 56429 - DNA, 15 bp, Homo sapiens
gatacctactaaatg

SEQ ID NO: 56430 - DNA, 15 bp, Homo sapiens
ggatacctactaaat

SEQ ID NO: 56431 - DNA, 15 bp, Homo sapiens
tggatacctactaaa

SEQ ID NO: 56432 - DNA, 15 bp, Homo sapiens
ctggatacctactaa

SEQ ID NO: 56433 - DNA, 15 bp, Homo sapiens
actggatacctacta

SEQ ID NO: 56434 - DNA, 15 bp, Homo sapiens
tactggatacctact

SEQ ID NO: 56435 - DNA, 15 bp, Homo sapiens
ttactggatacctac

SEQ ID NO: 56436 - DNA, 15 bp, Homo sapiens
tttactggataccta

SEQ ID NO: 56437 - DNA, 15 bp, Homo sapiens
gtttactggatacct

SEQ ID NO: 56438 - DNA, 15 bp, Homo sapiens
agtttactggatacc

SEQ ID NO: 56439 - DNA, 15 bp, Homo sapiens
tagtttactggatac

SEQ ID NO: 56440 - DNA, 15 bp, Homo sapiens
atagtttactggata

SEQ ID NO: 56441 - DNA, 15 bp, Homo sapiens
aatagtttactggat

SEQ ID NO: 56442 - DNA, 15 bp, Homo sapiens
aaatagtttactgga

SEQ ID NO: 56443 - DNA, 15 bp, Homo sapiens
caaatagtttactgg

SEQ ID NO: 56444 - DNA, 15 bp, Homo sapiens
acaaatagtttactg

SEQ ID NO: 56445 - DNA, 15 bp, Homo sapiens
tacaaatagtttact

SEQ ID NO: 56446 - DNA, 15 bp, Homo sapiens
ctacaaatagtttac

SEQ ID NO: 56447 - DNA, 15 bp, Homo sapiens
cctacaaatagttta

SEQ ID NO: 56448 - DNA, 15 bp, Homo sapiens
gcctacaaatagttt

SEQ ID NO: 56449 - DNA, 15 bp, Homo sapiens
agcctacaaatagtt

SEQ ID NO: 56450 - DNA, 15 bp, Homo sapiens
aagcctacaaatagt

SEQ ID NO: 56451 - DNA, 15 bp, Homo sapiens
taagcctacaaatag

SEQ ID NO: 56452 - DNA, 15 bp, Homo sapiens
ttaagcctacaaata

SEQ ID NO: 56453 - DNA, 15 bp, Homo sapiens
attaagcctacaaat

SEQ ID NO: 56454 - DNA, 15 bp, Homo sapiens
tattaagcctacaaa

SEQ ID NO: 56455 - DNA, 15 bp, Homo sapiens
ttattaagcctacaa

SEQ ID NO: 56456 - DNA, 15 bp, Homo sapiens
tttattaagcctaca

SEQ ID NO: 56457 - DNA, 15 bp, Homo sapiens
atttattaagcctac

SEQ ID NO: 56458 - DNA, 15 bp, Homo sapiens
tatttattaagccta

SEQ ID NO: 56459 - DNA, 15 bp, Homo sapiens
ttatttattaagcct

SEQ ID NO: 56460 - DNA, 15 bp, Homo sapiens
tttatttattaagcc

SEQ ID NO: 56461 - DNA, 15 bp, Homo sapiens
atttatttattaagc

SEQ ID NO: 56462 - DNA, 15 bp, Homo sapiens
catttatttattaag

SEQ ID NO: 56463 - DNA, 15 bp, Homo sapiens
tcatttatttattaa

SEQ ID NO: 56464 - DNA, 15 bp, Homo sapiens
ttcatttatttatta

SEQ ID NO: 56465 - DNA, 15 bp, Homo sapiens
cattcatttatttat

SEQ ID NO: 56466 - DNA, 15 bp, Homo sapiens
tcattcatttattta

SEQ ID NO: 56467 - DNA, 15 bp, Homo sapiens
gtcattcatttattt

SEQ ID NO: 56468 - DNA, 15 bp, Homo sapiens
tgtcattcatttatt

SEQ ID NO: 56469 - DNA, 15 bp, Homo sapiens
ttgtcattcatttat

SEQ ID NO: 56470 - DNA, 15 bp, Homo sapiens
attgtcattcattta

SEQ ID NO: 56471 - DNA, 15 bp, Homo sapiens
cattgtcattcattt

SEQ ID NO: 56472 - DNA, 15 bp, Homo sapiens
tcattgtcattcatt

SEQ ID NO: 56473 - DNA, 15 bp, Homo sapiens
gtcattgtcattcat

SEQ ID NO: 56474 - DNA, 15 bp, Homo sapiens
tgtcattgtcattca

SEQ ID NO: 56475 - DNA, 15 bp, Homo sapiens
atgtcattgtcattc

SEQ ID NO: 56476 - DNA, 15 bp, Homo sapiens
tatgtcattgtcatt

SEQ ID NO: 56477 - DNA, 15 bp, Homo sapiens
ctatgtcattgtcat

SEQ ID NO: 56478 - DNA, 15 bp, Homo sapiens
tctatgtcattgtca

SEQ ID NO: 56479 - DNA, 15 bp, Homo sapiens
gtctatgtcattgtc

SEQ ID NO: 56480 - DNA, 15 bp, Homo sapiens
tgtctatgtcattgt

SEQ ID NO: 56481 - DNA, 15 bp, Homo sapiens
atgtctatgtcattg

SEQ ID NO: 56482 - DNA, 15 bp, Homo sapiens
tatgtctatgtcatt

SEQ ID NO: 56483 - DNA, 15 bp, Homo sapiens
gtatgtctatgtcat

SEQ ID NO: 56484 - DNA, 15 bp, Homo sapiens
tgtatgtctatgtca

SEQ ID NO: 56485 - DNA, 15 bp, Homo sapiens
atgtatgtctatgtc

SEQ ID NO: 56486 - DNA, 15 bp, Homo sapiens
aatgtatgtctatgt

SEQ ID NO: 56487 - DNA, 15 bp, Homo sapiens
caatgtatgtctatg

SEQ ID NO: 56488 - DNA, 15 bp, Homo sapiens
tcaatgtatgtctat

SEQ ID NO: 56489 - DNA, 15 bp, Homo sapiens
ttcaatgtatgtcta

SEQ ID NO: 56490 - DNA, 15 bp, Homo sapiens
attcaatgtatgtct

SEQ ID NO: 56491 - DNA, 15 bp, Homo sapiens
tattcaatgtatgtc

SEQ ID NO: 56492 - DNA, 15 bp, Homo sapiens
atattcaatgtatgt

SEQ ID NO: 56493 - DNA, 15 bp, Homo sapiens
catattcaatgtatg

SEQ ID NO: 56494 - DNA, 15 bp, Homo sapiens
gcatattcaatgtat

SEQ ID NO: 56495 - DNA, 15 bp, Homo sapiens
ggcatattcaatgta

SEQ ID NO: 56496 - DNA, 15 bp, Homo sapiens
aggcatattcaatgt

SEQ ID NO: 56497 - DNA, 15 bp, Homo sapiens
taggcatattcaatg

SEQ ID NO: 56498 - DNA, 15 bp, Homo sapiens
ttaggcatattcaat

SEQ ID NO: 56499 - DNA, 15 bp, Homo sapiens
attaggcatattcaa

SEQ ID NO: 56500 - DNA, 15 bp, Homo sapiens
aattaggcatattca

SEQ ID NO: 56501 - DNA, 15 bp, Homo sapiens
gaattaggcatattc

SEQ ID NO: 56502 - DNA, 15 bp, Homo sapiens
agaattaggcatatt

SEQ ID NO: 56503 - DNA, 15 bp, Homo sapiens
tagaattaggcatat

SEQ ID NO: 56504 - DNA, 15 bp, Homo sapiens
atagaattaggcata

SEQ ID NO: 56505 - DNA, 15 bp, Homo sapiens
tatagaattaggcat

SEQ ID NO: 56506 - DNA, 15 bp, Homo sapiens
atatagaattaggca

SEQ ID NO: 56507 - DNA, 15 bp, Homo sapiens
catatagaattaggc

SEQ ID NO: 56508 - DNA, 15 bp, Homo sapiens
acatatagaattagg

SEQ ID NO: 56509 - DNA, 15 bp, Homo sapiens
aacatatagaattag

SEQ ID NO: 56510 - DNA, 15 bp, Homo sapiens
gaacatatagaatta

SEQ ID NO: 56511 - DNA, 15 bp, Homo sapiens
tgaacatatagaatt

SEQ ID NO: 56512 - DNA, 15 bp, Homo sapiens
atgaacatatagaat

SEQ ID NO: 56513 - DNA, 15 bp, Homo sapiens
tatgaacatatagaa

SEQ ID NO: 56514 - DNA, 15 bp, Homo sapiens
ttatgaacatataga

SEQ ID NO: 56515 - DNA, 15 bp, Homo sapiens
cttatgaacatatag

SEQ ID NO: 56516 - DNA, 15 bp, Homo sapiens
gcttatgaacatata

SEQ ID NO: 56517 - DNA, 15 bp, Homo sapiens
ggcttatgaacatat

SEQ ID NO: 56518 - DNA, 15 bp, Homo sapiens
tggcttatgaacata

SEQ ID NO: 56519 - DNA, 15 bp, Homo sapiens
gtggcttatgaacat

SEQ ID NO: 56520 - DNA, 15 bp, Homo sapiens
agtggcttatgaaca

SEQ ID NO: 56521 - DNA, 15 bp, Homo sapiens
aagtggcttatgaac

SEQ ID NO: 56522 - DNA, 15 bp, Homo sapiens
caagtggcttatgaa

SEQ ID NO: 56523 - DNA, 15 bp, Homo sapiens
ccaagtggcttatga

SEQ ID NO: 56524 - DNA, 15 bp, Homo sapiens
cccaagtggcttatg

SEQ ID NO: 56525 - DNA, 15 bp, Homo sapiens
ccccaagtggcttat

SEQ ID NO: 56526 - DNA, 15 bp, Homo sapiens
tccccaagtggctta

SEQ ID NO: 56527 - DNA, 15 bp, Homo sapiens
atccccaagtggctt

SEQ ID NO: 56528 - DNA, 15 bp, Homo sapiens
catccccaagtggct

SEQ ID NO: 56529 - DNA, 15 bp, Homo sapiens
ccatccccaagtggc

SEQ ID NO: 56530 - DNA, 15 bp, Homo sapiens
accatccccaagtgg

SEQ ID NO: 56531 - DNA, 15 bp, Homo sapiens
aaccatccccaagtg

SEQ ID NO: 56532 - DNA, 15 bp, Homo sapiens
caaccatccccaagt

SEQ ID NO: 56533 - DNA, 15 bp, Homo sapiens
gcaaccatccccaag

SEQ ID NO: 56534 - DNA, 15 bp, Homo sapiens
tgcaaccatccccaa

SEQ ID NO: 56535 - DNA, 15 bp, Homo sapiens
atgcaaccatcccca

SEQ ID NO: 56536 - DNA, 15 bp, Homo sapiens
aatgcaaccatcccc

SEQ ID NO: 56537 - DNA, 15 bp, Homo sapiens
caatgcaaccatccc

SEQ ID NO: 56538 - DNA, 15 bp, Homo sapiens
ccaatgcaaccatcc

SEQ ID NO: 56539 - DNA, 15 bp, Homo sapiens
tccaatgcaaccatc

SEQ ID NO: 56540 - DNA, 15 bp, Homo sapiens
ctccaatgcaaccat

SEQ ID NO: 56541 - DNA, 15 bp, Homo sapiens
tctccaatgcaacca

SEQ ID NO: 56542 - DNA, 15 bp, Homo sapiens
ctctccaatgcaacc

SEQ ID NO: 56543 - DNA, 15 bp, Homo sapiens
tctctccaatgcaac

SEQ ID NO: 56544 - DNA, 15 bp, Homo sapiens
gtctctccaatgcaa

SEQ ID NO: 56545 - DNA, 15 bp, Homo sapiens
tgtctctccaatgca

SEQ ID NO: 56546 - DNA, 15 bp, Homo sapiens
ctgtctctccaatgc

SEQ ID NO: 56547 - DNA, 15 bp, Homo sapiens
cctgtctctccaatg

SEQ ID NO: 56548 - DNA, 15 bp, Homo sapiens
tcctgtctctccaat

SEQ ID NO: 56549 - DNA, 15 bp, Homo sapiens
ctcctgtctctccaa

SEQ ID NO: 56550 - DNA, 15 bp, Homo sapiens
actcctgtctctcca

SEQ ID NO: 56551 - DNA, 15 bp, Homo sapiens
tactcctgtctctcc

SEQ ID NO: 56552 - DNA, 15 bp, Homo sapiens
ctactcctgtctctc

SEQ ID NO: 56553 - DNA, 15 bp, Homo sapiens
tctactcctgtctct

SEQ ID NO: 56554 - DNA, 15 bp, Homo sapiens
ctctactcctgtctc

SEQ ID NO: 56555 - DNA, 15 bp, Homo sapiens
actctactcctgtct

SEQ ID NO: 56556 - DNA, 15 bp, Homo sapiens
aactctactcctgtc

SEQ ID NO: 56557 - DNA, 15 bp, Homo sapiens
aaactctactcctgt

SEQ ID NO: 56558 - DNA, 15 bp, Homo sapiens
taaactctactcctg

SEQ ID NO: 56559 - DNA, 15 bp, Homo sapiens
ctaaactctactcct

SEQ ID NO: 56560 - DNA, 15 bp, Homo sapiens
cctaaactctactcc

SEQ ID NO: 56561 - DNA, 15 bp, Homo sapiens
tcctaaactctactc

SEQ ID NO: 56562 - DNA, 15 bp, Homo sapiens
gtcctaaactctact

SEQ ID NO: 56563 - DNA, 15 bp, Homo sapiens
agtcctaaactctac

SEQ ID NO: 56564 - DNA, 15 bp, Homo sapiens
cagtcctaaactcta

SEQ ID NO: 56565 - DNA, 15 bp, Homo sapiens
tcagtcctaaactct

SEQ ID NO: 56566 - DNA, 15 bp, Homo sapiens
ctcagtcctaaactc

SEQ ID NO: 56567 - DNA, 15 bp, Homo sapiens
actcagtcctaaact

SEQ ID NO: 56568 - DNA, 15 bp, Homo sapiens
cactcagtcctaaac

SEQ ID NO: 56569 - DNA, 15 bp, Homo sapiens
gcactcagtcctaaa

SEQ ID NO: 56570 - DNA, 15 bp, Homo sapiens
tgcactcagtcctaa

SEQ ID NO: 56571 - DNA, 15 bp, Homo sapiens
ttgcactcagtccta

SEQ ID NO: 56572 - DNA, 15 bp, Homo sapiens
gttgcactcagtcct

SEQ ID NO: 56573 - DNA, 15 bp, Homo sapiens
tgttgcactcagtcc

SEQ ID NO: 56574 - DNA, 15 bp, Homo sapiens
atgttgcactcagtc

SEQ ID NO: 56575 - DNA, 15 bp, Homo sapiens
catgttgcactcagt

SEQ ID NO: 56576 - DNA, 15 bp, Homo sapiens
ccatgttgcactcag

SEQ ID NO: 56577 - DNA, 15 bp, Homo sapiens
gccatgttgcactca

SEQ ID NO: 56578 - DNA, 15 bp, Homo sapiens
tgccatgttgcactc

SEQ ID NO: 56579 - DNA, 15 bp, Homo sapiens
atgccatgttgcact

SEQ ID NO: 56580 - DNA, 15 bp, Homo sapiens
catgccatgttgcac

SEQ ID NO: 56581 - DNA, 15 bp, Homo sapiens
tcatgccatgttgca

SEQ ID NO: 56582 - DNA, 15 bp, Homo sapiens
ttcatgccatgttgc

SEQ ID NO: 56583 - DNA, 15 bp, Homo sapiens
attcatgccatgttg

SEQ ID NO: 56584 - DNA, 15 bp, Homo sapiens
aattcatgccatgtt

SEQ ID NO: 56585 - DNA, 15 bp, Homo sapiens
caattcatgccatgt

SEQ ID NO: 56586 - DNA, 15 bp, Homo sapiens
acaattcatgccatg

SEQ ID NO: 56587 - DNA, 15 bp, Homo sapiens
cacaattcatgccat

SEQ ID NO: 56588 - DNA, 15 bp, Homo sapiens
gcacaattcatgcca

SEQ ID NO: 56589 - DNA, 15 bp, Homo sapiens
agcacaattcatgcc

SEQ ID NO: 56590 - DNA, 15 bp, Homo sapiens
tagcacaattcatgc

SEQ ID NO: 56591 - DNA, 15 bp, Homo sapiens
ttagcacaattcatg

SEQ ID NO: 56592 - DNA, 15 bp, Homo sapiens
cttagcacaattcat

SEQ ID NO: 56593 - DNA, 15 bp, Homo sapiens
acttagcacaattca

SEQ ID NO: 56594 - DNA, 15 bp, Homo sapiens
gacttagcacaattc

SEQ ID NO: 56595 - DNA, 15 bp, Homo sapiens
ggacttagcacaatt

SEQ ID NO: 56596 - DNA, 15 bp, Homo sapiens
aggacttagcacaat

SEQ ID NO: 56597 - DNA, 15 bp, Homo sapiens
caggacttagcacaa

SEQ ID NO: 56598 - DNA, 15 bp, Homo sapiens
ccaggacttagcaca

SEQ ID NO: 56599 - DNA, 15 bp, Homo sapiens
tccaggacttagcac

SEQ ID NO: 56600 - DNA, 15 bp, Homo sapiens
atccaggacttagca

SEQ ID NO: 56601 - DNA, 15 bp, Homo sapiens
tatccaggacttagc

SEQ ID NO: 56602 - DNA, 15 bp, Homo sapiens
atatccaggacttag

SEQ ID NO: 56603 - DNA, 15 bp, Homo sapiens
catatccaggactta

SEQ ID NO: 56604 - DNA, 15 bp, Homo sapiens
tcatatccaggactt

SEQ ID NO: 56605 - DNA, 15 bp, Homo sapiens
ttcatatccaggact

SEQ ID NO: 56606 - DNA, 15 bp, Homo sapiens
attcatatccaggac

SEQ ID NO: 56607 - DNA, 15 bp, Homo sapiens
tattcatatccagga

SEQ ID NO: 56608 - DNA, 15 bp, Homo sapiens
gtattcatatccagg

SEQ ID NO: 56609 - DNA, 15 bp, Homo sapiens
tgtattcatatccag

SEQ ID NO: 56610 - DNA, 15 bp, Homo sapiens
ttgtattcatatcca

SEQ ID NO: 56611 - DNA, 15 bp, Homo sapiens
attgtattcatatcc

SEQ ID NO: 56612 - DNA, 15 bp, Homo sapiens
cattgtattcatatc

SEQ ID NO: 56613 - DNA, 15 bp, Homo sapiens
gcattgtattcatat

SEQ ID NO: 56614 - DNA, 15 bp, Homo sapiens
tgcattgtattcata

SEQ ID NO: 56615 - DNA, 15 bp, Homo sapiens
atgcattgtattcat

SEQ ID NO: 56616 - DNA, 15 bp, Homo sapiens
gatgcattgtattca

SEQ ID NO: 56617 - DNA, 15 bp, Homo sapiens
tgatgcattgtattc

SEQ ID NO: 56618 - DNA, 15 bp, Homo sapiens
ctgatgcattgtatt

SEQ ID NO: 56619 - DNA, 15 bp, Homo sapiens
cctgatgcattgtat

SEQ ID NO: 56620 - DNA, 15 bp, Homo sapiens
tcctgatgcattgta

SEQ ID NO: 56621 - DNA, 15 bp, Homo sapiens
gtcctgatgcattgt

SEQ ID NO: 56622 - DNA, 15 bp, Homo sapiens
agtcctgatgcattg

SEQ ID NO: 56623 - DNA, 15 bp, Homo sapiens
aagtcctgatgcatt

SEQ ID NO: 56624 - DNA, 15 bp, Homo sapiens
aaagtcctgatgcat

SEQ ID NO: 56625 - DNA, 15 bp, Homo sapiens
aaaagtcctgatgca

SEQ ID NO: 56626 - DNA, 15 bp, Homo sapiens
caaaagtcctgatgc

SEQ ID NO: 56627 - DNA, 15 bp, Homo sapiens
gcaaaagtcctgatg

SEQ ID NO: 56628 - DNA, 15 bp, Homo sapiens
agcaaaagtcctgat

SEQ ID NO: 56629 - DNA, 15 bp, Homo sapiens
cagcaaaagtcctga

SEQ ID NO: 56630 - DNA, 15 bp, Homo sapiens
gcagcaaaagtcctg

SEQ ID NO: 56631 - DNA, 15 bp, Homo sapiens
tgcagcaaaagtcct

SEQ ID NO: 56632 - DNA, 15 bp, Homo sapiens
atgcagcaaaagtcc

SEQ ID NO: 56633 - DNA, 15 bp, Homo sapiens
aatgcagcaaaagtc

SEQ ID NO: 56634 - DNA, 15 bp, Homo sapiens
taatgcagcaaaagt

SEQ ID NO: 56635 - DNA, 15 bp, Homo sapiens
ataatgcagcaaaag

SEQ ID NO: 56636 - DNA, 15 bp, Homo sapiens
aataatgcagcaaaa

SEQ ID NO: 56637 - DNA, 15 bp, Homo sapiens
caataatgcagcaaa

SEQ ID NO: 56638 - DNA, 15 bp, Homo sapiens
tcaataatgcagcaa

SEQ ID NO: 56639 - DNA, 15 bp, Homo sapiens
gtcaataatgcagca

SEQ ID NO: 56640 - DNA, 15 bp, Homo sapiens
tgtcaataatgcagc

SEQ ID NO: 56641 - DNA, 15 bp, Homo sapiens
ttgtcaataatgcag

SEQ ID NO: 56642 - DNA, 15 bp, Homo sapiens
tttgtcaataatgca

SEQ ID NO: 56643 - DNA, 15 bp, Homo sapiens
ttttgtcaataatgc

SEQ ID NO: 56644 - DNA, 15 bp, Homo sapiens
tttttgtcaataatg

SEQ ID NO: 56645 - DNA, 15 bp, Homo sapiens
atttttgtcaataat

SEQ ID NO: 56646 - DNA, 15 bp, Homo sapiens
tatttttgtcaataa

SEQ ID NO: 56647 - DNA, 15 bp, Homo sapiens
ttatttttgtcaata

SEQ ID NO: 56648 - DNA, 15 bp, Homo sapiens
tttatttttgtcaat

SEQ ID NO: 56649 - DNA, 15 bp, Homo sapiens
gtttatttttgtcaa

SEQ ID NO: 56650 - DNA, 15 bp, Homo sapiens
tgtttatttttgtca

SEQ ID NO: 56651 - DNA, 15 bp, Homo sapiens
ttgtttatttttgtc

SEQ ID NO: 56652 - DNA, 15 bp, Homo sapiens
tttgtttatttttgt

SEQ ID NO: 56653 - DNA, 15 bp, Homo sapiens
atttgtttatttttg

SEQ ID NO: 56654 - DNA, 15 bp, Homo sapiens
gatttgtttattttt

SEQ ID NO: 56655 - DNA, 15 bp, Homo sapiens
ggatttgtttatttt

SEQ ID NO: 56656 - DNA, 15 bp, Homo sapiens
tggatttgtttattt

SEQ ID NO: 56657 - DNA, 15 bp, Homo sapiens
ctggatttgtttatt

SEQ ID NO: 56658 - DNA, 15 bp, Homo sapiens
gctggatttgtttat

SEQ ID NO: 56659 - DNA, 15 bp, Homo sapiens
agctggatttgttta

SEQ ID NO: 56660 - DNA, 15 bp, Homo sapiens
tagctggatttgttt

SEQ ID NO: 56661 - DNA, 15 bp, Homo sapiens
atagctggatttgtt

SEQ ID NO: 56662 - DNA, 15 bp, Homo sapiens
gatagctggatttgt

SEQ ID NO: 56663 - DNA, 15 bp, Homo sapiens
ggatagctggatttg

SEQ ID NO: 56664 - DNA, 15 bp, Homo sapiens
tggatagctggattt

SEQ ID NO: 56665 - DNA, 15 bp, Homo sapiens
ttggatagctggatt

SEQ ID NO: 56666 - DNA, 15 bp, Homo sapiens
tttggatagctggat

SEQ ID NO: 56667 - DNA, 15 bp, Homo sapiens
gtttggatagctgga

SEQ ID NO: 56668 - DNA, 15 bp, Homo sapiens
agtttggatagctgg

SEQ ID NO: 56669 - DNA, 15 bp, Homo sapiens
aagtttggatagctg

SEQ ID NO: 56670 - DNA, 15 bp, Homo sapiens
aaagtttggatagct

SEQ ID NO: 56671 - DNA, 15 bp, Homo sapiens
gaaagtttggatagc

SEQ ID NO: 56672 - DNA, 15 bp, Homo sapiens
ggaaagtttggatag

SEQ ID NO: 56673 - DNA, 15 bp, Homo sapiens
gggaaagtttggata

SEQ ID NO: 56674 - DNA, 15 bp, Homo sapiens
agggaaagtttggat

SEQ ID NO: 56675 - DNA, 15 bp, Homo sapiens
tagggaaagtttgga

SEQ ID NO: 56676 - DNA, 15 bp, Homo sapiens
atagggaaagtttgg

SEQ ID NO: 56677 - DNA, 15 bp, Homo sapiens
aatagggaaagtttg

SEQ ID NO: 56678 - DNA, 15 bp, Homo sapiens
aaatagggaaagttt

SEQ ID NO: 56679 - DNA, 15 bp, Homo sapiens
taaatagggaaagtt

SEQ ID NO: 56680 - DNA, 15 bp, Homo sapiens
gtaaatagggaaagt

SEQ ID NO: 56681 - DNA, 15 bp, Homo sapiens
ggtaaatagggaaag

SEQ ID NO: 56682 - DNA, 15 bp, Homo sapiens
aggtaaatagggaaa

SEQ ID NO: 56683 - DNA, 15 bp, Homo sapiens
caggtaaatagggaa

SEQ ID NO: 56684 - DNA, 15 bp, Homo sapiens
tcaggtaaataggga

SEQ ID NO: 56685 - DNA, 15 bp, Homo sapiens
atcaggtaaataggg

SEQ ID NO: 56686 - DNA, 15 bp, Homo sapiens
aatcaggtaaatagg

SEQ ID NO: 56687 - DNA, 15 bp, Homo sapiens
aaatcaggtaaatag

SEQ ID NO: 56688 - DNA, 15 bp, Homo sapiens
gaaatcaggtaaata

SEQ ID NO: 56689 - DNA, 15 bp, Homo sapiens
agaaatcaggtaaat

SEQ ID NO: 56690 - DNA, 15 bp, Homo sapiens
aagaaatcaggtaaa

SEQ ID NO: 56691 - DNA, 15 bp, Homo sapiens
caagaaatcaggtaa

SEQ ID NO: 56692 - DNA, 15 bp, Homo sapiens
ccaagaaatcaggta

SEQ ID NO: 56693 - DNA, 15 bp, Homo sapiens
tccaagaaatcaggt

SEQ ID NO: 56694 - DNA, 15 bp, Homo sapiens
ctccaagaaatcagg

SEQ ID NO: 56695 - DNA, 15 bp, Homo sapiens
actccaagaaatcag

SEQ ID NO: 56696 - DNA, 15 bp, Homo sapiens
aactccaagaaatca

SEQ ID NO: 56697 - DNA, 15 bp, Homo sapiens
caactccaagaaatc

SEQ ID NO: 56698 - DNA, 15 bp, Homo sapiens
acaactccaagaaat

SEQ ID NO: 56699 - DNA, 15 bp, Homo sapiens
cacaactccaagaaa

SEQ ID NO: 56700 - DNA, 15 bp, Homo sapiens
gcacaactccaagaa

SEQ ID NO: 56701 - DNA, 15 bp, Homo sapiens
agcacaactccaaga

SEQ ID NO: 56702 - DNA, 15 bp, Homo sapiens
cagcacaactccaag

SEQ ID NO: 56703 - DNA, 15 bp, Homo sapiens
gcagcacaactccaa

SEQ ID NO: 56704 - DNA, 15 bp, Homo sapiens
tgcagcacaactcca

SEQ ID NO: 56705 - DNA, 15 bp, Homo sapiens
ctgcagcacaactcc

SEQ ID NO: 56706 - DNA, 15 bp, Homo sapiens
actgcagcacaactc

SEQ ID NO: 56707 - DNA, 15 bp, Homo sapiens
cactgcagcacaact

SEQ ID NO: 56708 - DNA, 15 bp, Homo sapiens
tcactgcagcacaac

SEQ ID NO: 56709 - DNA, 15 bp, Homo sapiens
atcactgcagcacaa

SEQ ID NO: 56710 - DNA, 15 bp, Homo sapiens
aatcactgcagcaca

SEQ ID NO: 56711 - DNA, 15 bp, Homo sapiens
caatcactgcagcac

SEQ ID NO: 56712 - DNA, 15 bp, Homo sapiens
acaatcactgcagca

SEQ ID NO: 56713 - DNA, 15 bp, Homo sapiens
aacaatcactgcagc

SEQ ID NO: 56714 - DNA, 15 bp, Homo sapiens
taacaatcactgcag

SEQ ID NO: 56715 - DNA, 15 bp, Homo sapiens
ttaacaatcactgca

SEQ ID NO: 56716 - DNA, 15 bp, Homo sapiens
tttaacaatcactgc

SEQ ID NO: 56717 - DNA, 15 bp, Homo sapiens
atttaacaatcactg

SEQ ID NO: 56718 - DNA, 15 bp, Homo sapiens
tatttaacaatcact

SEQ ID NO: 56719 - DNA, 15 bp, Homo sapiens
ttatttaacaatcac

SEQ ID NO: 56720 - DNA, 15 bp, Homo sapiens
gttatttaacaatca

SEQ ID NO: 56721 - DNA, 15 bp, Homo sapiens
ggttatttaacaatc

SEQ ID NO: 56722 - DNA, 15 bp, Homo sapiens
tggttatttaacaat

SEQ ID NO: 56723 - DNA, 15 bp, Homo sapiens
gtggttatttaacaa

SEQ ID NO: 56724 - DNA, 15 bp, Homo sapiens
agtggttatttaaca

SEQ ID NO: 56725 - DNA, 15 bp, Homo sapiens
aagtggttatttaac

SEQ ID NO: 56726 - DNA, 15 bp, Homo sapiens
caagtggttatttaa

SEQ ID NO: 56727 - DNA, 15 bp, Homo sapiens
ccaagtggttattta

SEQ ID NO: 56728 - DNA, 15 bp, Homo sapiens
tccaagtggttattt

SEQ ID NO: 56729 - DNA, 15 bp, Homo sapiens
gtccaagtggttatt

SEQ ID NO: 56730 - DNA, 15 bp, Homo sapiens
agtccaagtggttat

SEQ ID NO: 56731 - DNA, 15 bp, Homo sapiens
aagtccaagtggtta

SEQ ID NO: 56732 - DNA, 15 bp, Homo sapiens
taagtccaagtggtt

SEQ ID NO: 56733 - DNA, 15 bp, Homo sapiens
ttaagtccaagtggt

SEQ ID NO: 56734 - DNA, 15 bp, Homo sapiens
attaagtccaagtgg

SEQ ID NO: 56735 - DNA, 15 bp, Homo sapiens
cattaagtccaagtg

SEQ ID NO: 56736 - DNA, 15 bp, Homo sapiens
gcattaagtccaagt

SEQ ID NO: 56737 - DNA, 15 bp, Homo sapiens
tgcattaagtccaag

SEQ ID NO: 56738 - DNA, 15 bp, Homo sapiens
atgcattaagtccaa

SEQ ID NO: 56739 - DNA, 15 bp, Homo sapiens
tatgcattaagtcca

SEQ ID NO: 56740 - DNA, 15 bp, Homo sapiens
atatgcattaagtcc

SEQ ID NO: 56741 - DNA, 15 bp, Homo sapiens
aatatgcattaagtc

SEQ ID NO: 56742 - DNA, 15 bp, Homo sapiens
taatatgcattaagt

SEQ ID NO: 56743 - DNA, 15 bp, Homo sapiens
ataatatgcattaag

SEQ ID NO: 56744 - DNA, 15 bp, Homo sapiens
aataatatgcattaa

SEQ ID NO: 56745 - DNA, 15 bp, Homo sapiens
caataatatgcatta

SEQ ID NO: 56746 - DNA, 15 bp, Homo sapiens
acaataatatgcatt

SEQ ID NO: 56747 - DNA, 15 bp, Homo sapiens
aacaataatatgcat

SEQ ID NO: 56748 - DNA, 15 bp, Homo sapiens
aaacaataatatgca

SEQ ID NO: 56749 - DNA, 15 bp, Homo sapiens
aaaacaataatatgc

SEQ ID NO: 56750 - DNA, 15 bp, Homo sapiens
taaaacaataatatg

SEQ ID NO: 56751 - DNA, 15 bp, Homo sapiens
ataaaacaataatat

SEQ ID NO: 56752 - DNA, 15 bp, Homo sapiens
aataaaacaataata

SEQ ID NO: 56753 - DNA, 15 bp, Homo sapiens
aaataaaacaataat

SEQ ID NO: 56754 - DNA, 15 bp, Homo sapiens
taaataaaacaataa

SEQ ID NO: 56755 - DNA, 15 bp, Homo sapiens
gtaaataaaacaata

SEQ ID NO: 56756 - DNA, 15 bp, Homo sapiens
ggtaaataaaacaat

SEQ ID NO: 56757 - DNA, 15 bp, Homo sapiens
gggtaaataaaacaa

SEQ ID NO: 56758 - DNA, 15 bp, Homo sapiens
tgggtaaataaaaca

SEQ ID NO: 56759 - DNA, 15 bp, Homo sapiens
ttgggtaaataaaac

SEQ ID NO: 56760 - DNA, 15 bp, Homo sapiens
attgggtaaataaaa

SEQ ID NO: 56761 - DNA, 15 bp, Homo sapiens
tattgggtaaataaa

SEQ ID NO: 56762 - DNA, 15 bp, Homo sapiens
gtattgggtaaataa

SEQ ID NO: 56763 - DNA, 15 bp, Homo sapiens
tgtattgggtaaata

SEQ ID NO: 56764 - DNA, 15 bp, Homo sapiens
ttgtattgggtaaat

SEQ ID NO: 56765 - DNA, 15 bp, Homo sapiens
attgtattgggtaaa

SEQ ID NO: 56766 - DNA, 15 bp, Homo sapiens
aattgtattgggtaa

SEQ ID NO: 56767 - DNA, 15 bp, Homo sapiens
gaattgtattgggta

SEQ ID NO: 56768 - DNA, 15 bp, Homo sapiens
agaattgtattgggt

SEQ ID NO: 56769 - DNA, 15 bp, Homo sapiens
aagaattgtattggg

SEQ ID NO: 56770 - DNA, 15 bp, Homo sapiens
gaagaattgtattgg

SEQ ID NO: 56771 - DNA, 15 bp, Homo sapiens
tgaagaattgtattg

SEQ ID NO: 56772 - DNA, 15 bp, Homo sapiens
gtgaagaattgtatt

SEQ ID NO: 56773 - DNA, 15 bp, Homo sapiens
tgtgaagaattgtat

SEQ ID NO: 56774 - DNA, 15 bp, Homo sapiens
atgtgaagaattgta

SEQ ID NO: 56775 - DNA, 15 bp, Homo sapiens
tatgtgaagaattgt

SEQ ID NO: 56776 - DNA, 15 bp, Homo sapiens
ctatgtgaagaattg

SEQ ID NO: 56777 - DNA, 15 bp, Homo sapiens
cctatgtgaagaatt

SEQ ID NO: 56778 - DNA, 15 bp, Homo sapiens
ccctatgtgaagaat

SEQ ID NO: 56779 - DNA, 15 bp, Homo sapiens
accctatgtgaagaa

SEQ ID NO: 56780 - DNA, 15 bp, Homo sapiens
gaccctatgtgaaga

SEQ ID NO: 56781 - DNA, 15 bp, Homo sapiens
agaccctatgtgaag

SEQ ID NO: 56782 - DNA, 15 bp, Homo sapiens
tagaccctatgtgaa

SEQ ID NO: 56783 - DNA, 15 bp, Homo sapiens
ttagaccctatgtga

SEQ ID NO: 56784 - DNA, 15 bp, Homo sapiens
gttagaccctatgtg

SEQ ID NO: 56785 - DNA, 15 bp, Homo sapiens
agttagaccctatgt

SEQ ID NO: 56786 - DNA, 15 bp, Homo sapiens
tagttagaccctatg

SEQ ID NO: 56787 - DNA, 15 bp, Homo sapiens
atagttagaccctat

SEQ ID NO: 56788 - DNA, 15 bp, Homo sapiens
aatagttagacccta

SEQ ID NO: 56789 - DNA, 15 bp, Homo sapiens
taatagttagaccct

SEQ ID NO: 56790 - DNA, 15 bp, Homo sapiens
ttaatagttagaccc

SEQ ID NO: 56791 - DNA, 15 bp, Homo sapiens
tttaatagttagacc

SEQ ID NO: 56792 - DNA, 15 bp, Homo sapiens
atttaatagttagac

SEQ ID NO: 56793 - DNA, 15 bp, Homo sapiens
aatttaatagttaga

SEQ ID NO: 56794 - DNA, 15 bp, Homo sapiens
gaatttaatagttag

SEQ ID NO: 56795 - DNA, 15 bp, Homo sapiens
tgaatttaatagtta

SEQ ID NO: 56796 - DNA, 15 bp, Homo sapiens
gtgaatttaatagtt

SEQ ID NO: 56797 - DNA, 15 bp, Homo sapiens
agtgaatttaatagt

SEQ ID NO: 56798 - DNA, 15 bp, Homo sapiens
cagtgaatttaatag

SEQ ID NO: 56799 - DNA, 15 bp, Homo sapiens
acagtgaatttaata

SEQ ID NO: 56800 - DNA, 15 bp, Homo sapiens
cacagtgaatttaat

SEQ ID NO: 56801 - DNA, 15 bp, Homo sapiens
tcacagtgaatttaa

SEQ ID NO: 56802 - DNA, 15 bp, Homo sapiens
ttcacagtgaattta

SEQ ID NO: 56803 - DNA, 15 bp, Homo sapiens
cttcacagtgaattt

SEQ ID NO: 56804 - DNA, 15 bp, Homo sapiens
tcttcacagtgaatt

SEQ ID NO: 56805 - DNA, 15 bp, Homo sapiens
ttcttcacagtgaat

SEQ ID NO: 56806 - DNA, 15 bp, Homo sapiens
tttcttcacagtgaa

SEQ ID NO: 56807 - DNA, 15 bp, Homo sapiens
ttttcttcacagtga

SEQ ID NO: 56808 - DNA, 15 bp, Homo sapiens
tttttcttcacagtg

SEQ ID NO: 56809 - DNA, 15 bp, Homo sapiens
atttttcttcacagt

SEQ ID NO: 56810 - DNA, 15 bp, Homo sapiens
tatttttcttcacag

SEQ ID NO: 56811 - DNA, 15 bp, Homo sapiens
ttatttttcttcaca

SEQ ID NO: 56812 - DNA, 15 bp, Homo sapiens
cttatttttcttcac

SEQ ID NO: 56813 - DNA, 15 bp, Homo sapiens
tcttatttttcttca

SEQ ID NO: 56814 - DNA, 15 bp, Homo sapiens
gtcttatttttcttc

SEQ ID NO: 56815 - DNA, 15 bp, Homo sapiens
agtcttatttttctt

SEQ ID NO: 56816 - DNA, 15 bp, Homo sapiens
aagtcttatttttct

SEQ ID NO: 56817 - DNA, 15 bp, Homo sapiens
taagtcttatttttc

SEQ ID NO: 56818 - DNA, 15 bp, Homo sapiens
ttaagtcttattttt

SEQ ID NO: 56819 - DNA, 15 bp, Homo sapiens
tttaagtcttatttt

SEQ ID NO: 56820 - DNA, 15 bp, Homo sapiens
ttttaagtcttattt

SEQ ID NO: 56821 - DNA, 15 bp, Homo sapiens
gttttaagtcttatt

SEQ ID NO: 56822 - DNA, 15 bp, Homo sapiens
agttttaagtcttat

SEQ ID NO: 56823 - DNA, 15 bp, Homo sapiens
aagttttaagtctta

SEQ ID NO: 56824 - DNA, 15 bp, Homo sapiens
taagttttaagtctt

SEQ ID NO: 56825 - DNA, 15 bp, Homo sapiens
ttaagttttaagtct

SEQ ID NO: 56826 - DNA, 15 bp, Homo sapiens
tttaagttttaagtc

SEQ ID NO: 56827 - DNA, 15 bp, Homo sapiens
ctttaagttttaagt

SEQ ID NO: 56828 - DNA, 15 bp, Homo sapiens
gctttaagttttaag

SEQ ID NO: 56829 - DNA, 15 bp, Homo sapiens
ggctttaagttttaa

SEQ ID NO: 56830 - DNA, 15 bp, Homo sapiens
tggctttaagtttta

SEQ ID NO: 56831 - DNA, 15 bp, Homo sapiens
ctggctttaagtttt

SEQ ID NO: 56832 - DNA, 15 bp, Homo sapiens
tctggctttaagttt

SEQ ID NO: 56833 - DNA, 15 bp, Homo sapiens
ttctggctttaagtt

SEQ ID NO: 56834 - DNA, 15 bp, Homo sapiens
gttctggctttaagt

SEQ ID NO: 56835 - DNA, 15 bp, Homo sapiens
tgttctggctttaag

SEQ ID NO: 56836 - DNA, 15 bp, Homo sapiens
ttgttctggctttaa

SEQ ID NO: 56837 - DNA, 15 bp, Homo sapiens
attgttctggcttta

SEQ ID NO: 56838 - DNA, 15 bp, Homo sapiens
aattgttctggcttt

SEQ ID NO: 56839 - DNA, 15 bp, Homo sapiens
gaattgttctggctt

SEQ ID NO: 56840 - DNA, 15 bp, Homo sapiens
agaattgttctggct

SEQ ID NO: 56841 - DNA, 15 bp, Homo sapiens
aagaattgttctggc

SEQ ID NO: 56842 - DNA, 15 bp, Homo sapiens
aaagaattgttctgg

SEQ ID NO: 56843 - DNA, 15 bp, Homo sapiens
aaaagaattgttctg

SEQ ID NO: 56844 - DNA, 15 bp, Homo sapiens
gaaaagaattgttct

SEQ ID NO: 56845 - DNA, 15 bp, Homo sapiens
agaaaagaattgttc

SEQ ID NO: 56846 - DNA, 15 bp, Homo sapiens
aagaaaagaattgtt

SEQ ID NO: 56847 - DNA, 15 bp, Homo sapiens
caagaaaagaattgt

SEQ ID NO: 56848 - DNA, 15 bp, Homo sapiens
tcaagaaaagaattg

SEQ ID NO: 56849 - DNA, 15 bp, Homo sapiens
atcaagaaaagaatt

SEQ ID NO: 56850 - DNA, 15 bp, Homo sapiens
tatcaagaaaagaat

SEQ ID NO: 56851 - DNA, 15 bp, Homo sapiens
ttatcaagaaaagaa

SEQ ID NO: 56852 - DNA, 15 bp, Homo sapiens
cttatcaagaaaaga

SEQ ID NO: 56853 - DNA, 15 bp, Homo sapiens
ccttatcaagaaaag

SEQ ID NO: 56854 - DNA, 15 bp, Homo sapiens
cccttatcaagaaaa

SEQ ID NO: 56855 - DNA, 15 bp, Homo sapiens
tcccttatcaagaaa

SEQ ID NO: 56856 - DNA, 15 bp, Homo sapiens
atcccttatcaagaa

SEQ ID NO: 56857 - DNA, 15 bp, Homo sapiens
aatcccttatcaaga

SEQ ID NO: 56858 - DNA, 15 bp, Homo sapiens
aaatcccttatcaag

SEQ ID NO: 56859 - DNA, 15 bp, Homo sapiens
caaatcccttatcaa

SEQ ID NO: 56860 - DNA, 15 bp, Homo sapiens
ccaaatcccttatca

SEQ ID NO: 56861 - DNA, 15 bp, Homo sapiens
accaaatcccttatc

SEQ ID NO: 56862 - DNA, 15 bp, Homo sapiens
taccaaatcccttat

SEQ ID NO: 56863 - DNA, 15 bp, Homo sapiens
ttaccaaatccctta

SEQ ID NO: 56864 - DNA, 15 bp, Homo sapiens
tttaccaaatccctt

SEQ ID NO: 56865 - DNA, 15 bp, Homo sapiens
ctttaccaaatccct

SEQ ID NO: 56866 - DNA, 15 bp, Homo sapiens
tctttaccaaatccc

SEQ ID NO: 56867 - DNA, 15 bp, Homo sapiens
ttctttaccaaatcc

SEQ ID NO: 56868 - DNA, 15 bp, Homo sapiens
gttctttaccaaatc

SEQ ID NO: 56869 - DNA, 15 bp, Homo sapiens
agttctttaccaaat

SEQ ID NO: 56870 - DNA, 15 bp, Homo sapiens
aagttctttaccaaa

SEQ ID NO: 56871 - DNA, 15 bp, Homo sapiens
caagttctttaccaa

SEQ ID NO: 56872 - DNA, 15 bp, Homo sapiens
tcaagttctttacca

SEQ ID NO: 56873 - DNA, 15 bp, Homo sapiens
ctcaagttctttacc

SEQ ID NO: 56874 - DNA, 15 bp, Homo sapiens
tctcaagttctttac

SEQ ID NO: 56875 - DNA, 15 bp, Homo sapiens
ttctcaagttcttta

SEQ ID NO: 56876 - DNA, 15 bp, Homo sapiens
attctcaagttcttt

SEQ ID NO: 56877 - DNA, 15 bp, Homo sapiens
tattctcaagttctt

SEQ ID NO: 56878 - DNA, 15 bp, Homo sapiens
ttattctcaagttct

SEQ ID NO: 56879 - DNA, 15 bp, Homo sapiens
attattctcaagttc

SEQ ID NO: 56880 - DNA, 15 bp, Homo sapiens
tattattctcaagtt

SEQ ID NO: 56881 - DNA, 15 bp, Homo sapiens
atattattctcaagt

SEQ ID NO: 56882 - DNA, 15 bp, Homo sapiens
gatattattctcaag

SEQ ID NO: 56883 - DNA, 15 bp, Homo sapiens
tgatattattctcaa

SEQ ID NO: 56884 - DNA, 15 bp, Homo sapiens
ctgatattattctca

SEQ ID NO: 56885 - DNA, 15 bp, Homo sapiens
actgatattattctc

SEQ ID NO: 56886 - DNA, 15 bp, Homo sapiens
gactgatattattct

SEQ ID NO: 56887 - DNA, 15 bp, Homo sapiens
agactgatattattc

SEQ ID NO: 56888 - DNA, 15 bp, Homo sapiens
tagactgatattatt

SEQ ID NO: 56889 - DNA, 15 bp, Homo sapiens
ttagactgatattat

SEQ ID NO: 56890 - DNA, 15 bp, Homo sapiens
tttagactgatatta

SEQ ID NO: 56891 - DNA, 15 bp, Homo sapiens
ttttagactgatatt

SEQ ID NO: 56892 - DNA, 15 bp, Homo sapiens
gttttagactgatat

SEQ ID NO: 56893 - DNA, 15 bp, Homo sapiens
ggttttagactgata

SEQ ID NO: 56894 - DNA, 15 bp, Homo sapiens
tggttttagactgat

SEQ ID NO: 56895 - DNA, 15 bp, Homo sapiens
atggttttagactga

SEQ ID NO: 56896 - DNA, 15 bp, Homo sapiens
gatggttttagactg

SEQ ID NO: 56897 - DNA, 15 bp, Homo sapiens
agatggttttagact

SEQ ID NO: 56898 - DNA, 15 bp, Homo sapiens
aagatggttttagac

SEQ ID NO: 56899 - DNA, 15 bp, Homo sapiens
aaagatggttttaga

SEQ ID NO: 56900 - DNA, 15 bp, Homo sapiens
aaaagatggttttag

SEQ ID NO: 56901 - DNA, 15 bp, Homo sapiens
taaaagatggtttta

SEQ ID NO: 56902 - DNA, 15 bp, Homo sapiens
ttaaaagatggtttt

SEQ ID NO: 56903 - DNA, 15 bp, Homo sapiens
attaaaagatggttt

SEQ ID NO: 56904 - DNA, 15 bp, Homo sapiens
aattaaaagatggtt

SEQ ID NO: 56905 - DNA, 15 bp, Homo sapiens
aaattaaaagatggt

SEQ ID NO: 56906 - DNA, 15 bp, Homo sapiens
caaattaaaagatgg

SEQ ID NO: 56907 - DNA, 15 bp, Homo sapiens
acaaattaaaagatg

SEQ ID NO: 56908 - DNA, 15 bp, Homo sapiens
tacaaattaaaagat

SEQ ID NO: 56909 - DNA, 15 bp, Homo sapiens
ttacaaattaaaaga

SEQ ID NO: 56910 - DNA, 15 bp, Homo sapiens
gttacaaattaaaag

SEQ ID NO: 56911 - DNA, 15 bp, Homo sapiens
agttacaaattaaaa

SEQ ID NO: 56912 - DNA, 15 bp, Homo sapiens
cagttacaaattaaa

SEQ ID NO: 56913 - DNA, 15 bp, Homo sapiens
acagttacaaattaa

SEQ ID NO: 56914 - DNA, 15 bp, Homo sapiens
tacagttacaaatta

SEQ ID NO: 56915 - DNA, 15 bp, Homo sapiens
ttacagttacaaatt

SEQ ID NO: 56916 - DNA, 15 bp, Homo sapiens
tttacagttacaaat

SEQ ID NO: 56917 - DNA, 15 bp, Homo sapiens
atttacagttacaaa

SEQ ID NO: 56918 - DNA, 15 bp, Homo sapiens
catttacagttacaa

SEQ ID NO: 56919 - DNA, 15 bp, Homo sapiens
tcatttacagttaca

SEQ ID NO: 56920 - DNA, 15 bp, Homo sapiens
ttcatttacagttac

SEQ ID NO: 56921 - DNA, 15 bp, Homo sapiens
attcatttacagtta

SEQ ID NO: 56922 - DNA, 15 bp, Homo sapiens
tattcatttacagtt

SEQ ID NO: 56923 - DNA, 15 bp, Homo sapiens
atattcatttacagt

SEQ ID NO: 56924 - DNA, 15 bp, Homo sapiens
tatattcatttacag

SEQ ID NO: 56925 - DNA, 15 bp, Homo sapiens
gtatattcatttaca

SEQ ID NO: 56926 - DNA, 15 bp, Homo sapiens
tgtatattcatttac

SEQ ID NO: 56927 - DNA, 15 bp, Homo sapiens
ctgtatattcattta

SEQ ID NO: 56928 - DNA, 15 bp, Homo sapiens
actgtatattcattt

SEQ ID NO: 56929 - DNA, 15 bp, Homo sapiens
tactgtatattcatt

SEQ ID NO: 56930 - DNA, 15 bp, Homo sapiens
ttactgtatattcat

SEQ ID NO: 56931 - DNA, 15 bp, Homo sapiens
gttactgtatattca

SEQ ID NO: 56932 - DNA, 15 bp, Homo sapiens
ggttactgtatattc

SEQ ID NO: 56933 - DNA, 15 bp, Homo sapiens
tggttactgtatatt

SEQ ID NO: 56934 - DNA, 15 bp, Homo sapiens
ttggttactgtatat

SEQ ID NO: 56935 - DNA, 15 bp, Homo sapiens
cttggttactgtata

SEQ ID NO: 56936 - DNA, 15 bp, Homo sapiens
tcttggttactgtat

SEQ ID NO: 56937 - DNA, 15 bp, Homo sapiens
gtcttggttactgta

SEQ ID NO: 56938 - DNA, 15 bp, Homo sapiens
tgtcttggttactgt

SEQ ID NO: 56939 - DNA, 15 bp, Homo sapiens
ctgtcttggttactg

SEQ ID NO: 56940 - DNA, 15 bp, Homo sapiens
actgtcttggttact

SEQ ID NO: 56941 - DNA, 15 bp, Homo sapiens
cactgtcttggttac

SEQ ID NO: 56942 - DNA, 15 bp, Homo sapiens
gcactgtcttggtta

SEQ ID NO: 56943 - DNA, 15 bp, Homo sapiens
agcactgtcttggtt

SEQ ID NO: 56944 - DNA, 15 bp, Homo sapiens
gagcactgtcttggt

SEQ ID NO: 56945 - DNA, 15 bp, Homo sapiens
tgagcactgtcttgg

SEQ ID NO: 56946 - DNA, 15 bp, Homo sapiens
gtgagcactgtcttg

SEQ ID NO: 56947 - DNA, 15 bp, Homo sapiens
agtgagcactgtctt

SEQ ID NO: 56948 - DNA, 15 bp, Homo sapiens
gagtgagcactgtct

SEQ ID NO: 56949 - DNA, 15 bp, Homo sapiens
tgagtgagcactgtc

SEQ ID NO: 56950 - DNA, 15 bp, Homo sapiens
ttgagtgagcactgt

SEQ ID NO: 56951 - DNA, 15 bp, Homo sapiens
tttgagtgagcactg

SEQ ID NO: 56952 - DNA, 15 bp, Homo sapiens
ttttgagtgagcact

SEQ ID NO: 56953 - DNA, 15 bp, Homo sapiens
attttgagtgagcac

SEQ ID NO: 56954 - DNA, 15 bp, Homo sapiens
tattttgagtgagca

SEQ ID NO: 56955 - DNA, 15 bp, Homo sapiens
atattttgagtgagc

SEQ ID NO: 56956 - DNA, 15 bp, Homo sapiens
catattttgagtgag

SEQ ID NO: 56957 - DNA, 15 bp, Homo sapiens
acatattttgagtga

SEQ ID NO: 56958 - DNA, 15 bp, Homo sapiens
tacatattttgagtg

SEQ ID NO: 56959 - DNA, 15 bp, Homo sapiens
atacatattttgagt

SEQ ID NO: 56960 - DNA, 15 bp, Homo sapiens
aatacatattttgag

SEQ ID NO: 56961 - DNA, 15 bp, Homo sapiens
gaatacatattttga

SEQ ID NO: 56962 - DNA, 15 bp, Homo sapiens
agaatacatattttg

SEQ ID NO: 56963 - DNA, 15 bp, Homo sapiens
aagaatacatatttt

SEQ ID NO: 56964 - DNA, 15 bp, Homo sapiens
aaagaatacatattt

SEQ ID NO: 56965 - DNA, 15 bp, Homo sapiens
aaaagaatacatatt

SEQ ID NO: 56966 - DNA, 15 bp, Homo sapiens
aaaaagaatacatat

SEQ ID NO: 56967 - DNA, 15 bp, Homo sapiens
caaaaagaatacata

SEQ ID NO: 56968 - DNA, 15 bp, Homo sapiens
gcaaaaagaatacat

SEQ ID NO: 56969 - DNA, 15 bp, Homo sapiens
agcaaaaagaataca

SEQ ID NO: 56970 - DNA, 15 bp, Homo sapiens
cagcaaaaagaatac

SEQ ID NO: 56971 - DNA, 15 bp, Homo sapiens
gcagcaaaaagaata

SEQ ID NO: 56972 - DNA, 15 bp, Homo sapiens
tgcagcaaaaagaat

SEQ ID NO: 56973 - DNA, 15 bp, Homo sapiens
ttgcagcaaaaagaa

SEQ ID NO: 56974 - DNA, 15 bp, Homo sapiens
tttgcagcaaaaaga

SEQ ID NO: 56975 - DNA, 15 bp, Homo sapiens
atttgcagcaaaaag

SEQ ID NO: 56976 - DNA, 15 bp, Homo sapiens
gatttgcagcaaaaa

SEQ ID NO: 56977 - DNA, 15 bp, Homo sapiens
ggatttgcagcaaaa

SEQ ID NO: 56978 - DNA, 15 bp, Homo sapiens
aggatttgcagcaaa

SEQ ID NO: 56979 - DNA, 15 bp, Homo sapiens
aaggatttgcagcaa

SEQ ID NO: 56980 - DNA, 15 bp, Homo sapiens
caaggatttgcagca

SEQ ID NO: 56981 - DNA, 15 bp, Homo sapiens
acaaggatttgcagc

SEQ ID NO: 56982 - DNA, 15 bp, Homo sapiens
cacaaggatttgcag

SEQ ID NO: 56983 - DNA, 15 bp, Homo sapiens
tcacaaggatttgca

SEQ ID NO: 56984 - DNA, 15 bp, Homo sapiens
ttcacaaggatttgc

SEQ ID NO: 56985 - DNA, 15 bp, Homo sapiens
gttcacaaggatttg

SEQ ID NO: 56986 - DNA, 15 bp, Homo sapiens
tgttcacaaggattt

SEQ ID NO: 56987 - DNA, 15 bp, Homo sapiens
atgttcacaaggatt

SEQ ID NO: 56988 - DNA, 15 bp, Homo sapiens
tatgttcacaaggat

SEQ ID NO: 56989 - DNA, 15 bp, Homo sapiens
atatgttcacaagga

SEQ ID NO: 56990 - DNA, 15 bp, Homo sapiens
gatatgttcacaagg

SEQ ID NO: 56991 - DNA, 15 bp, Homo sapiens
tgatatgttcacaag

SEQ ID NO: 56992 - DNA, 15 bp, Homo sapiens
atgatatgttcacaa

SEQ ID NO: 56993 - DNA, 15 bp, Homo sapiens
catgatatgttcaca

SEQ ID NO: 56994 - DNA, 15 bp, Homo sapiens
ccatgatatgttcac

SEQ ID NO: 56995 - DNA, 15 bp, Homo sapiens
tccatgatatgttca

SEQ ID NO: 56996 - DNA, 15 bp, Homo sapiens
ctccatgatatgttc

SEQ ID NO: 56997 - DNA, 15 bp, Homo sapiens
actccatgatatgtt

SEQ ID NO: 56998 - DNA, 15 bp, Homo sapiens
tactccatgatatgt

SEQ ID NO: 56999 - DNA, 15 bp, Homo sapiens
atactccatgatatg

SEQ ID NO: 57000 - DNA, 15 bp, Homo sapiens
tatactccatgatat

SEQ ID NO: 57001 - DNA, 15 bp, Homo sapiens
gtatactccatgata

SEQ ID NO: 57002 - DNA, 15 bp, Homo sapiens
tgtatactccatgat

SEQ ID NO: 57003 - DNA, 15 bp, Homo sapiens
ctgtatactccatga

SEQ ID NO: 57004 - DNA, 15 bp, Homo sapiens
actgtatactccatg

SEQ ID NO: 57005 - DNA, 15 bp, Homo sapiens
cactgtatactccat

SEQ ID NO: 57006 - DNA, 15 bp, Homo sapiens
gcactgtatactcca

SEQ ID NO: 57007 - DNA, 15 bp, Homo sapiens
agcactgtatactcc

SEQ ID NO: 57008 - DNA, 15 bp, Homo sapiens
aagcactgtatactc

SEQ ID NO: 57009 - DNA, 15 bp, Homo sapiens
aaagcactgtatact

SEQ ID NO: 57010 - DNA, 15 bp, Homo sapiens
caaagcactgtatac

SEQ ID NO: 57011 - DNA, 15 bp, Homo sapiens
ccaaagcactgtata

SEQ ID NO: 57012 - DNA, 15 bp, Homo sapiens
tccaaagcactgtat

SEQ ID NO: 57013 - DNA, 15 bp, Homo sapiens
ttccaaagcactgta

SEQ ID NO: 57014 - DNA, 15 bp, Homo sapiens
attccaaagcactgt

SEQ ID NO: 57015 - DNA, 15 bp, Homo sapiens
aattccaaagcactg

SEQ ID NO: 57016 - DNA, 15 bp, Homo sapiens
gaattccaaagcact

SEQ ID NO: 57017 - DNA, 15 bp, Homo sapiens
tgaattccaaagcac

SEQ ID NO: 57018 - DNA, 15 bp, Homo sapiens
ctgaattccaaagca

SEQ ID NO: 57019 - DNA, 15 bp, Homo sapiens
cctgaattccaaagc

SEQ ID NO: 57020 - DNA, 15 bp, Homo sapiens
tcctgaattccaaag

SEQ ID NO: 57021 - DNA, 15 bp, Homo sapiens
atcctgaattccaaa

SEQ ID NO: 57022 - DNA, 15 bp, Homo sapiens
gatcctgaattccaa

SEQ ID NO: 57023 - DNA, 15 bp, Homo sapiens
ggatcctgaattcca

SEQ ID NO: 57024 - DNA, 15 bp, Homo sapiens
aggatcctgaattcc

SEQ ID NO: 57025 - DNA, 15 bp, Homo sapiens
caggatcctgaattc

SEQ ID NO: 57026 - DNA, 15 bp, Homo sapiens
tcaggatcctgaatt

SEQ ID NO: 57027 - DNA, 15 bp, Homo sapiens
ctcaggatcctgaat

SEQ ID NO: 57028 - DNA, 15 bp, Homo sapiens
tctcaggatcctgaa

SEQ ID NO: 57029 - DNA, 15 bp, Homo sapiens
ttctcaggatcctga

SEQ ID NO: 57030 - DNA, 15 bp, Homo sapiens
cttctcaggatcctg

SEQ ID NO: 57031 - DNA, 15 bp, Homo sapiens
acttctcaggatcct

SEQ ID NO: 57032 - DNA, 15 bp, Homo sapiens
gacttctcaggatcc

SEQ ID NO: 57033 - DNA, 15 bp, Homo sapiens
tgacttctcaggatc

SEQ ID NO: 57034 - DNA, 15 bp, Homo sapiens
atgacttctcaggat

SEQ ID NO: 57035 - DNA, 15 bp, Homo sapiens
tatgacttctcagga

SEQ ID NO: 57036 - DNA, 15 bp, Homo sapiens
ctatgacttctcagg

SEQ ID NO: 57037 - DNA, 15 bp, Homo sapiens
actatgacttctcag

SEQ ID NO: 57038 - DNA, 15 bp, Homo sapiens
cactatgacttctca

SEQ ID NO: 57039 - DNA, 15 bp, Homo sapiens
acactatgacttctc

SEQ ID NO: 57040 - DNA, 15 bp, Homo sapiens
tacactatgacttct

SEQ ID NO: 57041 - DNA, 15 bp, Homo sapiens
ctacactatgacttc

SEQ ID NO: 57042 - DNA, 15 bp, Homo sapiens
tctacactatgactt

SEQ ID NO: 57043 - DNA, 15 bp, Homo sapiens
ctctacactatgact

SEQ ID NO: 57044 - DNA, 15 bp, Homo sapiens
actctacactatgac

SEQ ID NO: 57045 - DNA, 15 bp, Homo sapiens
tactctacactatga

SEQ ID NO: 57046 - DNA, 15 bp, Homo sapiens
ttactctacactatg

SEQ ID NO: 57047 - DNA, 15 bp, Homo sapiens
tttactctacactat

SEQ ID NO: 57048 - DNA, 15 bp, Homo sapiens
atttactctacacta

SEQ ID NO: 57049 - DNA, 15 bp, Homo sapiens
aatttactctacact

SEQ ID NO: 57050 - DNA, 15 bp, Homo sapiens
taatttactctacac

SEQ ID NO: 57051 - DNA, 15 bp, Homo sapiens
ataatttactctaca

SEQ ID NO: 57052 - DNA, 15 bp, Homo sapiens
cataatttactctac

SEQ ID NO: 57053 - DNA, 15 bp, Homo sapiens
ccataatttactcta

SEQ ID NO: 57054 - DNA, 15 bp, Homo sapiens
gccataatttactct

SEQ ID NO: 57055 - DNA, 15 bp, Homo sapiens
agccataatttactc

SEQ ID NO: 57056 - DNA, 15 bp, Homo sapiens
gagccataatttact

SEQ ID NO: 57057 - DNA, 15 bp, Homo sapiens
agagccataatttac

SEQ ID NO: 57058 - DNA, 15 bp, Homo sapiens
aagagccataattta

SEQ ID NO: 57059 - DNA, 15 bp, Homo sapiens
caagagccataattt

SEQ ID NO: 57060 - DNA, 15 bp, Homo sapiens
ccaagagccataatt

SEQ ID NO: 57061 - DNA, 15 bp, Homo sapiens
tccaagagccataat

SEQ ID NO: 57062 - DNA, 15 bp, Homo sapiens
atccaagagccataa

SEQ ID NO: 57063 - DNA, 15 bp, Homo sapiens
aatccaagagccata

SEQ ID NO: 57064 - DNA, 15 bp, Homo sapiens
aaatccaagagccat

SEQ ID NO: 57065 - DNA, 15 bp, Homo sapiens
aaaatccaagagcca

SEQ ID NO: 57066 - DNA, 15 bp, Homo sapiens
aaaaatccaagagcc

SEQ ID NO: 57067 - DNA, 15 bp, Homo sapiens
taaaaatccaagagc

SEQ ID NO: 57068 - DNA, 15 bp, Homo sapiens
ttaaaaatccaagag

SEQ ID NO: 57069 - DNA, 15 bp, Homo sapiens
tttaaaaatccaaga

SEQ ID NO: 57070 - DNA, 15 bp, Homo sapiens
ttttaaaaatccaag

SEQ ID NO: 57071 - DNA, 15 bp, Homo sapiens
cttttaaaaatccaa

SEQ ID NO: 57072 - DNA, 15 bp, Homo sapiens
acttttaaaaatcca

SEQ ID NO: 57073 - DNA, 15 bp, Homo sapiens
aacttttaaaaatcc

SEQ ID NO: 57074 - DNA, 15 bp, Homo sapiens
taacttttaaaaatc

SEQ ID NO: 57075 - DNA, 15 bp, Homo sapiens
tcataacttttaaaa

SEQ ID NO: 57076 - DNA, 15 bp, Homo sapiens
ttcataacttttaaa

SEQ ID NO: 57077 - DNA, 15 bp, Homo sapiens
cttcataacttttaa

SEQ ID NO: 57078 - DNA, 15 bp, Homo sapiens
tcttcataactttta

SEQ ID NO: 57079 - DNA, 15 bp, Homo sapiens
ctcttcataactttt

SEQ ID NO: 57080 - DNA, 15 bp, Homo sapiens
gctcttcataacttt

SEQ ID NO: 57081 - DNA, 15 bp, Homo sapiens
agctcttcataactt

SEQ ID NO: 57082 - DNA, 15 bp, Homo sapiens
gagctcttcataact

SEQ ID NO: 57083 - DNA, 15 bp, Homo sapiens
tgagctcttcataac

SEQ ID NO: 57084 - DNA, 15 bp, Homo sapiens
ctgagctcttcataa

SEQ ID NO: 57085 - DNA, 15 bp, Homo sapiens
tctgagctcttcata

SEQ ID NO: 57086 - DNA, 15 bp, Homo sapiens
ttctgagctcttcat

SEQ ID NO: 57087 - DNA, 15 bp, Homo sapiens
tttctgagctcttca

SEQ ID NO: 57088 - DNA, 15 bp, Homo sapiens
ttttctgagctcttc

SEQ ID NO: 57089 - DNA, 15 bp, Homo sapiens
tttttctgagctctt

SEQ ID NO: 57090 - DNA, 15 bp, Homo sapiens
ctttttctgagctct

SEQ ID NO: 57091 - DNA, 15 bp, Homo sapiens
actttttctgagctc

SEQ ID NO: 57092 - DNA, 15 bp, Homo sapiens
cactttttctgagct

SEQ ID NO: 57093 - DNA, 15 bp, Homo sapiens
tcactttttctgagc

SEQ ID NO: 57094 - DNA, 15 bp, Homo sapiens
atcactttttctgag

SEQ ID NO: 57095 - DNA, 15 bp, Homo sapiens
aatcactttttctga

SEQ ID NO: 57096 - DNA, 15 bp, Homo sapiens
taatcactttttctg

SEQ ID NO: 57097 - DNA, 15 bp, Homo sapiens
ataatcactttttct

SEQ ID NO: 57098 - DNA, 15 bp, Homo sapiens
gataatcactttttc

SEQ ID NO: 57099 - DNA, 15 bp, Homo sapiens
agataatcacttttt

SEQ ID NO: 57100 - DNA, 15 bp, Homo sapiens
tagataatcactttt

SEQ ID NO: 57101 - DNA, 15 bp, Homo sapiens
ttagataatcacttt

SEQ ID NO: 57102 - DNA, 15 bp, Homo sapiens
tttagataatcactt

SEQ ID NO: 57103 - DNA, 15 bp, Homo sapiens
ttttagataatcact

SEQ ID NO: 57104 - DNA, 15 bp, Homo sapiens
tttttagataatcac

SEQ ID NO: 57105 - DNA, 15 bp, Homo sapiens
ttttttagataatca

SEQ ID NO: 57106 - DNA, 15 bp, Homo sapiens
tttttttagataatc

SEQ ID NO: 57107 - DNA, 15 bp, Homo sapiens
ctttttttagataat

SEQ ID NO: 57108 - DNA, 15 bp, Homo sapiens
gctttttttagataa

SEQ ID NO: 57109 - DNA, 15 bp, Homo sapiens
agctttttttagata

SEQ ID NO: 57110 - DNA, 15 bp, Homo sapiens
tagctttttttagat

SEQ ID NO: 57111 - DNA, 15 bp, Homo sapiens
ttagctttttttaga

SEQ ID NO: 57112 - DNA, 15 bp, Homo sapiens
tttagctttttttag

SEQ ID NO: 57113 - DNA, 15 bp, Homo sapiens
ttttagcttttttta

SEQ ID NO: 57114 - DNA, 15 bp, Homo sapiens
tttttagcttttttt

SEQ ID NO: 57115 - DNA, 15 bp, Homo sapiens
atttttagctttttt

SEQ ID NO: 57116 - DNA, 15 bp, Homo sapiens
aatttttagcttttt

SEQ ID NO: 57117 - DNA, 15 bp, Homo sapiens
taatttttagctttt

SEQ ID NO: 57118 - DNA, 15 bp, Homo sapiens
ctaatttttagcttt

SEQ ID NO: 57119 - DNA, 15 bp, Homo sapiens
cctaatttttagctt

SEQ ID NO: 57120 - DNA, 15 bp, Homo sapiens
tcctaatttttagct

SEQ ID NO: 57121 - DNA, 15 bp, Homo sapiens
ttcctaatttttagc

SEQ ID NO: 57122 - DNA, 15 bp, Homo sapiens
tttcctaatttttag

SEQ ID NO: 57123 - DNA, 15 bp, Homo sapiens
atttcctaattttta

SEQ ID NO: 57124 - DNA, 15 bp, Homo sapiens
aatttcctaattttt

SEQ ID NO: 57125 - DNA, 15 bp, Homo sapiens
taatttcctaatttt

SEQ ID NO: 57126 - DNA, 15 bp, Homo sapiens
ttaatttcctaattt

SEQ ID NO: 57127 - DNA, 15 bp, Homo sapiens
tttaatttcctaatt

SEQ ID NO: 57128 - DNA, 15 bp, Homo sapiens
gtttaatttcctaat

SEQ ID NO: 57129 - DNA, 15 bp, Homo sapiens
tgtttaatttcctaa

SEQ ID NO: 57130 - DNA, 15 bp, Homo sapiens
gtgtttaatttccta

SEQ ID NO: 57131 - DNA, 15 bp, Homo sapiens
agtgtttaatttcct

SEQ ID NO: 57132 - DNA, 15 bp, Homo sapiens
aagtgtttaatttcc

SEQ ID NO: 57133 - DNA, 15 bp, Homo sapiens
taagtgtttaatttc

SEQ ID NO: 57134 - DNA, 15 bp, Homo sapiens
ataagtgtttaattt

SEQ ID NO: 57135 - DNA, 15 bp, Homo sapiens
aataagtgtttaatt

SEQ ID NO: 57136 - DNA, 15 bp, Homo sapiens
aaataagtgtttaat

SEQ ID NO: 57137 - DNA, 15 bp, Homo sapiens
gaaataagtgtttaa

SEQ ID NO: 57138 - DNA, 15 bp, Homo sapiens
agaaataagtgttta

SEQ ID NO: 57139 - DNA, 15 bp, Homo sapiens
cagaaataagtgttt

SEQ ID NO: 57140 - DNA, 15 bp, Homo sapiens
ccagaaataagtgtt

SEQ ID NO: 57141 - DNA, 15 bp, Homo sapiens
tccagaaataagtgt

SEQ ID NO: 57142 - DNA, 15 bp, Homo sapiens
atccagaaataagtg

SEQ ID NO: 57143 - DNA, 15 bp, Homo sapiens
tatccagaaataagt

SEQ ID NO: 57144 - DNA, 15 bp, Homo sapiens
atatccagaaataag

SEQ ID NO: 57145 - DNA, 15 bp, Homo sapiens
gatatccagaaataa

SEQ ID NO: 57146 - DNA, 15 bp, Homo sapiens
ggatatccagaaata

SEQ ID NO: 57147 - DNA, 15 bp, Homo sapiens
aggatatccagaaat

SEQ ID NO: 57148 - DNA, 15 bp, Homo sapiens
caggatatccagaaa

SEQ ID NO: 57149 - DNA, 15 bp, Homo sapiens
gcaggatatccagaa

SEQ ID NO: 57150 - DNA, 15 bp, Homo sapiens
agcaggatatccaga

SEQ ID NO: 57151 - DNA, 15 bp, Homo sapiens
gagcaggatatccag

SEQ ID NO: 57152 - DNA, 15 bp, Homo sapiens
tgagcaggatatcca

SEQ ID NO: 57153 - DNA, 15 bp, Homo sapiens
atgagcaggatatcc

SEQ ID NO: 57154 - DNA, 15 bp, Homo sapiens
aatgagcaggatatc

SEQ ID NO: 57155 - DNA, 15 bp, Homo sapiens
aaatgagcaggatat

SEQ ID NO: 57156 - DNA, 15 bp, Homo sapiens
taaatgagcaggata

SEQ ID NO: 57157 - DNA, 15 bp, Homo sapiens
ataaatgagcaggat

SEQ ID NO: 57158 - DNA, 15 bp, Homo sapiens
aataaatgagcagga

SEQ ID NO: 57159 - DNA, 15 bp, Homo sapiens
aaataaatgagcagg

SEQ ID NO: 57160 - DNA, 15 bp, Homo sapiens
taaataaatgagcag

SEQ ID NO: 57161 - DNA, 15 bp, Homo sapiens
ataaataaatgagca

SEQ ID NO: 57162 - DNA, 15 bp, Homo sapiens
cataaataaatgagc

SEQ ID NO: 57163 - DNA, 15 bp, Homo sapiens
tcataaataaatgag

SEQ ID NO: 57164 - DNA, 15 bp, Homo sapiens
gtcataaataaatga

SEQ ID NO: 57165 - DNA, 15 bp, Homo sapiens
ggtcataaataaatg

SEQ ID NO: 57166 - DNA, 15 bp, Homo sapiens
aggtcataaataaat

SEQ ID NO: 57167 - DNA, 15 bp, Homo sapiens
gaggtcataaataaa

SEQ ID NO: 57168 - DNA, 15 bp, Homo sapiens
tgaggtcataaataa

SEQ ID NO: 57169 - DNA, 15 bp, Homo sapiens
ctgaggtcataaata

SEQ ID NO: 57170 - DNA, 15 bp, Homo sapiens
cctgaggtcataaat

SEQ ID NO: 57171 - DNA, 15 bp, Homo sapiens
gcctgaggtcataaa

SEQ ID NO: 57172 - DNA, 15 bp, Homo sapiens
tgcctgaggtcataa

SEQ ID NO: 57173 - DNA, 15 bp, Homo sapiens
ttgcctgaggtcata

SEQ ID NO: 57174 - DNA, 15 bp, Homo sapiens
tttgcctgaggtcat

SEQ ID NO: 57175 - DNA, 15 bp, Homo sapiens
atttgcctgaggtca

SEQ ID NO: 57176 - DNA, 15 bp, Homo sapiens
aatttgcctgaggtc

SEQ ID NO: 57177 - DNA, 15 bp, Homo sapiens
taatttgcctgaggt

SEQ ID NO: 57178 - DNA, 15 bp, Homo sapiens
ataatttgcctgagg

SEQ ID NO: 57179 - DNA, 15 bp, Homo sapiens
aataatttgcctgag

SEQ ID NO: 57180 - DNA, 15 bp, Homo sapiens
taataatttgcctga

SEQ ID NO: 57181 - DNA, 15 bp, Homo sapiens
ctaataatttgcctg

SEQ ID NO: 57182 - DNA, 15 bp, Homo sapiens
actaataatttgcct

SEQ ID NO: 57183 - DNA, 15 bp, Homo sapiens
gactaataatttgcc

SEQ ID NO: 57184 - DNA, 15 bp, Homo sapiens
tgactaataatttgc

SEQ ID NO: 57185 - DNA, 15 bp, Homo sapiens
ttgactaataatttg

SEQ ID NO: 57186 - DNA, 15 bp, Homo sapiens
attgactaataattt

SEQ ID NO: 57187 - DNA, 15 bp, Homo sapiens
aattgactaataatt

SEQ ID NO: 57188 - DNA, 15 bp, Homo sapiens
aaattgactaataat

SEQ ID NO: 57189 - DNA, 15 bp, Homo sapiens
aaaattgactaataa

SEQ ID NO: 57190 - DNA, 15 bp, Homo sapiens
aaaaattgactaata

SEQ ID NO: 57191 - DNA, 15 bp, Homo sapiens
aaaaaattgactaat

SEQ ID NO: 57192 - DNA, 15 bp, Homo sapiens
gaaaaaattgactaa

SEQ ID NO: 57193 - DNA, 15 bp, Homo sapiens
tgaaaaaattgacta

SEQ ID NO: 57194 - DNA, 15 bp, Homo sapiens
ctgaaaaaattgact

SEQ ID NO: 57195 - DNA, 15 bp, Homo sapiens
tctgaaaaaattgac

SEQ ID NO: 57196 - DNA, 15 bp, Homo sapiens
atctgaaaaaattga

SEQ ID NO: 57197 - DNA, 15 bp, Homo sapiens
gatctgaaaaaattg

SEQ ID NO: 57198 - DNA, 15 bp, Homo sapiens
tgatctgaaaaaatt

SEQ ID NO: 57199 - DNA, 15 bp, Homo sapiens
gtgatctgaaaaaat

SEQ ID NO: 57200 - DNA, 15 bp, Homo sapiens
ggtgatctgaaaaaa

SEQ ID NO: 57201 - DNA, 15 bp, Homo sapiens
aggtgatctgaaaaa

SEQ ID NO: 57202 - DNA, 15 bp, Homo sapiens
caggtgatctgaaaa

SEQ ID NO: 57203 - DNA, 15 bp, Homo sapiens
ccaggtgatctgaaa

SEQ ID NO: 57204 - DNA, 15 bp, Homo sapiens
accaggtgatctgaa

SEQ ID NO: 57205 - DNA, 15 bp, Homo sapiens
gaccaggtgatctga

SEQ ID NO: 57206 - DNA, 15 bp, Homo sapiens
agaccaggtgatctg

SEQ ID NO: 57207 - DNA, 15 bp, Homo sapiens
tagaccaggtgatct

SEQ ID NO: 57208 - DNA, 15 bp, Homo sapiens
gtagaccaggtgatc

SEQ ID NO: 57209 - DNA, 15 bp, Homo sapiens
tgtagaccaggtgat

SEQ ID NO: 57210 - DNA, 15 bp, Homo sapiens
atgtagaccaggtga

SEQ ID NO: 57211 - DNA, 15 bp, Homo sapiens
aatgtagaccaggtg

SEQ ID NO: 57212 - DNA, 15 bp, Homo sapiens
aaatgtagaccaggt

SEQ ID NO: 57213 - DNA, 15 bp, Homo sapiens
gaaatgtagaccagg

SEQ ID NO: 57214 - DNA, 15 bp, Homo sapiens
ggaaatgtagaccag

SEQ ID NO: 57215 - DNA, 15 bp, Homo sapiens
tggaaatgtagacca

SEQ ID NO: 57216 - DNA, 15 bp, Homo sapiens
atggaaatgtagacc

SEQ ID NO: 57217 - DNA, 15 bp, Homo sapiens
tatggaaatgtagac

SEQ ID NO: 57218 - DNA, 15 bp, Homo sapiens
ctatggaaatgtaga

SEQ ID NO: 57219 - DNA, 15 bp, Homo sapiens
gctatggaaatgtag

SEQ ID NO: 57220 - DNA, 15 bp, Homo sapiens
ggctatggaaatgta

SEQ ID NO: 57221 - DNA, 15 bp, Homo sapiens
tggctatggaaatgt

SEQ ID NO: 57222 - DNA, 15 bp, Homo sapiens
atggctatggaaatg

SEQ ID NO: 57223 - DNA, 15 bp, Homo sapiens
tatggctatggaaat

SEQ ID NO: 57224 - DNA, 15 bp, Homo sapiens
ttatggctatggaaa

SEQ ID NO: 57225 - DNA, 15 bp, Homo sapiens
cttatggctatggaa

SEQ ID NO: 57226 - DNA, 15 bp, Homo sapiens
tcttatggctatgga

SEQ ID NO: 57227 - DNA, 15 bp, Homo sapiens
gtcttatggctatgg

SEQ ID NO: 57228 - DNA, 15 bp, Homo sapiens
cgtcttatggctatg

SEQ ID NO: 57229 - DNA, 15 bp, Homo sapiens
gcgtcttatggctat

SEQ ID NO: 57230 - DNA, 15 bp, Homo sapiens
tgcgtcttatggcta

SEQ ID NO: 57231 - DNA, 15 bp, Homo sapiens
ttgcgtcttatggct

SEQ ID NO: 57232 - DNA, 15 bp, Homo sapiens
attgcgtcttatggc

SEQ ID NO: 57233 - DNA, 15 bp, Homo sapiens
gattgcgtcttatgg

SEQ ID NO: 57234 - DNA, 15 bp, Homo sapiens
cgattgcgtcttatg

SEQ ID NO: 57235 - DNA, 15 bp, Homo sapiens
tcgattgcgtcttat

SEQ ID NO: 57236 - DNA, 15 bp, Homo sapiens
atcgattgcgtctta

SEQ ID NO: 57237 - DNA, 15 bp, Homo sapiens
gatcgattgcgtctt

SEQ ID NO: 57238 - DNA, 15 bp, Homo sapiens
tgatcgattgcgtct

SEQ ID NO: 57239 - DNA, 15 bp, Homo sapiens
atgatcgattgcgtc

SEQ ID NO: 57240 - DNA, 15 bp, Homo sapiens
aatgatcgattgcgt

SEQ ID NO: 57241 - DNA, 15 bp, Homo sapiens
taatgatcgattgcg

SEQ ID NO: 57242 - DNA, 15 bp, Homo sapiens
ataatgatcgattgc

SEQ ID NO: 57243 - DNA, 15 bp, Homo sapiens
aataatgatcgattg

SEQ ID NO: 57244 - DNA, 15 bp, Homo sapiens
taataatgatcgatt

SEQ ID NO: 57245 - DNA, 15 bp, Homo sapiens
gtaataatgatcgat

SEQ ID NO: 57246 - DNA, 15 bp, Homo sapiens
ggtaataatgatcga

SEQ ID NO: 57247 - DNA, 15 bp, Homo sapiens
aggtaataatgatcg

SEQ ID NO: 57248 - DNA, 15 bp, Homo sapiens
aaggtaataatgatc

SEQ ID NO: 57249 - DNA, 15 bp, Homo sapiens
gaaggtaataatgat

SEQ ID NO: 57250 - DNA, 15 bp, Homo sapiens
ggaaggtaataatga

SEQ ID NO: 57251 - DNA, 15 bp, Homo sapiens
aggaaggtaataatg

SEQ ID NO: 57252 - DNA, 15 bp, Homo sapiens
aaggaaggtaataat

SEQ ID NO: 57253 - DNA, 15 bp, Homo sapiens
taaggaaggtaataa

SEQ ID NO: 57254 - DNA, 15 bp, Homo sapiens
ataaggaaggtaata

SEQ ID NO: 57255 - DNA, 15 bp, Homo sapiens
tataaggaaggtaat

SEQ ID NO: 57256 - DNA, 15 bp, Homo sapiens
atataaggaaggtaa

SEQ ID NO: 57257 - DNA, 15 bp, Homo sapiens
gatataaggaaggta

SEQ ID NO: 57258 - DNA, 15 bp, Homo sapiens
cgatataaggaaggt

SEQ ID NO: 57259 - DNA, 15 bp, Homo sapiens
acgatataaggaagg

SEQ ID NO: 57260 - DNA, 15 bp, Homo sapiens
cacgatataaggaag

SEQ ID NO: 57261 - DNA, 15 bp, Homo sapiens
tcacgatataaggaa

SEQ ID NO: 57262 - DNA, 15 bp, Homo sapiens
ttcacgatataagga

SEQ ID NO: 57263 - DNA, 15 bp, Homo sapiens
cttcacgatataagg

SEQ ID NO: 57264 - DNA, 15 bp, Homo sapiens
tcttcacgatataag

SEQ ID NO: 57265 - DNA, 15 bp, Homo sapiens
ttcttcacgatataa

SEQ ID NO: 57266 - DNA, 15 bp, Homo sapiens
tttcttcacgatata

SEQ ID NO: 57267 - DNA, 15 bp, Homo sapiens
atttcttcacgatat

SEQ ID NO: 57268 - DNA, 15 bp, Homo sapiens
tatttcttcacgata

SEQ ID NO: 57269 - DNA, 15 bp, Homo sapiens
atatttcttcacgat

SEQ ID NO: 57270 - DNA, 15 bp, Homo sapiens
aatatttcttcacga

SEQ ID NO: 57271 - DNA, 15 bp, Homo sapiens
caatatttcttcacg

SEQ ID NO: 57272 - DNA, 15 bp, Homo sapiens
tcaatatttcttcac

SEQ ID NO: 57273 - DNA, 15 bp, Homo sapiens
ctcaatatttcttca

SEQ ID NO: 57274 - DNA, 15 bp, Homo sapiens
cctcaatatttcttc

SEQ ID NO: 57275 - DNA, 15 bp, Homo sapiens
gcctcaatatttctt

SEQ ID NO: 57276 - DNA, 15 bp, Homo sapiens
tgcctcaatatttct

SEQ ID NO: 57277 - DNA, 15 bp, Homo sapiens
atgcctcaatatttc

SEQ ID NO: 57278 - DNA, 15 bp, Homo sapiens
aatgcctcaatattt

SEQ ID NO: 57279 - DNA, 15 bp, Homo sapiens
caatgcctcaatatt

SEQ ID NO: 57280 - DNA, 15 bp, Homo sapiens
gcaatgcctcaatat

SEQ ID NO: 57281 - DNA, 15 bp, Homo sapiens
agcaatgcctcaata

SEQ ID NO: 57282 - DNA, 15 bp, Homo sapiens
cagcaatgcctcaat

SEQ ID NO: 57283 - DNA, 15 bp, Homo sapiens
tcagcaatgcctcaa

SEQ ID NO: 57284 - DNA, 15 bp, Homo sapiens
ctcagcaatgcctca

SEQ ID NO: 57285 - DNA, 15 bp, Homo sapiens
tctcagcaatgcctc

SEQ ID NO: 57286 - DNA, 15 bp, Homo sapiens
ttctcagcaatgcct

SEQ ID NO: 57287 - DNA, 15 bp, Homo sapiens
cttctcagcaatgcc

SEQ ID NO: 57288 - DNA, 15 bp, Homo sapiens
acttctcagcaatgc

SEQ ID NO: 57289 - DNA, 15 bp, Homo sapiens
cacttctcagcaatg

SEQ ID NO: 57290 - DNA, 15 bp, Homo sapiens
acacttctcagcaat

SEQ ID NO: 57291 - DNA, 15 bp, Homo sapiens
tacacttctcagcaa

SEQ ID NO: 57292 - DNA, 15 bp, Homo sapiens
atacacttctcagca

SEQ ID NO: 57293 - DNA, 15 bp, Homo sapiens
tatacacttctcagc

SEQ ID NO: 57294 - DNA, 15 bp, Homo sapiens
ctatacacttctcag

SEQ ID NO: 57295 - DNA, 15 bp, Homo sapiens
cctatacacttctca

SEQ ID NO: 57296 - DNA, 15 bp, Homo sapiens
tcctatacacttctc

SEQ ID NO: 57297 - DNA, 15 bp, Homo sapiens
ctcctatacacttct

SEQ ID NO: 57298 - DNA, 15 bp, Homo sapiens
tctcctatacacttc

SEQ ID NO: 57299 - DNA, 15 bp, Homo sapiens
atctcctatacactt

SEQ ID NO: 57300 - DNA, 15 bp, Homo sapiens
catctcctatacact

SEQ ID NO: 57301 - DNA, 15 bp, Homo sapiens
tcatctcctatacac

SEQ ID NO: 57302 - DNA, 15 bp, Homo sapiens
atcatctcctataca

SEQ ID NO: 57303 - DNA, 15 bp, Homo sapiens
tatcatctcctatac

SEQ ID NO: 57304 - DNA, 15 bp, Homo sapiens
ttatcatctcctata

SEQ ID NO: 57305 - DNA, 15 bp, Homo sapiens
attatcatctcctat

SEQ ID NO: 57306 - DNA, 15 bp, Homo sapiens
aattatcatctccta

SEQ ID NO: 57307 - DNA, 15 bp, Homo sapiens
taattatcatctcct

SEQ ID NO: 57308 - DNA, 15 bp, Homo sapiens
gtaattatcatctcc

SEQ ID NO: 57309 - DNA, 15 bp, Homo sapiens
agtaattatcatctc

SEQ ID NO: 57310 - DNA, 15 bp, Homo sapiens
aagtaattatcatct

SEQ ID NO: 57311 - DNA, 15 bp, Homo sapiens
taagtaattatcatc

SEQ ID NO: 57312 - DNA, 15 bp, Homo sapiens
ctaagtaattatcat

SEQ ID NO: 57313 - DNA, 15 bp, Homo sapiens
cctaagtaattatca

SEQ ID NO: 57314 - DNA, 15 bp, Homo sapiens
tcctaagtaattatc

SEQ ID NO: 57315 - DNA, 15 bp, Homo sapiens
ttcctaagtaattat

SEQ ID NO: 57316 - DNA, 15 bp, Homo sapiens
attcctaagtaatta

SEQ ID NO: 57317 - DNA, 15 bp, Homo sapiens
cattcctaagtaatt

SEQ ID NO: 57318 - DNA, 15 bp, Homo sapiens
gcattcctaagtaat

SEQ ID NO: 57319 - DNA, 15 bp, Homo sapiens
tgcattcctaagtaa

SEQ ID NO: 57320 - DNA, 15 bp, Homo sapiens
ttgcattcctaagta

SEQ ID NO: 57321 - DNA, 15 bp, Homo sapiens
tttgcattcctaagt

SEQ ID NO: 57322 - DNA, 15 bp, Homo sapiens
ttttgcattcctaag

SEQ ID NO: 57323 - DNA, 15 bp, Homo sapiens
attttgcattcctaa

SEQ ID NO: 57324 - DNA, 15 bp, Homo sapiens
tattttgcattccta

SEQ ID NO: 57325 - DNA, 15 bp, Homo sapiens
ttattttgcattcct

SEQ ID NO: 57326 - DNA, 15 bp, Homo sapiens
tttattttgcattcc

SEQ ID NO: 57327 - DNA, 15 bp, Homo sapiens
ttttattttgcattc

SEQ ID NO: 57328 - DNA, 15 bp, Homo sapiens
tttttattttgcatt

SEQ ID NO: 57329 - DNA, 15 bp, Homo sapiens
gtttttattttgcat

SEQ ID NO: 57330 - DNA, 15 bp, Homo sapiens
ggtttttattttgca

SEQ ID NO: 57331 - DNA, 15 bp, Homo sapiens
gggtttttattttgc

SEQ ID NO: 57332 - DNA, 15 bp, Homo sapiens
agggtttttattttg

SEQ ID NO: 57333 - DNA, 15 bp, Homo sapiens
tagggtttttatttt

SEQ ID NO: 57334 - DNA, 15 bp, Homo sapiens
atagggtttttattt

SEQ ID NO: 57335 - DNA, 15 bp, Homo sapiens
gatagggtttttatt

SEQ ID NO: 57336 - DNA, 15 bp, Homo sapiens
tgatagggtttttat

SEQ ID NO: 57337 - DNA, 15 bp, Homo sapiens
atgatagggttttta

SEQ ID NO: 57338 - DNA, 15 bp, Homo sapiens
tatgatagggttttt

SEQ ID NO: 57339 - DNA, 15 bp, Homo sapiens
atatgatagggtttt

SEQ ID NO: 57340 - DNA, 15 bp, Homo sapiens
tatatgatagggttt

SEQ ID NO: 57341 - DNA, 15 bp, Homo sapiens
gtatatgatagggtt

SEQ ID NO: 57342 - DNA, 15 bp, Homo sapiens
ggtatatgatagggt

SEQ ID NO: 57343 - DNA, 15 bp, Homo sapiens
aggtatatgataggg

SEQ ID NO: 57344 - DNA, 15 bp, Homo sapiens
gaggtatatgatagg

SEQ ID NO: 57345 - DNA, 15 bp, Homo sapiens
cgaggtatatgatag

SEQ ID NO: 57346 - DNA, 15 bp, Homo sapiens
tcgaggtatatgata

SEQ ID NO: 57347 - DNA, 15 bp, Homo sapiens
ttcgaggtatatgat

SEQ ID NO: 57348 - DNA, 15 bp, Homo sapiens
attcgaggtatatga

SEQ ID NO: 57349 - DNA, 15 bp, Homo sapiens
gattcgaggtatatg

SEQ ID NO: 57350 - DNA, 15 bp, Homo sapiens
agattcgaggtatat

SEQ ID NO: 57351 - DNA, 15 bp, Homo sapiens
cagattcgaggtata

SEQ ID NO: 57352 - DNA, 15 bp, Homo sapiens
acagattcgaggtat

SEQ ID NO: 57353 - DNA, 15 bp, Homo sapiens
cacagattcgaggta

SEQ ID NO: 57354 - DNA, 15 bp, Homo sapiens
tcacagattcgaggt

SEQ ID NO: 57355 - DNA, 15 bp, Homo sapiens
atcacagattcgagg

SEQ ID NO: 57356 - DNA, 15 bp, Homo sapiens
tatcacagattcgag

SEQ ID NO: 57357 - DNA, 15 bp, Homo sapiens
ctatcacagattcga

SEQ ID NO: 57358 - DNA, 15 bp, Homo sapiens
actatcacagattcg

SEQ ID NO: 57359 - DNA, 15 bp, Homo sapiens
gactatcacagattc

SEQ ID NO: 57360 - DNA, 15 bp, Homo sapiens
ggactatcacagatt

SEQ ID NO: 57361 - DNA, 15 bp, Homo sapiens
aggactatcacagat

SEQ ID NO: 57362 - DNA, 15 bp, Homo sapiens
caggactatcacaga

SEQ ID NO: 57363 - DNA, 15 bp, Homo sapiens
tcaggactatcacag

SEQ ID NO: 57364 - DNA, 15 bp, Homo sapiens
atcaggactatcaca

SEQ ID NO: 57365 - DNA, 15 bp, Homo sapiens
gatcaggactatcac

SEQ ID NO: 57366 - DNA, 15 bp, Homo sapiens
agatcaggactatca

SEQ ID NO: 57367 - DNA, 15 bp, Homo sapiens
cagatcaggactatc

SEQ ID NO: 57368 - DNA, 15 bp, Homo sapiens
acagatcaggactat

SEQ ID NO: 57369 - DNA, 15 bp, Homo sapiens
cacagatcaggacta

SEQ ID NO: 57370 - DNA, 15 bp, Homo sapiens
ccacagatcaggact

SEQ ID NO: 57371 - DNA, 15 bp, Homo sapiens
tccacagatcaggac

SEQ ID NO: 57372 - DNA, 15 bp, Homo sapiens
atccacagatcagga

SEQ ID NO: 57373 - DNA, 15 bp, Homo sapiens
gatccacagatcagg

SEQ ID NO: 57374 - DNA, 15 bp, Homo sapiens
ggatccacagatcag

SEQ ID NO: 57375 - DNA, 15 bp, Homo sapiens
cggatccacagatca

SEQ ID NO: 57376 - DNA, 15 bp, Homo sapiens
acggatccacagatc

SEQ ID NO: 57377 - DNA, 15 bp, Homo sapiens
cacggatccacagat

SEQ ID NO: 57378 - DNA, 15 bp, Homo sapiens
gcacggatccacaga

SEQ ID NO: 57379 - DNA, 15 bp, Homo sapiens
ggcacggatccacag

SEQ ID NO: 57380 - DNA, 15 bp, Homo sapiens
tggcacggatccaca

SEQ ID NO: 57381 - DNA, 15 bp, Homo sapiens
gtggcacggatccac

SEQ ID NO: 57382 - DNA, 15 bp, Homo sapiens
tgtggcacggatcca

SEQ ID NO: 57383 - DNA, 15 bp, Homo sapiens
gtgtggcacggatcc

SEQ ID NO: 57384 - DNA, 15 bp, Homo sapiens
cgtgtggcacggatc

SEQ ID NO: 57385 - DNA, 15 bp, Homo sapiens
acgtgtggcacggat

SEQ ID NO: 57386 - DNA, 15 bp, Homo sapiens
tacgtgtggcacgga

SEQ ID NO: 57387 - DNA, 15 bp, Homo sapiens
ttacgtgtggcacgg

SEQ ID NO: 57388 - DNA, 15 bp, Homo sapiens
tttacgtgtggcacg

SEQ ID NO: 57389 - DNA, 15 bp, Homo sapiens
gtttacgtgtggcac

SEQ ID NO: 57390 - DNA, 15 bp, Homo sapiens
tgtttacgtgtggca

SEQ ID NO: 57391 - DNA, 15 bp, Homo sapiens
ctgtttacgtgtggc

SEQ ID NO: 57392 - DNA, 15 bp, Homo sapiens
tctgtttacgtgtgg

SEQ ID NO: 57393 - DNA, 15 bp, Homo sapiens
ttctgtttacgtgtg

SEQ ID NO: 57394 - DNA, 15 bp, Homo sapiens
tttctgtttacgtgt

SEQ ID NO: 57395 - DNA, 15 bp, Homo sapiens
ttttctgtttacgtg

SEQ ID NO: 57396 - DNA, 15 bp, Homo sapiens
cttttctgtttacgt

SEQ ID NO: 57397 - DNA, 15 bp, Homo sapiens
ccttttctgtttacg

SEQ ID NO: 57398 - DNA, 15 bp, Homo sapiens
cccttttctgtttac

SEQ ID NO: 57399 - DNA, 15 bp, Homo sapiens
tcccttttctgttta

SEQ ID NO: 57400 - DNA, 15 bp, Homo sapiens
ttcccttttctgttt

SEQ ID NO: 57401 - DNA, 15 bp, Homo sapiens
tttcccttttctgtt

SEQ ID NO: 57402 - DNA, 15 bp, Homo sapiens
ttttcccttttctgt

SEQ ID NO: 57403 - DNA, 15 bp, Homo sapiens
tttttcccttttctg

SEQ ID NO: 57404 - DNA, 15 bp, Homo sapiens
ctttttcccttttct

SEQ ID NO: 57405 - DNA, 15 bp, Homo sapiens
gctttttcccttttc

SEQ ID NO: 57406 - DNA, 15 bp, Homo sapiens
tgctttttccctttt

SEQ ID NO: 57407 - DNA, 15 bp, Homo sapiens
gtgctttttcccttt

SEQ ID NO: 57408 - DNA, 15 bp, Homo sapiens
agtgctttttccctt

SEQ ID NO: 57409 - DNA, 15 bp, Homo sapiens
cagtgctttttccct

SEQ ID NO: 57410 - DNA, 15 bp, Homo sapiens
ccagtgctttttccc

SEQ ID NO: 57411 - DNA, 15 bp, Homo sapiens
gccagtgctttttcc

SEQ ID NO: 57412 - DNA, 15 bp, Homo sapiens
agccagtgctttttc

SEQ ID NO: 57413 - DNA, 15 bp, Homo sapiens
gagccagtgcttttt

SEQ ID NO: 57414 - DNA, 15 bp, Homo sapiens
tgagccagtgctttt

SEQ ID NO: 57415 - DNA, 15 bp, Homo sapiens
atgagccagtgcttt

SEQ ID NO: 57416 - DNA, 15 bp, Homo sapiens
aatgagccagtgctt

SEQ ID NO: 57417 - DNA, 15 bp, Homo sapiens
taatgagccagtgct

SEQ ID NO: 57418 - DNA, 15 bp, Homo sapiens
ttaatgagccagtgc

SEQ ID NO: 57419 - DNA, 15 bp, Homo sapiens
cttaatgagccagtg

SEQ ID NO: 57420 - DNA, 15 bp, Homo sapiens
gcttaatgagccagt

SEQ ID NO: 57421 - DNA, 15 bp, Homo sapiens
ggcttaatgagccag

SEQ ID NO: 57422 - DNA, 15 bp, Homo sapiens
gggcttaatgagcca

SEQ ID NO: 57423 - DNA, 15 bp, Homo sapiens
cgggcttaatgagcc

SEQ ID NO: 57424 - DNA, 15 bp, Homo sapiens
gcgggcttaatgagc

SEQ ID NO: 57425 - DNA, 15 bp, Homo sapiens
cgcgggcttaatgag

SEQ ID NO: 57426 - DNA, 15 bp, Homo sapiens
acgcgggcttaatga

SEQ ID NO: 57427 - DNA, 15 bp, Homo sapiens
aacgcgggcttaatg

SEQ ID NO: 57428 - DNA, 15 bp, Homo sapiens
gaacgcgggcttaat

SEQ ID NO: 57429 - DNA, 15 bp, Homo sapiens
agaacgcgggcttaa

SEQ ID NO: 57430 - DNA, 15 bp, Homo sapiens
aagaacgcgggctta

SEQ ID NO: 57431 - DNA, 15 bp, Homo sapiens
gaagaacgcgggctt

SEQ ID NO: 57432 - DNA, 15 bp, Homo sapiens
ggaagaacgcgggct

SEQ ID NO: 57433 - DNA, 15 bp, Homo sapiens
tggaagaacgcgggc

SEQ ID NO: 57434 - DNA, 15 bp, Homo sapiens
atggaagaacgcggg

SEQ ID NO: 57435 - DNA, 15 bp, Homo sapiens
aatggaagaacgcgg

SEQ ID NO: 57436 - DNA, 15 bp, Homo sapiens
caatggaagaacgcg

SEQ ID NO: 57437 - DNA, 15 bp, Homo sapiens
acaatggaagaacgc

SEQ ID NO: 57438 - DNA, 15 bp, Homo sapiens
tacaatggaagaacg

SEQ ID NO: 57439 - DNA, 15 bp, Homo sapiens
atacaatggaagaac

SEQ ID NO: 57440 - DNA, 15 bp, Homo sapiens
catacaatggaagaa

SEQ ID NO: 57441 - DNA, 15 bp, Homo sapiens
ccatacaatggaaga

SEQ ID NO: 57442 - DNA, 15 bp, Homo sapiens
accatacaatggaag

SEQ ID NO: 57443 - DNA, 15 bp, Homo sapiens
caccatacaatggaa

SEQ ID NO: 57444 - DNA, 15 bp, Homo sapiens
acaccatacaatgga

SEQ ID NO: 57445 - DNA, 15 bp, Homo sapiens
cacaccatacaatgg

SEQ ID NO: 57446 - DNA, 15 bp, Homo sapiens
acacaccatacaatg

SEQ ID NO: 57447 - DNA, 15 bp, Homo sapiens
tacacaccatacaat

SEQ ID NO: 57448 - DNA, 15 bp, Homo sapiens
atacacaccatacaa

SEQ ID NO: 57449 - DNA, 15 bp, Homo sapiens
catacacaccataca

SEQ ID NO: 57450 - DNA, 15 bp, Homo sapiens
tcatacacaccatac

SEQ ID NO: 57451 - DNA, 15 bp, Homo sapiens
gtcatacacaccata

SEQ ID NO: 57452 - DNA, 15 bp, Homo sapiens
agtcatacacaccat

SEQ ID NO: 57453 - DNA, 15 bp, Homo sapiens
aagtcatacacacca

SEQ ID NO: 57454 - DNA, 15 bp, Homo sapiens
caagtcatacacacc

SEQ ID NO: 57455 - DNA, 15 bp, Homo sapiens
tcaagtcatacacac

SEQ ID NO: 57456 - DNA, 15 bp, Homo sapiens
ctcaagtcatacaca

SEQ ID NO: 57457 - DNA, 15 bp, Homo sapiens
actcaagtcatacac

SEQ ID NO: 57458 - DNA, 15 bp, Homo sapiens
cactcaagtcataca

SEQ ID NO: 57459 - DNA, 15 bp, Homo sapiens
acactcaagtcatac

SEQ ID NO: 57460 - DNA, 15 bp, Homo sapiens
aacactcaagtcata

SEQ ID NO: 57461 - DNA, 15 bp, Homo sapiens
aaacactcaagtcat

SEQ ID NO: 57462 - DNA, 15 bp, Homo sapiens
aaaacactcaagtca

SEQ ID NO: 57463 - DNA, 15 bp, Homo sapiens
caaaacactcaagtc

SEQ ID NO: 57464 - DNA, 15 bp, Homo sapiens
gcaaaacactcaagt

SEQ ID NO: 57465 - DNA, 15 bp, Homo sapiens
ggcaaaacactcaag

SEQ ID NO: 57466 - DNA, 15 bp, Homo sapiens
gggcaaaacactcaa

SEQ ID NO: 57467 - DNA, 15 bp, Homo sapiens
ggggcaaaacactca

SEQ ID NO: 57468 - DNA, 15 bp, Homo sapiens
aggggcaaaacactc

SEQ ID NO: 57469 - DNA, 15 bp, Homo sapiens
aaggggcaaaacact

SEQ ID NO: 57470 - DNA, 15 bp, Homo sapiens
gaaggggcaaaacac

SEQ ID NO: 57471 - DNA, 15 bp, Homo sapiens
agaaggggcaaaaca

SEQ ID NO: 57472 - DNA, 15 bp, Homo sapiens
tagaaggggcaaaac

SEQ ID NO: 57473 - DNA, 15 bp, Homo sapiens
ttagaaggggcaaaa

SEQ ID NO: 57474 - DNA, 15 bp, Homo sapiens
tttagaaggggcaaa

SEQ ID NO: 57475 - DNA, 15 bp, Homo sapiens
atttagaaggggcaa

SEQ ID NO: 57476 - DNA, 15 bp, Homo sapiens
aatttagaaggggca

SEQ ID NO: 57477 - DNA, 15 bp, Homo sapiens
aaatttagaaggggc

SEQ ID NO: 57478 - DNA, 15 bp, Homo sapiens
gaaatttagaagggg

SEQ ID NO: 57479 - DNA, 15 bp, Homo sapiens
tgaaatttagaaggg

SEQ ID NO: 57480 - DNA, 15 bp, Homo sapiens
ctgaaatttagaagg

SEQ ID NO: 57481 - DNA, 15 bp, Homo sapiens
tctgaaatttagaag

SEQ ID NO: 57482 - DNA, 15 bp, Homo sapiens
ctctgaaatttagaa

SEQ ID NO: 57483 - DNA, 15 bp, Homo sapiens
gctctgaaatttaga

SEQ ID NO: 57484 - DNA, 15 bp, Homo sapiens
ggctctgaaatttag

SEQ ID NO: 57485 - DNA, 15 bp, Homo sapiens
aggctctgaaattta

SEQ ID NO: 57486 - DNA, 15 bp, Homo sapiens
gaggctctgaaattt

SEQ ID NO: 57487 - DNA, 15 bp, Homo sapiens
agaggctctgaaatt

SEQ ID NO: 57488 - DNA, 15 bp, Homo sapiens
cagaggctctgaaat

SEQ ID NO: 57489 - DNA, 15 bp, Homo sapiens
ccagaggctctgaaa

SEQ ID NO: 57490 - DNA, 15 bp, Homo sapiens
gccagaggctctgaa

SEQ ID NO: 57491 - DNA, 15 bp, Homo sapiens
agccagaggctctga

SEQ ID NO: 57492 - DNA, 15 bp, Homo sapiens
aagccagaggctctg

SEQ ID NO: 57493 - DNA, 15 bp, Homo sapiens
caagccagaggctct

SEQ ID NO: 57494 - DNA, 15 bp, Homo sapiens
acaagccagaggctc

SEQ ID NO: 57495 - DNA, 15 bp, Homo sapiens
aacaagccagaggct

SEQ ID NO: 57496 - DNA, 15 bp, Homo sapiens
taacaagccagaggc

SEQ ID NO: 57497 - DNA, 15 bp, Homo sapiens
ctaacaagccagagg

SEQ ID NO: 57498 - DNA, 15 bp, Homo sapiens
gctaacaagccagag

SEQ ID NO: 57499 - DNA, 15 bp, Homo sapiens
ggctaacaagccaga

SEQ ID NO: 57500 - DNA, 15 bp, Homo sapiens
cggctaacaagccag

SEQ ID NO: 57501 - DNA, 15 bp, Homo sapiens
ccggctaacaagcca

SEQ ID NO: 57502 - DNA, 15 bp, Homo sapiens
gccggctaacaagcc

SEQ ID NO: 57503 - DNA, 15 bp, Homo sapiens
ggccggctaacaagc

SEQ ID NO: 57504 - DNA, 15 bp, Homo sapiens
cggccggctaacaag

SEQ ID NO: 57505 - DNA, 15 bp, Homo sapiens
ccggccggctaacaa

SEQ ID NO: 57506 - DNA, 15 bp, Homo sapiens
accggccggctaaca

SEQ ID NO: 57507 - DNA, 15 bp, Homo sapiens
gaccggccggctaac

SEQ ID NO: 57508 - DNA, 15 bp, Homo sapiens
agaccggccggctaa

SEQ ID NO: 57509 - DNA, 15 bp, Homo sapiens
gagaccggccggcta

SEQ ID NO: 57510 - DNA, 15 bp, Homo sapiens
ggagaccggccggct

SEQ ID NO: 57511 - DNA, 15 bp, Homo sapiens
gggagaccggccggc

SEQ ID NO: 57512 - DNA, 15 bp, Homo sapiens
tgggagaccggccgg

SEQ ID NO: 57513 - DNA, 15 bp, Homo sapiens
ttgggagaccggccg

SEQ ID NO: 57514 - DNA, 15 bp, Homo sapiens
cttgggagaccggcc

SEQ ID NO: 57515 - DNA, 15 bp, Homo sapiens
ccttgggagaccggc

SEQ ID NO: 57516 - DNA, 15 bp, Homo sapiens
cccttgggagaccgg

SEQ ID NO: 57517 - DNA, 15 bp, Homo sapiens
tcccttgggagaccg

SEQ ID NO: 57518 - DNA, 15 bp, Homo sapiens
ctcccttgggagacc

SEQ ID NO: 57519 - DNA, 15 bp, Homo sapiens
cctcccttgggagac

SEQ ID NO: 57520 - DNA, 15 bp, Homo sapiens
gcctcccttgggaga

SEQ ID NO: 57521 - DNA, 15 bp, Homo sapiens
tgcctcccttgggag

SEQ ID NO: 57522 - DNA, 15 bp, Homo sapiens
ctgcctcccttggga

SEQ ID NO: 57523 - DNA, 15 bp, Homo sapiens
gctgcctcccttggg

SEQ ID NO: 57524 - DNA, 15 bp, Homo sapiens
tgctgcctcccttgg

SEQ ID NO: 57525 - DNA, 15 bp, Homo sapiens
ttgctgcctcccttg

SEQ ID NO: 57526 - DNA, 15 bp, Homo sapiens
tttgctgcctccctt

SEQ ID NO: 57527 - DNA, 15 bp, Homo sapiens
ctttgctgcctccct

SEQ ID NO: 57528 - DNA, 15 bp, Homo sapiens
cctttgctgcctccc

SEQ ID NO: 57529 - DNA, 15 bp, Homo sapiens
gcctttgctgcctcc

SEQ ID NO: 57530 - DNA, 15 bp, Homo sapiens
ggcctttgctgcctc

SEQ ID NO: 57531 - DNA, 15 bp, Homo sapiens
aggcctttgctgcct

SEQ ID NO: 57532 - DNA, 15 bp, Homo sapiens
gaggcctttgctgcc

SEQ ID NO: 57533 - DNA, 15 bp, Homo sapiens
tgaggcctttgctgc

SEQ ID NO: 57534 - DNA, 15 bp, Homo sapiens
atgaggcctttgctg

SEQ ID NO: 57535 - DNA, 15 bp, Homo sapiens
aatgaggcctttgct

SEQ ID NO: 57536 - DNA, 15 bp, Homo sapiens
caatgaggcctttgc

SEQ ID NO: 57537 - DNA, 15 bp, Homo sapiens
gcaatgaggcctttg

SEQ ID NO: 57538 - DNA, 15 bp, Homo sapiens
agcaatgaggccttt

SEQ ID NO: 57539 - DNA, 15 bp, Homo sapiens
aagcaatgaggcctt

SEQ ID NO: 57540 - DNA, 15 bp, Homo sapiens
aaagcaatgaggcct

SEQ ID NO: 57541 - DNA, 15 bp, Homo sapiens
caaagcaatgaggcc

SEQ ID NO: 57542 - DNA, 15 bp, Homo sapiens
gcaaagcaatgaggc

SEQ ID NO: 57543 - DNA, 15 bp, Homo sapiens
agcaaagcaatgagg

SEQ ID NO: 57544 - DNA, 15 bp, Homo sapiens
aagcaaagcaatgag

SEQ ID NO: 57545 - DNA, 15 bp, Homo sapiens
aaagcaaagcaatga

SEQ ID NO: 57546 - DNA, 15 bp, Homo sapiens
caaagcaaagcaatg

SEQ ID NO: 57547 - DNA, 15 bp, Homo sapiens
ccaaagcaaagcaat

SEQ ID NO: 57548 - DNA, 15 bp, Homo sapiens
cccaaagcaaagcaa

SEQ ID NO: 57549 - DNA, 15 bp, Homo sapiens
tcccaaagcaaagca

SEQ ID NO: 57550 - DNA, 15 bp, Homo sapiens
ttcccaaagcaaagc

SEQ ID NO: 57551 - DNA, 15 bp, Homo sapiens
tttcccaaagcaaag

SEQ ID NO: 57552 - DNA, 15 bp, Homo sapiens
atttcccaaagcaaa

SEQ ID NO: 57553 - DNA, 15 bp, Homo sapiens
aatttcccaaagcaa

SEQ ID NO: 57554 - DNA, 15 bp, Homo sapiens
aaatttcccaaagca

SEQ ID NO: 57555 - DNA, 15 bp, Homo sapiens
caaatttcccaaagc

SEQ ID NO: 57556 - DNA, 15 bp, Homo sapiens
gcaaatttcccaaag

SEQ ID NO: 57557 - DNA, 15 bp, Homo sapiens
agcaaatttcccaaa

SEQ ID NO: 57558 - DNA, 15 bp, Homo sapiens
gagcaaatttcccaa

SEQ ID NO: 57559 - DNA, 15 bp, Homo sapiens
agagcaaatttccca

SEQ ID NO: 57560 - DNA, 15 bp, Homo sapiens
cagagcaaatttccc

SEQ ID NO: 57561 - DNA, 15 bp, Homo sapiens
tcagagcaaatttcc

SEQ ID NO: 57562 - DNA, 15 bp, Homo sapiens
gtcagagcaaatttc

SEQ ID NO: 57563 - DNA, 15 bp, Homo sapiens
agtcagagcaaattt

SEQ ID NO: 57564 - DNA, 15 bp, Homo sapiens
aagtcagagcaaatt

SEQ ID NO: 57565 - DNA, 15 bp, Homo sapiens
aaagtcagagcaaat

SEQ ID NO: 57566 - DNA, 15 bp, Homo sapiens
caaagtcagagcaaa

SEQ ID NO: 57567 - DNA, 15 bp, Homo sapiens
tcaaagtcagagcaa

SEQ ID NO: 57568 - DNA, 15 bp, Homo sapiens
ctcaaagtcagagca

SEQ ID NO: 57569 - DNA, 15 bp, Homo sapiens
gctcaaagtcagagc

SEQ ID NO: 57570 - DNA, 15 bp, Homo sapiens
ggctcaaagtcagag

SEQ ID NO: 57571 - DNA, 15 bp, Homo sapiens
aggctcaaagtcaga

SEQ ID NO: 57572 - DNA, 15 bp, Homo sapiens
caggctcaaagtcag

SEQ ID NO: 57573 - DNA, 15 bp, Homo sapiens
gcaggctcaaagtca

SEQ ID NO: 57574 - DNA, 15 bp, Homo sapiens
tgcaggctcaaagtc

SEQ ID NO: 57575 - DNA, 15 bp, Homo sapiens
atgcaggctcaaagt

SEQ ID NO: 57576 - DNA, 15 bp, Homo sapiens
aatgcaggctcaaag

SEQ ID NO: 57577 - DNA, 15 bp, Homo sapiens
aaatgcaggctcaaa

SEQ ID NO: 57578 - DNA, 15 bp, Homo sapiens
aaaatgcaggctcaa

SEQ ID NO: 57579 - DNA, 15 bp, Homo sapiens
gaaaatgcaggctca

SEQ ID NO: 57580 - DNA, 15 bp, Homo sapiens
agaaaatgcaggctc

SEQ ID NO: 57581 - DNA, 15 bp, Homo sapiens
aagaaaatgcaggct

SEQ ID NO: 57582 - DNA, 15 bp, Homo sapiens
aaagaaaatgcaggc

SEQ ID NO: 57583 - DNA, 15 bp, Homo sapiens
caaagaaaatgcagg

SEQ ID NO: 57584 - DNA, 15 bp, Homo sapiens
ccaaagaaaatgcag

SEQ ID NO: 57585 - DNA, 15 bp, Homo sapiens
gccaaagaaaatgca

SEQ ID NO: 57586 - DNA, 15 bp, Homo sapiens
agccaaagaaaatgc

SEQ ID NO: 57587 - DNA, 15 bp, Homo sapiens
cagccaaagaaaatg

SEQ ID NO: 57588 - DNA, 15 bp, Homo sapiens
tcagccaaagaaaat

SEQ ID NO: 57589 - DNA, 15 bp, Homo sapiens
gtcagccaaagaaaa

SEQ ID NO: 57590 - DNA, 15 bp, Homo sapiens
agtcagccaaagaaa

SEQ ID NO: 57591 - DNA, 15 bp, Homo sapiens
aagtcagccaaagaa

SEQ ID NO: 57592 - DNA, 15 bp, Homo sapiens
aaagtcagccaaaga

SEQ ID NO: 57593 - DNA, 15 bp, Homo sapiens
gaaagtcagccaaag

SEQ ID NO: 57594 - DNA, 15 bp, Homo sapiens
tgaaagtcagccaaa

SEQ ID NO: 57595 - DNA, 15 bp, Homo sapiens
ctgaaagtcagccaa

SEQ ID NO: 57596 - DNA, 15 bp, Homo sapiens
tctgaaagtcagcca

SEQ ID NO: 57597 - DNA, 15 bp, Homo sapiens
ctctgaaagtcagcc

SEQ ID NO: 57598 - DNA, 15 bp, Homo sapiens
gctctgaaagtcagc

SEQ ID NO: 57599 - DNA, 15 bp, Homo sapiens
agctctgaaagtcag

SEQ ID NO: 57600 - DNA, 15 bp, Homo sapiens
cagctctgaaagtca

SEQ ID NO: 57601 - DNA, 15 bp, Homo sapiens
gcagctctgaaagtc

SEQ ID NO: 57602 - DNA, 15 bp, Homo sapiens
agcagctctgaaagt

SEQ ID NO: 57603 - DNA, 15 bp, Homo sapiens
gagcagctctgaaag

SEQ ID NO: 57604 - DNA, 15 bp, Homo sapiens
tgagcagctctgaaa

SEQ ID NO: 57605 - DNA, 15 bp, Homo sapiens
atgagcagctctgaa

SEQ ID NO: 57606 - DNA, 15 bp, Homo sapiens
gatgagcagctctga

SEQ ID NO: 57607 - DNA, 15 bp, Homo sapiens
agatgagcagctctg

SEQ ID NO: 57608 - DNA, 15 bp, Homo sapiens
cagatgagcagctct

SEQ ID NO: 57609 - DNA, 15 bp, Homo sapiens
ccagatgagcagctc

SEQ ID NO: 57610 - DNA, 15 bp, Homo sapiens
gccagatgagcagct

SEQ ID NO: 57611 - DNA, 15 bp, Homo sapiens
tgccagatgagcagc

SEQ ID NO: 57612 - DNA, 15 bp, Homo sapiens
ctgccagatgagcag

SEQ ID NO: 57613 - DNA, 15 bp, Homo sapiens
tctgccagatgagca

SEQ ID NO: 57614 - DNA, 15 bp, Homo sapiens
ctctgccagatgagc

SEQ ID NO: 57615 - DNA, 15 bp, Homo sapiens
gctctgccagatgag

SEQ ID NO: 57616 - DNA, 15 bp, Homo sapiens
agctctgccagatga

SEQ ID NO: 57617 - DNA, 15 bp, Homo sapiens
cagctctgccagatg

SEQ ID NO: 57618 - DNA, 15 bp, Homo sapiens
tcagctctgccagat

SEQ ID NO: 57619 - DNA, 15 bp, Homo sapiens
ttcagctctgccaga

SEQ ID NO: 57620 - DNA, 15 bp, Homo sapiens
tttcagctctgccag

SEQ ID NO: 57621 - DNA, 15 bp, Homo sapiens
ttttcagctctgcca

SEQ ID NO: 57622 - DNA, 15 bp, Homo sapiens
gttttcagctctgcc

SEQ ID NO: 57623 - DNA, 15 bp, Homo sapiens
tgttttcagctctgc

SEQ ID NO: 57624 - DNA, 15 bp, Homo sapiens
atgttttcagctctg

SEQ ID NO: 57625 - DNA, 15 bp, Homo sapiens
tatgttttcagctct

SEQ ID NO: 57626 - DNA, 15 bp, Homo sapiens
gtatgttttcagctc

SEQ ID NO: 57627 - DNA, 15 bp, Homo sapiens
tgtatgttttcagct

SEQ ID NO: 57628 - DNA, 15 bp, Homo sapiens
ttgtatgttttcagc

SEQ ID NO: 57629 - DNA, 15 bp, Homo sapiens
tttgtatgttttcag

SEQ ID NO: 57630 - DNA, 15 bp, Homo sapiens
atttgtatgttttca

SEQ ID NO: 57631 - DNA, 15 bp, Homo sapiens
aatttgtatgttttc

SEQ ID NO: 57632 - DNA, 15 bp, Homo sapiens
caatttgtatgtttt

SEQ ID NO: 57633 - DNA, 15 bp, Homo sapiens
gcaatttgtatgttt

SEQ ID NO: 57634 - DNA, 15 bp, Homo sapiens
tgcaatttgtatgtt

SEQ ID NO: 57635 - DNA, 15 bp, Homo sapiens
ctgcaatttgtatgt

SEQ ID NO: 57636 - DNA, 15 bp, Homo sapiens
tctgcaatttgtatg

SEQ ID NO: 57637 - DNA, 15 bp, Homo sapiens
ttctgcaatttgtat

SEQ ID NO: 57638 - DNA, 15 bp, Homo sapiens
cttctgcaatttgta

SEQ ID NO: 57639 - DNA, 15 bp, Homo sapiens
acttctgcaatttgt

SEQ ID NO: 57640 - DNA, 15 bp, Homo sapiens
aacttctgcaatttg

SEQ ID NO: 57641 - DNA, 15 bp, Homo sapiens
gaacttctgcaattt

SEQ ID NO: 57642 - DNA, 15 bp, Homo sapiens
agaacttctgcaatt

SEQ ID NO: 57643 - DNA, 15 bp, Homo sapiens
aagaacttctgcaat

SEQ ID NO: 57644 - DNA, 15 bp, Homo sapiens
aaagaacttctgcaa

SEQ ID NO: 57645 - DNA, 15 bp, Homo sapiens
aaaagaacttctgca

SEQ ID NO: 57646 - DNA, 15 bp, Homo sapiens
taaaagaacttctgc

SEQ ID NO: 57647 - DNA, 15 bp, Homo sapiens
ataaaagaacttctg

SEQ ID NO: 57648 - DNA, 15 bp, Homo sapiens
gataaaagaacttct

SEQ ID NO: 57649 - DNA, 15 bp, Homo sapiens
ggataaaagaacttc

SEQ ID NO: 57650 - DNA, 15 bp, Homo sapiens
tggataaaagaactt

SEQ ID NO: 57651 - DNA, 15 bp, Homo sapiens
atggataaaagaact

SEQ ID NO: 57652 - DNA, 15 bp, Homo sapiens
aatggataaaagaac

SEQ ID NO: 57653 - DNA, 15 bp, Homo sapiens
aaatggataaaagaa

SEQ ID NO: 57654 - DNA, 15 bp, Homo sapiens
caaatggataaaaga

SEQ ID NO: 57655 - DNA, 15 bp, Homo sapiens
ccaaatggataaaag

SEQ ID NO: 57656 - DNA, 15 bp, Homo sapiens
accaaatggataaaa

SEQ ID NO: 57657 - DNA, 15 bp, Homo sapiens
caccaaatggataaa

SEQ ID NO: 57658 - DNA, 15 bp, Homo sapiens
tcaccaaatggataa

SEQ ID NO: 57659 - DNA, 15 bp, Homo sapiens
ctcaccaaatggata

SEQ ID NO: 57660 - DNA, 15 bp, Homo sapiens
tctcaccaaatggat

SEQ ID NO: 57661 - DNA, 15 bp, Homo sapiens
atctcaccaaatgga

SEQ ID NO: 57662 - DNA, 15 bp, Homo sapiens
catctcaccaaatgg

SEQ ID NO: 57663 - DNA, 15 bp, Homo sapiens
ccatctcaccaaatg

SEQ ID NO: 57664 - DNA, 15 bp, Homo sapiens
accatctcaccaaat

SEQ ID NO: 57665 - DNA, 15 bp, Homo sapiens
aaccatctcaccaaa

SEQ ID NO: 57666 - DNA, 15 bp, Homo sapiens
gaaccatctcaccaa

SEQ ID NO: 57667 - DNA, 15 bp, Homo sapiens
agaaccatctcacca

SEQ ID NO: 57668 - DNA, 15 bp, Homo sapiens
gagaaccatctcacc

SEQ ID NO: 57669 - DNA, 15 bp, Homo sapiens
agagaaccatctcac

SEQ ID NO: 57670 - DNA, 15 bp, Homo sapiens
tagagaaccatctca

SEQ ID NO: 57671 - DNA, 15 bp, Homo sapiens
ttagagaaccatctc

SEQ ID NO: 57672 - DNA, 15 bp, Homo sapiens
tttagagaaccatct

SEQ ID NO: 57673 - DNA, 15 bp, Homo sapiens
ctttagagaaccatc

SEQ ID NO: 57674 - DNA, 15 bp, Homo sapiens
tctttagagaaccat

SEQ ID NO: 57675 - DNA, 15 bp, Homo sapiens
ctctttagagaacca

SEQ ID NO: 57676 - DNA, 15 bp, Homo sapiens
cctctttagagaacc

SEQ ID NO: 57677 - DNA, 15 bp, Homo sapiens
gcctctttagagaac

SEQ ID NO: 57678 - DNA, 15 bp, Homo sapiens
agcctctttagagaa

SEQ ID NO: 57679 - DNA, 15 bp, Homo sapiens
aagcctctttagaga

SEQ ID NO: 57680 - DNA, 15 bp, Homo sapiens
gaagcctctttagag

SEQ ID NO: 57681 - DNA, 15 bp, Homo sapiens
tgaagcctctttaga

SEQ ID NO: 57682 - DNA, 15 bp, Homo sapiens
gtgaagcctctttag

SEQ ID NO: 57683 - DNA, 15 bp, Homo sapiens
tgtgaagcctcttta

SEQ ID NO: 57684 - DNA, 15 bp, Homo sapiens
ttgtgaagcctcttt

SEQ ID NO: 57685 - DNA, 15 bp, Homo sapiens
tttgtgaagcctctt

SEQ ID NO: 57686 - DNA, 15 bp, Homo sapiens
atttgtgaagcctct

SEQ ID NO: 57687 - DNA, 15 bp, Homo sapiens
tatttgtgaagcctc

SEQ ID NO: 57688 - DNA, 15 bp, Homo sapiens
ttatttgtgaagcct

SEQ ID NO: 57689 - DNA, 15 bp, Homo sapiens
tttatttgtgaagcc

SEQ ID NO: 57690 - DNA, 15 bp, Homo sapiens
ctttatttgtgaagc

SEQ ID NO: 57691 - DNA, 15 bp, Homo sapiens
cctttatttgtgaag

SEQ ID NO: 57692 - DNA, 15 bp, Homo sapiens
acctttatttgtgaa

SEQ ID NO: 57693 - DNA, 15 bp, Homo sapiens
aacctttatttgtga

SEQ ID NO: 57694 - DNA, 15 bp, Homo sapiens
taacctttatttgtg

SEQ ID NO: 57695 - DNA, 15 bp, Homo sapiens
ctaacctttatttgt

SEQ ID NO: 57696 - DNA, 15 bp, Homo sapiens
cctaacctttatttg

SEQ ID NO: 57697 - DNA, 15 bp, Homo sapiens
acctaacctttattt

SEQ ID NO: 57698 - DNA, 15 bp, Homo sapiens
tacctaacctttatt

SEQ ID NO: 57699 - DNA, 15 bp, Homo sapiens
ctacctaacctttat

SEQ ID NO: 57700 - DNA, 15 bp, Homo sapiens
tctacctaaccttta

SEQ ID NO: 57701 - DNA, 15 bp, Homo sapiens
ttctacctaaccttt

SEQ ID NO: 57702 - DNA, 15 bp, Homo sapiens
tttctacctaacctt

SEQ ID NO: 57703 - DNA, 15 bp, Homo sapiens
ttttctacctaacct

SEQ ID NO: 57704 - DNA, 15 bp, Homo sapiens
attttctacctaacc

SEQ ID NO: 57705 - DNA, 15 bp, Homo sapiens
tattttctacctaac

SEQ ID NO: 57706 - DNA, 15 bp, Homo sapiens
atattttctacctaa

SEQ ID NO: 57707 - DNA, 15 bp, Homo sapiens
catattttctaccta

SEQ ID NO: 57708 - DNA, 15 bp, Homo sapiens
gcatattttctacct

SEQ ID NO: 57709 - DNA, 15 bp, Homo sapiens
tgcatattttctacc

SEQ ID NO: 57710 - DNA, 15 bp, Homo sapiens
ttgcatattttctac

SEQ ID NO: 57711 - DNA, 15 bp, Homo sapiens
tttgcatattttcta

SEQ ID NO: 57712 - DNA, 15 bp, Homo sapiens
ttttgcatattttct

SEQ ID NO: 57713 - DNA, 15 bp, Homo sapiens
attttgcatattttc

SEQ ID NO: 57714 - DNA, 15 bp, Homo sapiens
aattttgcatatttt

SEQ ID NO: 57715 - DNA, 15 bp, Homo sapiens
taattttgcatattt

SEQ ID NO: 57716 - DNA, 15 bp, Homo sapiens
ttaattttgcatatt

SEQ ID NO: 57717 - DNA, 15 bp, Homo sapiens
tttaattttgcatat

SEQ ID NO: 57718 - DNA, 15 bp, Homo sapiens
ttttaattttgcata

SEQ ID NO: 57719 - DNA, 15 bp, Homo sapiens
tttttaattttgcat

SEQ ID NO: 57720 - DNA, 15 bp, Homo sapiens
atttttaattttgca

SEQ ID NO: 57721 - DNA, 15 bp, Homo sapiens
catttttaattttgc

SEQ ID NO: 57722 - DNA, 15 bp, Homo sapiens
gcatttttaattttg

SEQ ID NO: 57723 - DNA, 15 bp, Homo sapiens
agcatttttaatttt

SEQ ID NO: 57724 - DNA, 15 bp, Homo sapiens
cagcatttttaattt

SEQ ID NO: 57725 - DNA, 15 bp, Homo sapiens
tcagcatttttaatt

SEQ ID NO: 57726 - DNA, 15 bp, Homo sapiens
ttcagcatttttaat

SEQ ID NO: 57727 - DNA, 15 bp, Homo sapiens
gttcagcatttttaa

SEQ ID NO: 57728 - DNA, 15 bp, Homo sapiens
agttcagcattttta

SEQ ID NO: 57729 - DNA, 15 bp, Homo sapiens
aagttcagcattttt

SEQ ID NO: 57730 - DNA, 15 bp, Homo sapiens
caagttcagcatttt

SEQ ID NO: 57731 - DNA, 15 bp, Homo sapiens
tcaagttcagcattt

SEQ ID NO: 57732 - DNA, 15 bp, Homo sapiens
ctcaagttcagcatt

SEQ ID NO: 57733 - DNA, 15 bp, Homo sapiens
actcaagttcagcat

SEQ ID NO: 57734 - DNA, 15 bp, Homo sapiens
aactcaagttcagca

SEQ ID NO: 57735 - DNA, 15 bp, Homo sapiens
aaactcaagttcagc

SEQ ID NO: 57736 - DNA, 15 bp, Homo sapiens
caaactcaagttcag

SEQ ID NO: 57737 - DNA, 15 bp, Homo sapiens
acaaactcaagttca

SEQ ID NO: 57738 - DNA, 15 bp, Homo sapiens
cacaaactcaagttc

SEQ ID NO: 57739 - DNA, 15 bp, Homo sapiens
gcacaaactcaagtt

SEQ ID NO: 57740 - DNA, 15 bp, Homo sapiens
tgcacaaactcaagt

SEQ ID NO: 57741 - DNA, 15 bp, Homo sapiens
ttgcacaaactcaag

SEQ ID NO: 57742 - DNA, 15 bp, Homo sapiens
tttgcacaaactcaa

SEQ ID NO: 57743 - DNA, 15 bp, Homo sapiens
atttgcacaaactca

SEQ ID NO: 57744 - DNA, 15 bp, Homo sapiens
gatttgcacaaactc

SEQ ID NO: 57745 - DNA, 15 bp, Homo sapiens
ggatttgcacaaact

SEQ ID NO: 57746 - DNA, 15 bp, Homo sapiens
gggatttgcacaaac

SEQ ID NO: 57747 - DNA, 15 bp, Homo sapiens
agggatttgcacaaa

SEQ ID NO: 57748 - DNA, 15 bp, Homo sapiens
cagggatttgcacaa

SEQ ID NO: 57749 - DNA, 15 bp, Homo sapiens
gcagggatttgcaca

SEQ ID NO: 57750 - DNA, 15 bp, Homo sapiens
agcagggatttgcac

SEQ ID NO: 57751 - DNA, 15 bp, Homo sapiens
aagcagggatttgca

SEQ ID NO: 57752 - DNA, 15 bp, Homo sapiens
aaagcagggatttgc

SEQ ID NO: 57753 - DNA, 15 bp, Homo sapiens
aaaagcagggatttg

SEQ ID NO: 57754 - DNA, 15 bp, Homo sapiens
gaaaagcagggattt

SEQ ID NO: 57755 - DNA, 15 bp, Homo sapiens
agaaaagcagggatt

SEQ ID NO: 57756 - DNA, 15 bp, Homo sapiens
gagaaaagcagggat

SEQ ID NO: 57757 - DNA, 15 bp, Homo sapiens
agagaaaagcaggga

SEQ ID NO: 57758 - DNA, 15 bp, Homo sapiens
aagagaaaagcaggg

SEQ ID NO: 57759 - DNA, 15 bp, Homo sapiens
aaagagaaaagcagg

SEQ ID NO: 57760 - DNA, 15 bp, Homo sapiens
aaaagagaaaagcag

SEQ ID NO: 57761 - DNA, 15 bp, Homo sapiens
gaaaagagaaaagca

SEQ ID NO: 57762 - DNA, 15 bp, Homo sapiens
agaaaagagaaaagc

SEQ ID NO: 57763 - DNA, 15 bp, Homo sapiens
tagaaaagagaaaag

SEQ ID NO: 57764 - DNA, 15 bp, Homo sapiens
ttagaaaagagaaaa

SEQ ID NO: 57765 - DNA, 15 bp, Homo sapiens
cttagaaaagagaaa

SEQ ID NO: 57766 - DNA, 15 bp, Homo sapiens
tcttagaaaagagaa

SEQ ID NO: 57767 - DNA, 15 bp, Homo sapiens
gtcttagaaaagaga

SEQ ID NO: 57768 - DNA, 15 bp, Homo sapiens
tgtcttagaaaagag

SEQ ID NO: 57769 - DNA, 15 bp, Homo sapiens
gtgtcttagaaaaga

SEQ ID NO: 57770 - DNA, 15 bp, Homo sapiens
tgtgtcttagaaaag

SEQ ID NO: 57771 - DNA, 15 bp, Homo sapiens
ctgtgtcttagaaaa

SEQ ID NO: 57772 - DNA, 15 bp, Homo sapiens
tctgtgtcttagaaa

SEQ ID NO: 57773 - DNA, 15 bp, Homo sapiens
atctgtgtcttagaa

SEQ ID NO: 57774 - DNA, 15 bp, Homo sapiens
catctgtgtcttaga

SEQ ID NO: 57775 - DNA, 15 bp, Homo sapiens
tcatctgtgtcttag

SEQ ID NO: 57776 - DNA, 15 bp, Homo sapiens
ctcatctgtgtctta

SEQ ID NO: 57777 - DNA, 15 bp, Homo sapiens
gctcatctgtgtctt

SEQ ID NO: 57778 - DNA, 15 bp, Homo sapiens
ggctcatctgtgtct

SEQ ID NO: 57779 - DNA, 15 bp, Homo sapiens
tggctcatctgtgtc

SEQ ID NO: 57780 - DNA, 15 bp, Homo sapiens
ttggctcatctgtgt

SEQ ID NO: 57781 - DNA, 15 bp, Homo sapiens
cttggctcatctgtg

SEQ ID NO: 57782 - DNA, 15 bp, Homo sapiens
acttggctcatctgt

SEQ ID NO: 57783 - DNA, 15 bp, Homo sapiens
aacttggctcatctg

SEQ ID NO: 57784 - DNA, 15 bp, Homo sapiens
aaacttggctcatct

SEQ ID NO: 57785 - DNA, 15 bp, Homo sapiens
aaaacttggctcatc

SEQ ID NO: 57786 - DNA, 15 bp, Homo sapiens
gaaaacttggctcat

SEQ ID NO: 57787 - DNA, 15 bp, Homo sapiens
tgaaaacttggctca

SEQ ID NO: 57788 - DNA, 15 bp, Homo sapiens
atgaaaacttggctc

SEQ ID NO: 57789 - DNA, 15 bp, Homo sapiens
catgaaaacttggct

SEQ ID NO: 57790 - DNA, 15 bp, Homo sapiens
acatgaaaacttggc

SEQ ID NO: 57791 - DNA, 15 bp, Homo sapiens
tacatgaaaacttgg

SEQ ID NO: 57792 - DNA, 15 bp, Homo sapiens
ttacatgaaaacttg

SEQ ID NO: 57793 - DNA, 15 bp, Homo sapiens
cttacatgaaaactt

SEQ ID NO: 57794 - DNA, 15 bp, Homo sapiens
acttacatgaaaact

SEQ ID NO: 57795 - DNA, 15 bp, Homo sapiens
aacttacatgaaaac

SEQ ID NO: 57796 - DNA, 15 bp, Homo sapiens
taacttacatgaaaa

SEQ ID NO: 57797 - DNA, 15 bp, Homo sapiens
gtaacttacatgaaa

SEQ ID NO: 57798 - DNA, 15 bp, Homo sapiens
tgtaacttacatgaa

SEQ ID NO: 57799 - DNA, 15 bp, Homo sapiens
ttgtaacttacatga

SEQ ID NO: 57800 - DNA, 15 bp, Homo sapiens
attgtaacttacatg

SEQ ID NO: 57801 - DNA, 15 bp, Homo sapiens
aattgtaacttacat

SEQ ID NO: 57802 - DNA, 15 bp, Homo sapiens
gaattgtaacttaca

SEQ ID NO: 57803 - DNA, 15 bp, Homo sapiens
ggaattgtaacttac

SEQ ID NO: 57804 - DNA, 15 bp, Homo sapiens
tggaattgtaactta

SEQ ID NO: 57805 - DNA, 15 bp, Homo sapiens
ttggaattgtaactt

SEQ ID NO: 57806 - DNA, 15 bp, Homo sapiens
gttggaattgtaact

SEQ ID NO: 57807 - DNA, 15 bp, Homo sapiens
ggttggaattgtaac

SEQ ID NO: 57808 - DNA, 15 bp, Homo sapiens
aggttggaattgtaa

SEQ ID NO: 57809 - DNA, 15 bp, Homo sapiens
aaggttggaattgta

SEQ ID NO: 57810 - DNA, 15 bp, Homo sapiens
caaggttggaattgt

SEQ ID NO: 57811 - DNA, 15 bp, Homo sapiens
tcaaggttggaattg

SEQ ID NO: 57812 - DNA, 15 bp, Homo sapiens
ttcaaggttggaatt

SEQ ID NO: 57813 - DNA, 15 bp, Homo sapiens
tttcaaggttggaat

SEQ ID NO: 57814 - DNA, 15 bp, Homo sapiens
atttcaaggttggaa

SEQ ID NO: 57815 - DNA, 15 bp, Homo sapiens
aatttcaaggttgga

SEQ ID NO: 57816 - DNA, 15 bp, Homo sapiens
gaatttcaaggttgg

SEQ ID NO: 57817 - DNA, 15 bp, Homo sapiens
tgaatttcaaggttg

SEQ ID NO: 57818 - DNA, 15 bp, Homo sapiens
ttgaatttcaaggtt

SEQ ID NO: 57819 - DNA, 15 bp, Homo sapiens
tttgaatttcaaggt

SEQ ID NO: 57820 - DNA, 15 bp, Homo sapiens
atttgaatttcaagg

SEQ ID NO: 57821 - DNA, 15 bp, Homo sapiens
aatttgaatttcaag

SEQ ID NO: 57822 - DNA, 15 bp, Homo sapiens
caatttgaatttcaa

SEQ ID NO: 57823 - DNA, 15 bp, Homo sapiens
tcaatttgaatttca

SEQ ID NO: 57824 - DNA, 15 bp, Homo sapiens
gtcaatttgaatttc

SEQ ID NO: 57825 - DNA, 15 bp, Homo sapiens
tgtcaatttgaattt

SEQ ID NO: 57826 - DNA, 15 bp, Homo sapiens
ctgtcaatttgaatt

SEQ ID NO: 57827 - DNA, 15 bp, Homo sapiens
tctgtcaatttgaat

SEQ ID NO: 57828 - DNA, 15 bp, Homo sapiens
ttctgtcaatttgaa

SEQ ID NO: 57829 - DNA, 15 bp, Homo sapiens
gttctgtcaatttga

SEQ ID NO: 57830 - DNA, 15 bp, Homo sapiens
cgttctgtcaatttg

SEQ ID NO: 57831 - DNA, 15 bp, Homo sapiens
acgttctgtcaattt

SEQ ID NO: 57832 - DNA, 15 bp, Homo sapiens
tacgttctgtcaatt

SEQ ID NO: 57833 - DNA, 15 bp, Homo sapiens
ttacgttctgtcaat

SEQ ID NO: 57834 - DNA, 15 bp, Homo sapiens
cttacgttctgtcaa

SEQ ID NO: 57835 - DNA, 15 bp, Homo sapiens
tcttacgttctgtca

SEQ ID NO: 57836 - DNA, 15 bp, Homo sapiens
ctcttacgttctgtc

SEQ ID NO: 57837 - DNA, 15 bp, Homo sapiens
tctcttacgttctgt

SEQ ID NO: 57838 - DNA, 15 bp, Homo sapiens
ctctcttacgttctg

SEQ ID NO: 57839 - DNA, 15 bp, Homo sapiens
cctctcttacgttct

SEQ ID NO: 57840 - DNA, 15 bp, Homo sapiens
tcctctcttacgttc

SEQ ID NO: 57841 - DNA, 15 bp, Homo sapiens
ttcctctcttacgtt

SEQ ID NO: 57842 - DNA, 15 bp, Homo sapiens
tttcctctcttacgt

SEQ ID NO: 57843 - DNA, 15 bp, Homo sapiens
ctttcctctcttacg

SEQ ID NO: 57844 - DNA, 15 bp, Homo sapiens
gctttcctctcttac

SEQ ID NO: 57845 - DNA, 15 bp, Homo sapiens
ggctttcctctctta

SEQ ID NO: 57846 - DNA, 15 bp, Homo sapiens
tggctttcctctctt

SEQ ID NO: 57847 - DNA, 15 bp, Homo sapiens
atggctttcctctct

SEQ ID NO: 57848 - DNA, 15 bp, Homo sapiens
catggctttcctctc

SEQ ID NO: 57849 - DNA, 15 bp, Homo sapiens
tcatggctttcctct

SEQ ID NO: 57850 - DNA, 15 bp, Homo sapiens
ttcatggctttcctc

SEQ ID NO: 57851 - DNA, 15 bp, Homo sapiens
cttcatggctttcct

SEQ ID NO: 57852 - DNA, 15 bp, Homo sapiens
gcttcatggctttcc

SEQ ID NO: 57853 - DNA, 15 bp, Homo sapiens
tgcttcatggctttc

SEQ ID NO: 57854 - DNA, 15 bp, Homo sapiens
atgcttcatggcttt

SEQ ID NO: 57855 - DNA, 15 bp, Homo sapiens
aatgcttcatggctt

SEQ ID NO: 57856 - DNA, 15 bp, Homo sapiens
aaatgcttcatggct

SEQ ID NO: 57857 - DNA, 15 bp, Homo sapiens
aaaatgcttcatggc

SEQ ID NO: 57858 - DNA, 15 bp, Homo sapiens
aaaaatgcttcatgg

SEQ ID NO: 57859 - DNA, 15 bp, Homo sapiens
aaaaaatgcttcatg

SEQ ID NO: 57860 - DNA, 15 bp, Homo sapiens
taaaaaatgcttcat

SEQ ID NO: 57861 - DNA, 15 bp, Homo sapiens
ataaaaaatgcttca

SEQ ID NO: 57862 - DNA, 15 bp, Homo sapiens
cataaaaaatgcttc

SEQ ID NO: 57863 - DNA, 15 bp, Homo sapiens
ccataaaaaatgctt

SEQ ID NO: 57864 - DNA, 15 bp, Homo sapiens
tccataaaaaatgct

SEQ ID NO: 57865 - DNA, 15 bp, Homo sapiens
atccataaaaaatgc

SEQ ID NO: 57866 - DNA, 15 bp, Homo sapiens
aatccataaaaaatg

SEQ ID NO: 57867 - DNA, 15 bp, Homo sapiens
gaatccataaaaaat

SEQ ID NO: 57868 - DNA, 15 bp, Homo sapiens
ggaatccataaaaaa

SEQ ID NO: 57869 - DNA, 15 bp, Homo sapiens
tggaatccataaaaa

SEQ ID NO: 57870 - DNA, 15 bp, Homo sapiens
ttggaatccataaaa

SEQ ID NO: 57871 - DNA, 15 bp, Homo sapiens
attggaatccataaa

SEQ ID NO: 57872 - DNA, 15 bp, Homo sapiens
tattggaatccataa

SEQ ID NO: 57873 - DNA, 15 bp, Homo sapiens
atattggaatccata

SEQ ID NO: 57874 - DNA, 15 bp, Homo sapiens
catattggaatccat

SEQ ID NO: 57875 - DNA, 15 bp, Homo sapiens
ccatattggaatcca

SEQ ID NO: 57876 - DNA, 15 bp, Homo sapiens
tccatattggaatcc

SEQ ID NO: 57877 - DNA, 15 bp, Homo sapiens
ctccatattggaatc

SEQ ID NO: 57878 - DNA, 15 bp, Homo sapiens
tctccatattggaat

SEQ ID NO: 57879 - DNA, 15 bp, Homo sapiens
ctctccatattggaa

SEQ ID NO: 57880 - DNA, 15 bp, Homo sapiens
gctctccatattgga

SEQ ID NO: 57881 - DNA, 15 bp, Homo sapiens
agctctccatattgg

SEQ ID NO: 57882 - DNA, 15 bp, Homo sapiens
tagctctccatattg

SEQ ID NO: 57883 - DNA, 15 bp, Homo sapiens
atagctctccatatt

SEQ ID NO: 57884 - DNA, 15 bp, Homo sapiens
aatagctctccatat

SEQ ID NO: 57885 - DNA, 15 bp, Homo sapiens
taatagctctccata

SEQ ID NO: 57886 - DNA, 15 bp, Homo sapiens
ttaatagctctccat

SEQ ID NO: 57887 - DNA, 15 bp, Homo sapiens
cttaatagctctcca

SEQ ID NO: 57888 - DNA, 15 bp, Homo sapiens
tcttaatagctctcc

SEQ ID NO: 57889 - DNA, 15 bp, Homo sapiens
atcttaatagctctc

SEQ ID NO: 57890 - DNA, 15 bp, Homo sapiens
catcttaatagctct

SEQ ID NO: 57891 - DNA, 15 bp, Homo sapiens
acatcttaatagctc

SEQ ID NO: 57892 - DNA, 15 bp, Homo sapiens
aacatcttaatagct

SEQ ID NO: 57893 - DNA, 15 bp, Homo sapiens
aaacatcttaatagc

SEQ ID NO: 57894 - DNA, 15 bp, Homo sapiens
aaaacatcttaatag

SEQ ID NO: 57895 - DNA, 15 bp, Homo sapiens
gaaaacatcttaata

SEQ ID NO: 57896 - DNA, 15 bp, Homo sapiens
ggaaaacatcttaat

SEQ ID NO: 57897 - DNA, 15 bp, Homo sapiens
aggaaaacatcttaa

SEQ ID NO: 57898 - DNA, 15 bp, Homo sapiens
aaggaaaacatctta

SEQ ID NO: 57899 - DNA, 15 bp, Homo sapiens
aaaggaaaacatctt

SEQ ID NO: 57900 - DNA, 15 bp, Homo sapiens
taaaggaaaacatct

SEQ ID NO: 57901 - DNA, 15 bp, Homo sapiens
ctaaaggaaaacatc

SEQ ID NO: 57902 - DNA, 15 bp, Homo sapiens
cctaaaggaaaacat

SEQ ID NO: 57903 - DNA, 15 bp, Homo sapiens
tcctaaaggaaaaca

SEQ ID NO: 57904 - DNA, 15 bp, Homo sapiens
ctcctaaaggaaaac

SEQ ID NO: 57905 - DNA, 15 bp, Homo sapiens
gtctcctaaaggaaa

SEQ ID NO: 57906 - DNA, 15 bp, Homo sapiens
tgtctcctaaaggaa

SEQ ID NO: 57907 - DNA, 15 bp, Homo sapiens
ctgtctcctaaagga

SEQ ID NO: 57908 - DNA, 15 bp, Homo sapiens
actgtctcctaaagg

SEQ ID NO: 57909 - DNA, 15 bp, Homo sapiens
cactgtctcctaaag

SEQ ID NO: 57910 - DNA, 15 bp, Homo sapiens
tcactgtctcctaaa

SEQ ID NO: 57911 - DNA, 15 bp, Homo sapiens
ctcactgtctcctaa

SEQ ID NO: 57912 - DNA, 15 bp, Homo sapiens
tctcactgtctccta

SEQ ID NO: 57913 - DNA, 15 bp, Homo sapiens
gtctcactgtctcct

SEQ ID NO: 57914 - DNA, 15 bp, Homo sapiens
tgtctcactgtctcc

SEQ ID NO: 57915 - DNA, 15 bp, Homo sapiens
atgtctcactgtctc

SEQ ID NO: 57916 - DNA, 15 bp, Homo sapiens
aatgtctcactgtct

SEQ ID NO: 57917 - DNA, 15 bp, Homo sapiens
caatgtctcactgtc

SEQ ID NO: 57918 - DNA, 15 bp, Homo sapiens
gcaatgtctcactgt

SEQ ID NO: 57919 - DNA, 15 bp, Homo sapiens
agcaatgtctcactg

SEQ ID NO: 57920 - DNA, 15 bp, Homo sapiens
aagcaatgtctcact

SEQ ID NO: 57921 - DNA, 15 bp, Homo sapiens
aaagcaatgtctcac

SEQ ID NO: 57922 - DNA, 15 bp, Homo sapiens
aaaagcaatgtctca

SEQ ID NO: 57923 - DNA, 15 bp, Homo sapiens
taaaagcaatgtctc

SEQ ID NO: 57924 - DNA, 15 bp, Homo sapiens
ctaaaagcaatgtct

SEQ ID NO: 57925 - DNA, 15 bp, Homo sapiens
tctaaaagcaatgtc

SEQ ID NO: 57926 - DNA, 15 bp, Homo sapiens
atctaaaagcaatgt

SEQ ID NO: 57927 - DNA, 15 bp, Homo sapiens
aatctaaaagcaatg

SEQ ID NO: 57928 - DNA, 15 bp, Homo sapiens
caatctaaaagcaat

SEQ ID NO: 57929 - DNA, 15 bp, Homo sapiens
acaatctaaaagcaa

SEQ ID NO: 57930 - DNA, 15 bp, Homo sapiens
aacaatctaaaagca

SEQ ID NO: 57931 - DNA, 15 bp, Homo sapiens
aaacaatctaaaagc

SEQ ID NO: 57932 - DNA, 15 bp, Homo sapiens
aaaacaatctaaaag

SEQ ID NO: 57933 - DNA, 15 bp, Homo sapiens
gaaaacaatctaaaa

SEQ ID NO: 57934 - DNA, 15 bp, Homo sapiens
ggaaaacaatctaaa

SEQ ID NO: 57935 - DNA, 15 bp, Homo sapiens
aggaaaacaatctaa

SEQ ID NO: 57936 - DNA, 15 bp, Homo sapiens
taggaaaacaatcta

SEQ ID NO: 57937 - DNA, 15 bp, Homo sapiens
gtaggaaaacaatct

SEQ ID NO: 57938 - DNA, 15 bp, Homo sapiens
agtaggaaaacaatc

SEQ ID NO: 57939 - DNA, 15 bp, Homo sapiens
aagtaggaaaacaat

SEQ ID NO: 57940 - DNA, 15 bp, Homo sapiens
aaagtaggaaaacaa

SEQ ID NO: 57941 - DNA, 15 bp, Homo sapiens
aaaagtaggaaaaca

SEQ ID NO: 57942 - DNA, 15 bp, Homo sapiens
aaaaagtaggaaaac

SEQ ID NO: 57943 - DNA, 15 bp, Homo sapiens
aaaaaagtaggaaaa

SEQ ID NO: 57944 - DNA, 15 bp, Homo sapiens
gaaaaaagtaggaaa

SEQ ID NO: 57945 - DNA, 15 bp, Homo sapiens
tgaaaaaagtaggaa

SEQ ID NO: 57946 - DNA, 15 bp, Homo sapiens
atgaaaaaagtagga

SEQ ID NO: 57947 - DNA, 15 bp, Homo sapiens
catgaaaaaagtagg

SEQ ID NO: 57948 - DNA, 15 bp, Homo sapiens
acatgaaaaaagtag

SEQ ID NO: 57949 - DNA, 15 bp, Homo sapiens
aacatgaaaaaagta

SEQ ID NO: 57950 - DNA, 15 bp, Homo sapiens
caacatgaaaaaagt

SEQ ID NO: 57951 - DNA, 15 bp, Homo sapiens
ccaacatgaaaaaag

SEQ ID NO: 57952 - DNA, 15 bp, Homo sapiens
tccaacatgaaaaaa

SEQ ID NO: 57953 - DNA, 15 bp, Homo sapiens
ttccaacatgaaaaa

SEQ ID NO: 57954 - DNA, 15 bp, Homo sapiens
cttccaacatgaaaa

SEQ ID NO: 57955 - DNA, 15 bp, Homo sapiens
acttccaacatgaaa

SEQ ID NO: 57956 - DNA, 15 bp, Homo sapiens
aacttccaacatgaa

SEQ ID NO: 57957 - DNA, 15 bp, Homo sapiens
taacttccaacatga

SEQ ID NO: 57958 - DNA, 15 bp, Homo sapiens
ttaacttccaacatg

SEQ ID NO: 57959 - DNA, 15 bp, Homo sapiens
attaacttccaacat

SEQ ID NO: 57960 - DNA, 15 bp, Homo sapiens
tattaacttccaaca

SEQ ID NO: 57961 - DNA, 15 bp, Homo sapiens
ttattaacttccaac

SEQ ID NO: 57962 - DNA, 15 bp, Homo sapiens
attattaacttccaa

SEQ ID NO: 57963 - DNA, 15 bp, Homo sapiens
gattattaacttcca

SEQ ID NO: 57964 - DNA, 15 bp, Homo sapiens
tgattattaacttcc

SEQ ID NO: 57965 - DNA, 15 bp, Homo sapiens
gtgattattaacttc

SEQ ID NO: 57966 - DNA, 15 bp, Homo sapiens
agtgattattaactt

SEQ ID NO: 57967 - DNA, 15 bp, Homo sapiens
tagtgattattaact

SEQ ID NO: 57968 - DNA, 15 bp, Homo sapiens
ttagtgattattaac

SEQ ID NO: 57969 - DNA, 15 bp, Homo sapiens
tttagtgattattaa

SEQ ID NO: 57970 - DNA, 15 bp, Homo sapiens
ttttagtgattatta

SEQ ID NO: 57971 - DNA, 15 bp, Homo sapiens
attttagtgattatt

SEQ ID NO: 57972 - DNA, 15 bp, Homo sapiens
tattttagtgattat

SEQ ID NO: 57973 - DNA, 15 bp, Homo sapiens
ttattttagtgatta

SEQ ID NO: 57974 - DNA, 15 bp, Homo sapiens
cttattttagtgatt

SEQ ID NO: 57975 - DNA, 15 bp, Homo sapiens
ccttattttagtgat

SEQ ID NO: 57976 - DNA, 15 bp, Homo sapiens
cccttattttagtga

SEQ ID NO: 57977 - DNA, 15 bp, Homo sapiens
acccttattttagtg

SEQ ID NO: 57978 - DNA, 15 bp, Homo sapiens
cacccttattttagt

SEQ ID NO: 57979 - DNA, 15 bp, Homo sapiens
ccacccttattttag

SEQ ID NO: 57980 - DNA, 15 bp, Homo sapiens
cccacccttatttta

SEQ ID NO: 57981 - DNA, 15 bp, Homo sapiens
tcccacccttatttt

SEQ ID NO: 57982 - DNA, 15 bp, Homo sapiens
ttcccacccttattt

SEQ ID NO: 57983 - DNA, 15 bp, Homo sapiens
tttcccacccttatt

SEQ ID NO: 57984 - DNA, 15 bp, Homo sapiens
ttttcccacccttat

SEQ ID NO: 57985 - DNA, 15 bp, Homo sapiens
cttttcccaccctta

SEQ ID NO: 57986 - DNA, 15 bp, Homo sapiens
tcttttcccaccctt

SEQ ID NO: 57987 - DNA, 15 bp, Homo sapiens
atcttttcccaccct

SEQ ID NO: 57988 - DNA, 15 bp, Homo sapiens
catcttttcccaccc

SEQ ID NO: 57989 - DNA, 15 bp, Homo sapiens
acatcttttcccacc

SEQ ID NO: 57990 - DNA, 15 bp, Homo sapiens
cacatcttttcccac

SEQ ID NO: 57991 - DNA, 15 bp, Homo sapiens
ccacatcttttccca

SEQ ID NO: 57992 - DNA, 15 bp, Homo sapiens
tccacatcttttccc

SEQ ID NO: 57993 - DNA, 15 bp, Homo sapiens
ctccacatcttttcc

SEQ ID NO: 57994 - DNA, 15 bp, Homo sapiens
cctccacatcttttc

SEQ ID NO: 57995 - DNA, 15 bp, Homo sapiens
ccctccacatctttt

SEQ ID NO: 57996 - DNA, 15 bp, Homo sapiens
tccctccacatcttt

SEQ ID NO: 57997 - DNA, 15 bp, Homo sapiens
ctccctccacatctt

SEQ ID NO: 57998 - DNA, 15 bp, Homo sapiens
tctccctccacatct

SEQ ID NO: 57999 - DNA, 15 bp, Homo sapiens
atctccctccacatc

SEQ ID NO: 58000 - DNA, 15 bp, Homo sapiens
aatctccctccacat

SEQ ID NO: 58001 - DNA, 15 bp, Homo sapiens
aaatctccctccaca

SEQ ID NO: 58002 - DNA, 15 bp, Homo sapiens
caaatctccctccac

SEQ ID NO: 58003 - DNA, 15 bp, Homo sapiens
acaaatctccctcca

SEQ ID NO: 58004 - DNA, 15 bp, Homo sapiens
tacaaatctccctcc

SEQ ID NO: 58005 - DNA, 15 bp, Homo sapiens
gtacaaatctccctc

SEQ ID NO: 58006 - DNA, 15 bp, Homo sapiens
tgtacaaatctccct

SEQ ID NO: 58007 - DNA, 15 bp, Homo sapiens
ctgtacaaatctccc

SEQ ID NO: 58008 - DNA, 15 bp, Homo sapiens
cctgtacaaatctcc

SEQ ID NO: 58009 - DNA, 15 bp, Homo sapiens
tcctgtacaaatctc

SEQ ID NO: 58010 - DNA, 15 bp, Homo sapiens
ctcctgtacaaatct

SEQ ID NO: 58011 - DNA, 15 bp, Homo sapiens
cctcctgtacaaatc

SEQ ID NO: 58012 - DNA, 15 bp, Homo sapiens
ccacccccaaagagt

SEQ ID NO: 58013 - DNA, 15 bp, Homo sapiens
cccacccccaaagag

SEQ ID NO: 58014 - DNA, 15 bp, Homo sapiens
ccccacccccaaaga

SEQ ID NO: 58015 - DNA, 15 bp, Homo sapiens
accccacccccaaag

SEQ ID NO: 58016 - DNA, 15 bp, Homo sapiens
aaccccacccccaaa

SEQ ID NO: 58017 - DNA, 15 bp, Homo sapiens
caaccccacccccaa

SEQ ID NO: 58018 - DNA, 15 bp, Homo sapiens
ccaaccccaccccca

SEQ ID NO: 58019 - DNA, 15 bp, Homo sapiens
tccaaccccaccccc

SEQ ID NO: 58020 - DNA, 15 bp, Homo sapiens
gtccaaccccacccc

SEQ ID NO: 58021 - DNA, 15 bp, Homo sapiens
tgtccaaccccaccc

SEQ ID NO: 58022 - DNA, 15 bp, Homo sapiens
ctgtccaaccccacc

SEQ ID NO: 58023 - DNA, 15 bp, Homo sapiens
tctgtccaaccccac

SEQ ID NO: 58024 - DNA, 15 bp, Homo sapiens
ctctgtccaacccca

SEQ ID NO: 58025 - DNA, 15 bp, Homo sapiens
cctctgtccaacccc

SEQ ID NO: 58026 - DNA, 15 bp, Homo sapiens
acctctgtccaaccc

SEQ ID NO: 58027 - DNA, 15 bp, Homo sapiens
tacctctgtccaacc

SEQ ID NO: 58028 - DNA, 15 bp, Homo sapiens
atacctctgtccaac

SEQ ID NO: 58029 - DNA, 15 bp, Homo sapiens
aatacctctgtccaa

SEQ ID NO: 58030 - DNA, 15 bp, Homo sapiens
caatacctctgtcca

SEQ ID NO: 58031 - DNA, 15 bp, Homo sapiens
ccaatacctctgtcc

SEQ ID NO: 58032 - DNA, 15 bp, Homo sapiens
accaatacctctgtc

SEQ ID NO: 58033 - DNA, 15 bp, Homo sapiens
caccaatacctctgt

SEQ ID NO: 58034 - DNA, 15 bp, Homo sapiens
acaccaatacctctg

SEQ ID NO: 58035 - DNA, 15 bp, Homo sapiens
aacaccaatacctct

SEQ ID NO: 58036 - DNA, 15 bp, Homo sapiens
aaacaccaatacctc

SEQ ID NO: 58037 - DNA, 15 bp, Homo sapiens
aaaacaccaatacct

SEQ ID NO: 58038 - DNA, 15 bp, Homo sapiens
aaaaacaccaatacc

SEQ ID NO: 58039 - DNA, 15 bp, Homo sapiens
taaaaacaccaatac

SEQ ID NO: 58040 - DNA, 15 bp, Homo sapiens
ataaaaacaccaata

SEQ ID NO: 58041 - DNA, 15 bp, Homo sapiens
cataaaaacaccaat

SEQ ID NO: 58042 - DNA, 15 bp, Homo sapiens
tcataaaaacaccaa

SEQ ID NO: 58043 - DNA, 15 bp, Homo sapiens
ttcataaaaacacca

SEQ ID NO: 58044 - DNA, 15 bp, Homo sapiens
cttcataaaaacacc

SEQ ID NO: 58045 - DNA, 15 bp, Homo sapiens
gcttcataaaaacac

SEQ ID NO: 58046 - DNA, 15 bp, Homo sapiens
agcttcataaaaaca

SEQ ID NO: 58047 - DNA, 15 bp, Homo sapiens
cagcttcataaaaac

SEQ ID NO: 58048 - DNA, 15 bp, Homo sapiens
gcagcttcataaaaa

SEQ ID NO: 58049 - DNA, 15 bp, Homo sapiens
ggcagcttcataaaa

SEQ ID NO: 58050 - DNA, 15 bp, Homo sapiens
aggcagcttcataaa

SEQ ID NO: 58051 - DNA, 15 bp, Homo sapiens
taggcagcttcataa

SEQ ID NO: 58052 - DNA, 15 bp, Homo sapiens
ctaggcagcttcata

SEQ ID NO: 58053 - DNA, 15 bp, Homo sapiens
cctaggcagcttcat

SEQ ID NO: 58054 - DNA, 15 bp, Homo sapiens
tcctaggcagcttca

SEQ ID NO: 58055 - DNA, 15 bp, Homo sapiens
ctcctaggcagcttc

SEQ ID NO: 58056 - DNA, 15 bp, Homo sapiens
tctcctaggcagctt

SEQ ID NO: 58057 - DNA, 15 bp, Homo sapiens
atctcctaggcagct

SEQ ID NO: 58058 - DNA, 15 bp, Homo sapiens
aatctcctaggcagc

SEQ ID NO: 58059 - DNA, 15 bp, Homo sapiens
aaatctcctaggcag

SEQ ID NO: 58060 - DNA, 15 bp, Homo sapiens
gaaatctcctaggca

SEQ ID NO: 58061 - DNA, 15 bp, Homo sapiens
tgaaatctcctaggc

SEQ ID NO: 58062 - DNA, 15 bp, Homo sapiens
ttgaaatctcctagg

SEQ ID NO: 58063 - DNA, 15 bp, Homo sapiens
gttgaaatctcctag

SEQ ID NO: 58064 - DNA, 15 bp, Homo sapiens
cgttgaaatctccta

SEQ ID NO: 58065 - DNA, 15 bp, Homo sapiens
acgttgaaatctcct

SEQ ID NO: 58066 - DNA, 15 bp, Homo sapiens
cacgttgaaatctcc

SEQ ID NO: 58067 - DNA, 15 bp, Homo sapiens
gcacgttgaaatctc

SEQ ID NO: 58068 - DNA, 15 bp, Homo sapiens
tgcacgttgaaatct

SEQ ID NO: 58069 - DNA, 15 bp, Homo sapiens
atgcacgttgaaatc

SEQ ID NO: 58070 - DNA, 15 bp, Homo sapiens
catgcacgttgaaat

SEQ ID NO: 58071 - DNA, 15 bp, Homo sapiens
gcatgcacgttgaaa

SEQ ID NO: 58072 - DNA, 15 bp, Homo sapiens
tgcatgcacgttgaa

SEQ ID NO: 58073 - DNA, 15 bp, Homo sapiens
ttgcatgcacgttga

SEQ ID NO: 58074 - DNA, 15 bp, Homo sapiens
cttgcatgcacgttg

SEQ ID NO: 58075 - DNA, 15 bp, Homo sapiens
acttgcatgcacgtt

SEQ ID NO: 58076 - DNA, 15 bp, Homo sapiens
aacttgcatgcacgt

SEQ ID NO: 58077 - DNA, 15 bp, Homo sapiens
taacttgcatgcacg

SEQ ID NO: 58078 - DNA, 15 bp, Homo sapiens
ctaacttgcatgcac

SEQ ID NO: 58079 - DNA, 15 bp, Homo sapiens
cctaacttgcatgca

SEQ ID NO: 58080 - DNA, 15 bp, Homo sapiens
ccctaacttgcatgc

SEQ ID NO: 58081 - DNA, 15 bp, Homo sapiens
tccctaacttgcatg

SEQ ID NO: 58082 - DNA, 15 bp, Homo sapiens
ttccctaacttgcat

SEQ ID NO: 58083 - DNA, 15 bp, Homo sapiens
gttccctaacttgca

SEQ ID NO: 58084 - DNA, 15 bp, Homo sapiens
agttccctaacttgc

SEQ ID NO: 58085 - DNA, 15 bp, Homo sapiens
cagttccctaacttg

SEQ ID NO: 58086 - DNA, 15 bp, Homo sapiens
ccagttccctaactt

SEQ ID NO: 58087 - DNA, 15 bp, Homo sapiens
accagttccctaact

SEQ ID NO: 58088 - DNA, 15 bp, Homo sapiens
taccagttccctaac

SEQ ID NO: 58089 - DNA, 15 bp, Homo sapiens
ataccagttccctaa

SEQ ID NO: 58090 - DNA, 15 bp, Homo sapiens
gataccagttcccta

SEQ ID NO: 58091 - DNA, 15 bp, Homo sapiens
agataccagttccct

SEQ ID NO: 58092 - DNA, 15 bp, Homo sapiens
aagataccagttccc

SEQ ID NO: 58093 - DNA, 15 bp, Homo sapiens
taagataccagttcc

SEQ ID NO: 58094 - DNA, 15 bp, Homo sapiens
ttaagataccagttc

SEQ ID NO: 58095 - DNA, 15 bp, Homo sapiens
cttaagataccagtt

SEQ ID NO: 58096 - DNA, 15 bp, Homo sapiens
tcttaagataccagt

SEQ ID NO: 58097 - DNA, 15 bp, Homo sapiens
atcttaagataccag

SEQ ID NO: 58098 - DNA, 15 bp, Homo sapiens
catcttaagatacca

SEQ ID NO: 58099 - DNA, 15 bp, Homo sapiens
acatcttaagatacc

SEQ ID NO: 58100 - DNA, 15 bp, Homo sapiens
aacatcttaagatac

SEQ ID NO: 58101 - DNA, 15 bp, Homo sapiens
caacatcttaagata

SEQ ID NO: 58102 - DNA, 15 bp, Homo sapiens
acaacatcttaagat

SEQ ID NO: 58103 - DNA, 15 bp, Homo sapiens
aacaacatcttaaga

SEQ ID NO: 58104 - DNA, 15 bp, Homo sapiens
taacaacatcttaag

SEQ ID NO: 58105 - DNA, 15 bp, Homo sapiens
ctaacaacatcttaa

SEQ ID NO: 58106 - DNA, 15 bp, Homo sapiens
actaacaacatctta

SEQ ID NO: 58107 - DNA, 15 bp, Homo sapiens
aactaacaacatctt

SEQ ID NO: 58108 - DNA, 15 bp, Homo sapiens
caactaacaacatct

SEQ ID NO: 58109 - DNA, 15 bp, Homo sapiens
tcaactaacaacatc

SEQ ID NO: 58110 - DNA, 15 bp, Homo sapiens
ctcaactaacaacat

SEQ ID NO: 58111 - DNA, 15 bp, Homo sapiens
cctcaactaacaaca

SEQ ID NO: 58112 - DNA, 15 bp, Homo sapiens
ccctcaactaacaac

SEQ ID NO: 58113 - DNA, 15 bp, Homo sapiens
tccctcaactaacaa

SEQ ID NO: 58114 - DNA, 15 bp, Homo sapiens
atccctcaactaaca

SEQ ID NO: 58115 - DNA, 15 bp, Homo sapiens
aatccctcaactaac

SEQ ID NO: 58116 - DNA, 15 bp, Homo sapiens
aaatccctcaactaa

SEQ ID NO: 58117 - DNA, 15 bp, Homo sapiens
aaaatccctcaacta

SEQ ID NO: 58118 - DNA, 15 bp, Homo sapiens
gaaaatccctcaact

SEQ ID NO: 58119 - DNA, 15 bp, Homo sapiens
tgaaaatccctcaac

SEQ ID NO: 58120 - DNA, 15 bp, Homo sapiens
atgaaaatccctcaa

SEQ ID NO: 58121 - DNA, 15 bp, Homo sapiens
tatgaaaatccctca

SEQ ID NO: 58122 - DNA, 15 bp, Homo sapiens
gtatgaaaatccctc

SEQ ID NO: 58123 - DNA, 15 bp, Homo sapiens
agtatgaaaatccct

SEQ ID NO: 58124 - DNA, 15 bp, Homo sapiens
cagtatgaaaatccc

SEQ ID NO: 58125 - DNA, 15 bp, Homo sapiens
acagtatgaaaatcc

SEQ ID NO: 58126 - DNA, 15 bp, Homo sapiens
cacagtatgaaaatc

SEQ ID NO: 58127 - DNA, 15 bp, Homo sapiens
tcacagtatgaaaat

SEQ ID NO: 58128 - DNA, 15 bp, Homo sapiens
ttcacagtatgaaaa

SEQ ID NO: 58129 - DNA, 15 bp, Homo sapiens
gttcacagtatgaaa

SEQ ID NO: 58130 - DNA, 15 bp, Homo sapiens
tgttcacagtatgaa

SEQ ID NO: 58131 - DNA, 15 bp, Homo sapiens
gtgttcacagtatga

SEQ ID NO: 58132 - DNA, 15 bp, Homo sapiens
ggtgttcacagtatg

SEQ ID NO: 58133 - DNA, 15 bp, Homo sapiens
tggtgttcacagtat

SEQ ID NO: 58134 - DNA, 15 bp, Homo sapiens
ctggtgttcacagta

SEQ ID NO: 58135 - DNA, 15 bp, Homo sapiens
gctggtgttcacagt

SEQ ID NO: 58136 - DNA, 15 bp, Homo sapiens
agctggtgttcacag

SEQ ID NO: 58137 - DNA, 15 bp, Homo sapiens
aagctggtgttcaca

SEQ ID NO: 58138 - DNA, 15 bp, Homo sapiens
gaagctggtgttcac

SEQ ID NO: 58139 - DNA, 15 bp, Homo sapiens
ggaagctggtgttca

SEQ ID NO: 58140 - DNA, 15 bp, Homo sapiens
tggaagctggtgttc

SEQ ID NO: 58141 - DNA, 15 bp, Homo sapiens
cctggaagctggtgt

SEQ ID NO: 58142 - DNA, 15 bp, Homo sapiens
ccctggaagctggtg

SEQ ID NO: 58143 - DNA, 15 bp, Homo sapiens
accctggaagctggt

SEQ ID NO: 58144 - DNA, 15 bp, Homo sapiens
caccctggaagctgg

SEQ ID NO: 58145 - DNA, 15 bp, Homo sapiens
ccaccctggaagctg

SEQ ID NO: 58146 - DNA, 15 bp, Homo sapiens
accaccctggaagct

SEQ ID NO: 58147 - DNA, 15 bp, Homo sapiens
taccaccctggaagc

SEQ ID NO: 58148 - DNA, 15 bp, Homo sapiens
ttaccaccctggaag

SEQ ID NO: 58149 - DNA, 15 bp, Homo sapiens
gttaccaccctggaa

SEQ ID NO: 58150 - DNA, 15 bp, Homo sapiens
ggttaccaccctgga

SEQ ID NO: 58151 - DNA, 15 bp, Homo sapiens
aggttaccaccctgg

SEQ ID NO: 58152 - DNA, 15 bp, Homo sapiens
caggttaccaccctg

SEQ ID NO: 58153 - DNA, 15 bp, Homo sapiens
tcaggttaccaccct

SEQ ID NO: 58154 - DNA, 15 bp, Homo sapiens
ctcaggttaccaccc

SEQ ID NO: 58155 - DNA, 15 bp, Homo sapiens
tctcaggttaccacc

SEQ ID NO: 58156 - DNA, 15 bp, Homo sapiens
gtctcaggttaccac

SEQ ID NO: 58157 - DNA, 15 bp, Homo sapiens
ggtctcaggttacca

SEQ ID NO: 58158 - DNA, 15 bp, Homo sapiens
aggtctcaggttacc

SEQ ID NO: 58159 - DNA, 15 bp, Homo sapiens
gaggtctcaggttac

SEQ ID NO: 58160 - DNA, 15 bp, Homo sapiens
tgaggtctcaggtta

SEQ ID NO: 58161 - DNA, 15 bp, Homo sapiens
ctgaggtctcaggtt

SEQ ID NO: 58162 - DNA, 15 bp, Homo sapiens
gctgaggtctcaggt

SEQ ID NO: 58163 - DNA, 15 bp, Homo sapiens
ggctgaggtctcagg

SEQ ID NO: 58164 - DNA, 15 bp, Homo sapiens
tggctgaggtctcag

SEQ ID NO: 58165 - DNA, 15 bp, Homo sapiens
ctggctgaggtctca

SEQ ID NO: 58166 - DNA, 15 bp, Homo sapiens
tctggctgaggtctc

SEQ ID NO: 58167 - DNA, 15 bp, Homo sapiens
atctggctgaggtct

SEQ ID NO: 58168 - DNA, 15 bp, Homo sapiens
gatctggctgaggtc

SEQ ID NO: 58169 - DNA, 15 bp, Homo sapiens
agatctggctgaggt

SEQ ID NO: 58170 - DNA, 15 bp, Homo sapiens
gagatctggctgagg

SEQ ID NO: 58171 - DNA, 15 bp, Homo sapiens
ggagatctggctgag

SEQ ID NO: 58172 - DNA, 15 bp, Homo sapiens
aggagatctggctga

SEQ ID NO: 58173 - DNA, 15 bp, Homo sapiens
caggagatctggctg

SEQ ID NO: 58174 - DNA, 15 bp, Homo sapiens
gcaggagatctggct

SEQ ID NO: 58175 - DNA, 15 bp, Homo sapiens
ggcaggagatctggc

SEQ ID NO: 58176 - DNA, 15 bp, Homo sapiens
aggcaggagatctgg

SEQ ID NO: 58177 - DNA, 15 bp, Homo sapiens
gaggcaggagatctg

SEQ ID NO: 58178 - DNA, 15 bp, Homo sapiens
agaggcaggagatct

SEQ ID NO: 58179 - DNA, 15 bp, Homo sapiens
cagaggcaggagatc

SEQ ID NO: 58180 - DNA, 15 bp, Homo sapiens
tcagaggcaggagat

SEQ ID NO: 58181 - DNA, 15 bp, Homo sapiens
ctcagaggcaggaga

SEQ ID NO: 58182 - DNA, 15 bp, Homo sapiens
cctcagaggcaggag

SEQ ID NO: 58183 - DNA, 15 bp, Homo sapiens
ccctcagaggcagga

SEQ ID NO: 58184 - DNA, 15 bp, Homo sapiens
cccctcagaggcagg

SEQ ID NO: 58185 - DNA, 15 bp, Homo sapiens
gcccctcagaggcag

SEQ ID NO: 58186 - DNA, 15 bp, Homo sapiens
ggcccctcagaggca

SEQ ID NO: 58187 - DNA, 15 bp, Homo sapiens
gggcccctcagaggc

SEQ ID NO: 58188 - DNA, 15 bp, Homo sapiens
agggcccctcagagg

SEQ ID NO: 58189 - DNA, 15 bp, Homo sapiens
cagggcccctcagag

SEQ ID NO: 58190 - DNA, 15 bp, Homo sapiens
acagggcccctcaga

SEQ ID NO: 58191 - DNA, 15 bp, Homo sapiens
tacagggcccctcag

SEQ ID NO: 58192 - DNA, 15 bp, Homo sapiens
gtacagggcccctca

SEQ ID NO: 58193 - DNA, 15 bp, Homo sapiens
cgtacagggcccctc

SEQ ID NO: 58194 - DNA, 15 bp, Homo sapiens
gcgtacagggcccct

SEQ ID NO: 58195 - DNA, 15 bp, Homo sapiens
agcgtacagggcccc

SEQ ID NO: 58196 - DNA, 15 bp, Homo sapiens
cagcgtacagggccc

SEQ ID NO: 58197 - DNA, 15 bp, Homo sapiens
tcagcgtacagggcc

SEQ ID NO: 58198 - DNA, 15 bp, Homo sapiens
ctcagcgtacagggc

SEQ ID NO: 58199 - DNA, 15 bp, Homo sapiens
gctcagcgtacaggg

SEQ ID NO: 58200 - DNA, 15 bp, Homo sapiens
agctcagcgtacagg

SEQ ID NO: 58201 - DNA, 15 bp, Homo sapiens
aagctcagcgtacag

SEQ ID NO: 58202 - DNA, 15 bp, Homo sapiens
gaagctcagcgtaca

SEQ ID NO: 58203 - DNA, 15 bp, Homo sapiens
tgaagctcagcgtac

SEQ ID NO: 58204 - DNA, 15 bp, Homo sapiens
gtgaagctcagcgta

SEQ ID NO: 58205 - DNA, 15 bp, Homo sapiens
agtgaagctcagcgt

SEQ ID NO: 58206 - DNA, 15 bp, Homo sapiens
aagtgaagctcagcg

SEQ ID NO: 58207 - DNA, 15 bp, Homo sapiens
gaagtgaagctcagc

SEQ ID NO: 58208 - DNA, 15 bp, Homo sapiens
agaagtgaagctcag

SEQ ID NO: 58209 - DNA, 15 bp, Homo sapiens
cagaagtgaagctca

SEQ ID NO: 58210 - DNA, 15 bp, Homo sapiens
acagaagtgaagctc

SEQ ID NO: 58211 - DNA, 15 bp, Homo sapiens
cacagaagtgaagct

SEQ ID NO: 58212 - DNA, 15 bp, Homo sapiens
acacagaagtgaagc

SEQ ID NO: 58213 - DNA, 15 bp, Homo sapiens
cacacagaagtgaag

SEQ ID NO: 58214 - DNA, 15 bp, Homo sapiens
acacacagaagtgaa

SEQ ID NO: 58215 - DNA, 15 bp, Homo sapiens
tacacacagaagtga

SEQ ID NO: 58216 - DNA, 15 bp, Homo sapiens
atacacacagaagtg

SEQ ID NO: 58217 - DNA, 15 bp, Homo sapiens
gatacacacagaagt

SEQ ID NO: 58218 - DNA, 15 bp, Homo sapiens
agatacacacagaag

SEQ ID NO: 58219 - DNA, 15 bp, Homo sapiens
gagatacacacagaa

SEQ ID NO: 58220 - DNA, 15 bp, Homo sapiens
tgagatacacacaga

SEQ ID NO: 58221 - DNA, 15 bp, Homo sapiens
ctgagatacacacag

SEQ ID NO: 58222 - DNA, 15 bp, Homo sapiens
actgagatacacaca

SEQ ID NO: 58223 - DNA, 15 bp, Homo sapiens
cactgagatacacac

SEQ ID NO: 58224 - DNA, 15 bp, Homo sapiens
gcactgagatacaca

SEQ ID NO: 58225 - DNA, 15 bp, Homo sapiens
agcactgagatacac

SEQ ID NO: 58226 - DNA, 15 bp, Homo sapiens
tagcactgagataca

SEQ ID NO: 58227 - DNA, 15 bp, Homo sapiens
ctagcactgagatac

SEQ ID NO: 58228 - DNA, 15 bp, Homo sapiens
actagcactgagata

SEQ ID NO: 58229 - DNA, 15 bp, Homo sapiens
cactagcactgagat

SEQ ID NO: 58230 - DNA, 15 bp, Homo sapiens
acactagcactgaga

SEQ ID NO: 58231 - DNA, 15 bp, Homo sapiens
aacactagcactgag

SEQ ID NO: 58232 - DNA, 15 bp, Homo sapiens
taacactagcactga

SEQ ID NO: 58233 - DNA, 15 bp, Homo sapiens
ctaacactagcactg

SEQ ID NO: 58234 - DNA, 15 bp, Homo sapiens
actaacactagcact

SEQ ID NO: 58235 - DNA, 15 bp, Homo sapiens
gactaacactagcac

SEQ ID NO: 58236 - DNA, 15 bp, Homo sapiens
tgactaacactagca

SEQ ID NO: 58237 - DNA, 15 bp, Homo sapiens
ctgactaacactagc

SEQ ID NO: 58238 - DNA, 15 bp, Homo sapiens
cctgactaacactag

SEQ ID NO: 58239 - DNA, 15 bp, Homo sapiens
gcctgactaacacta

SEQ ID NO: 58240 - DNA, 15 bp, Homo sapiens
tgcctgactaacact

SEQ ID NO: 58241 - DNA, 15 bp, Homo sapiens
atgcctgactaacac

SEQ ID NO: 58242 - DNA, 15 bp, Homo sapiens
tatgcctgactaaca

SEQ ID NO: 58243 - DNA, 15 bp, Homo sapiens
atatgcctgactaac

SEQ ID NO: 58244 - DNA, 15 bp, Homo sapiens
catatgcctgactaa

SEQ ID NO: 58245 - DNA, 15 bp, Homo sapiens
ccatatgcctgacta

SEQ ID NO: 58246 - DNA, 15 bp, Homo sapiens
tccatatgcctgact

SEQ ID NO: 58247 - DNA, 15 bp, Homo sapiens
ctccatatgcctgac

SEQ ID NO: 58248 - DNA, 15 bp, Homo sapiens
cctccatatgcctga

SEQ ID NO: 58249 - DNA, 15 bp, Homo sapiens
ccctccatatgcctg

SEQ ID NO: 58250 - DNA, 15 bp, Homo sapiens
tccctccatatgcct

SEQ ID NO: 58251 - DNA, 15 bp, Homo sapiens
gtccctccatatgcc

SEQ ID NO: 58252 - DNA, 15 bp, Homo sapiens
tgtccctccatatgc

SEQ ID NO: 58253 - DNA, 15 bp, Homo sapiens
ttgtccctccatatg

SEQ ID NO: 58254 - DNA, 15 bp, Homo sapiens
attgtccctccatat

SEQ ID NO: 58255 - DNA, 15 bp, Homo sapiens
gattgtccctccata

SEQ ID NO: 58256 - DNA, 15 bp, Homo sapiens
tgattgtccctccat

SEQ ID NO: 58257 - DNA, 15 bp, Homo sapiens
ctgattgtccctcca

SEQ ID NO: 58258 - DNA, 15 bp, Homo sapiens
actgattgtccctcc

SEQ ID NO: 58259 - DNA, 15 bp, Homo sapiens
aactgattgtccctc

SEQ ID NO: 58260 - DNA, 15 bp, Homo sapiens
aaactgattgtccct

SEQ ID NO: 58261 - DNA, 15 bp, Homo sapiens
aaaactgattgtccc

SEQ ID NO: 58262 - DNA, 15 bp, Homo sapiens
taaaactgattgtcc

SEQ ID NO: 58263 - DNA, 15 bp, Homo sapiens
gtaaaactgattgtc

SEQ ID NO: 58264 - DNA, 15 bp, Homo sapiens
agtaaaactgattgt

SEQ ID NO: 58265 - DNA, 15 bp, Homo sapiens
aagtaaaactgattg

SEQ ID NO: 58266 - DNA, 15 bp, Homo sapiens
caagtaaaactgatt

SEQ ID NO: 58267 - DNA, 15 bp, Homo sapiens
gcaagtaaaactgat

SEQ ID NO: 58268 - DNA, 15 bp, Homo sapiens
agcaagtaaaactga

SEQ ID NO: 58269 - DNA, 15 bp, Homo sapiens
aagcaagtaaaactg

SEQ ID NO: 58270 - DNA, 15 bp, Homo sapiens
aaagcaagtaaaact

SEQ ID NO: 58271 - DNA, 15 bp, Homo sapiens
aaaagcaagtaaaac

SEQ ID NO: 58272 - DNA, 15 bp, Homo sapiens
aaaaagcaagtaaaa

SEQ ID NO: 58273 - DNA, 15 bp, Homo sapiens
aaaaaagcaagtaaa

SEQ ID NO: 58274 - DNA, 15 bp, Homo sapiens
caaaaaagcaagtaa

SEQ ID NO: 58275 - DNA, 15 bp, Homo sapiens
acaaaaaagcaagta

SEQ ID NO: 58276 - DNA, 15 bp, Homo sapiens
aacaaaaaagcaagt

SEQ ID NO: 58277 - DNA, 15 bp, Homo sapiens
aaacaaaaaagcaag

SEQ ID NO: 58278 - DNA, 15 bp, Homo sapiens
aaaacaaaaaagcaa

SEQ ID NO: 58279 - DNA, 15 bp, Homo sapiens
taaaacaaaaaagca

SEQ ID NO: 58280 - DNA, 15 bp, Homo sapiens
ataaaacaaaaaagc

SEQ ID NO: 58281 - DNA, 15 bp, Homo sapiens
aataaaacaaaaaag

SEQ ID NO: 58282 - DNA, 15 bp, Homo sapiens
aaataaaacaaaaaa

SEQ ID NO: 58283 - DNA, 15 bp, Homo sapiens
aaaataaaacaaaaa

SEQ ID NO: 58284 - DNA, 15 bp, Homo sapiens
gaaaataaaacaaaa

SEQ ID NO: 58285 - DNA, 15 bp, Homo sapiens
ggaaaataaaacaaa

SEQ ID NO: 58286 - DNA, 15 bp, Homo sapiens
tggaaaataaaacaa

SEQ ID NO: 58287 - DNA, 15 bp, Homo sapiens
ctggaaaataaaaca

SEQ ID NO: 58288 - DNA, 15 bp, Homo sapiens
gctggaaaataaaac

SEQ ID NO: 58289 - DNA, 15 bp, Homo sapiens
ggctggaaaataaaa

SEQ ID NO: 58290 - DNA, 15 bp, Homo sapiens
tggctggaaaataaa

SEQ ID NO: 58291 - DNA, 15 bp, Homo sapiens
ttggctggaaaataa

SEQ ID NO: 58292 - DNA, 15 bp, Homo sapiens
tttggctggaaaata

SEQ ID NO: 58293 - DNA, 15 bp, Homo sapiens
ctttggctggaaaat

SEQ ID NO: 58294 - DNA, 15 bp, Homo sapiens
cctttggctggaaaa

SEQ ID NO: 58295 - DNA, 15 bp, Homo sapiens
tcctttggctggaaa

SEQ ID NO: 58296 - DNA, 15 bp, Homo sapiens
ttcctttggctggaa

SEQ ID NO: 58297 - DNA, 15 bp, Homo sapiens
gttcctttggctgga

SEQ ID NO: 58298 - DNA, 15 bp, Homo sapiens
cgttcctttggctgg

SEQ ID NO: 58299 - DNA, 15 bp, Homo sapiens
acgttcctttggctg

SEQ ID NO: 58300 - DNA, 15 bp, Homo sapiens
cacgttcctttggct

SEQ ID NO: 58301 - DNA, 15 bp, Homo sapiens
ccacgttcctttggc

SEQ ID NO: 58302 - DNA, 15 bp, Homo sapiens
accacgttcctttgg

SEQ ID NO: 58303 - DNA, 15 bp, Homo sapiens
aaccacgttcctttg

SEQ ID NO: 58304 - DNA, 15 bp, Homo sapiens
gaaccacgttccttt

SEQ ID NO: 58305 - DNA, 15 bp, Homo sapiens
ggaaccacgttcctt

SEQ ID NO: 58306 - DNA, 15 bp, Homo sapiens
tggaaccacgttcct

SEQ ID NO: 58307 - DNA, 15 bp, Homo sapiens
gtggaaccacgttcc

SEQ ID NO: 58308 - DNA, 15 bp, Homo sapiens
tgtggaaccacgttc

SEQ ID NO: 58309 - DNA, 15 bp, Homo sapiens
ttgtggaaccacgtt

SEQ ID NO: 58310 - DNA, 15 bp, Homo sapiens
cttgtggaaccacgt

SEQ ID NO: 58311 - DNA, 15 bp, Homo sapiens
ccttgtggaaccacg

SEQ ID NO: 58312 - DNA, 15 bp, Homo sapiens
cccttgtggaaccac

SEQ ID NO: 58313 - DNA, 15 bp, Homo sapiens
acccttgtggaacca

SEQ ID NO: 58314 - DNA, 15 bp, Homo sapiens
tacccttgtggaacc

SEQ ID NO: 58315 - DNA, 15 bp, Homo sapiens
gtacccttgtggaac

SEQ ID NO: 58316 - DNA, 15 bp, Homo sapiens
tgtacccttgtggaa

SEQ ID NO: 58317 - DNA, 15 bp, Homo sapiens
atgtacccttgtgga

SEQ ID NO: 58318 - DNA, 15 bp, Homo sapiens
catgtacccttgtgg

SEQ ID NO: 58319 - DNA, 15 bp, Homo sapiens
gcatgtacccttgtg

SEQ ID NO: 58320 - DNA, 15 bp, Homo sapiens
ggcatgtacccttgt

SEQ ID NO: 58321 - DNA, 15 bp, Homo sapiens
aggcatgtacccttg

SEQ ID NO: 58322 - DNA, 15 bp, Homo sapiens
aaggcatgtaccctt

SEQ ID NO: 58323 - DNA, 15 bp, Homo sapiens
taaggcatgtaccct

SEQ ID NO: 58324 - DNA, 15 bp, Homo sapiens
ttaaggcatgtaccc

SEQ ID NO: 58325 - DNA, 15 bp, Homo sapiens
tttaaggcatgtacc

SEQ ID NO: 58326 - DNA, 15 bp, Homo sapiens
atttaaggcatgtac

SEQ ID NO: 58327 - DNA, 15 bp, Homo sapiens
tatttaaggcatgta

SEQ ID NO: 58328 - DNA, 15 bp, Homo sapiens
ttatttaaggcatgt

SEQ ID NO: 58329 - DNA, 15 bp, Homo sapiens
gttatttaaggcatg

SEQ ID NO: 58330 - DNA, 15 bp, Homo sapiens
cgttatttaaggcat

SEQ ID NO: 58331 - DNA, 15 bp, Homo sapiens
acgttatttaaggca

SEQ ID NO: 58332 - DNA, 15 bp, Homo sapiens
gacgttatttaaggc

SEQ ID NO: 58333 - DNA, 15 bp, Homo sapiens
tgacgttatttaagg

SEQ ID NO: 58334 - DNA, 15 bp, Homo sapiens
ttgacgttatttaag

SEQ ID NO: 58335 - DNA, 15 bp, Homo sapiens
gttgacgttatttaa

SEQ ID NO: 58336 - DNA, 15 bp, Homo sapiens
tgttgacgttattta

SEQ ID NO: 58337 - DNA, 15 bp, Homo sapiens
ctgttgacgttattt

SEQ ID NO: 58338 - DNA, 15 bp, Homo sapiens
tctgttgacgttatt

SEQ ID NO: 58339 - DNA, 15 bp, Homo sapiens
ctctgttgacgttat

SEQ ID NO: 58340 - DNA, 15 bp, Homo sapiens
actctgttgacgtta

SEQ ID NO: 58341 - DNA, 15 bp, Homo sapiens
cactctgttgacgtt

SEQ ID NO: 58342 - DNA, 15 bp, Homo sapiens
gcactctgttgacgt

SEQ ID NO: 58343 - DNA, 15 bp, Homo sapiens
agcactctgttgacg

SEQ ID NO: 58344 - DNA, 15 bp, Homo sapiens
cagcactctgttgac

SEQ ID NO: 58345 - DNA, 15 bp, Homo sapiens
gcagcactctgttga

SEQ ID NO: 58346 - DNA, 15 bp, Homo sapiens
tgcagcactctgttg

SEQ ID NO: 58347 - DNA, 15 bp, Homo sapiens
ctgcagcactctgtt

SEQ ID NO: 58348 - DNA, 15 bp, Homo sapiens
cctgcagcactctgt

SEQ ID NO: 58349 - DNA, 15 bp, Homo sapiens
acctgcagcactctg

SEQ ID NO: 58350 - DNA, 15 bp, Homo sapiens
aacctgcagcactct

SEQ ID NO: 58351 - DNA, 15 bp, Homo sapiens
aaacctgcagcactc

SEQ ID NO: 58352 - DNA, 15 bp, Homo sapiens
aaaacctgcagcact

SEQ ID NO: 58353 - DNA, 15 bp, Homo sapiens
taaaacctgcagcac

SEQ ID NO: 58354 - DNA, 15 bp, Homo sapiens
gtaaaacctgcagca

SEQ ID NO: 58355 - DNA, 15 bp, Homo sapiens
tgtaaaacctgcagc

SEQ ID NO: 58356 - DNA, 15 bp, Homo sapiens
atgtaaaacctgcag

SEQ ID NO: 58357 - DNA, 15 bp, Homo sapiens
gatgtaaaacctgca

SEQ ID NO: 58358 - DNA, 15 bp, Homo sapiens
tgatgtaaaacctgc

SEQ ID NO: 58359 - DNA, 15 bp, Homo sapiens
ctgatgtaaaacctg

SEQ ID NO: 58360 - DNA, 15 bp, Homo sapiens
tctgatgtaaaacct

SEQ ID NO: 58361 - DNA, 15 bp, Homo sapiens
ttctgatgtaaaacc

SEQ ID NO: 58362 - DNA, 15 bp, Homo sapiens
gttctgatgtaaaac

SEQ ID NO: 58363 - DNA, 15 bp, Homo sapiens
tgttctgatgtaaaa

SEQ ID NO: 58364 - DNA, 15 bp, Homo sapiens
ttgttctgatgtaaa

SEQ ID NO: 58365 - DNA, 15 bp, Homo sapiens
attgttctgatgtaa

SEQ ID NO: 58366 - DNA, 15 bp, Homo sapiens
cattgttctgatgta

SEQ ID NO: 58367 - DNA, 15 bp, Homo sapiens
acattgttctgatgt

SEQ ID NO: 58368 - DNA, 15 bp, Homo sapiens
tacattgttctgatg

SEQ ID NO: 58369 - DNA, 15 bp, Homo sapiens
ttacattgttctgat

SEQ ID NO: 58370 - DNA, 15 bp, Homo sapiens
cttacattgttctga

SEQ ID NO: 58371 - DNA, 15 bp, Homo sapiens
acttacattgttctg

SEQ ID NO: 58372 - DNA, 15 bp, Homo sapiens
cacttacattgttct

SEQ ID NO: 58373 - DNA, 15 bp, Homo sapiens
acacttacattgttc

SEQ ID NO: 58374 - DNA, 15 bp, Homo sapiens
cacacttacattgtt

SEQ ID NO: 58375 - DNA, 15 bp, Homo sapiens
acacacttacattgt

SEQ ID NO: 58376 - DNA, 15 bp, Homo sapiens
tacacacttacattg

SEQ ID NO: 58377 - DNA, 15 bp, Homo sapiens
ttacacacttacatt

SEQ ID NO: 58378 - DNA, 15 bp, Homo sapiens
attacacacttacat

SEQ ID NO: 58379 - DNA, 15 bp, Homo sapiens
cattacacacttaca

SEQ ID NO: 58380 - DNA, 15 bp, Homo sapiens
acattacacacttac

SEQ ID NO: 58381 - DNA, 15 bp, Homo sapiens
cacattacacactta

SEQ ID NO: 58382 - DNA, 15 bp, Homo sapiens
tcacattacacactt

SEQ ID NO: 58383 - DNA, 15 bp, Homo sapiens
ctcacattacacact

SEQ ID NO: 58384 - DNA, 15 bp, Homo sapiens
actcacattacacac

SEQ ID NO: 58385 - DNA, 15 bp, Homo sapiens
aactcacattacaca

SEQ ID NO: 58386 - DNA, 15 bp, Homo sapiens
gaactcacattacac

SEQ ID NO: 58387 - DNA, 15 bp, Homo sapiens
agaactcacattaca

SEQ ID NO: 58388 - DNA, 15 bp, Homo sapiens
cagaactcacattac

SEQ ID NO: 58389 - DNA, 15 bp, Homo sapiens
ccagaactcacatta

SEQ ID NO: 58390 - DNA, 15 bp, Homo sapiens
cccagaactcacatt

SEQ ID NO: 58391 - DNA, 15 bp, Homo sapiens
ccccagaactcacat

SEQ ID NO: 58392 - DNA, 15 bp, Homo sapiens
cccccagaactcaca

SEQ ID NO: 58393 - DNA, 15 bp, Homo sapiens
acccccagaactcac

SEQ ID NO: 58394 - DNA, 15 bp, Homo sapiens
gacccccagaactca

SEQ ID NO: 58395 - DNA, 15 bp, Homo sapiens
agacccccagaactc

SEQ ID NO: 58396 - DNA, 15 bp, Homo sapiens
cagacccccagaact

SEQ ID NO: 58397 - DNA, 15 bp, Homo sapiens
acagacccccagaac

SEQ ID NO: 58398 - DNA, 15 bp, Homo sapiens
cacagacccccagaa

SEQ ID NO: 58399 - DNA, 15 bp, Homo sapiens
gcacagacccccaga

SEQ ID NO: 58400 - DNA, 15 bp, Homo sapiens
agcacagacccccag

SEQ ID NO: 58401 - DNA, 15 bp, Homo sapiens
cagcacagaccccca

SEQ ID NO: 58402 - DNA, 15 bp, Homo sapiens
gcagcacagaccccc

SEQ ID NO: 58403 - DNA, 15 bp, Homo sapiens
ggcagcacagacccc

SEQ ID NO: 58404 - DNA, 15 bp, Homo sapiens
tggcagcacagaccc

SEQ ID NO: 58405 - DNA, 15 bp, Homo sapiens
atggcagcacagacc

SEQ ID NO: 58406 - DNA, 15 bp, Homo sapiens
gatggcagcacagac

SEQ ID NO: 58407 - DNA, 15 bp, Homo sapiens
tgatggcagcacaga

SEQ ID NO: 58408 - DNA, 15 bp, Homo sapiens
ctgatggcagcacag

SEQ ID NO: 58409 - DNA, 15 bp, Homo sapiens
gctgatggcagcaca

SEQ ID NO: 58410 - DNA, 15 bp, Homo sapiens
tgctgatggcagcac

SEQ ID NO: 58411 - DNA, 15 bp, Homo sapiens
atgctgatggcagca

SEQ ID NO: 58412 - DNA, 15 bp, Homo sapiens
aatgctgatggcagc

SEQ ID NO: 58413 - DNA, 15 bp, Homo sapiens
taatgctgatggcag

SEQ ID NO: 58414 - DNA, 15 bp, Homo sapiens
ataatgctgatggca

SEQ ID NO: 58415 - DNA, 15 bp, Homo sapiens
aataatgctgatggc

SEQ ID NO: 58416 - DNA, 15 bp, Homo sapiens
aaataatgctgatgg

SEQ ID NO: 58417 - DNA, 15 bp, Homo sapiens
taaataatgctgatg

SEQ ID NO: 58418 - DNA, 15 bp, Homo sapiens
ataaataatgctgat

SEQ ID NO: 58419 - DNA, 15 bp, Homo sapiens
aataaataatgctga

SEQ ID NO: 58420 - DNA, 15 bp, Homo sapiens
caataaataatgctg

SEQ ID NO: 58421 - DNA, 15 bp, Homo sapiens
acaataaataatgct

SEQ ID NO: 58422 - DNA, 15 bp, Homo sapiens
cacaataaataatgc

SEQ ID NO: 58423 - DNA, 15 bp, Homo sapiens
tcacaataaataatg

SEQ ID NO: 58424 - DNA, 15 bp, Homo sapiens
ttcacaataaataat

SEQ ID NO: 58425 - DNA, 15 bp, Homo sapiens
tttcacaataaataa

SEQ ID NO: 58426 - DNA, 15 bp, Homo sapiens
gtttcacaataaata

SEQ ID NO: 58427 - DNA, 15 bp, Homo sapiens
agtttcacaataaat

SEQ ID NO: 58428 - DNA, 15 bp, Homo sapiens
gagtttcacaataaa

SEQ ID NO: 58429 - DNA, 15 bp, Homo sapiens
tgagtttcacaataa

SEQ ID NO: 58430 - DNA, 15 bp, Homo sapiens
gtgagtttcacaata

SEQ ID NO: 58431 - DNA, 15 bp, Homo sapiens
ggtgagtttcacaat

SEQ ID NO: 58432 - DNA, 15 bp, Homo sapiens
tggtgagtttcacaa

SEQ ID NO: 58433 - DNA, 15 bp, Homo sapiens
ttggtgagtttcaca

SEQ ID NO: 58434 - DNA, 15 bp, Homo sapiens
gttggtgagtttcac

SEQ ID NO: 58435 - DNA, 15 bp, Homo sapiens
agttggtgagtttca

SEQ ID NO: 58436 - DNA, 15 bp, Homo sapiens
cagttggtgagtttc

SEQ ID NO: 58437 - DNA, 15 bp, Homo sapiens
gcagttggtgagttt

SEQ ID NO: 58438 - DNA, 15 bp, Homo sapiens
agcagttggtgagtt

SEQ ID NO: 58439 - DNA, 15 bp, Homo sapiens
aagcagttggtgagt

SEQ ID NO: 58440 - DNA, 15 bp, Homo sapiens
caagcagttggtgag

SEQ ID NO: 58441 - DNA, 15 bp, Homo sapiens
tcaagcagttggtga

SEQ ID NO: 58442 - DNA, 15 bp, Homo sapiens
atcaagcagttggtg

SEQ ID NO: 58443 - DNA, 15 bp, Homo sapiens
catcaagcagttggt

SEQ ID NO: 58444 - DNA, 15 bp, Homo sapiens
gcatcaagcagttgg

SEQ ID NO: 58445 - DNA, 15 bp, Homo sapiens
tgcatcaagcagttg

SEQ ID NO: 58446 - DNA, 15 bp, Homo sapiens
atgcatcaagcagtt

SEQ ID NO: 58447 - DNA, 15 bp, Homo sapiens
aatgcatcaagcagt

SEQ ID NO: 58448 - DNA, 15 bp, Homo sapiens
caatgcatcaagcag

SEQ ID NO: 58449 - DNA, 15 bp, Homo sapiens
ccaatgcatcaagca

SEQ ID NO: 58450 - DNA, 15 bp, Homo sapiens
gccaatgcatcaagc

SEQ ID NO: 58451 - DNA, 15 bp, Homo sapiens
tgccaatgcatcaag

SEQ ID NO: 58452 - DNA, 15 bp, Homo sapiens
atgccaatgcatcaa

SEQ ID NO: 58453 - DNA, 15 bp, Homo sapiens
gatgccaatgcatca

SEQ ID NO: 58454 - DNA, 15 bp, Homo sapiens
ggatgccaatgcatc

SEQ ID NO: 58455 - DNA, 15 bp, Homo sapiens
tggatgccaatgcat

SEQ ID NO: 58456 - DNA, 15 bp, Homo sapiens
gtggatgccaatgca

SEQ ID NO: 58457 - DNA, 15 bp, Homo sapiens
agtggatgccaatgc

SEQ ID NO: 58458 - DNA, 15 bp, Homo sapiens
cagtggatgccaatg

SEQ ID NO: 58459 - DNA, 15 bp, Homo sapiens
tcagtggatgccaat

SEQ ID NO: 58460 - DNA, 15 bp, Homo sapiens
atcagtggatgccaa

SEQ ID NO: 58461 - DNA, 15 bp, Homo sapiens
aatcagtggatgcca

SEQ ID NO: 58462 - DNA, 15 bp, Homo sapiens
gaatcagtggatgcc

SEQ ID NO: 58463 - DNA, 15 bp, Homo sapiens
agaatcagtggatgc

SEQ ID NO: 58464 - DNA, 15 bp, Homo sapiens
aagaatcagtggatg

SEQ ID NO: 58465 - DNA, 15 bp, Homo sapiens
caagaatcagtggat

SEQ ID NO: 58466 - DNA, 15 bp, Homo sapiens
gcaagaatcagtgga

SEQ ID NO: 58467 - DNA, 15 bp, Homo sapiens
tgcaagaatcagtgg

SEQ ID NO: 58468 - DNA, 15 bp, Homo sapiens
ttgcaagaatcagtg

SEQ ID NO: 58469 - DNA, 15 bp, Homo sapiens
tttgcaagaatcagt

SEQ ID NO: 58470 - DNA, 15 bp, Homo sapiens
gtttgcaagaatcag

SEQ ID NO: 58471 - DNA, 15 bp, Homo sapiens
tgtttgcaagaatca

SEQ ID NO: 58472 - DNA, 15 bp, Homo sapiens
atgtttgcaagaatc

SEQ ID NO: 58473 - DNA, 15 bp, Homo sapiens
aatgtttgcaagaat

SEQ ID NO: 58474 - DNA, 15 bp, Homo sapiens
aaatgtttgcaagaa

SEQ ID NO: 58475 - DNA, 15 bp, Homo sapiens
aaaatgtttgcaaga

SEQ ID NO: 58476 - DNA, 15 bp, Homo sapiens
aaaaatgtttgcaag

SEQ ID NO: 58477 - DNA, 15 bp, Homo sapiens
aaaaaatgtttgcaa

SEQ ID NO: 58478 - DNA, 15 bp, Homo sapiens
gaaaaaatgtttgca

SEQ ID NO: 58479 - DNA, 15 bp, Homo sapiens
agaaaaaatgtttgc

SEQ ID NO: 58480 - DNA, 15 bp, Homo sapiens
aagaaaaaatgtttg

SEQ ID NO: 58481 - DNA, 15 bp, Homo sapiens
taagaaaaaatgttt

SEQ ID NO: 58482 - DNA, 15 bp, Homo sapiens
ataagaaaaaatgtt

SEQ ID NO: 58483 - DNA, 15 bp, Homo sapiens
cataagaaaaaatgt

SEQ ID NO: 58484 - DNA, 15 bp, Homo sapiens
tcataagaaaaaatg

SEQ ID NO: 58485 - DNA, 15 bp, Homo sapiens
ctcataagaaaaaat

SEQ ID NO: 58486 - DNA, 15 bp, Homo sapiens
tctcataagaaaaaa

SEQ ID NO: 58487 - DNA, 15 bp, Homo sapiens
ttctcataagaaaaa

SEQ ID NO: 58488 - DNA, 15 bp, Homo sapiens
tttctcataagaaaa

SEQ ID NO: 58489 - DNA, 15 bp, Homo sapiens
atttctcataagaaa

SEQ ID NO: 58490 - DNA, 15 bp, Homo sapiens
tatttctcataagaa

SEQ ID NO: 58491 - DNA, 15 bp, Homo sapiens
gtatttctcataaga

SEQ ID NO: 58492 - DNA, 15 bp, Homo sapiens
agtatttctcataag

SEQ ID NO: 58493 - DNA, 15 bp, Homo sapiens
cagtatttctcataa

SEQ ID NO: 58494 - DNA, 15 bp, Homo sapiens
tcagtatttctcata

SEQ ID NO: 58495 - DNA, 15 bp, Homo sapiens
ttcagtatttctcat

SEQ ID NO: 58496 - DNA, 15 bp, Homo sapiens
gttcagtatttctca

SEQ ID NO: 58497 - DNA, 15 bp, Homo sapiens
agttcagtatttctc

SEQ ID NO: 58498 - DNA, 15 bp, Homo sapiens
aagttcagtatttct

SEQ ID NO: 58499 - DNA, 15 bp, Homo sapiens
aaagttcagtatttc

SEQ ID NO: 58500 - DNA, 15 bp, Homo sapiens
aaaagttcagtattt

SEQ ID NO: 58501 - DNA, 15 bp, Homo sapiens
aaaaagttcagtatt

SEQ ID NO: 58502 - DNA, 15 bp, Homo sapiens
gaaaaagttcagtat

SEQ ID NO: 58503 - DNA, 15 bp, Homo sapiens
agaaaaagttcagta

SEQ ID NO: 58504 - DNA, 15 bp, Homo sapiens
cagaaaaagttcagt

SEQ ID NO: 58505 - DNA, 15 bp, Homo sapiens
acagaaaaagttcag

SEQ ID NO: 58506 - DNA, 15 bp, Homo sapiens
cacagaaaaagttca

SEQ ID NO: 58507 - DNA, 15 bp, Homo sapiens
tcacagaaaaagttc

SEQ ID NO: 58508 - DNA, 15 bp, Homo sapiens
ctcacagaaaaagtt

SEQ ID NO: 58509 - DNA, 15 bp, Homo sapiens
actcacagaaaaagt

SEQ ID NO: 58510 - DNA, 15 bp, Homo sapiens
cactcacagaaaaag

SEQ ID NO: 58511 - DNA, 15 bp, Homo sapiens
tcactcacagaaaaa

SEQ ID NO: 58512 - DNA, 15 bp, Homo sapiens
ttcactcacagaaaa

SEQ ID NO: 58513 - DNA, 15 bp, Homo sapiens
cttcactcacagaaa

SEQ ID NO: 58514 - DNA, 15 bp, Homo sapiens
tcttcactcacagaa

SEQ ID NO: 58515 - DNA, 15 bp, Homo sapiens
ttcttcactcacaga

SEQ ID NO: 58516 - DNA, 15 bp, Homo sapiens
tttcttcactcacag

SEQ ID NO: 58517 - DNA, 15 bp, Homo sapiens
gtttcttcactcaca

SEQ ID NO: 58518 - DNA, 15 bp, Homo sapiens
tgtttcttcactcac

SEQ ID NO: 58519 - DNA, 15 bp, Homo sapiens
ctgtttcttcactca

SEQ ID NO: 58520 - DNA, 15 bp, Homo sapiens
actgtttcttcactc

SEQ ID NO: 58521 - DNA, 15 bp, Homo sapiens
gactgtttcttcact

SEQ ID NO: 58522 - DNA, 15 bp, Homo sapiens
tgactgtttcttcac

SEQ ID NO: 58523 - DNA, 15 bp, Homo sapiens
atgactgtttcttca

SEQ ID NO: 58524 - DNA, 15 bp, Homo sapiens
catgactgtttcttc

SEQ ID NO: 58525 - DNA, 15 bp, Homo sapiens
acatgactgtttctt

SEQ ID NO: 58526 - DNA, 15 bp, Homo sapiens
cacatgactgtttct

SEQ ID NO: 58527 - DNA, 15 bp, Homo sapiens
gcacatgactgtttc

SEQ ID NO: 58528 - DNA, 15 bp, Homo sapiens
agcacatgactgttt

SEQ ID NO: 58529 - DNA, 15 bp, Homo sapiens
aagcacatgactgtt

SEQ ID NO: 58530 - DNA, 15 bp, Homo sapiens
aaagcacatgactgt

SEQ ID NO: 58531 - DNA, 15 bp, Homo sapiens
aaaagcacatgactg

SEQ ID NO: 58532 - DNA, 15 bp, Homo sapiens
aaaaagcacatgact

SEQ ID NO: 58533 - DNA, 15 bp, Homo sapiens
gaaaaagcacatgac

SEQ ID NO: 58534 - DNA, 15 bp, Homo sapiens
agaaaaagcacatga

SEQ ID NO: 58535 - DNA, 15 bp, Homo sapiens
cagaaaaagcacatg

SEQ ID NO: 58536 - DNA, 15 bp, Homo sapiens
tcagaaaaagcacat

SEQ ID NO: 58537 - DNA, 15 bp, Homo sapiens
atcagaaaaagcaca

SEQ ID NO: 58538 - DNA, 15 bp, Homo sapiens
catcagaaaaagcac

SEQ ID NO: 58539 - DNA, 15 bp, Homo sapiens
ccatcagaaaaagca

SEQ ID NO: 58540 - DNA, 15 bp, Homo sapiens
gccatcagaaaaagc

SEQ ID NO: 58541 - DNA, 15 bp, Homo sapiens
agccatcagaaaaag

SEQ ID NO: 58542 - DNA, 15 bp, Homo sapiens
cagccatcagaaaaa

SEQ ID NO: 58543 - DNA, 15 bp, Homo sapiens
acagccatcagaaaa

SEQ ID NO: 58544 - DNA, 15 bp, Homo sapiens
tacagccatcagaaa

SEQ ID NO: 58545 - DNA, 15 bp, Homo sapiens
atacagccatcagaa

SEQ ID NO: 58546 - DNA, 15 bp, Homo sapiens
aatacagccatcaga

SEQ ID NO: 58547 - DNA, 15 bp, Homo sapiens
caatacagccatcag

SEQ ID NO: 58548 - DNA, 15 bp, Homo sapiens
tcaatacagccatca

SEQ ID NO: 58549 - DNA, 15 bp, Homo sapiens
atcaatacagccatc

SEQ ID NO: 58550 - DNA, 15 bp, Homo sapiens
gatcaatacagccat

SEQ ID NO: 58551 - DNA, 15 bp, Homo sapiens
agatcaatacagcca

SEQ ID NO: 58552 - DNA, 15 bp, Homo sapiens
cagatcaatacagcc

SEQ ID NO: 58553 - DNA, 15 bp, Homo sapiens
acagatcaatacagc

SEQ ID NO: 58554 - DNA, 15 bp, Homo sapiens
tacagatcaatacag

SEQ ID NO: 58555 - DNA, 15 bp, Homo sapiens
ctacagatcaataca

SEQ ID NO: 58556 - DNA, 15 bp, Homo sapiens
actacagatcaatac

SEQ ID NO: 58557 - DNA, 15 bp, Homo sapiens
tactacagatcaata

SEQ ID NO: 58558 - DNA, 15 bp, Homo sapiens
atactacagatcaat

SEQ ID NO: 58559 - DNA, 15 bp, Homo sapiens
tatactacagatcaa

SEQ ID NO: 58560 - DNA, 15 bp, Homo sapiens
ttatactacagatca

SEQ ID NO: 58561 - DNA, 15 bp, Homo sapiens
tttatactacagatc

SEQ ID NO: 58562 - DNA, 15 bp, Homo sapiens
atttatactacagat

SEQ ID NO: 58563 - DNA, 15 bp, Homo sapiens
tatttatactacaga

SEQ ID NO: 58564 - DNA, 15 bp, Homo sapiens
ttatttatactacag

SEQ ID NO: 58565 - DNA, 15 bp, Homo sapiens
attatttatactaca

SEQ ID NO: 58566 - DNA, 15 bp, Homo sapiens
tattatttatactac

SEQ ID NO: 58567 - DNA, 15 bp, Homo sapiens
gtattatttatacta

SEQ ID NO: 58568 - DNA, 15 bp, Homo sapiens
tgtattatttatact

SEQ ID NO: 58569 - DNA, 15 bp, Homo sapiens
atgtattatttatac

SEQ ID NO: 58570 - DNA, 15 bp, Homo sapiens
aatgtattatttata

SEQ ID NO: 58571 - DNA, 15 bp, Homo sapiens
aaatgtattatttat

SEQ ID NO: 58572 - DNA, 15 bp, Homo sapiens
aaaatgtattattta

SEQ ID NO: 58573 - DNA, 15 bp, Homo sapiens
aaaaatgtattattt

SEQ ID NO: 58574 - DNA, 15 bp, Homo sapiens
caaaaatgtattatt

SEQ ID NO: 58575 - DNA, 15 bp, Homo sapiens
tcaaaaatgtattat

SEQ ID NO: 58576 - DNA, 15 bp, Homo sapiens
ctcaaaaatgtatta

SEQ ID NO: 58577 - DNA, 15 bp, Homo sapiens
tctcaaaaatgtatt

SEQ ID NO: 58578 - DNA, 15 bp, Homo sapiens
atctcaaaaatgtat

SEQ ID NO: 58579 - DNA, 15 bp, Homo sapiens
aatctcaaaaatgta

SEQ ID NO: 58580 - DNA, 15 bp, Homo sapiens
aaatctcaaaaatgt

SEQ ID NO: 58581 - DNA, 15 bp, Homo sapiens
taaatctcaaaaatg

SEQ ID NO: 58582 - DNA, 15 bp, Homo sapiens
ttaaatctcaaaaat

SEQ ID NO: 58583 - DNA, 15 bp, Homo sapiens
cttaaatctcaaaaa

SEQ ID NO: 58584 - DNA, 15 bp, Homo sapiens
gcttaaatctcaaaa

SEQ ID NO: 58585 - DNA, 15 bp, Homo sapiens
agcttaaatctcaaa

SEQ ID NO: 58586 - DNA, 15 bp, Homo sapiens
aagcttaaatctcaa

SEQ ID NO: 58587 - DNA, 15 bp, Homo sapiens
taagcttaaatctca

SEQ ID NO: 58588 - DNA, 15 bp, Homo sapiens
gtaagcttaaatctc

SEQ ID NO: 58589 - DNA, 15 bp, Homo sapiens
ggtaagcttaaatct

SEQ ID NO: 58590 - DNA, 15 bp, Homo sapiens
aggtaagcttaaatc

SEQ ID NO: 58591 - DNA, 15 bp, Homo sapiens
caggtaagcttaaat

SEQ ID NO: 58592 - DNA, 15 bp, Homo sapiens
tcaggtaagcttaaa

SEQ ID NO: 58593 - DNA, 15 bp, Homo sapiens
atcaggtaagcttaa

SEQ ID NO: 58594 - DNA, 15 bp, Homo sapiens
aatcaggtaagctta

SEQ ID NO: 58595 - DNA, 15 bp, Homo sapiens
gaatcaggtaagctt

SEQ ID NO: 58596 - DNA, 15 bp, Homo sapiens
agaatcaggtaagct

SEQ ID NO: 58597 - DNA, 15 bp, Homo sapiens
gagaatcaggtaagc

SEQ ID NO: 58598 - DNA, 15 bp, Homo sapiens
agagaatcaggtaag

SEQ ID NO: 58599 - DNA, 15 bp, Homo sapiens
tagagaatcaggtaa

SEQ ID NO: 58600 - DNA, 15 bp, Homo sapiens
ttagagaatcaggta

SEQ ID NO: 58601 - DNA, 15 bp, Homo sapiens
tttagagaatcaggt

SEQ ID NO: 58602 - DNA, 15 bp, Homo sapiens
ttttagagaatcagg

SEQ ID NO: 58603 - DNA, 15 bp, Homo sapiens
attttagagaatcag

SEQ ID NO: 58604 - DNA, 15 bp, Homo sapiens
cattttagagaatca

SEQ ID NO: 58605 - DNA, 15 bp, Homo sapiens
tcattttagagaatc

SEQ ID NO: 58606 - DNA, 15 bp, Homo sapiens
ttcattttagagaat

SEQ ID NO: 58607 - DNA, 15 bp, Homo sapiens
tttcattttagagaa

SEQ ID NO: 58608 - DNA, 15 bp, Homo sapiens
atttcattttagaga

SEQ ID NO: 58609 - DNA, 15 bp, Homo sapiens
aatttcattttagag

SEQ ID NO: 58610 - DNA, 15 bp, Homo sapiens
aaatttcattttaga

SEQ ID NO: 58611 - DNA, 15 bp, Homo sapiens
gaaatttcattttag

SEQ ID NO: 58612 - DNA, 15 bp, Homo sapiens
agaaatttcatttta

SEQ ID NO: 58613 - DNA, 15 bp, Homo sapiens
gagaaatttcatttt

SEQ ID NO: 58614 - DNA, 15 bp, Homo sapiens
agagaaatttcattt

SEQ ID NO: 58615 - DNA, 15 bp, Homo sapiens
aagagaaatttcatt

SEQ ID NO: 58616 - DNA, 15 bp, Homo sapiens
taagagaaatttcat

SEQ ID NO: 58617 - DNA, 15 bp, Homo sapiens
ataagagaaatttca

SEQ ID NO: 58618 - DNA, 15 bp, Homo sapiens
gataagagaaatttc

SEQ ID NO: 58619 - DNA, 15 bp, Homo sapiens
agataagagaaattt

SEQ ID NO: 58620 - DNA, 15 bp, Homo sapiens
gagataagagaaatt

SEQ ID NO: 58621 - DNA, 15 bp, Homo sapiens
agagataagagaaat

SEQ ID NO: 58622 - DNA, 15 bp, Homo sapiens
gagagataagagaaa

SEQ ID NO: 58623 - DNA, 15 bp, Homo sapiens
tgagagataagagaa

SEQ ID NO: 58624 - DNA, 15 bp, Homo sapiens
gtgagagataagaga

SEQ ID NO: 58625 - DNA, 15 bp, Homo sapiens
agtgagagataagag

SEQ ID NO: 58626 - DNA, 15 bp, Homo sapiens
aagtgagagataaga

SEQ ID NO: 58627 - DNA, 15 bp, Homo sapiens
taagtgagagataag

SEQ ID NO: 58628 - DNA, 15 bp, Homo sapiens
ataagtgagagataa

SEQ ID NO: 58629 - DNA, 15 bp, Homo sapiens
tataagtgagagata

SEQ ID NO: 58630 - DNA, 15 bp, Homo sapiens
gtataagtgagagat

SEQ ID NO: 58631 - DNA, 15 bp, Homo sapiens
agtataagtgagaga

SEQ ID NO: 58632 - DNA, 15 bp, Homo sapiens
cagtataagtgagag

SEQ ID NO: 58633 - DNA, 15 bp, Homo sapiens
gcagtataagtgaga

SEQ ID NO: 58634 - DNA, 15 bp, Homo sapiens
agcagtataagtgag

SEQ ID NO: 58635 - DNA, 15 bp, Homo sapiens
cagcagtataagtga

SEQ ID NO: 58636 - DNA, 15 bp, Homo sapiens
acagcagtataagtg

SEQ ID NO: 58637 - DNA, 15 bp, Homo sapiens
gacagcagtataagt

SEQ ID NO: 58638 - DNA, 15 bp, Homo sapiens
ggacagcagtataag

SEQ ID NO: 58639 - DNA, 15 bp, Homo sapiens
tggacagcagtataa

SEQ ID NO: 58640 - DNA, 15 bp, Homo sapiens
ttggacagcagtata

SEQ ID NO: 58641 - DNA, 15 bp, Homo sapiens
tttggacagcagtat

SEQ ID NO: 58642 - DNA, 15 bp, Homo sapiens
atttggacagcagta

SEQ ID NO: 58643 - DNA, 15 bp, Homo sapiens
catttggacagcagt

SEQ ID NO: 58644 - DNA, 15 bp, Homo sapiens
acatttggacagcag

SEQ ID NO: 58645 - DNA, 15 bp, Homo sapiens
cacatttggacagca

SEQ ID NO: 58646 - DNA, 15 bp, Homo sapiens
gcacatttggacagc

SEQ ID NO: 58647 - DNA, 15 bp, Homo sapiens
agcacatttggacag

SEQ ID NO: 58648 - DNA, 15 bp, Homo sapiens
tagcacatttggaca

SEQ ID NO: 58649 - DNA, 15 bp, Homo sapiens
ttagcacatttggac

SEQ ID NO: 58650 - DNA, 15 bp, Homo sapiens
tttagcacatttgga

SEQ ID NO: 58651 - DNA, 15 bp, Homo sapiens
ttttagcacatttgg

SEQ ID NO: 58652 - DNA, 15 bp, Homo sapiens
attttagcacatttg

SEQ ID NO: 58653 - DNA, 15 bp, Homo sapiens
tattttagcacattt

SEQ ID NO: 58654 - DNA, 15 bp, Homo sapiens
ttattttagcacatt

SEQ ID NO: 58655 - DNA, 15 bp, Homo sapiens
tttattttagcacat

SEQ ID NO: 58656 - DNA, 15 bp, Homo sapiens
ttttattttagcaca

SEQ ID NO: 58657 - DNA, 15 bp, Homo sapiens
tttttattttagcac

SEQ ID NO: 58658 - DNA, 15 bp, Homo sapiens
gtttttattttagca

SEQ ID NO: 58659 - DNA, 15 bp, Homo sapiens
ggtttttattttagc

SEQ ID NO: 58660 - DNA, 15 bp, Homo sapiens
aggtttttattttag

SEQ ID NO: 58661 - DNA, 15 bp, Homo sapiens
caggtttttatttta

SEQ ID NO: 58662 - DNA, 15 bp, Homo sapiens
ccaggtttttatttt

SEQ ID NO: 58663 - DNA, 15 bp, Homo sapiens
tccaggtttttattt

SEQ ID NO: 58664 - DNA, 15 bp, Homo sapiens
ctccaggtttttatt

SEQ ID NO: 58665 - DNA, 15 bp, Homo sapiens
actccaggtttttat

SEQ ID NO: 58666 - DNA, 15 bp, Homo sapiens
aactccaggttttta

SEQ ID NO: 58667 - DNA, 15 bp, Homo sapiens
gaactccaggttttt

SEQ ID NO: 58668 - DNA, 15 bp, Homo sapiens
agaactccaggtttt

SEQ ID NO: 58669 - DNA, 15 bp, Homo sapiens
cagaactccaggttt

SEQ ID NO: 58670 - DNA, 15 bp, Homo sapiens
acagaactccaggtt

SEQ ID NO: 58671 - DNA, 15 bp, Homo sapiens
cacagaactccaggt

SEQ ID NO: 58672 - DNA, 15 bp, Homo sapiens
tcacagaactccagg

SEQ ID NO: 58673 - DNA, 15 bp, Homo sapiens
ttcacagaactccag

SEQ ID NO: 58674 - DNA, 15 bp, Homo sapiens
cttcacagaactcca

SEQ ID NO: 58675 - DNA, 15 bp, Homo sapiens
tcttcacagaactcc

SEQ ID NO: 58676 - DNA, 15 bp, Homo sapiens
ttcttcacagaactc

SEQ ID NO: 58677 - DNA, 15 bp, Homo sapiens
tttcttcacagaact

SEQ ID NO: 58678 - DNA, 15 bp, Homo sapiens
atttcttcacagaac

SEQ ID NO: 58679 - DNA, 15 bp, Homo sapiens
aatttcttcacagaa

SEQ ID NO: 58680 - DNA, 15 bp, Homo sapiens
caatttcttcacaga

SEQ ID NO: 58681 - DNA, 15 bp, Homo sapiens
acaatttcttcacag

SEQ ID NO: 58682 - DNA, 15 bp, Homo sapiens
gacaatttcttcaca

SEQ ID NO: 58683 - DNA, 15 bp, Homo sapiens
agacaatttcttcac

SEQ ID NO: 58684 - DNA, 15 bp, Homo sapiens
aagacaatttcttca

SEQ ID NO: 58685 - DNA, 15 bp, Homo sapiens
taagacaatttcttc

SEQ ID NO: 58686 - DNA, 15 bp, Homo sapiens
ttaagacaatttctt

SEQ ID NO: 58687 - DNA, 15 bp, Homo sapiens
tttaagacaatttct

SEQ ID NO: 58688 - DNA, 15 bp, Homo sapiens
ttttaagacaatttc

SEQ ID NO: 58689 - DNA, 15 bp, Homo sapiens
cttttaagacaattt

SEQ ID NO: 58690 - DNA, 15 bp, Homo sapiens
gcttttaagacaatt

SEQ ID NO: 58691 - DNA, 15 bp, Homo sapiens
cgcttttaagacaat

SEQ ID NO: 58692 - DNA, 15 bp, Homo sapiens
acgcttttaagacaa

SEQ ID NO: 58693 - DNA, 15 bp, Homo sapiens
aacgcttttaagaca

SEQ ID NO: 58694 - DNA, 15 bp, Homo sapiens
aaacgcttttaagac

SEQ ID NO: 58695 - DNA, 15 bp, Homo sapiens
aaaacgcttttaaga

SEQ ID NO: 58696 - DNA, 15 bp, Homo sapiens
aaaaacgcttttaag

SEQ ID NO: 58697 - DNA, 15 bp, Homo sapiens
caaaaacgcttttaa

SEQ ID NO: 58698 - DNA, 15 bp, Homo sapiens
acaaaaacgctttta

SEQ ID NO: 58699 - DNA, 15 bp, Homo sapiens
aacaaaaacgctttt

SEQ ID NO: 58700 - DNA, 15 bp, Homo sapiens
aaacaaaaacgcttt

SEQ ID NO: 58701 - DNA, 15 bp, Homo sapiens
aaaacaaaaacgctt

SEQ ID NO: 58702 - DNA, 15 bp, Homo sapiens
aaaaacaaaaacgct

SEQ ID NO: 58703 - DNA, 15 bp, Homo sapiens
caaaaacaaaaacgc

SEQ ID NO: 58704 - DNA, 15 bp, Homo sapiens
acaaaaacaaaaacg

SEQ ID NO: 58705 - DNA, 15 bp, Homo sapiens
aacaaaaacaaaaac

SEQ ID NO: 58706 - DNA, 15 bp, Homo sapiens
aaacaaaaacaaaaa

SEQ ID NO: 58707 - DNA, 15 bp, Homo sapiens
aaaacaaaaacaaaa

SEQ ID NO: 58708 - DNA, 15 bp, Homo sapiens
aaaaacaaaaacaaa

SEQ ID NO: 58709 - DNA, 15 bp, Homo sapiens
aaaaaacaaaaacaa

SEQ ID NO: 58710 - DNA, 15 bp, Homo sapiens
acaaaaaacaaaaac

SEQ ID NO: 58711 - DNA, 15 bp, Homo sapiens
aacaaaaaacaaaaa

SEQ ID NO: 58712 - DNA, 15 bp, Homo sapiens
aaacaaaaaacaaaa

SEQ ID NO: 58713 - DNA, 15 bp, Homo sapiens
aaaacaaaaaacaaa

SEQ ID NO: 58714 - DNA, 15 bp, Homo sapiens
caaaacaaaaaacaa

SEQ ID NO: 58715 - DNA, 15 bp, Homo sapiens
acaaaacaaaaaaca

SEQ ID NO: 58716 - DNA, 15 bp, Homo sapiens
gacaaaacaaaaaac

SEQ ID NO: 58717 - DNA, 15 bp, Homo sapiens
agacaaaacaaaaaa

SEQ ID NO: 58718 - DNA, 15 bp, Homo sapiens
aagacaaaacaaaaa

SEQ ID NO: 58719 - DNA, 15 bp, Homo sapiens
taagacaaaacaaaa

SEQ ID NO: 58720 - DNA, 15 bp, Homo sapiens
ttaagacaaaacaaa

SEQ ID NO: 58721 - DNA, 15 bp, Homo sapiens
attaagacaaaacaa

SEQ ID NO: 58722 - DNA, 15 bp, Homo sapiens
tattaagacaaaaca

SEQ ID NO: 58723 - DNA, 15 bp, Homo sapiens
ctattaagacaaaac

SEQ ID NO: 58724 - DNA, 15 bp, Homo sapiens
cctattaagacaaaa

SEQ ID NO: 58725 - DNA, 15 bp, Homo sapiens
acctattaagacaaa

SEQ ID NO: 58726 - DNA, 15 bp, Homo sapiens
cacctattaagacaa

SEQ ID NO: 58727 - DNA, 15 bp, Homo sapiens
ccacctattaagaca

SEQ ID NO: 58728 - DNA, 15 bp, Homo sapiens
tccacctattaagac

SEQ ID NO: 58729 - DNA, 15 bp, Homo sapiens
ttccacctattaaga

SEQ ID NO: 58730 - DNA, 15 bp, Homo sapiens
attccacctattaag

SEQ ID NO: 58731 - DNA, 15 bp, Homo sapiens
aattccacctattaa

SEQ ID NO: 58732 - DNA, 15 bp, Homo sapiens
taattccacctatta

SEQ ID NO: 58733 - DNA, 15 bp, Homo sapiens
ctaattccacctatt

SEQ ID NO: 58734 - DNA, 15 bp, Homo sapiens
actaattccacctat

SEQ ID NO: 58735 - DNA, 15 bp, Homo sapiens
cactaattccaccta

SEQ ID NO: 58736 - DNA, 15 bp, Homo sapiens
tcactaattccacct

SEQ ID NO: 58737 - DNA, 15 bp, Homo sapiens
ttcactaattccacc

SEQ ID NO: 58738 - DNA, 15 bp, Homo sapiens
attcactaattccac

SEQ ID NO: 58739 - DNA, 15 bp, Homo sapiens
tattcactaattcca

SEQ ID NO: 58740 - DNA, 15 bp, Homo sapiens
atattcactaattcc

SEQ ID NO: 58741 - DNA, 15 bp, Homo sapiens
tatattcactaattc

SEQ ID NO: 58742 - DNA, 15 bp, Homo sapiens
ctatattcactaatt

SEQ ID NO: 58743 - DNA, 15 bp, Homo sapiens
cctatattcactaat

SEQ ID NO: 58744 - DNA, 15 bp, Homo sapiens
ccctatattcactaa

SEQ ID NO: 58745 - DNA, 15 bp, Homo sapiens
cccctatattcacta

SEQ ID NO: 58746 - DNA, 15 bp, Homo sapiens
ccccctatattcact

SEQ ID NO: 58747 - DNA, 15 bp, Homo sapiens
tccccctatattcac

SEQ ID NO: 58748 - DNA, 15 bp, Homo sapiens
ttccccctatattca

SEQ ID NO: 58749 - DNA, 15 bp, Homo sapiens
gttccccctatattc

SEQ ID NO: 58750 - DNA, 15 bp, Homo sapiens
agttccccctatatt

SEQ ID NO: 58751 - DNA, 15 bp, Homo sapiens
cagttccccctatat

SEQ ID NO: 58752 - DNA, 15 bp, Homo sapiens
tcagttccccctata

SEQ ID NO: 58753 - DNA, 15 bp, Homo sapiens
gtcagttccccctat

SEQ ID NO: 58754 - DNA, 15 bp, Homo sapiens
tgtcagttcccccta

SEQ ID NO: 58755 - DNA, 15 bp, Homo sapiens
atgtcagttccccct

SEQ ID NO: 58756 - DNA, 15 bp, Homo sapiens
aatgtcagttccccc

SEQ ID NO: 58757 - DNA, 15 bp, Homo sapiens
caatgtcagttcccc

SEQ ID NO: 58758 - DNA, 15 bp, Homo sapiens
acaatgtcagttccc

SEQ ID NO: 58759 - DNA, 15 bp, Homo sapiens
cacaatgtcagttcc

SEQ ID NO: 58760 - DNA, 15 bp, Homo sapiens
ccacaatgtcagttc

SEQ ID NO: 58761 - DNA, 15 bp, Homo sapiens
tccacaatgtcagtt

SEQ ID NO: 58762 - DNA, 15 bp, Homo sapiens
atccacaatgtcagt

SEQ ID NO: 58763 - DNA, 15 bp, Homo sapiens
catccacaatgtcag

SEQ ID NO: 58764 - DNA, 15 bp, Homo sapiens
ccatccacaatgtca

SEQ ID NO: 58765 - DNA, 15 bp, Homo sapiens
tccatccacaatgtc

SEQ ID NO: 58766 - DNA, 15 bp, Homo sapiens
ttccatccacaatgt

SEQ ID NO: 58767 - DNA, 15 bp, Homo sapiens
tttccatccacaatg

SEQ ID NO: 58768 - DNA, 15 bp, Homo sapiens
atttccatccacaat

SEQ ID NO: 58769 - DNA, 15 bp, Homo sapiens
gatttccatccacaa

SEQ ID NO: 58770 - DNA, 15 bp, Homo sapiens
tgatttccatccaca

SEQ ID NO: 58771 - DNA, 15 bp, Homo sapiens
gtgatttccatccac

SEQ ID NO: 58772 - DNA, 15 bp, Homo sapiens
tgtgatttccatcca

SEQ ID NO: 58773 - DNA, 15 bp, Homo sapiens
ttgtgatttccatcc

SEQ ID NO: 58774 - DNA, 15 bp, Homo sapiens
tttgtgatttccatc

SEQ ID NO: 58775 - DNA, 15 bp, Homo sapiens
gtttgtgatttccat

SEQ ID NO: 58776 - DNA, 15 bp, Homo sapiens
agtttgtgatttcca

SEQ ID NO: 58777 - DNA, 15 bp, Homo sapiens
cagtttgtgatttcc

SEQ ID NO: 58778 - DNA, 15 bp, Homo sapiens
tcagtttgtgatttc

SEQ ID NO: 58779 - DNA, 15 bp, Homo sapiens
gtcagtttgtgattt

SEQ ID NO: 58780 - DNA, 15 bp, Homo sapiens
agtcagtttgtgatt

SEQ ID NO: 58781 - DNA, 15 bp, Homo sapiens
aagtcagtttgtgat

SEQ ID NO: 58782 - DNA, 15 bp, Homo sapiens
aaagtcagtttgtga

SEQ ID NO: 58783 - DNA, 15 bp, Homo sapiens
caaagtcagtttgtg

SEQ ID NO: 58784 - DNA, 15 bp, Homo sapiens
ccaaagtcagtttgt

SEQ ID NO: 58785 - DNA, 15 bp, Homo sapiens
cccaaagtcagtttg

SEQ ID NO: 58786 - DNA, 15 bp, Homo sapiens
ccccaaagtcagttt

SEQ ID NO: 58787 - DNA, 15 bp, Homo sapiens
accccaaagtcagtt

SEQ ID NO: 58788 - DNA, 15 bp, Homo sapiens
aaccccaaagtcagt

SEQ ID NO: 58789 - DNA, 15 bp, Homo sapiens
taaccccaaagtcag

SEQ ID NO: 58790 - DNA, 15 bp, Homo sapiens
gtaaccccaaagtca

SEQ ID NO: 58791 - DNA, 15 bp, Homo sapiens
agtaaccccaaagtc

SEQ ID NO: 58792 - DNA, 15 bp, Homo sapiens
aagtaaccccaaagt

SEQ ID NO: 58793 - DNA, 15 bp, Homo sapiens
aaagtaaccccaaag

SEQ ID NO: 58794 - DNA, 15 bp, Homo sapiens
caaagtaaccccaaa

SEQ ID NO: 58795 - DNA, 15 bp, Homo sapiens
ccaaagtaaccccaa

SEQ ID NO: 58796 - DNA, 15 bp, Homo sapiens
tccaaagtaacccca

SEQ ID NO: 58797 - DNA, 15 bp, Homo sapiens
ctccaaagtaacccc

SEQ ID NO: 58798 - DNA, 15 bp, Homo sapiens
gctccaaagtaaccc

SEQ ID NO: 58799 - DNA, 15 bp, Homo sapiens
tgctccaaagtaacc

SEQ ID NO: 58800 - DNA, 15 bp, Homo sapiens
atgctccaaagtaac

SEQ ID NO: 58801 - DNA, 15 bp, Homo sapiens
gatgctccaaagtaa

SEQ ID NO: 58802 - DNA, 15 bp, Homo sapiens
tgatgctccaaagta

SEQ ID NO: 58803 - DNA, 15 bp, Homo sapiens
atgatgctccaaagt

SEQ ID NO: 58804 - DNA, 15 bp, Homo sapiens
aatgatgctccaaag

SEQ ID NO: 58805 - DNA, 15 bp, Homo sapiens
aaatgatgctccaaa

SEQ ID NO: 58806 - DNA, 15 bp, Homo sapiens
aaaatgatgctccaa

SEQ ID NO: 58807 - DNA, 15 bp, Homo sapiens
caaaatgatgctcca

SEQ ID NO: 58808 - DNA, 15 bp, Homo sapiens
gcaaaatgatgctcc

SEQ ID NO: 58809 - DNA, 15 bp, Homo sapiens
tgcaaaatgatgctc

SEQ ID NO: 58810 - DNA, 15 bp, Homo sapiens
gtgcaaaatgatgct

SEQ ID NO: 58811 - DNA, 15 bp, Homo sapiens
agtgcaaaatgatgc

SEQ ID NO: 58812 - DNA, 15 bp, Homo sapiens
cagtgcaaaatgatg

SEQ ID NO: 58813 - DNA, 15 bp, Homo sapiens
ccagtgcaaaatgat

SEQ ID NO: 58814 - DNA, 15 bp, Homo sapiens
gccagtgcaaaatga

SEQ ID NO: 58815 - DNA, 15 bp, Homo sapiens
tgccagtgcaaaatg

SEQ ID NO: 58816 - DNA, 15 bp, Homo sapiens
ctgccagtgcaaaat

SEQ ID NO: 58817 - DNA, 15 bp, Homo sapiens
cctgccagtgcaaaa

SEQ ID NO: 58818 - DNA, 15 bp, Homo sapiens
acctgccagtgcaaa

SEQ ID NO: 58819 - DNA, 15 bp, Homo sapiens
cacctgccagtgcaa

SEQ ID NO: 58820 - DNA, 15 bp, Homo sapiens
ccacctgccagtgca

SEQ ID NO: 58821 - DNA, 15 bp, Homo sapiens
cccacctgccagtgc

SEQ ID NO: 58822 - DNA, 15 bp, Homo sapiens
ccccacctgccagtg

SEQ ID NO: 58823 - DNA, 15 bp, Homo sapiens
tccccacctgccagt

SEQ ID NO: 58824 - DNA, 15 bp, Homo sapiens
ttccccacctgccag

SEQ ID NO: 58825 - DNA, 15 bp, Homo sapiens
tttccccacctgcca

SEQ ID NO: 58826 - DNA, 15 bp, Homo sapiens
atttccccacctgcc

SEQ ID NO: 58827 - DNA, 15 bp, Homo sapiens
aatttccccacctgc

SEQ ID NO: 58828 - DNA, 15 bp, Homo sapiens
aaatttccccacctg

SEQ ID NO: 58829 - DNA, 15 bp, Homo sapiens
gaaatttccccacct

SEQ ID NO: 58830 - DNA, 15 bp, Homo sapiens
ggaaatttccccacc

SEQ ID NO: 58831 - DNA, 15 bp, Homo sapiens
tggaaatttccccac

SEQ ID NO: 58832 - DNA, 15 bp, Homo sapiens
ttggaaatttcccca

SEQ ID NO: 58833 - DNA, 15 bp, Homo sapiens
attggaaatttcccc

SEQ ID NO: 58834 - DNA, 15 bp, Homo sapiens
gattggaaatttccc

SEQ ID NO: 58835 - DNA, 15 bp, Homo sapiens
tgattggaaatttcc

SEQ ID NO: 58836 - DNA, 15 bp, Homo sapiens
gtgattggaaatttc

SEQ ID NO: 58837 - DNA, 15 bp, Homo sapiens
agtgattggaaattt

SEQ ID NO: 58838 - DNA, 15 bp, Homo sapiens
aagtgattggaaatt

SEQ ID NO: 58839 - DNA, 15 bp, Homo sapiens
aaagtgattggaaat

SEQ ID NO: 58840 - DNA, 15 bp, Homo sapiens
aaaagtgattggaaa

SEQ ID NO: 58841 - DNA, 15 bp, Homo sapiens
aaaaagtgattggaa

SEQ ID NO: 58842 - DNA, 15 bp, Homo sapiens
taaaaagtgattgga

SEQ ID NO: 58843 - DNA, 15 bp, Homo sapiens
ttaaaaagtgattgg

SEQ ID NO: 58844 - DNA, 15 bp, Homo sapiens
attaaaaagtgattg

SEQ ID NO: 58845 - DNA, 15 bp, Homo sapiens
tattaaaaagtgatt

SEQ ID NO: 58846 - DNA, 15 bp, Homo sapiens
ctattaaaaagtgat

SEQ ID NO: 58847 - DNA, 15 bp, Homo sapiens
tctattaaaaagtga

SEQ ID NO: 58848 - DNA, 15 bp, Homo sapiens
ctctattaaaaagtg

SEQ ID NO: 58849 - DNA, 15 bp, Homo sapiens
tctctattaaaaagt

SEQ ID NO: 58850 - DNA, 15 bp, Homo sapiens
atctctattaaaaag

SEQ ID NO: 58851 - DNA, 15 bp, Homo sapiens
tccatctctattaaa

SEQ ID NO: 58852 - DNA, 15 bp, Homo sapiens
ttccatctctattaa

SEQ ID NO: 58853 - DNA, 15 bp, Homo sapiens
tttccatctctatta

SEQ ID NO: 58854 - DNA, 15 bp, Homo sapiens
ttttccatctctatt

SEQ ID NO: 58855 - DNA, 15 bp, Homo sapiens
attttccatctctat

SEQ ID NO: 58856 - DNA, 15 bp, Homo sapiens
cattttccatctcta

SEQ ID NO: 58857 - DNA, 15 bp, Homo sapiens
acattttccatctct

SEQ ID NO: 58858 - DNA, 15 bp, Homo sapiens
cacattttccatctc

SEQ ID NO: 58859 - DNA, 15 bp, Homo sapiens
acacattttccatct

SEQ ID NO: 58860 - DNA, 15 bp, Homo sapiens
aacacattttccatc

SEQ ID NO: 58861 - DNA, 15 bp, Homo sapiens
caacacattttccat

SEQ ID NO: 58862 - DNA, 15 bp, Homo sapiens
acaacacattttcca

SEQ ID NO: 58863 - DNA, 15 bp, Homo sapiens
aacaacacattttcc

SEQ ID NO: 58864 - DNA, 15 bp, Homo sapiens
aaacaacacattttc

SEQ ID NO: 58865 - DNA, 15 bp, Homo sapiens
caaacaacacatttt

SEQ ID NO: 58866 - DNA, 15 bp, Homo sapiens
acaaacaacacattt

SEQ ID NO: 58867 - DNA, 15 bp, Homo sapiens
gacaaacaacacatt

SEQ ID NO: 58868 - DNA, 15 bp, Homo sapiens
agacaaacaacacat

SEQ ID NO: 58869 - DNA, 15 bp, Homo sapiens
aagacaaacaacaca

SEQ ID NO: 58870 - DNA, 15 bp, Homo sapiens
aaagacaaacaacac

SEQ ID NO: 58871 - DNA, 15 bp, Homo sapiens
aaaagacaaacaaca

SEQ ID NO: 58872 - DNA, 15 bp, Homo sapiens
taaaagacaaacaac

SEQ ID NO: 58873 - DNA, 15 bp, Homo sapiens
ctaaaagacaaacaa

SEQ ID NO: 58874 - DNA, 15 bp, Homo sapiens
actaaaagacaaaca

SEQ ID NO: 58875 - DNA, 15 bp, Homo sapiens
aactaaaagacaaac

SEQ ID NO: 58876 - DNA, 15 bp, Homo sapiens
aaactaaaagacaaa

SEQ ID NO: 58877 - DNA, 15 bp, Homo sapiens
gaaactaaaagacaa

SEQ ID NO: 58878 - DNA, 15 bp, Homo sapiens
agaaactaaaagaca

SEQ ID NO: 58879 - DNA, 15 bp, Homo sapiens
aagaaactaaaagac

SEQ ID NO: 58880 - DNA, 15 bp, Homo sapiens
taagaaactaaaaga

SEQ ID NO: 58881 - DNA, 15 bp, Homo sapiens
ttaagaaactaaaag

SEQ ID NO: 58882 - DNA, 15 bp, Homo sapiens
cttaagaaactaaaa

SEQ ID NO: 58883 - DNA, 15 bp, Homo sapiens
ccttaagaaactaaa

SEQ ID NO: 58884 - DNA, 15 bp, Homo sapiens
gccttaagaaactaa

SEQ ID NO: 58885 - DNA, 15 bp, Homo sapiens
agccttaagaaacta

SEQ ID NO: 58886 - DNA, 15 bp, Homo sapiens
cagccttaagaaact

SEQ ID NO: 58887 - DNA, 15 bp, Homo sapiens
gcagccttaagaaac

SEQ ID NO: 58888 - DNA, 15 bp, Homo sapiens
ggcagccttaagaaa

SEQ ID NO: 58889 - DNA, 15 bp, Homo sapiens
cggcagccttaagaa

SEQ ID NO: 58890 - DNA, 15 bp, Homo sapiens
acggcagccttaaga

SEQ ID NO: 58891 - DNA, 15 bp, Homo sapiens
tacggcagccttaag

SEQ ID NO: 58892 - DNA, 15 bp, Homo sapiens
ttacggcagccttaa

SEQ ID NO: 58893 - DNA, 15 bp, Homo sapiens
gttacggcagcctta

SEQ ID NO: 58894 - DNA, 15 bp, Homo sapiens
ggttacggcagcctt

SEQ ID NO: 58895 - DNA, 15 bp, Homo sapiens
tggttacggcagcct

SEQ ID NO: 58896 - DNA, 15 bp, Homo sapiens
ttggttacggcagcc

SEQ ID NO: 58897 - DNA, 15 bp, Homo sapiens
cttggttacggcagc

SEQ ID NO: 58898 - DNA, 15 bp, Homo sapiens
acttggttacggcag

SEQ ID NO: 58899 - DNA, 15 bp, Homo sapiens
tacttggttacggca

SEQ ID NO: 58900 - DNA, 15 bp, Homo sapiens
gtacttggttacggc

SEQ ID NO: 58901 - DNA, 15 bp, Homo sapiens
ggtacttggttacgg

SEQ ID NO: 58902 - DNA, 15 bp, Homo sapiens
tggtacttggttacg

SEQ ID NO: 58903 - DNA, 15 bp, Homo sapiens
gtggtacttggttac

SEQ ID NO: 58904 - DNA, 15 bp, Homo sapiens
tgtggtacttggtta

SEQ ID NO: 58905 - DNA, 15 bp, Homo sapiens
ttgtggtacttggtt

SEQ ID NO: 58906 - DNA, 15 bp, Homo sapiens
cttgtggtacttggt

SEQ ID NO: 58907 - DNA, 15 bp, Homo sapiens
gcttgtggtacttgg

SEQ ID NO: 58908 - DNA, 15 bp, Homo sapiens
agcttgtggtacttg

SEQ ID NO: 58909 - DNA, 15 bp, Homo sapiens
cagcttgtggtactt

SEQ ID NO: 58910 - DNA, 15 bp, Homo sapiens
gcagcttgtggtact

SEQ ID NO: 58911 - DNA, 15 bp, Homo sapiens
agcagcttgtggtac

SEQ ID NO: 58912 - DNA, 15 bp, Homo sapiens
aagcagcttgtggta

SEQ ID NO: 58913 - DNA, 15 bp, Homo sapiens
caagcagcttgtggt

SEQ ID NO: 58914 - DNA, 15 bp, Homo sapiens
ccaagcagcttgtgg

SEQ ID NO: 58915 - DNA, 15 bp, Homo sapiens
gccaagcagcttgtg

SEQ ID NO: 58916 - DNA, 15 bp, Homo sapiens
agccaagcagcttgt

SEQ ID NO: 58917 - DNA, 15 bp, Homo sapiens
aagccaagcagcttg

SEQ ID NO: 58918 - DNA, 15 bp, Homo sapiens
caagccaagcagctt

SEQ ID NO: 58919 - DNA, 15 bp, Homo sapiens
tcaagccaagcagct

SEQ ID NO: 58920 - DNA, 15 bp, Homo sapiens
ttcaagccaagcagc

SEQ ID NO: 58921 - DNA, 15 bp, Homo sapiens
gttcaagccaagcag

SEQ ID NO: 58922 - DNA, 15 bp, Homo sapiens
tgttcaagccaagca

SEQ ID NO: 58923 - DNA, 15 bp, Homo sapiens
ttgttcaagccaagc

SEQ ID NO: 58924 - DNA, 15 bp, Homo sapiens
gttgttcaagccaag

SEQ ID NO: 58925 - DNA, 15 bp, Homo sapiens
tgttgttcaagccaa

SEQ ID NO: 58926 - DNA, 15 bp, Homo sapiens
ctgttgttcaagcca

SEQ ID NO: 58927 - DNA, 15 bp, Homo sapiens
tctgttgttcaagcc

SEQ ID NO: 58928 - DNA, 15 bp, Homo sapiens
ttctgttgttcaagc

SEQ ID NO: 58929 - DNA, 15 bp, Homo sapiens
tttctgttgttcaag

SEQ ID NO: 58930 - DNA, 15 bp, Homo sapiens
atttctgttgttcaa

SEQ ID NO: 58931 - DNA, 15 bp, Homo sapiens
aatttctgttgttca

SEQ ID NO: 58932 - DNA, 15 bp, Homo sapiens
aaatttctgttgttc

SEQ ID NO: 58933 - DNA, 15 bp, Homo sapiens
caaatttctgttgtt

SEQ ID NO: 58934 - DNA, 15 bp, Homo sapiens
acaaatttctgttgt

SEQ ID NO: 58935 - DNA, 15 bp, Homo sapiens
aacaaatttctgttg

SEQ ID NO: 58936 - DNA, 15 bp, Homo sapiens
caacaaatttctgtt

SEQ ID NO: 58937 - DNA, 15 bp, Homo sapiens
acaacaaatttctgt

SEQ ID NO: 58938 - DNA, 15 bp, Homo sapiens
gacaacaaatttctg

SEQ ID NO: 58939 - DNA, 15 bp, Homo sapiens
agacaacaaatttct

SEQ ID NO: 58940 - DNA, 15 bp, Homo sapiens
gagacaacaaatttc

SEQ ID NO: 58941 - DNA, 15 bp, Homo sapiens
ggagacaacaaattt

SEQ ID NO: 58942 - DNA, 15 bp, Homo sapiens
gggagacaacaaatt

SEQ ID NO: 58943 - DNA, 15 bp, Homo sapiens
tgggagacaacaaat

SEQ ID NO: 58944 - DNA, 15 bp, Homo sapiens
ctgggagacaacaaa

SEQ ID NO: 58945 - DNA, 15 bp, Homo sapiens
actgggagacaacaa

SEQ ID NO: 58946 - DNA, 15 bp, Homo sapiens
aactgggagacaaca

SEQ ID NO: 58947 - DNA, 15 bp, Homo sapiens
gaactgggagacaac

SEQ ID NO: 58948 - DNA, 15 bp, Homo sapiens
agaactgggagacaa

SEQ ID NO: 58949 - DNA, 15 bp, Homo sapiens
cagaactgggagaca

SEQ ID NO: 58950 - DNA, 15 bp, Homo sapiens
ccagaactgggagac

SEQ ID NO: 58951 - DNA, 15 bp, Homo sapiens
tccagaactgggaga

SEQ ID NO: 58952 - DNA, 15 bp, Homo sapiens
ctccagaactgggag

SEQ ID NO: 58953 - DNA, 15 bp, Homo sapiens
cctccagaactggga

SEQ ID NO: 58954 - DNA, 15 bp, Homo sapiens
gcctccagaactggg

SEQ ID NO: 58955 - DNA, 15 bp, Homo sapiens
ggcctccagaactgg

SEQ ID NO: 58956 - DNA, 15 bp, Homo sapiens
tggcctccagaactg

SEQ ID NO: 58957 - DNA, 15 bp, Homo sapiens
ctggcctccagaact

SEQ ID NO: 58958 - DNA, 15 bp, Homo sapiens
tctggcctccagaac

SEQ ID NO: 58959 - DNA, 15 bp, Homo sapiens
ttctggcctccagaa

SEQ ID NO: 58960 - DNA, 15 bp, Homo sapiens
cttctggcctccaga

SEQ ID NO: 58961 - DNA, 15 bp, Homo sapiens
acttctggcctccag

SEQ ID NO: 58962 - DNA, 15 bp, Homo sapiens
gacttctggcctcca

SEQ ID NO: 58963 - DNA, 15 bp, Homo sapiens
ggacttctggcctcc

SEQ ID NO: 58964 - DNA, 15 bp, Homo sapiens
tggacttctggcctc

SEQ ID NO: 58965 - DNA, 15 bp, Homo sapiens
ttggacttctggcct

SEQ ID NO: 58966 - DNA, 15 bp, Homo sapiens
cttggacttctggcc

SEQ ID NO: 58967 - DNA, 15 bp, Homo sapiens
tcttggacttctggc

SEQ ID NO: 58968 - DNA, 15 bp, Homo sapiens
atcttggacttctgg

SEQ ID NO: 58969 - DNA, 15 bp, Homo sapiens
gatcttggacttctg

SEQ ID NO: 58970 - DNA, 15 bp, Homo sapiens
tgatcttggacttct

SEQ ID NO: 58971 - DNA, 15 bp, Homo sapiens
ttgatcttggacttc

SEQ ID NO: 58972 - DNA, 15 bp, Homo sapiens
cttgatcttggactt

SEQ ID NO: 58973 - DNA, 15 bp, Homo sapiens
ccttgatcttggact

SEQ ID NO: 58974 - DNA, 15 bp, Homo sapiens
gccttgatcttggac

SEQ ID NO: 58975 - DNA, 15 bp, Homo sapiens
tgccttgatcttgga

SEQ ID NO: 58976 - DNA, 15 bp, Homo sapiens
atgccttgatcttgg

SEQ ID NO: 58977 - DNA, 15 bp, Homo sapiens
gatgccttgatcttg

SEQ ID NO: 58978 - DNA, 15 bp, Homo sapiens
tgatgccttgatctt

SEQ ID NO: 58979 - DNA, 15 bp, Homo sapiens
ctgatgccttgatct

SEQ ID NO: 58980 - DNA, 15 bp, Homo sapiens
gctgatgccttgatc

SEQ ID NO: 58981 - DNA, 15 bp, Homo sapiens
tgctgatgccttgat

SEQ ID NO: 58982 - DNA, 15 bp, Homo sapiens
ctgctgatgccttga

SEQ ID NO: 58983 - DNA, 15 bp, Homo sapiens
cctgctgatgccttg

SEQ ID NO: 58984 - DNA, 15 bp, Homo sapiens
ccctgctgatgcctt

SEQ ID NO: 58985 - DNA, 15 bp, Homo sapiens
accctgctgatgcct

SEQ ID NO: 58986 - DNA, 15 bp, Homo sapiens
aaccctgctgatgcc

SEQ ID NO: 58987 - DNA, 15 bp, Homo sapiens
caaccctgctgatgc

SEQ ID NO: 58988 - DNA, 15 bp, Homo sapiens
ccaaccctgctgatg

SEQ ID NO: 58989 - DNA, 15 bp, Homo sapiens
accaaccctgctgat

SEQ ID NO: 58990 - DNA, 15 bp, Homo sapiens
aaccaaccctgctga

SEQ ID NO: 58991 - DNA, 15 bp, Homo sapiens
aaaccaaccctgctg

SEQ ID NO: 58992 - DNA, 15 bp, Homo sapiens
aaaaccaaccctgct

SEQ ID NO: 58993 - DNA, 15 bp, Homo sapiens
aaaaaccaaccctgc

SEQ ID NO: 58994 - DNA, 15 bp, Homo sapiens
gaaaaaccaaccctg

SEQ ID NO: 58995 - DNA, 15 bp, Homo sapiens
ggaaaaaccaaccct

SEQ ID NO: 58996 - DNA, 15 bp, Homo sapiens
aggaaaaaccaaccc

SEQ ID NO: 58997 - DNA, 15 bp, Homo sapiens
caggaaaaaccaacc

SEQ ID NO: 58998 - DNA, 15 bp, Homo sapiens
tcaggaaaaaccaac

SEQ ID NO: 58999 - DNA, 15 bp, Homo sapiens
ctcaggaaaaaccaa

SEQ ID NO: 59000 - DNA, 15 bp, Homo sapiens
cctcaggaaaaacca

SEQ ID NO: 59001 - DNA, 15 bp, Homo sapiens
ccctcaggaaaaacc

SEQ ID NO: 59002 - DNA, 15 bp, Homo sapiens
gccctcaggaaaaac

SEQ ID NO: 59003 - DNA, 15 bp, Homo sapiens
agccctcaggaaaaa

SEQ ID NO: 59004 - DNA, 15 bp, Homo sapiens
gagccctcaggaaaa

SEQ ID NO: 59005 - DNA, 15 bp, Homo sapiens
agagccctcaggaaa

SEQ ID NO: 59006 - DNA, 15 bp, Homo sapiens
cagagccctcaggaa

SEQ ID NO: 59007 - DNA, 15 bp, Homo sapiens
tcagagccctcagga

SEQ ID NO: 59008 - DNA, 15 bp, Homo sapiens
ctcagagccctcagg

SEQ ID NO: 59009 - DNA, 15 bp, Homo sapiens
cctcagagccctcag

SEQ ID NO: 59010 - DNA, 15 bp, Homo sapiens
ccctcagagccctca

SEQ ID NO: 59011 - DNA, 15 bp, Homo sapiens
tccctcagagccctc

SEQ ID NO: 59012 - DNA, 15 bp, Homo sapiens
ctccctcagagccct

SEQ ID NO: 59013 - DNA, 15 bp, Homo sapiens
tctccctcagagccc

SEQ ID NO: 59014 - DNA, 15 bp, Homo sapiens
gtctccctcagagcc

SEQ ID NO: 59015 - DNA, 15 bp, Homo sapiens
agtctccctcagagc

SEQ ID NO: 59016 - DNA, 15 bp, Homo sapiens
gagtctccctcagag

SEQ ID NO: 59017 - DNA, 15 bp, Homo sapiens
agagtctccctcaga

SEQ ID NO: 59018 - DNA, 15 bp, Homo sapiens
cagagtctccctcag

SEQ ID NO: 59019 - DNA, 15 bp, Homo sapiens
tcagagtctccctca

SEQ ID NO: 59020 - DNA, 15 bp, Homo sapiens
atcagagtctccctc

SEQ ID NO: 59021 - DNA, 15 bp, Homo sapiens
gatcagagtctccct

SEQ ID NO: 59022 - DNA, 15 bp, Homo sapiens
ggatcagagtctccc

SEQ ID NO: 59023 - DNA, 15 bp, Homo sapiens
tggatcagagtctcc

SEQ ID NO: 59024 - DNA, 15 bp, Homo sapiens
ctggatcagagtctc

SEQ ID NO: 59025 - DNA, 15 bp, Homo sapiens
cctggatcagagtct

SEQ ID NO: 59026 - DNA, 15 bp, Homo sapiens
gcctggatcagagtc

SEQ ID NO: 59027 - DNA, 15 bp, Homo sapiens
ggcctggatcagagt

SEQ ID NO: 59028 - DNA, 15 bp, Homo sapiens
aggcctggatcagag

SEQ ID NO: 59029 - DNA, 15 bp, Homo sapiens
aaggcctggatcaga

SEQ ID NO: 59030 - DNA, 15 bp, Homo sapiens
caaggcctggatcag

SEQ ID NO: 59031 - DNA, 15 bp, Homo sapiens
gcaaggcctggatca

SEQ ID NO: 59032 - DNA, 15 bp, Homo sapiens
ggcaaggcctggatc

SEQ ID NO: 59033 - DNA, 15 bp, Homo sapiens
gggcaaggcctggat

SEQ ID NO: 59034 - DNA, 15 bp, Homo sapiens
ggggcaaggcctgga

SEQ ID NO: 59035 - DNA, 15 bp, Homo sapiens
gggggcaaggcctgg

SEQ ID NO: 59036 - DNA, 15 bp, Homo sapiens
tgggggcaaggcctg

SEQ ID NO: 59037 - DNA, 15 bp, Homo sapiens
ttgggggcaaggcct

SEQ ID NO: 59038 - DNA, 15 bp, Homo sapiens
tttgggggcaaggcc

SEQ ID NO: 59039 - DNA, 15 bp, Homo sapiens
atttgggggcaaggc

SEQ ID NO: 59040 - DNA, 15 bp, Homo sapiens
aatttgggggcaagg

SEQ ID NO: 59041 - DNA, 15 bp, Homo sapiens
gaatttgggggcaag

SEQ ID NO: 59042 - DNA, 15 bp, Homo sapiens
agaatttgggggcaa

SEQ ID NO: 59043 - DNA, 15 bp, Homo sapiens
cagaatttgggggca

SEQ ID NO: 59044 - DNA, 15 bp, Homo sapiens
ccagaatttgggggc

SEQ ID NO: 59045 - DNA, 15 bp, Homo sapiens
accagaatttggggg

SEQ ID NO: 59046 - DNA, 15 bp, Homo sapiens
caccagaatttgggg

SEQ ID NO: 59047 - DNA, 15 bp, Homo sapiens
ccaccagaatttggg

SEQ ID NO: 59048 - DNA, 15 bp, Homo sapiens
accaccagaatttgg

SEQ ID NO: 59049 - DNA, 15 bp, Homo sapiens
aaccaccagaatttg

SEQ ID NO: 59050 - DNA, 15 bp, Homo sapiens
aaaccaccagaattt

SEQ ID NO: 59051 - DNA, 15 bp, Homo sapiens
caaaccaccagaatt

SEQ ID NO: 59052 - DNA, 15 bp, Homo sapiens
acaaaccaccagaat

SEQ ID NO: 59053 - DNA, 15 bp, Homo sapiens
gacaaaccaccagaa

SEQ ID NO: 59054 - DNA, 15 bp, Homo sapiens
agacaaaccaccaga

SEQ ID NO: 59055 - DNA, 15 bp, Homo sapiens
cagacaaaccaccag

SEQ ID NO: 59056 - DNA, 15 bp, Homo sapiens
gcagacaaaccacca

SEQ ID NO: 59057 - DNA, 15 bp, Homo sapiens
tgcagacaaaccacc

SEQ ID NO: 59058 - DNA, 15 bp, Homo sapiens
ttgcagacaaaccac

SEQ ID NO: 59059 - DNA, 15 bp, Homo sapiens
attgcagacaaacca

SEQ ID NO: 59060 - DNA, 15 bp, Homo sapiens
aattgcagacaaacc

SEQ ID NO: 59061 - DNA, 15 bp, Homo sapiens
aaattgcagacaaac

SEQ ID NO: 59062 - DNA, 15 bp, Homo sapiens
aaaattgcagacaaa

SEQ ID NO: 59063 - DNA, 15 bp, Homo sapiens
aaaaattgcagacaa

SEQ ID NO: 59064 - DNA, 15 bp, Homo sapiens
caaaaattgcagaca

SEQ ID NO: 59065 - DNA, 15 bp, Homo sapiens
gcaaaaattgcagac

SEQ ID NO: 59066 - DNA, 15 bp, Homo sapiens
tgcaaaaattgcaga

SEQ ID NO: 59067 - DNA, 15 bp, Homo sapiens
ctgcaaaaattgcag

SEQ ID NO: 59068 - DNA, 15 bp, Homo sapiens
actgcaaaaattgca

SEQ ID NO: 59069 - DNA, 15 bp, Homo sapiens
aactgcaaaaattgc

SEQ ID NO: 59070 - DNA, 15 bp, Homo sapiens
gaactgcaaaaattg

SEQ ID NO: 59071 - DNA, 15 bp, Homo sapiens
ggaactgcaaaaatt

SEQ ID NO: 59072 - DNA, 15 bp, Homo sapiens
aggaactgcaaaaat

SEQ ID NO: 59073 - DNA, 15 bp, Homo sapiens
aaggaactgcaaaaa

SEQ ID NO: 59074 - DNA, 15 bp, Homo sapiens
caaggaactgcaaaa

SEQ ID NO: 59075 - DNA, 15 bp, Homo sapiens
ccaaggaactgcaaa

SEQ ID NO: 59076 - DNA, 15 bp, Homo sapiens
gccaaggaactgcaa

SEQ ID NO: 59077 - DNA, 15 bp, Homo sapiens
ggccaaggaactgca

SEQ ID NO: 59078 - DNA, 15 bp, Homo sapiens
aggccaaggaactgc

SEQ ID NO: 59079 - DNA, 15 bp, Homo sapiens
caggccaaggaactg

SEQ ID NO: 59080 - DNA, 15 bp, Homo sapiens
acaggccaaggaact

SEQ ID NO: 59081 - DNA, 15 bp, Homo sapiens
cacaggccaaggaac

SEQ ID NO: 59082 - DNA, 15 bp, Homo sapiens
tcacaggccaaggaa

SEQ ID NO: 59083 - DNA, 15 bp, Homo sapiens
atcacaggccaagga

SEQ ID NO: 59084 - DNA, 15 bp, Homo sapiens
tatcacaggccaagg

SEQ ID NO: 59085 - DNA, 15 bp, Homo sapiens
ttatcacaggccaag

SEQ ID NO: 59086 - DNA, 15 bp, Homo sapiens
gttatcacaggccaa

SEQ ID NO: 59087 - DNA, 15 bp, Homo sapiens
tgttatcacaggcca

SEQ ID NO: 59088 - DNA, 15 bp, Homo sapiens
atgttatcacaggcc

SEQ ID NO: 59089 - DNA, 15 bp, Homo sapiens
tatgttatcacaggc

SEQ ID NO: 59090 - DNA, 15 bp, Homo sapiens
ctatgttatcacagg

SEQ ID NO: 59091 - DNA, 15 bp, Homo sapiens
gctatgttatcacag

SEQ ID NO: 59092 - DNA, 15 bp, Homo sapiens
agctatgttatcaca

SEQ ID NO: 59093 - DNA, 15 bp, Homo sapiens
gagctatgttatcac

SEQ ID NO: 59094 - DNA, 15 bp, Homo sapiens
ggagctatgttatca

SEQ ID NO: 59095 - DNA, 15 bp, Homo sapiens
tggagctatgttatc

SEQ ID NO: 59096 - DNA, 15 bp, Homo sapiens
ctggagctatgttat

SEQ ID NO: 59097 - DNA, 15 bp, Homo sapiens
actggagctatgtta

SEQ ID NO: 59098 - DNA, 15 bp, Homo sapiens
cactggagctatgtt

SEQ ID NO: 59099 - DNA, 15 bp, Homo sapiens
acactggagctatgt

SEQ ID NO: 59100 - DNA, 15 bp, Homo sapiens
aacactggagctatg

SEQ ID NO: 59101 - DNA, 15 bp, Homo sapiens
caacactggagctat

SEQ ID NO: 59102 - DNA, 15 bp, Homo sapiens
tcaacactggagcta

SEQ ID NO: 59103 - DNA, 15 bp, Homo sapiens
gtcaacactggagct

SEQ ID NO: 59104 - DNA, 15 bp, Homo sapiens
cgtcaacactggagc

SEQ ID NO: 59105 - DNA, 15 bp, Homo sapiens
acgtcaacactggag

SEQ ID NO: 59106 - DNA, 15 bp, Homo sapiens
cacgtcaacactgga

SEQ ID NO: 59107 - DNA, 15 bp, Homo sapiens
ccacgtcaacactgg

SEQ ID NO: 59108 - DNA, 15 bp, Homo sapiens
accacgtcaacactg

SEQ ID NO: 59109 - DNA, 15 bp, Homo sapiens
caccacgtcaacact

SEQ ID NO: 59110 - DNA, 15 bp, Homo sapiens
acaccacgtcaacac

SEQ ID NO: 59111 - DNA, 15 bp, Homo sapiens
aacaccacgtcaaca

SEQ ID NO: 59112 - DNA, 15 bp, Homo sapiens
gaacaccacgtcaac

SEQ ID NO: 59113 - DNA, 15 bp, Homo sapiens
agaacaccacgtcaa

SEQ ID NO: 59114 - DNA, 15 bp, Homo sapiens
gagaacaccacgtca

SEQ ID NO: 59115 - DNA, 15 bp, Homo sapiens
ggagaacaccacgtc

SEQ ID NO: 59116 - DNA, 15 bp, Homo sapiens
gggagaacaccacgt

SEQ ID NO: 59117 - DNA, 15 bp, Homo sapiens
agggagaacaccacg

SEQ ID NO: 59118 - DNA, 15 bp, Homo sapiens
cagggagaacaccac

SEQ ID NO: 59119 - DNA, 15 bp, Homo sapiens
acagggagaacacca

SEQ ID NO: 59120 - DNA, 15 bp, Homo sapiens
cacagggagaacacc

SEQ ID NO: 59121 - DNA, 15 bp, Homo sapiens
acacagggagaacac

SEQ ID NO: 59122 - DNA, 15 bp, Homo sapiens
cacacagggagaaca

SEQ ID NO: 59123 - DNA, 15 bp, Homo sapiens
gcacacagggagaac

SEQ ID NO: 59124 - DNA, 15 bp, Homo sapiens
tgcacacagggagaa

SEQ ID NO: 59125 - DNA, 15 bp, Homo sapiens
atgcacacagggaga

SEQ ID NO: 59126 - DNA, 15 bp, Homo sapiens
tatgcacacagggag

SEQ ID NO: 59127 - DNA, 15 bp, Homo sapiens
atatgcacacaggga

SEQ ID NO: 59128 - DNA, 15 bp, Homo sapiens
gatatgcacacaggg

SEQ ID NO: 59129 - DNA, 15 bp, Homo sapiens
agatatgcacacagg

SEQ ID NO: 59130 - DNA, 15 bp, Homo sapiens
cagatatgcacacag

SEQ ID NO: 59131 - DNA, 15 bp, Homo sapiens
acagatatgcacaca

SEQ ID NO: 59132 - DNA, 15 bp, Homo sapiens
gacagatatgcacac

SEQ ID NO: 59133 - DNA, 15 bp, Homo sapiens
tgacagatatgcaca

SEQ ID NO: 59134 - DNA, 15 bp, Homo sapiens
ttgacagatatgcac

SEQ ID NO: 59135 - DNA, 15 bp, Homo sapiens
tttgacagatatgca

SEQ ID NO: 59136 - DNA, 15 bp, Homo sapiens
atttgacagatatgc

SEQ ID NO: 59137 - DNA, 15 bp, Homo sapiens
aatttgacagatatg

SEQ ID NO: 59138 - DNA, 15 bp, Homo sapiens
aaatttgacagatat

SEQ ID NO: 59139 - DNA, 15 bp, Homo sapiens
gaaatttgacagata

SEQ ID NO: 59140 - DNA, 15 bp, Homo sapiens
ggaaatttgacagat

SEQ ID NO: 59141 - DNA, 15 bp, Homo sapiens
aggaaatttgacaga

SEQ ID NO: 59142 - DNA, 15 bp, Homo sapiens
gaggaaatttgacag

SEQ ID NO: 59143 - DNA, 15 bp, Homo sapiens
agaggaaatttgaca

SEQ ID NO: 59144 - DNA, 15 bp, Homo sapiens
aagaggaaatttgac

SEQ ID NO: 59145 - DNA, 15 bp, Homo sapiens
aaagaggaaatttga

SEQ ID NO: 59146 - DNA, 15 bp, Homo sapiens
aaaagaggaaatttg

SEQ ID NO: 59147 - DNA, 15 bp, Homo sapiens
aaaaagaggaaattt

SEQ ID NO: 59148 - DNA, 15 bp, Homo sapiens
caaaaagaggaaatt

SEQ ID NO: 59149 - DNA, 15 bp, Homo sapiens
acaaaaagaggaaat

SEQ ID NO: 59150 - DNA, 15 bp, Homo sapiens
tacaaaaagaggaaa

SEQ ID NO: 59151 - DNA, 15 bp, Homo sapiens
ttacaaaaagaggaa

SEQ ID NO: 59152 - DNA, 15 bp, Homo sapiens
cttacaaaaagagga

SEQ ID NO: 59153 - DNA, 15 bp, Homo sapiens
ccttacaaaaagagg

SEQ ID NO: 59154 - DNA, 15 bp, Homo sapiens
tccttacaaaaagag

SEQ ID NO: 59155 - DNA, 15 bp, Homo sapiens
gtccttacaaaaaga

SEQ ID NO: 59156 - DNA, 15 bp, Homo sapiens
tgtccttacaaaaag

SEQ ID NO: 59157 - DNA, 15 bp, Homo sapiens
atgtccttacaaaaa

SEQ ID NO: 59158 - DNA, 15 bp, Homo sapiens
gatgtccttacaaaa

SEQ ID NO: 59159 - DNA, 15 bp, Homo sapiens
tgatgtccttacaaa

SEQ ID NO: 59160 - DNA, 15 bp, Homo sapiens
ctgatgtccttacaa

SEQ ID NO: 59161 - DNA, 15 bp, Homo sapiens
actgatgtccttaca

SEQ ID NO: 59162 - DNA, 15 bp, Homo sapiens
gactgatgtccttac

SEQ ID NO: 59163 - DNA, 15 bp, Homo sapiens
tgactgatgtcctta

SEQ ID NO: 59164 - DNA, 15 bp, Homo sapiens
atgactgatgtcctt

SEQ ID NO: 59165 - DNA, 15 bp, Homo sapiens
tatgactgatgtcct

SEQ ID NO: 59166 - DNA, 15 bp, Homo sapiens
atatgactgatgtcc

SEQ ID NO: 59167 - DNA, 15 bp, Homo sapiens
aatatgactgatgtc

SEQ ID NO: 59168 - DNA, 15 bp, Homo sapiens
caatatgactgatgt

SEQ ID NO: 59169 - DNA, 15 bp, Homo sapiens
ccaatatgactgatg

SEQ ID NO: 59170 - DNA, 15 bp, Homo sapiens
tccaatatgactgat

SEQ ID NO: 59171 - DNA, 15 bp, Homo sapiens
atccaatatgactga

SEQ ID NO: 59172 - DNA, 15 bp, Homo sapiens
aatccaatatgactg

SEQ ID NO: 59173 - DNA, 15 bp, Homo sapiens
aaatccaatatgact

SEQ ID NO: 59174 - DNA, 15 bp, Homo sapiens
taaatccaatatgac

SEQ ID NO: 59175 - DNA, 15 bp, Homo sapiens
ctaaatccaatatga

SEQ ID NO: 59176 - DNA, 15 bp, Homo sapiens
cctaaatccaatatg

SEQ ID NO: 59177 - DNA, 15 bp, Homo sapiens
ccctaaatccaatat

SEQ ID NO: 59178 - DNA, 15 bp, Homo sapiens
gccctaaatccaata

SEQ ID NO: 59179 - DNA, 15 bp, Homo sapiens
ggccctaaatccaat

SEQ ID NO: 59180 - DNA, 15 bp, Homo sapiens
gggccctaaatccaa

SEQ ID NO: 59181 - DNA, 15 bp, Homo sapiens
tgggccctaaatcca

SEQ ID NO: 59182 - DNA, 15 bp, Homo sapiens
gtgggccctaaatcc

SEQ ID NO: 59183 - DNA, 15 bp, Homo sapiens
tgtgggccctaaatc

SEQ ID NO: 59184 - DNA, 15 bp, Homo sapiens
atgtgggccctaaat

SEQ ID NO: 59185 - DNA, 15 bp, Homo sapiens
aatgtgggccctaaa

SEQ ID NO: 59186 - DNA, 15 bp, Homo sapiens
taatgtgggccctaa

SEQ ID NO: 59187 - DNA, 15 bp, Homo sapiens
gtaatgtgggcccta

SEQ ID NO: 59188 - DNA, 15 bp, Homo sapiens
agtaatgtgggccct

SEQ ID NO: 59189 - DNA, 15 bp, Homo sapiens
gagtaatgtgggccc

SEQ ID NO: 59190 - DNA, 15 bp, Homo sapiens
ggagtaatgtgggcc

SEQ ID NO: 59191 - DNA, 15 bp, Homo sapiens
aggagtaatgtgggc

SEQ ID NO: 59192 - DNA, 15 bp, Homo sapiens
caggagtaatgtggg

SEQ ID NO: 59193 - DNA, 15 bp, Homo sapiens
acaggagtaatgtgg

SEQ ID NO: 59194 - DNA, 15 bp, Homo sapiens
tacaggagtaatgtg

SEQ ID NO: 59195 - DNA, 15 bp, Homo sapiens
atacaggagtaatgt

SEQ ID NO: 59196 - DNA, 15 bp, Homo sapiens
catacaggagtaatg

SEQ ID NO: 59197 - DNA, 15 bp, Homo sapiens
tcatacaggagtaat

SEQ ID NO: 59198 - DNA, 15 bp, Homo sapiens
gtcatacaggagtaa

SEQ ID NO: 59199 - DNA, 15 bp, Homo sapiens
ggtcatacaggagta

SEQ ID NO: 59200 - DNA, 15 bp, Homo sapiens
aggtcatacaggagt

SEQ ID NO: 59201 - DNA, 15 bp, Homo sapiens
gaggtcatacaggag

SEQ ID NO: 59202 - DNA, 15 bp, Homo sapiens
tgaggtcatacagga

SEQ ID NO: 59203 - DNA, 15 bp, Homo sapiens
atgaggtcatacagg

SEQ ID NO: 59204 - DNA, 15 bp, Homo sapiens
aatgaggtcatacag

SEQ ID NO: 59205 - DNA, 15 bp, Homo sapiens
gaatgaggtcataca

SEQ ID NO: 59206 - DNA, 15 bp, Homo sapiens
agaatgaggtcatac

SEQ ID NO: 59207 - DNA, 15 bp, Homo sapiens
tagaatgaggtcata

SEQ ID NO: 59208 - DNA, 15 bp, Homo sapiens
ttagaatgaggtcat

SEQ ID NO: 59209 - DNA, 15 bp, Homo sapiens
gttagaatgaggtca

SEQ ID NO: 59210 - DNA, 15 bp, Homo sapiens
agttagaatgaggtc

SEQ ID NO: 59211 - DNA, 15 bp, Homo sapiens
tagttagaatgaggt

SEQ ID NO: 59212 - DNA, 15 bp, Homo sapiens
ctagttagaatgagg

SEQ ID NO: 59213 - DNA, 15 bp, Homo sapiens
actagttagaatgag

SEQ ID NO: 59214 - DNA, 15 bp, Homo sapiens
cactagttagaatga

SEQ ID NO: 59215 - DNA, 15 bp, Homo sapiens
tcactagttagaatg

SEQ ID NO: 59216 - DNA, 15 bp, Homo sapiens
gtcactagttagaat

SEQ ID NO: 59217 - DNA, 15 bp, Homo sapiens
tgtcactagttagaa

SEQ ID NO: 59218 - DNA, 15 bp, Homo sapiens
atgtcactagttaga

SEQ ID NO: 59219 - DNA, 15 bp, Homo sapiens
gatgtcactagttag

SEQ ID NO: 59220 - DNA, 15 bp, Homo sapiens
agatgtcactagtta

SEQ ID NO: 59221 - DNA, 15 bp, Homo sapiens
cagatgtcactagtt

SEQ ID NO: 59222 - DNA, 15 bp, Homo sapiens
gcagatgtcactagt

SEQ ID NO: 59223 - DNA, 15 bp, Homo sapiens
tgcagatgtcactag

SEQ ID NO: 59224 - DNA, 15 bp, Homo sapiens
ttgcagatgtcacta

SEQ ID NO: 59225 - DNA, 15 bp, Homo sapiens
attgcagatgtcact

SEQ ID NO: 59226 - DNA, 15 bp, Homo sapiens
cattgcagatgtcac

SEQ ID NO: 59227 - DNA, 15 bp, Homo sapiens
tcattgcagatgtca

SEQ ID NO: 59228 - DNA, 15 bp, Homo sapiens
gtcattgcagatgtc

SEQ ID NO: 59229 - DNA, 15 bp, Homo sapiens
ggtcattgcagatgt

SEQ ID NO: 59230 - DNA, 15 bp, Homo sapiens
aggtcattgcagatg

SEQ ID NO: 59231 - DNA, 15 bp, Homo sapiens
aaggtcattgcagat

SEQ ID NO: 59232 - DNA, 15 bp, Homo sapiens
taaggtcattgcaga

SEQ ID NO: 59233 - DNA, 15 bp, Homo sapiens
ataaggtcattgcag

SEQ ID NO: 59234 - DNA, 15 bp, Homo sapiens
aataaggtcattgca

SEQ ID NO: 59235 - DNA, 15 bp, Homo sapiens
aaataaggtcattgc

SEQ ID NO: 59236 - DNA, 15 bp, Homo sapiens
gaaataaggtcattg

SEQ ID NO: 59237 - DNA, 15 bp, Homo sapiens
ggaaataaggtcatt

SEQ ID NO: 59238 - DNA, 15 bp, Homo sapiens
tggaaataaggtcat

SEQ ID NO: 59239 - DNA, 15 bp, Homo sapiens
ttggaaataaggtca

SEQ ID NO: 59240 - DNA, 15 bp, Homo sapiens
tttggaaataaggtc

SEQ ID NO: 59241 - DNA, 15 bp, Homo sapiens
atttggaaataaggt

SEQ ID NO: 59242 - DNA, 15 bp, Homo sapiens
tatttggaaataagg

SEQ ID NO: 59243 - DNA, 15 bp, Homo sapiens
ctatttggaaataag

SEQ ID NO: 59244 - DNA, 15 bp, Homo sapiens
tctatttggaaataa

SEQ ID NO: 59245 - DNA, 15 bp, Homo sapiens
ctctatttggaaata

SEQ ID NO: 59246 - DNA, 15 bp, Homo sapiens
gctctatttggaaat

SEQ ID NO: 59247 - DNA, 15 bp, Homo sapiens
ggctctatttggaaa

SEQ ID NO: 59248 - DNA, 15 bp, Homo sapiens
gggctctatttggaa

SEQ ID NO: 59249 - DNA, 15 bp, Homo sapiens
ggggctctatttgga

SEQ ID NO: 59250 - DNA, 15 bp, Homo sapiens
aggggctctatttgg

SEQ ID NO: 59251 - DNA, 15 bp, Homo sapiens
gaggggctctatttg

SEQ ID NO: 59252 - DNA, 15 bp, Homo sapiens
agaggggctctattt

SEQ ID NO: 59253 - DNA, 15 bp, Homo sapiens
gagaggggctctatt

SEQ ID NO: 59254 - DNA, 15 bp, Homo sapiens
agagaggggctctat

SEQ ID NO: 59255 - DNA, 15 bp, Homo sapiens
cagagaggggctcta

SEQ ID NO: 59256 - DNA, 15 bp, Homo sapiens
tcagagaggggctct

SEQ ID NO: 59257 - DNA, 15 bp, Homo sapiens
ttcagagaggggctc

SEQ ID NO: 59258 - DNA, 15 bp, Homo sapiens
cttcagagaggggct

SEQ ID NO: 59259 - DNA, 15 bp, Homo sapiens
acttcagagaggggc

SEQ ID NO: 59260 - DNA, 15 bp, Homo sapiens
tacttcagagagggg

SEQ ID NO: 59261 - DNA, 15 bp, Homo sapiens
gtacttcagagaggg

SEQ ID NO: 59262 - DNA, 15 bp, Homo sapiens
agtacttcagagagg

SEQ ID NO: 59263 - DNA, 15 bp, Homo sapiens
cagtacttcagagag

SEQ ID NO: 59264 - DNA, 15 bp, Homo sapiens
tcagtacttcagaga

SEQ ID NO: 59265 - DNA, 15 bp, Homo sapiens
ctcagtacttcagag

SEQ ID NO: 59266 - DNA, 15 bp, Homo sapiens
cctcagtacttcaga

SEQ ID NO: 59267 - DNA, 15 bp, Homo sapiens
ccctcagtacttcag

SEQ ID NO: 59268 - DNA, 15 bp, Homo sapiens
accctcagtacttca

SEQ ID NO: 59269 - DNA, 15 bp, Homo sapiens
aaccctcagtacttc

SEQ ID NO: 59270 - DNA, 15 bp, Homo sapiens
taaccctcagtactt

SEQ ID NO: 59271 - DNA, 15 bp, Homo sapiens
ctaaccctcagtact

SEQ ID NO: 59272 - DNA, 15 bp, Homo sapiens
cctaaccctcagtac

SEQ ID NO: 59273 - DNA, 15 bp, Homo sapiens
tcctaaccctcagta

SEQ ID NO: 59274 - DNA, 15 bp, Homo sapiens
gtcctaaccctcagt

SEQ ID NO: 59275 - DNA, 15 bp, Homo sapiens
agtcctaaccctcag

SEQ ID NO: 59276 - DNA, 15 bp, Homo sapiens
aagtcctaaccctca

SEQ ID NO: 59277 - DNA, 15 bp, Homo sapiens
gaagtcctaaccctc

SEQ ID NO: 59278 - DNA, 15 bp, Homo sapiens
tgaagtcctaaccct

SEQ ID NO: 59279 - DNA, 15 bp, Homo sapiens
ttgaagtcctaaccc

SEQ ID NO: 59280 - DNA, 15 bp, Homo sapiens
gttgaagtcctaacc

SEQ ID NO: 59281 - DNA, 15 bp, Homo sapiens
tgttgaagtcctaac

SEQ ID NO: 59282 - DNA, 15 bp, Homo sapiens
atgttgaagtcctaa

SEQ ID NO: 59283 - DNA, 15 bp, Homo sapiens
tatgttgaagtccta

SEQ ID NO: 59284 - DNA, 15 bp, Homo sapiens
atatgttgaagtcct

SEQ ID NO: 59285 - DNA, 15 bp, Homo sapiens
aatatgttgaagtcc

SEQ ID NO: 59286 - DNA, 15 bp, Homo sapiens
taatatgttgaagtc

SEQ ID NO: 59287 - DNA, 15 bp, Homo sapiens
ttaatatgttgaagt

SEQ ID NO: 59288 - DNA, 15 bp, Homo sapiens
attaatatgttgaag

SEQ ID NO: 59289 - DNA, 15 bp, Homo sapiens
aattaatatgttgaa

SEQ ID NO: 59290 - DNA, 15 bp, Homo sapiens
aaattaatatgttga

SEQ ID NO: 59291 - DNA, 15 bp, Homo sapiens
aaaattaatatgttg

SEQ ID NO: 59292 - DNA, 15 bp, Homo sapiens
taaaattaatatgtt

SEQ ID NO: 59293 - DNA, 15 bp, Homo sapiens
ctaaaattaatatgt

SEQ ID NO: 59294 - DNA, 15 bp, Homo sapiens
tctaaaattaatatg

SEQ ID NO: 59295 - DNA, 15 bp, Homo sapiens
ctctaaaattaatat

SEQ ID NO: 59296 - DNA, 15 bp, Homo sapiens
tctctaaaattaata

SEQ ID NO: 59297 - DNA, 15 bp, Homo sapiens
ttctctaaaattaat

SEQ ID NO: 59298 - DNA, 15 bp, Homo sapiens
gttctctaaaattaa

SEQ ID NO: 59299 - DNA, 15 bp, Homo sapiens
tgttctctaaaatta

SEQ ID NO: 59300 - DNA, 15 bp, Homo sapiens
atgttctctaaaatt

SEQ ID NO: 59301 - DNA, 15 bp, Homo sapiens
tatgttctctaaaat

SEQ ID NO: 59302 - DNA, 15 bp, Homo sapiens
ttatgttctctaaaa

SEQ ID NO: 59303 - DNA, 15 bp, Homo sapiens
attatgttctctaaa

SEQ ID NO: 59304 - DNA, 15 bp, Homo sapiens
aattatgttctctaa

SEQ ID NO: 59305 - DNA, 15 bp, Homo sapiens
gaattatgttctcta

SEQ ID NO: 59306 - DNA, 15 bp, Homo sapiens
tgaattatgttctct

SEQ ID NO: 59307 - DNA, 15 bp, Homo sapiens
ttgaattatgttctc

SEQ ID NO: 59308 - DNA, 15 bp, Homo sapiens
gttgaattatgttct

SEQ ID NO: 59309 - DNA, 15 bp, Homo sapiens
agttgaattatgttc

SEQ ID NO: 59310 - DNA, 15 bp, Homo sapiens
gagttgaattatgtt

SEQ ID NO: 59311 - DNA, 15 bp, Homo sapiens
tgagttgaattatgt

SEQ ID NO: 59312 - DNA, 15 bp, Homo sapiens
atgagttgaattatg

SEQ ID NO: 59313 - DNA, 15 bp, Homo sapiens
tatgagttgaattat

SEQ ID NO: 59314 - DNA, 15 bp, Homo sapiens
ttatgagttgaatta

SEQ ID NO: 59315 - DNA, 15 bp, Homo sapiens
gttatgagttgaatt

SEQ ID NO: 59316 - DNA, 15 bp, Homo sapiens
tgttatgagttgaat

SEQ ID NO: 59317 - DNA, 15 bp, Homo sapiens
ttgttatgagttgaa

SEQ ID NO: 59318 - DNA, 15 bp, Homo sapiens
attgttatgagttga

SEQ ID NO: 59319 - DNA, 15 bp, Homo sapiens
aattgttatgagttg

SEQ ID NO: 59320 - DNA, 15 bp, Homo sapiens
aaattgttatgagtt

SEQ ID NO: 59321 - DNA, 15 bp, Homo sapiens
aaaattgttatgagt

SEQ ID NO: 59322 - DNA, 15 bp, Homo sapiens
gaaaattgttatgag

SEQ ID NO: 59323 - DNA, 15 bp, Homo sapiens
tgaaaattgttatga

SEQ ID NO: 59324 - DNA, 15 bp, Homo sapiens
ttgaaaattgttatg

SEQ ID NO: 59325 - DNA, 15 bp, Homo sapiens
attgaaaattgttat

SEQ ID NO: 59326 - DNA, 15 bp, Homo sapiens
cattgaaaattgtta

SEQ ID NO: 59327 - DNA, 15 bp, Homo sapiens
ccattgaaaattgtt

SEQ ID NO: 59328 - DNA, 15 bp, Homo sapiens
tccattgaaaattgt

SEQ ID NO: 59329 - DNA, 15 bp, Homo sapiens
ttccattgaaaattg

SEQ ID NO: 59330 - DNA, 15 bp, Homo sapiens
cttccattgaaaatt

SEQ ID NO: 59331 - DNA, 15 bp, Homo sapiens
tcttccattgaaaat

SEQ ID NO: 59332 - DNA, 15 bp, Homo sapiens
ctcttccattgaaaa

SEQ ID NO: 59333 - DNA, 15 bp, Homo sapiens
cctcttccattgaaa

SEQ ID NO: 59334 - DNA, 15 bp, Homo sapiens
gcctcttccattgaa

SEQ ID NO: 59335 - DNA, 15 bp, Homo sapiens
agcctcttccattga

SEQ ID NO: 59336 - DNA, 15 bp, Homo sapiens
cagcctcttccattg

SEQ ID NO: 59337 - DNA, 15 bp, Homo sapiens
tcagcctcttccatt

SEQ ID NO: 59338 - DNA, 15 bp, Homo sapiens
gtcagcctcttccat

SEQ ID NO: 59339 - DNA, 15 bp, Homo sapiens
tgtcagcctcttcca

SEQ ID NO: 59340 - DNA, 15 bp, Homo sapiens
ttgtcagcctcttcc

SEQ ID NO: 59341 - DNA, 15 bp, Homo sapiens
tttgtcagcctcttc

SEQ ID NO: 59342 - DNA, 15 bp, Homo sapiens
ttttgtcagcctctt

SEQ ID NO: 59343 - DNA, 15 bp, Homo sapiens
attttgtcagcctct

SEQ ID NO: 59344 - DNA, 15 bp, Homo sapiens
cattttgtcagcctc

SEQ ID NO: 59345 - DNA, 15 bp, Homo sapiens
gcattttgtcagcct

SEQ ID NO: 59346 - DNA, 15 bp, Homo sapiens
ggcattttgtcagcc

SEQ ID NO: 59347 - DNA, 15 bp, Homo sapiens
gggcattttgtcagc

SEQ ID NO: 59348 - DNA, 15 bp, Homo sapiens
agggcattttgtcag

SEQ ID NO: 59349 - DNA, 15 bp, Homo sapiens
tagggcattttgtca

SEQ ID NO: 59350 - DNA, 15 bp, Homo sapiens
atagggcattttgtc

SEQ ID NO: 59351 - DNA, 15 bp, Homo sapiens
aatagggcattttgt

SEQ ID NO: 59352 - DNA, 15 bp, Homo sapiens
aaatagggcattttg

SEQ ID NO: 59353 - DNA, 15 bp, Homo sapiens
aaaatagggcatttt

SEQ ID NO: 59354 - DNA, 15 bp, Homo sapiens
gaaaatagggcattt

SEQ ID NO: 59355 - DNA, 15 bp, Homo sapiens
ggaaaatagggcatt

SEQ ID NO: 59356 - DNA, 15 bp, Homo sapiens
aggaaaatagggcat

SEQ ID NO: 59357 - DNA, 15 bp, Homo sapiens
caggaaaatagggca

SEQ ID NO: 59358 - DNA, 15 bp, Homo sapiens
ccaggaaaatagggc

SEQ ID NO: 59359 - DNA, 15 bp, Homo sapiens
gccaggaaaataggg

SEQ ID NO: 59360 - DNA, 15 bp, Homo sapiens
tgccaggaaaatagg

SEQ ID NO: 59361 - DNA, 15 bp, Homo sapiens
atgccaggaaaatag

SEQ ID NO: 59362 - DNA, 15 bp, Homo sapiens
tatgccaggaaaata

SEQ ID NO: 59363 - DNA, 15 bp, Homo sapiens
ctatgccaggaaaat

SEQ ID NO: 59364 - DNA, 15 bp, Homo sapiens
cctatgccaggaaaa

SEQ ID NO: 59365 - DNA, 15 bp, Homo sapiens
ccctatgccaggaaa

SEQ ID NO: 59366 - DNA, 15 bp, Homo sapiens
tccctatgccaggaa

SEQ ID NO: 59367 - DNA, 15 bp, Homo sapiens
ttccctatgccagga

SEQ ID NO: 59368 - DNA, 15 bp, Homo sapiens
tttccctatgccagg

SEQ ID NO: 59369 - DNA, 15 bp, Homo sapiens
ttttccctatgccag

SEQ ID NO: 59370 - DNA, 15 bp, Homo sapiens
tttttccctatgcca

SEQ ID NO: 59371 - DNA, 15 bp, Homo sapiens
ttttttccctatgcc

SEQ ID NO: 59372 - DNA, 15 bp, Homo sapiens
cttttttccctatgc

SEQ ID NO: 59373 - DNA, 15 bp, Homo sapiens
acttttttccctatg

SEQ ID NO: 59374 - DNA, 15 bp, Homo sapiens
tacttttttccctat

SEQ ID NO: 59375 - DNA, 15 bp, Homo sapiens
gtacttttttcccta

SEQ ID NO: 59376 - DNA, 15 bp, Homo sapiens
ggtacttttttccct

SEQ ID NO: 59377 - DNA, 15 bp, Homo sapiens
aggtacttttttccc

SEQ ID NO: 59378 - DNA, 15 bp, Homo sapiens
taggtacttttttcc

SEQ ID NO: 59379 - DNA, 15 bp, Homo sapiens
gtaggtacttttttc

SEQ ID NO: 59380 - DNA, 15 bp, Homo sapiens
ggtaggtactttttt

SEQ ID NO: 59381 - DNA, 15 bp, Homo sapiens
aggtaggtacttttt

SEQ ID NO: 59382 - DNA, 15 bp, Homo sapiens
aaggtaggtactttt

SEQ ID NO: 59383 - DNA, 15 bp, Homo sapiens
aaaggtaggtacttt

SEQ ID NO: 59384 - DNA, 15 bp, Homo sapiens
gaaaggtaggtactt

SEQ ID NO: 59385 - DNA, 15 bp, Homo sapiens
agaaaggtaggtact

SEQ ID NO: 59386 - DNA, 15 bp, Homo sapiens
aagaaaggtaggtac

SEQ ID NO: 59387 - DNA, 15 bp, Homo sapiens
taagaaaggtaggta

SEQ ID NO: 59388 - DNA, 15 bp, Homo sapiens
ataagaaaggtaggt

SEQ ID NO: 59389 - DNA, 15 bp, Homo sapiens
cataagaaaggtagg

SEQ ID NO: 59390 - DNA, 15 bp, Homo sapiens
acataagaaaggtag

SEQ ID NO: 59391 - DNA, 15 bp, Homo sapiens
aacataagaaaggta

SEQ ID NO: 59392 - DNA, 15 bp, Homo sapiens
taacataagaaaggt

SEQ ID NO: 59393 - DNA, 15 bp, Homo sapiens
ttaacataagaaagg

SEQ ID NO: 59394 - DNA, 15 bp, Homo sapiens
tttaacataagaaag

SEQ ID NO: 59395 - DNA, 15 bp, Homo sapiens
atttaacataagaaa

SEQ ID NO: 59396 - DNA, 15 bp, Homo sapiens
aatttaacataagaa

SEQ ID NO: 59397 - DNA, 15 bp, Homo sapiens
aaatttaacataaga

SEQ ID NO: 59398 - DNA, 15 bp, Homo sapiens
aaaatttaacataag

SEQ ID NO: 59399 - DNA, 15 bp, Homo sapiens
taaaatttaacataa

SEQ ID NO: 59400 - DNA, 15 bp, Homo sapiens
ttaaaatttaacata

SEQ ID NO: 59401 - DNA, 15 bp, Homo sapiens
tttaaaatttaacat

SEQ ID NO: 59402 - DNA, 15 bp, Homo sapiens
ttttaaaatttaaca

SEQ ID NO: 59403 - DNA, 15 bp, Homo sapiens
tttttaaaatttaac

SEQ ID NO: 59404 - DNA, 15 bp, Homo sapiens
ctttttaaaatttaa

SEQ ID NO: 59405 - DNA, 15 bp, Homo sapiens
cctttttaaaattta

SEQ ID NO: 59406 - DNA, 15 bp, Homo sapiens
ccctttttaaaattt

SEQ ID NO: 59407 - DNA, 15 bp, Homo sapiens
tccctttttaaaatt

SEQ ID NO: 59408 - DNA, 15 bp, Homo sapiens
gtccctttttaaaat

SEQ ID NO: 59409 - DNA, 15 bp, Homo sapiens
tgtccctttttaaaa

SEQ ID NO: 59410 - DNA, 15 bp, Homo sapiens
atgtccctttttaaa

SEQ ID NO: 59411 - DNA, 15 bp, Homo sapiens
tatgtccctttttaa

SEQ ID NO: 59412 - DNA, 15 bp, Homo sapiens
ttatgtcccttttta

SEQ ID NO: 59413 - DNA, 15 bp, Homo sapiens
attatgtcccttttt

SEQ ID NO: 59414 - DNA, 15 bp, Homo sapiens
aattatgtccctttt

SEQ ID NO: 59415 - DNA, 15 bp, Homo sapiens
aaattatgtcccttt

SEQ ID NO: 59416 - DNA, 15 bp, Homo sapiens
gaaattatgtccctt

SEQ ID NO: 59417 - DNA, 15 bp, Homo sapiens
tgaaattatgtccct

SEQ ID NO: 59418 - DNA, 15 bp, Homo sapiens
gtgaaattatgtccc

SEQ ID NO: 59419 - DNA, 15 bp, Homo sapiens
tgtgaaattatgtcc

SEQ ID NO: 59420 - DNA, 15 bp, Homo sapiens
atgtgaaattatgtc

SEQ ID NO: 59421 - DNA, 15 bp, Homo sapiens
gatgtgaaattatgt

SEQ ID NO: 59422 - DNA, 15 bp, Homo sapiens
agatgtgaaattatg

SEQ ID NO: 59423 - DNA, 15 bp, Homo sapiens
tagatgtgaaattat

SEQ ID NO: 59424 - DNA, 15 bp, Homo sapiens
ctagatgtgaaatta

SEQ ID NO: 59425 - DNA, 15 bp, Homo sapiens
tctagatgtgaaatt

SEQ ID NO: 59426 - DNA, 15 bp, Homo sapiens
ttctagatgtgaaat

SEQ ID NO: 59427 - DNA, 15 bp, Homo sapiens
tttctagatgtgaaa

SEQ ID NO: 59428 - DNA, 15 bp, Homo sapiens
ttttctagatgtgaa

SEQ ID NO: 59429 - DNA, 15 bp, Homo sapiens
cttttctagatgtga

SEQ ID NO: 59430 - DNA, 15 bp, Homo sapiens
acttttctagatgtg

SEQ ID NO: 59431 - DNA, 15 bp, Homo sapiens
aacttttctagatgt

SEQ ID NO: 59432 - DNA, 15 bp, Homo sapiens
caacttttctagatg

SEQ ID NO: 59433 - DNA, 15 bp, Homo sapiens
gcaacttttctagat

SEQ ID NO: 59434 - DNA, 15 bp, Homo sapiens
tgcaacttttctaga

SEQ ID NO: 59435 - DNA, 15 bp, Homo sapiens
ctgcaacttttctag

SEQ ID NO: 59436 - DNA, 15 bp, Homo sapiens
cctgcaacttttcta

SEQ ID NO: 59437 - DNA, 15 bp, Homo sapiens
tcctgcaacttttct

SEQ ID NO: 59438 - DNA, 15 bp, Homo sapiens
ttcctgcaacttttc

SEQ ID NO: 59439 - DNA, 15 bp, Homo sapiens
attcctgcaactttt

SEQ ID NO: 59440 - DNA, 15 bp, Homo sapiens
tattcctgcaacttt

SEQ ID NO: 59441 - DNA, 15 bp, Homo sapiens
ctattcctgcaactt

SEQ ID NO: 59442 - DNA, 15 bp, Homo sapiens
actattcctgcaact

SEQ ID NO: 59443 - DNA, 15 bp, Homo sapiens
aactattcctgcaac

SEQ ID NO: 59444 - DNA, 15 bp, Homo sapiens
gaactattcctgcaa

SEQ ID NO: 59445 - DNA, 15 bp, Homo sapiens
tgaactattcctgca

SEQ ID NO: 59446 - DNA, 15 bp, Homo sapiens
ttgaactattcctgc

SEQ ID NO: 59447 - DNA, 15 bp, Homo sapiens
tttgaactattcctg

SEQ ID NO: 59448 - DNA, 15 bp, Homo sapiens
ctttgaactattcct

SEQ ID NO: 59449 - DNA, 15 bp, Homo sapiens
tctttgaactattcc

SEQ ID NO: 59450 - DNA, 15 bp, Homo sapiens
ttctttgaactattc

SEQ ID NO: 59451 - DNA, 15 bp, Homo sapiens
attctttgaactatt

SEQ ID NO: 59452 - DNA, 15 bp, Homo sapiens
aattctttgaactat

SEQ ID NO: 59453 - DNA, 15 bp, Homo sapiens
gaattctttgaacta

SEQ ID NO: 59454 - DNA, 15 bp, Homo sapiens
ggaattctttgaact

SEQ ID NO: 59455 - DNA, 15 bp, Homo sapiens
gggaattctttgaac

SEQ ID NO: 59456 - DNA, 15 bp, Homo sapiens
tgggaattctttgaa

SEQ ID NO: 59457 - DNA, 15 bp, Homo sapiens
ttgggaattctttga

SEQ ID NO: 59458 - DNA, 15 bp, Homo sapiens
cttgggaattctttg

SEQ ID NO: 59459 - DNA, 15 bp, Homo sapiens
acttgggaattcttt

SEQ ID NO: 59460 - DNA, 15 bp, Homo sapiens
tacttgggaattctt

SEQ ID NO: 59461 - DNA, 15 bp, Homo sapiens
gtacttgggaattct

SEQ ID NO: 59462 - DNA, 15 bp, Homo sapiens
ggtacttgggaattc

SEQ ID NO: 59463 - DNA, 15 bp, Homo sapiens
aggtacttgggaatt

SEQ ID NO: 59464 - DNA, 15 bp, Homo sapiens
aaggtacttgggaat

SEQ ID NO: 59465 - DNA, 15 bp, Homo sapiens
aaaggtacttgggaa

SEQ ID NO: 59466 - DNA, 15 bp, Homo sapiens
gaaaggtacttggga

SEQ ID NO: 59467 - DNA, 15 bp, Homo sapiens
tgaaaggtacttggg

SEQ ID NO: 59468 - DNA, 15 bp, Homo sapiens
gtgaaaggtacttgg

SEQ ID NO: 59469 - DNA, 15 bp, Homo sapiens
agtgaaaggtacttg

SEQ ID NO: 59470 - DNA, 15 bp, Homo sapiens
gagtgaaaggtactt

SEQ ID NO: 59471 - DNA, 15 bp, Homo sapiens
tgagtgaaaggtact

SEQ ID NO: 59472 - DNA, 15 bp, Homo sapiens
gtgagtgaaaggtac

SEQ ID NO: 59473 - DNA, 15 bp, Homo sapiens
tgtgagtgaaaggta

SEQ ID NO: 59474 - DNA, 15 bp, Homo sapiens
atgtgagtgaaaggt

SEQ ID NO: 59475 - DNA, 15 bp, Homo sapiens
aatgtgagtgaaagg

SEQ ID NO: 59476 - DNA, 15 bp, Homo sapiens
aaatgtgagtgaaag

SEQ ID NO: 59477 - DNA, 15 bp, Homo sapiens
gaaatgtgagtgaaa

SEQ ID NO: 59478 - DNA, 15 bp, Homo sapiens
ggaaatgtgagtgaa

SEQ ID NO: 59479 - DNA, 15 bp, Homo sapiens
aggaaatgtgagtga

SEQ ID NO: 59480 - DNA, 15 bp, Homo sapiens
taggaaatgtgagtg

SEQ ID NO: 59481 - DNA, 15 bp, Homo sapiens
ttaggaaatgtgagt

SEQ ID NO: 59482 - DNA, 15 bp, Homo sapiens
tttaggaaatgtgag

SEQ ID NO: 59483 - DNA, 15 bp, Homo sapiens
atttaggaaatgtga

SEQ ID NO: 59484 - DNA, 15 bp, Homo sapiens
catttaggaaatgtg

SEQ ID NO: 59485 - DNA, 15 bp, Homo sapiens
acatttaggaaatgt

SEQ ID NO: 59486 - DNA, 15 bp, Homo sapiens
aacatttaggaaatg

SEQ ID NO: 59487 - DNA, 15 bp, Homo sapiens
taacatttaggaaat

SEQ ID NO: 59488 - DNA, 15 bp, Homo sapiens
gtaacatttaggaaa

SEQ ID NO: 59489 - DNA, 15 bp, Homo sapiens
ggtaacatttaggaa

SEQ ID NO: 59490 - DNA, 15 bp, Homo sapiens
tggtaacatttagga

SEQ ID NO: 59491 - DNA, 15 bp, Homo sapiens
ctggtaacatttagg

SEQ ID NO: 59492 - DNA, 15 bp, Homo sapiens
actggtaacatttag

SEQ ID NO: 59493 - DNA, 15 bp, Homo sapiens
aactggtaacattta

SEQ ID NO: 59494 - DNA, 15 bp, Homo sapiens
caactggtaacattt

SEQ ID NO: 59495 - DNA, 15 bp, Homo sapiens
acaactggtaacatt

SEQ ID NO: 59496 - DNA, 15 bp, Homo sapiens
gacaactggtaacat

SEQ ID NO: 59497 - DNA, 15 bp, Homo sapiens
agacaactggtaaca

SEQ ID NO: 59498 - DNA, 15 bp, Homo sapiens
tagacaactggtaac

SEQ ID NO: 59499 - DNA, 15 bp, Homo sapiens
atagacaactggtaa

SEQ ID NO: 59500 - DNA, 15 bp, Homo sapiens
tatagacaactggta

SEQ ID NO: 59501 - DNA, 15 bp, Homo sapiens
atatagacaactggt

SEQ ID NO: 59502 - DNA, 15 bp, Homo sapiens
aatatagacaactgg

SEQ ID NO: 59503 - DNA, 15 bp, Homo sapiens
aaatatagacaactg

SEQ ID NO: 59504 - DNA, 15 bp, Homo sapiens
gaaatatagacaact

SEQ ID NO: 59505 - DNA, 15 bp, Homo sapiens
tgaaatatagacaac

SEQ ID NO: 59506 - DNA, 15 bp, Homo sapiens
atgaaatatagacaa

SEQ ID NO: 59507 - DNA, 15 bp, Homo sapiens
aatgaaatatagaca

SEQ ID NO: 59508 - DNA, 15 bp, Homo sapiens
aaatgaaatatagac

SEQ ID NO: 59509 - DNA, 15 bp, Homo sapiens
caaatgaaatataga

SEQ ID NO: 59510 - DNA, 15 bp, Homo sapiens
acaaatgaaatatag

SEQ ID NO: 59511 - DNA, 15 bp, Homo sapiens
tacaaatgaaatata

SEQ ID NO: 59512 - DNA, 15 bp, Homo sapiens
gtacaaatgaaatat

SEQ ID NO: 59513 - DNA, 15 bp, Homo sapiens
agtacaaatgaaata

SEQ ID NO: 59514 - DNA, 15 bp, Homo sapiens
gagtacaaatgaaat

SEQ ID NO: 59515 - DNA, 15 bp, Homo sapiens
agagtacaaatgaaa

SEQ ID NO: 59516 - DNA, 15 bp, Homo sapiens
gagagtacaaatgaa

SEQ ID NO: 59517 - DNA, 15 bp, Homo sapiens
agagagtacaaatga

SEQ ID NO: 59518 - DNA, 15 bp, Homo sapiens
gagagagtacaaatg

SEQ ID NO: 59519 - DNA, 15 bp, Homo sapiens
agagagagtacaaat

SEQ ID NO: 59520 - DNA, 15 bp, Homo sapiens
gagagagagtacaaa

SEQ ID NO: 59521 - DNA, 15 bp, Homo sapiens
tgagagagagtacaa

SEQ ID NO: 59522 - DNA, 15 bp, Homo sapiens
ctgagagagagtaca

SEQ ID NO: 59523 - DNA, 15 bp, Homo sapiens
actgagagagagtac

SEQ ID NO: 59524 - DNA, 15 bp, Homo sapiens
gactgagagagagta

SEQ ID NO: 59525 - DNA, 15 bp, Homo sapiens
agactgagagagagt

SEQ ID NO: 59526 - DNA, 15 bp, Homo sapiens
cagactgagagagag

SEQ ID NO: 59527 - DNA, 15 bp, Homo sapiens
gcagactgagagaga

SEQ ID NO: 59528 - DNA, 15 bp, Homo sapiens
ggcagactgagagag

SEQ ID NO: 59529 - DNA, 15 bp, Homo sapiens
aggcagactgagaga

SEQ ID NO: 59530 - DNA, 15 bp, Homo sapiens
taggcagactgagag

SEQ ID NO: 59531 - DNA, 15 bp, Homo sapiens
ttaggcagactgaga

SEQ ID NO: 59532 - DNA, 15 bp, Homo sapiens
tttaggcagactgag

SEQ ID NO: 59533 - DNA, 15 bp, Homo sapiens
ttttaggcagactga

SEQ ID NO: 59534 - DNA, 15 bp, Homo sapiens
attttaggcagactg

SEQ ID NO: 59535 - DNA, 15 bp, Homo sapiens
tattttaggcagact

SEQ ID NO: 59536 - DNA, 15 bp, Homo sapiens
atattttaggcagac

SEQ ID NO: 59537 - DNA, 15 bp, Homo sapiens
aatattttaggcaga

SEQ ID NO: 59538 - DNA, 15 bp, Homo sapiens
aaatattttaggcag

SEQ ID NO: 59539 - DNA, 15 bp, Homo sapiens
taaatattttaggca

SEQ ID NO: 59540 - DNA, 15 bp, Homo sapiens
ctaaatattttaggc

SEQ ID NO: 59541 - DNA, 15 bp, Homo sapiens
actaaatattttagg

SEQ ID NO: 59542 - DNA, 15 bp, Homo sapiens
cactaaatattttag

SEQ ID NO: 59543 - DNA, 15 bp, Homo sapiens
acactaaatatttta

SEQ ID NO: 59544 - DNA, 15 bp, Homo sapiens
cacactaaatatttt

SEQ ID NO: 59545 - DNA, 15 bp, Homo sapiens
acacactaaatattt

SEQ ID NO: 59546 - DNA, 15 bp, Homo sapiens
tacacactaaatatt

SEQ ID NO: 59547 - DNA, 15 bp, Homo sapiens
atacacactaaatat

SEQ ID NO: 59548 - DNA, 15 bp, Homo sapiens
aatacacactaaata

SEQ ID NO: 59549 - DNA, 15 bp, Homo sapiens
aaatacacactaaat

SEQ ID NO: 59550 - DNA, 15 bp, Homo sapiens
aaaatacacactaaa

SEQ ID NO: 59551 - DNA, 15 bp, Homo sapiens
gaaaatacacactaa

SEQ ID NO: 59552 - DNA, 15 bp, Homo sapiens
agaaaatacacacta

SEQ ID NO: 59553 - DNA, 15 bp, Homo sapiens
tagaaaatacacact

SEQ ID NO: 59554 - DNA, 15 bp, Homo sapiens
ttagaaaatacacac

SEQ ID NO: 59555 - DNA, 15 bp, Homo sapiens
gttagaaaatacaca

SEQ ID NO: 59556 - DNA, 15 bp, Homo sapiens
cgttagaaaatacac

SEQ ID NO: 59557 - DNA, 15 bp, Homo sapiens
gcgttagaaaataca

SEQ ID NO: 59558 - DNA, 15 bp, Homo sapiens
ggcgttagaaaatac

SEQ ID NO: 59559 - DNA, 15 bp, Homo sapiens
tggcgttagaaaata

SEQ ID NO: 59560 - DNA, 15 bp, Homo sapiens
atggcgttagaaaat

SEQ ID NO: 59561 - DNA, 15 bp, Homo sapiens
catggcgttagaaaa

SEQ ID NO: 59562 - DNA, 15 bp, Homo sapiens
ccatggcgttagaaa

SEQ ID NO: 59563 - DNA, 15 bp, Homo sapiens
gccatggcgttagaa

SEQ ID NO: 59564 - DNA, 15 bp, Homo sapiens
tgccatggcgttaga

SEQ ID NO: 59565 - DNA, 15 bp, Homo sapiens
atgccatggcgttag

SEQ ID NO: 59566 - DNA, 15 bp, Homo sapiens
aatgccatggcgtta

SEQ ID NO: 59567 - DNA, 15 bp, Homo sapiens
gaatgccatggcgtt

SEQ ID NO: 59568 - DNA, 15 bp, Homo sapiens
agaatgccatggcgt

SEQ ID NO: 59569 - DNA, 15 bp, Homo sapiens
gagaatgccatggcg

SEQ ID NO: 59570 - DNA, 15 bp, Homo sapiens
ggagaatgccatggc

SEQ ID NO: 59571 - DNA, 15 bp, Homo sapiens
aggagaatgccatgg

SEQ ID NO: 59572 - DNA, 15 bp, Homo sapiens
taggagaatgccatg

SEQ ID NO: 59573 - DNA, 15 bp, Homo sapiens
ttaggagaatgccat

SEQ ID NO: 59574 - DNA, 15 bp, Homo sapiens
tttaggagaatgcca

SEQ ID NO: 59575 - DNA, 15 bp, Homo sapiens
ttttaggagaatgcc

SEQ ID NO: 59576 - DNA, 15 bp, Homo sapiens
tttttaggagaatgc

SEQ ID NO: 59577 - DNA, 15 bp, Homo sapiens
gtttttaggagaatg

SEQ ID NO: 59578 - DNA, 15 bp, Homo sapiens
tgtttttaggagaat

SEQ ID NO: 59579 - DNA, 15 bp, Homo sapiens
ttgtttttaggagaa

SEQ ID NO: 59580 - DNA, 15 bp, Homo sapiens
cttgtttttaggaga

SEQ ID NO: 59581 - DNA, 15 bp, Homo sapiens
tcttgtttttaggag

SEQ ID NO: 59582 - DNA, 15 bp, Homo sapiens
ttcttgtttttagga

SEQ ID NO: 59583 - DNA, 15 bp, Homo sapiens
gttcttgtttttagg

SEQ ID NO: 59584 - DNA, 15 bp, Homo sapiens
agttcttgtttttag

SEQ ID NO: 59585 - DNA, 15 bp, Homo sapiens
gagttcttgttttta

SEQ ID NO: 59586 - DNA, 15 bp, Homo sapiens
agagttcttgttttt

SEQ ID NO: 59587 - DNA, 15 bp, Homo sapiens
gagagttcttgtttt

SEQ ID NO: 59588 - DNA, 15 bp, Homo sapiens
agagagttcttgttt

SEQ ID NO: 59589 - DNA, 15 bp, Homo sapiens
aagagagttcttgtt

SEQ ID NO: 59590 - DNA, 15 bp, Homo sapiens
taagagagttcttgt

SEQ ID NO: 59591 - DNA, 15 bp, Homo sapiens
ataagagagttcttg

SEQ ID NO: 59592 - DNA, 15 bp, Homo sapiens
cataagagagttctt

SEQ ID NO: 59593 - DNA, 15 bp, Homo sapiens
acataagagagttct

SEQ ID NO: 59594 - DNA, 15 bp, Homo sapiens
tacataagagagttc

SEQ ID NO: 59595 - DNA, 15 bp, Homo sapiens
ttacataagagagtt

SEQ ID NO: 59596 - DNA, 15 bp, Homo sapiens
tttacataagagagt

SEQ ID NO: 59597 - DNA, 15 bp, Homo sapiens
gtttacataagagag

SEQ ID NO: 59598 - DNA, 15 bp, Homo sapiens
tgtttacataagaga

SEQ ID NO: 59599 - DNA, 15 bp, Homo sapiens
gtgtttacataagag

SEQ ID NO: 59600 - DNA, 15 bp, Homo sapiens
tgtgtttacataaga

SEQ ID NO: 59601 - DNA, 15 bp, Homo sapiens
ttgtgtttacataag

SEQ ID NO: 59602 - DNA, 15 bp, Homo sapiens
attgtgtttacataa

SEQ ID NO: 59603 - DNA, 15 bp, Homo sapiens
tattgtgtttacata

SEQ ID NO: 59604 - DNA, 15 bp, Homo sapiens
ctattgtgtttacat

SEQ ID NO: 59605 - DNA, 15 bp, Homo sapiens
gctattgtgtttaca

SEQ ID NO: 59606 - DNA, 15 bp, Homo sapiens
tgctattgtgtttac

SEQ ID NO: 59607 - DNA, 15 bp, Homo sapiens
atgctattgtgttta

SEQ ID NO: 59608 - DNA, 15 bp, Homo sapiens
tatgctattgtgttt

SEQ ID NO: 59609 - DNA, 15 bp, Homo sapiens
atatgctattgtgtt

SEQ ID NO: 59610 - DNA, 15 bp, Homo sapiens
aatatgctattgtgt

SEQ ID NO: 59611 - DNA, 15 bp, Homo sapiens
caatatgctattgtg

SEQ ID NO: 59612 - DNA, 15 bp, Homo sapiens
ccaatatgctattgt

SEQ ID NO: 59613 - DNA, 15 bp, Homo sapiens
accaatatgctattg

SEQ ID NO: 59614 - DNA, 15 bp, Homo sapiens
taccaatatgctatt

SEQ ID NO: 59615 - DNA, 15 bp, Homo sapiens
ataccaatatgctat

SEQ ID NO: 59616 - DNA, 15 bp, Homo sapiens
tataccaatatgcta

SEQ ID NO: 59617 - DNA, 15 bp, Homo sapiens
ttataccaatatgct

SEQ ID NO: 59618 - DNA, 15 bp, Homo sapiens
attataccaatatgc

SEQ ID NO: 59619 - DNA, 15 bp, Homo sapiens
tattataccaatatg

SEQ ID NO: 59620 - DNA, 15 bp, Homo sapiens
ttattataccaatat

SEQ ID NO: 59621 - DNA, 15 bp, Homo sapiens
attattataccaata

SEQ ID NO: 59622 - DNA, 15 bp, Homo sapiens
tattattataccaat

SEQ ID NO: 59623 - DNA, 15 bp, Homo sapiens
atattattataccaa

SEQ ID NO: 59624 - DNA, 15 bp, Homo sapiens
catattattatacca

SEQ ID NO: 59625 - DNA, 15 bp, Homo sapiens
tcatattattatacc

SEQ ID NO: 59626 - DNA, 15 bp, Homo sapiens
ctcatattattatac

SEQ ID NO: 59627 - DNA, 15 bp, Homo sapiens
tctcatattattata

SEQ ID NO: 59628 - DNA, 15 bp, Homo sapiens
atctcatattattat

SEQ ID NO: 59629 - DNA, 15 bp, Homo sapiens
catctcatattatta

SEQ ID NO: 59630 - DNA, 15 bp, Homo sapiens
acatctcatattatt

SEQ ID NO: 59631 - DNA, 15 bp, Homo sapiens
tacatctcatattat

SEQ ID NO: 59632 - DNA, 15 bp, Homo sapiens
ttacatctcatatta

SEQ ID NO: 59633 - DNA, 15 bp, Homo sapiens
tttacatctcatatt

SEQ ID NO: 59634 - DNA, 15 bp, Homo sapiens
ttttacatctcatat

SEQ ID NO: 59635 - DNA, 15 bp, Homo sapiens
attttacatctcata

SEQ ID NO: 59636 - DNA, 15 bp, Homo sapiens
tattttacatctcat

SEQ ID NO: 59637 - DNA, 15 bp, Homo sapiens
atattttacatctca

SEQ ID NO: 59638 - DNA, 15 bp, Homo sapiens
aatattttacatctc

SEQ ID NO: 59639 - DNA, 15 bp, Homo sapiens
caatattttacatct

SEQ ID NO: 59640 - DNA, 15 bp, Homo sapiens
tcaatattttacatc

SEQ ID NO: 59641 - DNA, 15 bp, Homo sapiens
atcaatattttacat

SEQ ID NO: 59642 - DNA, 15 bp, Homo sapiens
tatcaatattttaca

SEQ ID NO: 59643 - DNA, 15 bp, Homo sapiens
atatcaatattttac

SEQ ID NO: 59644 - DNA, 15 bp, Homo sapiens
aatatcaatatttta

SEQ ID NO: 59645 - DNA, 15 bp, Homo sapiens
aaatatcaatatttt

SEQ ID NO: 59646 - DNA, 15 bp, Homo sapiens
taaatatcaatattt

SEQ ID NO: 59647 - DNA, 15 bp, Homo sapiens
ttaaatatcaatatt

SEQ ID NO: 59648 - DNA, 15 bp, Homo sapiens
tttaaatatcaatat

SEQ ID NO: 59649 - DNA, 15 bp, Homo sapiens
ttttaaatatcaata

SEQ ID NO: 59650 - DNA, 15 bp, Homo sapiens
attttaaatatcaat

SEQ ID NO: 59651 - DNA, 15 bp, Homo sapiens
cattttaaatatcaa

SEQ ID NO: 59652 - DNA, 15 bp, Homo sapiens
gcattttaaatatca

SEQ ID NO: 59653 - DNA, 15 bp, Homo sapiens
ggcattttaaatatc

SEQ ID NO: 59654 - DNA, 15 bp, Homo sapiens
tggcattttaaatat

SEQ ID NO: 59655 - DNA, 15 bp, Homo sapiens
ttggcattttaaata

SEQ ID NO: 59656 - DNA, 15 bp, Homo sapiens
attggcattttaaat

SEQ ID NO: 59657 - DNA, 15 bp, Homo sapiens
aattggcattttaaa

SEQ ID NO: 59658 - DNA, 15 bp, Homo sapiens
taattggcattttaa

SEQ ID NO: 59659 - DNA, 15 bp, Homo sapiens
ataattggcatttta

SEQ ID NO: 59660 - DNA, 15 bp, Homo sapiens
aataattggcatttt

SEQ ID NO: 59661 - DNA, 15 bp, Homo sapiens
caataattggcattt

SEQ ID NO: 59662 - DNA, 15 bp, Homo sapiens
tcaataattggcatt

SEQ ID NO: 59663 - DNA, 15 bp, Homo sapiens
atcaataattggcat

SEQ ID NO: 59664 - DNA, 15 bp, Homo sapiens
aatcaataattggca

SEQ ID NO: 59665 - DNA, 15 bp, Homo sapiens
taatcaataattggc

SEQ ID NO: 59666 - DNA, 15 bp, Homo sapiens
ataatcaataattgg

SEQ ID NO: 59667 - DNA, 15 bp, Homo sapiens
aataatcaataattg

SEQ ID NO: 59668 - DNA, 15 bp, Homo sapiens
taataatcaataatt

SEQ ID NO: 59669 - DNA, 15 bp, Homo sapiens
tttaataatcaataa

SEQ ID NO: 59670 - DNA, 15 bp, Homo sapiens
atttaataatcaata

SEQ ID NO: 59671 - DNA, 15 bp, Homo sapiens
tatttaataatcaat

SEQ ID NO: 59672 - DNA, 15 bp, Homo sapiens
atatttaataatcaa

SEQ ID NO: 59673 - DNA, 15 bp, Homo sapiens
catatttaataatca

SEQ ID NO: 59674 - DNA, 15 bp, Homo sapiens
tcatatttaataatc

SEQ ID NO: 59675 - DNA, 15 bp, Homo sapiens
ttttcatatttaata

SEQ ID NO: 59676 - DNA, 15 bp, Homo sapiens
gttttcatatttaat

SEQ ID NO: 59677 - DNA, 15 bp, Homo sapiens
agttttcatatttaa

SEQ ID NO: 59678 - DNA, 15 bp, Homo sapiens
aagttttcatattta

SEQ ID NO: 59679 - DNA, 15 bp, Homo sapiens
taagttttcatattt

SEQ ID NO: 59680 - DNA, 15 bp, Homo sapiens
ctaagttttcatatt

SEQ ID NO: 59681 - DNA, 15 bp, Homo sapiens
actaagttttcatat

SEQ ID NO: 59682 - DNA, 15 bp, Homo sapiens
tactaagttttcata

SEQ ID NO: 59683 - DNA, 15 bp, Homo sapiens
atactaagttttcat

SEQ ID NO: 59684 - DNA, 15 bp, Homo sapiens
tatactaagttttca

SEQ ID NO: 59685 - DNA, 15 bp, Homo sapiens
atatactaagttttc

SEQ ID NO: 59686 - DNA, 15 bp, Homo sapiens
tatatactaagtttt

SEQ ID NO: 59687 - DNA, 15 bp, Homo sapiens
ttatatactaagttt

SEQ ID NO: 59688 - DNA, 15 bp, Homo sapiens
attatatactaagtt

SEQ ID NO: 59689 - DNA, 15 bp, Homo sapiens
aattatatactaagt

SEQ ID NO: 59690 - DNA, 15 bp, Homo sapiens
taattatatactaag

SEQ ID NO: 59691 - DNA, 15 bp, Homo sapiens
ataattatatactaa

SEQ ID NO: 59692 - DNA, 15 bp, Homo sapiens
aataattatatacta

SEQ ID NO: 59693 - DNA, 15 bp, Homo sapiens
taataattatatact

SEQ ID NO: 59694 - DNA, 15 bp, Homo sapiens
ttaataattatatac

SEQ ID NO: 59695 - DNA, 15 bp, Homo sapiens
tttaataattatata

SEQ ID NO: 59696 - DNA, 15 bp, Homo sapiens
ttttaataattatat

SEQ ID NO: 59697 - DNA, 15 bp, Homo sapiens
attttaataattata

SEQ ID NO: 59698 - DNA, 15 bp, Homo sapiens
gattttaataattat

SEQ ID NO: 59699 - DNA, 15 bp, Homo sapiens
tgattttaataatta

SEQ ID NO: 59700 - DNA, 15 bp, Homo sapiens
ttgattttaataatt

SEQ ID NO: 59701 - DNA, 15 bp, Homo sapiens
cttgattttaataat

SEQ ID NO: 59702 - DNA, 15 bp, Homo sapiens
tcttgattttaataa

SEQ ID NO: 59703 - DNA, 15 bp, Homo sapiens
ttcttgattttaata

SEQ ID NO: 59704 - DNA, 15 bp, Homo sapiens
tttcttgattttaat

SEQ ID NO: 59705 - DNA, 15 bp, Homo sapiens
ttttcttgattttaa

SEQ ID NO: 59706 - DNA, 15 bp, Homo sapiens
attttcttgatttta

SEQ ID NO: 59707 - DNA, 15 bp, Homo sapiens
tattttcttgatttt

SEQ ID NO: 59708 - DNA, 15 bp, Homo sapiens
ttattttcttgattt

SEQ ID NO: 59709 - DNA, 15 bp, Homo sapiens
gttattttcttgatt

SEQ ID NO: 59710 - DNA, 15 bp, Homo sapiens
tgttattttcttgat

SEQ ID NO: 59711 - DNA, 15 bp, Homo sapiens
atgttattttcttga

SEQ ID NO: 59712 - DNA, 15 bp, Homo sapiens
aatgttattttcttg

SEQ ID NO: 59713 - DNA, 15 bp, Homo sapiens
caatgttattttctt

SEQ ID NO: 59714 - DNA, 15 bp, Homo sapiens
tcaatgttattttct

SEQ ID NO: 59715 - DNA, 15 bp, Homo sapiens
ttcaatgttattttc

SEQ ID NO: 59716 - DNA, 15 bp, Homo sapiens
tttcaatgttatttt

SEQ ID NO: 59717 - DNA, 15 bp, Homo sapiens
atttcaatgttattt

SEQ ID NO: 59718 - DNA, 15 bp, Homo sapiens
tatttcaatgttatt

SEQ ID NO: 59719 - DNA, 15 bp, Homo sapiens
ttatttcaatgttat

SEQ ID NO: 59720 - DNA, 15 bp, Homo sapiens
attatttcaatgtta

SEQ ID NO: 59721 - DNA, 15 bp, Homo sapiens
tattatttcaatgtt

SEQ ID NO: 59722 - DNA, 15 bp, Homo sapiens
gtattatttcaatgt

SEQ ID NO: 59723 - DNA, 15 bp, Homo sapiens
tgtattatttcaatg

SEQ ID NO: 59724 - DNA, 15 bp, Homo sapiens
ttgtattatttcaat

SEQ ID NO: 59725 - DNA, 15 bp, Homo sapiens
attgtattatttcaa

SEQ ID NO: 59726 - DNA, 15 bp, Homo sapiens
aattgtattatttca

SEQ ID NO: 59727 - DNA, 15 bp, Homo sapiens
taattgtattatttc

SEQ ID NO: 59728 - DNA, 15 bp, Homo sapiens
ataattgtattattt

SEQ ID NO: 59729 - DNA, 15 bp, Homo sapiens
cataattgtattatt

SEQ ID NO: 59730 - DNA, 15 bp, Homo sapiens
acataattgtattat

SEQ ID NO: 59731 - DNA, 15 bp, Homo sapiens
tacataattgtatta

SEQ ID NO: 59732 - DNA, 15 bp, Homo sapiens
ttacataattgtatt

SEQ ID NO: 59733 - DNA, 15 bp, Homo sapiens
attacataattgtat

SEQ ID NO: 59734 - DNA, 15 bp, Homo sapiens
gattacataattgta

SEQ ID NO: 59735 - DNA, 15 bp, Homo sapiens
agattacataattgt

SEQ ID NO: 59736 - DNA, 15 bp, Homo sapiens
tagattacataattg

SEQ ID NO: 59737 - DNA, 15 bp, Homo sapiens
gtagattacataatt

SEQ ID NO: 59738 - DNA, 15 bp, Homo sapiens
tgtagattacataat

SEQ ID NO: 59739 - DNA, 15 bp, Homo sapiens
ctgtagattacataa

SEQ ID NO: 59740 - DNA, 15 bp, Homo sapiens
tctgtagattacata

SEQ ID NO: 59741 - DNA, 15 bp, Homo sapiens
atctgtagattacat

SEQ ID NO: 59742 - DNA, 15 bp, Homo sapiens
gatctgtagattaca

SEQ ID NO: 59743 - DNA, 15 bp, Homo sapiens
agatctgtagattac

SEQ ID NO: 59744 - DNA, 15 bp, Homo sapiens
aagatctgtagatta

SEQ ID NO: 59745 - DNA, 15 bp, Homo sapiens
taagatctgtagatt

SEQ ID NO: 59746 - DNA, 15 bp, Homo sapiens
ttaagatctgtagat

SEQ ID NO: 59747 - DNA, 15 bp, Homo sapiens
cttaagatctgtaga

SEQ ID NO: 59748 - DNA, 15 bp, Homo sapiens
tcttaagatctgtag

SEQ ID NO: 59749 - DNA, 15 bp, Homo sapiens
atcttaagatctgta

SEQ ID NO: 59750 - DNA, 15 bp, Homo sapiens
aatcttaagatctgt

SEQ ID NO: 59751 - DNA, 15 bp, Homo sapiens
aaatcttaagatctg

SEQ ID NO: 59752 - DNA, 15 bp, Homo sapiens
aaaatcttaagatct

SEQ ID NO: 59753 - DNA, 15 bp, Homo sapiens
caaaatcttaagatc

SEQ ID NO: 59754 - DNA, 15 bp, Homo sapiens
acaaaatcttaagat

SEQ ID NO: 59755 - DNA, 15 bp, Homo sapiens
gacaaaatcttaaga

SEQ ID NO: 59756 - DNA, 15 bp, Homo sapiens
tgacaaaatcttaag

SEQ ID NO: 59757 - DNA, 15 bp, Homo sapiens
ctgacaaaatcttaa

SEQ ID NO: 59758 - DNA, 15 bp, Homo sapiens
actgacaaaatctta

SEQ ID NO: 59759 - DNA, 15 bp, Homo sapiens
aactgacaaaatctt

SEQ ID NO: 59760 - DNA, 15 bp, Homo sapiens
caactgacaaaatct

SEQ ID NO: 59761 - DNA, 15 bp, Homo sapiens
acaactgacaaaatc

SEQ ID NO: 59762 - DNA, 15 bp, Homo sapiens
gacaactgacaaaat

SEQ ID NO: 59763 - DNA, 15 bp, Homo sapiens
ggacaactgacaaaa

SEQ ID NO: 59764 - DNA, 15 bp, Homo sapiens
gggacaactgacaaa

SEQ ID NO: 59765 - DNA, 15 bp, Homo sapiens
tgggacaactgacaa

SEQ ID NO: 59766 - DNA, 15 bp, Homo sapiens
ttgggacaactgaca

SEQ ID NO: 59767 - DNA, 15 bp, Homo sapiens
attgggacaactgac

SEQ ID NO: 59768 - DNA, 15 bp, Homo sapiens
tattgggacaactga

SEQ ID NO: 59769 - DNA, 15 bp, Homo sapiens
ttattgggacaactg

SEQ ID NO: 59770 - DNA, 15 bp, Homo sapiens
attattgggacaact

SEQ ID NO: 59771 - DNA, 15 bp, Homo sapiens
tattattgggacaac

SEQ ID NO: 59772 - DNA, 15 bp, Homo sapiens
atattattgggacaa

SEQ ID NO: 59773 - DNA, 15 bp, Homo sapiens
gatattattgggaca

SEQ ID NO: 59774 - DNA, 15 bp, Homo sapiens
ggatattattgggac

SEQ ID NO: 59775 - DNA, 15 bp, Homo sapiens
aggatattattggga

SEQ ID NO: 59776 - DNA, 15 bp, Homo sapiens
aaggatattattggg

SEQ ID NO: 59777 - DNA, 15 bp, Homo sapiens
taaggatattattgg

SEQ ID NO: 59778 - DNA, 15 bp, Homo sapiens
ctaaggatattattg

SEQ ID NO: 59779 - DNA, 15 bp, Homo sapiens
actaaggatattatt

SEQ ID NO: 59780 - DNA, 15 bp, Homo sapiens
tactaaggatattat

SEQ ID NO: 59781 - DNA, 15 bp, Homo sapiens
ctactaaggatatta

SEQ ID NO: 59782 - DNA, 15 bp, Homo sapiens
gctactaaggatatt

SEQ ID NO: 59783 - DNA, 15 bp, Homo sapiens
tgctactaaggatat

SEQ ID NO: 59784 - DNA, 15 bp, Homo sapiens
ttgctactaaggata

SEQ ID NO: 59785 - DNA, 15 bp, Homo sapiens
tttgctactaaggat

SEQ ID NO: 59786 - DNA, 15 bp, Homo sapiens
ttttgctactaagga

SEQ ID NO: 59787 - DNA, 15 bp, Homo sapiens
cttttgctactaagg

SEQ ID NO: 59788 - DNA, 15 bp, Homo sapiens
tcttttgctactaag

SEQ ID NO: 59789 - DNA, 15 bp, Homo sapiens
ttcttttgctactaa

SEQ ID NO: 59790 - DNA, 15 bp, Homo sapiens
tttcttttgctacta

SEQ ID NO: 59791 - DNA, 15 bp, Homo sapiens
ttttcttttgctact

SEQ ID NO: 59792 - DNA, 15 bp, Homo sapiens
attttcttttgctac

SEQ ID NO: 59793 - DNA, 15 bp, Homo sapiens
gattttcttttgcta

SEQ ID NO: 59794 - DNA, 15 bp, Homo sapiens
agattttcttttgct

SEQ ID NO: 59795 - DNA, 15 bp, Homo sapiens
cagattttcttttgc

SEQ ID NO: 59796 - DNA, 15 bp, Homo sapiens
tcagattttcttttg

SEQ ID NO: 59797 - DNA, 15 bp, Homo sapiens
ctcagattttctttt

SEQ ID NO: 59798 - DNA, 15 bp, Homo sapiens
tctcagattttcttt

SEQ ID NO: 59799 - DNA, 15 bp, Homo sapiens
atctcagattttctt

SEQ ID NO: 59800 - DNA, 15 bp, Homo sapiens
gatctcagattttct

SEQ ID NO: 59801 - DNA, 15 bp, Homo sapiens
tgatctcagattttc

SEQ ID NO: 59802 - DNA, 15 bp, Homo sapiens
atgatctcagatttt

SEQ ID NO: 59803 - DNA, 15 bp, Homo sapiens
catgatctcagattt

SEQ ID NO: 59804 - DNA, 15 bp, Homo sapiens
gcatgatctcagatt

SEQ ID NO: 59805 - DNA, 15 bp, Homo sapiens
tgcatgatctcagat

SEQ ID NO: 59806 - DNA, 15 bp, Homo sapiens
atgcatgatctcaga

SEQ ID NO: 59807 - DNA, 15 bp, Homo sapiens
aatgcatgatctcag

SEQ ID NO: 59808 - DNA, 15 bp, Homo sapiens
taatgcatgatctca

SEQ ID NO: 59809 - DNA, 15 bp, Homo sapiens
gtaatgcatgatctc

SEQ ID NO: 59810 - DNA, 15 bp, Homo sapiens
tgtaatgcatgatct

SEQ ID NO: 59811 - DNA, 15 bp, Homo sapiens
atgtaatgcatgatc

SEQ ID NO: 59812 - DNA, 15 bp, Homo sapiens
aatgtaatgcatgat

SEQ ID NO: 59813 - DNA, 15 bp, Homo sapiens
aaatgtaatgcatga

SEQ ID NO: 59814 - DNA, 15 bp, Homo sapiens
taaatgtaatgcatg

SEQ ID NO: 59815 - DNA, 15 bp, Homo sapiens
ataaatgtaatgcat

SEQ ID NO: 59816 - DNA, 15 bp, Homo sapiens
aataaatgtaatgca

SEQ ID NO: 59817 - DNA, 15 bp, Homo sapiens
aaataaatgtaatgc

SEQ ID NO: 59818 - DNA, 15 bp, Homo sapiens
aaaataaatgtaatg

SEQ ID NO: 59819 - DNA, 15 bp, Homo sapiens
aaaaataaatgtaat

SEQ ID NO: 59820 - DNA, 15 bp, Homo sapiens
gaaaaataaatgtaa

SEQ ID NO: 59821 - DNA, 15 bp, Homo sapiens
tgaaaaataaatgta

SEQ ID NO: 59822 - DNA, 15 bp, Homo sapiens
atgaaaaataaatgt

SEQ ID NO: 59823 - DNA, 15 bp, Homo sapiens
catgaaaaataaatg

SEQ ID NO: 59824 - DNA, 15 bp, Homo sapiens
acatgaaaaataaat

SEQ ID NO: 59825 - DNA, 15 bp, Homo sapiens
gacatgaaaaataaa

SEQ ID NO: 59826 - DNA, 15 bp, Homo sapiens
agacatgaaaaataa

SEQ ID NO: 59827 - DNA, 15 bp, Homo sapiens
gagacatgaaaaata

SEQ ID NO: 59828 - DNA, 15 bp, Homo sapiens
agagacatgaaaaat

SEQ ID NO: 59829 - DNA, 15 bp, Homo sapiens
aagagacatgaaaaa

SEQ ID NO: 59830 - DNA, 15 bp, Homo sapiens
aaagagacatgaaaa

SEQ ID NO: 59831 - DNA, 15 bp, Homo sapiens
taaagagacatgaaa

SEQ ID NO: 59832 - DNA, 15 bp, Homo sapiens
ctaaagagacatgaa

SEQ ID NO: 59833 - DNA, 15 bp, Homo sapiens
actaaagagacatga

SEQ ID NO: 59834 - DNA, 15 bp, Homo sapiens
gactaaagagacatg

SEQ ID NO: 59835 - DNA, 15 bp, Homo sapiens
ggactaaagagacat

SEQ ID NO: 59836 - DNA, 15 bp, Homo sapiens
aggactaaagagaca

SEQ ID NO: 59837 - DNA, 15 bp, Homo sapiens
gaggactaaagagac

SEQ ID NO: 59838 - DNA, 15 bp, Homo sapiens
agaggactaaagaga

SEQ ID NO: 59839 - DNA, 15 bp, Homo sapiens
aagaggactaaagag

SEQ ID NO: 59840 - DNA, 15 bp, Homo sapiens
aaagaggactaaaga

SEQ ID NO: 59841 - DNA, 15 bp, Homo sapiens
taaagaggactaaag

SEQ ID NO: 59842 - DNA, 15 bp, Homo sapiens
ttaaagaggactaaa

SEQ ID NO: 59843 - DNA, 15 bp, Homo sapiens
attaaagaggactaa

SEQ ID NO: 59844 - DNA, 15 bp, Homo sapiens
gattaaagaggacta

SEQ ID NO: 59845 - DNA, 15 bp, Homo sapiens
agattaaagaggact

SEQ ID NO: 59846 - DNA, 15 bp, Homo sapiens
cagattaaagaggac

SEQ ID NO: 59847 - DNA, 15 bp, Homo sapiens
ccagattaaagagga

SEQ ID NO: 59848 - DNA, 15 bp, Homo sapiens
tccagattaaagagg

SEQ ID NO: 59849 - DNA, 15 bp, Homo sapiens
ttccagattaaagag

SEQ ID NO: 59850 - DNA, 15 bp, Homo sapiens
cttccagattaaaga

SEQ ID NO: 59851 - DNA, 15 bp, Homo sapiens
acttccagattaaag

SEQ ID NO: 59852 - DNA, 15 bp, Homo sapiens
aacttccagattaaa

SEQ ID NO: 59853 - DNA, 15 bp, Homo sapiens
aaacttccagattaa

SEQ ID NO: 59854 - DNA, 15 bp, Homo sapiens
aaaacttccagatta

SEQ ID NO: 59855 - DNA, 15 bp, Homo sapiens
aaaaacttccagatt

SEQ ID NO: 59856 - DNA, 15 bp, Homo sapiens
caaaaacttccagat

SEQ ID NO: 59857 - DNA, 15 bp, Homo sapiens
tcaaaaacttccaga

SEQ ID NO: 59858 - DNA, 15 bp, Homo sapiens
ctcaaaaacttccag

SEQ ID NO: 59859 - DNA, 15 bp, Homo sapiens
actcaaaaacttcca

SEQ ID NO: 59860 - DNA, 15 bp, Homo sapiens
gactcaaaaacttcc

SEQ ID NO: 59861 - DNA, 15 bp, Homo sapiens
agactcaaaaacttc

SEQ ID NO: 59862 - DNA, 15 bp, Homo sapiens
aagactcaaaaactt

SEQ ID NO: 59863 - DNA, 15 bp, Homo sapiens
aaagactcaaaaact

SEQ ID NO: 59864 - DNA, 15 bp, Homo sapiens
caaagactcaaaaac

SEQ ID NO: 59865 - DNA, 15 bp, Homo sapiens
acaaagactcaaaaa

SEQ ID NO: 59866 - DNA, 15 bp, Homo sapiens
tacaaagactcaaaa

SEQ ID NO: 59867 - DNA, 15 bp, Homo sapiens
atacaaagactcaaa

SEQ ID NO: 59868 - DNA, 15 bp, Homo sapiens
aatacaaagactcaa

SEQ ID NO: 59869 - DNA, 15 bp, Homo sapiens
aaatacaaagactca

SEQ ID NO: 59870 - DNA, 15 bp, Homo sapiens
gaaatacaaagactc

SEQ ID NO: 59871 - DNA, 15 bp, Homo sapiens
tgaaatacaaagact

SEQ ID NO: 59872 - DNA, 15 bp, Homo sapiens
atgaaatacaaagac

SEQ ID NO: 59873 - DNA, 15 bp, Homo sapiens
catgaaatacaaaga

SEQ ID NO: 59874 - DNA, 15 bp, Homo sapiens
tcatgaaatacaaag

SEQ ID NO: 59875 - DNA, 15 bp, Homo sapiens
atcatgaaatacaaa

SEQ ID NO: 59876 - DNA, 15 bp, Homo sapiens
tatcatgaaatacaa

SEQ ID NO: 59877 - DNA, 15 bp, Homo sapiens
atatcatgaaataca

SEQ ID NO: 59878 - DNA, 15 bp, Homo sapiens
aatatcatgaaatac

SEQ ID NO: 59879 - DNA, 15 bp, Homo sapiens
caatatcatgaaata

SEQ ID NO: 59880 - DNA, 15 bp, Homo sapiens
tcaatatcatgaaat

SEQ ID NO: 59881 - DNA, 15 bp, Homo sapiens
atcaatatcatgaaa

SEQ ID NO: 59882 - DNA, 15 bp, Homo sapiens
tatcaatatcatgaa

SEQ ID NO: 59883 - DNA, 15 bp, Homo sapiens
atatcaatatcatga

SEQ ID NO: 59884 - DNA, 15 bp, Homo sapiens
aatatcaatatcatg

SEQ ID NO: 59885 - DNA, 15 bp, Homo sapiens
aaatatcaatatcat

SEQ ID NO: 59886 - DNA, 15 bp, Homo sapiens
aaaatatcaatatca

SEQ ID NO: 59887 - DNA, 15 bp, Homo sapiens
aaaaatatcaatatc

SEQ ID NO: 59888 - DNA, 15 bp, Homo sapiens
caaaaatatcaatat

SEQ ID NO: 59889 - DNA, 15 bp, Homo sapiens
tcaaaaatatcaata

SEQ ID NO: 59890 - DNA, 15 bp, Homo sapiens
ttcaaaaatatcaat

SEQ ID NO: 59891 - DNA, 15 bp, Homo sapiens
cttcaaaaatatcaa

SEQ ID NO: 59892 - DNA, 15 bp, Homo sapiens
tcttcaaaaatatca

SEQ ID NO: 59893 - DNA, 15 bp, Homo sapiens
ctcttcaaaaatatc

SEQ ID NO: 59894 - DNA, 15 bp, Homo sapiens
actcttcaaaaatat

SEQ ID NO: 59895 - DNA, 15 bp, Homo sapiens
cactcttcaaaaata

SEQ ID NO: 59896 - DNA, 15 bp, Homo sapiens
gcactcttcaaaaat

SEQ ID NO: 59897 - DNA, 15 bp, Homo sapiens
agcactcttcaaaaa

SEQ ID NO: 59898 - DNA, 15 bp, Homo sapiens
cagcactcttcaaaa

SEQ ID NO: 59899 - DNA, 15 bp, Homo sapiens
ccagcactcttcaaa

SEQ ID NO: 59900 - DNA, 15 bp, Homo sapiens
gccagcactcttcaa

SEQ ID NO: 59901 - DNA, 15 bp, Homo sapiens
agccagcactcttca

SEQ ID NO: 59902 - DNA, 15 bp, Homo sapiens
tagccagcactcttc

SEQ ID NO: 59903 - DNA, 15 bp, Homo sapiens
ctagccagcactctt

SEQ ID NO: 59904 - DNA, 15 bp, Homo sapiens
actagccagcactct

SEQ ID NO: 59905 - DNA, 15 bp, Homo sapiens
aactagccagcactc

SEQ ID NO: 59906 - DNA, 15 bp, Homo sapiens
taactagccagcact

SEQ ID NO: 59907 - DNA, 15 bp, Homo sapiens
ataactagccagcac

SEQ ID NO: 59908 - DNA, 15 bp, Homo sapiens
aataactagccagca

SEQ ID NO: 59909 - DNA, 15 bp, Homo sapiens
aaataactagccagc

SEQ ID NO: 59910 - DNA, 15 bp, Homo sapiens
aaaataactagccag

SEQ ID NO: 59911 - DNA, 15 bp, Homo sapiens
caaaataactagcca

SEQ ID NO: 59912 - DNA, 15 bp, Homo sapiens
acaaaataactagcc

SEQ ID NO: 59913 - DNA, 15 bp, Homo sapiens
tacaaaataactagc

SEQ ID NO: 59914 - DNA, 15 bp, Homo sapiens
ctacaaaataactag

SEQ ID NO: 59915 - DNA, 15 bp, Homo sapiens
tctacaaaataacta

SEQ ID NO: 59916 - DNA, 15 bp, Homo sapiens
ttctacaaaataact

SEQ ID NO: 59917 - DNA, 15 bp, Homo sapiens
attctacaaaataac

SEQ ID NO: 59918 - DNA, 15 bp, Homo sapiens
cattctacaaaataa

SEQ ID NO: 59919 - DNA, 15 bp, Homo sapiens
acattctacaaaata

SEQ ID NO: 59920 - DNA, 15 bp, Homo sapiens
gacattctacaaaat

SEQ ID NO: 59921 - DNA, 15 bp, Homo sapiens
agacattctacaaaa

SEQ ID NO: 59922 - DNA, 15 bp, Homo sapiens
gagacattctacaaa

SEQ ID NO: 59923 - DNA, 15 bp, Homo sapiens
agagacattctacaa

SEQ ID NO: 59924 - DNA, 15 bp, Homo sapiens
gagagacattctaca

SEQ ID NO: 59925 - DNA, 15 bp, Homo sapiens
agagagacattctac

SEQ ID NO: 59926 - DNA, 15 bp, Homo sapiens
gagagagacattcta

SEQ ID NO: 59927 - DNA, 15 bp, Homo sapiens
tgagagagacattct

SEQ ID NO: 59928 - DNA, 15 bp, Homo sapiens
ctgagagagacattc

SEQ ID NO: 59929 - DNA, 15 bp, Homo sapiens
actgagagagacatt

SEQ ID NO: 59930 - DNA, 15 bp, Homo sapiens
cactgagagagacat

SEQ ID NO: 59931 - DNA, 15 bp, Homo sapiens
ccactgagagagaca

SEQ ID NO: 59932 - DNA, 15 bp, Homo sapiens
cccactgagagagac

SEQ ID NO: 59933 - DNA, 15 bp, Homo sapiens
gcccactgagagaga

SEQ ID NO: 59934 - DNA, 15 bp, Homo sapiens
agcccactgagagag

SEQ ID NO: 59935 - DNA, 15 bp, Homo sapiens
aagcccactgagaga

SEQ ID NO: 59936 - DNA, 15 bp, Homo sapiens
caagcccactgagag

SEQ ID NO: 59937 - DNA, 15 bp, Homo sapiens
ccaagcccactgaga

SEQ ID NO: 59938 - DNA, 15 bp, Homo sapiens
cccaagcccactgag

SEQ ID NO: 59939 - DNA, 15 bp, Homo sapiens
gcccaagcccactga

SEQ ID NO: 59940 - DNA, 15 bp, Homo sapiens
agcccaagcccactg

SEQ ID NO: 59941 - DNA, 15 bp, Homo sapiens
aagcccaagcccact

SEQ ID NO: 59942 - DNA, 15 bp, Homo sapiens
caagcccaagcccac

SEQ ID NO: 59943 - DNA, 15 bp, Homo sapiens
ccaagcccaagccca

SEQ ID NO: 59944 - DNA, 15 bp, Homo sapiens
gccaagcccaagccc

SEQ ID NO: 59945 - DNA, 15 bp, Homo sapiens
agccaagcccaagcc

SEQ ID NO: 59946 - DNA, 15 bp, Homo sapiens
cagccaagcccaagc

SEQ ID NO: 59947 - DNA, 15 bp, Homo sapiens
tcagccaagcccaag

SEQ ID NO: 59948 - DNA, 15 bp, Homo sapiens
ctcagccaagcccaa

SEQ ID NO: 59949 - DNA, 15 bp, Homo sapiens
gctcagccaagccca

SEQ ID NO: 59950 - DNA, 15 bp, Homo sapiens
agctcagccaagccc

SEQ ID NO: 59951 - DNA, 15 bp, Homo sapiens
aagctcagccaagcc

SEQ ID NO: 59952 - DNA, 15 bp, Homo sapiens
aaagctcagccaagc

SEQ ID NO: 59953 - DNA, 15 bp, Homo sapiens
gaaagctcagccaag

SEQ ID NO: 59954 - DNA, 15 bp, Homo sapiens
ggaaagctcagccaa

SEQ ID NO: 59955 - DNA, 15 bp, Homo sapiens
aggaaagctcagcca

SEQ ID NO: 59956 - DNA, 15 bp, Homo sapiens
aaggaaagctcagcc

SEQ ID NO: 59957 - DNA, 15 bp, Homo sapiens
taaggaaagctcagc

SEQ ID NO: 59958 - DNA, 15 bp, Homo sapiens
ataaggaaagctcag

SEQ ID NO: 59959 - DNA, 15 bp, Homo sapiens
cataaggaaagctca

SEQ ID NO: 59960 - DNA, 15 bp, Homo sapiens
tcataaggaaagctc

SEQ ID NO: 59961 - DNA, 15 bp, Homo sapiens
atcataaggaaagct

SEQ ID NO: 59962 - DNA, 15 bp, Homo sapiens
aatcataaggaaagc

SEQ ID NO: 59963 - DNA, 15 bp, Homo sapiens
taatcataaggaaag

SEQ ID NO: 59964 - DNA, 15 bp, Homo sapiens
ttaatcataaggaaa

SEQ ID NO: 59965 - DNA, 15 bp, Homo sapiens
cttaatcataaggaa

SEQ ID NO: 59966 - DNA, 15 bp, Homo sapiens
acttaatcataagga

SEQ ID NO: 59967 - DNA, 15 bp, Homo sapiens
aacttaatcataagg

SEQ ID NO: 59968 - DNA, 15 bp, Homo sapiens
gaacttaatcataag

SEQ ID NO: 59969 - DNA, 15 bp, Homo sapiens
tgaacttaatcataa

SEQ ID NO: 59970 - DNA, 15 bp, Homo sapiens
ctgaacttaatcata

SEQ ID NO: 59971 - DNA, 15 bp, Homo sapiens
cctgaacttaatcat

SEQ ID NO: 59972 - DNA, 15 bp, Homo sapiens
acctgaacttaatca

SEQ ID NO: 59973 - DNA, 15 bp, Homo sapiens
aacctgaacttaatc

SEQ ID NO: 59974 - DNA, 15 bp, Homo sapiens
caacctgaacttaat

SEQ ID NO: 59975 - DNA, 15 bp, Homo sapiens
acaacctgaacttaa

SEQ ID NO: 59976 - DNA, 15 bp, Homo sapiens
aacaacctgaactta

SEQ ID NO: 59977 - DNA, 15 bp, Homo sapiens
gaacaacctgaactt

SEQ ID NO: 59978 - DNA, 15 bp, Homo sapiens
tgaacaacctgaact

SEQ ID NO: 59979 - DNA, 15 bp, Homo sapiens
gtgaacaacctgaac

SEQ ID NO: 59980 - DNA, 15 bp, Homo sapiens
agtgaacaacctgaa

SEQ ID NO: 59981 - DNA, 15 bp, Homo sapiens
aagtgaacaacctga

SEQ ID NO: 59982 - DNA, 15 bp, Homo sapiens
aaagtgaacaacctg

SEQ ID NO: 59983 - DNA, 15 bp, Homo sapiens
aaaagtgaacaacct

SEQ ID NO: 59984 - DNA, 15 bp, Homo sapiens
caaaagtgaacaacc

SEQ ID NO: 59985 - DNA, 15 bp, Homo sapiens
ccaaaagtgaacaac

SEQ ID NO: 59986 - DNA, 15 bp, Homo sapiens
gccaaaagtgaacaa

SEQ ID NO: 59987 - DNA, 15 bp, Homo sapiens
tgccaaaagtgaaca

SEQ ID NO: 59988 - DNA, 15 bp, Homo sapiens
ctgccaaaagtgaac

SEQ ID NO: 59989 - DNA, 15 bp, Homo sapiens
cctgccaaaagtgaa

SEQ ID NO: 59990 - DNA, 15 bp, Homo sapiens
ccctgccaaaagtga

SEQ ID NO: 59991 - DNA, 15 bp, Homo sapiens
tccctgccaaaagtg

SEQ ID NO: 59992 - DNA, 15 bp, Homo sapiens
gtccctgccaaaagt

SEQ ID NO: 59993 - DNA, 15 bp, Homo sapiens
cgtccctgccaaaag

SEQ ID NO: 59994 - DNA, 15 bp, Homo sapiens
acgtccctgccaaaa

SEQ ID NO: 59995 - DNA, 15 bp, Homo sapiens
gacgtccctgccaaa

SEQ ID NO: 59996 - DNA, 15 bp, Homo sapiens
tgacgtccctgccaa

SEQ ID NO: 59997 - DNA, 15 bp, Homo sapiens
gtgacgtccctgcca

SEQ ID NO: 59998 - DNA, 15 bp, Homo sapiens
tgtgacgtccctgcc

SEQ ID NO: 59999 - DNA, 15 bp, Homo sapiens
ttgtgacgtccctgc

SEQ ID NO: 60000 - DNA, 15 bp, Homo sapiens
tttgtgacgtccctg

SEQ ID NO: 60001 - DNA, 15 bp, Homo sapiens
ttttgtgacgtccct

SEQ ID NO: 60002 - DNA, 15 bp, Homo sapiens
cttttgtgacgtccc

SEQ ID NO: 60003 - DNA, 15 bp, Homo sapiens
acttttgtgacgtcc

SEQ ID NO: 60004 - DNA, 15 bp, Homo sapiens
cacttttgtgacgtc

SEQ ID NO: 60005 - DNA, 15 bp, Homo sapiens
tcacttttgtgacgt

SEQ ID NO: 60006 - DNA, 15 bp, Homo sapiens
gtcacttttgtgacg

SEQ ID NO: 60007 - DNA, 15 bp, Homo sapiens
cgtcacttttgtgac

SEQ ID NO: 60008 - DNA, 15 bp, Homo sapiens
acgtcacttttgtga

SEQ ID NO: 60009 - DNA, 15 bp, Homo sapiens
cacgtcacttttgtg

SEQ ID NO: 60010 - DNA, 15 bp, Homo sapiens
tcacgtcacttttgt

SEQ ID NO: 60011 - DNA, 15 bp, Homo sapiens
ctcacgtcacttttg

SEQ ID NO: 60012 - DNA, 15 bp, Homo sapiens
actcacgtcactttt

SEQ ID NO: 60013 - DNA, 15 bp, Homo sapiens
aactcacgtcacttt

SEQ ID NO: 60014 - DNA, 15 bp, Homo sapiens
gaactcacgtcactt

SEQ ID NO: 60015 - DNA, 15 bp, Homo sapiens
agaactcacgtcact

SEQ ID NO: 60016 - DNA, 15 bp, Homo sapiens
aagaactcacgtcac

SEQ ID NO: 60017 - DNA, 15 bp, Homo sapiens
gaagaactcacgtca

SEQ ID NO: 60018 - DNA, 15 bp, Homo sapiens
agaagaactcacgtc

SEQ ID NO: 60019 - DNA, 15 bp, Homo sapiens
aagaagaactcacgt

SEQ ID NO: 60020 - DNA, 15 bp, Homo sapiens
taagaagaactcacg

SEQ ID NO: 60021 - DNA, 15 bp, Homo sapiens
ctaagaagaactcac

SEQ ID NO: 60022 - DNA, 15 bp, Homo sapiens
actaagaagaactca

SEQ ID NO: 60023 - DNA, 15 bp, Homo sapiens
cactaagaagaactc

SEQ ID NO: 60024 - DNA, 15 bp, Homo sapiens
gcactaagaagaact

SEQ ID NO: 60025 - DNA, 15 bp, Homo sapiens
tgcactaagaagaac

SEQ ID NO: 60026 - DNA, 15 bp, Homo sapiens
atgcactaagaagaa

SEQ ID NO: 60027 - DNA, 15 bp, Homo sapiens
gatgcactaagaaga

SEQ ID NO: 60028 - DNA, 15 bp, Homo sapiens
tgatgcactaagaag

SEQ ID NO: 60029 - DNA, 15 bp, Homo sapiens
atgatgcactaagaa

SEQ ID NO: 60030 - DNA, 15 bp, Homo sapiens
tatgatgcactaaga

SEQ ID NO: 60031 - DNA, 15 bp, Homo sapiens
atatgatgcactaag

SEQ ID NO: 60032 - DNA, 15 bp, Homo sapiens
gatatgatgcactaa

SEQ ID NO: 60033 - DNA, 15 bp, Homo sapiens
cgatatgatgcacta

SEQ ID NO: 60034 - DNA, 15 bp, Homo sapiens
ccgatatgatgcact

SEQ ID NO: 60035 - DNA, 15 bp, Homo sapiens
cccgatatgatgcac

SEQ ID NO: 60036 - DNA, 15 bp, Homo sapiens
ccccgatatgatgca

SEQ ID NO: 60037 - DNA, 15 bp, Homo sapiens
tccccgatatgatgc

SEQ ID NO: 60038 - DNA, 15 bp, Homo sapiens
atccccgatatgatg

SEQ ID NO: 60039 - DNA, 15 bp, Homo sapiens
tatccccgatatgat

SEQ ID NO: 60040 - DNA, 15 bp, Homo sapiens
ctatccccgatatga

SEQ ID NO: 60041 - DNA, 15 bp, Homo sapiens
cctatccccgatatg

SEQ ID NO: 60042 - DNA, 15 bp, Homo sapiens
acctatccccgatat

SEQ ID NO: 60043 - DNA, 15 bp, Homo sapiens
cacctatccccgata

SEQ ID NO: 60044 - DNA, 15 bp, Homo sapiens
tcacctatccccgat

SEQ ID NO: 60045 - DNA, 15 bp, Homo sapiens
atcacctatccccga

SEQ ID NO: 60046 - DNA, 15 bp, Homo sapiens
tatcacctatccccg

SEQ ID NO: 60047 - DNA, 15 bp, Homo sapiens
atatcacctatcccc

SEQ ID NO: 60048 - DNA, 15 bp, Homo sapiens
gatatcacctatccc

SEQ ID NO: 60049 - DNA, 15 bp, Homo sapiens
agatatcacctatcc

SEQ ID NO: 60050 - DNA, 15 bp, Homo sapiens
cagatatcacctatc

SEQ ID NO: 60051 - DNA, 15 bp, Homo sapiens
acagatatcacctat

SEQ ID NO: 60052 - DNA, 15 bp, Homo sapiens
aacagatatcaccta

SEQ ID NO: 60053 - DNA, 15 bp, Homo sapiens
gaacagatatcacct

SEQ ID NO: 60054 - DNA, 15 bp, Homo sapiens
agaacagatatcacc

SEQ ID NO: 60055 - DNA, 15 bp, Homo sapiens
aagaacagatatcac

SEQ ID NO: 60056 - DNA, 15 bp, Homo sapiens
aaagaacagatatca

SEQ ID NO: 60057 - DNA, 15 bp, Homo sapiens
aaaagaacagatatc

SEQ ID NO: 60058 - DNA, 15 bp, Homo sapiens
aaaaagaacagatat

SEQ ID NO: 60059 - DNA, 15 bp, Homo sapiens
gaaaaagaacagata

SEQ ID NO: 60060 - DNA, 15 bp, Homo sapiens
agaaaaagaacagat

SEQ ID NO: 60061 - DNA, 15 bp, Homo sapiens
cagaaaaagaacaga

SEQ ID NO: 60062 - DNA, 15 bp, Homo sapiens
ccagaaaaagaacag

SEQ ID NO: 60063 - DNA, 15 bp, Homo sapiens
gccagaaaaagaaca

SEQ ID NO: 60064 - DNA, 15 bp, Homo sapiens
tgccagaaaaagaac

SEQ ID NO: 60065 - DNA, 15 bp, Homo sapiens
ctgccagaaaaagaa

SEQ ID NO: 60066 - DNA, 15 bp, Homo sapiens
actgccagaaaaaga

SEQ ID NO: 60067 - DNA, 15 bp, Homo sapiens
cactgccagaaaaag

SEQ ID NO: 60068 - DNA, 15 bp, Homo sapiens
acactgccagaaaaa

SEQ ID NO: 60069 - DNA, 15 bp, Homo sapiens
aacactgccagaaaa

SEQ ID NO: 60070 - DNA, 15 bp, Homo sapiens
taacactgccagaaa

SEQ ID NO: 60071 - DNA, 15 bp, Homo sapiens
ttaacactgccagaa

SEQ ID NO: 60072 - DNA, 15 bp, Homo sapiens
gttaacactgccaga

SEQ ID NO: 60073 - DNA, 15 bp, Homo sapiens
agttaacactgccag

SEQ ID NO: 60074 - DNA, 15 bp, Homo sapiens
aagttaacactgcca

SEQ ID NO: 60075 - DNA, 15 bp, Homo sapiens
aaagttaacactgcc

SEQ ID NO: 60076 - DNA, 15 bp, Homo sapiens
caaagttaacactgc

SEQ ID NO: 60077 - DNA, 15 bp, Homo sapiens
tcaaagttaacactg

SEQ ID NO: 60078 - DNA, 15 bp, Homo sapiens
atcaaagttaacact

SEQ ID NO: 60079 - DNA, 15 bp, Homo sapiens
aatcaaagttaacac

SEQ ID NO: 60080 - DNA, 15 bp, Homo sapiens
caatcaaagttaaca

SEQ ID NO: 60081 - DNA, 15 bp, Homo sapiens
acaatcaaagttaac

SEQ ID NO: 60082 - DNA, 15 bp, Homo sapiens
aacaatcaaagttaa

SEQ ID NO: 60083 - DNA, 15 bp, Homo sapiens
aaacaatcaaagtta

SEQ ID NO: 60084 - DNA, 15 bp, Homo sapiens
caaacaatcaaagtt

SEQ ID NO: 60085 - DNA, 15 bp, Homo sapiens
ccaaacaatcaaagt

SEQ ID NO: 60086 - DNA, 15 bp, Homo sapiens
gccaaacaatcaaag

SEQ ID NO: 60087 - DNA, 15 bp, Homo sapiens
agccaaacaatcaaa

SEQ ID NO: 60088 - DNA, 15 bp, Homo sapiens
tagccaaacaatcaa

SEQ ID NO: 60089 - DNA, 15 bp, Homo sapiens
ttagccaaacaatca

SEQ ID NO: 60090 - DNA, 15 bp, Homo sapiens
cttagccaaacaatc

SEQ ID NO: 60091 - DNA, 15 bp, Homo sapiens
ccttagccaaacaat

SEQ ID NO: 60092 - DNA, 15 bp, Homo sapiens
accttagccaaacaa

SEQ ID NO: 60093 - DNA, 15 bp, Homo sapiens
caccttagccaaaca

SEQ ID NO: 60094 - DNA, 15 bp, Homo sapiens
ccaccttagccaaac

SEQ ID NO: 60095 - DNA, 15 bp, Homo sapiens
accaccttagccaaa

SEQ ID NO: 60096 - DNA, 15 bp, Homo sapiens
taccaccttagccaa

SEQ ID NO: 60097 - DNA, 15 bp, Homo sapiens
ataccaccttagcca

SEQ ID NO: 60098 - DNA, 15 bp, Homo sapiens
aataccaccttagcc

SEQ ID NO: 60099 - DNA, 15 bp, Homo sapiens
aaataccaccttagc

SEQ ID NO: 60100 - DNA, 15 bp, Homo sapiens
taaataccaccttag

SEQ ID NO: 60101 - DNA, 15 bp, Homo sapiens
gtaaataccacctta

SEQ ID NO: 60102 - DNA, 15 bp, Homo sapiens
ggtaaataccacctt

SEQ ID NO: 60103 - DNA, 15 bp, Homo sapiens
tggtaaataccacct

SEQ ID NO: 60104 - DNA, 15 bp, Homo sapiens
ttggtaaataccacc

SEQ ID NO: 60105 - DNA, 15 bp, Homo sapiens
cttggtaaataccac

SEQ ID NO: 60106 - DNA, 15 bp, Homo sapiens
acttggtaaatacca

SEQ ID NO: 60107 - DNA, 15 bp, Homo sapiens
aacttggtaaatacc

SEQ ID NO: 60108 - DNA, 15 bp, Homo sapiens
aaacttggtaaatac

SEQ ID NO: 60109 - DNA, 15 bp, Homo sapiens
gaaacttggtaaata

SEQ ID NO: 60110 - DNA, 15 bp, Homo sapiens
agaaacttggtaaat

SEQ ID NO: 60111 - DNA, 15 bp, Homo sapiens
aagaaacttggtaaa

SEQ ID NO: 60112 - DNA, 15 bp, Homo sapiens
gaagaaacttggtaa

SEQ ID NO: 60113 - DNA, 15 bp, Homo sapiens
ggaagaaacttggta

SEQ ID NO: 60114 - DNA, 15 bp, Homo sapiens
gggaagaaacttggt

SEQ ID NO: 60115 - DNA, 15 bp, Homo sapiens
agggaagaaacttgg

SEQ ID NO: 60116 - DNA, 15 bp, Homo sapiens
cagggaagaaacttg

SEQ ID NO: 60117 - DNA, 15 bp, Homo sapiens
acagggaagaaactt

SEQ ID NO: 60118 - DNA, 15 bp, Homo sapiens
tacagggaagaaact

SEQ ID NO: 60119 - DNA, 15 bp, Homo sapiens
ttacagggaagaaac

SEQ ID NO: 60120 - DNA, 15 bp, Homo sapiens
tttacagggaagaaa

SEQ ID NO: 60121 - DNA, 15 bp, Homo sapiens
atttacagggaagaa

SEQ ID NO: 60122 - DNA, 15 bp, Homo sapiens
aatttacagggaaga

SEQ ID NO: 60123 - DNA, 15 bp, Homo sapiens
caatttacagggaag

SEQ ID NO: 60124 - DNA, 15 bp, Homo sapiens
tcaatttacagggaa

SEQ ID NO: 60125 - DNA, 15 bp, Homo sapiens
gtcaatttacaggga

SEQ ID NO: 60126 - DNA, 15 bp, Homo sapiens
agtcaatttacaggg

SEQ ID NO: 60127 - DNA, 15 bp, Homo sapiens
tagtcaatttacagg

SEQ ID NO: 60128 - DNA, 15 bp, Homo sapiens
gtagtcaatttacag

SEQ ID NO: 60129 - DNA, 15 bp, Homo sapiens
ggtagtcaatttaca

SEQ ID NO: 60130 - DNA, 15 bp, Homo sapiens
gggtagtcaatttac

SEQ ID NO: 60131 - DNA, 15 bp, Homo sapiens
agggtagtcaattta

SEQ ID NO: 60132 - DNA, 15 bp, Homo sapiens
aagggtagtcaattt

SEQ ID NO: 60133 - DNA, 15 bp, Homo sapiens
aaagggtagtcaatt

SEQ ID NO: 60134 - DNA, 15 bp, Homo sapiens
caaagggtagtcaat

SEQ ID NO: 60135 - DNA, 15 bp, Homo sapiens
acaaagggtagtcaa

SEQ ID NO: 60136 - DNA, 15 bp, Homo sapiens
aacaaagggtagtca

SEQ ID NO: 60137 - DNA, 15 bp, Homo sapiens
taacaaagggtagtc

SEQ ID NO: 60138 - DNA, 15 bp, Homo sapiens
ataacaaagggtagt

SEQ ID NO: 60139 - DNA, 15 bp, Homo sapiens
aataacaaagggtag

SEQ ID NO: 60140 - DNA, 15 bp, Homo sapiens
taataacaaagggta

SEQ ID NO: 60141 - DNA, 15 bp, Homo sapiens
ttaataacaaagggt

SEQ ID NO: 60142 - DNA, 15 bp, Homo sapiens
tttaataacaaaggg

SEQ ID NO: 60143 - DNA, 15 bp, Homo sapiens
ttttaataacaaagg

SEQ ID NO: 60144 - DNA, 15 bp, Homo sapiens
cttttaataacaaag

SEQ ID NO: 60145 - DNA, 15 bp, Homo sapiens
acttttaataacaaa

SEQ ID NO: 60146 - DNA, 15 bp, Homo sapiens
tacttttaataacaa

SEQ ID NO: 60147 - DNA, 15 bp, Homo sapiens
atacttttaataaca

SEQ ID NO: 60148 - DNA, 15 bp, Homo sapiens
gatacttttaataac

SEQ ID NO: 60149 - DNA, 15 bp, Homo sapiens
cgatacttttaataa

SEQ ID NO: 60150 - DNA, 15 bp, Homo sapiens
ccgatacttttaata

SEQ ID NO: 60151 - DNA, 15 bp, Homo sapiens
cccgatacttttaat

SEQ ID NO: 60152 - DNA, 15 bp, Homo sapiens
acccgatacttttaa

SEQ ID NO: 60153 - DNA, 15 bp, Homo sapiens
cacccgatactttta

SEQ ID NO: 60154 - DNA, 15 bp, Homo sapiens
ccacccgatactttt

SEQ ID NO: 60155 - DNA, 15 bp, Homo sapiens
cccacccgatacttt

SEQ ID NO: 60156 - DNA, 15 bp, Homo sapiens
ccccacccgatactt

SEQ ID NO: 60157 - DNA, 15 bp, Homo sapiens
tccccacccgatact

SEQ ID NO: 60158 - DNA, 15 bp, Homo sapiens
atccccacccgatac

SEQ ID NO: 60159 - DNA, 15 bp, Homo sapiens
tatccccacccgata

SEQ ID NO: 60160 - DNA, 15 bp, Homo sapiens
atatccccacccgat

SEQ ID NO: 60161 - DNA, 15 bp, Homo sapiens
tatatccccacccga

SEQ ID NO: 60162 - DNA, 15 bp, Homo sapiens
gtatatccccacccg

SEQ ID NO: 60163 - DNA, 15 bp, Homo sapiens
agtatatccccaccc

SEQ ID NO: 60164 - DNA, 15 bp, Homo sapiens
aagtatatccccacc

SEQ ID NO: 60165 - DNA, 15 bp, Homo sapiens
aaagtatatccccac

SEQ ID NO: 60166 - DNA, 15 bp, Homo sapiens
caaagtatatcccca

SEQ ID NO: 60167 - DNA, 15 bp, Homo sapiens
tcaaagtatatcccc

SEQ ID NO: 60168 - DNA, 15 bp, Homo sapiens
ctcaaagtatatccc

SEQ ID NO: 60169 - DNA, 15 bp, Homo sapiens
tctcaaagtatatcc

SEQ ID NO: 60170 - DNA, 15 bp, Homo sapiens
gtctcaaagtatatc

SEQ ID NO: 60171 - DNA, 15 bp, Homo sapiens
agtctcaaagtatat

SEQ ID NO: 60172 - DNA, 15 bp, Homo sapiens
cagtctcaaagtata

SEQ ID NO: 60173 - DNA, 15 bp, Homo sapiens
acagtctcaaagtat

SEQ ID NO: 60174 - DNA, 15 bp, Homo sapiens
tacagtctcaaagta

SEQ ID NO: 60175 - DNA, 15 bp, Homo sapiens
atacagtctcaaagt

SEQ ID NO: 60176 - DNA, 15 bp, Homo sapiens
tatacagtctcaaag

SEQ ID NO: 60177 - DNA, 15 bp, Homo sapiens
ttatacagtctcaaa

SEQ ID NO: 60178 - DNA, 15 bp, Homo sapiens
tttatacagtctcaa

SEQ ID NO: 60179 - DNA, 15 bp, Homo sapiens
atttatacagtctca

SEQ ID NO: 60180 - DNA, 15 bp, Homo sapiens
tatttatacagtctc

SEQ ID NO: 60181 - DNA, 15 bp, Homo sapiens
atatttatacagtct

SEQ ID NO: 60182 - DNA, 15 bp, Homo sapiens
aatatttatacagtc

SEQ ID NO: 60183 - DNA, 15 bp, Homo sapiens
aaatatttatacagt

SEQ ID NO: 60184 - DNA, 15 bp, Homo sapiens
taaatatttatacag

SEQ ID NO: 60185 - DNA, 15 bp, Homo sapiens
ctaaatatttataca

SEQ ID NO: 60186 - DNA, 15 bp, Homo sapiens
actaaatatttatac

SEQ ID NO: 60187 - DNA, 15 bp, Homo sapiens
aactaaatatttata

SEQ ID NO: 60188 - DNA, 15 bp, Homo sapiens
aaactaaatatttat

SEQ ID NO: 60189 - DNA, 15 bp, Homo sapiens
aaaactaaatattta

SEQ ID NO: 60190 - DNA, 15 bp, Homo sapiens
aaaaactaaatattt

SEQ ID NO: 60191 - DNA, 15 bp, Homo sapiens
taaaaactaaatatt

SEQ ID NO: 60192 - DNA, 15 bp, Homo sapiens
ataaaaactaaatat

SEQ ID NO: 60193 - DNA, 15 bp, Homo sapiens
gataaaaactaaata

SEQ ID NO: 60194 - DNA, 15 bp, Homo sapiens
tgataaaaactaaat

SEQ ID NO: 60195 - DNA, 15 bp, Homo sapiens
ttgataaaaactaaa

SEQ ID NO: 60196 - DNA, 15 bp, Homo sapiens
tttgataaaaactaa

SEQ ID NO: 60197 - DNA, 15 bp, Homo sapiens
gtttgataaaaacta

SEQ ID NO: 60198 - DNA, 15 bp, Homo sapiens
agtttgataaaaact

SEQ ID NO: 60199 - DNA, 15 bp, Homo sapiens
aagtttgataaaaac

SEQ ID NO: 60200 - DNA, 15 bp, Homo sapiens
aaagtttgataaaaa

SEQ ID NO: 60201 - DNA, 15 bp, Homo sapiens
aaaagtttgataaaa

SEQ ID NO: 60202 - DNA, 15 bp, Homo sapiens
taaaagtttgataaa

SEQ ID NO: 60203 - DNA, 15 bp, Homo sapiens
ctaaaagtttgataa

SEQ ID NO: 60204 - DNA, 15 bp, Homo sapiens
gctaaaagtttgata

SEQ ID NO: 60205 - DNA, 15 bp, Homo sapiens
tgctaaaagtttgat

SEQ ID NO: 60206 - DNA, 15 bp, Homo sapiens
gtgctaaaagtttga

SEQ ID NO: 60207 - DNA, 15 bp, Homo sapiens
ggtgctaaaagtttg

SEQ ID NO: 60208 - DNA, 15 bp, Homo sapiens
gggtgctaaaagttt

SEQ ID NO: 60209 - DNA, 15 bp, Homo sapiens
cgggtgctaaaagtt

SEQ ID NO: 60210 - DNA, 15 bp, Homo sapiens
acgggtgctaaaagt

SEQ ID NO: 60211 - DNA, 15 bp, Homo sapiens
aacgggtgctaaaag

SEQ ID NO: 60212 - DNA, 15 bp, Homo sapiens
gaacgggtgctaaaa

SEQ ID NO: 60213 - DNA, 15 bp, Homo sapiens
tgaacgggtgctaaa

SEQ ID NO: 60214 - DNA, 15 bp, Homo sapiens
atgaacgggtgctaa

SEQ ID NO: 60215 - DNA, 15 bp, Homo sapiens
tatgaacgggtgcta

SEQ ID NO: 60216 - DNA, 15 bp, Homo sapiens
ttatgaacgggtgct

SEQ ID NO: 60217 - DNA, 15 bp, Homo sapiens
attatgaacgggtgc

SEQ ID NO: 60218 - DNA, 15 bp, Homo sapiens
aattatgaacgggtg

SEQ ID NO: 60219 - DNA, 15 bp, Homo sapiens
aaattatgaacgggt

SEQ ID NO: 60220 - DNA, 15 bp, Homo sapiens
aaaattatgaacggg

SEQ ID NO: 60221 - DNA, 15 bp, Homo sapiens
aaaaattatgaacgg

SEQ ID NO: 60222 - DNA, 15 bp, Homo sapiens
caaaaattatgaacg

SEQ ID NO: 60223 - DNA, 15 bp, Homo sapiens
gcaaaaattatgaac

SEQ ID NO: 60224 - DNA, 15 bp, Homo sapiens
ggcaaaaattatgaa

SEQ ID NO: 60225 - DNA, 15 bp, Homo sapiens
aggcaaaaattatga

SEQ ID NO: 60226 - DNA, 15 bp, Homo sapiens
caggcaaaaattatg

SEQ ID NO: 60227 - DNA, 15 bp, Homo sapiens
ccaggcaaaaattat

SEQ ID NO: 60228 - DNA, 15 bp, Homo sapiens
tccaggcaaaaatta

SEQ ID NO: 60229 - DNA, 15 bp, Homo sapiens
gtccaggcaaaaatt

SEQ ID NO: 60230 - DNA, 15 bp, Homo sapiens
ggtccaggcaaaaat

SEQ ID NO: 60231 - DNA, 15 bp, Homo sapiens
tggtccaggcaaaaa

SEQ ID NO: 60232 - DNA, 15 bp, Homo sapiens
ctggtccaggcaaaa

SEQ ID NO: 60233 - DNA, 15 bp, Homo sapiens
gctggtccaggcaaa

SEQ ID NO: 60234 - DNA, 15 bp, Homo sapiens
agctggtccaggcaa

SEQ ID NO: 60235 - DNA, 15 bp, Homo sapiens
tagctggtccaggca

SEQ ID NO: 60236 - DNA, 15 bp, Homo sapiens
atagctggtccaggc

SEQ ID NO: 60237 - DNA, 15 bp, Homo sapiens
aatagctggtccagg

SEQ ID NO: 60238 - DNA, 15 bp, Homo sapiens
taatagctggtccag

SEQ ID NO: 60239 - DNA, 15 bp, Homo sapiens
ataatagctggtcca

SEQ ID NO: 60240 - DNA, 15 bp, Homo sapiens
aataatagctggtcc

SEQ ID NO: 60241 - DNA, 15 bp, Homo sapiens
taataatagctggtc

SEQ ID NO: 60242 - DNA, 15 bp, Homo sapiens
ataataatagctggt

SEQ ID NO: 60243 - DNA, 15 bp, Homo sapiens
cataataatagctgg

SEQ ID NO: 60244 - DNA, 15 bp, Homo sapiens
tcataataatagctg

SEQ ID NO: 60245 - DNA, 15 bp, Homo sapiens
atcataataatagct

SEQ ID NO: 60246 - DNA, 15 bp, Homo sapiens
catcataataatagc

SEQ ID NO: 60247 - DNA, 15 bp, Homo sapiens
gcatcataataatag

SEQ ID NO: 60248 - DNA, 15 bp, Homo sapiens
agcatcataataata

SEQ ID NO: 60249 - DNA, 15 bp, Homo sapiens
aagcatcataataat

SEQ ID NO: 60250 - DNA, 15 bp, Homo sapiens
caagcatcataataa

SEQ ID NO: 60251 - DNA, 15 bp, Homo sapiens
tcaagcatcataata

SEQ ID NO: 60252 - DNA, 15 bp, Homo sapiens
atcaagcatcataat

SEQ ID NO: 60253 - DNA, 15 bp, Homo sapiens
tatcaagcatcataa

SEQ ID NO: 60254 - DNA, 15 bp, Homo sapiens
ctatcaagcatcata

SEQ ID NO: 60255 - DNA, 15 bp, Homo sapiens
tctatcaagcatcat

SEQ ID NO: 60256 - DNA, 15 bp, Homo sapiens
atctatcaagcatca

SEQ ID NO: 60257 - DNA, 15 bp, Homo sapiens
tatctatcaagcatc

SEQ ID NO: 60258 - DNA, 15 bp, Homo sapiens
ttatctatcaagcat

SEQ ID NO: 60259 - DNA, 15 bp, Homo sapiens
attatctatcaagca

SEQ ID NO: 60260 - DNA, 15 bp, Homo sapiens
cattatctatcaagc

SEQ ID NO: 60261 - DNA, 15 bp, Homo sapiens
tcattatctatcaag

SEQ ID NO: 60262 - DNA, 15 bp, Homo sapiens
atcattatctatcaa

SEQ ID NO: 60263 - DNA, 15 bp, Homo sapiens
aatcattatctatca

SEQ ID NO: 60264 - DNA, 15 bp, Homo sapiens
aaatcattatctatc

SEQ ID NO: 60265 - DNA, 15 bp, Homo sapiens
aaaatcattatctat

SEQ ID NO: 60266 - DNA, 15 bp, Homo sapiens
gaaaatcattatcta

SEQ ID NO: 60267 - DNA, 15 bp, Homo sapiens
agaaaatcattatct

SEQ ID NO: 60268 - DNA, 15 bp, Homo sapiens
tagaaaatcattatc

SEQ ID NO: 60269 - DNA, 15 bp, Homo sapiens
ttagaaaatcattat

SEQ ID NO: 60270 - DNA, 15 bp, Homo sapiens
attagaaaatcatta

SEQ ID NO: 60271 - DNA, 15 bp, Homo sapiens
aattagaaaatcatt

SEQ ID NO: 60272 - DNA, 15 bp, Homo sapiens
aaattagaaaatcat

SEQ ID NO: 60273 - DNA, 15 bp, Homo sapiens
gaaattagaaaatca

SEQ ID NO: 60274 - DNA, 15 bp, Homo sapiens
tgaaattagaaaatc

SEQ ID NO: 60275 - DNA, 15 bp, Homo sapiens
atgaaattagaaaat

SEQ ID NO: 60276 - DNA, 15 bp, Homo sapiens
aatgaaattagaaaa

SEQ ID NO: 60277 - DNA, 15 bp, Homo sapiens
taatgaaattagaaa

SEQ ID NO: 60278 - DNA, 15 bp, Homo sapiens
ttaatgaaattagaa

SEQ ID NO: 60279 - DNA, 15 bp, Homo sapiens
attaatgaaattaga

SEQ ID NO: 60280 - DNA, 15 bp, Homo sapiens
gattaatgaaattag

SEQ ID NO: 60281 - DNA, 15 bp, Homo sapiens
ggattaatgaaatta

SEQ ID NO: 60282 - DNA, 15 bp, Homo sapiens
aggattaatgaaatt

SEQ ID NO: 60283 - DNA, 15 bp, Homo sapiens
aaggattaatgaaat

SEQ ID NO: 60284 - DNA, 15 bp, Homo sapiens
gaaggattaatgaaa

SEQ ID NO: 60285 - DNA, 15 bp, Homo sapiens
agaaggattaatgaa

SEQ ID NO: 60286 - DNA, 15 bp, Homo sapiens
tagaaggattaatga

SEQ ID NO: 60287 - DNA, 15 bp, Homo sapiens
gtagaaggattaatg

SEQ ID NO: 60288 - DNA, 15 bp, Homo sapiens
tgtagaaggattaat

SEQ ID NO: 60289 - DNA, 15 bp, Homo sapiens
atgtagaaggattaa

SEQ ID NO: 60290 - DNA, 15 bp, Homo sapiens
aatgtagaaggatta

SEQ ID NO: 60291 - DNA, 15 bp, Homo sapiens
taatgtagaaggatt

SEQ ID NO: 60292 - DNA, 15 bp, Homo sapiens
ctaatgtagaaggat

SEQ ID NO: 60293 - DNA, 15 bp, Homo sapiens
actaatgtagaagga

SEQ ID NO: 60294 - DNA, 15 bp, Homo sapiens
aactaatgtagaagg

SEQ ID NO: 60295 - DNA, 15 bp, Homo sapiens
caactaatgtagaag

SEQ ID NO: 60296 - DNA, 15 bp, Homo sapiens
ccaactaatgtagaa

SEQ ID NO: 60297 - DNA, 15 bp, Homo sapiens
accaactaatgtaga

SEQ ID NO: 60298 - DNA, 15 bp, Homo sapiens
caccaactaatgtag

SEQ ID NO: 60299 - DNA, 15 bp, Homo sapiens
acaccaactaatgta

SEQ ID NO: 60300 - DNA, 15 bp, Homo sapiens
aacaccaactaatgt

SEQ ID NO: 60301 - DNA, 15 bp, Homo sapiens
gaacaccaactaatg

SEQ ID NO: 60302 - DNA, 15 bp, Homo sapiens
agaacaccaactaat

SEQ ID NO: 60303 - DNA, 15 bp, Homo sapiens
tagaacaccaactaa

SEQ ID NO: 60304 - DNA, 15 bp, Homo sapiens
gtagaacaccaacta

SEQ ID NO: 60305 - DNA, 15 bp, Homo sapiens
agtagaacaccaact

SEQ ID NO: 60306 - DNA, 15 bp, Homo sapiens
aagtagaacaccaac

SEQ ID NO: 60307 - DNA, 15 bp, Homo sapiens
caagtagaacaccaa

SEQ ID NO: 60308 - DNA, 15 bp, Homo sapiens
acaagtagaacacca

SEQ ID NO: 60309 - DNA, 15 bp, Homo sapiens
tacaagtagaacacc

SEQ ID NO: 60310 - DNA, 15 bp, Homo sapiens
ttacaagtagaacac

SEQ ID NO: 60311 - DNA, 15 bp, Homo sapiens
tttacaagtagaaca

SEQ ID NO: 60312 - DNA, 15 bp, Homo sapiens
ctttacaagtagaac

SEQ ID NO: 60313 - DNA, 15 bp, Homo sapiens
tctttacaagtagaa

SEQ ID NO: 60314 - DNA, 15 bp, Homo sapiens
ttctttacaagtaga

SEQ ID NO: 60315 - DNA, 15 bp, Homo sapiens
cttctttacaagtag

SEQ ID NO: 60316 - DNA, 15 bp, Homo sapiens
tcttctttacaagta

SEQ ID NO: 60317 - DNA, 15 bp, Homo sapiens
ctcttctttacaagt

SEQ ID NO: 60318 - DNA, 15 bp, Homo sapiens
gctcttctttacaag

SEQ ID NO: 60319 - DNA, 15 bp, Homo sapiens
agctcttctttacaa

SEQ ID NO: 60320 - DNA, 15 bp, Homo sapiens
aagctcttctttaca

SEQ ID NO: 60321 - DNA, 15 bp, Homo sapiens
gaagctcttctttac

SEQ ID NO: 60322 - DNA, 15 bp, Homo sapiens
ggaagctcttcttta

SEQ ID NO: 60323 - DNA, 15 bp, Homo sapiens
gggaagctcttcttt

SEQ ID NO: 60324 - DNA, 15 bp, Homo sapiens
ggggaagctcttctt

SEQ ID NO: 60325 - DNA, 15 bp, Homo sapiens
aggggaagctcttct

SEQ ID NO: 60326 - DNA, 15 bp, Homo sapiens
aaggggaagctcttc

SEQ ID NO: 60327 - DNA, 15 bp, Homo sapiens
caaggggaagctctt

SEQ ID NO: 60328 - DNA, 15 bp, Homo sapiens
acaaggggaagctct

SEQ ID NO: 60329 - DNA, 15 bp, Homo sapiens
aacaaggggaagctc

SEQ ID NO: 60330 - DNA, 15 bp, Homo sapiens
aaacaaggggaagct

SEQ ID NO: 60331 - DNA, 15 bp, Homo sapiens
gaaacaaggggaagc

SEQ ID NO: 60332 - DNA, 15 bp, Homo sapiens
agaaacaaggggaag

SEQ ID NO: 60333 - DNA, 15 bp, Homo sapiens
aagaaacaaggggaa

SEQ ID NO: 60334 - DNA, 15 bp, Homo sapiens
caagaaacaagggga

SEQ ID NO: 60335 - DNA, 15 bp, Homo sapiens
acaagaaacaagggg

SEQ ID NO: 60336 - DNA, 15 bp, Homo sapiens
aacaagaaacaaggg

SEQ ID NO: 60337 - DNA, 15 bp, Homo sapiens
aaacaagaaacaagg

SEQ ID NO: 60338 - DNA, 15 bp, Homo sapiens
gaaacaagaaacaag

SEQ ID NO: 60339 - DNA, 15 bp, Homo sapiens
agaaacaagaaacaa

SEQ ID NO: 60340 - DNA, 15 bp, Homo sapiens
gagaaacaagaaaca

SEQ ID NO: 60341 - DNA, 15 bp, Homo sapiens
agagaaacaagaaac

SEQ ID NO: 60342 - DNA, 15 bp, Homo sapiens
tagagaaacaagaaa

SEQ ID NO: 60343 - DNA, 15 bp, Homo sapiens
atagagaaacaagaa

SEQ ID NO: 60344 - DNA, 15 bp, Homo sapiens
gatagagaaacaaga

SEQ ID NO: 60345 - DNA, 15 bp, Homo sapiens
agatagagaaacaag

SEQ ID NO: 60346 - DNA, 15 bp, Homo sapiens
aagatagagaaacaa

SEQ ID NO: 60347 - DNA, 15 bp, Homo sapiens
taagatagagaaaca

SEQ ID NO: 60348 - DNA, 15 bp, Homo sapiens
ataagatagagaaac

SEQ ID NO: 60349 - DNA, 15 bp, Homo sapiens
gataagatagagaaa

SEQ ID NO: 60350 - DNA, 15 bp, Homo sapiens
agataagatagagaa

SEQ ID NO: 60351 - DNA, 15 bp, Homo sapiens
gagataagatagaga

SEQ ID NO: 60352 - DNA, 15 bp, Homo sapiens
agagataagatagag

SEQ ID NO: 60353 - DNA, 15 bp, Homo sapiens
gagagataagataga

SEQ ID NO: 60354 - DNA, 15 bp, Homo sapiens
agagagataagatag

SEQ ID NO: 60355 - DNA, 15 bp, Homo sapiens
gagagagataagata

SEQ ID NO: 60356 - DNA, 15 bp, Homo sapiens
agagagagataagat

SEQ ID NO: 60357 - DNA, 15 bp, Homo sapiens
gagagagagataaga

SEQ ID NO: 60358 - DNA, 15 bp, Homo sapiens
ggagagagagataag

SEQ ID NO: 60359 - DNA, 15 bp, Homo sapiens
tggagagagagataa

SEQ ID NO: 60360 - DNA, 15 bp, Homo sapiens
atggagagagagata

SEQ ID NO: 60361 - DNA, 15 bp, Homo sapiens
aatggagagagagat

SEQ ID NO: 60362 - DNA, 15 bp, Homo sapiens
gaatggagagagaga

SEQ ID NO: 60363 - DNA, 15 bp, Homo sapiens
tgaatggagagagag

SEQ ID NO: 60364 - DNA, 15 bp, Homo sapiens
atgaatggagagaga

SEQ ID NO: 60365 - DNA, 15 bp, Homo sapiens
aatgaatggagagag

SEQ ID NO: 60366 - DNA, 15 bp, Homo sapiens
aaatgaatggagaga

SEQ ID NO: 60367 - DNA, 15 bp, Homo sapiens
taaatgaatggagag

SEQ ID NO: 60368 - DNA, 15 bp, Homo sapiens
ataaatgaatggaga

SEQ ID NO: 60369 - DNA, 15 bp, Homo sapiens
aataaatgaatggag

SEQ ID NO: 60370 - DNA, 15 bp, Homo sapiens
gaataaatgaatgga

SEQ ID NO: 60371 - DNA, 15 bp, Homo sapiens
tgaataaatgaatgg

SEQ ID NO: 60372 - DNA, 15 bp, Homo sapiens
atgaataaatgaatg

SEQ ID NO: 60373 - DNA, 15 bp, Homo sapiens
aatgaataaatgaat

SEQ ID NO: 60374 - DNA, 15 bp, Homo sapiens
aaatgaataaatgaa

SEQ ID NO: 60375 - DNA, 15 bp, Homo sapiens
taaatgaataaatga

SEQ ID NO: 60376 - DNA, 15 bp, Homo sapiens
ataaatgaataaatg

SEQ ID NO: 60377 - DNA, 15 bp, Homo sapiens
cataaatgaataaat

SEQ ID NO: 60378 - DNA, 15 bp, Homo sapiens
acataaatgaataaa

SEQ ID NO: 60379 - DNA, 15 bp, Homo sapiens
tacataaatgaataa

SEQ ID NO: 60380 - DNA, 15 bp, Homo sapiens
atacataaatgaata

SEQ ID NO: 60381 - DNA, 15 bp, Homo sapiens
gatacataaatgaat

SEQ ID NO: 60382 - DNA, 15 bp, Homo sapiens
tgatacataaatgaa

SEQ ID NO: 60383 - DNA, 15 bp, Homo sapiens
ctgatacataaatga

SEQ ID NO: 60384 - DNA, 15 bp, Homo sapiens
actgatacataaatg

SEQ ID NO: 60385 - DNA, 15 bp, Homo sapiens
tactgatacataaat

SEQ ID NO: 60386 - DNA, 15 bp, Homo sapiens
atactgatacataaa

SEQ ID NO: 60387 - DNA, 15 bp, Homo sapiens
tatactgatacataa

SEQ ID NO: 60388 - DNA, 15 bp, Homo sapiens
ctatactgatacata

SEQ ID NO: 60389 - DNA, 15 bp, Homo sapiens
tctatactgatacat

SEQ ID NO: 60390 - DNA, 15 bp, Homo sapiens
atctatactgataca

SEQ ID NO: 60391 - DNA, 15 bp, Homo sapiens
aatctatactgatac

SEQ ID NO: 60392 - DNA, 15 bp, Homo sapiens
gaatctatactgata

SEQ ID NO: 60393 - DNA, 15 bp, Homo sapiens
tgaatctatactgat

SEQ ID NO: 60394 - DNA, 15 bp, Homo sapiens
atgaatctatactga

SEQ ID NO: 60395 - DNA, 15 bp, Homo sapiens
catgaatctatactg

SEQ ID NO: 60396 - DNA, 15 bp, Homo sapiens
ccatgaatctatact

SEQ ID NO: 60397 - DNA, 15 bp, Homo sapiens
tccatgaatctatac

SEQ ID NO: 60398 - DNA, 15 bp, Homo sapiens
gtccatgaatctata

SEQ ID NO: 60399 - DNA, 15 bp, Homo sapiens
tgtccatgaatctat

SEQ ID NO: 60400 - DNA, 15 bp, Homo sapiens
atgtccatgaatcta

SEQ ID NO: 60401 - DNA, 15 bp, Homo sapiens
aatgtccatgaatct

SEQ ID NO: 60402 - DNA, 15 bp, Homo sapiens
aaatgtccatgaatc

SEQ ID NO: 60403 - DNA, 15 bp, Homo sapiens
caaatgtccatgaat

SEQ ID NO: 60404 - DNA, 15 bp, Homo sapiens
gcaaatgtccatgaa

SEQ ID NO: 60405 - DNA, 15 bp, Homo sapiens
tgcaaatgtccatga

SEQ ID NO: 60406 - DNA, 15 bp, Homo sapiens
atgcaaatgtccatg

SEQ ID NO: 60407 - DNA, 15 bp, Homo sapiens
tatgcaaatgtccat

SEQ ID NO: 60408 - DNA, 15 bp, Homo sapiens
ctatgcaaatgtcca

SEQ ID NO: 60409 - DNA, 15 bp, Homo sapiens
cctatgcaaatgtcc

SEQ ID NO: 60410 - DNA, 15 bp, Homo sapiens
acctatgcaaatgtc

SEQ ID NO: 60411 - DNA, 15 bp, Homo sapiens
aacctatgcaaatgt

SEQ ID NO: 60412 - DNA, 15 bp, Homo sapiens
aaacctatgcaaatg

SEQ ID NO: 60413 - DNA, 15 bp, Homo sapiens
taaacctatgcaaat

SEQ ID NO: 60414 - DNA, 15 bp, Homo sapiens
ataaacctatgcaaa

SEQ ID NO: 60415 - DNA, 15 bp, Homo sapiens
cataaacctatgcaa

SEQ ID NO: 60416 - DNA, 15 bp, Homo sapiens
tcataaacctatgca

SEQ ID NO: 60417 - DNA, 15 bp, Homo sapiens
atcataaacctatgc

SEQ ID NO: 60418 - DNA, 15 bp, Homo sapiens
gatcataaacctatg

SEQ ID NO: 60419 - DNA, 15 bp, Homo sapiens
agatcataaacctat

SEQ ID NO: 60420 - DNA, 15 bp, Homo sapiens
aagatcataaaccta

SEQ ID NO: 60421 - DNA, 15 bp, Homo sapiens
aaagatcataaacct

SEQ ID NO: 60422 - DNA, 15 bp, Homo sapiens
aaaagatcataaacc

SEQ ID NO: 60423 - DNA, 15 bp, Homo sapiens
taaaagatcataaac

SEQ ID NO: 60424 - DNA, 15 bp, Homo sapiens
gtaaaagatcataaa

SEQ ID NO: 60425 - DNA, 15 bp, Homo sapiens
agtaaaagatcataa

SEQ ID NO: 60426 - DNA, 15 bp, Homo sapiens
tagtaaaagatcata

SEQ ID NO: 60427 - DNA, 15 bp, Homo sapiens
ctagtaaaagatcat

SEQ ID NO: 60428 - DNA, 15 bp, Homo sapiens
actagtaaaagatca

SEQ ID NO: 60429 - DNA, 15 bp, Homo sapiens
tactagtaaaagatc

SEQ ID NO: 60430 - DNA, 15 bp, Homo sapiens
gtactagtaaaagat

SEQ ID NO: 60431 - DNA, 15 bp, Homo sapiens
agtactagtaaaaga

SEQ ID NO: 60432 - DNA, 15 bp, Homo sapiens
gagtactagtaaaag

SEQ ID NO: 60433 - DNA, 15 bp, Homo sapiens
tgagtactagtaaaa

SEQ ID NO: 60434 - DNA, 15 bp, Homo sapiens
atgagtactagtaaa

SEQ ID NO: 60435 - DNA, 15 bp, Homo sapiens
aatgagtactagtaa

SEQ ID NO: 60436 - DNA, 15 bp, Homo sapiens
aaatgagtactagta

SEQ ID NO: 60437 - DNA, 15 bp, Homo sapiens
gaaatgagtactagt

SEQ ID NO: 60438 - DNA, 15 bp, Homo sapiens
tgaaatgagtactag

SEQ ID NO: 60439 - DNA, 15 bp, Homo sapiens
ctgaaatgagtacta

SEQ ID NO: 60440 - DNA, 15 bp, Homo sapiens
actgaaatgagtact

SEQ ID NO: 60441 - DNA, 15 bp, Homo sapiens
cactgaaatgagtac

SEQ ID NO: 60442 - DNA, 15 bp, Homo sapiens
acactgaaatgagta

SEQ ID NO: 60443 - DNA, 15 bp, Homo sapiens
aacactgaaatgagt

SEQ ID NO: 60444 - DNA, 15 bp, Homo sapiens
gaacactgaaatgag

SEQ ID NO: 60445 - DNA, 15 bp, Homo sapiens
tgaacactgaaatga

SEQ ID NO: 60446 - DNA, 15 bp, Homo sapiens
ttgaacactgaaatg

SEQ ID NO: 60447 - DNA, 15 bp, Homo sapiens
cttgaacactgaaat

SEQ ID NO: 60448 - DNA, 15 bp, Homo sapiens
acttgaacactgaaa

SEQ ID NO: 60449 - DNA, 15 bp, Homo sapiens
gacttgaacactgaa

SEQ ID NO: 60450 - DNA, 15 bp, Homo sapiens
tgacttgaacactga

SEQ ID NO: 60451 - DNA, 15 bp, Homo sapiens
atgacttgaacactg

SEQ ID NO: 60452 - DNA, 15 bp, Homo sapiens
gatgacttgaacact

SEQ ID NO: 60453 - DNA, 15 bp, Homo sapiens
ggatgacttgaacac

SEQ ID NO: 60454 - DNA, 15 bp, Homo sapiens
aggatgacttgaaca

SEQ ID NO: 60455 - DNA, 15 bp, Homo sapiens
taggatgacttgaac

SEQ ID NO: 60456 - DNA, 15 bp, Homo sapiens
ctaggatgacttgaa

SEQ ID NO: 60457 - DNA, 15 bp, Homo sapiens
tctaggatgacttga

SEQ ID NO: 60458 - DNA, 15 bp, Homo sapiens
atctaggatgacttg

SEQ ID NO: 60459 - DNA, 15 bp, Homo sapiens
aatctaggatgactt

SEQ ID NO: 60460 - DNA, 15 bp, Homo sapiens
aaatctaggatgact

SEQ ID NO: 60461 - DNA, 15 bp, Homo sapiens
caaatctaggatgac

SEQ ID NO: 60462 - DNA, 15 bp, Homo sapiens
ccaaatctaggatga

SEQ ID NO: 60463 - DNA, 15 bp, Homo sapiens
gccaaatctaggatg

SEQ ID NO: 60464 - DNA, 15 bp, Homo sapiens
ggccaaatctaggat

SEQ ID NO: 60465 - DNA, 15 bp, Homo sapiens
tggccaaatctagga

SEQ ID NO: 60466 - DNA, 15 bp, Homo sapiens
ctggccaaatctagg

SEQ ID NO: 60467 - DNA, 15 bp, Homo sapiens
actggccaaatctag

SEQ ID NO: 60468 - DNA, 15 bp, Homo sapiens
cactggccaaatcta

SEQ ID NO: 60469 - DNA, 15 bp, Homo sapiens
acactggccaaatct

SEQ ID NO: 60470 - DNA, 15 bp, Homo sapiens
cacactggccaaatc

SEQ ID NO: 60471 - DNA, 15 bp, Homo sapiens
tcacactggccaaat

SEQ ID NO: 60472 - DNA, 15 bp, Homo sapiens
ctcacactggccaaa

SEQ ID NO: 60473 - DNA, 15 bp, Homo sapiens
gctcacactggccaa

SEQ ID NO: 60474 - DNA, 15 bp, Homo sapiens
ggctcacactggcca

SEQ ID NO: 60475 - DNA, 15 bp, Homo sapiens
gggctcacactggcc

SEQ ID NO: 60476 - DNA, 15 bp, Homo sapiens
ggggctcacactggc

SEQ ID NO: 60477 - DNA, 15 bp, Homo sapiens
aggggctcacactgg

SEQ ID NO: 60478 - DNA, 15 bp, Homo sapiens
aaggggctcacactg

SEQ ID NO: 60479 - DNA, 15 bp, Homo sapiens
taaggggctcacact

SEQ ID NO: 60480 - DNA, 15 bp, Homo sapiens
ttaaggggctcacac

SEQ ID NO: 60481 - DNA, 15 bp, Homo sapiens
tttaaggggctcaca

SEQ ID NO: 60482 - DNA, 15 bp, Homo sapiens
atttaaggggctcac

SEQ ID NO: 60483 - DNA, 15 bp, Homo sapiens
aatttaaggggctca

SEQ ID NO: 60484 - DNA, 15 bp, Homo sapiens
caatttaaggggctc

SEQ ID NO: 60485 - DNA, 15 bp, Homo sapiens
ccaatttaaggggct

SEQ ID NO: 60486 - DNA, 15 bp, Homo sapiens
gccaatttaaggggc

SEQ ID NO: 60487 - DNA, 15 bp, Homo sapiens
agccaatttaagggg

SEQ ID NO: 60488 - DNA, 15 bp, Homo sapiens
gagccaatttaaggg

SEQ ID NO: 60489 - DNA, 15 bp, Homo sapiens
ggagccaatttaagg

SEQ ID NO: 60490 - DNA, 15 bp, Homo sapiens
aggagccaatttaag

SEQ ID NO: 60491 - DNA, 15 bp, Homo sapiens
caggagccaatttaa

SEQ ID NO: 60492 - DNA, 15 bp, Homo sapiens
acaggagccaattta

SEQ ID NO: 60493 - DNA, 15 bp, Homo sapiens
cacaggagccaattt

SEQ ID NO: 60494 - DNA, 15 bp, Homo sapiens
acacaggagccaatt

SEQ ID NO: 60495 - DNA, 15 bp, Homo sapiens
gacacaggagccaat

SEQ ID NO: 60496 - DNA, 15 bp, Homo sapiens
ggacacaggagccaa

SEQ ID NO: 60497 - DNA, 15 bp, Homo sapiens
gggacacaggagcca

SEQ ID NO: 60498 - DNA, 15 bp, Homo sapiens
agggacacaggagcc

SEQ ID NO: 60499 - DNA, 15 bp, Homo sapiens
aagggacacaggagc

SEQ ID NO: 60500 - DNA, 15 bp, Homo sapiens
taagggacacaggag

SEQ ID NO: 60501 - DNA, 15 bp, Homo sapiens
ctaagggacacagga

SEQ ID NO: 60502 - DNA, 15 bp, Homo sapiens
tctaagggacacagg

SEQ ID NO: 60503 - DNA, 15 bp, Homo sapiens
atctaagggacacag

SEQ ID NO: 60504 - DNA, 15 bp, Homo sapiens
tatctaagggacaca

SEQ ID NO: 60505 - DNA, 15 bp, Homo sapiens
ctatctaagggacac

SEQ ID NO: 60506 - DNA, 15 bp, Homo sapiens
tctatctaagggaca

SEQ ID NO: 60507 - DNA, 15 bp, Homo sapiens
atctatctaagggac

SEQ ID NO: 60508 - DNA, 15 bp, Homo sapiens
gatctatctaaggga

SEQ ID NO: 60509 - DNA, 15 bp, Homo sapiens
agatctatctaaggg

SEQ ID NO: 60510 - DNA, 15 bp, Homo sapiens
tagatctatctaagg

SEQ ID NO: 60511 - DNA, 15 bp, Homo sapiens
atagatctatctaag

SEQ ID NO: 60512 - DNA, 15 bp, Homo sapiens
catagatctatctaa

SEQ ID NO: 60513 - DNA, 15 bp, Homo sapiens
acatagatctatcta

SEQ ID NO: 60514 - DNA, 15 bp, Homo sapiens
gacatagatctatct

SEQ ID NO: 60515 - DNA, 15 bp, Homo sapiens
tgacatagatctatc

SEQ ID NO: 60516 - DNA, 15 bp, Homo sapiens
atgacatagatctat

SEQ ID NO: 60517 - DNA, 15 bp, Homo sapiens
aatgacatagatcta

SEQ ID NO: 60518 - DNA, 15 bp, Homo sapiens
gaatgacatagatct

SEQ ID NO: 60519 - DNA, 15 bp, Homo sapiens
agaatgacatagatc

SEQ ID NO: 60520 - DNA, 15 bp, Homo sapiens
aagaatgacatagat

SEQ ID NO: 60521 - DNA, 15 bp, Homo sapiens
aaagaatgacataga

SEQ ID NO: 60522 - DNA, 15 bp, Homo sapiens
caaagaatgacatag

SEQ ID NO: 60523 - DNA, 15 bp, Homo sapiens
tcaaagaatgacata

SEQ ID NO: 60524 - DNA, 15 bp, Homo sapiens
ctcaaagaatgacat

SEQ ID NO: 60525 - DNA, 15 bp, Homo sapiens
gctcaaagaatgaca

SEQ ID NO: 60526 - DNA, 15 bp, Homo sapiens
tgctcaaagaatgac

SEQ ID NO: 60527 - DNA, 15 bp, Homo sapiens
gtgctcaaagaatga

SEQ ID NO: 60528 - DNA, 15 bp, Homo sapiens
agtgctcaaagaatg

SEQ ID NO: 60529 - DNA, 15 bp, Homo sapiens
aagtgctcaaagaat

SEQ ID NO: 60530 - DNA, 15 bp, Homo sapiens
aaagtgctcaaagaa

SEQ ID NO: 60531 - DNA, 15 bp, Homo sapiens
gaaagtgctcaaaga

SEQ ID NO: 60532 - DNA, 15 bp, Homo sapiens
agaaagtgctcaaag

SEQ ID NO: 60533 - DNA, 15 bp, Homo sapiens
aagaaagtgctcaaa

SEQ ID NO: 60534 - DNA, 15 bp, Homo sapiens
taagaaagtgctcaa

SEQ ID NO: 60535 - DNA, 15 bp, Homo sapiens
ttaagaaagtgctca

SEQ ID NO: 60536 - DNA, 15 bp, Homo sapiens
tttaagaaagtgctc

SEQ ID NO: 60537 - DNA, 15 bp, Homo sapiens
ttttaagaaagtgct

SEQ ID NO: 60538 - DNA, 15 bp, Homo sapiens
gttttaagaaagtgc

SEQ ID NO: 60539 - DNA, 15 bp, Homo sapiens
tgttttaagaaagtg

SEQ ID NO: 60540 - DNA, 15 bp, Homo sapiens
atgttttaagaaagt

SEQ ID NO: 60541 - DNA, 15 bp, Homo sapiens
tatgttttaagaaag

SEQ ID NO: 60542 - DNA, 15 bp, Homo sapiens
atatgttttaagaaa

SEQ ID NO: 60543 - DNA, 15 bp, Homo sapiens
aatatgttttaagaa

SEQ ID NO: 60544 - DNA, 15 bp, Homo sapiens
aaatatgttttaaga

SEQ ID NO: 60545 - DNA, 15 bp, Homo sapiens
taaatatgttttaag

SEQ ID NO: 60546 - DNA, 15 bp, Homo sapiens
gtaaatatgttttaa

SEQ ID NO: 60547 - DNA, 15 bp, Homo sapiens
agtaaatatgtttta

SEQ ID NO: 60548 - DNA, 15 bp, Homo sapiens
tagtaaatatgtttt

SEQ ID NO: 60549 - DNA, 15 bp, Homo sapiens
ttagtaaatatgttt

SEQ ID NO: 60550 - DNA, 15 bp, Homo sapiens
attagtaaatatgtt

SEQ ID NO: 60551 - DNA, 15 bp, Homo sapiens
aattagtaaatatgt

SEQ ID NO: 60552 - DNA, 15 bp, Homo sapiens
aaattagtaaatatg

SEQ ID NO: 60553 - DNA, 15 bp, Homo sapiens
taaattagtaaatat

SEQ ID NO: 60554 - DNA, 15 bp, Homo sapiens
ctaaattagtaaata

SEQ ID NO: 60555 - DNA, 15 bp, Homo sapiens
tctaaattagtaaat

SEQ ID NO: 60556 - DNA, 15 bp, Homo sapiens
ttctaaattagtaaa

SEQ ID NO: 60557 - DNA, 15 bp, Homo sapiens
attctaaattagtaa

SEQ ID NO: 60558 - DNA, 15 bp, Homo sapiens
tattctaaattagta

SEQ ID NO: 60559 - DNA, 15 bp, Homo sapiens
ttattctaaattagt

SEQ ID NO: 60560 - DNA, 15 bp, Homo sapiens
attattctaaattag

SEQ ID NO: 60561 - DNA, 15 bp, Homo sapiens
tattattctaaatta

SEQ ID NO: 60562 - DNA, 15 bp, Homo sapiens
gtattattctaaatt

SEQ ID NO: 60563 - DNA, 15 bp, Homo sapiens
agtattattctaaat

SEQ ID NO: 60564 - DNA, 15 bp, Homo sapiens
tagtattattctaaa

SEQ ID NO: 60565 - DNA, 15 bp, Homo sapiens
atagtattattctaa

SEQ ID NO: 60566 - DNA, 15 bp, Homo sapiens
tatagtattattcta

SEQ ID NO: 60567 - DNA, 15 bp, Homo sapiens
ttatagtattattct

SEQ ID NO: 60568 - DNA, 15 bp, Homo sapiens
tttatagtattattc

SEQ ID NO: 60569 - DNA, 15 bp, Homo sapiens
ttttatagtattatt

SEQ ID NO: 60570 - DNA, 15 bp, Homo sapiens
attttatagtattat

SEQ ID NO: 60571 - DNA, 15 bp, Homo sapiens
cattttatagtatta

SEQ ID NO: 60572 - DNA, 15 bp, Homo sapiens
acattttatagtatt

SEQ ID NO: 60573 - DNA, 15 bp, Homo sapiens
aacattttatagtat

SEQ ID NO: 60574 - DNA, 15 bp, Homo sapiens
taacattttatagta

SEQ ID NO: 60575 - DNA, 15 bp, Homo sapiens
ctaacattttatagt

SEQ ID NO: 60576 - DNA, 15 bp, Homo sapiens
actaacattttatag

SEQ ID NO: 60577 - DNA, 15 bp, Homo sapiens
aactaacattttata

SEQ ID NO: 60578 - DNA, 15 bp, Homo sapiens
gaactaacattttat

SEQ ID NO: 60579 - DNA, 15 bp, Homo sapiens
agaactaacatttta

SEQ ID NO: 60580 - DNA, 15 bp, Homo sapiens
tagaactaacatttt

SEQ ID NO: 60581 - DNA, 15 bp, Homo sapiens
ctagaactaacattt

SEQ ID NO: 60582 - DNA, 15 bp, Homo sapiens
tctagaactaacatt

SEQ ID NO: 60583 - DNA, 15 bp, Homo sapiens
ctctagaactaacat

SEQ ID NO: 60584 - DNA, 15 bp, Homo sapiens
actctagaactaaca

SEQ ID NO: 60585 - DNA, 15 bp, Homo sapiens
tactctagaactaac

SEQ ID NO: 60586 - DNA, 15 bp, Homo sapiens
atactctagaactaa

SEQ ID NO: 60587 - DNA, 15 bp, Homo sapiens
tatactctagaacta

SEQ ID NO: 60588 - DNA, 15 bp, Homo sapiens
ttatactctagaact

SEQ ID NO: 60589 - DNA, 15 bp, Homo sapiens
attatactctagaac

SEQ ID NO: 60590 - DNA, 15 bp, Homo sapiens
gattatactctagaa

SEQ ID NO: 60591 - DNA, 15 bp, Homo sapiens
cgattatactctaga

SEQ ID NO: 60592 - DNA, 15 bp, Homo sapiens
acgattatactctag

SEQ ID NO: 60593 - DNA, 15 bp, Homo sapiens
cacgattatactcta

SEQ ID NO: 60594 - DNA, 15 bp, Homo sapiens
tcacgattatactct

SEQ ID NO: 60595 - DNA, 15 bp, Homo sapiens
atcacgattatactc

SEQ ID NO: 60596 - DNA, 15 bp, Homo sapiens
aatcacgattatact

SEQ ID NO: 60597 - DNA, 15 bp, Homo sapiens
caatcacgattatac

SEQ ID NO: 60598 - DNA, 15 bp, Homo sapiens
gcaatcacgattata

SEQ ID NO: 60599 - DNA, 15 bp, Homo sapiens
tgcaatcacgattat

SEQ ID NO: 60600 - DNA, 15 bp, Homo sapiens
ctgcaatcacgatta

SEQ ID NO: 60601 - DNA, 15 bp, Homo sapiens
actgcaatcacgatt

SEQ ID NO: 60602 - DNA, 15 bp, Homo sapiens
gactgcaatcacgat

SEQ ID NO: 60603 - DNA, 15 bp, Homo sapiens
tgactgcaatcacga

SEQ ID NO: 60604 - DNA, 15 bp, Homo sapiens
ctgactgcaatcacg

SEQ ID NO: 60605 - DNA, 15 bp, Homo sapiens
cctgactgcaatcac

SEQ ID NO: 60606 - DNA, 15 bp, Homo sapiens
tcctgactgcaatca

SEQ ID NO: 60607 - DNA, 15 bp, Homo sapiens
ttcctgactgcaatc

SEQ ID NO: 60608 - DNA, 15 bp, Homo sapiens
tttcctgactgcaat

SEQ ID NO: 60609 - DNA, 15 bp, Homo sapiens
ctttcctgactgcaa

SEQ ID NO: 60610 - DNA, 15 bp, Homo sapiens
tctttcctgactgca

SEQ ID NO: 60611 - DNA, 15 bp, Homo sapiens
atctttcctgactgc

SEQ ID NO: 60612 - DNA, 15 bp, Homo sapiens
tatctttcctgactg

SEQ ID NO: 60613 - DNA, 15 bp, Homo sapiens
gtatctttcctgact

SEQ ID NO: 60614 - DNA, 15 bp, Homo sapiens
agtatctttcctgac

SEQ ID NO: 60615 - DNA, 15 bp, Homo sapiens
aagtatctttcctga

SEQ ID NO: 60616 - DNA, 15 bp, Homo sapiens
aaagtatctttcctg

SEQ ID NO: 60617 - DNA, 15 bp, Homo sapiens
taaagtatctttcct

SEQ ID NO: 60618 - DNA, 15 bp, Homo sapiens
ataaagtatctttcc

SEQ ID NO: 60619 - DNA, 15 bp, Homo sapiens
aataaagtatctttc

SEQ ID NO: 60620 - DNA, 15 bp, Homo sapiens
aaataaagtatcttt

SEQ ID NO: 60621 - DNA, 15 bp, Homo sapiens
aaaataaagtatctt

SEQ ID NO: 60622 - DNA, 15 bp, Homo sapiens
caaaataaagtatct

SEQ ID NO: 60623 - DNA, 15 bp, Homo sapiens
acaaaataaagtatc

SEQ ID NO: 60624 - DNA, 15 bp, Homo sapiens
tacaaaataaagtat

SEQ ID NO: 60625 - DNA, 15 bp, Homo sapiens
ctacaaaataaagta

SEQ ID NO: 60626 - DNA, 15 bp, Homo sapiens
actacaaaataaagt

SEQ ID NO: 60627 - DNA, 15 bp, Homo sapiens
gactacaaaataaag

SEQ ID NO: 60628 - DNA, 15 bp, Homo sapiens
tgactacaaaataaa

SEQ ID NO: 60629 - DNA, 15 bp, Homo sapiens
gtgactacaaaataa

SEQ ID NO: 60630 - DNA, 15 bp, Homo sapiens
agtgactacaaaata

SEQ ID NO: 60631 - DNA, 15 bp, Homo sapiens
gagtgactacaaaat

SEQ ID NO: 60632 - DNA, 15 bp, Homo sapiens
tgagtgactacaaaa

SEQ ID NO: 60633 - DNA, 15 bp, Homo sapiens
ttgagtgactacaaa

SEQ ID NO: 60634 - DNA, 15 bp, Homo sapiens
tttgagtgactacaa

SEQ ID NO: 60635 - DNA, 15 bp, Homo sapiens
ttttgagtgactaca

SEQ ID NO: 60636 - DNA, 15 bp, Homo sapiens
cttttgagtgactac

SEQ ID NO: 60637 - DNA, 15 bp, Homo sapiens
acttttgagtgacta

SEQ ID NO: 60638 - DNA, 15 bp, Homo sapiens
aacttttgagtgact

SEQ ID NO: 60639 - DNA, 15 bp, Homo sapiens
aaacttttgagtgac

SEQ ID NO: 60640 - DNA, 15 bp, Homo sapiens
aaaacttttgagtga

SEQ ID NO: 60641 - DNA, 15 bp, Homo sapiens
aaaaacttttgagtg

SEQ ID NO: 60642 - DNA, 15 bp, Homo sapiens
gaaaaacttttgagt

SEQ ID NO: 60643 - DNA, 15 bp, Homo sapiens
ggaaaaacttttgag

SEQ ID NO: 60644 - DNA, 15 bp, Homo sapiens
aggaaaaacttttga

SEQ ID NO: 60645 - DNA, 15 bp, Homo sapiens
aaggaaaaacttttg

SEQ ID NO: 60646 - DNA, 15 bp, Homo sapiens
aaaggaaaaactttt

SEQ ID NO: 60647 - DNA, 15 bp, Homo sapiens
gaaaggaaaaacttt

SEQ ID NO: 60648 - DNA, 15 bp, Homo sapiens
agaaaggaaaaactt

SEQ ID NO: 60649 - DNA, 15 bp, Homo sapiens
gagaaaggaaaaact

SEQ ID NO: 60650 - DNA, 15 bp, Homo sapiens
tgagaaaggaaaaac

SEQ ID NO: 60651 - DNA, 15 bp, Homo sapiens
atgagaaaggaaaaa

SEQ ID NO: 60652 - DNA, 15 bp, Homo sapiens
aatgagaaaggaaaa

SEQ ID NO: 60653 - DNA, 15 bp, Homo sapiens
aaatgagaaaggaaa

SEQ ID NO: 60654 - DNA, 15 bp, Homo sapiens
aaaatgagaaaggaa

SEQ ID NO: 60655 - DNA, 15 bp, Homo sapiens
aaaaatgagaaagga

SEQ ID NO: 60656 - DNA, 15 bp, Homo sapiens
caaaaatgagaaagg

SEQ ID NO: 60657 - DNA, 15 bp, Homo sapiens
acaaaaatgagaaag

SEQ ID NO: 60658 - DNA, 15 bp, Homo sapiens
tacaaaaatgagaaa

SEQ ID NO: 60659 - DNA, 15 bp, Homo sapiens
ctacaaaaatgagaa

SEQ ID NO: 60660 - DNA, 15 bp, Homo sapiens
tctacaaaaatgaga

SEQ ID NO: 60661 - DNA, 15 bp, Homo sapiens
ttctacaaaaatgag

SEQ ID NO: 60662 - DNA, 15 bp, Homo sapiens
tttctacaaaaatga

SEQ ID NO: 60663 - DNA, 15 bp, Homo sapiens
ttttctacaaaaatg

SEQ ID NO: 60664 - DNA, 15 bp, Homo sapiens
attttctacaaaaat

SEQ ID NO: 60665 - DNA, 15 bp, Homo sapiens
tattttctacaaaaa

SEQ ID NO: 60666 - DNA, 15 bp, Homo sapiens
ttattttctacaaaa

SEQ ID NO: 60667 - DNA, 15 bp, Homo sapiens
tttattttctacaaa

SEQ ID NO: 60668 - DNA, 15 bp, Homo sapiens
ttttattttctacaa

SEQ ID NO: 60669 - DNA, 15 bp, Homo sapiens
attttattttctaca

SEQ ID NO: 60670 - DNA, 15 bp, Homo sapiens
aattttattttctac

SEQ ID NO: 60671 - DNA, 15 bp, Homo sapiens
aaattttattttcta

SEQ ID NO: 60672 - DNA, 15 bp, Homo sapiens
taaattttattttct

SEQ ID NO: 60673 - DNA, 15 bp, Homo sapiens
ttaaattttattttc

SEQ ID NO: 60674 - DNA, 15 bp, Homo sapiens
attaaattttatttt

SEQ ID NO: 60675 - DNA, 15 bp, Homo sapiens
aattaaattttattt

SEQ ID NO: 60676 - DNA, 15 bp, Homo sapiens
caattaaattttatt

SEQ ID NO: 60677 - DNA, 15 bp, Homo sapiens
tcaattaaattttat

SEQ ID NO: 60678 - DNA, 15 bp, Homo sapiens
ttcaattaaatttta

SEQ ID NO: 60679 - DNA, 15 bp, Homo sapiens
tttcaattaaatttt

SEQ ID NO: 60680 - DNA, 15 bp, Homo sapiens
ttttcaattaaattt

SEQ ID NO: 60681 - DNA, 15 bp, Homo sapiens
cttttcaattaaatt

SEQ ID NO: 60682 - DNA, 15 bp, Homo sapiens
ccttttcaattaaat

SEQ ID NO: 60683 - DNA, 15 bp, Homo sapiens
accttttcaattaaa

SEQ ID NO: 60684 - DNA, 15 bp, Homo sapiens
gaccttttcaattaa

SEQ ID NO: 60685 - DNA, 15 bp, Homo sapiens
agaccttttcaatta

SEQ ID NO: 60686 - DNA, 15 bp, Homo sapiens
aagaccttttcaatt

SEQ ID NO: 60687 - DNA, 15 bp, Homo sapiens
aaagaccttttcaat

SEQ ID NO: 60688 - DNA, 15 bp, Homo sapiens
caaagaccttttcaa

SEQ ID NO: 60689 - DNA, 15 bp, Homo sapiens
acaaagaccttttca

SEQ ID NO: 60690 - DNA, 15 bp, Homo sapiens
tacaaagaccttttc

SEQ ID NO: 60691 - DNA, 15 bp, Homo sapiens
ttacaaagacctttt

SEQ ID NO: 60692 - DNA, 15 bp, Homo sapiens
tttacaaagaccttt

SEQ ID NO: 60693 - DNA, 15 bp, Homo sapiens
gtttacaaagacctt

SEQ ID NO: 60694 - DNA, 15 bp, Homo sapiens
tgtttacaaagacct

SEQ ID NO: 60695 - DNA, 15 bp, Homo sapiens
gtgtttacaaagacc

SEQ ID NO: 60696 - DNA, 15 bp, Homo sapiens
tgtgtttacaaagac

SEQ ID NO: 60697 - DNA, 15 bp, Homo sapiens
atgtgtttacaaaga

SEQ ID NO: 60698 - DNA, 15 bp, Homo sapiens
tatgtgtttacaaag

SEQ ID NO: 60699 - DNA, 15 bp, Homo sapiens
ctatgtgtttacaaa

SEQ ID NO: 60700 - DNA, 15 bp, Homo sapiens
tctatgtgtttacaa

SEQ ID NO: 60701 - DNA, 15 bp, Homo sapiens
ctctatgtgtttaca

SEQ ID NO: 60702 - DNA, 15 bp, Homo sapiens
actctatgtgtttac

SEQ ID NO: 60703 - DNA, 15 bp, Homo sapiens
aactctatgtgttta

SEQ ID NO: 60704 - DNA, 15 bp, Homo sapiens
taactctatgtgttt

SEQ ID NO: 60705 - DNA, 15 bp, Homo sapiens
ttaactctatgtgtt

SEQ ID NO: 60706 - DNA, 15 bp, Homo sapiens
tttaactctatgtgt

SEQ ID NO: 60707 - DNA, 15 bp, Homo sapiens
atttaactctatgtg

SEQ ID NO: 60708 - DNA, 15 bp, Homo sapiens
tatttaactctatgt

SEQ ID NO: 60709 - DNA, 15 bp, Homo sapiens
atatttaactctatg

SEQ ID NO: 60710 - DNA, 15 bp, Homo sapiens
catatttaactctat

SEQ ID NO: 60711 - DNA, 15 bp, Homo sapiens
tcatatttaactcta

SEQ ID NO: 60712 - DNA, 15 bp, Homo sapiens
gtcatatttaactct

SEQ ID NO: 60713 - DNA, 15 bp, Homo sapiens
agtcatatttaactc

SEQ ID NO: 60714 - DNA, 15 bp, Homo sapiens
aagtcatatttaact

SEQ ID NO: 60715 - DNA, 15 bp, Homo sapiens
aaagtcatatttaac

SEQ ID NO: 60716 - DNA, 15 bp, Homo sapiens
gaaagtcatatttaa

SEQ ID NO: 60717 - DNA, 15 bp, Homo sapiens
agaaagtcatattta

SEQ ID NO: 60718 - DNA, 15 bp, Homo sapiens
tagaaagtcatattt

SEQ ID NO: 60719 - DNA, 15 bp, Homo sapiens
atagaaagtcatatt

SEQ ID NO: 60720 - DNA, 15 bp, Homo sapiens
catagaaagtcatat

SEQ ID NO: 60721 - DNA, 15 bp, Homo sapiens
tcatagaaagtcata

SEQ ID NO: 60722 - DNA, 15 bp, Homo sapiens
gtcatagaaagtcat

SEQ ID NO: 60723 - DNA, 15 bp, Homo sapiens
agtcatagaaagtca

SEQ ID NO: 60724 - DNA, 15 bp, Homo sapiens
cagtcatagaaagtc

SEQ ID NO: 60725 - DNA, 15 bp, Homo sapiens
acagtcatagaaagt

SEQ ID NO: 60726 - DNA, 15 bp, Homo sapiens
cacagtcatagaaag

SEQ ID NO: 60727 - DNA, 15 bp, Homo sapiens
tcacagtcatagaaa

SEQ ID NO: 60728 - DNA, 15 bp, Homo sapiens
ttcacagtcatagaa

SEQ ID NO: 60729 - DNA, 15 bp, Homo sapiens
tttcacagtcataga

SEQ ID NO: 60730 - DNA, 15 bp, Homo sapiens
ctttcacagtcatag

SEQ ID NO: 60731 - DNA, 15 bp, Homo sapiens
actttcacagtcata

SEQ ID NO: 60732 - DNA, 15 bp, Homo sapiens
aactttcacagtcat

SEQ ID NO: 60733 - DNA, 15 bp, Homo sapiens
taactttcacagtca

SEQ ID NO: 60734 - DNA, 15 bp, Homo sapiens
ataactttcacagtc

SEQ ID NO: 60735 - DNA, 15 bp, Homo sapiens
cataactttcacagt

SEQ ID NO: 60736 - DNA, 15 bp, Homo sapiens
acataactttcacag

SEQ ID NO: 60737 - DNA, 15 bp, Homo sapiens
aacataactttcaca

SEQ ID NO: 60738 - DNA, 15 bp, Homo sapiens
gaacataactttcac

SEQ ID NO: 60739 - DNA, 15 bp, Homo sapiens
tgaacataactttca

SEQ ID NO: 60740 - DNA, 15 bp, Homo sapiens
atgaacataactttc

SEQ ID NO: 60741 - DNA, 15 bp, Homo sapiens
aatgaacataacttt

SEQ ID NO: 60742 - DNA, 15 bp, Homo sapiens
caatgaacataactt

SEQ ID NO: 60743 - DNA, 15 bp, Homo sapiens
acaatgaacataact

SEQ ID NO: 60744 - DNA, 15 bp, Homo sapiens
tacaatgaacataac

SEQ ID NO: 60745 - DNA, 15 bp, Homo sapiens
ttacaatgaacataa

SEQ ID NO: 60746 - DNA, 15 bp, Homo sapiens
gttacaatgaacata

SEQ ID NO: 60747 - DNA, 15 bp, Homo sapiens
ggttacaatgaacat

SEQ ID NO: 60748 - DNA, 15 bp, Homo sapiens
tggttacaatgaaca

SEQ ID NO: 60749 - DNA, 15 bp, Homo sapiens
ttggttacaatgaac

SEQ ID NO: 60750 - DNA, 15 bp, Homo sapiens
tttggttacaatgaa

SEQ ID NO: 60751 - DNA, 15 bp, Homo sapiens
gtttggttacaatga

SEQ ID NO: 60752 - DNA, 15 bp, Homo sapiens
tgtttggttacaatg

SEQ ID NO: 60753 - DNA, 15 bp, Homo sapiens
atgtttggttacaat

SEQ ID NO: 60754 - DNA, 15 bp, Homo sapiens
tatgtttggttacaa

SEQ ID NO: 60755 - DNA, 15 bp, Homo sapiens
ctatgtttggttaca

SEQ ID NO: 60756 - DNA, 15 bp, Homo sapiens
actatgtttggttac

SEQ ID NO: 60757 - DNA, 15 bp, Homo sapiens
tactatgtttggtta

SEQ ID NO: 60758 - DNA, 15 bp, Homo sapiens
gtactatgtttggtt

SEQ ID NO: 60759 - DNA, 15 bp, Homo sapiens
tgtactatgtttggt

SEQ ID NO: 60760 - DNA, 15 bp, Homo sapiens
ttgtactatgtttgg

SEQ ID NO: 60761 - DNA, 15 bp, Homo sapiens
cttgtactatgtttg

SEQ ID NO: 60762 - DNA, 15 bp, Homo sapiens
acttgtactatgttt

SEQ ID NO: 60763 - DNA, 15 bp, Homo sapiens
tacttgtactatgtt

SEQ ID NO: 60764 - DNA, 15 bp, Homo sapiens
atacttgtactatgt

SEQ ID NO: 60765 - DNA, 15 bp, Homo sapiens
aatacttgtactatg

SEQ ID NO: 60766 - DNA, 15 bp, Homo sapiens
caatacttgtactat

SEQ ID NO: 60767 - DNA, 15 bp, Homo sapiens
gcaatacttgtacta

SEQ ID NO: 60768 - DNA, 15 bp, Homo sapiens
agcaatacttgtact

SEQ ID NO: 60769 - DNA, 15 bp, Homo sapiens
aagcaatacttgtac

SEQ ID NO: 60770 - DNA, 15 bp, Homo sapiens
taagcaatacttgta

SEQ ID NO: 60771 - DNA, 15 bp, Homo sapiens
ttaagcaatacttgt

SEQ ID NO: 60772 - DNA, 15 bp, Homo sapiens
cttaagcaatacttg

SEQ ID NO: 60773 - DNA, 15 bp, Homo sapiens
tcttaagcaatactt

SEQ ID NO: 60774 - DNA, 15 bp, Homo sapiens
atcttaagcaatact

SEQ ID NO: 60775 - DNA, 15 bp, Homo sapiens
tatcttaagcaatac

SEQ ID NO: 60776 - DNA, 15 bp, Homo sapiens
atatcttaagcaata

SEQ ID NO: 60777 - DNA, 15 bp, Homo sapiens
tatatcttaagcaat

SEQ ID NO: 60778 - DNA, 15 bp, Homo sapiens
ctatatcttaagcaa

SEQ ID NO: 60779 - DNA, 15 bp, Homo sapiens
tctatatcttaagca

SEQ ID NO: 60780 - DNA, 15 bp, Homo sapiens
ttctatatcttaagc

SEQ ID NO: 60781 - DNA, 15 bp, Homo sapiens
tttctatatcttaag

SEQ ID NO: 60782 - DNA, 15 bp, Homo sapiens
ttttctatatcttaa

SEQ ID NO: 60783 - DNA, 15 bp, Homo sapiens
gttttctatatctta

SEQ ID NO: 60784 - DNA, 15 bp, Homo sapiens
tgttttctatatctt

SEQ ID NO: 60785 - DNA, 15 bp, Homo sapiens
gtgttttctatatct

SEQ ID NO: 60786 - DNA, 15 bp, Homo sapiens
tgtgttttctatatc

SEQ ID NO: 60787 - DNA, 15 bp, Homo sapiens
ctgtgttttctatat

SEQ ID NO: 60788 - DNA, 15 bp, Homo sapiens
actgtgttttctata

SEQ ID NO: 60789 - DNA, 15 bp, Homo sapiens
tactgtgttttctat

SEQ ID NO: 60790 - DNA, 15 bp, Homo sapiens
ttactgtgttttcta

SEQ ID NO: 60791 - DNA, 15 bp, Homo sapiens
attactgtgttttct

SEQ ID NO: 60792 - DNA, 15 bp, Homo sapiens
cattactgtgttttc

SEQ ID NO: 60793 - DNA, 15 bp, Homo sapiens
acattactgtgtttt

SEQ ID NO: 60794 - DNA, 15 bp, Homo sapiens
tacattactgtgttt

SEQ ID NO: 60795 - DNA, 15 bp, Homo sapiens
atacattactgtgtt

SEQ ID NO: 60796 - DNA, 15 bp, Homo sapiens
tatacattactgtgt

SEQ ID NO: 60797 - DNA, 15 bp, Homo sapiens
ttatacattactgtg

SEQ ID NO: 60798 - DNA, 15 bp, Homo sapiens
tttatacattactgt

SEQ ID NO: 60799 - DNA, 15 bp, Homo sapiens
ttttatacattactg

SEQ ID NO: 60800 - DNA, 15 bp, Homo sapiens
cttttatacattact

SEQ ID NO: 60801 - DNA, 15 bp, Homo sapiens
acttttatacattac

SEQ ID NO: 60802 - DNA, 15 bp, Homo sapiens
cacttttatacatta

SEQ ID NO: 60803 - DNA, 15 bp, Homo sapiens
tcacttttatacatt

SEQ ID NO: 60804 - DNA, 15 bp, Homo sapiens
ctcacttttatacat

SEQ ID NO: 60805 - DNA, 15 bp, Homo sapiens
cctcacttttataca

SEQ ID NO: 60806 - DNA, 15 bp, Homo sapiens
acctcacttttatac

SEQ ID NO: 60807 - DNA, 15 bp, Homo sapiens
tacctcacttttata

SEQ ID NO: 60808 - DNA, 15 bp, Homo sapiens
ttacctcacttttat

SEQ ID NO: 60809 - DNA, 15 bp, Homo sapiens
tttacctcactttta

SEQ ID NO: 60810 - DNA, 15 bp, Homo sapiens
ttttacctcactttt

SEQ ID NO: 60811 - DNA, 15 bp, Homo sapiens
tttttacctcacttt

SEQ ID NO: 60812 - DNA, 15 bp, Homo sapiens
atttttacctcactt

SEQ ID NO: 60813 - DNA, 15 bp, Homo sapiens
gatttttacctcact

SEQ ID NO: 60814 - DNA, 15 bp, Homo sapiens
tgatttttacctcac

SEQ ID NO: 60815 - DNA, 15 bp, Homo sapiens
gtgatttttacctca

SEQ ID NO: 60816 - DNA, 15 bp, Homo sapiens
ggtgatttttacctc

SEQ ID NO: 60817 - DNA, 15 bp, Homo sapiens
aggtgatttttacct

SEQ ID NO: 60818 - DNA, 15 bp, Homo sapiens
gaggtgatttttacc

SEQ ID NO: 60819 - DNA, 15 bp, Homo sapiens
tgaggtgatttttac

SEQ ID NO: 60820 - DNA, 15 bp, Homo sapiens
ttgaggtgattttta

SEQ ID NO: 60821 - DNA, 15 bp, Homo sapiens
tttgaggtgattttt

SEQ ID NO: 60822 - DNA, 15 bp, Homo sapiens
atttgaggtgatttt

SEQ ID NO: 60823 - DNA, 15 bp, Homo sapiens
aatttgaggtgattt

SEQ ID NO: 60824 - DNA, 15 bp, Homo sapiens
gaatttgaggtgatt

SEQ ID NO: 60825 - DNA, 15 bp, Homo sapiens
agaatttgaggtgat

SEQ ID NO: 60826 - DNA, 15 bp, Homo sapiens
tagaatttgaggtga

SEQ ID NO: 60827 - DNA, 15 bp, Homo sapiens
ctagaatttgaggtg

SEQ ID NO: 60828 - DNA, 15 bp, Homo sapiens
actagaatttgaggt

SEQ ID NO: 60829 - DNA, 15 bp, Homo sapiens
gactagaatttgagg

SEQ ID NO: 60830 - DNA, 15 bp, Homo sapiens
ggactagaatttgag

SEQ ID NO: 60831 - DNA, 15 bp, Homo sapiens
gggactagaatttga

SEQ ID NO: 60832 - DNA, 15 bp, Homo sapiens
ggggactagaatttg

SEQ ID NO: 60833 - DNA, 15 bp, Homo sapiens
gggggactagaattt

SEQ ID NO: 60834 - DNA, 15 bp, Homo sapiens
tgggggactagaatt

SEQ ID NO: 60835 - DNA, 15 bp, Homo sapiens
ttgggggactagaat

SEQ ID NO: 60836 - DNA, 15 bp, Homo sapiens
tttgggggactagaa

SEQ ID NO: 60837 - DNA, 15 bp, Homo sapiens
ttttgggggactaga

SEQ ID NO: 60838 - DNA, 15 bp, Homo sapiens
attttgggggactag

SEQ ID NO: 60839 - DNA, 15 bp, Homo sapiens
tattttgggggacta

SEQ ID NO: 60840 - DNA, 15 bp, Homo sapiens
ttattttgggggact

SEQ ID NO: 60841 - DNA, 15 bp, Homo sapiens
attattttgggggac

SEQ ID NO: 60842 - DNA, 15 bp, Homo sapiens
gattattttggggga

SEQ ID NO: 60843 - DNA, 15 bp, Homo sapiens
tgattattttggggg

SEQ ID NO: 60844 - DNA, 15 bp, Homo sapiens
gtgattattttgggg

SEQ ID NO: 60845 - DNA, 15 bp, Homo sapiens
agtgattattttggg

SEQ ID NO: 60846 - DNA, 15 bp, Homo sapiens
cagtgattattttgg

SEQ ID NO: 60847 - DNA, 15 bp, Homo sapiens
acagtgattattttg

SEQ ID NO: 60848 - DNA, 15 bp, Homo sapiens
aacagtgattatttt

SEQ ID NO: 60849 - DNA, 15 bp, Homo sapiens
taacagtgattattt

SEQ ID NO: 60850 - DNA, 15 bp, Homo sapiens
ttaacagtgattatt

SEQ ID NO: 60851 - DNA, 15 bp, Homo sapiens
tttaacagtgattat

SEQ ID NO: 60852 - DNA, 15 bp, Homo sapiens
ttttaacagtgatta

SEQ ID NO: 60853 - DNA, 15 bp, Homo sapiens
attttaacagtgatt

SEQ ID NO: 60854 - DNA, 15 bp, Homo sapiens
cattttaacagtgat

SEQ ID NO: 60855 - DNA, 15 bp, Homo sapiens
acattttaacagtga

SEQ ID NO: 60856 - DNA, 15 bp, Homo sapiens
tacattttaacagtg

SEQ ID NO: 60857 - DNA, 15 bp, Homo sapiens
atacattttaacagt

SEQ ID NO: 60858 - DNA, 15 bp, Homo sapiens
aatacattttaacag

SEQ ID NO: 60859 - DNA, 15 bp, Homo sapiens
caatacattttaaca

SEQ ID NO: 60860 - DNA, 15 bp, Homo sapiens
gcaatacattttaac

SEQ ID NO: 60861 - DNA, 15 bp, Homo sapiens
agcaatacattttaa

SEQ ID NO: 60862 - DNA, 15 bp, Homo sapiens
gagcaatacatttta

SEQ ID NO: 60863 - DNA, 15 bp, Homo sapiens
agagcaatacatttt

SEQ ID NO: 60864 - DNA, 15 bp, Homo sapiens
tagagcaatacattt

SEQ ID NO: 60865 - DNA, 15 bp, Homo sapiens
ctagagcaatacatt

SEQ ID NO: 60866 - DNA, 15 bp, Homo sapiens
actagagcaatacat

SEQ ID NO: 60867 - DNA, 15 bp, Homo sapiens
cactagagcaataca

SEQ ID NO: 60868 - DNA, 15 bp, Homo sapiens
acactagagcaatac

SEQ ID NO: 60869 - DNA, 15 bp, Homo sapiens
gacactagagcaata

SEQ ID NO: 60870 - DNA, 15 bp, Homo sapiens
agacactagagcaat

SEQ ID NO: 60871 - DNA, 15 bp, Homo sapiens
tagacactagagcaa

SEQ ID NO: 60872 - DNA, 15 bp, Homo sapiens
gtagacactagagca

SEQ ID NO: 60873 - DNA, 15 bp, Homo sapiens
tgtagacactagagc

SEQ ID NO: 60874 - DNA, 15 bp, Homo sapiens
ctgtagacactagag

SEQ ID NO: 60875 - DNA, 15 bp, Homo sapiens
tctgtagacactaga

SEQ ID NO: 60876 - DNA, 15 bp, Homo sapiens
ttctgtagacactag

SEQ ID NO: 60877 - DNA, 15 bp, Homo sapiens
tttctgtagacacta

SEQ ID NO: 60878 - DNA, 15 bp, Homo sapiens
ttttctgtagacact

SEQ ID NO: 60879 - DNA, 15 bp, Homo sapiens
gatttttctgtagac

SEQ ID NO: 60880 - DNA, 15 bp, Homo sapiens
agatttttctgtaga

SEQ ID NO: 60881 - DNA, 15 bp, Homo sapiens
cagatttttctgtag

SEQ ID NO: 60882 - DNA, 15 bp, Homo sapiens
tcagatttttctgta

SEQ ID NO: 60883 - DNA, 15 bp, Homo sapiens
ttcagatttttctgt

SEQ ID NO: 60884 - DNA, 15 bp, Homo sapiens
cttcagatttttctg

SEQ ID NO: 60885 - DNA, 15 bp, Homo sapiens
acttcagatttttct

SEQ ID NO: 60886 - DNA, 15 bp, Homo sapiens
tacttcagatttttc

SEQ ID NO: 60887 - DNA, 15 bp, Homo sapiens
ttacttcagattttt

SEQ ID NO: 60888 - DNA, 15 bp, Homo sapiens
tttacttcagatttt

SEQ ID NO: 60889 - DNA, 15 bp, Homo sapiens
ttttacttcagattt

SEQ ID NO: 60890 - DNA, 15 bp, Homo sapiens
attttacttcagatt

SEQ ID NO: 60891 - DNA, 15 bp, Homo sapiens
cattttacttcagat

SEQ ID NO: 60892 - DNA, 15 bp, Homo sapiens
tcattttacttcaga

SEQ ID NO: 60893 - DNA, 15 bp, Homo sapiens
ttcattttacttcag

SEQ ID NO: 60894 - DNA, 15 bp, Homo sapiens
attcattttacttca

SEQ ID NO: 60895 - DNA, 15 bp, Homo sapiens
cattcattttacttc

SEQ ID NO: 60896 - DNA, 15 bp, Homo sapiens
gcattcattttactt

SEQ ID NO: 60897 - DNA, 15 bp, Homo sapiens
ggcattcattttact

SEQ ID NO: 60898 - DNA, 15 bp, Homo sapiens
tggcattcattttac

SEQ ID NO: 60899 - DNA, 15 bp, Homo sapiens
ctggcattcatttta

SEQ ID NO: 60900 - DNA, 15 bp, Homo sapiens
actggcattcatttt

SEQ ID NO: 60901 - DNA, 15 bp, Homo sapiens
aactggcattcattt

SEQ ID NO: 60902 - DNA, 15 bp, Homo sapiens
taactggcattcatt

SEQ ID NO: 60903 - DNA, 15 bp, Homo sapiens
gtaactggcattcat

SEQ ID NO: 60904 - DNA, 15 bp, Homo sapiens
ggtaactggcattca

SEQ ID NO: 60905 - DNA, 15 bp, Homo sapiens
aggtaactggcattc

SEQ ID NO: 60906 - DNA, 15 bp, Homo sapiens
caggtaactggcatt

SEQ ID NO: 60907 - DNA, 15 bp, Homo sapiens
tcaggtaactggcat

SEQ ID NO: 60908 - DNA, 15 bp, Homo sapiens
atcaggtaactggca

SEQ ID NO: 60909 - DNA, 15 bp, Homo sapiens
gatcaggtaactggc

SEQ ID NO: 60910 - DNA, 15 bp, Homo sapiens
ggatcaggtaactgg

SEQ ID NO: 60911 - DNA, 15 bp, Homo sapiens
tggatcaggtaactg

SEQ ID NO: 60912 - DNA, 15 bp, Homo sapiens
atggatcaggtaact

SEQ ID NO: 60913 - DNA, 15 bp, Homo sapiens
tatggatcaggtaac

SEQ ID NO: 60914 - DNA, 15 bp, Homo sapiens
ttatggatcaggtaa

SEQ ID NO: 60915 - DNA, 15 bp, Homo sapiens
attatggatcaggta

SEQ ID NO: 60916 - DNA, 15 bp, Homo sapiens
cattatggatcaggt

SEQ ID NO: 60917 - DNA, 15 bp, Homo sapiens
ccattatggatcagg

SEQ ID NO: 60918 - DNA, 15 bp, Homo sapiens
accattatggatcag

SEQ ID NO: 60919 - DNA, 15 bp, Homo sapiens
aaccattatggatca

SEQ ID NO: 60920 - DNA, 15 bp, Homo sapiens
taaccattatggatc

SEQ ID NO: 60921 - DNA, 15 bp, Homo sapiens
ttaaccattatggat

SEQ ID NO: 60922 - DNA, 15 bp, Homo sapiens
attaaccattatgga

SEQ ID NO: 60923 - DNA, 15 bp, Homo sapiens
aattaaccattatgg

SEQ ID NO: 60924 - DNA, 15 bp, Homo sapiens
taattaaccattatg

SEQ ID NO: 60925 - DNA, 15 bp, Homo sapiens
ctaattaaccattat

SEQ ID NO: 60926 - DNA, 15 bp, Homo sapiens
actaattaaccatta

SEQ ID NO: 60927 - DNA, 15 bp, Homo sapiens
cactaattaaccatt

SEQ ID NO: 60928 - DNA, 15 bp, Homo sapiens
gcactaattaaccat

SEQ ID NO: 60929 - DNA, 15 bp, Homo sapiens
tgcactaattaacca

SEQ ID NO: 60930 - DNA, 15 bp, Homo sapiens
ttgcactaattaacc

SEQ ID NO: 60931 - DNA, 15 bp, Homo sapiens
attgcactaattaac

SEQ ID NO: 60932 - DNA, 15 bp, Homo sapiens
tattgcactaattaa

SEQ ID NO: 60933 - DNA, 15 bp, Homo sapiens
atattgcactaatta

SEQ ID NO: 60934 - DNA, 15 bp, Homo sapiens
aatattgcactaatt

SEQ ID NO: 60935 - DNA, 15 bp, Homo sapiens
caatattgcactaat

SEQ ID NO: 60936 - DNA, 15 bp, Homo sapiens
gcaatattgcactaa

SEQ ID NO: 60937 - DNA, 15 bp, Homo sapiens
agcaatattgcacta

SEQ ID NO: 60938 - DNA, 15 bp, Homo sapiens
aagcaatattgcact

SEQ ID NO: 60939 - DNA, 15 bp, Homo sapiens
aaagcaatattgcac

SEQ ID NO: 60940 - DNA, 15 bp, Homo sapiens
aaaagcaatattgca

SEQ ID NO: 60941 - DNA, 15 bp, Homo sapiens
aaaaagcaatattgc

SEQ ID NO: 60942 - DNA, 15 bp, Homo sapiens
gaaaaagcaatattg

SEQ ID NO: 60943 - DNA, 15 bp, Homo sapiens
tgaaaaagcaatatt

SEQ ID NO: 60944 - DNA, 15 bp, Homo sapiens
ttgaaaaagcaatat

SEQ ID NO: 60945 - DNA, 15 bp, Homo sapiens
cttgaaaaagcaata

SEQ ID NO: 60946 - DNA, 15 bp, Homo sapiens
ccttgaaaaagcaat

SEQ ID NO: 60947 - DNA, 15 bp, Homo sapiens
tccttgaaaaagcaa

SEQ ID NO: 60948 - DNA, 15 bp, Homo sapiens
gtccttgaaaaagca

SEQ ID NO: 60949 - DNA, 15 bp, Homo sapiens
agtccttgaaaaagc

SEQ ID NO: 60950 - DNA, 15 bp, Homo sapiens
aagtccttgaaaaag

SEQ ID NO: 60951 - DNA, 15 bp, Homo sapiens
gaagtccttgaaaaa

SEQ ID NO: 60952 - DNA, 15 bp, Homo sapiens
tgaagtccttgaaaa

SEQ ID NO: 60953 - DNA, 15 bp, Homo sapiens
atgaagtccttgaaa

SEQ ID NO: 60954 - DNA, 15 bp, Homo sapiens
aatgaagtccttgaa

SEQ ID NO: 60955 - DNA, 15 bp, Homo sapiens
caatgaagtccttga

SEQ ID NO: 60956 - DNA, 15 bp, Homo sapiens
tcaatgaagtccttg

SEQ ID NO: 60957 - DNA, 15 bp, Homo sapiens
ttcaatgaagtcctt

SEQ ID NO: 60958 - DNA, 15 bp, Homo sapiens
cttcaatgaagtcct

SEQ ID NO: 60959 - DNA, 15 bp, Homo sapiens
acttcaatgaagtcc

SEQ ID NO: 60960 - DNA, 15 bp, Homo sapiens
tacttcaatgaagtc

SEQ ID NO: 60961 - DNA, 15 bp, Homo sapiens
ttacttcaatgaagt

SEQ ID NO: 60962 - DNA, 15 bp, Homo sapiens
cttacttcaatgaag

SEQ ID NO: 60963 - DNA, 15 bp, Homo sapiens
acttacttcaatgaa

SEQ ID NO: 60964 - DNA, 15 bp, Homo sapiens
aacttacttcaatga

SEQ ID NO: 60965 - DNA, 15 bp, Homo sapiens
caacttacttcaatg

SEQ ID NO: 60966 - DNA, 15 bp, Homo sapiens
tcaacttacttcaat

SEQ ID NO: 60967 - DNA, 15 bp, Homo sapiens
ttcaacttacttcaa

SEQ ID NO: 60968 - DNA, 15 bp, Homo sapiens
cttcaacttacttca

SEQ ID NO: 60969 - DNA, 15 bp, Homo sapiens
acttcaacttacttc

SEQ ID NO: 60970 - DNA, 15 bp, Homo sapiens
tacttcaacttactt

SEQ ID NO: 60971 - DNA, 15 bp, Homo sapiens
ttacttcaacttact

SEQ ID NO: 60972 - DNA, 15 bp, Homo sapiens
tttacttcaacttac

SEQ ID NO: 60973 - DNA, 15 bp, Homo sapiens
atttacttcaactta

SEQ ID NO: 60974 - DNA, 15 bp, Homo sapiens
aatttacttcaactt

SEQ ID NO: 60975 - DNA, 15 bp, Homo sapiens
taatttacttcaact

SEQ ID NO: 60976 - DNA, 15 bp, Homo sapiens
gtaatttacttcaac

SEQ ID NO: 60977 - DNA, 15 bp, Homo sapiens
agtaatttacttcaa

SEQ ID NO: 60978 - DNA, 15 bp, Homo sapiens
cagtaatttacttca

SEQ ID NO: 60979 - DNA, 15 bp, Homo sapiens
tcagtaatttacttc

SEQ ID NO: 60980 - DNA, 15 bp, Homo sapiens
ttcagtaatttactt

SEQ ID NO: 60981 - DNA, 15 bp, Homo sapiens
cttcagtaatttact

SEQ ID NO: 60982 - DNA, 15 bp, Homo sapiens
acttcagtaatttac

SEQ ID NO: 60983 - DNA, 15 bp, Homo sapiens
tacttcagtaattta

SEQ ID NO: 60984 - DNA, 15 bp, Homo sapiens
atacttcagtaattt

SEQ ID NO: 60985 - DNA, 15 bp, Homo sapiens
aatacttcagtaatt

SEQ ID NO: 60986 - DNA, 15 bp, Homo sapiens
taatacttcagtaat

SEQ ID NO: 60987 - DNA, 15 bp, Homo sapiens
ctaatacttcagtaa

SEQ ID NO: 60988 - DNA, 15 bp, Homo sapiens
actaatacttcagta

SEQ ID NO: 60989 - DNA, 15 bp, Homo sapiens
aactaatacttcagt

SEQ ID NO: 60990 - DNA, 15 bp, Homo sapiens
taactaatacttcag

SEQ ID NO: 60991 - DNA, 15 bp, Homo sapiens
ataactaatacttca

SEQ ID NO: 60992 - DNA, 15 bp, Homo sapiens
cataactaatacttc

SEQ ID NO: 60993 - DNA, 15 bp, Homo sapiens
ccataactaatactt

SEQ ID NO: 60994 - DNA, 15 bp, Homo sapiens
tccataactaatact

SEQ ID NO: 60995 - DNA, 15 bp, Homo sapiens
gtccataactaatac

SEQ ID NO: 60996 - DNA, 15 bp, Homo sapiens
tgtccataactaata

SEQ ID NO: 60997 - DNA, 15 bp, Homo sapiens
ctgtccataactaat

SEQ ID NO: 60998 - DNA, 15 bp, Homo sapiens
cctgtccataactaa

SEQ ID NO: 60999 - DNA, 15 bp, Homo sapiens
gcctgtccataacta

SEQ ID NO: 61000 - DNA, 15 bp, Homo sapiens
ggcctgtccataact

SEQ ID NO: 61001 - DNA, 15 bp, Homo sapiens
aggcctgtccataac

SEQ ID NO: 61002 - DNA, 15 bp, Homo sapiens
caggcctgtccataa

SEQ ID NO: 61003 - DNA, 15 bp, Homo sapiens
ccaggcctgtccata

SEQ ID NO: 61004 - DNA, 15 bp, Homo sapiens
accaggcctgtccat

SEQ ID NO: 61005 - DNA, 15 bp, Homo sapiens
aaccaggcctgtcca

SEQ ID NO: 61006 - DNA, 15 bp, Homo sapiens
aaaccaggcctgtcc

SEQ ID NO: 61007 - DNA, 15 bp, Homo sapiens
gaaaccaggcctgtc

SEQ ID NO: 61008 - DNA, 15 bp, Homo sapiens
agaaaccaggcctgt

SEQ ID NO: 61009 - DNA, 15 bp, Homo sapiens
gagaaaccaggcctg

SEQ ID NO: 61010 - DNA, 15 bp, Homo sapiens
agagaaaccaggcct

SEQ ID NO: 61011 - DNA, 15 bp, Homo sapiens
aagagaaaccaggcc

SEQ ID NO: 61012 - DNA, 15 bp, Homo sapiens
taagagaaaccaggc

SEQ ID NO: 61013 - DNA, 15 bp, Homo sapiens
gtaagagaaaccagg

SEQ ID NO: 61014 - DNA, 15 bp, Homo sapiens
tgtaagagaaaccag

SEQ ID NO: 61015 - DNA, 15 bp, Homo sapiens
atgtaagagaaacca

SEQ ID NO: 61016 - DNA, 15 bp, Homo sapiens
tatgtaagagaaacc

SEQ ID NO: 61017 - DNA, 15 bp, Homo sapiens
ctatgtaagagaaac

SEQ ID NO: 61018 - DNA, 15 bp, Homo sapiens
cctatgtaagagaaa

SEQ ID NO: 61019 - DNA, 15 bp, Homo sapiens
acctatgtaagagaa

SEQ ID NO: 61020 - DNA, 15 bp, Homo sapiens
cacctatgtaagaga

SEQ ID NO: 61021 - DNA, 15 bp, Homo sapiens
tcacctatgtaagag

SEQ ID NO: 61022 - DNA, 15 bp, Homo sapiens
ttcacctatgtaaga

SEQ ID NO: 61023 - DNA, 15 bp, Homo sapiens
tttcacctatgtaag

SEQ ID NO: 61024 - DNA, 15 bp, Homo sapiens
ctttcacctatgtaa

SEQ ID NO: 61025 - DNA, 15 bp, Homo sapiens
tctttcacctatgta

SEQ ID NO: 61026 - DNA, 15 bp, Homo sapiens
atctttcacctatgt

SEQ ID NO: 61027 - DNA, 15 bp, Homo sapiens
catctttcacctatg

SEQ ID NO: 61028 - DNA, 15 bp, Homo sapiens
acatctttcacctat

SEQ ID NO: 61029 - DNA, 15 bp, Homo sapiens
gacatctttcaccta

SEQ ID NO: 61030 - DNA, 15 bp, Homo sapiens
tgacatctttcacct

SEQ ID NO: 61031 - DNA, 15 bp, Homo sapiens
atgacatctttcacc

SEQ ID NO: 61032 - DNA, 15 bp, Homo sapiens
catgacatctttcac

SEQ ID NO: 61033 - DNA, 15 bp, Homo sapiens
tcatgacatctttca

SEQ ID NO: 61034 - DNA, 15 bp, Homo sapiens
ttcatgacatctttc

SEQ ID NO: 61035 - DNA, 15 bp, Homo sapiens
cttcatgacatcttt

SEQ ID NO: 61036 - DNA, 15 bp, Homo sapiens
ccttcatgacatctt

SEQ ID NO: 61037 - DNA, 15 bp, Homo sapiens
tccttcatgacatct

SEQ ID NO: 61038 - DNA, 15 bp, Homo sapiens
atccttcatgacatc

SEQ ID NO: 61039 - DNA, 15 bp, Homo sapiens
catccttcatgacat

SEQ ID NO: 61040 - DNA, 15 bp, Homo sapiens
acatccttcatgaca

SEQ ID NO: 61041 - DNA, 15 bp, Homo sapiens
gacatccttcatgac

SEQ ID NO: 61042 - DNA, 15 bp, Homo sapiens
tgacatccttcatga

SEQ ID NO: 61043 - DNA, 15 bp, Homo sapiens
atgacatccttcatg

SEQ ID NO: 61044 - DNA, 15 bp, Homo sapiens
catgacatccttcat

SEQ ID NO: 61045 - DNA, 15 bp, Homo sapiens
acatgacatccttca

SEQ ID NO: 61046 - DNA, 15 bp, Homo sapiens
gacatgacatccttc

SEQ ID NO: 61047 - DNA, 15 bp, Homo sapiens
cgacatgacatcctt

SEQ ID NO: 61048 - DNA, 15 bp, Homo sapiens
ccgacatgacatcct

SEQ ID NO: 61049 - DNA, 15 bp, Homo sapiens
tccgacatgacatcc

SEQ ID NO: 61050 - DNA, 15 bp, Homo sapiens
gtccgacatgacatc

SEQ ID NO: 61051 - DNA, 15 bp, Homo sapiens
ggtccgacatgacat

SEQ ID NO: 61052 - DNA, 15 bp, Homo sapiens
aggtccgacatgaca

SEQ ID NO: 61053 - DNA, 15 bp, Homo sapiens
caggtccgacatgac

SEQ ID NO: 61054 - DNA, 15 bp, Homo sapiens
gcaggtccgacatga

SEQ ID NO: 61055 - DNA, 15 bp, Homo sapiens
tgcaggtccgacatg

SEQ ID NO: 61056 - DNA, 15 bp, Homo sapiens
ctgcaggtccgacat

SEQ ID NO: 61057 - DNA, 15 bp, Homo sapiens
gctgcaggtccgaca

SEQ ID NO: 61058 - DNA, 15 bp, Homo sapiens
tgctgcaggtccgac

SEQ ID NO: 61059 - DNA, 15 bp, Homo sapiens
ctgctgcaggtccga

SEQ ID NO: 61060 - DNA, 15 bp, Homo sapiens
tctgctgcaggtccg

SEQ ID NO: 61061 - DNA, 15 bp, Homo sapiens
gtctgctgcaggtcc

SEQ ID NO: 61062 - DNA, 15 bp, Homo sapiens
cgtctgctgcaggtc

SEQ ID NO: 61063 - DNA, 15 bp, Homo sapiens
tcgtctgctgcaggt

SEQ ID NO: 61064 - DNA, 15 bp, Homo sapiens
ttcgtctgctgcagg

SEQ ID NO: 61065 - DNA, 15 bp, Homo sapiens
gttcgtctgctgcag

SEQ ID NO: 61066 - DNA, 15 bp, Homo sapiens
tgttcgtctgctgca

SEQ ID NO: 61067 - DNA, 15 bp, Homo sapiens
ctgttcgtctgctgc

SEQ ID NO: 61068 - DNA, 15 bp, Homo sapiens
actgttcgtctgctg

SEQ ID NO: 61069 - DNA, 15 bp, Homo sapiens
cactgttcgtctgct

SEQ ID NO: 61070 - DNA, 15 bp, Homo sapiens
tcactgttcgtctgc

SEQ ID NO: 61071 - DNA, 15 bp, Homo sapiens
ctcactgttcgtctg

SEQ ID NO: 61072 - DNA, 15 bp, Homo sapiens
tctcactgttcgtct

SEQ ID NO: 61073 - DNA, 15 bp, Homo sapiens
ttctcactgttcgtc

SEQ ID NO: 61074 - DNA, 15 bp, Homo sapiens
cttctcactgttcgt

SEQ ID NO: 61075 - DNA, 15 bp, Homo sapiens
tcttctcactgttcg

SEQ ID NO: 61076 - DNA, 15 bp, Homo sapiens
atcttctcactgttc

SEQ ID NO: 61077 - DNA, 15 bp, Homo sapiens
gatcttctcactgtt

SEQ ID NO: 61078 - DNA, 15 bp, Homo sapiens
ggatcttctcactgt

SEQ ID NO: 61079 - DNA, 15 bp, Homo sapiens
aggatcttctcactg

SEQ ID NO: 61080 - DNA, 15 bp, Homo sapiens
caggatcttctcact

SEQ ID NO: 61081 - DNA, 15 bp, Homo sapiens
gcaggatcttctcac

SEQ ID NO: 61082 - DNA, 15 bp, Homo sapiens
agcaggatcttctca

SEQ ID NO: 61083 - DNA, 15 bp, Homo sapiens
gagcaggatcttctc

SEQ ID NO: 61084 - DNA, 15 bp, Homo sapiens
tgagcaggatcttct

SEQ ID NO: 61085 - DNA, 15 bp, Homo sapiens
ctgagcaggatcttc

SEQ ID NO: 61086 - DNA, 15 bp, Homo sapiens
gctgagcaggatctt

SEQ ID NO: 61087 - DNA, 15 bp, Homo sapiens
agctgagcaggatct

SEQ ID NO: 61088 - DNA, 15 bp, Homo sapiens
cagctgagcaggatc

SEQ ID NO: 61089 - DNA, 15 bp, Homo sapiens
ccagctgagcaggat

SEQ ID NO: 61090 - DNA, 15 bp, Homo sapiens
cccagctgagcagga

SEQ ID NO: 61091 - DNA, 15 bp, Homo sapiens
acccagctgagcagg

SEQ ID NO: 61092 - DNA, 15 bp, Homo sapiens
cacccagctgagcag

SEQ ID NO: 61093 - DNA, 15 bp, Homo sapiens
gcacccagctgagca

SEQ ID NO: 61094 - DNA, 15 bp, Homo sapiens
cgcacccagctgagc

SEQ ID NO: 61095 - DNA, 15 bp, Homo sapiens
acgcacccagctgag

SEQ ID NO: 61096 - DNA, 15 bp, Homo sapiens
gacgcacccagctga

SEQ ID NO: 61097 - DNA, 15 bp, Homo sapiens
tgacgcacccagctg

SEQ ID NO: 61098 - DNA, 15 bp, Homo sapiens
ctgacgcacccagct

SEQ ID NO: 61099 - DNA, 15 bp, Homo sapiens
tctgacgcacccagc

SEQ ID NO: 61100 - DNA, 15 bp, Homo sapiens
gtctgacgcacccag

SEQ ID NO: 61101 - DNA, 15 bp, Homo sapiens
ggtctgacgcaccca

SEQ ID NO: 61102 - DNA, 15 bp, Homo sapiens
tggtctgacgcaccc

SEQ ID NO: 61103 - DNA, 15 bp, Homo sapiens
gtggtctgacgcacc

SEQ ID NO: 61104 - DNA, 15 bp, Homo sapiens
ggtggtctgacgcac

SEQ ID NO: 61105 - DNA, 15 bp, Homo sapiens
tggtggtctgacgca

SEQ ID NO: 61106 - DNA, 15 bp, Homo sapiens
ctggtggtctgacgc

SEQ ID NO: 61107 - DNA, 15 bp, Homo sapiens
cctggtggtctgacg

SEQ ID NO: 61108 - DNA, 15 bp, Homo sapiens
gcctggtggtctgac

SEQ ID NO: 61109 - DNA, 15 bp, Homo sapiens
ggcctggtggtctga

SEQ ID NO: 61110 - DNA, 15 bp, Homo sapiens
gggcctggtggtctg

SEQ ID NO: 61111 - DNA, 15 bp, Homo sapiens
agggcctggtggtct

SEQ ID NO: 61112 - DNA, 15 bp, Homo sapiens
tagggcctggtggtc

SEQ ID NO: 61113 - DNA, 15 bp, Homo sapiens
gtagggcctggtggt

SEQ ID NO: 61114 - DNA, 15 bp, Homo sapiens
tgtagggcctggtgg

SEQ ID NO: 61115 - DNA, 15 bp, Homo sapiens
ctgtagggcctggtg

SEQ ID NO: 61116 - DNA, 15 bp, Homo sapiens
gctgtagggcctggt

SEQ ID NO: 61117 - DNA, 15 bp, Homo sapiens
ggctgtagggcctgg

SEQ ID NO: 61118 - DNA, 15 bp, Homo sapiens
tggctgtagggcctg

SEQ ID NO: 61119 - DNA, 15 bp, Homo sapiens
ttggctgtagggcct

SEQ ID NO: 61120 - DNA, 15 bp, Homo sapiens
cttggctgtagggcc

SEQ ID NO: 61121 - DNA, 15 bp, Homo sapiens
acttggctgtagggc

SEQ ID NO: 61122 - DNA, 15 bp, Homo sapiens
gacttggctgtaggg

SEQ ID NO: 61123 - DNA, 15 bp, Homo sapiens
tgacttggctgtagg

SEQ ID NO: 61124 - DNA, 15 bp, Homo sapiens
ttgacttggctgtag

SEQ ID NO: 61125 - DNA, 15 bp, Homo sapiens
gttgacttggctgta

SEQ ID NO: 61126 - DNA, 15 bp, Homo sapiens
cgttgacttggctgt

SEQ ID NO: 61127 - DNA, 15 bp, Homo sapiens
acgttgacttggctg

SEQ ID NO: 61128 - DNA, 15 bp, Homo sapiens
gacgttgacttggct

SEQ ID NO: 61129 - DNA, 15 bp, Homo sapiens
ggacgttgacttggc

SEQ ID NO: 61130 - DNA, 15 bp, Homo sapiens
aggacgttgacttgg

SEQ ID NO: 61131 - DNA, 15 bp, Homo sapiens
gaggacgttgacttg

SEQ ID NO: 61132 - DNA, 15 bp, Homo sapiens
tgaggacgttgactt

SEQ ID NO: 61133 - DNA, 15 bp, Homo sapiens
ttgaggacgttgact

SEQ ID NO: 61134 - DNA, 15 bp, Homo sapiens
gttgaggacgttgac

SEQ ID NO: 61135 - DNA, 15 bp, Homo sapiens
agttgaggacgttga

SEQ ID NO: 61136 - DNA, 15 bp, Homo sapiens
aagttgaggacgttg

SEQ ID NO: 61137 - DNA, 15 bp, Homo sapiens
gaagttgaggacgtt

SEQ ID NO: 61138 - DNA, 15 bp, Homo sapiens
tgaagttgaggacgt

SEQ ID NO: 61139 - DNA, 15 bp, Homo sapiens
gtgaagttgaggacg

SEQ ID NO: 61140 - DNA, 15 bp, Homo sapiens
ggtgaagttgaggac

SEQ ID NO: 61141 - DNA, 15 bp, Homo sapiens
tggtgaagttgagga

SEQ ID NO: 61142 - DNA, 15 bp, Homo sapiens
gtggtgaagttgagg

SEQ ID NO: 61143 - DNA, 15 bp, Homo sapiens
ggtggtgaagttgag

SEQ ID NO: 61144 - DNA, 15 bp, Homo sapiens
tggtggtgaagttga

SEQ ID NO: 61145 - DNA, 15 bp, Homo sapiens
ctggtggtgaagttg

SEQ ID NO: 61146 - DNA, 15 bp, Homo sapiens
gctggtggtgaagtt

SEQ ID NO: 61147 - DNA, 15 bp, Homo sapiens
agctggtggtgaagt

SEQ ID NO: 61148 - DNA, 15 bp, Homo sapiens
cagctggtggtgaag

SEQ ID NO: 61149 - DNA, 15 bp, Homo sapiens
ccagctggtggtgaa

SEQ ID NO: 61150 - DNA, 15 bp, Homo sapiens
tccagctggtggtga

SEQ ID NO: 61151 - DNA, 15 bp, Homo sapiens
gtccagctggtggtg

SEQ ID NO: 61152 - DNA, 15 bp, Homo sapiens
tgtccagctggtggt

SEQ ID NO: 61153 - DNA, 15 bp, Homo sapiens
ctgtccagctggtgg

SEQ ID NO: 61154 - DNA, 15 bp, Homo sapiens
tctgtccagctggtg

SEQ ID NO: 61155 - DNA, 15 bp, Homo sapiens
atctgtccagctggt

SEQ ID NO: 61156 - DNA, 15 bp, Homo sapiens
catctgtccagctgg

SEQ ID NO: 61157 - DNA, 15 bp, Homo sapiens
ccatctgtccagctg

SEQ ID NO: 61158 - DNA, 15 bp, Homo sapiens
tccatctgtccagct

SEQ ID NO: 61159 - DNA, 15 bp, Homo sapiens
gtccatctgtccagc

SEQ ID NO: 61160 - DNA, 15 bp, Homo sapiens
agtccatctgtccag

SEQ ID NO: 61161 - DNA, 15 bp, Homo sapiens
gagtccatctgtcca

SEQ ID NO: 61162 - DNA, 15 bp, Homo sapiens
cgagtccatctgtcc

SEQ ID NO: 61163 - DNA, 15 bp, Homo sapiens
gcgagtccatctgtc

SEQ ID NO: 61164 - DNA, 15 bp, Homo sapiens
ggcgagtccatctgt

SEQ ID NO: 61165 - DNA, 15 bp, Homo sapiens
aggcgagtccatctg

SEQ ID NO: 61166 - DNA, 15 bp, Homo sapiens
aaggcgagtccatct

SEQ ID NO: 61167 - DNA, 15 bp, Homo sapiens
aaaggcgagtccatc

SEQ ID NO: 61168 - DNA, 15 bp, Homo sapiens
taaaggcgagtccat

SEQ ID NO: 61169 - DNA, 15 bp, Homo sapiens
ttaaaggcgagtcca

SEQ ID NO: 61170 - DNA, 15 bp, Homo sapiens
attaaaggcgagtcc

SEQ ID NO: 61171 - DNA, 15 bp, Homo sapiens
cattaaaggcgagtc

SEQ ID NO: 61172 - DNA, 15 bp, Homo sapiens
gcattaaaggcgagt

SEQ ID NO: 61173 - DNA, 15 bp, Homo sapiens
agcattaaaggcgag

SEQ ID NO: 61174 - DNA, 15 bp, Homo sapiens
cagcattaaaggcga

SEQ ID NO: 61175 - DNA, 15 bp, Homo sapiens
acagcattaaaggcg

SEQ ID NO: 61176 - DNA, 15 bp, Homo sapiens
gacagcattaaaggc

SEQ ID NO: 61177 - DNA, 15 bp, Homo sapiens
ggacagcattaaagg

SEQ ID NO: 61178 - DNA, 15 bp, Homo sapiens
aggacagcattaaag

SEQ ID NO: 61179 - DNA, 15 bp, Homo sapiens
gaggacagcattaaa

SEQ ID NO: 61180 - DNA, 15 bp, Homo sapiens
ggaggacagcattaa

SEQ ID NO: 61181 - DNA, 15 bp, Homo sapiens
tggaggacagcatta

SEQ ID NO: 61182 - DNA, 15 bp, Homo sapiens
gtggaggacagcatt

SEQ ID NO: 61183 - DNA, 15 bp, Homo sapiens
ggtggaggacagcat

SEQ ID NO: 61184 - DNA, 15 bp, Homo sapiens
cggtggaggacagca

SEQ ID NO: 61185 - DNA, 15 bp, Homo sapiens
tcggtggaggacagc

SEQ ID NO: 61186 - DNA, 15 bp, Homo sapiens
gtcggtggaggacag

SEQ ID NO: 61187 - DNA, 15 bp, Homo sapiens
tgtcggtggaggaca

SEQ ID NO: 61188 - DNA, 15 bp, Homo sapiens
atgtcggtggaggac

SEQ ID NO: 61189 - DNA, 15 bp, Homo sapiens
tatgtcggtggagga

SEQ ID NO: 61190 - DNA, 15 bp, Homo sapiens
ttatgtcggtggagg

SEQ ID NO: 61191 - DNA, 15 bp, Homo sapiens
cttatgtcggtggag

SEQ ID NO: 61192 - DNA, 15 bp, Homo sapiens
acttatgtcggtgga

SEQ ID NO: 61193 - DNA, 15 bp, Homo sapiens
cacttatgtcggtgg

SEQ ID NO: 61194 - DNA, 15 bp, Homo sapiens
tcacttatgtcggtg

SEQ ID NO: 61195 - DNA, 15 bp, Homo sapiens
ctcacttatgtcggt

SEQ ID NO: 61196 - DNA, 15 bp, Homo sapiens
tctcacttatgtcgg

SEQ ID NO: 61197 - DNA, 15 bp, Homo sapiens
gtctcacttatgtcg

SEQ ID NO: 61198 - DNA, 15 bp, Homo sapiens
tgtctcacttatgtc

SEQ ID NO: 61199 - DNA, 15 bp, Homo sapiens
atgtctcacttatgt

SEQ ID NO: 61200 - DNA, 15 bp, Homo sapiens
aatgtctcacttatg

SEQ ID NO: 61201 - DNA, 15 bp, Homo sapiens
taatgtctcacttat

SEQ ID NO: 61202 - DNA, 15 bp, Homo sapiens
gtaatgtctcactta

SEQ ID NO: 61203 - DNA, 15 bp, Homo sapiens
agtaatgtctcactt

SEQ ID NO: 61204 - DNA, 15 bp, Homo sapiens
gagtaatgtctcact

SEQ ID NO: 61205 - DNA, 15 bp, Homo sapiens
agagtaatgtctcac

SEQ ID NO: 61206 - DNA, 15 bp, Homo sapiens
tagagtaatgtctca

SEQ ID NO: 61207 - DNA, 15 bp, Homo sapiens
atagagtaatgtctc

SEQ ID NO: 61208 - DNA, 15 bp, Homo sapiens
gatagagtaatgtct

SEQ ID NO: 61209 - DNA, 15 bp, Homo sapiens
agatagagtaatgtc

SEQ ID NO: 61210 - DNA, 15 bp, Homo sapiens
tagatagagtaatgt

SEQ ID NO: 61211 - DNA, 15 bp, Homo sapiens
ctagatagagtaatg

SEQ ID NO: 61212 - DNA, 15 bp, Homo sapiens
tctagatagagtaat

SEQ ID NO: 61213 - DNA, 15 bp, Homo sapiens
ttctagatagagtaa

SEQ ID NO: 61214 - DNA, 15 bp, Homo sapiens
cttctagatagagta

SEQ ID NO: 61215 - DNA, 15 bp, Homo sapiens
acttctagatagagt

SEQ ID NO: 61216 - DNA, 15 bp, Homo sapiens
cacttctagatagag

SEQ ID NO: 61217 - DNA, 15 bp, Homo sapiens
ccacttctagataga

SEQ ID NO: 61218 - DNA, 15 bp, Homo sapiens
cccacttctagatag

SEQ ID NO: 61219 - DNA, 15 bp, Homo sapiens
gcccacttctagata

SEQ ID NO: 61220 - DNA, 15 bp, Homo sapiens
agcccacttctagat

SEQ ID NO: 61221 - DNA, 15 bp, Homo sapiens
aagcccacttctaga

SEQ ID NO: 61222 - DNA, 15 bp, Homo sapiens
aaagcccacttctag

SEQ ID NO: 61223 - DNA, 15 bp, Homo sapiens
taaagcccacttcta

SEQ ID NO: 61224 - DNA, 15 bp, Homo sapiens
gtaaagcccacttct

SEQ ID NO: 61225 - DNA, 15 bp, Homo sapiens
tgtaaagcccacttc

SEQ ID NO: 61226 - DNA, 15 bp, Homo sapiens
ttgtaaagcccactt

SEQ ID NO: 61227 - DNA, 15 bp, Homo sapiens
tttgtaaagcccact

SEQ ID NO: 61228 - DNA, 15 bp, Homo sapiens
atttgtaaagcccac

SEQ ID NO: 61229 - DNA, 15 bp, Homo sapiens
aatttgtaaagccca

SEQ ID NO: 61230 - DNA, 15 bp, Homo sapiens
gaatttgtaaagccc

SEQ ID NO: 61231 - DNA, 15 bp, Homo sapiens
tgaatttgtaaagcc

SEQ ID NO: 61232 - DNA, 15 bp, Homo sapiens
atgaatttgtaaagc

SEQ ID NO: 61233 - DNA, 15 bp, Homo sapiens
catgaatttgtaaag

SEQ ID NO: 61234 - DNA, 15 bp, Homo sapiens
acatgaatttgtaaa

SEQ ID NO: 61235 - DNA, 15 bp, Homo sapiens
gacatgaatttgtaa

SEQ ID NO: 61236 - DNA, 15 bp, Homo sapiens
agacatgaatttgta

SEQ ID NO: 61237 - DNA, 15 bp, Homo sapiens
gagacatgaatttgt

SEQ ID NO: 61238 - DNA, 15 bp, Homo sapiens
ggagacatgaatttg

SEQ ID NO: 61239 - DNA, 15 bp, Homo sapiens
aggagacatgaattt

SEQ ID NO: 61240 - DNA, 15 bp, Homo sapiens
gaggagacatgaatt

SEQ ID NO: 61241 - DNA, 15 bp, Homo sapiens
agaggagacatgaat

SEQ ID NO: 61242 - DNA, 15 bp, Homo sapiens
gagaggagacatgaa

SEQ ID NO: 61243 - DNA, 15 bp, Homo sapiens
agagaggagacatga

SEQ ID NO: 61244 - DNA, 15 bp, Homo sapiens
cagagaggagacatg

SEQ ID NO: 61245 - DNA, 15 bp, Homo sapiens
acagagaggagacat

SEQ ID NO: 61246 - DNA, 15 bp, Homo sapiens
gacagagaggagaca

SEQ ID NO: 61247 - DNA, 15 bp, Homo sapiens
ggacagagaggagac

SEQ ID NO: 61248 - DNA, 15 bp, Homo sapiens
gggacagagaggaga

SEQ ID NO: 61249 - DNA, 15 bp, Homo sapiens
agggacagagaggag

SEQ ID NO: 61250 - DNA, 15 bp, Homo sapiens
aagggacagagagga

SEQ ID NO: 61251 - DNA, 15 bp, Homo sapiens
aaagggacagagagg

SEQ ID NO: 61252 - DNA, 15 bp, Homo sapiens
caaagggacagagag

SEQ ID NO: 61253 - DNA, 15 bp, Homo sapiens
gcaaagggacagaga

SEQ ID NO: 61254 - DNA, 15 bp, Homo sapiens
agcaaagggacagag

SEQ ID NO: 61255 - DNA, 15 bp, Homo sapiens
cagcaaagggacaga

SEQ ID NO: 61256 - DNA, 15 bp, Homo sapiens
gcagcaaagggacag

SEQ ID NO: 61257 - DNA, 15 bp, Homo sapiens
ggcagcaaagggaca

SEQ ID NO: 61258 - DNA, 15 bp, Homo sapiens
tggcagcaaagggac

SEQ ID NO: 61259 - DNA, 15 bp, Homo sapiens
gtggcagcaaaggga

SEQ ID NO: 61260 - DNA, 15 bp, Homo sapiens
ggtggcagcaaaggg

SEQ ID NO: 61261 - DNA, 15 bp, Homo sapiens
tggtggcagcaaagg

SEQ ID NO: 61262 - DNA, 15 bp, Homo sapiens
gtggtggcagcaaag

SEQ ID NO: 61263 - DNA, 15 bp, Homo sapiens
agtggtggcagcaaa

SEQ ID NO: 61264 - DNA, 15 bp, Homo sapiens
tagtggtggcagcaa

SEQ ID NO: 61265 - DNA, 15 bp, Homo sapiens
gtagtggtggcagca

SEQ ID NO: 61266 - DNA, 15 bp, Homo sapiens
agtagtggtggcagc

SEQ ID NO: 61267 - DNA, 15 bp, Homo sapiens
gagtagtggtggcag

SEQ ID NO: 61268 - DNA, 15 bp, Homo sapiens
ggagtagtggtggca

SEQ ID NO: 61269 - DNA, 15 bp, Homo sapiens
gggagtagtggtggc

SEQ ID NO: 61270 - DNA, 15 bp, Homo sapiens
agggagtagtggtgg

SEQ ID NO: 61271 - DNA, 15 bp, Homo sapiens
cagggagtagtggtg

SEQ ID NO: 61272 - DNA, 15 bp, Homo sapiens
tcagggagtagtggt

SEQ ID NO: 61273 - DNA, 15 bp, Homo sapiens
ttcagggagtagtgg

SEQ ID NO: 61274 - DNA, 15 bp, Homo sapiens
cttcagggagtagtg

SEQ ID NO: 61275 - DNA, 15 bp, Homo sapiens
gcttcagggagtagt

SEQ ID NO: 61276 - DNA, 15 bp, Homo sapiens
ggcttcagggagtag

SEQ ID NO: 61277 - DNA, 15 bp, Homo sapiens
gggcttcagggagta

SEQ ID NO: 61278 - DNA, 15 bp, Homo sapiens
ggggcttcagggagt

SEQ ID NO: 61279 - DNA, 15 bp, Homo sapiens
aggggcttcagggag

SEQ ID NO: 61280 - DNA, 15 bp, Homo sapiens
aaggggcttcaggga

SEQ ID NO: 61281 - DNA, 15 bp, Homo sapiens
gaaggggcttcaggg

SEQ ID NO: 61282 - DNA, 15 bp, Homo sapiens
agaaggggcttcagg

SEQ ID NO: 61283 - DNA, 15 bp, Homo sapiens
gagaaggggcttcag

SEQ ID NO: 61284 - DNA, 15 bp, Homo sapiens
ggagaaggggcttca

SEQ ID NO: 61285 - DNA, 15 bp, Homo sapiens
tggagaaggggcttc

SEQ ID NO: 61286 - DNA, 15 bp, Homo sapiens
ctggagaaggggctt

SEQ ID NO: 61287 - DNA, 15 bp, Homo sapiens
actggagaaggggct

SEQ ID NO: 61288 - DNA, 15 bp, Homo sapiens
cactggagaaggggc

SEQ ID NO: 61289 - DNA, 15 bp, Homo sapiens
gcactggagaagggg

SEQ ID NO: 61290 - DNA, 15 bp, Homo sapiens
ggcactggagaaggg

SEQ ID NO: 61291 - DNA, 15 bp, Homo sapiens
tggcactggagaagg

SEQ ID NO: 61292 - DNA, 15 bp, Homo sapiens
gtggcactggagaag

SEQ ID NO: 61293 - DNA, 15 bp, Homo sapiens
agtggcactggagaa

SEQ ID NO: 61294 - DNA, 15 bp, Homo sapiens
cagtggcactggaga

SEQ ID NO: 61295 - DNA, 15 bp, Homo sapiens
gcagtggcactggag

SEQ ID NO: 61296 - DNA, 15 bp, Homo sapiens
agcagtggcactgga

SEQ ID NO: 61297 - DNA, 15 bp, Homo sapiens
gagcagtggcactgg

SEQ ID NO: 61298 - DNA, 15 bp, Homo sapiens
agagcagtggcactg

SEQ ID NO: 61299 - DNA, 15 bp, Homo sapiens
gagagcagtggcact

SEQ ID NO: 61300 - DNA, 15 bp, Homo sapiens
ggagagcagtggcac

SEQ ID NO: 61301 - DNA, 15 bp, Homo sapiens
aggagagcagtggca

SEQ ID NO: 61302 - DNA, 15 bp, Homo sapiens
aaggagagcagtggc

SEQ ID NO: 61303 - DNA, 15 bp, Homo sapiens
aaaggagagcagtgg

SEQ ID NO: 61304 - DNA, 15 bp, Homo sapiens
gaaaggagagcagtg

SEQ ID NO: 61305 - DNA, 15 bp, Homo sapiens
agaaaggagagcagt

SEQ ID NO: 61306 - DNA, 15 bp, Homo sapiens
cagaaaggagagcag

SEQ ID NO: 61307 - DNA, 15 bp, Homo sapiens
gcagaaaggagagca

SEQ ID NO: 61308 - DNA, 15 bp, Homo sapiens
tgcagaaaggagagc

SEQ ID NO: 61309 - DNA, 15 bp, Homo sapiens
gtgcagaaaggagag

SEQ ID NO: 61310 - DNA, 15 bp, Homo sapiens
tgtgcagaaaggaga

SEQ ID NO: 61311 - DNA, 15 bp, Homo sapiens
atgtgcagaaaggag

SEQ ID NO: 61312 - DNA, 15 bp, Homo sapiens
catgtgcagaaagga

SEQ ID NO: 61313 - DNA, 15 bp, Homo sapiens
acatgtgcagaaagg

SEQ ID NO: 61314 - DNA, 15 bp, Homo sapiens
aacatgtgcagaaag

SEQ ID NO: 61315 - DNA, 15 bp, Homo sapiens
gaacatgtgcagaaa

SEQ ID NO: 61316 - DNA, 15 bp, Homo sapiens
agaacatgtgcagaa

SEQ ID NO: 61317 - DNA, 15 bp, Homo sapiens
tagaacatgtgcaga

SEQ ID NO: 61318 - DNA, 15 bp, Homo sapiens
gtagaacatgtgcag

SEQ ID NO: 61319 - DNA, 15 bp, Homo sapiens
ggtagaacatgtgca

SEQ ID NO: 61320 - DNA, 15 bp, Homo sapiens
tggtagaacatgtgc

SEQ ID NO: 61321 - DNA, 15 bp, Homo sapiens
ttggtagaacatgtg

SEQ ID NO: 61322 - DNA, 15 bp, Homo sapiens
tttggtagaacatgt

SEQ ID NO: 61323 - DNA, 15 bp, Homo sapiens
ttttggtagaacatg

SEQ ID NO: 61324 - DNA, 15 bp, Homo sapiens
gttttggtagaacat

SEQ ID NO: 61325 - DNA, 15 bp, Homo sapiens
ggttttggtagaaca

SEQ ID NO: 61326 - DNA, 15 bp, Homo sapiens
aggttttggtagaac

SEQ ID NO: 61327 - DNA, 15 bp, Homo sapiens
aaggttttggtagaa

SEQ ID NO: 61328 - DNA, 15 bp, Homo sapiens
taaggttttggtaga

SEQ ID NO: 61329 - DNA, 15 bp, Homo sapiens
ttaaggttttggtag

SEQ ID NO: 61330 - DNA, 15 bp, Homo sapiens
cttaaggttttggta

SEQ ID NO: 61331 - DNA, 15 bp, Homo sapiens
tcttaaggttttggt

SEQ ID NO: 61332 - DNA, 15 bp, Homo sapiens
ttcttaaggttttgg

SEQ ID NO: 61333 - DNA, 15 bp, Homo sapiens
tttcttaaggttttg

SEQ ID NO: 61334 - DNA, 15 bp, Homo sapiens
ttttcttaaggtttt

SEQ ID NO: 61335 - DNA, 15 bp, Homo sapiens
cttttcttaaggttt

SEQ ID NO: 61336 - DNA, 15 bp, Homo sapiens
tcttttcttaaggtt

SEQ ID NO: 61337 - DNA, 15 bp, Homo sapiens
ttcttttcttaaggt

SEQ ID NO: 61338 - DNA, 15 bp, Homo sapiens
tttcttttcttaagg

SEQ ID NO: 61339 - DNA, 15 bp, Homo sapiens
atttcttttcttaag

SEQ ID NO: 61340 - DNA, 15 bp, Homo sapiens
tatttcttttcttaa

SEQ ID NO: 61341 - DNA, 15 bp, Homo sapiens
atatttcttttctta

SEQ ID NO: 61342 - DNA, 15 bp, Homo sapiens
gatatttcttttctt

SEQ ID NO: 61343 - DNA, 15 bp, Homo sapiens
tgatatttcttttct

SEQ ID NO: 61344 - DNA, 15 bp, Homo sapiens
atgatatttcttttc

SEQ ID NO: 61345 - DNA, 15 bp, Homo sapiens
catgatatttctttt

SEQ ID NO: 61346 - DNA, 15 bp, Homo sapiens
ccatgatatttcttt

SEQ ID NO: 61347 - DNA, 15 bp, Homo sapiens
tccatgatatttctt

SEQ ID NO: 61348 - DNA, 15 bp, Homo sapiens
ttccatgatatttct

SEQ ID NO: 61349 - DNA, 15 bp, Homo sapiens
cttccatgatatttc

SEQ ID NO: 61350 - DNA, 15 bp, Homo sapiens
tcttccatgatattt

SEQ ID NO: 61351 - DNA, 15 bp, Homo sapiens
ttcttccatgatatt

SEQ ID NO: 61352 - DNA, 15 bp, Homo sapiens
tttcttccatgatat

SEQ ID NO: 61353 - DNA, 15 bp, Homo sapiens
ttttcttccatgata

SEQ ID NO: 61354 - DNA, 15 bp, Homo sapiens
gttttcttccatgat

SEQ ID NO: 61355 - DNA, 15 bp, Homo sapiens
agttttcttccatga

SEQ ID NO: 61356 - DNA, 15 bp, Homo sapiens
tagttttcttccatg

SEQ ID NO: 61357 - DNA, 15 bp, Homo sapiens
gtagttttcttccat

SEQ ID NO: 61358 - DNA, 15 bp, Homo sapiens
ggtagttttcttcca

SEQ ID NO: 61359 - DNA, 15 bp, Homo sapiens
gggtagttttcttcc

SEQ ID NO: 61360 - DNA, 15 bp, Homo sapiens
tgggtagttttcttc

SEQ ID NO: 61361 - DNA, 15 bp, Homo sapiens
atgggtagttttctt

SEQ ID NO: 61362 - DNA, 15 bp, Homo sapiens
gatgggtagttttct

SEQ ID NO: 61363 - DNA, 15 bp, Homo sapiens
tgatgggtagttttc

SEQ ID NO: 61364 - DNA, 15 bp, Homo sapiens
ctgatgggtagtttt

SEQ ID NO: 61365 - DNA, 15 bp, Homo sapiens
cctgatgggtagttt

SEQ ID NO: 61366 - DNA, 15 bp, Homo sapiens
acctgatgggtagtt

SEQ ID NO: 61367 - DNA, 15 bp, Homo sapiens
aacctgatgggtagt

SEQ ID NO: 61368 - DNA, 15 bp, Homo sapiens
aaacctgatgggtag

SEQ ID NO: 61369 - DNA, 15 bp, Homo sapiens
aaaacctgatgggta

SEQ ID NO: 61370 - DNA, 15 bp, Homo sapiens
aaaaacctgatgggt

SEQ ID NO: 61371 - DNA, 15 bp, Homo sapiens
taaaaacctgatggg

SEQ ID NO: 61372 - DNA, 15 bp, Homo sapiens
ataaaaacctgatgg

SEQ ID NO: 61373 - DNA, 15 bp, Homo sapiens
aataaaaacctgatg

SEQ ID NO: 61374 - DNA, 15 bp, Homo sapiens
aaataaaaacctgat

SEQ ID NO: 61375 - DNA, 15 bp, Homo sapiens
gaaataaaaacctga

SEQ ID NO: 61376 - DNA, 15 bp, Homo sapiens
ggaaataaaaacctg

SEQ ID NO: 61377 - DNA, 15 bp, Homo sapiens
aggaaataaaaacct

SEQ ID NO: 61378 - DNA, 15 bp, Homo sapiens
aaggaaataaaaacc

SEQ ID NO: 61379 - DNA, 15 bp, Homo sapiens
taaggaaataaaaac

SEQ ID NO: 61380 - DNA, 15 bp, Homo sapiens
ctaaggaaataaaaa

SEQ ID NO: 61381 - DNA, 15 bp, Homo sapiens
cctaaggaaataaaa

SEQ ID NO: 61382 - DNA, 15 bp, Homo sapiens
tcctaaggaaataaa

SEQ ID NO: 61383 - DNA, 15 bp, Homo sapiens
gtcctaaggaaataa

SEQ ID NO: 61384 - DNA, 15 bp, Homo sapiens
agtcctaaggaaata

SEQ ID NO: 61385 - DNA, 15 bp, Homo sapiens
aagtcctaaggaaat

SEQ ID NO: 61386 - DNA, 15 bp, Homo sapiens
taagtcctaaggaaa

SEQ ID NO: 61387 - DNA, 15 bp, Homo sapiens
ttaagtcctaaggaa

SEQ ID NO: 61388 - DNA, 15 bp, Homo sapiens
tttaagtcctaagga

SEQ ID NO: 61389 - DNA, 15 bp, Homo sapiens
atttaagtcctaagg

SEQ ID NO: 61390 - DNA, 15 bp, Homo sapiens
catttaagtcctaag

SEQ ID NO: 61391 - DNA, 15 bp, Homo sapiens
gcatttaagtcctaa

SEQ ID NO: 61392 - DNA, 15 bp, Homo sapiens
agcatttaagtccta

SEQ ID NO: 61393 - DNA, 15 bp, Homo sapiens
cagcatttaagtcct

SEQ ID NO: 61394 - DNA, 15 bp, Homo sapiens
gcagcatttaagtcc

SEQ ID NO: 61395 - DNA, 15 bp, Homo sapiens
tgcagcatttaagtc

SEQ ID NO: 61396 - DNA, 15 bp, Homo sapiens
ttgcagcatttaagt

SEQ ID NO: 61397 - DNA, 15 bp, Homo sapiens
attgcagcatttaag

SEQ ID NO: 61398 - DNA, 15 bp, Homo sapiens
tattgcagcatttaa

SEQ ID NO: 61399 - DNA, 15 bp, Homo sapiens
gtattgcagcattta

SEQ ID NO: 61400 - DNA, 15 bp, Homo sapiens
tgtattgcagcattt

SEQ ID NO: 61401 - DNA, 15 bp, Homo sapiens
ttgtattgcagcatt

SEQ ID NO: 61402 - DNA, 15 bp, Homo sapiens
cttgtattgcagcat

SEQ ID NO: 61403 - DNA, 15 bp, Homo sapiens
ccttgtattgcagca

SEQ ID NO: 61404 - DNA, 15 bp, Homo sapiens
accttgtattgcagc

SEQ ID NO: 61405 - DNA, 15 bp, Homo sapiens
gaccttgtattgcag

SEQ ID NO: 61406 - DNA, 15 bp, Homo sapiens
ggaccttgtattgca

SEQ ID NO: 61407 - DNA, 15 bp, Homo sapiens
tggaccttgtattgc

SEQ ID NO: 61408 - DNA, 15 bp, Homo sapiens
atggaccttgtattg

SEQ ID NO: 61409 - DNA, 15 bp, Homo sapiens
tatggaccttgtatt

SEQ ID NO: 61410 - DNA, 15 bp, Homo sapiens
ctatggaccttgtat

SEQ ID NO: 61411 - DNA, 15 bp, Homo sapiens
actatggaccttgta

SEQ ID NO: 61412 - DNA, 15 bp, Homo sapiens
aactatggaccttgt

SEQ ID NO: 61413 - DNA, 15 bp, Homo sapiens
aaactatggaccttg

SEQ ID NO: 61414 - DNA, 15 bp, Homo sapiens
gaaactatggacctt

SEQ ID NO: 61415 - DNA, 15 bp, Homo sapiens
agaaactatggacct

SEQ ID NO: 61416 - DNA, 15 bp, Homo sapiens
gagaaactatggacc

SEQ ID NO: 61417 - DNA, 15 bp, Homo sapiens
ggagaaactatggac

SEQ ID NO: 61418 - DNA, 15 bp, Homo sapiens
aggagaaactatgga

SEQ ID NO: 61419 - DNA, 15 bp, Homo sapiens
caggagaaactatgg

SEQ ID NO: 61420 - DNA, 15 bp, Homo sapiens
gcaggagaaactatg

SEQ ID NO: 61421 - DNA, 15 bp, Homo sapiens
tgcaggagaaactat

SEQ ID NO: 61422 - DNA, 15 bp, Homo sapiens
atgcaggagaaacta

SEQ ID NO: 61423 - DNA, 15 bp, Homo sapiens
tatgcaggagaaact

SEQ ID NO: 61424 - DNA, 15 bp, Homo sapiens
atatgcaggagaaac

SEQ ID NO: 61425 - DNA, 15 bp, Homo sapiens
aatatgcaggagaaa

SEQ ID NO: 61426 - DNA, 15 bp, Homo sapiens
aaatatgcaggagaa

SEQ ID NO: 61427 - DNA, 15 bp, Homo sapiens
taaatatgcaggaga

SEQ ID NO: 61428 - DNA, 15 bp, Homo sapiens
ataaatatgcaggag

SEQ ID NO: 61429 - DNA, 15 bp, Homo sapiens
cataaatatgcagga

SEQ ID NO: 61430 - DNA, 15 bp, Homo sapiens
tcataaatatgcagg

SEQ ID NO: 61431 - DNA, 15 bp, Homo sapiens
ttcataaatatgcag

SEQ ID NO: 61432 - DNA, 15 bp, Homo sapiens
attcataaatatgca

SEQ ID NO: 61433 - DNA, 15 bp, Homo sapiens
aattcataaatatgc

SEQ ID NO: 61434 - DNA, 15 bp, Homo sapiens
aaattcataaatatg

SEQ ID NO: 61435 - DNA, 15 bp, Homo sapiens
taaattcataaatat

SEQ ID NO: 61436 - DNA, 15 bp, Homo sapiens
ttaaattcataaata

SEQ ID NO: 61437 - DNA, 15 bp, Homo sapiens
tttaaattcataaat

SEQ ID NO: 61438 - DNA, 15 bp, Homo sapiens
ttttaaattcataaa

SEQ ID NO: 61439 - DNA, 15 bp, Homo sapiens
tttttaaattcataa

SEQ ID NO: 61440 - DNA, 15 bp, Homo sapiens
ttttttaaattcata

SEQ ID NO: 61441 - DNA, 15 bp, Homo sapiens
attttttaaattcat

SEQ ID NO: 61442 - DNA, 15 bp, Homo sapiens
tattttttaaattca

SEQ ID NO: 61443 - DNA, 15 bp, Homo sapiens
atattttttaaattc

SEQ ID NO: 61444 - DNA, 15 bp, Homo sapiens
catattttttaaatt

SEQ ID NO: 61445 - DNA, 15 bp, Homo sapiens
atttcatatttttta

SEQ ID NO: 61446 - DNA, 15 bp, Homo sapiens
tatttcatatttttt

SEQ ID NO: 61447 - DNA, 15 bp, Homo sapiens
ttatttcatattttt

SEQ ID NO: 61448 - DNA, 15 bp, Homo sapiens
attatttcatatttt

SEQ ID NO: 61449 - DNA, 15 bp, Homo sapiens
aattatttcatattt

SEQ ID NO: 61450 - DNA, 15 bp, Homo sapiens
gaattatttcatatt

SEQ ID NO: 61451 - DNA, 15 bp, Homo sapiens
tgaattatttcatat

SEQ ID NO: 61452 - DNA, 15 bp, Homo sapiens
gtgaattatttcata

SEQ ID NO: 61453 - DNA, 15 bp, Homo sapiens
tgtgaattatttcat

SEQ ID NO: 61454 - DNA, 15 bp, Homo sapiens
ttgtgaattatttca

SEQ ID NO: 61455 - DNA, 15 bp, Homo sapiens
tttgtgaattatttc

SEQ ID NO: 61456 - DNA, 15 bp, Homo sapiens
ctttgtgaattattt

SEQ ID NO: 61457 - DNA, 15 bp, Homo sapiens
actttgtgaattatt

SEQ ID NO: 61458 - DNA, 15 bp, Homo sapiens
aactttgtgaattat

SEQ ID NO: 61459 - DNA, 15 bp, Homo sapiens
gaactttgtgaatta

SEQ ID NO: 61460 - DNA, 15 bp, Homo sapiens
tgaactttgtgaatt

SEQ ID NO: 61461 - DNA, 15 bp, Homo sapiens
ttgaactttgtgaat

SEQ ID NO: 61462 - DNA, 15 bp, Homo sapiens
gttgaactttgtgaa

SEQ ID NO: 61463 - DNA, 15 bp, Homo sapiens
ggttgaactttgtga

SEQ ID NO: 61464 - DNA, 15 bp, Homo sapiens
gggttgaactttgtg

SEQ ID NO: 61465 - DNA, 15 bp, Homo sapiens
ggggttgaactttgt

SEQ ID NO: 61466 - DNA, 15 bp, Homo sapiens
tggggttgaactttg

SEQ ID NO: 61467 - DNA, 15 bp, Homo sapiens
gtggggttgaacttt

SEQ ID NO: 61468 - DNA, 15 bp, Homo sapiens
agtggggttgaactt

SEQ ID NO: 61469 - DNA, 15 bp, Homo sapiens
gagtggggttgaact

SEQ ID NO: 61470 - DNA, 15 bp, Homo sapiens
tgagtggggttgaac

SEQ ID NO: 61471 - DNA, 15 bp, Homo sapiens
atgagtggggttgaa

SEQ ID NO: 61472 - DNA, 15 bp, Homo sapiens
aatgagtggggttga

SEQ ID NO: 61473 - DNA, 15 bp, Homo sapiens
gaatgagtggggttg

SEQ ID NO: 61474 - DNA, 15 bp, Homo sapiens
tgaatgagtggggtt

SEQ ID NO: 61475 - DNA, 15 bp, Homo sapiens
ctgaatgagtggggt

SEQ ID NO: 61476 - DNA, 15 bp, Homo sapiens
gctgaatgagtgggg

SEQ ID NO: 61477 - DNA, 15 bp, Homo sapiens
tgctgaatgagtggg

SEQ ID NO: 61478 - DNA, 15 bp, Homo sapiens
gtgctgaatgagtgg

SEQ ID NO: 61479 - DNA, 15 bp, Homo sapiens
agtgctgaatgagtg

SEQ ID NO: 61480 - DNA, 15 bp, Homo sapiens
tagtgctgaatgagt

SEQ ID NO: 61481 - DNA, 15 bp, Homo sapiens
ttagtgctgaatgag

SEQ ID NO: 61482 - DNA, 15 bp, Homo sapiens
gttagtgctgaatga

SEQ ID NO: 61483 - DNA, 15 bp, Homo sapiens
agttagtgctgaatg

SEQ ID NO: 61484 - DNA, 15 bp, Homo sapiens
cagttagtgctgaat

SEQ ID NO: 61485 - DNA, 15 bp, Homo sapiens
tcagttagtgctgaa

SEQ ID NO: 61486 - DNA, 15 bp, Homo sapiens
atcagttagtgctga

SEQ ID NO: 61487 - DNA, 15 bp, Homo sapiens
tatcagttagtgctg

SEQ ID NO: 61488 - DNA, 15 bp, Homo sapiens
ttatcagttagtgct

SEQ ID NO: 61489 - DNA, 15 bp, Homo sapiens
attatcagttagtgc

SEQ ID NO: 61490 - DNA, 15 bp, Homo sapiens
cattatcagttagtg

SEQ ID NO: 61491 - DNA, 15 bp, Homo sapiens
acattatcagttagt

SEQ ID NO: 61492 - DNA, 15 bp, Homo sapiens
tacattatcagttag

SEQ ID NO: 61493 - DNA, 15 bp, Homo sapiens
atacattatcagtta

SEQ ID NO: 61494 - DNA, 15 bp, Homo sapiens
tatacattatcagtt

SEQ ID NO: 61495 - DNA, 15 bp, Homo sapiens
gtatacattatcagt

SEQ ID NO: 61496 - DNA, 15 bp, Homo sapiens
tgtatacattatcag

SEQ ID NO: 61497 - DNA, 15 bp, Homo sapiens
ttgtatacattatca

SEQ ID NO: 61498 - DNA, 15 bp, Homo sapiens
tttgtatacattatc

SEQ ID NO: 61499 - DNA, 15 bp, Homo sapiens
ttttgtatacattat

SEQ ID NO: 61500 - DNA, 15 bp, Homo sapiens
tttttgtatacatta

SEQ ID NO: 61501 - DNA, 15 bp, Homo sapiens
ttttttgtatacatt

SEQ ID NO: 61502 - DNA, 15 bp, Homo sapiens
attttttgtatacat

SEQ ID NO: 61503 - DNA, 15 bp, Homo sapiens
aattttttgtataca

SEQ ID NO: 61504 - DNA, 15 bp, Homo sapiens
caattttttgtatac

SEQ ID NO: 61505 - DNA, 15 bp, Homo sapiens
acaattttttgtata

SEQ ID NO: 61506 - DNA, 15 bp, Homo sapiens
cacaattttttgtat

SEQ ID NO: 61507 - DNA, 15 bp, Homo sapiens
acacaattttttgta

SEQ ID NO: 61508 - DNA, 15 bp, Homo sapiens
aacacaattttttgt

SEQ ID NO: 61509 - DNA, 15 bp, Homo sapiens
taacacaattttttg

SEQ ID NO: 61510 - DNA, 15 bp, Homo sapiens
ctaacacaatttttt

SEQ ID NO: 61511 - DNA, 15 bp, Homo sapiens
gctaacacaattttt

SEQ ID NO: 61512 - DNA, 15 bp, Homo sapiens
agctaacacaatttt

SEQ ID NO: 61513 - DNA, 15 bp, Homo sapiens
aagctaacacaattt

SEQ ID NO: 61514 - DNA, 15 bp, Homo sapiens
aaagctaacacaatt

SEQ ID NO: 61515 - DNA, 15 bp, Homo sapiens
aaaagctaacacaat

SEQ ID NO: 61516 - DNA, 15 bp, Homo sapiens
gaaaagctaacacaa

SEQ ID NO: 61517 - DNA, 15 bp, Homo sapiens
agaaaagctaacaca

SEQ ID NO: 61518 - DNA, 15 bp, Homo sapiens
aagaaaagctaacac

SEQ ID NO: 61519 - DNA, 15 bp, Homo sapiens
gaagaaaagctaaca

SEQ ID NO: 61520 - DNA, 15 bp, Homo sapiens
agaagaaaagctaac

SEQ ID NO: 61521 - DNA, 15 bp, Homo sapiens
gagaagaaaagctaa

SEQ ID NO: 61522 - DNA, 15 bp, Homo sapiens
tgagaagaaaagcta

SEQ ID NO: 61523 - DNA, 15 bp, Homo sapiens
ttgagaagaaaagct

SEQ ID NO: 61524 - DNA, 15 bp, Homo sapiens
tttgagaagaaaagc

SEQ ID NO: 61525 - DNA, 15 bp, Homo sapiens
gtttgagaagaaaag

SEQ ID NO: 61526 - DNA, 15 bp, Homo sapiens
agtttgagaagaaaa

SEQ ID NO: 61527 - DNA, 15 bp, Homo sapiens
cagtttgagaagaaa

SEQ ID NO: 61528 - DNA, 15 bp, Homo sapiens
tcagtttgagaagaa

SEQ ID NO: 61529 - DNA, 15 bp, Homo sapiens
ttcagtttgagaaga

SEQ ID NO: 61530 - DNA, 15 bp, Homo sapiens
tttcagtttgagaag

SEQ ID NO: 61531 - DNA, 15 bp, Homo sapiens
ctttcagtttgagaa

SEQ ID NO: 61532 - DNA, 15 bp, Homo sapiens
actttcagtttgaga

SEQ ID NO: 61533 - DNA, 15 bp, Homo sapiens
tactttcagtttgag

SEQ ID NO: 61534 - DNA, 15 bp, Homo sapiens
ttactttcagtttga

SEQ ID NO: 61535 - DNA, 15 bp, Homo sapiens
tttactttcagtttg

SEQ ID NO: 61536 - DNA, 15 bp, Homo sapiens
ttttactttcagttt

SEQ ID NO: 61537 - DNA, 15 bp, Homo sapiens
gttttactttcagtt

SEQ ID NO: 61538 - DNA, 15 bp, Homo sapiens
agttttactttcagt

SEQ ID NO: 61539 - DNA, 15 bp, Homo sapiens
gagttttactttcag

SEQ ID NO: 61540 - DNA, 15 bp, Homo sapiens
agagttttactttca

SEQ ID NO: 61541 - DNA, 15 bp, Homo sapiens
cagagttttactttc

SEQ ID NO: 61542 - DNA, 15 bp, Homo sapiens
acagagttttacttt

SEQ ID NO: 61543 - DNA, 15 bp, Homo sapiens
tacagagttttactt

SEQ ID NO: 61544 - DNA, 15 bp, Homo sapiens
ttacagagttttact

SEQ ID NO: 61545 - DNA, 15 bp, Homo sapiens
tttacagagttttac

SEQ ID NO: 61546 - DNA, 15 bp, Homo sapiens
atttacagagtttta

SEQ ID NO: 61547 - DNA, 15 bp, Homo sapiens
aatttacagagtttt

SEQ ID NO: 61548 - DNA, 15 bp, Homo sapiens
gaatttacagagttt

SEQ ID NO: 61549 - DNA, 15 bp, Homo sapiens
tgaatttacagagtt

SEQ ID NO: 61550 - DNA, 15 bp, Homo sapiens
ttgaatttacagagt

SEQ ID NO: 61551 - DNA, 15 bp, Homo sapiens
attgaatttacagag

SEQ ID NO: 61552 - DNA, 15 bp, Homo sapiens
cattgaatttacaga

SEQ ID NO: 61553 - DNA, 15 bp, Homo sapiens
gcattgaatttacag

SEQ ID NO: 61554 - DNA, 15 bp, Homo sapiens
tgcattgaatttaca

SEQ ID NO: 61555 - DNA, 15 bp, Homo sapiens
atgcattgaatttac

SEQ ID NO: 61556 - DNA, 15 bp, Homo sapiens
aatgcattgaattta

SEQ ID NO: 61557 - DNA, 15 bp, Homo sapiens
gaatgcattgaattt

SEQ ID NO: 61558 - DNA, 15 bp, Homo sapiens
ggaatgcattgaatt

SEQ ID NO: 61559 - DNA, 15 bp, Homo sapiens
gggaatgcattgaat

SEQ ID NO: 61560 - DNA, 15 bp, Homo sapiens
tgggaatgcattgaa

SEQ ID NO: 61561 - DNA, 15 bp, Homo sapiens
ttgggaatgcattga

SEQ ID NO: 61562 - DNA, 15 bp, Homo sapiens
attgggaatgcattg

SEQ ID NO: 61563 - DNA, 15 bp, Homo sapiens
aattgggaatgcatt

SEQ ID NO: 61564 - DNA, 15 bp, Homo sapiens
taattgggaatgcat

SEQ ID NO: 61565 - DNA, 15 bp, Homo sapiens
ttaattgggaatgca

SEQ ID NO: 61566 - DNA, 15 bp, Homo sapiens
tttaattgggaatgc

SEQ ID NO: 61567 - DNA, 15 bp, Homo sapiens
ttttaattgggaatg

SEQ ID NO: 61568 - DNA, 15 bp, Homo sapiens
tttttaattgggaat

SEQ ID NO: 61569 - DNA, 15 bp, Homo sapiens
atttttaattgggaa

SEQ ID NO: 61570 - DNA, 15 bp, Homo sapiens
tatttttaattggga

SEQ ID NO: 61571 - DNA, 15 bp, Homo sapiens
ctatttttaattggg

SEQ ID NO: 61572 - DNA, 15 bp, Homo sapiens
gctatttttaattgg

SEQ ID NO: 61573 - DNA, 15 bp, Homo sapiens
ggctatttttaattg

SEQ ID NO: 61574 - DNA, 15 bp, Homo sapiens
tggctatttttaatt

SEQ ID NO: 61575 - DNA, 15 bp, Homo sapiens
ttggctatttttaat

SEQ ID NO: 61576 - DNA, 15 bp, Homo sapiens
tttggctatttttaa

SEQ ID NO: 61577 - DNA, 15 bp, Homo sapiens
atttggctattttta

SEQ ID NO: 61578 - DNA, 15 bp, Homo sapiens
aatttggctattttt

SEQ ID NO: 61579 - DNA, 15 bp, Homo sapiens
caatttggctatttt

SEQ ID NO: 61580 - DNA, 15 bp, Homo sapiens
acaatttggctattt

SEQ ID NO: 61581 - DNA, 15 bp, Homo sapiens
gacaatttggctatt

SEQ ID NO: 61582 - DNA, 15 bp, Homo sapiens
agacaatttggctat

SEQ ID NO: 61583 - DNA, 15 bp, Homo sapiens
aagacaatttggcta

SEQ ID NO: 61584 - DNA, 15 bp, Homo sapiens
aaagacaatttggct

SEQ ID NO: 61585 - DNA, 15 bp, Homo sapiens
taaagacaatttggc

SEQ ID NO: 61586 - DNA, 15 bp, Homo sapiens
ttaaagacaatttgg

SEQ ID NO: 61587 - DNA, 15 bp, Homo sapiens
attaaagacaatttg

SEQ ID NO: 61588 - DNA, 15 bp, Homo sapiens
cattaaagacaattt

SEQ ID NO: 61589 - DNA, 15 bp, Homo sapiens
tcattaaagacaatt

SEQ ID NO: 61590 - DNA, 15 bp, Homo sapiens
ttcattaaagacaat

SEQ ID NO: 61591 - DNA, 15 bp, Homo sapiens
tttcattaaagacaa

SEQ ID NO: 61592 - DNA, 15 bp, Homo sapiens
gtttcattaaagaca

SEQ ID NO: 61593 - DNA, 15 bp, Homo sapiens
agtttcattaaagac

SEQ ID NO: 61594 - DNA, 15 bp, Homo sapiens
aagtttcattaaaga

SEQ ID NO: 61595 - DNA, 15 bp, Homo sapiens
caagtttcattaaag

SEQ ID NO: 61596 - DNA, 15 bp, Homo sapiens
acaagtttcattaaa

SEQ ID NO: 61597 - DNA, 15 bp, Homo sapiens
cacaagtttcattaa

SEQ ID NO: 61598 - DNA, 15 bp, Homo sapiens
tcacaagtttcatta

SEQ ID NO: 61599 - DNA, 15 bp, Homo sapiens
ttcacaagtttcatt

SEQ ID NO: 61600 - DNA, 15 bp, Homo sapiens
gttcacaagtttcat

SEQ ID NO: 61601 - DNA, 15 bp, Homo sapiens
tgttcacaagtttca

SEQ ID NO: 61602 - DNA, 15 bp, Homo sapiens
ctgttcacaagtttc

SEQ ID NO: 61603 - DNA, 15 bp, Homo sapiens
tctgttcacaagttt

SEQ ID NO: 61604 - DNA, 15 bp, Homo sapiens
atctgttcacaagtt

SEQ ID NO: 61605 - DNA, 15 bp, Homo sapiens
aatctgttcacaagt

SEQ ID NO: 61606 - DNA, 15 bp, Homo sapiens
gaatctgttcacaag

SEQ ID NO: 61607 - DNA, 15 bp, Homo sapiens
agaatctgttcacaa

SEQ ID NO: 61608 - DNA, 15 bp, Homo sapiens
tagaatctgttcaca

SEQ ID NO: 61609 - DNA, 15 bp, Homo sapiens
ttagaatctgttcac

SEQ ID NO: 61610 - DNA, 15 bp, Homo sapiens
attagaatctgttca

SEQ ID NO: 61611 - DNA, 15 bp, Homo sapiens
aattagaatctgttc

SEQ ID NO: 61612 - DNA, 15 bp, Homo sapiens
taattagaatctgtt

SEQ ID NO: 61613 - DNA, 15 bp, Homo sapiens
ataattagaatctgt

SEQ ID NO: 61614 - DNA, 15 bp, Homo sapiens
tataattagaatctg

SEQ ID NO: 61615 - DNA, 15 bp, Homo sapiens
atataattagaatct

SEQ ID NO: 61616 - DNA, 15 bp, Homo sapiens
tatataattagaatc

SEQ ID NO: 61617 - DNA, 15 bp, Homo sapiens
ttatataattagaat

SEQ ID NO: 61618 - DNA, 15 bp, Homo sapiens
tttatataattagaa

SEQ ID NO: 61619 - DNA, 15 bp, Homo sapiens
ttttatataattaga

SEQ ID NO: 61620 - DNA, 15 bp, Homo sapiens
cttttatataattag

SEQ ID NO: 61621 - DNA, 15 bp, Homo sapiens
tcttttatataatta

SEQ ID NO: 61622 - DNA, 15 bp, Homo sapiens
gtcttttatataatt

SEQ ID NO: 61623 - DNA, 15 bp, Homo sapiens
cgtcttttatataat

SEQ ID NO: 61624 - DNA, 15 bp, Homo sapiens
tcgtcttttatataa

SEQ ID NO: 61625 - DNA, 15 bp, Homo sapiens
ctcgtcttttatata

SEQ ID NO: 61626 - DNA, 15 bp, Homo sapiens
cctcgtcttttatat

SEQ ID NO: 61627 - DNA, 15 bp, Homo sapiens
gcctcgtcttttata

SEQ ID NO: 61628 - DNA, 15 bp, Homo sapiens
ggcctcgtcttttat

SEQ ID NO: 61629 - DNA, 15 bp, Homo sapiens
gggcctcgtctttta

SEQ ID NO: 61630 - DNA, 15 bp, Homo sapiens
tgggcctcgtctttt

SEQ ID NO: 61631 - DNA, 15 bp, Homo sapiens
ttgggcctcgtcttt

SEQ ID NO: 61632 - DNA, 15 bp, Homo sapiens
cttgggcctcgtctt

SEQ ID NO: 61633 - DNA, 15 bp, Homo sapiens
tcttgggcctcgtct

SEQ ID NO: 61634 - DNA, 15 bp, Homo sapiens
ttcttgggcctcgtc

SEQ ID NO: 61635 - DNA, 15 bp, Homo sapiens
attcttgggcctcgt

SEQ ID NO: 61636 - DNA, 15 bp, Homo sapiens
tattcttgggcctcg

SEQ ID NO: 61637 - DNA, 15 bp, Homo sapiens
ctattcttgggcctc

SEQ ID NO: 61638 - DNA, 15 bp, Homo sapiens
gctattcttgggcct

SEQ ID NO: 61639 - DNA, 15 bp, Homo sapiens
ggctattcttgggcc

SEQ ID NO: 61640 - DNA, 15 bp, Homo sapiens
tggctattcttgggc

SEQ ID NO: 61641 - DNA, 15 bp, Homo sapiens
ctggctattcttggg

SEQ ID NO: 61642 - DNA, 15 bp, Homo sapiens
actggctattcttgg

SEQ ID NO: 61643 - DNA, 15 bp, Homo sapiens
tactggctattcttg

SEQ ID NO: 61644 - DNA, 15 bp, Homo sapiens
ctactggctattctt

SEQ ID NO: 61645 - DNA, 15 bp, Homo sapiens
tctactggctattct

SEQ ID NO: 61646 - DNA, 15 bp, Homo sapiens
gtctactggctattc

SEQ ID NO: 61647 - DNA, 15 bp, Homo sapiens
agtctactggctatt

SEQ ID NO: 61648 - DNA, 15 bp, Homo sapiens
aagtctactggctat

SEQ ID NO: 61649 - DNA, 15 bp, Homo sapiens
gaagtctactggcta

SEQ ID NO: 61650 - DNA, 15 bp, Homo sapiens
agaagtctactggct

SEQ ID NO: 61651 - DNA, 15 bp, Homo sapiens
cagaagtctactggc

SEQ ID NO: 61652 - DNA, 15 bp, Homo sapiens
tcagaagtctactgg

SEQ ID NO: 61653 - DNA, 15 bp, Homo sapiens
ctcagaagtctactg

SEQ ID NO: 61654 - DNA, 15 bp, Homo sapiens
cctcagaagtctact

SEQ ID NO: 61655 - DNA, 15 bp, Homo sapiens
tcctcagaagtctac

SEQ ID NO: 61656 - DNA, 15 bp, Homo sapiens
ttcctcagaagtcta

SEQ ID NO: 61657 - DNA, 15 bp, Homo sapiens
cttcctcagaagtct

SEQ ID NO: 61658 - DNA, 15 bp, Homo sapiens
tcttcctcagaagtc

SEQ ID NO: 61659 - DNA, 15 bp, Homo sapiens
ttcttcctcagaagt

SEQ ID NO: 61660 - DNA, 15 bp, Homo sapiens
attcttcctcagaag

SEQ ID NO: 61661 - DNA, 15 bp, Homo sapiens
gattcttcctcagaa

SEQ ID NO: 61662 - DNA, 15 bp, Homo sapiens
tgattcttcctcaga

SEQ ID NO: 61663 - DNA, 15 bp, Homo sapiens
ctgattcttcctcag

SEQ ID NO: 61664 - DNA, 15 bp, Homo sapiens
cctgattcttcctca

SEQ ID NO: 61665 - DNA, 15 bp, Homo sapiens
gcctgattcttcctc

SEQ ID NO: 61666 - DNA, 15 bp, Homo sapiens
agcctgattcttcct

SEQ ID NO: 61667 - DNA, 15 bp, Homo sapiens
cagcctgattcttcc

SEQ ID NO: 61668 - DNA, 15 bp, Homo sapiens
tcagcctgattcttc

SEQ ID NO: 61669 - DNA, 15 bp, Homo sapiens
ttcagcctgattctt

SEQ ID NO: 61670 - DNA, 15 bp, Homo sapiens
tttcagcctgattct

SEQ ID NO: 61671 - DNA, 15 bp, Homo sapiens
atttcagcctgattc

SEQ ID NO: 61672 - DNA, 15 bp, Homo sapiens
tatttcagcctgatt

SEQ ID NO: 61673 - DNA, 15 bp, Homo sapiens
gtatttcagcctgat

SEQ ID NO: 61674 - DNA, 15 bp, Homo sapiens
agtatttcagcctga

SEQ ID NO: 61675 - DNA, 15 bp, Homo sapiens
aagtatttcagcctg

SEQ ID NO: 61676 - DNA, 15 bp, Homo sapiens
aaagtatttcagcct

SEQ ID NO: 61677 - DNA, 15 bp, Homo sapiens
gaaagtatttcagcc

SEQ ID NO: 61678 - DNA, 15 bp, Homo sapiens
ggaaagtatttcagc

SEQ ID NO: 61679 - DNA, 15 bp, Homo sapiens
tggaaagtatttcag

SEQ ID NO: 61680 - DNA, 15 bp, Homo sapiens
ttggaaagtatttca

SEQ ID NO: 61681 - DNA, 15 bp, Homo sapiens
tttggaaagtatttc

SEQ ID NO: 61682 - DNA, 15 bp, Homo sapiens
ttttggaaagtattt

SEQ ID NO: 61683 - DNA, 15 bp, Homo sapiens
tttttggaaagtatt

SEQ ID NO: 61684 - DNA, 15 bp, Homo sapiens
ctttttggaaagtat

SEQ ID NO: 61685 - DNA, 15 bp, Homo sapiens
tctttttggaaagta

SEQ ID NO: 61686 - DNA, 15 bp, Homo sapiens
ttctttttggaaagt

SEQ ID NO: 61687 - DNA, 15 bp, Homo sapiens
tttctttttggaaag

SEQ ID NO: 61688 - DNA, 15 bp, Homo sapiens
gtttctttttggaaa

SEQ ID NO: 61689 - DNA, 15 bp, Homo sapiens
ggtttctttttggaa

SEQ ID NO: 61690 - DNA, 15 bp, Homo sapiens
tggtttctttttgga

SEQ ID NO: 61691 - DNA, 15 bp, Homo sapiens
ttggtttctttttgg

SEQ ID NO: 61692 - DNA, 15 bp, Homo sapiens
tttggtttctttttg

SEQ ID NO: 61693 - DNA, 15 bp, Homo sapiens
ttttggtttcttttt

SEQ ID NO: 61694 - DNA, 15 bp, Homo sapiens
gttttggtttctttt

SEQ ID NO: 61695 - DNA, 15 bp, Homo sapiens
agttttggtttcttt

SEQ ID NO: 61696 - DNA, 15 bp, Homo sapiens
tagttttggtttctt

SEQ ID NO: 61697 - DNA, 15 bp, Homo sapiens
atagttttggtttct

SEQ ID NO: 61698 - DNA, 15 bp, Homo sapiens
catagttttggtttc

SEQ ID NO: 61699 - DNA, 15 bp, Homo sapiens
tcatagttttggttt

SEQ ID NO: 61700 - DNA, 15 bp, Homo sapiens
ttcatagttttggtt

SEQ ID NO: 61701 - DNA, 15 bp, Homo sapiens
cttcatagttttggt

SEQ ID NO: 61702 - DNA, 15 bp, Homo sapiens
gcttcatagttttgg

SEQ ID NO: 61703 - DNA, 15 bp, Homo sapiens
agcttcatagttttg

SEQ ID NO: 61704 - DNA, 15 bp, Homo sapiens
tagcttcatagtttt

SEQ ID NO: 61705 - DNA, 15 bp, Homo sapiens
atagcttcatagttt

SEQ ID NO: 61706 - DNA, 15 bp, Homo sapiens
tatagcttcatagtt

SEQ ID NO: 61707 - DNA, 15 bp, Homo sapiens
atatagcttcatagt

SEQ ID NO: 61708 - DNA, 15 bp, Homo sapiens
aatatagcttcatag

SEQ ID NO: 61709 - DNA, 15 bp, Homo sapiens
taatatagcttcata

SEQ ID NO: 61710 - DNA, 15 bp, Homo sapiens
ttaatatagcttcat

SEQ ID NO: 61711 - DNA, 15 bp, Homo sapiens
attaatatagcttca

SEQ ID NO: 61712 - DNA, 15 bp, Homo sapiens
aattaatatagcttc

SEQ ID NO: 61713 - DNA, 15 bp, Homo sapiens
taattaatatagctt

SEQ ID NO: 61714 - DNA, 15 bp, Homo sapiens
ttaattaatatagct

SEQ ID NO: 61715 - DNA, 15 bp, Homo sapiens
cttaattaatatagc

SEQ ID NO: 61716 - DNA, 15 bp, Homo sapiens
tcttaattaatatag

SEQ ID NO: 61717 - DNA, 15 bp, Homo sapiens
gtcttaattaatata

SEQ ID NO: 61718 - DNA, 15 bp, Homo sapiens
agtcttaattaatat

SEQ ID NO: 61719 - DNA, 15 bp, Homo sapiens
tagtcttaattaata

SEQ ID NO: 61720 - DNA, 15 bp, Homo sapiens
atagtcttaattaat

SEQ ID NO: 61721 - DNA, 15 bp, Homo sapiens
catagtcttaattaa

SEQ ID NO: 61722 - DNA, 15 bp, Homo sapiens
gcatagtcttaatta

SEQ ID NO: 61723 - DNA, 15 bp, Homo sapiens
tgcatagtcttaatt

SEQ ID NO: 61724 - DNA, 15 bp, Homo sapiens
ctgcatagtcttaat

SEQ ID NO: 61725 - DNA, 15 bp, Homo sapiens
actgcatagtcttaa

SEQ ID NO: 61726 - DNA, 15 bp, Homo sapiens
tactgcatagtctta

SEQ ID NO: 61727 - DNA, 15 bp, Homo sapiens
gtactgcatagtctt

SEQ ID NO: 61728 - DNA, 15 bp, Homo sapiens
agtactgcatagtct

SEQ ID NO: 61729 - DNA, 15 bp, Homo sapiens
tagtactgcatagtc

SEQ ID NO: 61730 - DNA, 15 bp, Homo sapiens
atagtactgcatagt

SEQ ID NO: 61731 - DNA, 15 bp, Homo sapiens
gatagtactgcatag

SEQ ID NO: 61732 - DNA, 15 bp, Homo sapiens
tgatagtactgcata

SEQ ID NO: 61733 - DNA, 15 bp, Homo sapiens
ttgatagtactgcat

SEQ ID NO: 61734 - DNA, 15 bp, Homo sapiens
attgatagtactgca

SEQ ID NO: 61735 - DNA, 15 bp, Homo sapiens
tattgatagtactgc

SEQ ID NO: 61736 - DNA, 15 bp, Homo sapiens
atattgatagtactg

SEQ ID NO: 61737 - DNA, 15 bp, Homo sapiens
tatattgatagtact

SEQ ID NO: 61738 - DNA, 15 bp, Homo sapiens
gtatattgatagtac

SEQ ID NO: 61739 - DNA, 15 bp, Homo sapiens
tgtatattgatagta

SEQ ID NO: 61740 - DNA, 15 bp, Homo sapiens
gtgtatattgatagt

SEQ ID NO: 61741 - DNA, 15 bp, Homo sapiens
tgtgtatattgatag

SEQ ID NO: 61742 - DNA, 15 bp, Homo sapiens
gtgtgtatattgata

SEQ ID NO: 61743 - DNA, 15 bp, Homo sapiens
ggtgtgtatattgat

SEQ ID NO: 61744 - DNA, 15 bp, Homo sapiens
tggtgtgtatattga

SEQ ID NO: 61745 - DNA, 15 bp, Homo sapiens
ttggtgtgtatattg

SEQ ID NO: 61746 - DNA, 15 bp, Homo sapiens
attggtgtgtatatt

SEQ ID NO: 61747 - DNA, 15 bp, Homo sapiens
tattggtgtgtatat

SEQ ID NO: 61748 - DNA, 15 bp, Homo sapiens
atattggtgtgtata

SEQ ID NO: 61749 - DNA, 15 bp, Homo sapiens
tatattggtgtgtat

SEQ ID NO: 61750 - DNA, 15 bp, Homo sapiens
ttatattggtgtgta

SEQ ID NO: 61751 - DNA, 15 bp, Homo sapiens
cttatattggtgtgt

SEQ ID NO: 61752 - DNA, 15 bp, Homo sapiens
gcttatattggtgtg

SEQ ID NO: 61753 - DNA, 15 bp, Homo sapiens
agcttatattggtgt

SEQ ID NO: 61754 - DNA, 15 bp, Homo sapiens
cagcttatattggtg

SEQ ID NO: 61755 - DNA, 15 bp, Homo sapiens
tcagcttatattggt

SEQ ID NO: 61756 - DNA, 15 bp, Homo sapiens
ttcagcttatattgg

SEQ ID NO: 61757 - DNA, 15 bp, Homo sapiens
gttcagcttatattg

SEQ ID NO: 61758 - DNA, 15 bp, Homo sapiens
ggttcagcttatatt

SEQ ID NO: 61759 - DNA, 15 bp, Homo sapiens
tggttcagcttatat

SEQ ID NO: 61760 - DNA, 15 bp, Homo sapiens
atggttcagcttata

SEQ ID NO: 61761 - DNA, 15 bp, Homo sapiens
tatggttcagcttat

SEQ ID NO: 61762 - DNA, 15 bp, Homo sapiens
atatggttcagctta

SEQ ID NO: 61763 - DNA, 15 bp, Homo sapiens
catatggttcagctt

SEQ ID NO: 61764 - DNA, 15 bp, Homo sapiens
tcatatggttcagct

SEQ ID NO: 61765 - DNA, 15 bp, Homo sapiens
ttcatatggttcagc

SEQ ID NO: 61766 - DNA, 15 bp, Homo sapiens
tttcatatggttcag

SEQ ID NO: 61767 - DNA, 15 bp, Homo sapiens
atttcatatggttca

SEQ ID NO: 61768 - DNA, 15 bp, Homo sapiens
aatttcatatggttc

SEQ ID NO: 61769 - DNA, 15 bp, Homo sapiens
caatttcatatggtt

SEQ ID NO: 61770 - DNA, 15 bp, Homo sapiens
gcaatttcatatggt

SEQ ID NO: 61771 - DNA, 15 bp, Homo sapiens
ggcaatttcatatgg

SEQ ID NO: 61772 - DNA, 15 bp, Homo sapiens
cggcaatttcatatg

SEQ ID NO: 61773 - DNA, 15 bp, Homo sapiens
tcggcaatttcatat

SEQ ID NO: 61774 - DNA, 15 bp, Homo sapiens
gtcggcaatttcata

SEQ ID NO: 61775 - DNA, 15 bp, Homo sapiens
tgtcggcaatttcat

SEQ ID NO: 61776 - DNA, 15 bp, Homo sapiens
atgtcggcaatttca

SEQ ID NO: 61777 - DNA, 15 bp, Homo sapiens
catgtcggcaatttc

SEQ ID NO: 61778 - DNA, 15 bp, Homo sapiens
acatgtcggcaattt

SEQ ID NO: 61779 - DNA, 15 bp, Homo sapiens
cacatgtcggcaatt

SEQ ID NO: 61780 - DNA, 15 bp, Homo sapiens
tcacatgtcggcaat

SEQ ID NO: 61781 - DNA, 15 bp, Homo sapiens
ctcacatgtcggcaa

SEQ ID NO: 61782 - DNA, 15 bp, Homo sapiens
actcacatgtcggca

SEQ ID NO: 61783 - DNA, 15 bp, Homo sapiens
cactcacatgtcggc

SEQ ID NO: 61784 - DNA, 15 bp, Homo sapiens
acactcacatgtcgg

SEQ ID NO: 61785 - DNA, 15 bp, Homo sapiens
aacactcacatgtcg

SEQ ID NO: 61786 - DNA, 15 bp, Homo sapiens
aaacactcacatgtc

SEQ ID NO: 61787 - DNA, 15 bp, Homo sapiens
aaaacactcacatgt

SEQ ID NO: 61788 - DNA, 15 bp, Homo sapiens
aaaaacactcacatg

SEQ ID NO: 61789 - DNA, 15 bp, Homo sapiens
caaaaacactcacat

SEQ ID NO: 61790 - DNA, 15 bp, Homo sapiens
gcaaaaacactcaca

SEQ ID NO: 61791 - DNA, 15 bp, Homo sapiens
agcaaaaacactcac

SEQ ID NO: 61792 - DNA, 15 bp, Homo sapiens
tagcaaaaacactca

SEQ ID NO: 61793 - DNA, 15 bp, Homo sapiens
atagcaaaaacactc

SEQ ID NO: 61794 - DNA, 15 bp, Homo sapiens
tatagcaaaaacact

SEQ ID NO: 61795 - DNA, 15 bp, Homo sapiens
atatagcaaaaacac

SEQ ID NO: 61796 - DNA, 15 bp, Homo sapiens
tatatagcaaaaaca

SEQ ID NO: 61797 - DNA, 15 bp, Homo sapiens
ttatatagcaaaaac

SEQ ID NO: 61798 - DNA, 15 bp, Homo sapiens
cttatatagcaaaaa

SEQ ID NO: 61799 - DNA, 15 bp, Homo sapiens
tcttatatagcaaaa

SEQ ID NO: 61800 - DNA, 15 bp, Homo sapiens
ttcttatatagcaaa

SEQ ID NO: 61801 - DNA, 15 bp, Homo sapiens
attcttatatagcaa

SEQ ID NO: 61802 - DNA, 15 bp, Homo sapiens
cattcttatatagca

SEQ ID NO: 61803 - DNA, 15 bp, Homo sapiens
ccattcttatatagc

SEQ ID NO: 61804 - DNA, 15 bp, Homo sapiens
accattcttatatag

SEQ ID NO: 61805 - DNA, 15 bp, Homo sapiens
caccattcttatata

SEQ ID NO: 61806 - DNA, 15 bp, Homo sapiens
acaccattcttatat

SEQ ID NO: 61807 - DNA, 15 bp, Homo sapiens
aacaccattcttata

SEQ ID NO: 61808 - DNA, 15 bp, Homo sapiens
aaacaccattcttat

SEQ ID NO: 61809 - DNA, 15 bp, Homo sapiens
aaaacaccattctta

SEQ ID NO: 61810 - DNA, 15 bp, Homo sapiens
gaaaacaccattctt

SEQ ID NO: 61811 - DNA, 15 bp, Homo sapiens
tgaaaacaccattct

SEQ ID NO: 61812 - DNA, 15 bp, Homo sapiens
atgaaaacaccattc

SEQ ID NO: 61813 - DNA, 15 bp, Homo sapiens
tatgaaaacaccatt

SEQ ID NO: 61814 - DNA, 15 bp, Homo sapiens
atatgaaaacaccat

SEQ ID NO: 61815 - DNA, 15 bp, Homo sapiens
catatgaaaacacca

SEQ ID NO: 61816 - DNA, 15 bp, Homo sapiens
ccatatgaaaacacc

SEQ ID NO: 61817 - DNA, 15 bp, Homo sapiens
accatatgaaaacac

SEQ ID NO: 61818 - DNA, 15 bp, Homo sapiens
aaccatatgaaaaca

SEQ ID NO: 61819 - DNA, 15 bp, Homo sapiens
gaaccatatgaaaac

SEQ ID NO: 61820 - DNA, 15 bp, Homo sapiens
tgaaccatatgaaaa

SEQ ID NO: 61821 - DNA, 15 bp, Homo sapiens
ttgaaccatatgaaa

SEQ ID NO: 61822 - DNA, 15 bp, Homo sapiens
gttgaaccatatgaa

SEQ ID NO: 61823 - DNA, 15 bp, Homo sapiens
ggttgaaccatatga

SEQ ID NO: 61824 - DNA, 15 bp, Homo sapiens
aggttgaaccatatg

SEQ ID NO: 61825 - DNA, 15 bp, Homo sapiens
taggttgaaccatat

SEQ ID NO: 61826 - DNA, 15 bp, Homo sapiens
ttaggttgaaccata

SEQ ID NO: 61827 - DNA, 15 bp, Homo sapiens
attaggttgaaccat

SEQ ID NO: 61828 - DNA, 15 bp, Homo sapiens
tattaggttgaacca

SEQ ID NO: 61829 - DNA, 15 bp, Homo sapiens
ttattaggttgaacc

SEQ ID NO: 61830 - DNA, 15 bp, Homo sapiens
tttattaggttgaac

SEQ ID NO: 61831 - DNA, 15 bp, Homo sapiens
ttttattaggttgaa

SEQ ID NO: 61832 - DNA, 15 bp, Homo sapiens
attttattaggttga

SEQ ID NO: 61833 - DNA, 15 bp, Homo sapiens
aattttattaggttg

SEQ ID NO: 61834 - DNA, 15 bp, Homo sapiens
taattttattaggtt

SEQ ID NO: 61835 - DNA, 15 bp, Homo sapiens
ttaattttattaggt

SEQ ID NO: 61836 - DNA, 15 bp, Homo sapiens
cttaattttattagg

SEQ ID NO: 61837 - DNA, 15 bp, Homo sapiens
tcttaattttattag

SEQ ID NO: 61838 - DNA, 15 bp, Homo sapiens
ttcttaattttatta

SEQ ID NO: 61839 - DNA, 15 bp, Homo sapiens
gttcttaattttatt

SEQ ID NO: 61840 - DNA, 15 bp, Homo sapiens
agttcttaattttat

SEQ ID NO: 61841 - DNA, 15 bp, Homo sapiens
gagttcttaatttta

SEQ ID NO: 61842 - DNA, 15 bp, Homo sapiens
tgagttcttaatttt

SEQ ID NO: 61843 - DNA, 15 bp, Homo sapiens
ctgagttcttaattt

SEQ ID NO: 61844 - DNA, 15 bp, Homo sapiens
tctgagttcttaatt

SEQ ID NO: 61845 - DNA, 15 bp, Homo sapiens
ttctgagttcttaat

SEQ ID NO: 61846 - DNA, 15 bp, Homo sapiens
tttctgagttcttaa

SEQ ID NO: 61847 - DNA, 15 bp, Homo sapiens
atttctgagttctta

SEQ ID NO: 61848 - DNA, 15 bp, Homo sapiens
aatttctgagttctt

SEQ ID NO: 61849 - DNA, 15 bp, Homo sapiens
caatttctgagttct

SEQ ID NO: 61850 - DNA, 15 bp, Homo sapiens
gcaatttctgagttc

SEQ ID NO: 61851 - DNA, 15 bp, Homo sapiens
agcaatttctgagtt

SEQ ID NO: 61852 - DNA, 15 bp, Homo sapiens
gagcaatttctgagt

SEQ ID NO: 61853 - DNA, 15 bp, Homo sapiens
ggagcaatttctgag

SEQ ID NO: 61854 - DNA, 15 bp, Homo sapiens
tggagcaatttctga

SEQ ID NO: 61855 - DNA, 15 bp, Homo sapiens
atggagcaatttctg

SEQ ID NO: 61856 - DNA, 15 bp, Homo sapiens
aatggagcaatttct

SEQ ID NO: 61857 - DNA, 15 bp, Homo sapiens
taatggagcaatttc

SEQ ID NO: 61858 - DNA, 15 bp, Homo sapiens
gtaatggagcaattt

SEQ ID NO: 61859 - DNA, 15 bp, Homo sapiens
tgtaatggagcaatt

SEQ ID NO: 61860 - DNA, 15 bp, Homo sapiens
gtgtaatggagcaat

SEQ ID NO: 61861 - DNA, 15 bp, Homo sapiens
tgtgtaatggagcaa

SEQ ID NO: 61862 - DNA, 15 bp, Homo sapiens
ctgtgtaatggagca

SEQ ID NO: 61863 - DNA, 15 bp, Homo sapiens
cctgtgtaatggagc

SEQ ID NO: 61864 - DNA, 15 bp, Homo sapiens
tcctgtgtaatggag

SEQ ID NO: 61865 - DNA, 15 bp, Homo sapiens
ttcctgtgtaatgga

SEQ ID NO: 61866 - DNA, 15 bp, Homo sapiens
tttcctgtgtaatgg

SEQ ID NO: 61867 - DNA, 15 bp, Homo sapiens
ttttcctgtgtaatg

SEQ ID NO: 61868 - DNA, 15 bp, Homo sapiens
attttcctgtgtaat

SEQ ID NO: 61869 - DNA, 15 bp, Homo sapiens
gattttcctgtgtaa

SEQ ID NO: 61870 - DNA, 15 bp, Homo sapiens
agattttcctgtgta

SEQ ID NO: 61871 - DNA, 15 bp, Homo sapiens
cagattttcctgtgt

SEQ ID NO: 61872 - DNA, 15 bp, Homo sapiens
tcagattttcctgtg

SEQ ID NO: 61873 - DNA, 15 bp, Homo sapiens
atcagattttcctgt

SEQ ID NO: 61874 - DNA, 15 bp, Homo sapiens
tatcagattttcctg

SEQ ID NO: 61875 - DNA, 15 bp, Homo sapiens
atatcagattttcct

SEQ ID NO: 61876 - DNA, 15 bp, Homo sapiens
tatatcagattttcc

SEQ ID NO: 61877 - DNA, 15 bp, Homo sapiens
gtatatcagattttc

SEQ ID NO: 61878 - DNA, 15 bp, Homo sapiens
cgtatatcagatttt

SEQ ID NO: 61879 - DNA, 15 bp, Homo sapiens
gcgtatatcagattt

SEQ ID NO: 61880 - DNA, 15 bp, Homo sapiens
agcgtatatcagatt

SEQ ID NO: 61881 - DNA, 15 bp, Homo sapiens
aagcgtatatcagat

SEQ ID NO: 61882 - DNA, 15 bp, Homo sapiens
caagcgtatatcaga

SEQ ID NO: 61883 - DNA, 15 bp, Homo sapiens
tcaagcgtatatcag

SEQ ID NO: 61884 - DNA, 15 bp, Homo sapiens
ctcaagcgtatatca

SEQ ID NO: 61885 - DNA, 15 bp, Homo sapiens
gctcaagcgtatatc

SEQ ID NO: 61886 - DNA, 15 bp, Homo sapiens
agctcaagcgtatat

SEQ ID NO: 61887 - DNA, 15 bp, Homo sapiens
cagctcaagcgtata

SEQ ID NO: 61888 - DNA, 15 bp, Homo sapiens
tcagctcaagcgtat

SEQ ID NO: 61889 - DNA, 15 bp, Homo sapiens
gtcagctcaagcgta

SEQ ID NO: 61890 - DNA, 15 bp, Homo sapiens
tgtcagctcaagcgt

SEQ ID NO: 61891 - DNA, 15 bp, Homo sapiens
atgtcagctcaagcg

SEQ ID NO: 61892 - DNA, 15 bp, Homo sapiens
aatgtcagctcaagc

SEQ ID NO: 61893 - DNA, 15 bp, Homo sapiens
caatgtcagctcaag

SEQ ID NO: 61894 - DNA, 15 bp, Homo sapiens
gcaatgtcagctcaa

SEQ ID NO: 61895 - DNA, 15 bp, Homo sapiens
tgcaatgtcagctca

SEQ ID NO: 61896 - DNA, 15 bp, Homo sapiens
ctgcaatgtcagctc

SEQ ID NO: 61897 - DNA, 15 bp, Homo sapiens
tctgcaatgtcagct

SEQ ID NO: 61898 - DNA, 15 bp, Homo sapiens
atctgcaatgtcagc

SEQ ID NO: 61899 - DNA, 15 bp, Homo sapiens
aatctgcaatgtcag

SEQ ID NO: 61900 - DNA, 15 bp, Homo sapiens
taatctgcaatgtca

SEQ ID NO: 61901 - DNA, 15 bp, Homo sapiens
ttaatctgcaatgtc

SEQ ID NO: 61902 - DNA, 15 bp, Homo sapiens
attaatctgcaatgt

SEQ ID NO: 61903 - DNA, 15 bp, Homo sapiens
tattaatctgcaatg

SEQ ID NO: 61904 - DNA, 15 bp, Homo sapiens
ctattaatctgcaat

SEQ ID NO: 61905 - DNA, 15 bp, Homo sapiens
tctattaatctgcaa

SEQ ID NO: 61906 - DNA, 15 bp, Homo sapiens
atctattaatctgca

SEQ ID NO: 61907 - DNA, 15 bp, Homo sapiens
catctattaatctgc

SEQ ID NO: 61908 - DNA, 15 bp, Homo sapiens
tcatctattaatctg

SEQ ID NO: 61909 - DNA, 15 bp, Homo sapiens
atcatctattaatct

SEQ ID NO: 61910 - DNA, 15 bp, Homo sapiens
aatcatctattaatc

SEQ ID NO: 61911 - DNA, 15 bp, Homo sapiens
aaatcatctattaat

SEQ ID NO: 61912 - DNA, 15 bp, Homo sapiens
caaatcatctattaa

SEQ ID NO: 61913 - DNA, 15 bp, Homo sapiens
ccaaatcatctatta

SEQ ID NO: 61914 - DNA, 15 bp, Homo sapiens
tccaaatcatctatt

SEQ ID NO: 61915 - DNA, 15 bp, Homo sapiens
gtccaaatcatctat

SEQ ID NO: 61916 - DNA, 15 bp, Homo sapiens
tgtccaaatcatcta

SEQ ID NO: 61917 - DNA, 15 bp, Homo sapiens
ttgtccaaatcatct

SEQ ID NO: 61918 - DNA, 15 bp, Homo sapiens
attgtccaaatcatc

SEQ ID NO: 61919 - DNA, 15 bp, Homo sapiens
aattgtccaaatcat

SEQ ID NO: 61920 - DNA, 15 bp, Homo sapiens
caattgtccaaatca

SEQ ID NO: 61921 - DNA, 15 bp, Homo sapiens
tcaattgtccaaatc

SEQ ID NO: 61922 - DNA, 15 bp, Homo sapiens
atcaattgtccaaat

SEQ ID NO: 61923 - DNA, 15 bp, Homo sapiens
aatcaattgtccaaa

SEQ ID NO: 61924 - DNA, 15 bp, Homo sapiens
taatcaattgtccaa

SEQ ID NO: 61925 - DNA, 15 bp, Homo sapiens
gtaatcaattgtcca

SEQ ID NO: 61926 - DNA, 15 bp, Homo sapiens
ggtaatcaattgtcc

SEQ ID NO: 61927 - DNA, 15 bp, Homo sapiens
gggtaatcaattgtc

SEQ ID NO: 61928 - DNA, 15 bp, Homo sapiens
tgggtaatcaattgt

SEQ ID NO: 61929 - DNA, 15 bp, Homo sapiens
atgggtaatcaattg

SEQ ID NO: 61930 - DNA, 15 bp, Homo sapiens
tatgggtaatcaatt

SEQ ID NO: 61931 - DNA, 15 bp, Homo sapiens
atatgggtaatcaat

SEQ ID NO: 61932 - DNA, 15 bp, Homo sapiens
tatatgggtaatcaa

SEQ ID NO: 61933 - DNA, 15 bp, Homo sapiens
atatatgggtaatca

SEQ ID NO: 61934 - DNA, 15 bp, Homo sapiens
tatatatgggtaatc

SEQ ID NO: 61935 - DNA, 15 bp, Homo sapiens
ttatatatgggtaat

SEQ ID NO: 61936 - DNA, 15 bp, Homo sapiens
tttatatatgggtaa

SEQ ID NO: 61937 - DNA, 15 bp, Homo sapiens
atttatatatgggta

SEQ ID NO: 61938 - DNA, 15 bp, Homo sapiens
tatttatatatgggt

SEQ ID NO: 61939 - DNA, 15 bp, Homo sapiens
ttatttatatatggg

SEQ ID NO: 61940 - DNA, 15 bp, Homo sapiens
tttatttatatatgg

SEQ ID NO: 61941 - DNA, 15 bp, Homo sapiens
atttatttatatatg

SEQ ID NO: 61942 - DNA, 15 bp, Homo sapiens
catttatttatatat

SEQ ID NO: 61943 - DNA, 15 bp, Homo sapiens
acatttatttatata

SEQ ID NO: 61944 - DNA, 15 bp, Homo sapiens
tacatttatttatat

SEQ ID NO: 61945 - DNA, 15 bp, Homo sapiens
atacatttatttata

SEQ ID NO: 61946 - DNA, 15 bp, Homo sapiens
aatacatttatttat

SEQ ID NO: 61947 - DNA, 15 bp, Homo sapiens
caatacatttattta

SEQ ID NO: 61948 - DNA, 15 bp, Homo sapiens
ccaatacatttattt

SEQ ID NO: 61949 - DNA, 15 bp, Homo sapiens
tccaatacatttatt

SEQ ID NO: 61950 - DNA, 15 bp, Homo sapiens
atccaatacatttat

SEQ ID NO: 61951 - DNA, 15 bp, Homo sapiens
gatccaatacattta

SEQ ID NO: 61952 - DNA, 15 bp, Homo sapiens
agatccaatacattt

SEQ ID NO: 61953 - DNA, 15 bp, Homo sapiens
aagatccaatacatt

SEQ ID NO: 61954 - DNA, 15 bp, Homo sapiens
aaagatccaatacat

SEQ ID NO: 61955 - DNA, 15 bp, Homo sapiens
taaagatccaataca

SEQ ID NO: 61956 - DNA, 15 bp, Homo sapiens
gtaaagatccaatac

SEQ ID NO: 61957 - DNA, 15 bp, Homo sapiens
agtaaagatccaata

SEQ ID NO: 61958 - DNA, 15 bp, Homo sapiens
aagtaaagatccaat

SEQ ID NO: 61959 - DNA, 15 bp, Homo sapiens
gaagtaaagatccaa

SEQ ID NO: 61960 - DNA, 15 bp, Homo sapiens
tgaagtaaagatcca

SEQ ID NO: 61961 - DNA, 15 bp, Homo sapiens
gtgaagtaaagatcc

SEQ ID NO: 61962 - DNA, 15 bp, Homo sapiens
ggtgaagtaaagatc

SEQ ID NO: 61963 - DNA, 15 bp, Homo sapiens
tggtgaagtaaagat

SEQ ID NO: 61964 - DNA, 15 bp, Homo sapiens
gtggtgaagtaaaga

SEQ ID NO: 61965 - DNA, 15 bp, Homo sapiens
tgtggtgaagtaaag

SEQ ID NO: 61966 - DNA, 15 bp, Homo sapiens
gtgtggtgaagtaaa

SEQ ID NO: 61967 - DNA, 15 bp, Homo sapiens
agtgtggtgaagtaa

SEQ ID NO: 61968 - DNA, 15 bp, Homo sapiens
tagtgtggtgaagta

SEQ ID NO: 61969 - DNA, 15 bp, Homo sapiens
ttagtgtggtgaagt

SEQ ID NO: 61970 - DNA, 15 bp, Homo sapiens
tttagtgtggtgaag

SEQ ID NO: 61971 - DNA, 15 bp, Homo sapiens
ttttagtgtggtgaa

SEQ ID NO: 61972 - DNA, 15 bp, Homo sapiens
tttttagtgtggtga

SEQ ID NO: 61973 - DNA, 15 bp, Homo sapiens
ttttttagtgtggtg

SEQ ID NO: 61974 - DNA, 15 bp, Homo sapiens
tttttttagtgtggt

SEQ ID NO: 61975 - DNA, 15 bp, Homo sapiens
ttttttttagtgtgg

SEQ ID NO: 61976 - DNA, 15 bp, Homo sapiens
tttttttttagtgtg

SEQ ID NO: 61977 - DNA, 15 bp, Homo sapiens
ttttttttttagtgt

SEQ ID NO: 61978 - DNA, 15 bp, Homo sapiens
attttttttttagtg

SEQ ID NO: 61979 - DNA, 15 bp, Homo sapiens
tattttttttttagt

SEQ ID NO: 61980 - DNA, 15 bp, Homo sapiens
ttattttttttttag

SEQ ID NO: 61981 - DNA, 15 bp, Homo sapiens
attatttttttttta

SEQ ID NO: 61982 - DNA, 15 bp, Homo sapiens
tattatttttttttt

SEQ ID NO: 61983 - DNA, 15 bp, Homo sapiens
ttattattttttttt

SEQ ID NO: 61984 - DNA, 15 bp, Homo sapiens
attattatttttttt

SEQ ID NO: 61985 - DNA, 15 bp, Homo sapiens
gaaattattattttt

SEQ ID NO: 61986 - DNA, 15 bp, Homo sapiens
agaaattattatttt

SEQ ID NO: 61987 - DNA, 15 bp, Homo sapiens
tagaaattattattt

SEQ ID NO: 61988 - DNA, 15 bp, Homo sapiens
gtagaaattattatt

SEQ ID NO: 61989 - DNA, 15 bp, Homo sapiens
tgtagaaattattat

SEQ ID NO: 61990 - DNA, 15 bp, Homo sapiens
atgtagaaattatta

SEQ ID NO: 61991 - DNA, 15 bp, Homo sapiens
catgtagaaattatt

SEQ ID NO: 61992 - DNA, 15 bp, Homo sapiens
ccatgtagaaattat

SEQ ID NO: 61993 - DNA, 15 bp, Homo sapiens
tccatgtagaaatta

SEQ ID NO: 61994 - DNA, 15 bp, Homo sapiens
atccatgtagaaatt

SEQ ID NO: 61995 - DNA, 15 bp, Homo sapiens
gatccatgtagaaat

SEQ ID NO: 61996 - DNA, 15 bp, Homo sapiens
tgatccatgtagaaa

SEQ ID NO: 61997 - DNA, 15 bp, Homo sapiens
ctgatccatgtagaa

SEQ ID NO: 61998 - DNA, 15 bp, Homo sapiens
cctgatccatgtaga

SEQ ID NO: 61999 - DNA, 15 bp, Homo sapiens
ccctgatccatgtag

SEQ ID NO: 62000 - DNA, 15 bp, Homo sapiens
tccctgatccatgta

SEQ ID NO: 62001 - DNA, 15 bp, Homo sapiens
atccctgatccatgt

SEQ ID NO: 62002 - DNA, 15 bp, Homo sapiens
aatccctgatccatg

SEQ ID NO: 62003 - DNA, 15 bp, Homo sapiens
aaatccctgatccat

SEQ ID NO: 62004 - DNA, 15 bp, Homo sapiens
taaatccctgatcca

SEQ ID NO: 62005 - DNA, 15 bp, Homo sapiens
ttaaatccctgatcc

SEQ ID NO: 62006 - DNA, 15 bp, Homo sapiens
tttaaatccctgatc

SEQ ID NO: 62007 - DNA, 15 bp, Homo sapiens
atttaaatccctgat

SEQ ID NO: 62008 - DNA, 15 bp, Homo sapiens
catttaaatccctga

SEQ ID NO: 62009 - DNA, 15 bp, Homo sapiens
gcatttaaatccctg

SEQ ID NO: 62010 - DNA, 15 bp, Homo sapiens
ggcatttaaatccct

SEQ ID NO: 62011 - DNA, 15 bp, Homo sapiens
tggcatttaaatccc

SEQ ID NO: 62012 - DNA, 15 bp, Homo sapiens
ttggcatttaaatcc

SEQ ID NO: 62013 - DNA, 15 bp, Homo sapiens
tttggcatttaaatc

SEQ ID NO: 62014 - DNA, 15 bp, Homo sapiens
ctttggcatttaaat

SEQ ID NO: 62015 - DNA, 15 bp, Homo sapiens
cctttggcatttaaa

SEQ ID NO: 62016 - DNA, 15 bp, Homo sapiens
gcctttggcatttaa

SEQ ID NO: 62017 - DNA, 15 bp, Homo sapiens
tgcctttggcattta

SEQ ID NO: 62018 - DNA, 15 bp, Homo sapiens
ttgcctttggcattt

SEQ ID NO: 62019 - DNA, 15 bp, Homo sapiens
tttgcctttggcatt

SEQ ID NO: 62020 - DNA, 15 bp, Homo sapiens
ttttgcctttggcat

SEQ ID NO: 62021 - DNA, 15 bp, Homo sapiens
attttgcctttggca

SEQ ID NO: 62022 - DNA, 15 bp, Homo sapiens
aattttgcctttggc

SEQ ID NO: 62023 - DNA, 15 bp, Homo sapiens
aaattttgcctttgg

SEQ ID NO: 62024 - DNA, 15 bp, Homo sapiens
caaattttgcctttg

SEQ ID NO: 62025 - DNA, 15 bp, Homo sapiens
acaaattttgccttt

SEQ ID NO: 62026 - DNA, 15 bp, Homo sapiens
aacaaattttgcctt

SEQ ID NO: 62027 - DNA, 15 bp, Homo sapiens
taacaaattttgcct

SEQ ID NO: 62028 - DNA, 15 bp, Homo sapiens
ataacaaattttgcc

SEQ ID NO: 62029 - DNA, 15 bp, Homo sapiens
tataacaaattttgc

SEQ ID NO: 62030 - DNA, 15 bp, Homo sapiens
atataacaaattttg

SEQ ID NO: 62031 - DNA, 15 bp, Homo sapiens
aatataacaaatttt

SEQ ID NO: 62032 - DNA, 15 bp, Homo sapiens
aaatataacaaattt

SEQ ID NO: 62033 - DNA, 15 bp, Homo sapiens
aaaatataacaaatt

SEQ ID NO: 62034 - DNA, 15 bp, Homo sapiens
taaaatataacaaat

SEQ ID NO: 62035 - DNA, 15 bp, Homo sapiens
ataaaatataacaaa

SEQ ID NO: 62036 - DNA, 15 bp, Homo sapiens
aataaaatataacaa

SEQ ID NO: 62037 - DNA, 15 bp, Homo sapiens
caataaaatataaca

SEQ ID NO: 62038 - DNA, 15 bp, Homo sapiens
acaataaaatataac

SEQ ID NO: 62039 - DNA, 15 bp, Homo sapiens
aacaataaaatataa

SEQ ID NO: 62040 - DNA, 15 bp, Homo sapiens
caacaataaaatata

SEQ ID NO: 62041 - DNA, 15 bp, Homo sapiens
acaacaataaaatat

SEQ ID NO: 62042 - DNA, 15 bp, Homo sapiens
tacaacaataaaata

SEQ ID NO: 62043 - DNA, 15 bp, Homo sapiens
ttacaacaataaaat

SEQ ID NO: 62044 - DNA, 15 bp, Homo sapiens
tttacaacaataaaa

SEQ ID NO: 62045 - DNA, 15 bp, Homo sapiens
atttacaacaataaa

SEQ ID NO: 62046 - DNA, 15 bp, Homo sapiens
catttacaacaataa

SEQ ID NO: 62047 - DNA, 15 bp, Homo sapiens
tcatttacaacaata

SEQ ID NO: 62048 - DNA, 15 bp, Homo sapiens
atcatttacaacaat

SEQ ID NO: 62049 - DNA, 15 bp, Homo sapiens
aatcatttacaacaa

SEQ ID NO: 62050 - DNA, 15 bp, Homo sapiens
taatcatttacaaca

SEQ ID NO: 62051 - DNA, 15 bp, Homo sapiens
gtaatcatttacaac

SEQ ID NO: 62052 - DNA, 15 bp, Homo sapiens
agtaatcatttacaa

SEQ ID NO: 62053 - DNA, 15 bp, Homo sapiens
aagtaatcatttaca

SEQ ID NO: 62054 - DNA, 15 bp, Homo sapiens
aaagtaatcatttac

SEQ ID NO: 62055 - DNA, 15 bp, Homo sapiens
aaaagtaatcattta

SEQ ID NO: 62056 - DNA, 15 bp, Homo sapiens
gaaaagtaatcattt

SEQ ID NO: 62057 - DNA, 15 bp, Homo sapiens
agaaaagtaatcatt

SEQ ID NO: 62058 - DNA, 15 bp, Homo sapiens
gagaaaagtaatcat

SEQ ID NO: 62059 - DNA, 15 bp, Homo sapiens
tgagaaaagtaatca

SEQ ID NO: 62060 - DNA, 15 bp, Homo sapiens
ttgagaaaagtaatc

SEQ ID NO: 62061 - DNA, 15 bp, Homo sapiens
tttgagaaaagtaat

SEQ ID NO: 62062 - DNA, 15 bp, Homo sapiens
atttgagaaaagtaa

SEQ ID NO: 62063 - DNA, 15 bp, Homo sapiens
aatttgagaaaagta

SEQ ID NO: 62064 - DNA, 15 bp, Homo sapiens
aaatttgagaaaagt

SEQ ID NO: 62065 - DNA, 15 bp, Homo sapiens
gaaatttgagaaaag

SEQ ID NO: 62066 - DNA, 15 bp, Homo sapiens
tgaaatttgagaaaa

SEQ ID NO: 62067 - DNA, 15 bp, Homo sapiens
gtgaaatttgagaaa

SEQ ID NO: 62068 - DNA, 15 bp, Homo sapiens
agtgaaatttgagaa

SEQ ID NO: 62069 - DNA, 15 bp, Homo sapiens
aagtgaaatttgaga

SEQ ID NO: 62070 - DNA, 15 bp, Homo sapiens
gaagtgaaatttgag

SEQ ID NO: 62071 - DNA, 15 bp, Homo sapiens
ggaagtgaaatttga

SEQ ID NO: 62072 - DNA, 15 bp, Homo sapiens
aggaagtgaaatttg

SEQ ID NO: 62073 - DNA, 15 bp, Homo sapiens
gaggaagtgaaattt

SEQ ID NO: 62074 - DNA, 15 bp, Homo sapiens
agaggaagtgaaatt

SEQ ID NO: 62075 - DNA, 15 bp, Homo sapiens
tagaggaagtgaaat

SEQ ID NO: 62076 - DNA, 15 bp, Homo sapiens
atagaggaagtgaaa

SEQ ID NO: 62077 - DNA, 15 bp, Homo sapiens
catagaggaagtgaa

SEQ ID NO: 62078 - DNA, 15 bp, Homo sapiens
acatagaggaagtga

SEQ ID NO: 62079 - DNA, 15 bp, Homo sapiens
aacatagaggaagtg

SEQ ID NO: 62080 - DNA, 15 bp, Homo sapiens
aaacatagaggaagt

SEQ ID NO: 62081 - DNA, 15 bp, Homo sapiens
aaaacatagaggaag

SEQ ID NO: 62082 - DNA, 15 bp, Homo sapiens
aaaaacatagaggaa

SEQ ID NO: 62083 - DNA, 15 bp, Homo sapiens
aaaaaacatagagga

SEQ ID NO: 62084 - DNA, 15 bp, Homo sapiens
aaaaaaacatagagg

SEQ ID NO: 62085 - DNA, 15 bp, Homo sapiens
caaaaaaacatagag

SEQ ID NO: 62086 - DNA, 15 bp, Homo sapiens
gcaaaaaaacataga

SEQ ID NO: 62087 - DNA, 15 bp, Homo sapiens
agcaaaaaaacatag

SEQ ID NO: 62088 - DNA, 15 bp, Homo sapiens
cagcaaaaaaacata

SEQ ID NO: 62089 - DNA, 15 bp, Homo sapiens
ccagcaaaaaaacat

SEQ ID NO: 62090 - DNA, 15 bp, Homo sapiens
accagcaaaaaaaca

SEQ ID NO: 62091 - DNA, 15 bp, Homo sapiens
taccagcaaaaaaac

SEQ ID NO: 62092 - DNA, 15 bp, Homo sapiens
ataccagcaaaaaaa

SEQ ID NO: 62093 - DNA, 15 bp, Homo sapiens
tataccagcaaaaaa

SEQ ID NO: 62094 - DNA, 15 bp, Homo sapiens
atataccagcaaaaa

SEQ ID NO: 62095 - DNA, 15 bp, Homo sapiens
tatataccagcaaaa

SEQ ID NO: 62096 - DNA, 15 bp, Homo sapiens
ttatataccagcaaa

SEQ ID NO: 62097 - DNA, 15 bp, Homo sapiens
tttatataccagcaa

SEQ ID NO: 62098 - DNA, 15 bp, Homo sapiens
ttttatataccagca

SEQ ID NO: 62099 - DNA, 15 bp, Homo sapiens
cttttatataccagc

SEQ ID NO: 62100 - DNA, 15 bp, Homo sapiens
acttttatataccag

SEQ ID NO: 62101 - DNA, 15 bp, Homo sapiens
cacttttatatacca

SEQ ID NO: 62102 - DNA, 15 bp, Homo sapiens
gcacttttatatacc

SEQ ID NO: 62103 - DNA, 15 bp, Homo sapiens
tgcacttttatatac

SEQ ID NO: 62104 - DNA, 15 bp, Homo sapiens
ttgcacttttatata

SEQ ID NO: 62105 - DNA, 15 bp, Homo sapiens
attgcacttttatat

SEQ ID NO: 62106 - DNA, 15 bp, Homo sapiens
tattgcacttttata

SEQ ID NO: 62107 - DNA, 15 bp, Homo sapiens
ctattgcacttttat

SEQ ID NO: 62108 - DNA, 15 bp, Homo sapiens
tctattgcactttta

SEQ ID NO: 62109 - DNA, 15 bp, Homo sapiens
gtctattgcactttt

SEQ ID NO: 62110 - DNA, 15 bp, Homo sapiens
agtctattgcacttt

SEQ ID NO: 62111 - DNA, 15 bp, Homo sapiens
aagtctattgcactt

SEQ ID NO: 62112 - DNA, 15 bp, Homo sapiens
aaagtctattgcact

SEQ ID NO: 62113 - DNA, 15 bp, Homo sapiens
aaaagtctattgcac

SEQ ID NO: 62114 - DNA, 15 bp, Homo sapiens
gaaaagtctattgca

SEQ ID NO: 62115 - DNA, 15 bp, Homo sapiens
agaaaagtctattgc

SEQ ID NO: 62116 - DNA, 15 bp, Homo sapiens
tagaaaagtctattg

SEQ ID NO: 62117 - DNA, 15 bp, Homo sapiens
gtagaaaagtctatt

SEQ ID NO: 62118 - DNA, 15 bp, Homo sapiens
cgtagaaaagtctat

SEQ ID NO: 62119 - DNA, 15 bp, Homo sapiens
acgtagaaaagtcta

SEQ ID NO: 62120 - DNA, 15 bp, Homo sapiens
gacgtagaaaagtct

SEQ ID NO: 62121 - DNA, 15 bp, Homo sapiens
agacgtagaaaagtc

SEQ ID NO: 62122 - DNA, 15 bp, Homo sapiens
aagacgtagaaaagt

SEQ ID NO: 62123 - DNA, 15 bp, Homo sapiens
taagacgtagaaaag

SEQ ID NO: 62124 - DNA, 15 bp, Homo sapiens
ataagacgtagaaaa

SEQ ID NO: 62125 - DNA, 15 bp, Homo sapiens
tataagacgtagaaa

SEQ ID NO: 62126 - DNA, 15 bp, Homo sapiens
atataagacgtagaa

SEQ ID NO: 62127 - DNA, 15 bp, Homo sapiens
gatataagacgtaga

SEQ ID NO: 62128 - DNA, 15 bp, Homo sapiens
agatataagacgtag

SEQ ID NO: 62129 - DNA, 15 bp, Homo sapiens
cagatataagacgta

SEQ ID NO: 62130 - DNA, 15 bp, Homo sapiens
ccagatataagacgt

SEQ ID NO: 62131 - DNA, 15 bp, Homo sapiens
tccagatataagacg

SEQ ID NO: 62132 - DNA, 15 bp, Homo sapiens
ttccagatataagac

SEQ ID NO: 62133 - DNA, 15 bp, Homo sapiens
tttccagatataaga

SEQ ID NO: 62134 - DNA, 15 bp, Homo sapiens
gtttccagatataag

SEQ ID NO: 62135 - DNA, 15 bp, Homo sapiens
agtttccagatataa

SEQ ID NO: 62136 - DNA, 15 bp, Homo sapiens
aagtttccagatata

SEQ ID NO: 62137 - DNA, 15 bp, Homo sapiens
taagtttccagatat

SEQ ID NO: 62138 - DNA, 15 bp, Homo sapiens
ttaagtttccagata

SEQ ID NO: 62139 - DNA, 15 bp, Homo sapiens
attaagtttccagat

SEQ ID NO: 62140 - DNA, 15 bp, Homo sapiens
gattaagtttccaga

SEQ ID NO: 62141 - DNA, 15 bp, Homo sapiens
tgattaagtttccag

SEQ ID NO: 62142 - DNA, 15 bp, Homo sapiens
ctgattaagtttcca

SEQ ID NO: 62143 - DNA, 15 bp, Homo sapiens
actgattaagtttcc

SEQ ID NO: 62144 - DNA, 15 bp, Homo sapiens
aactgattaagtttc

SEQ ID NO: 62145 - DNA, 15 bp, Homo sapiens
gaactgattaagttt

SEQ ID NO: 62146 - DNA, 15 bp, Homo sapiens
agaactgattaagtt

SEQ ID NO: 62147 - DNA, 15 bp, Homo sapiens
aagaactgattaagt

SEQ ID NO: 62148 - DNA, 15 bp, Homo sapiens
taagaactgattaag

SEQ ID NO: 62149 - DNA, 15 bp, Homo sapiens
gtaagaactgattaa

SEQ ID NO: 62150 - DNA, 15 bp, Homo sapiens
tgtaagaactgatta

SEQ ID NO: 62151 - DNA, 15 bp, Homo sapiens
ttgtaagaactgatt

SEQ ID NO: 62152 - DNA, 15 bp, Homo sapiens
tttgtaagaactgat

SEQ ID NO: 62153 - DNA, 15 bp, Homo sapiens
atttgtaagaactga

SEQ ID NO: 62154 - DNA, 15 bp, Homo sapiens
aatttgtaagaactg

SEQ ID NO: 62155 - DNA, 15 bp, Homo sapiens
aaatttgtaagaact

SEQ ID NO: 62156 - DNA, 15 bp, Homo sapiens
aaaatttgtaagaac

SEQ ID NO: 62157 - DNA, 15 bp, Homo sapiens
taaaatttgtaagaa

SEQ ID NO: 62158 - DNA, 15 bp, Homo sapiens
ctaaaatttgtaaga

SEQ ID NO: 62159 - DNA, 15 bp, Homo sapiens
actaaaatttgtaag

SEQ ID NO: 62160 - DNA, 15 bp, Homo sapiens
tactaaaatttgtaa

SEQ ID NO: 62161 - DNA, 15 bp, Homo sapiens
ttactaaaatttgta

SEQ ID NO: 62162 - DNA, 15 bp, Homo sapiens
cttactaaaatttgt

SEQ ID NO: 62163 - DNA, 15 bp, Homo sapiens
acttactaaaatttg

SEQ ID NO: 62164 - DNA, 15 bp, Homo sapiens
aacttactaaaattt

SEQ ID NO: 62165 - DNA, 15 bp, Homo sapiens
aaacttactaaaatt

SEQ ID NO: 62166 - DNA, 15 bp, Homo sapiens
caaacttactaaaat

SEQ ID NO: 62167 - DNA, 15 bp, Homo sapiens
acaaacttactaaaa

SEQ ID NO: 62168 - DNA, 15 bp, Homo sapiens
gacaaacttactaaa

SEQ ID NO: 62169 - DNA, 15 bp, Homo sapiens
agacaaacttactaa

SEQ ID NO: 62170 - DNA, 15 bp, Homo sapiens
gagacaaacttacta

SEQ ID NO: 62171 - DNA, 15 bp, Homo sapiens
agagacaaacttact

SEQ ID NO: 62172 - DNA, 15 bp, Homo sapiens
tagagacaaacttac

SEQ ID NO: 62173 - DNA, 15 bp, Homo sapiens
ctagagacaaactta

SEQ ID NO: 62174 - DNA, 15 bp, Homo sapiens
tctagagacaaactt

SEQ ID NO: 62175 - DNA, 15 bp, Homo sapiens
atctagagacaaact

SEQ ID NO: 62176 - DNA, 15 bp, Homo sapiens
aatctagagacaaac

SEQ ID NO: 62177 - DNA, 15 bp, Homo sapiens
caatctagagacaaa

SEQ ID NO: 62178 - DNA, 15 bp, Homo sapiens
acaatctagagacaa

SEQ ID NO: 62179 - DNA, 15 bp, Homo sapiens
tacaatctagagaca

SEQ ID NO: 62180 - DNA, 15 bp, Homo sapiens
ctacaatctagagac

SEQ ID NO: 62181 - DNA, 15 bp, Homo sapiens
cctacaatctagaga

SEQ ID NO: 62182 - DNA, 15 bp, Homo sapiens
acctacaatctagag

SEQ ID NO: 62183 - DNA, 15 bp, Homo sapiens
aacctacaatctaga

SEQ ID NO: 62184 - DNA, 15 bp, Homo sapiens
aaacctacaatctag

SEQ ID NO: 62185 - DNA, 15 bp, Homo sapiens
gaaacctacaatcta

SEQ ID NO: 62186 - DNA, 15 bp, Homo sapiens
agaaacctacaatct

SEQ ID NO: 62187 - DNA, 15 bp, Homo sapiens
aagaaacctacaatc

SEQ ID NO: 62188 - DNA, 15 bp, Homo sapiens
caagaaacctacaat

SEQ ID NO: 62189 - DNA, 15 bp, Homo sapiens
ccaagaaacctacaa

SEQ ID NO: 62190 - DNA, 15 bp, Homo sapiens
tccaagaaacctaca

SEQ ID NO: 62191 - DNA, 15 bp, Homo sapiens
ctccaagaaacctac

SEQ ID NO: 62192 - DNA, 15 bp, Homo sapiens
cctccaagaaaccta

SEQ ID NO: 62193 - DNA, 15 bp, Homo sapiens
tcctccaagaaacct

SEQ ID NO: 62194 - DNA, 15 bp, Homo sapiens
ctcctccaagaaacc

SEQ ID NO: 62195 - DNA, 15 bp, Homo sapiens
cctcctccaagaaac

SEQ ID NO: 62196 - DNA, 15 bp, Homo sapiens
tcctcctccaagaaa

SEQ ID NO: 62197 - DNA, 15 bp, Homo sapiens
ctcctcctccaagaa

SEQ ID NO: 62198 - DNA, 15 bp, Homo sapiens
cctcctcctccaaga

SEQ ID NO: 62199 - DNA, 15 bp, Homo sapiens
ccctcctcctccaag

SEQ ID NO: 62200 - DNA, 15 bp, Homo sapiens
tccctcctcctccaa

SEQ ID NO: 62201 - DNA, 15 bp, Homo sapiens
atccctcctcctcca

SEQ ID NO: 62202 - DNA, 15 bp, Homo sapiens
aatccctcctcctcc

SEQ ID NO: 62203 - DNA, 15 bp, Homo sapiens
taatccctcctcctc

SEQ ID NO: 62204 - DNA, 15 bp, Homo sapiens
ctaatccctcctcct

SEQ ID NO: 62205 - DNA, 15 bp, Homo sapiens
tctaatccctcctcc

SEQ ID NO: 62206 - DNA, 15 bp, Homo sapiens
ttctaatccctcctc

SEQ ID NO: 62207 - DNA, 15 bp, Homo sapiens
attctaatccctcct

SEQ ID NO: 62208 - DNA, 15 bp, Homo sapiens
cattctaatccctcc

SEQ ID NO: 62209 - DNA, 15 bp, Homo sapiens
acattctaatccctc

SEQ ID NO: 62210 - DNA, 15 bp, Homo sapiens
gacattctaatccct

SEQ ID NO: 62211 - DNA, 15 bp, Homo sapiens
ggacattctaatccc

SEQ ID NO: 62212 - DNA, 15 bp, Homo sapiens
aggacattctaatcc

SEQ ID NO: 62213 - DNA, 15 bp, Homo sapiens
taggacattctaatc

SEQ ID NO: 62214 - DNA, 15 bp, Homo sapiens
ctaggacattctaat

SEQ ID NO: 62215 - DNA, 15 bp, Homo sapiens
tctaggacattctaa

SEQ ID NO: 62216 - DNA, 15 bp, Homo sapiens
ttctaggacattcta

SEQ ID NO: 62217 - DNA, 15 bp, Homo sapiens
attctaggacattct

SEQ ID NO: 62218 - DNA, 15 bp, Homo sapiens
aattctaggacattc

SEQ ID NO: 62219 - DNA, 15 bp, Homo sapiens
taattctaggacatt

SEQ ID NO: 62220 - DNA, 15 bp, Homo sapiens
ataattctaggacat

SEQ ID NO: 62221 - DNA, 15 bp, Homo sapiens
cataattctaggaca

SEQ ID NO: 62222 - DNA, 15 bp, Homo sapiens
tcataattctaggac

SEQ ID NO: 62223 - DNA, 15 bp, Homo sapiens
atcataattctagga

SEQ ID NO: 62224 - DNA, 15 bp, Homo sapiens
gatcataattctagg

SEQ ID NO: 62225 - DNA, 15 bp, Homo sapiens
ggatcataattctag

SEQ ID NO: 62226 - DNA, 15 bp, Homo sapiens
aggatcataattcta

SEQ ID NO: 62227 - DNA, 15 bp, Homo sapiens
aaggatcataattct

SEQ ID NO: 62228 - DNA, 15 bp, Homo sapiens
aaaggatcataattc

SEQ ID NO: 62229 - DNA, 15 bp, Homo sapiens
aaaaggatcataatt

SEQ ID NO: 62230 - DNA, 15 bp, Homo sapiens
taaaaggatcataat

SEQ ID NO: 62231 - DNA, 15 bp, Homo sapiens
ataaaaggatcataa

SEQ ID NO: 62232 - DNA, 15 bp, Homo sapiens
aataaaaggatcata

SEQ ID NO: 62233 - DNA, 15 bp, Homo sapiens
aaataaaaggatcat

SEQ ID NO: 62234 - DNA, 15 bp, Homo sapiens
gaaataaaaggatca

SEQ ID NO: 62235 - DNA, 15 bp, Homo sapiens
agaaataaaaggatc

SEQ ID NO: 62236 - DNA, 15 bp, Homo sapiens
aagaaataaaaggat

SEQ ID NO: 62237 - DNA, 15 bp, Homo sapiens
gaagaaataaaagga

SEQ ID NO: 62238 - DNA, 15 bp, Homo sapiens
agaagaaataaaagg

SEQ ID NO: 62239 - DNA, 15 bp, Homo sapiens
cagaagaaataaaag

SEQ ID NO: 62240 - DNA, 15 bp, Homo sapiens
acagaagaaataaaa

SEQ ID NO: 62241 - DNA, 15 bp, Homo sapiens
aacagaagaaataaa

SEQ ID NO: 62242 - DNA, 15 bp, Homo sapiens
aaacagaagaaataa

SEQ ID NO: 62243 - DNA, 15 bp, Homo sapiens
aaaacagaagaaata

SEQ ID NO: 62244 - DNA, 15 bp, Homo sapiens
gaaaacagaagaaat

SEQ ID NO: 62245 - DNA, 15 bp, Homo sapiens
agaaaacagaagaaa

SEQ ID NO: 62246 - DNA, 15 bp, Homo sapiens
aagaaaacagaagaa

SEQ ID NO: 62247 - DNA, 15 bp, Homo sapiens
aaagaaaacagaaga

SEQ ID NO: 62248 - DNA, 15 bp, Homo sapiens
aaaagaaaacagaag

SEQ ID NO: 62249 - DNA, 15 bp, Homo sapiens
aaaaagaaaacagaa

SEQ ID NO: 62250 - DNA, 15 bp, Homo sapiens
aaaaaagaaaacaga

SEQ ID NO: 62251 - DNA, 15 bp, Homo sapiens
caaaaaagaaaacag

SEQ ID NO: 62252 - DNA, 15 bp, Homo sapiens
acaaaaaagaaaaca

SEQ ID NO: 62253 - DNA, 15 bp, Homo sapiens
aacaaaaaagaaaac

SEQ ID NO: 62254 - DNA, 15 bp, Homo sapiens
gaacaaaaaagaaaa

SEQ ID NO: 62255 - DNA, 15 bp, Homo sapiens
agaacaaaaaagaaa

SEQ ID NO: 62256 - DNA, 15 bp, Homo sapiens
gagaacaaaaaagaa

SEQ ID NO: 62257 - DNA, 15 bp, Homo sapiens
agagaacaaaaaaga

SEQ ID NO: 62258 - DNA, 15 bp, Homo sapiens
tagagaacaaaaaag

SEQ ID NO: 62259 - DNA, 15 bp, Homo sapiens
atagagaacaaaaaa

SEQ ID NO: 62260 - DNA, 15 bp, Homo sapiens
aatagagaacaaaaa

SEQ ID NO: 62261 - DNA, 15 bp, Homo sapiens
caatagagaacaaaa

SEQ ID NO: 62262 - DNA, 15 bp, Homo sapiens
acaatagagaacaaa

SEQ ID NO: 62263 - DNA, 15 bp, Homo sapiens
cacaatagagaacaa

SEQ ID NO: 62264 - DNA, 15 bp, Homo sapiens
gcacaatagagaaca

SEQ ID NO: 62265 - DNA, 15 bp, Homo sapiens
ggcacaatagagaac

SEQ ID NO: 62266 - DNA, 15 bp, Homo sapiens
aggcacaatagagaa

SEQ ID NO: 62267 - DNA, 15 bp, Homo sapiens
aaggcacaatagaga

SEQ ID NO: 62268 - DNA, 15 bp, Homo sapiens
caaggcacaatagag

SEQ ID NO: 62269 - DNA, 15 bp, Homo sapiens
acaaggcacaataga

SEQ ID NO: 62270 - DNA, 15 bp, Homo sapiens
gacaaggcacaatag

SEQ ID NO: 62271 - DNA, 15 bp, Homo sapiens
ggacaaggcacaata

SEQ ID NO: 62272 - DNA, 15 bp, Homo sapiens
aggacaaggcacaat

SEQ ID NO: 62273 - DNA, 15 bp, Homo sapiens
aaggacaaggcacaa

SEQ ID NO: 62274 - DNA, 15 bp, Homo sapiens
gaaggacaaggcaca

SEQ ID NO: 62275 - DNA, 15 bp, Homo sapiens
tgaaggacaaggcac

SEQ ID NO: 62276 - DNA, 15 bp, Homo sapiens
ttgaaggacaaggca

SEQ ID NO: 62277 - DNA, 15 bp, Homo sapiens
attgaaggacaaggc

SEQ ID NO: 62278 - DNA, 15 bp, Homo sapiens
cattgaaggacaagg

SEQ ID NO: 62279 - DNA, 15 bp, Homo sapiens
gcattgaaggacaag

SEQ ID NO: 62280 - DNA, 15 bp, Homo sapiens
tgcattgaaggacaa

SEQ ID NO: 62281 - DNA, 15 bp, Homo sapiens
ttgcattgaaggaca

SEQ ID NO: 62282 - DNA, 15 bp, Homo sapiens
attgcattgaaggac

SEQ ID NO: 62283 - DNA, 15 bp, Homo sapiens
cattgcattgaagga

SEQ ID NO: 62284 - DNA, 15 bp, Homo sapiens
acattgcattgaagg

SEQ ID NO: 62285 - DNA, 15 bp, Homo sapiens
aacattgcattgaag

SEQ ID NO: 62286 - DNA, 15 bp, Homo sapiens
caacattgcattgaa

SEQ ID NO: 62287 - DNA, 15 bp, Homo sapiens
tcaacattgcattga

SEQ ID NO: 62288 - DNA, 15 bp, Homo sapiens
atcaacattgcattg

SEQ ID NO: 62289 - DNA, 15 bp, Homo sapiens
aatcaacattgcatt

SEQ ID NO: 62290 - DNA, 15 bp, Homo sapiens
aaatcaacattgcat

SEQ ID NO: 62291 - DNA, 15 bp, Homo sapiens
caaatcaacattgca

SEQ ID NO: 62292 - DNA, 15 bp, Homo sapiens
tcaaatcaacattgc

SEQ ID NO: 62293 - DNA, 15 bp, Homo sapiens
ttcaaatcaacattg

SEQ ID NO: 62294 - DNA, 15 bp, Homo sapiens
attcaaatcaacatt

SEQ ID NO: 62295 - DNA, 15 bp, Homo sapiens
aattcaaatcaacat

SEQ ID NO: 62296 - DNA, 15 bp, Homo sapiens
caattcaaatcaaca

SEQ ID NO: 62297 - DNA, 15 bp, Homo sapiens
ccaattcaaatcaac

SEQ ID NO: 62298 - DNA, 15 bp, Homo sapiens
accaattcaaatcaa

SEQ ID NO: 62299 - DNA, 15 bp, Homo sapiens
caccaattcaaatca

SEQ ID NO: 62300 - DNA, 15 bp, Homo sapiens
tcaccaattcaaatc

SEQ ID NO: 62301 - DNA, 15 bp, Homo sapiens
atcaccaattcaaat

SEQ ID NO: 62302 - DNA, 15 bp, Homo sapiens
tatcaccaattcaaa

SEQ ID NO: 62303 - DNA, 15 bp, Homo sapiens
ctatcaccaattcaa

SEQ ID NO: 62304 - DNA, 15 bp, Homo sapiens
actatcaccaattca

SEQ ID NO: 62305 - DNA, 15 bp, Homo sapiens
cactatcaccaattc

SEQ ID NO: 62306 - DNA, 15 bp, Homo sapiens
ccactatcaccaatt

SEQ ID NO: 62307 - DNA, 15 bp, Homo sapiens
cccactatcaccaat

SEQ ID NO: 62308 - DNA, 15 bp, Homo sapiens
gcccactatcaccaa

SEQ ID NO: 62309 - DNA, 15 bp, Homo sapiens
tgcccactatcacca

SEQ ID NO: 62310 - DNA, 15 bp, Homo sapiens
ctgcccactatcacc

SEQ ID NO: 62311 - DNA, 15 bp, Homo sapiens
tctgcccactatcac

SEQ ID NO: 62312 - DNA, 15 bp, Homo sapiens
ttctgcccactatca

SEQ ID NO: 62313 - DNA, 15 bp, Homo sapiens
attctgcccactatc

SEQ ID NO: 62314 - DNA, 15 bp, Homo sapiens
aattctgcccactat

SEQ ID NO: 62315 - DNA, 15 bp, Homo sapiens
aaattctgcccacta

SEQ ID NO: 62316 - DNA, 15 bp, Homo sapiens
aaaattctgcccact

SEQ ID NO: 62317 - DNA, 15 bp, Homo sapiens
aaaaattctgcccac

SEQ ID NO: 62318 - DNA, 15 bp, Homo sapiens
caaaaattctgccca

SEQ ID NO: 62319 - DNA, 15 bp, Homo sapiens
acaaaaattctgccc

SEQ ID NO: 62320 - DNA, 15 bp, Homo sapiens
aacaaaaattctgcc

SEQ ID NO: 62321 - DNA, 15 bp, Homo sapiens
caacaaaaattctgc

SEQ ID NO: 62322 - DNA, 15 bp, Homo sapiens
acaacaaaaattctg

SEQ ID NO: 62323 - DNA, 15 bp, Homo sapiens
aacaacaaaaattct

SEQ ID NO: 62324 - DNA, 15 bp, Homo sapiens
caacaacaaaaattc

SEQ ID NO: 62325 - DNA, 15 bp, Homo sapiens
tcaacaacaaaaatt

SEQ ID NO: 62326 - DNA, 15 bp, Homo sapiens
atcaacaacaaaaat

SEQ ID NO: 62327 - DNA, 15 bp, Homo sapiens
tatcaacaacaaaaa

SEQ ID NO: 62328 - DNA, 15 bp, Homo sapiens
ttatcaacaacaaaa

SEQ ID NO: 62329 - DNA, 15 bp, Homo sapiens
attatcaacaacaaa

SEQ ID NO: 62330 - DNA, 15 bp, Homo sapiens
tattatcaacaacaa

SEQ ID NO: 62331 - DNA, 15 bp, Homo sapiens
ttattatcaacaaca

SEQ ID NO: 62332 - DNA, 15 bp, Homo sapiens
tttattatcaacaac

SEQ ID NO: 62333 - DNA, 15 bp, Homo sapiens
ttttattatcaacaa

SEQ ID NO: 62334 - DNA, 15 bp, Homo sapiens
cttttattatcaaca

SEQ ID NO: 62335 - DNA, 15 bp, Homo sapiens
ccttttattatcaac

SEQ ID NO: 62336 - DNA, 15 bp, Homo sapiens
tccttttattatcaa

SEQ ID NO: 62337 - DNA, 15 bp, Homo sapiens
ctccttttattatca

SEQ ID NO: 62338 - DNA, 15 bp, Homo sapiens
actccttttattatc

SEQ ID NO: 62339 - DNA, 15 bp, Homo sapiens
cactccttttattat

SEQ ID NO: 62340 - DNA, 15 bp, Homo sapiens
gcactccttttatta

SEQ ID NO: 62341 - DNA, 15 bp, Homo sapiens
agcactccttttatt

SEQ ID NO: 62342 - DNA, 15 bp, Homo sapiens
aagcactccttttat

SEQ ID NO: 62343 - DNA, 15 bp, Homo sapiens
aaagcactcctttta

SEQ ID NO: 62344 - DNA, 15 bp, Homo sapiens
aaaagcactcctttt

SEQ ID NO: 62345 - DNA, 15 bp, Homo sapiens
taaaagcactccttt

SEQ ID NO: 62346 - DNA, 15 bp, Homo sapiens
ctaaaagcactcctt

SEQ ID NO: 62347 - DNA, 15 bp, Homo sapiens
actaaaagcactcct

SEQ ID NO: 62348 - DNA, 15 bp, Homo sapiens
cactaaaagcactcc

SEQ ID NO: 62349 - DNA, 15 bp, Homo sapiens
acactaaaagcactc

SEQ ID NO: 62350 - DNA, 15 bp, Homo sapiens
aacactaaaagcact

SEQ ID NO: 62351 - DNA, 15 bp, Homo sapiens
aaacactaaaagcac

SEQ ID NO: 62352 - DNA, 15 bp, Homo sapiens
aaaacactaaaagca

SEQ ID NO: 62353 - DNA, 15 bp, Homo sapiens
taaaacactaaaagc

SEQ ID NO: 62354 - DNA, 15 bp, Homo sapiens
gtaaaacactaaaag

SEQ ID NO: 62355 - DNA, 15 bp, Homo sapiens
ggtaaaacactaaaa

SEQ ID NO: 62356 - DNA, 15 bp, Homo sapiens
tggtaaaacactaaa

SEQ ID NO: 62357 - DNA, 15 bp, Homo sapiens
atggtaaaacactaa

SEQ ID NO: 62358 - DNA, 15 bp, Homo sapiens
tatggtaaaacacta

SEQ ID NO: 62359 - DNA, 15 bp, Homo sapiens
ttatggtaaaacact

SEQ ID NO: 62360 - DNA, 15 bp, Homo sapiens
cttatggtaaaacac

SEQ ID NO: 62361 - DNA, 15 bp, Homo sapiens
tcttatggtaaaaca

SEQ ID NO: 62362 - DNA, 15 bp, Homo sapiens
ttcttatggtaaaac

SEQ ID NO: 62363 - DNA, 15 bp, Homo sapiens
attcttatggtaaaa

SEQ ID NO: 62364 - DNA, 15 bp, Homo sapiens
cattcttatggtaaa

SEQ ID NO: 62365 - DNA, 15 bp, Homo sapiens
tcattcttatggtaa

SEQ ID NO: 62366 - DNA, 15 bp, Homo sapiens
atcattcttatggta

SEQ ID NO: 62367 - DNA, 15 bp, Homo sapiens
tatcattcttatggt

SEQ ID NO: 62368 - DNA, 15 bp, Homo sapiens
ctatcattcttatgg

SEQ ID NO: 62369 - DNA, 15 bp, Homo sapiens
actatcattcttatg

SEQ ID NO: 62370 - DNA, 15 bp, Homo sapiens
aactatcattcttat

SEQ ID NO: 62371 - DNA, 15 bp, Homo sapiens
aaactatcattctta

SEQ ID NO: 62372 - DNA, 15 bp, Homo sapiens
aaaactatcattctt

SEQ ID NO: 62373 - DNA, 15 bp, Homo sapiens
aaaaactatcattct

SEQ ID NO: 62374 - DNA, 15 bp, Homo sapiens
caaaaactatcattc

SEQ ID NO: 62375 - DNA, 15 bp, Homo sapiens
acaaaaactatcatt

SEQ ID NO: 62376 - DNA, 15 bp, Homo sapiens
tacaaaaactatcat

SEQ ID NO: 62377 - DNA, 15 bp, Homo sapiens
ctacaaaaactatca

SEQ ID NO: 62378 - DNA, 15 bp, Homo sapiens
gctacaaaaactatc

SEQ ID NO: 62379 - DNA, 15 bp, Homo sapiens
agctacaaaaactat

SEQ ID NO: 62380 - DNA, 15 bp, Homo sapiens
aagctacaaaaacta

SEQ ID NO: 62381 - DNA, 15 bp, Homo sapiens
aaagctacaaaaact

SEQ ID NO: 62382 - DNA, 15 bp, Homo sapiens
aaaagctacaaaaac

SEQ ID NO: 62383 - DNA, 15 bp, Homo sapiens
aaaaagctacaaaaa

SEQ ID NO: 62384 - DNA, 15 bp, Homo sapiens
aaaaaagctacaaaa

SEQ ID NO: 62385 - DNA, 15 bp, Homo sapiens
caaaaaagctacaaa

SEQ ID NO: 62386 - DNA, 15 bp, Homo sapiens
ccaaaaaagctacaa

SEQ ID NO: 62387 - DNA, 15 bp, Homo sapiens
accaaaaaagctaca

SEQ ID NO: 62388 - DNA, 15 bp, Homo sapiens
taccaaaaaagctac

SEQ ID NO: 62389 - DNA, 15 bp, Homo sapiens
gtaccaaaaaagcta

SEQ ID NO: 62390 - DNA, 15 bp, Homo sapiens
tgtaccaaaaaagct

SEQ ID NO: 62391 - DNA, 15 bp, Homo sapiens
gtgtaccaaaaaagc

SEQ ID NO: 62392 - DNA, 15 bp, Homo sapiens
agtgtaccaaaaaag

SEQ ID NO: 62393 - DNA, 15 bp, Homo sapiens
aagtgtaccaaaaaa

SEQ ID NO: 62394 - DNA, 15 bp, Homo sapiens
aaagtgtaccaaaaa

SEQ ID NO: 62395 - DNA, 15 bp, Homo sapiens
aaaagtgtaccaaaa

SEQ ID NO: 62396 - DNA, 15 bp, Homo sapiens
aaaaagtgtaccaaa

SEQ ID NO: 62397 - DNA, 15 bp, Homo sapiens
taaaaagtgtaccaa

SEQ ID NO: 62398 - DNA, 15 bp, Homo sapiens
ataaaaagtgtacca

SEQ ID NO: 62399 - DNA, 15 bp, Homo sapiens
cataaaaagtgtacc

SEQ ID NO: 62400 - DNA, 15 bp, Homo sapiens
tcataaaaagtgtac

SEQ ID NO: 62401 - DNA, 15 bp, Homo sapiens
ctcataaaaagtgta

SEQ ID NO: 62402 - DNA, 15 bp, Homo sapiens
cctcataaaaagtgt

SEQ ID NO: 62403 - DNA, 15 bp, Homo sapiens
acctcataaaaagtg

SEQ ID NO: 62404 - DNA, 15 bp, Homo sapiens
aacctcataaaaagt

SEQ ID NO: 62405 - DNA, 15 bp, Homo sapiens
taacctcataaaaag

SEQ ID NO: 62406 - DNA, 15 bp, Homo sapiens
ttaacctcataaaaa

SEQ ID NO: 62407 - DNA, 15 bp, Homo sapiens
tttaacctcataaaa

SEQ ID NO: 62408 - DNA, 15 bp, Homo sapiens
ctttaacctcataaa

SEQ ID NO: 62409 - DNA, 15 bp, Homo sapiens
cctttaacctcataa

SEQ ID NO: 62410 - DNA, 15 bp, Homo sapiens
tcctttaacctcata

SEQ ID NO: 62411 - DNA, 15 bp, Homo sapiens
ctcctttaacctcat

SEQ ID NO: 62412 - DNA, 15 bp, Homo sapiens
cctcctttaacctca

SEQ ID NO: 62413 - DNA, 15 bp, Homo sapiens
acctcctttaacctc

SEQ ID NO: 62414 - DNA, 15 bp, Homo sapiens
aacctcctttaacct

SEQ ID NO: 62415 - DNA, 15 bp, Homo sapiens
caacctcctttaacc

SEQ ID NO: 62416 - DNA, 15 bp, Homo sapiens
gcaacctcctttaac

SEQ ID NO: 62417 - DNA, 15 bp, Homo sapiens
ggcaacctcctttaa

SEQ ID NO: 62418 - DNA, 15 bp, Homo sapiens
gggcaacctccttta

SEQ ID NO: 62419 - DNA, 15 bp, Homo sapiens
agggcaacctccttt

SEQ ID NO: 62420 - DNA, 15 bp, Homo sapiens
tagggcaacctcctt

SEQ ID NO: 62421 - DNA, 15 bp, Homo sapiens
ctagggcaacctcct

SEQ ID NO: 62422 - DNA, 15 bp, Homo sapiens
cctagggcaacctcc

SEQ ID NO: 62423 - DNA, 15 bp, Homo sapiens
acctagggcaacctc

SEQ ID NO: 62424 - DNA, 15 bp, Homo sapiens
aacctagggcaacct

SEQ ID NO: 62425 - DNA, 15 bp, Homo sapiens
aaacctagggcaacc

SEQ ID NO: 62426 - DNA, 15 bp, Homo sapiens
aaaacctagggcaac

SEQ ID NO: 62427 - DNA, 15 bp, Homo sapiens
aaaaacctagggcaa

SEQ ID NO: 62428 - DNA, 15 bp, Homo sapiens
taaaaacctagggca

SEQ ID NO: 62429 - DNA, 15 bp, Homo sapiens
ctaaaaacctagggc

SEQ ID NO: 62430 - DNA, 15 bp, Homo sapiens
actaaaaacctaggg

SEQ ID NO: 62431 - DNA, 15 bp, Homo sapiens
aactaaaaacctagg

SEQ ID NO: 62432 - DNA, 15 bp, Homo sapiens
caactaaaaacctag

SEQ ID NO: 62433 - DNA, 15 bp, Homo sapiens
ccaactaaaaaccta

SEQ ID NO: 62434 - DNA, 15 bp, Homo sapiens
accaactaaaaacct

SEQ ID NO: 62435 - DNA, 15 bp, Homo sapiens
aaccaactaaaaacc

SEQ ID NO: 62436 - DNA, 15 bp, Homo sapiens
taaccaactaaaaac

SEQ ID NO: 62437 - DNA, 15 bp, Homo sapiens
ttaaccaactaaaaa

SEQ ID NO: 62438 - DNA, 15 bp, Homo sapiens
cttaaccaactaaaa

SEQ ID NO: 62439 - DNA, 15 bp, Homo sapiens
ccttaaccaactaaa

SEQ ID NO: 62440 - DNA, 15 bp, Homo sapiens
cccttaaccaactaa

SEQ ID NO: 62441 - DNA, 15 bp, Homo sapiens
tcccttaaccaacta

SEQ ID NO: 62442 - DNA, 15 bp, Homo sapiens
atcccttaaccaact

SEQ ID NO: 62443 - DNA, 15 bp, Homo sapiens
aatcccttaaccaac

SEQ ID NO: 62444 - DNA, 15 bp, Homo sapiens
aaatcccttaaccaa

SEQ ID NO: 62445 - DNA, 15 bp, Homo sapiens
aaaatcccttaacca

SEQ ID NO: 62446 - DNA, 15 bp, Homo sapiens
taaaatcccttaacc

SEQ ID NO: 62447 - DNA, 15 bp, Homo sapiens
ataaaatcccttaac

SEQ ID NO: 62448 - DNA, 15 bp, Homo sapiens
gataaaatcccttaa

SEQ ID NO: 62449 - DNA, 15 bp, Homo sapiens
tgataaaatccctta

SEQ ID NO: 62450 - DNA, 15 bp, Homo sapiens
ttgataaaatccctt

SEQ ID NO: 62451 - DNA, 15 bp, Homo sapiens
cttgataaaatccct

SEQ ID NO: 62452 - DNA, 15 bp, Homo sapiens
tcttgataaaatccc

SEQ ID NO: 62453 - DNA, 15 bp, Homo sapiens
ttcttgataaaatcc

SEQ ID NO: 62454 - DNA, 15 bp, Homo sapiens
tttcttgataaaatc

SEQ ID NO: 62455 - DNA, 15 bp, Homo sapiens
gtttcttgataaaat

SEQ ID NO: 62456 - DNA, 15 bp, Homo sapiens
agtttcttgataaaa

SEQ ID NO: 62457 - DNA, 15 bp, Homo sapiens
cagtttcttgataaa

SEQ ID NO: 62458 - DNA, 15 bp, Homo sapiens
acagtttcttgataa

SEQ ID NO: 62459 - DNA, 15 bp, Homo sapiens
tacagtttcttgata

SEQ ID NO: 62460 - DNA, 15 bp, Homo sapiens
ctacagtttcttgat

SEQ ID NO: 62461 - DNA, 15 bp, Homo sapiens
tctacagtttcttga

SEQ ID NO: 62462 - DNA, 15 bp, Homo sapiens
ttctacagtttcttg

SEQ ID NO: 62463 - DNA, 15 bp, Homo sapiens
attctacagtttctt

SEQ ID NO: 62464 - DNA, 15 bp, Homo sapiens
aattctacagtttct

SEQ ID NO: 62465 - DNA, 15 bp, Homo sapiens
aaattctacagtttc

SEQ ID NO: 62466 - DNA, 15 bp, Homo sapiens
aaaattctacagttt

SEQ ID NO: 62467 - DNA, 15 bp, Homo sapiens
taaaattctacagtt

SEQ ID NO: 62468 - DNA, 15 bp, Homo sapiens
ctaaaattctacagt

SEQ ID NO: 62469 - DNA, 15 bp, Homo sapiens
gctaaaattctacag

SEQ ID NO: 62470 - DNA, 15 bp, Homo sapiens
ggctaaaattctaca

SEQ ID NO: 62471 - DNA, 15 bp, Homo sapiens
tggctaaaattctac

SEQ ID NO: 62472 - DNA, 15 bp, Homo sapiens
ttggctaaaattcta

SEQ ID NO: 62473 - DNA, 15 bp, Homo sapiens
attggctaaaattct

SEQ ID NO: 62474 - DNA, 15 bp, Homo sapiens
tattggctaaaattc

SEQ ID NO: 62475 - DNA, 15 bp, Homo sapiens
atattggctaaaatt

SEQ ID NO: 62476 - DNA, 15 bp, Homo sapiens
tatattggctaaaat

SEQ ID NO: 62477 - DNA, 15 bp, Homo sapiens
gtatattggctaaaa

SEQ ID NO: 62478 - DNA, 15 bp, Homo sapiens
ggtatattggctaaa

SEQ ID NO: 62479 - DNA, 15 bp, Homo sapiens
tggtatattggctaa

SEQ ID NO: 62480 - DNA, 15 bp, Homo sapiens
atggtatattggcta

SEQ ID NO: 62481 - DNA, 15 bp, Homo sapiens
aatggtatattggct

SEQ ID NO: 62482 - DNA, 15 bp, Homo sapiens
gaatggtatattggc

SEQ ID NO: 62483 - DNA, 15 bp, Homo sapiens
ggaatggtatattgg

SEQ ID NO: 62484 - DNA, 15 bp, Homo sapiens
tggaatggtatattg

SEQ ID NO: 62485 - DNA, 15 bp, Homo sapiens
atggaatggtatatt

SEQ ID NO: 62486 - DNA, 15 bp, Homo sapiens
aatggaatggtatat

SEQ ID NO: 62487 - DNA, 15 bp, Homo sapiens
aaatggaatggtata

SEQ ID NO: 62488 - DNA, 15 bp, Homo sapiens
taaatggaatggtat

SEQ ID NO: 62489 - DNA, 15 bp, Homo sapiens
ataaatggaatggta

SEQ ID NO: 62490 - DNA, 15 bp, Homo sapiens
aataaatggaatggt

SEQ ID NO: 62491 - DNA, 15 bp, Homo sapiens
taataaatggaatgg

SEQ ID NO: 62492 - DNA, 15 bp, Homo sapiens
ttaataaatggaatg

SEQ ID NO: 62493 - DNA, 15 bp, Homo sapiens
attaataaatggaat

SEQ ID NO: 62494 - DNA, 15 bp, Homo sapiens
aattaataaatggaa

SEQ ID NO: 62495 - DNA, 15 bp, Homo sapiens
taattaataaatgga

SEQ ID NO: 62496 - DNA, 15 bp, Homo sapiens
ttaattaataaatgg

SEQ ID NO: 62497 - DNA, 15 bp, Homo sapiens
attaattaataaatg

SEQ ID NO: 62498 - DNA, 15 bp, Homo sapiens
aattaattaataaat

SEQ ID NO: 62499 - DNA, 15 bp, Homo sapiens
caattaattaataaa

SEQ ID NO: 62500 - DNA, 15 bp, Homo sapiens
tcaattaattaataa

SEQ ID NO: 62501 - DNA, 15 bp, Homo sapiens
atcaattaattaata

SEQ ID NO: 62502 - DNA, 15 bp, Homo sapiens
aatcaattaattaat

SEQ ID NO: 62503 - DNA, 15 bp, Homo sapiens
gaatcaattaattaa

SEQ ID NO: 62504 - DNA, 15 bp, Homo sapiens
tgaatcaattaatta

SEQ ID NO: 62505 - DNA, 15 bp, Homo sapiens
ttgaatcaattaatt

SEQ ID NO: 62506 - DNA, 15 bp, Homo sapiens
gttgaatcaattaat

SEQ ID NO: 62507 - DNA, 15 bp, Homo sapiens
tgttgaatcaattaa

SEQ ID NO: 62508 - DNA, 15 bp, Homo sapiens
ttgttgaatcaatta

SEQ ID NO: 62509 - DNA, 15 bp, Homo sapiens
tttgttgaatcaatt

SEQ ID NO: 62510 - DNA, 15 bp, Homo sapiens
atttgttgaatcaat

SEQ ID NO: 62511 - DNA, 15 bp, Homo sapiens
tatttgttgaatcaa

SEQ ID NO: 62512 - DNA, 15 bp, Homo sapiens
gtatttgttgaatca

SEQ ID NO: 62513 - DNA, 15 bp, Homo sapiens
cgtatttgttgaatc

SEQ ID NO: 62514 - DNA, 15 bp, Homo sapiens
acgtatttgttgaat

SEQ ID NO: 62515 - DNA, 15 bp, Homo sapiens
cacgtatttgttgaa

SEQ ID NO: 62516 - DNA, 15 bp, Homo sapiens
acacgtatttgttga

SEQ ID NO: 62517 - DNA, 15 bp, Homo sapiens
cacacgtatttgttg

SEQ ID NO: 62518 - DNA, 15 bp, Homo sapiens
ccacacgtatttgtt

SEQ ID NO: 62519 - DNA, 15 bp, Homo sapiens
cccacacgtatttgt

SEQ ID NO: 62520 - DNA, 15 bp, Homo sapiens
ccccacacgtatttg

SEQ ID NO: 62521 - DNA, 15 bp, Homo sapiens
accccacacgtattt

SEQ ID NO: 62522 - DNA, 15 bp, Homo sapiens
caccccacacgtatt

SEQ ID NO: 62523 - DNA, 15 bp, Homo sapiens
gcaccccacacgtat

SEQ ID NO: 62524 - DNA, 15 bp, Homo sapiens
ggcaccccacacgta

SEQ ID NO: 62525 - DNA, 15 bp, Homo sapiens
aggcaccccacacgt

SEQ ID NO: 62526 - DNA, 15 bp, Homo sapiens
aaggcaccccacacg

SEQ ID NO: 62527 - DNA, 15 bp, Homo sapiens
aaaggcaccccacac

SEQ ID NO: 62528 - DNA, 15 bp, Homo sapiens
aaaaggcaccccaca

SEQ ID NO: 62529 - DNA, 15 bp, Homo sapiens
taaaaggcaccccac

SEQ ID NO: 62530 - DNA, 15 bp, Homo sapiens
ataaaaggcacccca

SEQ ID NO: 62531 - DNA, 15 bp, Homo sapiens
cataaaaggcacccc

SEQ ID NO: 62532 - DNA, 15 bp, Homo sapiens
acataaaaggcaccc

SEQ ID NO: 62533 - DNA, 15 bp, Homo sapiens
cacataaaaggcacc

SEQ ID NO: 62534 - DNA, 15 bp, Homo sapiens
gcacataaaaggcac

SEQ ID NO: 62535 - DNA, 15 bp, Homo sapiens
agcacataaaaggca

SEQ ID NO: 62536 - DNA, 15 bp, Homo sapiens
tagcacataaaaggc

SEQ ID NO: 62537 - DNA, 15 bp, Homo sapiens
ctagcacataaaagg

SEQ ID NO: 62538 - DNA, 15 bp, Homo sapiens
tctagcacataaaag

SEQ ID NO: 62539 - DNA, 15 bp, Homo sapiens
gtctagcacataaaa

SEQ ID NO: 62540 - DNA, 15 bp, Homo sapiens
tgtctagcacataaa

SEQ ID NO: 62541 - DNA, 15 bp, Homo sapiens
gtgtctagcacataa

SEQ ID NO: 62542 - DNA, 15 bp, Homo sapiens
tgtgtctagcacata

SEQ ID NO: 62543 - DNA, 15 bp, Homo sapiens
ctgtgtctagcacat

SEQ ID NO: 62544 - DNA, 15 bp, Homo sapiens
cctgtgtctagcaca

SEQ ID NO: 62545 - DNA, 15 bp, Homo sapiens
ccctgtgtctagcac

SEQ ID NO: 62546 - DNA, 15 bp, Homo sapiens
accctgtgtctagca

SEQ ID NO: 62547 - DNA, 15 bp, Homo sapiens
taccctgtgtctagc

SEQ ID NO: 62548 - DNA, 15 bp, Homo sapiens
ataccctgtgtctag

SEQ ID NO: 62549 - DNA, 15 bp, Homo sapiens
tataccctgtgtcta

SEQ ID NO: 62550 - DNA, 15 bp, Homo sapiens
gtataccctgtgtct

SEQ ID NO: 62551 - DNA, 15 bp, Homo sapiens
tgtataccctgtgtc

SEQ ID NO: 62552 - DNA, 15 bp, Homo sapiens
ctgtataccctgtgt

SEQ ID NO: 62553 - DNA, 15 bp, Homo sapiens
gctgtataccctgtg

SEQ ID NO: 62554 - DNA, 15 bp, Homo sapiens
tgctgtataccctgt

SEQ ID NO: 62555 - DNA, 15 bp, Homo sapiens
ctgctgtataccctg

SEQ ID NO: 62556 - DNA, 15 bp, Homo sapiens
tctgctgtataccct

SEQ ID NO: 62557 - DNA, 15 bp, Homo sapiens
ctctgctgtataccc

SEQ ID NO: 62558 - DNA, 15 bp, Homo sapiens
tctctgctgtatacc

SEQ ID NO: 62559 - DNA, 15 bp, Homo sapiens
ttctctgctgtatac

SEQ ID NO: 62560 - DNA, 15 bp, Homo sapiens
gttctctgctgtata

SEQ ID NO: 62561 - DNA, 15 bp, Homo sapiens
tgttctctgctgtat

SEQ ID NO: 62562 - DNA, 15 bp, Homo sapiens
ttgttctctgctgta

SEQ ID NO: 62563 - DNA, 15 bp, Homo sapiens
tttgttctctgctgt

SEQ ID NO: 62564 - DNA, 15 bp, Homo sapiens
ttttgttctctgctg

SEQ ID NO: 62565 - DNA, 15 bp, Homo sapiens
gttttgttctctgct

SEQ ID NO: 62566 - DNA, 15 bp, Homo sapiens
tgttttgttctctgc

SEQ ID NO: 62567 - DNA, 15 bp, Homo sapiens
ctgttttgttctctg

SEQ ID NO: 62568 - DNA, 15 bp, Homo sapiens
cctgttttgttctct

SEQ ID NO: 62569 - DNA, 15 bp, Homo sapiens
gcctgttttgttctc

SEQ ID NO: 62570 - DNA, 15 bp, Homo sapiens
tgcctgttttgttct

SEQ ID NO: 62571 - DNA, 15 bp, Homo sapiens
ttgcctgttttgttc

SEQ ID NO: 62572 - DNA, 15 bp, Homo sapiens
tttgcctgttttgtt

SEQ ID NO: 62573 - DNA, 15 bp, Homo sapiens
ttttgcctgttttgt

SEQ ID NO: 62574 - DNA, 15 bp, Homo sapiens
tttttgcctgttttg

SEQ ID NO: 62575 - DNA, 15 bp, Homo sapiens
atttttgcctgtttt

SEQ ID NO: 62576 - DNA, 15 bp, Homo sapiens
gatttttgcctgttt

SEQ ID NO: 62577 - DNA, 15 bp, Homo sapiens
agatttttgcctgtt

SEQ ID NO: 62578 - DNA, 15 bp, Homo sapiens
aagatttttgcctgt

SEQ ID NO: 62579 - DNA, 15 bp, Homo sapiens
taagatttttgcctg

SEQ ID NO: 62580 - DNA, 15 bp, Homo sapiens
ctaagatttttgcct

SEQ ID NO: 62581 - DNA, 15 bp, Homo sapiens
actaagatttttgcc

SEQ ID NO: 62582 - DNA, 15 bp, Homo sapiens
aactaagatttttgc

SEQ ID NO: 62583 - DNA, 15 bp, Homo sapiens
gaactaagatttttg

SEQ ID NO: 62584 - DNA, 15 bp, Homo sapiens
agaactaagattttt

SEQ ID NO: 62585 - DNA, 15 bp, Homo sapiens
gagaactaagatttt

SEQ ID NO: 62586 - DNA, 15 bp, Homo sapiens
cgagaactaagattt

SEQ ID NO: 62587 - DNA, 15 bp, Homo sapiens
acgagaactaagatt

SEQ ID NO: 62588 - DNA, 15 bp, Homo sapiens
cacgagaactaagat

SEQ ID NO: 62589 - DNA, 15 bp, Homo sapiens
ccacgagaactaaga

SEQ ID NO: 62590 - DNA, 15 bp, Homo sapiens
tccacgagaactaag

SEQ ID NO: 62591 - DNA, 15 bp, Homo sapiens
ctccacgagaactaa

SEQ ID NO: 62592 - DNA, 15 bp, Homo sapiens
gctccacgagaacta

SEQ ID NO: 62593 - DNA, 15 bp, Homo sapiens
agctccacgagaact

SEQ ID NO: 62594 - DNA, 15 bp, Homo sapiens
aagctccacgagaac

SEQ ID NO: 62595 - DNA, 15 bp, Homo sapiens
taagctccacgagaa

SEQ ID NO: 62596 - DNA, 15 bp, Homo sapiens
ataagctccacgaga

SEQ ID NO: 62597 - DNA, 15 bp, Homo sapiens
cataagctccacgag

SEQ ID NO: 62598 - DNA, 15 bp, Homo sapiens
acataagctccacga

SEQ ID NO: 62599 - DNA, 15 bp, Homo sapiens
aacataagctccacg

SEQ ID NO: 62600 - DNA, 15 bp, Homo sapiens
gaacataagctccac

SEQ ID NO: 62601 - DNA, 15 bp, Homo sapiens
ggaacataagctcca

SEQ ID NO: 62602 - DNA, 15 bp, Homo sapiens
tggaacataagctcc

SEQ ID NO: 62603 - DNA, 15 bp, Homo sapiens
ttggaacataagctc

SEQ ID NO: 62604 - DNA, 15 bp, Homo sapiens
gttggaacataagct

SEQ ID NO: 62605 - DNA, 15 bp, Homo sapiens
tgttggaacataagc

SEQ ID NO: 62606 - DNA, 15 bp, Homo sapiens
ctgttggaacataag

SEQ ID NO: 62607 - DNA, 15 bp, Homo sapiens
tctgttggaacataa

SEQ ID NO: 62608 - DNA, 15 bp, Homo sapiens
ctctgttggaacata

SEQ ID NO: 62609 - DNA, 15 bp, Homo sapiens
cctctgttggaacat

SEQ ID NO: 62610 - DNA, 15 bp, Homo sapiens
ccctctgttggaaca

SEQ ID NO: 62611 - DNA, 15 bp, Homo sapiens
tccctctgttggaac

SEQ ID NO: 62612 - DNA, 15 bp, Homo sapiens
ctccctctgttggaa

SEQ ID NO: 62613 - DNA, 15 bp, Homo sapiens
tctccctctgttgga

SEQ ID NO: 62614 - DNA, 15 bp, Homo sapiens
gtctccctctgttgg

SEQ ID NO: 62615 - DNA, 15 bp, Homo sapiens
tgtctccctctgttg

SEQ ID NO: 62616 - DNA, 15 bp, Homo sapiens
ttgtctccctctgtt

SEQ ID NO: 62617 - DNA, 15 bp, Homo sapiens
cttgtctccctctgt

SEQ ID NO: 62618 - DNA, 15 bp, Homo sapiens
tcttgtctccctctg

SEQ ID NO: 62619 - DNA, 15 bp, Homo sapiens
gtcttgtctccctct

SEQ ID NO: 62620 - DNA, 15 bp, Homo sapiens
tgtcttgtctccctc

SEQ ID NO: 62621 - DNA, 15 bp, Homo sapiens
ttgtcttgtctccct

SEQ ID NO: 62622 - DNA, 15 bp, Homo sapiens
attgtcttgtctccc

SEQ ID NO: 62623 - DNA, 15 bp, Homo sapiens
tattgtcttgtctcc

SEQ ID NO: 62624 - DNA, 15 bp, Homo sapiens
ttattgtcttgtctc

SEQ ID NO: 62625 - DNA, 15 bp, Homo sapiens
attattgtcttgtct

SEQ ID NO: 62626 - DNA, 15 bp, Homo sapiens
tattattgtcttgtc

SEQ ID NO: 62627 - DNA, 15 bp, Homo sapiens
ttattattgtcttgt

SEQ ID NO: 62628 - DNA, 15 bp, Homo sapiens
tttattattgtcttg

SEQ ID NO: 62629 - DNA, 15 bp, Homo sapiens
ctttattattgtctt

SEQ ID NO: 62630 - DNA, 15 bp, Homo sapiens
actttattattgtct

SEQ ID NO: 62631 - DNA, 15 bp, Homo sapiens
aactttattattgtc

SEQ ID NO: 62632 - DNA, 15 bp, Homo sapiens
caactttattattgt

SEQ ID NO: 62633 - DNA, 15 bp, Homo sapiens
acaactttattattg

SEQ ID NO: 62634 - DNA, 15 bp, Homo sapiens
cacaactttattatt

SEQ ID NO: 62635 - DNA, 15 bp, Homo sapiens
acacaactttattat

SEQ ID NO: 62636 - DNA, 15 bp, Homo sapiens
tacacaactttatta

SEQ ID NO: 62637 - DNA, 15 bp, Homo sapiens
ctacacaactttatt

SEQ ID NO: 62638 - DNA, 15 bp, Homo sapiens
actacacaactttat

SEQ ID NO: 62639 - DNA, 15 bp, Homo sapiens
tactacacaacttta

SEQ ID NO: 62640 - DNA, 15 bp, Homo sapiens
atactacacaacttt

SEQ ID NO: 62641 - DNA, 15 bp, Homo sapiens
tatactacacaactt

SEQ ID NO: 62642 - DNA, 15 bp, Homo sapiens
atatactacacaact

SEQ ID NO: 62643 - DNA, 15 bp, Homo sapiens
tatatactacacaac

SEQ ID NO: 62644 - DNA, 15 bp, Homo sapiens
ctatatactacacaa

SEQ ID NO: 62645 - DNA, 15 bp, Homo sapiens
tctatatactacaca

SEQ ID NO: 62646 - DNA, 15 bp, Homo sapiens
ttctatatactacac

SEQ ID NO: 62647 - DNA, 15 bp, Homo sapiens
tttctatatactaca

SEQ ID NO: 62648 - DNA, 15 bp, Homo sapiens
atttctatatactac

SEQ ID NO: 62649 - DNA, 15 bp, Homo sapiens
catttctatatacta

SEQ ID NO: 62650 - DNA, 15 bp, Homo sapiens
acatttctatatact

SEQ ID NO: 62651 - DNA, 15 bp, Homo sapiens
tacatttctatatac

SEQ ID NO: 62652 - DNA, 15 bp, Homo sapiens
gtacatttctatata

SEQ ID NO: 62653 - DNA, 15 bp, Homo sapiens
tgtacatttctatat

SEQ ID NO: 62654 - DNA, 15 bp, Homo sapiens
gtgtacatttctata

SEQ ID NO: 62655 - DNA, 15 bp, Homo sapiens
tgtgtacatttctat

SEQ ID NO: 62656 - DNA, 15 bp, Homo sapiens
gtgtgtacatttcta

SEQ ID NO: 62657 - DNA, 15 bp, Homo sapiens
tgtgtgtacatttct

SEQ ID NO: 62658 - DNA, 15 bp, Homo sapiens
gtgtgtgtacatttc

SEQ ID NO: 62659 - DNA, 15 bp, Homo sapiens
agtgtgtgtacattt

SEQ ID NO: 62660 - DNA, 15 bp, Homo sapiens
cagtgtgtgtacatt

SEQ ID NO: 62661 - DNA, 15 bp, Homo sapiens
tcagtgtgtgtacat

SEQ ID NO: 62662 - DNA, 15 bp, Homo sapiens
ttcagtgtgtgtaca

SEQ ID NO: 62663 - DNA, 15 bp, Homo sapiens
cttcagtgtgtgtac

SEQ ID NO: 62664 - DNA, 15 bp, Homo sapiens
ccttcagtgtgtgta

SEQ ID NO: 62665 - DNA, 15 bp, Homo sapiens
tccttcagtgtgtgt

SEQ ID NO: 62666 - DNA, 15 bp, Homo sapiens
ttccttcagtgtgtg

SEQ ID NO: 62667 - DNA, 15 bp, Homo sapiens
tttccttcagtgtgt

SEQ ID NO: 62668 - DNA, 15 bp, Homo sapiens
ttttccttcagtgtg

SEQ ID NO: 62669 - DNA, 15 bp, Homo sapiens
attttccttcagtgt

SEQ ID NO: 62670 - DNA, 15 bp, Homo sapiens
tattttccttcagtg

SEQ ID NO: 62671 - DNA, 15 bp, Homo sapiens
gtattttccttcagt

SEQ ID NO: 62672 - DNA, 15 bp, Homo sapiens
tgtattttccttcag

SEQ ID NO: 62673 - DNA, 15 bp, Homo sapiens
atgtattttccttca

SEQ ID NO: 62674 - DNA, 15 bp, Homo sapiens
gatgtattttccttc

SEQ ID NO: 62675 - DNA, 15 bp, Homo sapiens
tgatgtattttcctt

SEQ ID NO: 62676 - DNA, 15 bp, Homo sapiens
ctgatgtattttcct

SEQ ID NO: 62677 - DNA, 15 bp, Homo sapiens
tctgatgtattttcc

SEQ ID NO: 62678 - DNA, 15 bp, Homo sapiens
gtctgatgtattttc

SEQ ID NO: 62679 - DNA, 15 bp, Homo sapiens
tgtctgatgtatttt

SEQ ID NO: 62680 - DNA, 15 bp, Homo sapiens
ttgtctgatgtattt

SEQ ID NO: 62681 - DNA, 15 bp, Homo sapiens
cttgtctgatgtatt

SEQ ID NO: 62682 - DNA, 15 bp, Homo sapiens
tcttgtctgatgtat

SEQ ID NO: 62683 - DNA, 15 bp, Homo sapiens
ctcttgtctgatgta

SEQ ID NO: 62684 - DNA, 15 bp, Homo sapiens
gctcttgtctgatgt

SEQ ID NO: 62685 - DNA, 15 bp, Homo sapiens
tgctcttgtctgatg

SEQ ID NO: 62686 - DNA, 15 bp, Homo sapiens
ctgctcttgtctgat

SEQ ID NO: 62687 - DNA, 15 bp, Homo sapiens
tctgctcttgtctga

SEQ ID NO: 62688 - DNA, 15 bp, Homo sapiens
ctctgctcttgtctg

SEQ ID NO: 62689 - DNA, 15 bp, Homo sapiens
cctctgctcttgtct

SEQ ID NO: 62690 - DNA, 15 bp, Homo sapiens
tcctctgctcttgtc

SEQ ID NO: 62691 - DNA, 15 bp, Homo sapiens
ctcctctgctcttgt

SEQ ID NO: 62692 - DNA, 15 bp, Homo sapiens
cctcctctgctcttg

SEQ ID NO: 62693 - DNA, 15 bp, Homo sapiens
gcctcctctgctctt

SEQ ID NO: 62694 - DNA, 15 bp, Homo sapiens
tgcctcctctgctct

SEQ ID NO: 62695 - DNA, 15 bp, Homo sapiens
gtgcctcctctgctc

SEQ ID NO: 62696 - DNA, 15 bp, Homo sapiens
agtgcctcctctgct

SEQ ID NO: 62697 - DNA, 15 bp, Homo sapiens
aagtgcctcctctgc

SEQ ID NO: 62698 - DNA, 15 bp, Homo sapiens
caagtgcctcctctg

SEQ ID NO: 62699 - DNA, 15 bp, Homo sapiens
ccaagtgcctcctct

SEQ ID NO: 62700 - DNA, 15 bp, Homo sapiens
gccaagtgcctcctc

SEQ ID NO: 62701 - DNA, 15 bp, Homo sapiens
tgccaagtgcctcct

SEQ ID NO: 62702 - DNA, 15 bp, Homo sapiens
atgccaagtgcctcc

SEQ ID NO: 62703 - DNA, 15 bp, Homo sapiens
gatgccaagtgcctc

SEQ ID NO: 62704 - DNA, 15 bp, Homo sapiens
cgatgccaagtgcct

SEQ ID NO: 62705 - DNA, 15 bp, Homo sapiens
ccgatgccaagtgcc

SEQ ID NO: 62706 - DNA, 15 bp, Homo sapiens
tccgatgccaagtgc

SEQ ID NO: 62707 - DNA, 15 bp, Homo sapiens
ctccgatgccaagtg

SEQ ID NO: 62708 - DNA, 15 bp, Homo sapiens
tctccgatgccaagt

SEQ ID NO: 62709 - DNA, 15 bp, Homo sapiens
ctctccgatgccaag

SEQ ID NO: 62710 - DNA, 15 bp, Homo sapiens
cctctccgatgccaa

SEQ ID NO: 62711 - DNA, 15 bp, Homo sapiens
ccctctccgatgcca

SEQ ID NO: 62712 - DNA, 15 bp, Homo sapiens
gccctctccgatgcc

SEQ ID NO: 62713 - DNA, 15 bp, Homo sapiens
tgccctctccgatgc

SEQ ID NO: 62714 - DNA, 15 bp, Homo sapiens
ctgccctctccgatg

SEQ ID NO: 62715 - DNA, 15 bp, Homo sapiens
actgccctctccgat

SEQ ID NO: 62716 - DNA, 15 bp, Homo sapiens
cactgccctctccga

SEQ ID NO: 62717 - DNA, 15 bp, Homo sapiens
ccactgccctctccg

SEQ ID NO: 62718 - DNA, 15 bp, Homo sapiens
gccactgccctctcc

SEQ ID NO: 62719 - DNA, 15 bp, Homo sapiens
agccactgccctctc

SEQ ID NO: 62720 - DNA, 15 bp, Homo sapiens
cagccactgccctct

SEQ ID NO: 62721 - DNA, 15 bp, Homo sapiens
gcagccactgccctc

SEQ ID NO: 62722 - DNA, 15 bp, Homo sapiens
tgcagccactgccct

SEQ ID NO: 62723 - DNA, 15 bp, Homo sapiens
ctgcagccactgccc

SEQ ID NO: 62724 - DNA, 15 bp, Homo sapiens
actgcagccactgcc

SEQ ID NO: 62725 - DNA, 15 bp, Homo sapiens
cactgcagccactgc

SEQ ID NO: 62726 - DNA, 15 bp, Homo sapiens
tcactgcagccactg

SEQ ID NO: 62727 - DNA, 15 bp, Homo sapiens
gtcactgcagccact

SEQ ID NO: 62728 - DNA, 15 bp, Homo sapiens
ggtcactgcagccac

SEQ ID NO: 62729 - DNA, 15 bp, Homo sapiens
aggtcactgcagcca

SEQ ID NO: 62730 - DNA, 15 bp, Homo sapiens
caggtcactgcagcc

SEQ ID NO: 62731 - DNA, 15 bp, Homo sapiens
tcaggtcactgcagc

SEQ ID NO: 62732 - DNA, 15 bp, Homo sapiens
ctcaggtcactgcag

SEQ ID NO: 62733 - DNA, 15 bp, Homo sapiens
actcaggtcactgca

SEQ ID NO: 62734 - DNA, 15 bp, Homo sapiens
cactcaggtcactgc

SEQ ID NO: 62735 - DNA, 15 bp, Homo sapiens
ccactcaggtcactg

SEQ ID NO: 62736 - DNA, 15 bp, Homo sapiens
cccactcaggtcact

SEQ ID NO: 62737 - DNA, 15 bp, Homo sapiens
ccccactcaggtcac

SEQ ID NO: 62738 - DNA, 15 bp, Homo sapiens
cccccactcaggtca

SEQ ID NO: 62739 - DNA, 15 bp, Homo sapiens
ccccccactcaggtc

SEQ ID NO: 62740 - DNA, 15 bp, Homo sapiens
tccccccactcaggt

SEQ ID NO: 62741 - DNA, 15 bp, Homo sapiens
ctccccccactcagg

SEQ ID NO: 62742 - DNA, 15 bp, Homo sapiens
actccccccactcag

SEQ ID NO: 62743 - DNA, 15 bp, Homo sapiens
tactccccccactca

SEQ ID NO: 62744 - DNA, 15 bp, Homo sapiens
ttactccccccactc

SEQ ID NO: 62745 - DNA, 15 bp, Homo sapiens
attactccccccact

SEQ ID NO: 62746 - DNA, 15 bp, Homo sapiens
cattactccccccac

SEQ ID NO: 62747 - DNA, 15 bp, Homo sapiens
ccattactcccccca

SEQ ID NO: 62748 - DNA, 15 bp, Homo sapiens
cccattactcccccc

SEQ ID NO: 62749 - DNA, 15 bp, Homo sapiens
tcccattactccccc

SEQ ID NO: 62750 - DNA, 15 bp, Homo sapiens
ctcccattactcccc

SEQ ID NO: 62751 - DNA, 15 bp, Homo sapiens
tctcccattactccc

SEQ ID NO: 62752 - DNA, 15 bp, Homo sapiens
atctcccattactcc

SEQ ID NO: 62753 - DNA, 15 bp, Homo sapiens
catctcccattactc

SEQ ID NO: 62754 - DNA, 15 bp, Homo sapiens
tcatctcccattact

SEQ ID NO: 62755 - DNA, 15 bp, Homo sapiens
ttcatctcccattac

SEQ ID NO: 62756 - DNA, 15 bp, Homo sapiens
attcatctcccatta

SEQ ID NO: 62757 - DNA, 15 bp, Homo sapiens
aattcatctcccatt

SEQ ID NO: 62758 - DNA, 15 bp, Homo sapiens
gaattcatctcccat

SEQ ID NO: 62759 - DNA, 15 bp, Homo sapiens
tgaattcatctccca

SEQ ID NO: 62760 - DNA, 15 bp, Homo sapiens
ctgaattcatctccc

SEQ ID NO: 62761 - DNA, 15 bp, Homo sapiens
cctgaattcatctcc

SEQ ID NO: 62762 - DNA, 15 bp, Homo sapiens
ccctgaattcatctc

SEQ ID NO: 62763 - DNA, 15 bp, Homo sapiens
tccctgaattcatct

SEQ ID NO: 62764 - DNA, 15 bp, Homo sapiens
ctccctgaattcatc

SEQ ID NO: 62765 - DNA, 15 bp, Homo sapiens
cctccctgaattcat

SEQ ID NO: 62766 - DNA, 15 bp, Homo sapiens
ccctccctgaattca

SEQ ID NO: 62767 - DNA, 15 bp, Homo sapiens
tccctccctgaattc

SEQ ID NO: 62768 - DNA, 15 bp, Homo sapiens
ttccctccctgaatt

SEQ ID NO: 62769 - DNA, 15 bp, Homo sapiens
cttccctccctgaat

SEQ ID NO: 62770 - DNA, 15 bp, Homo sapiens
acttccctccctgaa

SEQ ID NO: 62771 - DNA, 15 bp, Homo sapiens
cacttccctccctga

SEQ ID NO: 62772 - DNA, 15 bp, Homo sapiens
ccacttccctccctg

SEQ ID NO: 62773 - DNA, 15 bp, Homo sapiens
cccacttccctccct

SEQ ID NO: 62774 - DNA, 15 bp, Homo sapiens
ccccacttccctccc

SEQ ID NO: 62775 - DNA, 15 bp, Homo sapiens
cccccacttccctcc

SEQ ID NO: 62776 - DNA, 15 bp, Homo sapiens
tcccccacttccctc

SEQ ID NO: 62777 - DNA, 15 bp, Homo sapiens
ttcccccacttccct

SEQ ID NO: 62778 - DNA, 15 bp, Homo sapiens
cttcccccacttccc

SEQ ID NO: 62779 - DNA, 15 bp, Homo sapiens
acttcccccacttcc

SEQ ID NO: 62780 - DNA, 15 bp, Homo sapiens
cacttcccccacttc

SEQ ID NO: 62781 - DNA, 15 bp, Homo sapiens
gcacttcccccactt

SEQ ID NO: 62782 - DNA, 15 bp, Homo sapiens
tgcacttcccccact

SEQ ID NO: 62783 - DNA, 15 bp, Homo sapiens
atgcacttcccccac

SEQ ID NO: 62784 - DNA, 15 bp, Homo sapiens
gatgcacttccccca

SEQ ID NO: 62785 - DNA, 15 bp, Homo sapiens
ggatgcacttccccc

SEQ ID NO: 62786 - DNA, 15 bp, Homo sapiens
gggatgcacttcccc

SEQ ID NO: 62787 - DNA, 15 bp, Homo sapiens
tgggatgcacttccc

SEQ ID NO: 62788 - DNA, 15 bp, Homo sapiens
ctgggatgcacttcc

SEQ ID NO: 62789 - DNA, 15 bp, Homo sapiens
tctgggatgcacttc

SEQ ID NO: 62790 - DNA, 15 bp, Homo sapiens
ttctgggatgcactt

SEQ ID NO: 62791 - DNA, 15 bp, Homo sapiens
cttctgggatgcact

SEQ ID NO: 62792 - DNA, 15 bp, Homo sapiens
ccttctgggatgcac

SEQ ID NO: 62793 - DNA, 15 bp, Homo sapiens
accttctgggatgca

SEQ ID NO: 62794 - DNA, 15 bp, Homo sapiens
caccttctgggatgc

SEQ ID NO: 62795 - DNA, 15 bp, Homo sapiens
ccaccttctgggatg

SEQ ID NO: 62796 - DNA, 15 bp, Homo sapiens
cccaccttctgggat

SEQ ID NO: 62797 - DNA, 15 bp, Homo sapiens
acccaccttctggga

SEQ ID NO: 62798 - DNA, 15 bp, Homo sapiens
cacccaccttctggg

SEQ ID NO: 62799 - DNA, 15 bp, Homo sapiens
ccacccaccttctgg

SEQ ID NO: 62800 - DNA, 15 bp, Homo sapiens
cccacccaccttctg

SEQ ID NO: 62801 - DNA, 15 bp, Homo sapiens
acccacccaccttct

SEQ ID NO: 62802 - DNA, 15 bp, Homo sapiens
gacccacccaccttc

SEQ ID NO: 62803 - DNA, 15 bp, Homo sapiens
agacccacccacctt

SEQ ID NO: 62804 - DNA, 15 bp, Homo sapiens
tagacccacccacct

SEQ ID NO: 62805 - DNA, 15 bp, Homo sapiens
ttagacccacccacc

SEQ ID NO: 62806 - DNA, 15 bp, Homo sapiens
gttagacccacccac

SEQ ID NO: 62807 - DNA, 15 bp, Homo sapiens
tgttagacccaccca

SEQ ID NO: 62808 - DNA, 15 bp, Homo sapiens
atgttagacccaccc

SEQ ID NO: 62809 - DNA, 15 bp, Homo sapiens
catgttagacccacc

SEQ ID NO: 62810 - DNA, 15 bp, Homo sapiens
gcatgttagacccac

SEQ ID NO: 62811 - DNA, 15 bp, Homo sapiens
tgcatgttagaccca

SEQ ID NO: 62812 - DNA, 15 bp, Homo sapiens
ttgcatgttagaccc

SEQ ID NO: 62813 - DNA, 15 bp, Homo sapiens
cttgcatgttagacc

SEQ ID NO: 62814 - DNA, 15 bp, Homo sapiens
tcttgcatgttagac

SEQ ID NO: 62815 - DNA, 15 bp, Homo sapiens
ttcttgcatgttaga

SEQ ID NO: 62816 - DNA, 15 bp, Homo sapiens
gttcttgcatgttag

SEQ ID NO: 62817 - DNA, 15 bp, Homo sapiens
tgttcttgcatgtta

SEQ ID NO: 62818 - DNA, 15 bp, Homo sapiens
ctgttcttgcatgtt

SEQ ID NO: 62819 - DNA, 15 bp, Homo sapiens
tctgttcttgcatgt

SEQ ID NO: 62820 - DNA, 15 bp, Homo sapiens
gtctgttcttgcatg

SEQ ID NO: 62821 - DNA, 15 bp, Homo sapiens
tgtctgttcttgcat

SEQ ID NO: 62822 - DNA, 15 bp, Homo sapiens
gtgtctgttcttgca

SEQ ID NO: 62823 - DNA, 15 bp, Homo sapiens
tgtgtctgttcttgc

SEQ ID NO: 62824 - DNA, 15 bp, Homo sapiens
ctgtgtctgttcttg

SEQ ID NO: 62825 - DNA, 15 bp, Homo sapiens
tctgtgtctgttctt

SEQ ID NO: 62826 - DNA, 15 bp, Homo sapiens
ttctgtgtctgttct

SEQ ID NO: 62827 - DNA, 15 bp, Homo sapiens
attctgtgtctgttc

SEQ ID NO: 62828 - DNA, 15 bp, Homo sapiens
tattctgtgtctgtt

SEQ ID NO: 62829 - DNA, 15 bp, Homo sapiens
ttattctgtgtctgt

SEQ ID NO: 62830 - DNA, 15 bp, Homo sapiens
tttattctgtgtctg

SEQ ID NO: 62831 - DNA, 15 bp, Homo sapiens
ctttattctgtgtct

SEQ ID NO: 62832 - DNA, 15 bp, Homo sapiens
tctttattctgtgtc

SEQ ID NO: 62833 - DNA, 15 bp, Homo sapiens
ttctttattctgtgt

SEQ ID NO: 62834 - DNA, 15 bp, Homo sapiens
tttctttattctgtg

SEQ ID NO: 62835 - DNA, 15 bp, Homo sapiens
ttttctttattctgt

SEQ ID NO: 62836 - DNA, 15 bp, Homo sapiens
attttctttattctg

SEQ ID NO: 62837 - DNA, 15 bp, Homo sapiens
cattttctttattct

SEQ ID NO: 62838 - DNA, 15 bp, Homo sapiens
tcattttctttattc

SEQ ID NO: 62839 - DNA, 15 bp, Homo sapiens
atcattttctttatt

SEQ ID NO: 62840 - DNA, 15 bp, Homo sapiens
aatcattttctttat

SEQ ID NO: 62841 - DNA, 15 bp, Homo sapiens
taatcattttcttta

SEQ ID NO: 62842 - DNA, 15 bp, Homo sapiens
ttaatcattttcttt

SEQ ID NO: 62843 - DNA, 15 bp, Homo sapiens
gttaatcattttctt

SEQ ID NO: 62844 - DNA, 15 bp, Homo sapiens
agttaatcattttct

SEQ ID NO: 62845 - DNA, 15 bp, Homo sapiens
aagttaatcattttc

SEQ ID NO: 62846 - DNA, 15 bp, Homo sapiens
aaagttaatcatttt

SEQ ID NO: 62847 - DNA, 15 bp, Homo sapiens
aaaagttaatcattt

SEQ ID NO: 62848 - DNA, 15 bp, Homo sapiens
caaaagttaatcatt

SEQ ID NO: 62849 - DNA, 15 bp, Homo sapiens
ccaaaagttaatcat

SEQ ID NO: 62850 - DNA, 15 bp, Homo sapiens
tccaaaagttaatca

SEQ ID NO: 62851 - DNA, 15 bp, Homo sapiens
atccaaaagttaatc

SEQ ID NO: 62852 - DNA, 15 bp, Homo sapiens
tatccaaaagttaat

SEQ ID NO: 62853 - DNA, 15 bp, Homo sapiens
ttatccaaaagttaa

SEQ ID NO: 62854 - DNA, 15 bp, Homo sapiens
cttatccaaaagtta

SEQ ID NO: 62855 - DNA, 15 bp, Homo sapiens
acttatccaaaagtt

SEQ ID NO: 62856 - DNA, 15 bp, Homo sapiens
gacttatccaaaagt

SEQ ID NO: 62857 - DNA, 15 bp, Homo sapiens
tgacttatccaaaag

SEQ ID NO: 62858 - DNA, 15 bp, Homo sapiens
ttgacttatccaaaa

SEQ ID NO: 62859 - DNA, 15 bp, Homo sapiens
tttgacttatccaaa

SEQ ID NO: 62860 - DNA, 15 bp, Homo sapiens
ctttgacttatccaa

SEQ ID NO: 62861 - DNA, 15 bp, Homo sapiens
gctttgacttatcca

SEQ ID NO: 62862 - DNA, 15 bp, Homo sapiens
tgctttgacttatcc

SEQ ID NO: 62863 - DNA, 15 bp, Homo sapiens
ttgctttgacttatc

SEQ ID NO: 62864 - DNA, 15 bp, Homo sapiens
gttgctttgacttat

SEQ ID NO: 62865 - DNA, 15 bp, Homo sapiens
tgttgctttgactta

SEQ ID NO: 62866 - DNA, 15 bp, Homo sapiens
ttgttgctttgactt

SEQ ID NO: 62867 - DNA, 15 bp, Homo sapiens
attgttgctttgact

SEQ ID NO: 62868 - DNA, 15 bp, Homo sapiens
tattgttgctttgac

SEQ ID NO: 62869 - DNA, 15 bp, Homo sapiens
ttattgttgctttga

SEQ ID NO: 62870 - DNA, 15 bp, Homo sapiens
attattgttgctttg

SEQ ID NO: 62871 - DNA, 15 bp, Homo sapiens
cattattgttgcttt

SEQ ID NO: 62872 - DNA, 15 bp, Homo sapiens
acattattgttgctt

SEQ ID NO: 62873 - DNA, 15 bp, Homo sapiens
gacattattgttgct

SEQ ID NO: 62874 - DNA, 15 bp, Homo sapiens
ggacattattgttgc

SEQ ID NO: 62875 - DNA, 15 bp, Homo sapiens
tggacattattgttg

SEQ ID NO: 62876 - DNA, 15 bp, Homo sapiens
ttggacattattgtt

SEQ ID NO: 62877 - DNA, 15 bp, Homo sapiens
attggacattattgt

SEQ ID NO: 62878 - DNA, 15 bp, Homo sapiens
aattggacattattg

SEQ ID NO: 62879 - DNA, 15 bp, Homo sapiens
aaattggacattatt

SEQ ID NO: 62880 - DNA, 15 bp, Homo sapiens
caaattggacattat

SEQ ID NO: 62881 - DNA, 15 bp, Homo sapiens
acaaattggacatta

SEQ ID NO: 62882 - DNA, 15 bp, Homo sapiens
cacaaattggacatt

SEQ ID NO: 62883 - DNA, 15 bp, Homo sapiens
tcacaaattggacat

SEQ ID NO: 62884 - DNA, 15 bp, Homo sapiens
ctcacaaattggaca

SEQ ID NO: 62885 - DNA, 15 bp, Homo sapiens
tctcacaaattggac

SEQ ID NO: 62886 - DNA, 15 bp, Homo sapiens
atctcacaaattgga

SEQ ID NO: 62887 - DNA, 15 bp, Homo sapiens
aatctcacaaattgg

SEQ ID NO: 62888 - DNA, 15 bp, Homo sapiens
taatctcacaaattg

SEQ ID NO: 62889 - DNA, 15 bp, Homo sapiens
ttaatctcacaaatt

SEQ ID NO: 62890 - DNA, 15 bp, Homo sapiens
tttaatctcacaaat

SEQ ID NO: 62891 - DNA, 15 bp, Homo sapiens
ttttaatctcacaaa

SEQ ID NO: 62892 - DNA, 15 bp, Homo sapiens
cttttaatctcacaa

SEQ ID NO: 62893 - DNA, 15 bp, Homo sapiens
tcttttaatctcaca

SEQ ID NO: 62894 - DNA, 15 bp, Homo sapiens
ttcttttaatctcac

SEQ ID NO: 62895 - DNA, 15 bp, Homo sapiens
tttcttttaatctca

SEQ ID NO: 62896 - DNA, 15 bp, Homo sapiens
ttttcttttaatctc

SEQ ID NO: 62897 - DNA, 15 bp, Homo sapiens
attttcttttaatct

SEQ ID NO: 62898 - DNA, 15 bp, Homo sapiens
gattttcttttaatc

SEQ ID NO: 62899 - DNA, 15 bp, Homo sapiens
tgattttcttttaat

SEQ ID NO: 62900 - DNA, 15 bp, Homo sapiens
ttgattttcttttaa

SEQ ID NO: 62901 - DNA, 15 bp, Homo sapiens
cttgattttctttta

SEQ ID NO: 62902 - DNA, 15 bp, Homo sapiens
tcttgattttctttt

SEQ ID NO: 62903 - DNA, 15 bp, Homo sapiens
atcttgattttcttt

SEQ ID NO: 62904 - DNA, 15 bp, Homo sapiens
tatcttgattttctt

SEQ ID NO: 62905 - DNA, 15 bp, Homo sapiens
ctatcttgattttct

SEQ ID NO: 62906 - DNA, 15 bp, Homo sapiens
tctatcttgattttc

SEQ ID NO: 62907 - DNA, 15 bp, Homo sapiens
ttctatcttgatttt

SEQ ID NO: 62908 - DNA, 15 bp, Homo sapiens
tttctatcttgattt

SEQ ID NO: 62909 - DNA, 15 bp, Homo sapiens
atttctatcttgatt

SEQ ID NO: 62910 - DNA, 15 bp, Homo sapiens
catttctatcttgat

SEQ ID NO: 62911 - DNA, 15 bp, Homo sapiens
tcatttctatcttga

SEQ ID NO: 62912 - DNA, 15 bp, Homo sapiens
ttcatttctatcttg

SEQ ID NO: 62913 - DNA, 15 bp, Homo sapiens
tttcatttctatctt

SEQ ID NO: 62914 - DNA, 15 bp, Homo sapiens
atttcatttctatct

SEQ ID NO: 62915 - DNA, 15 bp, Homo sapiens
tatttcatttctatc

SEQ ID NO: 62916 - DNA, 15 bp, Homo sapiens
gtatttcatttctat

SEQ ID NO: 62917 - DNA, 15 bp, Homo sapiens
tgtatttcatttcta

SEQ ID NO: 62918 - DNA, 15 bp, Homo sapiens
ctgtatttcatttct

SEQ ID NO: 62919 - DNA, 15 bp, Homo sapiens
actgtatttcatttc

SEQ ID NO: 62920 - DNA, 15 bp, Homo sapiens
gactgtatttcattt

SEQ ID NO: 62921 - DNA, 15 bp, Homo sapiens
ggactgtatttcatt

SEQ ID NO: 62922 - DNA, 15 bp, Homo sapiens
aggactgtatttcat

SEQ ID NO: 62923 - DNA, 15 bp, Homo sapiens
taggactgtatttca

SEQ ID NO: 62924 - DNA, 15 bp, Homo sapiens
ctaggactgtatttc

SEQ ID NO: 62925 - DNA, 15 bp, Homo sapiens
tctaggactgtattt

SEQ ID NO: 62926 - DNA, 15 bp, Homo sapiens
gtctaggactgtatt

SEQ ID NO: 62927 - DNA, 15 bp, Homo sapiens
tgtctaggactgtat

SEQ ID NO: 62928 - DNA, 15 bp, Homo sapiens
ttgtctaggactgta

SEQ ID NO: 62929 - DNA, 15 bp, Homo sapiens
attgtctaggactgt

SEQ ID NO: 62930 - DNA, 15 bp, Homo sapiens
tattgtctaggactg

SEQ ID NO: 62931 - DNA, 15 bp, Homo sapiens
atattgtctaggact

SEQ ID NO: 62932 - DNA, 15 bp, Homo sapiens
tatattgtctaggac

SEQ ID NO: 62933 - DNA, 15 bp, Homo sapiens
ctatattgtctagga

SEQ ID NO: 62934 - DNA, 15 bp, Homo sapiens
actatattgtctagg

SEQ ID NO: 62935 - DNA, 15 bp, Homo sapiens
tactatattgtctag

SEQ ID NO: 62936 - DNA, 15 bp, Homo sapiens
ctactatattgtcta

SEQ ID NO: 62937 - DNA, 15 bp, Homo sapiens
actactatattgtct

SEQ ID NO: 62938 - DNA, 15 bp, Homo sapiens
tactactatattgtc

SEQ ID NO: 62939 - DNA, 15 bp, Homo sapiens
ctactactatattgt

SEQ ID NO: 62940 - DNA, 15 bp, Homo sapiens
gctactactatattg

SEQ ID NO: 62941 - DNA, 15 bp, Homo sapiens
tgctactactatatt

SEQ ID NO: 62942 - DNA, 15 bp, Homo sapiens
atgctactactatat

SEQ ID NO: 62943 - DNA, 15 bp, Homo sapiens
catgctactactata

SEQ ID NO: 62944 - DNA, 15 bp, Homo sapiens
ccatgctactactat

SEQ ID NO: 62945 - DNA, 15 bp, Homo sapiens
tccatgctactacta

SEQ ID NO: 62946 - DNA, 15 bp, Homo sapiens
ttccatgctactact

SEQ ID NO: 62947 - DNA, 15 bp, Homo sapiens
cttccatgctactac

SEQ ID NO: 62948 - DNA, 15 bp, Homo sapiens
gcttccatgctacta

SEQ ID NO: 62949 - DNA, 15 bp, Homo sapiens
tgcttccatgctact

SEQ ID NO: 62950 - DNA, 15 bp, Homo sapiens
ctgcttccatgctac

SEQ ID NO: 62951 - DNA, 15 bp, Homo sapiens
cctgcttccatgcta

SEQ ID NO: 62952 - DNA, 15 bp, Homo sapiens
ccctgcttccatgct

SEQ ID NO: 62953 - DNA, 15 bp, Homo sapiens
cccctgcttccatgc

SEQ ID NO: 62954 - DNA, 15 bp, Homo sapiens
tcccctgcttccatg

SEQ ID NO: 62955 - DNA, 15 bp, Homo sapiens
atcccctgcttccat

SEQ ID NO: 62956 - DNA, 15 bp, Homo sapiens
aatcccctgcttcca

SEQ ID NO: 62957 - DNA, 15 bp, Homo sapiens
caatcccctgcttcc

SEQ ID NO: 62958 - DNA, 15 bp, Homo sapiens
ccaatcccctgcttc

SEQ ID NO: 62959 - DNA, 15 bp, Homo sapiens
tccaatcccctgctt

SEQ ID NO: 62960 - DNA, 15 bp, Homo sapiens
ctccaatcccctgct

SEQ ID NO: 62961 - DNA, 15 bp, Homo sapiens
cctccaatcccctgc

SEQ ID NO: 62962 - DNA, 15 bp, Homo sapiens
ccctccaatcccctg

SEQ ID NO: 62963 - DNA, 15 bp, Homo sapiens
tccctccaatcccct

SEQ ID NO: 62964 - DNA, 15 bp, Homo sapiens
ttccctccaatcccc

SEQ ID NO: 62965 - DNA, 15 bp, Homo sapiens
tttccctccaatccc

SEQ ID NO: 62966 - DNA, 15 bp, Homo sapiens
gtttccctccaatcc

SEQ ID NO: 62967 - DNA, 15 bp, Homo sapiens
agtttccctccaatc

SEQ ID NO: 62968 - DNA, 15 bp, Homo sapiens
gagtttccctccaat

SEQ ID NO: 62969 - DNA, 15 bp, Homo sapiens
agagtttccctccaa

SEQ ID NO: 62970 - DNA, 15 bp, Homo sapiens
aagagtttccctcca

SEQ ID NO: 62971 - DNA, 15 bp, Homo sapiens
gaagagtttccctcc

SEQ ID NO: 62972 - DNA, 15 bp, Homo sapiens
ggaagagtttccctc

SEQ ID NO: 62973 - DNA, 15 bp, Homo sapiens
tggaagagtttccct

SEQ ID NO: 62974 - DNA, 15 bp, Homo sapiens
ttggaagagtttccc

SEQ ID NO: 62975 - DNA, 15 bp, Homo sapiens
cttggaagagtttcc

SEQ ID NO: 62976 - DNA, 15 bp, Homo sapiens
ccttggaagagtttc

SEQ ID NO: 62977 - DNA, 15 bp, Homo sapiens
gccttggaagagttt

SEQ ID NO: 62978 - DNA, 15 bp, Homo sapiens
agccttggaagagtt

SEQ ID NO: 62979 - DNA, 15 bp, Homo sapiens
aagccttggaagagt

SEQ ID NO: 62980 - DNA, 15 bp, Homo sapiens
aaagccttggaagag

SEQ ID NO: 62981 - DNA, 15 bp, Homo sapiens
aaaagccttggaaga

SEQ ID NO: 62982 - DNA, 15 bp, Homo sapiens
caaaagccttggaag

SEQ ID NO: 62983 - DNA, 15 bp, Homo sapiens
acaaaagccttggaa

SEQ ID NO: 62984 - DNA, 15 bp, Homo sapiens
aacaaaagccttgga

SEQ ID NO: 62985 - DNA, 15 bp, Homo sapiens
aaacaaaagccttgg

SEQ ID NO: 62986 - DNA, 15 bp, Homo sapiens
aaaacaaaagccttg

SEQ ID NO: 62987 - DNA, 15 bp, Homo sapiens
taaaacaaaagcctt

SEQ ID NO: 62988 - DNA, 15 bp, Homo sapiens
ctaaaacaaaagcct

SEQ ID NO: 62989 - DNA, 15 bp, Homo sapiens
cctaaaacaaaagcc

SEQ ID NO: 62990 - DNA, 15 bp, Homo sapiens
tcctaaaacaaaagc

SEQ ID NO: 62991 - DNA, 15 bp, Homo sapiens
ttcctaaaacaaaag

SEQ ID NO: 62992 - DNA, 15 bp, Homo sapiens
attcctaaaacaaaa

SEQ ID NO: 62993 - DNA, 15 bp, Homo sapiens
tattcctaaaacaaa

SEQ ID NO: 62994 - DNA, 15 bp, Homo sapiens
atattcctaaaacaa

SEQ ID NO: 62995 - DNA, 15 bp, Homo sapiens
gatattcctaaaaca

SEQ ID NO: 62996 - DNA, 15 bp, Homo sapiens
ggatattcctaaaac

SEQ ID NO: 62997 - DNA, 15 bp, Homo sapiens
aggatattcctaaaa

SEQ ID NO: 62998 - DNA, 15 bp, Homo sapiens
caggatattcctaaa

SEQ ID NO: 62999 - DNA, 15 bp, Homo sapiens
tcaggatattcctaa

SEQ ID NO: 63000 - DNA, 15 bp, Homo sapiens
ctcaggatattccta

SEQ ID NO: 63001 - DNA, 15 bp, Homo sapiens
tctcaggatattcct

SEQ ID NO: 63002 - DNA, 15 bp, Homo sapiens
ttctcaggatattcc

SEQ ID NO: 63003 - DNA, 15 bp, Homo sapiens
gttctcaggatattc

SEQ ID NO: 63004 - DNA, 15 bp, Homo sapiens
tgttctcaggatatt

SEQ ID NO: 63005 - DNA, 15 bp, Homo sapiens
ctgttctcaggatat

SEQ ID NO: 63006 - DNA, 15 bp, Homo sapiens
tctgttctcaggata

SEQ ID NO: 63007 - DNA, 15 bp, Homo sapiens
atctgttctcaggat

SEQ ID NO: 63008 - DNA, 15 bp, Homo sapiens
aatctgttctcagga

SEQ ID NO: 63009 - DNA, 15 bp, Homo sapiens
taatctgttctcagg

SEQ ID NO: 63010 - DNA, 15 bp, Homo sapiens
ctaatctgttctcag

SEQ ID NO: 63011 - DNA, 15 bp, Homo sapiens
tctaatctgttctca

SEQ ID NO: 63012 - DNA, 15 bp, Homo sapiens
ctctaatctgttctc

SEQ ID NO: 63013 - DNA, 15 bp, Homo sapiens
gctctaatctgttct

SEQ ID NO: 63014 - DNA, 15 bp, Homo sapiens
agctctaatctgttc

SEQ ID NO: 63015 - DNA, 15 bp, Homo sapiens
tagctctaatctgtt

SEQ ID NO: 63016 - DNA, 15 bp, Homo sapiens
ctagctctaatctgt

SEQ ID NO: 63017 - DNA, 15 bp, Homo sapiens
tctagctctaatctg

SEQ ID NO: 63018 - DNA, 15 bp, Homo sapiens
atctagctctaatct

SEQ ID NO: 63019 - DNA, 15 bp, Homo sapiens
aatctagctctaatc

SEQ ID NO: 63020 - DNA, 15 bp, Homo sapiens
aaatctagctctaat

SEQ ID NO: 63021 - DNA, 15 bp, Homo sapiens
aaaatctagctctaa

SEQ ID NO: 63022 - DNA, 15 bp, Homo sapiens
caaaatctagctcta

SEQ ID NO: 63023 - DNA, 15 bp, Homo sapiens
acaaaatctagctct

SEQ ID NO: 63024 - DNA, 15 bp, Homo sapiens
cacaaaatctagctc

SEQ ID NO: 63025 - DNA, 15 bp, Homo sapiens
acacaaaatctagct

SEQ ID NO: 63026 - DNA, 15 bp, Homo sapiens
aacacaaaatctagc

SEQ ID NO: 63027 - DNA, 15 bp, Homo sapiens
gaacacaaaatctag

SEQ ID NO: 63028 - DNA, 15 bp, Homo sapiens
agaacacaaaatcta

SEQ ID NO: 63029 - DNA, 15 bp, Homo sapiens
cagaacacaaaatct

SEQ ID NO: 63030 - DNA, 15 bp, Homo sapiens
gcagaacacaaaatc

SEQ ID NO: 63031 - DNA, 15 bp, Homo sapiens
agcagaacacaaaat

SEQ ID NO: 63032 - DNA, 15 bp, Homo sapiens
tagcagaacacaaaa

SEQ ID NO: 63033 - DNA, 15 bp, Homo sapiens
ttagcagaacacaaa

SEQ ID NO: 63034 - DNA, 15 bp, Homo sapiens
attagcagaacacaa

SEQ ID NO: 63035 - DNA, 15 bp, Homo sapiens
gattagcagaacaca

SEQ ID NO: 63036 - DNA, 15 bp, Homo sapiens
agattagcagaacac

SEQ ID NO: 63037 - DNA, 15 bp, Homo sapiens
aagattagcagaaca

SEQ ID NO: 63038 - DNA, 15 bp, Homo sapiens
caagattagcagaac

SEQ ID NO: 63039 - DNA, 15 bp, Homo sapiens
tcaagattagcagaa

SEQ ID NO: 63040 - DNA, 15 bp, Homo sapiens
atcaagattagcaga

SEQ ID NO: 63041 - DNA, 15 bp, Homo sapiens
gatcaagattagcag

SEQ ID NO: 63042 - DNA, 15 bp, Homo sapiens
agatcaagattagca

SEQ ID NO: 63043 - DNA, 15 bp, Homo sapiens
aagatcaagattagc

SEQ ID NO: 63044 - DNA, 15 bp, Homo sapiens
aaagatcaagattag

SEQ ID NO: 63045 - DNA, 15 bp, Homo sapiens
aaaagatcaagatta

SEQ ID NO: 63046 - DNA, 15 bp, Homo sapiens
taaaagatcaagatt

SEQ ID NO: 63047 - DNA, 15 bp, Homo sapiens
ttaaaagatcaagat

SEQ ID NO: 63048 - DNA, 15 bp, Homo sapiens
attaaaagatcaaga

SEQ ID NO: 63049 - DNA, 15 bp, Homo sapiens
aattaaaagatcaag

SEQ ID NO: 63050 - DNA, 15 bp, Homo sapiens
caattaaaagatcaa

SEQ ID NO: 63051 - DNA, 15 bp, Homo sapiens
tcaattaaaagatca

SEQ ID NO: 63052 - DNA, 15 bp, Homo sapiens
ttcaattaaaagatc

SEQ ID NO: 63053 - DNA, 15 bp, Homo sapiens
cttcaattaaaagat

SEQ ID NO: 63054 - DNA, 15 bp, Homo sapiens
tcttcaattaaaaga

SEQ ID NO: 63055 - DNA, 15 bp, Homo sapiens
ttcttcaattaaaag

SEQ ID NO: 63056 - DNA, 15 bp, Homo sapiens
attcttcaattaaaa

SEQ ID NO: 63057 - DNA, 15 bp, Homo sapiens
aattcttcaattaaa

SEQ ID NO: 63058 - DNA, 15 bp, Homo sapiens
aaattcttcaattaa

SEQ ID NO: 63059 - DNA, 15 bp, Homo sapiens
taaattcttcaatta

SEQ ID NO: 63060 - DNA, 15 bp, Homo sapiens
ctaaattcttcaatt

SEQ ID NO: 63061 - DNA, 15 bp, Homo sapiens
actaaattcttcaat

SEQ ID NO: 63062 - DNA, 15 bp, Homo sapiens
gactaaattcttcaa

SEQ ID NO: 63063 - DNA, 15 bp, Homo sapiens
ggactaaattcttca

SEQ ID NO: 63064 - DNA, 15 bp, Homo sapiens
tggactaaattcttc

SEQ ID NO: 63065 - DNA, 15 bp, Homo sapiens
atggactaaattctt

SEQ ID NO: 63066 - DNA, 15 bp, Homo sapiens
aatggactaaattct

SEQ ID NO: 63067 - DNA, 15 bp, Homo sapiens
taatggactaaattc

SEQ ID NO: 63068 - DNA, 15 bp, Homo sapiens
ttaatggactaaatt

SEQ ID NO: 63069 - DNA, 15 bp, Homo sapiens
gttaatggactaaat

SEQ ID NO: 63070 - DNA, 15 bp, Homo sapiens
tgttaatggactaaa

SEQ ID NO: 63071 - DNA, 15 bp, Homo sapiens
atgttaatggactaa

SEQ ID NO: 63072 - DNA, 15 bp, Homo sapiens
aatgttaatggacta

SEQ ID NO: 63073 - DNA, 15 bp, Homo sapiens
caatgttaatggact

SEQ ID NO: 63074 - DNA, 15 bp, Homo sapiens
tcaatgttaatggac

SEQ ID NO: 63075 - DNA, 15 bp, Homo sapiens
atcaatgttaatgga

SEQ ID NO: 63076 - DNA, 15 bp, Homo sapiens
aatcaatgttaatgg

SEQ ID NO: 63077 - DNA, 15 bp, Homo sapiens
taatcaatgttaatg

SEQ ID NO: 63078 - DNA, 15 bp, Homo sapiens
ataatcaatgttaat

SEQ ID NO: 63079 - DNA, 15 bp, Homo sapiens
cataatcaatgttaa

SEQ ID NO: 63080 - DNA, 15 bp, Homo sapiens
tcataatcaatgtta

SEQ ID NO: 63081 - DNA, 15 bp, Homo sapiens
atcataatcaatgtt

SEQ ID NO: 63082 - DNA, 15 bp, Homo sapiens
aatcataatcaatgt

SEQ ID NO: 63083 - DNA, 15 bp, Homo sapiens
taatcataatcaatg

SEQ ID NO: 63084 - DNA, 15 bp, Homo sapiens
ataatcataatcaat

SEQ ID NO: 63085 - DNA, 15 bp, Homo sapiens
aataatcataatcaa

SEQ ID NO: 63086 - DNA, 15 bp, Homo sapiens
aaataatcataatca

SEQ ID NO: 63087 - DNA, 15 bp, Homo sapiens
taaataatcataatc

SEQ ID NO: 63088 - DNA, 15 bp, Homo sapiens
tataaataatcataa

SEQ ID NO: 63089 - DNA, 15 bp, Homo sapiens
atataaataatcata

SEQ ID NO: 63090 - DNA, 15 bp, Homo sapiens
tatataaataatcat

SEQ ID NO: 63091 - DNA, 15 bp, Homo sapiens
atatataaataatca

SEQ ID NO: 63092 - DNA, 15 bp, Homo sapiens
aatatataaataatc

SEQ ID NO: 63093 - DNA, 15 bp, Homo sapiens
aaatatataaataat

SEQ ID NO: 63094 - DNA, 15 bp, Homo sapiens
taaatatataaataa

SEQ ID NO: 63095 - DNA, 15 bp, Homo sapiens
ctaaatatataaata

SEQ ID NO: 63096 - DNA, 15 bp, Homo sapiens
cctaaatatataaat

SEQ ID NO: 63097 - DNA, 15 bp, Homo sapiens
acctaaatatataaa

SEQ ID NO: 63098 - DNA, 15 bp, Homo sapiens
aacctaaatatataa

SEQ ID NO: 63099 - DNA, 15 bp, Homo sapiens
gaacctaaatatata

SEQ ID NO: 63100 - DNA, 15 bp, Homo sapiens
tgaacctaaatatat

SEQ ID NO: 63101 - DNA, 15 bp, Homo sapiens
atgaacctaaatata

SEQ ID NO: 63102 - DNA, 15 bp, Homo sapiens
aatgaacctaaatat

SEQ ID NO: 63103 - DNA, 15 bp, Homo sapiens
aaatgaacctaaata

SEQ ID NO: 63104 - DNA, 15 bp, Homo sapiens
aaaatgaacctaaat

SEQ ID NO: 63105 - DNA, 15 bp, Homo sapiens
aaaaatgaacctaaa

SEQ ID NO: 63106 - DNA, 15 bp, Homo sapiens
taaaaatgaacctaa

SEQ ID NO: 63107 - DNA, 15 bp, Homo sapiens
gtaaaaatgaaccta

SEQ ID NO: 63108 - DNA, 15 bp, Homo sapiens
ggtaaaaatgaacct

SEQ ID NO: 63109 - DNA, 15 bp, Homo sapiens
cggtaaaaatgaacc

SEQ ID NO: 63110 - DNA, 15 bp, Homo sapiens
gcggtaaaaatgaac

SEQ ID NO: 63111 - DNA, 15 bp, Homo sapiens
tgcggtaaaaatgaa

SEQ ID NO: 63112 - DNA, 15 bp, Homo sapiens
atgcggtaaaaatga

SEQ ID NO: 63113 - DNA, 15 bp, Homo sapiens
tatgcggtaaaaatg

SEQ ID NO: 63114 - DNA, 15 bp, Homo sapiens
ctatgcggtaaaaat

SEQ ID NO: 63115 - DNA, 15 bp, Homo sapiens
actatgcggtaaaaa

SEQ ID NO: 63116 - DNA, 15 bp, Homo sapiens
cactatgcggtaaaa

SEQ ID NO: 63117 - DNA, 15 bp, Homo sapiens
acactatgcggtaaa

SEQ ID NO: 63118 - DNA, 15 bp, Homo sapiens
cacactatgcggtaa

SEQ ID NO: 63119 - DNA, 15 bp, Homo sapiens
tcacactatgcggta

SEQ ID NO: 63120 - DNA, 15 bp, Homo sapiens
ctcacactatgcggt

SEQ ID NO: 63121 - DNA, 15 bp, Homo sapiens
gctcacactatgcgg

SEQ ID NO: 63122 - DNA, 15 bp, Homo sapiens
agctcacactatgcg

SEQ ID NO: 63123 - DNA, 15 bp, Homo sapiens
cagctcacactatgc

SEQ ID NO: 63124 - DNA, 15 bp, Homo sapiens
gcagctcacactatg

SEQ ID NO: 63125 - DNA, 15 bp, Homo sapiens
agcagctcacactat

SEQ ID NO: 63126 - DNA, 15 bp, Homo sapiens
gagcagctcacacta

SEQ ID NO: 63127 - DNA, 15 bp, Homo sapiens
tgagcagctcacact

SEQ ID NO: 63128 - DNA, 15 bp, Homo sapiens
atgagcagctcacac

SEQ ID NO: 63129 - DNA, 15 bp, Homo sapiens
aatgagcagctcaca

SEQ ID NO: 63130 - DNA, 15 bp, Homo sapiens
aaatgagcagctcac

SEQ ID NO: 63131 - DNA, 15 bp, Homo sapiens
aaaatgagcagctca

SEQ ID NO: 63132 - DNA, 15 bp, Homo sapiens
aaaaatgagcagctc

SEQ ID NO: 63133 - DNA, 15 bp, Homo sapiens
gaaaaatgagcagct

SEQ ID NO: 63134 - DNA, 15 bp, Homo sapiens
agaaaaatgagcagc

SEQ ID NO: 63135 - DNA, 15 bp, Homo sapiens
aagaaaaatgagcag

SEQ ID NO: 63136 - DNA, 15 bp, Homo sapiens
taagaaaaatgagca

SEQ ID NO: 63137 - DNA, 15 bp, Homo sapiens
ataagaaaaatgagc

SEQ ID NO: 63138 - DNA, 15 bp, Homo sapiens
aataagaaaaatgag

SEQ ID NO: 63139 - DNA, 15 bp, Homo sapiens
aaataagaaaaatga

SEQ ID NO: 63140 - DNA, 15 bp, Homo sapiens
aaaataagaaaaatg

SEQ ID NO: 63141 - DNA, 15 bp, Homo sapiens
aaaaataagaaaaat

SEQ ID NO: 63142 - DNA, 15 bp, Homo sapiens
aaaaaataagaaaaa

SEQ ID NO: 63143 - DNA, 15 bp, Homo sapiens
gaaaaaataagaaaa

SEQ ID NO: 63144 - DNA, 15 bp, Homo sapiens
agaaaaaataagaaa

SEQ ID NO: 63145 - DNA, 15 bp, Homo sapiens
cagaaaaaataagaa

SEQ ID NO: 63146 - DNA, 15 bp, Homo sapiens
acagaaaaaataaga

SEQ ID NO: 63147 - DNA, 15 bp, Homo sapiens
cacagaaaaaataag

SEQ ID NO: 63148 - DNA, 15 bp, Homo sapiens
ccacagaaaaaataa

SEQ ID NO: 63149 - DNA, 15 bp, Homo sapiens
accacagaaaaaata

SEQ ID NO: 63150 - DNA, 15 bp, Homo sapiens
aaccacagaaaaaat

SEQ ID NO: 63151 - DNA, 15 bp, Homo sapiens
aaaccacagaaaaaa

SEQ ID NO: 63152 - DNA, 15 bp, Homo sapiens
aaaaccacagaaaaa

SEQ ID NO: 63153 - DNA, 15 bp, Homo sapiens
aaaaaccacagaaaa

SEQ ID NO: 63154 - DNA, 15 bp, Homo sapiens
aaaaaaccacagaaa

SEQ ID NO: 63155 - DNA, 15 bp, Homo sapiens
aaaaaaaccacagaa

SEQ ID NO: 63156 - DNA, 15 bp, Homo sapiens
aaaaaaaaccacaga

SEQ ID NO: 63157 - DNA, 15 bp, Homo sapiens
aaaaaaaaaccacag

SEQ ID NO: 63158 - DNA, 15 bp, Homo sapiens
aaaaaaaaaaccaca

SEQ ID NO: 63159 - DNA, 15 bp, Homo sapiens
aaaaaaaaaaaccac

SEQ ID NO: 63160 - DNA, 15 bp, Homo sapiens
aaaaaaaaaaaacca

SEQ ID NO: 63161 - DNA, 15 bp, Homo sapiens
aaaaaaaaaaaaacc

SEQ ID NO: 63162 - DNA, 15 bp, Homo sapiens
gtaaaaaaaaaaaaa

SEQ ID NO: 63163 - DNA, 15 bp, Homo sapiens
agtaaaaaaaaaaaa

SEQ ID NO: 63164 - DNA, 15 bp, Homo sapiens
aagtaaaaaaaaaaa

SEQ ID NO: 63165 - DNA, 15 bp, Homo sapiens
aaagtaaaaaaaaaa

SEQ ID NO: 63166 - DNA, 15 bp, Homo sapiens
gaaagtaaaaaaaaa

SEQ ID NO: 63167 - DNA, 15 bp, Homo sapiens
agaaagtaaaaaaaa

SEQ ID NO: 63168 - DNA, 15 bp, Homo sapiens
aagaaagtaaaaaaa

SEQ ID NO: 63169 - DNA, 15 bp, Homo sapiens
taagaaagtaaaaaa

SEQ ID NO: 63170 - DNA, 15 bp, Homo sapiens
ataagaaagtaaaaa

SEQ ID NO: 63171 - DNA, 15 bp, Homo sapiens
gataagaaagtaaaa

SEQ ID NO: 63172 - DNA, 15 bp, Homo sapiens
agataagaaagtaaa

SEQ ID NO: 63173 - DNA, 15 bp, Homo sapiens
gagataagaaagtaa

SEQ ID NO: 63174 - DNA, 15 bp, Homo sapiens
agagataagaaagta

SEQ ID NO: 63175 - DNA, 15 bp, Homo sapiens
aagagataagaaagt

SEQ ID NO: 63176 - DNA, 15 bp, Homo sapiens
aaagagataagaaag

SEQ ID NO: 63177 - DNA, 15 bp, Homo sapiens
aaaagagataagaaa

SEQ ID NO: 63178 - DNA, 15 bp, Homo sapiens
aaaaagagataagaa

SEQ ID NO: 63179 - DNA, 15 bp, Homo sapiens
caaaaagagataaga

SEQ ID NO: 63180 - DNA, 15 bp, Homo sapiens
acaaaaagagataag

SEQ ID NO: 63181 - DNA, 15 bp, Homo sapiens
tacaaaaagagataa

SEQ ID NO: 63182 - DNA, 15 bp, Homo sapiens
atacaaaaagagata

SEQ ID NO: 63183 - DNA, 15 bp, Homo sapiens
gatacaaaaagagat

SEQ ID NO: 63184 - DNA, 15 bp, Homo sapiens
cgatacaaaaagaga

SEQ ID NO: 63185 - DNA, 15 bp, Homo sapiens
ccgatacaaaaagag

SEQ ID NO: 63186 - DNA, 15 bp, Homo sapiens
accgatacaaaaaga

SEQ ID NO: 63187 - DNA, 15 bp, Homo sapiens
taccgatacaaaaag

SEQ ID NO: 63188 - DNA, 15 bp, Homo sapiens
ctaccgatacaaaaa

SEQ ID NO: 63189 - DNA, 15 bp, Homo sapiens
cctaccgatacaaaa

SEQ ID NO: 63190 - DNA, 15 bp, Homo sapiens
acctaccgatacaaa

SEQ ID NO: 63191 - DNA, 15 bp, Homo sapiens
aacctaccgatacaa

SEQ ID NO: 63192 - DNA, 15 bp, Homo sapiens
aaacctaccgataca

SEQ ID NO: 63193 - DNA, 15 bp, Homo sapiens
gaaacctaccgatac

SEQ ID NO: 63194 - DNA, 15 bp, Homo sapiens
ggaaacctaccgata

SEQ ID NO: 63195 - DNA, 15 bp, Homo sapiens
gggaaacctaccgat

SEQ ID NO: 63196 - DNA, 15 bp, Homo sapiens
agggaaacctaccga

SEQ ID NO: 63197 - DNA, 15 bp, Homo sapiens
aagggaaacctaccg

SEQ ID NO: 63198 - DNA, 15 bp, Homo sapiens
aaagggaaacctacc

SEQ ID NO: 63199 - DNA, 15 bp, Homo sapiens
taaagggaaacctac

SEQ ID NO: 63200 - DNA, 15 bp, Homo sapiens
gtaaagggaaaccta

SEQ ID NO: 63201 - DNA, 15 bp, Homo sapiens
ggtaaagggaaacct

SEQ ID NO: 63202 - DNA, 15 bp, Homo sapiens
gggtaaagggaaacc

SEQ ID NO: 63203 - DNA, 15 bp, Homo sapiens
ggggtaaagggaaac

SEQ ID NO: 63204 - DNA, 15 bp, Homo sapiens
gggggtaaagggaaa

SEQ ID NO: 63205 - DNA, 15 bp, Homo sapiens
agggggtaaagggaa

SEQ ID NO: 63206 - DNA, 15 bp, Homo sapiens
aagggggtaaaggga

SEQ ID NO: 63207 - DNA, 15 bp, Homo sapiens
aaagggggtaaaggg

SEQ ID NO: 63208 - DNA, 15 bp, Homo sapiens
aaaagggggtaaagg

SEQ ID NO: 63209 - DNA, 15 bp, Homo sapiens
gaaaagggggtaaag

SEQ ID NO: 63210 - DNA, 15 bp, Homo sapiens
agaaaagggggtaaa

SEQ ID NO: 63211 - DNA, 15 bp, Homo sapiens
aagaaaagggggtaa

SEQ ID NO: 63212 - DNA, 15 bp, Homo sapiens
gaagaaaagggggta

SEQ ID NO: 63213 - DNA, 15 bp, Homo sapiens
agaagaaaagggggt

SEQ ID NO: 63214 - DNA, 15 bp, Homo sapiens
aagaagaaaaggggg

SEQ ID NO: 63215 - DNA, 15 bp, Homo sapiens
gaagaagaaaagggg

SEQ ID NO: 63216 - DNA, 15 bp, Homo sapiens
agaagaagaaaaggg

SEQ ID NO: 63217 - DNA, 15 bp, Homo sapiens
tagaagaagaaaagg

SEQ ID NO: 63218 - DNA, 15 bp, Homo sapiens
gtagaagaagaaaag

SEQ ID NO: 63219 - DNA, 15 bp, Homo sapiens
agtagaagaagaaaa

SEQ ID NO: 63220 - DNA, 15 bp, Homo sapiens
gagtagaagaagaaa

SEQ ID NO: 63221 - DNA, 15 bp, Homo sapiens
agagtagaagaagaa

SEQ ID NO: 63222 - DNA, 15 bp, Homo sapiens
aagagtagaagaaga

SEQ ID NO: 63223 - DNA, 15 bp, Homo sapiens
aaagagtagaagaag

SEQ ID NO: 63224 - DNA, 15 bp, Homo sapiens
caaagagtagaagaa

SEQ ID NO: 63225 - DNA, 15 bp, Homo sapiens
ccaaagagtagaaga

SEQ ID NO: 63226 - DNA, 15 bp, Homo sapiens
cccaaagagtagaag

SEQ ID NO: 63227 - DNA, 15 bp, Homo sapiens
tcccaaagagtagaa

SEQ ID NO: 63228 - DNA, 15 bp, Homo sapiens
ttcccaaagagtaga

SEQ ID NO: 63229 - DNA, 15 bp, Homo sapiens
tttcccaaagagtag

SEQ ID NO: 63230 - DNA, 15 bp, Homo sapiens
gtttcccaaagagta

SEQ ID NO: 63231 - DNA, 15 bp, Homo sapiens
tgtttcccaaagagt

SEQ ID NO: 63232 - DNA, 15 bp, Homo sapiens
atgtttcccaaagag

SEQ ID NO: 63233 - DNA, 15 bp, Homo sapiens
aatgtttcccaaaga

SEQ ID NO: 63234 - DNA, 15 bp, Homo sapiens
taatgtttcccaaag

SEQ ID NO: 63235 - DNA, 15 bp, Homo sapiens
ataatgtttcccaaa

SEQ ID NO: 63236 - DNA, 15 bp, Homo sapiens
tataatgtttcccaa

SEQ ID NO: 63237 - DNA, 15 bp, Homo sapiens
atataatgtttccca

SEQ ID NO: 63238 - DNA, 15 bp, Homo sapiens
tatataatgtttccc

SEQ ID NO: 63239 - DNA, 15 bp, Homo sapiens
gtatataatgtttcc

SEQ ID NO: 63240 - DNA, 15 bp, Homo sapiens
agtatataatgtttc

SEQ ID NO: 63241 - DNA, 15 bp, Homo sapiens
tagtatataatgttt

SEQ ID NO: 63242 - DNA, 15 bp, Homo sapiens
gtagtatataatgtt

SEQ ID NO: 63243 - DNA, 15 bp, Homo sapiens
agtagtatataatgt

SEQ ID NO: 63244 - DNA, 15 bp, Homo sapiens
aagtagtatataatg

SEQ ID NO: 63245 - DNA, 15 bp, Homo sapiens
gaagtagtatataat

SEQ ID NO: 63246 - DNA, 15 bp, Homo sapiens
agaagtagtatataa

SEQ ID NO: 63247 - DNA, 15 bp, Homo sapiens
tagaagtagtatata

SEQ ID NO: 63248 - DNA, 15 bp, Homo sapiens
ctagaagtagtatat

SEQ ID NO: 63249 - DNA, 15 bp, Homo sapiens
actagaagtagtata

SEQ ID NO: 63250 - DNA, 15 bp, Homo sapiens
gactagaagtagtat

SEQ ID NO: 63251 - DNA, 15 bp, Homo sapiens
agactagaagtagta

SEQ ID NO: 63252 - DNA, 15 bp, Homo sapiens
aagactagaagtagt

SEQ ID NO: 63253 - DNA, 15 bp, Homo sapiens
taagactagaagtag

SEQ ID NO: 63254 - DNA, 15 bp, Homo sapiens
ttaagactagaagta

SEQ ID NO: 63255 - DNA, 15 bp, Homo sapiens
attaagactagaagt

SEQ ID NO: 63256 - DNA, 15 bp, Homo sapiens
cattaagactagaag

SEQ ID NO: 63257 - DNA, 15 bp, Homo sapiens
ccattaagactagaa

SEQ ID NO: 63258 - DNA, 15 bp, Homo sapiens
accattaagactaga

SEQ ID NO: 63259 - DNA, 15 bp, Homo sapiens
aaccattaagactag

SEQ ID NO: 63260 - DNA, 15 bp, Homo sapiens
taaccattaagacta

SEQ ID NO: 63261 - DNA, 15 bp, Homo sapiens
gtaaccattaagact

SEQ ID NO: 63262 - DNA, 15 bp, Homo sapiens
ggtaaccattaagac

SEQ ID NO: 63263 - DNA, 15 bp, Homo sapiens
tggtaaccattaaga

SEQ ID NO: 63264 - DNA, 15 bp, Homo sapiens
gtggtaaccattaag

SEQ ID NO: 63265 - DNA, 15 bp, Homo sapiens
tgtggtaaccattaa

SEQ ID NO: 63266 - DNA, 15 bp, Homo sapiens
ctgtggtaaccatta

SEQ ID NO: 63267 - DNA, 15 bp, Homo sapiens
tctgtggtaaccatt

SEQ ID NO: 63268 - DNA, 15 bp, Homo sapiens
ttctgtggtaaccat

SEQ ID NO: 63269 - DNA, 15 bp, Homo sapiens
tttctgtggtaacca

SEQ ID NO: 63270 - DNA, 15 bp, Homo sapiens
ttttctgtggtaacc

SEQ ID NO: 63271 - DNA, 15 bp, Homo sapiens
attttctgtggtaac

SEQ ID NO: 63272 - DNA, 15 bp, Homo sapiens
tattttctgtggtaa

SEQ ID NO: 63273 - DNA, 15 bp, Homo sapiens
ctattttctgtggta

SEQ ID NO: 63274 - DNA, 15 bp, Homo sapiens
gctattttctgtggt

SEQ ID NO: 63275 - DNA, 15 bp, Homo sapiens
tgctattttctgtgg

SEQ ID NO: 63276 - DNA, 15 bp, Homo sapiens
ctgctattttctgtg

SEQ ID NO: 63277 - DNA, 15 bp, Homo sapiens
actgctattttctgt

SEQ ID NO: 63278 - DNA, 15 bp, Homo sapiens
gactgctattttctg

SEQ ID NO: 63279 - DNA, 15 bp, Homo sapiens
ggactgctattttct

SEQ ID NO: 63280 - DNA, 15 bp, Homo sapiens
aggactgctattttc

SEQ ID NO: 63281 - DNA, 15 bp, Homo sapiens
taggactgctatttt

SEQ ID NO: 63282 - DNA, 15 bp, Homo sapiens
ataggactgctattt

SEQ ID NO: 63283 - DNA, 15 bp, Homo sapiens
aataggactgctatt

SEQ ID NO: 63284 - DNA, 15 bp, Homo sapiens
aaataggactgctat

SEQ ID NO: 63285 - DNA, 15 bp, Homo sapiens
taaataggactgcta

SEQ ID NO: 63286 - DNA, 15 bp, Homo sapiens
ctaaataggactgct

SEQ ID NO: 63287 - DNA, 15 bp, Homo sapiens
gctaaataggactgc

SEQ ID NO: 63288 - DNA, 15 bp, Homo sapiens
agctaaataggactg

SEQ ID NO: 63289 - DNA, 15 bp, Homo sapiens
tagctaaataggact

SEQ ID NO: 63290 - DNA, 15 bp, Homo sapiens
ttagctaaataggac

SEQ ID NO: 63291 - DNA, 15 bp, Homo sapiens
attagctaaatagga

SEQ ID NO: 63292 - DNA, 15 bp, Homo sapiens
tattagctaaatagg

SEQ ID NO: 63293 - DNA, 15 bp, Homo sapiens
gtattagctaaatag

SEQ ID NO: 63294 - DNA, 15 bp, Homo sapiens
tgtattagctaaata

SEQ ID NO: 63295 - DNA, 15 bp, Homo sapiens
ttgtattagctaaat

SEQ ID NO: 63296 - DNA, 15 bp, Homo sapiens
cttgtattagctaaa

SEQ ID NO: 63297 - DNA, 15 bp, Homo sapiens
tcttgtattagctaa

SEQ ID NO: 63298 - DNA, 15 bp, Homo sapiens
gtcttgtattagcta

SEQ ID NO: 63299 - DNA, 15 bp, Homo sapiens
ggtcttgtattagct

SEQ ID NO: 63300 - DNA, 15 bp, Homo sapiens
gggtcttgtattagc

SEQ ID NO: 63301 - DNA, 15 bp, Homo sapiens
agggtcttgtattag

SEQ ID NO: 63302 - DNA, 15 bp, Homo sapiens
aagggtcttgtatta

SEQ ID NO: 63303 - DNA, 15 bp, Homo sapiens
caagggtcttgtatt

SEQ ID NO: 63304 - DNA, 15 bp, Homo sapiens
ccaagggtcttgtat

SEQ ID NO: 63305 - DNA, 15 bp, Homo sapiens
tccaagggtcttgta

SEQ ID NO: 63306 - DNA, 15 bp, Homo sapiens
ttccaagggtcttgt

SEQ ID NO: 63307 - DNA, 15 bp, Homo sapiens
tttccaagggtcttg

SEQ ID NO: 63308 - DNA, 15 bp, Homo sapiens
ctttccaagggtctt

SEQ ID NO: 63309 - DNA, 15 bp, Homo sapiens
actttccaagggtct

SEQ ID NO: 63310 - DNA, 15 bp, Homo sapiens
tactttccaagggtc

SEQ ID NO: 63311 - DNA, 15 bp, Homo sapiens
atactttccaagggt

SEQ ID NO: 63312 - DNA, 15 bp, Homo sapiens
aatactttccaaggg

SEQ ID NO: 63313 - DNA, 15 bp, Homo sapiens
taatactttccaagg

SEQ ID NO: 63314 - DNA, 15 bp, Homo sapiens
ataatactttccaag

SEQ ID NO: 63315 - DNA, 15 bp, Homo sapiens
gataatactttccaa

SEQ ID NO: 63316 - DNA, 15 bp, Homo sapiens
agataatactttcca

SEQ ID NO: 63317 - DNA, 15 bp, Homo sapiens
cagataatactttcc

SEQ ID NO: 63318 - DNA, 15 bp, Homo sapiens
acagataatactttc

SEQ ID NO: 63319 - DNA, 15 bp, Homo sapiens
aacagataatacttt

SEQ ID NO: 63320 - DNA, 15 bp, Homo sapiens
taacagataatactt

SEQ ID NO: 63321 - DNA, 15 bp, Homo sapiens
ataacagataatact

SEQ ID NO: 63322 - DNA, 15 bp, Homo sapiens
aataacagataatac

SEQ ID NO: 63323 - DNA, 15 bp, Homo sapiens
aaataacagataata

SEQ ID NO: 63324 - DNA, 15 bp, Homo sapiens
aaaataacagataat

SEQ ID NO: 63325 - DNA, 15 bp, Homo sapiens
gaaaataacagataa

SEQ ID NO: 63326 - DNA, 15 bp, Homo sapiens
tgaaaataacagata

SEQ ID NO: 63327 - DNA, 15 bp, Homo sapiens
atgaaaataacagat

SEQ ID NO: 63328 - DNA, 15 bp, Homo sapiens
tatgaaaataacaga

SEQ ID NO: 63329 - DNA, 15 bp, Homo sapiens
atatgaaaataacag

SEQ ID NO: 63330 - DNA, 15 bp, Homo sapiens
aatatgaaaataaca

SEQ ID NO: 63331 - DNA, 15 bp, Homo sapiens
aaatatgaaaataac

SEQ ID NO: 63332 - DNA, 15 bp, Homo sapiens
caaatatgaaaataa

SEQ ID NO: 63333 - DNA, 15 bp, Homo sapiens
acaaatatgaaaata

SEQ ID NO: 63334 - DNA, 15 bp, Homo sapiens
cacaaatatgaaaat

SEQ ID NO: 63335 - DNA, 15 bp, Homo sapiens
tcacaaatatgaaaa

SEQ ID NO: 63336 - DNA, 15 bp, Homo sapiens
ttcacaaatatgaaa

SEQ ID NO: 63337 - DNA, 15 bp, Homo sapiens
attcacaaatatgaa

SEQ ID NO: 63338 - DNA, 15 bp, Homo sapiens
aattcacaaatatga

SEQ ID NO: 63339 - DNA, 15 bp, Homo sapiens
taattcacaaatatg

SEQ ID NO: 63340 - DNA, 15 bp, Homo sapiens
ttaattcacaaatat

SEQ ID NO: 63341 - DNA, 15 bp, Homo sapiens
attaattcacaaata

SEQ ID NO: 63342 - DNA, 15 bp, Homo sapiens
aattaattcacaaat

SEQ ID NO: 63343 - DNA, 15 bp, Homo sapiens
aaattaattcacaaa

SEQ ID NO: 63344 - DNA, 15 bp, Homo sapiens
gaaattaattcacaa

SEQ ID NO: 63345 - DNA, 15 bp, Homo sapiens
tgaaattaattcaca

SEQ ID NO: 63346 - DNA, 15 bp, Homo sapiens
ttgaaattaattcac

SEQ ID NO: 63347 - DNA, 15 bp, Homo sapiens
cttgaaattaattca

SEQ ID NO: 63348 - DNA, 15 bp, Homo sapiens
acttgaaattaattc

SEQ ID NO: 63349 - DNA, 15 bp, Homo sapiens
tacttgaaattaatt

SEQ ID NO: 63350 - DNA, 15 bp, Homo sapiens
atacttgaaattaat

SEQ ID NO: 63351 - DNA, 15 bp, Homo sapiens
catacttgaaattaa

SEQ ID NO: 63352 - DNA, 15 bp, Homo sapiens
acatacttgaaatta

SEQ ID NO: 63353 - DNA, 15 bp, Homo sapiens
tacatacttgaaatt

SEQ ID NO: 63354 - DNA, 15 bp, Homo sapiens
atacatacttgaaat

SEQ ID NO: 63355 - DNA, 15 bp, Homo sapiens
aatacatacttgaaa

SEQ ID NO: 63356 - DNA, 15 bp, Homo sapiens
aaatacatacttgaa

SEQ ID NO: 63357 - DNA, 15 bp, Homo sapiens
caaatacatacttga

SEQ ID NO: 63358 - DNA, 15 bp, Homo sapiens
tcaaatacatacttg

SEQ ID NO: 63359 - DNA, 15 bp, Homo sapiens
gtcaaatacatactt

SEQ ID NO: 63360 - DNA, 15 bp, Homo sapiens
tgtcaaatacatact

SEQ ID NO: 63361 - DNA, 15 bp, Homo sapiens
ttgtcaaatacatac

SEQ ID NO: 63362 - DNA, 15 bp, Homo sapiens
cttgtcaaatacata

SEQ ID NO: 63363 - DNA, 15 bp, Homo sapiens
gcttgtcaaatacat

SEQ ID NO: 63364 - DNA, 15 bp, Homo sapiens
ggcttgtcaaataca

SEQ ID NO: 63365 - DNA, 15 bp, Homo sapiens
aggcttgtcaaatac

SEQ ID NO: 63366 - DNA, 15 bp, Homo sapiens
aaggcttgtcaaata

SEQ ID NO: 63367 - DNA, 15 bp, Homo sapiens
aaaggcttgtcaaat

SEQ ID NO: 63368 - DNA, 15 bp, Homo sapiens
caaaggcttgtcaaa

SEQ ID NO: 63369 - DNA, 15 bp, Homo sapiens
ccaaaggcttgtcaa

SEQ ID NO: 63370 - DNA, 15 bp, Homo sapiens
cccaaaggcttgtca

SEQ ID NO: 63371 - DNA, 15 bp, Homo sapiens
tcccaaaggcttgtc

SEQ ID NO: 63372 - DNA, 15 bp, Homo sapiens
atcccaaaggcttgt

SEQ ID NO: 63373 - DNA, 15 bp, Homo sapiens
tatcccaaaggcttg

SEQ ID NO: 63374 - DNA, 15 bp, Homo sapiens
atatcccaaaggctt

SEQ ID NO: 63375 - DNA, 15 bp, Homo sapiens
tatatcccaaaggct

SEQ ID NO: 63376 - DNA, 15 bp, Homo sapiens
ttatatcccaaaggc

SEQ ID NO: 63377 - DNA, 15 bp, Homo sapiens
tttatatcccaaagg

SEQ ID NO: 63378 - DNA, 15 bp, Homo sapiens
ttttatatcccaaag

SEQ ID NO: 63379 - DNA, 15 bp, Homo sapiens
tttttatatcccaaa

SEQ ID NO: 63380 - DNA, 15 bp, Homo sapiens
atttttatatcccaa

SEQ ID NO: 63381 - DNA, 15 bp, Homo sapiens
tatttttatatccca

SEQ ID NO: 63382 - DNA, 15 bp, Homo sapiens
ttatttttatatccc

SEQ ID NO: 63383 - DNA, 15 bp, Homo sapiens
tttatttttatatcc

SEQ ID NO: 63384 - DNA, 15 bp, Homo sapiens
gtttatttttatatc

SEQ ID NO: 63385 - DNA, 15 bp, Homo sapiens
agtttatttttatat

SEQ ID NO: 63386 - DNA, 15 bp, Homo sapiens
gagtttatttttata

SEQ ID NO: 63387 - DNA, 15 bp, Homo sapiens
tgagtttatttttat

SEQ ID NO: 63388 - DNA, 15 bp, Homo sapiens
ttgagtttattttta

SEQ ID NO: 63389 - DNA, 15 bp, Homo sapiens
tttgagtttattttt

SEQ ID NO: 63390 - DNA, 15 bp, Homo sapiens
ttttgagtttatttt

SEQ ID NO: 63391 - DNA, 15 bp, Homo sapiens
tttttgagtttattt

SEQ ID NO: 63392 - DNA, 15 bp, Homo sapiens
ttttttgagtttatt

SEQ ID NO: 63393 - DNA, 15 bp, Homo sapiens
tttttttgagtttat

SEQ ID NO: 63394 - DNA, 15 bp, Homo sapiens
gtttttttgagttta

SEQ ID NO: 63395 - DNA, 15 bp, Homo sapiens
ggtttttttgagttt

SEQ ID NO: 63396 - DNA, 15 bp, Homo sapiens
aggtttttttgagtt

SEQ ID NO: 63397 - DNA, 15 bp, Homo sapiens
gaggtttttttgagt

SEQ ID NO: 63398 - DNA, 15 bp, Homo sapiens
tgaggtttttttgag

SEQ ID NO: 63399 - DNA, 15 bp, Homo sapiens
gtgaggtttttttga

SEQ ID NO: 63400 - DNA, 15 bp, Homo sapiens
tgtgaggtttttttg

SEQ ID NO: 63401 - DNA, 15 bp, Homo sapiens
ttgtgaggttttttt

SEQ ID NO: 63402 - DNA, 15 bp, Homo sapiens
tttgtgaggtttttt

SEQ ID NO: 63403 - DNA, 15 bp, Homo sapiens
atttgtgaggttttt

SEQ ID NO: 63404 - DNA, 15 bp, Homo sapiens
tatttgtgaggtttt

SEQ ID NO: 63405 - DNA, 15 bp, Homo sapiens
ttatttgtgaggttt

SEQ ID NO: 63406 - DNA, 15 bp, Homo sapiens
tttatttgtgaggtt

SEQ ID NO: 63407 - DNA, 15 bp, Homo sapiens
ttttatttgtgaggt

SEQ ID NO: 63408 - DNA, 15 bp, Homo sapiens
tttttatttgtgagg

SEQ ID NO: 63409 - DNA, 15 bp, Homo sapiens
atttttatttgtgag

SEQ ID NO: 63410 - DNA, 15 bp, Homo sapiens
tatttttatttgtga

SEQ ID NO: 63411 - DNA, 15 bp, Homo sapiens
ttatttttatttgtg

SEQ ID NO: 63412 - DNA, 15 bp, Homo sapiens
attatttttatttgt

SEQ ID NO: 63413 - DNA, 15 bp, Homo sapiens
gattatttttatttg

SEQ ID NO: 63414 - DNA, 15 bp, Homo sapiens
agattatttttattt

SEQ ID NO: 63415 - DNA, 15 bp, Homo sapiens
tagattatttttatt

SEQ ID NO: 63416 - DNA, 15 bp, Homo sapiens
ttagattatttttat

SEQ ID NO: 63417 - DNA, 15 bp, Homo sapiens
tttagattattttta

SEQ ID NO: 63418 - DNA, 15 bp, Homo sapiens
ttttagattattttt

SEQ ID NO: 63419 - DNA, 15 bp, Homo sapiens
gttttagattatttt

SEQ ID NO: 63420 - DNA, 15 bp, Homo sapiens
agttttagattattt

SEQ ID NO: 63421 - DNA, 15 bp, Homo sapiens
tagttttagattatt

SEQ ID NO: 63422 - DNA, 15 bp, Homo sapiens
ttagttttagattat

SEQ ID NO: 63423 - DNA, 15 bp, Homo sapiens
tttagttttagatta

SEQ ID NO: 63424 - DNA, 15 bp, Homo sapiens
ttttagttttagatt

SEQ ID NO: 63425 - DNA, 15 bp, Homo sapiens
attttagttttagat

SEQ ID NO: 63426 - DNA, 15 bp, Homo sapiens
cattttagttttaga

SEQ ID NO: 63427 - DNA, 15 bp, Homo sapiens
acattttagttttag

SEQ ID NO: 63428 - DNA, 15 bp, Homo sapiens
tacattttagtttta

SEQ ID NO: 63429 - DNA, 15 bp, Homo sapiens
atacattttagtttt

SEQ ID NO: 63430 - DNA, 15 bp, Homo sapiens
aatacattttagttt

SEQ ID NO: 63431 - DNA, 15 bp, Homo sapiens
taatacattttagtt

SEQ ID NO: 63432 - DNA, 15 bp, Homo sapiens
ctaatacattttagt

SEQ ID NO: 63433 - DNA, 15 bp, Homo sapiens
tctaatacattttag

SEQ ID NO: 63434 - DNA, 15 bp, Homo sapiens
atctaatacatttta

SEQ ID NO: 63435 - DNA, 15 bp, Homo sapiens
aatctaatacatttt

SEQ ID NO: 63436 - DNA, 15 bp, Homo sapiens
taatctaatacattt

SEQ ID NO: 63437 - DNA, 15 bp, Homo sapiens
ataatctaatacatt

SEQ ID NO: 63438 - DNA, 15 bp, Homo sapiens
tataatctaatacat

SEQ ID NO: 63439 - DNA, 15 bp, Homo sapiens
ttataatctaataca

SEQ ID NO: 63440 - DNA, 15 bp, Homo sapiens
gttataatctaatac

SEQ ID NO: 63441 - DNA, 15 bp, Homo sapiens
tgttataatctaata

SEQ ID NO: 63442 - DNA, 15 bp, Homo sapiens
ttgttataatctaat

SEQ ID NO: 63443 - DNA, 15 bp, Homo sapiens
attgttataatctaa

SEQ ID NO: 63444 - DNA, 15 bp, Homo sapiens
cattgttataatcta

SEQ ID NO: 63445 - DNA, 15 bp, Homo sapiens
gcattgttataatct

SEQ ID NO: 63446 - DNA, 15 bp, Homo sapiens
ggcattgttataatc

SEQ ID NO: 63447 - DNA, 15 bp, Homo sapiens
aggcattgttataat

SEQ ID NO: 63448 - DNA, 15 bp, Homo sapiens
taggcattgttataa

SEQ ID NO: 63449 - DNA, 15 bp, Homo sapiens
gtaggcattgttata

SEQ ID NO: 63450 - DNA, 15 bp, Homo sapiens
agtaggcattgttat

SEQ ID NO: 63451 - DNA, 15 bp, Homo sapiens
aagtaggcattgtta

SEQ ID NO: 63452 - DNA, 15 bp, Homo sapiens
aaagtaggcattgtt

SEQ ID NO: 63453 - DNA, 15 bp, Homo sapiens
caaagtaggcattgt

SEQ ID NO: 63454 - DNA, 15 bp, Homo sapiens
acaaagtaggcattg

SEQ ID NO: 63455 - DNA, 15 bp, Homo sapiens
aacaaagtaggcatt

SEQ ID NO: 63456 - DNA, 15 bp, Homo sapiens
aaacaaagtaggcat

SEQ ID NO: 63457 - DNA, 15 bp, Homo sapiens
gaaacaaagtaggca

SEQ ID NO: 63458 - DNA, 15 bp, Homo sapiens
ggaaacaaagtaggc

SEQ ID NO: 63459 - DNA, 15 bp, Homo sapiens
tggaaacaaagtagg

SEQ ID NO: 63460 - DNA, 15 bp, Homo sapiens
gtggaaacaaagtag

SEQ ID NO: 63461 - DNA, 15 bp, Homo sapiens
tgtggaaacaaagta

SEQ ID NO: 63462 - DNA, 15 bp, Homo sapiens
atgtggaaacaaagt

SEQ ID NO: 63463 - DNA, 15 bp, Homo sapiens
tatgtggaaacaaag

SEQ ID NO: 63464 - DNA, 15 bp, Homo sapiens
atatgtggaaacaaa

SEQ ID NO: 63465 - DNA, 15 bp, Homo sapiens
aatatgtggaaacaa

SEQ ID NO: 63466 - DNA, 15 bp, Homo sapiens
aaatatgtggaaaca

SEQ ID NO: 63467 - DNA, 15 bp, Homo sapiens
gaaatatgtggaaac

SEQ ID NO: 63468 - DNA, 15 bp, Homo sapiens
tgaaatatgtggaaa

SEQ ID NO: 63469 - DNA, 15 bp, Homo sapiens
atgaaatatgtggaa

SEQ ID NO: 63470 - DNA, 15 bp, Homo sapiens
gatgaaatatgtgga

SEQ ID NO: 63471 - DNA, 15 bp, Homo sapiens
agatgaaatatgtgg

SEQ ID NO: 63472 - DNA, 15 bp, Homo sapiens
aagatgaaatatgtg

SEQ ID NO: 63473 - DNA, 15 bp, Homo sapiens
gaagatgaaatatgt

SEQ ID NO: 63474 - DNA, 15 bp, Homo sapiens
tgaagatgaaatatg

SEQ ID NO: 63475 - DNA, 15 bp, Homo sapiens
atgaagatgaaatat

SEQ ID NO: 63476 - DNA, 15 bp, Homo sapiens
aatgaagatgaaata

SEQ ID NO: 63477 - DNA, 15 bp, Homo sapiens
caatgaagatgaaat

SEQ ID NO: 63478 - DNA, 15 bp, Homo sapiens
gcaatgaagatgaaa

SEQ ID NO: 63479 - DNA, 15 bp, Homo sapiens
tgcaatgaagatgaa

SEQ ID NO: 63480 - DNA, 15 bp, Homo sapiens
atgcaatgaagatga

SEQ ID NO: 63481 - DNA, 15 bp, Homo sapiens
aatgcaatgaagatg

SEQ ID NO: 63482 - DNA, 15 bp, Homo sapiens
aaatgcaatgaagat

SEQ ID NO: 63483 - DNA, 15 bp, Homo sapiens
aaaatgcaatgaaga

SEQ ID NO: 63484 - DNA, 15 bp, Homo sapiens
taaaatgcaatgaag

SEQ ID NO: 63485 - DNA, 15 bp, Homo sapiens
ataaaatgcaatgaa

SEQ ID NO: 63486 - DNA, 15 bp, Homo sapiens
aataaaatgcaatga

SEQ ID NO: 63487 - DNA, 15 bp, Homo sapiens
aaataaaatgcaatg

SEQ ID NO: 63488 - DNA, 15 bp, Homo sapiens
caaataaaatgcaat

SEQ ID NO: 63489 - DNA, 15 bp, Homo sapiens
gcaaataaaatgcaa

SEQ ID NO: 63490 - DNA, 15 bp, Homo sapiens
tgcaaataaaatgca

SEQ ID NO: 63491 - DNA, 15 bp, Homo sapiens
atgcaaataaaatgc

SEQ ID NO: 63492 - DNA, 15 bp, Homo sapiens
catgcaaataaaatg

SEQ ID NO: 63493 - DNA, 15 bp, Homo sapiens
ccatgcaaataaaat

SEQ ID NO: 63494 - DNA, 15 bp, Homo sapiens
accatgcaaataaaa

SEQ ID NO: 63495 - DNA, 15 bp, Homo sapiens
aaccatgcaaataaa

SEQ ID NO: 63496 - DNA, 15 bp, Homo sapiens
aaaccatgcaaataa

SEQ ID NO: 63497 - DNA, 15 bp, Homo sapiens
aaaaccatgcaaata

SEQ ID NO: 63498 - DNA, 15 bp, Homo sapiens
gaaaaccatgcaaat

SEQ ID NO: 63499 - DNA, 15 bp, Homo sapiens
tgaaaaccatgcaaa

SEQ ID NO: 63500 - DNA, 15 bp, Homo sapiens
ctgaaaaccatgcaa

SEQ ID NO: 63501 - DNA, 15 bp, Homo sapiens
tctgaaaaccatgca

SEQ ID NO: 63502 - DNA, 15 bp, Homo sapiens
gtctgaaaaccatgc

SEQ ID NO: 63503 - DNA, 15 bp, Homo sapiens
ggtctgaaaaccatg

SEQ ID NO: 63504 - DNA, 15 bp, Homo sapiens
aggtctgaaaaccat

SEQ ID NO: 63505 - DNA, 15 bp, Homo sapiens
caggtctgaaaacca

SEQ ID NO: 63506 - DNA, 15 bp, Homo sapiens
tcaggtctgaaaacc

SEQ ID NO: 63507 - DNA, 15 bp, Homo sapiens
atcaggtctgaaaac

SEQ ID NO: 63508 - DNA, 15 bp, Homo sapiens
gatcaggtctgaaaa

SEQ ID NO: 63509 - DNA, 15 bp, Homo sapiens
agatcaggtctgaaa

SEQ ID NO: 63510 - DNA, 15 bp, Homo sapiens
gagatcaggtctgaa

SEQ ID NO: 63511 - DNA, 15 bp, Homo sapiens
agagatcaggtctga

SEQ ID NO: 63512 - DNA, 15 bp, Homo sapiens
aagagatcaggtctg

SEQ ID NO: 63513 - DNA, 15 bp, Homo sapiens
gaagagatcaggtct

SEQ ID NO: 63514 - DNA, 15 bp, Homo sapiens
tgaagagatcaggtc

SEQ ID NO: 63515 - DNA, 15 bp, Homo sapiens
ctgaagagatcaggt

SEQ ID NO: 63516 - DNA, 15 bp, Homo sapiens
gctgaagagatcagg

SEQ ID NO: 63517 - DNA, 15 bp, Homo sapiens
agctgaagagatcag

SEQ ID NO: 63518 - DNA, 15 bp, Homo sapiens
cagctgaagagatca

SEQ ID NO: 63519 - DNA, 15 bp, Homo sapiens
ccagctgaagagatc

SEQ ID NO: 63520 - DNA, 15 bp, Homo sapiens
cccagctgaagagat

SEQ ID NO: 63521 - DNA, 15 bp, Homo sapiens
tcccagctgaagaga

SEQ ID NO: 63522 - DNA, 15 bp, Homo sapiens
atcccagctgaagag

SEQ ID NO: 63523 - DNA, 15 bp, Homo sapiens
tatcccagctgaaga

SEQ ID NO: 63524 - DNA, 15 bp, Homo sapiens
ttatcccagctgaag

SEQ ID NO: 63525 - DNA, 15 bp, Homo sapiens
tttatcccagctgaa

SEQ ID NO: 63526 - DNA, 15 bp, Homo sapiens
ctttatcccagctga

SEQ ID NO: 63527 - DNA, 15 bp, Homo sapiens
actttatcccagctg

SEQ ID NO: 63528 - DNA, 15 bp, Homo sapiens
aactttatcccagct

SEQ ID NO: 63529 - DNA, 15 bp, Homo sapiens
caactttatcccagc

SEQ ID NO: 63530 - DNA, 15 bp, Homo sapiens
acaactttatcccag

SEQ ID NO: 63531 - DNA, 15 bp, Homo sapiens
gacaactttatccca

SEQ ID NO: 63532 - DNA, 15 bp, Homo sapiens
tgacaactttatccc

SEQ ID NO: 63533 - DNA, 15 bp, Homo sapiens
ttgacaactttatcc

SEQ ID NO: 63534 - DNA, 15 bp, Homo sapiens
tttgacaactttatc

SEQ ID NO: 63535 - DNA, 15 bp, Homo sapiens
ttttgacaactttat

SEQ ID NO: 63536 - DNA, 15 bp, Homo sapiens
attttgacaacttta

SEQ ID NO: 63537 - DNA, 15 bp, Homo sapiens
cattttgacaacttt

SEQ ID NO: 63538 - DNA, 15 bp, Homo sapiens
acattttgacaactt

SEQ ID NO: 63539 - DNA, 15 bp, Homo sapiens
gacattttgacaact

SEQ ID NO: 63540 - DNA, 15 bp, Homo sapiens
tgacattttgacaac

SEQ ID NO: 63541 - DNA, 15 bp, Homo sapiens
gtgacattttgacaa

SEQ ID NO: 63542 - DNA, 15 bp, Homo sapiens
ggtgacattttgaca

SEQ ID NO: 63543 - DNA, 15 bp, Homo sapiens
tggtgacattttgac

SEQ ID NO: 63544 - DNA, 15 bp, Homo sapiens
ttggtgacattttga

SEQ ID NO: 63545 - DNA, 15 bp, Homo sapiens
attggtgacattttg

SEQ ID NO: 63546 - DNA, 15 bp, Homo sapiens
aattggtgacatttt

SEQ ID NO: 63547 - DNA, 15 bp, Homo sapiens
caattggtgacattt

SEQ ID NO: 63548 - DNA, 15 bp, Homo sapiens
tcaattggtgacatt

SEQ ID NO: 63549 - DNA, 15 bp, Homo sapiens
ctcaattggtgacat

SEQ ID NO: 63550 - DNA, 15 bp, Homo sapiens
tctcaattggtgaca

SEQ ID NO: 63551 - DNA, 15 bp, Homo sapiens
ctctcaattggtgac

SEQ ID NO: 63552 - DNA, 15 bp, Homo sapiens
tctctcaattggtga

SEQ ID NO: 63553 - DNA, 15 bp, Homo sapiens
gtctctcaattggtg

SEQ ID NO: 63554 - DNA, 15 bp, Homo sapiens
agtctctcaattggt

SEQ ID NO: 63555 - DNA, 15 bp, Homo sapiens
aagtctctcaattgg

SEQ ID NO: 63556 - DNA, 15 bp, Homo sapiens
caagtctctcaattg

SEQ ID NO: 63557 - DNA, 15 bp, Homo sapiens
tcaagtctctcaatt

SEQ ID NO: 63558 - DNA, 15 bp, Homo sapiens
ttcaagtctctcaat

SEQ ID NO: 63559 - DNA, 15 bp, Homo sapiens
gttcaagtctctcaa

SEQ ID NO: 63560 - DNA, 15 bp, Homo sapiens
tgttcaagtctctca

SEQ ID NO: 63561 - DNA, 15 bp, Homo sapiens
atgttcaagtctctc

SEQ ID NO: 63562 - DNA, 15 bp, Homo sapiens
catgttcaagtctct

SEQ ID NO: 63563 - DNA, 15 bp, Homo sapiens
gcatgttcaagtctc

SEQ ID NO: 63564 - DNA, 15 bp, Homo sapiens
ggcatgttcaagtct

SEQ ID NO: 63565 - DNA, 15 bp, Homo sapiens
aggcatgttcaagtc

SEQ ID NO: 63566 - DNA, 15 bp, Homo sapiens
aaggcatgttcaagt

SEQ ID NO: 63567 - DNA, 15 bp, Homo sapiens
gaaggcatgttcaag

SEQ ID NO: 63568 - DNA, 15 bp, Homo sapiens
tgaaggcatgttcaa

SEQ ID NO: 63569 - DNA, 15 bp, Homo sapiens
ctgaaggcatgttca

SEQ ID NO: 63570 - DNA, 15 bp, Homo sapiens
gctgaaggcatgttc

SEQ ID NO: 63571 - DNA, 15 bp, Homo sapiens
tgctgaaggcatgtt

SEQ ID NO: 63572 - DNA, 15 bp, Homo sapiens
ttgctgaaggcatgt

SEQ ID NO: 63573 - DNA, 15 bp, Homo sapiens
cttgctgaaggcatg

SEQ ID NO: 63574 - DNA, 15 bp, Homo sapiens
ccttgctgaaggcat

SEQ ID NO: 63575 - DNA, 15 bp, Homo sapiens
gccttgctgaaggca

SEQ ID NO: 63576 - DNA, 15 bp, Homo sapiens
agccttgctgaaggc

SEQ ID NO: 63577 - DNA, 15 bp, Homo sapiens
gagccttgctgaagg

SEQ ID NO: 63578 - DNA, 15 bp, Homo sapiens
tgagccttgctgaag

SEQ ID NO: 63579 - DNA, 15 bp, Homo sapiens
ttgagccttgctgaa

SEQ ID NO: 63580 - DNA, 15 bp, Homo sapiens
tttgagccttgctga

SEQ ID NO: 63581 - DNA, 15 bp, Homo sapiens
gtttgagccttgctg

SEQ ID NO: 63582 - DNA, 15 bp, Homo sapiens
agtttgagccttgct

SEQ ID NO: 63583 - DNA, 15 bp, Homo sapiens
aagtttgagccttgc

SEQ ID NO: 63584 - DNA, 15 bp, Homo sapiens
taagtttgagccttg

SEQ ID NO: 63585 - DNA, 15 bp, Homo sapiens
ataagtttgagcctt

SEQ ID NO: 63586 - DNA, 15 bp, Homo sapiens
aataagtttgagcct

SEQ ID NO: 63587 - DNA, 15 bp, Homo sapiens
aaataagtttgagcc

SEQ ID NO: 63588 - DNA, 15 bp, Homo sapiens
caaataagtttgagc

SEQ ID NO: 63589 - DNA, 15 bp, Homo sapiens
ccaaataagtttgag

SEQ ID NO: 63590 - DNA, 15 bp, Homo sapiens
cccaaataagtttga

SEQ ID NO: 63591 - DNA, 15 bp, Homo sapiens
tcccaaataagtttg

SEQ ID NO: 63592 - DNA, 15 bp, Homo sapiens
ttcccaaataagttt

SEQ ID NO: 63593 - DNA, 15 bp, Homo sapiens
attcccaaataagtt

SEQ ID NO: 63594 - DNA, 15 bp, Homo sapiens
aattcccaaataagt

SEQ ID NO: 63595 - DNA, 15 bp, Homo sapiens
caattcccaaataag

SEQ ID NO: 63596 - DNA, 15 bp, Homo sapiens
tcaattcccaaataa

SEQ ID NO: 63597 - DNA, 15 bp, Homo sapiens
ttcaattcccaaata

SEQ ID NO: 63598 - DNA, 15 bp, Homo sapiens
tttcaattcccaaat

SEQ ID NO: 63599 - DNA, 15 bp, Homo sapiens
ttttcaattcccaaa

SEQ ID NO: 63600 - DNA, 15 bp, Homo sapiens
cttttcaattcccaa

SEQ ID NO: 63601 - DNA, 15 bp, Homo sapiens
gcttttcaattccca

SEQ ID NO: 63602 - DNA, 15 bp, Homo sapiens
agcttttcaattccc

SEQ ID NO: 63603 - DNA, 15 bp, Homo sapiens
cagcttttcaattcc

SEQ ID NO: 63604 - DNA, 15 bp, Homo sapiens
acagcttttcaattc

SEQ ID NO: 63605 - DNA, 15 bp, Homo sapiens
aacagcttttcaatt

SEQ ID NO: 63606 - DNA, 15 bp, Homo sapiens
taacagcttttcaat

SEQ ID NO: 63607 - DNA, 15 bp, Homo sapiens
ctaacagcttttcaa

SEQ ID NO: 63608 - DNA, 15 bp, Homo sapiens
tctaacagcttttca

SEQ ID NO: 63609 - DNA, 15 bp, Homo sapiens
atctaacagcttttc

SEQ ID NO: 63610 - DNA, 15 bp, Homo sapiens
gatctaacagctttt

SEQ ID NO: 63611 - DNA, 15 bp, Homo sapiens
ggatctaacagcttt

SEQ ID NO: 63612 - DNA, 15 bp, Homo sapiens
aggatctaacagctt

SEQ ID NO: 63613 - DNA, 15 bp, Homo sapiens
caggatctaacagct

SEQ ID NO: 63614 - DNA, 15 bp, Homo sapiens
tcaggatctaacagc

SEQ ID NO: 63615 - DNA, 15 bp, Homo sapiens
ttcaggatctaacag

SEQ ID NO: 63616 - DNA, 15 bp, Homo sapiens
cttcaggatctaaca

SEQ ID NO: 63617 - DNA, 15 bp, Homo sapiens
ccttcaggatctaac

SEQ ID NO: 63618 - DNA, 15 bp, Homo sapiens
accttcaggatctaa

SEQ ID NO: 63619 - DNA, 15 bp, Homo sapiens
taccttcaggatcta

SEQ ID NO: 63620 - DNA, 15 bp, Homo sapiens
ataccttcaggatct

SEQ ID NO: 63621 - DNA, 15 bp, Homo sapiens
aataccttcaggatc

SEQ ID NO: 63622 - DNA, 15 bp, Homo sapiens
caataccttcaggat

SEQ ID NO: 63623 - DNA, 15 bp, Homo sapiens
acaataccttcagga

SEQ ID NO: 63624 - DNA, 15 bp, Homo sapiens
gacaataccttcagg

SEQ ID NO: 63625 - DNA, 15 bp, Homo sapiens
ggacaataccttcag

SEQ ID NO: 63626 - DNA, 15 bp, Homo sapiens
tggacaataccttca

SEQ ID NO: 63627 - DNA, 15 bp, Homo sapiens
ctggacaataccttc

SEQ ID NO: 63628 - DNA, 15 bp, Homo sapiens
actggacaatacctt

SEQ ID NO: 63629 - DNA, 15 bp, Homo sapiens
tactggacaatacct

SEQ ID NO: 63630 - DNA, 15 bp, Homo sapiens
atactggacaatacc

SEQ ID NO: 63631 - DNA, 15 bp, Homo sapiens
aatactggacaatac

SEQ ID NO: 63632 - DNA, 15 bp, Homo sapiens
aaatactggacaata

SEQ ID NO: 63633 - DNA, 15 bp, Homo sapiens
taaatactggacaat

SEQ ID NO: 63634 - DNA, 15 bp, Homo sapiens
ttaaatactggacaa

SEQ ID NO: 63635 - DNA, 15 bp, Homo sapiens
attaaatactggaca

SEQ ID NO: 63636 - DNA, 15 bp, Homo sapiens
aattaaatactggac

SEQ ID NO: 63637 - DNA, 15 bp, Homo sapiens
aaattaaatactgga

SEQ ID NO: 63638 - DNA, 15 bp, Homo sapiens
gaaattaaatactgg

SEQ ID NO: 63639 - DNA, 15 bp, Homo sapiens
ggaaattaaatactg

SEQ ID NO: 63640 - DNA, 15 bp, Homo sapiens
tggaaattaaatact

SEQ ID NO: 63641 - DNA, 15 bp, Homo sapiens
gtggaaattaaatac

SEQ ID NO: 63642 - DNA, 15 bp, Homo sapiens
ggtggaaattaaata

SEQ ID NO: 63643 - DNA, 15 bp, Homo sapiens
aggtggaaattaaat

SEQ ID NO: 63644 - DNA, 15 bp, Homo sapiens
aaggtggaaattaaa

SEQ ID NO: 63645 - DNA, 15 bp, Homo sapiens
caaggtggaaattaa

SEQ ID NO: 63646 - DNA, 15 bp, Homo sapiens
tcaaggtggaaatta

SEQ ID NO: 63647 - DNA, 15 bp, Homo sapiens
atcaaggtggaaatt

SEQ ID NO: 63648 - DNA, 15 bp, Homo sapiens
aatcaaggtggaaat

SEQ ID NO: 63649 - DNA, 15 bp, Homo sapiens
aaatcaaggtggaaa

SEQ ID NO: 63650 - DNA, 15 bp, Homo sapiens
aaaatcaaggtggaa

SEQ ID NO: 63651 - DNA, 15 bp, Homo sapiens
caaaatcaaggtgga

SEQ ID NO: 63652 - DNA, 15 bp, Homo sapiens
gcaaaatcaaggtgg

SEQ ID NO: 63653 - DNA, 15 bp, Homo sapiens
agcaaaatcaaggtg

SEQ ID NO: 63654 - DNA, 15 bp, Homo sapiens
aagcaaaatcaaggt

SEQ ID NO: 63655 - DNA, 15 bp, Homo sapiens
aaagcaaaatcaagg

SEQ ID NO: 63656 - DNA, 15 bp, Homo sapiens
taaagcaaaatcaag

SEQ ID NO: 63657 - DNA, 15 bp, Homo sapiens
gtaaagcaaaatcaa

SEQ ID NO: 63658 - DNA, 15 bp, Homo sapiens
tgtaaagcaaaatca

SEQ ID NO: 63659 - DNA, 15 bp, Homo sapiens
ctgtaaagcaaaatc

SEQ ID NO: 63660 - DNA, 15 bp, Homo sapiens
actgtaaagcaaaat

SEQ ID NO: 63661 - DNA, 15 bp, Homo sapiens
aactgtaaagcaaaa

SEQ ID NO: 63662 - DNA, 15 bp, Homo sapiens
aaactgtaaagcaaa

SEQ ID NO: 63663 - DNA, 15 bp, Homo sapiens
aaaactgtaaagcaa

SEQ ID NO: 63664 - DNA, 15 bp, Homo sapiens
caaaactgtaaagca

SEQ ID NO: 63665 - DNA, 15 bp, Homo sapiens
gcaaaactgtaaagc

SEQ ID NO: 63666 - DNA, 15 bp, Homo sapiens
tgcaaaactgtaaag

SEQ ID NO: 63667 - DNA, 15 bp, Homo sapiens
atgcaaaactgtaaa

SEQ ID NO: 63668 - DNA, 15 bp, Homo sapiens
aatgcaaaactgtaa

SEQ ID NO: 63669 - DNA, 15 bp, Homo sapiens
gaatgcaaaactgta

SEQ ID NO: 63670 - DNA, 15 bp, Homo sapiens
agaatgcaaaactgt

SEQ ID NO: 63671 - DNA, 15 bp, Homo sapiens
aagaatgcaaaactg

SEQ ID NO: 63672 - DNA, 15 bp, Homo sapiens
caagaatgcaaaact

SEQ ID NO: 63673 - DNA, 15 bp, Homo sapiens
tcaagaatgcaaaac

SEQ ID NO: 63674 - DNA, 15 bp, Homo sapiens
ttcaagaatgcaaaa

SEQ ID NO: 63675 - DNA, 15 bp, Homo sapiens
tttcaagaatgcaaa

SEQ ID NO: 63676 - DNA, 15 bp, Homo sapiens
ttttcaagaatgcaa

SEQ ID NO: 63677 - DNA, 15 bp, Homo sapiens
cttttcaagaatgca

SEQ ID NO: 63678 - DNA, 15 bp, Homo sapiens
gcttttcaagaatgc

SEQ ID NO: 63679 - DNA, 15 bp, Homo sapiens
tgcttttcaagaatg

SEQ ID NO: 63680 - DNA, 15 bp, Homo sapiens
ctgcttttcaagaat

SEQ ID NO: 63681 - DNA, 15 bp, Homo sapiens
actgcttttcaagaa

SEQ ID NO: 63682 - DNA, 15 bp, Homo sapiens
cactgcttttcaaga

SEQ ID NO: 63683 - DNA, 15 bp, Homo sapiens
acactgcttttcaag

SEQ ID NO: 63684 - DNA, 15 bp, Homo sapiens
aacactgcttttcaa

SEQ ID NO: 63685 - DNA, 15 bp, Homo sapiens
aaacactgcttttca

SEQ ID NO: 63686 - DNA, 15 bp, Homo sapiens
gaaacactgcttttc

SEQ ID NO: 63687 - DNA, 15 bp, Homo sapiens
agaaacactgctttt

SEQ ID NO: 63688 - DNA, 15 bp, Homo sapiens
aagaaacactgcttt

SEQ ID NO: 63689 - DNA, 15 bp, Homo sapiens
aaagaaacactgctt

SEQ ID NO: 63690 - DNA, 15 bp, Homo sapiens
caaagaaacactgct

SEQ ID NO: 63691 - DNA, 15 bp, Homo sapiens
acaaagaaacactgc

SEQ ID NO: 63692 - DNA, 15 bp, Homo sapiens
gacaaagaaacactg

SEQ ID NO: 63693 - DNA, 15 bp, Homo sapiens
ggacaaagaaacact

SEQ ID NO: 63694 - DNA, 15 bp, Homo sapiens
aggacaaagaaacac

SEQ ID NO: 63695 - DNA, 15 bp, Homo sapiens
aaggacaaagaaaca

SEQ ID NO: 63696 - DNA, 15 bp, Homo sapiens
aaaggacaaagaaac

SEQ ID NO: 63697 - DNA, 15 bp, Homo sapiens
aaaaggacaaagaaa

SEQ ID NO: 63698 - DNA, 15 bp, Homo sapiens
taaaaggacaaagaa

SEQ ID NO: 63699 - DNA, 15 bp, Homo sapiens
ttaaaaggacaaaga

SEQ ID NO: 63700 - DNA, 15 bp, Homo sapiens
tttaaaaggacaaag

SEQ ID NO: 63701 - DNA, 15 bp, Homo sapiens
ttttaaaaggacaaa

SEQ ID NO: 63702 - DNA, 15 bp, Homo sapiens
tttttaaaaggacaa

SEQ ID NO: 63703 - DNA, 15 bp, Homo sapiens
atttttaaaaggaca

SEQ ID NO: 63704 - DNA, 15 bp, Homo sapiens
catttttaaaaggac

SEQ ID NO: 63705 - DNA, 15 bp, Homo sapiens
tcatttttaaaagga

SEQ ID NO: 63706 - DNA, 15 bp, Homo sapiens
ttcatttttaaaagg

SEQ ID NO: 63707 - DNA, 15 bp, Homo sapiens
attcatttttaaaag

SEQ ID NO: 63708 - DNA, 15 bp, Homo sapiens
aattcatttttaaaa

SEQ ID NO: 63709 - DNA, 15 bp, Homo sapiens
taattcatttttaaa

SEQ ID NO: 63710 - DNA, 15 bp, Homo sapiens
ataattcatttttaa

SEQ ID NO: 63711 - DNA, 15 bp, Homo sapiens
cataattcattttta

SEQ ID NO: 63712 - DNA, 15 bp, Homo sapiens
tcataattcattttt

SEQ ID NO: 63713 - DNA, 15 bp, Homo sapiens
ctcataattcatttt

SEQ ID NO: 63714 - DNA, 15 bp, Homo sapiens
tctcataattcattt

SEQ ID NO: 63715 - DNA, 15 bp, Homo sapiens
gtctcataattcatt

SEQ ID NO: 63716 - DNA, 15 bp, Homo sapiens
agtctcataattcat

SEQ ID NO: 63717 - DNA, 15 bp, Homo sapiens
aagtctcataattca

SEQ ID NO: 63718 - DNA, 15 bp, Homo sapiens
caagtctcataattc

SEQ ID NO: 63719 - DNA, 15 bp, Homo sapiens
tcaagtctcataatt

SEQ ID NO: 63720 - DNA, 15 bp, Homo sapiens
ttcaagtctcataat

SEQ ID NO: 63721 - DNA, 15 bp, Homo sapiens
cttcaagtctcataa

SEQ ID NO: 63722 - DNA, 15 bp, Homo sapiens
tcttcaagtctcata

SEQ ID NO: 63723 - DNA, 15 bp, Homo sapiens
ttcttcaagtctcat

SEQ ID NO: 63724 - DNA, 15 bp, Homo sapiens
gttcttcaagtctca

SEQ ID NO: 63725 - DNA, 15 bp, Homo sapiens
ggttcttcaagtctc

SEQ ID NO: 63726 - DNA, 15 bp, Homo sapiens
aggttcttcaagtct

SEQ ID NO: 63727 - DNA, 15 bp, Homo sapiens
aaggttcttcaagtc

SEQ ID NO: 63728 - DNA, 15 bp, Homo sapiens
aaaggttcttcaagt

SEQ ID NO: 63729 - DNA, 15 bp, Homo sapiens
aaaaggttcttcaag

SEQ ID NO: 63730 - DNA, 15 bp, Homo sapiens
gaaaaggttcttcaa

SEQ ID NO: 63731 - DNA, 15 bp, Homo sapiens
ggaaaaggttcttca

SEQ ID NO: 63732 - DNA, 15 bp, Homo sapiens
aggaaaaggttcttc

SEQ ID NO: 63733 - DNA, 15 bp, Homo sapiens
aaggaaaaggttctt

SEQ ID NO: 63734 - DNA, 15 bp, Homo sapiens
aaaggaaaaggttct

SEQ ID NO: 63735 - DNA, 15 bp, Homo sapiens
aaaaggaaaaggttc

SEQ ID NO: 63736 - DNA, 15 bp, Homo sapiens
aaaaaggaaaaggtt

SEQ ID NO: 63737 - DNA, 15 bp, Homo sapiens
caaaaaggaaaaggt

SEQ ID NO: 63738 - DNA, 15 bp, Homo sapiens
ccaaaaaggaaaagg

SEQ ID NO: 63739 - DNA, 15 bp, Homo sapiens
tccaaaaaggaaaag

SEQ ID NO: 63740 - DNA, 15 bp, Homo sapiens
ctccaaaaaggaaaa

SEQ ID NO: 63741 - DNA, 15 bp, Homo sapiens
actccaaaaaggaaa

SEQ ID NO: 63742 - DNA, 15 bp, Homo sapiens
tactccaaaaaggaa

SEQ ID NO: 63743 - DNA, 15 bp, Homo sapiens
atactccaaaaagga

SEQ ID NO: 63744 - DNA, 15 bp, Homo sapiens
tatactccaaaaagg

SEQ ID NO: 63745 - DNA, 15 bp, Homo sapiens
ctatactccaaaaag

SEQ ID NO: 63746 - DNA, 15 bp, Homo sapiens
cctatactccaaaaa

SEQ ID NO: 63747 - DNA, 15 bp, Homo sapiens
acctatactccaaaa

SEQ ID NO: 63748 - DNA, 15 bp, Homo sapiens
cacctatactccaaa

SEQ ID NO: 63749 - DNA, 15 bp, Homo sapiens
gcacctatactccaa

SEQ ID NO: 63750 - DNA, 15 bp, Homo sapiens
cgcacctatactcca

SEQ ID NO: 63751 - DNA, 15 bp, Homo sapiens
tcgcacctatactcc

SEQ ID NO: 63752 - DNA, 15 bp, Homo sapiens
ctcgcacctatactc

SEQ ID NO: 63753 - DNA, 15 bp, Homo sapiens
actcgcacctatact

SEQ ID NO: 63754 - DNA, 15 bp, Homo sapiens
gactcgcacctatac

SEQ ID NO: 63755 - DNA, 15 bp, Homo sapiens
tgactcgcacctata

SEQ ID NO: 63756 - DNA, 15 bp, Homo sapiens
atgactcgcacctat

SEQ ID NO: 63757 - DNA, 15 bp, Homo sapiens
aatgactcgcaccta

SEQ ID NO: 63758 - DNA, 15 bp, Homo sapiens
aaatgactcgcacct

SEQ ID NO: 63759 - DNA, 15 bp, Homo sapiens
aaaatgactcgcacc

SEQ ID NO: 63760 - DNA, 15 bp, Homo sapiens
taaaatgactcgcac

SEQ ID NO: 63761 - DNA, 15 bp, Homo sapiens
ataaaatgactcgca

SEQ ID NO: 63762 - DNA, 15 bp, Homo sapiens
aataaaatgactcgc

SEQ ID NO: 63763 - DNA, 15 bp, Homo sapiens
taataaaatgactcg

SEQ ID NO: 63764 - DNA, 15 bp, Homo sapiens
gtaataaaatgactc

SEQ ID NO: 63765 - DNA, 15 bp, Homo sapiens
agtaataaaatgact

SEQ ID NO: 63766 - DNA, 15 bp, Homo sapiens
cagtaataaaatgac

SEQ ID NO: 63767 - DNA, 15 bp, Homo sapiens
tcagtaataaaatga

SEQ ID NO: 63768 - DNA, 15 bp, Homo sapiens
gtcagtaataaaatg

SEQ ID NO: 63769 - DNA, 15 bp, Homo sapiens
tgtcagtaataaaat

SEQ ID NO: 63770 - DNA, 15 bp, Homo sapiens
gtgtcagtaataaaa

SEQ ID NO: 63771 - DNA, 15 bp, Homo sapiens
agtgtcagtaataaa

SEQ ID NO: 63772 - DNA, 15 bp, Homo sapiens
aagtgtcagtaataa

SEQ ID NO: 63773 - DNA, 15 bp, Homo sapiens
taagtgtcagtaata

SEQ ID NO: 63774 - DNA, 15 bp, Homo sapiens
ataagtgtcagtaat

SEQ ID NO: 63775 - DNA, 15 bp, Homo sapiens
aataagtgtcagtaa

SEQ ID NO: 63776 - DNA, 15 bp, Homo sapiens
taataagtgtcagta

SEQ ID NO: 63777 - DNA, 15 bp, Homo sapiens
ttaataagtgtcagt

SEQ ID NO: 63778 - DNA, 15 bp, Homo sapiens
attaataagtgtcag

SEQ ID NO: 63779 - DNA, 15 bp, Homo sapiens
tattaataagtgtca

SEQ ID NO: 63780 - DNA, 15 bp, Homo sapiens
gtattaataagtgtc

SEQ ID NO: 63781 - DNA, 15 bp, Homo sapiens
agtattaataagtgt

SEQ ID NO: 63782 - DNA, 15 bp, Homo sapiens
aagtattaataagtg

SEQ ID NO: 63783 - DNA, 15 bp, Homo sapiens
aaagtattaataagt

SEQ ID NO: 63784 - DNA, 15 bp, Homo sapiens
aaaagtattaataag

SEQ ID NO: 63785 - DNA, 15 bp, Homo sapiens
caaaagtattaataa

SEQ ID NO: 63786 - DNA, 15 bp, Homo sapiens
acaaaagtattaata

SEQ ID NO: 63787 - DNA, 15 bp, Homo sapiens
tacaaaagtattaat

SEQ ID NO: 63788 - DNA, 15 bp, Homo sapiens
gtacaaaagtattaa

SEQ ID NO: 63789 - DNA, 15 bp, Homo sapiens
agtacaaaagtatta

SEQ ID NO: 63790 - DNA, 15 bp, Homo sapiens
aagtacaaaagtatt

SEQ ID NO: 63791 - DNA, 15 bp, Homo sapiens
taagtacaaaagtat

SEQ ID NO: 63792 - DNA, 15 bp, Homo sapiens
ctaagtacaaaagta

SEQ ID NO: 63793 - DNA, 15 bp, Homo sapiens
gctaagtacaaaagt

SEQ ID NO: 63794 - DNA, 15 bp, Homo sapiens
tgctaagtacaaaag

SEQ ID NO: 63795 - DNA, 15 bp, Homo sapiens
ctgctaagtacaaaa

SEQ ID NO: 63796 - DNA, 15 bp, Homo sapiens
actgctaagtacaaa

SEQ ID NO: 63797 - DNA, 15 bp, Homo sapiens
aactgctaagtacaa

SEQ ID NO: 63798 - DNA, 15 bp, Homo sapiens
aaactgctaagtaca

SEQ ID NO: 63799 - DNA, 15 bp, Homo sapiens
caaactgctaagtac

SEQ ID NO: 63800 - DNA, 15 bp, Homo sapiens
acaaactgctaagta

SEQ ID NO: 63801 - DNA, 15 bp, Homo sapiens
cacaaactgctaagt

SEQ ID NO: 63802 - DNA, 15 bp, Homo sapiens
ccacaaactgctaag

SEQ ID NO: 63803 - DNA, 15 bp, Homo sapiens
cccacaaactgctaa

SEQ ID NO: 63804 - DNA, 15 bp, Homo sapiens
tcccacaaactgcta

SEQ ID NO: 63805 - DNA, 15 bp, Homo sapiens
atcccacaaactgct

SEQ ID NO: 63806 - DNA, 15 bp, Homo sapiens
gatcccacaaactgc

SEQ ID NO: 63807 - DNA, 15 bp, Homo sapiens
agatcccacaaactg

SEQ ID NO: 63808 - DNA, 15 bp, Homo sapiens
aagatcccacaaact

SEQ ID NO: 63809 - DNA, 15 bp, Homo sapiens
aaagatcccacaaac

SEQ ID NO: 63810 - DNA, 15 bp, Homo sapiens
aaaagatcccacaaa

SEQ ID NO: 63811 - DNA, 15 bp, Homo sapiens
taaaagatcccacaa

SEQ ID NO: 63812 - DNA, 15 bp, Homo sapiens
ctaaaagatcccaca

SEQ ID NO: 63813 - DNA, 15 bp, Homo sapiens
cctaaaagatcccac

SEQ ID NO: 63814 - DNA, 15 bp, Homo sapiens
acctaaaagatccca

SEQ ID NO: 63815 - DNA, 15 bp, Homo sapiens
tacctaaaagatccc

SEQ ID NO: 63816 - DNA, 15 bp, Homo sapiens
ctacctaaaagatcc

SEQ ID NO: 63817 - DNA, 15 bp, Homo sapiens
tctacctaaaagatc

SEQ ID NO: 63818 - DNA, 15 bp, Homo sapiens
ttctacctaaaagat

SEQ ID NO: 63819 - DNA, 15 bp, Homo sapiens
tttctacctaaaaga

SEQ ID NO: 63820 - DNA, 15 bp, Homo sapiens
atttctacctaaaag

SEQ ID NO: 63821 - DNA, 15 bp, Homo sapiens
aatttctacctaaaa

SEQ ID NO: 63822 - DNA, 15 bp, Homo sapiens
aaatttctacctaaa

SEQ ID NO: 63823 - DNA, 15 bp, Homo sapiens
taaatttctacctaa

SEQ ID NO: 63824 - DNA, 15 bp, Homo sapiens
ttaaatttctaccta

SEQ ID NO: 63825 - DNA, 15 bp, Homo sapiens
gttaaatttctacct

SEQ ID NO: 63826 - DNA, 15 bp, Homo sapiens
agttaaatttctacc

SEQ ID NO: 63827 - DNA, 15 bp, Homo sapiens
tagttaaatttctac

SEQ ID NO: 63828 - DNA, 15 bp, Homo sapiens
tgtagttaaatttct

SEQ ID NO: 63829 - DNA, 15 bp, Homo sapiens
ctgtagttaaatttc

SEQ ID NO: 63830 - DNA, 15 bp, Homo sapiens
gctgtagttaaattt

SEQ ID NO: 63831 - DNA, 15 bp, Homo sapiens
tgctgtagttaaatt

SEQ ID NO: 63832 - DNA, 15 bp, Homo sapiens
gtgctgtagttaaat

SEQ ID NO: 63833 - DNA, 15 bp, Homo sapiens
agtgctgtagttaaa

SEQ ID NO: 63834 - DNA, 15 bp, Homo sapiens
cagtgctgtagttaa

SEQ ID NO: 63835 - DNA, 15 bp, Homo sapiens
ccagtgctgtagtta

SEQ ID NO: 63836 - DNA, 15 bp, Homo sapiens
tccagtgctgtagtt

SEQ ID NO: 63837 - DNA, 15 bp, Homo sapiens
gtccagtgctgtagt

SEQ ID NO: 63838 - DNA, 15 bp, Homo sapiens
tgtccagtgctgtag

SEQ ID NO: 63839 - DNA, 15 bp, Homo sapiens
ttgtccagtgctgta

SEQ ID NO: 63840 - DNA, 15 bp, Homo sapiens
attgtccagtgctgt

SEQ ID NO: 63841 - DNA, 15 bp, Homo sapiens
tattgtccagtgctg

SEQ ID NO: 63842 - DNA, 15 bp, Homo sapiens
ctattgtccagtgct

SEQ ID NO: 63843 - DNA, 15 bp, Homo sapiens
actattgtccagtgc

SEQ ID NO: 63844 - DNA, 15 bp, Homo sapiens
aactattgtccagtg

SEQ ID NO: 63845 - DNA, 15 bp, Homo sapiens
taactattgtccagt

SEQ ID NO: 63846 - DNA, 15 bp, Homo sapiens
ttaactattgtccag

SEQ ID NO: 63847 - DNA, 15 bp, Homo sapiens
attaactattgtcca

SEQ ID NO: 63848 - DNA, 15 bp, Homo sapiens
gattaactattgtcc

SEQ ID NO: 63849 - DNA, 15 bp, Homo sapiens
agattaactattgtc

SEQ ID NO: 63850 - DNA, 15 bp, Homo sapiens
tagattaactattgt

SEQ ID NO: 63851 - DNA, 15 bp, Homo sapiens
ttagattaactattg

SEQ ID NO: 63852 - DNA, 15 bp, Homo sapiens
tttagattaactatt

SEQ ID NO: 63853 - DNA, 15 bp, Homo sapiens
atttagattaactat

SEQ ID NO: 63854 - DNA, 15 bp, Homo sapiens
aatttagattaacta

SEQ ID NO: 63855 - DNA, 15 bp, Homo sapiens
taatttagattaact

SEQ ID NO: 63856 - DNA, 15 bp, Homo sapiens
ttaatttagattaac

SEQ ID NO: 63857 - DNA, 15 bp, Homo sapiens
cttaatttagattaa

SEQ ID NO: 63858 - DNA, 15 bp, Homo sapiens
acttaatttagatta

SEQ ID NO: 63859 - DNA, 15 bp, Homo sapiens
tacttaatttagatt

SEQ ID NO: 63860 - DNA, 15 bp, Homo sapiens
ttacttaatttagat

SEQ ID NO: 63861 - DNA, 15 bp, Homo sapiens
cttacttaatttaga

SEQ ID NO: 63862 - DNA, 15 bp, Homo sapiens
tcttacttaatttag

SEQ ID NO: 63863 - DNA, 15 bp, Homo sapiens
ctcttacttaattta

SEQ ID NO: 63864 - DNA, 15 bp, Homo sapiens
actcttacttaattt

SEQ ID NO: 63865 - DNA, 15 bp, Homo sapiens
aactcttacttaatt

SEQ ID NO: 63866 - DNA, 15 bp, Homo sapiens
taactcttacttaat

SEQ ID NO: 63867 - DNA, 15 bp, Homo sapiens
ttaactcttacttaa

SEQ ID NO: 63868 - DNA, 15 bp, Homo sapiens
tttaactcttactta

SEQ ID NO: 63869 - DNA, 15 bp, Homo sapiens
ctttaactcttactt

SEQ ID NO: 63870 - DNA, 15 bp, Homo sapiens
actttaactcttact

SEQ ID NO: 63871 - DNA, 15 bp, Homo sapiens
aactttaactcttac

SEQ ID NO: 63872 - DNA, 15 bp, Homo sapiens
aaactttaactctta

SEQ ID NO: 63873 - DNA, 15 bp, Homo sapiens
aaaactttaactctt

SEQ ID NO: 63874 - DNA, 15 bp, Homo sapiens
taaaactttaactct

SEQ ID NO: 63875 - DNA, 15 bp, Homo sapiens
ttaaaactttaactc

SEQ ID NO: 63876 - DNA, 15 bp, Homo sapiens
cttaaaactttaact

SEQ ID NO: 63877 - DNA, 15 bp, Homo sapiens
tcttaaaactttaac

SEQ ID NO: 63878 - DNA, 15 bp, Homo sapiens
ttcttaaaactttaa

SEQ ID NO: 63879 - DNA, 15 bp, Homo sapiens
tttcttaaaacttta

SEQ ID NO: 63880 - DNA, 15 bp, Homo sapiens
ttttcttaaaacttt

SEQ ID NO: 63881 - DNA, 15 bp, Homo sapiens
attttcttaaaactt

SEQ ID NO: 63882 - DNA, 15 bp, Homo sapiens
cattttcttaaaact

SEQ ID NO: 63883 - DNA, 15 bp, Homo sapiens
acattttcttaaaac

SEQ ID NO: 63884 - DNA, 15 bp, Homo sapiens
tacattttcttaaaa

SEQ ID NO: 63885 - DNA, 15 bp, Homo sapiens
ttacattttcttaaa

SEQ ID NO: 63886 - DNA, 15 bp, Homo sapiens
attacattttcttaa

SEQ ID NO: 63887 - DNA, 15 bp, Homo sapiens
aattacattttctta

SEQ ID NO: 63888 - DNA, 15 bp, Homo sapiens
taattacattttctt

SEQ ID NO: 63889 - DNA, 15 bp, Homo sapiens
ataattacattttct

SEQ ID NO: 63890 - DNA, 15 bp, Homo sapiens
aataattacattttc

SEQ ID NO: 63891 - DNA, 15 bp, Homo sapiens
taataattacatttt

SEQ ID NO: 63892 - DNA, 15 bp, Homo sapiens
ctaataattacattt

SEQ ID NO: 63893 - DNA, 15 bp, Homo sapiens
tctaataattacatt

SEQ ID NO: 63894 - DNA, 15 bp, Homo sapiens
atctaataattacat

SEQ ID NO: 63895 - DNA, 15 bp, Homo sapiens
tatctaataattaca

SEQ ID NO: 63896 - DNA, 15 bp, Homo sapiens
ttatctaataattac

SEQ ID NO: 63897 - DNA, 15 bp, Homo sapiens
tttatctaataatta

SEQ ID NO: 63898 - DNA, 15 bp, Homo sapiens
atttatctaataatt

SEQ ID NO: 63899 - DNA, 15 bp, Homo sapiens
aatttatctaataat

SEQ ID NO: 63900 - DNA, 15 bp, Homo sapiens
gaatttatctaataa

SEQ ID NO: 63901 - DNA, 15 bp, Homo sapiens
tgaatttatctaata

SEQ ID NO: 63902 - DNA, 15 bp, Homo sapiens
ctgaatttatctaat

SEQ ID NO: 63903 - DNA, 15 bp, Homo sapiens
actgaatttatctaa

SEQ ID NO: 63904 - DNA, 15 bp, Homo sapiens
tactgaatttatcta

SEQ ID NO: 63905 - DNA, 15 bp, Homo sapiens
atactgaatttatct

SEQ ID NO: 63906 - DNA, 15 bp, Homo sapiens
gatactgaatttatc

SEQ ID NO: 63907 - DNA, 15 bp, Homo sapiens
agatactgaatttat

SEQ ID NO: 63908 - DNA, 15 bp, Homo sapiens
cagatactgaattta

SEQ ID NO: 63909 - DNA, 15 bp, Homo sapiens
ccagatactgaattt

SEQ ID NO: 63910 - DNA, 15 bp, Homo sapiens
accagatactgaatt

SEQ ID NO: 63911 - DNA, 15 bp, Homo sapiens
aaccagatactgaat

SEQ ID NO: 63912 - DNA, 15 bp, Homo sapiens
taaccagatactgaa

SEQ ID NO: 63913 - DNA, 15 bp, Homo sapiens
ctaaccagatactga

SEQ ID NO: 63914 - DNA, 15 bp, Homo sapiens
actaaccagatactg

SEQ ID NO: 63915 - DNA, 15 bp, Homo sapiens
gactaaccagatact

SEQ ID NO: 63916 - DNA, 15 bp, Homo sapiens
ggactaaccagatac

SEQ ID NO: 63917 - DNA, 15 bp, Homo sapiens
tggactaaccagata

SEQ ID NO: 63918 - DNA, 15 bp, Homo sapiens
ttggactaaccagat

SEQ ID NO: 63919 - DNA, 15 bp, Homo sapiens
attggactaaccaga

SEQ ID NO: 63920 - DNA, 15 bp, Homo sapiens
tattggactaaccag

SEQ ID NO: 63921 - DNA, 15 bp, Homo sapiens
ttattggactaacca

SEQ ID NO: 63922 - DNA, 15 bp, Homo sapiens
tttattggactaacc

SEQ ID NO: 63923 - DNA, 15 bp, Homo sapiens
ttttattggactaac

SEQ ID NO: 63924 - DNA, 15 bp, Homo sapiens
attttattggactaa

SEQ ID NO: 63925 - DNA, 15 bp, Homo sapiens
cattttattggacta

SEQ ID NO: 63926 - DNA, 15 bp, Homo sapiens
gcattttattggact

SEQ ID NO: 63927 - DNA, 15 bp, Homo sapiens
tgcattttattggac

SEQ ID NO: 63928 - DNA, 15 bp, Homo sapiens
atgcattttattgga

SEQ ID NO: 63929 - DNA, 15 bp, Homo sapiens
aatgcattttattgg

SEQ ID NO: 63930 - DNA, 15 bp, Homo sapiens
aaatgcattttattg

SEQ ID NO: 63931 - DNA, 15 bp, Homo sapiens
aaaatgcattttatt

SEQ ID NO: 63932 - DNA, 15 bp, Homo sapiens
aaaaatgcattttat

SEQ ID NO: 63933 - DNA, 15 bp, Homo sapiens
taaaaatgcatttta

SEQ ID NO: 63934 - DNA, 15 bp, Homo sapiens
ataaaaatgcatttt

SEQ ID NO: 63935 - DNA, 15 bp, Homo sapiens
cataaaaatgcattt

SEQ ID NO: 63936 - DNA, 15 bp, Homo sapiens
acataaaaatgcatt

SEQ ID NO: 63937 - DNA, 15 bp, Homo sapiens
cacataaaaatgcat

SEQ ID NO: 63938 - DNA, 15 bp, Homo sapiens
tcacataaaaatgca

SEQ ID NO: 63939 - DNA, 15 bp, Homo sapiens
ctcacataaaaatgc

SEQ ID NO: 63940 - DNA, 15 bp, Homo sapiens
gctcacataaaaatg

SEQ ID NO: 63941 - DNA, 15 bp, Homo sapiens
tgctcacataaaaat

SEQ ID NO: 63942 - DNA, 15 bp, Homo sapiens
atgctcacataaaaa

SEQ ID NO: 63943 - DNA, 15 bp, Homo sapiens
gatgctcacataaaa

SEQ ID NO: 63944 - DNA, 15 bp, Homo sapiens
agatgctcacataaa

SEQ ID NO: 63945 - DNA, 15 bp, Homo sapiens
aagatgctcacataa

SEQ ID NO: 63946 - DNA, 15 bp, Homo sapiens
caagatgctcacata

SEQ ID NO: 63947 - DNA, 15 bp, Homo sapiens
gcaagatgctcacat

SEQ ID NO: 63948 - DNA, 15 bp, Homo sapiens
tgcaagatgctcaca

SEQ ID NO: 63949 - DNA, 15 bp, Homo sapiens
atgcaagatgctcac

SEQ ID NO: 63950 - DNA, 15 bp, Homo sapiens
catgcaagatgctca

SEQ ID NO: 63951 - DNA, 15 bp, Homo sapiens
acatgcaagatgctc

SEQ ID NO: 63952 - DNA, 15 bp, Homo sapiens
cacatgcaagatgct

SEQ ID NO: 63953 - DNA, 15 bp, Homo sapiens
tcacatgcaagatgc

SEQ ID NO: 63954 - DNA, 15 bp, Homo sapiens
atcacatgcaagatg

SEQ ID NO: 63955 - DNA, 15 bp, Homo sapiens
catcacatgcaagat

SEQ ID NO: 63956 - DNA, 15 bp, Homo sapiens
acatcacatgcaaga

SEQ ID NO: 63957 - DNA, 15 bp, Homo sapiens
tacatcacatgcaag

SEQ ID NO: 63958 - DNA, 15 bp, Homo sapiens
ttacatcacatgcaa

SEQ ID NO: 63959 - DNA, 15 bp, Homo sapiens
tttacatcacatgca

SEQ ID NO: 63960 - DNA, 15 bp, Homo sapiens
ctttacatcacatgc

SEQ ID NO: 63961 - DNA, 15 bp, Homo sapiens
tctttacatcacatg

SEQ ID NO: 63962 - DNA, 15 bp, Homo sapiens
gtctttacatcacat

SEQ ID NO: 63963 - DNA, 15 bp, Homo sapiens
agtctttacatcaca

SEQ ID NO: 63964 - DNA, 15 bp, Homo sapiens
aagtctttacatcac

SEQ ID NO: 63965 - DNA, 15 bp, Homo sapiens
aaagtctttacatca

SEQ ID NO: 63966 - DNA, 15 bp, Homo sapiens
taaagtctttacatc

SEQ ID NO: 63967 - DNA, 15 bp, Homo sapiens
ctaaagtctttacat

SEQ ID NO: 63968 - DNA, 15 bp, Homo sapiens
actaaagtctttaca

SEQ ID NO: 63969 - DNA, 15 bp, Homo sapiens
aactaaagtctttac

SEQ ID NO: 63970 - DNA, 15 bp, Homo sapiens
taactaaagtcttta

SEQ ID NO: 63971 - DNA, 15 bp, Homo sapiens
ataactaaagtcttt

SEQ ID NO: 63972 - DNA, 15 bp, Homo sapiens
tataactaaagtctt

SEQ ID NO: 63973 - DNA, 15 bp, Homo sapiens
ttataactaaagtct

SEQ ID NO: 63974 - DNA, 15 bp, Homo sapiens
tttataactaaagtc

SEQ ID NO: 63975 - DNA, 15 bp, Homo sapiens
atttataactaaagt

SEQ ID NO: 63976 - DNA, 15 bp, Homo sapiens
catttataactaaag

SEQ ID NO: 63977 - DNA, 15 bp, Homo sapiens
acatttataactaaa

SEQ ID NO: 63978 - DNA, 15 bp, Homo sapiens
aacatttataactaa

SEQ ID NO: 63979 - DNA, 15 bp, Homo sapiens
caacatttataacta

SEQ ID NO: 63980 - DNA, 15 bp, Homo sapiens
gcaacatttataact

SEQ ID NO: 63981 - DNA, 15 bp, Homo sapiens
tgcaacatttataac

SEQ ID NO: 63982 - DNA, 15 bp, Homo sapiens
ctgcaacatttataa

SEQ ID NO: 63983 - DNA, 15 bp, Homo sapiens
cctgcaacatttata

SEQ ID NO: 63984 - DNA, 15 bp, Homo sapiens
tcctgcaacatttat

SEQ ID NO: 63985 - DNA, 15 bp, Homo sapiens
atcctgcaacattta

SEQ ID NO: 63986 - DNA, 15 bp, Homo sapiens
aatcctgcaacattt

SEQ ID NO: 63987 - DNA, 15 bp, Homo sapiens
caatcctgcaacatt

SEQ ID NO: 63988 - DNA, 15 bp, Homo sapiens
tcaatcctgcaacat

SEQ ID NO: 63989 - DNA, 15 bp, Homo sapiens
ttcaatcctgcaaca

SEQ ID NO: 63990 - DNA, 15 bp, Homo sapiens
attcaatcctgcaac

SEQ ID NO: 63991 - DNA, 15 bp, Homo sapiens
aattcaatcctgcaa

SEQ ID NO: 63992 - DNA, 15 bp, Homo sapiens
gaattcaatcctgca

SEQ ID NO: 63993 - DNA, 15 bp, Homo sapiens
agaattcaatcctgc

SEQ ID NO: 63994 - DNA, 15 bp, Homo sapiens
tagaattcaatcctg

SEQ ID NO: 63995 - DNA, 15 bp, Homo sapiens
ctagaattcaatcct

SEQ ID NO: 63996 - DNA, 15 bp, Homo sapiens
tctagaattcaatcc

SEQ ID NO: 63997 - DNA, 15 bp, Homo sapiens
gtctagaattcaatc

SEQ ID NO: 63998 - DNA, 15 bp, Homo sapiens
agtctagaattcaat

SEQ ID NO: 63999 - DNA, 15 bp, Homo sapiens
aagtctagaattcaa

SEQ ID NO: 64000 - DNA, 15 bp, Homo sapiens
taagtctagaattca

SEQ ID NO: 64001 - DNA, 15 bp, Homo sapiens
ataagtctagaattc

SEQ ID NO: 64002 - DNA, 15 bp, Homo sapiens
aataagtctagaatt

SEQ ID NO: 64003 - DNA, 15 bp, Homo sapiens
aaataagtctagaat

SEQ ID NO: 64004 - DNA, 15 bp, Homo sapiens
aaaataagtctagaa

SEQ ID NO: 64005 - DNA, 15 bp, Homo sapiens
gaaaataagtctaga

SEQ ID NO: 64006 - DNA, 15 bp, Homo sapiens
tgaaaataagtctag

SEQ ID NO: 64007 - DNA, 15 bp, Homo sapiens
atgaaaataagtcta

SEQ ID NO: 64008 - DNA, 15 bp, Homo sapiens
tatgaaaataagtct

SEQ ID NO: 64009 - DNA, 15 bp, Homo sapiens
ctatgaaaataagtc

SEQ ID NO: 64010 - DNA, 15 bp, Homo sapiens
actatgaaaataagt

SEQ ID NO: 64011 - DNA, 15 bp, Homo sapiens
tactatgaaaataag

SEQ ID NO: 64012 - DNA, 15 bp, Homo sapiens
atactatgaaaataa

SEQ ID NO: 64013 - DNA, 15 bp, Homo sapiens
catactatgaaaata

SEQ ID NO: 64014 - DNA, 15 bp, Homo sapiens
tcatactatgaaaat

SEQ ID NO: 64015 - DNA, 15 bp, Homo sapiens
ttcatactatgaaaa

SEQ ID NO: 64016 - DNA, 15 bp, Homo sapiens
attcatactatgaaa

SEQ ID NO: 64017 - DNA, 15 bp, Homo sapiens
tattcatactatgaa

SEQ ID NO: 64018 - DNA, 15 bp, Homo sapiens
ttattcatactatga

SEQ ID NO: 64019 - DNA, 15 bp, Homo sapiens
tttattcatactatg

SEQ ID NO: 64020 - DNA, 15 bp, Homo sapiens
ctttattcatactat

SEQ ID NO: 64021 - DNA, 15 bp, Homo sapiens
actttattcatacta

SEQ ID NO: 64022 - DNA, 15 bp, Homo sapiens
gactttattcatact

SEQ ID NO: 64023 - DNA, 15 bp, Homo sapiens
agactttattcatac

SEQ ID NO: 64024 - DNA, 15 bp, Homo sapiens
cagactttattcata

SEQ ID NO: 64025 - DNA, 15 bp, Homo sapiens
acagactttattcat

SEQ ID NO: 64026 - DNA, 15 bp, Homo sapiens
tacagactttattca

SEQ ID NO: 64027 - DNA, 15 bp, Homo sapiens
atacagactttattc

SEQ ID NO: 64028 - DNA, 15 bp, Homo sapiens
gatacagactttatt

SEQ ID NO: 64029 - DNA, 15 bp, Homo sapiens
agatacagactttat

SEQ ID NO: 64030 - DNA, 15 bp, Homo sapiens
aagatacagacttta

SEQ ID NO: 64031 - DNA, 15 bp, Homo sapiens
aaagatacagacttt

SEQ ID NO: 64032 - DNA, 15 bp, Homo sapiens
taaagatacagactt

SEQ ID NO: 64033 - DNA, 15 bp, Homo sapiens
ataaagatacagact

SEQ ID NO: 64034 - DNA, 15 bp, Homo sapiens
gataaagatacagac

SEQ ID NO: 64035 - DNA, 15 bp, Homo sapiens
agataaagatacaga

SEQ ID NO: 64036 - DNA, 15 bp, Homo sapiens
aagataaagatacag

SEQ ID NO: 64037 - DNA, 15 bp, Homo sapiens
taagataaagataca

SEQ ID NO: 64038 - DNA, 15 bp, Homo sapiens
ttaagataaagatac

SEQ ID NO: 64039 - DNA, 15 bp, Homo sapiens
tttaagataaagata

SEQ ID NO: 64040 - DNA, 15 bp, Homo sapiens
atttaagataaagat

SEQ ID NO: 64041 - DNA, 15 bp, Homo sapiens
catttaagataaaga

SEQ ID NO: 64042 - DNA, 15 bp, Homo sapiens
ccatttaagataaag

SEQ ID NO: 64043 - DNA, 15 bp, Homo sapiens
accatttaagataaa

SEQ ID NO: 64044 - DNA, 15 bp, Homo sapiens
taccatttaagataa

SEQ ID NO: 64045 - DNA, 15 bp, Homo sapiens
ttaccatttaagata

SEQ ID NO: 64046 - DNA, 15 bp, Homo sapiens
gttaccatttaagat

SEQ ID NO: 64047 - DNA, 15 bp, Homo sapiens
tgttaccatttaaga

SEQ ID NO: 64048 - DNA, 15 bp, Homo sapiens
atgttaccatttaag

SEQ ID NO: 64049 - DNA, 15 bp, Homo sapiens
tatgttaccatttaa

SEQ ID NO: 64050 - DNA, 15 bp, Homo sapiens
atatgttaccattta

SEQ ID NO: 64051 - DNA, 15 bp, Homo sapiens
catatgttaccattt

SEQ ID NO: 64052 - DNA, 15 bp, Homo sapiens
ccatatgttaccatt

SEQ ID NO: 64053 - DNA, 15 bp, Homo sapiens
accatatgttaccat

SEQ ID NO: 64054 - DNA, 15 bp, Homo sapiens
taccatatgttacca

SEQ ID NO: 64055 - DNA, 15 bp, Homo sapiens
ctaccatatgttacc

SEQ ID NO: 64056 - DNA, 15 bp, Homo sapiens
gctaccatatgttac

SEQ ID NO: 64057 - DNA, 15 bp, Homo sapiens
agctaccatatgtta

SEQ ID NO: 64058 - DNA, 15 bp, Homo sapiens
aagctaccatatgtt

SEQ ID NO: 64059 - DNA, 15 bp, Homo sapiens
taagctaccatatgt

SEQ ID NO: 64060 - DNA, 15 bp, Homo sapiens
ataagctaccatatg

SEQ ID NO: 64061 - DNA, 15 bp, Homo sapiens
gataagctaccatat

SEQ ID NO: 64062 - DNA, 15 bp, Homo sapiens
agataagctaccata

SEQ ID NO: 64063 - DNA, 15 bp, Homo sapiens
aagataagctaccat

SEQ ID NO: 64064 - DNA, 15 bp, Homo sapiens
aaagataagctacca

SEQ ID NO: 64065 - DNA, 15 bp, Homo sapiens
caaagataagctacc

SEQ ID NO: 64066 - DNA, 15 bp, Homo sapiens
tcaaagataagctac

SEQ ID NO: 64067 - DNA, 15 bp, Homo sapiens
gtcaaagataagcta

SEQ ID NO: 64068 - DNA, 15 bp, Homo sapiens
ggtcaaagataagct

SEQ ID NO: 64069 - DNA, 15 bp, Homo sapiens
tggtcaaagataagc

SEQ ID NO: 64070 - DNA, 15 bp, Homo sapiens
atggtcaaagataag

SEQ ID NO: 64071 - DNA, 15 bp, Homo sapiens
aatggtcaaagataa

SEQ ID NO: 64072 - DNA, 15 bp, Homo sapiens
aaatggtcaaagata

SEQ ID NO: 64073 - DNA, 15 bp, Homo sapiens
aaaatggtcaaagat

SEQ ID NO: 64074 - DNA, 15 bp, Homo sapiens
caaaatggtcaaaga

SEQ ID NO: 64075 - DNA, 15 bp, Homo sapiens
ccaaaatggtcaaag

SEQ ID NO: 64076 - DNA, 15 bp, Homo sapiens
cccaaaatggtcaaa

SEQ ID NO: 64077 - DNA, 15 bp, Homo sapiens
ccccaaaatggtcaa

SEQ ID NO: 64078 - DNA, 15 bp, Homo sapiens
tccccaaaatggtca

SEQ ID NO: 64079 - DNA, 15 bp, Homo sapiens
ctccccaaaatggtc

SEQ ID NO: 64080 - DNA, 15 bp, Homo sapiens
cctccccaaaatggt

SEQ ID NO: 64081 - DNA, 15 bp, Homo sapiens
gcctccccaaaatgg

SEQ ID NO: 64082 - DNA, 15 bp, Homo sapiens
agcctccccaaaatg

SEQ ID NO: 64083 - DNA, 15 bp, Homo sapiens
aagcctccccaaaat

SEQ ID NO: 64084 - DNA, 15 bp, Homo sapiens
aaagcctccccaaaa

SEQ ID NO: 64085 - DNA, 15 bp, Homo sapiens
aaaagcctccccaaa

SEQ ID NO: 64086 - DNA, 15 bp, Homo sapiens
taaaagcctccccaa

SEQ ID NO: 64087 - DNA, 15 bp, Homo sapiens
ctaaaagcctcccca

SEQ ID NO: 64088 - DNA, 15 bp, Homo sapiens
cctaaaagcctcccc

SEQ ID NO: 64089 - DNA, 15 bp, Homo sapiens
ccctaaaagcctccc

SEQ ID NO: 64090 - DNA, 15 bp, Homo sapiens
tccctaaaagcctcc

SEQ ID NO: 64091 - DNA, 15 bp, Homo sapiens
ttccctaaaagcctc

SEQ ID NO: 64092 - DNA, 15 bp, Homo sapiens
cttccctaaaagcct

SEQ ID NO: 64093 - DNA, 15 bp, Homo sapiens
tcttccctaaaagcc

SEQ ID NO: 64094 - DNA, 15 bp, Homo sapiens
gtcttccctaaaagc

SEQ ID NO: 64095 - DNA, 15 bp, Homo sapiens
agtcttccctaaaag

SEQ ID NO: 64096 - DNA, 15 bp, Homo sapiens
aagtcttccctaaaa

SEQ ID NO: 64097 - DNA, 15 bp, Homo sapiens
aaagtcttccctaaa

SEQ ID NO: 64098 - DNA, 15 bp, Homo sapiens
taaagtcttccctaa

SEQ ID NO: 64099 - DNA, 15 bp, Homo sapiens
ttaaagtcttcccta

SEQ ID NO: 64100 - DNA, 15 bp, Homo sapiens
tttaaagtcttccct

SEQ ID NO: 64101 - DNA, 15 bp, Homo sapiens
ttttaaagtcttccc

SEQ ID NO: 64102 - DNA, 15 bp, Homo sapiens
tttttaaagtcttcc

SEQ ID NO: 64103 - DNA, 15 bp, Homo sapiens
ttttttaaagtcttc

SEQ ID NO: 64104 - DNA, 15 bp, Homo sapiens
attttttaaagtctt

SEQ ID NO: 64105 - DNA, 15 bp, Homo sapiens
cattttttaaagtct

SEQ ID NO: 64106 - DNA, 15 bp, Homo sapiens
tcattttttaaagtc

SEQ ID NO: 64107 - DNA, 15 bp, Homo sapiens
ctcattttttaaagt

SEQ ID NO: 64108 - DNA, 15 bp, Homo sapiens
tctcattttttaaag

SEQ ID NO: 64109 - DNA, 15 bp, Homo sapiens
atctcattttttaaa

SEQ ID NO: 64110 - DNA, 15 bp, Homo sapiens
tatctcattttttaa

SEQ ID NO: 64111 - DNA, 15 bp, Homo sapiens
gtatctcatttttta

SEQ ID NO: 64112 - DNA, 15 bp, Homo sapiens
agtatctcatttttt

SEQ ID NO: 64113 - DNA, 15 bp, Homo sapiens
cagtatctcattttt

SEQ ID NO: 64114 - DNA, 15 bp, Homo sapiens
tcagtatctcatttt

SEQ ID NO: 64115 - DNA, 15 bp, Homo sapiens
ttcagtatctcattt

SEQ ID NO: 64116 - DNA, 15 bp, Homo sapiens
gttcagtatctcatt

SEQ ID NO: 64117 - DNA, 15 bp, Homo sapiens
tgttcagtatctcat

SEQ ID NO: 64118 - DNA, 15 bp, Homo sapiens
ttgttcagtatctca

SEQ ID NO: 64119 - DNA, 15 bp, Homo sapiens
tttgttcagtatctc

SEQ ID NO: 64120 - DNA, 15 bp, Homo sapiens
ttttgttcagtatct

SEQ ID NO: 64121 - DNA, 15 bp, Homo sapiens
tttttgttcagtatc

SEQ ID NO: 64122 - DNA, 15 bp, Homo sapiens
atttttgttcagtat

SEQ ID NO: 64123 - DNA, 15 bp, Homo sapiens
tatttttgttcagta

SEQ ID NO: 64124 - DNA, 15 bp, Homo sapiens
ttatttttgttcagt

SEQ ID NO: 64125 - DNA, 15 bp, Homo sapiens
cttatttttgttcag

SEQ ID NO: 64126 - DNA, 15 bp, Homo sapiens
acttatttttgttca

SEQ ID NO: 64127 - DNA, 15 bp, Homo sapiens
tacttatttttgttc

SEQ ID NO: 64128 - DNA, 15 bp, Homo sapiens
ttacttatttttgtt

SEQ ID NO: 64129 - DNA, 15 bp, Homo sapiens
attacttatttttgt

SEQ ID NO: 64130 - DNA, 15 bp, Homo sapiens
gattacttatttttg

SEQ ID NO: 64131 - DNA, 15 bp, Homo sapiens
ggattacttattttt

SEQ ID NO: 64132 - DNA, 15 bp, Homo sapiens
gggattacttatttt

SEQ ID NO: 64133 - DNA, 15 bp, Homo sapiens
agggattacttattt

SEQ ID NO: 64134 - DNA, 15 bp, Homo sapiens
aagggattacttatt

SEQ ID NO: 64135 - DNA, 15 bp, Homo sapiens
aaagggattacttat

SEQ ID NO: 64136 - DNA, 15 bp, Homo sapiens
aaaagggattactta

SEQ ID NO: 64137 - DNA, 15 bp, Homo sapiens
caaaagggattactt

SEQ ID NO: 64138 - DNA, 15 bp, Homo sapiens
gcaaaagggattact

SEQ ID NO: 64139 - DNA, 15 bp, Homo sapiens
ggcaaaagggattac

SEQ ID NO: 64140 - DNA, 15 bp, Homo sapiens
aggcaaaagggatta

SEQ ID NO: 64141 - DNA, 15 bp, Homo sapiens
aaggcaaaagggatt

SEQ ID NO: 64142 - DNA, 15 bp, Homo sapiens
aaaggcaaaagggat

SEQ ID NO: 64143 - DNA, 15 bp, Homo sapiens
caaaggcaaaaggga

SEQ ID NO: 64144 - DNA, 15 bp, Homo sapiens
acaaaggcaaaaggg

SEQ ID NO: 64145 - DNA, 15 bp, Homo sapiens
gacaaaggcaaaagg

SEQ ID NO: 64146 - DNA, 15 bp, Homo sapiens
agacaaaggcaaaag

SEQ ID NO: 64147 - DNA, 15 bp, Homo sapiens
gagacaaaggcaaaa

SEQ ID NO: 64148 - DNA, 15 bp, Homo sapiens
tgagacaaaggcaaa

SEQ ID NO: 64149 - DNA, 15 bp, Homo sapiens
atgagacaaaggcaa

SEQ ID NO: 64150 - DNA, 15 bp, Homo sapiens
tatgagacaaaggca

SEQ ID NO: 64151 - DNA, 15 bp, Homo sapiens
atatgagacaaaggc

SEQ ID NO: 64152 - DNA, 15 bp, Homo sapiens
tatatgagacaaagg

SEQ ID NO: 64153 - DNA, 15 bp, Homo sapiens
atatatgagacaaag

SEQ ID NO: 64154 - DNA, 15 bp, Homo sapiens
aatatatgagacaaa

SEQ ID NO: 64155 - DNA, 15 bp, Homo sapiens
taatatatgagacaa

SEQ ID NO: 64156 - DNA, 15 bp, Homo sapiens
ataatatatgagaca

SEQ ID NO: 64157 - DNA, 15 bp, Homo sapiens
cataatatatgagac

SEQ ID NO: 64158 - DNA, 15 bp, Homo sapiens
tcataatatatgaga

SEQ ID NO: 64159 - DNA, 15 bp, Homo sapiens
ttcataatatatgag

SEQ ID NO: 64160 - DNA, 15 bp, Homo sapiens
cttcataatatatga

SEQ ID NO: 64161 - DNA, 15 bp, Homo sapiens
acttcataatatatg

SEQ ID NO: 64162 - DNA, 15 bp, Homo sapiens
cacttcataatatat

SEQ ID NO: 64163 - DNA, 15 bp, Homo sapiens
ccacttcataatata

SEQ ID NO: 64164 - DNA, 15 bp, Homo sapiens
gccacttcataatat

SEQ ID NO: 64165 - DNA, 15 bp, Homo sapiens
tgccacttcataata

SEQ ID NO: 64166 - DNA, 15 bp, Homo sapiens
ttgccacttcataat

SEQ ID NO: 64167 - DNA, 15 bp, Homo sapiens
attgccacttcataa

SEQ ID NO: 64168 - DNA, 15 bp, Homo sapiens
aattgccacttcata

SEQ ID NO: 64169 - DNA, 15 bp, Homo sapiens
aaattgccacttcat

SEQ ID NO: 64170 - DNA, 15 bp, Homo sapiens
taaattgccacttca

SEQ ID NO: 64171 - DNA, 15 bp, Homo sapiens
gtaaattgccacttc

SEQ ID NO: 64172 - DNA, 15 bp, Homo sapiens
agtaaattgccactt

SEQ ID NO: 64173 - DNA, 15 bp, Homo sapiens
cagtaaattgccact

SEQ ID NO: 64174 - DNA, 15 bp, Homo sapiens
ccagtaaattgccac

SEQ ID NO: 64175 - DNA, 15 bp, Homo sapiens
accagtaaattgcca

SEQ ID NO: 64176 - DNA, 15 bp, Homo sapiens
taccagtaaattgcc

SEQ ID NO: 64177 - DNA, 15 bp, Homo sapiens
ataccagtaaattgc

SEQ ID NO: 64178 - DNA, 15 bp, Homo sapiens
aataccagtaaattg

SEQ ID NO: 64179 - DNA, 15 bp, Homo sapiens
caataccagtaaatt

SEQ ID NO: 64180 - DNA, 15 bp, Homo sapiens
gcaataccagtaaat

SEQ ID NO: 64181 - DNA, 15 bp, Homo sapiens
tgcaataccagtaaa

SEQ ID NO: 64182 - DNA, 15 bp, Homo sapiens
ttgcaataccagtaa

SEQ ID NO: 64183 - DNA, 15 bp, Homo sapiens
tttgcaataccagta

SEQ ID NO: 64184 - DNA, 15 bp, Homo sapiens
ctttgcaataccagt

SEQ ID NO: 64185 - DNA, 15 bp, Homo sapiens
tctttgcaataccag

SEQ ID NO: 64186 - DNA, 15 bp, Homo sapiens
atctttgcaatacca

SEQ ID NO: 64187 - DNA, 15 bp, Homo sapiens
aatctttgcaatacc

SEQ ID NO: 64188 - DNA, 15 bp, Homo sapiens
taatctttgcaatac

SEQ ID NO: 64189 - DNA, 15 bp, Homo sapiens
ataatctttgcaata

SEQ ID NO: 64190 - DNA, 15 bp, Homo sapiens
tataatctttgcaat

SEQ ID NO: 64191 - DNA, 15 bp, Homo sapiens
atataatctttgcaa

SEQ ID NO: 64192 - DNA, 15 bp, Homo sapiens
tatataatctttgca

SEQ ID NO: 64193 - DNA, 15 bp, Homo sapiens
atatataatctttgc

SEQ ID NO: 64194 - DNA, 15 bp, Homo sapiens
aatatataatctttg

SEQ ID NO: 64195 - DNA, 15 bp, Homo sapiens
taatatataatcttt

SEQ ID NO: 64196 - DNA, 15 bp, Homo sapiens
ctaatatataatctt

SEQ ID NO: 64197 - DNA, 15 bp, Homo sapiens
cctaatatataatct

SEQ ID NO: 64198 - DNA, 15 bp, Homo sapiens
acctaatatataatc

SEQ ID NO: 64199 - DNA, 15 bp, Homo sapiens
tacctaatatataat

SEQ ID NO: 64200 - DNA, 15 bp, Homo sapiens
atacctaatatataa

SEQ ID NO: 64201 - DNA, 15 bp, Homo sapiens
aatacctaatatata

SEQ ID NO: 64202 - DNA, 15 bp, Homo sapiens
caatacctaatatat

SEQ ID NO: 64203 - DNA, 15 bp, Homo sapiens
acaatacctaatata

SEQ ID NO: 64204 - DNA, 15 bp, Homo sapiens
aacaatacctaatat

SEQ ID NO: 64205 - DNA, 15 bp, Homo sapiens
aaacaatacctaata

SEQ ID NO: 64206 - DNA, 15 bp, Homo sapiens
taaacaatacctaat

SEQ ID NO: 64207 - DNA, 15 bp, Homo sapiens
ataaacaatacctaa

SEQ ID NO: 64208 - DNA, 15 bp, Homo sapiens
cataaacaataccta

SEQ ID NO: 64209 - DNA, 15 bp, Homo sapiens
ccataaacaatacct

SEQ ID NO: 64210 - DNA, 15 bp, Homo sapiens
cccataaacaatacc

SEQ ID NO: 64211 - DNA, 15 bp, Homo sapiens
acccataaacaatac

SEQ ID NO: 64212 - DNA, 15 bp, Homo sapiens
tacccataaacaata

SEQ ID NO: 64213 - DNA, 15 bp, Homo sapiens
gtacccataaacaat

SEQ ID NO: 64214 - DNA, 15 bp, Homo sapiens
agtacccataaacaa

SEQ ID NO: 64215 - DNA, 15 bp, Homo sapiens
tagtacccataaaca

SEQ ID NO: 64216 - DNA, 15 bp, Homo sapiens
ttagtacccataaac

SEQ ID NO: 64217 - DNA, 15 bp, Homo sapiens
cttagtacccataaa

SEQ ID NO: 64218 - DNA, 15 bp, Homo sapiens
ccttagtacccataa

SEQ ID NO: 64219 - DNA, 15 bp, Homo sapiens
tccttagtacccata

SEQ ID NO: 64220 - DNA, 15 bp, Homo sapiens
ctccttagtacccat

SEQ ID NO: 64221 - DNA, 15 bp, Homo sapiens
tctccttagtaccca

SEQ ID NO: 64222 - DNA, 15 bp, Homo sapiens
ctctccttagtaccc

SEQ ID NO: 64223 - DNA, 15 bp, Homo sapiens
actctccttagtacc

SEQ ID NO: 64224 - DNA, 15 bp, Homo sapiens
aactctccttagtac

SEQ ID NO: 64225 - DNA, 15 bp, Homo sapiens
taactctccttagta

SEQ ID NO: 64226 - DNA, 15 bp, Homo sapiens
ataactctccttagt

SEQ ID NO: 64227 - DNA, 15 bp, Homo sapiens
aataactctccttag

SEQ ID NO: 64228 - DNA, 15 bp, Homo sapiens
aaataactctcctta

SEQ ID NO: 64229 - DNA, 15 bp, Homo sapiens
aaaataactctcctt

SEQ ID NO: 64230 - DNA, 15 bp, Homo sapiens
taaaataactctcct

SEQ ID NO: 64231 - DNA, 15 bp, Homo sapiens
ataaaataactctcc

SEQ ID NO: 64232 - DNA, 15 bp, Homo sapiens
tataaaataactctc

SEQ ID NO: 64233 - DNA, 15 bp, Homo sapiens
atataaaataactct

SEQ ID NO: 64234 - DNA, 15 bp, Homo sapiens
gatataaaataactc

SEQ ID NO: 64235 - DNA, 15 bp, Homo sapiens
agatataaaataact

SEQ ID NO: 64236 - DNA, 15 bp, Homo sapiens
tagatataaaataac

SEQ ID NO: 64237 - DNA, 15 bp, Homo sapiens
ttagatataaaataa

SEQ ID NO: 64238 - DNA, 15 bp, Homo sapiens
attagatataaaata

SEQ ID NO: 64239 - DNA, 15 bp, Homo sapiens
tattagatataaaat

SEQ ID NO: 64240 - DNA, 15 bp, Homo sapiens
atattagatataaaa

SEQ ID NO: 64241 - DNA, 15 bp, Homo sapiens
aatattagatataaa

SEQ ID NO: 64242 - DNA, 15 bp, Homo sapiens
caatattagatataa

SEQ ID NO: 64243 - DNA, 15 bp, Homo sapiens
tcaatattagatata

SEQ ID NO: 64244 - DNA, 15 bp, Homo sapiens
ctcaatattagatat

SEQ ID NO: 64245 - DNA, 15 bp, Homo sapiens
gctcaatattagata

SEQ ID NO: 64246 - DNA, 15 bp, Homo sapiens
tgctcaatattagat

SEQ ID NO: 64247 - DNA, 15 bp, Homo sapiens
ttgctcaatattaga

SEQ ID NO: 64248 - DNA, 15 bp, Homo sapiens
attgctcaatattag

SEQ ID NO: 64249 - DNA, 15 bp, Homo sapiens
aattgctcaatatta

SEQ ID NO: 64250 - DNA, 15 bp, Homo sapiens
gaattgctcaatatt

SEQ ID NO: 64251 - DNA, 15 bp, Homo sapiens
tgaattgctcaatat

SEQ ID NO: 64252 - DNA, 15 bp, Homo sapiens
gtgaattgctcaata

SEQ ID NO: 64253 - DNA, 15 bp, Homo sapiens
tgtgaattgctcaat

SEQ ID NO: 64254 - DNA, 15 bp, Homo sapiens
atgtgaattgctcaa

SEQ ID NO: 64255 - DNA, 15 bp, Homo sapiens
tatgtgaattgctca

SEQ ID NO: 64256 - DNA, 15 bp, Homo sapiens
atatgtgaattgctc

SEQ ID NO: 64257 - DNA, 15 bp, Homo sapiens
aatatgtgaattgct

SEQ ID NO: 64258 - DNA, 15 bp, Homo sapiens
aaatatgtgaattgc

SEQ ID NO: 64259 - DNA, 15 bp, Homo sapiens
aaaatatgtgaattg

SEQ ID NO: 64260 - DNA, 15 bp, Homo sapiens
caaaatatgtgaatt

SEQ ID NO: 64261 - DNA, 15 bp, Homo sapiens
ccaaaatatgtgaat

SEQ ID NO: 64262 - DNA, 15 bp, Homo sapiens
tccaaaatatgtgaa

SEQ ID NO: 64263 - DNA, 15 bp, Homo sapiens
gtccaaaatatgtga

SEQ ID NO: 64264 - DNA, 15 bp, Homo sapiens
tgtccaaaatatgtg

SEQ ID NO: 64265 - DNA, 15 bp, Homo sapiens
gtgtccaaaatatgt

SEQ ID NO: 64266 - DNA, 15 bp, Homo sapiens
ggtgtccaaaatatg

SEQ ID NO: 64267 - DNA, 15 bp, Homo sapiens
aggtgtccaaaatat

SEQ ID NO: 64268 - DNA, 15 bp, Homo sapiens
taggtgtccaaaata

SEQ ID NO: 64269 - DNA, 15 bp, Homo sapiens
ttaggtgtccaaaat

SEQ ID NO: 64270 - DNA, 15 bp, Homo sapiens
attaggtgtccaaaa

SEQ ID NO: 64271 - DNA, 15 bp, Homo sapiens
aattaggtgtccaaa

SEQ ID NO: 64272 - DNA, 15 bp, Homo sapiens
aaattaggtgtccaa

SEQ ID NO: 64273 - DNA, 15 bp, Homo sapiens
taaattaggtgtcca

SEQ ID NO: 64274 - DNA, 15 bp, Homo sapiens
ttaaattaggtgtcc

SEQ ID NO: 64275 - DNA, 15 bp, Homo sapiens
cttaaattaggtgtc

SEQ ID NO: 64276 - DNA, 15 bp, Homo sapiens
gcttaaattaggtgt

SEQ ID NO: 64277 - DNA, 15 bp, Homo sapiens
agcttaaattaggtg

SEQ ID NO: 64278 - DNA, 15 bp, Homo sapiens
cagcttaaattaggt

SEQ ID NO: 64279 - DNA, 15 bp, Homo sapiens
ccagcttaaattagg

SEQ ID NO: 64280 - DNA, 15 bp, Homo sapiens
accagcttaaattag

SEQ ID NO: 64281 - DNA, 15 bp, Homo sapiens
aaccagcttaaatta

SEQ ID NO: 64282 - DNA, 15 bp, Homo sapiens
gaaccagcttaaatt

SEQ ID NO: 64283 - DNA, 15 bp, Homo sapiens
agaaccagcttaaat

SEQ ID NO: 64284 - DNA, 15 bp, Homo sapiens
aagaaccagcttaaa

SEQ ID NO: 64285 - DNA, 15 bp, Homo sapiens
taagaaccagcttaa

SEQ ID NO: 64286 - DNA, 15 bp, Homo sapiens
ataagaaccagctta

SEQ ID NO: 64287 - DNA, 15 bp, Homo sapiens
tataagaaccagctt

SEQ ID NO: 64288 - DNA, 15 bp, Homo sapiens
atataagaaccagct

SEQ ID NO: 64289 - DNA, 15 bp, Homo sapiens
aatataagaaccagc

SEQ ID NO: 64290 - DNA, 15 bp, Homo sapiens
gaatataagaaccag

SEQ ID NO: 64291 - DNA, 15 bp, Homo sapiens
agaatataagaacca

SEQ ID NO: 64292 - DNA, 15 bp, Homo sapiens
aagaatataagaacc

SEQ ID NO: 64293 - DNA, 15 bp, Homo sapiens
gaagaatataagaac

SEQ ID NO: 64294 - DNA, 15 bp, Homo sapiens
ggaagaatataagaa

SEQ ID NO: 64295 - DNA, 15 bp, Homo sapiens
tggaagaatataaga

SEQ ID NO: 64296 - DNA, 15 bp, Homo sapiens
gtggaagaatataag

SEQ ID NO: 64297 - DNA, 15 bp, Homo sapiens
agtggaagaatataa

SEQ ID NO: 64298 - DNA, 15 bp, Homo sapiens
aagtggaagaatata

SEQ ID NO: 64299 - DNA, 15 bp, Homo sapiens
aaagtggaagaatat

SEQ ID NO: 64300 - DNA, 15 bp, Homo sapiens
aaaagtggaagaata

SEQ ID NO: 64301 - DNA, 15 bp, Homo sapiens
taaaagtggaagaat

SEQ ID NO: 64302 - DNA, 15 bp, Homo sapiens
ctaaaagtggaagaa

SEQ ID NO: 64303 - DNA, 15 bp, Homo sapiens
tctaaaagtggaaga

SEQ ID NO: 64304 - DNA, 15 bp, Homo sapiens
atctaaaagtggaag

SEQ ID NO: 64305 - DNA, 15 bp, Homo sapiens
catctaaaagtggaa

SEQ ID NO: 64306 - DNA, 15 bp, Homo sapiens
acatctaaaagtgga

SEQ ID NO: 64307 - DNA, 15 bp, Homo sapiens
aacatctaaaagtgg

SEQ ID NO: 64308 - DNA, 15 bp, Homo sapiens
caacatctaaaagtg

SEQ ID NO: 64309 - DNA, 15 bp, Homo sapiens
gcaacatctaaaagt

SEQ ID NO: 64310 - DNA, 15 bp, Homo sapiens
ggcaacatctaaaag

SEQ ID NO: 64311 - DNA, 15 bp, Homo sapiens
cggcaacatctaaaa

SEQ ID NO: 64312 - DNA, 15 bp, Homo sapiens
acggcaacatctaaa

SEQ ID NO: 64313 - DNA, 15 bp, Homo sapiens
aacggcaacatctaa

SEQ ID NO: 64314 - DNA, 15 bp, Homo sapiens
gaacggcaacatcta

SEQ ID NO: 64315 - DNA, 15 bp, Homo sapiens
tgaacggcaacatct

SEQ ID NO: 64316 - DNA, 15 bp, Homo sapiens
ctgaacggcaacatc

SEQ ID NO: 64317 - DNA, 15 bp, Homo sapiens
gctgaacggcaacat

SEQ ID NO: 64318 - DNA, 15 bp, Homo sapiens
agctgaacggcaaca

SEQ ID NO: 64319 - DNA, 15 bp, Homo sapiens
aagctgaacggcaac

SEQ ID NO: 64320 - DNA, 15 bp, Homo sapiens
gaagctgaacggcaa

SEQ ID NO: 64321 - DNA, 15 bp, Homo sapiens
ggaagctgaacggca

SEQ ID NO: 64322 - DNA, 15 bp, Homo sapiens
aggaagctgaacggc

SEQ ID NO: 64323 - DNA, 15 bp, Homo sapiens
caggaagctgaacgg

SEQ ID NO: 64324 - DNA, 15 bp, Homo sapiens
tcaggaagctgaacg

SEQ ID NO: 64325 - DNA, 15 bp, Homo sapiens
gtcaggaagctgaac

SEQ ID NO: 64326 - DNA, 15 bp, Homo sapiens
tgtcaggaagctgaa

SEQ ID NO: 64327 - DNA, 15 bp, Homo sapiens
ttgtcaggaagctga

SEQ ID NO: 64328 - DNA, 15 bp, Homo sapiens
cttgtcaggaagctg

SEQ ID NO: 64329 - DNA, 15 bp, Homo sapiens
tcttgtcaggaagct

SEQ ID NO: 64330 - DNA, 15 bp, Homo sapiens
ttcttgtcaggaagc

SEQ ID NO: 64331 - DNA, 15 bp, Homo sapiens
tttcttgtcaggaag

SEQ ID NO: 64332 - DNA, 15 bp, Homo sapiens
atttcttgtcaggaa

SEQ ID NO: 64333 - DNA, 15 bp, Homo sapiens
gatttcttgtcagga

SEQ ID NO: 64334 - DNA, 15 bp, Homo sapiens
ggatttcttgtcagg

SEQ ID NO: 64335 - DNA, 15 bp, Homo sapiens
tggatttcttgtcag

SEQ ID NO: 64336 - DNA, 15 bp, Homo sapiens
atggatttcttgtca

SEQ ID NO: 64337 - DNA, 15 bp, Homo sapiens
tatggatttcttgtc

SEQ ID NO: 64338 - DNA, 15 bp, Homo sapiens
ttatggatttcttgt

SEQ ID NO: 64339 - DNA, 15 bp, Homo sapiens
attatggatttcttg

SEQ ID NO: 64340 - DNA, 15 bp, Homo sapiens
aattatggatttctt

SEQ ID NO: 64341 - DNA, 15 bp, Homo sapiens
taattatggatttct

SEQ ID NO: 64342 - DNA, 15 bp, Homo sapiens
ataattatggatttc

SEQ ID NO: 64343 - DNA, 15 bp, Homo sapiens
cataattatggattt

SEQ ID NO: 64344 - DNA, 15 bp, Homo sapiens
acataattatggatt

SEQ ID NO: 64345 - DNA, 15 bp, Homo sapiens
tacataattatggat

SEQ ID NO: 64346 - DNA, 15 bp, Homo sapiens
atacataattatgga

SEQ ID NO: 64347 - DNA, 15 bp, Homo sapiens
aatacataattatgg

SEQ ID NO: 64348 - DNA, 15 bp, Homo sapiens
aaatacataattatg

SEQ ID NO: 64349 - DNA, 15 bp, Homo sapiens
taaatacataattat

SEQ ID NO: 64350 - DNA, 15 bp, Homo sapiens
ttaaatacataatta

SEQ ID NO: 64351 - DNA, 15 bp, Homo sapiens
gttaaatacataatt

SEQ ID NO: 64352 - DNA, 15 bp, Homo sapiens
tgttaaatacataat

SEQ ID NO: 64353 - DNA, 15 bp, Homo sapiens
atgttaaatacataa

SEQ ID NO: 64354 - DNA, 15 bp, Homo sapiens
gatgttaaatacata

SEQ ID NO: 64355 - DNA, 15 bp, Homo sapiens
agatgttaaatacat

SEQ ID NO: 64356 - DNA, 15 bp, Homo sapiens
aagatgttaaataca

SEQ ID NO: 64357 - DNA, 15 bp, Homo sapiens
aaagatgttaaatac

SEQ ID NO: 64358 - DNA, 15 bp, Homo sapiens
caaagatgttaaata

SEQ ID NO: 64359 - DNA, 15 bp, Homo sapiens
acaaagatgttaaat

SEQ ID NO: 64360 - DNA, 15 bp, Homo sapiens
aacaaagatgttaaa

SEQ ID NO: 64361 - DNA, 15 bp, Homo sapiens
aaacaaagatgttaa

SEQ ID NO: 64362 - DNA, 15 bp, Homo sapiens
caaacaaagatgtta

SEQ ID NO: 64363 - DNA, 15 bp, Homo sapiens
tcaaacaaagatgtt

SEQ ID NO: 64364 - DNA, 15 bp, Homo sapiens
ctcaaacaaagatgt

SEQ ID NO: 64365 - DNA, 15 bp, Homo sapiens
cctcaaacaaagatg

SEQ ID NO: 64366 - DNA, 15 bp, Homo sapiens
acctcaaacaaagat

SEQ ID NO: 64367 - DNA, 15 bp, Homo sapiens
cacctcaaacaaaga

SEQ ID NO: 64368 - DNA, 15 bp, Homo sapiens
gcacctcaaacaaag

SEQ ID NO: 64369 - DNA, 15 bp, Homo sapiens
agcacctcaaacaaa

SEQ ID NO: 64370 - DNA, 15 bp, Homo sapiens
tagcacctcaaacaa

SEQ ID NO: 64371 - DNA, 15 bp, Homo sapiens
gtagcacctcaaaca

SEQ ID NO: 64372 - DNA, 15 bp, Homo sapiens
ggtagcacctcaaac

SEQ ID NO: 64373 - DNA, 15 bp, Homo sapiens
aggtagcacctcaaa

SEQ ID NO: 64374 - DNA, 15 bp, Homo sapiens
gaggtagcacctcaa

SEQ ID NO: 64375 - DNA, 15 bp, Homo sapiens
tgaggtagcacctca

SEQ ID NO: 64376 - DNA, 15 bp, Homo sapiens
ctgaggtagcacctc

SEQ ID NO: 64377 - DNA, 15 bp, Homo sapiens
gctgaggtagcacct

SEQ ID NO: 64378 - DNA, 15 bp, Homo sapiens
tgctgaggtagcacc

SEQ ID NO: 64379 - DNA, 15 bp, Homo sapiens
ttgctgaggtagcac

SEQ ID NO: 64380 - DNA, 15 bp, Homo sapiens
cttgctgaggtagca

SEQ ID NO: 64381 - DNA, 15 bp, Homo sapiens
acttgctgaggtagc

SEQ ID NO: 64382 - DNA, 15 bp, Homo sapiens
gacttgctgaggtag

SEQ ID NO: 64383 - DNA, 15 bp, Homo sapiens
tgacttgctgaggta

SEQ ID NO: 64384 - DNA, 15 bp, Homo sapiens
gtgacttgctgaggt

SEQ ID NO: 64385 - DNA, 15 bp, Homo sapiens
ggtgacttgctgagg

SEQ ID NO: 64386 - DNA, 15 bp, Homo sapiens
tggtgacttgctgag

SEQ ID NO: 64387 - DNA, 15 bp, Homo sapiens
atggtgacttgctga

SEQ ID NO: 64388 - DNA, 15 bp, Homo sapiens
tatggtgacttgctg

SEQ ID NO: 64389 - DNA, 15 bp, Homo sapiens
ctatggtgacttgct

SEQ ID NO: 64390 - DNA, 15 bp, Homo sapiens
tctatggtgacttgc

SEQ ID NO: 64391 - DNA, 15 bp, Homo sapiens
gtctatggtgacttg

SEQ ID NO: 64392 - DNA, 15 bp, Homo sapiens
cgtctatggtgactt

SEQ ID NO: 64393 - DNA, 15 bp, Homo sapiens
gcgtctatggtgact

SEQ ID NO: 64394 - DNA, 15 bp, Homo sapiens
ggcgtctatggtgac

SEQ ID NO: 64395 - DNA, 15 bp, Homo sapiens
tggcgtctatggtga

SEQ ID NO: 64396 - DNA, 15 bp, Homo sapiens
atggcgtctatggtg

SEQ ID NO: 64397 - DNA, 15 bp, Homo sapiens
gatggcgtctatggt

SEQ ID NO: 64398 - DNA, 15 bp, Homo sapiens
ggatggcgtctatgg

SEQ ID NO: 64399 - DNA, 15 bp, Homo sapiens
cggatggcgtctatg

SEQ ID NO: 64400 - DNA, 15 bp, Homo sapiens
acggatggcgtctat

SEQ ID NO: 64401 - DNA, 15 bp, Homo sapiens
cacggatggcgtcta

SEQ ID NO: 64402 - DNA, 15 bp, Homo sapiens
tcacggatggcgtct

SEQ ID NO: 64403 - DNA, 15 bp, Homo sapiens
ctcacggatggcgtc

SEQ ID NO: 64404 - DNA, 15 bp, Homo sapiens
cctcacggatggcgt

SEQ ID NO: 64405 - DNA, 15 bp, Homo sapiens
acctcacggatggcg

SEQ ID NO: 64406 - DNA, 15 bp, Homo sapiens
tacctcacggatggc

SEQ ID NO: 64407 - DNA, 15 bp, Homo sapiens
ctacctcacggatgg

SEQ ID NO: 64408 - DNA, 15 bp, Homo sapiens
tctacctcacggatg

SEQ ID NO: 64409 - DNA, 15 bp, Homo sapiens
ctctacctcacggat

SEQ ID NO: 64410 - DNA, 15 bp, Homo sapiens
tctctacctcacgga

SEQ ID NO: 64411 - DNA, 15 bp, Homo sapiens
gtctctacctcacgg

SEQ ID NO: 64412 - DNA, 15 bp, Homo sapiens
tgtctctacctcacg

SEQ ID NO: 64413 - DNA, 15 bp, Homo sapiens
gtgtctctacctcac

SEQ ID NO: 64414 - DNA, 15 bp, Homo sapiens
agtgtctctacctca

SEQ ID NO: 64415 - DNA, 15 bp, Homo sapiens
gagtgtctctacctc

SEQ ID NO: 64416 - DNA, 15 bp, Homo sapiens
ggagtgtctctacct

SEQ ID NO: 64417 - DNA, 15 bp, Homo sapiens
gggagtgtctctacc

SEQ ID NO: 64418 - DNA, 15 bp, Homo sapiens
tgggagtgtctctac

SEQ ID NO: 64419 - DNA, 15 bp, Homo sapiens
ttgggagtgtctcta

SEQ ID NO: 64420 - DNA, 15 bp, Homo sapiens
cttgggagtgtctct

SEQ ID NO: 64421 - DNA, 15 bp, Homo sapiens
ccttgggagtgtctc

SEQ ID NO: 64422 - DNA, 15 bp, Homo sapiens
tccttgggagtgtct

SEQ ID NO: 64423 - DNA, 15 bp, Homo sapiens
ttccttgggagtgtc

SEQ ID NO: 64424 - DNA, 15 bp, Homo sapiens
tttccttgggagtgt

SEQ ID NO: 64425 - DNA, 15 bp, Homo sapiens
atttccttgggagtg

SEQ ID NO: 64426 - DNA, 15 bp, Homo sapiens
tatttccttgggagt

SEQ ID NO: 64427 - DNA, 15 bp, Homo sapiens
atatttccttgggag

SEQ ID NO: 64428 - DNA, 15 bp, Homo sapiens
tatatttccttggga

SEQ ID NO: 64429 - DNA, 15 bp, Homo sapiens
ttatatttccttggg

SEQ ID NO: 64430 - DNA, 15 bp, Homo sapiens
tttatatttccttgg

SEQ ID NO: 64431 - DNA, 15 bp, Homo sapiens
ttttatatttccttg

SEQ ID NO: 64432 - DNA, 15 bp, Homo sapiens
tttttatatttcctt

SEQ ID NO: 64433 - DNA, 15 bp, Homo sapiens
ttttttatatttcct

SEQ ID NO: 64434 - DNA, 15 bp, Homo sapiens
cttttttatatttcc

SEQ ID NO: 64435 - DNA, 15 bp, Homo sapiens
tcttttttatatttc

SEQ ID NO: 64436 - DNA, 15 bp, Homo sapiens
ttcttttttatattt

SEQ ID NO: 64437 - DNA, 15 bp, Homo sapiens
attcttttttatatt

SEQ ID NO: 64438 - DNA, 15 bp, Homo sapiens
cattcttttttatat

SEQ ID NO: 64439 - DNA, 15 bp, Homo sapiens
acattcttttttata

SEQ ID NO: 64440 - DNA, 15 bp, Homo sapiens
cacattcttttttat

SEQ ID NO: 64441 - DNA, 15 bp, Homo sapiens
tcacattctttttta

SEQ ID NO: 64442 - DNA, 15 bp, Homo sapiens
ttcacattctttttt

SEQ ID NO: 64443 - DNA, 15 bp, Homo sapiens
cttcacattcttttt

SEQ ID NO: 64444 - DNA, 15 bp, Homo sapiens
tcttcacattctttt

SEQ ID NO: 64445 - DNA, 15 bp, Homo sapiens
ttcttcacattcttt

SEQ ID NO: 64446 - DNA, 15 bp, Homo sapiens
cttcttcacattctt

SEQ ID NO: 64447 - DNA, 15 bp, Homo sapiens
tcttcttcacattct

SEQ ID NO: 64448 - DNA, 15 bp, Homo sapiens
ctcttcttcacattc

SEQ ID NO: 64449 - DNA, 15 bp, Homo sapiens
cctcttcttcacatt

SEQ ID NO: 64450 - DNA, 15 bp, Homo sapiens
gcctcttcttcacat

SEQ ID NO: 64451 - DNA, 15 bp, Homo sapiens
tgcctcttcttcaca

SEQ ID NO: 64452 - DNA, 15 bp, Homo sapiens
ttgcctcttcttcac

SEQ ID NO: 64453 - DNA, 15 bp, Homo sapiens
attgcctcttcttca

SEQ ID NO: 64454 - DNA, 15 bp, Homo sapiens
aattgcctcttcttc

SEQ ID NO: 64455 - DNA, 15 bp, Homo sapiens
taattgcctcttctt

SEQ ID NO: 64456 - DNA, 15 bp, Homo sapiens
ttaattgcctcttct

SEQ ID NO: 64457 - DNA, 15 bp, Homo sapiens
attaattgcctcttc

SEQ ID NO: 64458 - DNA, 15 bp, Homo sapiens
tattaattgcctctt

SEQ ID NO: 64459 - DNA, 15 bp, Homo sapiens
atattaattgcctct

SEQ ID NO: 64460 - DNA, 15 bp, Homo sapiens
tatattaattgcctc

SEQ ID NO: 64461 - DNA, 15 bp, Homo sapiens
gtatattaattgcct

SEQ ID NO: 64462 - DNA, 15 bp, Homo sapiens
tgtatattaattgcc

SEQ ID NO: 64463 - DNA, 15 bp, Homo sapiens
ctgtatattaattgc

SEQ ID NO: 64464 - DNA, 15 bp, Homo sapiens
cctgtatattaattg

SEQ ID NO: 64465 - DNA, 15 bp, Homo sapiens
acctgtatattaatt

SEQ ID NO: 64466 - DNA, 15 bp, Homo sapiens
tacctgtatattaat

SEQ ID NO: 64467 - DNA, 15 bp, Homo sapiens
gtacctgtatattaa

SEQ ID NO: 64468 - DNA, 15 bp, Homo sapiens
tgtacctgtatatta

SEQ ID NO: 64469 - DNA, 15 bp, Homo sapiens
ctgtacctgtatatt

SEQ ID NO: 64470 - DNA, 15 bp, Homo sapiens
cctgtacctgtatat

SEQ ID NO: 64471 - DNA, 15 bp, Homo sapiens
acctgtacctgtata

SEQ ID NO: 64472 - DNA, 15 bp, Homo sapiens
tacctgtacctgtat

SEQ ID NO: 64473 - DNA, 15 bp, Homo sapiens
ttacctgtacctgta

SEQ ID NO: 64474 - DNA, 15 bp, Homo sapiens
gttacctgtacctgt

SEQ ID NO: 64475 - DNA, 15 bp, Homo sapiens
tgttacctgtacctg

SEQ ID NO: 64476 - DNA, 15 bp, Homo sapiens
atgttacctgtacct

SEQ ID NO: 64477 - DNA, 15 bp, Homo sapiens
aatgttacctgtacc

SEQ ID NO: 64478 - DNA, 15 bp, Homo sapiens
aaatgttacctgtac

SEQ ID NO: 64479 - DNA, 15 bp, Homo sapiens
aaaatgttacctgta

SEQ ID NO: 64480 - DNA, 15 bp, Homo sapiens
taaaatgttacctgt

SEQ ID NO: 64481 - DNA, 15 bp, Homo sapiens
ataaaatgttacctg

SEQ ID NO: 64482 - DNA, 15 bp, Homo sapiens
aataaaatgttacct

SEQ ID NO: 64483 - DNA, 15 bp, Homo sapiens
taataaaatgttacc

SEQ ID NO: 64484 - DNA, 15 bp, Homo sapiens
ttaataaaatgttac

SEQ ID NO: 64485 - DNA, 15 bp, Homo sapiens
cttaataaaatgtta

SEQ ID NO: 64486 - DNA, 15 bp, Homo sapiens
tcttaataaaatgtt

SEQ ID NO: 64487 - DNA, 15 bp, Homo sapiens
atcttaataaaatgt

SEQ ID NO: 64488 - DNA, 15 bp, Homo sapiens
catcttaataaaatg

SEQ ID NO: 64489 - DNA, 15 bp, Homo sapiens
acatcttaataaaat

SEQ ID NO: 64490 - DNA, 15 bp, Homo sapiens
aacatcttaataaaa

SEQ ID NO: 64491 - DNA, 15 bp, Homo sapiens
aaacatcttaataaa

SEQ ID NO: 64492 - DNA, 15 bp, Homo sapiens
caaacatcttaataa

SEQ ID NO: 64493 - DNA, 15 bp, Homo sapiens
ccaaacatcttaata

SEQ ID NO: 64494 - DNA, 15 bp, Homo sapiens
gccaaacatcttaat

SEQ ID NO: 64495 - DNA, 15 bp, Homo sapiens
agccaaacatcttaa

SEQ ID NO: 64496 - DNA, 15 bp, Homo sapiens
aagccaaacatctta

SEQ ID NO: 64497 - DNA, 15 bp, Homo sapiens
caagccaaacatctt

SEQ ID NO: 64498 - DNA, 15 bp, Homo sapiens
gcaagccaaacatct

SEQ ID NO: 64499 - DNA, 15 bp, Homo sapiens
ggcaagccaaacatc

SEQ ID NO: 64500 - DNA, 15 bp, Homo sapiens
cggcaagccaaacat

SEQ ID NO: 64501 - DNA, 15 bp, Homo sapiens
acggcaagccaaaca

SEQ ID NO: 64502 - DNA, 15 bp, Homo sapiens
tacggcaagccaaac

SEQ ID NO: 64503 - DNA, 15 bp, Homo sapiens
atacggcaagccaaa

SEQ ID NO: 64504 - DNA, 15 bp, Homo sapiens
aatacggcaagccaa

SEQ ID NO: 64505 - DNA, 15 bp, Homo sapiens
aaatacggcaagcca

SEQ ID NO: 64506 - DNA, 15 bp, Homo sapiens
caaatacggcaagcc

SEQ ID NO: 64507 - DNA, 15 bp, Homo sapiens
acaaatacggcaagc

SEQ ID NO: 64508 - DNA, 15 bp, Homo sapiens
aacaaatacggcaag

SEQ ID NO: 64509 - DNA, 15 bp, Homo sapiens
aaacaaatacggcaa

SEQ ID NO: 64510 - DNA, 15 bp, Homo sapiens
aaaacaaatacggca

SEQ ID NO: 64511 - DNA, 15 bp, Homo sapiens
gaaaacaaatacggc

SEQ ID NO: 64512 - DNA, 15 bp, Homo sapiens
agaaaacaaatacgg

SEQ ID NO: 64513 - DNA, 15 bp, Homo sapiens
gagaaaacaaatacg

SEQ ID NO: 64514 - DNA, 15 bp, Homo sapiens
ggagaaaacaaatac

SEQ ID NO: 64515 - DNA, 15 bp, Homo sapiens
aggagaaaacaaata

SEQ ID NO: 64516 - DNA, 15 bp, Homo sapiens
taggagaaaacaaat

SEQ ID NO: 64517 - DNA, 15 bp, Homo sapiens
ctaggagaaaacaaa

SEQ ID NO: 64518 - DNA, 15 bp, Homo sapiens
cctaggagaaaacaa

SEQ ID NO: 64519 - DNA, 15 bp, Homo sapiens
acctaggagaaaaca

SEQ ID NO: 64520 - DNA, 15 bp, Homo sapiens
tacctaggagaaaac

SEQ ID NO: 64521 - DNA, 15 bp, Homo sapiens
gtacctaggagaaaa

SEQ ID NO: 64522 - DNA, 15 bp, Homo sapiens
agtacctaggagaaa

SEQ ID NO: 64523 - DNA, 15 bp, Homo sapiens
tagtacctaggagaa

SEQ ID NO: 64524 - DNA, 15 bp, Homo sapiens
ctagtacctaggaga

SEQ ID NO: 64525 - DNA, 15 bp, Homo sapiens
tctagtacctaggag

SEQ ID NO: 64526 - DNA, 15 bp, Homo sapiens
atctagtacctagga

SEQ ID NO: 64527 - DNA, 15 bp, Homo sapiens
tatctagtacctagg

SEQ ID NO: 64528 - DNA, 15 bp, Homo sapiens
ttatctagtacctag

SEQ ID NO: 64529 - DNA, 15 bp, Homo sapiens
tttatctagtaccta

SEQ ID NO: 64530 - DNA, 15 bp, Homo sapiens
ttttatctagtacct

SEQ ID NO: 64531 - DNA, 15 bp, Homo sapiens
tttttatctagtacc

SEQ ID NO: 64532 - DNA, 15 bp, Homo sapiens
gtttttatctagtac

SEQ ID NO: 64533 - DNA, 15 bp, Homo sapiens
tgtttttatctagta

SEQ ID NO: 64534 - DNA, 15 bp, Homo sapiens
gtgtttttatctagt

SEQ ID NO: 64535 - DNA, 15 bp, Homo sapiens
agtgtttttatctag

SEQ ID NO: 64536 - DNA, 15 bp, Homo sapiens
aagtgtttttatcta

SEQ ID NO: 64537 - DNA, 15 bp, Homo sapiens
aaagtgtttttatct

SEQ ID NO: 64538 - DNA, 15 bp, Homo sapiens
aaaagtgtttttatc

SEQ ID NO: 64539 - DNA, 15 bp, Homo sapiens
taaaagtgtttttat

SEQ ID NO: 64540 - DNA, 15 bp, Homo sapiens
ctaaaagtgttttta

SEQ ID NO: 64541 - DNA, 15 bp, Homo sapiens
tctaaaagtgttttt

SEQ ID NO: 64542 - DNA, 15 bp, Homo sapiens
ctctaaaagtgtttt

SEQ ID NO: 64543 - DNA, 15 bp, Homo sapiens
cctctaaaagtgttt

SEQ ID NO: 64544 - DNA, 15 bp, Homo sapiens
ccctctaaaagtgtt

SEQ ID NO: 64545 - DNA, 15 bp, Homo sapiens
accctctaaaagtgt

SEQ ID NO: 64546 - DNA, 15 bp, Homo sapiens
aaccctctaaaagtg

SEQ ID NO: 64547 - DNA, 15 bp, Homo sapiens
aaaccctctaaaagt

SEQ ID NO: 64548 - DNA, 15 bp, Homo sapiens
aaaaccctctaaaag

SEQ ID NO: 64549 - DNA, 15 bp, Homo sapiens
aaaaaccctctaaaa

SEQ ID NO: 64550 - DNA, 15 bp, Homo sapiens
aaaaaaccctctaaa

SEQ ID NO: 64551 - DNA, 15 bp, Homo sapiens
aaaaaaaccctctaa

SEQ ID NO: 64552 - DNA, 15 bp, Homo sapiens
gaaaaaaaccctcta

SEQ ID NO: 64553 - DNA, 15 bp, Homo sapiens
agaaaaaaaccctct

SEQ ID NO: 64554 - DNA, 15 bp, Homo sapiens
aagaaaaaaaccctc

SEQ ID NO: 64555 - DNA, 15 bp, Homo sapiens
caagaaaaaaaccct

SEQ ID NO: 64556 - DNA, 15 bp, Homo sapiens
tcaagaaaaaaaccc

SEQ ID NO: 64557 - DNA, 15 bp, Homo sapiens
gtcaagaaaaaaacc

SEQ ID NO: 64558 - DNA, 15 bp, Homo sapiens
agtcaagaaaaaaac

SEQ ID NO: 64559 - DNA, 15 bp, Homo sapiens
cagtcaagaaaaaaa

SEQ ID NO: 64560 - DNA, 15 bp, Homo sapiens
tcagtcaagaaaaaa

SEQ ID NO: 64561 - DNA, 15 bp, Homo sapiens
ctcagtcaagaaaaa

SEQ ID NO: 64562 - DNA, 15 bp, Homo sapiens
tctcagtcaagaaaa

SEQ ID NO: 64563 - DNA, 15 bp, Homo sapiens
ttctcagtcaagaaa

SEQ ID NO: 64564 - DNA, 15 bp, Homo sapiens
gttctcagtcaagaa

SEQ ID NO: 64565 - DNA, 15 bp, Homo sapiens
tgttctcagtcaaga

SEQ ID NO: 64566 - DNA, 15 bp, Homo sapiens
atgttctcagtcaag

SEQ ID NO: 64567 - DNA, 15 bp, Homo sapiens
gatgttctcagtcaa

SEQ ID NO: 64568 - DNA, 15 bp, Homo sapiens
agatgttctcagtca

SEQ ID NO: 64569 - DNA, 15 bp, Homo sapiens
aagatgttctcagtc

SEQ ID NO: 64570 - DNA, 15 bp, Homo sapiens
caagatgttctcagt

SEQ ID NO: 64571 - DNA, 15 bp, Homo sapiens
ccaagatgttctcag

SEQ ID NO: 64572 - DNA, 15 bp, Homo sapiens
accaagatgttctca

SEQ ID NO: 64573 - DNA, 15 bp, Homo sapiens
aaccaagatgttctc

SEQ ID NO: 64574 - DNA, 15 bp, Homo sapiens
aaaccaagatgttct

SEQ ID NO: 64575 - DNA, 15 bp, Homo sapiens
gaaaccaagatgttc

SEQ ID NO: 64576 - DNA, 15 bp, Homo sapiens
agaaaccaagatgtt

SEQ ID NO: 64577 - DNA, 15 bp, Homo sapiens
gagaaaccaagatgt

SEQ ID NO: 64578 - DNA, 15 bp, Homo sapiens
tgagaaaccaagatg

SEQ ID NO: 64579 - DNA, 15 bp, Homo sapiens
ctgagaaaccaagat

SEQ ID NO: 64580 - DNA, 15 bp, Homo sapiens
gctgagaaaccaaga

SEQ ID NO: 64581 - DNA, 15 bp, Homo sapiens
agctgagaaaccaag

SEQ ID NO: 64582 - DNA, 15 bp, Homo sapiens
aagctgagaaaccaa

SEQ ID NO: 64583 - DNA, 15 bp, Homo sapiens
taagctgagaaacca

SEQ ID NO: 64584 - DNA, 15 bp, Homo sapiens
gtaagctgagaaacc

SEQ ID NO: 64585 - DNA, 15 bp, Homo sapiens
tgtaagctgagaaac

SEQ ID NO: 64586 - DNA, 15 bp, Homo sapiens
atgtaagctgagaaa

SEQ ID NO: 64587 - DNA, 15 bp, Homo sapiens
aatgtaagctgagaa

SEQ ID NO: 64588 - DNA, 15 bp, Homo sapiens
aaatgtaagctgaga

SEQ ID NO: 64589 - DNA, 15 bp, Homo sapiens
caaatgtaagctgag

SEQ ID NO: 64590 - DNA, 15 bp, Homo sapiens
gcaaatgtaagctga

SEQ ID NO: 64591 - DNA, 15 bp, Homo sapiens
tgcaaatgtaagctg

SEQ ID NO: 64592 - DNA, 15 bp, Homo sapiens
atgcaaatgtaagct

SEQ ID NO: 64593 - DNA, 15 bp, Homo sapiens
tatgcaaatgtaagc

SEQ ID NO: 64594 - DNA, 15 bp, Homo sapiens
ttatgcaaatgtaag

SEQ ID NO: 64595 - DNA, 15 bp, Homo sapiens
cttatgcaaatgtaa

SEQ ID NO: 64596 - DNA, 15 bp, Homo sapiens
tcttatgcaaatgta

SEQ ID NO: 64597 - DNA, 15 bp, Homo sapiens
ttcttatgcaaatgt

SEQ ID NO: 64598 - DNA, 15 bp, Homo sapiens
cttcttatgcaaatg

SEQ ID NO: 64599 - DNA, 15 bp, Homo sapiens
acttcttatgcaaat

SEQ ID NO: 64600 - DNA, 15 bp, Homo sapiens
aacttcttatgcaaa

SEQ ID NO: 64601 - DNA, 15 bp, Homo sapiens
gaacttcttatgcaa

SEQ ID NO: 64602 - DNA, 15 bp, Homo sapiens
tgaacttcttatgca

SEQ ID NO: 64603 - DNA, 15 bp, Homo sapiens
ctgaacttcttatgc

SEQ ID NO: 64604 - DNA, 15 bp, Homo sapiens
gctgaacttcttatg

SEQ ID NO: 64605 - DNA, 15 bp, Homo sapiens
agctgaacttcttat

SEQ ID NO: 64606 - DNA, 15 bp, Homo sapiens
aagctgaacttctta

SEQ ID NO: 64607 - DNA, 15 bp, Homo sapiens
taagctgaacttctt

SEQ ID NO: 64608 - DNA, 15 bp, Homo sapiens
ctaagctgaacttct

SEQ ID NO: 64609 - DNA, 15 bp, Homo sapiens
gctaagctgaacttc

SEQ ID NO: 64610 - DNA, 15 bp, Homo sapiens
tgctaagctgaactt

SEQ ID NO: 64611 - DNA, 15 bp, Homo sapiens
ctgctaagctgaact

SEQ ID NO: 64612 - DNA, 15 bp, Homo sapiens
actgctaagctgaac

SEQ ID NO: 64613 - DNA, 15 bp, Homo sapiens
aactgctaagctgaa

SEQ ID NO: 64614 - DNA, 15 bp, Homo sapiens
taactgctaagctga

SEQ ID NO: 64615 - DNA, 15 bp, Homo sapiens
ctaactgctaagctg

SEQ ID NO: 64616 - DNA, 15 bp, Homo sapiens
gctaactgctaagct

SEQ ID NO: 64617 - DNA, 15 bp, Homo sapiens
tgctaactgctaagc

SEQ ID NO: 64618 - DNA, 15 bp, Homo sapiens
atgctaactgctaag

SEQ ID NO: 64619 - DNA, 15 bp, Homo sapiens
aatgctaactgctaa

SEQ ID NO: 64620 - DNA, 15 bp, Homo sapiens
gaatgctaactgcta

SEQ ID NO: 64621 - DNA, 15 bp, Homo sapiens
agaatgctaactgct

SEQ ID NO: 64622 - DNA, 15 bp, Homo sapiens
cagaatgctaactgc

SEQ ID NO: 64623 - DNA, 15 bp, Homo sapiens
acagaatgctaactg

SEQ ID NO: 64624 - DNA, 15 bp, Homo sapiens
gacagaatgctaact

SEQ ID NO: 64625 - DNA, 15 bp, Homo sapiens
tgacagaatgctaac

SEQ ID NO: 64626 - DNA, 15 bp, Homo sapiens
gtgacagaatgctaa

SEQ ID NO: 64627 - DNA, 15 bp, Homo sapiens
tgtgacagaatgcta

SEQ ID NO: 64628 - DNA, 15 bp, Homo sapiens
atgtgacagaatgct

SEQ ID NO: 64629 - DNA, 15 bp, Homo sapiens
catgtgacagaatgc

SEQ ID NO: 64630 - DNA, 15 bp, Homo sapiens
acatgtgacagaatg

SEQ ID NO: 64631 - DNA, 15 bp, Homo sapiens
cacatgtgacagaat

SEQ ID NO: 64632 - DNA, 15 bp, Homo sapiens
acacatgtgacagaa

SEQ ID NO: 64633 - DNA, 15 bp, Homo sapiens
cacacatgtgacaga

SEQ ID NO: 64634 - DNA, 15 bp, Homo sapiens
acacacatgtgacag

SEQ ID NO: 64635 - DNA, 15 bp, Homo sapiens
tacacacatgtgaca

SEQ ID NO: 64636 - DNA, 15 bp, Homo sapiens
ttacacacatgtgac

SEQ ID NO: 64637 - DNA, 15 bp, Homo sapiens
attacacacatgtga

SEQ ID NO: 64638 - DNA, 15 bp, Homo sapiens
tattacacacatgtg

SEQ ID NO: 64639 - DNA, 15 bp, Homo sapiens
ctattacacacatgt

SEQ ID NO: 64640 - DNA, 15 bp, Homo sapiens
tctattacacacatg

SEQ ID NO: 64641 - DNA, 15 bp, Homo sapiens
ttctattacacacat

SEQ ID NO: 64642 - DNA, 15 bp, Homo sapiens
gttctattacacaca

SEQ ID NO: 64643 - DNA, 15 bp, Homo sapiens
tgttctattacacac

SEQ ID NO: 64644 - DNA, 15 bp, Homo sapiens
gtgttctattacaca

SEQ ID NO: 64645 - DNA, 15 bp, Homo sapiens
ggtgttctattacac

SEQ ID NO: 64646 - DNA, 15 bp, Homo sapiens
tggtgttctattaca

SEQ ID NO: 64647 - DNA, 15 bp, Homo sapiens
atggtgttctattac

SEQ ID NO: 64648 - DNA, 15 bp, Homo sapiens
tatggtgttctatta

SEQ ID NO: 64649 - DNA, 15 bp, Homo sapiens
ttatggtgttctatt

SEQ ID NO: 64650 - DNA, 15 bp, Homo sapiens
gttatggtgttctat

SEQ ID NO: 64651 - DNA, 15 bp, Homo sapiens
agttatggtgttcta

SEQ ID NO: 64652 - DNA, 15 bp, Homo sapiens
gagttatggtgttct

SEQ ID NO: 64653 - DNA, 15 bp, Homo sapiens
tgagttatggtgttc

SEQ ID NO: 64654 - DNA, 15 bp, Homo sapiens
ttgagttatggtgtt

SEQ ID NO: 64655 - DNA, 15 bp, Homo sapiens
attgagttatggtgt

SEQ ID NO: 64656 - DNA, 15 bp, Homo sapiens
cattgagttatggtg

SEQ ID NO: 64657 - DNA, 15 bp, Homo sapiens
ccattgagttatggt

SEQ ID NO: 64658 - DNA, 15 bp, Homo sapiens
tccattgagttatgg

SEQ ID NO: 64659 - DNA, 15 bp, Homo sapiens
gtccattgagttatg

SEQ ID NO: 64660 - DNA, 15 bp, Homo sapiens
agtccattgagttat

SEQ ID NO: 64661 - DNA, 15 bp, Homo sapiens
aagtccattgagtta

SEQ ID NO: 64662 - DNA, 15 bp, Homo sapiens
aaagtccattgagtt

SEQ ID NO: 64663 - DNA, 15 bp, Homo sapiens
taaagtccattgagt

SEQ ID NO: 64664 - DNA, 15 bp, Homo sapiens
ataaagtccattgag

SEQ ID NO: 64665 - DNA, 15 bp, Homo sapiens
aataaagtccattga

SEQ ID NO: 64666 - DNA, 15 bp, Homo sapiens
taataaagtccattg

SEQ ID NO: 64667 - DNA, 15 bp, Homo sapiens
ttaataaagtccatt

SEQ ID NO: 64668 - DNA, 15 bp, Homo sapiens
cttaataaagtccat

SEQ ID NO: 64669 - DNA, 15 bp, Homo sapiens
tcttaataaagtcca

SEQ ID NO: 64670 - DNA, 15 bp, Homo sapiens
ttcttaataaagtcc

SEQ ID NO: 64671 - DNA, 15 bp, Homo sapiens
cttcttaataaagtc

SEQ ID NO: 64672 - DNA, 15 bp, Homo sapiens
ccttcttaataaagt

SEQ ID NO: 64673 - DNA, 15 bp, Homo sapiens
tccttcttaataaag

SEQ ID NO: 64674 - DNA, 15 bp, Homo sapiens
ttccttcttaataaa

SEQ ID NO: 64675 - DNA, 15 bp, Homo sapiens
tttccttcttaataa

SEQ ID NO: 64676 - DNA, 15 bp, Homo sapiens
ttttccttcttaata

SEQ ID NO: 64677 - DNA, 15 bp, Homo sapiens
attttccttcttaat

SEQ ID NO: 64678 - DNA, 15 bp, Homo sapiens
tattttccttcttaa

SEQ ID NO: 64679 - DNA, 15 bp, Homo sapiens
gtattttccttctta

SEQ ID NO: 64680 - DNA, 15 bp, Homo sapiens
agtattttccttctt

SEQ ID NO: 64681 - DNA, 15 bp, Homo sapiens
aagtattttccttct

SEQ ID NO: 64682 - DNA, 15 bp, Homo sapiens
aaagtattttccttc

SEQ ID NO: 64683 - DNA, 15 bp, Homo sapiens
taaagtattttcctt

SEQ ID NO: 64684 - DNA, 15 bp, Homo sapiens
ataaagtattttcct

SEQ ID NO: 64685 - DNA, 15 bp, Homo sapiens
aataaagtattttcc

SEQ ID NO: 64686 - DNA, 15 bp, Homo sapiens
aaataaagtattttc

SEQ ID NO: 64687 - DNA, 15 bp, Homo sapiens
gaaataaagtatttt

SEQ ID NO: 64688 - DNA, 15 bp, Homo sapiens
tgaaataaagtattt

SEQ ID NO: 64689 - DNA, 15 bp, Homo sapiens
gtgaaataaagtatt

SEQ ID NO: 64690 - DNA, 15 bp, Homo sapiens
ggtgaaataaagtat

SEQ ID NO: 64691 - DNA, 15 bp, Homo sapiens
gggtgaaataaagta

SEQ ID NO: 64692 - DNA, 15 bp, Homo sapiens
tgggtgaaataaagt

SEQ ID NO: 64693 - DNA, 15 bp, Homo sapiens
ctgggtgaaataaag

SEQ ID NO: 64694 - DNA, 15 bp, Homo sapiens
gctgggtgaaataaa

SEQ ID NO: 64695 - DNA, 15 bp, Homo sapiens
tgctgggtgaaataa

SEQ ID NO: 64696 - DNA, 15 bp, Homo sapiens
ttgctgggtgaaata

SEQ ID NO: 64697 - DNA, 15 bp, Homo sapiens
tttgctgggtgaaat

SEQ ID NO: 64698 - DNA, 15 bp, Homo sapiens
ttttgctgggtgaaa

SEQ ID NO: 64699 - DNA, 15 bp, Homo sapiens
gttttgctgggtgaa

SEQ ID NO: 64700 - DNA, 15 bp, Homo sapiens
agttttgctgggtga

SEQ ID NO: 64701 - DNA, 15 bp, Homo sapiens
cagttttgctgggtg

SEQ ID NO: 64702 - DNA, 15 bp, Homo sapiens
ccagttttgctgggt

SEQ ID NO: 64703 - DNA, 15 bp, Homo sapiens
cccagttttgctggg

SEQ ID NO: 64704 - DNA, 15 bp, Homo sapiens
gcccagttttgctgg

SEQ ID NO: 64705 - DNA, 15 bp, Homo sapiens
agcccagttttgctg

SEQ ID NO: 64706 - DNA, 15 bp, Homo sapiens
cagcccagttttgct

SEQ ID NO: 64707 - DNA, 15 bp, Homo sapiens
acagcccagttttgc

SEQ ID NO: 64708 - DNA, 15 bp, Homo sapiens
aacagcccagttttg

SEQ ID NO: 64709 - DNA, 15 bp, Homo sapiens
caacagcccagtttt

SEQ ID NO: 64710 - DNA, 15 bp, Homo sapiens
gcaacagcccagttt

SEQ ID NO: 64711 - DNA, 15 bp, Homo sapiens
agcaacagcccagtt

SEQ ID NO: 64712 - DNA, 15 bp, Homo sapiens
gagcaacagcccagt

SEQ ID NO: 64713 - DNA, 15 bp, Homo sapiens
tgagcaacagcccag

SEQ ID NO: 64714 - DNA, 15 bp, Homo sapiens
atgagcaacagccca

SEQ ID NO: 64715 - DNA, 15 bp, Homo sapiens
catgagcaacagccc

SEQ ID NO: 64716 - DNA, 15 bp, Homo sapiens
gcatgagcaacagcc

SEQ ID NO: 64717 - DNA, 15 bp, Homo sapiens
agcatgagcaacagc

SEQ ID NO: 64718 - DNA, 15 bp, Homo sapiens
cagcatgagcaacag

SEQ ID NO: 64719 - DNA, 15 bp, Homo sapiens
gcagcatgagcaaca

SEQ ID NO: 64720 - DNA, 15 bp, Homo sapiens
agcagcatgagcaac

SEQ ID NO: 64721 - DNA, 15 bp, Homo sapiens
cagcagcatgagcaa

SEQ ID NO: 64722 - DNA, 15 bp, Homo sapiens
gcagcagcatgagca

SEQ ID NO: 64723 - DNA, 15 bp, Homo sapiens
tgcagcagcatgagc

SEQ ID NO: 64724 - DNA, 15 bp, Homo sapiens
atgcagcagcatgag

SEQ ID NO: 64725 - DNA, 15 bp, Homo sapiens
catgcagcagcatga

SEQ ID NO: 64726 - DNA, 15 bp, Homo sapiens
tcatgcagcagcatg

SEQ ID NO: 64727 - DNA, 15 bp, Homo sapiens
gtcatgcagcagcat

SEQ ID NO: 64728 - DNA, 15 bp, Homo sapiens
tgtcatgcagcagca

SEQ ID NO: 64729 - DNA, 15 bp, Homo sapiens
atgtcatgcagcagc

SEQ ID NO: 64730 - DNA, 15 bp, Homo sapiens
catgtcatgcagcag

SEQ ID NO: 64731 - DNA, 15 bp, Homo sapiens
gcatgtcatgcagca

SEQ ID NO: 64732 - DNA, 15 bp, Homo sapiens
agcatgtcatgcagc

SEQ ID NO: 64733 - DNA, 15 bp, Homo sapiens
cagcatgtcatgcag

SEQ ID NO: 64734 - DNA, 15 bp, Homo sapiens
ccagcatgtcatgca

SEQ ID NO: 64735 - DNA, 15 bp, Homo sapiens
cccagcatgtcatgc

SEQ ID NO: 64736 - DNA, 15 bp, Homo sapiens
tcccagcatgtcatg

SEQ ID NO: 64737 - DNA, 15 bp, Homo sapiens
ttcccagcatgtcat

SEQ ID NO: 64738 - DNA, 15 bp, Homo sapiens
attcccagcatgtca

SEQ ID NO: 64739 - DNA, 15 bp, Homo sapiens
gattcccagcatgtc

SEQ ID NO: 64740 - DNA, 15 bp, Homo sapiens
agattcccagcatgt

SEQ ID NO: 64741 - DNA, 15 bp, Homo sapiens
tagattcccagcatg

SEQ ID NO: 64742 - DNA, 15 bp, Homo sapiens
atagattcccagcat

SEQ ID NO: 64743 - DNA, 15 bp, Homo sapiens
catagattcccagca

SEQ ID NO: 64744 - DNA, 15 bp, Homo sapiens
acatagattcccagc

SEQ ID NO: 64745 - DNA, 15 bp, Homo sapiens
aacatagattcccag

SEQ ID NO: 64746 - DNA, 15 bp, Homo sapiens
aaacatagattccca

SEQ ID NO: 64747 - DNA, 15 bp, Homo sapiens
aaaacatagattccc

SEQ ID NO: 64748 - DNA, 15 bp, Homo sapiens
gaaaacatagattcc

SEQ ID NO: 64749 - DNA, 15 bp, Homo sapiens
tgaaaacatagattc

SEQ ID NO: 64750 - DNA, 15 bp, Homo sapiens
gtgaaaacatagatt

SEQ ID NO: 64751 - DNA, 15 bp, Homo sapiens
tgtgaaaacatagat

SEQ ID NO: 64752 - DNA, 15 bp, Homo sapiens
atgtgaaaacataga

SEQ ID NO: 64753 - DNA, 15 bp, Homo sapiens
gatgtgaaaacatag

SEQ ID NO: 64754 - DNA, 15 bp, Homo sapiens
tgatgtgaaaacata

SEQ ID NO: 64755 - DNA, 15 bp, Homo sapiens
atgatgtgaaaacat

SEQ ID NO: 64756 - DNA, 15 bp, Homo sapiens
gatgatgtgaaaaca

SEQ ID NO: 64757 - DNA, 15 bp, Homo sapiens
agatgatgtgaaaac

SEQ ID NO: 64758 - DNA, 15 bp, Homo sapiens
cagatgatgtgaaaa

SEQ ID NO: 64759 - DNA, 15 bp, Homo sapiens
ccagatgatgtgaaa

SEQ ID NO: 64760 - DNA, 15 bp, Homo sapiens
accagatgatgtgaa

SEQ ID NO: 64761 - DNA, 15 bp, Homo sapiens
aaccagatgatgtga

SEQ ID NO: 64762 - DNA, 15 bp, Homo sapiens
caaccagatgatgtg

SEQ ID NO: 64763 - DNA, 15 bp, Homo sapiens
gcaaccagatgatgt

SEQ ID NO: 64764 - DNA, 15 bp, Homo sapiens
ggcaaccagatgatg

SEQ ID NO: 64765 - DNA, 15 bp, Homo sapiens
tggcaaccagatgat

SEQ ID NO: 64766 - DNA, 15 bp, Homo sapiens
ctggcaaccagatga

SEQ ID NO: 64767 - DNA, 15 bp, Homo sapiens
gctggcaaccagatg

SEQ ID NO: 64768 - DNA, 15 bp, Homo sapiens
agctggcaaccagat

SEQ ID NO: 64769 - DNA, 15 bp, Homo sapiens
aagctggcaaccaga

SEQ ID NO: 64770 - DNA, 15 bp, Homo sapiens
aaagctggcaaccag

SEQ ID NO: 64771 - DNA, 15 bp, Homo sapiens
aaaagctggcaacca

SEQ ID NO: 64772 - DNA, 15 bp, Homo sapiens
taaaagctggcaacc

SEQ ID NO: 64773 - DNA, 15 bp, Homo sapiens
ataaaagctggcaac

SEQ ID NO: 64774 - DNA, 15 bp, Homo sapiens
aataaaagctggcaa

SEQ ID NO: 64775 - DNA, 15 bp, Homo sapiens
aaataaaagctggca

SEQ ID NO: 64776 - DNA, 15 bp, Homo sapiens
gaaataaaagctggc

SEQ ID NO: 64777 - DNA, 15 bp, Homo sapiens
agaaataaaagctgg

SEQ ID NO: 64778 - DNA, 15 bp, Homo sapiens
cagaaataaaagctg

SEQ ID NO: 64779 - DNA, 15 bp, Homo sapiens
acagaaataaaagct

SEQ ID NO: 64780 - DNA, 15 bp, Homo sapiens
gacagaaataaaagc

SEQ ID NO: 64781 - DNA, 15 bp, Homo sapiens
tgacagaaataaaag

SEQ ID NO: 64782 - DNA, 15 bp, Homo sapiens
atgacagaaataaaa

SEQ ID NO: 64783 - DNA, 15 bp, Homo sapiens
catgacagaaataaa

SEQ ID NO: 64784 - DNA, 15 bp, Homo sapiens
acatgacagaaataa

SEQ ID NO: 64785 - DNA, 15 bp, Homo sapiens
cacatgacagaaata

SEQ ID NO: 64786 - DNA, 15 bp, Homo sapiens
gcacatgacagaaat

SEQ ID NO: 64787 - DNA, 15 bp, Homo sapiens
agcacatgacagaaa

SEQ ID NO: 64788 - DNA, 15 bp, Homo sapiens
tagcacatgacagaa

SEQ ID NO: 64789 - DNA, 15 bp, Homo sapiens
ttagcacatgacaga

SEQ ID NO: 64790 - DNA, 15 bp, Homo sapiens
tttagcacatgacag

SEQ ID NO: 64791 - DNA, 15 bp, Homo sapiens
ctttagcacatgaca

SEQ ID NO: 64792 - DNA, 15 bp, Homo sapiens
tctttagcacatgac

SEQ ID NO: 64793 - DNA, 15 bp, Homo sapiens
atctttagcacatga

SEQ ID NO: 64794 - DNA, 15 bp, Homo sapiens
catctttagcacatg

SEQ ID NO: 64795 - DNA, 15 bp, Homo sapiens
ccatctttagcacat

SEQ ID NO: 64796 - DNA, 15 bp, Homo sapiens
accatctttagcaca

SEQ ID NO: 64797 - DNA, 15 bp, Homo sapiens
aaccatctttagcac

SEQ ID NO: 64798 - DNA, 15 bp, Homo sapiens
aaaccatctttagca

SEQ ID NO: 64799 - DNA, 15 bp, Homo sapiens
aaaaccatctttagc

SEQ ID NO: 64800 - DNA, 15 bp, Homo sapiens
aaaaaccatctttag

SEQ ID NO: 64801 - DNA, 15 bp, Homo sapiens
gaaaaaccatcttta

SEQ ID NO: 64802 - DNA, 15 bp, Homo sapiens
agaaaaaccatcttt

SEQ ID NO: 64803 - DNA, 15 bp, Homo sapiens
gagaaaaaccatctt

SEQ ID NO: 64804 - DNA, 15 bp, Homo sapiens
tgagaaaaaccatct

SEQ ID NO: 64805 - DNA, 15 bp, Homo sapiens
atgagaaaaaccatc

SEQ ID NO: 64806 - DNA, 15 bp, Homo sapiens
tatgagaaaaaccat

SEQ ID NO: 64807 - DNA, 15 bp, Homo sapiens
atatgagaaaaacca

SEQ ID NO: 64808 - DNA, 15 bp, Homo sapiens
gatatgagaaaaacc

SEQ ID NO: 64809 - DNA, 15 bp, Homo sapiens
tgatatgagaaaaac

SEQ ID NO: 64810 - DNA, 15 bp, Homo sapiens
ctgatatgagaaaaa

SEQ ID NO: 64811 - DNA, 15 bp, Homo sapiens
gctgatatgagaaaa

SEQ ID NO: 64812 - DNA, 15 bp, Homo sapiens
ggctgatatgagaaa

SEQ ID NO: 64813 - DNA, 15 bp, Homo sapiens
aggctgatatgagaa

SEQ ID NO: 64814 - DNA, 15 bp, Homo sapiens
taggctgatatgaga

SEQ ID NO: 64815 - DNA, 15 bp, Homo sapiens
ctaggctgatatgag

SEQ ID NO: 64816 - DNA, 15 bp, Homo sapiens
actaggctgatatga

SEQ ID NO: 64817 - DNA, 15 bp, Homo sapiens
aactaggctgatatg

SEQ ID NO: 64818 - DNA, 15 bp, Homo sapiens
aaactaggctgatat

SEQ ID NO: 64819 - DNA, 15 bp, Homo sapiens
aaaactaggctgata

SEQ ID NO: 64820 - DNA, 15 bp, Homo sapiens
aaaaactaggctgat

SEQ ID NO: 64821 - DNA, 15 bp, Homo sapiens
aaaaaactaggctga

SEQ ID NO: 64822 - DNA, 15 bp, Homo sapiens
aaaaaaactaggctg

SEQ ID NO: 64823 - DNA, 15 bp, Homo sapiens
aaaaaaaactaggct

SEQ ID NO: 64824 - DNA, 15 bp, Homo sapiens
gaaaaaaaactaggc

SEQ ID NO: 64825 - DNA, 15 bp, Homo sapiens
agaaaaaaaactagg

SEQ ID NO: 64826 - DNA, 15 bp, Homo sapiens
tagaaaaaaaactag

SEQ ID NO: 64827 - DNA, 15 bp, Homo sapiens
ttagaaaaaaaacta

SEQ ID NO: 64828 - DNA, 15 bp, Homo sapiens
cttagaaaaaaaact

SEQ ID NO: 64829 - DNA, 15 bp, Homo sapiens
acttagaaaaaaaac

SEQ ID NO: 64830 - DNA, 15 bp, Homo sapiens
tacttagaaaaaaaa

SEQ ID NO: 64831 - DNA, 15 bp, Homo sapiens
gtacttagaaaaaaa

SEQ ID NO: 64832 - DNA, 15 bp, Homo sapiens
agtacttagaaaaaa

SEQ ID NO: 64833 - DNA, 15 bp, Homo sapiens
tagtacttagaaaaa

SEQ ID NO: 64834 - DNA, 15 bp, Homo sapiens
ttagtacttagaaaa

SEQ ID NO: 64835 - DNA, 15 bp, Homo sapiens
attagtacttagaaa

SEQ ID NO: 64836 - DNA, 15 bp, Homo sapiens
aattagtacttagaa

SEQ ID NO: 64837 - DNA, 15 bp, Homo sapiens
caattagtacttaga

SEQ ID NO: 64838 - DNA, 15 bp, Homo sapiens
acaattagtacttag

SEQ ID NO: 64839 - DNA, 15 bp, Homo sapiens
gacaattagtactta

SEQ ID NO: 64840 - DNA, 15 bp, Homo sapiens
agacaattagtactt

SEQ ID NO: 64841 - DNA, 15 bp, Homo sapiens
aagacaattagtact

SEQ ID NO: 64842 - DNA, 15 bp, Homo sapiens
aaagacaattagtac

SEQ ID NO: 64843 - DNA, 15 bp, Homo sapiens
gaaagacaattagta

SEQ ID NO: 64844 - DNA, 15 bp, Homo sapiens
agaaagacaattagt

SEQ ID NO: 64845 - DNA, 15 bp, Homo sapiens
aagaaagacaattag

SEQ ID NO: 64846 - DNA, 15 bp, Homo sapiens
aaagaaagacaatta

SEQ ID NO: 64847 - DNA, 15 bp, Homo sapiens
aaaagaaagacaatt

SEQ ID NO: 64848 - DNA, 15 bp, Homo sapiens
aaaaagaaagacaat

SEQ ID NO: 64849 - DNA, 15 bp, Homo sapiens
aaaaaagaaagacaa

SEQ ID NO: 64850 - DNA, 15 bp, Homo sapiens
aaaaaaagaaagaca

SEQ ID NO: 64851 - DNA, 15 bp, Homo sapiens
caaaaaaagaaagac

SEQ ID NO: 64852 - DNA, 15 bp, Homo sapiens
gcaaaaaaagaaaga

SEQ ID NO: 64853 - DNA, 15 bp, Homo sapiens
ggcaaaaaaagaaag

SEQ ID NO: 64854 - DNA, 15 bp, Homo sapiens
tggcaaaaaaagaaa

SEQ ID NO: 64855 - DNA, 15 bp, Homo sapiens
atggcaaaaaaagaa

SEQ ID NO: 64856 - DNA, 15 bp, Homo sapiens
aatggcaaaaaaaga

SEQ ID NO: 64857 - DNA, 15 bp, Homo sapiens
caatggcaaaaaaag

SEQ ID NO: 64858 - DNA, 15 bp, Homo sapiens
tcaatggcaaaaaaa

SEQ ID NO: 64859 - DNA, 15 bp, Homo sapiens
ctcaatggcaaaaaa

SEQ ID NO: 64860 - DNA, 15 bp, Homo sapiens
tctcaatggcaaaaa

SEQ ID NO: 64861 - DNA, 15 bp, Homo sapiens
ttctcaatggcaaaa

SEQ ID NO: 64862 - DNA, 15 bp, Homo sapiens
tttctcaatggcaaa

SEQ ID NO: 64863 - DNA, 15 bp, Homo sapiens
ttttctcaatggcaa

SEQ ID NO: 64864 - DNA, 15 bp, Homo sapiens
cttttctcaatggca

SEQ ID NO: 64865 - DNA, 15 bp, Homo sapiens
tcttttctcaatggc

SEQ ID NO: 64866 - DNA, 15 bp, Homo sapiens
atcttttctcaatgg

SEQ ID NO: 64867 - DNA, 15 bp, Homo sapiens
aatcttttctcaatg

SEQ ID NO: 64868 - DNA, 15 bp, Homo sapiens
aaatcttttctcaat

SEQ ID NO: 64869 - DNA, 15 bp, Homo sapiens
aaaatcttttctcaa

SEQ ID NO: 64870 - DNA, 15 bp, Homo sapiens
aaaaatcttttctca

SEQ ID NO: 64871 - DNA, 15 bp, Homo sapiens
aaaaaatcttttctc

SEQ ID NO: 64872 - DNA, 15 bp, Homo sapiens
aaaaaaatcttttct

SEQ ID NO: 64873 - DNA, 15 bp, Homo sapiens
aaaaaaaatcttttc

SEQ ID NO: 64874 - DNA, 15 bp, Homo sapiens
gaaaaaaaatctttt

SEQ ID NO: 64875 - DNA, 15 bp, Homo sapiens
ggaaaaaaaatcttt

SEQ ID NO: 64876 - DNA, 15 bp, Homo sapiens
tggaaaaaaaatctt

SEQ ID NO: 64877 - DNA, 15 bp, Homo sapiens
atggaaaaaaaatct

SEQ ID NO: 64878 - DNA, 15 bp, Homo sapiens
aatggaaaaaaaatc

SEQ ID NO: 64879 - DNA, 15 bp, Homo sapiens
taatggaaaaaaaat

SEQ ID NO: 64880 - DNA, 15 bp, Homo sapiens
ataatggaaaaaaaa

SEQ ID NO: 64881 - DNA, 15 bp, Homo sapiens
tataatggaaaaaaa

SEQ ID NO: 64882 - DNA, 15 bp, Homo sapiens
atataatggaaaaaa

SEQ ID NO: 64883 - DNA, 15 bp, Homo sapiens
tatataatggaaaaa

SEQ ID NO: 64884 - DNA, 15 bp, Homo sapiens
atatataatggaaaa

SEQ ID NO: 64885 - DNA, 15 bp, Homo sapiens
gatatataatggaaa

SEQ ID NO: 64886 - DNA, 15 bp, Homo sapiens
agatatataatggaa

SEQ ID NO: 64887 - DNA, 15 bp, Homo sapiens
gagatatataatgga

SEQ ID NO: 64888 - DNA, 15 bp, Homo sapiens
tgagatatataatgg

SEQ ID NO: 64889 - DNA, 15 bp, Homo sapiens
gtgagatatataatg

SEQ ID NO: 64890 - DNA, 15 bp, Homo sapiens
tgtgagatatataat

SEQ ID NO: 64891 - DNA, 15 bp, Homo sapiens
ttgtgagatatataa

SEQ ID NO: 64892 - DNA, 15 bp, Homo sapiens
cttgtgagatatata

SEQ ID NO: 64893 - DNA, 15 bp, Homo sapiens
ccttgtgagatatat

SEQ ID NO: 64894 - DNA, 15 bp, Homo sapiens
cccttgtgagatata

SEQ ID NO: 64895 - DNA, 15 bp, Homo sapiens
gcccttgtgagatat

SEQ ID NO: 64896 - DNA, 15 bp, Homo sapiens
agcccttgtgagata

SEQ ID NO: 64897 - DNA, 15 bp, Homo sapiens
tagcccttgtgagat

SEQ ID NO: 64898 - DNA, 15 bp, Homo sapiens
atagcccttgtgaga

SEQ ID NO: 64899 - DNA, 15 bp, Homo sapiens
gatagcccttgtgag

SEQ ID NO: 64900 - DNA, 15 bp, Homo sapiens
tgatagcccttgtga

SEQ ID NO: 64901 - DNA, 15 bp, Homo sapiens
ttgatagcccttgtg

SEQ ID NO: 64902 - DNA, 15 bp, Homo sapiens
tttgatagcccttgt

SEQ ID NO: 64903 - DNA, 15 bp, Homo sapiens
ttttgatagcccttg

SEQ ID NO: 64904 - DNA, 15 bp, Homo sapiens
attttgatagccctt

SEQ ID NO: 64905 - DNA, 15 bp, Homo sapiens
cattttgatagccct

SEQ ID NO: 64906 - DNA, 15 bp, Homo sapiens
acattttgatagccc

SEQ ID NO: 64907 - DNA, 15 bp, Homo sapiens
tacattttgatagcc

SEQ ID NO: 64908 - DNA, 15 bp, Homo sapiens
ttacattttgatagc

SEQ ID NO: 64909 - DNA, 15 bp, Homo sapiens
cttacattttgatag

SEQ ID NO: 64910 - DNA, 15 bp, Homo sapiens
gcttacattttgata

SEQ ID NO: 64911 - DNA, 15 bp, Homo sapiens
ggcttacattttgat

SEQ ID NO: 64912 - DNA, 15 bp, Homo sapiens
aggcttacattttga

SEQ ID NO: 64913 - DNA, 15 bp, Homo sapiens
aaggcttacattttg

SEQ ID NO: 64914 - DNA, 15 bp, Homo sapiens
taaggcttacatttt

SEQ ID NO: 64915 - DNA, 15 bp, Homo sapiens
ataaggcttacattt

SEQ ID NO: 64916 - DNA, 15 bp, Homo sapiens
aataaggcttacatt

SEQ ID NO: 64917 - DNA, 15 bp, Homo sapiens
aaataaggcttacat

SEQ ID NO: 64918 - DNA, 15 bp, Homo sapiens
aaaataaggcttaca

SEQ ID NO: 64919 - DNA, 15 bp, Homo sapiens
gaaaataaggcttac

SEQ ID NO: 64920 - DNA, 15 bp, Homo sapiens
ggaaaataaggctta

SEQ ID NO: 64921 - DNA, 15 bp, Homo sapiens
gggaaaataaggctt

SEQ ID NO: 64922 - DNA, 15 bp, Homo sapiens
agggaaaataaggct

SEQ ID NO: 64923 - DNA, 15 bp, Homo sapiens
aagggaaaataaggc

SEQ ID NO: 64924 - DNA, 15 bp, Homo sapiens
aaagggaaaataagg

SEQ ID NO: 64925 - DNA, 15 bp, Homo sapiens
gaaagggaaaataag

SEQ ID NO: 64926 - DNA, 15 bp, Homo sapiens
ggaaagggaaaataa

SEQ ID NO: 64927 - DNA, 15 bp, Homo sapiens
aggaaagggaaaata

SEQ ID NO: 64928 - DNA, 15 bp, Homo sapiens
aaggaaagggaaaat

SEQ ID NO: 64929 - DNA, 15 bp, Homo sapiens
aaaggaaagggaaaa

SEQ ID NO: 64930 - DNA, 15 bp, Homo sapiens
taaaggaaagggaaa

SEQ ID NO: 64931 - DNA, 15 bp, Homo sapiens
ctaaaggaaagggaa

SEQ ID NO: 64932 - DNA, 15 bp, Homo sapiens
cctaaaggaaaggga

SEQ ID NO: 64933 - DNA, 15 bp, Homo sapiens
tcctaaaggaaaggg

SEQ ID NO: 64934 - DNA, 15 bp, Homo sapiens
ctcctaaaggaaagg

SEQ ID NO: 64935 - DNA, 15 bp, Homo sapiens
cctcctaaaggaaag

SEQ ID NO: 64936 - DNA, 15 bp, Homo sapiens
tcctcctaaaggaaa

SEQ ID NO: 64937 - DNA, 15 bp, Homo sapiens
ctcctcctaaaggaa

SEQ ID NO: 64938 - DNA, 15 bp, Homo sapiens
actcctcctaaagga

SEQ ID NO: 64939 - DNA, 15 bp, Homo sapiens
tactcctcctaaagg

SEQ ID NO: 64940 - DNA, 15 bp, Homo sapiens
ttactcctcctaaag

SEQ ID NO: 64941 - DNA, 15 bp, Homo sapiens
attactcctcctaaa

SEQ ID NO: 64942 - DNA, 15 bp, Homo sapiens
cattactcctcctaa

SEQ ID NO: 64943 - DNA, 15 bp, Homo sapiens
acattactcctccta

SEQ ID NO: 64944 - DNA, 15 bp, Homo sapiens
tacattactcctcct

SEQ ID NO: 64945 - DNA, 15 bp, Homo sapiens
atacattactcctcc

SEQ ID NO: 64946 - DNA, 15 bp, Homo sapiens
catacattactcctc

SEQ ID NO: 64947 - DNA, 15 bp, Homo sapiens
ccatacattactcct

SEQ ID NO: 64948 - DNA, 15 bp, Homo sapiens
accatacattactcc

SEQ ID NO: 64949 - DNA, 15 bp, Homo sapiens
taccatacattactc

SEQ ID NO: 64950 - DNA, 15 bp, Homo sapiens
ttaccatacattact

SEQ ID NO: 64951 - DNA, 15 bp, Homo sapiens
tttaccatacattac

SEQ ID NO: 64952 - DNA, 15 bp, Homo sapiens
gtttaccatacatta

SEQ ID NO: 64953 - DNA, 15 bp, Homo sapiens
agtttaccatacatt

SEQ ID NO: 64954 - DNA, 15 bp, Homo sapiens
tagtttaccatacat

SEQ ID NO: 64955 - DNA, 15 bp, Homo sapiens
gtagtttaccataca

SEQ ID NO: 64956 - DNA, 15 bp, Homo sapiens
agtagtttaccatac

SEQ ID NO: 64957 - DNA, 15 bp, Homo sapiens
aagtagtttaccata

SEQ ID NO: 64958 - DNA, 15 bp, Homo sapiens
caagtagtttaccat

SEQ ID NO: 64959 - DNA, 15 bp, Homo sapiens
ccaagtagtttacca

SEQ ID NO: 64960 - DNA, 15 bp, Homo sapiens
accaagtagtttacc

SEQ ID NO: 64961 - DNA, 15 bp, Homo sapiens
caccaagtagtttac

SEQ ID NO: 64962 - DNA, 15 bp, Homo sapiens
tcaccaagtagttta

SEQ ID NO: 64963 - DNA, 15 bp, Homo sapiens
ctcaccaagtagttt

SEQ ID NO: 64964 - DNA, 15 bp, Homo sapiens
gctcaccaagtagtt

SEQ ID NO: 64965 - DNA, 15 bp, Homo sapiens
agctcaccaagtagt

SEQ ID NO: 64966 - DNA, 15 bp, Homo sapiens
aagctcaccaagtag

SEQ ID NO: 64967 - DNA, 15 bp, Homo sapiens
aaagctcaccaagta

SEQ ID NO: 64968 - DNA, 15 bp, Homo sapiens
aaaagctcaccaagt

SEQ ID NO: 64969 - DNA, 15 bp, Homo sapiens
gaaaagctcaccaag

SEQ ID NO: 64970 - DNA, 15 bp, Homo sapiens
tgaaaagctcaccaa

SEQ ID NO: 64971 - DNA, 15 bp, Homo sapiens
atgaaaagctcacca

SEQ ID NO: 64972 - DNA, 15 bp, Homo sapiens
catgaaaagctcacc

SEQ ID NO: 64973 - DNA, 15 bp, Homo sapiens
tcatgaaaagctcac

SEQ ID NO: 64974 - DNA, 15 bp, Homo sapiens
ttcatgaaaagctca

SEQ ID NO: 64975 - DNA, 15 bp, Homo sapiens
cttcatgaaaagctc

SEQ ID NO: 64976 - DNA, 15 bp, Homo sapiens
ccttcatgaaaagct

SEQ ID NO: 64977 - DNA, 15 bp, Homo sapiens
cccttcatgaaaagc

SEQ ID NO: 64978 - DNA, 15 bp, Homo sapiens
tcccttcatgaaaag

SEQ ID NO: 64979 - DNA, 15 bp, Homo sapiens
atcccttcatgaaaa

SEQ ID NO: 64980 - DNA, 15 bp, Homo sapiens
aatcccttcatgaaa

SEQ ID NO: 64981 - DNA, 15 bp, Homo sapiens
taatcccttcatgaa

SEQ ID NO: 64982 - DNA, 15 bp, Homo sapiens
gtaatcccttcatga

SEQ ID NO: 64983 - DNA, 15 bp, Homo sapiens
cgtaatcccttcatg

SEQ ID NO: 64984 - DNA, 15 bp, Homo sapiens
tcgtaatcccttcat

SEQ ID NO: 64985 - DNA, 15 bp, Homo sapiens
atcgtaatcccttca

SEQ ID NO: 64986 - DNA, 15 bp, Homo sapiens
catcgtaatcccttc

SEQ ID NO: 64987 - DNA, 15 bp, Homo sapiens
tcatcgtaatccctt

SEQ ID NO: 64988 - DNA, 15 bp, Homo sapiens
atcatcgtaatccct

SEQ ID NO: 64989 - DNA, 15 bp, Homo sapiens
aatcatcgtaatccc

SEQ ID NO: 64990 - DNA, 15 bp, Homo sapiens
aaatcatcgtaatcc

SEQ ID NO: 64991 - DNA, 15 bp, Homo sapiens
gaaatcatcgtaatc

SEQ ID NO: 64992 - DNA, 15 bp, Homo sapiens
tgaaatcatcgtaat

SEQ ID NO: 64993 - DNA, 15 bp, Homo sapiens
atgaaatcatcgtaa

SEQ ID NO: 64994 - DNA, 15 bp, Homo sapiens
aatgaaatcatcgta

SEQ ID NO: 64995 - DNA, 15 bp, Homo sapiens
gaatgaaatcatcgt

SEQ ID NO: 64996 - DNA, 15 bp, Homo sapiens
tgaatgaaatcatcg

SEQ ID NO: 64997 - DNA, 15 bp, Homo sapiens
atgaatgaaatcatc

SEQ ID NO: 64998 - DNA, 15 bp, Homo sapiens
gatgaatgaaatcat

SEQ ID NO: 64999 - DNA, 15 bp, Homo sapiens
tgatgaatgaaatca

SEQ ID NO: 65000 - DNA, 15 bp, Homo sapiens
ctgatgaatgaaatc

SEQ ID NO: 65001 - DNA, 15 bp, Homo sapiens
cctgatgaatgaaat

SEQ ID NO: 65002 - DNA, 15 bp, Homo sapiens
tcctgatgaatgaaa

SEQ ID NO: 65003 - DNA, 15 bp, Homo sapiens
atcctgatgaatgaa

SEQ ID NO: 65004 - DNA, 15 bp, Homo sapiens
tatcctgatgaatga

SEQ ID NO: 65005 - DNA, 15 bp, Homo sapiens
atatcctgatgaatg

SEQ ID NO: 65006 - DNA, 15 bp, Homo sapiens
tatatcctgatgaat

SEQ ID NO: 65007 - DNA, 15 bp, Homo sapiens
ttatatcctgatgaa

SEQ ID NO: 65008 - DNA, 15 bp, Homo sapiens
tttatatcctgatga

SEQ ID NO: 65009 - DNA, 15 bp, Homo sapiens
atttatatcctgatg

SEQ ID NO: 65010 - DNA, 15 bp, Homo sapiens
catttatatcctgat

SEQ ID NO: 65011 - DNA, 15 bp, Homo sapiens
tcatttatatcctga

SEQ ID NO: 65012 - DNA, 15 bp, Homo sapiens
ttcatttatatcctg

SEQ ID NO: 65013 - DNA, 15 bp, Homo sapiens
attcatttatatcct

SEQ ID NO: 65014 - DNA, 15 bp, Homo sapiens
aattcatttatatcc

SEQ ID NO: 65015 - DNA, 15 bp, Homo sapiens
aaattcatttatatc

SEQ ID NO: 65016 - DNA, 15 bp, Homo sapiens
aaaattcatttatat

SEQ ID NO: 65017 - DNA, 15 bp, Homo sapiens
aaaaattcatttata

SEQ ID NO: 65018 - DNA, 15 bp, Homo sapiens
taaaaattcatttat

SEQ ID NO: 65019 - DNA, 15 bp, Homo sapiens
ttaaaaattcattta

SEQ ID NO: 65020 - DNA, 15 bp, Homo sapiens
ctttaaaaattcatt

SEQ ID NO: 65021 - DNA, 15 bp, Homo sapiens
tctttaaaaattcat

SEQ ID NO: 65022 - DNA, 15 bp, Homo sapiens
ctctttaaaaattca

SEQ ID NO: 65023 - DNA, 15 bp, Homo sapiens
tctctttaaaaattc

SEQ ID NO: 65024 - DNA, 15 bp, Homo sapiens
ctctctttaaaaatt

SEQ ID NO: 65025 - DNA, 15 bp, Homo sapiens
tctctctttaaaaat

SEQ ID NO: 65026 - DNA, 15 bp, Homo sapiens
ttctctctttaaaaa

SEQ ID NO: 65027 - DNA, 15 bp, Homo sapiens
tttctctctttaaaa

SEQ ID NO: 65028 - DNA, 15 bp, Homo sapiens
atttctctctttaaa

SEQ ID NO: 65029 - DNA, 15 bp, Homo sapiens
tatttctctctttaa

SEQ ID NO: 65030 - DNA, 15 bp, Homo sapiens
ttatttctctcttta

SEQ ID NO: 65031 - DNA, 15 bp, Homo sapiens
tttatttctctcttt

SEQ ID NO: 65032 - DNA, 15 bp, Homo sapiens
ttttatttctctctt

SEQ ID NO: 65033 - DNA, 15 bp, Homo sapiens
attttatttctctct

SEQ ID NO: 65034 - DNA, 15 bp, Homo sapiens
gattttatttctctc

SEQ ID NO: 65035 - DNA, 15 bp, Homo sapiens
tgattttatttctct

SEQ ID NO: 65036 - DNA, 15 bp, Homo sapiens
atgattttatttctc

SEQ ID NO: 65037 - DNA, 15 bp, Homo sapiens
tatgattttatttct

SEQ ID NO: 65038 - DNA, 15 bp, Homo sapiens
ttatgattttatttc

SEQ ID NO: 65039 - DNA, 15 bp, Homo sapiens
attatgattttattt

SEQ ID NO: 65040 - DNA, 15 bp, Homo sapiens
aattatgattttatt

SEQ ID NO: 65041 - DNA, 15 bp, Homo sapiens
aaattatgattttat

SEQ ID NO: 65042 - DNA, 15 bp, Homo sapiens
taaattatgatttta

SEQ ID NO: 65043 - DNA, 15 bp, Homo sapiens
ataaattatgatttt

SEQ ID NO: 65044 - DNA, 15 bp, Homo sapiens
aataaattatgattt

SEQ ID NO: 65045 - DNA, 15 bp, Homo sapiens
aaataaattatgatt

SEQ ID NO: 65046 - DNA, 15 bp, Homo sapiens
aaaataaattatgat

SEQ ID NO: 65047 - DNA, 15 bp, Homo sapiens
gaaaataaattatga

SEQ ID NO: 65048 - DNA, 15 bp, Homo sapiens
agaaaataaattatg

SEQ ID NO: 65049 - DNA, 15 bp, Homo sapiens
aagaaaataaattat

SEQ ID NO: 65050 - DNA, 15 bp, Homo sapiens
gaagaaaataaatta

SEQ ID NO: 65051 - DNA, 15 bp, Homo sapiens
ggaagaaaataaatt

SEQ ID NO: 65052 - DNA, 15 bp, Homo sapiens
aggaagaaaataaat

SEQ ID NO: 65053 - DNA, 15 bp, Homo sapiens
aaggaagaaaataaa

SEQ ID NO: 65054 - DNA, 15 bp, Homo sapiens
taaggaagaaaataa

SEQ ID NO: 65055 - DNA, 15 bp, Homo sapiens
ctaaggaagaaaata

SEQ ID NO: 65056 - DNA, 15 bp, Homo sapiens
actaaggaagaaaat

SEQ ID NO: 65057 - DNA, 15 bp, Homo sapiens
aactaaggaagaaaa

SEQ ID NO: 65058 - DNA, 15 bp, Homo sapiens
gaactaaggaagaaa

SEQ ID NO: 65059 - DNA, 15 bp, Homo sapiens
agaactaaggaagaa

SEQ ID NO: 65060 - DNA, 15 bp, Homo sapiens
tagaactaaggaaga

SEQ ID NO: 65061 - DNA, 15 bp, Homo sapiens
gtagaactaaggaag

SEQ ID NO: 65062 - DNA, 15 bp, Homo sapiens
agtagaactaaggaa

SEQ ID NO: 65063 - DNA, 15 bp, Homo sapiens
cagtagaactaagga

SEQ ID NO: 65064 - DNA, 15 bp, Homo sapiens
acagtagaactaagg

SEQ ID NO: 65065 - DNA, 15 bp, Homo sapiens
aacagtagaactaag

SEQ ID NO: 65066 - DNA, 15 bp, Homo sapiens
aaacagtagaactaa

SEQ ID NO: 65067 - DNA, 15 bp, Homo sapiens
caaacagtagaacta

SEQ ID NO: 65068 - DNA, 15 bp, Homo sapiens
tcaaacagtagaact

SEQ ID NO: 65069 - DNA, 15 bp, Homo sapiens
ttcaaacagtagaac

SEQ ID NO: 65070 - DNA, 15 bp, Homo sapiens
attcaaacagtagaa

SEQ ID NO: 65071 - DNA, 15 bp, Homo sapiens
gattcaaacagtaga

SEQ ID NO: 65072 - DNA, 15 bp, Homo sapiens
tgattcaaacagtag

SEQ ID NO: 65073 - DNA, 15 bp, Homo sapiens
ttgattcaaacagta

SEQ ID NO: 65074 - DNA, 15 bp, Homo sapiens
attgattcaaacagt

SEQ ID NO: 65075 - DNA, 15 bp, Homo sapiens
gattgattcaaacag

SEQ ID NO: 65076 - DNA, 15 bp, Homo sapiens
ggattgattcaaaca

SEQ ID NO: 65077 - DNA, 15 bp, Homo sapiens
tggattgattcaaac

SEQ ID NO: 65078 - DNA, 15 bp, Homo sapiens
atggattgattcaaa

SEQ ID NO: 65079 - DNA, 15 bp, Homo sapiens
tatggattgattcaa

SEQ ID NO: 65080 - DNA, 15 bp, Homo sapiens
atatggattgattca

SEQ ID NO: 65081 - DNA, 15 bp, Homo sapiens
aatatggattgattc

SEQ ID NO: 65082 - DNA, 15 bp, Homo sapiens
aaatatggattgatt

SEQ ID NO: 65083 - DNA, 15 bp, Homo sapiens
taaatatggattgat

SEQ ID NO: 65084 - DNA, 15 bp, Homo sapiens
ttaaatatggattga

SEQ ID NO: 65085 - DNA, 15 bp, Homo sapiens
attaaatatggattg

SEQ ID NO: 65086 - DNA, 15 bp, Homo sapiens
gattaaatatggatt

SEQ ID NO: 65087 - DNA, 15 bp, Homo sapiens
agattaaatatggat

SEQ ID NO: 65088 - DNA, 15 bp, Homo sapiens
gagattaaatatgga

SEQ ID NO: 65089 - DNA, 15 bp, Homo sapiens
tgagattaaatatgg

SEQ ID NO: 65090 - DNA, 15 bp, Homo sapiens
atgagattaaatatg

SEQ ID NO: 65091 - DNA, 15 bp, Homo sapiens
aatgagattaaatat

SEQ ID NO: 65092 - DNA, 15 bp, Homo sapiens
gaatgagattaaata

SEQ ID NO: 65093 - DNA, 15 bp, Homo sapiens
agaatgagattaaat

SEQ ID NO: 65094 - DNA, 15 bp, Homo sapiens
cagaatgagattaaa

SEQ ID NO: 65095 - DNA, 15 bp, Homo sapiens
acagaatgagattaa

SEQ ID NO: 65096 - DNA, 15 bp, Homo sapiens
aacagaatgagatta

SEQ ID NO: 65097 - DNA, 15 bp, Homo sapiens
aaacagaatgagatt

SEQ ID NO: 65098 - DNA, 15 bp, Homo sapiens
aaaacagaatgagat

SEQ ID NO: 65099 - DNA, 15 bp, Homo sapiens
taaaacagaatgaga

SEQ ID NO: 65100 - DNA, 15 bp, Homo sapiens
ctaaaacagaatgag

SEQ ID NO: 65101 - DNA, 15 bp, Homo sapiens
actaaaacagaatga

SEQ ID NO: 65102 - DNA, 15 bp, Homo sapiens
gactaaaacagaatg

SEQ ID NO: 65103 - DNA, 15 bp, Homo sapiens
agactaaaacagaat

SEQ ID NO: 65104 - DNA, 15 bp, Homo sapiens
tagactaaaacagaa

SEQ ID NO: 65105 - DNA, 15 bp, Homo sapiens
ctagactaaaacaga

SEQ ID NO: 65106 - DNA, 15 bp, Homo sapiens
gctagactaaaacag

SEQ ID NO: 65107 - DNA, 15 bp, Homo sapiens
ggctagactaaaaca

SEQ ID NO: 65108 - DNA, 15 bp, Homo sapiens
tggctagactaaaac

SEQ ID NO: 65109 - DNA, 15 bp, Homo sapiens
ctggctagactaaaa

SEQ ID NO: 65110 - DNA, 15 bp, Homo sapiens
actggctagactaaa

SEQ ID NO: 65111 - DNA, 15 bp, Homo sapiens
gactggctagactaa

SEQ ID NO: 65112 - DNA, 15 bp, Homo sapiens
ggactggctagacta

SEQ ID NO: 65113 - DNA, 15 bp, Homo sapiens
aggactggctagact

SEQ ID NO: 65114 - DNA, 15 bp, Homo sapiens
aaggactggctagac

SEQ ID NO: 65115 - DNA, 15 bp, Homo sapiens
caaggactggctaga

SEQ ID NO: 65116 - DNA, 15 bp, Homo sapiens
acaaggactggctag

SEQ ID NO: 65117 - DNA, 15 bp, Homo sapiens
tacaaggactggcta

SEQ ID NO: 65118 - DNA, 15 bp, Homo sapiens
ttacaaggactggct

SEQ ID NO: 65119 - DNA, 15 bp, Homo sapiens
attacaaggactggc

SEQ ID NO: 65120 - DNA, 15 bp, Homo sapiens
aattacaaggactgg

SEQ ID NO: 65121 - DNA, 15 bp, Homo sapiens
gaattacaaggactg

SEQ ID NO: 65122 - DNA, 15 bp, Homo sapiens
tgaattacaaggact

SEQ ID NO: 65123 - DNA, 15 bp, Homo sapiens
atgaattacaaggac

SEQ ID NO: 65124 - DNA, 15 bp, Homo sapiens
tatgaattacaagga

SEQ ID NO: 65125 - DNA, 15 bp, Homo sapiens
ttatgaattacaagg

SEQ ID NO: 65126 - DNA, 15 bp, Homo sapiens
cttatgaattacaag

SEQ ID NO: 65127 - DNA, 15 bp, Homo sapiens
tcttatgaattacaa

SEQ ID NO: 65128 - DNA, 15 bp, Homo sapiens
atcttatgaattaca

SEQ ID NO: 65129 - DNA, 15 bp, Homo sapiens
catcttatgaattac

SEQ ID NO: 65130 - DNA, 15 bp, Homo sapiens
tcatcttatgaatta

SEQ ID NO: 65131 - DNA, 15 bp, Homo sapiens
ctcatcttatgaatt

SEQ ID NO: 65132 - DNA, 15 bp, Homo sapiens
tctcatcttatgaat

SEQ ID NO: 65133 - DNA, 15 bp, Homo sapiens
ctctcatcttatgaa

SEQ ID NO: 65134 - DNA, 15 bp, Homo sapiens
tctctcatcttatga

SEQ ID NO: 65135 - DNA, 15 bp, Homo sapiens
ttctctcatcttatg

SEQ ID NO: 65136 - DNA, 15 bp, Homo sapiens
attctctcatcttat

SEQ ID NO: 65137 - DNA, 15 bp, Homo sapiens
gattctctcatctta

SEQ ID NO: 65138 - DNA, 15 bp, Homo sapiens
agattctctcatctt

SEQ ID NO: 65139 - DNA, 15 bp, Homo sapiens
aagattctctcatct

SEQ ID NO: 65140 - DNA, 15 bp, Homo sapiens
taagattctctcatc

SEQ ID NO: 65141 - DNA, 15 bp, Homo sapiens
ttaagattctctcat

SEQ ID NO: 65142 - DNA, 15 bp, Homo sapiens
cttaagattctctca

SEQ ID NO: 65143 - DNA, 15 bp, Homo sapiens
tcttaagattctctc

SEQ ID NO: 65144 - DNA, 15 bp, Homo sapiens
ttcttaagattctct

SEQ ID NO: 65145 - DNA, 15 bp, Homo sapiens
attcttaagattctc

SEQ ID NO: 65146 - DNA, 15 bp, Homo sapiens
aattcttaagattct

SEQ ID NO: 65147 - DNA, 15 bp, Homo sapiens
caattcttaagattc

SEQ ID NO: 65148 - DNA, 15 bp, Homo sapiens
ccaattcttaagatt

SEQ ID NO: 65149 - DNA, 15 bp, Homo sapiens
tccaattcttaagat

SEQ ID NO: 65150 - DNA, 15 bp, Homo sapiens
gtccaattcttaaga

SEQ ID NO: 65151 - DNA, 15 bp, Homo sapiens
ggtccaattcttaag

SEQ ID NO: 65152 - DNA, 15 bp, Homo sapiens
aggtccaattcttaa

SEQ ID NO: 65153 - DNA, 15 bp, Homo sapiens
aaggtccaattctta

SEQ ID NO: 65154 - DNA, 15 bp, Homo sapiens
taaggtccaattctt

SEQ ID NO: 65155 - DNA, 15 bp, Homo sapiens
ctaaggtccaattct

SEQ ID NO: 65156 - DNA, 15 bp, Homo sapiens
tctaaggtccaattc

SEQ ID NO: 65157 - DNA, 15 bp, Homo sapiens
ttctaaggtccaatt

SEQ ID NO: 65158 - DNA, 15 bp, Homo sapiens
cttctaaggtccaat

SEQ ID NO: 65159 - DNA, 15 bp, Homo sapiens
acttctaaggtccaa

SEQ ID NO: 65160 - DNA, 15 bp, Homo sapiens
gacttctaaggtcca

SEQ ID NO: 65161 - DNA, 15 bp, Homo sapiens
tgacttctaaggtcc

SEQ ID NO: 65162 - DNA, 15 bp, Homo sapiens
gtgacttctaaggtc

SEQ ID NO: 65163 - DNA, 15 bp, Homo sapiens
agtgacttctaaggt

SEQ ID NO: 65164 - DNA, 15 bp, Homo sapiens
aagtgacttctaagg

SEQ ID NO: 65165 - DNA, 15 bp, Homo sapiens
caagtgacttctaag

SEQ ID NO: 65166 - DNA, 15 bp, Homo sapiens
ccaagtgacttctaa

SEQ ID NO: 65167 - DNA, 15 bp, Homo sapiens
accaagtgacttcta

SEQ ID NO: 65168 - DNA, 15 bp, Homo sapiens
aaccaagtgacttct

SEQ ID NO: 65169 - DNA, 15 bp, Homo sapiens
gaaccaagtgacttc

SEQ ID NO: 65170 - DNA, 15 bp, Homo sapiens
tgaaccaagtgactt

SEQ ID NO: 65171 - DNA, 15 bp, Homo sapiens
ttgaaccaagtgact

SEQ ID NO: 65172 - DNA, 15 bp, Homo sapiens
gttgaaccaagtgac

SEQ ID NO: 65173 - DNA, 15 bp, Homo sapiens
tgttgaaccaagtga

SEQ ID NO: 65174 - DNA, 15 bp, Homo sapiens
atgttgaaccaagtg

SEQ ID NO: 65175 - DNA, 15 bp, Homo sapiens
aatgttgaaccaagt

SEQ ID NO: 65176 - DNA, 15 bp, Homo sapiens
gaatgttgaaccaag

SEQ ID NO: 65177 - DNA, 15 bp, Homo sapiens
agaatgttgaaccaa

SEQ ID NO: 65178 - DNA, 15 bp, Homo sapiens
tagaatgttgaacca

SEQ ID NO: 65179 - DNA, 15 bp, Homo sapiens
ctagaatgttgaacc

SEQ ID NO: 65180 - DNA, 15 bp, Homo sapiens
actagaatgttgaac

SEQ ID NO: 65181 - DNA, 15 bp, Homo sapiens
cactagaatgttgaa

SEQ ID NO: 65182 - DNA, 15 bp, Homo sapiens
tcactagaatgttga

SEQ ID NO: 65183 - DNA, 15 bp, Homo sapiens
gtcactagaatgttg

SEQ ID NO: 65184 - DNA, 15 bp, Homo sapiens
ggtcactagaatgtt

SEQ ID NO: 65185 - DNA, 15 bp, Homo sapiens
tggtcactagaatgt

SEQ ID NO: 65186 - DNA, 15 bp, Homo sapiens
ttggtcactagaatg

SEQ ID NO: 65187 - DNA, 15 bp, Homo sapiens
cttggtcactagaat

SEQ ID NO: 65188 - DNA, 15 bp, Homo sapiens
gcttggtcactagaa

SEQ ID NO: 65189 - DNA, 15 bp, Homo sapiens
tgcttggtcactaga

SEQ ID NO: 65190 - DNA, 15 bp, Homo sapiens
ttgcttggtcactag

SEQ ID NO: 65191 - DNA, 15 bp, Homo sapiens
gttgcttggtcacta

SEQ ID NO: 65192 - DNA, 15 bp, Homo sapiens
ggttgcttggtcact

SEQ ID NO: 65193 - DNA, 15 bp, Homo sapiens
tggttgcttggtcac

SEQ ID NO: 65194 - DNA, 15 bp, Homo sapiens
ttggttgcttggtca

SEQ ID NO: 65195 - DNA, 15 bp, Homo sapiens
cttggttgcttggtc

SEQ ID NO: 65196 - DNA, 15 bp, Homo sapiens
tcttggttgcttggt

SEQ ID NO: 65197 - DNA, 15 bp, Homo sapiens
gtcttggttgcttgg

SEQ ID NO: 65198 - DNA, 15 bp, Homo sapiens
tgtcttggttgcttg

SEQ ID NO: 65199 - DNA, 15 bp, Homo sapiens
atgtcttggttgctt

SEQ ID NO: 65200 - DNA, 15 bp, Homo sapiens
tatgtcttggttgct

SEQ ID NO: 65201 - DNA, 15 bp, Homo sapiens
gtatgtcttggttgc

SEQ ID NO: 65202 - DNA, 15 bp, Homo sapiens
tgtatgtcttggttg

SEQ ID NO: 65203 - DNA, 15 bp, Homo sapiens
atgtatgtcttggtt

SEQ ID NO: 65204 - DNA, 15 bp, Homo sapiens
catgtatgtcttggt

SEQ ID NO: 65205 - DNA, 15 bp, Homo sapiens
acatgtatgtcttgg

SEQ ID NO: 65206 - DNA, 15 bp, Homo sapiens
tacatgtatgtcttg

SEQ ID NO: 65207 - DNA, 15 bp, Homo sapiens
ctacatgtatgtctt

SEQ ID NO: 65208 - DNA, 15 bp, Homo sapiens
tctacatgtatgtct

SEQ ID NO: 65209 - DNA, 15 bp, Homo sapiens
atctacatgtatgtc

SEQ ID NO: 65210 - DNA, 15 bp, Homo sapiens
aatctacatgtatgt

SEQ ID NO: 65211 - DNA, 15 bp, Homo sapiens
aaatctacatgtatg

SEQ ID NO: 65212 - DNA, 15 bp, Homo sapiens
gaaatctacatgtat

SEQ ID NO: 65213 - DNA, 15 bp, Homo sapiens
tgaaatctacatgta

SEQ ID NO: 65214 - DNA, 15 bp, Homo sapiens
ttgaaatctacatgt

SEQ ID NO: 65215 - DNA, 15 bp, Homo sapiens
tttgaaatctacatg

SEQ ID NO: 65216 - DNA, 15 bp, Homo sapiens
ttttgaaatctacat

SEQ ID NO: 65217 - DNA, 15 bp, Homo sapiens
attttgaaatctaca

SEQ ID NO: 65218 - DNA, 15 bp, Homo sapiens
aattttgaaatctac

SEQ ID NO: 65219 - DNA, 15 bp, Homo sapiens
taattttgaaatcta

SEQ ID NO: 65220 - DNA, 15 bp, Homo sapiens
ataattttgaaatct

SEQ ID NO: 65221 - DNA, 15 bp, Homo sapiens
tataattttgaaatc

SEQ ID NO: 65222 - DNA, 15 bp, Homo sapiens
ttataattttgaaat

SEQ ID NO: 65223 - DNA, 15 bp, Homo sapiens
cttataattttgaaa

SEQ ID NO: 65224 - DNA, 15 bp, Homo sapiens
tcttataattttgaa

SEQ ID NO: 65225 - DNA, 15 bp, Homo sapiens
ttcttataattttga

SEQ ID NO: 65226 - DNA, 15 bp, Homo sapiens
gttcttataattttg

SEQ ID NO: 65227 - DNA, 15 bp, Homo sapiens
agttcttataatttt

SEQ ID NO: 65228 - DNA, 15 bp, Homo sapiens
tagttcttataattt

SEQ ID NO: 65229 - DNA, 15 bp, Homo sapiens
gtagttcttataatt

SEQ ID NO: 65230 - DNA, 15 bp, Homo sapiens
tgtagttcttataat

SEQ ID NO: 65231 - DNA, 15 bp, Homo sapiens
atgtagttcttataa

SEQ ID NO: 65232 - DNA, 15 bp, Homo sapiens
aatgtagttcttata

SEQ ID NO: 65233 - DNA, 15 bp, Homo sapiens
aaatgtagttcttat

SEQ ID NO: 65234 - DNA, 15 bp, Homo sapiens
gaaatgtagttctta

SEQ ID NO: 65235 - DNA, 15 bp, Homo sapiens
tgaaatgtagttctt

SEQ ID NO: 65236 - DNA, 15 bp, Homo sapiens
ctgaaatgtagttct

SEQ ID NO: 65237 - DNA, 15 bp, Homo sapiens
tctgaaatgtagttc

SEQ ID NO: 65238 - DNA, 15 bp, Homo sapiens
ctctgaaatgtagtt

SEQ ID NO: 65239 - DNA, 15 bp, Homo sapiens
tctctgaaatgtagt

SEQ ID NO: 65240 - DNA, 15 bp, Homo sapiens
ctctctgaaatgtag

SEQ ID NO: 65241 - DNA, 15 bp, Homo sapiens
tctctctgaaatgta

SEQ ID NO: 65242 - DNA, 15 bp, Homo sapiens
ttctctctgaaatgt

SEQ ID NO: 65243 - DNA, 15 bp, Homo sapiens
tttctctctgaaatg

SEQ ID NO: 65244 - DNA, 15 bp, Homo sapiens
ctttctctctgaaat

SEQ ID NO: 65245 - DNA, 15 bp, Homo sapiens
tctttctctctgaaa

SEQ ID NO: 65246 - DNA, 15 bp, Homo sapiens
ttctttctctctgaa

SEQ ID NO: 65247 - DNA, 15 bp, Homo sapiens
tttctttctctctga

SEQ ID NO: 65248 - DNA, 15 bp, Homo sapiens
ctttctttctctctg

SEQ ID NO: 65249 - DNA, 15 bp, Homo sapiens
gctttctttctctct

SEQ ID NO: 65250 - DNA, 15 bp, Homo sapiens
agctttctttctctc

SEQ ID NO: 65251 - DNA, 15 bp, Homo sapiens
aagctttctttctct

SEQ ID NO: 65252 - DNA, 15 bp, Homo sapiens
gaagctttctttctc

SEQ ID NO: 65253 - DNA, 15 bp, Homo sapiens
agaagctttctttct

SEQ ID NO: 65254 - DNA, 15 bp, Homo sapiens
gagaagctttctttc

SEQ ID NO: 65255 - DNA, 15 bp, Homo sapiens
agagaagctttcttt

SEQ ID NO: 65256 - DNA, 15 bp, Homo sapiens
cagagaagctttctt

SEQ ID NO: 65257 - DNA, 15 bp, Homo sapiens
ccagagaagctttct

SEQ ID NO: 65258 - DNA, 15 bp, Homo sapiens
tccagagaagctttc

SEQ ID NO: 65259 - DNA, 15 bp, Homo sapiens
atccagagaagcttt

SEQ ID NO: 65260 - DNA, 15 bp, Homo sapiens
catccagagaagctt

SEQ ID NO: 65261 - DNA, 15 bp, Homo sapiens
ccatccagagaagct

SEQ ID NO: 65262 - DNA, 15 bp, Homo sapiens
tccatccagagaagc

SEQ ID NO: 65263 - DNA, 15 bp, Homo sapiens
gtccatccagagaag

SEQ ID NO: 65264 - DNA, 15 bp, Homo sapiens
ggtccatccagagaa

SEQ ID NO: 65265 - DNA, 15 bp, Homo sapiens
aggtccatccagaga

SEQ ID NO: 65266 - DNA, 15 bp, Homo sapiens
aaggtccatccagag

SEQ ID NO: 65267 - DNA, 15 bp, Homo sapiens
taaggtccatccaga

SEQ ID NO: 65268 - DNA, 15 bp, Homo sapiens
ttaaggtccatccag

SEQ ID NO: 65269 - DNA, 15 bp, Homo sapiens
tttaaggtccatcca

SEQ ID NO: 65270 - DNA, 15 bp, Homo sapiens
atttaaggtccatcc

SEQ ID NO: 65271 - DNA, 15 bp, Homo sapiens
aatttaaggtccatc

SEQ ID NO: 65272 - DNA, 15 bp, Homo sapiens
gaatttaaggtccat

SEQ ID NO: 65273 - DNA, 15 bp, Homo sapiens
tgaatttaaggtcca

SEQ ID NO: 65274 - DNA, 15 bp, Homo sapiens
atgaatttaaggtcc

SEQ ID NO: 65275 - DNA, 15 bp, Homo sapiens
gatgaatttaaggtc

SEQ ID NO: 65276 - DNA, 15 bp, Homo sapiens
ggatgaatttaaggt

SEQ ID NO: 65277 - DNA, 15 bp, Homo sapiens
aggatgaatttaagg

SEQ ID NO: 65278 - DNA, 15 bp, Homo sapiens
caggatgaatttaag

SEQ ID NO: 65279 - DNA, 15 bp, Homo sapiens
acaggatgaatttaa

SEQ ID NO: 65280 - DNA, 15 bp, Homo sapiens
aacaggatgaattta

SEQ ID NO: 65281 - DNA, 15 bp, Homo sapiens
caacaggatgaattt

SEQ ID NO: 65282 - DNA, 15 bp, Homo sapiens
gcaacaggatgaatt

SEQ ID NO: 65283 - DNA, 15 bp, Homo sapiens
agcaacaggatgaat

SEQ ID NO: 65284 - DNA, 15 bp, Homo sapiens
tagcaacaggatgaa

SEQ ID NO: 65285 - DNA, 15 bp, Homo sapiens
gtagcaacaggatga

SEQ ID NO: 65286 - DNA, 15 bp, Homo sapiens
agtagcaacaggatg

SEQ ID NO: 65287 - DNA, 15 bp, Homo sapiens
aagtagcaacaggat

SEQ ID NO: 65288 - DNA, 15 bp, Homo sapiens
caagtagcaacagga

SEQ ID NO: 65289 - DNA, 15 bp, Homo sapiens
acaagtagcaacagg

SEQ ID NO: 65290 - DNA, 15 bp, Homo sapiens
aacaagtagcaacag

SEQ ID NO: 65291 - DNA, 15 bp, Homo sapiens
aaacaagtagcaaca

SEQ ID NO: 65292 - DNA, 15 bp, Homo sapiens
aaaacaagtagcaac

SEQ ID NO: 65293 - DNA, 15 bp, Homo sapiens
caaaacaagtagcaa

SEQ ID NO: 65294 - DNA, 15 bp, Homo sapiens
ccaaaacaagtagca

SEQ ID NO: 65295 - DNA, 15 bp, Homo sapiens
cccaaaacaagtagc

SEQ ID NO: 65296 - DNA, 15 bp, Homo sapiens
acccaaaacaagtag

SEQ ID NO: 65297 - DNA, 15 bp, Homo sapiens
aacccaaaacaagta

SEQ ID NO: 65298 - DNA, 15 bp, Homo sapiens
caacccaaaacaagt

SEQ ID NO: 65299 - DNA, 15 bp, Homo sapiens
acaacccaaaacaag

SEQ ID NO: 65300 - DNA, 15 bp, Homo sapiens
aacaacccaaaacaa

SEQ ID NO: 65301 - DNA, 15 bp, Homo sapiens
taacaacccaaaaca

SEQ ID NO: 65302 - DNA, 15 bp, Homo sapiens
gtaacaacccaaaac

SEQ ID NO: 65303 - DNA, 15 bp, Homo sapiens
agtaacaacccaaaa

SEQ ID NO: 65304 - DNA, 15 bp, Homo sapiens
aagtaacaacccaaa

SEQ ID NO: 65305 - DNA, 15 bp, Homo sapiens
taagtaacaacccaa

SEQ ID NO: 65306 - DNA, 15 bp, Homo sapiens
ttaagtaacaaccca

SEQ ID NO: 65307 - DNA, 15 bp, Homo sapiens
tttaagtaacaaccc

SEQ ID NO: 65308 - DNA, 15 bp, Homo sapiens
gtttaagtaacaacc

SEQ ID NO: 65309 - DNA, 15 bp, Homo sapiens
agtttaagtaacaac

SEQ ID NO: 65310 - DNA, 15 bp, Homo sapiens
gagtttaagtaacaa

SEQ ID NO: 65311 - DNA, 15 bp, Homo sapiens
agagtttaagtaaca

SEQ ID NO: 65312 - DNA, 15 bp, Homo sapiens
gagagtttaagtaac

SEQ ID NO: 65313 - DNA, 15 bp, Homo sapiens
tgagagtttaagtaa

SEQ ID NO: 65314 - DNA, 15 bp, Homo sapiens
ttgagagtttaagta

SEQ ID NO: 65315 - DNA, 15 bp, Homo sapiens
attgagagtttaagt

SEQ ID NO: 65316 - DNA, 15 bp, Homo sapiens
gattgagagtttaag

SEQ ID NO: 65317 - DNA, 15 bp, Homo sapiens
tgattgagagtttaa

SEQ ID NO: 65318 - DNA, 15 bp, Homo sapiens
gtgattgagagttta

SEQ ID NO: 65319 - DNA, 15 bp, Homo sapiens
tgtgattgagagttt

SEQ ID NO: 65320 - DNA, 15 bp, Homo sapiens
ctgtgattgagagtt

SEQ ID NO: 65321 - DNA, 15 bp, Homo sapiens
actgtgattgagagt

SEQ ID NO: 65322 - DNA, 15 bp, Homo sapiens
aactgtgattgagag

SEQ ID NO: 65323 - DNA, 15 bp, Homo sapiens
aaactgtgattgaga

SEQ ID NO: 65324 - DNA, 15 bp, Homo sapiens
aaaactgtgattgag

SEQ ID NO: 65325 - DNA, 15 bp, Homo sapiens
caaaactgtgattga

SEQ ID NO: 65326 - DNA, 15 bp, Homo sapiens
acaaaactgtgattg

SEQ ID NO: 65327 - DNA, 15 bp, Homo sapiens
gacaaaactgtgatt

SEQ ID NO: 65328 - DNA, 15 bp, Homo sapiens
agacaaaactgtgat

SEQ ID NO: 65329 - DNA, 15 bp, Homo sapiens
cagacaaaactgtga

SEQ ID NO: 65330 - DNA, 15 bp, Homo sapiens
gcagacaaaactgtg

SEQ ID NO: 65331 - DNA, 15 bp, Homo sapiens
tgcagacaaaactgt

SEQ ID NO: 65332 - DNA, 15 bp, Homo sapiens
ttgcagacaaaactg

SEQ ID NO: 65333 - DNA, 15 bp, Homo sapiens
tttgcagacaaaact

SEQ ID NO: 65334 - DNA, 15 bp, Homo sapiens
ttttgcagacaaaac

SEQ ID NO: 65335 - DNA, 15 bp, Homo sapiens
attttgcagacaaaa

SEQ ID NO: 65336 - DNA, 15 bp, Homo sapiens
cattttgcagacaaa

SEQ ID NO: 65337 - DNA, 15 bp, Homo sapiens
acattttgcagacaa

SEQ ID NO: 65338 - DNA, 15 bp, Homo sapiens
cacattttgcagaca

SEQ ID NO: 65339 - DNA, 15 bp, Homo sapiens
ccacattttgcagac

SEQ ID NO: 65340 - DNA, 15 bp, Homo sapiens
accacattttgcaga

SEQ ID NO: 65341 - DNA, 15 bp, Homo sapiens
aaccacattttgcag

SEQ ID NO: 65342 - DNA, 15 bp, Homo sapiens
taaccacattttgca

SEQ ID NO: 65343 - DNA, 15 bp, Homo sapiens
ttaaccacattttgc

SEQ ID NO: 65344 - DNA, 15 bp, Homo sapiens
tttaaccacattttg

SEQ ID NO: 65345 - DNA, 15 bp, Homo sapiens
ttttaaccacatttt

SEQ ID NO: 65346 - DNA, 15 bp, Homo sapiens
gttttaaccacattt

SEQ ID NO: 65347 - DNA, 15 bp, Homo sapiens
ggttttaaccacatt

SEQ ID NO: 65348 - DNA, 15 bp, Homo sapiens
tggttttaaccacat

SEQ ID NO: 65349 - DNA, 15 bp, Homo sapiens
gtggttttaaccaca

SEQ ID NO: 65350 - DNA, 15 bp, Homo sapiens
ggtggttttaaccac

SEQ ID NO: 65351 - DNA, 15 bp, Homo sapiens
tggtggttttaacca

SEQ ID NO: 65352 - DNA, 15 bp, Homo sapiens
ttggtggttttaacc

SEQ ID NO: 65353 - DNA, 15 bp, Homo sapiens
gttggtggttttaac

SEQ ID NO: 65354 - DNA, 15 bp, Homo sapiens
agttggtggttttaa

SEQ ID NO: 65355 - DNA, 15 bp, Homo sapiens
aagttggtggtttta

SEQ ID NO: 65356 - DNA, 15 bp, Homo sapiens
gaagttggtggtttt

SEQ ID NO: 65357 - DNA, 15 bp, Homo sapiens
tgaagttggtggttt

SEQ ID NO: 65358 - DNA, 15 bp, Homo sapiens
atgaagttggtggtt

SEQ ID NO: 65359 - DNA, 15 bp, Homo sapiens
tatgaagttggtggt

SEQ ID NO: 65360 - DNA, 15 bp, Homo sapiens
ttatgaagttggtgg

SEQ ID NO: 65361 - DNA, 15 bp, Homo sapiens
tttatgaagttggtg

SEQ ID NO: 65362 - DNA, 15 bp, Homo sapiens
ctttatgaagttggt

SEQ ID NO: 65363 - DNA, 15 bp, Homo sapiens
tctttatgaagttgg

SEQ ID NO: 65364 - DNA, 15 bp, Homo sapiens
atctttatgaagttg

SEQ ID NO: 65365 - DNA, 15 bp, Homo sapiens
tatctttatgaagtt

SEQ ID NO: 65366 - DNA, 15 bp, Homo sapiens
ttatctttatgaagt

SEQ ID NO: 65367 - DNA, 15 bp, Homo sapiens
attatctttatgaag

SEQ ID NO: 65368 - DNA, 15 bp, Homo sapiens
cattatctttatgaa

SEQ ID NO: 65369 - DNA, 15 bp, Homo sapiens
tcattatctttatga

SEQ ID NO: 65370 - DNA, 15 bp, Homo sapiens
ttcattatctttatg

SEQ ID NO: 65371 - DNA, 15 bp, Homo sapiens
attcattatctttat

SEQ ID NO: 65372 - DNA, 15 bp, Homo sapiens
aattcattatcttta

SEQ ID NO: 65373 - DNA, 15 bp, Homo sapiens
gaattcattatcttt

SEQ ID NO: 65374 - DNA, 15 bp, Homo sapiens
tgaattcattatctt

SEQ ID NO: 65375 - DNA, 15 bp, Homo sapiens
ttgaattcattatct

SEQ ID NO: 65376 - DNA, 15 bp, Homo sapiens
tttgaattcattatc

SEQ ID NO: 65377 - DNA, 15 bp, Homo sapiens
ctttgaattcattat

SEQ ID NO: 65378 - DNA, 15 bp, Homo sapiens
actttgaattcatta

SEQ ID NO: 65379 - DNA, 15 bp, Homo sapiens
tactttgaattcatt

SEQ ID NO: 65380 - DNA, 15 bp, Homo sapiens
atactttgaattcat

SEQ ID NO: 65381 - DNA, 15 bp, Homo sapiens
gatactttgaattca

SEQ ID NO: 65382 - DNA, 15 bp, Homo sapiens
agatactttgaattc

SEQ ID NO: 65383 - DNA, 15 bp, Homo sapiens
tagatactttgaatt

SEQ ID NO: 65384 - DNA, 15 bp, Homo sapiens
ttagatactttgaat

SEQ ID NO: 65385 - DNA, 15 bp, Homo sapiens
tttagatactttgaa

SEQ ID NO: 65386 - DNA, 15 bp, Homo sapiens
ttttagatactttga

SEQ ID NO: 65387 - DNA, 15 bp, Homo sapiens
attttagatactttg

SEQ ID NO: 65388 - DNA, 15 bp, Homo sapiens
cattttagatacttt

SEQ ID NO: 65389 - DNA, 15 bp, Homo sapiens
tcattttagatactt

SEQ ID NO: 65390 - DNA, 15 bp, Homo sapiens
gtcattttagatact

SEQ ID NO: 65391 - DNA, 15 bp, Homo sapiens
tgtcattttagatac

SEQ ID NO: 65392 - DNA, 15 bp, Homo sapiens
atgtcattttagata

SEQ ID NO: 65393 - DNA, 15 bp, Homo sapiens
aatgtcattttagat

SEQ ID NO: 65394 - DNA, 15 bp, Homo sapiens
taatgtcattttaga

SEQ ID NO: 65395 - DNA, 15 bp, Homo sapiens
ttaatgtcattttag

SEQ ID NO: 65396 - DNA, 15 bp, Homo sapiens
attaatgtcatttta

SEQ ID NO: 65397 - DNA, 15 bp, Homo sapiens
tattaatgtcatttt

SEQ ID NO: 65398 - DNA, 15 bp, Homo sapiens
ttattaatgtcattt

SEQ ID NO: 65399 - DNA, 15 bp, Homo sapiens
tttattaatgtcatt

SEQ ID NO: 65400 - DNA, 15 bp, Homo sapiens
gtttattaatgtcat

SEQ ID NO: 65401 - DNA, 15 bp, Homo sapiens
tgtttattaatgtca

SEQ ID NO: 65402 - DNA, 15 bp, Homo sapiens
gtgtttattaatgtc

SEQ ID NO: 65403 - DNA, 15 bp, Homo sapiens
agtgtttattaatgt

SEQ ID NO: 65404 - DNA, 15 bp, Homo sapiens
gagtgtttattaatg

SEQ ID NO: 65405 - DNA, 15 bp, Homo sapiens
tgagtgtttattaat

SEQ ID NO: 65406 - DNA, 15 bp, Homo sapiens
ttgagtgtttattaa

SEQ ID NO: 65407 - DNA, 15 bp, Homo sapiens
gttgagtgtttatta

SEQ ID NO: 65408 - DNA, 15 bp, Homo sapiens
tgttgagtgtttatt

SEQ ID NO: 65409 - DNA, 15 bp, Homo sapiens
ttgttgagtgtttat

SEQ ID NO: 65410 - DNA, 15 bp, Homo sapiens
cttgttgagtgttta

SEQ ID NO: 65411 - DNA, 15 bp, Homo sapiens
gcttgttgagtgttt

SEQ ID NO: 65412 - DNA, 15 bp, Homo sapiens
tgcttgttgagtgtt

SEQ ID NO: 65413 - DNA, 15 bp, Homo sapiens
ttgcttgttgagtgt

SEQ ID NO: 65414 - DNA, 15 bp, Homo sapiens
gttgcttgttgagtg

SEQ ID NO: 65415 - DNA, 15 bp, Homo sapiens
tgttgcttgttgagt

SEQ ID NO: 65416 - DNA, 15 bp, Homo sapiens
ctgttgcttgttgag

SEQ ID NO: 65417 - DNA, 15 bp, Homo sapiens
gctgttgcttgttga

SEQ ID NO: 65418 - DNA, 15 bp, Homo sapiens
agctgttgcttgttg

SEQ ID NO: 65419 - DNA, 15 bp, Homo sapiens
tagctgttgcttgtt

SEQ ID NO: 65420 - DNA, 15 bp, Homo sapiens
atagctgttgcttgt

SEQ ID NO: 65421 - DNA, 15 bp, Homo sapiens
gatagctgttgcttg

SEQ ID NO: 65422 - DNA, 15 bp, Homo sapiens
tgatagctgttgctt

SEQ ID NO: 65423 - DNA, 15 bp, Homo sapiens
atgatagctgttgct

SEQ ID NO: 65424 - DNA, 15 bp, Homo sapiens
aatgatagctgttgc

SEQ ID NO: 65425 - DNA, 15 bp, Homo sapiens
taatgatagctgttg

SEQ ID NO: 65426 - DNA, 15 bp, Homo sapiens
ataatgatagctgtt

SEQ ID NO: 65427 - DNA, 15 bp, Homo sapiens
aataatgatagctgt

SEQ ID NO: 65428 - DNA, 15 bp, Homo sapiens
taataatgatagctg

SEQ ID NO: 65429 - DNA, 15 bp, Homo sapiens
ataataatgatagct

SEQ ID NO: 65430 - DNA, 15 bp, Homo sapiens
gataataatgatagc

SEQ ID NO: 65431 - DNA, 15 bp, Homo sapiens
tgataataatgatag

SEQ ID NO: 65432 - DNA, 15 bp, Homo sapiens
atgataataatgata

SEQ ID NO: 65433 - DNA, 15 bp, Homo sapiens
aatgataataatgat

SEQ ID NO: 65434 - DNA, 15 bp, Homo sapiens
aaatgataataatga

SEQ ID NO: 65435 - DNA, 15 bp, Homo sapiens
aaaatgataataatg

SEQ ID NO: 65436 - DNA, 15 bp, Homo sapiens
aaaaatgataataat

SEQ ID NO: 65437 - DNA, 15 bp, Homo sapiens
gaaaaatgataataa

SEQ ID NO: 65438 - DNA, 15 bp, Homo sapiens
agaaaaatgataata

SEQ ID NO: 65439 - DNA, 15 bp, Homo sapiens
aagaaaaatgataat

SEQ ID NO: 65440 - DNA, 15 bp, Homo sapiens
gaagaaaaatgataa

SEQ ID NO: 65441 - DNA, 15 bp, Homo sapiens
agaagaaaaatgata

SEQ ID NO: 65442 - DNA, 15 bp, Homo sapiens
aagaagaaaaatgat

SEQ ID NO: 65443 - DNA, 15 bp, Homo sapiens
caagaagaaaaatga

SEQ ID NO: 65444 - DNA, 15 bp, Homo sapiens
tcaagaagaaaaatg

SEQ ID NO: 65445 - DNA, 15 bp, Homo sapiens
atcaagaagaaaaat

SEQ ID NO: 65446 - DNA, 15 bp, Homo sapiens
aatcaagaagaaaaa

SEQ ID NO: 65447 - DNA, 15 bp, Homo sapiens
aaatcaagaagaaaa

SEQ ID NO: 65448 - DNA, 15 bp, Homo sapiens
caaatcaagaagaaa

SEQ ID NO: 65449 - DNA, 15 bp, Homo sapiens
acaaatcaagaagaa

SEQ ID NO: 65450 - DNA, 15 bp, Homo sapiens
aacaaatcaagaaga

SEQ ID NO: 65451 - DNA, 15 bp, Homo sapiens
aaacaaatcaagaag

SEQ ID NO: 65452 - DNA, 15 bp, Homo sapiens
aaaacaaatcaagaa

SEQ ID NO: 65453 - DNA, 15 bp, Homo sapiens
caaaacaaatcaaga

SEQ ID NO: 65454 - DNA, 15 bp, Homo sapiens
ccaaaacaaatcaag

SEQ ID NO: 65455 - DNA, 15 bp, Homo sapiens
gccaaaacaaatcaa

SEQ ID NO: 65456 - DNA, 15 bp, Homo sapiens
tgccaaaacaaatca

SEQ ID NO: 65457 - DNA, 15 bp, Homo sapiens
atgccaaaacaaatc

SEQ ID NO: 65458 - DNA, 15 bp, Homo sapiens
aatgccaaaacaaat

SEQ ID NO: 65459 - DNA, 15 bp, Homo sapiens
gaatgccaaaacaaa

SEQ ID NO: 65460 - DNA, 15 bp, Homo sapiens
agaatgccaaaacaa

SEQ ID NO: 65461 - DNA, 15 bp, Homo sapiens
gagaatgccaaaaca

SEQ ID NO: 65462 - DNA, 15 bp, Homo sapiens
tgagaatgccaaaac

SEQ ID NO: 65463 - DNA, 15 bp, Homo sapiens
atgagaatgccaaaa

SEQ ID NO: 65464 - DNA, 15 bp, Homo sapiens
aatgagaatgccaaa

SEQ ID NO: 65465 - DNA, 15 bp, Homo sapiens
aaatgagaatgccaa

SEQ ID NO: 65466 - DNA, 15 bp, Homo sapiens
taaatgagaatgcca

SEQ ID NO: 65467 - DNA, 15 bp, Homo sapiens
ttaaatgagaatgcc

SEQ ID NO: 65468 - DNA, 15 bp, Homo sapiens
gttaaatgagaatgc

SEQ ID NO: 65469 - DNA, 15 bp, Homo sapiens
tgttaaatgagaatg

SEQ ID NO: 65470 - DNA, 15 bp, Homo sapiens
ctgttaaatgagaat

SEQ ID NO: 65471 - DNA, 15 bp, Homo sapiens
tctgttaaatgagaa

SEQ ID NO: 65472 - DNA, 15 bp, Homo sapiens
atctgttaaatgaga

SEQ ID NO: 65473 - DNA, 15 bp, Homo sapiens
aatctgttaaatgag

SEQ ID NO: 65474 - DNA, 15 bp, Homo sapiens
aaatctgttaaatga

SEQ ID NO: 65475 - DNA, 15 bp, Homo sapiens
gaaatctgttaaatg

SEQ ID NO: 65476 - DNA, 15 bp, Homo sapiens
agaaatctgttaaat

SEQ ID NO: 65477 - DNA, 15 bp, Homo sapiens
aagaaatctgttaaa

SEQ ID NO: 65478 - DNA, 15 bp, Homo sapiens
aaagaaatctgttaa

SEQ ID NO: 65479 - DNA, 15 bp, Homo sapiens
taaagaaatctgtta

SEQ ID NO: 65480 - DNA, 15 bp, Homo sapiens
ttaaagaaatctgtt

SEQ ID NO: 65481 - DNA, 15 bp, Homo sapiens
tttaaagaaatctgt

SEQ ID NO: 65482 - DNA, 15 bp, Homo sapiens
ttttaaagaaatctg

SEQ ID NO: 65483 - DNA, 15 bp, Homo sapiens
tttttaaagaaatct

SEQ ID NO: 65484 - DNA, 15 bp, Homo sapiens
ttttttaaagaaatc

SEQ ID NO: 65485 - DNA, 15 bp, Homo sapiens
attttttaaagaaat

SEQ ID NO: 65486 - DNA, 15 bp, Homo sapiens
tattttttaaagaaa

SEQ ID NO: 65487 - DNA, 15 bp, Homo sapiens
atattttttaaagaa

SEQ ID NO: 65488 - DNA, 15 bp, Homo sapiens
aatattttttaaaga

SEQ ID NO: 65489 - DNA, 15 bp, Homo sapiens
taatattttttaaag

SEQ ID NO: 65490 - DNA, 15 bp, Homo sapiens
ataatattttttaaa

SEQ ID NO: 65491 - DNA, 15 bp, Homo sapiens
aataatattttttaa

SEQ ID NO: 65492 - DNA, 15 bp, Homo sapiens
aaataatatttttta

SEQ ID NO: 65493 - DNA, 15 bp, Homo sapiens
taaataatatttttt

SEQ ID NO: 65494 - DNA, 15 bp, Homo sapiens
ttaaataatattttt

SEQ ID NO: 65495 - DNA, 15 bp, Homo sapiens
attaaataatatttt

SEQ ID NO: 65496 - DNA, 15 bp, Homo sapiens
aattaaataatattt

SEQ ID NO: 65497 - DNA, 15 bp, Homo sapiens
gaattaaataatatt

SEQ ID NO: 65498 - DNA, 15 bp, Homo sapiens
ggaattaaataatat

SEQ ID NO: 65499 - DNA, 15 bp, Homo sapiens
gggaattaaataata

SEQ ID NO: 65500 - DNA, 15 bp, Homo sapiens
tgggaattaaataat

SEQ ID NO: 65501 - DNA, 15 bp, Homo sapiens
atgggaattaaataa

SEQ ID NO: 65502 - DNA, 15 bp, Homo sapiens
tatgggaattaaata

SEQ ID NO: 65503 - DNA, 15 bp, Homo sapiens
atatgggaattaaat

SEQ ID NO: 65504 - DNA, 15 bp, Homo sapiens
aatatgggaattaaa

SEQ ID NO: 65505 - DNA, 15 bp, Homo sapiens
taatatgggaattaa

SEQ ID NO: 65506 - DNA, 15 bp, Homo sapiens
ataatatgggaatta

SEQ ID NO: 65507 - DNA, 15 bp, Homo sapiens
cataatatgggaatt

SEQ ID NO: 65508 - DNA, 15 bp, Homo sapiens
tcataatatgggaat

SEQ ID NO: 65509 - DNA, 15 bp, Homo sapiens
atcataatatgggaa

SEQ ID NO: 65510 - DNA, 15 bp, Homo sapiens
tatcataatatggga

SEQ ID NO: 65511 - DNA, 15 bp, Homo sapiens
gtatcataatatggg

SEQ ID NO: 65512 - DNA, 15 bp, Homo sapiens
agtatcataatatgg

SEQ ID NO: 65513 - DNA, 15 bp, Homo sapiens
tagtatcataatatg

SEQ ID NO: 65514 - DNA, 15 bp, Homo sapiens
ctagtatcataatat

SEQ ID NO: 65515 - DNA, 15 bp, Homo sapiens
actagtatcataata

SEQ ID NO: 65516 - DNA, 15 bp, Homo sapiens
gactagtatcataat

SEQ ID NO: 65517 - DNA, 15 bp, Homo sapiens
agactagtatcataa

SEQ ID NO: 65518 - DNA, 15 bp, Homo sapiens
aagactagtatcata

SEQ ID NO: 65519 - DNA, 15 bp, Homo sapiens
caagactagtatcat

SEQ ID NO: 65520 - DNA, 15 bp, Homo sapiens
tcaagactagtatca

SEQ ID NO: 65521 - DNA, 15 bp, Homo sapiens
ttcaagactagtatc

SEQ ID NO: 65522 - DNA, 15 bp, Homo sapiens
attcaagactagtat

SEQ ID NO: 65523 - DNA, 15 bp, Homo sapiens
aattcaagactagta

SEQ ID NO: 65524 - DNA, 15 bp, Homo sapiens
caattcaagactagt

SEQ ID NO: 65525 - DNA, 15 bp, Homo sapiens
tcaattcaagactag

SEQ ID NO: 65526 - DNA, 15 bp, Homo sapiens
gtcaattcaagacta

SEQ ID NO: 65527 - DNA, 15 bp, Homo sapiens
tgtcaattcaagact

SEQ ID NO: 65528 - DNA, 15 bp, Homo sapiens
atgtcaattcaagac

SEQ ID NO: 65529 - DNA, 15 bp, Homo sapiens
tatgtcaattcaaga

SEQ ID NO: 65530 - DNA, 15 bp, Homo sapiens
ctatgtcaattcaag

SEQ ID NO: 65531 - DNA, 15 bp, Homo sapiens
gctatgtcaattcaa

SEQ ID NO: 65532 - DNA, 15 bp, Homo sapiens
tgctatgtcaattca

SEQ ID NO: 65533 - DNA, 15 bp, Homo sapiens
atgctatgtcaattc

SEQ ID NO: 65534 - DNA, 15 bp, Homo sapiens
gatgctatgtcaatt

SEQ ID NO: 65535 - DNA, 15 bp, Homo sapiens
agatgctatgtcaat

SEQ ID NO: 65536 - DNA, 15 bp, Homo sapiens
aagatgctatgtcaa

SEQ ID NO: 65537 - DNA, 15 bp, Homo sapiens
aaagatgctatgtca

SEQ ID NO: 65538 - DNA, 15 bp, Homo sapiens
aaaagatgctatgtc

SEQ ID NO: 65539 - DNA, 15 bp, Homo sapiens
aaaaagatgctatgt

SEQ ID NO: 65540 - DNA, 15 bp, Homo sapiens
aaaaaagatgctatg

SEQ ID NO: 65541 - DNA, 15 bp, Homo sapiens
aaaaaaagatgctat

SEQ ID NO: 65542 - DNA, 15 bp, Homo sapiens
aaaaaaaagatgcta

SEQ ID NO: 65543 - DNA, 15 bp, Homo sapiens
gaaaaaaaagatgct

SEQ ID NO: 65544 - DNA, 15 bp, Homo sapiens
ggaaaaaaaagatgc

SEQ ID NO: 65545 - DNA, 15 bp, Homo sapiens
tggaaaaaaaagatg

SEQ ID NO: 65546 - DNA, 15 bp, Homo sapiens
atggaaaaaaaagat

SEQ ID NO: 65547 - DNA, 15 bp, Homo sapiens
gatggaaaaaaaaga

SEQ ID NO: 65548 - DNA, 15 bp, Homo sapiens
ggatggaaaaaaaag

SEQ ID NO: 65549 - DNA, 15 bp, Homo sapiens
aggatggaaaaaaaa

SEQ ID NO: 65550 - DNA, 15 bp, Homo sapiens
gaggatggaaaaaaa

SEQ ID NO: 65551 - DNA, 15 bp, Homo sapiens
agaggatggaaaaaa

SEQ ID NO: 65552 - DNA, 15 bp, Homo sapiens
cagaggatggaaaaa

SEQ ID NO: 65553 - DNA, 15 bp, Homo sapiens
tcagaggatggaaaa

SEQ ID NO: 65554 - DNA, 15 bp, Homo sapiens
ctcagaggatggaaa

SEQ ID NO: 65555 - DNA, 15 bp, Homo sapiens
tctcagaggatggaa

SEQ ID NO: 65556 - DNA, 15 bp, Homo sapiens
atctcagaggatgga

SEQ ID NO: 65557 - DNA, 15 bp, Homo sapiens
aatctcagaggatgg

SEQ ID NO: 65558 - DNA, 15 bp, Homo sapiens
gaatctcagaggatg

SEQ ID NO: 65559 - DNA, 15 bp, Homo sapiens
tgaatctcagaggat

SEQ ID NO: 65560 - DNA, 15 bp, Homo sapiens
ctgaatctcagagga

SEQ ID NO: 65561 - DNA, 15 bp, Homo sapiens
tctgaatctcagagg

SEQ ID NO: 65562 - DNA, 15 bp, Homo sapiens
ctctgaatctcagag

SEQ ID NO: 65563 - DNA, 15 bp, Homo sapiens
tctctgaatctcaga

SEQ ID NO: 65564 - DNA, 15 bp, Homo sapiens
ttctctgaatctcag

SEQ ID NO: 65565 - DNA, 15 bp, Homo sapiens
attctctgaatctca

SEQ ID NO: 65566 - DNA, 15 bp, Homo sapiens
aattctctgaatctc

SEQ ID NO: 65567 - DNA, 15 bp, Homo sapiens
aaattctctgaatct

SEQ ID NO: 65568 - DNA, 15 bp, Homo sapiens
taaattctctgaatc

SEQ ID NO: 65569 - DNA, 15 bp, Homo sapiens
gtaaattctctgaat

SEQ ID NO: 65570 - DNA, 15 bp, Homo sapiens
agtaaattctctgaa

SEQ ID NO: 65571 - DNA, 15 bp, Homo sapiens
aagtaaattctctga

SEQ ID NO: 65572 - DNA, 15 bp, Homo sapiens
taagtaaattctctg

SEQ ID NO: 65573 - DNA, 15 bp, Homo sapiens
ataagtaaattctct

SEQ ID NO: 65574 - DNA, 15 bp, Homo sapiens
aataagtaaattctc

SEQ ID NO: 65575 - DNA, 15 bp, Homo sapiens
gaataagtaaattct

SEQ ID NO: 65576 - DNA, 15 bp, Homo sapiens
agaataagtaaattc

SEQ ID NO: 65577 - DNA, 15 bp, Homo sapiens
aagaataagtaaatt

SEQ ID NO: 65578 - DNA, 15 bp, Homo sapiens
aaagaataagtaaat

SEQ ID NO: 65579 - DNA, 15 bp, Homo sapiens
aaaagaataagtaaa

SEQ ID NO: 65580 - DNA, 15 bp, Homo sapiens
taaaagaataagtaa

SEQ ID NO: 65581 - DNA, 15 bp, Homo sapiens
ttaaaagaataagta

SEQ ID NO: 65582 - DNA, 15 bp, Homo sapiens
tttaaaagaataagt

SEQ ID NO: 65583 - DNA, 15 bp, Homo sapiens
atttaaaagaataag

SEQ ID NO: 65584 - DNA, 15 bp, Homo sapiens
aatttaaaagaataa

SEQ ID NO: 65585 - DNA, 15 bp, Homo sapiens
aaatttaaaagaata

SEQ ID NO: 65586 - DNA, 15 bp, Homo sapiens
aaaatttaaaagaat

SEQ ID NO: 65587 - DNA, 15 bp, Homo sapiens
gaaaatttaaaagaa

SEQ ID NO: 65588 - DNA, 15 bp, Homo sapiens
agaaaatttaaaaga

SEQ ID NO: 65589 - DNA, 15 bp, Homo sapiens
aagaaaatttaaaag

SEQ ID NO: 65590 - DNA, 15 bp, Homo sapiens
aaagaaaatttaaaa

SEQ ID NO: 65591 - DNA, 15 bp, Homo sapiens
caaagaaaatttaaa

SEQ ID NO: 65592 - DNA, 15 bp, Homo sapiens
ccaaagaaaatttaa

SEQ ID NO: 65593 - DNA, 15 bp, Homo sapiens
cccaaagaaaattta

SEQ ID NO: 65594 - DNA, 15 bp, Homo sapiens
acccaaagaaaattt

SEQ ID NO: 65595 - DNA, 15 bp, Homo sapiens
tacccaaagaaaatt

SEQ ID NO: 65596 - DNA, 15 bp, Homo sapiens
ttacccaaagaaaat

SEQ ID NO: 65597 - DNA, 15 bp, Homo sapiens
attacccaaagaaaa

SEQ ID NO: 65598 - DNA, 15 bp, Homo sapiens
tattacccaaagaaa

SEQ ID NO: 65599 - DNA, 15 bp, Homo sapiens
atattacccaaagaa

SEQ ID NO: 65600 - DNA, 15 bp, Homo sapiens
catattacccaaaga

SEQ ID NO: 65601 - DNA, 15 bp, Homo sapiens
acatattacccaaag

SEQ ID NO: 65602 - DNA, 15 bp, Homo sapiens
tacatattacccaaa

SEQ ID NO: 65603 - DNA, 15 bp, Homo sapiens
gtacatattacccaa

SEQ ID NO: 65604 - DNA, 15 bp, Homo sapiens
ggtacatattaccca

SEQ ID NO: 65605 - DNA, 15 bp, Homo sapiens
gggtacatattaccc

SEQ ID NO: 65606 - DNA, 15 bp, Homo sapiens
tgggtacatattacc

SEQ ID NO: 65607 - DNA, 15 bp, Homo sapiens
atgggtacatattac

SEQ ID NO: 65608 - DNA, 15 bp, Homo sapiens
gatgggtacatatta

SEQ ID NO: 65609 - DNA, 15 bp, Homo sapiens
ggatgggtacatatt

SEQ ID NO: 65610 - DNA, 15 bp, Homo sapiens
aggatgggtacatat

SEQ ID NO: 65611 - DNA, 15 bp, Homo sapiens
aaggatgggtacata

SEQ ID NO: 65612 - DNA, 15 bp, Homo sapiens
aaaggatgggtacat

SEQ ID NO: 65613 - DNA, 15 bp, Homo sapiens
aaaaggatgggtaca

SEQ ID NO: 65614 - DNA, 15 bp, Homo sapiens
taaaaggatgggtac

SEQ ID NO: 65615 - DNA, 15 bp, Homo sapiens
ataaaaggatgggta

SEQ ID NO: 65616 - DNA, 15 bp, Homo sapiens
aataaaaggatgggt

SEQ ID NO: 65617 - DNA, 15 bp, Homo sapiens
aaataaaaggatggg

SEQ ID NO: 65618 - DNA, 15 bp, Homo sapiens
gaaataaaaggatgg

SEQ ID NO: 65619 - DNA, 15 bp, Homo sapiens
ggaaataaaaggatg

SEQ ID NO: 65620 - DNA, 15 bp, Homo sapiens
gggaaataaaaggat

SEQ ID NO: 65621 - DNA, 15 bp, Homo sapiens
ggggaaataaaagga

SEQ ID NO: 65622 - DNA, 15 bp, Homo sapiens
gggggaaataaaagg

SEQ ID NO: 65623 - DNA, 15 bp, Homo sapiens
cgggggaaataaaag

SEQ ID NO: 65624 - DNA, 15 bp, Homo sapiens
acgggggaaataaaa

SEQ ID NO: 65625 - DNA, 15 bp, Homo sapiens
aacgggggaaataaa

SEQ ID NO: 65626 - DNA, 15 bp, Homo sapiens
aaacgggggaaataa

SEQ ID NO: 65627 - DNA, 15 bp, Homo sapiens
gaaacgggggaaata

SEQ ID NO: 65628 - DNA, 15 bp, Homo sapiens
tgaaacgggggaaat

SEQ ID NO: 65629 - DNA, 15 bp, Homo sapiens
ttgaaacgggggaaa

SEQ ID NO: 65630 - DNA, 15 bp, Homo sapiens
tttgaaacgggggaa

SEQ ID NO: 65631 - DNA, 15 bp, Homo sapiens
ttttgaaacggggga

SEQ ID NO: 65632 - DNA, 15 bp, Homo sapiens
tttttgaaacggggg

SEQ ID NO: 65633 - DNA, 15 bp, Homo sapiens
atttttgaaacgggg

SEQ ID NO: 65634 - DNA, 15 bp, Homo sapiens
tatttttgaaacggg

SEQ ID NO: 65635 - DNA, 15 bp, Homo sapiens
ctatttttgaaacgg

SEQ ID NO: 65636 - DNA, 15 bp, Homo sapiens
actatttttgaaacg

SEQ ID NO: 65637 - DNA, 15 bp, Homo sapiens
cactatttttgaaac

SEQ ID NO: 65638 - DNA, 15 bp, Homo sapiens
acactatttttgaaa

SEQ ID NO: 65639 - DNA, 15 bp, Homo sapiens
cacactatttttgaa

SEQ ID NO: 65640 - DNA, 15 bp, Homo sapiens
tcacactatttttga

SEQ ID NO: 65641 - DNA, 15 bp, Homo sapiens
atcacactatttttg

SEQ ID NO: 65642 - DNA, 15 bp, Homo sapiens
aatcacactattttt

SEQ ID NO: 65643 - DNA, 15 bp, Homo sapiens
aaatcacactatttt

SEQ ID NO: 65644 - DNA, 15 bp, Homo sapiens
taaatcacactattt

SEQ ID NO: 65645 - DNA, 15 bp, Homo sapiens
ataaatcacactatt

SEQ ID NO: 65646 - DNA, 15 bp, Homo sapiens
tataaatcacactat

SEQ ID NO: 65647 - DNA, 15 bp, Homo sapiens
ctataaatcacacta

SEQ ID NO: 65648 - DNA, 15 bp, Homo sapiens
tctataaatcacact

SEQ ID NO: 65649 - DNA, 15 bp, Homo sapiens
ttctataaatcacac

SEQ ID NO: 65650 - DNA, 15 bp, Homo sapiens
tttctataaatcaca

SEQ ID NO: 65651 - DNA, 15 bp, Homo sapiens
ttttctataaatcac

SEQ ID NO: 65652 - DNA, 15 bp, Homo sapiens
tttttctataaatca

SEQ ID NO: 65653 - DNA, 15 bp, Homo sapiens
ctttttctataaatc

SEQ ID NO: 65654 - DNA, 15 bp, Homo sapiens
tctttttctataaat

SEQ ID NO: 65655 - DNA, 15 bp, Homo sapiens
ttctttttctataaa

SEQ ID NO: 65656 - DNA, 15 bp, Homo sapiens
tttctttttctataa

SEQ ID NO: 65657 - DNA, 15 bp, Homo sapiens
ttttctttttctata

SEQ ID NO: 65658 - DNA, 15 bp, Homo sapiens
tttttctttttctat

SEQ ID NO: 65659 - DNA, 15 bp, Homo sapiens
ttttttctttttcta

SEQ ID NO: 65660 - DNA, 15 bp, Homo sapiens
aatttttttcttttt

SEQ ID NO: 65661 - DNA, 15 bp, Homo sapiens
aaatttttttctttt

SEQ ID NO: 65662 - DNA, 15 bp, Homo sapiens
taaatttttttcttt

SEQ ID NO: 65663 - DNA, 15 bp, Homo sapiens
gtaaatttttttctt

SEQ ID NO: 65664 - DNA, 15 bp, Homo sapiens
agtaaatttttttct

SEQ ID NO: 65665 - DNA, 15 bp, Homo sapiens
cagtaaatttttttc

SEQ ID NO: 65666 - DNA, 15 bp, Homo sapiens
tcagtaaattttttt

SEQ ID NO: 65667 - DNA, 15 bp, Homo sapiens
ttcagtaaatttttt

SEQ ID NO: 65668 - DNA, 15 bp, Homo sapiens
tttcagtaaattttt

SEQ ID NO: 65669 - DNA, 15 bp, Homo sapiens
ttttcagtaaatttt

SEQ ID NO: 65670 - DNA, 15 bp, Homo sapiens
cttttcagtaaattt

SEQ ID NO: 65671 - DNA, 15 bp, Homo sapiens
tcttttcagtaaatt

SEQ ID NO: 65672 - DNA, 15 bp, Homo sapiens
ttcttttcagtaaat

SEQ ID NO: 65673 - DNA, 15 bp, Homo sapiens
tttcttttcagtaaa

SEQ ID NO: 65674 - DNA, 15 bp, Homo sapiens
ctttcttttcagtaa

SEQ ID NO: 65675 - DNA, 15 bp, Homo sapiens
cctttcttttcagta

SEQ ID NO: 65676 - DNA, 15 bp, Homo sapiens
tcctttcttttcagt

SEQ ID NO: 65677 - DNA, 15 bp, Homo sapiens
atcctttcttttcag

SEQ ID NO: 65678 - DNA, 15 bp, Homo sapiens
aatcctttcttttca

SEQ ID NO: 65679 - DNA, 15 bp, Homo sapiens
caatcctttcttttc

SEQ ID NO: 65680 - DNA, 15 bp, Homo sapiens
tcaatcctttctttt

SEQ ID NO: 65681 - DNA, 15 bp, Homo sapiens
ctcaatcctttcttt

SEQ ID NO: 65682 - DNA, 15 bp, Homo sapiens
tctcaatcctttctt

SEQ ID NO: 65683 - DNA, 15 bp, Homo sapiens
ttctcaatcctttct

SEQ ID NO: 65684 - DNA, 15 bp, Homo sapiens
tttctcaatcctttc

SEQ ID NO: 65685 - DNA, 15 bp, Homo sapiens
atttctcaatccttt

SEQ ID NO: 65686 - DNA, 15 bp, Homo sapiens
catttctcaatcctt

SEQ ID NO: 65687 - DNA, 15 bp, Homo sapiens
tcatttctcaatcct

SEQ ID NO: 65688 - DNA, 15 bp, Homo sapiens
ctcatttctcaatcc

SEQ ID NO: 65689 - DNA, 15 bp, Homo sapiens
cctcatttctcaatc

SEQ ID NO: 65690 - DNA, 15 bp, Homo sapiens
gcctcatttctcaat

SEQ ID NO: 65691 - DNA, 15 bp, Homo sapiens
ggcctcatttctcaa

SEQ ID NO: 65692 - DNA, 15 bp, Homo sapiens
aggcctcatttctca

SEQ ID NO: 65693 - DNA, 15 bp, Homo sapiens
caggcctcatttctc

SEQ ID NO: 65694 - DNA, 15 bp, Homo sapiens
tcaggcctcatttct

SEQ ID NO: 65695 - DNA, 15 bp, Homo sapiens
atcaggcctcatttc

SEQ ID NO: 65696 - DNA, 15 bp, Homo sapiens
aatcaggcctcattt

SEQ ID NO: 65697 - DNA, 15 bp, Homo sapiens
caatcaggcctcatt

SEQ ID NO: 65698 - DNA, 15 bp, Homo sapiens
acaatcaggcctcat

SEQ ID NO: 65699 - DNA, 15 bp, Homo sapiens
cacaatcaggcctca

SEQ ID NO: 65700 - DNA, 15 bp, Homo sapiens
tcacaatcaggcctc

SEQ ID NO: 65701 - DNA, 15 bp, Homo sapiens
ttcacaatcaggcct

SEQ ID NO: 65702 - DNA, 15 bp, Homo sapiens
gttcacaatcaggcc

SEQ ID NO: 65703 - DNA, 15 bp, Homo sapiens
ggttcacaatcaggc

SEQ ID NO: 65704 - DNA, 15 bp, Homo sapiens
gggttcacaatcagg

SEQ ID NO: 65705 - DNA, 15 bp, Homo sapiens
tgggttcacaatcag

SEQ ID NO: 65706 - DNA, 15 bp, Homo sapiens
ctgggttcacaatca

SEQ ID NO: 65707 - DNA, 15 bp, Homo sapiens
cctgggttcacaatc

SEQ ID NO: 65708 - DNA, 15 bp, Homo sapiens
ccctgggttcacaat

SEQ ID NO: 65709 - DNA, 15 bp, Homo sapiens
gccctgggttcacaa

SEQ ID NO: 65710 - DNA, 15 bp, Homo sapiens
agccctgggttcaca

SEQ ID NO: 65711 - DNA, 15 bp, Homo sapiens
gagccctgggttcac

SEQ ID NO: 65712 - DNA, 15 bp, Homo sapiens
agagccctgggttca

SEQ ID NO: 65713 - DNA, 15 bp, Homo sapiens
gagagccctgggttc

SEQ ID NO: 65714 - DNA, 15 bp, Homo sapiens
agagagccctgggtt

SEQ ID NO: 65715 - DNA, 15 bp, Homo sapiens
aagagagccctgggt

SEQ ID NO: 65716 - DNA, 15 bp, Homo sapiens
aaagagagccctggg

SEQ ID NO: 65717 - DNA, 15 bp, Homo sapiens
aaaagagagccctgg

SEQ ID NO: 65718 - DNA, 15 bp, Homo sapiens
caaaagagagccctg

SEQ ID NO: 65719 - DNA, 15 bp, Homo sapiens
acaaaagagagccct

SEQ ID NO: 65720 - DNA, 15 bp, Homo sapiens
tacaaaagagagccc

SEQ ID NO: 65721 - DNA, 15 bp, Homo sapiens
ctacaaaagagagcc

SEQ ID NO: 65722 - DNA, 15 bp, Homo sapiens
actacaaaagagagc

SEQ ID NO: 65723 - DNA, 15 bp, Homo sapiens
cactacaaaagagag

SEQ ID NO: 65724 - DNA, 15 bp, Homo sapiens
tcactacaaaagaga

SEQ ID NO: 65725 - DNA, 15 bp, Homo sapiens
ttcactacaaaagag

SEQ ID NO: 65726 - DNA, 15 bp, Homo sapiens
attcactacaaaaga

SEQ ID NO: 65727 - DNA, 15 bp, Homo sapiens
tattcactacaaaag

SEQ ID NO: 65728 - DNA, 15 bp, Homo sapiens
atattcactacaaaa

SEQ ID NO: 65729 - DNA, 15 bp, Homo sapiens
gatattcactacaaa

SEQ ID NO: 65730 - DNA, 15 bp, Homo sapiens
tgatattcactacaa

SEQ ID NO: 65731 - DNA, 15 bp, Homo sapiens
ttgatattcactaca

SEQ ID NO: 65732 - DNA, 15 bp, Homo sapiens
tttgatattcactac

SEQ ID NO: 65733 - DNA, 15 bp, Homo sapiens
atttgatattcacta

SEQ ID NO: 65734 - DNA, 15 bp, Homo sapiens
catttgatattcact

SEQ ID NO: 65735 - DNA, 15 bp, Homo sapiens
tcatttgatattcac

SEQ ID NO: 65736 - DNA, 15 bp, Homo sapiens
atcatttgatattca

SEQ ID NO: 65737 - DNA, 15 bp, Homo sapiens
catcatttgatattc

SEQ ID NO: 65738 - DNA, 15 bp, Homo sapiens
gcatcatttgatatt

SEQ ID NO: 65739 - DNA, 15 bp, Homo sapiens
agcatcatttgatat

SEQ ID NO: 65740 - DNA, 15 bp, Homo sapiens
cagcatcatttgata

SEQ ID NO: 65741 - DNA, 15 bp, Homo sapiens
tcagcatcatttgat

SEQ ID NO: 65742 - DNA, 15 bp, Homo sapiens
ctcagcatcatttga

SEQ ID NO: 65743 - DNA, 15 bp, Homo sapiens
cctcagcatcatttg

SEQ ID NO: 65744 - DNA, 15 bp, Homo sapiens
tcctcagcatcattt

SEQ ID NO: 65745 - DNA, 15 bp, Homo sapiens
ttcctcagcatcatt

SEQ ID NO: 65746 - DNA, 15 bp, Homo sapiens
tttcctcagcatcat

SEQ ID NO: 65747 - DNA, 15 bp, Homo sapiens
ttttcctcagcatca

SEQ ID NO: 65748 - DNA, 15 bp, Homo sapiens
attttcctcagcatc

SEQ ID NO: 65749 - DNA, 15 bp, Homo sapiens
aattttcctcagcat

SEQ ID NO: 65750 - DNA, 15 bp, Homo sapiens
gaattttcctcagca

SEQ ID NO: 65751 - DNA, 15 bp, Homo sapiens
ggaattttcctcagc

SEQ ID NO: 65752 - DNA, 15 bp, Homo sapiens
aggaattttcctcag

SEQ ID NO: 65753 - DNA, 15 bp, Homo sapiens
taggaattttcctca

SEQ ID NO: 65754 - DNA, 15 bp, Homo sapiens
ttaggaattttcctc

SEQ ID NO: 65755 - DNA, 15 bp, Homo sapiens
gttaggaattttcct

SEQ ID NO: 65756 - DNA, 15 bp, Homo sapiens
agttaggaattttcc

SEQ ID NO: 65757 - DNA, 15 bp, Homo sapiens
aagttaggaattttc

SEQ ID NO: 65758 - DNA, 15 bp, Homo sapiens
taagttaggaatttt

SEQ ID NO: 65759 - DNA, 15 bp, Homo sapiens
gtaagttaggaattt

SEQ ID NO: 65760 - DNA, 15 bp, Homo sapiens
agtaagttaggaatt

SEQ ID NO: 65761 - DNA, 15 bp, Homo sapiens
tagtaagttaggaat

SEQ ID NO: 65762 - DNA, 15 bp, Homo sapiens
atagtaagttaggaa

SEQ ID NO: 65763 - DNA, 15 bp, Homo sapiens
tatagtaagttagga

SEQ ID NO: 65764 - DNA, 15 bp, Homo sapiens
ttatagtaagttagg

SEQ ID NO: 65765 - DNA, 15 bp, Homo sapiens
attatagtaagttag

SEQ ID NO: 65766 - DNA, 15 bp, Homo sapiens
aattatagtaagtta

SEQ ID NO: 65767 - DNA, 15 bp, Homo sapiens
caattatagtaagtt

SEQ ID NO: 65768 - DNA, 15 bp, Homo sapiens
tcaattatagtaagt

SEQ ID NO: 65769 - DNA, 15 bp, Homo sapiens
ttcaattatagtaag

SEQ ID NO: 65770 - DNA, 15 bp, Homo sapiens
tttcaattatagtaa

SEQ ID NO: 65771 - DNA, 15 bp, Homo sapiens
ttttcaattatagta

SEQ ID NO: 65772 - DNA, 15 bp, Homo sapiens
tttttcaattatagt

SEQ ID NO: 65773 - DNA, 15 bp, Homo sapiens
ttttttcaattatag

SEQ ID NO: 65774 - DNA, 15 bp, Homo sapiens
tttttttcaattata

SEQ ID NO: 65775 - DNA, 15 bp, Homo sapiens
atttttttcaattat

SEQ ID NO: 65776 - DNA, 15 bp, Homo sapiens
catttttttcaatta

SEQ ID NO: 65777 - DNA, 15 bp, Homo sapiens
gcatttttttcaatt

SEQ ID NO: 65778 - DNA, 15 bp, Homo sapiens
agcatttttttcaat

SEQ ID NO: 65779 - DNA, 15 bp, Homo sapiens
tagcatttttttcaa

SEQ ID NO: 65780 - DNA, 15 bp, Homo sapiens
ctagcatttttttca

SEQ ID NO: 65781 - DNA, 15 bp, Homo sapiens
cctagcatttttttc

SEQ ID NO: 65782 - DNA, 15 bp, Homo sapiens
tcctagcattttttt

SEQ ID NO: 65783 - DNA, 15 bp, Homo sapiens
ttcctagcatttttt

SEQ ID NO: 65784 - DNA, 15 bp, Homo sapiens
cttcctagcattttt

SEQ ID NO: 65785 - DNA, 15 bp, Homo sapiens
acttcctagcatttt

SEQ ID NO: 65786 - DNA, 15 bp, Homo sapiens
tacttcctagcattt

SEQ ID NO: 65787 - DNA, 15 bp, Homo sapiens
atacttcctagcatt

SEQ ID NO: 65788 - DNA, 15 bp, Homo sapiens
aatacttcctagcat

SEQ ID NO: 65789 - DNA, 15 bp, Homo sapiens
aaatacttcctagca

SEQ ID NO: 65790 - DNA, 15 bp, Homo sapiens
caaatacttcctagc

SEQ ID NO: 65791 - DNA, 15 bp, Homo sapiens
gcaaatacttcctag

SEQ ID NO: 65792 - DNA, 15 bp, Homo sapiens
ggcaaatacttccta

SEQ ID NO: 65793 - DNA, 15 bp, Homo sapiens
aggcaaatacttcct

SEQ ID NO: 65794 - DNA, 15 bp, Homo sapiens
gaggcaaatacttcc

SEQ ID NO: 65795 - DNA, 15 bp, Homo sapiens
agaggcaaatacttc

SEQ ID NO: 65796 - DNA, 15 bp, Homo sapiens
tagaggcaaatactt

SEQ ID NO: 65797 - DNA, 15 bp, Homo sapiens
ttagaggcaaatact

SEQ ID NO: 65798 - DNA, 15 bp, Homo sapiens
tttagaggcaaatac

SEQ ID NO: 65799 - DNA, 15 bp, Homo sapiens
ttttagaggcaaata

SEQ ID NO: 65800 - DNA, 15 bp, Homo sapiens
cttttagaggcaaat

SEQ ID NO: 65801 - DNA, 15 bp, Homo sapiens
acttttagaggcaaa

SEQ ID NO: 65802 - DNA, 15 bp, Homo sapiens
tacttttagaggcaa

SEQ ID NO: 65803 - DNA, 15 bp, Homo sapiens
atacttttagaggca

SEQ ID NO: 65804 - DNA, 15 bp, Homo sapiens
tatacttttagaggc

SEQ ID NO: 65805 - DNA, 15 bp, Homo sapiens
ctatacttttagagg

SEQ ID NO: 65806 - DNA, 15 bp, Homo sapiens
actatacttttagag

SEQ ID NO: 65807 - DNA, 15 bp, Homo sapiens
aactatacttttaga

SEQ ID NO: 65808 - DNA, 15 bp, Homo sapiens
taactatacttttag

SEQ ID NO: 65809 - DNA, 15 bp, Homo sapiens
ataactatactttta

SEQ ID NO: 65810 - DNA, 15 bp, Homo sapiens
aataactatactttt

SEQ ID NO: 65811 - DNA, 15 bp, Homo sapiens
taataactatacttt

SEQ ID NO: 65812 - DNA, 15 bp, Homo sapiens
ataataactatactt

SEQ ID NO: 65813 - DNA, 15 bp, Homo sapiens
aataataactatact

SEQ ID NO: 65814 - DNA, 15 bp, Homo sapiens
gaataataactatac

SEQ ID NO: 65815 - DNA, 15 bp, Homo sapiens
agaataataactata

SEQ ID NO: 65816 - DNA, 15 bp, Homo sapiens
tagaataataactat

SEQ ID NO: 65817 - DNA, 15 bp, Homo sapiens
gtagaataataacta

SEQ ID NO: 65818 - DNA, 15 bp, Homo sapiens
tgtagaataataact

SEQ ID NO: 65819 - DNA, 15 bp, Homo sapiens
atgtagaataataac

SEQ ID NO: 65820 - DNA, 15 bp, Homo sapiens
aatgtagaataataa

SEQ ID NO: 65821 - DNA, 15 bp, Homo sapiens
taatgtagaataata

SEQ ID NO: 65822 - DNA, 15 bp, Homo sapiens
ttaatgtagaataat

SEQ ID NO: 65823 - DNA, 15 bp, Homo sapiens
attaatgtagaataa

SEQ ID NO: 65824 - DNA, 15 bp, Homo sapiens
cattaatgtagaata

SEQ ID NO: 65825 - DNA, 15 bp, Homo sapiens
tcattaatgtagaat

SEQ ID NO: 65826 - DNA, 15 bp, Homo sapiens
atcattaatgtagaa

SEQ ID NO: 65827 - DNA, 15 bp, Homo sapiens
catcattaatgtaga

SEQ ID NO: 65828 - DNA, 15 bp, Homo sapiens
gcatcattaatgtag

SEQ ID NO: 65829 - DNA, 15 bp, Homo sapiens
tgcatcattaatgta

SEQ ID NO: 65830 - DNA, 15 bp, Homo sapiens
gtgcatcattaatgt

SEQ ID NO: 65831 - DNA, 15 bp, Homo sapiens
ggtgcatcattaatg

SEQ ID NO: 65832 - DNA, 15 bp, Homo sapiens
aggtgcatcattaat

SEQ ID NO: 65833 - DNA, 15 bp, Homo sapiens
aaggtgcatcattaa

SEQ ID NO: 65834 - DNA, 15 bp, Homo sapiens
aaaggtgcatcatta

SEQ ID NO: 65835 - DNA, 15 bp, Homo sapiens
aaaaggtgcatcatt

SEQ ID NO: 65836 - DNA, 15 bp, Homo sapiens
aaaaaggtgcatcat

SEQ ID NO: 65837 - DNA, 15 bp, Homo sapiens
taaaaaggtgcatca

SEQ ID NO: 65838 - DNA, 15 bp, Homo sapiens
ctaaaaaggtgcatc

SEQ ID NO: 65839 - DNA, 15 bp, Homo sapiens
actaaaaaggtgcat

SEQ ID NO: 65840 - DNA, 15 bp, Homo sapiens
aactaaaaaggtgca

SEQ ID NO: 65841 - DNA, 15 bp, Homo sapiens
caactaaaaaggtgc

SEQ ID NO: 65842 - DNA, 15 bp, Homo sapiens
ccaactaaaaaggtg

SEQ ID NO: 65843 - DNA, 15 bp, Homo sapiens
gccaactaaaaaggt

SEQ ID NO: 65844 - DNA, 15 bp, Homo sapiens
agccaactaaaaagg

SEQ ID NO: 65845 - DNA, 15 bp, Homo sapiens
gagccaactaaaaag

SEQ ID NO: 65846 - DNA, 15 bp, Homo sapiens
tgagccaactaaaaa

SEQ ID NO: 65847 - DNA, 15 bp, Homo sapiens
ctgagccaactaaaa

SEQ ID NO: 65848 - DNA, 15 bp, Homo sapiens
tctgagccaactaaa

SEQ ID NO: 65849 - DNA, 15 bp, Homo sapiens
atctgagccaactaa

SEQ ID NO: 65850 - DNA, 15 bp, Homo sapiens
catctgagccaacta

SEQ ID NO: 65851 - DNA, 15 bp, Homo sapiens
tcatctgagccaact

SEQ ID NO: 65852 - DNA, 15 bp, Homo sapiens
atcatctgagccaac

SEQ ID NO: 65853 - DNA, 15 bp, Homo sapiens
gatcatctgagccaa

SEQ ID NO: 65854 - DNA, 15 bp, Homo sapiens
agatcatctgagcca

SEQ ID NO: 65855 - DNA, 15 bp, Homo sapiens
aagatcatctgagcc

SEQ ID NO: 65856 - DNA, 15 bp, Homo sapiens
gaagatcatctgagc

SEQ ID NO: 65857 - DNA, 15 bp, Homo sapiens
agaagatcatctgag

SEQ ID NO: 65858 - DNA, 15 bp, Homo sapiens
cagaagatcatctga

SEQ ID NO: 65859 - DNA, 15 bp, Homo sapiens
tcagaagatcatctg

SEQ ID NO: 65860 - DNA, 15 bp, Homo sapiens
ctcagaagatcatct

SEQ ID NO: 65861 - DNA, 15 bp, Homo sapiens
actcagaagatcatc

SEQ ID NO: 65862 - DNA, 15 bp, Homo sapiens
aactcagaagatcat

SEQ ID NO: 65863 - DNA, 15 bp, Homo sapiens
aaactcagaagatca

SEQ ID NO: 65864 - DNA, 15 bp, Homo sapiens
caaactcagaagatc

SEQ ID NO: 65865 - DNA, 15 bp, Homo sapiens
acaaactcagaagat

SEQ ID NO: 65866 - DNA, 15 bp, Homo sapiens
aacaaactcagaaga

SEQ ID NO: 65867 - DNA, 15 bp, Homo sapiens
taacaaactcagaag

SEQ ID NO: 65868 - DNA, 15 bp, Homo sapiens
gtaacaaactcagaa

SEQ ID NO: 65869 - DNA, 15 bp, Homo sapiens
tgtaacaaactcaga

SEQ ID NO: 65870 - DNA, 15 bp, Homo sapiens
ctgtaacaaactcag

SEQ ID NO: 65871 - DNA, 15 bp, Homo sapiens
cctgtaacaaactca

SEQ ID NO: 65872 - DNA, 15 bp, Homo sapiens
ccctgtaacaaactc

SEQ ID NO: 65873 - DNA, 15 bp, Homo sapiens
accctgtaacaaact

SEQ ID NO: 65874 - DNA, 15 bp, Homo sapiens
aaccctgtaacaaac

SEQ ID NO: 65875 - DNA, 15 bp, Homo sapiens
aaaccctgtaacaaa

SEQ ID NO: 65876 - DNA, 15 bp, Homo sapiens
aaaaccctgtaacaa

SEQ ID NO: 65877 - DNA, 15 bp, Homo sapiens
taaaaccctgtaaca

SEQ ID NO: 65878 - DNA, 15 bp, Homo sapiens
ctaaaaccctgtaac

SEQ ID NO: 65879 - DNA, 15 bp, Homo sapiens
tctaaaaccctgtaa

SEQ ID NO: 65880 - DNA, 15 bp, Homo sapiens
atctaaaaccctgta

SEQ ID NO: 65881 - DNA, 15 bp, Homo sapiens
aatctaaaaccctgt

SEQ ID NO: 65882 - DNA, 15 bp, Homo sapiens
gaatctaaaaccctg

SEQ ID NO: 65883 - DNA, 15 bp, Homo sapiens
tgaatctaaaaccct

SEQ ID NO: 65884 - DNA, 15 bp, Homo sapiens
atgaatctaaaaccc

SEQ ID NO: 65885 - DNA, 15 bp, Homo sapiens
aatgaatctaaaacc

SEQ ID NO: 65886 - DNA, 15 bp, Homo sapiens
aaatgaatctaaaac

SEQ ID NO: 65887 - DNA, 15 bp, Homo sapiens
gaaatgaatctaaaa

SEQ ID NO: 65888 - DNA, 15 bp, Homo sapiens
ggaaatgaatctaaa

SEQ ID NO: 65889 - DNA, 15 bp, Homo sapiens
aggaaatgaatctaa

SEQ ID NO: 65890 - DNA, 15 bp, Homo sapiens
aaggaaatgaatcta

SEQ ID NO: 65891 - DNA, 15 bp, Homo sapiens
taaggaaatgaatct

SEQ ID NO: 65892 - DNA, 15 bp, Homo sapiens
ataaggaaatgaatc

SEQ ID NO: 65893 - DNA, 15 bp, Homo sapiens
aataaggaaatgaat

SEQ ID NO: 65894 - DNA, 15 bp, Homo sapiens
caataaggaaatgaa

SEQ ID NO: 65895 - DNA, 15 bp, Homo sapiens
gcaataaggaaatga

SEQ ID NO: 65896 - DNA, 15 bp, Homo sapiens
tgcaataaggaaatg

SEQ ID NO: 65897 - DNA, 15 bp, Homo sapiens
atgcaataaggaaat

SEQ ID NO: 65898 - DNA, 15 bp, Homo sapiens
aatgcaataaggaaa

SEQ ID NO: 65899 - DNA, 15 bp, Homo sapiens
aaatgcaataaggaa

SEQ ID NO: 65900 - DNA, 15 bp, Homo sapiens
aaaatgcaataagga

SEQ ID NO: 65901 - DNA, 15 bp, Homo sapiens
caaaatgcaataagg

SEQ ID NO: 65902 - DNA, 15 bp, Homo sapiens
acaaaatgcaataag

SEQ ID NO: 65903 - DNA, 15 bp, Homo sapiens
aacaaaatgcaataa

SEQ ID NO: 65904 - DNA, 15 bp, Homo sapiens
taacaaaatgcaata

SEQ ID NO: 65905 - DNA, 15 bp, Homo sapiens
ctaacaaaatgcaat

SEQ ID NO: 65906 - DNA, 15 bp, Homo sapiens
tctaacaaaatgcaa

SEQ ID NO: 65907 - DNA, 15 bp, Homo sapiens
ttctaacaaaatgca

SEQ ID NO: 65908 - DNA, 15 bp, Homo sapiens
cttctaacaaaatgc

SEQ ID NO: 65909 - DNA, 15 bp, Homo sapiens
ccttctaacaaaatg

SEQ ID NO: 65910 - DNA, 15 bp, Homo sapiens
tccttctaacaaaat

SEQ ID NO: 65911 - DNA, 15 bp, Homo sapiens
ctccttctaacaaaa

SEQ ID NO: 65912 - DNA, 15 bp, Homo sapiens
cctccttctaacaaa

SEQ ID NO: 65913 - DNA, 15 bp, Homo sapiens
tcctccttctaacaa

SEQ ID NO: 65914 - DNA, 15 bp, Homo sapiens
ctcctccttctaaca

SEQ ID NO: 65915 - DNA, 15 bp, Homo sapiens
tctcctccttctaac

SEQ ID NO: 65916 - DNA, 15 bp, Homo sapiens
atctcctccttctaa

SEQ ID NO: 65917 - DNA, 15 bp, Homo sapiens
tatctcctccttcta

SEQ ID NO: 65918 - DNA, 15 bp, Homo sapiens
atatctcctccttct

SEQ ID NO: 65919 - DNA, 15 bp, Homo sapiens
aatatctcctccttc

SEQ ID NO: 65920 - DNA, 15 bp, Homo sapiens
aaatatctcctcctt

SEQ ID NO: 65921 - DNA, 15 bp, Homo sapiens
aaaatatctcctcct

SEQ ID NO: 65922 - DNA, 15 bp, Homo sapiens
taaaatatctcctcc

SEQ ID NO: 65923 - DNA, 15 bp, Homo sapiens
ataaaatatctcctc

SEQ ID NO: 65924 - DNA, 15 bp, Homo sapiens
aataaaatatctcct

SEQ ID NO: 65925 - DNA, 15 bp, Homo sapiens
aaataaaatatctcc

SEQ ID NO: 65926 - DNA, 15 bp, Homo sapiens
taaataaaatatctc

SEQ ID NO: 65927 - DNA, 15 bp, Homo sapiens
ctaaataaaatatct

SEQ ID NO: 65928 - DNA, 15 bp, Homo sapiens
actaaataaaatatc

SEQ ID NO: 65929 - DNA, 15 bp, Homo sapiens
aactaaataaaatat

SEQ ID NO: 65930 - DNA, 15 bp, Homo sapiens
gaactaaataaaata

SEQ ID NO: 65931 - DNA, 15 bp, Homo sapiens
agaactaaataaaat

SEQ ID NO: 65932 - DNA, 15 bp, Homo sapiens
aagaactaaataaaa

SEQ ID NO: 65933 - DNA, 15 bp, Homo sapiens
taagaactaaataaa

SEQ ID NO: 65934 - DNA, 15 bp, Homo sapiens
ataagaactaaataa

SEQ ID NO: 65935 - DNA, 15 bp, Homo sapiens
tataagaactaaata

SEQ ID NO: 65936 - DNA, 15 bp, Homo sapiens
ctataagaactaaat

SEQ ID NO: 65937 - DNA, 15 bp, Homo sapiens
actataagaactaaa

SEQ ID NO: 65938 - DNA, 15 bp, Homo sapiens
aactataagaactaa

SEQ ID NO: 65939 - DNA, 15 bp, Homo sapiens
taactataagaacta

SEQ ID NO: 65940 - DNA, 15 bp, Homo sapiens
ttaactataagaact

SEQ ID NO: 65941 - DNA, 15 bp, Homo sapiens
cttaactataagaac

SEQ ID NO: 65942 - DNA, 15 bp, Homo sapiens
ccttaactataagaa

SEQ ID NO: 65943 - DNA, 15 bp, Homo sapiens
cccttaactataaga

SEQ ID NO: 65944 - DNA, 15 bp, Homo sapiens
gcccttaactataag

SEQ ID NO: 65945 - DNA, 15 bp, Homo sapiens
ggcccttaactataa

SEQ ID NO: 65946 - DNA, 15 bp, Homo sapiens
aggcccttaactata

SEQ ID NO: 65947 - DNA, 15 bp, Homo sapiens
aaggcccttaactat

SEQ ID NO: 65948 - DNA, 15 bp, Homo sapiens
gaaggcccttaacta

SEQ ID NO: 65949 - DNA, 15 bp, Homo sapiens
agaaggcccttaact

SEQ ID NO: 65950 - DNA, 15 bp, Homo sapiens
gagaaggcccttaac

SEQ ID NO: 65951 - DNA, 15 bp, Homo sapiens
agagaaggcccttaa

SEQ ID NO: 65952 - DNA, 15 bp, Homo sapiens
gagagaaggccctta

SEQ ID NO: 65953 - DNA, 15 bp, Homo sapiens
agagagaaggccctt

SEQ ID NO: 65954 - DNA, 15 bp, Homo sapiens
aagagagaaggccct

SEQ ID NO: 65955 - DNA, 15 bp, Homo sapiens
taagagagaaggccc

SEQ ID NO: 65956 - DNA, 15 bp, Homo sapiens
ttaagagagaaggcc

SEQ ID NO: 65957 - DNA, 15 bp, Homo sapiens
tttaagagagaaggc

SEQ ID NO: 65958 - DNA, 15 bp, Homo sapiens
ttttaagagagaagg

SEQ ID NO: 65959 - DNA, 15 bp, Homo sapiens
tttttaagagagaag

SEQ ID NO: 65960 - DNA, 15 bp, Homo sapiens
ctttttaagagagaa

SEQ ID NO: 65961 - DNA, 15 bp, Homo sapiens
cctttttaagagaga

SEQ ID NO: 65962 - DNA, 15 bp, Homo sapiens
tcctttttaagagag

SEQ ID NO: 65963 - DNA, 15 bp, Homo sapiens
ttcctttttaagaga

SEQ ID NO: 65964 - DNA, 15 bp, Homo sapiens
cttcctttttaagag

SEQ ID NO: 65965 - DNA, 15 bp, Homo sapiens
ccttcctttttaaga

SEQ ID NO: 65966 - DNA, 15 bp, Homo sapiens
tccttcctttttaag

SEQ ID NO: 65967 - DNA, 15 bp, Homo sapiens
ctccttcctttttaa

SEQ ID NO: 65968 - DNA, 15 bp, Homo sapiens
tctccttccttttta

SEQ ID NO: 65969 - DNA, 15 bp, Homo sapiens
gtctccttccttttt

SEQ ID NO: 65970 - DNA, 15 bp, Homo sapiens
agtctccttcctttt

SEQ ID NO: 65971 - DNA, 15 bp, Homo sapiens
aagtctccttccttt

SEQ ID NO: 65972 - DNA, 15 bp, Homo sapiens
gaagtctccttcctt

SEQ ID NO: 65973 - DNA, 15 bp, Homo sapiens
tgaagtctccttcct

SEQ ID NO: 65974 - DNA, 15 bp, Homo sapiens
atgaagtctccttcc

SEQ ID NO: 65975 - DNA, 15 bp, Homo sapiens
aatgaagtctccttc

SEQ ID NO: 65976 - DNA, 15 bp, Homo sapiens
aaatgaagtctcctt

SEQ ID NO: 65977 - DNA, 15 bp, Homo sapiens
taaatgaagtctcct

SEQ ID NO: 65978 - DNA, 15 bp, Homo sapiens
gtaaatgaagtctcc

SEQ ID NO: 65979 - DNA, 15 bp, Homo sapiens
agtaaatgaagtctc

SEQ ID NO: 65980 - DNA, 15 bp, Homo sapiens
aagtaaatgaagtct

SEQ ID NO: 65981 - DNA, 15 bp, Homo sapiens
aaagtaaatgaagtc

SEQ ID NO: 65982 - DNA, 15 bp, Homo sapiens
aaaagtaaatgaagt

SEQ ID NO: 65983 - DNA, 15 bp, Homo sapiens
gaaaagtaaatgaag

SEQ ID NO: 65984 - DNA, 15 bp, Homo sapiens
tgaaaagtaaatgaa

SEQ ID NO: 65985 - DNA, 15 bp, Homo sapiens
atgaaaagtaaatga

SEQ ID NO: 65986 - DNA, 15 bp, Homo sapiens
catgaaaagtaaatg

SEQ ID NO: 65987 - DNA, 15 bp, Homo sapiens
tcatgaaaagtaaat

SEQ ID NO: 65988 - DNA, 15 bp, Homo sapiens
atcatgaaaagtaaa

SEQ ID NO: 65989 - DNA, 15 bp, Homo sapiens
catcatgaaaagtaa

SEQ ID NO: 65990 - DNA, 15 bp, Homo sapiens
acatcatgaaaagta

SEQ ID NO: 65991 - DNA, 15 bp, Homo sapiens
cacatcatgaaaagt

SEQ ID NO: 65992 - DNA, 15 bp, Homo sapiens
acacatcatgaaaag

SEQ ID NO: 65993 - DNA, 15 bp, Homo sapiens
tacacatcatgaaaa

SEQ ID NO: 65994 - DNA, 15 bp, Homo sapiens
ctacacatcatgaaa

SEQ ID NO: 65995 - DNA, 15 bp, Homo sapiens
tctacacatcatgaa

SEQ ID NO: 65996 - DNA, 15 bp, Homo sapiens
atctacacatcatga

SEQ ID NO: 65997 - DNA, 15 bp, Homo sapiens
tatctacacatcatg

SEQ ID NO: 65998 - DNA, 15 bp, Homo sapiens
ttatctacacatcat

SEQ ID NO: 65999 - DNA, 15 bp, Homo sapiens
tttatctacacatca

SEQ ID NO: 66000 - DNA, 15 bp, Homo sapiens
ttttatctacacatc

SEQ ID NO: 66001 - DNA, 15 bp, Homo sapiens
attttatctacacat

SEQ ID NO: 66002 - DNA, 15 bp, Homo sapiens
tattttatctacaca

SEQ ID NO: 66003 - DNA, 15 bp, Homo sapiens
ttattttatctacac

SEQ ID NO: 66004 - DNA, 15 bp, Homo sapiens
attattttatctaca

SEQ ID NO: 66005 - DNA, 15 bp, Homo sapiens
gattattttatctac

SEQ ID NO: 66006 - DNA, 15 bp, Homo sapiens
tgattattttatcta

SEQ ID NO: 66007 - DNA, 15 bp, Homo sapiens
gtgattattttatct

SEQ ID NO: 66008 - DNA, 15 bp, Homo sapiens
agtgattattttatc

SEQ ID NO: 66009 - DNA, 15 bp, Homo sapiens
aagtgattattttat

SEQ ID NO: 66010 - DNA, 15 bp, Homo sapiens
gaagtgattatttta

SEQ ID NO: 66011 - DNA, 15 bp, Homo sapiens
agaagtgattatttt

SEQ ID NO: 66012 - DNA, 15 bp, Homo sapiens
cagaagtgattattt

SEQ ID NO: 66013 - DNA, 15 bp, Homo sapiens
acagaagtgattatt

SEQ ID NO: 66014 - DNA, 15 bp, Homo sapiens
aacagaagtgattat

SEQ ID NO: 66015 - DNA, 15 bp, Homo sapiens
aaacagaagtgatta

SEQ ID NO: 66016 - DNA, 15 bp, Homo sapiens
taaacagaagtgatt

SEQ ID NO: 66017 - DNA, 15 bp, Homo sapiens
ctaaacagaagtgat

SEQ ID NO: 66018 - DNA, 15 bp, Homo sapiens
cctaaacagaagtga

SEQ ID NO: 66019 - DNA, 15 bp, Homo sapiens
ccctaaacagaagtg

SEQ ID NO: 66020 - DNA, 15 bp, Homo sapiens
gccctaaacagaagt

SEQ ID NO: 66021 - DNA, 15 bp, Homo sapiens
agccctaaacagaag

SEQ ID NO: 66022 - DNA, 15 bp, Homo sapiens
gagccctaaacagaa

SEQ ID NO: 66023 - DNA, 15 bp, Homo sapiens
tgagccctaaacaga

SEQ ID NO: 66024 - DNA, 15 bp, Homo sapiens
ctgagccctaaacag

SEQ ID NO: 66025 - DNA, 15 bp, Homo sapiens
gctgagccctaaaca

SEQ ID NO: 66026 - DNA, 15 bp, Homo sapiens
cgctgagccctaaac

SEQ ID NO: 66027 - DNA, 15 bp, Homo sapiens
acgctgagccctaaa

SEQ ID NO: 66028 - DNA, 15 bp, Homo sapiens
cacgctgagccctaa

SEQ ID NO: 66029 - DNA, 15 bp, Homo sapiens
ccacgctgagcccta

SEQ ID NO: 66030 - DNA, 15 bp, Homo sapiens
gccacgctgagccct

SEQ ID NO: 66031 - DNA, 15 bp, Homo sapiens
tgccacgctgagccc

SEQ ID NO: 66032 - DNA, 15 bp, Homo sapiens
atgccacgctgagcc

SEQ ID NO: 66033 - DNA, 15 bp, Homo sapiens
catgccacgctgagc

SEQ ID NO: 66034 - DNA, 15 bp, Homo sapiens
tcatgccacgctgag

SEQ ID NO: 66035 - DNA, 15 bp, Homo sapiens
atcatgccacgctga

SEQ ID NO: 66036 - DNA, 15 bp, Homo sapiens
tatcatgccacgctg

SEQ ID NO: 66037 - DNA, 15 bp, Homo sapiens
ttatcatgccacgct

SEQ ID NO: 66038 - DNA, 15 bp, Homo sapiens
cttatcatgccacgc

SEQ ID NO: 66039 - DNA, 15 bp, Homo sapiens
tcttatcatgccacg

SEQ ID NO: 66040 - DNA, 15 bp, Homo sapiens
ttcttatcatgccac

SEQ ID NO: 66041 - DNA, 15 bp, Homo sapiens
gttcttatcatgcca

SEQ ID NO: 66042 - DNA, 15 bp, Homo sapiens
agttcttatcatgcc

SEQ ID NO: 66043 - DNA, 15 bp, Homo sapiens
aagttcttatcatgc

SEQ ID NO: 66044 - DNA, 15 bp, Homo sapiens
gaagttcttatcatg

SEQ ID NO: 66045 - DNA, 15 bp, Homo sapiens
tgaagttcttatcat

SEQ ID NO: 66046 - DNA, 15 bp, Homo sapiens
ctgaagttcttatca

SEQ ID NO: 66047 - DNA, 15 bp, Homo sapiens
tctgaagttcttatc

SEQ ID NO: 66048 - DNA, 15 bp, Homo sapiens
ttctgaagttcttat

SEQ ID NO: 66049 - DNA, 15 bp, Homo sapiens
tttctgaagttctta

SEQ ID NO: 66050 - DNA, 15 bp, Homo sapiens
ttttctgaagttctt

SEQ ID NO: 66051 - DNA, 15 bp, Homo sapiens
gttttctgaagttct

SEQ ID NO: 66052 - DNA, 15 bp, Homo sapiens
tgttttctgaagttc

SEQ ID NO: 66053 - DNA, 15 bp, Homo sapiens
atgttttctgaagtt

SEQ ID NO: 66054 - DNA, 15 bp, Homo sapiens
aatgttttctgaagt

SEQ ID NO: 66055 - DNA, 15 bp, Homo sapiens
aaatgttttctgaag

SEQ ID NO: 66056 - DNA, 15 bp, Homo sapiens
caaatgttttctgaa

SEQ ID NO: 66057 - DNA, 15 bp, Homo sapiens
gcaaatgttttctga

SEQ ID NO: 66058 - DNA, 15 bp, Homo sapiens
agcaaatgttttctg

SEQ ID NO: 66059 - DNA, 15 bp, Homo sapiens
tagcaaatgttttct

SEQ ID NO: 66060 - DNA, 15 bp, Homo sapiens
atagcaaatgttttc

SEQ ID NO: 66061 - DNA, 15 bp, Homo sapiens
aatagcaaatgtttt

SEQ ID NO: 66062 - DNA, 15 bp, Homo sapiens
aaatagcaaatgttt

SEQ ID NO: 66063 - DNA, 15 bp, Homo sapiens
caaatagcaaatgtt

SEQ ID NO: 66064 - DNA, 15 bp, Homo sapiens
tcaaatagcaaatgt

SEQ ID NO: 66065 - DNA, 15 bp, Homo sapiens
atcaaatagcaaatg

SEQ ID NO: 66066 - DNA, 15 bp, Homo sapiens
aatcaaatagcaaat

SEQ ID NO: 66067 - DNA, 15 bp, Homo sapiens
taatcaaatagcaaa

SEQ ID NO: 66068 - DNA, 15 bp, Homo sapiens
ttaatcaaatagcaa

SEQ ID NO: 66069 - DNA, 15 bp, Homo sapiens
cttaatcaaatagca

SEQ ID NO: 66070 - DNA, 15 bp, Homo sapiens
acttaatcaaatagc

SEQ ID NO: 66071 - DNA, 15 bp, Homo sapiens
cacttaatcaaatag

SEQ ID NO: 66072 - DNA, 15 bp, Homo sapiens
gcacttaatcaaata

SEQ ID NO: 66073 - DNA, 15 bp, Homo sapiens
tgcacttaatcaaat

SEQ ID NO: 66074 - DNA, 15 bp, Homo sapiens
ttgcacttaatcaaa

SEQ ID NO: 66075 - DNA, 15 bp, Homo sapiens
cttgcacttaatcaa

SEQ ID NO: 66076 - DNA, 15 bp, Homo sapiens
acttgcacttaatca

SEQ ID NO: 66077 - DNA, 15 bp, Homo sapiens
cacttgcacttaatc

SEQ ID NO: 66078 - DNA, 15 bp, Homo sapiens
acacttgcacttaat

SEQ ID NO: 66079 - DNA, 15 bp, Homo sapiens
tacacttgcacttaa

SEQ ID NO: 66080 - DNA, 15 bp, Homo sapiens
atacacttgcactta

SEQ ID NO: 66081 - DNA, 15 bp, Homo sapiens
aatacacttgcactt

SEQ ID NO: 66082 - DNA, 15 bp, Homo sapiens
taatacacttgcact

SEQ ID NO: 66083 - DNA, 15 bp, Homo sapiens
ttaatacacttgcac

SEQ ID NO: 66084 - DNA, 15 bp, Homo sapiens
gttaatacacttgca

SEQ ID NO: 66085 - DNA, 15 bp, Homo sapiens
tgttaatacacttgc

SEQ ID NO: 66086 - DNA, 15 bp, Homo sapiens
gtgttaatacacttg

SEQ ID NO: 66087 - DNA, 15 bp, Homo sapiens
ggtgttaatacactt

SEQ ID NO: 66088 - DNA, 15 bp, Homo sapiens
aggtgttaatacact

SEQ ID NO: 66089 - DNA, 15 bp, Homo sapiens
gaggtgttaatacac

SEQ ID NO: 66090 - DNA, 15 bp, Homo sapiens
agaggtgttaataca

SEQ ID NO: 66091 - DNA, 15 bp, Homo sapiens
aagaggtgttaatac

SEQ ID NO: 66092 - DNA, 15 bp, Homo sapiens
gaagaggtgttaata

SEQ ID NO: 66093 - DNA, 15 bp, Homo sapiens
tgaagaggtgttaat

SEQ ID NO: 66094 - DNA, 15 bp, Homo sapiens
atgaagaggtgttaa

SEQ ID NO: 66095 - DNA, 15 bp, Homo sapiens
aatgaagaggtgtta

SEQ ID NO: 66096 - DNA, 15 bp, Homo sapiens
aaatgaagaggtgtt

SEQ ID NO: 66097 - DNA, 15 bp, Homo sapiens
caaatgaagaggtgt

SEQ ID NO: 66098 - DNA, 15 bp, Homo sapiens
gcaaatgaagaggtg

SEQ ID NO: 66099 - DNA, 15 bp, Homo sapiens
tgcaaatgaagaggt

SEQ ID NO: 66100 - DNA, 15 bp, Homo sapiens
ttgcaaatgaagagg

SEQ ID NO: 66101 - DNA, 15 bp, Homo sapiens
cttgcaaatgaagag

SEQ ID NO: 66102 - DNA, 15 bp, Homo sapiens
gcttgcaaatgaaga

SEQ ID NO: 66103 - DNA, 15 bp, Homo sapiens
agcttgcaaatgaag

SEQ ID NO: 66104 - DNA, 15 bp, Homo sapiens
aagcttgcaaatgaa

SEQ ID NO: 66105 - DNA, 15 bp, Homo sapiens
aaagcttgcaaatga

SEQ ID NO: 66106 - DNA, 15 bp, Homo sapiens
gaaagcttgcaaatg

SEQ ID NO: 66107 - DNA, 15 bp, Homo sapiens
tgaaagcttgcaaat

SEQ ID NO: 66108 - DNA, 15 bp, Homo sapiens
atgaaagcttgcaaa

SEQ ID NO: 66109 - DNA, 15 bp, Homo sapiens
aatgaaagcttgcaa

SEQ ID NO: 66110 - DNA, 15 bp, Homo sapiens
taatgaaagcttgca

SEQ ID NO: 66111 - DNA, 15 bp, Homo sapiens
ctaatgaaagcttgc

SEQ ID NO: 66112 - DNA, 15 bp, Homo sapiens
actaatgaaagcttg

SEQ ID NO: 66113 - DNA, 15 bp, Homo sapiens
cactaatgaaagctt

SEQ ID NO: 66114 - DNA, 15 bp, Homo sapiens
acactaatgaaagct

SEQ ID NO: 66115 - DNA, 15 bp, Homo sapiens
gacactaatgaaagc

SEQ ID NO: 66116 - DNA, 15 bp, Homo sapiens
agacactaatgaaag

SEQ ID NO: 66117 - DNA, 15 bp, Homo sapiens
aagacactaatgaaa

SEQ ID NO: 66118 - DNA, 15 bp, Homo sapiens
taagacactaatgaa

SEQ ID NO: 66119 - DNA, 15 bp, Homo sapiens
ctaagacactaatga

SEQ ID NO: 66120 - DNA, 15 bp, Homo sapiens
tctaagacactaatg

SEQ ID NO: 66121 - DNA, 15 bp, Homo sapiens
ctctaagacactaat

SEQ ID NO: 66122 - DNA, 15 bp, Homo sapiens
cctctaagacactaa

SEQ ID NO: 66123 - DNA, 15 bp, Homo sapiens
gcctctaagacacta

SEQ ID NO: 66124 - DNA, 15 bp, Homo sapiens
agcctctaagacact

SEQ ID NO: 66125 - DNA, 15 bp, Homo sapiens
cagcctctaagacac

SEQ ID NO: 66126 - DNA, 15 bp, Homo sapiens
tcagcctctaagaca

SEQ ID NO: 66127 - DNA, 15 bp, Homo sapiens
ttcagcctctaagac

SEQ ID NO: 66128 - DNA, 15 bp, Homo sapiens
attcagcctctaaga

SEQ ID NO: 66129 - DNA, 15 bp, Homo sapiens
aattcagcctctaag

SEQ ID NO: 66130 - DNA, 15 bp, Homo sapiens
taattcagcctctaa

SEQ ID NO: 66131 - DNA, 15 bp, Homo sapiens
gtaattcagcctcta

SEQ ID NO: 66132 - DNA, 15 bp, Homo sapiens
cgtaattcagcctct

SEQ ID NO: 66133 - DNA, 15 bp, Homo sapiens
acgtaattcagcctc

SEQ ID NO: 66134 - DNA, 15 bp, Homo sapiens
aacgtaattcagcct

SEQ ID NO: 66135 - DNA, 15 bp, Homo sapiens
taacgtaattcagcc

SEQ ID NO: 66136 - DNA, 15 bp, Homo sapiens
ttaacgtaattcagc

SEQ ID NO: 66137 - DNA, 15 bp, Homo sapiens
attaacgtaattcag

SEQ ID NO: 66138 - DNA, 15 bp, Homo sapiens
aattaacgtaattca

SEQ ID NO: 66139 - DNA, 15 bp, Homo sapiens
caattaacgtaattc

SEQ ID NO: 66140 - DNA, 15 bp, Homo sapiens
tcaattaacgtaatt

SEQ ID NO: 66141 - DNA, 15 bp, Homo sapiens
ttcaattaacgtaat

SEQ ID NO: 66142 - DNA, 15 bp, Homo sapiens
tttcaattaacgtaa

SEQ ID NO: 66143 - DNA, 15 bp, Homo sapiens
ttttcaattaacgta

SEQ ID NO: 66144 - DNA, 15 bp, Homo sapiens
gttttcaattaacgt

SEQ ID NO: 66145 - DNA, 15 bp, Homo sapiens
agttttcaattaacg

SEQ ID NO: 66146 - DNA, 15 bp, Homo sapiens
tagttttcaattaac

SEQ ID NO: 66147 - DNA, 15 bp, Homo sapiens
ttagttttcaattaa

SEQ ID NO: 66148 - DNA, 15 bp, Homo sapiens
tttagttttcaatta

SEQ ID NO: 66149 - DNA, 15 bp, Homo sapiens
ttttagttttcaatt

SEQ ID NO: 66150 - DNA, 15 bp, Homo sapiens
attttagttttcaat

SEQ ID NO: 66151 - DNA, 15 bp, Homo sapiens
cattttagttttcaa

SEQ ID NO: 66152 - DNA, 15 bp, Homo sapiens
acattttagttttca

SEQ ID NO: 66153 - DNA, 15 bp, Homo sapiens
cacattttagttttc

SEQ ID NO: 66154 - DNA, 15 bp, Homo sapiens
tcacattttagtttt

SEQ ID NO: 66155 - DNA, 15 bp, Homo sapiens
atcacattttagttt

SEQ ID NO: 66156 - DNA, 15 bp, Homo sapiens
gatcacattttagtt

SEQ ID NO: 66157 - DNA, 15 bp, Homo sapiens
tgatcacattttagt

SEQ ID NO: 66158 - DNA, 15 bp, Homo sapiens
ttgatcacattttag

SEQ ID NO: 66159 - DNA, 15 bp, Homo sapiens
cttgatcacatttta

SEQ ID NO: 66160 - DNA, 15 bp, Homo sapiens
acttgatcacatttt

SEQ ID NO: 66161 - DNA, 15 bp, Homo sapiens
aacttgatcacattt

SEQ ID NO: 66162 - DNA, 15 bp, Homo sapiens
aaacttgatcacatt

SEQ ID NO: 66163 - DNA, 15 bp, Homo sapiens
aaaacttgatcacat

SEQ ID NO: 66164 - DNA, 15 bp, Homo sapiens
taaaacttgatcaca

SEQ ID NO: 66165 - DNA, 15 bp, Homo sapiens
ttaaaacttgatcac

SEQ ID NO: 66166 - DNA, 15 bp, Homo sapiens
attaaaacttgatca

SEQ ID NO: 66167 - DNA, 15 bp, Homo sapiens
gattaaaacttgatc

SEQ ID NO: 66168 - DNA, 15 bp, Homo sapiens
tgattaaaacttgat

SEQ ID NO: 66169 - DNA, 15 bp, Homo sapiens
atgattaaaacttga

SEQ ID NO: 66170 - DNA, 15 bp, Homo sapiens
gatgattaaaacttg

SEQ ID NO: 66171 - DNA, 15 bp, Homo sapiens
agatgattaaaactt

SEQ ID NO: 66172 - DNA, 15 bp, Homo sapiens
gagatgattaaaact

SEQ ID NO: 66173 - DNA, 15 bp, Homo sapiens
agagatgattaaaac

SEQ ID NO: 66174 - DNA, 15 bp, Homo sapiens
gagagatgattaaaa

SEQ ID NO: 66175 - DNA, 15 bp, Homo sapiens
agagagatgattaaa

SEQ ID NO: 66176 - DNA, 15 bp, Homo sapiens
cagagagatgattaa

SEQ ID NO: 66177 - DNA, 15 bp, Homo sapiens
tcagagagatgatta

SEQ ID NO: 66178 - DNA, 15 bp, Homo sapiens
gtcagagagatgatt

SEQ ID NO: 66179 - DNA, 15 bp, Homo sapiens
tgtcagagagatgat

SEQ ID NO: 66180 - DNA, 15 bp, Homo sapiens
atgtcagagagatga

SEQ ID NO: 66181 - DNA, 15 bp, Homo sapiens
tatgtcagagagatg

SEQ ID NO: 66182 - DNA, 15 bp, Homo sapiens
ctatgtcagagagat

SEQ ID NO: 66183 - DNA, 15 bp, Homo sapiens
gctatgtcagagaga

SEQ ID NO: 66184 - DNA, 15 bp, Homo sapiens
agctatgtcagagag

SEQ ID NO: 66185 - DNA, 15 bp, Homo sapiens
aagctatgtcagaga

SEQ ID NO: 66186 - DNA, 15 bp, Homo sapiens
caagctatgtcagag

SEQ ID NO: 66187 - DNA, 15 bp, Homo sapiens
gcaagctatgtcaga

SEQ ID NO: 66188 - DNA, 15 bp, Homo sapiens
ggcaagctatgtcag

SEQ ID NO: 66189 - DNA, 15 bp, Homo sapiens
tggcaagctatgtca

SEQ ID NO: 66190 - DNA, 15 bp, Homo sapiens
atggcaagctatgtc

SEQ ID NO: 66191 - DNA, 15 bp, Homo sapiens
gatggcaagctatgt

SEQ ID NO: 66192 - DNA, 15 bp, Homo sapiens
agatggcaagctatg

SEQ ID NO: 66193 - DNA, 15 bp, Homo sapiens
cagatggcaagctat

SEQ ID NO: 66194 - DNA, 15 bp, Homo sapiens
gcagatggcaagcta

SEQ ID NO: 66195 - DNA, 15 bp, Homo sapiens
agcagatggcaagct

SEQ ID NO: 66196 - DNA, 15 bp, Homo sapiens
tagcagatggcaagc

SEQ ID NO: 66197 - DNA, 15 bp, Homo sapiens
gtagcagatggcaag

SEQ ID NO: 66198 - DNA, 15 bp, Homo sapiens
agtagcagatggcaa

SEQ ID NO: 66199 - DNA, 15 bp, Homo sapiens
gagtagcagatggca

SEQ ID NO: 66200 - DNA, 15 bp, Homo sapiens
agagtagcagatggc

SEQ ID NO: 66201 - DNA, 15 bp, Homo sapiens
gagagtagcagatgg

SEQ ID NO: 66202 - DNA, 15 bp, Homo sapiens
ggagagtagcagatg

SEQ ID NO: 66203 - DNA, 15 bp, Homo sapiens
aggagagtagcagat

SEQ ID NO: 66204 - DNA, 15 bp, Homo sapiens
taggagagtagcaga

SEQ ID NO: 66205 - DNA, 15 bp, Homo sapiens
ttaggagagtagcag

SEQ ID NO: 66206 - DNA, 15 bp, Homo sapiens
attaggagagtagca

SEQ ID NO: 66207 - DNA, 15 bp, Homo sapiens
tattaggagagtagc

SEQ ID NO: 66208 - DNA, 15 bp, Homo sapiens
ctattaggagagtag

SEQ ID NO: 66209 - DNA, 15 bp, Homo sapiens
actattaggagagta

SEQ ID NO: 66210 - DNA, 15 bp, Homo sapiens
gactattaggagagt

SEQ ID NO: 66211 - DNA, 15 bp, Homo sapiens
tgactattaggagag

SEQ ID NO: 66212 - DNA, 15 bp, Homo sapiens
ctgactattaggaga

SEQ ID NO: 66213 - DNA, 15 bp, Homo sapiens
tctgactattaggag

SEQ ID NO: 66214 - DNA, 15 bp, Homo sapiens
gtctgactattagga

SEQ ID NO: 66215 - DNA, 15 bp, Homo sapiens
agtctgactattagg

SEQ ID NO: 66216 - DNA, 15 bp, Homo sapiens
aagtctgactattag

SEQ ID NO: 66217 - DNA, 15 bp, Homo sapiens
gaagtctgactatta

SEQ ID NO: 66218 - DNA, 15 bp, Homo sapiens
agaagtctgactatt

SEQ ID NO: 66219 - DNA, 15 bp, Homo sapiens
aagaagtctgactat

SEQ ID NO: 66220 - DNA, 15 bp, Homo sapiens
gaagaagtctgacta

SEQ ID NO: 66221 - DNA, 15 bp, Homo sapiens
agaagaagtctgact

SEQ ID NO: 66222 - DNA, 15 bp, Homo sapiens
cagaagaagtctgac

SEQ ID NO: 66223 - DNA, 15 bp, Homo sapiens
gcagaagaagtctga

SEQ ID NO: 66224 - DNA, 15 bp, Homo sapiens
ggcagaagaagtctg

SEQ ID NO: 66225 - DNA, 15 bp, Homo sapiens
gggcagaagaagtct

SEQ ID NO: 66226 - DNA, 15 bp, Homo sapiens
agggcagaagaagtc

SEQ ID NO: 66227 - DNA, 15 bp, Homo sapiens
cagggcagaagaagt

SEQ ID NO: 66228 - DNA, 15 bp, Homo sapiens
acagggcagaagaag

SEQ ID NO: 66229 - DNA, 15 bp, Homo sapiens
aacagggcagaagaa

SEQ ID NO: 66230 - DNA, 15 bp, Homo sapiens
gaacagggcagaaga

SEQ ID NO: 66231 - DNA, 15 bp, Homo sapiens
agaacagggcagaag

SEQ ID NO: 66232 - DNA, 15 bp, Homo sapiens
aagaacagggcagaa

SEQ ID NO: 66233 - DNA, 15 bp, Homo sapiens
aaagaacagggcaga

SEQ ID NO: 66234 - DNA, 15 bp, Homo sapiens
gaaagaacagggcag

SEQ ID NO: 66235 - DNA, 15 bp, Homo sapiens
agaaagaacagggca

SEQ ID NO: 66236 - DNA, 15 bp, Homo sapiens
tagaaagaacagggc

SEQ ID NO: 66237 - DNA, 15 bp, Homo sapiens
gtagaaagaacaggg

SEQ ID NO: 66238 - DNA, 15 bp, Homo sapiens
tgtagaaagaacagg

SEQ ID NO: 66239 - DNA, 15 bp, Homo sapiens
ttgtagaaagaacag

SEQ ID NO: 66240 - DNA, 15 bp, Homo sapiens
tttgtagaaagaaca

SEQ ID NO: 66241 - DNA, 15 bp, Homo sapiens
gtttgtagaaagaac

SEQ ID NO: 66242 - DNA, 15 bp, Homo sapiens
tgtttgtagaaagaa

SEQ ID NO: 66243 - DNA, 15 bp, Homo sapiens
atgtttgtagaaaga

SEQ ID NO: 66244 - DNA, 15 bp, Homo sapiens
tatgtttgtagaaag

SEQ ID NO: 66245 - DNA, 15 bp, Homo sapiens
gtatgtttgtagaaa

SEQ ID NO: 66246 - DNA, 15 bp, Homo sapiens
cgtatgtttgtagaa

SEQ ID NO: 66247 - DNA, 15 bp, Homo sapiens
gcgtatgtttgtaga

SEQ ID NO: 66248 - DNA, 15 bp, Homo sapiens
agcgtatgtttgtag

SEQ ID NO: 66249 - DNA, 15 bp, Homo sapiens
cagcgtatgtttgta

SEQ ID NO: 66250 - DNA, 15 bp, Homo sapiens
ccagcgtatgtttgt

SEQ ID NO: 66251 - DNA, 15 bp, Homo sapiens
accagcgtatgtttg

SEQ ID NO: 66252 - DNA, 15 bp, Homo sapiens
caccagcgtatgttt

SEQ ID NO: 66253 - DNA, 15 bp, Homo sapiens
ccaccagcgtatgtt

SEQ ID NO: 66254 - DNA, 15 bp, Homo sapiens
accaccagcgtatgt

SEQ ID NO: 66255 - DNA, 15 bp, Homo sapiens
gaccaccagcgtatg

SEQ ID NO: 66256 - DNA, 15 bp, Homo sapiens
tgaccaccagcgtat

SEQ ID NO: 66257 - DNA, 15 bp, Homo sapiens
ttgaccaccagcgta

SEQ ID NO: 66258 - DNA, 15 bp, Homo sapiens
attgaccaccagcgt

SEQ ID NO: 66259 - DNA, 15 bp, Homo sapiens
cattgaccaccagcg

SEQ ID NO: 66260 - DNA, 15 bp, Homo sapiens
tcattgaccaccagc

SEQ ID NO: 66261 - DNA, 15 bp, Homo sapiens
ttcattgaccaccag

SEQ ID NO: 66262 - DNA, 15 bp, Homo sapiens
attcattgaccacca

SEQ ID NO: 66263 - DNA, 15 bp, Homo sapiens
tattcattgaccacc

SEQ ID NO: 66264 - DNA, 15 bp, Homo sapiens
ttattcattgaccac

SEQ ID NO: 66265 - DNA, 15 bp, Homo sapiens
attattcattgacca

SEQ ID NO: 66266 - DNA, 15 bp, Homo sapiens
aattattcattgacc

SEQ ID NO: 66267 - DNA, 15 bp, Homo sapiens
gaattattcattgac

SEQ ID NO: 66268 - DNA, 15 bp, Homo sapiens
ggaattattcattga

SEQ ID NO: 66269 - DNA, 15 bp, Homo sapiens
aggaattattcattg

SEQ ID NO: 66270 - DNA, 15 bp, Homo sapiens
caggaattattcatt

SEQ ID NO: 66271 - DNA, 15 bp, Homo sapiens
gcaggaattattcat

SEQ ID NO: 66272 - DNA, 15 bp, Homo sapiens
tgcaggaattattca

SEQ ID NO: 66273 - DNA, 15 bp, Homo sapiens
atgcaggaattattc

SEQ ID NO: 66274 - DNA, 15 bp, Homo sapiens
aatgcaggaattatt

SEQ ID NO: 66275 - DNA, 15 bp, Homo sapiens
aaatgcaggaattat

SEQ ID NO: 66276 - DNA, 15 bp, Homo sapiens
gaaatgcaggaatta

SEQ ID NO: 66277 - DNA, 15 bp, Homo sapiens
agaaatgcaggaatt

SEQ ID NO: 66278 - DNA, 15 bp, Homo sapiens
gagaaatgcaggaat

SEQ ID NO: 66279 - DNA, 15 bp, Homo sapiens
agagaaatgcaggaa

SEQ ID NO: 66280 - DNA, 15 bp, Homo sapiens
aagagaaatgcagga

SEQ ID NO: 66281 - DNA, 15 bp, Homo sapiens
aaagagaaatgcagg

SEQ ID NO: 66282 - DNA, 15 bp, Homo sapiens
taaagagaaatgcag

SEQ ID NO: 66283 - DNA, 15 bp, Homo sapiens
ttaaagagaaatgca

SEQ ID NO: 66284 - DNA, 15 bp, Homo sapiens
tttaaagagaaatgc

SEQ ID NO: 66285 - DNA, 15 bp, Homo sapiens
atttaaagagaaatg

SEQ ID NO: 66286 - DNA, 15 bp, Homo sapiens
tatttaaagagaaat

SEQ ID NO: 66287 - DNA, 15 bp, Homo sapiens
atatttaaagagaaa

SEQ ID NO: 66288 - DNA, 15 bp, Homo sapiens
gatatttaaagagaa

SEQ ID NO: 66289 - DNA, 15 bp, Homo sapiens
ggatatttaaagaga

SEQ ID NO: 66290 - DNA, 15 bp, Homo sapiens
cggatatttaaagag

SEQ ID NO: 66291 - DNA, 15 bp, Homo sapiens
acggatatttaaaga

SEQ ID NO: 66292 - DNA, 15 bp, Homo sapiens
gacggatatttaaag

SEQ ID NO: 66293 - DNA, 15 bp, Homo sapiens
tgacggatatttaaa

SEQ ID NO: 66294 - DNA, 15 bp, Homo sapiens
ctgacggatatttaa

SEQ ID NO: 66295 - DNA, 15 bp, Homo sapiens
actgacggatattta

SEQ ID NO: 66296 - DNA, 15 bp, Homo sapiens
aactgacggatattt

SEQ ID NO: 66297 - DNA, 15 bp, Homo sapiens
caactgacggatatt

SEQ ID NO: 66298 - DNA, 15 bp, Homo sapiens
tcaactgacggatat

SEQ ID NO: 66299 - DNA, 15 bp, Homo sapiens
ttcaactgacggata

SEQ ID NO: 66300 - DNA, 15 bp, Homo sapiens
tttcaactgacggat

SEQ ID NO: 66301 - DNA, 15 bp, Homo sapiens
ctttcaactgacgga

SEQ ID NO: 66302 - DNA, 15 bp, Homo sapiens
actttcaactgacgg

SEQ ID NO: 66303 - DNA, 15 bp, Homo sapiens
aactttcaactgacg

SEQ ID NO: 66304 - DNA, 15 bp, Homo sapiens
aaactttcaactgac

SEQ ID NO: 66305 - DNA, 15 bp, Homo sapiens
gaaactttcaactga

SEQ ID NO: 66306 - DNA, 15 bp, Homo sapiens
ggaaactttcaactg

SEQ ID NO: 66307 - DNA, 15 bp, Homo sapiens
aggaaactttcaact

SEQ ID NO: 66308 - DNA, 15 bp, Homo sapiens
gaggaaactttcaac

SEQ ID NO: 66309 - DNA, 15 bp, Homo sapiens
tgaggaaactttcaa

SEQ ID NO: 66310 - DNA, 15 bp, Homo sapiens
atgaggaaactttca

SEQ ID NO: 66311 - DNA, 15 bp, Homo sapiens
catgaggaaactttc

SEQ ID NO: 66312 - DNA, 15 bp, Homo sapiens
acatgaggaaacttt

SEQ ID NO: 66313 - DNA, 15 bp, Homo sapiens
cacatgaggaaactt

SEQ ID NO: 66314 - DNA, 15 bp, Homo sapiens
acacatgaggaaact

SEQ ID NO: 66315 - DNA, 15 bp, Homo sapiens
aacacatgaggaaac

SEQ ID NO: 66316 - DNA, 15 bp, Homo sapiens
gaacacatgaggaaa

SEQ ID NO: 66317 - DNA, 15 bp, Homo sapiens
cgaacacatgaggaa

SEQ ID NO: 66318 - DNA, 15 bp, Homo sapiens
tcgaacacatgagga

SEQ ID NO: 66319 - DNA, 15 bp, Homo sapiens
ttcgaacacatgagg

SEQ ID NO: 66320 - DNA, 15 bp, Homo sapiens
attcgaacacatgag

SEQ ID NO: 66321 - DNA, 15 bp, Homo sapiens
aattcgaacacatga

SEQ ID NO: 66322 - DNA, 15 bp, Homo sapiens
taattcgaacacatg

SEQ ID NO: 66323 - DNA, 15 bp, Homo sapiens
ttaattcgaacacat

SEQ ID NO: 66324 - DNA, 15 bp, Homo sapiens
attaattcgaacaca

SEQ ID NO: 66325 - DNA, 15 bp, Homo sapiens
tattaattcgaacac

SEQ ID NO: 66326 - DNA, 15 bp, Homo sapiens
gtattaattcgaaca

SEQ ID NO: 66327 - DNA, 15 bp, Homo sapiens
ggtattaattcgaac

SEQ ID NO: 66328 - DNA, 15 bp, Homo sapiens
cggtattaattcgaa

SEQ ID NO: 66329 - DNA, 15 bp, Homo sapiens
acggtattaattcga

SEQ ID NO: 66330 - DNA, 15 bp, Homo sapiens
gacggtattaattcg

SEQ ID NO: 66331 - DNA, 15 bp, Homo sapiens
agacggtattaattc

SEQ ID NO: 66332 - DNA, 15 bp, Homo sapiens
cagacggtattaatt

SEQ ID NO: 66333 - DNA, 15 bp, Homo sapiens
tcagacggtattaat

SEQ ID NO: 66334 - DNA, 15 bp, Homo sapiens
ttcagacggtattaa

SEQ ID NO: 66335 - DNA, 15 bp, Homo sapiens
gttcagacggtatta

SEQ ID NO: 66336 - DNA, 15 bp, Homo sapiens
tgttcagacggtatt

SEQ ID NO: 66337 - DNA, 15 bp, Homo sapiens
atgttcagacggtat

SEQ ID NO: 66338 - DNA, 15 bp, Homo sapiens
aatgttcagacggta

SEQ ID NO: 66339 - DNA, 15 bp, Homo sapiens
aaatgttcagacggt

SEQ ID NO: 66340 - DNA, 15 bp, Homo sapiens
caaatgttcagacgg

SEQ ID NO: 66341 - DNA, 15 bp, Homo sapiens
acaaatgttcagacg

SEQ ID NO: 66342 - DNA, 15 bp, Homo sapiens
cacaaatgttcagac

SEQ ID NO: 66343 - DNA, 15 bp, Homo sapiens
acacaaatgttcaga

SEQ ID NO: 66344 - DNA, 15 bp, Homo sapiens
aacacaaatgttcag

SEQ ID NO: 66345 - DNA, 15 bp, Homo sapiens
aaacacaaatgttca

SEQ ID NO: 66346 - DNA, 15 bp, Homo sapiens
taaacacaaatgttc

SEQ ID NO: 66347 - DNA, 15 bp, Homo sapiens
ctaaacacaaatgtt

SEQ ID NO: 66348 - DNA, 15 bp, Homo sapiens
tctaaacacaaatgt

SEQ ID NO: 66349 - DNA, 15 bp, Homo sapiens
atctaaacacaaatg

SEQ ID NO: 66350 - DNA, 15 bp, Homo sapiens
tatctaaacacaaat

SEQ ID NO: 66351 - DNA, 15 bp, Homo sapiens
ctatctaaacacaaa

SEQ ID NO: 66352 - DNA, 15 bp, Homo sapiens
actatctaaacacaa

SEQ ID NO: 66353 - DNA, 15 bp, Homo sapiens
cactatctaaacaca

SEQ ID NO: 66354 - DNA, 15 bp, Homo sapiens
gcactatctaaacac

SEQ ID NO: 66355 - DNA, 15 bp, Homo sapiens
ggcactatctaaaca

SEQ ID NO: 66356 - DNA, 15 bp, Homo sapiens
aggcactatctaaac

SEQ ID NO: 66357 - DNA, 15 bp, Homo sapiens
aaggcactatctaaa

SEQ ID NO: 66358 - DNA, 15 bp, Homo sapiens
gaaggcactatctaa

SEQ ID NO: 66359 - DNA, 15 bp, Homo sapiens
ggaaggcactatcta

SEQ ID NO: 66360 - DNA, 15 bp, Homo sapiens
aggaaggcactatct

SEQ ID NO: 66361 - DNA, 15 bp, Homo sapiens
aaggaaggcactatc

SEQ ID NO: 66362 - DNA, 15 bp, Homo sapiens
gaaggaaggcactat

SEQ ID NO: 66363 - DNA, 15 bp, Homo sapiens
agaaggaaggcacta

SEQ ID NO: 66364 - DNA, 15 bp, Homo sapiens
gagaaggaaggcact

SEQ ID NO: 66365 - DNA, 15 bp, Homo sapiens
cgagaaggaaggcac

SEQ ID NO: 66366 - DNA, 15 bp, Homo sapiens
tcgagaaggaaggca

SEQ ID NO: 66367 - DNA, 15 bp, Homo sapiens
gtcgagaaggaaggc

SEQ ID NO: 66368 - DNA, 15 bp, Homo sapiens
ggtcgagaaggaagg

SEQ ID NO: 66369 - DNA, 15 bp, Homo sapiens
aggtcgagaaggaag

SEQ ID NO: 66370 - DNA, 15 bp, Homo sapiens
gaggtcgagaaggaa

SEQ ID NO: 66371 - DNA, 15 bp, Homo sapiens
tgaggtcgagaagga

SEQ ID NO: 66372 - DNA, 15 bp, Homo sapiens
atgaggtcgagaagg

SEQ ID NO: 66373 - DNA, 15 bp, Homo sapiens
catgaggtcgagaag

SEQ ID NO: 66374 - DNA, 15 bp, Homo sapiens
ccatgaggtcgagaa

SEQ ID NO: 66375 - DNA, 15 bp, Homo sapiens
tccatgaggtcgaga

SEQ ID NO: 66376 - DNA, 15 bp, Homo sapiens
atccatgaggtcgag

SEQ ID NO: 66377 - DNA, 15 bp, Homo sapiens
catccatgaggtcga

SEQ ID NO: 66378 - DNA, 15 bp, Homo sapiens
gcatccatgaggtcg

SEQ ID NO: 66379 - DNA, 15 bp, Homo sapiens
agcatccatgaggtc

SEQ ID NO: 66380 - DNA, 15 bp, Homo sapiens
cagcatccatgaggt

SEQ ID NO: 66381 - DNA, 15 bp, Homo sapiens
ccagcatccatgagg

SEQ ID NO: 66382 - DNA, 15 bp, Homo sapiens
accagcatccatgag

SEQ ID NO: 66383 - DNA, 15 bp, Homo sapiens
caccagcatccatga

SEQ ID NO: 66384 - DNA, 15 bp, Homo sapiens
gcaccagcatccatg

SEQ ID NO: 66385 - DNA, 15 bp, Homo sapiens
ggcaccagcatccat

SEQ ID NO: 66386 - DNA, 15 bp, Homo sapiens
aggcaccagcatcca

SEQ ID NO: 66387 - DNA, 15 bp, Homo sapiens
taggcaccagcatcc

SEQ ID NO: 66388 - DNA, 15 bp, Homo sapiens
ataggcaccagcatc

SEQ ID NO: 66389 - DNA, 15 bp, Homo sapiens
gataggcaccagcat

SEQ ID NO: 66390 - DNA, 15 bp, Homo sapiens
agataggcaccagca

SEQ ID NO: 66391 - DNA, 15 bp, Homo sapiens
gagataggcaccagc

SEQ ID NO: 66392 - DNA, 15 bp, Homo sapiens
tgagataggcaccag

SEQ ID NO: 66393 - DNA, 15 bp, Homo sapiens
ctgagataggcacca

SEQ ID NO: 66394 - DNA, 15 bp, Homo sapiens
actgagataggcacc

SEQ ID NO: 66395 - DNA, 15 bp, Homo sapiens
cactgagataggcac

SEQ ID NO: 66396 - DNA, 15 bp, Homo sapiens
tcactgagataggca

SEQ ID NO: 66397 - DNA, 15 bp, Homo sapiens
gtcactgagataggc

SEQ ID NO: 66398 - DNA, 15 bp, Homo sapiens
ggtcactgagatagg

SEQ ID NO: 66399 - DNA, 15 bp, Homo sapiens
aggtcactgagatag

SEQ ID NO: 66400 - DNA, 15 bp, Homo sapiens
aaggtcactgagata

SEQ ID NO: 66401 - DNA, 15 bp, Homo sapiens
aaaggtcactgagat

SEQ ID NO: 66402 - DNA, 15 bp, Homo sapiens
caaaggtcactgaga

SEQ ID NO: 66403 - DNA, 15 bp, Homo sapiens
ccaaaggtcactgag

SEQ ID NO: 66404 - DNA, 15 bp, Homo sapiens
gccaaaggtcactga

SEQ ID NO: 66405 - DNA, 15 bp, Homo sapiens
agccaaaggtcactg

SEQ ID NO: 66406 - DNA, 15 bp, Homo sapiens
cagccaaaggtcact

SEQ ID NO: 66407 - DNA, 15 bp, Homo sapiens
ccagccaaaggtcac

SEQ ID NO: 66408 - DNA, 15 bp, Homo sapiens
accagccaaaggtca

SEQ ID NO: 66409 - DNA, 15 bp, Homo sapiens
gaccagccaaaggtc

SEQ ID NO: 66410 - DNA, 15 bp, Homo sapiens
tgaccagccaaaggt

SEQ ID NO: 66411 - DNA, 15 bp, Homo sapiens
gtgaccagccaaagg

SEQ ID NO: 66412 - DNA, 15 bp, Homo sapiens
agtgaccagccaaag

SEQ ID NO: 66413 - DNA, 15 bp, Homo sapiens
tagtgaccagccaaa

SEQ ID NO: 66414 - DNA, 15 bp, Homo sapiens
ttagtgaccagccaa

SEQ ID NO: 66415 - DNA, 15 bp, Homo sapiens
gttagtgaccagcca

SEQ ID NO: 66416 - DNA, 15 bp, Homo sapiens
agttagtgaccagcc

SEQ ID NO: 66417 - DNA, 15 bp, Homo sapiens
aagttagtgaccagc

SEQ ID NO: 66418 - DNA, 15 bp, Homo sapiens
aaagttagtgaccag

SEQ ID NO: 66419 - DNA, 15 bp, Homo sapiens
gaaagttagtgacca

SEQ ID NO: 66420 - DNA, 15 bp, Homo sapiens
ggaaagttagtgacc

SEQ ID NO: 66421 - DNA, 15 bp, Homo sapiens
aggaaagttagtgac

SEQ ID NO: 66422 - DNA, 15 bp, Homo sapiens
caggaaagttagtga

SEQ ID NO: 66423 - DNA, 15 bp, Homo sapiens
ccaggaaagttagtg

SEQ ID NO: 66424 - DNA, 15 bp, Homo sapiens
accaggaaagttagt

SEQ ID NO: 66425 - DNA, 15 bp, Homo sapiens
aaccaggaaagttag

SEQ ID NO: 66426 - DNA, 15 bp, Homo sapiens
gaaccaggaaagtta

SEQ ID NO: 66427 - DNA, 15 bp, Homo sapiens
agaaccaggaaagtt

SEQ ID NO: 66428 - DNA, 15 bp, Homo sapiens
aagaaccaggaaagt

SEQ ID NO: 66429 - DNA, 15 bp, Homo sapiens
taagaaccaggaaag

SEQ ID NO: 66430 - DNA, 15 bp, Homo sapiens
ctaagaaccaggaaa

SEQ ID NO: 66431 - DNA, 15 bp, Homo sapiens
tctaagaaccaggaa

SEQ ID NO: 66432 - DNA, 15 bp, Homo sapiens
ttctaagaaccagga

SEQ ID NO: 66433 - DNA, 15 bp, Homo sapiens
tttctaagaaccagg

SEQ ID NO: 66434 - DNA, 15 bp, Homo sapiens
atttctaagaaccag

SEQ ID NO: 66435 - DNA, 15 bp, Homo sapiens
aatttctaagaacca

SEQ ID NO: 66436 - DNA, 15 bp, Homo sapiens
gaatttctaagaacc

SEQ ID NO: 66437 - DNA, 15 bp, Homo sapiens
agaatttctaagaac

SEQ ID NO: 66438 - DNA, 15 bp, Homo sapiens
gagaatttctaagaa

SEQ ID NO: 66439 - DNA, 15 bp, Homo sapiens
tgagaatttctaaga

SEQ ID NO: 66440 - DNA, 15 bp, Homo sapiens
atgagaatttctaag

SEQ ID NO: 66441 - DNA, 15 bp, Homo sapiens
aatgagaatttctaa

SEQ ID NO: 66442 - DNA, 15 bp, Homo sapiens
taatgagaatttcta

SEQ ID NO: 66443 - DNA, 15 bp, Homo sapiens
ataatgagaatttct

SEQ ID NO: 66444 - DNA, 15 bp, Homo sapiens
tataatgagaatttc

SEQ ID NO: 66445 - DNA, 15 bp, Homo sapiens
ctataatgagaattt

SEQ ID NO: 66446 - DNA, 15 bp, Homo sapiens
actataatgagaatt

SEQ ID NO: 66447 - DNA, 15 bp, Homo sapiens
tactataatgagaat

SEQ ID NO: 66448 - DNA, 15 bp, Homo sapiens
atactataatgagaa

SEQ ID NO: 66449 - DNA, 15 bp, Homo sapiens
tatactataatgaga

SEQ ID NO: 66450 - DNA, 15 bp, Homo sapiens
ctatactataatgag

SEQ ID NO: 66451 - DNA, 15 bp, Homo sapiens
tgatctcggctcgct

SEQ ID NO: 66452 - DNA, 15 bp, Homo sapiens
gtgatctcggctcgc

SEQ ID NO: 66453 - DNA, 15 bp, Homo sapiens
cgtgatctcggctcg

SEQ ID NO: 66454 - DNA, 15 bp, Homo sapiens
gcgtgatctcggctc

SEQ ID NO: 66455 - DNA, 15 bp, Homo sapiens
ggcgtgatctcggct

SEQ ID NO: 66456 - DNA, 15 bp, Homo sapiens
tggcgtgatctcggc

SEQ ID NO: 66457 - DNA, 15 bp, Homo sapiens
gtggcgtgatctcgg

SEQ ID NO: 66458 - DNA, 15 bp, Homo sapiens
agtggcgtgatctcg

SEQ ID NO: 66459 - DNA, 15 bp, Homo sapiens
gtgcccaggctggag

SEQ ID NO: 66460 - DNA, 15 bp, Homo sapiens
ggtgcccaggctgga

SEQ ID NO: 66461 - DNA, 15 bp, Homo sapiens
tggtgcccaggctgg

SEQ ID NO: 66462 - DNA, 15 bp, Homo sapiens
atggtgcccaggctg

SEQ ID NO: 66463 - DNA, 15 bp, Homo sapiens
aatggtgcccaggct

SEQ ID NO: 66464 - DNA, 15 bp, Homo sapiens
caatggtgcccaggc

SEQ ID NO: 66465 - DNA, 15 bp, Homo sapiens
tcaatggtgcccagg

SEQ ID NO: 66466 - DNA, 15 bp, Homo sapiens
ctcaatggtgcccag

SEQ ID NO: 66467 - DNA, 15 bp, Homo sapiens
gctcaatggtgccca

SEQ ID NO: 66468 - DNA, 15 bp, Homo sapiens
cgctcaatggtgccc

SEQ ID NO: 66469 - DNA, 15 bp, Homo sapiens
gcgctcaatggtgcc

SEQ ID NO: 66470 - DNA, 15 bp, Homo sapiens
agcgctcaatggtgc

SEQ ID NO: 66471 - DNA, 15 bp, Homo sapiens
cagcgctcaatggtg

SEQ ID NO: 66472 - DNA, 15 bp, Homo sapiens
tcagcgctcaatggt

SEQ ID NO: 66473 - DNA, 15 bp, Homo sapiens
ctcagcgctcaatgg

SEQ ID NO: 66474 - DNA, 15 bp, Homo sapiens
actcagcgctcaatg

SEQ ID NO: 66475 - DNA, 15 bp, Homo sapiens
cactcagcgctcaat

SEQ ID NO: 66476 - DNA, 15 bp, Homo sapiens
tcactcagcgctcaa

SEQ ID NO: 66477 - DNA, 15 bp, Homo sapiens
ttcactcagcgctca

SEQ ID NO: 66478 - DNA, 15 bp, Homo sapiens
gttcactcagcgctc

SEQ ID NO: 66479 - DNA, 15 bp, Homo sapiens
agttcactcagcgct

SEQ ID NO: 66480 - DNA, 15 bp, Homo sapiens
tagttcactcagcgc

SEQ ID NO: 66481 - DNA, 15 bp, Homo sapiens
ctagttcactcagcg

SEQ ID NO: 66482 - DNA, 15 bp, Homo sapiens
tctagttcactcagc

SEQ ID NO: 66483 - DNA, 15 bp, Homo sapiens
gtctagttcactcag

SEQ ID NO: 66484 - DNA, 15 bp, Homo sapiens
agtctagttcactca

SEQ ID NO: 66485 - DNA, 15 bp, Homo sapiens
gagtctagttcactc

SEQ ID NO: 66486 - DNA, 15 bp, Homo sapiens
ggagtctagttcact

SEQ ID NO: 66487 - DNA, 15 bp, Homo sapiens
cggagtctagttcac

SEQ ID NO: 66488 - DNA, 15 bp, Homo sapiens
acggagtctagttca

SEQ ID NO: 66489 - DNA, 15 bp, Homo sapiens
gacggagtctagttc

SEQ ID NO: 66490 - DNA, 15 bp, Homo sapiens
agacggagtctagtt

SEQ ID NO: 66491 - DNA, 15 bp, Homo sapiens
cagacggagtctagt

SEQ ID NO: 66492 - DNA, 15 bp, Homo sapiens
gcagacggagtctag

SEQ ID NO: 66493 - DNA, 15 bp, Homo sapiens
tgcagacggagtcta

SEQ ID NO: 66494 - DNA, 15 bp, Homo sapiens
ttgcagacggagtct

SEQ ID NO: 66495 - DNA, 15 bp, Homo sapiens
attgcagacggagtc

SEQ ID NO: 66496 - DNA, 15 bp, Homo sapiens
gattgcagacggagt

SEQ ID NO: 66497 - DNA, 15 bp, Homo sapiens
ggattgcagacggag

SEQ ID NO: 66498 - DNA, 15 bp, Homo sapiens
gggattgcagacgga

SEQ ID NO: 66499 - DNA, 15 bp, Homo sapiens
cgggattgcagacgg

SEQ ID NO: 66500 - DNA, 15 bp, Homo sapiens
ccgggattgcagacg

SEQ ID NO: 66501 - DNA, 15 bp, Homo sapiens
gccgggattgcagac

SEQ ID NO: 66502 - DNA, 15 bp, Homo sapiens
tgccgggattgcaga

SEQ ID NO: 66503 - DNA, 15 bp, Homo sapiens
gtgccgggattgcag

SEQ ID NO: 66504 - DNA, 15 bp, Homo sapiens
ggtgccgggattgca

SEQ ID NO: 66505 - DNA, 15 bp, Homo sapiens
aggtgccgggattgc

SEQ ID NO: 66506 - DNA, 15 bp, Homo sapiens
gaggtgccgggattg

SEQ ID NO: 66507 - DNA, 15 bp, Homo sapiens
cgaggtgccgggatt

SEQ ID NO: 66508 - DNA, 15 bp, Homo sapiens
ccgaggtgccgggat

SEQ ID NO: 66509 - DNA, 15 bp, Homo sapiens
cccgaggtgccggga

SEQ ID NO: 66510 - DNA, 15 bp, Homo sapiens
tcccgaggtgccggg

SEQ ID NO: 66511 - DNA, 15 bp, Homo sapiens
ctcccgaggtgccgg

SEQ ID NO: 66512 - DNA, 15 bp, Homo sapiens
cctcccgaggtgccg

SEQ ID NO: 66513 - DNA, 15 bp, Homo sapiens
gcctcccgaggtgcc

SEQ ID NO: 66514 - DNA, 15 bp, Homo sapiens
ggcctcccgaggtgc

SEQ ID NO: 66515 - DNA, 15 bp, Homo sapiens
cggcctcccgaggtg

SEQ ID NO: 66516 - DNA, 15 bp, Homo sapiens
tcggcctcccgaggt

SEQ ID NO: 66517 - DNA, 15 bp, Homo sapiens
ctcggcctcccgagg

SEQ ID NO: 66518 - DNA, 15 bp, Homo sapiens
cctcggcctcccgag

SEQ ID NO: 66519 - DNA, 15 bp, Homo sapiens
gcctcggcctcccga

SEQ ID NO: 66520 - DNA, 15 bp, Homo sapiens
agcctcggcctcccg

SEQ ID NO: 66521 - DNA, 15 bp, Homo sapiens
cagcctcggcctccc

SEQ ID NO: 66522 - DNA, 15 bp, Homo sapiens
ccagcctcggcctcc

SEQ ID NO: 66523 - DNA, 15 bp, Homo sapiens
gccagcctcggcctc

SEQ ID NO: 66524 - DNA, 15 bp, Homo sapiens
cgccagcctcggcct

SEQ ID NO: 66525 - DNA, 15 bp, Homo sapiens
ccgccagcctcggcc

SEQ ID NO: 66526 - DNA, 15 bp, Homo sapiens
tccgccagcctcggc

SEQ ID NO: 66527 - DNA, 15 bp, Homo sapiens
atccgccagcctcgg

SEQ ID NO: 66528 - DNA, 15 bp, Homo sapiens
gatccgccagcctcg

SEQ ID NO: 66529 - DNA, 15 bp, Homo sapiens
tgatccgccagcctc

SEQ ID NO: 66530 - DNA, 15 bp, Homo sapiens
gtgatccgccagcct

SEQ ID NO: 66531 - DNA, 15 bp, Homo sapiens
agtgatccgccagcc

SEQ ID NO: 66532 - DNA, 15 bp, Homo sapiens
gagtgatccgccagc

SEQ ID NO: 66533 - DNA, 15 bp, Homo sapiens
cgagtgatccgccag

SEQ ID NO: 66534 - DNA, 15 bp, Homo sapiens
gcgagtgatccgcca

SEQ ID NO: 66535 - DNA, 15 bp, Homo sapiens
cgcgagtgatccgcc

SEQ ID NO: 66536 - DNA, 15 bp, Homo sapiens
ccgcgagtgatccgc

SEQ ID NO: 66537 - DNA, 15 bp, Homo sapiens
accgcgagtgatccg

SEQ ID NO: 66538 - DNA, 15 bp, Homo sapiens
gaccgcgagtgatcc

SEQ ID NO: 66539 - DNA, 15 bp, Homo sapiens
tgaccgcgagtgatc

SEQ ID NO: 66540 - DNA, 15 bp, Homo sapiens
ctgaccgcgagtgat

SEQ ID NO: 66541 - DNA, 15 bp, Homo sapiens
cctgaccgcgagtga

SEQ ID NO: 66542 - DNA, 15 bp, Homo sapiens
tcctgaccgcgagtg

SEQ ID NO: 66543 - DNA, 15 bp, Homo sapiens
ctcctgaccgcgagt

SEQ ID NO: 66544 - DNA, 15 bp, Homo sapiens
gctcctgaccgcgag

SEQ ID NO: 66545 - DNA, 15 bp, Homo sapiens
agctcctgaccgcga

SEQ ID NO: 66546 - DNA, 15 bp, Homo sapiens
cagctcctgaccgcg

SEQ ID NO: 66547 - DNA, 15 bp, Homo sapiens
ccagctcctgaccgc

SEQ ID NO: 66548 - DNA, 15 bp, Homo sapiens
tccagctcctgaccg

SEQ ID NO: 66549 - DNA, 15 bp, Homo sapiens
ctccagctcctgacc

SEQ ID NO: 66550 - DNA, 15 bp, Homo sapiens
tctccagctcctgac

SEQ ID NO: 66551 - DNA, 15 bp, Homo sapiens
gtctccagctcctga

SEQ ID NO: 66552 - DNA, 15 bp, Homo sapiens
ggtctccagctcctg

SEQ ID NO: 66553 - DNA, 15 bp, Homo sapiens
tggtctccagctcct

SEQ ID NO: 66554 - DNA, 15 bp, Homo sapiens
ctggtctccagctcc

SEQ ID NO: 66555 - DNA, 15 bp, Homo sapiens
gctggtctccagctc

SEQ ID NO: 66556 - DNA, 15 bp, Homo sapiens
ggctggtctccagct

SEQ ID NO: 66557 - DNA, 15 bp, Homo sapiens
gggctggtctccagc

SEQ ID NO: 66558 - DNA, 15 bp, Homo sapiens
cgggctggtctccag

SEQ ID NO: 66559 - DNA, 15 bp, Homo sapiens
ccgggctggtctcca

SEQ ID NO: 66560 - DNA, 15 bp, Homo sapiens
gccgggctggtctcc

SEQ ID NO: 66561 - DNA, 15 bp, Homo sapiens
ggccgggctggtctc

SEQ ID NO: 66562 - DNA, 15 bp, Homo sapiens
tggccgggctggtct

SEQ ID NO: 66563 - DNA, 15 bp, Homo sapiens
ttggccgggctggtc

SEQ ID NO: 66564 - DNA, 15 bp, Homo sapiens
gttggccgggctggt

SEQ ID NO: 66565 - DNA, 15 bp, Homo sapiens
tgttggccgggctgg

SEQ ID NO: 66566 - DNA, 15 bp, Homo sapiens
gtgttggccgggctg

SEQ ID NO: 66567 - DNA, 15 bp, Homo sapiens
tgtgttggccgggct

SEQ ID NO: 66568 - DNA, 15 bp, Homo sapiens
ctgtgttggccgggc

SEQ ID NO: 66569 - DNA, 15 bp, Homo sapiens
gctgtgttggccggg

SEQ ID NO: 66570 - DNA, 15 bp, Homo sapiens
cgctgtgttggccgg

SEQ ID NO: 66571 - DNA, 15 bp, Homo sapiens
tcgctgtgttggccg

SEQ ID NO: 66572 - DNA, 15 bp, Homo sapiens
ttcgctgtgttggcc

SEQ ID NO: 66573 - DNA, 15 bp, Homo sapiens
tttcgctgtgttggc

SEQ ID NO: 66574 - DNA, 15 bp, Homo sapiens
gtttcgctgtgttgg

SEQ ID NO: 66575 - DNA, 15 bp, Homo sapiens
ggtttcgctgtgttg

SEQ ID NO: 66576 - DNA, 15 bp, Homo sapiens
gggtttcgctgtgtt

SEQ ID NO: 66577 - DNA, 15 bp, Homo sapiens
ggggtttcgctgtgt

SEQ ID NO: 66578 - DNA, 15 bp, Homo sapiens
cggggtttcgctgtg

SEQ ID NO: 66579 - DNA, 15 bp, Homo sapiens
acggggtttcgctgt

SEQ ID NO: 66580 - DNA, 15 bp, Homo sapiens
gacggggtttcgctg

SEQ ID NO: 66581 - DNA, 15 bp, Homo sapiens
agacggggtttcgct

SEQ ID NO: 66582 - DNA, 15 bp, Homo sapiens
gagacggggtttcgc

SEQ ID NO: 66583 - DNA, 15 bp, Homo sapiens
ggagacggggtttcg

SEQ ID NO: 66584 - DNA, 15 bp, Homo sapiens
tggagacggggtttc

SEQ ID NO: 66585 - DNA, 15 bp, Homo sapiens
gtggagacggggttt

SEQ ID NO: 66586 - DNA, 15 bp, Homo sapiens
ggtggagacggggtt

SEQ ID NO: 66587 - DNA, 15 bp, Homo sapiens
tggtggagacggggt

SEQ ID NO: 66588 - DNA, 15 bp, Homo sapiens
ttggtggagacgggg

SEQ ID NO: 66589 - DNA, 15 bp, Homo sapiens
tttggtggagacggg

SEQ ID NO: 66590 - DNA, 15 bp, Homo sapiens
ttttggtggagacgg

SEQ ID NO: 66591 - DNA, 15 bp, Homo sapiens
tttttggtggagacg

SEQ ID NO: 66592 - DNA, 15 bp, Homo sapiens
ttttttggtggagac

SEQ ID NO: 66593 - DNA, 15 bp, Homo sapiens
tttttttggtggaga

SEQ ID NO: 66594 - DNA, 15 bp, Homo sapiens
atttttttggtggag

SEQ ID NO: 66595 - DNA, 15 bp, Homo sapiens
tatttttttggtgga

SEQ ID NO: 66596 - DNA, 15 bp, Homo sapiens
gtatttttttggtgg

SEQ ID NO: 66597 - DNA, 15 bp, Homo sapiens
cgtatttttttggtg

SEQ ID NO: 66598 - DNA, 15 bp, Homo sapiens
tcgtatttttttggt

SEQ ID NO: 66599 - DNA, 15 bp, Homo sapiens
ttcgtatttttttgg

SEQ ID NO: 66600 - DNA, 15 bp, Homo sapiens
tttcgtatttttttg

SEQ ID NO: 66601 - DNA, 15 bp, Homo sapiens
ttttcgtattttttt

SEQ ID NO: 66602 - DNA, 15 bp, Homo sapiens
gttttcgtatttttt

SEQ ID NO: 66603 - DNA, 15 bp, Homo sapiens
ggttttcgtattttt

SEQ ID NO: 66604 - DNA, 15 bp, Homo sapiens
tggttttcgtatttt

SEQ ID NO: 66605 - DNA, 15 bp, Homo sapiens
ctggttttcgtattt

SEQ ID NO: 66606 - DNA, 15 bp, Homo sapiens
actggttttcgtatt

SEQ ID NO: 66607 - DNA, 15 bp, Homo sapiens
gactggttttcgtat

SEQ ID NO: 66608 - DNA, 15 bp, Homo sapiens
tgactggttttcgta

SEQ ID NO: 66609 - DNA, 15 bp, Homo sapiens
ctgactggttttcgt

SEQ ID NO: 66610 - DNA, 15 bp, Homo sapiens
cctgactggttttcg

SEQ ID NO: 66611 - DNA, 15 bp, Homo sapiens
gcctgactggttttc

SEQ ID NO: 66612 - DNA, 15 bp, Homo sapiens
cgcctgactggtttt

SEQ ID NO: 66613 - DNA, 15 bp, Homo sapiens
acgcctgactggttt

SEQ ID NO: 66614 - DNA, 15 bp, Homo sapiens
cacgcctgactggtt

SEQ ID NO: 66615 - DNA, 15 bp, Homo sapiens
ccacgcctgactggt

SEQ ID NO: 66616 - DNA, 15 bp, Homo sapiens
accacgcctgactgg

SEQ ID NO: 66617 - DNA, 15 bp, Homo sapiens
caccacgcctgactg

SEQ ID NO: 66618 - DNA, 15 bp, Homo sapiens
ccaccacgcctgact

SEQ ID NO: 66619 - DNA, 15 bp, Homo sapiens
gccaccacgcctgac

SEQ ID NO: 66620 - DNA, 15 bp, Homo sapiens
cgccaccacgcctga

SEQ ID NO: 66621 - DNA, 15 bp, Homo sapiens
gcgccaccacgcctg

SEQ ID NO: 66622 - DNA, 15 bp, Homo sapiens
cgcgccaccacgcct

SEQ ID NO: 66623 - DNA, 15 bp, Homo sapiens
gcgcgccaccacgcc

SEQ ID NO: 66624 - DNA, 15 bp, Homo sapiens
tgcgcgccaccacgc

SEQ ID NO: 66625 - DNA, 15 bp, Homo sapiens
gtgcgcgccaccacg

SEQ ID NO: 66626 - DNA, 15 bp, Homo sapiens
ggtgcgcgccaccac

SEQ ID NO: 66627 - DNA, 15 bp, Homo sapiens
aggtgcgcgccacca

SEQ ID NO: 66628 - DNA, 15 bp, Homo sapiens
caggtgcgcgccacc

SEQ ID NO: 66629 - DNA, 15 bp, Homo sapiens
gcaggtgcgcgccac

SEQ ID NO: 66630 - DNA, 15 bp, Homo sapiens
tgcaggtgcgcgcca

SEQ ID NO: 66631 - DNA, 15 bp, Homo sapiens
ttgcaggtgcgcgcc

SEQ ID NO: 66632 - DNA, 15 bp, Homo sapiens
attgcaggtgcgcgc

SEQ ID NO: 66633 - DNA, 15 bp, Homo sapiens
aattgcaggtgcgcg

SEQ ID NO: 66634 - DNA, 15 bp, Homo sapiens
caattgcaggtgcgc

SEQ ID NO: 66635 - DNA, 15 bp, Homo sapiens
gcaattgcaggtgcg

SEQ ID NO: 66636 - DNA, 15 bp, Homo sapiens
tgcaattgcaggtgc

SEQ ID NO: 66637 - DNA, 15 bp, Homo sapiens
ctgcaattgcaggtg

SEQ ID NO: 66638 - DNA, 15 bp, Homo sapiens
cctgcaattgcaggt

SEQ ID NO: 66639 - DNA, 15 bp, Homo sapiens
gcctgcaattgcagg

SEQ ID NO: 66640 - DNA, 15 bp, Homo sapiens
tgcctgcaattgcag

SEQ ID NO: 66641 - DNA, 15 bp, Homo sapiens
gtgcctgcaattgca

SEQ ID NO: 66642 - DNA, 15 bp, Homo sapiens
agtgcctgcaattgc

SEQ ID NO: 66643 - DNA, 15 bp, Homo sapiens
gagtgcctgcaattg

SEQ ID NO: 66644 - DNA, 15 bp, Homo sapiens
cgagtgcctgcaatt

SEQ ID NO: 66645 - DNA, 15 bp, Homo sapiens
ccgagtgcctgcaat

SEQ ID NO: 66646 - DNA, 15 bp, Homo sapiens
gccgagtgcctgcaa

SEQ ID NO: 66647 - DNA, 15 bp, Homo sapiens
tgccgagtgcctgca

SEQ ID NO: 66648 - DNA, 15 bp, Homo sapiens
ctgccgagtgcctgc

SEQ ID NO: 66649 - DNA, 15 bp, Homo sapiens
cctgccgagtgcctg

SEQ ID NO: 66650 - DNA, 15 bp, Homo sapiens
gcctgccgagtgcct

SEQ ID NO: 66651 - DNA, 15 bp, Homo sapiens
agcctgccgagtgcc

SEQ ID NO: 66652 - DNA, 15 bp, Homo sapiens
cagcctgccgagtgc

SEQ ID NO: 66653 - DNA, 15 bp, Homo sapiens
tcagcctgccgagtg

SEQ ID NO: 66654 - DNA, 15 bp, Homo sapiens
ctcagcctgccgagt

SEQ ID NO: 66655 - DNA, 15 bp, Homo sapiens
cctcagcctgccgag

SEQ ID NO: 66656 - DNA, 15 bp, Homo sapiens
gcctcagcctgccga

SEQ ID NO: 66657 - DNA, 15 bp, Homo sapiens
tgcctcagcctgccg

SEQ ID NO: 66658 - DNA, 15 bp, Homo sapiens
ctgcctcagcctgcc

SEQ ID NO: 66659 - DNA, 15 bp, Homo sapiens
cctgcctcagcctgc

SEQ ID NO: 66660 - DNA, 15 bp, Homo sapiens
tcctgcctcagcctg

SEQ ID NO: 66661 - DNA, 15 bp, Homo sapiens
ctgattctcctgcct

SEQ ID NO: 66662 - DNA, 15 bp, Homo sapiens
cctgattctcctgcc

SEQ ID NO: 66663 - DNA, 15 bp, Homo sapiens
gcctgattctcctgc

SEQ ID NO: 66664 - DNA, 15 bp, Homo sapiens
tgcctgattctcctg

SEQ ID NO: 66665 - DNA, 15 bp, Homo sapiens
ctgcctgattctcct

SEQ ID NO: 66666 - DNA, 15 bp, Homo sapiens
cctgcctgattctcc

SEQ ID NO: 66667 - DNA, 15 bp, Homo sapiens
ccctgcctgattctc

SEQ ID NO: 66668 - DNA, 15 bp, Homo sapiens
tccctgcctgattct

SEQ ID NO: 66669 - DNA, 15 bp, Homo sapiens
ctccctgcctgattc

SEQ ID NO: 66670 - DNA, 15 bp, Homo sapiens
cctccctgcctgatt

SEQ ID NO: 66671 - DNA, 15 bp, Homo sapiens
acctccctgcctgat

SEQ ID NO: 66672 - DNA, 15 bp, Homo sapiens
aacctccctgcctga

SEQ ID NO: 66673 - DNA, 15 bp, Homo sapiens
caacctccctgcctg

SEQ ID NO: 66674 - DNA, 15 bp, Homo sapiens
gcaacctccctgcct

SEQ ID NO: 66675 - DNA, 15 bp, Homo sapiens
tgcaacctccctgcc

SEQ ID NO: 66676 - DNA, 15 bp, Homo sapiens
ctgcaacctccctgc

SEQ ID NO: 66677 - DNA, 15 bp, Homo sapiens
actgcaacctccctg

SEQ ID NO: 66678 - DNA, 15 bp, Homo sapiens
cactgcaacctccct

SEQ ID NO: 66679 - DNA, 15 bp, Homo sapiens
tcactgcaacctccc

SEQ ID NO: 66680 - DNA, 15 bp, Homo sapiens
catctcggctcactg

SEQ ID NO: 66681 - DNA, 15 bp, Homo sapiens
ccatctcggctcact

SEQ ID NO: 66682 - DNA, 15 bp, Homo sapiens
gccatctcggctcac

SEQ ID NO: 66683 - DNA, 15 bp, Homo sapiens
tgccatctcggctca

SEQ ID NO: 66684 - DNA, 15 bp, Homo sapiens
ctgccatctcggctc

SEQ ID NO: 66685 - DNA, 15 bp, Homo sapiens
gctgccatctcggct

SEQ ID NO: 66686 - DNA, 15 bp, Homo sapiens
tgctgccatctcggc

SEQ ID NO: 66687 - DNA, 15 bp, Homo sapiens
ctgctgccatctcgg

SEQ ID NO: 66688 - DNA, 15 bp, Homo sapiens
actgctgccatctcg

SEQ ID NO: 66689 - DNA, 15 bp, Homo sapiens
tactgctgccatctc

SEQ ID NO: 66690 - DNA, 15 bp, Homo sapiens
gtactgctgccatct

SEQ ID NO: 66691 - DNA, 15 bp, Homo sapiens
tgtactgctgccatc

SEQ ID NO: 66692 - DNA, 15 bp, Homo sapiens
ctgtactgctgccat

SEQ ID NO: 66693 - DNA, 15 bp, Homo sapiens
actgtactgctgcca

SEQ ID NO: 66694 - DNA, 15 bp, Homo sapiens
gactgtactgctgcc

SEQ ID NO: 66695 - DNA, 15 bp, Homo sapiens
ggactgtactgctgc

SEQ ID NO: 66696 - DNA, 15 bp, Homo sapiens
tggactgtactgctg

SEQ ID NO: 66697 - DNA, 15 bp, Homo sapiens
ctggactgtactgct

SEQ ID NO: 66698 - DNA, 15 bp, Homo sapiens
gctggactgtactgc

SEQ ID NO: 66699 - DNA, 15 bp, Homo sapiens
agctggactgtactg

SEQ ID NO: 66700 - DNA, 15 bp, Homo sapiens
aagctggactgtact

SEQ ID NO: 66701 - DNA, 15 bp, Homo sapiens
gaagctggactgtac

SEQ ID NO: 66702 - DNA, 15 bp, Homo sapiens
cgaagctggactgta

SEQ ID NO: 66703 - DNA, 15 bp, Homo sapiens
ccgaagctggactgt

SEQ ID NO: 66704 - DNA, 15 bp, Homo sapiens
gccgaagctggactg

SEQ ID NO: 66705 - DNA, 15 bp, Homo sapiens
agccgaagctggact

SEQ ID NO: 66706 - DNA, 15 bp, Homo sapiens
gagccgaagctggac

SEQ ID NO: 66707 - DNA, 15 bp, Homo sapiens
cgagccgaagctgga

SEQ ID NO: 66708 - DNA, 15 bp, Homo sapiens
ccgagccgaagctgg

SEQ ID NO: 66709 - DNA, 15 bp, Homo sapiens
gccgagccgaagctg

SEQ ID NO: 66710 - DNA, 15 bp, Homo sapiens
tgccgagccgaagct

SEQ ID NO: 66711 - DNA, 15 bp, Homo sapiens
atgccgagccgaagc

SEQ ID NO: 66712 - DNA, 15 bp, Homo sapiens
gatgccgagccgaag

SEQ ID NO: 66713 - DNA, 15 bp, Homo sapiens
tgatgccgagccgaa

SEQ ID NO: 66714 - DNA, 15 bp, Homo sapiens
ctgatgccgagccga

SEQ ID NO: 66715 - DNA, 15 bp, Homo sapiens
tctgatgccgagccg

SEQ ID NO: 66716 - DNA, 15 bp, Homo sapiens
ctctgatgccgagcc

SEQ ID NO: 66717 - DNA, 15 bp, Homo sapiens
cctctgatgccgagc

SEQ ID NO: 66718 - DNA, 15 bp, Homo sapiens
ccctctgatgccgag

SEQ ID NO: 66719 - DNA, 15 bp, Homo sapiens
tccctctgatgccga

SEQ ID NO: 66720 - DNA, 15 bp, Homo sapiens
ctccctctgatgccg

SEQ ID NO: 66721 - DNA, 15 bp, Homo sapiens
tctccctctgatgcc

SEQ ID NO: 66722 - DNA, 15 bp, Homo sapiens
gtctccctctgatgc

SEQ ID NO: 66723 - DNA, 15 bp, Homo sapiens
ggtctccctctgatg

SEQ ID NO: 66724 - DNA, 15 bp, Homo sapiens
cggtctccctctgat

SEQ ID NO: 66725 - DNA, 15 bp, Homo sapiens
acggtctccctctga

SEQ ID NO: 66726 - DNA, 15 bp, Homo sapiens
cacggtctccctctg

SEQ ID NO: 66727 - DNA, 15 bp, Homo sapiens
ccacggtctccctct

SEQ ID NO: 66728 - DNA, 15 bp, Homo sapiens
tccacggtctccctc

SEQ ID NO: 66729 - DNA, 15 bp, Homo sapiens
ttccacggtctccct

SEQ ID NO: 66730 - DNA, 15 bp, Homo sapiens
tttccacggtctccc

SEQ ID NO: 66731 - DNA, 15 bp, Homo sapiens
ctttccacggtctcc

SEQ ID NO: 66732 - DNA, 15 bp, Homo sapiens
tctttccacggtctc

SEQ ID NO: 66733 - DNA, 15 bp, Homo sapiens
ctctttccacggtct

SEQ ID NO: 66734 - DNA, 15 bp, Homo sapiens
cctctttccacggtc

SEQ ID NO: 66735 - DNA, 15 bp, Homo sapiens
ccctctttccacggt

SEQ ID NO: 66736 - DNA, 15 bp, Homo sapiens
cccctctttccacgg

SEQ ID NO: 66737 - DNA, 15 bp, Homo sapiens
tcccctctttccacg

SEQ ID NO: 66738 - DNA, 15 bp, Homo sapiens
ctcccctctttccac

SEQ ID NO: 66739 - DNA, 15 bp, Homo sapiens
cctcccctctttcca

SEQ ID NO: 66740 - DNA, 15 bp, Homo sapiens
ccctcccctctttcc

SEQ ID NO: 66741 - DNA, 15 bp, Homo sapiens
cccctcccctctttc

SEQ ID NO: 66742 - DNA, 15 bp, Homo sapiens
ccccctcccctcttt

SEQ ID NO: 66743 - DNA, 15 bp, Homo sapiens
tccccctcccctctt

SEQ ID NO: 66744 - DNA, 15 bp, Homo sapiens
ctccccctcccctct

SEQ ID NO: 66745 - DNA, 15 bp, Homo sapiens
cctccccctcccctc

SEQ ID NO: 66746 - DNA, 15 bp, Homo sapiens
ccctccccctcccct

SEQ ID NO: 66747 - DNA, 15 bp, Homo sapiens
cccctccccctcccc

SEQ ID NO: 66748 - DNA, 15 bp, Homo sapiens
ccccctccccctccc

SEQ ID NO: 66749 - DNA, 15 bp, Homo sapiens
tccccctccccctcc

SEQ ID NO: 66750 - DNA, 15 bp, Homo sapiens
ctccccctccccctc

SEQ ID NO: 66751 - DNA, 15 bp, Homo sapiens
cctccccctccccct

SEQ ID NO: 66752 - DNA, 15 bp, Homo sapiens
ccctccccctccccc

SEQ ID NO: 66753 - DNA, 15 bp, Homo sapiens
tccctccccctcccc

SEQ ID NO: 66754 - DNA, 15 bp, Homo sapiens
ctccctccccctccc

SEQ ID NO: 66755 - DNA, 15 bp, Homo sapiens
tctccctccccctcc

SEQ ID NO: 66756 - DNA, 15 bp, Homo sapiens
ctctccctccccctc

SEQ ID NO: 66757 - DNA, 15 bp, Homo sapiens
cctctccctccccct

SEQ ID NO: 66758 - DNA, 15 bp, Homo sapiens
ccctctccctccccc

SEQ ID NO: 66759 - DNA, 15 bp, Homo sapiens
tccctctccctcccc

SEQ ID NO: 66760 - DNA, 15 bp, Homo sapiens
ctccctctccctccc

SEQ ID NO: 66761 - DNA, 15 bp, Homo sapiens
gctccctctccctcc

SEQ ID NO: 66762 - DNA, 15 bp, Homo sapiens
cgctccctctccctc

SEQ ID NO: 66763 - DNA, 15 bp, Homo sapiens
tcgctccctctccct

SEQ ID NO: 66764 - DNA, 15 bp, Homo sapiens
ttcgctccctctccc

SEQ ID NO: 66765 - DNA, 15 bp, Homo sapiens
cttcgctccctctcc

SEQ ID NO: 66766 - DNA, 15 bp, Homo sapiens
acttcgctccctctc

SEQ ID NO: 66767 - DNA, 15 bp, Homo sapiens
aacttcgctccctct

SEQ ID NO: 66768 - DNA, 15 bp, Homo sapiens
aaacttcgctccctc

SEQ ID NO: 66769 - DNA, 15 bp, Homo sapiens
aaaacttcgctccct

SEQ ID NO: 66770 - DNA, 15 bp, Homo sapiens
caaaacttcgctccc

SEQ ID NO: 66771 - DNA, 15 bp, Homo sapiens
tcaaaacttcgctcc

SEQ ID NO: 66772 - DNA, 15 bp, Homo sapiens
ttcaaaacttcgctc

SEQ ID NO: 66773 - DNA, 15 bp, Homo sapiens
cttcaaaacttcgct

SEQ ID NO: 66774 - DNA, 15 bp, Homo sapiens
ccttcaaaacttcgc

SEQ ID NO: 66775 - DNA, 15 bp, Homo sapiens
tccttcaaaacttcg

SEQ ID NO: 66776 - DNA, 15 bp, Homo sapiens
ttccttcaaaacttc

SEQ ID NO: 66777 - DNA, 15 bp, Homo sapiens
cttccttcaaaactt

SEQ ID NO: 66778 - DNA, 15 bp, Homo sapiens
ccttccttcaaaact

SEQ ID NO: 66779 - DNA, 15 bp, Homo sapiens
accttccttcaaaac

SEQ ID NO: 66780 - DNA, 15 bp, Homo sapiens
gaccttccttcaaaa

SEQ ID NO: 66781 - DNA, 15 bp, Homo sapiens
tgaccttccttcaaa

SEQ ID NO: 66782 - DNA, 15 bp, Homo sapiens
ctgaccttccttcaa

SEQ ID NO: 66783 - DNA, 15 bp, Homo sapiens
tctgaccttccttca

SEQ ID NO: 66784 - DNA, 15 bp, Homo sapiens
ttctgaccttccttc

SEQ ID NO: 66785 - DNA, 15 bp, Homo sapiens
attctgaccttcctt

SEQ ID NO: 66786 - DNA, 15 bp, Homo sapiens
aattctgaccttcct

SEQ ID NO: 66787 - DNA, 15 bp, Homo sapiens
taattctgaccttcc

SEQ ID NO: 66788 - DNA, 15 bp, Homo sapiens
gtaattctgaccttc

SEQ ID NO: 66789 - DNA, 15 bp, Homo sapiens
agtaattctgacctt

SEQ ID NO: 66790 - DNA, 15 bp, Homo sapiens
aagtaattctgacct

SEQ ID NO: 66791 - DNA, 15 bp, Homo sapiens
taagtaattctgacc

SEQ ID NO: 66792 - DNA, 15 bp, Homo sapiens
ataagtaattctgac

SEQ ID NO: 66793 - DNA, 15 bp, Homo sapiens
cataagtaattctga

SEQ ID NO: 66794 - DNA, 15 bp, Homo sapiens
acataagtaattctg

SEQ ID NO: 66795 - DNA, 15 bp, Homo sapiens
tacataagtaattct

SEQ ID NO: 66796 - DNA, 15 bp, Homo sapiens
atacataagtaattc

SEQ ID NO: 66797 - DNA, 15 bp, Homo sapiens
aatacataagtaatt

SEQ ID NO: 66798 - DNA, 15 bp, Homo sapiens
taatacataagtaat

SEQ ID NO: 66799 - DNA, 15 bp, Homo sapiens
ttaatacataagtaa

SEQ ID NO: 66800 - DNA, 15 bp, Homo sapiens
tttaatacataagta

SEQ ID NO: 66801 - DNA, 15 bp, Homo sapiens
atttaatacataagt

SEQ ID NO: 66802 - DNA, 15 bp, Homo sapiens
catttaatacataag

SEQ ID NO: 66803 - DNA, 15 bp, Homo sapiens
acatttaatacataa

SEQ ID NO: 66804 - DNA, 15 bp, Homo sapiens
cacatttaatacata

SEQ ID NO: 66805 - DNA, 15 bp, Homo sapiens
ccacatttaatacat

SEQ ID NO: 66806 - DNA, 15 bp, Homo sapiens
tccacatttaataca

SEQ ID NO: 66807 - DNA, 15 bp, Homo sapiens
ttccacatttaatac

SEQ ID NO: 66808 - DNA, 15 bp, Homo sapiens
cttccacatttaata

SEQ ID NO: 66809 - DNA, 15 bp, Homo sapiens
tcttccacatttaat

SEQ ID NO: 66810 - DNA, 15 bp, Homo sapiens
atcttccacatttaa

SEQ ID NO: 66811 - DNA, 15 bp, Homo sapiens
catcttccacattta

SEQ ID NO: 66812 - DNA, 15 bp, Homo sapiens
tcatcttccacattt

SEQ ID NO: 66813 - DNA, 15 bp, Homo sapiens
ttcatcttccacatt

SEQ ID NO: 66814 - DNA, 15 bp, Homo sapiens
cttcatcttccacat

SEQ ID NO: 66815 - DNA, 15 bp, Homo sapiens
ccttcatcttccaca

SEQ ID NO: 66816 - DNA, 15 bp, Homo sapiens
tccttcatcttccac

SEQ ID NO: 66817 - DNA, 15 bp, Homo sapiens
ctccttcatcttcca

SEQ ID NO: 66818 - DNA, 15 bp, Homo sapiens
tctccttcatcttcc

SEQ ID NO: 66819 - DNA, 15 bp, Homo sapiens
ctctccttcatcttc

SEQ ID NO: 66820 - DNA, 15 bp, Homo sapiens
tctctccttcatctt

SEQ ID NO: 66821 - DNA, 15 bp, Homo sapiens
ctctctccttcatct

SEQ ID NO: 66822 - DNA, 15 bp, Homo sapiens
tctctctccttcatc

SEQ ID NO: 66823 - DNA, 15 bp, Homo sapiens
ttctctctccttcat

SEQ ID NO: 66824 - DNA, 15 bp, Homo sapiens
cttctctctccttca

SEQ ID NO: 66825 - DNA, 15 bp, Homo sapiens
gcttctctctccttc

SEQ ID NO: 66826 - DNA, 15 bp, Homo sapiens
agcttctctctcctt

SEQ ID NO: 66827 - DNA, 15 bp, Homo sapiens
cagcttctctctcct

SEQ ID NO: 66828 - DNA, 15 bp, Homo sapiens
ccagcttctctctcc

SEQ ID NO: 66829 - DNA, 15 bp, Homo sapiens
cccagcttctctctc

SEQ ID NO: 66830 - DNA, 15 bp, Homo sapiens
ccccagcttctctct

SEQ ID NO: 66831 - DNA, 15 bp, Homo sapiens
gccccagcttctctc

SEQ ID NO: 66832 - DNA, 15 bp, Homo sapiens
agccccagcttctct

SEQ ID NO: 66833 - DNA, 15 bp, Homo sapiens
cagccccagcttctc

SEQ ID NO: 66834 - DNA, 15 bp, Homo sapiens
ccagccccagcttct

SEQ ID NO: 66835 - DNA, 15 bp, Homo sapiens
gccagccccagcttc

SEQ ID NO: 66836 - DNA, 15 bp, Homo sapiens
agccagccccagctt

SEQ ID NO: 66837 - DNA, 15 bp, Homo sapiens
gagccagccccagct

SEQ ID NO: 66838 - DNA, 15 bp, Homo sapiens
ggagccagccccagc

SEQ ID NO: 66839 - DNA, 15 bp, Homo sapiens
gggagccagccccag

SEQ ID NO: 66840 - DNA, 15 bp, Homo sapiens
tgggagccagcccca

SEQ ID NO: 66841 - DNA, 15 bp, Homo sapiens
ctgggagccagcccc

SEQ ID NO: 66842 - DNA, 15 bp, Homo sapiens
cctgggagccagccc

SEQ ID NO: 66843 - DNA, 15 bp, Homo sapiens
acctgggagccagcc

SEQ ID NO: 66844 - DNA, 15 bp, Homo sapiens
aacctgggagccagc

SEQ ID NO: 66845 - DNA, 15 bp, Homo sapiens
aaacctgggagccag

SEQ ID NO: 66846 - DNA, 15 bp, Homo sapiens
caaacctgggagcca

SEQ ID NO: 66847 - DNA, 15 bp, Homo sapiens
acaaacctgggagcc

SEQ ID NO: 66848 - DNA, 15 bp, Homo sapiens
tacaaacctgggagc

SEQ ID NO: 66849 - DNA, 15 bp, Homo sapiens
ctacaaacctgggag

SEQ ID NO: 66850 - DNA, 15 bp, Homo sapiens
gctacaaacctggga

SEQ ID NO: 66851 - DNA, 15 bp, Homo sapiens
agctacaaacctggg

SEQ ID NO: 66852 - DNA, 15 bp, Homo sapiens
cagctacaaacctgg

SEQ ID NO: 66853 - DNA, 15 bp, Homo sapiens
ccagctacaaacctg

SEQ ID NO: 66854 - DNA, 15 bp, Homo sapiens
tccagctacaaacct

SEQ ID NO: 66855 - DNA, 15 bp, Homo sapiens
ctccagctacaaacc

SEQ ID NO: 66856 - DNA, 15 bp, Homo sapiens
actccagctacaaac

SEQ ID NO: 66857 - DNA, 15 bp, Homo sapiens
tactccagctacaaa

SEQ ID NO: 66858 - DNA, 15 bp, Homo sapiens
gtactccagctacaa

SEQ ID NO: 66859 - DNA, 15 bp, Homo sapiens
ggtactccagctaca

SEQ ID NO: 66860 - DNA, 15 bp, Homo sapiens
aggtactccagctac

SEQ ID NO: 66861 - DNA, 15 bp, Homo sapiens
taggtactccagcta

SEQ ID NO: 66862 - DNA, 15 bp, Homo sapiens
ctaggtactccagct

SEQ ID NO: 66863 - DNA, 15 bp, Homo sapiens
actaggtactccagc

SEQ ID NO: 66864 - DNA, 15 bp, Homo sapiens
aactaggtactccag

SEQ ID NO: 66865 - DNA, 15 bp, Homo sapiens
caactaggtactcca

SEQ ID NO: 66866 - DNA, 15 bp, Homo sapiens
gcaactaggtactcc

SEQ ID NO: 66867 - DNA, 15 bp, Homo sapiens
tgcaactaggtactc

SEQ ID NO: 66868 - DNA, 15 bp, Homo sapiens
ctgcaactaggtact

SEQ ID NO: 66869 - DNA, 15 bp, Homo sapiens
cctgcaactaggtac

SEQ ID NO: 66870 - DNA, 15 bp, Homo sapiens
ccctgcaactaggta

SEQ ID NO: 66871 - DNA, 15 bp, Homo sapiens
tccctgcaactaggt

SEQ ID NO: 66872 - DNA, 15 bp, Homo sapiens
ctccctgcaactagg

SEQ ID NO: 66873 - DNA, 15 bp, Homo sapiens
cctccctgcaactag

SEQ ID NO: 66874 - DNA, 15 bp, Homo sapiens
tcctccctgcaacta

SEQ ID NO: 66875 - DNA, 15 bp, Homo sapiens
ctcctccctgcaact

SEQ ID NO: 66876 - DNA, 15 bp, Homo sapiens
gctcctccctgcaac

SEQ ID NO: 66877 - DNA, 15 bp, Homo sapiens
ggctcctccctgcaa

SEQ ID NO: 66878 - DNA, 15 bp, Homo sapiens
tggctcctccctgca

SEQ ID NO: 66879 - DNA, 15 bp, Homo sapiens
atggctcctccctgc

SEQ ID NO: 66880 - DNA, 15 bp, Homo sapiens
gatggctcctccctg

SEQ ID NO: 66881 - DNA, 15 bp, Homo sapiens
agatggctcctccct

SEQ ID NO: 66882 - DNA, 15 bp, Homo sapiens
tagatggctcctccc

SEQ ID NO: 66883 - DNA, 15 bp, Homo sapiens
gtagatggctcctcc

SEQ ID NO: 66884 - DNA, 15 bp, Homo sapiens
agtagatggctcctc

SEQ ID NO: 66885 - DNA, 15 bp, Homo sapiens
cagtagatggctcct

SEQ ID NO: 66886 - DNA, 15 bp, Homo sapiens
tcagtagatggctcc

SEQ ID NO: 66887 - DNA, 15 bp, Homo sapiens
ctcagtagatggctc

SEQ ID NO: 66888 - DNA, 15 bp, Homo sapiens
actcagtagatggct

SEQ ID NO: 66889 - DNA, 15 bp, Homo sapiens
aactcagtagatggc

SEQ ID NO: 66890 - DNA, 15 bp, Homo sapiens
caactcagtagatgg

SEQ ID NO: 66891 - DNA, 15 bp, Homo sapiens
ccaactcagtagatg

SEQ ID NO: 66892 - DNA, 15 bp, Homo sapiens
tccaactcagtagat

SEQ ID NO: 66893 - DNA, 15 bp, Homo sapiens
ctccaactcagtaga

SEQ ID NO: 66894 - DNA, 15 bp, Homo sapiens
tctccaactcagtag

SEQ ID NO: 66895 - DNA, 15 bp, Homo sapiens
ttctccaactcagta

SEQ ID NO: 66896 - DNA, 15 bp, Homo sapiens
cttctccaactcagt

SEQ ID NO: 66897 - DNA, 15 bp, Homo sapiens
acttctccaactcag

SEQ ID NO: 66898 - DNA, 15 bp, Homo sapiens
gacttctccaactca

SEQ ID NO: 66899 - DNA, 15 bp, Homo sapiens
agacttctccaactc

SEQ ID NO: 66900 - DNA, 15 bp, Homo sapiens
cagacttctccaact

SEQ ID NO: 66901 - DNA, 15 bp, Homo sapiens
tcagacttctccaac

SEQ ID NO: 66902 - DNA, 15 bp, Homo sapiens
ctcagacttctccaa

SEQ ID NO: 66903 - DNA, 15 bp, Homo sapiens
cctcagacttctcca

SEQ ID NO: 66904 - DNA, 15 bp, Homo sapiens
tcctcagacttctcc

SEQ ID NO: 66905 - DNA, 15 bp, Homo sapiens
ctcctcagacttctc

SEQ ID NO: 66906 - DNA, 15 bp, Homo sapiens
cctcctcagacttct

SEQ ID NO: 66907 - DNA, 15 bp, Homo sapiens
tcctcctcagacttc

SEQ ID NO: 66908 - DNA, 15 bp, Homo sapiens
ttcctcctcagactt

SEQ ID NO: 66909 - DNA, 15 bp, Homo sapiens
gttcctcctcagact

SEQ ID NO: 66910 - DNA, 15 bp, Homo sapiens
tgttcctcctcagac

SEQ ID NO: 66911 - DNA, 15 bp, Homo sapiens
ttgttcctcctcaga

SEQ ID NO: 66912 - DNA, 15 bp, Homo sapiens
cttgttcctcctcag

SEQ ID NO: 66913 - DNA, 15 bp, Homo sapiens
gcttgttcctcctca

SEQ ID NO: 66914 - DNA, 15 bp, Homo sapiens
agcttgttcctcctc

SEQ ID NO: 66915 - DNA, 15 bp, Homo sapiens
aagcttgttcctcct

SEQ ID NO: 66916 - DNA, 15 bp, Homo sapiens
aaagcttgttcctcc

SEQ ID NO: 66917 - DNA, 15 bp, Homo sapiens
caaagcttgttcctc

SEQ ID NO: 66918 - DNA, 15 bp, Homo sapiens
ccaaagcttgttcct

SEQ ID NO: 66919 - DNA, 15 bp, Homo sapiens
tccaaagcttgttcc

SEQ ID NO: 66920 - DNA, 15 bp, Homo sapiens
ttccaaagcttgttc

SEQ ID NO: 66921 - DNA, 15 bp, Homo sapiens
cttccaaagcttgtt

SEQ ID NO: 66922 - DNA, 15 bp, Homo sapiens
tcttccaaagcttgt

SEQ ID NO: 66923 - DNA, 15 bp, Homo sapiens
ttcttccaaagcttg

SEQ ID NO: 66924 - DNA, 15 bp, Homo sapiens
tttcttccaaagctt

SEQ ID NO: 66925 - DNA, 15 bp, Homo sapiens
ctttcttccaaagct

SEQ ID NO: 66926 - DNA, 15 bp, Homo sapiens
actttcttccaaagc

SEQ ID NO: 66927 - DNA, 15 bp, Homo sapiens
tactttcttccaaag

SEQ ID NO: 66928 - DNA, 15 bp, Homo sapiens
ttactttcttccaaa

SEQ ID NO: 66929 - DNA, 15 bp, Homo sapiens
tttactttcttccaa

SEQ ID NO: 66930 - DNA, 15 bp, Homo sapiens
ctttactttcttcca

SEQ ID NO: 66931 - DNA, 15 bp, Homo sapiens
cctttactttcttcc

SEQ ID NO: 66932 - DNA, 15 bp, Homo sapiens
acctttactttcttc

SEQ ID NO: 66933 - DNA, 15 bp, Homo sapiens
aacctttactttctt

SEQ ID NO: 66934 - DNA, 15 bp, Homo sapiens
aaacctttactttct

SEQ ID NO: 66935 - DNA, 15 bp, Homo sapiens
aaaacctttactttc

SEQ ID NO: 66936 - DNA, 15 bp, Homo sapiens
caaaacctttacttt

SEQ ID NO: 66937 - DNA, 15 bp, Homo sapiens
tcaaaacctttactt

SEQ ID NO: 66938 - DNA, 15 bp, Homo sapiens
ttcaaaacctttact

SEQ ID NO: 66939 - DNA, 15 bp, Homo sapiens
attcaaaacctttac

SEQ ID NO: 66940 - DNA, 15 bp, Homo sapiens
tattcaaaaccttta

SEQ ID NO: 66941 - DNA, 15 bp, Homo sapiens
atattcaaaaccttt

SEQ ID NO: 66942 - DNA, 15 bp, Homo sapiens
catattcaaaacctt

SEQ ID NO: 66943 - DNA, 15 bp, Homo sapiens
ccatattcaaaacct

SEQ ID NO: 66944 - DNA, 15 bp, Homo sapiens
tccatattcaaaacc

SEQ ID NO: 66945 - DNA, 15 bp, Homo sapiens
gtccatattcaaaac

SEQ ID NO: 66946 - DNA, 15 bp, Homo sapiens
tgtccatattcaaaa

SEQ ID NO: 66947 - DNA, 15 bp, Homo sapiens
atgtccatattcaaa

SEQ ID NO: 66948 - DNA, 15 bp, Homo sapiens
catgtccatattcaa

SEQ ID NO: 66949 - DNA, 15 bp, Homo sapiens
ccatgtccatattca

SEQ ID NO: 66950 - DNA, 15 bp, Homo sapiens
accatgtccatattc

SEQ ID NO: 66951 - DNA, 15 bp, Homo sapiens
aaccatgtccatatt

SEQ ID NO: 66952 - DNA, 15 bp, Homo sapiens
aaaccatgtccatat

SEQ ID NO: 66953 - DNA, 15 bp, Homo sapiens
taaaccatgtccata

SEQ ID NO: 66954 - DNA, 15 bp, Homo sapiens
ttaaaccatgtccat

SEQ ID NO: 66955 - DNA, 15 bp, Homo sapiens
attaaaccatgtcca

SEQ ID NO: 66956 - DNA, 15 bp, Homo sapiens
tattaaaccatgtcc

SEQ ID NO: 66957 - DNA, 15 bp, Homo sapiens
atattaaaccatgtc

SEQ ID NO: 66958 - DNA, 15 bp, Homo sapiens
catattaaaccatgt

SEQ ID NO: 66959 - DNA, 15 bp, Homo sapiens
gcatattaaaccatg

SEQ ID NO: 66960 - DNA, 15 bp, Homo sapiens
ggcatattaaaccat

SEQ ID NO: 66961 - DNA, 15 bp, Homo sapiens
aggcatattaaacca

SEQ ID NO: 66962 - DNA, 15 bp, Homo sapiens
taggcatattaaacc

SEQ ID NO: 66963 - DNA, 15 bp, Homo sapiens
ctaggcatattaaac

SEQ ID NO: 66964 - DNA, 15 bp, Homo sapiens
cctaggcatattaaa

SEQ ID NO: 66965 - DNA, 15 bp, Homo sapiens
tcctaggcatattaa

SEQ ID NO: 66966 - DNA, 15 bp, Homo sapiens
ctcctaggcatatta

SEQ ID NO: 66967 - DNA, 15 bp, Homo sapiens
cctcctaggcatatt

SEQ ID NO: 66968 - DNA, 15 bp, Homo sapiens
gcctcctaggcatat

SEQ ID NO: 66969 - DNA, 15 bp, Homo sapiens
cgcctcctaggcata

SEQ ID NO: 66970 - DNA, 15 bp, Homo sapiens
gcgcctcctaggcat

SEQ ID NO: 66971 - DNA, 15 bp, Homo sapiens
agcgcctcctaggca

SEQ ID NO: 66972 - DNA, 15 bp, Homo sapiens
cagcgcctcctaggc

SEQ ID NO: 66973 - DNA, 15 bp, Homo sapiens
tcagcgcctcctagg

SEQ ID NO: 66974 - DNA, 15 bp, Homo sapiens
ttcagcgcctcctag

SEQ ID NO: 66975 - DNA, 15 bp, Homo sapiens
cttcagcgcctccta

SEQ ID NO: 66976 - DNA, 15 bp, Homo sapiens
acttcagcgcctcct

SEQ ID NO: 66977 - DNA, 15 bp, Homo sapiens
tacttcagcgcctcc

SEQ ID NO: 66978 - DNA, 15 bp, Homo sapiens
ctacttcagcgcctc

SEQ ID NO: 66979 - DNA, 15 bp, Homo sapiens
tctacttcagcgcct

SEQ ID NO: 66980 - DNA, 15 bp, Homo sapiens
ctctacttcagcgcc

SEQ ID NO: 66981 - DNA, 15 bp, Homo sapiens
tctctacttcagcgc

SEQ ID NO: 66982 - DNA, 15 bp, Homo sapiens
atctctacttcagcg

SEQ ID NO: 66983 - DNA, 15 bp, Homo sapiens
catctctacttcagc

SEQ ID NO: 66984 - DNA, 15 bp, Homo sapiens
acatctctacttcag

SEQ ID NO: 66985 - DNA, 15 bp, Homo sapiens
cacatctctacttca

SEQ ID NO: 66986 - DNA, 15 bp, Homo sapiens
tcacatctctacttc

SEQ ID NO: 66987 - DNA, 15 bp, Homo sapiens
ttcacatctctactt

SEQ ID NO: 66988 - DNA, 15 bp, Homo sapiens
tttcacatctctact

SEQ ID NO: 66989 - DNA, 15 bp, Homo sapiens
ttttcacatctctac

SEQ ID NO: 66990 - DNA, 15 bp, Homo sapiens
attttcacatctcta

SEQ ID NO: 66991 - DNA, 15 bp, Homo sapiens
tattttcacatctct

SEQ ID NO: 66992 - DNA, 15 bp, Homo sapiens
ctattttcacatctc

SEQ ID NO: 66993 - DNA, 15 bp, Homo sapiens
actattttcacatct

SEQ ID NO: 66994 - DNA, 15 bp, Homo sapiens
cactattttcacatc

SEQ ID NO: 66995 - DNA, 15 bp, Homo sapiens
ccactattttcacat

SEQ ID NO: 66996 - DNA, 15 bp, Homo sapiens
cccactattttcaca

SEQ ID NO: 66997 - DNA, 15 bp, Homo sapiens
tcccactattttcac

SEQ ID NO: 66998 - DNA, 15 bp, Homo sapiens
atcccactattttca

SEQ ID NO: 66999 - DNA, 15 bp, Homo sapiens
tatcccactattttc

SEQ ID NO: 67000 - DNA, 15 bp, Homo sapiens
atatcccactatttt

SEQ ID NO: 67001 - DNA, 15 bp, Homo sapiens
catatcccactattt

SEQ ID NO: 67002 - DNA, 15 bp, Homo sapiens
tcatatcccactatt

SEQ ID NO: 67003 - DNA, 15 bp, Homo sapiens
ctcatatcccactat

SEQ ID NO: 67004 - DNA, 15 bp, Homo sapiens
tctcatatcccacta

SEQ ID NO: 67005 - DNA, 15 bp, Homo sapiens
ctctcatatcccact

SEQ ID NO: 67006 - DNA, 15 bp, Homo sapiens
actctcatatcccac

SEQ ID NO: 67007 - DNA, 15 bp, Homo sapiens
aactctcatatccca

SEQ ID NO: 67008 - DNA, 15 bp, Homo sapiens
aaactctcatatccc

SEQ ID NO: 67009 - DNA, 15 bp, Homo sapiens
caaactctcatatcc

SEQ ID NO: 67010 - DNA, 15 bp, Homo sapiens
ccaaactctcatatc

SEQ ID NO: 67011 - DNA, 15 bp, Homo sapiens
tccaaactctcatat

SEQ ID NO: 67012 - DNA, 15 bp, Homo sapiens
ttccaaactctcata

SEQ ID NO: 67013 - DNA, 15 bp, Homo sapiens
attccaaactctcat

SEQ ID NO: 67014 - DNA, 15 bp, Homo sapiens
gattccaaactctca

SEQ ID NO: 67015 - DNA, 15 bp, Homo sapiens
ggattccaaactctc

SEQ ID NO: 67016 - DNA, 15 bp, Homo sapiens
tggattccaaactct

SEQ ID NO: 67017 - DNA, 15 bp, Homo sapiens
ctggattccaaactc

SEQ ID NO: 67018 - DNA, 15 bp, Homo sapiens
tctggattccaaact

SEQ ID NO: 67019 - DNA, 15 bp, Homo sapiens
gtctggattccaaac

SEQ ID NO: 67020 - DNA, 15 bp, Homo sapiens
agtctggattccaaa

SEQ ID NO: 67021 - DNA, 15 bp, Homo sapiens
gagtctggattccaa

SEQ ID NO: 67022 - DNA, 15 bp, Homo sapiens
ggagtctggattcca

SEQ ID NO: 67023 - DNA, 15 bp, Homo sapiens
aggagtctggattcc

SEQ ID NO: 67024 - DNA, 15 bp, Homo sapiens
taggagtctggattc

SEQ ID NO: 67025 - DNA, 15 bp, Homo sapiens
ctaggagtctggatt

SEQ ID NO: 67026 - DNA, 15 bp, Homo sapiens
cctaggagtctggat

SEQ ID NO: 67027 - DNA, 15 bp, Homo sapiens
acctaggagtctgga

SEQ ID NO: 67028 - DNA, 15 bp, Homo sapiens
cacctaggagtctgg

SEQ ID NO: 67029 - DNA, 15 bp, Homo sapiens
ccacctaggagtctg

SEQ ID NO: 67030 - DNA, 15 bp, Homo sapiens
accacctaggagtct

SEQ ID NO: 67031 - DNA, 15 bp, Homo sapiens
aaccacctaggagtc

SEQ ID NO: 67032 - DNA, 15 bp, Homo sapiens
gaaccacctaggagt

SEQ ID NO: 67033 - DNA, 15 bp, Homo sapiens
agaaccacctaggag

SEQ ID NO: 67034 - DNA, 15 bp, Homo sapiens
tagaaccacctagga

SEQ ID NO: 67035 - DNA, 15 bp, Homo sapiens
ctagaaccacctagg

SEQ ID NO: 67036 - DNA, 15 bp, Homo sapiens
tctagaaccacctag

SEQ ID NO: 67037 - DNA, 15 bp, Homo sapiens
atctagaaccaccta

SEQ ID NO: 67038 - DNA, 15 bp, Homo sapiens
catctagaaccacct

SEQ ID NO: 67039 - DNA, 15 bp, Homo sapiens
acatctagaaccacc

SEQ ID NO: 67040 - DNA, 15 bp, Homo sapiens
aacatctagaaccac

SEQ ID NO: 67041 - DNA, 15 bp, Homo sapiens
gaacatctagaacca

SEQ ID NO: 67042 - DNA, 15 bp, Homo sapiens
agaacatctagaacc

SEQ ID NO: 67043 - DNA, 15 bp, Homo sapiens
aagaacatctagaac

SEQ ID NO: 67044 - DNA, 15 bp, Homo sapiens
aaagaacatctagaa

SEQ ID NO: 67045 - DNA, 15 bp, Homo sapiens
taaagaacatctaga

SEQ ID NO: 67046 - DNA, 15 bp, Homo sapiens
ttaaagaacatctag

SEQ ID NO: 67047 - DNA, 15 bp, Homo sapiens
tttaaagaacatcta

SEQ ID NO: 67048 - DNA, 15 bp, Homo sapiens
atttaaagaacatct

SEQ ID NO: 67049 - DNA, 15 bp, Homo sapiens
gatttaaagaacatc

SEQ ID NO: 67050 - DNA, 15 bp, Homo sapiens
ggatttaaagaacat

SEQ ID NO: 67051 - DNA, 15 bp, Homo sapiens
tggatttaaagaaca

SEQ ID NO: 67052 - DNA, 15 bp, Homo sapiens
ttggatttaaagaac

SEQ ID NO: 67053 - DNA, 15 bp, Homo sapiens
attggatttaaagaa

SEQ ID NO: 67054 - DNA, 15 bp, Homo sapiens
tattggatttaaaga

SEQ ID NO: 67055 - DNA, 15 bp, Homo sapiens
ctattggatttaaag

SEQ ID NO: 67056 - DNA, 15 bp, Homo sapiens
cctattggatttaaa

SEQ ID NO: 67057 - DNA, 15 bp, Homo sapiens
tcctattggatttaa

SEQ ID NO: 67058 - DNA, 15 bp, Homo sapiens
ctcctattggattta

SEQ ID NO: 67059 - DNA, 15 bp, Homo sapiens
actcctattggattt

SEQ ID NO: 67060 - DNA, 15 bp, Homo sapiens
tactcctattggatt

SEQ ID NO: 67061 - DNA, 15 bp, Homo sapiens
ctactcctattggat

SEQ ID NO: 67062 - DNA, 15 bp, Homo sapiens
tctactcctattgga

SEQ ID NO: 67063 - DNA, 15 bp, Homo sapiens
atctactcctattgg

SEQ ID NO: 67064 - DNA, 15 bp, Homo sapiens
catctactcctattg

SEQ ID NO: 67065 - DNA, 15 bp, Homo sapiens
tcatctactcctatt

SEQ ID NO: 67066 - DNA, 15 bp, Homo sapiens
ctcatctactcctat

SEQ ID NO: 67067 - DNA, 15 bp, Homo sapiens
tctcatctactccta

SEQ ID NO: 67068 - DNA, 15 bp, Homo sapiens
atctcatctactcct

SEQ ID NO: 67069 - DNA, 15 bp, Homo sapiens
aatctcatctactcc

SEQ ID NO: 67070 - DNA, 15 bp, Homo sapiens
taatctcatctactc

SEQ ID NO: 67071 - DNA, 15 bp, Homo sapiens
gtaatctcatctact

SEQ ID NO: 67072 - DNA, 15 bp, Homo sapiens
agtaatctcatctac

SEQ ID NO: 67073 - DNA, 15 bp, Homo sapiens
gagtaatctcatcta

SEQ ID NO: 67074 - DNA, 15 bp, Homo sapiens
tgagtaatctcatct

SEQ ID NO: 67075 - DNA, 15 bp, Homo sapiens
ctgagtaatctcatc

SEQ ID NO: 67076 - DNA, 15 bp, Homo sapiens
tctgagtaatctcat

SEQ ID NO: 67077 - DNA, 15 bp, Homo sapiens
gtctgagtaatctca

SEQ ID NO: 67078 - DNA, 15 bp, Homo sapiens
tgtctgagtaatctc

SEQ ID NO: 67079 - DNA, 15 bp, Homo sapiens
gtgtctgagtaatct

SEQ ID NO: 67080 - DNA, 15 bp, Homo sapiens
tgtgtctgagtaatc

SEQ ID NO: 67081 - DNA, 15 bp, Homo sapiens
ctgtgtctgagtaat

SEQ ID NO: 67082 - DNA, 15 bp, Homo sapiens
actgtgtctgagtaa

SEQ ID NO: 67083 - DNA, 15 bp, Homo sapiens
tactgtgtctgagta

SEQ ID NO: 67084 - DNA, 15 bp, Homo sapiens
atactgtgtctgagt

SEQ ID NO: 67085 - DNA, 15 bp, Homo sapiens
tatactgtgtctgag

SEQ ID NO: 67086 - DNA, 15 bp, Homo sapiens
gtatactgtgtctga

SEQ ID NO: 67087 - DNA, 15 bp, Homo sapiens
tgtatactgtgtctg

SEQ ID NO: 67088 - DNA, 15 bp, Homo sapiens
ctgtatactgtgtct

SEQ ID NO: 67089 - DNA, 15 bp, Homo sapiens
actgtatactgtgtc

SEQ ID NO: 67090 - DNA, 15 bp, Homo sapiens
cactgtatactgtgt

SEQ ID NO: 67091 - DNA, 15 bp, Homo sapiens
ccactgtatactgtg

SEQ ID NO: 67092 - DNA, 15 bp, Homo sapiens
cccactgtatactgt

SEQ ID NO: 67093 - DNA, 15 bp, Homo sapiens
ccccactgtatactg

SEQ ID NO: 67094 - DNA, 15 bp, Homo sapiens
tccccactgtatact

SEQ ID NO: 67095 - DNA, 15 bp, Homo sapiens
ctccccactgtatac

SEQ ID NO: 67096 - DNA, 15 bp, Homo sapiens
tctccccactgtata

SEQ ID NO: 67097 - DNA, 15 bp, Homo sapiens
ttctccccactgtat

SEQ ID NO: 67098 - DNA, 15 bp, Homo sapiens
tttctccccactgta

SEQ ID NO: 67099 - DNA, 15 bp, Homo sapiens
ttttctccccactgt

SEQ ID NO: 67100 - DNA, 15 bp, Homo sapiens
tttttctccccactg

SEQ ID NO: 67101 - DNA, 15 bp, Homo sapiens
ttttttctccccact

SEQ ID NO: 67102 - DNA, 15 bp, Homo sapiens
cttttttctccccac

SEQ ID NO: 67103 - DNA, 15 bp, Homo sapiens
tcttttttctcccca

SEQ ID NO: 67104 - DNA, 15 bp, Homo sapiens
ctcttttttctcccc

SEQ ID NO: 67105 - DNA, 15 bp, Homo sapiens
gctcttttttctccc

SEQ ID NO: 67106 - DNA, 15 bp, Homo sapiens
ggctcttttttctcc

SEQ ID NO: 67107 - DNA, 15 bp, Homo sapiens
aggctcttttttctc

SEQ ID NO: 67108 - DNA, 15 bp, Homo sapiens
taggctcttttttct

SEQ ID NO: 67109 - DNA, 15 bp, Homo sapiens
ctaggctcttttttc

SEQ ID NO: 67110 - DNA, 15 bp, Homo sapiens
tctaggctctttttt

SEQ ID NO: 67111 - DNA, 15 bp, Homo sapiens
ttctaggctcttttt

SEQ ID NO: 67112 - DNA, 15 bp, Homo sapiens
gttctaggctctttt

SEQ ID NO: 67113 - DNA, 15 bp, Homo sapiens
agttctaggctcttt

SEQ ID NO: 67114 - DNA, 15 bp, Homo sapiens
aagttctaggctctt

SEQ ID NO: 67115 - DNA, 15 bp, Homo sapiens
taagttctaggctct

SEQ ID NO: 67116 - DNA, 15 bp, Homo sapiens
ttaagttctaggctc

SEQ ID NO: 67117 - DNA, 15 bp, Homo sapiens
attaagttctaggct

SEQ ID NO: 67118 - DNA, 15 bp, Homo sapiens
aattaagttctaggc

SEQ ID NO: 67119 - DNA, 15 bp, Homo sapiens
aaattaagttctagg

SEQ ID NO: 67120 - DNA, 15 bp, Homo sapiens
aaaattaagttctag

SEQ ID NO: 67121 - DNA, 15 bp, Homo sapiens
caaaattaagttcta

SEQ ID NO: 67122 - DNA, 15 bp, Homo sapiens
tcaaaattaagttct

SEQ ID NO: 67123 - DNA, 15 bp, Homo sapiens
ctcaaaattaagttc

SEQ ID NO: 67124 - DNA, 15 bp, Homo sapiens
cctcaaaattaagtt

SEQ ID NO: 67125 - DNA, 15 bp, Homo sapiens
tcctcaaaattaagt

SEQ ID NO: 67126 - DNA, 15 bp, Homo sapiens
ctcctcaaaattaag

SEQ ID NO: 67127 - DNA, 15 bp, Homo sapiens
tctcctcaaaattaa

SEQ ID NO: 67128 - DNA, 15 bp, Homo sapiens
atctcctcaaaatta

SEQ ID NO: 67129 - DNA, 15 bp, Homo sapiens
aatctcctcaaaatt

SEQ ID NO: 67130 - DNA, 15 bp, Homo sapiens
gaatctcctcaaaat

SEQ ID NO: 67131 - DNA, 15 bp, Homo sapiens
tgaatctcctcaaaa

SEQ ID NO: 67132 - DNA, 15 bp, Homo sapiens
atgaatctcctcaaa

SEQ ID NO: 67133 - DNA, 15 bp, Homo sapiens
aatgaatctcctcaa

SEQ ID NO: 67134 - DNA, 15 bp, Homo sapiens
taatgaatctcctca

SEQ ID NO: 67135 - DNA, 15 bp, Homo sapiens
gtaatgaatctcctc

SEQ ID NO: 67136 - DNA, 15 bp, Homo sapiens
agtaatgaatctcct

SEQ ID NO: 67137 - DNA, 15 bp, Homo sapiens
aagtaatgaatctcc

SEQ ID NO: 67138 - DNA, 15 bp, Homo sapiens
taagtaatgaatctc

SEQ ID NO: 67139 - DNA, 15 bp, Homo sapiens
ataagtaatgaatct

SEQ ID NO: 67140 - DNA, 15 bp, Homo sapiens
cataagtaatgaatc

SEQ ID NO: 67141 - DNA, 15 bp, Homo sapiens
tcataagtaatgaat

SEQ ID NO: 67142 - DNA, 15 bp, Homo sapiens
ctcataagtaatgaa

SEQ ID NO: 67143 - DNA, 15 bp, Homo sapiens
actcataagtaatga

SEQ ID NO: 67144 - DNA, 15 bp, Homo sapiens
gactcataagtaatg

SEQ ID NO: 67145 - DNA, 15 bp, Homo sapiens
tgactcataagtaat

SEQ ID NO: 67146 - DNA, 15 bp, Homo sapiens
ctgactcataagtaa

SEQ ID NO: 67147 - DNA, 15 bp, Homo sapiens
gctgactcataagta

SEQ ID NO: 67148 - DNA, 15 bp, Homo sapiens
tgctgactcataagt

SEQ ID NO: 67149 - DNA, 15 bp, Homo sapiens
ctgctgactcataag

SEQ ID NO: 67150 - DNA, 15 bp, Homo sapiens
gctgctgactcataa

SEQ ID NO: 67151 - DNA, 15 bp, Homo sapiens
agctgctgactcata

SEQ ID NO: 67152 - DNA, 15 bp, Homo sapiens
cagctgctgactcat

SEQ ID NO: 67153 - DNA, 15 bp, Homo sapiens
gcagctgctgactca

SEQ ID NO: 67154 - DNA, 15 bp, Homo sapiens
agcagctgctgactc

SEQ ID NO: 67155 - DNA, 15 bp, Homo sapiens
cagcagctgctgact

SEQ ID NO: 67156 - DNA, 15 bp, Homo sapiens
acagcagctgctgac

SEQ ID NO: 67157 - DNA, 15 bp, Homo sapiens
aacagcagctgctga

SEQ ID NO: 67158 - DNA, 15 bp, Homo sapiens
caacagcagctgctg

SEQ ID NO: 67159 - DNA, 15 bp, Homo sapiens
tcaacagcagctgct

SEQ ID NO: 67160 - DNA, 15 bp, Homo sapiens
ttcaacagcagctgc

SEQ ID NO: 67161 - DNA, 15 bp, Homo sapiens
gttcaacagcagctg

SEQ ID NO: 67162 - DNA, 15 bp, Homo sapiens
ggttcaacagcagct

SEQ ID NO: 67163 - DNA, 15 bp, Homo sapiens
tggttcaacagcagc

SEQ ID NO: 67164 - DNA, 15 bp, Homo sapiens
ctggttcaacagcag

SEQ ID NO: 67165 - DNA, 15 bp, Homo sapiens
gctggttcaacagca

SEQ ID NO: 67166 - DNA, 15 bp, Homo sapiens
tgctggttcaacagc

SEQ ID NO: 67167 - DNA, 15 bp, Homo sapiens
ctgctggttcaacag

SEQ ID NO: 67168 - DNA, 15 bp, Homo sapiens
cctgctggttcaaca

SEQ ID NO: 67169 - DNA, 15 bp, Homo sapiens
tcctgctggttcaac

SEQ ID NO: 67170 - DNA, 15 bp, Homo sapiens
ttcctgctggttcaa

SEQ ID NO: 67171 - DNA, 15 bp, Homo sapiens
tttcctgctggttca

SEQ ID NO: 67172 - DNA, 15 bp, Homo sapiens
gtttcctgctggttc

SEQ ID NO: 67173 - DNA, 15 bp, Homo sapiens
ggtttcctgctggtt

SEQ ID NO: 67174 - DNA, 15 bp, Homo sapiens
tggtttcctgctggt

SEQ ID NO: 67175 - DNA, 15 bp, Homo sapiens
ctggtttcctgctgg

SEQ ID NO: 67176 - DNA, 15 bp, Homo sapiens
cctggtttcctgctg

SEQ ID NO: 67177 - DNA, 15 bp, Homo sapiens
ccctggtttcctgct

SEQ ID NO: 67178 - DNA, 15 bp, Homo sapiens
gccctggtttcctgc

SEQ ID NO: 67179 - DNA, 15 bp, Homo sapiens
tgccctggtttcctg

SEQ ID NO: 67180 - DNA, 15 bp, Homo sapiens
ctgccctggtttcct

SEQ ID NO: 67181 - DNA, 15 bp, Homo sapiens
actgccctggtttcc

SEQ ID NO: 67182 - DNA, 15 bp, Homo sapiens
cactgccctggtttc

SEQ ID NO: 67183 - DNA, 15 bp, Homo sapiens
acactgccctggttt

SEQ ID NO: 67184 - DNA, 15 bp, Homo sapiens
gacactgccctggtt

SEQ ID NO: 67185 - DNA, 15 bp, Homo sapiens
tgacactgccctggt

SEQ ID NO: 67186 - DNA, 15 bp, Homo sapiens
gtgacactgccctgg

SEQ ID NO: 67187 - DNA, 15 bp, Homo sapiens
tgtgacactgccctg

SEQ ID NO: 67188 - DNA, 15 bp, Homo sapiens
ctgtgacactgccct

SEQ ID NO: 67189 - DNA, 15 bp, Homo sapiens
tctgtgacactgccc

SEQ ID NO: 67190 - DNA, 15 bp, Homo sapiens
ttctgtgacactgcc

SEQ ID NO: 67191 - DNA, 15 bp, Homo sapiens
cttctgtgacactgc

SEQ ID NO: 67192 - DNA, 15 bp, Homo sapiens
gcttctgtgacactg

SEQ ID NO: 67193 - DNA, 15 bp, Homo sapiens
tgcttctgtgacact

SEQ ID NO: 67194 - DNA, 15 bp, Homo sapiens
ctgcttctgtgacac

SEQ ID NO: 67195 - DNA, 15 bp, Homo sapiens
cctgcttctgtgaca

SEQ ID NO: 67196 - DNA, 15 bp, Homo sapiens
ccctgcttctgtgac

SEQ ID NO: 67197 - DNA, 15 bp, Homo sapiens
tccctgcttctgtga

SEQ ID NO: 67198 - DNA, 15 bp, Homo sapiens
ttccctgcttctgtg

SEQ ID NO: 67199 - DNA, 15 bp, Homo sapiens
tttccctgcttctgt

SEQ ID NO: 67200 - DNA, 15 bp, Homo sapiens
gtttccctgcttctg

SEQ ID NO: 67201 - DNA, 15 bp, Homo sapiens
tgtttccctgcttct

SEQ ID NO: 67202 - DNA, 15 bp, Homo sapiens
ttgtttccctgcttc

SEQ ID NO: 67203 - DNA, 15 bp, Homo sapiens
cttgtttccctgctt

SEQ ID NO: 67204 - DNA, 15 bp, Homo sapiens
gcttgtttccctgct

SEQ ID NO: 67205 - DNA, 15 bp, Homo sapiens
agcttgtttccctgc

SEQ ID NO: 67206 - DNA, 15 bp, Homo sapiens
aagcttgtttccctg

SEQ ID NO: 67207 - DNA, 15 bp, Homo sapiens
gaagcttgtttccct

SEQ ID NO: 67208 - DNA, 15 bp, Homo sapiens
agaagcttgtttccc

SEQ ID NO: 67209 - DNA, 15 bp, Homo sapiens
cagaagcttgtttcc

SEQ ID NO: 67210 - DNA, 15 bp, Homo sapiens
tcagaagcttgtttc

SEQ ID NO: 67211 - DNA, 15 bp, Homo sapiens
ttcagaagcttgttt

SEQ ID NO: 67212 - DNA, 15 bp, Homo sapiens
tttcagaagcttgtt

SEQ ID NO: 67213 - DNA, 15 bp, Homo sapiens
ctttcagaagcttgt

SEQ ID NO: 67214 - DNA, 15 bp, Homo sapiens
gctttcagaagcttg

SEQ ID NO: 67215 - DNA, 15 bp, Homo sapiens
agctttcagaagctt

SEQ ID NO: 67216 - DNA, 15 bp, Homo sapiens
gagctttcagaagct

SEQ ID NO: 67217 - DNA, 15 bp, Homo sapiens
tgagctttcagaagc

SEQ ID NO: 67218 - DNA, 15 bp, Homo sapiens
ttgagctttcagaag

SEQ ID NO: 67219 - DNA, 15 bp, Homo sapiens
cttgagctttcagaa

SEQ ID NO: 67220 - DNA, 15 bp, Homo sapiens
acttgagctttcaga

SEQ ID NO: 67221 - DNA, 15 bp, Homo sapiens
aacttgagctttcag

SEQ ID NO: 67222 - DNA, 15 bp, Homo sapiens
caacttgagctttca

SEQ ID NO: 67223 - DNA, 15 bp, Homo sapiens
gcaacttgagctttc

SEQ ID NO: 67224 - DNA, 15 bp, Homo sapiens
agcaacttgagcttt

SEQ ID NO: 67225 - DNA, 15 bp, Homo sapiens
gagcaacttgagctt

SEQ ID NO: 67226 - DNA, 15 bp, Homo sapiens
tgagcaacttgagct

SEQ ID NO: 67227 - DNA, 15 bp, Homo sapiens
ctgagcaacttgagc

SEQ ID NO: 67228 - DNA, 15 bp, Homo sapiens
gctgagcaacttgag

SEQ ID NO: 67229 - DNA, 15 bp, Homo sapiens
ggctgagcaacttga

SEQ ID NO: 67230 - DNA, 15 bp, Homo sapiens
aggctgagcaacttg

SEQ ID NO: 67231 - DNA, 15 bp, Homo sapiens
aaggctgagcaactt

SEQ ID NO: 67232 - DNA, 15 bp, Homo sapiens
caaggctgagcaact

SEQ ID NO: 67233 - DNA, 15 bp, Homo sapiens
tcaaggctgagcaac

SEQ ID NO: 67234 - DNA, 15 bp, Homo sapiens
ctcaaggctgagcaa

SEQ ID NO: 67235 - DNA, 15 bp, Homo sapiens
cctcaaggctgagca

SEQ ID NO: 67236 - DNA, 15 bp, Homo sapiens
tcctcaaggctgagc

SEQ ID NO: 67237 - DNA, 15 bp, Homo sapiens
ctcctcaaggctgag

SEQ ID NO: 67238 - DNA, 15 bp, Homo sapiens
actcctcaaggctga

SEQ ID NO: 67239 - DNA, 15 bp, Homo sapiens
cactcctcaaggctg

SEQ ID NO: 67240 - DNA, 15 bp, Homo sapiens
gcactcctcaaggct

SEQ ID NO: 67241 - DNA, 15 bp, Homo sapiens
agcactcctcaaggc

SEQ ID NO: 67242 - DNA, 15 bp, Homo sapiens
tagcactcctcaagg

SEQ ID NO: 67243 - DNA, 15 bp, Homo sapiens
gtagcactcctcaag

SEQ ID NO: 67244 - DNA, 15 bp, Homo sapiens
ggtagcactcctcaa

SEQ ID NO: 67245 - DNA, 15 bp, Homo sapiens
tggtagcactcctca

SEQ ID NO: 67246 - DNA, 15 bp, Homo sapiens
ttggtagcactcctc

SEQ ID NO: 67247 - DNA, 15 bp, Homo sapiens
cttggtagcactcct

SEQ ID NO: 67248 - DNA, 15 bp, Homo sapiens
ccttggtagcactcc

SEQ ID NO: 67249 - DNA, 15 bp, Homo sapiens
accttggtagcactc

SEQ ID NO: 67250 - DNA, 15 bp, Homo sapiens
gaccttggtagcact

SEQ ID NO: 67251 - DNA, 15 bp, Homo sapiens
agaccttggtagcac

SEQ ID NO: 67252 - DNA, 15 bp, Homo sapiens
cagaccttggtagca

SEQ ID NO: 67253 - DNA, 15 bp, Homo sapiens
tcagaccttggtagc

SEQ ID NO: 67254 - DNA, 15 bp, Homo sapiens
ttcagaccttggtag

SEQ ID NO: 67255 - DNA, 15 bp, Homo sapiens
cttcagaccttggta

SEQ ID NO: 67256 - DNA, 15 bp, Homo sapiens
gcttcagaccttggt

SEQ ID NO: 67257 - DNA, 15 bp, Homo sapiens
tgcttcagaccttgg

SEQ ID NO: 67258 - DNA, 15 bp, Homo sapiens
ttgcttcagaccttg

SEQ ID NO: 67259 - DNA, 15 bp, Homo sapiens
cttgcttcagacctt

SEQ ID NO: 67260 - DNA, 15 bp, Homo sapiens
ccttgcttcagacct

SEQ ID NO: 67261 - DNA, 15 bp, Homo sapiens
tccttgcttcagacc

SEQ ID NO: 67262 - DNA, 15 bp, Homo sapiens
ttccttgcttcagac

SEQ ID NO: 67263 - DNA, 15 bp, Homo sapiens
gttccttgcttcaga

SEQ ID NO: 67264 - DNA, 15 bp, Homo sapiens
cgttccttgcttcag

SEQ ID NO: 67265 - DNA, 15 bp, Homo sapiens
acgttccttgcttca

SEQ ID NO: 67266 - DNA, 15 bp, Homo sapiens
cacgttccttgcttc

SEQ ID NO: 67267 - DNA, 15 bp, Homo sapiens
ccacgttccttgctt

SEQ ID NO: 67268 - DNA, 15 bp, Homo sapiens
cccacgttccttgct

SEQ ID NO: 67269 - DNA, 15 bp, Homo sapiens
acccacgttccttgc

SEQ ID NO: 67270 - DNA, 15 bp, Homo sapiens
cacccacgttccttg

SEQ ID NO: 67271 - DNA, 15 bp, Homo sapiens
ccacccacgttcctt

SEQ ID NO: 67272 - DNA, 15 bp, Homo sapiens
gccacccacgttcct

SEQ ID NO: 67273 - DNA, 15 bp, Homo sapiens
ggccacccacgttcc

SEQ ID NO: 67274 - DNA, 15 bp, Homo sapiens
tggccacccacgttc

SEQ ID NO: 67275 - DNA, 15 bp, Homo sapiens
ctggccacccacgtt

SEQ ID NO: 67276 - DNA, 15 bp, Homo sapiens
gctggccacccacgt

SEQ ID NO: 67277 - DNA, 15 bp, Homo sapiens
agctggccacccacg

SEQ ID NO: 67278 - DNA, 15 bp, Homo sapiens
gagctggccacccac

SEQ ID NO: 67279 - DNA, 15 bp, Homo sapiens
agagctggccaccca

SEQ ID NO: 67280 - DNA, 15 bp, Homo sapiens
gagagctggccaccc

SEQ ID NO: 67281 - DNA, 15 bp, Homo sapiens
ggagagctggccacc

SEQ ID NO: 67282 - DNA, 15 bp, Homo sapiens
cggagagctggccac

SEQ ID NO: 67283 - DNA, 15 bp, Homo sapiens
ccggagagctggcca

SEQ ID NO: 67284 - DNA, 15 bp, Homo sapiens
cccggagagctggcc

SEQ ID NO: 67285 - DNA, 15 bp, Homo sapiens
gcccggagagctggc

SEQ ID NO: 67286 - DNA, 15 bp, Homo sapiens
agcccggagagctgg

SEQ ID NO: 67287 - DNA, 15 bp, Homo sapiens
aagcccggagagctg

SEQ ID NO: 67288 - DNA, 15 bp, Homo sapiens
taagcccggagagct

SEQ ID NO: 67289 - DNA, 15 bp, Homo sapiens
gtaagcccggagagc

SEQ ID NO: 67290 - DNA, 15 bp, Homo sapiens
agtaagcccggagag

SEQ ID NO: 67291 - DNA, 15 bp, Homo sapiens
aagtaagcccggaga

SEQ ID NO: 67292 - DNA, 15 bp, Homo sapiens
caagtaagcccggag

SEQ ID NO: 67293 - DNA, 15 bp, Homo sapiens
ccaagtaagcccgga

SEQ ID NO: 67294 - DNA, 15 bp, Homo sapiens
cccaagtaagcccgg

SEQ ID NO: 67295 - DNA, 15 bp, Homo sapiens
tcccaagtaagcccg

SEQ ID NO: 67296 - DNA, 15 bp, Homo sapiens
gtcccaagtaagccc

SEQ ID NO: 67297 - DNA, 15 bp, Homo sapiens
tgtcccaagtaagcc

SEQ ID NO: 67298 - DNA, 15 bp, Homo sapiens
ctgtcccaagtaagc

SEQ ID NO: 67299 - DNA, 15 bp, Homo sapiens
actgtcccaagtaag

SEQ ID NO: 67300 - DNA, 15 bp, Homo sapiens
aactgtcccaagtaa

SEQ ID NO: 67301 - DNA, 15 bp, Homo sapiens
gaactgtcccaagta

SEQ ID NO: 67302 - DNA, 15 bp, Homo sapiens
agaactgtcccaagt

SEQ ID NO: 67303 - DNA, 15 bp, Homo sapiens
cagaactgtcccaag

SEQ ID NO: 67304 - DNA, 15 bp, Homo sapiens
ccagaactgtcccaa

SEQ ID NO: 67305 - DNA, 15 bp, Homo sapiens
accagaactgtccca

SEQ ID NO: 67306 - DNA, 15 bp, Homo sapiens
aaccagaactgtccc

SEQ ID NO: 67307 - DNA, 15 bp, Homo sapiens
aaaccagaactgtcc

SEQ ID NO: 67308 - DNA, 15 bp, Homo sapiens
caaaccagaactgtc

SEQ ID NO: 67309 - DNA, 15 bp, Homo sapiens
ccaaaccagaactgt

SEQ ID NO: 67310 - DNA, 15 bp, Homo sapiens
tccaaaccagaactg

SEQ ID NO: 67311 - DNA, 15 bp, Homo sapiens
atccaaaccagaact

SEQ ID NO: 67312 - DNA, 15 bp, Homo sapiens
aatccaaaccagaac

SEQ ID NO: 67313 - DNA, 15 bp, Homo sapiens
aaatccaaaccagaa

SEQ ID NO: 67314 - DNA, 15 bp, Homo sapiens
caaatccaaaccaga

SEQ ID NO: 67315 - DNA, 15 bp, Homo sapiens
acaaatccaaaccag

SEQ ID NO: 67316 - DNA, 15 bp, Homo sapiens
aacaaatccaaacca

SEQ ID NO: 67317 - DNA, 15 bp, Homo sapiens
caacaaatccaaacc

SEQ ID NO: 67318 - DNA, 15 bp, Homo sapiens
acaacaaatccaaac

SEQ ID NO: 67319 - DNA, 15 bp, Homo sapiens
aacaacaaatccaaa

SEQ ID NO: 67320 - DNA, 15 bp, Homo sapiens
aaacaacaaatccaa

SEQ ID NO: 67321 - DNA, 15 bp, Homo sapiens
caaacaacaaatcca

SEQ ID NO: 67322 - DNA, 15 bp, Homo sapiens
tcaaacaacaaatcc

SEQ ID NO: 67323 - DNA, 15 bp, Homo sapiens
ctcaaacaacaaatc

SEQ ID NO: 67324 - DNA, 15 bp, Homo sapiens
gctcaaacaacaaat

SEQ ID NO: 67325 - DNA, 15 bp, Homo sapiens
tgctcaaacaacaaa

SEQ ID NO: 67326 - DNA, 15 bp, Homo sapiens
gtgctcaaacaacaa

SEQ ID NO: 67327 - DNA, 15 bp, Homo sapiens
tgtgctcaaacaaca

SEQ ID NO: 67328 - DNA, 15 bp, Homo sapiens
ctgtgctcaaacaac

SEQ ID NO: 67329 - DNA, 15 bp, Homo sapiens
actgtgctcaaacaa

SEQ ID NO: 67330 - DNA, 15 bp, Homo sapiens
aactgtgctcaaaca

SEQ ID NO: 67331 - DNA, 15 bp, Homo sapiens
taactgtgctcaaac

SEQ ID NO: 67332 - DNA, 15 bp, Homo sapiens
ataactgtgctcaaa

SEQ ID NO: 67333 - DNA, 15 bp, Homo sapiens
gataactgtgctcaa

SEQ ID NO: 67334 - DNA, 15 bp, Homo sapiens
tgataactgtgctca

SEQ ID NO: 67335 - DNA, 15 bp, Homo sapiens
atgataactgtgctc

SEQ ID NO: 67336 - DNA, 15 bp, Homo sapiens
gatgataactgtgct

SEQ ID NO: 67337 - DNA, 15 bp, Homo sapiens
tgatgataactgtgc

SEQ ID NO: 67338 - DNA, 15 bp, Homo sapiens
ttgatgataactgtg

SEQ ID NO: 67339 - DNA, 15 bp, Homo sapiens
tttgatgataactgt

SEQ ID NO: 67340 - DNA, 15 bp, Homo sapiens
ttttgatgataactg

SEQ ID NO: 67341 - DNA, 15 bp, Homo sapiens
tttttgatgataact

SEQ ID NO: 67342 - DNA, 15 bp, Homo sapiens
atttttgatgataac

SEQ ID NO: 67343 - DNA, 15 bp, Homo sapiens
tatttttgatgataa

SEQ ID NO: 67344 - DNA, 15 bp, Homo sapiens
gtatttttgatgata

SEQ ID NO: 67345 - DNA, 15 bp, Homo sapiens
agtatttttgatgat

SEQ ID NO: 67346 - DNA, 15 bp, Homo sapiens
gagtatttttgatga

SEQ ID NO: 67347 - DNA, 15 bp, Homo sapiens
agagtatttttgatg

SEQ ID NO: 67348 - DNA, 15 bp, Homo sapiens
tagagtatttttgat

SEQ ID NO: 67349 - DNA, 15 bp, Homo sapiens
ctagagtatttttga

SEQ ID NO: 67350 - DNA, 15 bp, Homo sapiens
actagagtatttttg

SEQ ID NO: 67351 - DNA, 15 bp, Homo sapiens
aactagagtattttt

SEQ ID NO: 67352 - DNA, 15 bp, Homo sapiens
aaactagagtatttt

SEQ ID NO: 67353 - DNA, 15 bp, Homo sapiens
caaactagagtattt

SEQ ID NO: 67354 - DNA, 15 bp, Homo sapiens
acaaactagagtatt

SEQ ID NO: 67355 - DNA, 15 bp, Homo sapiens
aacaaactagagtat

SEQ ID NO: 67356 - DNA, 15 bp, Homo sapiens
caacaaactagagta

SEQ ID NO: 67357 - DNA, 15 bp, Homo sapiens
ccaacaaactagagt

SEQ ID NO: 67358 - DNA, 15 bp, Homo sapiens
accaacaaactagag

SEQ ID NO: 67359 - DNA, 15 bp, Homo sapiens
aaccaacaaactaga

SEQ ID NO: 67360 - DNA, 15 bp, Homo sapiens
taaccaacaaactag

SEQ ID NO: 67361 - DNA, 15 bp, Homo sapiens
ttaaccaacaaacta

SEQ ID NO: 67362 - DNA, 15 bp, Homo sapiens
attaaccaacaaact

SEQ ID NO: 67363 - DNA, 15 bp, Homo sapiens
aattaaccaacaaac

SEQ ID NO: 67364 - DNA, 15 bp, Homo sapiens
taattaaccaacaaa

SEQ ID NO: 67365 - DNA, 15 bp, Homo sapiens
ataattaaccaacaa

SEQ ID NO: 67366 - DNA, 15 bp, Homo sapiens
tataattaaccaaca

SEQ ID NO: 67367 - DNA, 15 bp, Homo sapiens
atataattaaccaac

SEQ ID NO: 67368 - DNA, 15 bp, Homo sapiens
catataattaaccaa

SEQ ID NO: 67369 - DNA, 15 bp, Homo sapiens
ccatataattaacca

SEQ ID NO: 67370 - DNA, 15 bp, Homo sapiens
accatataattaacc

SEQ ID NO: 67371 - DNA, 15 bp, Homo sapiens
gaccatataattaac

SEQ ID NO: 67372 - DNA, 15 bp, Homo sapiens
tgaccatataattaa

SEQ ID NO: 67373 - DNA, 15 bp, Homo sapiens
gtgaccatataatta

SEQ ID NO: 67374 - DNA, 15 bp, Homo sapiens
ggtgaccatataatt

SEQ ID NO: 67375 - DNA, 15 bp, Homo sapiens
gggtgaccatataat

SEQ ID NO: 67376 - DNA, 15 bp, Homo sapiens
agggtgaccatataa

SEQ ID NO: 67377 - DNA, 15 bp, Homo sapiens
cagggtgaccatata

SEQ ID NO: 67378 - DNA, 15 bp, Homo sapiens
tcagggtgaccatat

SEQ ID NO: 67379 - DNA, 15 bp, Homo sapiens
ttcagggtgaccata

SEQ ID NO: 67380 - DNA, 15 bp, Homo sapiens
cttcagggtgaccat

SEQ ID NO: 67381 - DNA, 15 bp, Homo sapiens
tcttcagggtgacca

SEQ ID NO: 67382 - DNA, 15 bp, Homo sapiens
atcttcagggtgacc

SEQ ID NO: 67383 - DNA, 15 bp, Homo sapiens
catcttcagggtgac

SEQ ID NO: 67384 - DNA, 15 bp, Homo sapiens
tcatcttcagggtga

SEQ ID NO: 67385 - DNA, 15 bp, Homo sapiens
atcatcttcagggtg

SEQ ID NO: 67386 - DNA, 15 bp, Homo sapiens
catcatcttcagggt

SEQ ID NO: 67387 - DNA, 15 bp, Homo sapiens
gcatcatcttcaggg

SEQ ID NO: 67388 - DNA, 15 bp, Homo sapiens
agcatcatcttcagg

SEQ ID NO: 67389 - DNA, 15 bp, Homo sapiens
tagcatcatcttcag

SEQ ID NO: 67390 - DNA, 15 bp, Homo sapiens
ctagcatcatcttca

SEQ ID NO: 67391 - DNA, 15 bp, Homo sapiens
tctagcatcatcttc

SEQ ID NO: 67392 - DNA, 15 bp, Homo sapiens
ttctagcatcatctt

SEQ ID NO: 67393 - DNA, 15 bp, Homo sapiens
tttctagcatcatct

SEQ ID NO: 67394 - DNA, 15 bp, Homo sapiens
ctttctagcatcatc

SEQ ID NO: 67395 - DNA, 15 bp, Homo sapiens
cctttctagcatcat

SEQ ID NO: 67396 - DNA, 15 bp, Homo sapiens
acctttctagcatca

SEQ ID NO: 67397 - DNA, 15 bp, Homo sapiens
gacctttctagcatc

SEQ ID NO: 67398 - DNA, 15 bp, Homo sapiens
ggacctttctagcat

SEQ ID NO: 67399 - DNA, 15 bp, Homo sapiens
cggacctttctagca

SEQ ID NO: 67400 - DNA, 15 bp, Homo sapiens
acggacctttctagc

SEQ ID NO: 67401 - DNA, 15 bp, Homo sapiens
aacggacctttctag

SEQ ID NO: 67402 - DNA, 15 bp, Homo sapiens
aaacggacctttcta

SEQ ID NO: 67403 - DNA, 15 bp, Homo sapiens
caaacggacctttct

SEQ ID NO: 67404 - DNA, 15 bp, Homo sapiens
ccaaacggacctttc

SEQ ID NO: 67405 - DNA, 15 bp, Homo sapiens
gccaaacggaccttt

SEQ ID NO: 67406 - DNA, 15 bp, Homo sapiens
tgccaaacggacctt

SEQ ID NO: 67407 - DNA, 15 bp, Homo sapiens
ttgccaaacggacct

SEQ ID NO: 67408 - DNA, 15 bp, Homo sapiens
attgccaaacggacc

SEQ ID NO: 67409 - DNA, 15 bp, Homo sapiens
cattgccaaacggac

SEQ ID NO: 67410 - DNA, 15 bp, Homo sapiens
ccattgccaaacgga

SEQ ID NO: 67411 - DNA, 15 bp, Homo sapiens
cccattgccaaacgg

SEQ ID NO: 67412 - DNA, 15 bp, Homo sapiens
tcccattgccaaacg

SEQ ID NO: 67413 - DNA, 15 bp, Homo sapiens
ttcccattgccaaac

SEQ ID NO: 67414 - DNA, 15 bp, Homo sapiens
cttcccattgccaaa

SEQ ID NO: 67415 - DNA, 15 bp, Homo sapiens
ccttcccattgccaa

SEQ ID NO: 67416 - DNA, 15 bp, Homo sapiens
accttcccattgcca

SEQ ID NO: 67417 - DNA, 15 bp, Homo sapiens
aaccttcccattgcc

SEQ ID NO: 67418 - DNA, 15 bp, Homo sapiens
taaccttcccattgc

SEQ ID NO: 67419 - DNA, 15 bp, Homo sapiens
ataaccttcccattg

SEQ ID NO: 67420 - DNA, 15 bp, Homo sapiens
aataaccttcccatt

SEQ ID NO: 67421 - DNA, 15 bp, Homo sapiens
caataaccttcccat

SEQ ID NO: 67422 - DNA, 15 bp, Homo sapiens
tcaataaccttccca

SEQ ID NO: 67423 - DNA, 15 bp, Homo sapiens
atcaataaccttccc

SEQ ID NO: 67424 - DNA, 15 bp, Homo sapiens
catcaataaccttcc

SEQ ID NO: 67425 - DNA, 15 bp, Homo sapiens
tcatcaataaccttc

SEQ ID NO: 67426 - DNA, 15 bp, Homo sapiens
gtcatcaataacctt

SEQ ID NO: 67427 - DNA, 15 bp, Homo sapiens
tgtcatcaataacct

SEQ ID NO: 67428 - DNA, 15 bp, Homo sapiens
atgtcatcaataacc

SEQ ID NO: 67429 - DNA, 15 bp, Homo sapiens
aatgtcatcaataac

SEQ ID NO: 67430 - DNA, 15 bp, Homo sapiens
caatgtcatcaataa

SEQ ID NO: 67431 - DNA, 15 bp, Homo sapiens
ccaatgtcatcaata

SEQ ID NO: 67432 - DNA, 15 bp, Homo sapiens
accaatgtcatcaat

SEQ ID NO: 67433 - DNA, 15 bp, Homo sapiens
taccaatgtcatcaa

SEQ ID NO: 67434 - DNA, 15 bp, Homo sapiens
ttaccaatgtcatca

SEQ ID NO: 67435 - DNA, 15 bp, Homo sapiens
tttaccaatgtcatc

SEQ ID NO: 67436 - DNA, 15 bp, Homo sapiens
ttttaccaatgtcat

SEQ ID NO: 67437 - DNA, 15 bp, Homo sapiens
cttttaccaatgtca

SEQ ID NO: 67438 - DNA, 15 bp, Homo sapiens
gcttttaccaatgtc

SEQ ID NO: 67439 - DNA, 15 bp, Homo sapiens
ggcttttaccaatgt

SEQ ID NO: 67440 - DNA, 15 bp, Homo sapiens
aggcttttaccaatg

SEQ ID NO: 67441 - DNA, 15 bp, Homo sapiens
aaggcttttaccaat

SEQ ID NO: 67442 - DNA, 15 bp, Homo sapiens
aaaggcttttaccaa

SEQ ID NO: 67443 - DNA, 15 bp, Homo sapiens
aaaaggcttttacca

SEQ ID NO: 67444 - DNA, 15 bp, Homo sapiens
gaaaaggcttttacc

SEQ ID NO: 67445 - DNA, 15 bp, Homo sapiens
tgaaaaggcttttac

SEQ ID NO: 67446 - DNA, 15 bp, Homo sapiens
ctgaaaaggctttta

SEQ ID NO: 67447 - DNA, 15 bp, Homo sapiens
actgaaaaggctttt

SEQ ID NO: 67448 - DNA, 15 bp, Homo sapiens
aactgaaaaggcttt

SEQ ID NO: 67449 - DNA, 15 bp, Homo sapiens
caactgaaaaggctt

SEQ ID NO: 67450 - DNA, 15 bp, Homo sapiens
tcaactgaaaaggct

SEQ ID NO: 67451 - DNA, 15 bp, Homo sapiens
ctcaactgaaaaggc

SEQ ID NO: 67452 - DNA, 15 bp, Homo sapiens
actcaactgaaaagg

SEQ ID NO: 67453 - DNA, 15 bp, Homo sapiens
gactcaactgaaaag

SEQ ID NO: 67454 - DNA, 15 bp, Homo sapiens
tgactcaactgaaaa

SEQ ID NO: 67455 - DNA, 15 bp, Homo sapiens
atgactcaactgaaa

SEQ ID NO: 67456 - DNA, 15 bp, Homo sapiens
catgactcaactgaa

SEQ ID NO: 67457 - DNA, 15 bp, Homo sapiens
ccatgactcaactga

SEQ ID NO: 67458 - DNA, 15 bp, Homo sapiens
cccatgactcaactg

SEQ ID NO: 67459 - DNA, 15 bp, Homo sapiens
ccccatgactcaact

SEQ ID NO: 67460 - DNA, 15 bp, Homo sapiens
gccccatgactcaac

SEQ ID NO: 67461 - DNA, 15 bp, Homo sapiens
tgccccatgactcaa

SEQ ID NO: 67462 - DNA, 15 bp, Homo sapiens
ttgccccatgactca

SEQ ID NO: 67463 - DNA, 15 bp, Homo sapiens
tttgccccatgactc

SEQ ID NO: 67464 - DNA, 15 bp, Homo sapiens
atttgccccatgact

SEQ ID NO: 67465 - DNA, 15 bp, Homo sapiens
tatttgccccatgac

SEQ ID NO: 67466 - DNA, 15 bp, Homo sapiens
ctatttgccccatga

SEQ ID NO: 67467 - DNA, 15 bp, Homo sapiens
gctatttgccccatg

SEQ ID NO: 67468 - DNA, 15 bp, Homo sapiens
tgctatttgccccat

SEQ ID NO: 67469 - DNA, 15 bp, Homo sapiens
ttgctatttgcccca

SEQ ID NO: 67470 - DNA, 15 bp, Homo sapiens
cttgctatttgcccc

SEQ ID NO: 67471 - DNA, 15 bp, Homo sapiens
acttgctatttgccc

SEQ ID NO: 67472 - DNA, 15 bp, Homo sapiens
aacttgctatttgcc

SEQ ID NO: 67473 - DNA, 15 bp, Homo sapiens
caacttgctatttgc

SEQ ID NO: 67474 - DNA, 15 bp, Homo sapiens
tcaacttgctatttg

SEQ ID NO: 67475 - DNA, 15 bp, Homo sapiens
ttcaacttgctattt

SEQ ID NO: 67476 - DNA, 15 bp, Homo sapiens
cttcaacttgctatt

SEQ ID NO: 67477 - DNA, 15 bp, Homo sapiens
acttcaacttgctat

SEQ ID NO: 67478 - DNA, 15 bp, Homo sapiens
aacttcaacttgcta

SEQ ID NO: 67479 - DNA, 15 bp, Homo sapiens
taacttcaacttgct

SEQ ID NO: 67480 - DNA, 15 bp, Homo sapiens
ttaacttcaacttgc

SEQ ID NO: 67481 - DNA, 15 bp, Homo sapiens
tttaacttcaacttg

SEQ ID NO: 67482 - DNA, 15 bp, Homo sapiens
ctttaacttcaactt

SEQ ID NO: 67483 - DNA, 15 bp, Homo sapiens
cctttaacttcaact

SEQ ID NO: 67484 - DNA, 15 bp, Homo sapiens
ccctttaacttcaac

SEQ ID NO: 67485 - DNA, 15 bp, Homo sapiens
tccctttaacttcaa

SEQ ID NO: 67486 - DNA, 15 bp, Homo sapiens
ttccctttaacttca

SEQ ID NO: 67487 - DNA, 15 bp, Homo sapiens
attccctttaacttc

SEQ ID NO: 67488 - DNA, 15 bp, Homo sapiens
cattccctttaactt

SEQ ID NO: 67489 - DNA, 15 bp, Homo sapiens
acattccctttaact

SEQ ID NO: 67490 - DNA, 15 bp, Homo sapiens
aacattccctttaac

SEQ ID NO: 67491 - DNA, 15 bp, Homo sapiens
taacattccctttaa

SEQ ID NO: 67492 - DNA, 15 bp, Homo sapiens
ttaacattcccttta

SEQ ID NO: 67493 - DNA, 15 bp, Homo sapiens
gttaacattcccttt

SEQ ID NO: 67494 - DNA, 15 bp, Homo sapiens
tgttaacattccctt

SEQ ID NO: 67495 - DNA, 15 bp, Homo sapiens
ttgttaacattccct

SEQ ID NO: 67496 - DNA, 15 bp, Homo sapiens
tttgttaacattccc

SEQ ID NO: 67497 - DNA, 15 bp, Homo sapiens
gtttgttaacattcc

SEQ ID NO: 67498 - DNA, 15 bp, Homo sapiens
ggtttgttaacattc

SEQ ID NO: 67499 - DNA, 15 bp, Homo sapiens
tggtttgttaacatt

SEQ ID NO: 67500 - DNA, 15 bp, Homo sapiens
atggtttgttaacat

SEQ ID NO: 67501 - DNA, 15 bp, Homo sapiens
tatggtttgttaaca

SEQ ID NO: 67502 - DNA, 15 bp, Homo sapiens
ctatggtttgttaac

SEQ ID NO: 67503 - DNA, 15 bp, Homo sapiens
gctatggtttgttaa

SEQ ID NO: 67504 - DNA, 15 bp, Homo sapiens
agctatggtttgtta

SEQ ID NO: 67505 - DNA, 15 bp, Homo sapiens
cagctatggtttgtt

SEQ ID NO: 67506 - DNA, 15 bp, Homo sapiens
acagctatggtttgt

SEQ ID NO: 67507 - DNA, 15 bp, Homo sapiens
aacagctatggtttg

SEQ ID NO: 67508 - DNA, 15 bp, Homo sapiens
taacagctatggttt

SEQ ID NO: 67509 - DNA, 15 bp, Homo sapiens
ttaacagctatggtt

SEQ ID NO: 67510 - DNA, 15 bp, Homo sapiens
tttaacagctatggt

SEQ ID NO: 67511 - DNA, 15 bp, Homo sapiens
atttaacagctatgg

SEQ ID NO: 67512 - DNA, 15 bp, Homo sapiens
tatttaacagctatg

SEQ ID NO: 67513 - DNA, 15 bp, Homo sapiens
gtatttaacagctat

SEQ ID NO: 67514 - DNA, 15 bp, Homo sapiens
agtatttaacagcta

SEQ ID NO: 67515 - DNA, 15 bp, Homo sapiens
aagtatttaacagct

SEQ ID NO: 67516 - DNA, 15 bp, Homo sapiens
caagtatttaacagc

SEQ ID NO: 67517 - DNA, 15 bp, Homo sapiens
tcaagtatttaacag

SEQ ID NO: 67518 - DNA, 15 bp, Homo sapiens
ctcaagtatttaaca

SEQ ID NO: 67519 - DNA, 15 bp, Homo sapiens
gctcaagtatttaac

SEQ ID NO: 67520 - DNA, 15 bp, Homo sapiens
tgctcaagtatttaa

SEQ ID NO: 67521 - DNA, 15 bp, Homo sapiens
atgctcaagtattta

SEQ ID NO: 67522 - DNA, 15 bp, Homo sapiens
aatgctcaagtattt

SEQ ID NO: 67523 - DNA, 15 bp, Homo sapiens
aaatgctcaagtatt

SEQ ID NO: 67524 - DNA, 15 bp, Homo sapiens
aaaatgctcaagtat

SEQ ID NO: 67525 - DNA, 15 bp, Homo sapiens
aaaaatgctcaagta

SEQ ID NO: 67526 - DNA, 15 bp, Homo sapiens
aaaaaatgctcaagt

SEQ ID NO: 67527 - DNA, 15 bp, Homo sapiens
caaaaaatgctcaag

SEQ ID NO: 67528 - DNA, 15 bp, Homo sapiens
acaaaaaatgctcaa

SEQ ID NO: 67529 - DNA, 15 bp, Homo sapiens
tacaaaaaatgctca

SEQ ID NO: 67530 - DNA, 15 bp, Homo sapiens
atacaaaaaatgctc

SEQ ID NO: 67531 - DNA, 15 bp, Homo sapiens
aatacaaaaaatgct

SEQ ID NO: 67532 - DNA, 15 bp, Homo sapiens
caatacaaaaaatgc

SEQ ID NO: 67533 - DNA, 15 bp, Homo sapiens
acaatacaaaaaatg

SEQ ID NO: 67534 - DNA, 15 bp, Homo sapiens
aacaatacaaaaaat

SEQ ID NO: 67535 - DNA, 15 bp, Homo sapiens
gaacaatacaaaaaa

SEQ ID NO: 67536 - DNA, 15 bp, Homo sapiens
agaacaatacaaaaa

SEQ ID NO: 67537 - DNA, 15 bp, Homo sapiens
gagaacaatacaaaa

SEQ ID NO: 67538 - DNA, 15 bp, Homo sapiens
agagaacaatacaaa

SEQ ID NO: 67539 - DNA, 15 bp, Homo sapiens
tagagaacaatacaa

SEQ ID NO: 67540 - DNA, 15 bp, Homo sapiens
atagagaacaataca

SEQ ID NO: 67541 - DNA, 15 bp, Homo sapiens
tatagagaacaatac

SEQ ID NO: 67542 - DNA, 15 bp, Homo sapiens
gtatagagaacaata

SEQ ID NO: 67543 - DNA, 15 bp, Homo sapiens
cgtatagagaacaat

SEQ ID NO: 67544 - DNA, 15 bp, Homo sapiens
acgtatagagaacaa

SEQ ID NO: 67545 - DNA, 15 bp, Homo sapiens
aacgtatagagaaca

SEQ ID NO: 67546 - DNA, 15 bp, Homo sapiens
aaacgtatagagaac

SEQ ID NO: 67547 - DNA, 15 bp, Homo sapiens
gaaacgtatagagaa

SEQ ID NO: 67548 - DNA, 15 bp, Homo sapiens
agaaacgtatagaga

SEQ ID NO: 67549 - DNA, 15 bp, Homo sapiens
cagaaacgtatagag

SEQ ID NO: 67550 - DNA, 15 bp, Homo sapiens
acagaaacgtataga

SEQ ID NO: 67551 - DNA, 15 bp, Homo sapiens
tacagaaacgtatag

SEQ ID NO: 67552 - DNA, 15 bp, Homo sapiens
gtacagaaacgtata

SEQ ID NO: 67553 - DNA, 15 bp, Homo sapiens
tgtacagaaacgtat

SEQ ID NO: 67554 - DNA, 15 bp, Homo sapiens
atgtacagaaacgta

SEQ ID NO: 67555 - DNA, 15 bp, Homo sapiens
aatgtacagaaacgt

SEQ ID NO: 67556 - DNA, 15 bp, Homo sapiens
aaatgtacagaaacg

SEQ ID NO: 67557 - DNA, 15 bp, Homo sapiens
caaatgtacagaaac

SEQ ID NO: 67558 - DNA, 15 bp, Homo sapiens
tcaaatgtacagaaa

SEQ ID NO: 67559 - DNA, 15 bp, Homo sapiens
ttcaaatgtacagaa

SEQ ID NO: 67560 - DNA, 15 bp, Homo sapiens
tttcaaatgtacaga

SEQ ID NO: 67561 - DNA, 15 bp, Homo sapiens
atttcaaatgtacag

SEQ ID NO: 67562 - DNA, 15 bp, Homo sapiens
tatttcaaatgtaca

SEQ ID NO: 67563 - DNA, 15 bp, Homo sapiens
atatttcaaatgtac

SEQ ID NO: 67564 - DNA, 15 bp, Homo sapiens
aatatttcaaatgta

SEQ ID NO: 67565 - DNA, 15 bp, Homo sapiens
caatatttcaaatgt

SEQ ID NO: 67566 - DNA, 15 bp, Homo sapiens
acaatatttcaaatg

SEQ ID NO: 67567 - DNA, 15 bp, Homo sapiens
tacaatatttcaaat

SEQ ID NO: 67568 - DNA, 15 bp, Homo sapiens
gtacaatatttcaaa

SEQ ID NO: 67569 - DNA, 15 bp, Homo sapiens
agtacaatatttcaa

SEQ ID NO: 67570 - DNA, 15 bp, Homo sapiens
aagtacaatatttca

SEQ ID NO: 67571 - DNA, 15 bp, Homo sapiens
taagtacaatatttc

SEQ ID NO: 67572 - DNA, 15 bp, Homo sapiens
ttaagtacaatattt

SEQ ID NO: 67573 - DNA, 15 bp, Homo sapiens
tttaagtacaatatt

SEQ ID NO: 67574 - DNA, 15 bp, Homo sapiens
ttttaagtacaatat

SEQ ID NO: 67575 - DNA, 15 bp, Homo sapiens
tttttaagtacaata

SEQ ID NO: 67576 - DNA, 15 bp, Homo sapiens
atttttaagtacaat

SEQ ID NO: 67577 - DNA, 15 bp, Homo sapiens
gatttttaagtacaa

SEQ ID NO: 67578 - DNA, 15 bp, Homo sapiens
tgatttttaagtaca

SEQ ID NO: 67579 - DNA, 15 bp, Homo sapiens
atgatttttaagtac

SEQ ID NO: 67580 - DNA, 15 bp, Homo sapiens
catgatttttaagta

SEQ ID NO: 67581 - DNA, 15 bp, Homo sapiens
gcatgatttttaagt

SEQ ID NO: 67582 - DNA, 15 bp, Homo sapiens
tgcatgatttttaag

SEQ ID NO: 67583 - DNA, 15 bp, Homo sapiens
atgcatgatttttaa

SEQ ID NO: 67584 - DNA, 15 bp, Homo sapiens
catgcatgattttta

SEQ ID NO: 67585 - DNA, 15 bp, Homo sapiens
tcatgcatgattttt

SEQ ID NO: 67586 - DNA, 15 bp, Homo sapiens
ctcatgcatgatttt

SEQ ID NO: 67587 - DNA, 15 bp, Homo sapiens
tctcatgcatgattt

SEQ ID NO: 67588 - DNA, 15 bp, Homo sapiens
ctctcatgcatgatt

SEQ ID NO: 67589 - DNA, 15 bp, Homo sapiens
actctcatgcatgat

SEQ ID NO: 67590 - DNA, 15 bp, Homo sapiens
aactctcatgcatga

SEQ ID NO: 67591 - DNA, 15 bp, Homo sapiens
caactctcatgcatg

SEQ ID NO: 67592 - DNA, 15 bp, Homo sapiens
tcaactctcatgcat

SEQ ID NO: 67593 - DNA, 15 bp, Homo sapiens
atcaactctcatgca

SEQ ID NO: 67594 - DNA, 15 bp, Homo sapiens
tatcaactctcatgc

SEQ ID NO: 67595 - DNA, 15 bp, Homo sapiens
ttatcaactctcatg

SEQ ID NO: 67596 - DNA, 15 bp, Homo sapiens
tttatcaactctcat

SEQ ID NO: 67597 - DNA, 15 bp, Homo sapiens
ctttatcaactctca

SEQ ID NO: 67598 - DNA, 15 bp, Homo sapiens
actttatcaactctc

SEQ ID NO: 67599 - DNA, 15 bp, Homo sapiens
tactttatcaactct

SEQ ID NO: 67600 - DNA, 15 bp, Homo sapiens
ctactttatcaactc

SEQ ID NO: 67601 - DNA, 15 bp, Homo sapiens
tctactttatcaact

SEQ ID NO: 67602 - DNA, 15 bp, Homo sapiens
ctctactttatcaac

SEQ ID NO: 67603 - DNA, 15 bp, Homo sapiens
tctctactttatcaa

SEQ ID NO: 67604 - DNA, 15 bp, Homo sapiens
gtctctactttatca

SEQ ID NO: 67605 - DNA, 15 bp, Homo sapiens
tgtctctactttatc

SEQ ID NO: 67606 - DNA, 15 bp, Homo sapiens
ctgtctctactttat

SEQ ID NO: 67607 - DNA, 15 bp, Homo sapiens
tctgtctctacttta

SEQ ID NO: 67608 - DNA, 15 bp, Homo sapiens
ttctgtctctacttt

SEQ ID NO: 67609 - DNA, 15 bp, Homo sapiens
attctgtctctactt

SEQ ID NO: 67610 - DNA, 15 bp, Homo sapiens
cattctgtctctact

SEQ ID NO: 67611 - DNA, 15 bp, Homo sapiens
acattctgtctctac

SEQ ID NO: 67612 - DNA, 15 bp, Homo sapiens
tacattctgtctcta

SEQ ID NO: 67613 - DNA, 15 bp, Homo sapiens
ctacattctgtctct

SEQ ID NO: 67614 - DNA, 15 bp, Homo sapiens
cctacattctgtctc

SEQ ID NO: 67615 - DNA, 15 bp, Homo sapiens
gcctacattctgtct

SEQ ID NO: 67616 - DNA, 15 bp, Homo sapiens
tgcctacattctgtc

SEQ ID NO: 67617 - DNA, 15 bp, Homo sapiens
ttgcctacattctgt

SEQ ID NO: 67618 - DNA, 15 bp, Homo sapiens
cttgcctacattctg

SEQ ID NO: 67619 - DNA, 15 bp, Homo sapiens
acttgcctacattct

SEQ ID NO: 67620 - DNA, 15 bp, Homo sapiens
gacttgcctacattc

SEQ ID NO: 67621 - DNA, 15 bp, Homo sapiens
agacttgcctacatt

SEQ ID NO: 67622 - DNA, 15 bp, Homo sapiens
aagacttgcctacat

SEQ ID NO: 67623 - DNA, 15 bp, Homo sapiens
gaagacttgcctaca

SEQ ID NO: 67624 - DNA, 15 bp, Homo sapiens
tgaagacttgcctac

SEQ ID NO: 67625 - DNA, 15 bp, Homo sapiens
ttgaagacttgccta

SEQ ID NO: 67626 - DNA, 15 bp, Homo sapiens
cttgaagacttgcct

SEQ ID NO: 67627 - DNA, 15 bp, Homo sapiens
tcttgaagacttgcc

SEQ ID NO: 67628 - DNA, 15 bp, Homo sapiens
ttcttgaagacttgc

SEQ ID NO: 67629 - DNA, 15 bp, Homo sapiens
tttcttgaagacttg

SEQ ID NO: 67630 - DNA, 15 bp, Homo sapiens
atttcttgaagactt

SEQ ID NO: 67631 - DNA, 15 bp, Homo sapiens
gatttcttgaagact

SEQ ID NO: 67632 - DNA, 15 bp, Homo sapiens
agatttcttgaagac

SEQ ID NO: 67633 - DNA, 15 bp, Homo sapiens
aagatttcttgaaga

SEQ ID NO: 67634 - DNA, 15 bp, Homo sapiens
caagatttcttgaag

SEQ ID NO: 67635 - DNA, 15 bp, Homo sapiens
gcaagatttcttgaa

SEQ ID NO: 67636 - DNA, 15 bp, Homo sapiens
agcaagatttcttga

SEQ ID NO: 67637 - DNA, 15 bp, Homo sapiens
gagcaagatttcttg

SEQ ID NO: 67638 - DNA, 15 bp, Homo sapiens
agagcaagatttctt

SEQ ID NO: 67639 - DNA, 15 bp, Homo sapiens
cagagcaagatttct

SEQ ID NO: 67640 - DNA, 15 bp, Homo sapiens
tcagagcaagatttc

SEQ ID NO: 67641 - DNA, 15 bp, Homo sapiens
ttcagagcaagattt

SEQ ID NO: 67642 - DNA, 15 bp, Homo sapiens
tttcagagcaagatt

SEQ ID NO: 67643 - DNA, 15 bp, Homo sapiens
ctttcagagcaagat

SEQ ID NO: 67644 - DNA, 15 bp, Homo sapiens
cctttcagagcaaga

SEQ ID NO: 67645 - DNA, 15 bp, Homo sapiens
ccctttcagagcaag

SEQ ID NO: 67646 - DNA, 15 bp, Homo sapiens
tccctttcagagcaa

SEQ ID NO: 67647 - DNA, 15 bp, Homo sapiens
ttccctttcagagca

SEQ ID NO: 67648 - DNA, 15 bp, Homo sapiens
gttccctttcagagc

SEQ ID NO: 67649 - DNA, 15 bp, Homo sapiens
tgttccctttcagag

SEQ ID NO: 67650 - DNA, 15 bp, Homo sapiens
ttgttccctttcaga

SEQ ID NO: 67651 - DNA, 15 bp, Homo sapiens
tttgttccctttcag

SEQ ID NO: 67652 - DNA, 15 bp, Homo sapiens
ttttgttccctttca

SEQ ID NO: 67653 - DNA, 15 bp, Homo sapiens
cttttgttccctttc

SEQ ID NO: 67654 - DNA, 15 bp, Homo sapiens
tcttttgttcccttt

SEQ ID NO: 67655 - DNA, 15 bp, Homo sapiens
ttcttttgttccctt

SEQ ID NO: 67656 - DNA, 15 bp, Homo sapiens
gttcttttgttccct

SEQ ID NO: 67657 - DNA, 15 bp, Homo sapiens
agttcttttgttccc

SEQ ID NO: 67658 - DNA, 15 bp, Homo sapiens
tagttcttttgttcc

SEQ ID NO: 67659 - DNA, 15 bp, Homo sapiens
ctagttcttttgttc

SEQ ID NO: 67660 - DNA, 15 bp, Homo sapiens
cctagttcttttgtt

SEQ ID NO: 67661 - DNA, 15 bp, Homo sapiens
ccctagttcttttgt

SEQ ID NO: 67662 - DNA, 15 bp, Homo sapiens
tccctagttcttttg

SEQ ID NO: 67663 - DNA, 15 bp, Homo sapiens
ctccctagttctttt

SEQ ID NO: 67664 - DNA, 15 bp, Homo sapiens
tctccctagttcttt

SEQ ID NO: 67665 - DNA, 15 bp, Homo sapiens
ctctccctagttctt

SEQ ID NO: 67666 - DNA, 15 bp, Homo sapiens
actctccctagttct

SEQ ID NO: 67667 - DNA, 15 bp, Homo sapiens
gactctccctagttc

SEQ ID NO: 67668 - DNA, 15 bp, Homo sapiens
tgactctccctagtt

SEQ ID NO: 67669 - DNA, 15 bp, Homo sapiens
ttgactctccctagt

SEQ ID NO: 67670 - DNA, 15 bp, Homo sapiens
attgactctccctag

SEQ ID NO: 67671 - DNA, 15 bp, Homo sapiens
aattgactctcccta

SEQ ID NO: 67672 - DNA, 15 bp, Homo sapiens
aaattgactctccct

SEQ ID NO: 67673 - DNA, 15 bp, Homo sapiens
caaattgactctccc

SEQ ID NO: 67674 - DNA, 15 bp, Homo sapiens
ccaaattgactctcc

SEQ ID NO: 67675 - DNA, 15 bp, Homo sapiens
accaaattgactctc

SEQ ID NO: 67676 - DNA, 15 bp, Homo sapiens
aaccaaattgactct

SEQ ID NO: 67677 - DNA, 15 bp, Homo sapiens
taaccaaattgactc

SEQ ID NO: 67678 - DNA, 15 bp, Homo sapiens
ataaccaaattgact

SEQ ID NO: 67679 - DNA, 15 bp, Homo sapiens
tataaccaaattgac

SEQ ID NO: 67680 - DNA, 15 bp, Homo sapiens
ttataaccaaattga

SEQ ID NO: 67681 - DNA, 15 bp, Homo sapiens
cttataaccaaattg

SEQ ID NO: 67682 - DNA, 15 bp, Homo sapiens
gcttataaccaaatt

SEQ ID NO: 67683 - DNA, 15 bp, Homo sapiens
agcttataaccaaat

SEQ ID NO: 67684 - DNA, 15 bp, Homo sapiens
gagcttataaccaaa

SEQ ID NO: 67685 - DNA, 15 bp, Homo sapiens
agagcttataaccaa

SEQ ID NO: 67686 - DNA, 15 bp, Homo sapiens
aagagcttataacca

SEQ ID NO: 67687 - DNA, 15 bp, Homo sapiens
taagagcttataacc

SEQ ID NO: 67688 - DNA, 15 bp, Homo sapiens
ttaagagcttataac

SEQ ID NO: 67689 - DNA, 15 bp, Homo sapiens
tttaagagcttataa

SEQ ID NO: 67690 - DNA, 15 bp, Homo sapiens
ctttaagagcttata

SEQ ID NO: 67691 - DNA, 15 bp, Homo sapiens
actttaagagcttat

SEQ ID NO: 67692 - DNA, 15 bp, Homo sapiens
tactttaagagctta

SEQ ID NO: 67693 - DNA, 15 bp, Homo sapiens
atactttaagagctt

SEQ ID NO: 67694 - DNA, 15 bp, Homo sapiens
tatactttaagagct

SEQ ID NO: 67695 - DNA, 15 bp, Homo sapiens
atatactttaagagc

SEQ ID NO: 67696 - DNA, 15 bp, Homo sapiens
tatatactttaagag

SEQ ID NO: 67697 - DNA, 15 bp, Homo sapiens
atatatactttaaga

SEQ ID NO: 67698 - DNA, 15 bp, Homo sapiens
catatatactttaag

SEQ ID NO: 67699 - DNA, 15 bp, Homo sapiens
ccatatatactttaa

SEQ ID NO: 67700 - DNA, 15 bp, Homo sapiens
tccatatatacttta

SEQ ID NO: 67701 - DNA, 15 bp, Homo sapiens
ttccatatatacttt

SEQ ID NO: 67702 - DNA, 15 bp, Homo sapiens
tttccatatatactt

SEQ ID NO: 67703 - DNA, 15 bp, Homo sapiens
atttccatatatact

SEQ ID NO: 67704 - DNA, 15 bp, Homo sapiens
tatttccatatatac

SEQ ID NO: 67705 - DNA, 15 bp, Homo sapiens
gtatttccatatata

SEQ ID NO: 67706 - DNA, 15 bp, Homo sapiens
agtatttccatatat

SEQ ID NO: 67707 - DNA, 15 bp, Homo sapiens
gagtatttccatata

SEQ ID NO: 67708 - DNA, 15 bp, Homo sapiens
tgagtatttccatat

SEQ ID NO: 67709 - DNA, 15 bp, Homo sapiens
ctgagtatttccata

SEQ ID NO: 67710 - DNA, 15 bp, Homo sapiens
actgagtatttccat

SEQ ID NO: 67711 - DNA, 15 bp, Homo sapiens
aactgagtatttcca

SEQ ID NO: 67712 - DNA, 15 bp, Homo sapiens
taactgagtatttcc

SEQ ID NO: 67713 - DNA, 15 bp, Homo sapiens
ataactgagtatttc

SEQ ID NO: 67714 - DNA, 15 bp, Homo sapiens
aataactgagtattt

SEQ ID NO: 67715 - DNA, 15 bp, Homo sapiens
aaataactgagtatt

SEQ ID NO: 67716 - DNA, 15 bp, Homo sapiens
taaataactgagtat

SEQ ID NO: 67717 - DNA, 15 bp, Homo sapiens
ctaaataactgagta

SEQ ID NO: 67718 - DNA, 15 bp, Homo sapiens
tctaaataactgagt

SEQ ID NO: 67719 - DNA, 15 bp, Homo sapiens
ttctaaataactgag

SEQ ID NO: 67720 - DNA, 15 bp, Homo sapiens
tttctaaataactga

SEQ ID NO: 67721 - DNA, 15 bp, Homo sapiens
ctttctaaataactg

SEQ ID NO: 67722 - DNA, 15 bp, Homo sapiens
tctttctaaataact

SEQ ID NO: 67723 - DNA, 15 bp, Homo sapiens
ctctttctaaataac

SEQ ID NO: 67724 - DNA, 15 bp, Homo sapiens
cctctttctaaataa

SEQ ID NO: 67725 - DNA, 15 bp, Homo sapiens
acctctttctaaata

SEQ ID NO: 67726 - DNA, 15 bp, Homo sapiens
aacctctttctaaat

SEQ ID NO: 67727 - DNA, 15 bp, Homo sapiens
caacctctttctaaa

SEQ ID NO: 67728 - DNA, 15 bp, Homo sapiens
tcaacctctttctaa

SEQ ID NO: 67729 - DNA, 15 bp, Homo sapiens
atcaacctctttcta

SEQ ID NO: 67730 - DNA, 15 bp, Homo sapiens
tatcaacctctttct

SEQ ID NO: 67731 - DNA, 15 bp, Homo sapiens
ctatcaacctctttc

SEQ ID NO: 67732 - DNA, 15 bp, Homo sapiens
tctatcaacctcttt

SEQ ID NO: 67733 - DNA, 15 bp, Homo sapiens
ttctatcaacctctt

SEQ ID NO: 67734 - DNA, 15 bp, Homo sapiens
tttctatcaacctct

SEQ ID NO: 67735 - DNA, 15 bp, Homo sapiens
atttctatcaacctc

SEQ ID NO: 67736 - DNA, 15 bp, Homo sapiens
aatttctatcaacct

SEQ ID NO: 67737 - DNA, 15 bp, Homo sapiens
aaatttctatcaacc

SEQ ID NO: 67738 - DNA, 15 bp, Homo sapiens
taaatttctatcaac

SEQ ID NO: 67739 - DNA, 15 bp, Homo sapiens
ataaatttctatcaa

SEQ ID NO: 67740 - DNA, 15 bp, Homo sapiens
aataaatttctatca

SEQ ID NO: 67741 - DNA, 15 bp, Homo sapiens
gaataaatttctatc

SEQ ID NO: 67742 - DNA, 15 bp, Homo sapiens
ggaataaatttctat

SEQ ID NO: 67743 - DNA, 15 bp, Homo sapiens
tggaataaatttcta

SEQ ID NO: 67744 - DNA, 15 bp, Homo sapiens
atggaataaatttct

SEQ ID NO: 67745 - DNA, 15 bp, Homo sapiens
catggaataaatttc

SEQ ID NO: 67746 - DNA, 15 bp, Homo sapiens
tcatggaataaattt

SEQ ID NO: 67747 - DNA, 15 bp, Homo sapiens
ctcatggaataaatt

SEQ ID NO: 67748 - DNA, 15 bp, Homo sapiens
gctcatggaataaat

SEQ ID NO: 67749 - DNA, 15 bp, Homo sapiens
ggctcatggaataaa

SEQ ID NO: 67750 - DNA, 15 bp, Homo sapiens
gggctcatggaataa

SEQ ID NO: 67751 - DNA, 15 bp, Homo sapiens
agggctcatggaata

SEQ ID NO: 67752 - DNA, 15 bp, Homo sapiens
tagggctcatggaat

SEQ ID NO: 67753 - DNA, 15 bp, Homo sapiens
ttagggctcatggaa

SEQ ID NO: 67754 - DNA, 15 bp, Homo sapiens
tttagggctcatgga

SEQ ID NO: 67755 - DNA, 15 bp, Homo sapiens
ttttagggctcatgg

SEQ ID NO: 67756 - DNA, 15 bp, Homo sapiens
cttttagggctcatg

SEQ ID NO: 67757 - DNA, 15 bp, Homo sapiens
ccttttagggctcat

SEQ ID NO: 67758 - DNA, 15 bp, Homo sapiens
gccttttagggctca

SEQ ID NO: 67759 - DNA, 15 bp, Homo sapiens
ggccttttagggctc

SEQ ID NO: 67760 - DNA, 15 bp, Homo sapiens
tggccttttagggct

SEQ ID NO: 67761 - DNA, 15 bp, Homo sapiens
atggccttttagggc

SEQ ID NO: 67762 - DNA, 15 bp, Homo sapiens
gatggccttttaggg

SEQ ID NO: 67763 - DNA, 15 bp, Homo sapiens
tgatggccttttagg

SEQ ID NO: 67764 - DNA, 15 bp, Homo sapiens
ctgatggccttttag

SEQ ID NO: 67765 - DNA, 15 bp, Homo sapiens
tctgatggcctttta

SEQ ID NO: 67766 - DNA, 15 bp, Homo sapiens
atctgatggcctttt

SEQ ID NO: 67767 - DNA, 15 bp, Homo sapiens
tatctgatggccttt

SEQ ID NO: 67768 - DNA, 15 bp, Homo sapiens
ttatctgatggcctt

SEQ ID NO: 67769 - DNA, 15 bp, Homo sapiens
tttatctgatggcct

SEQ ID NO: 67770 - DNA, 15 bp, Homo sapiens
gtttatctgatggcc

SEQ ID NO: 67771 - DNA, 15 bp, Homo sapiens
ggtttatctgatggc

SEQ ID NO: 67772 - DNA, 15 bp, Homo sapiens
tggtttatctgatgg

SEQ ID NO: 67773 - DNA, 15 bp, Homo sapiens
ctggtttatctgatg

SEQ ID NO: 67774 - DNA, 15 bp, Homo sapiens
tctggtttatctgat

SEQ ID NO: 67775 - DNA, 15 bp, Homo sapiens
ctctggtttatctga

SEQ ID NO: 67776 - DNA, 15 bp, Homo sapiens
cctctggtttatctg

SEQ ID NO: 67777 - DNA, 15 bp, Homo sapiens
ccctctggtttatct

SEQ ID NO: 67778 - DNA, 15 bp, Homo sapiens
gccctctggtttatc

SEQ ID NO: 67779 - DNA, 15 bp, Homo sapiens
tgccctctggtttat

SEQ ID NO: 67780 - DNA, 15 bp, Homo sapiens
ttgccctctggttta

SEQ ID NO: 67781 - DNA, 15 bp, Homo sapiens
gttgccctctggttt

SEQ ID NO: 67782 - DNA, 15 bp, Homo sapiens
agttgccctctggtt

SEQ ID NO: 67783 - DNA, 15 bp, Homo sapiens
cagttgccctctggt

SEQ ID NO: 67784 - DNA, 15 bp, Homo sapiens
gcagttgccctctgg

SEQ ID NO: 67785 - DNA, 15 bp, Homo sapiens
ggcagttgccctctg

SEQ ID NO: 67786 - DNA, 15 bp, Homo sapiens
aggcagttgccctct

SEQ ID NO: 67787 - DNA, 15 bp, Homo sapiens
taggcagttgccctc

SEQ ID NO: 67788 - DNA, 15 bp, Homo sapiens
ttaggcagttgccct

SEQ ID NO: 67789 - DNA, 15 bp, Homo sapiens
cttaggcagttgccc

SEQ ID NO: 67790 - DNA, 15 bp, Homo sapiens
tcttaggcagttgcc

SEQ ID NO: 67791 - DNA, 15 bp, Homo sapiens
ttcttaggcagttgc

SEQ ID NO: 67792 - DNA, 15 bp, Homo sapiens
tttcttaggcagttg

SEQ ID NO: 67793 - DNA, 15 bp, Homo sapiens
ttttcttaggcagtt

SEQ ID NO: 67794 - DNA, 15 bp, Homo sapiens
tttttcttaggcagt

SEQ ID NO: 67795 - DNA, 15 bp, Homo sapiens
atttttcttaggcag

SEQ ID NO: 67796 - DNA, 15 bp, Homo sapiens
tatttttcttaggca

SEQ ID NO: 67797 - DNA, 15 bp, Homo sapiens
gtatttttcttaggc

SEQ ID NO: 67798 - DNA, 15 bp, Homo sapiens
tgtatttttcttagg

SEQ ID NO: 67799 - DNA, 15 bp, Homo sapiens
ttgtatttttcttag

SEQ ID NO: 67800 - DNA, 15 bp, Homo sapiens
attgtatttttctta

SEQ ID NO: 67801 - DNA, 15 bp, Homo sapiens
gattgtatttttctt

SEQ ID NO: 67802 - DNA, 15 bp, Homo sapiens
tgattgtatttttct

SEQ ID NO: 67803 - DNA, 15 bp, Homo sapiens
ctgattgtatttttc

SEQ ID NO: 67804 - DNA, 15 bp, Homo sapiens
actgattgtattttt

SEQ ID NO: 67805 - DNA, 15 bp, Homo sapiens
tactgattgtatttt

SEQ ID NO: 67806 - DNA, 15 bp, Homo sapiens
gtactgattgtattt

SEQ ID NO: 67807 - DNA, 15 bp, Homo sapiens
tgtactgattgtatt

SEQ ID NO: 67808 - DNA, 15 bp, Homo sapiens
ctgtactgattgtat

SEQ ID NO: 67809 - DNA, 15 bp, Homo sapiens
gctgtactgattgta

SEQ ID NO: 67810 - DNA, 15 bp, Homo sapiens
tgctgtactgattgt

SEQ ID NO: 67811 - DNA, 15 bp, Homo sapiens
ctgctgtactgattg

SEQ ID NO: 67812 - DNA, 15 bp, Homo sapiens
gctgctgtactgatt

SEQ ID NO: 67813 - DNA, 15 bp, Homo sapiens
ggctgctgtactgat

SEQ ID NO: 67814 - DNA, 15 bp, Homo sapiens
aggctgctgtactga

SEQ ID NO: 67815 - DNA, 15 bp, Homo sapiens
caggctgctgtactg

SEQ ID NO: 67816 - DNA, 15 bp, Homo sapiens
acaggctgctgtact

SEQ ID NO: 67817 - DNA, 15 bp, Homo sapiens
cacaggctgctgtac

SEQ ID NO: 67818 - DNA, 15 bp, Homo sapiens
acacaggctgctgta

SEQ ID NO: 67819 - DNA, 15 bp, Homo sapiens
cacacaggctgctgt

SEQ ID NO: 67820 - DNA, 15 bp, Homo sapiens
ccacacaggctgctg

SEQ ID NO: 67821 - DNA, 15 bp, Homo sapiens
gccacacaggctgct

SEQ ID NO: 67822 - DNA, 15 bp, Homo sapiens
agccacacaggctgc

SEQ ID NO: 67823 - DNA, 15 bp, Homo sapiens
cagccacacaggctg

SEQ ID NO: 67824 - DNA, 15 bp, Homo sapiens
acagccacacaggct

SEQ ID NO: 67825 - DNA, 15 bp, Homo sapiens
gacagccacacaggc

SEQ ID NO: 67826 - DNA, 15 bp, Homo sapiens
agacagccacacagg

SEQ ID NO: 67827 - DNA, 15 bp, Homo sapiens
aagacagccacacag

SEQ ID NO: 67828 - DNA, 15 bp, Homo sapiens
aaagacagccacaca

SEQ ID NO: 67829 - DNA, 15 bp, Homo sapiens
aaaagacagccacac

SEQ ID NO: 67830 - DNA, 15 bp, Homo sapiens
taaaagacagccaca

SEQ ID NO: 67831 - DNA, 15 bp, Homo sapiens
ctaaaagacagccac

SEQ ID NO: 67832 - DNA, 15 bp, Homo sapiens
actaaaagacagcca

SEQ ID NO: 67833 - DNA, 15 bp, Homo sapiens
cactaaaagacagcc

SEQ ID NO: 67834 - DNA, 15 bp, Homo sapiens
acactaaaagacagc

SEQ ID NO: 67835 - DNA, 15 bp, Homo sapiens
gacactaaaagacag

SEQ ID NO: 67836 - DNA, 15 bp, Homo sapiens
agacactaaaagaca

SEQ ID NO: 67837 - DNA, 15 bp, Homo sapiens
tagacactaaaagac

SEQ ID NO: 67838 - DNA, 15 bp, Homo sapiens
ttagacactaaaaga

SEQ ID NO: 67839 - DNA, 15 bp, Homo sapiens
tttagacactaaaag

SEQ ID NO: 67840 - DNA, 15 bp, Homo sapiens
ttttagacactaaaa

SEQ ID NO: 67841 - DNA, 15 bp, Homo sapiens
attttagacactaaa

SEQ ID NO: 67842 - DNA, 15 bp, Homo sapiens
cattttagacactaa

SEQ ID NO: 67843 - DNA, 15 bp, Homo sapiens
gcattttagacacta

SEQ ID NO: 67844 - DNA, 15 bp, Homo sapiens
tgcattttagacact

SEQ ID NO: 67845 - DNA, 15 bp, Homo sapiens
ttgcattttagacac

SEQ ID NO: 67846 - DNA, 15 bp, Homo sapiens
attgcattttagaca

SEQ ID NO: 67847 - DNA, 15 bp, Homo sapiens
cattgcattttagac

SEQ ID NO: 67848 - DNA, 15 bp, Homo sapiens
gcattgcattttaga

SEQ ID NO: 67849 - DNA, 15 bp, Homo sapiens
agcattgcattttag

SEQ ID NO: 67850 - DNA, 15 bp, Homo sapiens
tagcattgcatttta

SEQ ID NO: 67851 - DNA, 15 bp, Homo sapiens
ttagcattgcatttt

SEQ ID NO: 67852 - DNA, 15 bp, Homo sapiens
tttagcattgcattt

SEQ ID NO: 67853 - DNA, 15 bp, Homo sapiens
ttttagcattgcatt

SEQ ID NO: 67854 - DNA, 15 bp, Homo sapiens
attttagcattgcat

SEQ ID NO: 67855 - DNA, 15 bp, Homo sapiens
cattttagcattgca

SEQ ID NO: 67856 - DNA, 15 bp, Homo sapiens
gcattttagcattgc

SEQ ID NO: 67857 - DNA, 15 bp, Homo sapiens
tgcattttagcattg

SEQ ID NO: 67858 - DNA, 15 bp, Homo sapiens
ctgcattttagcatt

SEQ ID NO: 67859 - DNA, 15 bp, Homo sapiens
actgcattttagcat

SEQ ID NO: 67860 - DNA, 15 bp, Homo sapiens
aactgcattttagca

SEQ ID NO: 67861 - DNA, 15 bp, Homo sapiens
gaactgcattttagc

SEQ ID NO: 67862 - DNA, 15 bp, Homo sapiens
tgaactgcattttag

SEQ ID NO: 67863 - DNA, 15 bp, Homo sapiens
ctgaactgcatttta

SEQ ID NO: 67864 - DNA, 15 bp, Homo sapiens
gctgaactgcatttt

SEQ ID NO: 67865 - DNA, 15 bp, Homo sapiens
tgctgaactgcattt

SEQ ID NO: 67866 - DNA, 15 bp, Homo sapiens
ttgctgaactgcatt

SEQ ID NO: 67867 - DNA, 15 bp, Homo sapiens
tttgctgaactgcat

SEQ ID NO: 67868 - DNA, 15 bp, Homo sapiens
ttttgctgaactgca

SEQ ID NO: 67869 - DNA, 15 bp, Homo sapiens
cttttgctgaactgc

SEQ ID NO: 67870 - DNA, 15 bp, Homo sapiens
gcttttgctgaactg

SEQ ID NO: 67871 - DNA, 15 bp, Homo sapiens
tgcttttgctgaact

SEQ ID NO: 67872 - DNA, 15 bp, Homo sapiens
ttgcttttgctgaac

SEQ ID NO: 67873 - DNA, 15 bp, Homo sapiens
attgcttttgctgaa

SEQ ID NO: 67874 - DNA, 15 bp, Homo sapiens
aattgcttttgctga

SEQ ID NO: 67875 - DNA, 15 bp, Homo sapiens
aaattgcttttgctg

SEQ ID NO: 67876 - DNA, 15 bp, Homo sapiens
taaattgcttttgct

SEQ ID NO: 67877 - DNA, 15 bp, Homo sapiens
gtaaattgcttttgc

SEQ ID NO: 67878 - DNA, 15 bp, Homo sapiens
ggtaaattgcttttg

SEQ ID NO: 67879 - DNA, 15 bp, Homo sapiens
aggtaaattgctttt

SEQ ID NO: 67880 - DNA, 15 bp, Homo sapiens
taggtaaattgcttt

SEQ ID NO: 67881 - DNA, 15 bp, Homo sapiens
ttaggtaaattgctt

SEQ ID NO: 67882 - DNA, 15 bp, Homo sapiens
cttaggtaaattgct

SEQ ID NO: 67883 - DNA, 15 bp, Homo sapiens
ccttaggtaaattgc

SEQ ID NO: 67884 - DNA, 15 bp, Homo sapiens
cccttaggtaaattg

SEQ ID NO: 67885 - DNA, 15 bp, Homo sapiens
acccttaggtaaatt

SEQ ID NO: 67886 - DNA, 15 bp, Homo sapiens
gacccttaggtaaat

SEQ ID NO: 67887 - DNA, 15 bp, Homo sapiens
tgacccttaggtaaa

SEQ ID NO: 67888 - DNA, 15 bp, Homo sapiens
ttgacccttaggtaa

SEQ ID NO: 67889 - DNA, 15 bp, Homo sapiens
cttgacccttaggta

SEQ ID NO: 67890 - DNA, 15 bp, Homo sapiens
ccttgacccttaggt

SEQ ID NO: 67891 - DNA, 15 bp, Homo sapiens
gccttgacccttagg

SEQ ID NO: 67892 - DNA, 15 bp, Homo sapiens
tgccttgacccttag

SEQ ID NO: 67893 - DNA, 15 bp, Homo sapiens
ctgccttgaccctta

SEQ ID NO: 67894 - DNA, 15 bp, Homo sapiens
tctgccttgaccctt

SEQ ID NO: 67895 - DNA, 15 bp, Homo sapiens
ttctgccttgaccct

SEQ ID NO: 67896 - DNA, 15 bp, Homo sapiens
attctgccttgaccc

SEQ ID NO: 67897 - DNA, 15 bp, Homo sapiens
aattctgccttgacc

SEQ ID NO: 67898 - DNA, 15 bp, Homo sapiens
gaattctgccttgac

SEQ ID NO: 67899 - DNA, 15 bp, Homo sapiens
agaattctgccttga

SEQ ID NO: 67900 - DNA, 15 bp, Homo sapiens
gagaattctgccttg

SEQ ID NO: 67901 - DNA, 15 bp, Homo sapiens
tgagaattctgcctt

SEQ ID NO: 67902 - DNA, 15 bp, Homo sapiens
gtgagaattctgcct

SEQ ID NO: 67903 - DNA, 15 bp, Homo sapiens
ggtgagaattctgcc

SEQ ID NO: 67904 - DNA, 15 bp, Homo sapiens
aggtgagaattctgc

SEQ ID NO: 67905 - DNA, 15 bp, Homo sapiens
aaggtgagaattctg

SEQ ID NO: 67906 - DNA, 15 bp, Homo sapiens
aaaggtgagaattct

SEQ ID NO: 67907 - DNA, 15 bp, Homo sapiens
gaaaggtgagaattc

SEQ ID NO: 67908 - DNA, 15 bp, Homo sapiens
agaaaggtgagaatt

SEQ ID NO: 67909 - DNA, 15 bp, Homo sapiens
aagaaaggtgagaat

SEQ ID NO: 67910 - DNA, 15 bp, Homo sapiens
aaagaaaggtgagaa

SEQ ID NO: 67911 - DNA, 15 bp, Homo sapiens
aaaagaaaggtgaga

SEQ ID NO: 67912 - DNA, 15 bp, Homo sapiens
aaaaagaaaggtgag

SEQ ID NO: 67913 - DNA, 15 bp, Homo sapiens
gaaaaagaaaggtga

SEQ ID NO: 67914 - DNA, 15 bp, Homo sapiens
agaaaaagaaaggtg

SEQ ID NO: 67915 - DNA, 15 bp, Homo sapiens
aagaaaaagaaaggt

SEQ ID NO: 67916 - DNA, 15 bp, Homo sapiens
atttaaagaaaaaga

SEQ ID NO: 67917 - DNA, 15 bp, Homo sapiens
aatttaaagaaaaag

SEQ ID NO: 67918 - DNA, 15 bp, Homo sapiens
taatttaaagaaaaa

SEQ ID NO: 67919 - DNA, 15 bp, Homo sapiens
gtaatttaaagaaaa

SEQ ID NO: 67920 - DNA, 15 bp, Homo sapiens
tgtaatttaaagaaa

SEQ ID NO: 67921 - DNA, 15 bp, Homo sapiens
ctgtaatttaaagaa

SEQ ID NO: 67922 - DNA, 15 bp, Homo sapiens
tctgtaatttaaaga

SEQ ID NO: 67923 - DNA, 15 bp, Homo sapiens
ttctgtaatttaaag

SEQ ID NO: 67924 - DNA, 15 bp, Homo sapiens
tttctgtaatttaaa

SEQ ID NO: 67925 - DNA, 15 bp, Homo sapiens
ttttctgtaatttaa

SEQ ID NO: 67926 - DNA, 15 bp, Homo sapiens
cttttctgtaattta

SEQ ID NO: 67927 - DNA, 15 bp, Homo sapiens
ccttttctgtaattt

SEQ ID NO: 67928 - DNA, 15 bp, Homo sapiens
gccttttctgtaatt

SEQ ID NO: 67929 - DNA, 15 bp, Homo sapiens
ggccttttctgtaat

SEQ ID NO: 67930 - DNA, 15 bp, Homo sapiens
aggccttttctgtaa

SEQ ID NO: 67931 - DNA, 15 bp, Homo sapiens
taggccttttctgta

SEQ ID NO: 67932 - DNA, 15 bp, Homo sapiens
ttaggccttttctgt

SEQ ID NO: 67933 - DNA, 15 bp, Homo sapiens
gttaggccttttctg

SEQ ID NO: 67934 - DNA, 15 bp, Homo sapiens
tgttaggccttttct

SEQ ID NO: 67935 - DNA, 15 bp, Homo sapiens
gtgttaggccttttc

SEQ ID NO: 67936 - DNA, 15 bp, Homo sapiens
cgtgttaggcctttt

SEQ ID NO: 67937 - DNA, 15 bp, Homo sapiens
acgtgttaggccttt

SEQ ID NO: 67938 - DNA, 15 bp, Homo sapiens
aacgtgttaggcctt

SEQ ID NO: 67939 - DNA, 15 bp, Homo sapiens
gaacgtgttaggcct

SEQ ID NO: 67940 - DNA, 15 bp, Homo sapiens
ggaacgtgttaggcc

SEQ ID NO: 67941 - DNA, 15 bp, Homo sapiens
tggaacgtgttaggc

SEQ ID NO: 67942 - DNA, 15 bp, Homo sapiens
ctggaacgtgttagg

SEQ ID NO: 67943 - DNA, 15 bp, Homo sapiens
gctggaacgtgttag

SEQ ID NO: 67944 - DNA, 15 bp, Homo sapiens
agctggaacgtgtta

SEQ ID NO: 67945 - DNA, 15 bp, Homo sapiens
gagctggaacgtgtt

SEQ ID NO: 67946 - DNA, 15 bp, Homo sapiens
ggagctggaacgtgt

SEQ ID NO: 67947 - DNA, 15 bp, Homo sapiens
aggagctggaacgtg

SEQ ID NO: 67948 - DNA, 15 bp, Homo sapiens
gaggagctggaacgt

SEQ ID NO: 67949 - DNA, 15 bp, Homo sapiens
agaggagctggaacg

SEQ ID NO: 67950 - DNA, 15 bp, Homo sapiens
tagaggagctggaac

SEQ ID NO: 67951 - DNA, 15 bp, Homo sapiens
gtagaggagctggaa

SEQ ID NO: 67952 - DNA, 15 bp, Homo sapiens
cgtagaggagctgga

SEQ ID NO: 67953 - DNA, 15 bp, Homo sapiens
tcgtagaggagctgg

SEQ ID NO: 67954 - DNA, 15 bp, Homo sapiens
ttcgtagaggagctg

SEQ ID NO: 67955 - DNA, 15 bp, Homo sapiens
tttcgtagaggagct

SEQ ID NO: 67956 - DNA, 15 bp, Homo sapiens
gtttcgtagaggagc

SEQ ID NO: 67957 - DNA, 15 bp, Homo sapiens
agtttcgtagaggag

SEQ ID NO: 67958 - DNA, 15 bp, Homo sapiens
aagtttcgtagagga

SEQ ID NO: 67959 - DNA, 15 bp, Homo sapiens
aaagtttcgtagagg

SEQ ID NO: 67960 - DNA, 15 bp, Homo sapiens
gaaagtttcgtagag

SEQ ID NO: 67961 - DNA, 15 bp, Homo sapiens
ggaaagtttcgtaga

SEQ ID NO: 67962 - DNA, 15 bp, Homo sapiens
aggaaagtttcgtag

SEQ ID NO: 67963 - DNA, 15 bp, Homo sapiens
caggaaagtttcgta

SEQ ID NO: 67964 - DNA, 15 bp, Homo sapiens
acaggaaagtttcgt

SEQ ID NO: 67965 - DNA, 15 bp, Homo sapiens
aacaggaaagtttcg

SEQ ID NO: 67966 - DNA, 15 bp, Homo sapiens
aaacaggaaagtttc

SEQ ID NO: 67967 - DNA, 15 bp, Homo sapiens
aaaacaggaaagttt

SEQ ID NO: 67968 - DNA, 15 bp, Homo sapiens
taaaacaggaaagtt

SEQ ID NO: 67969 - DNA, 15 bp, Homo sapiens
ctaaaacaggaaagt

SEQ ID NO: 67970 - DNA, 15 bp, Homo sapiens
gctaaaacaggaaag

SEQ ID NO: 67971 - DNA, 15 bp, Homo sapiens
ggctaaaacaggaaa

SEQ ID NO: 67972 - DNA, 15 bp, Homo sapiens
aggctaaaacaggaa

SEQ ID NO: 67973 - DNA, 15 bp, Homo sapiens
aaggctaaaacagga

SEQ ID NO: 67974 - DNA, 15 bp, Homo sapiens
aaaggctaaaacagg

SEQ ID NO: 67975 - DNA, 15 bp, Homo sapiens
caaaggctaaaacag

SEQ ID NO: 67976 - DNA, 15 bp, Homo sapiens
acaaaggctaaaaca

SEQ ID NO: 67977 - DNA, 15 bp, Homo sapiens
aacaaaggctaaaac

SEQ ID NO: 67978 - DNA, 15 bp, Homo sapiens
caacaaaggctaaaa

SEQ ID NO: 67979 - DNA, 15 bp, Homo sapiens
tcaacaaaggctaaa

SEQ ID NO: 67980 - DNA, 15 bp, Homo sapiens
ttcaacaaaggctaa

SEQ ID NO: 67981 - DNA, 15 bp, Homo sapiens
gttcaacaaaggcta

SEQ ID NO: 67982 - DNA, 15 bp, Homo sapiens
agttcaacaaaggct

SEQ ID NO: 67983 - DNA, 15 bp, Homo sapiens
gagttcaacaaaggc

SEQ ID NO: 67984 - DNA, 15 bp, Homo sapiens
tgagttcaacaaagg

SEQ ID NO: 67985 - DNA, 15 bp, Homo sapiens
ttgagttcaacaaag

SEQ ID NO: 67986 - DNA, 15 bp, Homo sapiens
tttgagttcaacaaa

SEQ ID NO: 67987 - DNA, 15 bp, Homo sapiens
atttgagttcaacaa

SEQ ID NO: 67988 - DNA, 15 bp, Homo sapiens
tatttgagttcaaca

SEQ ID NO: 67989 - DNA, 15 bp, Homo sapiens
atatttgagttcaac

SEQ ID NO: 67990 - DNA, 15 bp, Homo sapiens
gatatttgagttcaa

SEQ ID NO: 67991 - DNA, 15 bp, Homo sapiens
tgatatttgagttca

SEQ ID NO: 67992 - DNA, 15 bp, Homo sapiens
atgatatttgagttc

SEQ ID NO: 67993 - DNA, 15 bp, Homo sapiens
catgatatttgagtt

SEQ ID NO: 67994 - DNA, 15 bp, Homo sapiens
gcatgatatttgagt

SEQ ID NO: 67995 - DNA, 15 bp, Homo sapiens
ggcatgatatttgag

SEQ ID NO: 67996 - DNA, 15 bp, Homo sapiens
aggcatgatatttga

SEQ ID NO: 67997 - DNA, 15 bp, Homo sapiens
aaggcatgatatttg

SEQ ID NO: 67998 - DNA, 15 bp, Homo sapiens
caaggcatgatattt

SEQ ID NO: 67999 - DNA, 15 bp, Homo sapiens
acaaggcatgatatt

SEQ ID NO: 68000 - DNA, 15 bp, Homo sapiens
aacaaggcatgatat

SEQ ID NO: 68001 - DNA, 15 bp, Homo sapiens
caacaaggcatgata

SEQ ID NO: 68002 - DNA, 15 bp, Homo sapiens
ccaacaaggcatgat

SEQ ID NO: 68003 - DNA, 15 bp, Homo sapiens
cccaacaaggcatga

SEQ ID NO: 68004 - DNA, 15 bp, Homo sapiens
tcccaacaaggcatg

SEQ ID NO: 68005 - DNA, 15 bp, Homo sapiens
gtcccaacaaggcat

SEQ ID NO: 68006 - DNA, 15 bp, Homo sapiens
ggtcccaacaaggca

SEQ ID NO: 68007 - DNA, 15 bp, Homo sapiens
tggtcccaacaaggc

SEQ ID NO: 68008 - DNA, 15 bp, Homo sapiens
atggtcccaacaagg

SEQ ID NO: 68009 - DNA, 15 bp, Homo sapiens
catggtcccaacaag

SEQ ID NO: 68010 - DNA, 15 bp, Homo sapiens
ccatggtcccaacaa

SEQ ID NO: 68011 - DNA, 15 bp, Homo sapiens
gccatggtcccaaca

SEQ ID NO: 68012 - DNA, 15 bp, Homo sapiens
tgccatggtcccaac

SEQ ID NO: 68013 - DNA, 15 bp, Homo sapiens
atgccatggtcccaa

SEQ ID NO: 68014 - DNA, 15 bp, Homo sapiens
aatgccatggtccca

SEQ ID NO: 68015 - DNA, 15 bp, Homo sapiens
aaatgccatggtccc

SEQ ID NO: 68016 - DNA, 15 bp, Homo sapiens
taaatgccatggtcc

SEQ ID NO: 68017 - DNA, 15 bp, Homo sapiens
gtaaatgccatggtc

SEQ ID NO: 68018 - DNA, 15 bp, Homo sapiens
agtaaatgccatggt

SEQ ID NO: 68019 - DNA, 15 bp, Homo sapiens
aagtaaatgccatgg

SEQ ID NO: 68020 - DNA, 15 bp, Homo sapiens
aaagtaaatgccatg

SEQ ID NO: 68021 - DNA, 15 bp, Homo sapiens
aaaagtaaatgccat

SEQ ID NO: 68022 - DNA, 15 bp, Homo sapiens
gaaaagtaaatgcca

SEQ ID NO: 68023 - DNA, 15 bp, Homo sapiens
agaaaagtaaatgcc

SEQ ID NO: 68024 - DNA, 15 bp, Homo sapiens
tagaaaagtaaatgc

SEQ ID NO: 68025 - DNA, 15 bp, Homo sapiens
ttagaaaagtaaatg

SEQ ID NO: 68026 - DNA, 15 bp, Homo sapiens
attagaaaagtaaat

SEQ ID NO: 68027 - DNA, 15 bp, Homo sapiens
tattagaaaagtaaa

SEQ ID NO: 68028 - DNA, 15 bp, Homo sapiens
ctattagaaaagtaa

SEQ ID NO: 68029 - DNA, 15 bp, Homo sapiens
gctattagaaaagta

SEQ ID NO: 68030 - DNA, 15 bp, Homo sapiens
agctattagaaaagt

SEQ ID NO: 68031 - DNA, 15 bp, Homo sapiens
cagctattagaaaag

SEQ ID NO: 68032 - DNA, 15 bp, Homo sapiens
acagctattagaaaa

SEQ ID NO: 68033 - DNA, 15 bp, Homo sapiens
aacagctattagaaa

SEQ ID NO: 68034 - DNA, 15 bp, Homo sapiens
gaacagctattagaa

SEQ ID NO: 68035 - DNA, 15 bp, Homo sapiens
agaacagctattaga

SEQ ID NO: 68036 - DNA, 15 bp, Homo sapiens
aagaacagctattag

SEQ ID NO: 68037 - DNA, 15 bp, Homo sapiens
gaagaacagctatta

SEQ ID NO: 68038 - DNA, 15 bp, Homo sapiens
tgaagaacagctatt

SEQ ID NO: 68039 - DNA, 15 bp, Homo sapiens
ttgaagaacagctat

SEQ ID NO: 68040 - DNA, 15 bp, Homo sapiens
attgaagaacagcta

SEQ ID NO: 68041 - DNA, 15 bp, Homo sapiens
aattgaagaacagct

SEQ ID NO: 68042 - DNA, 15 bp, Homo sapiens
aaattgaagaacagc

SEQ ID NO: 68043 - DNA, 15 bp, Homo sapiens
gaaattgaagaacag

SEQ ID NO: 68044 - DNA, 15 bp, Homo sapiens
agaaattgaagaaca

SEQ ID NO: 68045 - DNA, 15 bp, Homo sapiens
cagaaattgaagaac

SEQ ID NO: 68046 - DNA, 15 bp, Homo sapiens
acagaaattgaagaa

SEQ ID NO: 68047 - DNA, 15 bp, Homo sapiens
aacagaaattgaaga

SEQ ID NO: 68048 - DNA, 15 bp, Homo sapiens
gaacagaaattgaag

SEQ ID NO: 68049 - DNA, 15 bp, Homo sapiens
tgaacagaaattgaa

SEQ ID NO: 68050 - DNA, 15 bp, Homo sapiens
ctgaacagaaattga

SEQ ID NO: 68051 - DNA, 15 bp, Homo sapiens
tctgaacagaaattg

SEQ ID NO: 68052 - DNA, 15 bp, Homo sapiens
ttctgaacagaaatt

SEQ ID NO: 68053 - DNA, 15 bp, Homo sapiens
cttctgaacagaaat

SEQ ID NO: 68054 - DNA, 15 bp, Homo sapiens
acttctgaacagaaa

SEQ ID NO: 68055 - DNA, 15 bp, Homo sapiens
cacttctgaacagaa

SEQ ID NO: 68056 - DNA, 15 bp, Homo sapiens
tcacttctgaacaga

SEQ ID NO: 68057 - DNA, 15 bp, Homo sapiens
atcacttctgaacag

SEQ ID NO: 68058 - DNA, 15 bp, Homo sapiens
aatcacttctgaaca

SEQ ID NO: 68059 - DNA, 15 bp, Homo sapiens
gaatcacttctgaac

SEQ ID NO: 68060 - DNA, 15 bp, Homo sapiens
tgaatcacttctgaa

SEQ ID NO: 68061 - DNA, 15 bp, Homo sapiens
atgaatcacttctga

SEQ ID NO: 68062 - DNA, 15 bp, Homo sapiens
catgaatcacttctg

SEQ ID NO: 68063 - DNA, 15 bp, Homo sapiens
acatgaatcacttct

SEQ ID NO: 68064 - DNA, 15 bp, Homo sapiens
cacatgaatcacttc

SEQ ID NO: 68065 - DNA, 15 bp, Homo sapiens
ccacatgaatcactt

SEQ ID NO: 68066 - DNA, 15 bp, Homo sapiens
cccacatgaatcact

SEQ ID NO: 68067 - DNA, 15 bp, Homo sapiens
acccacatgaatcac

SEQ ID NO: 68068 - DNA, 15 bp, Homo sapiens
aacccacatgaatca

SEQ ID NO: 68069 - DNA, 15 bp, Homo sapiens
gaacccacatgaatc

SEQ ID NO: 68070 - DNA, 15 bp, Homo sapiens
agaacccacatgaat

SEQ ID NO: 68071 - DNA, 15 bp, Homo sapiens
gagaacccacatgaa

SEQ ID NO: 68072 - DNA, 15 bp, Homo sapiens
agagaacccacatga

SEQ ID NO: 68073 - DNA, 15 bp, Homo sapiens
cagagaacccacatg

SEQ ID NO: 68074 - DNA, 15 bp, Homo sapiens
acagagaacccacat

SEQ ID NO: 68075 - DNA, 15 bp, Homo sapiens
gacagagaacccaca

SEQ ID NO: 68076 - DNA, 15 bp, Homo sapiens
ggacagagaacccac

SEQ ID NO: 68077 - DNA, 15 bp, Homo sapiens
gggacagagaaccca

SEQ ID NO: 68078 - DNA, 15 bp, Homo sapiens
agggacagagaaccc

SEQ ID NO: 68079 - DNA, 15 bp, Homo sapiens
tagggacagagaacc

SEQ ID NO: 68080 - DNA, 15 bp, Homo sapiens
ttagggacagagaac

SEQ ID NO: 68081 - DNA, 15 bp, Homo sapiens
gttagggacagagaa

SEQ ID NO: 68082 - DNA, 15 bp, Homo sapiens
agttagggacagaga

SEQ ID NO: 68083 - DNA, 15 bp, Homo sapiens
tagttagggacagag

SEQ ID NO: 68084 - DNA, 15 bp, Homo sapiens
atagttagggacaga

SEQ ID NO: 68085 - DNA, 15 bp, Homo sapiens
tatagttagggacag

SEQ ID NO: 68086 - DNA, 15 bp, Homo sapiens
atatagttagggaca

SEQ ID NO: 68087 - DNA, 15 bp, Homo sapiens
aatatagttagggac

SEQ ID NO: 68088 - DNA, 15 bp, Homo sapiens
taatatagttaggga

SEQ ID NO: 68089 - DNA, 15 bp, Homo sapiens
ctaatatagttaggg

SEQ ID NO: 68090 - DNA, 15 bp, Homo sapiens
tctaatatagttagg

SEQ ID NO: 68091 - DNA, 15 bp, Homo sapiens
ttctaatatagttag

SEQ ID NO: 68092 - DNA, 15 bp, Homo sapiens
attctaatatagtta

SEQ ID NO: 68093 - DNA, 15 bp, Homo sapiens
gattctaatatagtt

SEQ ID NO: 68094 - DNA, 15 bp, Homo sapiens
agattctaatatagt

SEQ ID NO: 68095 - DNA, 15 bp, Homo sapiens
gagattctaatatag

SEQ ID NO: 68096 - DNA, 15 bp, Homo sapiens
ggagattctaatata

SEQ ID NO: 68097 - DNA, 15 bp, Homo sapiens
aggagattctaatat

SEQ ID NO: 68098 - DNA, 15 bp, Homo sapiens
aaggagattctaata

SEQ ID NO: 68099 - DNA, 15 bp, Homo sapiens
caaggagattctaat

SEQ ID NO: 68100 - DNA, 15 bp, Homo sapiens
tcaaggagattctaa

SEQ ID NO: 68101 - DNA, 15 bp, Homo sapiens
ctcaaggagattcta

SEQ ID NO: 68102 - DNA, 15 bp, Homo sapiens
actcaaggagattct

SEQ ID NO: 68103 - DNA, 15 bp, Homo sapiens
tactcaaggagattc

SEQ ID NO: 68104 - DNA, 15 bp, Homo sapiens
gtactcaaggagatt

SEQ ID NO: 68105 - DNA, 15 bp, Homo sapiens
tgtactcaaggagat

SEQ ID NO: 68106 - DNA, 15 bp, Homo sapiens
ctgtactcaaggaga

SEQ ID NO: 68107 - DNA, 15 bp, Homo sapiens
tctgtactcaaggag

SEQ ID NO: 68108 - DNA, 15 bp, Homo sapiens
ttctgtactcaagga

SEQ ID NO: 68109 - DNA, 15 bp, Homo sapiens
attctgtactcaagg

SEQ ID NO: 68110 - DNA, 15 bp, Homo sapiens
aattctgtactcaag

SEQ ID NO: 68111 - DNA, 15 bp, Homo sapiens
gaattctgtactcaa

SEQ ID NO: 68112 - DNA, 15 bp, Homo sapiens
tgaattctgtactca

SEQ ID NO: 68113 - DNA, 15 bp, Homo sapiens
atgaattctgtactc

SEQ ID NO: 68114 - DNA, 15 bp, Homo sapiens
catgaattctgtact

SEQ ID NO: 68115 - DNA, 15 bp, Homo sapiens
tcatgaattctgtac

SEQ ID NO: 68116 - DNA, 15 bp, Homo sapiens
ctcatgaattctgta

SEQ ID NO: 68117 - DNA, 15 bp, Homo sapiens
actcatgaattctgt

SEQ ID NO: 68118 - DNA, 15 bp, Homo sapiens
cactcatgaattctg

SEQ ID NO: 68119 - DNA, 15 bp, Homo sapiens
gcactcatgaattct

SEQ ID NO: 68120 - DNA, 15 bp, Homo sapiens
tgcactcatgaattc

SEQ ID NO: 68121 - DNA, 15 bp, Homo sapiens
atgcactcatgaatt

SEQ ID NO: 68122 - DNA, 15 bp, Homo sapiens
catgcactcatgaat

SEQ ID NO: 68123 - DNA, 15 bp, Homo sapiens
gcatgcactcatgaa

SEQ ID NO: 68124 - DNA, 15 bp, Homo sapiens
agcatgcactcatga

SEQ ID NO: 68125 - DNA, 15 bp, Homo sapiens
cagcatgcactcatg

SEQ ID NO: 68126 - DNA, 15 bp, Homo sapiens
gcagcatgcactcat

SEQ ID NO: 68127 - DNA, 15 bp, Homo sapiens
agcagcatgcactca

SEQ ID NO: 68128 - DNA, 15 bp, Homo sapiens
aagcagcatgcactc

SEQ ID NO: 68129 - DNA, 15 bp, Homo sapiens
aaagcagcatgcact

SEQ ID NO: 68130 - DNA, 15 bp, Homo sapiens
aaaagcagcatgcac

SEQ ID NO: 68131 - DNA, 15 bp, Homo sapiens
taaaagcagcatgca

SEQ ID NO: 68132 - DNA, 15 bp, Homo sapiens
ataaaagcagcatgc

SEQ ID NO: 68133 - DNA, 15 bp, Homo sapiens
tataaaagcagcatg

SEQ ID NO: 68134 - DNA, 15 bp, Homo sapiens
gtataaaagcagcat

SEQ ID NO: 68135 - DNA, 15 bp, Homo sapiens
agtataaaagcagca

SEQ ID NO: 68136 - DNA, 15 bp, Homo sapiens
gagtataaaagcagc

SEQ ID NO: 68137 - DNA, 15 bp, Homo sapiens
agagtataaaagcag

SEQ ID NO: 68138 - DNA, 15 bp, Homo sapiens
aagagtataaaagca

SEQ ID NO: 68139 - DNA, 15 bp, Homo sapiens
aaagagtataaaagc

SEQ ID NO: 68140 - DNA, 15 bp, Homo sapiens
caaagagtataaaag

SEQ ID NO: 68141 - DNA, 15 bp, Homo sapiens
gcaaagagtataaaa

SEQ ID NO: 68142 - DNA, 15 bp, Homo sapiens
agcaaagagtataaa

SEQ ID NO: 68143 - DNA, 15 bp, Homo sapiens
tagcaaagagtataa

SEQ ID NO: 68144 - DNA, 15 bp, Homo sapiens
gtagcaaagagtata

SEQ ID NO: 68145 - DNA, 15 bp, Homo sapiens
ggtagcaaagagtat

SEQ ID NO: 68146 - DNA, 15 bp, Homo sapiens
gggtagcaaagagta

SEQ ID NO: 68147 - DNA, 15 bp, Homo sapiens
agggtagcaaagagt

SEQ ID NO: 68148 - DNA, 15 bp, Homo sapiens
tagggtagcaaagag

SEQ ID NO: 68149 - DNA, 15 bp, Homo sapiens
ctagggtagcaaaga

SEQ ID NO: 68150 - DNA, 15 bp, Homo sapiens
actagggtagcaaag

SEQ ID NO: 68151 - DNA, 15 bp, Homo sapiens
cactagggtagcaaa

SEQ ID NO: 68152 - DNA, 15 bp, Homo sapiens
gcactagggtagcaa

SEQ ID NO: 68153 - DNA, 15 bp, Homo sapiens
tgcactagggtagca

SEQ ID NO: 68154 - DNA, 15 bp, Homo sapiens
gtgcactagggtagc

SEQ ID NO: 68155 - DNA, 15 bp, Homo sapiens
agtgcactagggtag

SEQ ID NO: 68156 - DNA, 15 bp, Homo sapiens
aagtgcactagggta

SEQ ID NO: 68157 - DNA, 15 bp, Homo sapiens
taagtgcactagggt

SEQ ID NO: 68158 - DNA, 15 bp, Homo sapiens
gtaagtgcactaggg

SEQ ID NO: 68159 - DNA, 15 bp, Homo sapiens
agtaagtgcactagg

SEQ ID NO: 68160 - DNA, 15 bp, Homo sapiens
gagtaagtgcactag

SEQ ID NO: 68161 - DNA, 15 bp, Homo sapiens
tgagtaagtgcacta

SEQ ID NO: 68162 - DNA, 15 bp, Homo sapiens
ttgagtaagtgcact

SEQ ID NO: 68163 - DNA, 15 bp, Homo sapiens
attgagtaagtgcac

SEQ ID NO: 68164 - DNA, 15 bp, Homo sapiens
cattgagtaagtgca

SEQ ID NO: 68165 - DNA, 15 bp, Homo sapiens
gcattgagtaagtgc

SEQ ID NO: 68166 - DNA, 15 bp, Homo sapiens
agcattgagtaagtg

SEQ ID NO: 68167 - DNA, 15 bp, Homo sapiens
aagcattgagtaagt

SEQ ID NO: 68168 - DNA, 15 bp, Homo sapiens
gaagcattgagtaag

SEQ ID NO: 68169 - DNA, 15 bp, Homo sapiens
agaagcattgagtaa

SEQ ID NO: 68170 - DNA, 15 bp, Homo sapiens
tagaagcattgagta

SEQ ID NO: 68171 - DNA, 15 bp, Homo sapiens
ttagaagcattgagt

SEQ ID NO: 68172 - DNA, 15 bp, Homo sapiens
gttagaagcattgag

SEQ ID NO: 68173 - DNA, 15 bp, Homo sapiens
agttagaagcattga

SEQ ID NO: 68174 - DNA, 15 bp, Homo sapiens
gagttagaagcattg

SEQ ID NO: 68175 - DNA, 15 bp, Homo sapiens
tgagttagaagcatt

SEQ ID NO: 68176 - DNA, 15 bp, Homo sapiens
atgagttagaagcat

SEQ ID NO: 68177 - DNA, 15 bp, Homo sapiens
aatgagttagaagca

SEQ ID NO: 68178 - DNA, 15 bp, Homo sapiens
gaatgagttagaagc

SEQ ID NO: 68179 - DNA, 15 bp, Homo sapiens
tgaatgagttagaag

SEQ ID NO: 68180 - DNA, 15 bp, Homo sapiens
atgaatgagttagaa

SEQ ID NO: 68181 - DNA, 15 bp, Homo sapiens
catgaatgagttaga

SEQ ID NO: 68182 - DNA, 15 bp, Homo sapiens
ccatgaatgagttag

SEQ ID NO: 68183 - DNA, 15 bp, Homo sapiens
gccatgaatgagtta

SEQ ID NO: 68184 - DNA, 15 bp, Homo sapiens
tgccatgaatgagtt

SEQ ID NO: 68185 - DNA, 15 bp, Homo sapiens
ctgccatgaatgagt

SEQ ID NO: 68186 - DNA, 15 bp, Homo sapiens
actgccatgaatgag

SEQ ID NO: 68187 - DNA, 15 bp, Homo sapiens
cactgccatgaatga

SEQ ID NO: 68188 - DNA, 15 bp, Homo sapiens
gcactgccatgaatg

SEQ ID NO: 68189 - DNA, 15 bp, Homo sapiens
ggcactgccatgaat

SEQ ID NO: 68190 - DNA, 15 bp, Homo sapiens
gggcactgccatgaa

SEQ ID NO: 68191 - DNA, 15 bp, Homo sapiens
tgggcactgccatga

SEQ ID NO: 68192 - DNA, 15 bp, Homo sapiens
atgggcactgccatg

SEQ ID NO: 68193 - DNA, 15 bp, Homo sapiens
aatgggcactgccat

SEQ ID NO: 68194 - DNA, 15 bp, Homo sapiens
aaatgggcactgcca

SEQ ID NO: 68195 - DNA, 15 bp, Homo sapiens
caaatgggcactgcc

SEQ ID NO: 68196 - DNA, 15 bp, Homo sapiens
ccaaatgggcactgc

SEQ ID NO: 68197 - DNA, 15 bp, Homo sapiens
gccaaatgggcactg

SEQ ID NO: 68198 - DNA, 15 bp, Homo sapiens
agccaaatgggcact

SEQ ID NO: 68199 - DNA, 15 bp, Homo sapiens
gagccaaatgggcac

SEQ ID NO: 68200 - DNA, 15 bp, Homo sapiens
ggagccaaatgggca

SEQ ID NO: 68201 - DNA, 15 bp, Homo sapiens
aggagccaaatgggc

SEQ ID NO: 68202 - DNA, 15 bp, Homo sapiens
caggagccaaatggg

SEQ ID NO: 68203 - DNA, 15 bp, Homo sapiens
tcaggagccaaatgg

SEQ ID NO: 68204 - DNA, 15 bp, Homo sapiens
ctcaggagccaaatg

SEQ ID NO: 68205 - DNA, 15 bp, Homo sapiens
tctcaggagccaaat

SEQ ID NO: 68206 - DNA, 15 bp, Homo sapiens
ttctcaggagccaaa

SEQ ID NO: 68207 - DNA, 15 bp, Homo sapiens
attctcaggagccaa

SEQ ID NO: 68208 - DNA, 15 bp, Homo sapiens
aattctcaggagcca

SEQ ID NO: 68209 - DNA, 15 bp, Homo sapiens
caattctcaggagcc

SEQ ID NO: 68210 - DNA, 15 bp, Homo sapiens
ccaattctcaggagc

SEQ ID NO: 68211 - DNA, 15 bp, Homo sapiens
tccaattctcaggag

SEQ ID NO: 68212 - DNA, 15 bp, Homo sapiens
atccaattctcagga

SEQ ID NO: 68213 - DNA, 15 bp, Homo sapiens
aatccaattctcagg

SEQ ID NO: 68214 - DNA, 15 bp, Homo sapiens
taatccaattctcag

SEQ ID NO: 68215 - DNA, 15 bp, Homo sapiens
ctaatccaattctca

SEQ ID NO: 68216 - DNA, 15 bp, Homo sapiens
actaatccaattctc

SEQ ID NO: 68217 - DNA, 15 bp, Homo sapiens
cactaatccaattct

SEQ ID NO: 68218 - DNA, 15 bp, Homo sapiens
gcactaatccaattc

SEQ ID NO: 68219 - DNA, 15 bp, Homo sapiens
ggcactaatccaatt

SEQ ID NO: 68220 - DNA, 15 bp, Homo sapiens
aggcactaatccaat

SEQ ID NO: 68221 - DNA, 15 bp, Homo sapiens
taggcactaatccaa

SEQ ID NO: 68222 - DNA, 15 bp, Homo sapiens
ttaggcactaatcca

SEQ ID NO: 68223 - DNA, 15 bp, Homo sapiens
cttaggcactaatcc

SEQ ID NO: 68224 - DNA, 15 bp, Homo sapiens
tcttaggcactaatc

SEQ ID NO: 68225 - DNA, 15 bp, Homo sapiens
gtcttaggcactaat

SEQ ID NO: 68226 - DNA, 15 bp, Homo sapiens
tgtcttaggcactaa

SEQ ID NO: 68227 - DNA, 15 bp, Homo sapiens
ctgtcttaggcacta

SEQ ID NO: 68228 - DNA, 15 bp, Homo sapiens
tctgtcttaggcact

SEQ ID NO: 68229 - DNA, 15 bp, Homo sapiens
ctctgtcttaggcac

SEQ ID NO: 68230 - DNA, 15 bp, Homo sapiens
actctgtcttaggca

SEQ ID NO: 68231 - DNA, 15 bp, Homo sapiens
cactctgtcttaggc

SEQ ID NO: 68232 - DNA, 15 bp, Homo sapiens
ccactctgtcttagg

SEQ ID NO: 68233 - DNA, 15 bp, Homo sapiens
accactctgtcttag

SEQ ID NO: 68234 - DNA, 15 bp, Homo sapiens
caccactctgtctta

SEQ ID NO: 68235 - DNA, 15 bp, Homo sapiens
ccaccactctgtctt

SEQ ID NO: 68236 - DNA, 15 bp, Homo sapiens
cccaccactctgtct

SEQ ID NO: 68237 - DNA, 15 bp, Homo sapiens
acccaccactctgtc

SEQ ID NO: 68238 - DNA, 15 bp, Homo sapiens
tacccaccactctgt

SEQ ID NO: 68239 - DNA, 15 bp, Homo sapiens
gtacccaccactctg

SEQ ID NO: 68240 - DNA, 15 bp, Homo sapiens
agtacccaccactct

SEQ ID NO: 68241 - DNA, 15 bp, Homo sapiens
aagtacccaccactc

SEQ ID NO: 68242 - DNA, 15 bp, Homo sapiens
aaagtacccaccact

SEQ ID NO: 68243 - DNA, 15 bp, Homo sapiens
caaagtacccaccac

SEQ ID NO: 68244 - DNA, 15 bp, Homo sapiens
ccaaagtacccacca

SEQ ID NO: 68245 - DNA, 15 bp, Homo sapiens
cccaaagtacccacc

SEQ ID NO: 68246 - DNA, 15 bp, Homo sapiens
acccaaagtacccac

SEQ ID NO: 68247 - DNA, 15 bp, Homo sapiens
aacccaaagtaccca

SEQ ID NO: 68248 - DNA, 15 bp, Homo sapiens
gaacccaaagtaccc

SEQ ID NO: 68249 - DNA, 15 bp, Homo sapiens
cgaacccaaagtacc

SEQ ID NO: 68250 - DNA, 15 bp, Homo sapiens
gcgaacccaaagtac

SEQ ID NO: 68251 - DNA, 15 bp, Homo sapiens
ggcgaacccaaagta

SEQ ID NO: 68252 - DNA, 15 bp, Homo sapiens
tggcgaacccaaagt

SEQ ID NO: 68253 - DNA, 15 bp, Homo sapiens
atggcgaacccaaag

SEQ ID NO: 68254 - DNA, 15 bp, Homo sapiens
tatggcgaacccaaa

SEQ ID NO: 68255 - DNA, 15 bp, Homo sapiens
gtatggcgaacccaa

SEQ ID NO: 68256 - DNA, 15 bp, Homo sapiens
tgtatggcgaaccca

SEQ ID NO: 68257 - DNA, 15 bp, Homo sapiens
ctgtatggcgaaccc

SEQ ID NO: 68258 - DNA, 15 bp, Homo sapiens
actgtatggcgaacc

SEQ ID NO: 68259 - DNA, 15 bp, Homo sapiens
cactgtatggcgaac

SEQ ID NO: 68260 - DNA, 15 bp, Homo sapiens
acactgtatggcgaa

SEQ ID NO: 68261 - DNA, 15 bp, Homo sapiens
cacactgtatggcga

SEQ ID NO: 68262 - DNA, 15 bp, Homo sapiens
tcacactgtatggcg

SEQ ID NO: 68263 - DNA, 15 bp, Homo sapiens
ctcacactgtatggc

SEQ ID NO: 68264 - DNA, 15 bp, Homo sapiens
actcacactgtatgg

SEQ ID NO: 68265 - DNA, 15 bp, Homo sapiens
aactcacactgtatg

SEQ ID NO: 68266 - DNA, 15 bp, Homo sapiens
aaactcacactgtat

SEQ ID NO: 68267 - DNA, 15 bp, Homo sapiens
caaactcacactgta

SEQ ID NO: 68268 - DNA, 15 bp, Homo sapiens
gcaaactcacactgt

SEQ ID NO: 68269 - DNA, 15 bp, Homo sapiens
agcaaactcacactg

SEQ ID NO: 68270 - DNA, 15 bp, Homo sapiens
cagcaaactcacact

SEQ ID NO: 68271 - DNA, 15 bp, Homo sapiens
ttcagcaaactcaca

SEQ ID NO: 68272 - DNA, 15 bp, Homo sapiens
gttcagcaaactcac

SEQ ID NO: 68273 - DNA, 15 bp, Homo sapiens
tgttcagcaaactca

SEQ ID NO: 68274 - DNA, 15 bp, Homo sapiens
gtgttcagcaaactc

SEQ ID NO: 68275 - DNA, 15 bp, Homo sapiens
ggtgttcagcaaact

SEQ ID NO: 68276 - DNA, 15 bp, Homo sapiens
aggtgttcagcaaac

SEQ ID NO: 68277 - DNA, 15 bp, Homo sapiens
gaggtgttcagcaaa

SEQ ID NO: 68278 - DNA, 15 bp, Homo sapiens
agaggtgttcagcaa

SEQ ID NO: 68279 - DNA, 15 bp, Homo sapiens
aagaggtgttcagca

SEQ ID NO: 68280 - DNA, 15 bp, Homo sapiens
caagaggtgttcagc

SEQ ID NO: 68281 - DNA, 15 bp, Homo sapiens
gcaagaggtgttcag

SEQ ID NO: 68282 - DNA, 15 bp, Homo sapiens
aagcaagaggtgttc

SEQ ID NO: 68283 - DNA, 15 bp, Homo sapiens
aaagcaagaggtgtt

SEQ ID NO: 68284 - DNA, 15 bp, Homo sapiens
caaagcaagaggtgt

SEQ ID NO: 68285 - DNA, 15 bp, Homo sapiens
tcaaagcaagaggtg

SEQ ID NO: 68286 - DNA, 15 bp, Homo sapiens
atcaaagcaagaggt

SEQ ID NO: 68287 - DNA, 15 bp, Homo sapiens
catcaaagcaagagg

SEQ ID NO: 68288 - DNA, 15 bp, Homo sapiens
tcatcaaagcaagag

SEQ ID NO: 68289 - DNA, 15 bp, Homo sapiens
atcatcaaagcaaga

SEQ ID NO: 68290 - DNA, 15 bp, Homo sapiens
aatcatcaaagcaag

SEQ ID NO: 68291 - DNA, 15 bp, Homo sapiens
taatcatcaaagcaa

SEQ ID NO: 68292 - DNA, 15 bp, Homo sapiens
ctaatcatcaaagca

SEQ ID NO: 68293 - DNA, 15 bp, Homo sapiens
actaatcatcaaagc

SEQ ID NO: 68294 - DNA, 15 bp, Homo sapiens
cactaatcatcaaag

SEQ ID NO: 68295 - DNA, 15 bp, Homo sapiens
acactaatcatcaaa

SEQ ID NO: 68296 - DNA, 15 bp, Homo sapiens
cacactaatcatcaa

SEQ ID NO: 68297 - DNA, 15 bp, Homo sapiens
ccacactaatcatca

SEQ ID NO: 68298 - DNA, 15 bp, Homo sapiens
cccacactaatcatc

SEQ ID NO: 68299 - DNA, 15 bp, Homo sapiens
acccacactaatcat

SEQ ID NO: 68300 - DNA, 15 bp, Homo sapiens
aacccacactaatca

SEQ ID NO: 68301 - DNA, 15 bp, Homo sapiens
aaacccacactaatc

SEQ ID NO: 68302 - DNA, 15 bp, Homo sapiens
aaaacccacactaat

SEQ ID NO: 68303 - DNA, 15 bp, Homo sapiens
aaaaacccacactaa

SEQ ID NO: 68304 - DNA, 15 bp, Homo sapiens
gaaaaacccacacta

SEQ ID NO: 68305 - DNA, 15 bp, Homo sapiens
agaaaaacccacact

SEQ ID NO: 68306 - DNA, 15 bp, Homo sapiens
aagaaaaacccacac

SEQ ID NO: 68307 - DNA, 15 bp, Homo sapiens
caagaaaaacccaca

SEQ ID NO: 68308 - DNA, 15 bp, Homo sapiens
ccaagaaaaacccac

SEQ ID NO: 68309 - DNA, 15 bp, Homo sapiens
gccaagaaaaaccca

SEQ ID NO: 68310 - DNA, 15 bp, Homo sapiens
agccaagaaaaaccc

SEQ ID NO: 68311 - DNA, 15 bp, Homo sapiens
aagccaagaaaaacc

SEQ ID NO: 68312 - DNA, 15 bp, Homo sapiens
aaagccaagaaaaac

SEQ ID NO: 68313 - DNA, 15 bp, Homo sapiens
caaagccaagaaaaa

SEQ ID NO: 68314 - DNA, 15 bp, Homo sapiens
acaaagccaagaaaa

SEQ ID NO: 68315 - DNA, 15 bp, Homo sapiens
aacaaagccaagaaa

SEQ ID NO: 68316 - DNA, 15 bp, Homo sapiens
aaacaaagccaagaa

SEQ ID NO: 68317 - DNA, 15 bp, Homo sapiens
aaaacaaagccaaga

SEQ ID NO: 68318 - DNA, 15 bp, Homo sapiens
aaaaacaaagccaag

SEQ ID NO: 68319 - DNA, 15 bp, Homo sapiens
taaaaacaaagccaa

SEQ ID NO: 68320 - DNA, 15 bp, Homo sapiens
gtaaaaacaaagcca

SEQ ID NO: 68321 - DNA, 15 bp, Homo sapiens
tgtaaaaacaaagcc

SEQ ID NO: 68322 - DNA, 15 bp, Homo sapiens
ctgtaaaaacaaagc

SEQ ID NO: 68323 - DNA, 15 bp, Homo sapiens
tctgtaaaaacaaag

SEQ ID NO: 68324 - DNA, 15 bp, Homo sapiens
ctctgtaaaaacaaa

SEQ ID NO: 68325 - DNA, 15 bp, Homo sapiens
actctgtaaaaacaa

SEQ ID NO: 68326 - DNA, 15 bp, Homo sapiens
tactctgtaaaaaca

SEQ ID NO: 68327 - DNA, 15 bp, Homo sapiens
gtactctgtaaaaac

SEQ ID NO: 68328 - DNA, 15 bp, Homo sapiens
tgtactctgtaaaaa

SEQ ID NO: 68329 - DNA, 15 bp, Homo sapiens
ctgtactctgtaaaa

SEQ ID NO: 68330 - DNA, 15 bp, Homo sapiens
gctgtactctgtaaa

SEQ ID NO: 68331 - DNA, 15 bp, Homo sapiens
cgctgtactctgtaa

SEQ ID NO: 68332 - DNA, 15 bp, Homo sapiens
gcgctgtactctgta

SEQ ID NO: 68333 - DNA, 15 bp, Homo sapiens
ggcgctgtactctgt

SEQ ID NO: 68334 - DNA, 15 bp, Homo sapiens
aggcgctgtactctg

SEQ ID NO: 68335 - DNA, 15 bp, Homo sapiens
caggcgctgtactct

SEQ ID NO: 68336 - DNA, 15 bp, Homo sapiens
tcaggcgctgtactc

SEQ ID NO: 68337 - DNA, 15 bp, Homo sapiens
ctcaggcgctgtact

SEQ ID NO: 68338 - DNA, 15 bp, Homo sapiens
cctcaggcgctgtac

SEQ ID NO: 68339 - DNA, 15 bp, Homo sapiens
tcctcaggcgctgta

SEQ ID NO: 68340 - DNA, 15 bp, Homo sapiens
ctcctcaggcgctgt

SEQ ID NO: 68341 - DNA, 15 bp, Homo sapiens
cctcctcaggcgctg

SEQ ID NO: 68342 - DNA, 15 bp, Homo sapiens
tcctcctcaggcgct

SEQ ID NO: 68343 - DNA, 15 bp, Homo sapiens
ctcctcctcaggcgc

SEQ ID NO: 68344 - DNA, 15 bp, Homo sapiens
gctcctcctcaggcg

SEQ ID NO: 68345 - DNA, 15 bp, Homo sapiens
tgctcctcctcaggc

SEQ ID NO: 68346 - DNA, 15 bp, Homo sapiens
atgctcctcctcagg

SEQ ID NO: 68347 - DNA, 15 bp, Homo sapiens
catgctcctcctcag

SEQ ID NO: 68348 - DNA, 15 bp, Homo sapiens
tcatgctcctcctca

SEQ ID NO: 68349 - DNA, 15 bp, Homo sapiens
ctcatgctcctcctc

SEQ ID NO: 68350 - DNA, 15 bp, Homo sapiens
tctcatgctcctcct

SEQ ID NO: 68351 - DNA, 15 bp, Homo sapiens
ctctcatgctcctcc

SEQ ID NO: 68352 - DNA, 15 bp, Homo sapiens
actctcatgctcctc

SEQ ID NO: 68353 - DNA, 15 bp, Homo sapiens
gactctcatgctcct

SEQ ID NO: 68354 - DNA, 15 bp, Homo sapiens
ggactctcatgctcc

SEQ ID NO: 68355 - DNA, 15 bp, Homo sapiens
gggactctcatgctc

SEQ ID NO: 68356 - DNA, 15 bp, Homo sapiens
ggggactctcatgct

SEQ ID NO: 68357 - DNA, 15 bp, Homo sapiens
cggggactctcatgc

SEQ ID NO: 68358 - DNA, 15 bp, Homo sapiens
tcggggactctcatg

SEQ ID NO: 68359 - DNA, 15 bp, Homo sapiens
ctcggggactctcat

SEQ ID NO: 68360 - DNA, 15 bp, Homo sapiens
gctcggggactctca

SEQ ID NO: 68361 - DNA, 15 bp, Homo sapiens
agctcggggactctc

SEQ ID NO: 68362 - DNA, 15 bp, Homo sapiens
cagctcggggactct

SEQ ID NO: 68363 - DNA, 15 bp, Homo sapiens
tcagctcggggactc

SEQ ID NO: 68364 - DNA, 15 bp, Homo sapiens
ttcagctcggggact

SEQ ID NO: 68365 - DNA, 15 bp, Homo sapiens
tttcagctcggggac

SEQ ID NO: 68366 - DNA, 15 bp, Homo sapiens
gtttcagctcgggga

SEQ ID NO: 68367 - DNA, 15 bp, Homo sapiens
agtttcagctcgggg

SEQ ID NO: 68368 - DNA, 15 bp, Homo sapiens
gagtttcagctcggg

SEQ ID NO: 68369 - DNA, 15 bp, Homo sapiens
ggagtttcagctcgg

SEQ ID NO: 68370 - DNA, 15 bp, Homo sapiens
gggagtttcagctcg

SEQ ID NO: 68371 - DNA, 15 bp, Homo sapiens
tgggagtttcagctc

SEQ ID NO: 68372 - DNA, 15 bp, Homo sapiens
ctgggagtttcagct

SEQ ID NO: 68373 - DNA, 15 bp, Homo sapiens
gctgggagtttcagc

SEQ ID NO: 68374 - DNA, 15 bp, Homo sapiens
tgctgggagtttcag

SEQ ID NO: 68375 - DNA, 15 bp, Homo sapiens
gtgctgggagtttca

SEQ ID NO: 68376 - DNA, 15 bp, Homo sapiens
agtgctgggagtttc

SEQ ID NO: 68377 - DNA, 15 bp, Homo sapiens
cagtgctgggagttt

SEQ ID NO: 68378 - DNA, 15 bp, Homo sapiens
acagtgctgggagtt

SEQ ID NO: 68379 - DNA, 15 bp, Homo sapiens
gacagtgctgggagt

SEQ ID NO: 68380 - DNA, 15 bp, Homo sapiens
tgacagtgctgggag

SEQ ID NO: 68381 - DNA, 15 bp, Homo sapiens
gtgacagtgctggga

SEQ ID NO: 68382 - DNA, 15 bp, Homo sapiens
agtgacagtgctggg

SEQ ID NO: 68383 - DNA, 15 bp, Homo sapiens
cagtgacagtgctgg

SEQ ID NO: 68384 - DNA, 15 bp, Homo sapiens
tcagtgacagtgctg

SEQ ID NO: 68385 - DNA, 15 bp, Homo sapiens
ctcagtgacagtgct

SEQ ID NO: 68386 - DNA, 15 bp, Homo sapiens
cctcagtgacagtgc

SEQ ID NO: 68387 - DNA, 15 bp, Homo sapiens
acctcagtgacagtg

SEQ ID NO: 68388 - DNA, 15 bp, Homo sapiens
aacctcagtgacagt

SEQ ID NO: 68389 - DNA, 15 bp, Homo sapiens
caacctcagtgacag

SEQ ID NO: 68390 - DNA, 15 bp, Homo sapiens
tcaacctcagtgaca

SEQ ID NO: 68391 - DNA, 15 bp, Homo sapiens
gtcaacctcagtgac

SEQ ID NO: 68392 - DNA, 15 bp, Homo sapiens
tgtcaacctcagtga

SEQ ID NO: 68393 - DNA, 15 bp, Homo sapiens
atgtcaacctcagtg

SEQ ID NO: 68394 - DNA, 15 bp, Homo sapiens
catgtcaacctcagt

SEQ ID NO: 68395 - DNA, 15 bp, Homo sapiens
ccatgtcaacctcag

SEQ ID NO: 68396 - DNA, 15 bp, Homo sapiens
tccatgtcaacctca

SEQ ID NO: 68397 - DNA, 15 bp, Homo sapiens
atccatgtcaacctc

SEQ ID NO: 68398 - DNA, 15 bp, Homo sapiens
gatccatgtcaacct

SEQ ID NO: 68399 - DNA, 15 bp, Homo sapiens
agatccatgtcaacc

SEQ ID NO: 68400 - DNA, 15 bp, Homo sapiens
cagatccatgtcaac

SEQ ID NO: 68401 - DNA, 15 bp, Homo sapiens
ccagatccatgtcaa

SEQ ID NO: 68402 - DNA, 15 bp, Homo sapiens
tccagatccatgtca

SEQ ID NO: 68403 - DNA, 15 bp, Homo sapiens
gtccagatccatgtc

SEQ ID NO: 68404 - DNA, 15 bp, Homo sapiens
tgtccagatccatgt

SEQ ID NO: 68405 - DNA, 15 bp, Homo sapiens
ctgtccagatccatg

SEQ ID NO: 68406 - DNA, 15 bp, Homo sapiens
gctgtccagatccat

SEQ ID NO: 68407 - DNA, 15 bp, Homo sapiens
agctgtccagatcca

SEQ ID NO: 68408 - DNA, 15 bp, Homo sapiens
tagctgtccagatcc

SEQ ID NO: 68409 - DNA, 15 bp, Homo sapiens
atagctgtccagatc

SEQ ID NO: 68410 - DNA, 15 bp, Homo sapiens
gatagctgtccagat

SEQ ID NO: 68411 - DNA, 15 bp, Homo sapiens
tgatagctgtccaga

SEQ ID NO: 68412 - DNA, 15 bp, Homo sapiens
ctgatagctgtccag

SEQ ID NO: 68413 - DNA, 15 bp, Homo sapiens
tctgatagctgtcca

SEQ ID NO: 68414 - DNA, 15 bp, Homo sapiens
atctgatagctgtcc

SEQ ID NO: 68415 - DNA, 15 bp, Homo sapiens
aatctgatagctgtc

SEQ ID NO: 68416 - DNA, 15 bp, Homo sapiens
caatctgatagctgt

SEQ ID NO: 68417 - DNA, 15 bp, Homo sapiens
gcaatctgatagctg

SEQ ID NO: 68418 - DNA, 15 bp, Homo sapiens
cgcaatctgatagct

SEQ ID NO: 68419 - DNA, 15 bp, Homo sapiens
acgcaatctgatagc

SEQ ID NO: 68420 - DNA, 15 bp, Homo sapiens
aacgcaatctgatag

SEQ ID NO: 68421 - DNA, 15 bp, Homo sapiens
caacgcaatctgata

SEQ ID NO: 68422 - DNA, 15 bp, Homo sapiens
ccaacgcaatctgat

SEQ ID NO: 68423 - DNA, 15 bp, Homo sapiens
tccaacgcaatctga

SEQ ID NO: 68424 - DNA, 15 bp, Homo sapiens
ctccaacgcaatctg

SEQ ID NO: 68425 - DNA, 15 bp, Homo sapiens
cctccaacgcaatct

SEQ ID NO: 68426 - DNA, 15 bp, Homo sapiens
tcctccaacgcaatc

SEQ ID NO: 68427 - DNA, 15 bp, Homo sapiens
ttcctccaacgcaat

SEQ ID NO: 68428 - DNA, 15 bp, Homo sapiens
cttcctccaacgcaa

SEQ ID NO: 68429 - DNA, 15 bp, Homo sapiens
acttcctccaacgca

SEQ ID NO: 68430 - DNA, 15 bp, Homo sapiens
cacttcctccaacgc

SEQ ID NO: 68431 - DNA, 15 bp, Homo sapiens
gcacttcctccaacg

SEQ ID NO: 68432 - DNA, 15 bp, Homo sapiens
agcacttcctccaac

SEQ ID NO: 68433 - DNA, 15 bp, Homo sapiens
cagcacttcctccaa

SEQ ID NO: 68434 - DNA, 15 bp, Homo sapiens
tcagcacttcctcca

SEQ ID NO: 68435 - DNA, 15 bp, Homo sapiens
gtcagcacttcctcc

SEQ ID NO: 68436 - DNA, 15 bp, Homo sapiens
ggtcagcacttcctc

SEQ ID NO: 68437 - DNA, 15 bp, Homo sapiens
aggtcagcacttcct

SEQ ID NO: 68438 - DNA, 15 bp, Homo sapiens
caggtcagcacttcc

SEQ ID NO: 68439 - DNA, 15 bp, Homo sapiens
ccaggtcagcacttc

SEQ ID NO: 68440 - DNA, 15 bp, Homo sapiens
accaggtcagcactt

SEQ ID NO: 68441 - DNA, 15 bp, Homo sapiens
aaccaggtcagcact

SEQ ID NO: 68442 - DNA, 15 bp, Homo sapiens
caaccaggtcagcac

SEQ ID NO: 68443 - DNA, 15 bp, Homo sapiens
gcaaccaggtcagca

SEQ ID NO: 68444 - DNA, 15 bp, Homo sapiens
agcaaccaggtcagc

SEQ ID NO: 68445 - DNA, 15 bp, Homo sapiens
aagcaaccaggtcag

SEQ ID NO: 68446 - DNA, 15 bp, Homo sapiens
aaagcaaccaggtca

SEQ ID NO: 68447 - DNA, 15 bp, Homo sapiens
gaaagcaaccaggtc

SEQ ID NO: 68448 - DNA, 15 bp, Homo sapiens
agaaagcaaccaggt

SEQ ID NO: 68449 - DNA, 15 bp, Homo sapiens
cagaaagcaaccagg

SEQ ID NO: 68450 - DNA, 15 bp, Homo sapiens
gcagaaagcaaccag

SEQ ID NO: 68451 - DNA, 15 bp, Homo sapiens
agcagaaagcaacca

SEQ ID NO: 68452 - DNA, 15 bp, Homo sapiens
cagcagaaagcaacc

SEQ ID NO: 68453 - DNA, 15 bp, Homo sapiens
tcagcagaaagcaac

SEQ ID NO: 68454 - DNA, 15 bp, Homo sapiens
ctcagcagaaagcaa

SEQ ID NO: 68455 - DNA, 15 bp, Homo sapiens
cctcagcagaaagca

SEQ ID NO: 68456 - DNA, 15 bp, Homo sapiens
tcctcagcagaaagc

SEQ ID NO: 68457 - DNA, 15 bp, Homo sapiens
gtcctcagcagaaag

SEQ ID NO: 68458 - DNA, 15 bp, Homo sapiens
tgtcctcagcagaaa

SEQ ID NO: 68459 - DNA, 15 bp, Homo sapiens
gtgtcctcagcagaa

SEQ ID NO: 68460 - DNA, 15 bp, Homo sapiens
agtgtcctcagcaga

SEQ ID NO: 68461 - DNA, 15 bp, Homo sapiens
aagtgtcctcagcag

SEQ ID NO: 68462 - DNA, 15 bp, Homo sapiens
aaagtgtcctcagca

SEQ ID NO: 68463 - DNA, 15 bp, Homo sapiens
gaaagtgtcctcagc

SEQ ID NO: 68464 - DNA, 15 bp, Homo sapiens
ggaaagtgtcctcag

SEQ ID NO: 68465 - DNA, 15 bp, Homo sapiens
tggaaagtgtcctca

SEQ ID NO: 68466 - DNA, 15 bp, Homo sapiens
ctggaaagtgtcctc

SEQ ID NO: 68467 - DNA, 15 bp, Homo sapiens
cctggaaagtgtcct

SEQ ID NO: 68468 - DNA, 15 bp, Homo sapiens
tcctggaaagtgtcc

SEQ ID NO: 68469 - DNA, 15 bp, Homo sapiens
ctcctggaaagtgtc

SEQ ID NO: 68470 - DNA, 15 bp, Homo sapiens
gctcctggaaagtgt

SEQ ID NO: 68471 - DNA, 15 bp, Homo sapiens
tgctcctggaaagtg

SEQ ID NO: 68472 - DNA, 15 bp, Homo sapiens
ctgctcctggaaagt

SEQ ID NO: 68473 - DNA, 15 bp, Homo sapiens
cctgctcctggaaag

SEQ ID NO: 68474 - DNA, 15 bp, Homo sapiens
tcctgctcctggaaa

SEQ ID NO: 68475 - DNA, 15 bp, Homo sapiens
atcctgctcctggaa

SEQ ID NO: 68476 - DNA, 15 bp, Homo sapiens
catcctgctcctgga

SEQ ID NO: 68477 - DNA, 15 bp, Homo sapiens
tcatcctgctcctgg

SEQ ID NO: 68478 - DNA, 15 bp, Homo sapiens
atcatcctgctcctg

SEQ ID NO: 68479 - DNA, 15 bp, Homo sapiens
tatcatcctgctcct

SEQ ID NO: 68480 - DNA, 15 bp, Homo sapiens
atatcatcctgctcc

SEQ ID NO: 68481 - DNA, 15 bp, Homo sapiens
aatatcatcctgctc

SEQ ID NO: 68482 - DNA, 15 bp, Homo sapiens
aaatatcatcctgct

SEQ ID NO: 68483 - DNA, 15 bp, Homo sapiens
gaaatatcatcctgc

SEQ ID NO: 68484 - DNA, 15 bp, Homo sapiens
agaaatatcatcctg

SEQ ID NO: 68485 - DNA, 15 bp, Homo sapiens
cagaaatatcatcct

SEQ ID NO: 68486 - DNA, 15 bp, Homo sapiens
tcagaaatatcatcc

SEQ ID NO: 68487 - DNA, 15 bp, Homo sapiens
atcagaaatatcatc

SEQ ID NO: 68488 - DNA, 15 bp, Homo sapiens
catcagaaatatcat

SEQ ID NO: 68489 - DNA, 15 bp, Homo sapiens
tcatcagaaatatca

SEQ ID NO: 68490 - DNA, 15 bp, Homo sapiens
atcatcagaaatatc

SEQ ID NO: 68491 - DNA, 15 bp, Homo sapiens
catcatcagaaatat

SEQ ID NO: 68492 - DNA, 15 bp, Homo sapiens
acatcatcagaaata

SEQ ID NO: 68493 - DNA, 15 bp, Homo sapiens
aacatcatcagaaat

SEQ ID NO: 68494 - DNA, 15 bp, Homo sapiens
caacatcatcagaaa

SEQ ID NO: 68495 - DNA, 15 bp, Homo sapiens
tcaacatcatcagaa

SEQ ID NO: 68496 - DNA, 15 bp, Homo sapiens
ttcaacatcatcaga

SEQ ID NO: 68497 - DNA, 15 bp, Homo sapiens
cttcaacatcatcag

SEQ ID NO: 68498 - DNA, 15 bp, Homo sapiens
tcttcaacatcatca

SEQ ID NO: 68499 - DNA, 15 bp, Homo sapiens
ttcttcaacatcatc

SEQ ID NO: 68500 - DNA, 15 bp, Homo sapiens
cttcttcaacatcat

SEQ ID NO: 68501 - DNA, 15 bp, Homo sapiens
acttcttcaacatca

SEQ ID NO: 68502 - DNA, 15 bp, Homo sapiens
gacttcttcaacatc

SEQ ID NO: 68503 - DNA, 15 bp, Homo sapiens
tgacttcttcaacat

SEQ ID NO: 68504 - DNA, 15 bp, Homo sapiens
ttgacttcttcaaca

SEQ ID NO: 68505 - DNA, 15 bp, Homo sapiens
tttgacttcttcaac

SEQ ID NO: 68506 - DNA, 15 bp, Homo sapiens
ctttgacttcttcaa

SEQ ID NO: 68507 - DNA, 15 bp, Homo sapiens
tctttgacttcttca

SEQ ID NO: 68508 - DNA, 15 bp, Homo sapiens
gtctttgacttcttc

SEQ ID NO: 68509 - DNA, 15 bp, Homo sapiens
ggtctttgacttctt

SEQ ID NO: 68510 - DNA, 15 bp, Homo sapiens
tggtctttgacttct

SEQ ID NO: 68511 - DNA, 15 bp, Homo sapiens
ctggtctttgacttc

SEQ ID NO: 68512 - DNA, 15 bp, Homo sapiens
actggtctttgactt

SEQ ID NO: 68513 - DNA, 15 bp, Homo sapiens
aactggtctttgact

SEQ ID NO: 68514 - DNA, 15 bp, Homo sapiens
aaactggtctttgac

SEQ ID NO: 68515 - DNA, 15 bp, Homo sapiens
caaactggtctttga

SEQ ID NO: 68516 - DNA, 15 bp, Homo sapiens
gcaaactggtctttg

SEQ ID NO: 68517 - DNA, 15 bp, Homo sapiens
tgcaaactggtcttt

SEQ ID NO: 68518 - DNA, 15 bp, Homo sapiens
ttgcaaactggtctt

SEQ ID NO: 68519 - DNA, 15 bp, Homo sapiens
gttgcaaactggtct

SEQ ID NO: 68520 - DNA, 15 bp, Homo sapiens
ggttgcaaactggtc

SEQ ID NO: 68521 - DNA, 15 bp, Homo sapiens
gggttgcaaactggt

SEQ ID NO: 68522 - DNA, 15 bp, Homo sapiens
tgggttgcaaactgg

SEQ ID NO: 68523 - DNA, 15 bp, Homo sapiens
atgggttgcaaactg

SEQ ID NO: 68524 - DNA, 15 bp, Homo sapiens
catgggttgcaaact

SEQ ID NO: 68525 - DNA, 15 bp, Homo sapiens
tcatgggttgcaaac

SEQ ID NO: 68526 - DNA, 15 bp, Homo sapiens
ttcatgggttgcaaa

SEQ ID NO: 68527 - DNA, 15 bp, Homo sapiens
cttcatgggttgcaa

SEQ ID NO: 68528 - DNA, 15 bp, Homo sapiens
acttcatgggttgca

SEQ ID NO: 68529 - DNA, 15 bp, Homo sapiens
tacttcatgggttgc

SEQ ID NO: 68530 - DNA, 15 bp, Homo sapiens
ttacttcatgggttg

SEQ ID NO: 68531 - DNA, 15 bp, Homo sapiens
tttacttcatgggtt

SEQ ID NO: 68532 - DNA, 15 bp, Homo sapiens
atttacttcatgggt

SEQ ID NO: 68533 - DNA, 15 bp, Homo sapiens
tatttacttcatggg

SEQ ID NO: 68534 - DNA, 15 bp, Homo sapiens
atatttacttcatgg

SEQ ID NO: 68535 - DNA, 15 bp, Homo sapiens
gatatttacttcatg

SEQ ID NO: 68536 - DNA, 15 bp, Homo sapiens
agatatttacttcat

SEQ ID NO: 68537 - DNA, 15 bp, Homo sapiens
cagatatttacttca

SEQ ID NO: 68538 - DNA, 15 bp, Homo sapiens
acagatatttacttc

SEQ ID NO: 68539 - DNA, 15 bp, Homo sapiens
tacagatatttactt

SEQ ID NO: 68540 - DNA, 15 bp, Homo sapiens
ctacagatatttact

SEQ ID NO: 68541 - DNA, 15 bp, Homo sapiens
actacagatatttac

SEQ ID NO: 68542 - DNA, 15 bp, Homo sapiens
aactacagatattta

SEQ ID NO: 68543 - DNA, 15 bp, Homo sapiens
aaactacagatattt

SEQ ID NO: 68544 - DNA, 15 bp, Homo sapiens
gaaactacagatatt

SEQ ID NO: 68545 - DNA, 15 bp, Homo sapiens
agaaactacagatat

SEQ ID NO: 68546 - DNA, 15 bp, Homo sapiens
aagaaactacagata

SEQ ID NO: 68547 - DNA, 15 bp, Homo sapiens
taagaaactacagat

SEQ ID NO: 68548 - DNA, 15 bp, Homo sapiens
ctaagaaactacaga

SEQ ID NO: 68549 - DNA, 15 bp, Homo sapiens
gctaagaaactacag

SEQ ID NO: 68550 - DNA, 15 bp, Homo sapiens
tgctaagaaactaca

SEQ ID NO: 68551 - DNA, 15 bp, Homo sapiens
ctgctaagaaactac

SEQ ID NO: 68552 - DNA, 15 bp, Homo sapiens
cctgctaagaaacta

SEQ ID NO: 68553 - DNA, 15 bp, Homo sapiens
ccctgctaagaaact

SEQ ID NO: 68554 - DNA, 15 bp, Homo sapiens
accctgctaagaaac

SEQ ID NO: 68555 - DNA, 15 bp, Homo sapiens
caccctgctaagaaa

SEQ ID NO: 68556 - DNA, 15 bp, Homo sapiens
acaccctgctaagaa

SEQ ID NO: 68557 - DNA, 15 bp, Homo sapiens
cacaccctgctaaga

SEQ ID NO: 68558 - DNA, 15 bp, Homo sapiens
acacaccctgctaag

SEQ ID NO: 68559 - DNA, 15 bp, Homo sapiens
gacacaccctgctaa

SEQ ID NO: 68560 - DNA, 15 bp, Homo sapiens
ggacacaccctgcta

SEQ ID NO: 68561 - DNA, 15 bp, Homo sapiens
gggacacaccctgct

SEQ ID NO: 68562 - DNA, 15 bp, Homo sapiens
ggggacacaccctgc

SEQ ID NO: 68563 - DNA, 15 bp, Homo sapiens
gggggacacaccctg

SEQ ID NO: 68564 - DNA, 15 bp, Homo sapiens
tgggggacacaccct

SEQ ID NO: 68565 - DNA, 15 bp, Homo sapiens
gtgggggacacaccc

SEQ ID NO: 68566 - DNA, 15 bp, Homo sapiens
cgtgggggacacacc

SEQ ID NO: 68567 - DNA, 15 bp, Homo sapiens
ccgtgggggacacac

SEQ ID NO: 68568 - DNA, 15 bp, Homo sapiens
cccgtgggggacaca

SEQ ID NO: 68569 - DNA, 15 bp, Homo sapiens
tcccgtgggggacac

SEQ ID NO: 68570 - DNA, 15 bp, Homo sapiens
gtcccgtgggggaca

SEQ ID NO: 68571 - DNA, 15 bp, Homo sapiens
ggtcccgtgggggac

SEQ ID NO: 68572 - DNA, 15 bp, Homo sapiens
aggtcccgtggggga

SEQ ID NO: 68573 - DNA, 15 bp, Homo sapiens
caggtcccgtggggg

SEQ ID NO: 68574 - DNA, 15 bp, Homo sapiens
tcaggtcccgtgggg

SEQ ID NO: 68575 - DNA, 15 bp, Homo sapiens
ctcaggtcccgtggg

SEQ ID NO: 68576 - DNA, 15 bp, Homo sapiens
gctcaggtcccgtgg

SEQ ID NO: 68577 - DNA, 15 bp, Homo sapiens
ggctcaggtcccgtg

SEQ ID NO: 68578 - DNA, 15 bp, Homo sapiens
aggctcaggtcccgt

SEQ ID NO: 68579 - DNA, 15 bp, Homo sapiens
aaggctcaggtcccg

SEQ ID NO: 68580 - DNA, 15 bp, Homo sapiens
taaggctcaggtccc

SEQ ID NO: 68581 - DNA, 15 bp, Homo sapiens
ttaaggctcaggtcc

SEQ ID NO: 68582 - DNA, 15 bp, Homo sapiens
attaaggctcaggtc

SEQ ID NO: 68583 - DNA, 15 bp, Homo sapiens
gattaaggctcaggt

SEQ ID NO: 68584 - DNA, 15 bp, Homo sapiens
tgattaaggctcagg

SEQ ID NO: 68585 - DNA, 15 bp, Homo sapiens
ctgattaaggctcag

SEQ ID NO: 68586 - DNA, 15 bp, Homo sapiens
cctgattaaggctca

SEQ ID NO: 68587 - DNA, 15 bp, Homo sapiens
ccctgattaaggctc

SEQ ID NO: 68588 - DNA, 15 bp, Homo sapiens
tccctgattaaggct

SEQ ID NO: 68589 - DNA, 15 bp, Homo sapiens
gtccctgattaaggc

SEQ ID NO: 68590 - DNA, 15 bp, Homo sapiens
agtccctgattaagg

SEQ ID NO: 68591 - DNA, 15 bp, Homo sapiens
gagtccctgattaag

SEQ ID NO: 68592 - DNA, 15 bp, Homo sapiens
agagtccctgattaa

SEQ ID NO: 68593 - DNA, 15 bp, Homo sapiens
tagagtccctgatta

SEQ ID NO: 68594 - DNA, 15 bp, Homo sapiens
gtagagtccctgatt

SEQ ID NO: 68595 - DNA, 15 bp, Homo sapiens
agtagagtccctgat

SEQ ID NO: 68596 - DNA, 15 bp, Homo sapiens
gagtagagtccctga

SEQ ID NO: 68597 - DNA, 15 bp, Homo sapiens
agagtagagtccctg

SEQ ID NO: 68598 - DNA, 15 bp, Homo sapiens
gagagtagagtccct

SEQ ID NO: 68599 - DNA, 15 bp, Homo sapiens
ggagagtagagtccc

SEQ ID NO: 68600 - DNA, 15 bp, Homo sapiens
aggagagtagagtcc

SEQ ID NO: 68601 - DNA, 15 bp, Homo sapiens
taggagagtagagtc

SEQ ID NO: 68602 - DNA, 15 bp, Homo sapiens
ataggagagtagagt

SEQ ID NO: 68603 - DNA, 15 bp, Homo sapiens
aataggagagtagag

SEQ ID NO: 68604 - DNA, 15 bp, Homo sapiens
aaataggagagtaga

SEQ ID NO: 68605 - DNA, 15 bp, Homo sapiens
caaataggagagtag

SEQ ID NO: 68606 - DNA, 15 bp, Homo sapiens
acaaataggagagta

SEQ ID NO: 68607 - DNA, 15 bp, Homo sapiens
aacaaataggagagt

SEQ ID NO: 68608 - DNA, 15 bp, Homo sapiens
taacaaataggagag

SEQ ID NO: 68609 - DNA, 15 bp, Homo sapiens
ataacaaataggaga

SEQ ID NO: 68610 - DNA, 15 bp, Homo sapiens
gataacaaataggag

SEQ ID NO: 68611 - DNA, 15 bp, Homo sapiens
agataacaaatagga

SEQ ID NO: 68612 - DNA, 15 bp, Homo sapiens
tagataacaaatagg

SEQ ID NO: 68613 - DNA, 15 bp, Homo sapiens
gtagataacaaatag

SEQ ID NO: 68614 - DNA, 15 bp, Homo sapiens
agtagataacaaata

SEQ ID NO: 68615 - DNA, 15 bp, Homo sapiens
cagtagataacaaat

SEQ ID NO: 68616 - DNA, 15 bp, Homo sapiens
tcagtagataacaaa

SEQ ID NO: 68617 - DNA, 15 bp, Homo sapiens
ttcagtagataacaa

SEQ ID NO: 68618 - DNA, 15 bp, Homo sapiens
attcagtagataaca

SEQ ID NO: 68619 - DNA, 15 bp, Homo sapiens
aattcagtagataac

SEQ ID NO: 68620 - DNA, 15 bp, Homo sapiens
gaattcagtagataa

SEQ ID NO: 68621 - DNA, 15 bp, Homo sapiens
agaattcagtagata

SEQ ID NO: 68622 - DNA, 15 bp, Homo sapiens
cagaattcagtagat

SEQ ID NO: 68623 - DNA, 15 bp, Homo sapiens
acagaattcagtaga

SEQ ID NO: 68624 - DNA, 15 bp, Homo sapiens
aacagaattcagtag

SEQ ID NO: 68625 - DNA, 15 bp, Homo sapiens
gaacagaattcagta

SEQ ID NO: 68626 - DNA, 15 bp, Homo sapiens
agaacagaattcagt

SEQ ID NO: 68627 - DNA, 15 bp, Homo sapiens
aagaacagaattcag

SEQ ID NO: 68628 - DNA, 15 bp, Homo sapiens
aaagaacagaattca

SEQ ID NO: 68629 - DNA, 15 bp, Homo sapiens
caaagaacagaattc

SEQ ID NO: 68630 - DNA, 15 bp, Homo sapiens
ccaaagaacagaatt

SEQ ID NO: 68631 - DNA, 15 bp, Homo sapiens
tccaaagaacagaat

SEQ ID NO: 68632 - DNA, 15 bp, Homo sapiens
ttccaaagaacagaa

SEQ ID NO: 68633 - DNA, 15 bp, Homo sapiens
tttccaaagaacaga

SEQ ID NO: 68634 - DNA, 15 bp, Homo sapiens
ctttccaaagaacag

SEQ ID NO: 68635 - DNA, 15 bp, Homo sapiens
cctttccaaagaaca

SEQ ID NO: 68636 - DNA, 15 bp, Homo sapiens
acctttccaaagaac

SEQ ID NO: 68637 - DNA, 15 bp, Homo sapiens
gacctttccaaagaa

SEQ ID NO: 68638 - DNA, 15 bp, Homo sapiens
tgacctttccaaaga

SEQ ID NO: 68639 - DNA, 15 bp, Homo sapiens
ttgacctttccaaag

SEQ ID NO: 68640 - DNA, 15 bp, Homo sapiens
attgacctttccaaa

SEQ ID NO: 68641 - DNA, 15 bp, Homo sapiens
cattgacctttccaa

SEQ ID NO: 68642 - DNA, 15 bp, Homo sapiens
ccattgacctttcca

SEQ ID NO: 68643 - DNA, 15 bp, Homo sapiens
accattgacctttcc

SEQ ID NO: 68644 - DNA, 15 bp, Homo sapiens
aaccattgacctttc

SEQ ID NO: 68645 - DNA, 15 bp, Homo sapiens
aaaccattgaccttt

SEQ ID NO: 68646 - DNA, 15 bp, Homo sapiens
taaaccattgacctt

SEQ ID NO: 68647 - DNA, 15 bp, Homo sapiens
ataaaccattgacct

SEQ ID NO: 68648 - DNA, 15 bp, Homo sapiens
aataaaccattgacc

SEQ ID NO: 68649 - DNA, 15 bp, Homo sapiens
aaataaaccattgac

SEQ ID NO: 68650 - DNA, 15 bp, Homo sapiens
gaaataaaccattga

SEQ ID NO: 68651 - DNA, 15 bp, Homo sapiens
tgaaataaaccattg

SEQ ID NO: 68652 - DNA, 15 bp, Homo sapiens
ctgaaataaaccatt

SEQ ID NO: 68653 - DNA, 15 bp, Homo sapiens
cctgaaataaaccat

SEQ ID NO: 68654 - DNA, 15 bp, Homo sapiens
tcctgaaataaacca

SEQ ID NO: 68655 - DNA, 15 bp, Homo sapiens
ttcctgaaataaacc

SEQ ID NO: 68656 - DNA, 15 bp, Homo sapiens
gttcctgaaataaac

SEQ ID NO: 68657 - DNA, 15 bp, Homo sapiens
agttcctgaaataaa

SEQ ID NO: 68658 - DNA, 15 bp, Homo sapiens
cagttcctgaaataa

SEQ ID NO: 68659 - DNA, 15 bp, Homo sapiens
acagttcctgaaata

SEQ ID NO: 68660 - DNA, 15 bp, Homo sapiens
cacagttcctgaaat

SEQ ID NO: 68661 - DNA, 15 bp, Homo sapiens
tcacagttcctgaaa

SEQ ID NO: 68662 - DNA, 15 bp, Homo sapiens
atcacagttcctgaa

SEQ ID NO: 68663 - DNA, 15 bp, Homo sapiens
tatcacagttcctga

SEQ ID NO: 68664 - DNA, 15 bp, Homo sapiens
atatcacagttcctg

SEQ ID NO: 68665 - DNA, 15 bp, Homo sapiens
aatatcacagttcct

SEQ ID NO: 68666 - DNA, 15 bp, Homo sapiens
aaatatcacagttcc

SEQ ID NO: 68667 - DNA, 15 bp, Homo sapiens
taaatatcacagttc

SEQ ID NO: 68668 - DNA, 15 bp, Homo sapiens
ttaaatatcacagtt

SEQ ID NO: 68669 - DNA, 15 bp, Homo sapiens
tttaaatatcacagt

SEQ ID NO: 68670 - DNA, 15 bp, Homo sapiens
atttaaatatcacag

SEQ ID NO: 68671 - DNA, 15 bp, Homo sapiens
tatttaaatatcaca

SEQ ID NO: 68672 - DNA, 15 bp, Homo sapiens
ctatttaaatatcac

SEQ ID NO: 68673 - DNA, 15 bp, Homo sapiens
actatttaaatatca

SEQ ID NO: 68674 - DNA, 15 bp, Homo sapiens
cactatttaaatatc

SEQ ID NO: 68675 - DNA, 15 bp, Homo sapiens
gcactatttaaatat

SEQ ID NO: 68676 - DNA, 15 bp, Homo sapiens
agcactatttaaata

SEQ ID NO: 68677 - DNA, 15 bp, Homo sapiens
aagcactatttaaat

SEQ ID NO: 68678 - DNA, 15 bp, Homo sapiens
aaagcactatttaaa

SEQ ID NO: 68679 - DNA, 15 bp, Homo sapiens
caaagcactatttaa

SEQ ID NO: 68680 - DNA, 15 bp, Homo sapiens
acaaagcactattta

SEQ ID NO: 68681 - DNA, 15 bp, Homo sapiens
gacaaagcactattt

SEQ ID NO: 68682 - DNA, 15 bp, Homo sapiens
tgacaaagcactatt

SEQ ID NO: 68683 - DNA, 15 bp, Homo sapiens
gtgacaaagcactat

SEQ ID NO: 68684 - DNA, 15 bp, Homo sapiens
tgtgacaaagcacta

SEQ ID NO: 68685 - DNA, 15 bp, Homo sapiens
ttgtgacaaagcact

SEQ ID NO: 68686 - DNA, 15 bp, Homo sapiens
tttgtgacaaagcac

SEQ ID NO: 68687 - DNA, 15 bp, Homo sapiens
ttttgtgacaaagca

SEQ ID NO: 68688 - DNA, 15 bp, Homo sapiens
attttgtgacaaagc

SEQ ID NO: 68689 - DNA, 15 bp, Homo sapiens
aattttgtgacaaag

SEQ ID NO: 68690 - DNA, 15 bp, Homo sapiens
caattttgtgacaaa

SEQ ID NO: 68691 - DNA, 15 bp, Homo sapiens
ccaattttgtgacaa

SEQ ID NO: 68692 - DNA, 15 bp, Homo sapiens
accaattttgtgaca

SEQ ID NO: 68693 - DNA, 15 bp, Homo sapiens
taccaattttgtgac

SEQ ID NO: 68694 - DNA, 15 bp, Homo sapiens
ataccaattttgtga

SEQ ID NO: 68695 - DNA, 15 bp, Homo sapiens
cataccaattttgtg

SEQ ID NO: 68696 - DNA, 15 bp, Homo sapiens
ccataccaattttgt

SEQ ID NO: 68697 - DNA, 15 bp, Homo sapiens
cccataccaattttg

SEQ ID NO: 68698 - DNA, 15 bp, Homo sapiens
acccataccaatttt

SEQ ID NO: 68699 - DNA, 15 bp, Homo sapiens
cacccataccaattt

SEQ ID NO: 68700 - DNA, 15 bp, Homo sapiens
tcacccataccaatt

SEQ ID NO: 68701 - DNA, 15 bp, Homo sapiens
atcacccataccaat

SEQ ID NO: 68702 - DNA, 15 bp, Homo sapiens
aatcacccataccaa

SEQ ID NO: 68703 - DNA, 15 bp, Homo sapiens
taatcacccatacca

SEQ ID NO: 68704 - DNA, 15 bp, Homo sapiens
ttaatcacccatacc

SEQ ID NO: 68705 - DNA, 15 bp, Homo sapiens
tttaatcacccatac

SEQ ID NO: 68706 - DNA, 15 bp, Homo sapiens
gtttaatcacccata

SEQ ID NO: 68707 - DNA, 15 bp, Homo sapiens
agtttaatcacccat

SEQ ID NO: 68708 - DNA, 15 bp, Homo sapiens
cagtttaatcaccca

SEQ ID NO: 68709 - DNA, 15 bp, Homo sapiens
acagtttaatcaccc

SEQ ID NO: 68710 - DNA, 15 bp, Homo sapiens
cacagtttaatcacc

SEQ ID NO: 68711 - DNA, 15 bp, Homo sapiens
gcacagtttaatcac

SEQ ID NO: 68712 - DNA, 15 bp, Homo sapiens
ggcacagtttaatca

SEQ ID NO: 68713 - DNA, 15 bp, Homo sapiens
aggcacagtttaatc

SEQ ID NO: 68714 - DNA, 15 bp, Homo sapiens
gaggcacagtttaat

SEQ ID NO: 68715 - DNA, 15 bp, Homo sapiens
tgaggcacagtttaa

SEQ ID NO: 68716 - DNA, 15 bp, Homo sapiens
ctgaggcacagttta

SEQ ID NO: 68717 - DNA, 15 bp, Homo sapiens
tctgaggcacagttt

SEQ ID NO: 68718 - DNA, 15 bp, Homo sapiens
ttctgaggcacagtt

SEQ ID NO: 68719 - DNA, 15 bp, Homo sapiens
attctgaggcacagt

SEQ ID NO: 68720 - DNA, 15 bp, Homo sapiens
ctaattctgaggcac

SEQ ID NO: 68721 - DNA, 15 bp, Homo sapiens
tctaattctgaggca

SEQ ID NO: 68722 - DNA, 15 bp, Homo sapiens
atctaattctgaggc

SEQ ID NO: 68723 - DNA, 15 bp, Homo sapiens
aatctaattctgagg

SEQ ID NO: 68724 - DNA, 15 bp, Homo sapiens
aaatctaattctgag

SEQ ID NO: 68725 - DNA, 15 bp, Homo sapiens
aaaatctaattctga

SEQ ID NO: 68726 - DNA, 15 bp, Homo sapiens
taaaatctaattctg

SEQ ID NO: 68727 - DNA, 15 bp, Homo sapiens
ctaaaatctaattct

SEQ ID NO: 68728 - DNA, 15 bp, Homo sapiens
tctaaaatctaattc

SEQ ID NO: 68729 - DNA, 15 bp, Homo sapiens
atctaaaatctaatt

SEQ ID NO: 68730 - DNA, 15 bp, Homo sapiens
aatctaaaatctaat

SEQ ID NO: 68731 - DNA, 15 bp, Homo sapiens
aaatctaaaatctaa

SEQ ID NO: 68732 - DNA, 15 bp, Homo sapiens
aaaatctaaaatcta

SEQ ID NO: 68733 - DNA, 15 bp, Homo sapiens
taaaatctaaaatct

SEQ ID NO: 68734 - DNA, 15 bp, Homo sapiens
ctaaaatctaaaatc

SEQ ID NO: 68735 - DNA, 15 bp, Homo sapiens
actaaaatctaaaat

SEQ ID NO: 68736 - DNA, 15 bp, Homo sapiens
gactaaaatctaaaa

SEQ ID NO: 68737 - DNA, 15 bp, Homo sapiens
agactaaaatctaaa

SEQ ID NO: 68738 - DNA, 15 bp, Homo sapiens
gagactaaaatctaa

SEQ ID NO: 68739 - DNA, 15 bp, Homo sapiens
ggagactaaaatcta

SEQ ID NO: 68740 - DNA, 15 bp, Homo sapiens
aggagactaaaatct

SEQ ID NO: 68741 - DNA, 15 bp, Homo sapiens
aaggagactaaaatc

SEQ ID NO: 68742 - DNA, 15 bp, Homo sapiens
caaggagactaaaat

SEQ ID NO: 68743 - DNA, 15 bp, Homo sapiens
acaaggagactaaaa

SEQ ID NO: 68744 - DNA, 15 bp, Homo sapiens
cacaaggagactaaa

SEQ ID NO: 68745 - DNA, 15 bp, Homo sapiens
acacaaggagactaa

SEQ ID NO: 68746 - DNA, 15 bp, Homo sapiens
cacacaaggagacta

SEQ ID NO: 68747 - DNA, 15 bp, Homo sapiens
acacacaaggagact

SEQ ID NO: 68748 - DNA, 15 bp, Homo sapiens
aacacacaaggagac

SEQ ID NO: 68749 - DNA, 15 bp, Homo sapiens
aaacacacaaggaga

SEQ ID NO: 68750 - DNA, 15 bp, Homo sapiens
aaaacacacaaggag

SEQ ID NO: 68751 - DNA, 15 bp, Homo sapiens
caaaacacacaagga

SEQ ID NO: 68752 - DNA, 15 bp, Homo sapiens
ccaaaacacacaagg

SEQ ID NO: 68753 - DNA, 15 bp, Homo sapiens
tccaaaacacacaag

SEQ ID NO: 68754 - DNA, 15 bp, Homo sapiens
ctccaaaacacacaa

SEQ ID NO: 68755 - DNA, 15 bp, Homo sapiens
tctccaaaacacaca

SEQ ID NO: 68756 - DNA, 15 bp, Homo sapiens
ctctccaaaacacac

SEQ ID NO: 68757 - DNA, 15 bp, Homo sapiens
gctctccaaaacaca

SEQ ID NO: 68758 - DNA, 15 bp, Homo sapiens
ggctctccaaaacac

SEQ ID NO: 68759 - DNA, 15 bp, Homo sapiens
tggctctccaaaaca

SEQ ID NO: 68760 - DNA, 15 bp, Homo sapiens
gtggctctccaaaac

SEQ ID NO: 68761 - DNA, 15 bp, Homo sapiens
agtggctctccaaaa

SEQ ID NO: 68762 - DNA, 15 bp, Homo sapiens
cagtggctctccaaa

SEQ ID NO: 68763 - DNA, 15 bp, Homo sapiens
tcagtggctctccaa

SEQ ID NO: 68764 - DNA, 15 bp, Homo sapiens
atcagtggctctcca

SEQ ID NO: 68765 - DNA, 15 bp, Homo sapiens
catcagtggctctcc

SEQ ID NO: 68766 - DNA, 15 bp, Homo sapiens
tcatcagtggctctc

SEQ ID NO: 68767 - DNA, 15 bp, Homo sapiens
ttcatcagtggctct

SEQ ID NO: 68768 - DNA, 15 bp, Homo sapiens
tttcatcagtggctc

SEQ ID NO: 68769 - DNA, 15 bp, Homo sapiens
ttttcatcagtggct

SEQ ID NO: 68770 - DNA, 15 bp, Homo sapiens
attttcatcagtggc

SEQ ID NO: 68771 - DNA, 15 bp, Homo sapiens
gattttcatcagtgg

SEQ ID NO: 68772 - DNA, 15 bp, Homo sapiens
tgattttcatcagtg

SEQ ID NO: 68773 - DNA, 15 bp, Homo sapiens
atgattttcatcagt

SEQ ID NO: 68774 - DNA, 15 bp, Homo sapiens
aatgattttcatcag

SEQ ID NO: 68775 - DNA, 15 bp, Homo sapiens
caatgattttcatca

SEQ ID NO: 68776 - DNA, 15 bp, Homo sapiens
gcaatgattttcatc

SEQ ID NO: 68777 - DNA, 15 bp, Homo sapiens
tgcaatgattttcat

SEQ ID NO: 68778 - DNA, 15 bp, Homo sapiens
atgcaatgattttca

SEQ ID NO: 68779 - DNA, 15 bp, Homo sapiens
tatgcaatgattttc

SEQ ID NO: 68780 - DNA, 15 bp, Homo sapiens
ctatgcaatgatttt

SEQ ID NO: 68781 - DNA, 15 bp, Homo sapiens
actatgcaatgattt

SEQ ID NO: 68782 - DNA, 15 bp, Homo sapiens
tactatgcaatgatt

SEQ ID NO: 68783 - DNA, 15 bp, Homo sapiens
gtactatgcaatgat

SEQ ID NO: 68784 - DNA, 15 bp, Homo sapiens
agtactatgcaatga

SEQ ID NO: 68785 - DNA, 15 bp, Homo sapiens
cagtactatgcaatg

SEQ ID NO: 68786 - DNA, 15 bp, Homo sapiens
gcagtactatgcaat

SEQ ID NO: 68787 - DNA, 15 bp, Homo sapiens
agcagtactatgcaa

SEQ ID NO: 68788 - DNA, 15 bp, Homo sapiens
gagcagtactatgca

SEQ ID NO: 68789 - DNA, 15 bp, Homo sapiens
tgagcagtactatgc

SEQ ID NO: 68790 - DNA, 15 bp, Homo sapiens
ctgagcagtactatg

SEQ ID NO: 68791 - DNA, 15 bp, Homo sapiens
actgagcagtactat

SEQ ID NO: 68792 - DNA, 15 bp, Homo sapiens
aactgagcagtacta

SEQ ID NO: 68793 - DNA, 15 bp, Homo sapiens
gaactgagcagtact

SEQ ID NO: 68794 - DNA, 15 bp, Homo sapiens
agaactgagcagtac

SEQ ID NO: 68795 - DNA, 15 bp, Homo sapiens
cagaactgagcagta

SEQ ID NO: 68796 - DNA, 15 bp, Homo sapiens
tcagaactgagcagt

SEQ ID NO: 68797 - DNA, 15 bp, Homo sapiens
ttcagaactgagcag

SEQ ID NO: 68798 - DNA, 15 bp, Homo sapiens
cttcagaactgagca

SEQ ID NO: 68799 - DNA, 15 bp, Homo sapiens
acttcagaactgagc

SEQ ID NO: 68800 - DNA, 15 bp, Homo sapiens
cacttcagaactgag

SEQ ID NO: 68801 - DNA, 15 bp, Homo sapiens
gcacttcagaactga

SEQ ID NO: 68802 - DNA, 15 bp, Homo sapiens
tgcacttcagaactg

SEQ ID NO: 68803 - DNA, 15 bp, Homo sapiens
atgcacttcagaact

SEQ ID NO: 68804 - DNA, 15 bp, Homo sapiens
aatgcacttcagaac

SEQ ID NO: 68805 - DNA, 15 bp, Homo sapiens
caatgcacttcagaa

SEQ ID NO: 68806 - DNA, 15 bp, Homo sapiens
acaatgcacttcaga

SEQ ID NO: 68807 - DNA, 15 bp, Homo sapiens
aacaatgcacttcag

SEQ ID NO: 68808 - DNA, 15 bp, Homo sapiens
taacaatgcacttca

SEQ ID NO: 68809 - DNA, 15 bp, Homo sapiens
ataacaatgcacttc

SEQ ID NO: 68810 - DNA, 15 bp, Homo sapiens
tataacaatgcactt

SEQ ID NO: 68811 - DNA, 15 bp, Homo sapiens
atataacaatgcact

SEQ ID NO: 68812 - DNA, 15 bp, Homo sapiens
aatataacaatgcac

SEQ ID NO: 68813 - DNA, 15 bp, Homo sapiens
aaatataacaatgca

SEQ ID NO: 68814 - DNA, 15 bp, Homo sapiens
gaaatataacaatgc

SEQ ID NO: 68815 - DNA, 15 bp, Homo sapiens
tgaaatataacaatg

SEQ ID NO: 68816 - DNA, 15 bp, Homo sapiens
ttgaaatataacaat

SEQ ID NO: 68817 - DNA, 15 bp, Homo sapiens
tttgaaatataacaa

SEQ ID NO: 68818 - DNA, 15 bp, Homo sapiens
ttttgaaatataaca

SEQ ID NO: 68819 - DNA, 15 bp, Homo sapiens
cttttgaaatataac

SEQ ID NO: 68820 - DNA, 15 bp, Homo sapiens
gcttttgaaatataa

SEQ ID NO: 68821 - DNA, 15 bp, Homo sapiens
tgcttttgaaatata

SEQ ID NO: 68822 - DNA, 15 bp, Homo sapiens
ttgcttttgaaatat

SEQ ID NO: 68823 - DNA, 15 bp, Homo sapiens
tttgcttttgaaata

SEQ ID NO: 68824 - DNA, 15 bp, Homo sapiens
gtttgcttttgaaat

SEQ ID NO: 68825 - DNA, 15 bp, Homo sapiens
cgtttgcttttgaaa

SEQ ID NO: 68826 - DNA, 15 bp, Homo sapiens
tcgtttgcttttgaa

SEQ ID NO: 68827 - DNA, 15 bp, Homo sapiens
ctcgtttgcttttga

SEQ ID NO: 68828 - DNA, 15 bp, Homo sapiens
actcgtttgcttttg

SEQ ID NO: 68829 - DNA, 15 bp, Homo sapiens
cactcgtttgctttt

SEQ ID NO: 68830 - DNA, 15 bp, Homo sapiens
tcactcgtttgcttt

SEQ ID NO: 68831 - DNA, 15 bp, Homo sapiens
ttcactcgtttgctt

SEQ ID NO: 68832 - DNA, 15 bp, Homo sapiens
gttcactcgtttgct

SEQ ID NO: 68833 - DNA, 15 bp, Homo sapiens
ggttcactcgtttgc

SEQ ID NO: 68834 - DNA, 15 bp, Homo sapiens
tggttcactcgtttg

SEQ ID NO: 68835 - DNA, 15 bp, Homo sapiens
ttggttcactcgttt

SEQ ID NO: 68836 - DNA, 15 bp, Homo sapiens
attggttcactcgtt

SEQ ID NO: 68837 - DNA, 15 bp, Homo sapiens
tattggttcactcgt

SEQ ID NO: 68838 - DNA, 15 bp, Homo sapiens
gtattggttcactcg

SEQ ID NO: 68839 - DNA, 15 bp, Homo sapiens
tgtattggttcactc

SEQ ID NO: 68840 - DNA, 15 bp, Homo sapiens
gtgtattggttcact

SEQ ID NO: 68841 - DNA, 15 bp, Homo sapiens
ggtgtattggttcac

SEQ ID NO: 68842 - DNA, 15 bp, Homo sapiens
tggtgtattggttca

SEQ ID NO: 68843 - DNA, 15 bp, Homo sapiens
ttggtgtattggttc

SEQ ID NO: 68844 - DNA, 15 bp, Homo sapiens
tttggtgtattggtt

SEQ ID NO: 68845 - DNA, 15 bp, Homo sapiens
atttggtgtattggt

SEQ ID NO: 68846 - DNA, 15 bp, Homo sapiens
gatttggtgtattgg

SEQ ID NO: 68847 - DNA, 15 bp, Homo sapiens
agatttggtgtattg

SEQ ID NO: 68848 - DNA, 15 bp, Homo sapiens
aagatttggtgtatt

SEQ ID NO: 68849 - DNA, 15 bp, Homo sapiens
aaagatttggtgtat

SEQ ID NO: 68850 - DNA, 15 bp, Homo sapiens
taaagatttggtgta

SEQ ID NO: 68851 - DNA, 15 bp, Homo sapiens
ttaaagatttggtgt

SEQ ID NO: 68852 - DNA, 15 bp, Homo sapiens
cttaaagatttggtg

SEQ ID NO: 68853 - DNA, 15 bp, Homo sapiens
tcttaaagatttggt

SEQ ID NO: 68854 - DNA, 15 bp, Homo sapiens
atcttaaagatttgg

SEQ ID NO: 68855 - DNA, 15 bp, Homo sapiens
aatcttaaagatttg

SEQ ID NO: 68856 - DNA, 15 bp, Homo sapiens
aaatcttaaagattt

SEQ ID NO: 68857 - DNA, 15 bp, Homo sapiens
caaatcttaaagatt

SEQ ID NO: 68858 - DNA, 15 bp, Homo sapiens
tcaaatcttaaagat

SEQ ID NO: 68859 - DNA, 15 bp, Homo sapiens
ctcaaatcttaaaga

SEQ ID NO: 68860 - DNA, 15 bp, Homo sapiens
actcaaatcttaaag

SEQ ID NO: 68861 - DNA, 15 bp, Homo sapiens
cactcaaatcttaaa

SEQ ID NO: 68862 - DNA, 15 bp, Homo sapiens
acactcaaatcttaa

SEQ ID NO: 68863 - DNA, 15 bp, Homo sapiens
aacactcaaatctta

SEQ ID NO: 68864 - DNA, 15 bp, Homo sapiens
gaacactcaaatctt

SEQ ID NO: 68865 - DNA, 15 bp, Homo sapiens
ggaacactcaaatct

SEQ ID NO: 68866 - DNA, 15 bp, Homo sapiens
gggaacactcaaatc

SEQ ID NO: 68867 - DNA, 15 bp, Homo sapiens
agggaacactcaaat

SEQ ID NO: 68868 - DNA, 15 bp, Homo sapiens
tagggaacactcaaa

SEQ ID NO: 68869 - DNA, 15 bp, Homo sapiens
ctagggaacactcaa

SEQ ID NO: 68870 - DNA, 15 bp, Homo sapiens
cctagggaacactca

SEQ ID NO: 68871 - DNA, 15 bp, Homo sapiens
tcctagggaacactc

SEQ ID NO: 68872 - DNA, 15 bp, Homo sapiens
ttcctagggaacact

SEQ ID NO: 68873 - DNA, 15 bp, Homo sapiens
tttcctagggaacac

SEQ ID NO: 68874 - DNA, 15 bp, Homo sapiens
atttcctagggaaca

SEQ ID NO: 68875 - DNA, 15 bp, Homo sapiens
catttcctagggaac

SEQ ID NO: 68876 - DNA, 15 bp, Homo sapiens
tcatttcctagggaa

SEQ ID NO: 68877 - DNA, 15 bp, Homo sapiens
atcatttcctaggga

SEQ ID NO: 68878 - DNA, 15 bp, Homo sapiens
aatcatttcctaggg

SEQ ID NO: 68879 - DNA, 15 bp, Homo sapiens
taatcatttcctagg

SEQ ID NO: 68880 - DNA, 15 bp, Homo sapiens
ataatcatttcctag

SEQ ID NO: 68881 - DNA, 15 bp, Homo sapiens
aataatcatttccta

SEQ ID NO: 68882 - DNA, 15 bp, Homo sapiens
gaataatcatttcct

SEQ ID NO: 68883 - DNA, 15 bp, Homo sapiens
agaataatcatttcc

SEQ ID NO: 68884 - DNA, 15 bp, Homo sapiens
aagaataatcatttc

SEQ ID NO: 68885 - DNA, 15 bp, Homo sapiens
aaagaataatcattt

SEQ ID NO: 68886 - DNA, 15 bp, Homo sapiens
aaaagaataatcatt

SEQ ID NO: 68887 - DNA, 15 bp, Homo sapiens
aaaaagaataatcat

SEQ ID NO: 68888 - DNA, 15 bp, Homo sapiens
taaaaagaataatca

SEQ ID NO: 68889 - DNA, 15 bp, Homo sapiens
ttaaaaagaataatc

SEQ ID NO: 68890 - DNA, 15 bp, Homo sapiens
attaaaaagaataat

SEQ ID NO: 68891 - DNA, 15 bp, Homo sapiens
aattaaaaagaataa

SEQ ID NO: 68892 - DNA, 15 bp, Homo sapiens
caattaaaaagaata

SEQ ID NO: 68893 - DNA, 15 bp, Homo sapiens
gcaattaaaaagaat

SEQ ID NO: 68894 - DNA, 15 bp, Homo sapiens
tgcaattaaaaagaa

SEQ ID NO: 68895 - DNA, 15 bp, Homo sapiens
atgcaattaaaaaga

SEQ ID NO: 68896 - DNA, 15 bp, Homo sapiens
catgcaattaaaaag

SEQ ID NO: 68897 - DNA, 15 bp, Homo sapiens
tcatgcaattaaaaa

SEQ ID NO: 68898 - DNA, 15 bp, Homo sapiens
atcatgcaattaaaa

SEQ ID NO: 68899 - DNA, 15 bp, Homo sapiens
aatcatgcaattaaa

SEQ ID NO: 68900 - DNA, 15 bp, Homo sapiens
taatcatgcaattaa

SEQ ID NO: 68901 - DNA, 15 bp, Homo sapiens
ttaatcatgcaatta

SEQ ID NO: 68902 - DNA, 15 bp, Homo sapiens
cttaatcatgcaatt

SEQ ID NO: 68903 - DNA, 15 bp, Homo sapiens
gcttaatcatgcaat

SEQ ID NO: 68904 - DNA, 15 bp, Homo sapiens
tgcttaatcatgcaa

SEQ ID NO: 68905 - DNA, 15 bp, Homo sapiens
ttgcttaatcatgca

SEQ ID NO: 68906 - DNA, 15 bp, Homo sapiens
tttgcttaatcatgc

SEQ ID NO: 68907 - DNA, 15 bp, Homo sapiens
atttgcttaatcatg

SEQ ID NO: 68908 - DNA, 15 bp, Homo sapiens
catttgcttaatcat

SEQ ID NO: 68909 - DNA, 15 bp, Homo sapiens
acatttgcttaatca

SEQ ID NO: 68910 - DNA, 15 bp, Homo sapiens
gacatttgcttaatc

SEQ ID NO: 68911 - DNA, 15 bp, Homo sapiens
tgacatttgcttaat

SEQ ID NO: 68912 - DNA, 15 bp, Homo sapiens
atgacatttgcttaa

SEQ ID NO: 68913 - DNA, 15 bp, Homo sapiens
tatgacatttgctta

SEQ ID NO: 68914 - DNA, 15 bp, Homo sapiens
gtatgacatttgctt

SEQ ID NO: 68915 - DNA, 15 bp, Homo sapiens
ggtatgacatttgct

SEQ ID NO: 68916 - DNA, 15 bp, Homo sapiens
gggtatgacatttgc

SEQ ID NO: 68917 - DNA, 15 bp, Homo sapiens
tgggtatgacatttg

SEQ ID NO: 68918 - DNA, 15 bp, Homo sapiens
ctgggtatgacattt

SEQ ID NO: 68919 - DNA, 15 bp, Homo sapiens
cctgggtatgacatt

SEQ ID NO: 68920 - DNA, 15 bp, Homo sapiens
ccctgggtatgacat

SEQ ID NO: 68921 - DNA, 15 bp, Homo sapiens
accctgggtatgaca

SEQ ID NO: 68922 - DNA, 15 bp, Homo sapiens
aaccctgggtatgac

SEQ ID NO: 68923 - DNA, 15 bp, Homo sapiens
gaaccctgggtatga

SEQ ID NO: 68924 - DNA, 15 bp, Homo sapiens
ggaaccctgggtatg

SEQ ID NO: 68925 - DNA, 15 bp, Homo sapiens
aggaaccctgggtat

SEQ ID NO: 68926 - DNA, 15 bp, Homo sapiens
caggaaccctgggta

SEQ ID NO: 68927 - DNA, 15 bp, Homo sapiens
acaggaaccctgggt

SEQ ID NO: 68928 - DNA, 15 bp, Homo sapiens
tacaggaaccctggg

SEQ ID NO: 68929 - DNA, 15 bp, Homo sapiens
atacaggaaccctgg

SEQ ID NO: 68930 - DNA, 15 bp, Homo sapiens
aatacaggaaccctg

SEQ ID NO: 68931 - DNA, 15 bp, Homo sapiens
aaatacaggaaccct

SEQ ID NO: 68932 - DNA, 15 bp, Homo sapiens
aaaatacaggaaccc

SEQ ID NO: 68933 - DNA, 15 bp, Homo sapiens
aaaaatacaggaacc

SEQ ID NO: 68934 - DNA, 15 bp, Homo sapiens
aaaaaatacaggaac

SEQ ID NO: 68935 - DNA, 15 bp, Homo sapiens
gaaaaaatacaggaa

SEQ ID NO: 68936 - DNA, 15 bp, Homo sapiens
tgaaaaaatacagga

SEQ ID NO: 68937 - DNA, 15 bp, Homo sapiens
atgaaaaaatacagg

SEQ ID NO: 68938 - DNA, 15 bp, Homo sapiens
tatgaaaaaatacag

SEQ ID NO: 68939 - DNA, 15 bp, Homo sapiens
atatgaaaaaataca

SEQ ID NO: 68940 - DNA, 15 bp, Homo sapiens
gatatgaaaaaatac

SEQ ID NO: 68941 - DNA, 15 bp, Homo sapiens
tgatatgaaaaaata

SEQ ID NO: 68942 - DNA, 15 bp, Homo sapiens
atgatatgaaaaaat

SEQ ID NO: 68943 - DNA, 15 bp, Homo sapiens
tatgatatgaaaaaa

SEQ ID NO: 68944 - DNA, 15 bp, Homo sapiens
ttatgatatgaaaaa

SEQ ID NO: 68945 - DNA, 15 bp, Homo sapiens
tttatgatatgaaaa

SEQ ID NO: 68946 - DNA, 15 bp, Homo sapiens
ttttatgatatgaaa

SEQ ID NO: 68947 - DNA, 15 bp, Homo sapiens
cttttatgatatgaa

SEQ ID NO: 68948 - DNA, 15 bp, Homo sapiens
acttttatgatatga

SEQ ID NO: 68949 - DNA, 15 bp, Homo sapiens
aacttttatgatatg

SEQ ID NO: 68950 - DNA, 15 bp, Homo sapiens
aaacttttatgatat

SEQ ID NO: 68951 - DNA, 15 bp, Homo sapiens
gaaacttttatgata

SEQ ID NO: 68952 - DNA, 15 bp, Homo sapiens
ggaaacttttatgat

SEQ ID NO: 68953 - DNA, 15 bp, Homo sapiens
aggaaacttttatga

SEQ ID NO: 68954 - DNA, 15 bp, Homo sapiens
caggaaacttttatg

SEQ ID NO: 68955 - DNA, 15 bp, Homo sapiens
gcaggaaacttttat

SEQ ID NO: 68956 - DNA, 15 bp, Homo sapiens
agcaggaaactttta

SEQ ID NO: 68957 - DNA, 15 bp, Homo sapiens
gagcaggaaactttt

SEQ ID NO: 68958 - DNA, 15 bp, Homo sapiens
ggagcaggaaacttt

SEQ ID NO: 68959 - DNA, 15 bp, Homo sapiens
aggagcaggaaactt

SEQ ID NO: 68960 - DNA, 15 bp, Homo sapiens
aaggagcaggaaact

SEQ ID NO: 68961 - DNA, 15 bp, Homo sapiens
aaaggagcaggaaac

SEQ ID NO: 68962 - DNA, 15 bp, Homo sapiens
caaaggagcaggaaa

SEQ ID NO: 68963 - DNA, 15 bp, Homo sapiens
tcaaaggagcaggaa

SEQ ID NO: 68964 - DNA, 15 bp, Homo sapiens
ctcaaaggagcagga

SEQ ID NO: 68965 - DNA, 15 bp, Homo sapiens
cctcaaaggagcagg

SEQ ID NO: 68966 - DNA, 15 bp, Homo sapiens
tcctcaaaggagcag

SEQ ID NO: 68967 - DNA, 15 bp, Homo sapiens
gtcctcaaaggagca

SEQ ID NO: 68968 - DNA, 15 bp, Homo sapiens
tgtcctcaaaggagc

SEQ ID NO: 68969 - DNA, 15 bp, Homo sapiens
atgtcctcaaaggag

SEQ ID NO: 68970 - DNA, 15 bp, Homo sapiens
tatgtcctcaaagga

SEQ ID NO: 68971 - DNA, 15 bp, Homo sapiens
gtatgtcctcaaagg

SEQ ID NO: 68972 - DNA, 15 bp, Homo sapiens
agtatgtcctcaaag

SEQ ID NO: 68973 - DNA, 15 bp, Homo sapiens
tagtatgtcctcaaa

SEQ ID NO: 68974 - DNA, 15 bp, Homo sapiens
atagtatgtcctcaa

SEQ ID NO: 68975 - DNA, 15 bp, Homo sapiens
tatagtatgtcctca

SEQ ID NO: 68976 - DNA, 15 bp, Homo sapiens
atatagtatgtcctc

SEQ ID NO: 68977 - DNA, 15 bp, Homo sapiens
aatatagtatgtcct

SEQ ID NO: 68978 - DNA, 15 bp, Homo sapiens
caatatagtatgtcc

SEQ ID NO: 68979 - DNA, 15 bp, Homo sapiens
gcaatatagtatgtc

SEQ ID NO: 68980 - DNA, 15 bp, Homo sapiens
tgcaatatagtatgt

SEQ ID NO: 68981 - DNA, 15 bp, Homo sapiens
ctgcaatatagtatg

SEQ ID NO: 68982 - DNA, 15 bp, Homo sapiens
gctgcaatatagtat

SEQ ID NO: 68983 - DNA, 15 bp, Homo sapiens
tgctgcaatatagta

SEQ ID NO: 68984 - DNA, 15 bp, Homo sapiens
atgctgcaatatagt

SEQ ID NO: 68985 - DNA, 15 bp, Homo sapiens
tatgctgcaatatag

SEQ ID NO: 68986 - DNA, 15 bp, Homo sapiens
ctatgctgcaatata

SEQ ID NO: 68987 - DNA, 15 bp, Homo sapiens
actatgctgcaatat

SEQ ID NO: 68988 - DNA, 15 bp, Homo sapiens
cactatgctgcaata

SEQ ID NO: 68989 - DNA, 15 bp, Homo sapiens
tcactatgctgcaat

SEQ ID NO: 68990 - DNA, 15 bp, Homo sapiens
ttcactatgctgcaa

SEQ ID NO: 68991 - DNA, 15 bp, Homo sapiens
attcactatgctgca

SEQ ID NO: 68992 - DNA, 15 bp, Homo sapiens
aattcactatgctgc

SEQ ID NO: 68993 - DNA, 15 bp, Homo sapiens
aaattcactatgctg

SEQ ID NO: 68994 - DNA, 15 bp, Homo sapiens
gaaattcactatgct

SEQ ID NO: 68995 - DNA, 15 bp, Homo sapiens
tgaaattcactatgc

SEQ ID NO: 68996 - DNA, 15 bp, Homo sapiens
gtgaaattcactatg

SEQ ID NO: 68997 - DNA, 15 bp, Homo sapiens
agtgaaattcactat

SEQ ID NO: 68998 - DNA, 15 bp, Homo sapiens
tagtgaaattcacta

SEQ ID NO: 68999 - DNA, 15 bp, Homo sapiens
atagtgaaattcact

SEQ ID NO: 69000 - DNA, 15 bp, Homo sapiens
tatagtgaaattcac

SEQ ID NO: 69001 - DNA, 15 bp, Homo sapiens
atatagtgaaattca

SEQ ID NO: 69002 - DNA, 15 bp, Homo sapiens
catatagtgaaattc

SEQ ID NO: 69003 - DNA, 15 bp, Homo sapiens
ccatatagtgaaatt

SEQ ID NO: 69004 - DNA, 15 bp, Homo sapiens
tccatatagtgaaat

SEQ ID NO: 69005 - DNA, 15 bp, Homo sapiens
ctccatatagtgaaa

SEQ ID NO: 69006 - DNA, 15 bp, Homo sapiens
tctccatatagtgaa

SEQ ID NO: 69007 - DNA, 15 bp, Homo sapiens
atctccatatagtga

SEQ ID NO: 69008 - DNA, 15 bp, Homo sapiens
aatctccatatagtg

SEQ ID NO: 69009 - DNA, 15 bp, Homo sapiens
aaatctccatatagt

SEQ ID NO: 69010 - DNA, 15 bp, Homo sapiens
gaaatctccatatag

SEQ ID NO: 69011 - DNA, 15 bp, Homo sapiens
agaaatctccatata

SEQ ID NO: 69012 - DNA, 15 bp, Homo sapiens
aagaaatctccatat

SEQ ID NO: 69013 - DNA, 15 bp, Homo sapiens
aaagaaatctccata

SEQ ID NO: 69014 - DNA, 15 bp, Homo sapiens
aaaagaaatctccat

SEQ ID NO: 69015 - DNA, 15 bp, Homo sapiens
caaaagaaatctcca

SEQ ID NO: 69016 - DNA, 15 bp, Homo sapiens
ccaaaagaaatctcc

SEQ ID NO: 69017 - DNA, 15 bp, Homo sapiens
accaaaagaaatctc

SEQ ID NO: 69018 - DNA, 15 bp, Homo sapiens
aaccaaaagaaatct

SEQ ID NO: 69019 - DNA, 15 bp, Homo sapiens
taaccaaaagaaatc

SEQ ID NO: 69020 - DNA, 15 bp, Homo sapiens
ttaaccaaaagaaat

SEQ ID NO: 69021 - DNA, 15 bp, Homo sapiens
tttaaccaaaagaaa

SEQ ID NO: 69022 - DNA, 15 bp, Homo sapiens
atttaaccaaaagaa

SEQ ID NO: 69023 - DNA, 15 bp, Homo sapiens
aatttaaccaaaaga

SEQ ID NO: 69024 - DNA, 15 bp, Homo sapiens
aaatttaaccaaaag

SEQ ID NO: 69025 - DNA, 15 bp, Homo sapiens
aaaatttaaccaaaa

SEQ ID NO: 69026 - DNA, 15 bp, Homo sapiens
aaaaatttaaccaaa

SEQ ID NO: 69027 - DNA, 15 bp, Homo sapiens
gaaaaatttaaccaa

SEQ ID NO: 69028 - DNA, 15 bp, Homo sapiens
agaaaaatttaacca

SEQ ID NO: 69029 - DNA, 15 bp, Homo sapiens
aagaaaaatttaacc

SEQ ID NO: 69030 - DNA, 15 bp, Homo sapiens
aaagaaaaatttaac

SEQ ID NO: 69031 - DNA, 15 bp, Homo sapiens
aaaagaaaaatttaa

SEQ ID NO: 69032 - DNA, 15 bp, Homo sapiens
caaaagaaaaattta

SEQ ID NO: 69033 - DNA, 15 bp, Homo sapiens
acaaaagaaaaattt

SEQ ID NO: 69034 - DNA, 15 bp, Homo sapiens
tacaaaagaaaaatt

SEQ ID NO: 69035 - DNA, 15 bp, Homo sapiens
atacaaaagaaaaat

SEQ ID NO: 69036 - DNA, 15 bp, Homo sapiens
tatacaaaagaaaaa

SEQ ID NO: 69037 - DNA, 15 bp, Homo sapiens
ctatacaaaagaaaa

SEQ ID NO: 69038 - DNA, 15 bp, Homo sapiens
actatacaaaagaaa

SEQ ID NO: 69039 - DNA, 15 bp, Homo sapiens
aactatacaaaagaa

SEQ ID NO: 69040 - DNA, 15 bp, Homo sapiens
taactatacaaaaga

SEQ ID NO: 69041 - DNA, 15 bp, Homo sapiens
ataactatacaaaag

SEQ ID NO: 69042 - DNA, 15 bp, Homo sapiens
cataactatacaaaa

SEQ ID NO: 69043 - DNA, 15 bp, Homo sapiens
acataactatacaaa

SEQ ID NO: 69044 - DNA, 15 bp, Homo sapiens
cacataactatacaa

SEQ ID NO: 69045 - DNA, 15 bp, Homo sapiens
tcacataactataca

SEQ ID NO: 69046 - DNA, 15 bp, Homo sapiens
ttcacataactatac

SEQ ID NO: 69047 - DNA, 15 bp, Homo sapiens
attcacataactata

SEQ ID NO: 69048 - DNA, 15 bp, Homo sapiens
aattcacataactat

SEQ ID NO: 69049 - DNA, 15 bp, Homo sapiens
caattcacataacta

SEQ ID NO: 69050 - DNA, 15 bp, Homo sapiens
tcaattcacataact

SEQ ID NO: 69051 - DNA, 15 bp, Homo sapiens
gtcaattcacataac

SEQ ID NO: 69052 - DNA, 15 bp, Homo sapiens
tgtcaattcacataa

SEQ ID NO: 69053 - DNA, 15 bp, Homo sapiens
ctgtcaattcacata

SEQ ID NO: 69054 - DNA, 15 bp, Homo sapiens
tctgtcaattcacat

SEQ ID NO: 69055 - DNA, 15 bp, Homo sapiens
atctgtcaattcaca

SEQ ID NO: 69056 - DNA, 15 bp, Homo sapiens
gatctgtcaattcac

SEQ ID NO: 69057 - DNA, 15 bp, Homo sapiens
agatctgtcaattca

SEQ ID NO: 69058 - DNA, 15 bp, Homo sapiens
aagatctgtcaattc

SEQ ID NO: 69059 - DNA, 15 bp, Homo sapiens
taagatctgtcaatt

SEQ ID NO: 69060 - DNA, 15 bp, Homo sapiens
ataagatctgtcaat

SEQ ID NO: 69061 - DNA, 15 bp, Homo sapiens
aataagatctgtcaa

SEQ ID NO: 69062 - DNA, 15 bp, Homo sapiens
aaataagatctgtca

SEQ ID NO: 69063 - DNA, 15 bp, Homo sapiens
caaataagatctgtc

SEQ ID NO: 69064 - DNA, 15 bp, Homo sapiens
acaaataagatctgt

SEQ ID NO: 69065 - DNA, 15 bp, Homo sapiens
aacaaataagatctg

SEQ ID NO: 69066 - DNA, 15 bp, Homo sapiens
caacaaataagatct

SEQ ID NO: 69067 - DNA, 15 bp, Homo sapiens
acaacaaataagatc

SEQ ID NO: 69068 - DNA, 15 bp, Homo sapiens
aacaacaaataagat

SEQ ID NO: 69069 - DNA, 15 bp, Homo sapiens
aaacaacaaataaga

SEQ ID NO: 69070 - DNA, 15 bp, Homo sapiens
aaaacaacaaataag

SEQ ID NO: 69071 - DNA, 15 bp, Homo sapiens
caaaacaacaaataa

SEQ ID NO: 69072 - DNA, 15 bp, Homo sapiens
ccaaaacaacaaata

SEQ ID NO: 69073 - DNA, 15 bp, Homo sapiens
tccaaaacaacaaat

SEQ ID NO: 69074 - DNA, 15 bp, Homo sapiens
atccaaaacaacaaa

SEQ ID NO: 69075 - DNA, 15 bp, Homo sapiens
tatccaaaacaacaa

SEQ ID NO: 69076 - DNA, 15 bp, Homo sapiens
ctatccaaaacaaca

SEQ ID NO: 69077 - DNA, 15 bp, Homo sapiens
tctatccaaaacaac

SEQ ID NO: 69078 - DNA, 15 bp, Homo sapiens
ttctatccaaaacaa

SEQ ID NO: 69079 - DNA, 15 bp, Homo sapiens
tttctatccaaaaca

SEQ ID NO: 69080 - DNA, 15 bp, Homo sapiens
ttttctatccaaaac

SEQ ID NO: 69081 - DNA, 15 bp, Homo sapiens
attttctatccaaaa

SEQ ID NO: 69082 - DNA, 15 bp, Homo sapiens
tattttctatccaaa

SEQ ID NO: 69083 - DNA, 15 bp, Homo sapiens
ttattttctatccaa

SEQ ID NO: 69084 - DNA, 15 bp, Homo sapiens
attattttctatcca

SEQ ID NO: 69085 - DNA, 15 bp, Homo sapiens
tattattttctatcc

SEQ ID NO: 69086 - DNA, 15 bp, Homo sapiens
atattattttctatc

SEQ ID NO: 69087 - DNA, 15 bp, Homo sapiens
tatattattttctat

SEQ ID NO: 69088 - DNA, 15 bp, Homo sapiens
ttatattattttcta

SEQ ID NO: 69089 - DNA, 15 bp, Homo sapiens
cttatattattttct

SEQ ID NO: 69090 - DNA, 15 bp, Homo sapiens
acttatattattttc

SEQ ID NO: 69091 - DNA, 15 bp, Homo sapiens
cacttatattatttt

SEQ ID NO: 69092 - DNA, 15 bp, Homo sapiens
ccacttatattattt

SEQ ID NO: 69093 - DNA, 15 bp, Homo sapiens
accacttatattatt

SEQ ID NO: 69094 - DNA, 15 bp, Homo sapiens
taccacttatattat

SEQ ID NO: 69095 - DNA, 15 bp, Homo sapiens
ttaccacttatatta

SEQ ID NO: 69096 - DNA, 15 bp, Homo sapiens
attaccacttatatt

SEQ ID NO: 69097 - DNA, 15 bp, Homo sapiens
tattaccacttatat

SEQ ID NO: 69098 - DNA, 15 bp, Homo sapiens
atattaccacttata

SEQ ID NO: 69099 - DNA, 15 bp, Homo sapiens
gatattaccacttat

SEQ ID NO: 69100 - DNA, 15 bp, Homo sapiens
agatattaccactta

SEQ ID NO: 69101 - DNA, 15 bp, Homo sapiens
gagatattaccactt

SEQ ID NO: 69102 - DNA, 15 bp, Homo sapiens
agagatattaccact

SEQ ID NO: 69103 - DNA, 15 bp, Homo sapiens
aagagatattaccac

SEQ ID NO: 69104 - DNA, 15 bp, Homo sapiens
taagagatattacca

SEQ ID NO: 69105 - DNA, 15 bp, Homo sapiens
ttaagagatattacc

SEQ ID NO: 69106 - DNA, 15 bp, Homo sapiens
tttaagagatattac

SEQ ID NO: 69107 - DNA, 15 bp, Homo sapiens
gtttaagagatatta

SEQ ID NO: 69108 - DNA, 15 bp, Homo sapiens
tgtttaagagatatt

SEQ ID NO: 69109 - DNA, 15 bp, Homo sapiens
ctgtttaagagatat

SEQ ID NO: 69110 - DNA, 15 bp, Homo sapiens
actgtttaagagata

SEQ ID NO: 69111 - DNA, 15 bp, Homo sapiens
aactgtttaagagat

SEQ ID NO: 69112 - DNA, 15 bp, Homo sapiens
gaactgtttaagaga

SEQ ID NO: 69113 - DNA, 15 bp, Homo sapiens
ggaactgtttaagag

SEQ ID NO: 69114 - DNA, 15 bp, Homo sapiens
aggaactgtttaaga

SEQ ID NO: 69115 - DNA, 15 bp, Homo sapiens
gaggaactgtttaag

SEQ ID NO: 69116 - DNA, 15 bp, Homo sapiens
agaggaactgtttaa

SEQ ID NO: 69117 - DNA, 15 bp, Homo sapiens
aagaggaactgttta

SEQ ID NO: 69118 - DNA, 15 bp, Homo sapiens
caagaggaactgttt

SEQ ID NO: 69119 - DNA, 15 bp, Homo sapiens
ccaagaggaactgtt

SEQ ID NO: 69120 - DNA, 15 bp, Homo sapiens
cccaagaggaactgt

SEQ ID NO: 69121 - DNA, 15 bp, Homo sapiens
acccaagaggaactg

SEQ ID NO: 69122 - DNA, 15 bp, Homo sapiens
cacccaagaggaact

SEQ ID NO: 69123 - DNA, 15 bp, Homo sapiens
tcacccaagaggaac

SEQ ID NO: 69124 - DNA, 15 bp, Homo sapiens
ctcacccaagaggaa

SEQ ID NO: 69125 - DNA, 15 bp, Homo sapiens
actcacccaagagga

SEQ ID NO: 69126 - DNA, 15 bp, Homo sapiens
tactcacccaagagg

SEQ ID NO: 69127 - DNA, 15 bp, Homo sapiens
atactcacccaagag

SEQ ID NO: 69128 - DNA, 15 bp, Homo sapiens
catactcacccaaga

SEQ ID NO: 69129 - DNA, 15 bp, Homo sapiens
ccatactcacccaag

SEQ ID NO: 69130 - DNA, 15 bp, Homo sapiens
accatactcacccaa

SEQ ID NO: 69131 - DNA, 15 bp, Homo sapiens
taccatactcaccca

SEQ ID NO: 69132 - DNA, 15 bp, Homo sapiens
ataccatactcaccc

SEQ ID NO: 69133 - DNA, 15 bp, Homo sapiens
aataccatactcacc

SEQ ID NO: 69134 - DNA, 15 bp, Homo sapiens
aaataccatactcac

SEQ ID NO: 69135 - DNA, 15 bp, Homo sapiens
aaaataccatactca

SEQ ID NO: 69136 - DNA, 15 bp, Homo sapiens
taaaataccatactc

SEQ ID NO: 69137 - DNA, 15 bp, Homo sapiens
ataaaataccatact

SEQ ID NO: 69138 - DNA, 15 bp, Homo sapiens
aataaaataccatac

SEQ ID NO: 69139 - DNA, 15 bp, Homo sapiens
aaataaaataccata

SEQ ID NO: 69140 - DNA, 15 bp, Homo sapiens
aaaataaaataccat

SEQ ID NO: 69141 - DNA, 15 bp, Homo sapiens
taaaataaaatacca

SEQ ID NO: 69142 - DNA, 15 bp, Homo sapiens
ataaaataaaatacc

SEQ ID NO: 69143 - DNA, 15 bp, Homo sapiens
tataaaataaaatac

SEQ ID NO: 69144 - DNA, 15 bp, Homo sapiens
atataaaataaaata

SEQ ID NO: 69145 - DNA, 15 bp, Homo sapiens
tatataaaataaaat

SEQ ID NO: 69146 - DNA, 15 bp, Homo sapiens
atatataaaataaaa

SEQ ID NO: 69147 - DNA, 15 bp, Homo sapiens
tatatataaaataaa

SEQ ID NO: 69148 - DNA, 15 bp, Homo sapiens
atatatataaaataa

SEQ ID NO: 69149 - DNA, 15 bp, Homo sapiens
tatatatataaaata

SEQ ID NO: 69150 - DNA, 15 bp, Homo sapiens
atatatatataaaat

SEQ ID NO: 69151 - DNA, 15 bp, Homo sapiens
aatatatatataaaa

SEQ ID NO: 69152 - DNA, 15 bp, Homo sapiens
aaatatatatataaa

SEQ ID NO: 69153 - DNA, 15 bp, Homo sapiens
taaatatatatataa

SEQ ID NO: 69154 - DNA, 15 bp, Homo sapiens
ataaatatatatata

SEQ ID NO: 69155 - DNA, 15 bp, Homo sapiens
tataaatatatatat

SEQ ID NO: 69156 - DNA, 15 bp, Homo sapiens
atatatataaatata

SEQ ID NO: 69157 - DNA, 15 bp, Homo sapiens
tatatatataaatat

SEQ ID NO: 69158 - DNA, 15 bp, Homo sapiens
ttatatatataaata

SEQ ID NO: 69159 - DNA, 15 bp, Homo sapiens
attatatatataaat

SEQ ID NO: 69160 - DNA, 15 bp, Homo sapiens
tattatatatataaa

SEQ ID NO: 69161 - DNA, 15 bp, Homo sapiens
ttattatatatataa

SEQ ID NO: 69162 - DNA, 15 bp, Homo sapiens
tttattatatatata

SEQ ID NO: 69163 - DNA, 15 bp, Homo sapiens
atttattatatatat

SEQ ID NO: 69164 - DNA, 15 bp, Homo sapiens
tatttattatatata

SEQ ID NO: 69165 - DNA, 15 bp, Homo sapiens
ttatttattatatat

SEQ ID NO: 69166 - DNA, 15 bp, Homo sapiens
tttatttattatata

SEQ ID NO: 69167 - DNA, 15 bp, Homo sapiens
atttatttattatat

SEQ ID NO: 69168 - DNA, 15 bp, Homo sapiens
tatttatttattata

SEQ ID NO: 69169 - DNA, 15 bp, Homo sapiens
atatttatttattat

SEQ ID NO: 69170 - DNA, 15 bp, Homo sapiens
tatatttatttatta

SEQ ID NO: 69171 - DNA, 15 bp, Homo sapiens
tatatatttatttat

SEQ ID NO: 69172 - DNA, 15 bp, Homo sapiens
atatatatttattta

SEQ ID NO: 69173 - DNA, 15 bp, Homo sapiens
aatatatatttattt

SEQ ID NO: 69174 - DNA, 15 bp, Homo sapiens
aaatatatatttatt

SEQ ID NO: 69175 - DNA, 15 bp, Homo sapiens
tataaatatatattt

SEQ ID NO: 69176 - DNA, 15 bp, Homo sapiens
atataaatatatatt

SEQ ID NO: 69177 - DNA, 15 bp, Homo sapiens
ttatatatatttata

SEQ ID NO: 69178 - DNA, 15 bp, Homo sapiens
tttatatatatttat

SEQ ID NO: 69179 - DNA, 15 bp, Homo sapiens
atttatatatattta

SEQ ID NO: 69180 - DNA, 15 bp, Homo sapiens
tatttatatatattt

SEQ ID NO: 69181 - DNA, 15 bp, Homo sapiens
ttatttatatatatt

SEQ ID NO: 69182 - DNA, 15 bp, Homo sapiens
tttatttatatatat

SEQ ID NO: 69183 - DNA, 15 bp, Homo sapiens
ttttatttatatata

SEQ ID NO: 69184 - DNA, 15 bp, Homo sapiens
tttttatttatatat

SEQ ID NO: 69185 - DNA, 15 bp, Homo sapiens
atttttatttatata

SEQ ID NO: 69186 - DNA, 15 bp, Homo sapiens
tatttttatttatat

SEQ ID NO: 69187 - DNA, 15 bp, Homo sapiens
ttatttttatttata

SEQ ID NO: 69188 - DNA, 15 bp, Homo sapiens
tttatttttatttat

SEQ ID NO: 69189 - DNA, 15 bp, Homo sapiens
atttatttttattta

SEQ ID NO: 69190 - DNA, 15 bp, Homo sapiens
tatttatttttattt

SEQ ID NO: 69191 - DNA, 15 bp, Homo sapiens
atatttatttttatt

SEQ ID NO: 69192 - DNA, 15 bp, Homo sapiens
tatatttatttttat

SEQ ID NO: 69193 - DNA, 15 bp, Homo sapiens
atatatttattttta

SEQ ID NO: 69194 - DNA, 15 bp, Homo sapiens
tatatatttattttt

SEQ ID NO: 69195 - DNA, 15 bp, Homo sapiens
atatatatttatttt

SEQ ID NO: 69196 - DNA, 15 bp, Homo sapiens
aaaatatatatttat

SEQ ID NO: 69197 - DNA, 15 bp, Homo sapiens
taaaatatatattta

SEQ ID NO: 69198 - DNA, 15 bp, Homo sapiens
ataaaatatatattt

SEQ ID NO: 69199 - DNA, 15 bp, Homo sapiens
aataaaatatatatt

SEQ ID NO: 69200 - DNA, 15 bp, Homo sapiens
aaataaaatatatat

SEQ ID NO: 69201 - DNA, 15 bp, Homo sapiens
aaaataaaatatata

SEQ ID NO: 69202 - DNA, 15 bp, Homo sapiens
taaaataaaatatat

SEQ ID NO: 69203 - DNA, 15 bp, Homo sapiens
ataaaataaaatata

SEQ ID NO: 69204 - DNA, 15 bp, Homo sapiens
tataaaataaaatat

SEQ ID NO: 69205 - DNA, 15 bp, Homo sapiens
ttatatataaaataa

SEQ ID NO: 69206 - DNA, 15 bp, Homo sapiens
tttatatataaaata

SEQ ID NO: 69207 - DNA, 15 bp, Homo sapiens
atttatatataaaat

SEQ ID NO: 69208 - DNA, 15 bp, Homo sapiens
tatttatatataaaa

SEQ ID NO: 69209 - DNA, 15 bp, Homo sapiens
ttatttatatataaa

SEQ ID NO: 69210 - DNA, 15 bp, Homo sapiens
tttatttatatataa

SEQ ID NO: 69211 - DNA, 15 bp, Homo sapiens
attttatttatatat

SEQ ID NO: 69212 - DNA, 15 bp, Homo sapiens
tattttatttatata

SEQ ID NO: 69213 - DNA, 15 bp, Homo sapiens
atattttatttatat

SEQ ID NO: 69214 - DNA, 15 bp, Homo sapiens
tatattttatttata

SEQ ID NO: 69215 - DNA, 15 bp, Homo sapiens
atatattttatttat

SEQ ID NO: 69216 - DNA, 15 bp, Homo sapiens
tatatattttattta

SEQ ID NO: 69217 - DNA, 15 bp, Homo sapiens
ttatatattttattt

SEQ ID NO: 69218 - DNA, 15 bp, Homo sapiens
tttatatattttatt

SEQ ID NO: 69219 - DNA, 15 bp, Homo sapiens
ttatttatatatttt

SEQ ID NO: 69220 - DNA, 15 bp, Homo sapiens
tttatttatatattt

SEQ ID NO: 69221 - DNA, 15 bp, Homo sapiens
atttatttatatatt

SEQ ID NO: 69222 - DNA, 15 bp, Homo sapiens
tatttatttatatat

SEQ ID NO: 69223 - DNA, 15 bp, Homo sapiens
atatttatttatata

SEQ ID NO: 69224 - DNA, 15 bp, Homo sapiens
tatatttatttatat

SEQ ID NO: 69225 - DNA, 15 bp, Homo sapiens
atatatttatttata

SEQ ID NO: 69226 - DNA, 15 bp, Homo sapiens
tatatatatttattt

SEQ ID NO: 69227 - DNA, 15 bp, Homo sapiens
ttatatatatttatt

SEQ ID NO: 69228 - DNA, 15 bp, Homo sapiens
atatttatatatttt

SEQ ID NO: 69229 - DNA, 15 bp, Homo sapiens
aatatttatatattt

SEQ ID NO: 69230 - DNA, 15 bp, Homo sapiens
aaatatttatatatt

SEQ ID NO: 69231 - DNA, 15 bp, Homo sapiens
aaaatatttatatat

SEQ ID NO: 69232 - DNA, 15 bp, Homo sapiens
aaaaatatttatata

SEQ ID NO: 69233 - DNA, 15 bp, Homo sapiens
taaaaatatttatat

SEQ ID NO: 69234 - DNA, 15 bp, Homo sapiens
ataaaaatatttata

SEQ ID NO: 69235 - DNA, 15 bp, Homo sapiens
tataaaaatatttat

SEQ ID NO: 69236 - DNA, 15 bp, Homo sapiens
atataaaaatattta

SEQ ID NO: 69237 - DNA, 15 bp, Homo sapiens
tatataaaaatattt

SEQ ID NO: 69238 - DNA, 15 bp, Homo sapiens
atatataaaaatatt

SEQ ID NO: 69239 - DNA, 15 bp, Homo sapiens
tatatataaaaatat

SEQ ID NO: 69240 - DNA, 15 bp, Homo sapiens
ttatatataaaaata

SEQ ID NO: 69241 - DNA, 15 bp, Homo sapiens
attatatataaaaat

SEQ ID NO: 69242 - DNA, 15 bp, Homo sapiens
gattatatataaaaa

SEQ ID NO: 69243 - DNA, 15 bp, Homo sapiens
agattatatataaaa

SEQ ID NO: 69244 - DNA, 15 bp, Homo sapiens
tagattatatataaa

SEQ ID NO: 69245 - DNA, 15 bp, Homo sapiens
atagattatatataa

SEQ ID NO: 69246 - DNA, 15 bp, Homo sapiens
aatagattatatata

SEQ ID NO: 69247 - DNA, 15 bp, Homo sapiens
aaatagattatatat

SEQ ID NO: 69248 - DNA, 15 bp, Homo sapiens
taaatagattatata

SEQ ID NO: 69249 - DNA, 15 bp, Homo sapiens
ataaatagattatat

SEQ ID NO: 69250 - DNA, 15 bp, Homo sapiens
tataaatagattata

SEQ ID NO: 69251 - DNA, 15 bp, Homo sapiens
atataaatagattat

SEQ ID NO: 69252 - DNA, 15 bp, Homo sapiens
tatataaatagatta

SEQ ID NO: 69253 - DNA, 15 bp, Homo sapiens
atatataaatagatt

SEQ ID NO: 69254 - DNA, 15 bp, Homo sapiens
aatatataaatagat

SEQ ID NO: 69255 - DNA, 15 bp, Homo sapiens
taatatataaataga

SEQ ID NO: 69256 - DNA, 15 bp, Homo sapiens
ataatatataaatag

SEQ ID NO: 69257 - DNA, 15 bp, Homo sapiens
tataatatataaata

SEQ ID NO: 69258 - DNA, 15 bp, Homo sapiens
atataatatataaat

SEQ ID NO: 69259 - DNA, 15 bp, Homo sapiens
tatataatatataaa

SEQ ID NO: 69260 - DNA, 15 bp, Homo sapiens
atatataatatataa

SEQ ID NO: 69261 - DNA, 15 bp, Homo sapiens
catatataatatata

SEQ ID NO: 69262 - DNA, 15 bp, Homo sapiens
acatatataatatat

SEQ ID NO: 69263 - DNA, 15 bp, Homo sapiens
tacatatataatata

SEQ ID NO: 69264 - DNA, 15 bp, Homo sapiens
atacatatataatat

SEQ ID NO: 69265 - DNA, 15 bp, Homo sapiens
tatacatatataata

SEQ ID NO: 69266 - DNA, 15 bp, Homo sapiens
atatacatatataat

SEQ ID NO: 69267 - DNA, 15 bp, Homo sapiens
catatacatatataa

SEQ ID NO: 69268 - DNA, 15 bp, Homo sapiens
acatatacatatata

SEQ ID NO: 69269 - DNA, 15 bp, Homo sapiens
tacatatacatatat

SEQ ID NO: 69270 - DNA, 15 bp, Homo sapiens
atacatatacatata

SEQ ID NO: 69271 - DNA, 15 bp, Homo sapiens
tatacatatacatat

SEQ ID NO: 69272 - DNA, 15 bp, Homo sapiens
atatacatatacata

SEQ ID NO: 69273 - DNA, 15 bp, Homo sapiens
catatacatatacat

SEQ ID NO: 69274 - DNA, 15 bp, Homo sapiens
acatatacatataca

SEQ ID NO: 69275 - DNA, 15 bp, Homo sapiens
cacatatacatatac

SEQ ID NO: 69276 - DNA, 15 bp, Homo sapiens
acacatatacatata

SEQ ID NO: 69277 - DNA, 15 bp, Homo sapiens
cacacatatacatat

SEQ ID NO: 69278 - DNA, 15 bp, Homo sapiens
acacacatatacata

SEQ ID NO: 69279 - DNA, 15 bp, Homo sapiens
cacacacatatacat

SEQ ID NO: 69280 - DNA, 15 bp, Homo sapiens
aatatatatatatac

SEQ ID NO: 69281 - DNA, 15 bp, Homo sapiens
aaatatatatatata

SEQ ID NO: 69282 - DNA, 15 bp, Homo sapiens
taaatatatatatat

SEQ ID NO: 69283 - DNA, 15 bp, Homo sapiens
ttataaatatatata

SEQ ID NO: 69284 - DNA, 15 bp, Homo sapiens
aattataaatatata

SEQ ID NO: 69285 - DNA, 15 bp, Homo sapiens
aaattataaatatat

SEQ ID NO: 69286 - DNA, 15 bp, Homo sapiens
aaaattataaatata

SEQ ID NO: 69287 - DNA, 15 bp, Homo sapiens
aaaaattataaatat

SEQ ID NO: 69288 - DNA, 15 bp, Homo sapiens
aaaaaattataaata

SEQ ID NO: 69289 - DNA, 15 bp, Homo sapiens
aaaaaaattataaat

SEQ ID NO: 69290 - DNA, 15 bp, Homo sapiens
aaaaaaaattataaa

SEQ ID NO: 69291 - DNA, 15 bp, Homo sapiens
aaaaaaaaattataa

SEQ ID NO: 69292 - DNA, 15 bp, Homo sapiens
aaaaaaaaaattata

SEQ ID NO: 69293 - DNA, 15 bp, Homo sapiens
aaaaaaaaaaattat

SEQ ID NO: 69294 - DNA, 15 bp, Homo sapiens
taaaaaaaaaaaaat

SEQ ID NO: 69295 - DNA, 15 bp, Homo sapiens
gttaaaaaaaaaaaa

SEQ ID NO: 69296 - DNA, 15 bp, Homo sapiens
tgttaaaaaaaaaaa

SEQ ID NO: 69297 - DNA, 15 bp, Homo sapiens
ctgttaaaaaaaaaa

SEQ ID NO: 69298 - DNA, 15 bp, Homo sapiens
tctgttaaaaaaaaa

SEQ ID NO: 69299 - DNA, 15 bp, Homo sapiens
ctctgttaaaaaaaa

SEQ ID NO: 69300 - DNA, 15 bp, Homo sapiens
actctgttaaaaaaa

SEQ ID NO: 69301 - DNA, 15 bp, Homo sapiens
gactctgttaaaaaa

SEQ ID NO: 69302 - DNA, 15 bp, Homo sapiens
agactctgttaaaaa

SEQ ID NO: 69303 - DNA, 15 bp, Homo sapiens
aagactctgttaaaa

SEQ ID NO: 69304 - DNA, 15 bp, Homo sapiens
taagactctgttaaa

SEQ ID NO: 69305 - DNA, 15 bp, Homo sapiens
gtaagactctgttaa

SEQ ID NO: 69306 - DNA, 15 bp, Homo sapiens
agtaagactctgtta

SEQ ID NO: 69307 - DNA, 15 bp, Homo sapiens
gagtaagactctgtt

SEQ ID NO: 69308 - DNA, 15 bp, Homo sapiens
agagtaagactctgt

SEQ ID NO: 69309 - DNA, 15 bp, Homo sapiens
cagagtaagactctg

SEQ ID NO: 69310 - DNA, 15 bp, Homo sapiens
acagagtaagactct

SEQ ID NO: 69311 - DNA, 15 bp, Homo sapiens
gacagagtaagactc

SEQ ID NO: 69312 - DNA, 15 bp, Homo sapiens
tgacagagtaagact

SEQ ID NO: 69313 - DNA, 15 bp, Homo sapiens
gtgacagagtaagac

SEQ ID NO: 69314 - DNA, 15 bp, Homo sapiens
ggtgacagagtaaga

SEQ ID NO: 69315 - DNA, 15 bp, Homo sapiens
gggtgacagagtaag

SEQ ID NO: 69316 - DNA, 15 bp, Homo sapiens
tgggtgacagagtaa

SEQ ID NO: 69317 - DNA, 15 bp, Homo sapiens
ctgggtgacagagta

SEQ ID NO: 69318 - DNA, 15 bp, Homo sapiens
ttgtgccactgcact

SEQ ID NO: 69319 - DNA, 15 bp, Homo sapiens
attgtgccactgcac

SEQ ID NO: 69320 - DNA, 15 bp, Homo sapiens
gattgtgccactgca

SEQ ID NO: 69321 - DNA, 15 bp, Homo sapiens
agattgtgccactgc

SEQ ID NO: 69322 - DNA, 15 bp, Homo sapiens
aagattgtgccactg

SEQ ID NO: 69323 - DNA, 15 bp, Homo sapiens
caagattgtgccact

SEQ ID NO: 69324 - DNA, 15 bp, Homo sapiens
ccaagattgtgccac

SEQ ID NO: 69325 - DNA, 15 bp, Homo sapiens
gccaagattgtgcca

SEQ ID NO: 69326 - DNA, 15 bp, Homo sapiens
agccaagattgtgcc

SEQ ID NO: 69327 - DNA, 15 bp, Homo sapiens
gagccaagattgtgc

SEQ ID NO: 69328 - DNA, 15 bp, Homo sapiens
tgagccaagattgtg

SEQ ID NO: 69329 - DNA, 15 bp, Homo sapiens
gtgagccaagattgt

SEQ ID NO: 69330 - DNA, 15 bp, Homo sapiens
agttgcagtgagcca

SEQ ID NO: 69331 - DNA, 15 bp, Homo sapiens
ggaggtagaagttgc

SEQ ID NO: 69332 - DNA, 15 bp, Homo sapiens
aggaggtagaagttg

SEQ ID NO: 69333 - DNA, 15 bp, Homo sapiens
caggaggtagaagtt

SEQ ID NO: 69334 - DNA, 15 bp, Homo sapiens
ccaggaggtagaagt

SEQ ID NO: 69335 - DNA, 15 bp, Homo sapiens
gccaggaggtagaag

SEQ ID NO: 69336 - DNA, 15 bp, Homo sapiens
agccaggaggtagaa

SEQ ID NO: 69337 - DNA, 15 bp, Homo sapiens
aagccaggaggtaga

SEQ ID NO: 69338 - DNA, 15 bp, Homo sapiens
gaagccaggaggtag

SEQ ID NO: 69339 - DNA, 15 bp, Homo sapiens
tgaagccaggaggta

SEQ ID NO: 69340 - DNA, 15 bp, Homo sapiens
ttgaagccaggaggt

SEQ ID NO: 69341 - DNA, 15 bp, Homo sapiens
cttgaagccaggagg

SEQ ID NO: 69342 - DNA, 15 bp, Homo sapiens
acttgaagccaggag

SEQ ID NO: 69343 - DNA, 15 bp, Homo sapiens
cacttgaagccagga

SEQ ID NO: 69344 - DNA, 15 bp, Homo sapiens
tcacttgaagccagg

SEQ ID NO: 69345 - DNA, 15 bp, Homo sapiens
atcacttgaagccag

SEQ ID NO: 69346 - DNA, 15 bp, Homo sapiens
aatcacttgaagcca

SEQ ID NO: 69347 - DNA, 15 bp, Homo sapiens
gaatcacttgaagcc

SEQ ID NO: 69348 - DNA, 15 bp, Homo sapiens
agaatcacttgaagc

SEQ ID NO: 69349 - DNA, 15 bp, Homo sapiens
gagaatcacttgaag

SEQ ID NO: 69350 - DNA, 15 bp, Homo sapiens
tgcaggagaatcact

SEQ ID NO: 69351 - DNA, 15 bp, Homo sapiens
atgcaggagaatcac

SEQ ID NO: 69352 - DNA, 15 bp, Homo sapiens
gatgcaggagaatca

SEQ ID NO: 69353 - DNA, 15 bp, Homo sapiens
tgatgcaggagaatc

SEQ ID NO: 69354 - DNA, 15 bp, Homo sapiens
ctgatgcaggagaat

SEQ ID NO: 69355 - DNA, 15 bp, Homo sapiens
gctgatgcaggagaa

SEQ ID NO: 69356 - DNA, 15 bp, Homo sapiens
ggctgatgcaggaga

SEQ ID NO: 69357 - DNA, 15 bp, Homo sapiens
aggctgatgcaggag

SEQ ID NO: 69358 - DNA, 15 bp, Homo sapiens
gaggctgatgcagga

SEQ ID NO: 69359 - DNA, 15 bp, Homo sapiens
ggaggctgatgcagg

SEQ ID NO: 69360 - DNA, 15 bp, Homo sapiens
gggaggctgatgcag

SEQ ID NO: 69361 - DNA, 15 bp, Homo sapiens
tgggaggctgatgca

SEQ ID NO: 69362 - DNA, 15 bp, Homo sapiens
ttgggaggctgatgc

SEQ ID NO: 69363 - DNA, 15 bp, Homo sapiens
cttgggaggctgatg

SEQ ID NO: 69364 - DNA, 15 bp, Homo sapiens
acttgggaggctgat

SEQ ID NO: 69365 - DNA, 15 bp, Homo sapiens
cagtcccagctactt

SEQ ID NO: 69366 - DNA, 15 bp, Homo sapiens
ttgcagtcccagcta

SEQ ID NO: 69367 - DNA, 15 bp, Homo sapiens
tttgcagtcccagct

SEQ ID NO: 69368 - DNA, 15 bp, Homo sapiens
gtttgcagtcccagc

SEQ ID NO: 69369 - DNA, 15 bp, Homo sapiens
tgtttgcagtcccag

SEQ ID NO: 69370 - DNA, 15 bp, Homo sapiens
atgtttgcagtccca

SEQ ID NO: 69371 - DNA, 15 bp, Homo sapiens
catgtttgcagtccc

SEQ ID NO: 69372 - DNA, 15 bp, Homo sapiens
acatgtttgcagtcc

SEQ ID NO: 69373 - DNA, 15 bp, Homo sapiens
cacatgtttgcagtc

SEQ ID NO: 69374 - DNA, 15 bp, Homo sapiens
gcacatgtttgcagt

SEQ ID NO: 69375 - DNA, 15 bp, Homo sapiens
ggcacatgtttgcag

SEQ ID NO: 69376 - DNA, 15 bp, Homo sapiens
tggcacatgtttgca

SEQ ID NO: 69377 - DNA, 15 bp, Homo sapiens
gtggcacatgtttgc

SEQ ID NO: 69378 - DNA, 15 bp, Homo sapiens
ggtggcacatgtttg

SEQ ID NO: 69379 - DNA, 15 bp, Homo sapiens
tggtggcacatgttt

SEQ ID NO: 69380 - DNA, 15 bp, Homo sapiens
gtggtggcacatgtt

SEQ ID NO: 69381 - DNA, 15 bp, Homo sapiens
cgtggtggcacatgt

SEQ ID NO: 69382 - DNA, 15 bp, Homo sapiens
cacaaaaaattagcc

SEQ ID NO: 69383 - DNA, 15 bp, Homo sapiens
acacaaaaaattagc

SEQ ID NO: 69384 - DNA, 15 bp, Homo sapiens
aacacaaaaaattag

SEQ ID NO: 69385 - DNA, 15 bp, Homo sapiens
aaacacaaaaaatta

SEQ ID NO: 69386 - DNA, 15 bp, Homo sapiens
aaaacacaaaaaatt

SEQ ID NO: 69387 - DNA, 15 bp, Homo sapiens
aaaaacacaaaaaat

SEQ ID NO: 69388 - DNA, 15 bp, Homo sapiens
taaaaacacaaaaaa

SEQ ID NO: 69389 - DNA, 15 bp, Homo sapiens
ctaaaaacacaaaaa

SEQ ID NO: 69390 - DNA, 15 bp, Homo sapiens
actaaaaacacaaaa

SEQ ID NO: 69391 - DNA, 15 bp, Homo sapiens
aactaaaaacacaaa

SEQ ID NO: 69392 - DNA, 15 bp, Homo sapiens
taactaaaaacacaa

SEQ ID NO: 69393 - DNA, 15 bp, Homo sapiens
ctaactaaaaacaca

SEQ ID NO: 69394 - DNA, 15 bp, Homo sapiens
tctaactaaaaacac

SEQ ID NO: 69395 - DNA, 15 bp, Homo sapiens
ctctaactaaaaaca

SEQ ID NO: 69396 - DNA, 15 bp, Homo sapiens
tctctaactaaaaac

SEQ ID NO: 69397 - DNA, 15 bp, Homo sapiens
gtctctaactaaaaa

SEQ ID NO: 69398 - DNA, 15 bp, Homo sapiens
cgtctctaactaaaa

SEQ ID NO: 69399 - DNA, 15 bp, Homo sapiens
ccgtctctaactaaa

SEQ ID NO: 69400 - DNA, 15 bp, Homo sapiens
cccgtctctaactaa

SEQ ID NO: 69401 - DNA, 15 bp, Homo sapiens
ccccgtctctaacta

SEQ ID NO: 69402 - DNA, 15 bp, Homo sapiens
accccgtctctaact

SEQ ID NO: 69403 - DNA, 15 bp, Homo sapiens
aaccccgtctctaac

SEQ ID NO: 69404 - DNA, 15 bp, Homo sapiens
aaaccccgtctctaa

SEQ ID NO: 69405 - DNA, 15 bp, Homo sapiens
aggtgaaaccccgtc

SEQ ID NO: 69406 - DNA, 15 bp, Homo sapiens
aaggtgaaaccccgt

SEQ ID NO: 69407 - DNA, 15 bp, Homo sapiens
caaggtgaaaccccg

SEQ ID NO: 69408 - DNA, 15 bp, Homo sapiens
acaaggtgaaacccc

SEQ ID NO: 69409 - DNA, 15 bp, Homo sapiens
aacaaggtgaaaccc

SEQ ID NO: 69410 - DNA, 15 bp, Homo sapiens
caacaaggtgaaacc

SEQ ID NO: 69411 - DNA, 15 bp, Homo sapiens
acaacaaggtgaaac

SEQ ID NO: 69412 - DNA, 15 bp, Homo sapiens
gacaacaaggtgaaa

SEQ ID NO: 69413 - DNA, 15 bp, Homo sapiens
ggacaacaaggtgaa

SEQ ID NO: 69414 - DNA, 15 bp, Homo sapiens
tggacaacaaggtga

SEQ ID NO: 69415 - DNA, 15 bp, Homo sapiens
ctggacaacaaggtg

SEQ ID NO: 69416 - DNA, 15 bp, Homo sapiens
cctggacaacaaggt

SEQ ID NO: 69417 - DNA, 15 bp, Homo sapiens
gcctggacaacaagg

SEQ ID NO: 69418 - DNA, 15 bp, Homo sapiens
agcctggacaacaag

SEQ ID NO: 69419 - DNA, 15 bp, Homo sapiens
accagcctggacaac

SEQ ID NO: 69420 - DNA, 15 bp, Homo sapiens
gaccagcctggacaa

SEQ ID NO: 69421 - DNA, 15 bp, Homo sapiens
agaccagcctggaca

SEQ ID NO: 69422 - DNA, 15 bp, Homo sapiens
aagaccagcctggac

SEQ ID NO: 69423 - DNA, 15 bp, Homo sapiens
caagaccagcctgga

SEQ ID NO: 69424 - DNA, 15 bp, Homo sapiens
taggccaggagttca

SEQ ID NO: 69425 - DNA, 15 bp, Homo sapiens
ctaggccaggagttc

SEQ ID NO: 69426 - DNA, 15 bp, Homo sapiens
cctaggccaggagtt

SEQ ID NO: 69427 - DNA, 15 bp, Homo sapiens
acctaggccaggagt

SEQ ID NO: 69428 - DNA, 15 bp, Homo sapiens
cacctaggccaggag

SEQ ID NO: 69429 - DNA, 15 bp, Homo sapiens
tcacctaggccagga

SEQ ID NO: 69430 - DNA, 15 bp, Homo sapiens
atcacctaggccagg

SEQ ID NO: 69431 - DNA, 15 bp, Homo sapiens
gatcacctaggccag

SEQ ID NO: 69432 - DNA, 15 bp, Homo sapiens
ggatcacctaggcca

SEQ ID NO: 69433 - DNA, 15 bp, Homo sapiens
tggatcacctaggcc

SEQ ID NO: 69434 - DNA, 15 bp, Homo sapiens
gtggatcacctaggc

SEQ ID NO: 69435 - DNA, 15 bp, Homo sapiens
ggtggatcacctagg

SEQ ID NO: 69436 - DNA, 15 bp, Homo sapiens
aggtggatcacctag

SEQ ID NO: 69437 - DNA, 15 bp, Homo sapiens
caggtggatcaccta

SEQ ID NO: 69438 - DNA, 15 bp, Homo sapiens
gcaggtggatcacct

SEQ ID NO: 69439 - DNA, 15 bp, Homo sapiens
ggcaggtggatcacc

SEQ ID NO: 69440 - DNA, 15 bp, Homo sapiens
ataatcccagcattt

SEQ ID NO: 69441 - DNA, 15 bp, Homo sapiens
tataatcccagcatt

SEQ ID NO: 69442 - DNA, 15 bp, Homo sapiens
ctataatcccagcat

SEQ ID NO: 69443 - DNA, 15 bp, Homo sapiens
gtggtggctcacacc

SEQ ID NO: 69444 - DNA, 15 bp, Homo sapiens
tgtggtggctcacac

SEQ ID NO: 69445 - DNA, 15 bp, Homo sapiens
gtgtggtggctcaca

SEQ ID NO: 69446 - DNA, 15 bp, Homo sapiens
aggctgggtgtggtg

SEQ ID NO: 69447 - DNA, 15 bp, Homo sapiens
aaggctgggtgtggt

SEQ ID NO: 69448 - DNA, 15 bp, Homo sapiens
aaaggctgggtgtgg

SEQ ID NO: 69449 - DNA, 15 bp, Homo sapiens
aaaaggctgggtgtg

SEQ ID NO: 69450 - DNA, 15 bp, Homo sapiens
taaaaggctgggtgt

SEQ ID NO: 69451 - DNA, 15 bp, Homo sapiens
ataaaaggctgggtg

SEQ ID NO: 69452 - DNA, 15 bp, Homo sapiens
aataaaaggctgggt

SEQ ID NO: 69453 - DNA, 15 bp, Homo sapiens
aaataaaaggctggg

SEQ ID NO: 69454 - DNA, 15 bp, Homo sapiens
aaaataaaaggctgg

SEQ ID NO: 69455 - DNA, 15 bp, Homo sapiens
taaaataaaaggctg

SEQ ID NO: 69456 - DNA, 15 bp, Homo sapiens
ataaaataaaaggct

SEQ ID NO: 69457 - DNA, 15 bp, Homo sapiens
aataaaataaaaggc

SEQ ID NO: 69458 - DNA, 15 bp, Homo sapiens
aaataaaataaaagg

SEQ ID NO: 69459 - DNA, 15 bp, Homo sapiens
taaataaaataaaag

SEQ ID NO: 69460 - DNA, 15 bp, Homo sapiens
ataaataaaataaaa

SEQ ID NO: 69461 - DNA, 15 bp, Homo sapiens
aataaataaaataaa

SEQ ID NO: 69462 - DNA, 15 bp, Homo sapiens
aaataaataaaataa

SEQ ID NO: 69463 - DNA, 15 bp, Homo sapiens
taaataaataaaata

SEQ ID NO: 69464 - DNA, 15 bp, Homo sapiens
ctaaataaataaaat

SEQ ID NO: 69465 - DNA, 15 bp, Homo sapiens
tctaaataaataaaa

SEQ ID NO: 69466 - DNA, 15 bp, Homo sapiens
ttctaaataaataaa

SEQ ID NO: 69467 - DNA, 15 bp, Homo sapiens
attctaaataaataa

SEQ ID NO: 69468 - DNA, 15 bp, Homo sapiens
aattctaaataaata

SEQ ID NO: 69469 - DNA, 15 bp, Homo sapiens
gaattctaaataaat

SEQ ID NO: 69470 - DNA, 15 bp, Homo sapiens
ggaattctaaataaa

SEQ ID NO: 69471 - DNA, 15 bp, Homo sapiens
tggaattctaaataa

SEQ ID NO: 69472 - DNA, 15 bp, Homo sapiens
atggaattctaaata

SEQ ID NO: 69473 - DNA, 15 bp, Homo sapiens
catggaattctaaat

SEQ ID NO: 69474 - DNA, 15 bp, Homo sapiens
acatggaattctaaa

SEQ ID NO: 69475 - DNA, 15 bp, Homo sapiens
aacatggaattctaa

SEQ ID NO: 69476 - DNA, 15 bp, Homo sapiens
gaacatggaattcta

SEQ ID NO: 69477 - DNA, 15 bp, Homo sapiens
tgaacatggaattct

SEQ ID NO: 69478 - DNA, 15 bp, Homo sapiens
atgaacatggaattc

SEQ ID NO: 69479 - DNA, 15 bp, Homo sapiens
catgaacatggaatt

SEQ ID NO: 69480 - DNA, 15 bp, Homo sapiens
tcatgaacatggaat

SEQ ID NO: 69481 - DNA, 15 bp, Homo sapiens
atcatgaacatggaa

SEQ ID NO: 69482 - DNA, 15 bp, Homo sapiens
gatcatgaacatgga

SEQ ID NO: 69483 - DNA, 15 bp, Homo sapiens
agatcatgaacatgg

SEQ ID NO: 69484 - DNA, 15 bp, Homo sapiens
tagatcatgaacatg

SEQ ID NO: 69485 - DNA, 15 bp, Homo sapiens
atagatcatgaacat

SEQ ID NO: 69486 - DNA, 15 bp, Homo sapiens
catagatcatgaaca

SEQ ID NO: 69487 - DNA, 15 bp, Homo sapiens
tcatagatcatgaac

SEQ ID NO: 69488 - DNA, 15 bp, Homo sapiens
ctcatagatcatgaa

SEQ ID NO: 69489 - DNA, 15 bp, Homo sapiens
actcatagatcatga

SEQ ID NO: 69490 - DNA, 15 bp, Homo sapiens
tactcatagatcatg

SEQ ID NO: 69491 - DNA, 15 bp, Homo sapiens
ctactcatagatcat

SEQ ID NO: 69492 - DNA, 15 bp, Homo sapiens
gctactcatagatca

SEQ ID NO: 69493 - DNA, 15 bp, Homo sapiens
tgctactcatagatc

SEQ ID NO: 69494 - DNA, 15 bp, Homo sapiens
atgctactcatagat

SEQ ID NO: 69495 - DNA, 15 bp, Homo sapiens
tatgctactcataga

SEQ ID NO: 69496 - DNA, 15 bp, Homo sapiens
ctatgctactcatag

SEQ ID NO: 69497 - DNA, 15 bp, Homo sapiens
actatgctactcata

SEQ ID NO: 69498 - DNA, 15 bp, Homo sapiens
gactatgctactcat

SEQ ID NO: 69499 - DNA, 15 bp, Homo sapiens
tgactatgctactca

SEQ ID NO: 69500 - DNA, 15 bp, Homo sapiens
ctgactatgctactc

SEQ ID NO: 69501 - DNA, 15 bp, Homo sapiens
gctgactatgctact

SEQ ID NO: 69502 - DNA, 15 bp, Homo sapiens
tgctgactatgctac

SEQ ID NO: 69503 - DNA, 15 bp, Homo sapiens
atgctgactatgcta

SEQ ID NO: 69504 - DNA, 15 bp, Homo sapiens
aatgctgactatgct

SEQ ID NO: 69505 - DNA, 15 bp, Homo sapiens
aaatgctgactatgc

SEQ ID NO: 69506 - DNA, 15 bp, Homo sapiens
taaatgctgactatg

SEQ ID NO: 69507 - DNA, 15 bp, Homo sapiens
gtaaatgctgactat

SEQ ID NO: 69508 - DNA, 15 bp, Homo sapiens
agtaaatgctgacta

SEQ ID NO: 69509 - DNA, 15 bp, Homo sapiens
aagtaaatgctgact

SEQ ID NO: 69510 - DNA, 15 bp, Homo sapiens
aaagtaaatgctgac

SEQ ID NO: 69511 - DNA, 15 bp, Homo sapiens
taaagtaaatgctga

SEQ ID NO: 69512 - DNA, 15 bp, Homo sapiens
ttaaagtaaatgctg

SEQ ID NO: 69513 - DNA, 15 bp, Homo sapiens
tttaaagtaaatgct

SEQ ID NO: 69514 - DNA, 15 bp, Homo sapiens
ttttaaagtaaatgc

SEQ ID NO: 69515 - DNA, 15 bp, Homo sapiens
attttaaagtaaatg

SEQ ID NO: 69516 - DNA, 15 bp, Homo sapiens
ctattttaaagtaaa

SEQ ID NO: 69517 - DNA, 15 bp, Homo sapiens
gctattttaaagtaa

SEQ ID NO: 69518 - DNA, 15 bp, Homo sapiens
agctattttaaagta

SEQ ID NO: 69519 - DNA, 15 bp, Homo sapiens
cagctattttaaagt

SEQ ID NO: 69520 - DNA, 15 bp, Homo sapiens
ccagctattttaaag

SEQ ID NO: 69521 - DNA, 15 bp, Homo sapiens
accagctattttaaa

SEQ ID NO: 69522 - DNA, 15 bp, Homo sapiens
taccagctattttaa

SEQ ID NO: 69523 - DNA, 15 bp, Homo sapiens
ataccagctatttta

SEQ ID NO: 69524 - DNA, 15 bp, Homo sapiens
aataccagctatttt

SEQ ID NO: 69525 - DNA, 15 bp, Homo sapiens
taataccagctattt

SEQ ID NO: 69526 - DNA, 15 bp, Homo sapiens
ataataccagctatt

SEQ ID NO: 69527 - DNA, 15 bp, Homo sapiens
gataataccagctat

SEQ ID NO: 69528 - DNA, 15 bp, Homo sapiens
tgataataccagcta

SEQ ID NO: 69529 - DNA, 15 bp, Homo sapiens
ctgataataccagct

SEQ ID NO: 69530 - DNA, 15 bp, Homo sapiens
tctgataataccagc

SEQ ID NO: 69531 - DNA, 15 bp, Homo sapiens
atctgataataccag

SEQ ID NO: 69532 - DNA, 15 bp, Homo sapiens
catctgataatacca

SEQ ID NO: 69533 - DNA, 15 bp, Homo sapiens
gcatctgataatacc

SEQ ID NO: 69534 - DNA, 15 bp, Homo sapiens
tgcatctgataatac

SEQ ID NO: 69535 - DNA, 15 bp, Homo sapiens
atgcatctgataata

SEQ ID NO: 69536 - DNA, 15 bp, Homo sapiens
gatgcatctgataat

SEQ ID NO: 69537 - DNA, 15 bp, Homo sapiens
tgatgcatctgataa

SEQ ID NO: 69538 - DNA, 15 bp, Homo sapiens
atgatgcatctgata

SEQ ID NO: 69539 - DNA, 15 bp, Homo sapiens
aatgatgcatctgat

SEQ ID NO: 69540 - DNA, 15 bp, Homo sapiens
caatgatgcatctga

SEQ ID NO: 69541 - DNA, 15 bp, Homo sapiens
gcaatgatgcatctg

SEQ ID NO: 69542 - DNA, 15 bp, Homo sapiens
agcaatgatgcatct

SEQ ID NO: 69543 - DNA, 15 bp, Homo sapiens
aagcaatgatgcatc

SEQ ID NO: 69544 - DNA, 15 bp, Homo sapiens
caagcaatgatgcat

SEQ ID NO: 69545 - DNA, 15 bp, Homo sapiens
gcaagcaatgatgca

SEQ ID NO: 69546 - DNA, 15 bp, Homo sapiens
agcaagcaatgatgc

SEQ ID NO: 69547 - DNA, 15 bp, Homo sapiens
aagcaagcaatgatg

SEQ ID NO: 69548 - DNA, 15 bp, Homo sapiens
aaagcaagcaatgat

SEQ ID NO: 69549 - DNA, 15 bp, Homo sapiens
caaagcaagcaatga

SEQ ID NO: 69550 - DNA, 15 bp, Homo sapiens
tcaaagcaagcaatg

SEQ ID NO: 69551 - DNA, 15 bp, Homo sapiens
ctcaaagcaagcaat

SEQ ID NO: 69552 - DNA, 15 bp, Homo sapiens
gctcaaagcaagcaa

SEQ ID NO: 69553 - DNA, 15 bp, Homo sapiens
agctcaaagcaagca

SEQ ID NO: 69554 - DNA, 15 bp, Homo sapiens
tagctcaaagcaagc

SEQ ID NO: 69555 - DNA, 15 bp, Homo sapiens
atagctcaaagcaag

SEQ ID NO: 69556 - DNA, 15 bp, Homo sapiens
aatagctcaaagcaa

SEQ ID NO: 69557 - DNA, 15 bp, Homo sapiens
aaatagctcaaagca
